United States Patent 7,691,997 (FUNCTIONAL AND HYPERFUNCTIONAL SIRNA) - sequence listing, part 27

SEQ ID NO: 1089531 - RNA, 19 nt, Homo sapiens
guacgguucaauaaacuau

SEQ ID NO: 1089532 - RNA, 19 nt, Homo sapiens
gcgcacaucuccgucaacu

SEQ ID NO: 1089533 - RNA, 19 nt, Homo sapiens
gaaguccgacguggaaaca

SEQ ID NO: 1089534 - RNA, 19 nt, Homo sapiens
gggcgcacaucuccgucaa

SEQ ID NO: 1089535 - RNA, 19 nt, Homo sapiens
gauguuuguuacagagcuu

SEQ ID NO: 1089536 - RNA, 19 nt, Homo sapiens
ugcagaggaucaugacguu

SEQ ID NO: 1089537 - RNA, 19 nt, Homo sapiens
caaagaacuagcagagaag

SEQ ID NO: 1089538 - RNA, 19 nt, Homo sapiens
uaaagacuucaauggagaa

SEQ ID NO: 1089539 - RNA, 19 nt, Homo sapiens
ugagagcuguggaccugau

SEQ ID NO: 1089540 - RNA, 19 nt, Homo sapiens
caucacaggcucgaaggaa

SEQ ID NO: 1089541 - RNA, 19 nt, Homo sapiens
cagaaaugcccacucuaca

SEQ ID NO: 1089542 - RNA, 19 nt, Homo sapiens
ucuacuaugucuccaaguc

SEQ ID NO: 1089543 - RNA, 19 nt, Homo sapiens
gcagugcgucuacuauguc

SEQ ID NO: 1089544 - RNA, 19 nt, Homo sapiens
gacuugcagcccauucuuu

SEQ ID NO: 1089545 - RNA, 19 nt, Homo sapiens
guggaaacagccaagaaga

SEQ ID NO: 1089546 - RNA, 19 nt, Homo sapiens
cuucgucccuguuuuguaa

SEQ ID NO: 1089547 - RNA, 19 nt, Homo sapiens
ggaaaagcgcucccagaga

SEQ ID NO: 1089548 - RNA, 19 nt, Homo sapiens
cagcagugcgucuacuaug

SEQ ID NO: 1089549 - RNA, 19 nt, Homo sapiens
agaaaugcccacucuacau

SEQ ID NO: 1089550 - RNA, 19 nt, Homo sapiens
ucgagcuccuguacuuuau

SEQ ID NO: 1089551 - RNA, 19 nt, Homo sapiens
gcaucucaguguagguucu

SEQ ID NO: 1089552 - RNA, 19 nt, Homo sapiens
gcucgaaggaaucgcuguu

SEQ ID NO: 1089553 - RNA, 19 nt, Homo sapiens
cagagaagcaggcgcaacu

SEQ ID NO: 1089554 - RNA, 19 nt, Homo sapiens
ccgggacacugcuucucaa

SEQ ID NO: 1089555 - RNA, 19 nt, Homo sapiens
gagcuccuguacuuuaucc

SEQ ID NO: 1089556 - RNA, 19 nt, Homo sapiens
gcucuacuaccugcugcua

SEQ ID NO: 1089557 - RNA, 19 nt, Homo sapiens
gaggagcagcuggacauca

SEQ ID NO: 1089558 - RNA, 19 nt, Homo sapiens
ggcagaugacgugaaauug

SEQ ID NO: 1089559 - RNA, 19 nt, Homo sapiens
ucgaaggaaucgcuguucu

SEQ ID NO: 1089560 - RNA, 19 nt, Homo sapiens
gaacugaugugguuauaaa

SEQ ID NO: 1089561 - RNA, 19 nt, Homo sapiens
gaaagaaagccaagauuua

SEQ ID NO: 1089562 - RNA, 19 nt, Homo sapiens
caaacaagauuaccgaauu

SEQ ID NO: 1089563 - RNA, 19 nt, Homo sapiens
gaacaacacggcagugaua

SEQ ID NO: 1089564 - RNA, 19 nt, Homo sapiens
ggaaagaaagccaagauuu

SEQ ID NO: 1089565 - RNA, 19 nt, Homo sapiens
gcaaagagccuccguaugg

SEQ ID NO: 1089566 - RNA, 19 nt, Homo sapiens
caaugaagcuguuugcuau

SEQ ID NO: 1089567 - RNA, 19 nt, Homo sapiens
gaaacaacauuugagacua

SEQ ID NO: 1089568 - RNA, 19 nt, Homo sapiens
gguaaugaguggaugagua

SEQ ID NO: 1089569 - RNA, 19 nt, Homo sapiens
gauagaaccuggacugcuu

SEQ ID NO: 1089570 - RNA, 19 nt, Homo sapiens
gaaauuccucaucaacuua

SEQ ID NO: 1089571 - RNA, 19 nt, Homo sapiens
cagcacauaccuuauauua

SEQ ID NO: 1089572 - RNA, 19 nt, Homo sapiens
gagacuauuucaacacuuu

SEQ ID NO: 1089573 - RNA, 19 nt, Homo sapiens
gaagagagcaccuuauaag

SEQ ID NO: 1089574 - RNA, 19 nt, Homo sapiens
gcaugucagucguucaaua

SEQ ID NO: 1089575 - RNA, 19 nt, Homo sapiens
aaacgacgcucuugucaga

SEQ ID NO: 1089576 - RNA, 19 nt, Homo sapiens
ccacugagcauauuguuaa

SEQ ID NO: 1089577 - RNA, 19 nt, Homo sapiens
gaggagaaauuggugcaua

SEQ ID NO: 1089578 - RNA, 19 nt, Homo sapiens
gaaagaaagcuagaucauu

SEQ ID NO: 1089579 - RNA, 19 nt, Homo sapiens
agagaugacugcagaugua

SEQ ID NO: 1089580 - RNA, 19 nt, Homo sapiens
gagagcaccuuauaagaca

SEQ ID NO: 1089581 - RNA, 19 nt, Homo sapiens
gagcagauuuguacuugga

SEQ ID NO: 1089582 - RNA, 19 nt, Homo sapiens
aaaguaugcuguugugaaa

SEQ ID NO: 1089583 - RNA, 19 nt, Homo sapiens
gaaauuuauuccuggauca

SEQ ID NO: 1089584 - RNA, 19 nt, Homo sapiens
ggaagagagcaccuuauaa

SEQ ID NO: 1089585 - RNA, 19 nt, Homo sapiens
aaagcuagaucauuugcua

SEQ ID NO: 1089586 - RNA, 19 nt, Homo sapiens
guaaugaguggaugaguaa

SEQ ID NO: 1089587 - RNA, 19 nt, Homo sapiens
caagaacccuccugacagu

SEQ ID NO: 1089588 - RNA, 19 nt, Homo sapiens
guauucagcuugucuucaa

SEQ ID NO: 1089589 - RNA, 19 nt, Homo sapiens
gcagcugaguacaagguua

SEQ ID NO: 1089590 - RNA, 19 nt, Homo sapiens
gaugauauuagcaagcuua

SEQ ID NO: 1089591 - RNA, 19 nt, Homo sapiens
gaugaauacuugaucaaca

SEQ ID NO: 1089592 - RNA, 19 nt, Homo sapiens
uaucagaacuugguagaga

SEQ ID NO: 1089593 - RNA, 19 nt, Homo sapiens
uaaagcagccauugagaaa

SEQ ID NO: 1089594 - RNA, 19 nt, Homo sapiens
gauauuagcaagcuuagga

SEQ ID NO: 1089595 - RNA, 19 nt, Homo sapiens
ccaaaccacugagcauauu

SEQ ID NO: 1089596 - RNA, 19 nt, Homo sapiens
ggacgaagauggaguuuuc

SEQ ID NO: 1089597 - RNA, 19 nt, Homo sapiens
gcaccucucaguugaauga

SEQ ID NO: 1089598 - RNA, 19 nt, Homo sapiens
gaauacacuucgcuuucuu

SEQ ID NO: 1089599 - RNA, 19 nt, Homo sapiens
ggaauacacuucgcuuucu

SEQ ID NO: 1089600 - RNA, 19 nt, Homo sapiens
agaaauuggugcauagcua

SEQ ID NO: 1089601 - RNA, 19 nt, Homo sapiens
cuuagaagguggugauauu

SEQ ID NO: 1089602 - RNA, 19 nt, Homo sapiens
uuaaagagcccaagagugu

SEQ ID NO: 1089603 - RNA, 19 nt, Homo sapiens
gcccauggauugucuagug

SEQ ID NO: 1089604 - RNA, 19 nt, Homo sapiens
gcucaaugcugccagagau

SEQ ID NO: 1089605 - RNA, 19 nt, Homo sapiens
gcaagcagugguuuauaaa

SEQ ID NO: 1089606 - RNA, 19 nt, Homo sapiens
agagggaacugaugugguu

SEQ ID NO: 1089607 - RNA, 19 nt, Homo sapiens
caaauacggccaagcagaa

SEQ ID NO: 1089608 - RNA, 19 nt, Homo sapiens
aaugauggcuucugaguca

SEQ ID NO: 1089609 - RNA, 19 nt, Homo sapiens
uagagaugcugcagucuga

SEQ ID NO: 1089610 - RNA, 19 nt, Homo sapiens
gaaauuggugcauagcuau

SEQ ID NO: 1089611 - RNA, 19 nt, Homo sapiens
gauaaaguagcaucuguug

SEQ ID NO: 1089612 - RNA, 19 nt, Homo sapiens
caaaguaugcuguugugaa

SEQ ID NO: 1089613 - RNA, 19 nt, Homo sapiens
gcuauaugccugaaucaaa

SEQ ID NO: 1089614 - RNA, 19 nt, Homo sapiens
guggguagcugauuccaau

SEQ ID NO: 1089615 - RNA, 19 nt, Homo sapiens
gagaaaagauguccaaguc

SEQ ID NO: 1089616 - RNA, 19 nt, Homo sapiens
uuggacaucugguuugaua

SEQ ID NO: 1089617 - RNA, 19 nt, Homo sapiens
ccaaugaagcuguuugcua

SEQ ID NO: 1089618 - RNA, 19 nt, Homo sapiens
cugaacaacuucuuccaaa

SEQ ID NO: 1089619 - RNA, 19 nt, Homo sapiens
uagagaagcucagaaucuu

SEQ ID NO: 1089620 - RNA, 19 nt, Homo sapiens
gggaacugaugugguuaua

SEQ ID NO: 1089621 - RNA, 19 nt, Homo sapiens
gaagcagaacuugaauaua

SEQ ID NO: 1089622 - RNA, 19 nt, Homo sapiens
guaugaagccaaacaguug

SEQ ID NO: 1089623 - RNA, 19 nt, Homo sapiens
gaacuucauggucuuaugu

SEQ ID NO: 1089624 - RNA, 19 nt, Homo sapiens
ggacgauuccagccaauga

SEQ ID NO: 1089625 - RNA, 19 nt, Homo sapiens
ggauuuacccuuggagaaa

SEQ ID NO: 1089626 - RNA, 19 nt, Homo sapiens
ggaacuucauggucuuaug

SEQ ID NO: 1089627 - RNA, 19 nt, Homo sapiens
ugaauggcaugguugaaau

SEQ ID NO: 1089628 - RNA, 19 nt, Homo sapiens
guucaucuccuguuaguau

SEQ ID NO: 1089629 - RNA, 19 nt, Homo sapiens
gcucagaaucuuucagcua

SEQ ID NO: 1089630 - RNA, 19 nt, Homo sapiens
guaauugucaugccgacua

SEQ ID NO: 1089631 - RNA, 19 nt, Homo sapiens
gcagauguaaucgagcuua

SEQ ID NO: 1089632 - RNA, 19 nt, Homo sapiens
ccucucaguugaaugaauu

SEQ ID NO: 1089633 - RNA, 19 nt, Homo sapiens
gaaucaaaguaugcuguug

SEQ ID NO: 1089634 - RNA, 19 nt, Homo sapiens
ggaauaauugcuacuauac

SEQ ID NO: 1089635 - RNA, 19 nt, Homo sapiens
gaaagccaagauuuaggua

SEQ ID NO: 1089636 - RNA, 19 nt, Homo sapiens
caagauuaccgaauuauac

SEQ ID NO: 1089637 - RNA, 19 nt, Homo sapiens
cagauuccaucccuguaaa

SEQ ID NO: 1089638 - RNA, 19 nt, Homo sapiens
gagcauauuguuaaacuag

SEQ ID NO: 1089639 - RNA, 19 nt, Homo sapiens
agcaagcagugguuuauaa

SEQ ID NO: 1089640 - RNA, 19 nt, Homo sapiens
ggaaacaacauuugagacu

SEQ ID NO: 1089641 - RNA, 19 nt, Homo sapiens
guugugaaauguucuaagu

SEQ ID NO: 1089642 - RNA, 19 nt, Homo sapiens
gccaagauuuagguaauga

SEQ ID NO: 1089643 - RNA, 19 nt, Homo sapiens
gagaagcucagaaucuuuc

SEQ ID NO: 1089644 - RNA, 19 nt, Homo sapiens
gcccugaugccuuggaaua

SEQ ID NO: 1089645 - RNA, 19 nt, Homo sapiens
gauaucugguggacucuuc

SEQ ID NO: 1089646 - RNA, 19 nt, Homo sapiens
gcauauuguuaaacuagug

SEQ ID NO: 1089647 - RNA, 19 nt, Homo sapiens
guagagaagcucagaaucu

SEQ ID NO: 1089648 - RNA, 19 nt, Homo sapiens
ugaagcagaacuugaauau

SEQ ID NO: 1089649 - RNA, 19 nt, Homo sapiens
cagauguaaucgagcuuaa

SEQ ID NO: 1089650 - RNA, 19 nt, Homo sapiens
gcaaacaagauuaccgaau

SEQ ID NO: 1089651 - RNA, 19 nt, Homo sapiens
ggacuuauucagaacauag

SEQ ID NO: 1089652 - RNA, 19 nt, Homo sapiens
ggagagugcgugugcaaug

SEQ ID NO: 1089653 - RNA, 19 nt, Homo sapiens
auaguggacuuauucagaa

SEQ ID NO: 1089654 - RNA, 19 nt, Homo sapiens
gagucuuccuauaaaguaa

SEQ ID NO: 1089655 - RNA, 19 nt, Homo sapiens
gaagcuguuugcuauaugc

SEQ ID NO: 1089656 - RNA, 19 nt, Homo sapiens
aaauuggcaucucuuauag

SEQ ID NO: 1089657 - RNA, 19 nt, Homo sapiens
ugucagucguucaauauau

SEQ ID NO: 1089658 - RNA, 19 nt, Homo sapiens
gagcaugucagucguucaa

SEQ ID NO: 1089659 - RNA, 19 nt, Homo sapiens
ggagucaaaaucagaauua

SEQ ID NO: 1089660 - RNA, 19 nt, Homo sapiens
gaaggaggcugugcagaaa

SEQ ID NO: 1089661 - RNA, 19 nt, Homo sapiens
ucacagaaguccuuuaaga

SEQ ID NO: 1089662 - RNA, 19 nt, Homo sapiens
gauuaaaugucuccagaaa

SEQ ID NO: 1089663 - RNA, 19 nt, Homo sapiens
gacacaagcuggcaaagga

SEQ ID NO: 1089664 - RNA, 19 nt, Homo sapiens
gaagaaggcaggagagaga

SEQ ID NO: 1089665 - RNA, 19 nt, Homo sapiens
gaaagcgucuggaggagau

SEQ ID NO: 1089666 - RNA, 19 nt, Homo sapiens
ccaaacacguggacucuau

SEQ ID NO: 1089667 - RNA, 19 nt, Homo sapiens
gaucuuccucucucuauuu

SEQ ID NO: 1089668 - RNA, 19 nt, Homo sapiens
ggucacagaaguccuuuaa

SEQ ID NO: 1089669 - RNA, 19 nt, Homo sapiens
ggaaggaggaggcaaagga

SEQ ID NO: 1089670 - RNA, 19 nt, Homo sapiens
caggaugucuggaggagaa

SEQ ID NO: 1089671 - RNA, 19 nt, Homo sapiens
ggaugugaauacuguaaau

SEQ ID NO: 1089672 - RNA, 19 nt, Homo sapiens
ccacagcucuccaggacau

SEQ ID NO: 1089673 - RNA, 19 nt, Homo sapiens
uaagaggguuugccuugga

SEQ ID NO: 1089674 - RNA, 19 nt, Homo sapiens
ccaagaagcaggacagcaa

SEQ ID NO: 1089675 - RNA, 19 nt, Homo sapiens
ggaggaaggaggaggcaaa

SEQ ID NO: 1089676 - RNA, 19 nt, Homo sapiens
ucaacaagcggcucucaaa

SEQ ID NO: 1089677 - RNA, 19 nt, Homo sapiens
caaaggagcggcgagaaga

SEQ ID NO: 1089678 - RNA, 19 nt, Homo sapiens
uguaguauuugccuugauu

SEQ ID NO: 1089679 - RNA, 19 nt, Homo sapiens
cacguggacucuauaauca

SEQ ID NO: 1089680 - RNA, 19 nt, Homo sapiens
caguuaaccugcccaaaca

SEQ ID NO: 1089681 - RNA, 19 nt, Homo sapiens
cagcgucccuggugaaugg

SEQ ID NO: 1089682 - RNA, 19 nt, Homo sapiens
acaagcggcucucaaaguc

SEQ ID NO: 1089683 - RNA, 19 nt, Homo sapiens
caguguggcuggagaagga

SEQ ID NO: 1089684 - RNA, 19 nt, Homo sapiens
guauuugccuugauuuggu

SEQ ID NO: 1089685 - RNA, 19 nt, Homo sapiens
uaaauagcuugugcucaga

SEQ ID NO: 1089686 - RNA, 19 nt, Homo sapiens
gcaaaggagcggcgagaag

SEQ ID NO: 1089687 - RNA, 19 nt, Homo sapiens
agaaggaggcugugcagaa

SEQ ID NO: 1089688 - RNA, 19 nt, Homo sapiens
ggaggagcaacgucuuaaa

SEQ ID NO: 1089689 - RNA, 19 nt, Homo sapiens
uggaggagaucaugaagag

SEQ ID NO: 1089690 - RNA, 19 nt, Homo sapiens
caaacacguggacucuaua

SEQ ID NO: 1089691 - RNA, 19 nt, Homo sapiens
acacacauauacacucaca

SEQ ID NO: 1089692 - RNA, 19 nt, Homo sapiens
gaaagggacaagcgaaugc

SEQ ID NO: 1089693 - RNA, 19 nt, Homo sapiens
gcaagcgcagggccaguaa

SEQ ID NO: 1089694 - RNA, 19 nt, Homo sapiens
gccacacucugccuccaaa

SEQ ID NO: 1089695 - RNA, 19 nt, Homo sapiens
cagccucucuggccucuuc

SEQ ID NO: 1089696 - RNA, 19 nt, Homo sapiens
auacacacauauacacuca

SEQ ID NO: 1089697 - RNA, 19 nt, Homo sapiens
caccacagaccgagaagaa

SEQ ID NO: 1089698 - RNA, 19 nt, Homo sapiens
aaacacguggacucuauaa

SEQ ID NO: 1089699 - RNA, 19 nt, Homo sapiens
gaggagcaacgucuuaaag

SEQ ID NO: 1089700 - RNA, 19 nt, Homo sapiens
uacugcaucugauuaaaug

SEQ ID NO: 1089701 - RNA, 19 nt, Homo sapiens
gagacacuccugcccuuug

SEQ ID NO: 1089702 - RNA, 19 nt, Homo sapiens
acucggaagucagaaguuu

SEQ ID NO: 1089703 - RNA, 19 nt, Homo sapiens
guacaguggaugugaauac

SEQ ID NO: 1089704 - RNA, 19 nt, Homo sapiens
gcaggucacagaaguccuu

SEQ ID NO: 1089705 - RNA, 19 nt, Homo sapiens
gcccagagccugugaaagc

SEQ ID NO: 1089706 - RNA, 19 nt, Homo sapiens
gaaagaggaggccgaagcu

SEQ ID NO: 1089707 - RNA, 19 nt, Homo sapiens
gcaggaggcacgagagaag

SEQ ID NO: 1089708 - RNA, 19 nt, Homo sapiens
ccaagcaagaggugaagaa

SEQ ID NO: 1089709 - RNA, 19 nt, Homo sapiens
acacguggacucuauaauc

SEQ ID NO: 1089710 - RNA, 19 nt, Homo sapiens
gaagacgugggccgaaauc

SEQ ID NO: 1089711 - RNA, 19 nt, Homo sapiens
aagaagacgugggccgaaa

SEQ ID NO: 1089712 - RNA, 19 nt, Homo sapiens
gagcaggaggcacgagaga

SEQ ID NO: 1089713 - RNA, 19 nt, Homo sapiens
guuacugcaucugauuaaa

SEQ ID NO: 1089714 - RNA, 19 nt, Homo sapiens
cagcaaggagcgcuaugaa

SEQ ID NO: 1089715 - RNA, 19 nt, Homo sapiens
ggggccaccuguaguauuu

SEQ ID NO: 1089716 - RNA, 19 nt, Homo sapiens
caacaagcggcucucaaag

SEQ ID NO: 1089717 - RNA, 19 nt, Homo sapiens
caccuugggccacaggaua

SEQ ID NO: 1089718 - RNA, 19 nt, Homo sapiens
gcagggccaguaacgagaa

SEQ ID NO: 1089719 - RNA, 19 nt, Homo sapiens
gagccgaacaccagagaca

SEQ ID NO: 1089720 - RNA, 19 nt, Homo sapiens
aggaggcugugcagaaaga

SEQ ID NO: 1089721 - RNA, 19 nt, Homo sapiens
ggcagaagcucgagaaaac

SEQ ID NO: 1089722 - RNA, 19 nt, Homo sapiens
gguggguccucucuguugu

SEQ ID NO: 1089723 - RNA, 19 nt, Homo sapiens
cagcacaccaggagaaugg

SEQ ID NO: 1089724 - RNA, 19 nt, Homo sapiens
gaugccagaccuccucgaa

SEQ ID NO: 1089725 - RNA, 19 nt, Homo sapiens
agacagaacaaagauggaa

SEQ ID NO: 1089726 - RNA, 19 nt, Homo sapiens
ucgccuggaaucaguguua

SEQ ID NO: 1089727 - RNA, 19 nt, Homo sapiens
caacggucagugaagaaga

SEQ ID NO: 1089728 - RNA, 19 nt, Homo sapiens
guaguauuugccuugauuu

SEQ ID NO: 1089729 - RNA, 19 nt, Homo sapiens
acucggcucuuggcugaaa

SEQ ID NO: 1089730 - RNA, 19 nt, Homo sapiens
ggagagcagcaucguggau

SEQ ID NO: 1089731 - RNA, 19 nt, Homo sapiens
caaggagcgcuaugaagca

SEQ ID NO: 1089732 - RNA, 19 nt, Homo sapiens
guguuacugcaucugauua

SEQ ID NO: 1089733 - RNA, 19 nt, Homo sapiens
gcccucgccuggaaucagu

SEQ ID NO: 1089734 - RNA, 19 nt, Homo sapiens
ggguggguccucucuguug

SEQ ID NO: 1089735 - RNA, 19 nt, Homo sapiens
cagaaagggacaagcgaau

SEQ ID NO: 1089736 - RNA, 19 nt, Homo sapiens
guggaugugaauacuguaa

SEQ ID NO: 1089737 - RNA, 19 nt, Homo sapiens
ggaggggccaccuguagua

SEQ ID NO: 1089738 - RNA, 19 nt, Homo sapiens
uggguccucucuguuguuu

SEQ ID NO: 1089739 - RNA, 19 nt, Homo sapiens
cuaugaagcagccauccaa

SEQ ID NO: 1089740 - RNA, 19 nt, Homo sapiens
ccuguaguauuugccuuga

SEQ ID NO: 1089741 - RNA, 19 nt, Homo sapiens
cacagaaguccuuuaagag

SEQ ID NO: 1089742 - RNA, 19 nt, Homo sapiens
uggacucuauaaucaacaa

SEQ ID NO: 1089743 - RNA, 19 nt, Homo sapiens
ggucagagauguuuguuua

SEQ ID NO: 1089744 - RNA, 19 nt, Homo sapiens
cagaaacacuugacucuuc

SEQ ID NO: 1089745 - RNA, 19 nt, Homo sapiens
ggacagcggacucugcuuu

SEQ ID NO: 1089746 - RNA, 19 nt, Homo sapiens
gacacaaacuggagaaugg

SEQ ID NO: 1089747 - RNA, 19 nt, Homo sapiens
ggacacagaggaggucuaa

SEQ ID NO: 1089748 - RNA, 19 nt, Homo sapiens
gaacuugcgugcagcuucu

SEQ ID NO: 1089749 - RNA, 19 nt, Homo sapiens
gagcugcgauuccgugcuu

SEQ ID NO: 1089750 - RNA, 19 nt, Homo sapiens
caaugaagcuaugcaaaca

SEQ ID NO: 1089751 - RNA, 19 nt, Homo sapiens
ggcgaucgcugaauuucuu

SEQ ID NO: 1089752 - RNA, 19 nt, Homo sapiens
gaaccguagacuuuauaua

SEQ ID NO: 1089753 - RNA, 19 nt, Homo sapiens
ccacauugcuugccuucau

SEQ ID NO: 1089754 - RNA, 19 nt, Homo sapiens
gggaaaggcuucgcagcuu

SEQ ID NO: 1089755 - RNA, 19 nt, Homo sapiens
caccagagaucaaacucaa

SEQ ID NO: 1089756 - RNA, 19 nt, Homo sapiens
gaaggugcuggauaucuuu

SEQ ID NO: 1089757 - RNA, 19 nt, Homo sapiens
gagcaucuccuccuguuca

SEQ ID NO: 1089758 - RNA, 19 nt, Homo sapiens
cgagggaucuuagggcuau

SEQ ID NO: 1089759 - RNA, 19 nt, Homo sapiens
gaacagcugacucgguaug

SEQ ID NO: 1089760 - RNA, 19 nt, Homo sapiens
gcaaugaagcuaugcaaac

SEQ ID NO: 1089761 - RNA, 19 nt, Homo sapiens
cacauugcuugccuucaua

SEQ ID NO: 1089762 - RNA, 19 nt, Homo sapiens
ccuggugacuccauucuga

SEQ ID NO: 1089763 - RNA, 19 nt, Homo sapiens
agaaggugcuggauaucuu

SEQ ID NO: 1089764 - RNA, 19 nt, Homo sapiens
gaucuggacgucaagcaaa

SEQ ID NO: 1089765 - RNA, 19 nt, Homo sapiens
ucagagauguuuguuuaca

SEQ ID NO: 1089766 - RNA, 19 nt, Homo sapiens
gcuggugucugagcugauu

SEQ ID NO: 1089767 - RNA, 19 nt, Homo sapiens
ccaugggcauugggaauaa

SEQ ID NO: 1089768 - RNA, 19 nt, Homo sapiens
caggcaaccucaccagaga

SEQ ID NO: 1089769 - RNA, 19 nt, Homo sapiens
gggaccaguucagccuuua

SEQ ID NO: 1089770 - RNA, 19 nt, Homo sapiens
gggaaccguagacuuuaua

SEQ ID NO: 1089771 - RNA, 19 nt, Homo sapiens
gcugauugccugugaacaa

SEQ ID NO: 1089772 - RNA, 19 nt, Homo sapiens
ccguagacuuuauauaugu

SEQ ID NO: 1089773 - RNA, 19 nt, Homo sapiens
cacaagcaaugaagcuaug

SEQ ID NO: 1089774 - RNA, 19 nt, Homo sapiens
ucugugaccuggagaagau

SEQ ID NO: 1089775 - RNA, 19 nt, Homo sapiens
ugacuuucccugagaagaa

SEQ ID NO: 1089776 - RNA, 19 nt, Homo sapiens
agucagagcagccacauug

SEQ ID NO: 1089777 - RNA, 19 nt, Homo sapiens
ccugggcgaucgcugaauu

SEQ ID NO: 1089778 - RNA, 19 nt, Homo sapiens
gugcguggcugugagauag

SEQ ID NO: 1089779 - RNA, 19 nt, Homo sapiens
cccaagagcugugcugauc

SEQ ID NO: 1089780 - RNA, 19 nt, Homo sapiens
ggugcuggauaucuuugaa

SEQ ID NO: 1089781 - RNA, 19 nt, Homo sapiens
ggagaagauccagaacuug

SEQ ID NO: 1089782 - RNA, 19 nt, Homo sapiens
ggagacaggcagcccacaa

SEQ ID NO: 1089783 - RNA, 19 nt, Homo sapiens
aagauuacguggccaccuu

SEQ ID NO: 1089784 - RNA, 19 nt, Homo sapiens
gagcgcaagcgaagcauca

SEQ ID NO: 1089785 - RNA, 19 nt, Homo sapiens
gagaggacuaugaggaaga

SEQ ID NO: 1089786 - RNA, 19 nt, Homo sapiens
caaguggacaaguucuauu

SEQ ID NO: 1089787 - RNA, 19 nt, Homo sapiens
ggagacagagcugcgauuc

SEQ ID NO: 1089788 - RNA, 19 nt, Homo sapiens
cuuuaagacugcugauaug

SEQ ID NO: 1089789 - RNA, 19 nt, Homo sapiens
ccauggaggcuggcccuua

SEQ ID NO: 1089790 - RNA, 19 nt, Homo sapiens
agaggaggauccagcaaca

SEQ ID NO: 1089791 - RNA, 19 nt, Homo sapiens
ucacaagcaaugaagcuau

SEQ ID NO: 1089792 - RNA, 19 nt, Homo sapiens
ccugggaucuggacgucaa

SEQ ID NO: 1089793 - RNA, 19 nt, Homo sapiens
ccagagaucaaacucaagu

SEQ ID NO: 1089794 - RNA, 19 nt, Homo sapiens
ucgagcaucuccuccuguu

SEQ ID NO: 1089795 - RNA, 19 nt, Homo sapiens
cauggaggcuggcccuuac

SEQ ID NO: 1089796 - RNA, 19 nt, Homo sapiens
gagcugacgccugaacuuc

SEQ ID NO: 1089797 - RNA, 19 nt, Homo sapiens
gauugccugugaacaagau

SEQ ID NO: 1089798 - RNA, 19 nt, Homo sapiens
ugacucuucuggagaugug

SEQ ID NO: 1089799 - RNA, 19 nt, Homo sapiens
uuuacaagcaggccuuuaa

SEQ ID NO: 1089800 - RNA, 19 nt, Homo sapiens
cgacacaaacuggagaaug

SEQ ID NO: 1089801 - RNA, 19 nt, Homo sapiens
ggaaccguagacuuuauau

SEQ ID NO: 1089802 - RNA, 19 nt, Homo sapiens
gacuuucccugagaagaau

SEQ ID NO: 1089803 - RNA, 19 nt, Homo sapiens
gaauuucuucccucugcuu

SEQ ID NO: 1089804 - RNA, 19 nt, Homo sapiens
caaccucaccagagaucaa

SEQ ID NO: 1089805 - RNA, 19 nt, Homo sapiens
ccuuuaagacugcugauau

SEQ ID NO: 1089806 - RNA, 19 nt, Homo sapiens
gaccaguucagccuuuaug

SEQ ID NO: 1089807 - RNA, 19 nt, Homo sapiens
uuagggcuaucccgacaga

SEQ ID NO: 1089808 - RNA, 19 nt, Homo sapiens
gauauggggcugacagaaa

SEQ ID NO: 1089809 - RNA, 19 nt, Homo sapiens
caagcaggccuuuaagacu

SEQ ID NO: 1089810 - RNA, 19 nt, Homo sapiens
augaagcuaugcaaacaau

SEQ ID NO: 1089811 - RNA, 19 nt, Homo sapiens
ucuaacgaccagaguauug

SEQ ID NO: 1089812 - RNA, 19 nt, Homo sapiens
gaaugccaccucccagaag

SEQ ID NO: 1089813 - RNA, 19 nt, Homo sapiens
accguagacuuuauauaug

SEQ ID NO: 1089814 - RNA, 19 nt, Homo sapiens
gacaggcagcccacaacaa

SEQ ID NO: 1089815 - RNA, 19 nt, Homo sapiens
acagcggacucugcuuuga

SEQ ID NO: 1089816 - RNA, 19 nt, Homo sapiens
ugucaucuguggccgaaag

SEQ ID NO: 1089817 - RNA, 19 nt, Homo sapiens
ucugaggugucacaagcaa

SEQ ID NO: 1089818 - RNA, 19 nt, Homo sapiens
gacagcggacucugcuuug

SEQ ID NO: 1089819 - RNA, 19 nt, Homo sapiens
ggaccaguucagccuuuau

SEQ ID NO: 1089820 - RNA, 19 nt, Homo sapiens
ugaggugucacaagcaaug

SEQ ID NO: 1089821 - RNA, 19 nt, Homo sapiens
ggaucuggacgucaagcaa

SEQ ID NO: 1089822 - RNA, 19 nt, Homo sapiens
caugggcauugggaauaaa

SEQ ID NO: 1089823 - RNA, 19 nt, Homo sapiens
ucaaguggacaaguucuau

SEQ ID NO: 1089824 - RNA, 19 nt, Homo sapiens
cauguggagaggacuauga

SEQ ID NO: 1089825 - RNA, 19 nt, Homo sapiens
ggugcguggcugugagaua

SEQ ID NO: 1089826 - RNA, 19 nt, Homo sapiens
gcagcagccucuggaacag

SEQ ID NO: 1089827 - RNA, 19 nt, Homo sapiens
gcagggacagcucuugcau

SEQ ID NO: 1089828 - RNA, 19 nt, Homo sapiens
gaagcaccgacacaaacug

SEQ ID NO: 1089829 - RNA, 19 nt, Homo sapiens
cgugaagcaccgacacaaa

SEQ ID NO: 1089830 - RNA, 19 nt, Homo sapiens
ccagaaacacuugacucuu

SEQ ID NO: 1089831 - RNA, 19 nt, Homo sapiens
agaaugccaccucccagaa

SEQ ID NO: 1089832 - RNA, 19 nt, Homo sapiens
uaagcaagggcuccaugga

SEQ ID NO: 1089833 - RNA, 19 nt, Homo sapiens
gugaagcaccgacacaaac

SEQ ID NO: 1089834 - RNA, 19 nt, Homo sapiens
uggagaggacuaugaggaa

SEQ ID NO: 1089835 - RNA, 19 nt, Homo sapiens
ccagcaggcacaugaaugg

SEQ ID NO: 1089836 - RNA, 19 nt, Homo sapiens
caggggaaccguagacuuu

SEQ ID NO: 1089837 - RNA, 19 nt, Homo sapiens
acacagaggaggucuaacg

SEQ ID NO: 1089838 - RNA, 19 nt, Homo sapiens
acaggcagcccacaacaag

SEQ ID NO: 1089839 - RNA, 19 nt, Homo sapiens
uacaagcaggccuuuaaga

SEQ ID NO: 1089840 - RNA, 19 nt, Homo sapiens
cgagaccccuucacuguca

SEQ ID NO: 1089841 - RNA, 19 nt, Homo sapiens
gcgcucagucccuuaagca

SEQ ID NO: 1089842 - RNA, 19 nt, Homo sapiens
gugcauaccuggacaguga

SEQ ID NO: 1089843 - RNA, 19 nt, Homo sapiens
ggaaggagacggugcagaa

SEQ ID NO: 1089844 - RNA, 19 nt, Homo sapiens
gcagagaucaccuucaaga

SEQ ID NO: 1089845 - RNA, 19 nt, Homo sapiens
ccaugaaggugcuggagaa

SEQ ID NO: 1089846 - RNA, 19 nt, Homo sapiens
gaucagaaggcaaagaugu

SEQ ID NO: 1089847 - RNA, 19 nt, Homo sapiens
caaacugucuagaaccaau

SEQ ID NO: 1089848 - RNA, 19 nt, Homo sapiens
uggcagagaucaccuucaa

SEQ ID NO: 1089849 - RNA, 19 nt, Homo sapiens
agaagagggugcagaagga

SEQ ID NO: 1089850 - RNA, 19 nt, Homo sapiens
gaggugaucagaaggcaaa

SEQ ID NO: 1089851 - RNA, 19 nt, Homo sapiens
ggagcagcuuccaacacua

SEQ ID NO: 1089852 - RNA, 19 nt, Homo sapiens
gaggagagagagaaagaga

SEQ ID NO: 1089853 - RNA, 19 nt, Homo sapiens
agauggaggugcuggagaa

SEQ ID NO: 1089854 - RNA, 19 nt, Homo sapiens
gaaggaggccaacccuaca

SEQ ID NO: 1089855 - RNA, 19 nt, Homo sapiens
agagagagaaagagaacua

SEQ ID NO: 1089856 - RNA, 19 nt, Homo sapiens
gagagaaagagaacuaguc

SEQ ID NO: 1089857 - RNA, 19 nt, Homo sapiens
ggagagagagaaagagaac

SEQ ID NO: 1089858 - RNA, 19 nt, Homo sapiens
cagcaacggcagcaacuga

SEQ ID NO: 1089859 - RNA, 19 nt, Homo sapiens
ugagccaacugggugcaua

SEQ ID NO: 1089860 - RNA, 19 nt, Homo sapiens
guaagacgugcggagaaua

SEQ ID NO: 1089861 - RNA, 19 nt, Homo sapiens
ggacuccgacucagaggau

SEQ ID NO: 1089862 - RNA, 19 nt, Homo sapiens
ccaaagaccggcaguacgu

SEQ ID NO: 1089863 - RNA, 19 nt, Homo sapiens
caaagaugucggagcgaaa

SEQ ID NO: 1089864 - RNA, 19 nt, Homo sapiens
caucaaagauccccaaacu

SEQ ID NO: 1089865 - RNA, 19 nt, Homo sapiens
cacaaacugucuagaacca

SEQ ID NO: 1089866 - RNA, 19 nt, Homo sapiens
cagcgugcuccaacacaua

SEQ ID NO: 1089867 - RNA, 19 nt, Homo sapiens
ccacauugaggccagcauu

SEQ ID NO: 1089868 - RNA, 19 nt, Homo sapiens
uguaagacgugcggagaau

SEQ ID NO: 1089869 - RNA, 19 nt, Homo sapiens
ucaaagauccccaaacuca

SEQ ID NO: 1089870 - RNA, 19 nt, Homo sapiens
ccaccugucacugugcuua

SEQ ID NO: 1089871 - RNA, 19 nt, Homo sapiens
agagaucaccuucaagaca

SEQ ID NO: 1089872 - RNA, 19 nt, Homo sapiens
caggaggucccuucucugu

SEQ ID NO: 1089873 - RNA, 19 nt, Homo sapiens
gcggagaauacaucuacaa

SEQ ID NO: 1089874 - RNA, 19 nt, Homo sapiens
aaacugucuagaaccaaua

SEQ ID NO: 1089875 - RNA, 19 nt, Homo sapiens
gagcagcuuccaacacuac

SEQ ID NO: 1089876 - RNA, 19 nt, Homo sapiens
ggaccaaggacuccaagcu

SEQ ID NO: 1089877 - RNA, 19 nt, Homo sapiens
caucucuuccuuccacaaa

SEQ ID NO: 1089878 - RNA, 19 nt, Homo sapiens
cccaggaggucccuucucu

SEQ ID NO: 1089879 - RNA, 19 nt, Homo sapiens
gaauuuccaggcugagaag

SEQ ID NO: 1089880 - RNA, 19 nt, Homo sapiens
gacagacccugaaaacaca

SEQ ID NO: 1089881 - RNA, 19 nt, Homo sapiens
uaagacgugcggagaauac

SEQ ID NO: 1089882 - RNA, 19 nt, Homo sapiens
ccagcgugcuccaacacau

SEQ ID NO: 1089883 - RNA, 19 nt, Homo sapiens
gugcggagaauacaucuac

SEQ ID NO: 1089884 - RNA, 19 nt, Homo sapiens
ccuucaacaugagguguaa

SEQ ID NO: 1089885 - RNA, 19 nt, Homo sapiens
agucacacguccagcuuca

SEQ ID NO: 1089886 - RNA, 19 nt, Homo sapiens
aggagacggugcagaacga

SEQ ID NO: 1089887 - RNA, 19 nt, Homo sapiens
gugaucagaaggcaaagau

SEQ ID NO: 1089888 - RNA, 19 nt, Homo sapiens
gagcgaaaaguauuaaaca

SEQ ID NO: 1089889 - RNA, 19 nt, Homo sapiens
cauggagccacgcggaauu

SEQ ID NO: 1089890 - RNA, 19 nt, Homo sapiens
gcauggagccacgcggaau

SEQ ID NO: 1089891 - RNA, 19 nt, Homo sapiens
cgaggcuggucguggugaa

SEQ ID NO: 1089892 - RNA, 19 nt, Homo sapiens
uggagaaccggaccaagga

SEQ ID NO: 1089893 - RNA, 19 nt, Homo sapiens
gggaggacgaggagcugaa

SEQ ID NO: 1089894 - RNA, 19 nt, Homo sapiens
gcaacagacucauauauug

SEQ ID NO: 1089895 - RNA, 19 nt, Homo sapiens
gcaaagagcagcccaguuu

SEQ ID NO: 1089896 - RNA, 19 nt, Homo sapiens
gaacgaaugucccuuagau

SEQ ID NO: 1089897 - RNA, 19 nt, Homo sapiens
gaugugaccuaaaggauaa

SEQ ID NO: 1089898 - RNA, 19 nt, Homo sapiens
uaaacaaccuugaucauug

SEQ ID NO: 1089899 - RNA, 19 nt, Homo sapiens
gaacgugacuguuuaaucg

SEQ ID NO: 1089900 - RNA, 19 nt, Homo sapiens
ccaaggagauaauaaaguu

SEQ ID NO: 1089901 - RNA, 19 nt, Homo sapiens
gaacuacagucuaugaaca

SEQ ID NO: 1089902 - RNA, 19 nt, Homo sapiens
ggacucaauugcuauuauu

SEQ ID NO: 1089903 - RNA, 19 nt, Homo sapiens
gaaccaauauggcugugaa

SEQ ID NO: 1089904 - RNA, 19 nt, Homo sapiens
gaagauauacccauuguca

SEQ ID NO: 1089905 - RNA, 19 nt, Homo sapiens
gaaggacggucucgugaug

SEQ ID NO: 1089906 - RNA, 19 nt, Homo sapiens
uaaauuagccaguaacuug

SEQ ID NO: 1089907 - RNA, 19 nt, Homo sapiens
gcaguaaagugaaggaugu

SEQ ID NO: 1089908 - RNA, 19 nt, Homo sapiens
uaccauaucuucuggcuaa

SEQ ID NO: 1089909 - RNA, 19 nt, Homo sapiens
gugcugaucucuugacauu

SEQ ID NO: 1089910 - RNA, 19 nt, Homo sapiens
cgacagagauuauuauggu

SEQ ID NO: 1089911 - RNA, 19 nt, Homo sapiens
gacaaggcguccagaaauu

SEQ ID NO: 1089912 - RNA, 19 nt, Homo sapiens
gaauugauacucucaugua

SEQ ID NO: 1089913 - RNA, 19 nt, Homo sapiens
cagaagggauuuaggacua

SEQ ID NO: 1089914 - RNA, 19 nt, Homo sapiens
ggcguugccuuguauauaa

SEQ ID NO: 1089915 - RNA, 19 nt, Homo sapiens
ugaaaggccuugugaaaca

SEQ ID NO: 1089916 - RNA, 19 nt, Homo sapiens
ugacacacaucacaacuga

SEQ ID NO: 1089917 - RNA, 19 nt, Homo sapiens
cuagagagacuaaugauuu

SEQ ID NO: 1089918 - RNA, 19 nt, Homo sapiens
gugaugauaucuucaaaug

SEQ ID NO: 1089919 - RNA, 19 nt, Homo sapiens
uaauaaaguugacgacaga

SEQ ID NO: 1089920 - RNA, 19 nt, Homo sapiens
aaacaaccuugaucauuga

SEQ ID NO: 1089921 - RNA, 19 nt, Homo sapiens
gaaacagaauugauacucu

SEQ ID NO: 1089922 - RNA, 19 nt, Homo sapiens
gagaagagcaggauauauc

SEQ ID NO: 1089923 - RNA, 19 nt, Homo sapiens
gaauacauuucgacucaug

SEQ ID NO: 1089924 - RNA, 19 nt, Homo sapiens
caauauggcugugaaacaa

SEQ ID NO: 1089925 - RNA, 19 nt, Homo sapiens
gaaacagcauauagauuca

SEQ ID NO: 1089926 - RNA, 19 nt, Homo sapiens
gcugaucucuugacauuca

SEQ ID NO: 1089927 - RNA, 19 nt, Homo sapiens
gaugauaucuucaaaugcu

SEQ ID NO: 1089928 - RNA, 19 nt, Homo sapiens
gagucugguugaauauuua

SEQ ID NO: 1089929 - RNA, 19 nt, Homo sapiens
gugaauacauuucgacuca

SEQ ID NO: 1089930 - RNA, 19 nt, Homo sapiens
gugcuggacuuaucccaua

SEQ ID NO: 1089931 - RNA, 19 nt, Homo sapiens
gcgcggagguucuaucugu

SEQ ID NO: 1089932 - RNA, 19 nt, Homo sapiens
gaaauugugcagaugauug

SEQ ID NO: 1089933 - RNA, 19 nt, Homo sapiens
aagagcagcugucuaagaa

SEQ ID NO: 1089934 - RNA, 19 nt, Homo sapiens
aaaccuaucuggcgacaug

SEQ ID NO: 1089935 - RNA, 19 nt, Homo sapiens
ucauguaucuacuagcaua

SEQ ID NO: 1089936 - RNA, 19 nt, Homo sapiens
cagcgaaacagaauugaua

SEQ ID NO: 1089937 - RNA, 19 nt, Homo sapiens
ccagguggcuacuucauug

SEQ ID NO: 1089938 - RNA, 19 nt, Homo sapiens
gaguagaagaugugaauuu

SEQ ID NO: 1089939 - RNA, 19 nt, Homo sapiens
gagcagcugucuaagaaca

SEQ ID NO: 1089940 - RNA, 19 nt, Homo sapiens
gguggcuacuucauuguua

SEQ ID NO: 1089941 - RNA, 19 nt, Homo sapiens
gacccuaugugguacuuaa

SEQ ID NO: 1089942 - RNA, 19 nt, Homo sapiens
ggugaaaggccuugugaaa

SEQ ID NO: 1089943 - RNA, 19 nt, Homo sapiens
caacagacucauauauuga

SEQ ID NO: 1089944 - RNA, 19 nt, Homo sapiens
gguaacaucuuagguguca

SEQ ID NO: 1089945 - RNA, 19 nt, Homo sapiens
ggaugugaccuaaaggaua

SEQ ID NO: 1089946 - RNA, 19 nt, Homo sapiens
gagagaugcugaccaugug

SEQ ID NO: 1089947 - RNA, 19 nt, Homo sapiens
gaagaauucccuugcguau

SEQ ID NO: 1089948 - RNA, 19 nt, Homo sapiens
gaacaagugauacauccaa

SEQ ID NO: 1089949 - RNA, 19 nt, Homo sapiens
ggaaggaaguaauguacca

SEQ ID NO: 1089950 - RNA, 19 nt, Homo sapiens
gacauucacucauuagaag

SEQ ID NO: 1089951 - RNA, 19 nt, Homo sapiens
aauggaacgugacuguuua

SEQ ID NO: 1089952 - RNA, 19 nt, Homo sapiens
caaggccucuuuagacaga

SEQ ID NO: 1089953 - RNA, 19 nt, Homo sapiens
ugaaacagcauauagauuc

SEQ ID NO: 1089954 - RNA, 19 nt, Homo sapiens
ccaaauguguuucuugucu

SEQ ID NO: 1089955 - RNA, 19 nt, Homo sapiens
gaucauccgcaaugccuua

SEQ ID NO: 1089956 - RNA, 19 nt, Homo sapiens
gguuaaaacuguccaagua

SEQ ID NO: 1089957 - RNA, 19 nt, Homo sapiens
ggaaauggaacgugacugu

SEQ ID NO: 1089958 - RNA, 19 nt, Homo sapiens
gcuccuggcuuccaccauu

SEQ ID NO: 1089959 - RNA, 19 nt, Homo sapiens
ccuauggacucaauugcua

SEQ ID NO: 1089960 - RNA, 19 nt, Homo sapiens
ggagagaugcugaccaugu

SEQ ID NO: 1089961 - RNA, 19 nt, Homo sapiens
gauuucaagugaugccuuu

SEQ ID NO: 1089962 - RNA, 19 nt, Homo sapiens
gagcaacagacucauauau

SEQ ID NO: 1089963 - RNA, 19 nt, Homo sapiens
cagaagauauacccauugu

SEQ ID NO: 1089964 - RNA, 19 nt, Homo sapiens
gcauaauacuuugucagaa

SEQ ID NO: 1089965 - RNA, 19 nt, Homo sapiens
ggucaaauuuaccauaucu

SEQ ID NO: 1089966 - RNA, 19 nt, Homo sapiens
cuaaugauuucaagugaug

SEQ ID NO: 1089967 - RNA, 19 nt, Homo sapiens
gacuaaugauuucaaguga

SEQ ID NO: 1089968 - RNA, 19 nt, Homo sapiens
aaacacauggugcuagaua

SEQ ID NO: 1089969 - RNA, 19 nt, Homo sapiens
caaaggagcaacagacuca

SEQ ID NO: 1089970 - RNA, 19 nt, Homo sapiens
ugacucagauuccuuugga

SEQ ID NO: 1089971 - RNA, 19 nt, Homo sapiens
caucuuaggugucauucga

SEQ ID NO: 1089972 - RNA, 19 nt, Homo sapiens
ugaaacacauggugcuaga

SEQ ID NO: 1089973 - RNA, 19 nt, Homo sapiens
acagaucgaugugucuaua

SEQ ID NO: 1089974 - RNA, 19 nt, Homo sapiens
gcacugggcaugaugacaa

SEQ ID NO: 1089975 - RNA, 19 nt, Homo sapiens
cgagccaaauguaucuaua

SEQ ID NO: 1089976 - RNA, 19 nt, Homo sapiens
cauaauacuuugucagaag

SEQ ID NO: 1089977 - RNA, 19 nt, Homo sapiens
ggaaagcagaagggauuua

SEQ ID NO: 1089978 - RNA, 19 nt, Homo sapiens
gcccaaggguacaggaauu

SEQ ID NO: 1089979 - RNA, 19 nt, Homo sapiens
ggaauuggcaggacagcuu

SEQ ID NO: 1089980 - RNA, 19 nt, Homo sapiens
gagcaggauauaucaauga

SEQ ID NO: 1089981 - RNA, 19 nt, Homo sapiens
guaacaagcgacuggaauu

SEQ ID NO: 1089982 - RNA, 19 nt, Homo sapiens
gacagagauuauuauggua

SEQ ID NO: 1089983 - RNA, 19 nt, Homo sapiens
caagagcagcugucuaaga

SEQ ID NO: 1089984 - RNA, 19 nt, Homo sapiens
gcagucacaaauaaacaua

SEQ ID NO: 1089985 - RNA, 19 nt, Homo sapiens
caaggacgauuuuauuuga

SEQ ID NO: 1089986 - RNA, 19 nt, Homo sapiens
gcuguuggagcuucaguua

SEQ ID NO: 1089987 - RNA, 19 nt, Homo sapiens
gaucccgacuguagaggaa

SEQ ID NO: 1089988 - RNA, 19 nt, Homo sapiens
gauagaauuugagaaacug

SEQ ID NO: 1089989 - RNA, 19 nt, Homo sapiens
gauaaugaaagccaaugaa

SEQ ID NO: 1089990 - RNA, 19 nt, Homo sapiens
agagucugguugaauauuu

SEQ ID NO: 1089991 - RNA, 19 nt, Homo sapiens
gaucgaugugucuauauuu

SEQ ID NO: 1089992 - RNA, 19 nt, Homo sapiens
guaagaaggcaaaggaugu

SEQ ID NO: 1089993 - RNA, 19 nt, Homo sapiens
ccucaugagugccguuuga

SEQ ID NO: 1089994 - RNA, 19 nt, Homo sapiens
ccagaaaucucuaacauua

SEQ ID NO: 1089995 - RNA, 19 nt, Homo sapiens
caaaguaccucacucauga

SEQ ID NO: 1089996 - RNA, 19 nt, Homo sapiens
gcaauaagcuuaccucagu

SEQ ID NO: 1089997 - RNA, 19 nt, Homo sapiens
gaacaaagacaguacauug

SEQ ID NO: 1089998 - RNA, 19 nt, Homo sapiens
agacaucacuggccuauaa

SEQ ID NO: 1089999 - RNA, 19 nt, Homo sapiens
caaagacaguacauugaua

SEQ ID NO: 1090000 - RNA, 19 nt, Homo sapiens
gcaacuggauuacucuaaa

SEQ ID NO: 1090001 - RNA, 19 nt, Homo sapiens
gacaguacauugauaaguu

SEQ ID NO: 1090002 - RNA, 19 nt, Homo sapiens
gaagugaaguuguuacucu

SEQ ID NO: 1090003 - RNA, 19 nt, Homo sapiens
gaauuuagccugcuucaug

SEQ ID NO: 1090004 - RNA, 19 nt, Homo sapiens
gaagaauccacgaauuaua

SEQ ID NO: 1090005 - RNA, 19 nt, Homo sapiens
gcuauggccuucucuacua

SEQ ID NO: 1090006 - RNA, 19 nt, Homo sapiens
gaauaccacucuucaaaca

SEQ ID NO: 1090007 - RNA, 19 nt, Homo sapiens
caaccaagcugaauaacca

SEQ ID NO: 1090008 - RNA, 19 nt, Homo sapiens
caaagcaggugcaguuaau

SEQ ID NO: 1090009 - RNA, 19 nt, Homo sapiens
ggagguuccugauguuauu

SEQ ID NO: 1090010 - RNA, 19 nt, Homo sapiens
uagaagaauccacgaauua

SEQ ID NO: 1090011 - RNA, 19 nt, Homo sapiens
gcaggacaguggacaggua

SEQ ID NO: 1090012 - RNA, 19 nt, Homo sapiens
gaacaaacaagauuagaag

SEQ ID NO: 1090013 - RNA, 19 nt, Homo sapiens
uuuagaagcucgauuagaa

SEQ ID NO: 1090014 - RNA, 19 nt, Homo sapiens
cuacagaacagaacacuuu

SEQ ID NO: 1090015 - RNA, 19 nt, Homo sapiens
caagaaacuuuguggugaa

SEQ ID NO: 1090016 - RNA, 19 nt, Homo sapiens
gaacagaauaccacucuuc

SEQ ID NO: 1090017 - RNA, 19 nt, Homo sapiens
gaacauagagaccuugaag

SEQ ID NO: 1090018 - RNA, 19 nt, Homo sapiens
ucacuggccuauaauaaau

SEQ ID NO: 1090019 - RNA, 19 nt, Homo sapiens
ucucuuaucucuaaacaug

SEQ ID NO: 1090020 - RNA, 19 nt, Homo sapiens
gaacauccacuagcaauag

SEQ ID NO: 1090021 - RNA, 19 nt, Homo sapiens
caucaagacagucaagaua

SEQ ID NO: 1090022 - RNA, 19 nt, Homo sapiens
ggaacaaacaagauuagaa

SEQ ID NO: 1090023 - RNA, 19 nt, Homo sapiens
guaugaaucucuuaucucu

SEQ ID NO: 1090024 - RNA, 19 nt, Homo sapiens
cagaauaccacucuucaaa

SEQ ID NO: 1090025 - RNA, 19 nt, Homo sapiens
gaagcucgauuagaagaau

SEQ ID NO: 1090026 - RNA, 19 nt, Homo sapiens
gccaagaacuuaaaacaaa

SEQ ID NO: 1090027 - RNA, 19 nt, Homo sapiens
gauacuacauccuuugaag

SEQ ID NO: 1090028 - RNA, 19 nt, Homo sapiens
ggagaaacuagaagagaaa

SEQ ID NO: 1090029 - RNA, 19 nt, Homo sapiens
ccagcagucuuccuuagaa

SEQ ID NO: 1090030 - RNA, 19 nt, Homo sapiens
gauaccuacuucauuaguu

SEQ ID NO: 1090031 - RNA, 19 nt, Homo sapiens
uaugauagacggacaacua

SEQ ID NO: 1090032 - RNA, 19 nt, Homo sapiens
ugaagcaacuugagacaca

SEQ ID NO: 1090033 - RNA, 19 nt, Homo sapiens
gauaaaguccucaagucaa

SEQ ID NO: 1090034 - RNA, 19 nt, Homo sapiens
agacauaaguccacaaggu

SEQ ID NO: 1090035 - RNA, 19 nt, Homo sapiens
gcagaauacaagaaacuuu

SEQ ID NO: 1090036 - RNA, 19 nt, Homo sapiens
gaguaugaaucucuuaucu

SEQ ID NO: 1090037 - RNA, 19 nt, Homo sapiens
uuagaagaauccacgaauu

SEQ ID NO: 1090038 - RNA, 19 nt, Homo sapiens
ggacagguaguacugagaa

SEQ ID NO: 1090039 - RNA, 19 nt, Homo sapiens
ggaaaagacaaaccaguua

SEQ ID NO: 1090040 - RNA, 19 nt, Homo sapiens
cagauaaaguccucaaguc

SEQ ID NO: 1090041 - RNA, 19 nt, Homo sapiens
caauaagcuuaccucagua

SEQ ID NO: 1090042 - RNA, 19 nt, Homo sapiens
gcaguccaauccaguacuu

SEQ ID NO: 1090043 - RNA, 19 nt, Homo sapiens
gaauaaccagugugaguug

SEQ ID NO: 1090044 - RNA, 19 nt, Homo sapiens
caucaaccaagcugaauaa

SEQ ID NO: 1090045 - RNA, 19 nt, Homo sapiens
aacaguagcugcagaauac

SEQ ID NO: 1090046 - RNA, 19 nt, Homo sapiens
aaggacaguuggaagauuu

SEQ ID NO: 1090047 - RNA, 19 nt, Homo sapiens
gaagaccguuacaaucagu

SEQ ID NO: 1090048 - RNA, 19 nt, Homo sapiens
gaaccagaaugcccaacuc

SEQ ID NO: 1090049 - RNA, 19 nt, Homo sapiens
gcaauugcgccaagaacuu

SEQ ID NO: 1090050 - RNA, 19 nt, Homo sapiens
aaacaguagcugcagaaua

SEQ ID NO: 1090051 - RNA, 19 nt, Homo sapiens
caauugcgccaagaacuua

SEQ ID NO: 1090052 - RNA, 19 nt, Homo sapiens
caacugaagcaacuugaga

SEQ ID NO: 1090053 - RNA, 19 nt, Homo sapiens
agacuccagugaaggauuu

SEQ ID NO: 1090054 - RNA, 19 nt, Homo sapiens
agacauuaaugcuacagaa

SEQ ID NO: 1090055 - RNA, 19 nt, Homo sapiens
ucugaagucugcccacaaa

SEQ ID NO: 1090056 - RNA, 19 nt, Homo sapiens
aaacucaacugaagcaacu

SEQ ID NO: 1090057 - RNA, 19 nt, Homo sapiens
gcuggaacuucuucaugaa

SEQ ID NO: 1090058 - RNA, 19 nt, Homo sapiens
caucacuggccuauaauaa

SEQ ID NO: 1090059 - RNA, 19 nt, Homo sapiens
ggacaguggacagguagua

SEQ ID NO: 1090060 - RNA, 19 nt, Homo sapiens
gaacgccagaaaucucuaa

SEQ ID NO: 1090061 - RNA, 19 nt, Homo sapiens
gaaaagaauugggagcuau

SEQ ID NO: 1090062 - RNA, 19 nt, Homo sapiens
gcucaaaguagaacaggaa

SEQ ID NO: 1090063 - RNA, 19 nt, Homo sapiens
gaaaggacaguuggaagau

SEQ ID NO: 1090064 - RNA, 19 nt, Homo sapiens
ccaggggacuucuaugaua

SEQ ID NO: 1090065 - RNA, 19 nt, Homo sapiens
ccagaaugcccaacuccua

SEQ ID NO: 1090066 - RNA, 19 nt, Homo sapiens
guaccucacucaugaacca

SEQ ID NO: 1090067 - RNA, 19 nt, Homo sapiens
agacgcuccucuacucuuu

SEQ ID NO: 1090068 - RNA, 19 nt, Homo sapiens
cagaauacaagaaacuuug

SEQ ID NO: 1090069 - RNA, 19 nt, Homo sapiens
ccguuacaaucaguuauua

SEQ ID NO: 1090070 - RNA, 19 nt, Homo sapiens
ggucuggccaggucaguaa

SEQ ID NO: 1090071 - RNA, 19 nt, Homo sapiens
aagcuuaccucaguacaga

SEQ ID NO: 1090072 - RNA, 19 nt, Homo sapiens
gaagacauaaguccacaag

SEQ ID NO: 1090073 - RNA, 19 nt, Homo sapiens
cagguaguacugagaauuu

SEQ ID NO: 1090074 - RNA, 19 nt, Homo sapiens
ucaagacagucaagauagu

SEQ ID NO: 1090075 - RNA, 19 nt, Homo sapiens
aaucauaccuauagucaac

SEQ ID NO: 1090076 - RNA, 19 nt, Homo sapiens
cagaaugcccaacuccuaa

SEQ ID NO: 1090077 - RNA, 19 nt, Homo sapiens
ccaaaguaccucacucaug

SEQ ID NO: 1090078 - RNA, 19 nt, Homo sapiens
gcaauaauaaugcuucacu

SEQ ID NO: 1090079 - RNA, 19 nt, Homo sapiens
aggagaaacuagaagagaa

SEQ ID NO: 1090080 - RNA, 19 nt, Homo sapiens
cagcagucuuccuuagaaa

SEQ ID NO: 1090081 - RNA, 19 nt, Homo sapiens
gagagucgacaucacaaga

SEQ ID NO: 1090082 - RNA, 19 nt, Homo sapiens
gcaauagcaauaauaaugc

SEQ ID NO: 1090083 - RNA, 19 nt, Homo sapiens
ggcagaacauccacuagca

SEQ ID NO: 1090084 - RNA, 19 nt, Homo sapiens
gguucaaacucuuuagaag

SEQ ID NO: 1090085 - RNA, 19 nt, Homo sapiens
caaacuggaacaaacaaga

SEQ ID NO: 1090086 - RNA, 19 nt, Homo sapiens
gaagacugaaggaguugaa

SEQ ID NO: 1090087 - RNA, 19 nt, Homo sapiens
aaacugaagauaccuacuu

SEQ ID NO: 1090088 - RNA, 19 nt, Homo sapiens
gucugucucuucugacuuu

SEQ ID NO: 1090089 - RNA, 19 nt, Homo sapiens
aauaaugcuucacuacaug

SEQ ID NO: 1090090 - RNA, 19 nt, Homo sapiens
cacaagguguuagugauga

SEQ ID NO: 1090091 - RNA, 19 nt, Homo sapiens
ugacccaucuccuccuaga

SEQ ID NO: 1090092 - RNA, 19 nt, Homo sapiens
uaaaggaacaauaccaaca

SEQ ID NO: 1090093 - RNA, 19 nt, Homo sapiens
aaaggacaguuggaagauu

SEQ ID NO: 1090094 - RNA, 19 nt, Homo sapiens
caagaugacuccaaugaua

SEQ ID NO: 1090095 - RNA, 19 nt, Homo sapiens
gaugauacauucuccuaua

SEQ ID NO: 1090096 - RNA, 19 nt, Homo sapiens
guaaauaugaggaggauua

SEQ ID NO: 1090097 - RNA, 19 nt, Homo sapiens
ccacagauuuccagaauga

SEQ ID NO: 1090098 - RNA, 19 nt, Homo sapiens
ggaauuugguguucacuug

SEQ ID NO: 1090099 - RNA, 19 nt, Homo sapiens
caaaagcacuguuaagaaa

SEQ ID NO: 1090100 - RNA, 19 nt, Homo sapiens
ucaaggagcugucccagau

SEQ ID NO: 1090101 - RNA, 19 nt, Homo sapiens
gugcaucguuuguacagua

SEQ ID NO: 1090102 - RNA, 19 nt, Homo sapiens
gagaggagaucuacagcau

SEQ ID NO: 1090103 - RNA, 19 nt, Homo sapiens
gauccucucuaucagauug

SEQ ID NO: 1090104 - RNA, 19 nt, Homo sapiens
gacaaacggcuacaggaua

SEQ ID NO: 1090105 - RNA, 19 nt, Homo sapiens
ugaaggauccucucuauca

SEQ ID NO: 1090106 - RNA, 19 nt, Homo sapiens
ggaggaggaggaugguuua

SEQ ID NO: 1090107 - RNA, 19 nt, Homo sapiens
acaaacggcuacaggauau

SEQ ID NO: 1090108 - RNA, 19 nt, Homo sapiens
ugaaggccaucaucacuga

SEQ ID NO: 1090109 - RNA, 19 nt, Homo sapiens
ucagucaucuugaaacaau

SEQ ID NO: 1090110 - RNA, 19 nt, Homo sapiens
ggccacagauuuccagaau

SEQ ID NO: 1090111 - RNA, 19 nt, Homo sapiens
ucacugaggagcagauuaa

SEQ ID NO: 1090112 - RNA, 19 nt, Homo sapiens
aaucucgucuuuagcauuu

SEQ ID NO: 1090113 - RNA, 19 nt, Homo sapiens
ggaaaagggugcagccaaa

SEQ ID NO: 1090114 - RNA, 19 nt, Homo sapiens
gagaaucgauaagcaaagu

SEQ ID NO: 1090115 - RNA, 19 nt, Homo sapiens
cuacgaggaugaugaggaa

SEQ ID NO: 1090116 - RNA, 19 nt, Homo sapiens
gcagagacgcucaguguca

SEQ ID NO: 1090117 - RNA, 19 nt, Homo sapiens
ugaagaugaugauacauuc

SEQ ID NO: 1090118 - RNA, 19 nt, Homo sapiens
ugacaacaguaguacgaaa

SEQ ID NO: 1090119 - RNA, 19 nt, Homo sapiens
gcacugagcacugguggaa

SEQ ID NO: 1090120 - RNA, 19 nt, Homo sapiens
gaagaugaagaugaugaua

SEQ ID NO: 1090121 - RNA, 19 nt, Homo sapiens
ccuaauggguugagagaau

SEQ ID NO: 1090122 - RNA, 19 nt, Homo sapiens
uggcagaacugacuguaga

SEQ ID NO: 1090123 - RNA, 19 nt, Homo sapiens
gagagaaucgauaagcaaa

SEQ ID NO: 1090124 - RNA, 19 nt, Homo sapiens
gaaacaauauguggagacu

SEQ ID NO: 1090125 - RNA, 19 nt, Homo sapiens
uagaaccucucuuggaguu

SEQ ID NO: 1090126 - RNA, 19 nt, Homo sapiens
agaaagccuugccugaauu

SEQ ID NO: 1090127 - RNA, 19 nt, Homo sapiens
aagaaagccuugccugaau

SEQ ID NO: 1090128 - RNA, 19 nt, Homo sapiens
uaagaaagccuugccugaa

SEQ ID NO: 1090129 - RNA, 19 nt, Homo sapiens
gcaaagugcgcuccagugu

SEQ ID NO: 1090130 - RNA, 19 nt, Homo sapiens
ucacuggugugcccaauca

SEQ ID NO: 1090131 - RNA, 19 nt, Homo sapiens
ccugaaggauccucucuau

SEQ ID NO: 1090132 - RNA, 19 nt, Homo sapiens
ggaggaggaugguuuagcu

SEQ ID NO: 1090133 - RNA, 19 nt, Homo sapiens
gcaaaccugcucuagaguu

SEQ ID NO: 1090134 - RNA, 19 nt, Homo sapiens
ucccagagauguauaagau

SEQ ID NO: 1090135 - RNA, 19 nt, Homo sapiens
acacacagaugccacuugu

SEQ ID NO: 1090136 - RNA, 19 nt, Homo sapiens
ucaacgagcucuccaacgu

SEQ ID NO: 1090137 - RNA, 19 nt, Homo sapiens
gauacauucuccuauacug

SEQ ID NO: 1090138 - RNA, 19 nt, Homo sapiens
ucacagaggccuuuguuca

SEQ ID NO: 1090139 - RNA, 19 nt, Homo sapiens
gugcccauaugaucuguaa

SEQ ID NO: 1090140 - RNA, 19 nt, Homo sapiens
acacagaugccacuuguug

SEQ ID NO: 1090141 - RNA, 19 nt, Homo sapiens
ggaggugacggaggaauuu

SEQ ID NO: 1090142 - RNA, 19 nt, Homo sapiens
cagcaagcauggaaagcaa

SEQ ID NO: 1090143 - RNA, 19 nt, Homo sapiens
uguagaagaugaagaugau

SEQ ID NO: 1090144 - RNA, 19 nt, Homo sapiens
gcagugacagcccuaguga

SEQ ID NO: 1090145 - RNA, 19 nt, Homo sapiens
gaaguuacagacacacaga

SEQ ID NO: 1090146 - RNA, 19 nt, Homo sapiens
uggcaaaccugcucuagag

SEQ ID NO: 1090147 - RNA, 19 nt, Homo sapiens
uggcugagguguaugguau

SEQ ID NO: 1090148 - RNA, 19 nt, Homo sapiens
gaaggauccucucuaucag

SEQ ID NO: 1090149 - RNA, 19 nt, Homo sapiens
acaauggacugugguaugu

SEQ ID NO: 1090150 - RNA, 19 nt, Homo sapiens
gaauagcagcucaagacuu

SEQ ID NO: 1090151 - RNA, 19 nt, Homo sapiens
gaaagccuugccugaauug

SEQ ID NO: 1090152 - RNA, 19 nt, Homo sapiens
uaaccgagagugcagcuuu

SEQ ID NO: 1090153 - RNA, 19 nt, Homo sapiens
aaauuuaggccuccugaaa

SEQ ID NO: 1090154 - RNA, 19 nt, Homo sapiens
aacaauauguggagacuca

SEQ ID NO: 1090155 - RNA, 19 nt, Homo sapiens
caucagucaucuugaaaca

SEQ ID NO: 1090156 - RNA, 19 nt, Homo sapiens
gagacccugugcaucguuu

SEQ ID NO: 1090157 - RNA, 19 nt, Homo sapiens
ugcagccacucgacauuua

SEQ ID NO: 1090158 - RNA, 19 nt, Homo sapiens
gauuuccucugccaguuug

SEQ ID NO: 1090159 - RNA, 19 nt, Homo sapiens
agaugaagaugaugauaca

SEQ ID NO: 1090160 - RNA, 19 nt, Homo sapiens
ugaggaagaugacccugau

SEQ ID NO: 1090161 - RNA, 19 nt, Homo sapiens
aauaugaggaggauuacua

SEQ ID NO: 1090162 - RNA, 19 nt, Homo sapiens
uuacacagaagaaguagaa

SEQ ID NO: 1090163 - RNA, 19 nt, Homo sapiens
uggcaucagucaucuugaa

SEQ ID NO: 1090164 - RNA, 19 nt, Homo sapiens
ugguuuagcuggccaacuu

SEQ ID NO: 1090165 - RNA, 19 nt, Homo sapiens
ucgaauuucugcagugaga

SEQ ID NO: 1090166 - RNA, 19 nt, Homo sapiens
cuccuauacuguuagaaua

SEQ ID NO: 1090167 - RNA, 19 nt, Homo sapiens
gaggagcagauuaaaguau

SEQ ID NO: 1090168 - RNA, 19 nt, Homo sapiens
ugaggacagaaguaaauua

SEQ ID NO: 1090169 - RNA, 19 nt, Homo sapiens
uguauaagaucuucaccau

SEQ ID NO: 1090170 - RNA, 19 nt, Homo sapiens
gagaggcgaguucuacaga

SEQ ID NO: 1090171 - RNA, 19 nt, Homo sapiens
gaaguccugggcuuugaaa

SEQ ID NO: 1090172 - RNA, 19 nt, Homo sapiens
cgggagcuauugccuaaug

SEQ ID NO: 1090173 - RNA, 19 nt, Homo sapiens
guucgaauuucugcaguga

SEQ ID NO: 1090174 - RNA, 19 nt, Homo sapiens
ccaacgucauggaggcuaa

SEQ ID NO: 1090175 - RNA, 19 nt, Homo sapiens
aaaggaagcguuaguggau

SEQ ID NO: 1090176 - RNA, 19 nt, Homo sapiens
gaaaaucucgucuuuagca

SEQ ID NO: 1090177 - RNA, 19 nt, Homo sapiens
gugaaguccugggcuuuga

SEQ ID NO: 1090178 - RNA, 19 nt, Homo sapiens
agacuuaaaugccguccau

SEQ ID NO: 1090179 - RNA, 19 nt, Homo sapiens
gaacgcuggacaaacauuc

SEQ ID NO: 1090180 - RNA, 19 nt, Homo sapiens
caacaguaguacgaaauac

SEQ ID NO: 1090181 - RNA, 19 nt, Homo sapiens
acaacaguaguacgaaaua

SEQ ID NO: 1090182 - RNA, 19 nt, Homo sapiens
ugucagggcccaaugcaaa

SEQ ID NO: 1090183 - RNA, 19 nt, Homo sapiens
uaagauggagguccuaaag

SEQ ID NO: 1090184 - RNA, 19 nt, Homo sapiens
cagccaaaguccugaucuu

SEQ ID NO: 1090185 - RNA, 19 nt, Homo sapiens
uccgggagcuauugccuaa

SEQ ID NO: 1090186 - RNA, 19 nt, Homo sapiens
gcagaguggagucaagaug

SEQ ID NO: 1090187 - RNA, 19 nt, Homo sapiens
aaggagcugucccagauug

SEQ ID NO: 1090188 - RNA, 19 nt, Homo sapiens
gaccucaaccucucagugu

SEQ ID NO: 1090189 - RNA, 19 nt, Homo sapiens
uccaguggcacaaggauua

SEQ ID NO: 1090190 - RNA, 19 nt, Homo sapiens
acauucuccuauacuguua

SEQ ID NO: 1090191 - RNA, 19 nt, Homo sapiens
ccugaucuuucccguggua

SEQ ID NO: 1090192 - RNA, 19 nt, Homo sapiens
gaaauuuaggccuccugaa

SEQ ID NO: 1090193 - RNA, 19 nt, Homo sapiens
cagaguggagucaagauga

SEQ ID NO: 1090194 - RNA, 19 nt, Homo sapiens
gaauaaacgugaacagauu

SEQ ID NO: 1090195 - RNA, 19 nt, Homo sapiens
gcaaaguccucagcuaaua

SEQ ID NO: 1090196 - RNA, 19 nt, Homo sapiens
ggagaucucugcucuuauu

SEQ ID NO: 1090197 - RNA, 19 nt, Homo sapiens
gcgcaaaccugcuuaaaug

SEQ ID NO: 1090198 - RNA, 19 nt, Homo sapiens
gcuauagccuccuguauuu

SEQ ID NO: 1090199 - RNA, 19 nt, Homo sapiens
gaagaaaacggacuaauua

SEQ ID NO: 1090200 - RNA, 19 nt, Homo sapiens
cuaauuagaugcuuccuuu

SEQ ID NO: 1090201 - RNA, 19 nt, Homo sapiens
gaggauagauuuggaguug

SEQ ID NO: 1090202 - RNA, 19 nt, Homo sapiens
gaggauaguugcaaguauu

SEQ ID NO: 1090203 - RNA, 19 nt, Homo sapiens
ccauuuggcucuaguguaa

SEQ ID NO: 1090204 - RNA, 19 nt, Homo sapiens
ucucugcucuuauuaguua

SEQ ID NO: 1090205 - RNA, 19 nt, Homo sapiens
gagaaaucauggaaagaaa

SEQ ID NO: 1090206 - RNA, 19 nt, Homo sapiens
uaggagaucucugcucuua

SEQ ID NO: 1090207 - RNA, 19 nt, Homo sapiens
ccucuuaaaucucucguua

SEQ ID NO: 1090208 - RNA, 19 nt, Homo sapiens
gaaucacuguuccugguua

SEQ ID NO: 1090209 - RNA, 19 nt, Homo sapiens
gcaagcaucugcagaacau

SEQ ID NO: 1090210 - RNA, 19 nt, Homo sapiens
ggaguucaaagaauaguua

SEQ ID NO: 1090211 - RNA, 19 nt, Homo sapiens
caugaacuaucuuccauuu

SEQ ID NO: 1090212 - RNA, 19 nt, Homo sapiens
cagcuauccuuaauacuuu

SEQ ID NO: 1090213 - RNA, 19 nt, Homo sapiens
ggagagugucuucaucuua

SEQ ID NO: 1090214 - RNA, 19 nt, Homo sapiens
uaaaugguaugacucagaa

SEQ ID NO: 1090215 - RNA, 19 nt, Homo sapiens
ugauguugcuuucucaaua

SEQ ID NO: 1090216 - RNA, 19 nt, Homo sapiens
ucacauagaugagcagguu

SEQ ID NO: 1090217 - RNA, 19 nt, Homo sapiens
ucagugaccuguauaguuc

SEQ ID NO: 1090218 - RNA, 19 nt, Homo sapiens
gaaaagacuucaacaguuc

SEQ ID NO: 1090219 - RNA, 19 nt, Homo sapiens
caacucaugcacucauuua

SEQ ID NO: 1090220 - RNA, 19 nt, Homo sapiens
cagcaggauugauuuguuu

SEQ ID NO: 1090221 - RNA, 19 nt, Homo sapiens
ggagaaaucauggaaagaa

SEQ ID NO: 1090222 - RNA, 19 nt, Homo sapiens
gauguugcuuucucaauau

SEQ ID NO: 1090223 - RNA, 19 nt, Homo sapiens
guacagcuuucuugugguu

SEQ ID NO: 1090224 - RNA, 19 nt, Homo sapiens
gcucauguguuuccuguuc

SEQ ID NO: 1090225 - RNA, 19 nt, Homo sapiens
gguacuaacagcuuugaua

SEQ ID NO: 1090226 - RNA, 19 nt, Homo sapiens
gaaggucugucgcacuuag

SEQ ID NO: 1090227 - RNA, 19 nt, Homo sapiens
gagagugucuucaucuuac

SEQ ID NO: 1090228 - RNA, 19 nt, Homo sapiens
cacagugaguggccucuua

SEQ ID NO: 1090229 - RNA, 19 nt, Homo sapiens
caaaccugcuuaaaugaau

SEQ ID NO: 1090230 - RNA, 19 nt, Homo sapiens
ggaggauaguugcaaguau

SEQ ID NO: 1090231 - RNA, 19 nt, Homo sapiens
gcaaaccugcuuaaaugaa

SEQ ID NO: 1090232 - RNA, 19 nt, Homo sapiens
ggaguucuaugcaguugug

SEQ ID NO: 1090233 - RNA, 19 nt, Homo sapiens
gacauacuguggcgcguuu

SEQ ID NO: 1090234 - RNA, 19 nt, Homo sapiens
gcaccacaguauuuauaau

SEQ ID NO: 1090235 - RNA, 19 nt, Homo sapiens
uuaaaucucucguuacucu

SEQ ID NO: 1090236 - RNA, 19 nt, Homo sapiens
gaucucugcucuuauuagu

SEQ ID NO: 1090237 - RNA, 19 nt, Homo sapiens
gaucauucauccucagcaa

SEQ ID NO: 1090238 - RNA, 19 nt, Homo sapiens
aguggaaccuaagaaauua

SEQ ID NO: 1090239 - RNA, 19 nt, Homo sapiens
gcagaagggucagaugagu

SEQ ID NO: 1090240 - RNA, 19 nt, Homo sapiens
caacaguucuuggaguuca

SEQ ID NO: 1090241 - RNA, 19 nt, Homo sapiens
gcacuuaguagcagcauca

SEQ ID NO: 1090242 - RNA, 19 nt, Homo sapiens
ccaucuaccucuauuagug

SEQ ID NO: 1090243 - RNA, 19 nt, Homo sapiens
caaaguccucagcuaauaa

SEQ ID NO: 1090244 - RNA, 19 nt, Homo sapiens
ccuacugacuggagcauuu

SEQ ID NO: 1090245 - RNA, 19 nt, Homo sapiens
ggauagauuuggaguuguc

SEQ ID NO: 1090246 - RNA, 19 nt, Homo sapiens
uagaaggucugucgcacuu

SEQ ID NO: 1090247 - RNA, 19 nt, Homo sapiens
ccagugugauuuauucaug

SEQ ID NO: 1090248 - RNA, 19 nt, Homo sapiens
gacaguaaauguucagcau

SEQ ID NO: 1090249 - RNA, 19 nt, Homo sapiens
aagaggcagucgacaagua

SEQ ID NO: 1090250 - RNA, 19 nt, Homo sapiens
gugguucccugcacuggua

SEQ ID NO: 1090251 - RNA, 19 nt, Homo sapiens
gcaguugugccuucuauuc

SEQ ID NO: 1090252 - RNA, 19 nt, Homo sapiens
caucugcaccacaguauuu

SEQ ID NO: 1090253 - RNA, 19 nt, Homo sapiens
gaauaacuacuacauuugg

SEQ ID NO: 1090254 - RNA, 19 nt, Homo sapiens
uguggacacuucauauaaa

SEQ ID NO: 1090255 - RNA, 19 nt, Homo sapiens
gagacaacccagugugauu

SEQ ID NO: 1090256 - RNA, 19 nt, Homo sapiens
ucagugccaccauuaguua

SEQ ID NO: 1090257 - RNA, 19 nt, Homo sapiens
ugaguggccucuuaaaucu

SEQ ID NO: 1090258 - RNA, 19 nt, Homo sapiens
gagcauuuaugggcuauag

SEQ ID NO: 1090259 - RNA, 19 nt, Homo sapiens
cuuaguagcagcaucauuu

SEQ ID NO: 1090260 - RNA, 19 nt, Homo sapiens
gacaacccagugugauuua

SEQ ID NO: 1090261 - RNA, 19 nt, Homo sapiens
caguggaaccuaagaaauu

SEQ ID NO: 1090262 - RNA, 19 nt, Homo sapiens
aaacugccaucuaucgaau

SEQ ID NO: 1090263 - RNA, 19 nt, Homo sapiens
gcaagaggcagucgacaag

SEQ ID NO: 1090264 - RNA, 19 nt, Homo sapiens
gcugucagugguaauaaua

SEQ ID NO: 1090265 - RNA, 19 nt, Homo sapiens
gcagucgacaaguacuuua

SEQ ID NO: 1090266 - RNA, 19 nt, Homo sapiens
guacuaacagcuuugauag

SEQ ID NO: 1090267 - RNA, 19 nt, Homo sapiens
ccagcuauccuuaauacuu

SEQ ID NO: 1090268 - RNA, 19 nt, Homo sapiens
gggagagugucuucaucuu

SEQ ID NO: 1090269 - RNA, 19 nt, Homo sapiens
gcacugguacuaacagcuu

SEQ ID NO: 1090270 - RNA, 19 nt, Homo sapiens
ucagcaggauugauuuguu

SEQ ID NO: 1090271 - RNA, 19 nt, Homo sapiens
cgaauaacuacuacauuug

SEQ ID NO: 1090272 - RNA, 19 nt, Homo sapiens
cgacaaguacuuuaagcuu

SEQ ID NO: 1090273 - RNA, 19 nt, Homo sapiens
ucacgaagacaagaaguuu

SEQ ID NO: 1090274 - RNA, 19 nt, Homo sapiens
uaucuuccauuucccauca

SEQ ID NO: 1090275 - RNA, 19 nt, Homo sapiens
guucagcauucuuggauca

SEQ ID NO: 1090276 - RNA, 19 nt, Homo sapiens
ucagaugagugccuuccaa

SEQ ID NO: 1090277 - RNA, 19 nt, Homo sapiens
gaaaacggacuaauuagau

SEQ ID NO: 1090278 - RNA, 19 nt, Homo sapiens
gggccaagauuguggacau

SEQ ID NO: 1090279 - RNA, 19 nt, Homo sapiens
ccgcaaaguccucagcuaa

SEQ ID NO: 1090280 - RNA, 19 nt, Homo sapiens
gauguaaacaccugcuaug

SEQ ID NO: 1090281 - RNA, 19 nt, Homo sapiens
gugaguggccucuuaaauc

SEQ ID NO: 1090282 - RNA, 19 nt, Homo sapiens
guucauaggccacuugaca

SEQ ID NO: 1090283 - RNA, 19 nt, Homo sapiens
agaaaagacuucaacaguu

SEQ ID NO: 1090284 - RNA, 19 nt, Homo sapiens
agacgacacuaccagcuau

SEQ ID NO: 1090285 - RNA, 19 nt, Homo sapiens
cuggugugcugcagugaua

SEQ ID NO: 1090286 - RNA, 19 nt, Homo sapiens
gcaacucaugcacucauuu

SEQ ID NO: 1090287 - RNA, 19 nt, Homo sapiens
gaccugauguugcuuucuc

SEQ ID NO: 1090288 - RNA, 19 nt, Homo sapiens
ugaacuaucuuccauuucc

SEQ ID NO: 1090289 - RNA, 19 nt, Homo sapiens
cucaugcacucauuuauuc

SEQ ID NO: 1090290 - RNA, 19 nt, Homo sapiens
gaugggacaguaaauguuc

SEQ ID NO: 1090291 - RNA, 19 nt, Homo sapiens
cuacagaugggacaguaaa

SEQ ID NO: 1090292 - RNA, 19 nt, Homo sapiens
ucauuacacugcugauaca

SEQ ID NO: 1090293 - RNA, 19 nt, Homo sapiens
uaccagcuauccuuaauac

SEQ ID NO: 1090294 - RNA, 19 nt, Homo sapiens
gcaaugaccuguauuaaac

SEQ ID NO: 1090295 - RNA, 19 nt, Homo sapiens
ggaccgaggugaugccuuu

SEQ ID NO: 1090296 - RNA, 19 nt, Homo sapiens
gaaagcaccucugacauuc

SEQ ID NO: 1090297 - RNA, 19 nt, Homo sapiens
ggaaggcgcucccucaucu

SEQ ID NO: 1090298 - RNA, 19 nt, Homo sapiens
uaaagugccuuaucugcaa

SEQ ID NO: 1090299 - RNA, 19 nt, Homo sapiens
gaaacagcagugugaauuu

SEQ ID NO: 1090300 - RNA, 19 nt, Homo sapiens
gaagaaggagcucaguaaa

SEQ ID NO: 1090301 - RNA, 19 nt, Homo sapiens
gaagguggaugcuguuguc

SEQ ID NO: 1090302 - RNA, 19 nt, Homo sapiens
ucgcaaacaugaagaagaa

SEQ ID NO: 1090303 - RNA, 19 nt, Homo sapiens
ucaagaccgugaacugaaa

SEQ ID NO: 1090304 - RNA, 19 nt, Homo sapiens
ugaaagcaccucugacauu

SEQ ID NO: 1090305 - RNA, 19 nt, Homo sapiens
gaaauuggaaggauuagca

SEQ ID NO: 1090306 - RNA, 19 nt, Homo sapiens
ccucucaguugaaagauuu

SEQ ID NO: 1090307 - RNA, 19 nt, Homo sapiens
gagggaaauuggaaggauu

SEQ ID NO: 1090308 - RNA, 19 nt, Homo sapiens
ggaaggagcagcugggaau

SEQ ID NO: 1090309 - RNA, 19 nt, Homo sapiens
aaacagcagugugaauuug

SEQ ID NO: 1090310 - RNA, 19 nt, Homo sapiens
cgacgggcguuuauuggaa

SEQ ID NO: 1090311 - RNA, 19 nt, Homo sapiens
ggagcucaguaaacuagaa

SEQ ID NO: 1090312 - RNA, 19 nt, Homo sapiens
uaccaaaucuacaggauca

SEQ ID NO: 1090313 - RNA, 19 nt, Homo sapiens
gggcauguuuggcaguaaa

SEQ ID NO: 1090314 - RNA, 19 nt, Homo sapiens
agaagaaggagcucaguaa

SEQ ID NO: 1090315 - RNA, 19 nt, Homo sapiens
gguggaugcuguugucaug

SEQ ID NO: 1090316 - RNA, 19 nt, Homo sapiens
uuuauuaacucaccucuca

SEQ ID NO: 1090317 - RNA, 19 nt, Homo sapiens
agaaggagcucaguaaacu

SEQ ID NO: 1090318 - RNA, 19 nt, Homo sapiens
ggagggaaauuggaaggau

SEQ ID NO: 1090319 - RNA, 19 nt, Homo sapiens
ugaguuugcugccaggauu

SEQ ID NO: 1090320 - RNA, 19 nt, Homo sapiens
ucucuuuggugguuucuaa

SEQ ID NO: 1090321 - RNA, 19 nt, Homo sapiens
caacaucgcaaacaugaag

SEQ ID NO: 1090322 - RNA, 19 nt, Homo sapiens
ugaaacagcagugugaauu

SEQ ID NO: 1090323 - RNA, 19 nt, Homo sapiens
gaaggagcucaguaaacua

SEQ ID NO: 1090324 - RNA, 19 nt, Homo sapiens
aagaagagguugaguuugc

SEQ ID NO: 1090325 - RNA, 19 nt, Homo sapiens
ccagaacacaggagaagaa

SEQ ID NO: 1090326 - RNA, 19 nt, Homo sapiens
gcaaacaacuucuuuucuc

SEQ ID NO: 1090327 - RNA, 19 nt, Homo sapiens
guccaggguugcuugguuu

SEQ ID NO: 1090328 - RNA, 19 nt, Homo sapiens
gaacugugaauggcuagaa

SEQ ID NO: 1090329 - RNA, 19 nt, Homo sapiens
ucauggagcugugggaguu

SEQ ID NO: 1090330 - RNA, 19 nt, Homo sapiens
ccucucggcucacauguuc

SEQ ID NO: 1090331 - RNA, 19 nt, Homo sapiens
ugaccuguauuaaacacaa

SEQ ID NO: 1090332 - RNA, 19 nt, Homo sapiens
ggugaugccuuugacuuca

SEQ ID NO: 1090333 - RNA, 19 nt, Homo sapiens
agacuuggguuuucucuuu

SEQ ID NO: 1090334 - RNA, 19 nt, Homo sapiens
uuuagaggcugcagcuuga

SEQ ID NO: 1090335 - RNA, 19 nt, Homo sapiens
gcaccucugacauuccuuu

SEQ ID NO: 1090336 - RNA, 19 nt, Homo sapiens
gauccgcacuaacucaucu

SEQ ID NO: 1090337 - RNA, 19 nt, Homo sapiens
cgcaaugaccuguauuaaa

SEQ ID NO: 1090338 - RNA, 19 nt, Homo sapiens
gggcgacgggcguuuauug

SEQ ID NO: 1090339 - RNA, 19 nt, Homo sapiens
ugaagggauuccucacugu

SEQ ID NO: 1090340 - RNA, 19 nt, Homo sapiens
gcuacaaucaggagggaaa

SEQ ID NO: 1090341 - RNA, 19 nt, Homo sapiens
gaacacaggagaagaaaag

SEQ ID NO: 1090342 - RNA, 19 nt, Homo sapiens
gaggugaugccuuugacuu

SEQ ID NO: 1090343 - RNA, 19 nt, Homo sapiens
ggugucacaugaucacagu

SEQ ID NO: 1090344 - RNA, 19 nt, Homo sapiens
aaaagaagagguugaguuu

SEQ ID NO: 1090345 - RNA, 19 nt, Homo sapiens
guaaauuggcaccguguca

SEQ ID NO: 1090346 - RNA, 19 nt, Homo sapiens
uagaagaaggagcucagua

SEQ ID NO: 1090347 - RNA, 19 nt, Homo sapiens
guugucugguuuccaugua

SEQ ID NO: 1090348 - RNA, 19 nt, Homo sapiens
uugcuugguuuacugguuu

SEQ ID NO: 1090349 - RNA, 19 nt, Homo sapiens
uuucuaaagugccuuaucu

SEQ ID NO: 1090350 - RNA, 19 nt, Homo sapiens
gacgggcguuuauuggaau

SEQ ID NO: 1090351 - RNA, 19 nt, Homo sapiens
gcucaacaucgcaaacaug

SEQ ID NO: 1090352 - RNA, 19 nt, Homo sapiens
gggugaaacagcaguguga

SEQ ID NO: 1090353 - RNA, 19 nt, Homo sapiens
ggcugaggaucacugcaaa

SEQ ID NO: 1090354 - RNA, 19 nt, Homo sapiens
ucaccucucaguugaaaga

SEQ ID NO: 1090355 - RNA, 19 nt, Homo sapiens
gucuggcucuguugacaaa

SEQ ID NO: 1090356 - RNA, 19 nt, Homo sapiens
aaagugccuuaucugcaaa

SEQ ID NO: 1090357 - RNA, 19 nt, Homo sapiens
gcacuaacucaucuuugca

SEQ ID NO: 1090358 - RNA, 19 nt, Homo sapiens
ccaucgcaaugaccuguau

SEQ ID NO: 1090359 - RNA, 19 nt, Homo sapiens
gggagacuuuaccaaaucu

SEQ ID NO: 1090360 - RNA, 19 nt, Homo sapiens
acucaccucucaguugaaa

SEQ ID NO: 1090361 - RNA, 19 nt, Homo sapiens
uggaaggauuagcagcuuu

SEQ ID NO: 1090362 - RNA, 19 nt, Homo sapiens
caaaagaagagguugaguu

SEQ ID NO: 1090363 - RNA, 19 nt, Homo sapiens
caaacaugaagaagaagga

SEQ ID NO: 1090364 - RNA, 19 nt, Homo sapiens
agggaaauuggaaggauua

SEQ ID NO: 1090365 - RNA, 19 nt, Homo sapiens
gucaagaccgugaacugaa

SEQ ID NO: 1090366 - RNA, 19 nt, Homo sapiens
ugccuuaucugcaaacaac

SEQ ID NO: 1090367 - RNA, 19 nt, Homo sapiens
uggagagugugacggauuc

SEQ ID NO: 1090368 - RNA, 19 nt, Homo sapiens
gucugcaggugucacauga

SEQ ID NO: 1090369 - RNA, 19 nt, Homo sapiens
aaucugaaagcaccucuga

SEQ ID NO: 1090370 - RNA, 19 nt, Homo sapiens
ggaagguggaugcuguugu

SEQ ID NO: 1090371 - RNA, 19 nt, Homo sapiens
ugucugguuuccauguauu

SEQ ID NO: 1090372 - RNA, 19 nt, Homo sapiens
gccagaccaucaagcucaa

SEQ ID NO: 1090373 - RNA, 19 nt, Homo sapiens
ccucugacauuccuuuuau

SEQ ID NO: 1090374 - RNA, 19 nt, Homo sapiens
caaccagaacacaggagaa

SEQ ID NO: 1090375 - RNA, 19 nt, Homo sapiens
ccucagcuggccuguguuu

SEQ ID NO: 1090376 - RNA, 19 nt, Homo sapiens
acgagucggugcucugugu

SEQ ID NO: 1090377 - RNA, 19 nt, Homo sapiens
ucugaaagcaccucugaca

SEQ ID NO: 1090378 - RNA, 19 nt, Homo sapiens
ugacggauuccagcaggua

SEQ ID NO: 1090379 - RNA, 19 nt, Homo sapiens
cggcucacauguucacagu

SEQ ID NO: 1090380 - RNA, 19 nt, Homo sapiens
cagcagguacuucgugauc

SEQ ID NO: 1090381 - RNA, 19 nt, Homo sapiens
uggaugcuguugucaugga

SEQ ID NO: 1090382 - RNA, 19 nt, Homo sapiens
cugcaggugucacaugauc

SEQ ID NO: 1090383 - RNA, 19 nt, Homo sapiens
cauguuuggcaguaaauug

SEQ ID NO: 1090384 - RNA, 19 nt, Homo sapiens
cuccucagcuggccugugu

SEQ ID NO: 1090385 - RNA, 19 nt, Homo sapiens
gaccaucaagcucaacauc

SEQ ID NO: 1090386 - RNA, 19 nt, Homo sapiens
gguuuacugguuuauaaga

SEQ ID NO: 1090387 - RNA, 19 nt, Homo sapiens
guugcuugguuuacugguu

SEQ ID NO: 1090388 - RNA, 19 nt, Homo sapiens
gcgacgggcguuuauugga

SEQ ID NO: 1090389 - RNA, 19 nt, Homo sapiens
caacuucuuuucuccuuca

SEQ ID NO: 1090390 - RNA, 19 nt, Homo sapiens
agaccaaggcccuaaacug

SEQ ID NO: 1090391 - RNA, 19 nt, Homo sapiens
ggaaggauuagcagcuuuu

SEQ ID NO: 1090392 - RNA, 19 nt, Homo sapiens
gagacucugagacuucuuc

SEQ ID NO: 1090393 - RNA, 19 nt, Homo sapiens
cagaacacaggagaagaaa

SEQ ID NO: 1090394 - RNA, 19 nt, Homo sapiens
ggacuaagcugaaggugua

SEQ ID NO: 1090395 - RNA, 19 nt, Homo sapiens
gaugagaacuacuuuguga

SEQ ID NO: 1090396 - RNA, 19 nt, Homo sapiens
ggaaagaugcccaauugua

SEQ ID NO: 1090397 - RNA, 19 nt, Homo sapiens
ccaacgcagucauuuauua

SEQ ID NO: 1090398 - RNA, 19 nt, Homo sapiens
ggaaagaugccauauauuc

SEQ ID NO: 1090399 - RNA, 19 nt, Homo sapiens
gaaguuggcuagcauggaa

SEQ ID NO: 1090400 - RNA, 19 nt, Homo sapiens
gagaacugcucacuccuuu

SEQ ID NO: 1090401 - RNA, 19 nt, Homo sapiens
gauaauguguggacagaga

SEQ ID NO: 1090402 - RNA, 19 nt, Homo sapiens
ugaaauggcuaguugauca

SEQ ID NO: 1090403 - RNA, 19 nt, Homo sapiens
gcaagacacugcaagauac

SEQ ID NO: 1090404 - RNA, 19 nt, Homo sapiens
gggaaagagucaucucgua

SEQ ID NO: 1090405 - RNA, 19 nt, Homo sapiens
ccauggagguguucuguuu

SEQ ID NO: 1090406 - RNA, 19 nt, Homo sapiens
gcauaaagaucugguguuc

SEQ ID NO: 1090407 - RNA, 19 nt, Homo sapiens
cgggaaagaugccauauau

SEQ ID NO: 1090408 - RNA, 19 nt, Homo sapiens
ggacaagcuugaaggaaau

SEQ ID NO: 1090409 - RNA, 19 nt, Homo sapiens
gcuaggaacuguugauaca

SEQ ID NO: 1090410 - RNA, 19 nt, Homo sapiens
aaggaaagaugcccaauug

SEQ ID NO: 1090411 - RNA, 19 nt, Homo sapiens
ggaaauguaacuuugguuu

SEQ ID NO: 1090412 - RNA, 19 nt, Homo sapiens
gauguuccuucuauuguuu

SEQ ID NO: 1090413 - RNA, 19 nt, Homo sapiens
gcacagccucuccucuuua

SEQ ID NO: 1090414 - RNA, 19 nt, Homo sapiens
gaaagaugccauauauuca

SEQ ID NO: 1090415 - RNA, 19 nt, Homo sapiens
gcucuaagcuaagucaaga

SEQ ID NO: 1090416 - RNA, 19 nt, Homo sapiens
cacaaagaauuagguguua

SEQ ID NO: 1090417 - RNA, 19 nt, Homo sapiens
gaaacugccuucaggugau

SEQ ID NO: 1090418 - RNA, 19 nt, Homo sapiens
agaauuagguguuaagagu

SEQ ID NO: 1090419 - RNA, 19 nt, Homo sapiens
gaaagaugcccaauuguac

SEQ ID NO: 1090420 - RNA, 19 nt, Homo sapiens
ggaguuccguguucucaga

SEQ ID NO: 1090421 - RNA, 19 nt, Homo sapiens
gaucuggacuucuuuacca

SEQ ID NO: 1090422 - RNA, 19 nt, Homo sapiens
uaaggugucugcucuuuua

SEQ ID NO: 1090423 - RNA, 19 nt, Homo sapiens
ggcaagacacugcaagaua

SEQ ID NO: 1090424 - RNA, 19 nt, Homo sapiens
ggaaauuuaugagguguca

SEQ ID NO: 1090425 - RNA, 19 nt, Homo sapiens
ggauguuccuucuauuguu

SEQ ID NO: 1090426 - RNA, 19 nt, Homo sapiens
gagaauggacuaagcugaa

SEQ ID NO: 1090427 - RNA, 19 nt, Homo sapiens
cagcugacaucucucuuug

SEQ ID NO: 1090428 - RNA, 19 nt, Homo sapiens
uaggaacuguugauacaaa

SEQ ID NO: 1090429 - RNA, 19 nt, Homo sapiens
gaacccaacagaggcaaua

SEQ ID NO: 1090430 - RNA, 19 nt, Homo sapiens
gaggagcucuuugcugaug

SEQ ID NO: 1090431 - RNA, 19 nt, Homo sapiens
ccacaaagaauuagguguu

SEQ ID NO: 1090432 - RNA, 19 nt, Homo sapiens
acagacaaaugccauguga

SEQ ID NO: 1090433 - RNA, 19 nt, Homo sapiens
ggagaaugaucuggacuuc

SEQ ID NO: 1090434 - RNA, 19 nt, Homo sapiens
gggaucaucuacuuacuag

SEQ ID NO: 1090435 - RNA, 19 nt, Homo sapiens
ucaaagaucggucacauuc

SEQ ID NO: 1090436 - RNA, 19 nt, Homo sapiens
gagagaaguuggcuagcau

SEQ ID NO: 1090437 - RNA, 19 nt, Homo sapiens
caacgggaucaucuacuua

SEQ ID NO: 1090438 - RNA, 19 nt, Homo sapiens
gcagaauacagaggaauuu

SEQ ID NO: 1090439 - RNA, 19 nt, Homo sapiens
agaacuacuuugugaacua

SEQ ID NO: 1090440 - RNA, 19 nt, Homo sapiens
uauaaggugucugcucuuu

SEQ ID NO: 1090441 - RNA, 19 nt, Homo sapiens
auaaagaucugguguucau

SEQ ID NO: 1090442 - RNA, 19 nt, Homo sapiens
gaacgcaggugagaaagcu

SEQ ID NO: 1090443 - RNA, 19 nt, Homo sapiens
gaacuacuuugugaacuac

SEQ ID NO: 1090444 - RNA, 19 nt, Homo sapiens
ggcacagccucuccucuuu

SEQ ID NO: 1090445 - RNA, 19 nt, Homo sapiens
gagcaagccuuuucucaga

SEQ ID NO: 1090446 - RNA, 19 nt, Homo sapiens
caccacagcuugcuuagag

SEQ ID NO: 1090447 - RNA, 19 nt, Homo sapiens
aagccuggaucaacuuuaa

SEQ ID NO: 1090448 - RNA, 19 nt, Homo sapiens
gcugaggaguugcaggaaa

SEQ ID NO: 1090449 - RNA, 19 nt, Homo sapiens
ccugaucaauguuaaaugu

SEQ ID NO: 1090450 - RNA, 19 nt, Homo sapiens
ccaauucagaguuauguuu

SEQ ID NO: 1090451 - RNA, 19 nt, Homo sapiens
acacagagacagacaaaug

SEQ ID NO: 1090452 - RNA, 19 nt, Homo sapiens
ucaacgggaucaucuacuu

SEQ ID NO: 1090453 - RNA, 19 nt, Homo sapiens
aggacaagcuugaaggaaa

SEQ ID NO: 1090454 - RNA, 19 nt, Homo sapiens
gaugucagcgagucuguuu

SEQ ID NO: 1090455 - RNA, 19 nt, Homo sapiens
gagcuaggaacuguugaua

SEQ ID NO: 1090456 - RNA, 19 nt, Homo sapiens
gucaggaaauguaacuuug

SEQ ID NO: 1090457 - RNA, 19 nt, Homo sapiens
ggaacuguugauacaaaua

SEQ ID NO: 1090458 - RNA, 19 nt, Homo sapiens
ccugugaaauggcuaguug

SEQ ID NO: 1090459 - RNA, 19 nt, Homo sapiens
guaacugucacaagaggua

SEQ ID NO: 1090460 - RNA, 19 nt, Homo sapiens
cgaggacgcugaagaacca

SEQ ID NO: 1090461 - RNA, 19 nt, Homo sapiens
gcugacaucucucuuugag

SEQ ID NO: 1090462 - RNA, 19 nt, Homo sapiens
gugcuacaaucccuugcua

SEQ ID NO: 1090463 - RNA, 19 nt, Homo sapiens
caacgcagucauuuauuau

SEQ ID NO: 1090464 - RNA, 19 nt, Homo sapiens
agaggaauuucuccacuug

SEQ ID NO: 1090465 - RNA, 19 nt, Homo sapiens
gaggaaugcucucgguuuu

SEQ ID NO: 1090466 - RNA, 19 nt, Homo sapiens
caagagcuaggaacuguug

SEQ ID NO: 1090467 - RNA, 19 nt, Homo sapiens
ggaguugcaggaaauuuau

SEQ ID NO: 1090468 - RNA, 19 nt, Homo sapiens
gucaagagcuaggaacugu

SEQ ID NO: 1090469 - RNA, 19 nt, Homo sapiens
gaauuagguguuaagaguu

SEQ ID NO: 1090470 - RNA, 19 nt, Homo sapiens
uaaggaaagaugcccaauu

SEQ ID NO: 1090471 - RNA, 19 nt, Homo sapiens
uacaaucccuugcuagaca

SEQ ID NO: 1090472 - RNA, 19 nt, Homo sapiens
ucgcguaggugauaaugug

SEQ ID NO: 1090473 - RNA, 19 nt, Homo sapiens
gcaauagaagccuggauca

SEQ ID NO: 1090474 - RNA, 19 nt, Homo sapiens
cagaggaauuucuccacuu

SEQ ID NO: 1090475 - RNA, 19 nt, Homo sapiens
gugauaauguguggacaga

SEQ ID NO: 1090476 - RNA, 19 nt, Homo sapiens
uguaucagcugacaucucu

SEQ ID NO: 1090477 - RNA, 19 nt, Homo sapiens
gugcacauuuaccugauug

SEQ ID NO: 1090478 - RNA, 19 nt, Homo sapiens
ggaagauugccagcuguaa

SEQ ID NO: 1090479 - RNA, 19 nt, Homo sapiens
acgcagcugugcauaaaga

SEQ ID NO: 1090480 - RNA, 19 nt, Homo sapiens
gaagccuggaucaacuuua

SEQ ID NO: 1090481 - RNA, 19 nt, Homo sapiens
aaagaucggucacauucag

SEQ ID NO: 1090482 - RNA, 19 nt, Homo sapiens
gcuacaaucccuugcuaga

SEQ ID NO: 1090483 - RNA, 19 nt, Homo sapiens
ugacacagagacagacaaa

SEQ ID NO: 1090484 - RNA, 19 nt, Homo sapiens
caaggcaucaugaaacugu

SEQ ID NO: 1090485 - RNA, 19 nt, Homo sapiens
ugaggaaugcucucgguuu

SEQ ID NO: 1090486 - RNA, 19 nt, Homo sapiens
gcuuaccaauuugcaguuu

SEQ ID NO: 1090487 - RNA, 19 nt, Homo sapiens
ucaugaaacugugucuaga

SEQ ID NO: 1090488 - RNA, 19 nt, Homo sapiens
gcuccugguugauuauauc

SEQ ID NO: 1090489 - RNA, 19 nt, Homo sapiens
agccguaacugucacaaga

SEQ ID NO: 1090490 - RNA, 19 nt, Homo sapiens
gccuggaucaacuuuaaua

SEQ ID NO: 1090491 - RNA, 19 nt, Homo sapiens
gggaaagaugccauauauu

SEQ ID NO: 1090492 - RNA, 19 nt, Homo sapiens
gcucaaggcaucaugaaac

SEQ ID NO: 1090493 - RNA, 19 nt, Homo sapiens
gaauacagaggaauuucuc

SEQ ID NO: 1090494 - RNA, 19 nt, Homo sapiens
ggaaucauguccacaauug

SEQ ID NO: 1090495 - RNA, 19 nt, Homo sapiens
gaauggagcacguacaaua

SEQ ID NO: 1090496 - RNA, 19 nt, Homo sapiens
gcacaucgaugaaguuauc

SEQ ID NO: 1090497 - RNA, 19 nt, Homo sapiens
gcaaagugcuaauggagaa

SEQ ID NO: 1090498 - RNA, 19 nt, Homo sapiens
gaucagagcuauuuaugca

SEQ ID NO: 1090499 - RNA, 19 nt, Homo sapiens
ugucaaaugucaccuguua

SEQ ID NO: 1090500 - RNA, 19 nt, Homo sapiens
ugacaaagcucaugaaucg

SEQ ID NO: 1090501 - RNA, 19 nt, Homo sapiens
ccagcacgcucaaaguuua

SEQ ID NO: 1090502 - RNA, 19 nt, Homo sapiens
gagaagaucagagcuauuu

SEQ ID NO: 1090503 - RNA, 19 nt, Homo sapiens
gagcuucucuccuguacaa

SEQ ID NO: 1090504 - RNA, 19 nt, Homo sapiens
gaaagucauuuacauccuu

SEQ ID NO: 1090505 - RNA, 19 nt, Homo sapiens
ucauugcucuuuagaagua

SEQ ID NO: 1090506 - RNA, 19 nt, Homo sapiens
uuuaugcccuugcguauua

SEQ ID NO: 1090507 - RNA, 19 nt, Homo sapiens
uaagaacuguuuccauguu

SEQ ID NO: 1090508 - RNA, 19 nt, Homo sapiens
guuagacgaugcuauuauu

SEQ ID NO: 1090509 - RNA, 19 nt, Homo sapiens
acaguaagcuauuugagaa

SEQ ID NO: 1090510 - RNA, 19 nt, Homo sapiens
ggaaggaagcccaggauga

SEQ ID NO: 1090511 - RNA, 19 nt, Homo sapiens
cagguuggguugauaauau

SEQ ID NO: 1090512 - RNA, 19 nt, Homo sapiens
gaagaucagagcuauuuau

SEQ ID NO: 1090513 - RNA, 19 nt, Homo sapiens
gcauuuagccaucgccuuu

SEQ ID NO: 1090514 - RNA, 19 nt, Homo sapiens
uaacaugaaucccugcaau

SEQ ID NO: 1090515 - RNA, 19 nt, Homo sapiens
cuggaagccuuuauacaua

SEQ ID NO: 1090516 - RNA, 19 nt, Homo sapiens
gacaugcugugcaacuuaa

SEQ ID NO: 1090517 - RNA, 19 nt, Homo sapiens
gaugaaccauucuucugaa

SEQ ID NO: 1090518 - RNA, 19 nt, Homo sapiens
aaauuccucuccuacuuua

SEQ ID NO: 1090519 - RNA, 19 nt, Homo sapiens
caacuuggcaggagccuuu

SEQ ID NO: 1090520 - RNA, 19 nt, Homo sapiens
acauuagucuaccacauua

SEQ ID NO: 1090521 - RNA, 19 nt, Homo sapiens
gaacauugccaucauaagg

SEQ ID NO: 1090522 - RNA, 19 nt, Homo sapiens
ccagagaguauucaacuuu

SEQ ID NO: 1090523 - RNA, 19 nt, Homo sapiens
caaggaauaugcccaaacu

SEQ ID NO: 1090524 - RNA, 19 nt, Homo sapiens
gaaaguaacaaggaauaug

SEQ ID NO: 1090525 - RNA, 19 nt, Homo sapiens
guuauaaauuccucuccua

SEQ ID NO: 1090526 - RNA, 19 nt, Homo sapiens
gaacugguuggaauacauu

SEQ ID NO: 1090527 - RNA, 19 nt, Homo sapiens
gcacguacaauacagaaau

SEQ ID NO: 1090528 - RNA, 19 nt, Homo sapiens
cacccaagcugaucagaga

SEQ ID NO: 1090529 - RNA, 19 nt, Homo sapiens
guccaaaugugcaugagaa

SEQ ID NO: 1090530 - RNA, 19 nt, Homo sapiens
gaauaugcccaaacuguca

SEQ ID NO: 1090531 - RNA, 19 nt, Homo sapiens
aaacugugauucucaagau

SEQ ID NO: 1090532 - RNA, 19 nt, Homo sapiens
ggcccaauauuuauaccua

SEQ ID NO: 1090533 - RNA, 19 nt, Homo sapiens
gcuuauggcuagucagaug

SEQ ID NO: 1090534 - RNA, 19 nt, Homo sapiens
cagaaugacuuugccauca

SEQ ID NO: 1090535 - RNA, 19 nt, Homo sapiens
cagagaguauucaacuuug

SEQ ID NO: 1090536 - RNA, 19 nt, Homo sapiens
uaaauuccucuccuacuuu

SEQ ID NO: 1090537 - RNA, 19 nt, Homo sapiens
cauaaaagcuacuccaaug

SEQ ID NO: 1090538 - RNA, 19 nt, Homo sapiens
augcagaucucaaucagaa

SEQ ID NO: 1090539 - RNA, 19 nt, Homo sapiens
gagaaagucaaagaaguuu

SEQ ID NO: 1090540 - RNA, 19 nt, Homo sapiens
ggaggaaucauguccacaa

SEQ ID NO: 1090541 - RNA, 19 nt, Homo sapiens
gaaccucuuucaggagcua

SEQ ID NO: 1090542 - RNA, 19 nt, Homo sapiens
cggaaugucugguucuuca

SEQ ID NO: 1090543 - RNA, 19 nt, Homo sapiens
caacauuagucuaccacau

SEQ ID NO: 1090544 - RNA, 19 nt, Homo sapiens
ucacagaccuaagucaaca

SEQ ID NO: 1090545 - RNA, 19 nt, Homo sapiens
ccugaacauugccaucaua

SEQ ID NO: 1090546 - RNA, 19 nt, Homo sapiens
gacaguaagcuauuugaga

SEQ ID NO: 1090547 - RNA, 19 nt, Homo sapiens
gaaccugaagccagagaaa

SEQ ID NO: 1090548 - RNA, 19 nt, Homo sapiens
gagagaaggaaaguuguaa

SEQ ID NO: 1090549 - RNA, 19 nt, Homo sapiens
aaugucaccuguuauguau

SEQ ID NO: 1090550 - RNA, 19 nt, Homo sapiens
uaaauggaccuaauggaau

SEQ ID NO: 1090551 - RNA, 19 nt, Homo sapiens
gcuggaagccuuuauacau

SEQ ID NO: 1090552 - RNA, 19 nt, Homo sapiens
cggcagcucuugcuuaugg

SEQ ID NO: 1090553 - RNA, 19 nt, Homo sapiens
gauccuagacaguaagcua

SEQ ID NO: 1090554 - RNA, 19 nt, Homo sapiens
gaggaaucauguccacaau

SEQ ID NO: 1090555 - RNA, 19 nt, Homo sapiens
auaaauuccucuccuacuu

SEQ ID NO: 1090556 - RNA, 19 nt, Homo sapiens
gcuguaggaugguauacug

SEQ ID NO: 1090557 - RNA, 19 nt, Homo sapiens
gcagaucucaaucagaaug

SEQ ID NO: 1090558 - RNA, 19 nt, Homo sapiens
ggucauagaggaaccugaa

SEQ ID NO: 1090559 - RNA, 19 nt, Homo sapiens
caaaugugcaugagaagau

SEQ ID NO: 1090560 - RNA, 19 nt, Homo sapiens
guuguaaacuagcccauag

SEQ ID NO: 1090561 - RNA, 19 nt, Homo sapiens
ucaaaugucaccuguuaug

SEQ ID NO: 1090562 - RNA, 19 nt, Homo sapiens
gaaauauucacuaccucuu

SEQ ID NO: 1090563 - RNA, 19 nt, Homo sapiens
ugagaaagucaaagaaguu

SEQ ID NO: 1090564 - RNA, 19 nt, Homo sapiens
gcccagaccugaaagucau

SEQ ID NO: 1090565 - RNA, 19 nt, Homo sapiens
aaaugucaccuguuaugua

SEQ ID NO: 1090566 - RNA, 19 nt, Homo sapiens
gauuagaaaguaacaagga

SEQ ID NO: 1090567 - RNA, 19 nt, Homo sapiens
ucacaucacaguacuggaa

SEQ ID NO: 1090568 - RNA, 19 nt, Homo sapiens
gcaacagcuucacaucaca

SEQ ID NO: 1090569 - RNA, 19 nt, Homo sapiens
gcucaugaaucggcuuuua

SEQ ID NO: 1090570 - RNA, 19 nt, Homo sapiens
aaauggaccuaauggaauc

SEQ ID NO: 1090571 - RNA, 19 nt, Homo sapiens
ucuacugccuauucaaauu

SEQ ID NO: 1090572 - RNA, 19 nt, Homo sapiens
ucucagacaugcugugcaa

SEQ ID NO: 1090573 - RNA, 19 nt, Homo sapiens
ugacgacacucucagacau

SEQ ID NO: 1090574 - RNA, 19 nt, Homo sapiens
ucucauugcucuuuagaag

SEQ ID NO: 1090575 - RNA, 19 nt, Homo sapiens
auacugcccucuuccuuau

SEQ ID NO: 1090576 - RNA, 19 nt, Homo sapiens
auacagaaaugcugauguc

SEQ ID NO: 1090577 - RNA, 19 nt, Homo sapiens
cauuaucuaugacugcuau

SEQ ID NO: 1090578 - RNA, 19 nt, Homo sapiens
gcaguucacagaccuaagu

SEQ ID NO: 1090579 - RNA, 19 nt, Homo sapiens
gaagcacaucgaugaaguu

SEQ ID NO: 1090580 - RNA, 19 nt, Homo sapiens
ugaagcacaucgaugaagu

SEQ ID NO: 1090581 - RNA, 19 nt, Homo sapiens
uggaagccuuuauacauau

SEQ ID NO: 1090582 - RNA, 19 nt, Homo sapiens
agacaugcugugcaacuua

SEQ ID NO: 1090583 - RNA, 19 nt, Homo sapiens
cguauuaaacgugaaagua

SEQ ID NO: 1090584 - RNA, 19 nt, Homo sapiens
ugucaccuguuauguauuc

SEQ ID NO: 1090585 - RNA, 19 nt, Homo sapiens
ccucucagauaccucuaaa

SEQ ID NO: 1090586 - RNA, 19 nt, Homo sapiens
gggaauggagcacguacaa

SEQ ID NO: 1090587 - RNA, 19 nt, Homo sapiens
ucaggaggccaaaugcuaa

SEQ ID NO: 1090588 - RNA, 19 nt, Homo sapiens
gcagacguaauuccaguug

SEQ ID NO: 1090589 - RNA, 19 nt, Homo sapiens
auaaauggaccuaauggaa

SEQ ID NO: 1090590 - RNA, 19 nt, Homo sapiens
ggaagccuuuauacauauc

SEQ ID NO: 1090591 - RNA, 19 nt, Homo sapiens
gcaaguccauucucaucac

SEQ ID NO: 1090592 - RNA, 19 nt, Homo sapiens
gaugguauacugcaguuca

SEQ ID NO: 1090593 - RNA, 19 nt, Homo sapiens
agacguaauuccaguugau

SEQ ID NO: 1090594 - RNA, 19 nt, Homo sapiens
ggaccuacaucauucauua

SEQ ID NO: 1090595 - RNA, 19 nt, Homo sapiens
caaggaagcuucaggauau

SEQ ID NO: 1090596 - RNA, 19 nt, Homo sapiens
gcaaagaacuucccucagu

SEQ ID NO: 1090597 - RNA, 19 nt, Homo sapiens
gcagauuugucuucucuua

SEQ ID NO: 1090598 - RNA, 19 nt, Homo sapiens
gagcaacgcugcccaguau

SEQ ID NO: 1090599 - RNA, 19 nt, Homo sapiens
gcuaaagacuucauuguug

SEQ ID NO: 1090600 - RNA, 19 nt, Homo sapiens
ggaacuaugcuuugaaaua

SEQ ID NO: 1090601 - RNA, 19 nt, Homo sapiens
ggaauuggaagcauuaaua

SEQ ID NO: 1090602 - RNA, 19 nt, Homo sapiens
gaacggcuaugcaauuguu

SEQ ID NO: 1090603 - RNA, 19 nt, Homo sapiens
gaacuaugcuuugaaauac

SEQ ID NO: 1090604 - RNA, 19 nt, Homo sapiens
acagagacauguucuuuaa

SEQ ID NO: 1090605 - RNA, 19 nt, Homo sapiens
agaaaucucugaccaagaa

SEQ ID NO: 1090606 - RNA, 19 nt, Homo sapiens
gcaccagucuuaacuuaug

SEQ ID NO: 1090607 - RNA, 19 nt, Homo sapiens
guggaugacuccuugguua

SEQ ID NO: 1090608 - RNA, 19 nt, Homo sapiens
ggacagagacauguucuuu

SEQ ID NO: 1090609 - RNA, 19 nt, Homo sapiens
ccaagaagauguuccuaug

SEQ ID NO: 1090610 - RNA, 19 nt, Homo sapiens
gaaaacagccucuucguaa

SEQ ID NO: 1090611 - RNA, 19 nt, Homo sapiens
ugaaauacauggagagcaa

SEQ ID NO: 1090612 - RNA, 19 nt, Homo sapiens
agacaaagaccgcagauuu

SEQ ID NO: 1090613 - RNA, 19 nt, Homo sapiens
ggaaugguauacugcuaaa

SEQ ID NO: 1090614 - RNA, 19 nt, Homo sapiens
cauagagccuguuguagaa

SEQ ID NO: 1090615 - RNA, 19 nt, Homo sapiens
agaccuaaaucgaggaaua

SEQ ID NO: 1090616 - RNA, 19 nt, Homo sapiens
gaaauacaccuuacacucu

SEQ ID NO: 1090617 - RNA, 19 nt, Homo sapiens
gcaggaauuggaagcauua

SEQ ID NO: 1090618 - RNA, 19 nt, Homo sapiens
gaaagcaagcaaacugaaa

SEQ ID NO: 1090619 - RNA, 19 nt, Homo sapiens
acaaacagguccuucgauu

SEQ ID NO: 1090620 - RNA, 19 nt, Homo sapiens
gccaaggaauugaguuaaa

SEQ ID NO: 1090621 - RNA, 19 nt, Homo sapiens
caacauucgugaggcauuu

SEQ ID NO: 1090622 - RNA, 19 nt, Homo sapiens
acaaggugcuucguuauuu

SEQ ID NO: 1090623 - RNA, 19 nt, Homo sapiens
ggacuaaaguuguuaaacc

SEQ ID NO: 1090624 - RNA, 19 nt, Homo sapiens
aaagagaaguuuggaauca

SEQ ID NO: 1090625 - RNA, 19 nt, Homo sapiens
cagcauguauggugaaugu

SEQ ID NO: 1090626 - RNA, 19 nt, Homo sapiens
caagcaauuucucaccuuu

SEQ ID NO: 1090627 - RNA, 19 nt, Homo sapiens
agaagcaacugaaagauca

SEQ ID NO: 1090628 - RNA, 19 nt, Homo sapiens
gcacucgcgucaauucaga

SEQ ID NO: 1090629 - RNA, 19 nt, Homo sapiens
gaaaacagccuuccacaga

SEQ ID NO: 1090630 - RNA, 19 nt, Homo sapiens
aaagaucacucaugcaaag

SEQ ID NO: 1090631 - RNA, 19 nt, Homo sapiens
cagaagcacucgcgucaau

SEQ ID NO: 1090632 - RNA, 19 nt, Homo sapiens
gacagagacauguucuuua

SEQ ID NO: 1090633 - RNA, 19 nt, Homo sapiens
gugcauggcuugcccuuuc

SEQ ID NO: 1090634 - RNA, 19 nt, Homo sapiens
caggauauguggacagaga

SEQ ID NO: 1090635 - RNA, 19 nt, Homo sapiens
agauggcucuugauccuua

SEQ ID NO: 1090636 - RNA, 19 nt, Homo sapiens
gcagaaagcaagcaaacug

SEQ ID NO: 1090637 - RNA, 19 nt, Homo sapiens
caaggugcuucguuauuug

SEQ ID NO: 1090638 - RNA, 19 nt, Homo sapiens
aaacugaccugcugaugag

SEQ ID NO: 1090639 - RNA, 19 nt, Homo sapiens
gaaagaucacucaugcaaa

SEQ ID NO: 1090640 - RNA, 19 nt, Homo sapiens
ggaaccaccuccaguaaaa

SEQ ID NO: 1090641 - RNA, 19 nt, Homo sapiens
caucacaauuuauggcaaa

SEQ ID NO: 1090642 - RNA, 19 nt, Homo sapiens
cagcaugucugucauagag

SEQ ID NO: 1090643 - RNA, 19 nt, Homo sapiens
uggaugaguuggccaguaa

SEQ ID NO: 1090644 - RNA, 19 nt, Homo sapiens
caaacugaccugcugauga

SEQ ID NO: 1090645 - RNA, 19 nt, Homo sapiens
ugucuucucuuacuuucua

SEQ ID NO: 1090646 - RNA, 19 nt, Homo sapiens
ccaaggaauugaguuaaau

SEQ ID NO: 1090647 - RNA, 19 nt, Homo sapiens
uaacuuauggccaaccuaa

SEQ ID NO: 1090648 - RNA, 19 nt, Homo sapiens
aggcugagcuggaugaguu

SEQ ID NO: 1090649 - RNA, 19 nt, Homo sapiens
cuaccgacaugaucaguau

SEQ ID NO: 1090650 - RNA, 19 nt, Homo sapiens
uaugcaaucugggaugaua

SEQ ID NO: 1090651 - RNA, 19 nt, Homo sapiens
ugaaagaucacucaugcaa

SEQ ID NO: 1090652 - RNA, 19 nt, Homo sapiens
aggcaccagucuuaacuua

SEQ ID NO: 1090653 - RNA, 19 nt, Homo sapiens
ucgcaauucugguaucauu

SEQ ID NO: 1090654 - RNA, 19 nt, Homo sapiens
gacaugaucaguaucuuug

SEQ ID NO: 1090655 - RNA, 19 nt, Homo sapiens
ccaauucacacagguauuu

SEQ ID NO: 1090656 - RNA, 19 nt, Homo sapiens
ggaagucacucacuauccu

SEQ ID NO: 1090657 - RNA, 19 nt, Homo sapiens
acaaggaagcuucaggaua

SEQ ID NO: 1090658 - RNA, 19 nt, Homo sapiens
gagaccggcuccaguucaa

SEQ ID NO: 1090659 - RNA, 19 nt, Homo sapiens
gaagcacucgcgucaauuc

SEQ ID NO: 1090660 - RNA, 19 nt, Homo sapiens
guugggaagucacucacua

SEQ ID NO: 1090661 - RNA, 19 nt, Homo sapiens
uccgucaggugaacauuua

SEQ ID NO: 1090662 - RNA, 19 nt, Homo sapiens
aaauacaccuuacacucuu

SEQ ID NO: 1090663 - RNA, 19 nt, Homo sapiens
uuauuuggcuguacuggaa

SEQ ID NO: 1090664 - RNA, 19 nt, Homo sapiens
uuaaaaugcuggugaauga

SEQ ID NO: 1090665 - RNA, 19 nt, Homo sapiens
gaucaacucaagcaauuuc

SEQ ID NO: 1090666 - RNA, 19 nt, Homo sapiens
ucauagagccuguuguaga

SEQ ID NO: 1090667 - RNA, 19 nt, Homo sapiens
gaauuggaagcauuaauag

SEQ ID NO: 1090668 - RNA, 19 nt, Homo sapiens
cccagugacuucuucauug

SEQ ID NO: 1090669 - RNA, 19 nt, Homo sapiens
aagaaguguuggaauggua

SEQ ID NO: 1090670 - RNA, 19 nt, Homo sapiens
cuucaaggcaaguuaauaa

SEQ ID NO: 1090671 - RNA, 19 nt, Homo sapiens
gauacuggaacuaugcuuu

SEQ ID NO: 1090672 - RNA, 19 nt, Homo sapiens
gacuaaaguuguuaaacca

SEQ ID NO: 1090673 - RNA, 19 nt, Homo sapiens
cgacaugaucaguaucuuu

SEQ ID NO: 1090674 - RNA, 19 nt, Homo sapiens
gauaacaaggugcuucguu

SEQ ID NO: 1090675 - RNA, 19 nt, Homo sapiens
gaccuaaaucgaggaauaa

SEQ ID NO: 1090676 - RNA, 19 nt, Homo sapiens
uaacuuuguucgugcuuuc

SEQ ID NO: 1090677 - RNA, 19 nt, Homo sapiens
guauacugcuaaagacuuc

SEQ ID NO: 1090678 - RNA, 19 nt, Homo sapiens
uuagaaagccaaggaauug

SEQ ID NO: 1090679 - RNA, 19 nt, Homo sapiens
ugucauagagccuguugua

SEQ ID NO: 1090680 - RNA, 19 nt, Homo sapiens
gaagauguuccuaugucaa

SEQ ID NO: 1090681 - RNA, 19 nt, Homo sapiens
aaaugcuggugaaugauaa

SEQ ID NO: 1090682 - RNA, 19 nt, Homo sapiens
ucacugauuuaccacguau

SEQ ID NO: 1090683 - RNA, 19 nt, Homo sapiens
aagaagauguuccuauguc

SEQ ID NO: 1090684 - RNA, 19 nt, Homo sapiens
caggaacggcuaugcaauu

SEQ ID NO: 1090685 - RNA, 19 nt, Homo sapiens
gaucacucaugcaaagaca

SEQ ID NO: 1090686 - RNA, 19 nt, Homo sapiens
gcaacgcugcccaguauuc

SEQ ID NO: 1090687 - RNA, 19 nt, Homo sapiens
uggcaggacuaaaguuguu

SEQ ID NO: 1090688 - RNA, 19 nt, Homo sapiens
ugucggaccuacaucauuc

SEQ ID NO: 1090689 - RNA, 19 nt, Homo sapiens
cuaaaucgaggaauaaaca

SEQ ID NO: 1090690 - RNA, 19 nt, Homo sapiens
gcauuaauagacacaauuc

SEQ ID NO: 1090691 - RNA, 19 nt, Homo sapiens
cuucauuggugcugugauu

SEQ ID NO: 1090692 - RNA, 19 nt, Homo sapiens
aaacagguccuucgauucu

SEQ ID NO: 1090693 - RNA, 19 nt, Homo sapiens
gccagcggcuagccaagaa

SEQ ID NO: 1090694 - RNA, 19 nt, Homo sapiens
ggaaaugccuucagcaaga

SEQ ID NO: 1090695 - RNA, 19 nt, Homo sapiens
ugacaaaucugcccuuauu

SEQ ID NO: 1090696 - RNA, 19 nt, Homo sapiens
gaaaucguaucuuguugua

SEQ ID NO: 1090697 - RNA, 19 nt, Homo sapiens
gguagaaucuccauuguga

SEQ ID NO: 1090698 - RNA, 19 nt, Homo sapiens
uaagagaucuacccucauu

SEQ ID NO: 1090699 - RNA, 19 nt, Homo sapiens
agagaaaccuuaugaaugu

SEQ ID NO: 1090700 - RNA, 19 nt, Homo sapiens
guaagagaaugaacacaaa

SEQ ID NO: 1090701 - RNA, 19 nt, Homo sapiens
gaaagauuccugauggaua

SEQ ID NO: 1090702 - RNA, 19 nt, Homo sapiens
acaaggaaauccaagauaa

SEQ ID NO: 1090703 - RNA, 19 nt, Homo sapiens
gaaaggaaaccaaaugaau

SEQ ID NO: 1090704 - RNA, 19 nt, Homo sapiens
gcacaucagauaacucaua

SEQ ID NO: 1090705 - RNA, 19 nt, Homo sapiens
caccaugccuggcuaauuu

SEQ ID NO: 1090706 - RNA, 19 nt, Homo sapiens
ggaaauccuucugccauaa

SEQ ID NO: 1090707 - RNA, 19 nt, Homo sapiens
ggagaaaccauaugaaugu

SEQ ID NO: 1090708 - RNA, 19 nt, Homo sapiens
ggagaaauccuaugagugu

SEQ ID NO: 1090709 - RNA, 19 nt, Homo sapiens
gagagaagcccuaugaaug

SEQ ID NO: 1090710 - RNA, 19 nt, Homo sapiens
agacauugaugaugccuua

SEQ ID NO: 1090711 - RNA, 19 nt, Homo sapiens
gaacuucacccaagaggaa

SEQ ID NO: 1090712 - RNA, 19 nt, Homo sapiens
gaaaucauguaggaaagaa

SEQ ID NO: 1090713 - RNA, 19 nt, Homo sapiens
gggaaauccuucugccaua

SEQ ID NO: 1090714 - RNA, 19 nt, Homo sapiens
gcaauucucauuacacaaa

SEQ ID NO: 1090715 - RNA, 19 nt, Homo sapiens
gagagaaaccuuaugaaug

SEQ ID NO: 1090716 - RNA, 19 nt, Homo sapiens
gaaguucuccuuuguugaa

SEQ ID NO: 1090717 - RNA, 19 nt, Homo sapiens
ggagaagccuuacgaaugc

SEQ ID NO: 1090718 - RNA, 19 nt, Homo sapiens
gacacaaacuguauucuuc

SEQ ID NO: 1090719 - RNA, 19 nt, Homo sapiens
ggagagagacccuaugaau

SEQ ID NO: 1090720 - RNA, 19 nt, Homo sapiens
gaggaauucucaaaucaga

SEQ ID NO: 1090721 - RNA, 19 nt, Homo sapiens
ucagagaaaucauguagga

SEQ ID NO: 1090722 - RNA, 19 nt, Homo sapiens
caacaaagcaacaaaucaa

SEQ ID NO: 1090723 - RNA, 19 nt, Homo sapiens
ggacagagacccuaugagu

SEQ ID NO: 1090724 - RNA, 19 nt, Homo sapiens
gaggagagaagccaaauga

SEQ ID NO: 1090725 - RNA, 19 nt, Homo sapiens
gaaaugccuucagcaagaa

SEQ ID NO: 1090726 - RNA, 19 nt, Homo sapiens
guacaucagagaauucaua

SEQ ID NO: 1090727 - RNA, 19 nt, Homo sapiens
gagacagacugaaaggaaa

SEQ ID NO: 1090728 - RNA, 19 nt, Homo sapiens
gaaaucagcccucauugca

SEQ ID NO: 1090729 - RNA, 19 nt, Homo sapiens
gagagaagccaaaugaaug

SEQ ID NO: 1090730 - RNA, 19 nt, Homo sapiens
ucuuacaucuccuuucuua

SEQ ID NO: 1090731 - RNA, 19 nt, Homo sapiens
ggagagaaaccuuaugaau

SEQ ID NO: 1090732 - RNA, 19 nt, Homo sapiens
gagaaaccauaugaaugua

SEQ ID NO: 1090733 - RNA, 19 nt, Homo sapiens
ggagagaaaccauaugaau

SEQ ID NO: 1090734 - RNA, 19 nt, Homo sapiens
gagaaaccauaugaaugua

SEQ ID NO: 1090735 - RNA, 19 nt, Homo sapiens
ggaaaccaaaugaauguaa

SEQ ID NO: 1090736 - RNA, 19 nt, Homo sapiens
gguccaaguucuguaauuu

SEQ ID NO: 1090737 - RNA, 19 nt, Homo sapiens
gcuaaacugugaguaugua

SEQ ID NO: 1090738 - RNA, 19 nt, Homo sapiens
ccaaaugaauguaaggaau

SEQ ID NO: 1090739 - RNA, 19 nt, Homo sapiens
ggagacagacugaaaggaa

SEQ ID NO: 1090740 - RNA, 19 nt, Homo sapiens
gaugaugccuuagagaaga

SEQ ID NO: 1090741 - RNA, 19 nt, Homo sapiens
ucagagugcugggauuaua

SEQ ID NO: 1090742 - RNA, 19 nt, Homo sapiens
ggagagaagccaaaugaau

SEQ ID NO: 1090743 - RNA, 19 nt, Homo sapiens
gggagaagccuuacgaaug

SEQ ID NO: 1090744 - RNA, 19 nt, Homo sapiens
gaauaguguucccucaaga

SEQ ID NO: 1090745 - RNA, 19 nt, Homo sapiens
gaacaucagcgaacucaca

SEQ ID NO: 1090746 - RNA, 19 nt, Homo sapiens
gaucuacccucauuguaca

SEQ ID NO: 1090747 - RNA, 19 nt, Homo sapiens
gaacaaggaaauccaagau

SEQ ID NO: 1090748 - RNA, 19 nt, Homo sapiens
gagagaaaccauaugaaug

SEQ ID NO: 1090749 - RNA, 19 nt, Homo sapiens
caaaucugcccuuauugua

SEQ ID NO: 1090750 - RNA, 19 nt, Homo sapiens
gaguauguauagaggagua

SEQ ID NO: 1090751 - RNA, 19 nt, Homo sapiens
guacaucagagaacuauau

SEQ ID NO: 1090752 - RNA, 19 nt, Homo sapiens
ggagagaagcccuaugaau

SEQ ID NO: 1090753 - RNA, 19 nt, Homo sapiens
uaagucaacccucaaugua

SEQ ID NO: 1090754 - RNA, 19 nt, Homo sapiens
agaaaucccacaaggaaua

SEQ ID NO: 1090755 - RNA, 19 nt, Homo sapiens
caccagaacauucagauuu

SEQ ID NO: 1090756 - RNA, 19 nt, Homo sapiens
ucagaaaucccacaaggaa

SEQ ID NO: 1090757 - RNA, 19 nt, Homo sapiens
gagaaaccuuaugaaugua

SEQ ID NO: 1090758 - RNA, 19 nt, Homo sapiens
cgacaccgaagaauucaua

SEQ ID NO: 1090759 - RNA, 19 nt, Homo sapiens
gggcaauucucauuacaca

SEQ ID NO: 1090760 - RNA, 19 nt, Homo sapiens
caagagggcaauucucauu

SEQ ID NO: 1090761 - RNA, 19 nt, Homo sapiens
gaggaaagccagcaaucaa

SEQ ID NO: 1090762 - RNA, 19 nt, Homo sapiens
ggaccugacugugaacuuc

SEQ ID NO: 1090763 - RNA, 19 nt, Homo sapiens
caaauaacuuacacaaugc

SEQ ID NO: 1090764 - RNA, 19 nt, Homo sapiens
gaauguaacaaaugugaga

SEQ ID NO: 1090765 - RNA, 19 nt, Homo sapiens
ggagagaccauaugaaugc

SEQ ID NO: 1090766 - RNA, 19 nt, Homo sapiens
gagaaauccuaugagugua

SEQ ID NO: 1090767 - RNA, 19 nt, Homo sapiens
gaacuacccagacauugau

SEQ ID NO: 1090768 - RNA, 19 nt, Homo sapiens
gagaaaucauguaggaaag

SEQ ID NO: 1090769 - RNA, 19 nt, Homo sapiens
ggagaaucuuuaugagugu

SEQ ID NO: 1090770 - RNA, 19 nt, Homo sapiens
ggaguacaguggcacaauc

SEQ ID NO: 1090771 - RNA, 19 nt, Homo sapiens
gaacauuucaggucacaca

SEQ ID NO: 1090772 - RNA, 19 nt, Homo sapiens
gaaauccuaugaguguaau

SEQ ID NO: 1090773 - RNA, 19 nt, Homo sapiens
gagagagacccuaugaaug

SEQ ID NO: 1090774 - RNA, 19 nt, Homo sapiens
caaggaaauccaagauaaa

SEQ ID NO: 1090775 - RNA, 19 nt, Homo sapiens
aaagauaccaguuucauuc

SEQ ID NO: 1090776 - RNA, 19 nt, Homo sapiens
gaaaucccacaaggaauaa

SEQ ID NO: 1090777 - RNA, 19 nt, Homo sapiens
cagaaguaauuguugcaaa

SEQ ID NO: 1090778 - RNA, 19 nt, Homo sapiens
gaagaacaaggaaauccaa

SEQ ID NO: 1090779 - RNA, 19 nt, Homo sapiens
uagcaaaccagaugugauu

SEQ ID NO: 1090780 - RNA, 19 nt, Homo sapiens
ccauaugaaugcaaugaau

SEQ ID NO: 1090781 - RNA, 19 nt, Homo sapiens
uaagucaacacucacuaua

SEQ ID NO: 1090782 - RNA, 19 nt, Homo sapiens
gugcaucgaagaagucaua

SEQ ID NO: 1090783 - RNA, 19 nt, Homo sapiens
gaagccaaaugaauguaag

SEQ ID NO: 1090784 - RNA, 19 nt, Homo sapiens
aacaaccguuugacuauaa

SEQ ID NO: 1090785 - RNA, 19 nt, Homo sapiens
gauacaauccaaugaggaa

SEQ ID NO: 1090786 - RNA, 19 nt, Homo sapiens
caucuccuuucuuacauaa

SEQ ID NO: 1090787 - RNA, 19 nt, Homo sapiens
caaauuggagcaaggagaa

SEQ ID NO: 1090788 - RNA, 19 nt, Homo sapiens
gagaaucuuuaugagugua

SEQ ID NO: 1090789 - RNA, 19 nt, Homo sapiens
gaaugaacacaaaggagaa

SEQ ID NO: 1090790 - RNA, 19 nt, Homo sapiens
ggaaauccaagauaaacau

SEQ ID NO: 1090791 - RNA, 19 nt, Homo sapiens
ggagaacuacagcaacuug

SEQ ID NO: 1090792 - RNA, 19 nt, Homo sapiens
ccacaaaucaaacuuucuu

SEQ ID NO: 1090793 - RNA, 19 nt, Homo sapiens
agagaaaccauaugaaugu

SEQ ID NO: 1090794 - RNA, 19 nt, Homo sapiens
gaaauuaccucccuguauu

SEQ ID NO: 1090795 - RNA, 19 nt, Homo sapiens
gcacggaaaucuuugaaua

SEQ ID NO: 1090796 - RNA, 19 nt, Homo sapiens
ggacagugaucuaccguua

SEQ ID NO: 1090797 - RNA, 19 nt, Homo sapiens
ucaaggagauucaauauga

SEQ ID NO: 1090798 - RNA, 19 nt, Homo sapiens
gacaacagcuuucgaguga

SEQ ID NO: 1090799 - RNA, 19 nt, Homo sapiens
gcaaugggcuuaugcugaa

SEQ ID NO: 1090800 - RNA, 19 nt, Homo sapiens
uaacaacccugcaagcaaa

SEQ ID NO: 1090801 - RNA, 19 nt, Homo sapiens
gacaacaccugacauagaa

SEQ ID NO: 1090802 - RNA, 19 nt, Homo sapiens
ggaugaagaugguuuccua

SEQ ID NO: 1090803 - RNA, 19 nt, Homo sapiens
ggauuacaauucaguauga

SEQ ID NO: 1090804 - RNA, 19 nt, Homo sapiens
ggcaguacaucuucgaaua

SEQ ID NO: 1090805 - RNA, 19 nt, Homo sapiens
gcgagaaaguagauuauga

SEQ ID NO: 1090806 - RNA, 19 nt, Homo sapiens
ggacaacaccugacauaga

SEQ ID NO: 1090807 - RNA, 19 nt, Homo sapiens
agaaacagcuaccagauug

SEQ ID NO: 1090808 - RNA, 19 nt, Homo sapiens
caagaucaguuaagaaaca

SEQ ID NO: 1090809 - RNA, 19 nt, Homo sapiens
caacuggaguggucacaaa

SEQ ID NO: 1090810 - RNA, 19 nt, Homo sapiens
ugacauuucuggcaaaguu

SEQ ID NO: 1090811 - RNA, 19 nt, Homo sapiens
gaucgugucucgggucuuu

SEQ ID NO: 1090812 - RNA, 19 nt, Homo sapiens
aaacauggaguuacacaua

SEQ ID NO: 1090813 - RNA, 19 nt, Homo sapiens
gcauagcgcugcacucagu

SEQ ID NO: 1090814 - RNA, 19 nt, Homo sapiens
ccacuaggauuacucaugu

SEQ ID NO: 1090815 - RNA, 19 nt, Homo sapiens
caguaaaccuccagaguga

SEQ ID NO: 1090816 - RNA, 19 nt, Homo sapiens
ggucuuugcugaugguaaa

SEQ ID NO: 1090817 - RNA, 19 nt, Homo sapiens
caccaaauaugcuuaugaa

SEQ ID NO: 1090818 - RNA, 19 nt, Homo sapiens
ggcaguggcuggacaguga

SEQ ID NO: 1090819 - RNA, 19 nt, Homo sapiens
ggaaaccuccauuuacuga

SEQ ID NO: 1090820 - RNA, 19 nt, Homo sapiens
agacuaggcucucagaaau

SEQ ID NO: 1090821 - RNA, 19 nt, Homo sapiens
uccaugacgugaaagauua

SEQ ID NO: 1090822 - RNA, 19 nt, Homo sapiens
gaaacuggauggacaacgu

SEQ ID NO: 1090823 - RNA, 19 nt, Homo sapiens
gaaacgccacugccuauug

SEQ ID NO: 1090824 - RNA, 19 nt, Homo sapiens
caccguaaauuucuacuga

SEQ ID NO: 1090825 - RNA, 19 nt, Homo sapiens
uuaccucccuguauuauga

SEQ ID NO: 1090826 - RNA, 19 nt, Homo sapiens
aaacgccacugccuauuga

SEQ ID NO: 1090827 - RNA, 19 nt, Homo sapiens
gaaagcaacgccuccauca

SEQ ID NO: 1090828 - RNA, 19 nt, Homo sapiens
gcaaggacacgcacuacuu

SEQ ID NO: 1090829 - RNA, 19 nt, Homo sapiens
gaaggucgucugacaaaug

SEQ ID NO: 1090830 - RNA, 19 nt, Homo sapiens
gaacguagccagaggaaaa

SEQ ID NO: 1090831 - RNA, 19 nt, Homo sapiens
gaucggcuuuaacgaauau

SEQ ID NO: 1090832 - RNA, 19 nt, Homo sapiens
ggagauucaauaugagaua

SEQ ID NO: 1090833 - RNA, 19 nt, Homo sapiens
caacuacgaucugaaugga

SEQ ID NO: 1090834 - RNA, 19 nt, Homo sapiens
gcuacuaccgcaacauaua

SEQ ID NO: 1090835 - RNA, 19 nt, Homo sapiens
guaaauuucuacugaggau

SEQ ID NO: 1090836 - RNA, 19 nt, Homo sapiens
caaaauccaugacgugaaa

SEQ ID NO: 1090837 - RNA, 19 nt, Homo sapiens
gaaggcguguuucuagcaa

SEQ ID NO: 1090838 - RNA, 19 nt, Homo sapiens
ggaaaucuuugaauauagc

SEQ ID NO: 1090839 - RNA, 19 nt, Homo sapiens
uggaaaguuuggaguuaua

SEQ ID NO: 1090840 - RNA, 19 nt, Homo sapiens
gaagaugggaugguaaaug

SEQ ID NO: 1090841 - RNA, 19 nt, Homo sapiens
ggaaugagacugcuguuac

SEQ ID NO: 1090842 - RNA, 19 nt, Homo sapiens
cagcaucacuucaaaucug

SEQ ID NO: 1090843 - RNA, 19 nt, Homo sapiens
cauucgaguucagaaauua

SEQ ID NO: 1090844 - RNA, 19 nt, Homo sapiens
ggaguuacacauauuuaga

SEQ ID NO: 1090845 - RNA, 19 nt, Homo sapiens
acaaaggccucgaccuguu

SEQ ID NO: 1090846 - RNA, 19 nt, Homo sapiens
gcaaauugguccccugauu

SEQ ID NO: 1090847 - RNA, 19 nt, Homo sapiens
ggucgucugacaaauguua

SEQ ID NO: 1090848 - RNA, 19 nt, Homo sapiens
ugacgaccaccguaaauuu

SEQ ID NO: 1090849 - RNA, 19 nt, Homo sapiens
ggagaaagagauuaugaca

SEQ ID NO: 1090850 - RNA, 19 nt, Homo sapiens
guacaacuacgaucugaau

SEQ ID NO: 1090851 - RNA, 19 nt, Homo sapiens
uaaccaagagagagauuaa

SEQ ID NO: 1090852 - RNA, 19 nt, Homo sapiens
ucaggucgcucauguacug

SEQ ID NO: 1090853 - RNA, 19 nt, Homo sapiens
uggcaaaguugagcaguuu

SEQ ID NO: 1090854 - RNA, 19 nt, Homo sapiens
gauaacaugggucggguaa

SEQ ID NO: 1090855 - RNA, 19 nt, Homo sapiens
ggacucacacuaccaaaca

SEQ ID NO: 1090856 - RNA, 19 nt, Homo sapiens
acaaugcuauuccuggauu

SEQ ID NO: 1090857 - RNA, 19 nt, Homo sapiens
ugaauaugauguugaugga

SEQ ID NO: 1090858 - RNA, 19 nt, Homo sapiens
guaucaaggagauucaaua

SEQ ID NO: 1090859 - RNA, 19 nt, Homo sapiens
cuucaaaucuguccucgau

SEQ ID NO: 1090860 - RNA, 19 nt, Homo sapiens
ugacauagaaaucuggaaa

SEQ ID NO: 1090861 - RNA, 19 nt, Homo sapiens
acagugaucuaccguuaug

SEQ ID NO: 1090862 - RNA, 19 nt, Homo sapiens
ucgcucauguacuggauua

SEQ ID NO: 1090863 - RNA, 19 nt, Homo sapiens
cggagggucuuauucaaau

SEQ ID NO: 1090864 - RNA, 19 nt, Homo sapiens
aaacagagccgcacguucu

SEQ ID NO: 1090865 - RNA, 19 nt, Homo sapiens
ugacaaauguuacguuucc

SEQ ID NO: 1090866 - RNA, 19 nt, Homo sapiens
ucugacaaauguuacguuu

SEQ ID NO: 1090867 - RNA, 19 nt, Homo sapiens
acuaggcucucagaaauuu

SEQ ID NO: 1090868 - RNA, 19 nt, Homo sapiens
uaugacggcucccucagaa

SEQ ID NO: 1090869 - RNA, 19 nt, Homo sapiens
gcacuguauuuaacuaacu

SEQ ID NO: 1090870 - RNA, 19 nt, Homo sapiens
gaaugagacugcuguuacg

SEQ ID NO: 1090871 - RNA, 19 nt, Homo sapiens
guauuaugaucuccaagga

SEQ ID NO: 1090872 - RNA, 19 nt, Homo sapiens
ccauucgaguucagaaauu

SEQ ID NO: 1090873 - RNA, 19 nt, Homo sapiens
uaugauagcacaagaguca

SEQ ID NO: 1090874 - RNA, 19 nt, Homo sapiens
uguccucgaucgauucuuu

SEQ ID NO: 1090875 - RNA, 19 nt, Homo sapiens
gugaucggcuuuaacgaau

SEQ ID NO: 1090876 - RNA, 19 nt, Homo sapiens
gggcuuaugcugaaacaga

SEQ ID NO: 1090877 - RNA, 19 nt, Homo sapiens
uaauguggcgguacaacua

SEQ ID NO: 1090878 - RNA, 19 nt, Homo sapiens
gacuauagcuaugacaaca

SEQ ID NO: 1090879 - RNA, 19 nt, Homo sapiens
gaacaacaaagacagaaaa

SEQ ID NO: 1090880 - RNA, 19 nt, Homo sapiens
ucaguugacuuugaucgaa

SEQ ID NO: 1090881 - RNA, 19 nt, Homo sapiens
ggugaucggcuuuaacgaa

SEQ ID NO: 1090882 - RNA, 19 nt, Homo sapiens
aaauuaccucccuguauua

SEQ ID NO: 1090883 - RNA, 19 nt, Homo sapiens
ggacagcaccugcaguuuu

SEQ ID NO: 1090884 - RNA, 19 nt, Homo sapiens
ugacuuugaucgaacaaca

SEQ ID NO: 1090885 - RNA, 19 nt, Homo sapiens
ugacggcucccucagaauu

SEQ ID NO: 1090886 - RNA, 19 nt, Homo sapiens
gggaaugagacugcuguua

SEQ ID NO: 1090887 - RNA, 19 nt, Homo sapiens
uggauucccuguucccaaa

SEQ ID NO: 1090888 - RNA, 19 nt, Homo sapiens
gggaugaauucuauauugc

SEQ ID NO: 1090889 - RNA, 19 nt, Homo sapiens
ugagucaucuagccgagaa

SEQ ID NO: 1090890 - RNA, 19 nt, Homo sapiens
gaugguuuccuacgucaaa

SEQ ID NO: 1090891 - RNA, 19 nt, Homo sapiens
acuacgaucugaauggaaa

SEQ ID NO: 1090892 - RNA, 19 nt, Homo sapiens
cagacuaggcucucagaaa

SEQ ID NO: 1090893 - RNA, 19 nt, Homo sapiens
gguucaagaucaguuaaga

SEQ ID NO: 1090894 - RNA, 19 nt, Homo sapiens
gaacagaccuucuuguaaa

SEQ ID NO: 1090895 - RNA, 19 nt, Homo sapiens
gcagguggcuucucaguuc

SEQ ID NO: 1090896 - RNA, 19 nt, Homo sapiens
gaagggcuaucuuucuauu

SEQ ID NO: 1090897 - RNA, 19 nt, Homo sapiens
gcaggaagcucgggaucua

SEQ ID NO: 1090898 - RNA, 19 nt, Homo sapiens
gcacggaacauuacucgua

SEQ ID NO: 1090899 - RNA, 19 nt, Homo sapiens
cgaaggagcugcuagaaca

SEQ ID NO: 1090900 - RNA, 19 nt, Homo sapiens
ggaacagaccuucuuguaa

SEQ ID NO: 1090901 - RNA, 19 nt, Homo sapiens
gcaaugcaauuaaagcaau

SEQ ID NO: 1090902 - RNA, 19 nt, Homo sapiens
gcagaggagugguacaaga

SEQ ID NO: 1090903 - RNA, 19 nt, Homo sapiens
ugaaggagauuauguugug

SEQ ID NO: 1090904 - RNA, 19 nt, Homo sapiens
gaggaaggcuggagcuugu

SEQ ID NO: 1090905 - RNA, 19 nt, Homo sapiens
gggaugagcuagccuguag

SEQ ID NO: 1090906 - RNA, 19 nt, Homo sapiens
gcaggaggaugauaaagca

SEQ ID NO: 1090907 - RNA, 19 nt, Homo sapiens
gagauuauguugugcucuu

SEQ ID NO: 1090908 - RNA, 19 nt, Homo sapiens
aaacagaccuccucaacag

SEQ ID NO: 1090909 - RNA, 19 nt, Homo sapiens
gggaacagaccuucuugua

SEQ ID NO: 1090910 - RNA, 19 nt, Homo sapiens
cagaccuucuuguaaauaa

SEQ ID NO: 1090911 - RNA, 19 nt, Homo sapiens
gugggacuauauacuguua

SEQ ID NO: 1090912 - RNA, 19 nt, Homo sapiens
gagcuaccgugggacuaua

SEQ ID NO: 1090913 - RNA, 19 nt, Homo sapiens
acagaucgcuucaaugucu

SEQ ID NO: 1090914 - RNA, 19 nt, Homo sapiens
ggagaaguauccagaugag

SEQ ID NO: 1090915 - RNA, 19 nt, Homo sapiens
gaaacagaccuccucaaca

SEQ ID NO: 1090916 - RNA, 19 nt, Homo sapiens
gaacagacagaucgcuuca

SEQ ID NO: 1090917 - RNA, 19 nt, Homo sapiens
ccaagagccuggagaaagg

SEQ ID NO: 1090918 - RNA, 19 nt, Homo sapiens
caacagauucauccugcua

SEQ ID NO: 1090919 - RNA, 19 nt, Homo sapiens
agacagaucgcuucaaugu

SEQ ID NO: 1090920 - RNA, 19 nt, Homo sapiens
acagacagaucgcuucaau

SEQ ID NO: 1090921 - RNA, 19 nt, Homo sapiens
gcaugaaggagauuauguu

SEQ ID NO: 1090922 - RNA, 19 nt, Homo sapiens
ggaaacagaccuccucaac

SEQ ID NO: 1090923 - RNA, 19 nt, Homo sapiens
acaagggcacggaacauua

SEQ ID NO: 1090924 - RNA, 19 nt, Homo sapiens
cgacaucagucugggagaa

SEQ ID NO: 1090925 - RNA, 19 nt, Homo sapiens
gggacuauauacuguuaau

SEQ ID NO: 1090926 - RNA, 19 nt, Homo sapiens
gaucagcaacgucaagugu

SEQ ID NO: 1090927 - RNA, 19 nt, Homo sapiens
gaggcucccugcugcaaug

SEQ ID NO: 1090928 - RNA, 19 nt, Homo sapiens
ccaccaauacacacaaauu

SEQ ID NO: 1090929 - RNA, 19 nt, Homo sapiens
aaaccaagaccuucccauu

SEQ ID NO: 1090930 - RNA, 19 nt, Homo sapiens
caccaauacacacaaauuu

SEQ ID NO: 1090931 - RNA, 19 nt, Homo sapiens
agaaguauccagaugagaa

SEQ ID NO: 1090932 - RNA, 19 nt, Homo sapiens
gauuauguugugcucuuua

SEQ ID NO: 1090933 - RNA, 19 nt, Homo sapiens
gaugacgcaugaaggagau

SEQ ID NO: 1090934 - RNA, 19 nt, Homo sapiens
aaaccauggcgaccaauuu

SEQ ID NO: 1090935 - RNA, 19 nt, Homo sapiens
gcagucagccucgcucuca

SEQ ID NO: 1090936 - RNA, 19 nt, Homo sapiens
gcagaucacccacgagaac

SEQ ID NO: 1090937 - RNA, 19 nt, Homo sapiens
ggaaaaccauggcgaccaa

SEQ ID NO: 1090938 - RNA, 19 nt, Homo sapiens
gcugguauuuguugacuac

SEQ ID NO: 1090939 - RNA, 19 nt, Homo sapiens
gaacaagggcacggaacau

SEQ ID NO: 1090940 - RNA, 19 nt, Homo sapiens
aagcaaggcuacgugaaga

SEQ ID NO: 1090941 - RNA, 19 nt, Homo sapiens
gccgaagccuccagcuaug

SEQ ID NO: 1090942 - RNA, 19 nt, Homo sapiens
cacggaacauuacucguau

SEQ ID NO: 1090943 - RNA, 19 nt, Homo sapiens
ucagcaacgucaagugugu

SEQ ID NO: 1090944 - RNA, 19 nt, Homo sapiens
ucuauucacgucaaacuuu

SEQ ID NO: 1090945 - RNA, 19 nt, Homo sapiens
ccacaccaccugagcaugu

SEQ ID NO: 1090946 - RNA, 19 nt, Homo sapiens
acagauucauccugcuaaa

SEQ ID NO: 1090947 - RNA, 19 nt, Homo sapiens
gcuccuuccugcuuuguag

SEQ ID NO: 1090948 - RNA, 19 nt, Homo sapiens
gcaaggcuacgugaagaug

SEQ ID NO: 1090949 - RNA, 19 nt, Homo sapiens
guggcacgaugacgcauga

SEQ ID NO: 1090950 - RNA, 19 nt, Homo sapiens
gaaggagcugcuagaacaa

SEQ ID NO: 1090951 - RNA, 19 nt, Homo sapiens
gaaguauccagaugagaag

SEQ ID NO: 1090952 - RNA, 19 nt, Homo sapiens
uauguugugcucuuuauug

SEQ ID NO: 1090953 - RNA, 19 nt, Homo sapiens
cagcuaaguggcacgauga

SEQ ID NO: 1090954 - RNA, 19 nt, Homo sapiens
ggaccugcuugaacuacca

SEQ ID NO: 1090955 - RNA, 19 nt, Homo sapiens
gcaggcgguggccaucaua

SEQ ID NO: 1090956 - RNA, 19 nt, Homo sapiens
caagcaaggcuacgugaag

SEQ ID NO: 1090957 - RNA, 19 nt, Homo sapiens
guugacgccucaggugaaa

SEQ ID NO: 1090958 - RNA, 19 nt, Homo sapiens
gguacaagacacuaucugu

SEQ ID NO: 1090959 - RNA, 19 nt, Homo sapiens
uaaccacuauuugaguugu

SEQ ID NO: 1090960 - RNA, 19 nt, Homo sapiens
agggcuaucuuucuauuca

SEQ ID NO: 1090961 - RNA, 19 nt, Homo sapiens
gccaagagccuggagaaag

SEQ ID NO: 1090962 - RNA, 19 nt, Homo sapiens
cgggaugccacacgcuuua

SEQ ID NO: 1090963 - RNA, 19 nt, Homo sapiens
caugaaggagauuauguug

SEQ ID NO: 1090964 - RNA, 19 nt, Homo sapiens
gguggacaaugcccaagca

SEQ ID NO: 1090965 - RNA, 19 nt, Homo sapiens
cagaccuccucaacagauu

SEQ ID NO: 1090966 - RNA, 19 nt, Homo sapiens
ggagcuaccgugggacuau

SEQ ID NO: 1090967 - RNA, 19 nt, Homo sapiens
acugaugacucggcacgua

SEQ ID NO: 1090968 - RNA, 19 nt, Homo sapiens
gggcgaaggagcugcuaga

SEQ ID NO: 1090969 - RNA, 19 nt, Homo sapiens
ccacacgcuuuaccuucga

SEQ ID NO: 1090970 - RNA, 19 nt, Homo sapiens
ggaaggcuggagcuuguuc

SEQ ID NO: 1090971 - RNA, 19 nt, Homo sapiens
aacagcagguggcuucuca

SEQ ID NO: 1090972 - RNA, 19 nt, Homo sapiens
gaggcuggacugaggcaaa

SEQ ID NO: 1090973 - RNA, 19 nt, Homo sapiens
aaggcuacgugaagaugaa

SEQ ID NO: 1090974 - RNA, 19 nt, Homo sapiens
caaaagcacucugaaacca

SEQ ID NO: 1090975 - RNA, 19 nt, Homo sapiens
cgccgaagccuccagcuau

SEQ ID NO: 1090976 - RNA, 19 nt, Homo sapiens
caaggcuacgugaagauga

SEQ ID NO: 1090977 - RNA, 19 nt, Homo sapiens
ggcgguggccaucauauuc

SEQ ID NO: 1090978 - RNA, 19 nt, Homo sapiens
caagggcacggaacauuac

SEQ ID NO: 1090979 - RNA, 19 nt, Homo sapiens
gcgaccaauuucagugaca

SEQ ID NO: 1090980 - RNA, 19 nt, Homo sapiens
aacagaccuucuuguaaau

SEQ ID NO: 1090981 - RNA, 19 nt, Homo sapiens
acuuuaggguccugauuug

SEQ ID NO: 1090982 - RNA, 19 nt, Homo sapiens
ugacgcaugaaggagauua

SEQ ID NO: 1090983 - RNA, 19 nt, Homo sapiens
gguugacgccucaggugaa

SEQ ID NO: 1090984 - RNA, 19 nt, Homo sapiens
uggcugguguuccggaaau

SEQ ID NO: 1090985 - RNA, 19 nt, Homo sapiens
acgugaggcugcugaacaa

SEQ ID NO: 1090986 - RNA, 19 nt, Homo sapiens
ggugcagugugaacagaca

SEQ ID NO: 1090987 - RNA, 19 nt, Homo sapiens
caccugcgacucagagcua

SEQ ID NO: 1090988 - RNA, 19 nt, Homo sapiens
gcgguggccaucauauuca

SEQ ID NO: 1090989 - RNA, 19 nt, Homo sapiens
acagaccuucuuguaaaua

SEQ ID NO: 1090990 - RNA, 19 nt, Homo sapiens
aaccaagaccuucccauuc

SEQ ID NO: 1090991 - RNA, 19 nt, Homo sapiens
cacucugacugcuggcuuu

SEQ ID NO: 1090992 - RNA, 19 nt, Homo sapiens
ggacuauauacuguuaaug

SEQ ID NO: 1090993 - RNA, 19 nt, Homo sapiens
ugcuggaaauggagaagaa

SEQ ID NO: 1090994 - RNA, 19 nt, Homo sapiens
caaaggagaugguuaaugu

SEQ ID NO: 1090995 - RNA, 19 nt, Homo sapiens
ggaagcaccugacuacgaa

SEQ ID NO: 1090996 - RNA, 19 nt, Homo sapiens
ccagagaccucccugauga

SEQ ID NO: 1090997 - RNA, 19 nt, Homo sapiens
ggagaugguuaaugugaaa

SEQ ID NO: 1090998 - RNA, 19 nt, Homo sapiens
caagaagccugcugaguuc

SEQ ID NO: 1090999 - RNA, 19 nt, Homo sapiens
ucaacuggcugggcaauuu

SEQ ID NO: 1091000 - RNA, 19 nt, Homo sapiens
ccaaaucuguuuacacauc

SEQ ID NO: 1091001 - RNA, 19 nt, Homo sapiens
ucaagaagccugcugaguu

SEQ ID NO: 1091002 - RNA, 19 nt, Homo sapiens
gcagauaauugggaacugu

SEQ ID NO: 1091003 - RNA, 19 nt, Homo sapiens
guacucaucuuuuaccuaa

SEQ ID NO: 1091004 - RNA, 19 nt, Homo sapiens
gcauauuucuucacugagu

SEQ ID NO: 1091005 - RNA, 19 nt, Homo sapiens
gggaaccuguggaugauga

SEQ ID NO: 1091006 - RNA, 19 nt, Homo sapiens
gcucagcacuuccugucuu

SEQ ID NO: 1091007 - RNA, 19 nt, Homo sapiens
gcugggcaauuucuacauu

SEQ ID NO: 1091008 - RNA, 19 nt, Homo sapiens
cuaaugguguccucaguug

SEQ ID NO: 1091009 - RNA, 19 nt, Homo sapiens
gauccgcgaguguauuaua

SEQ ID NO: 1091010 - RNA, 19 nt, Homo sapiens
caaaucuguuuacacauca

SEQ ID NO: 1091011 - RNA, 19 nt, Homo sapiens
gcguaacaaugucuaccua

SEQ ID NO: 1091012 - RNA, 19 nt, Homo sapiens
agagccaucugcacuauug

SEQ ID NO: 1091013 - RNA, 19 nt, Homo sapiens
ucccaaaucuguuuacaca

SEQ ID NO: 1091014 - RNA, 19 nt, Homo sapiens
gagaggauccgcgagugua

SEQ ID NO: 1091015 - RNA, 19 nt, Homo sapiens
cuauagcucuccacucuuc

SEQ ID NO: 1091016 - RNA, 19 nt, Homo sapiens
uugcauauuucuucacuga

SEQ ID NO: 1091017 - RNA, 19 nt, Homo sapiens
ucaccacaguuucauccua

SEQ ID NO: 1091018 - RNA, 19 nt, Homo sapiens
guccuaagcucagcacuuc

SEQ ID NO: 1091019 - RNA, 19 nt, Homo sapiens
cuucagccaucagcaauaa

SEQ ID NO: 1091020 - RNA, 19 nt, Homo sapiens
gcacuauugcauaaucuga

SEQ ID NO: 1091021 - RNA, 19 nt, Homo sapiens
gaagacccagcaccaguga

SEQ ID NO: 1091022 - RNA, 19 nt, Homo sapiens
caaccugucccucaucuuc

SEQ ID NO: 1091023 - RNA, 19 nt, Homo sapiens
caugcaggguaccuccuua

SEQ ID NO: 1091024 - RNA, 19 nt, Homo sapiens
gcgaguguauuauaucaac

SEQ ID NO: 1091025 - RNA, 19 nt, Homo sapiens
gggccugucugugcucauu

SEQ ID NO: 1091026 - RNA, 19 nt, Homo sapiens
caccucggcuucagucaug

SEQ ID NO: 1091027 - RNA, 19 nt, Homo sapiens
guaacaaugucuaccuacu

SEQ ID NO: 1091028 - RNA, 19 nt, Homo sapiens
caagaacaaggccaacaga

SEQ ID NO: 1091029 - RNA, 19 nt, Homo sapiens
ugugucaucuccucuccua

SEQ ID NO: 1091030 - RNA, 19 nt, Homo sapiens
gccaugacgcagauaauug

SEQ ID NO: 1091031 - RNA, 19 nt, Homo sapiens
agacaguggugacguugau

SEQ ID NO: 1091032 - RNA, 19 nt, Homo sapiens
gaagaugccaccgucaaca

SEQ ID NO: 1091033 - RNA, 19 nt, Homo sapiens
gcugaguucaccacaguuu

SEQ ID NO: 1091034 - RNA, 19 nt, Homo sapiens
ccgcgaguguauuauauca

SEQ ID NO: 1091035 - RNA, 19 nt, Homo sapiens
gaccagagaccucccugau

SEQ ID NO: 1091036 - RNA, 19 nt, Homo sapiens
gccaucagcaauaaaguug

SEQ ID NO: 1091037 - RNA, 19 nt, Homo sapiens
guugugggcuucuauagcu

SEQ ID NO: 1091038 - RNA, 19 nt, Homo sapiens
gcucaacggcucccucauc

SEQ ID NO: 1091039 - RNA, 19 nt, Homo sapiens
caaaaugggcguaacaaug

SEQ ID NO: 1091040 - RNA, 19 nt, Homo sapiens
gaucccaaaucuguuuaca

SEQ ID NO: 1091041 - RNA, 19 nt, Homo sapiens
ccugcuggcugccuuuaga

SEQ ID NO: 1091042 - RNA, 19 nt, Homo sapiens
agaacaaggccaacagaga

SEQ ID NO: 1091043 - RNA, 19 nt, Homo sapiens
cugggaagcugcuagucaa

SEQ ID NO: 1091044 - RNA, 19 nt, Homo sapiens
caacggcucccucauccau

SEQ ID NO: 1091045 - RNA, 19 nt, Homo sapiens
cccaggguuugcuuuguuu

SEQ ID NO: 1091046 - RNA, 19 nt, Homo sapiens
caugauuugaugugcaaua

SEQ ID NO: 1091047 - RNA, 19 nt, Homo sapiens
gguccuggcucugcagaca

SEQ ID NO: 1091048 - RNA, 19 nt, Homo sapiens
cucgagcugugcaccuuua

SEQ ID NO: 1091049 - RNA, 19 nt, Homo sapiens
ccaaaggagaugguuaaug

SEQ ID NO: 1091050 - RNA, 19 nt, Homo sapiens
gaucccaggguuugcuuug

SEQ ID NO: 1091051 - RNA, 19 nt, Homo sapiens
guacauccucugccacauc

SEQ ID NO: 1091052 - RNA, 19 nt, Homo sapiens
aaggagaugguuaauguga

SEQ ID NO: 1091053 - RNA, 19 nt, Homo sapiens
cuuccugucuucucucgaa

SEQ ID NO: 1091054 - RNA, 19 nt, Homo sapiens
agaggguccugcuggagaa

SEQ ID NO: 1091055 - RNA, 19 nt, Homo sapiens
ccacagccaggaccagaga

SEQ ID NO: 1091056 - RNA, 19 nt, Homo sapiens
ucccaggguuugcuuuguu

SEQ ID NO: 1091057 - RNA, 19 nt, Homo sapiens
gcaacugcuggaugaaugu

SEQ ID NO: 1091058 - RNA, 19 nt, Homo sapiens
aggauccgcgaguguauua

SEQ ID NO: 1091059 - RNA, 19 nt, Homo sapiens
ccugaucccaaaucuguuu

SEQ ID NO: 1091060 - RNA, 19 nt, Homo sapiens
cuacaacgcagccuuugca

SEQ ID NO: 1091061 - RNA, 19 nt, Homo sapiens
ucaguugugggcuucuaua

SEQ ID NO: 1091062 - RNA, 19 nt, Homo sapiens
guauggaagcaccugacua

SEQ ID NO: 1091063 - RNA, 19 nt, Homo sapiens
gcccuuugcauauuucuuc

SEQ ID NO: 1091064 - RNA, 19 nt, Homo sapiens
uaacaaugucuaccuacuc

SEQ ID NO: 1091065 - RNA, 19 nt, Homo sapiens
aaaguugaucccaggguuu

SEQ ID NO: 1091066 - RNA, 19 nt, Homo sapiens
gcuucagccaucagcaaua

SEQ ID NO: 1091067 - RNA, 19 nt, Homo sapiens
gaugccaccgucaacaaga

SEQ ID NO: 1091068 - RNA, 19 nt, Homo sapiens
caacuggcugggcaauuuc

SEQ ID NO: 1091069 - RNA, 19 nt, Homo sapiens
cugcugaguucaccacagu

SEQ ID NO: 1091070 - RNA, 19 nt, Homo sapiens
gguccuaagcucagcacuu

SEQ ID NO: 1091071 - RNA, 19 nt, Homo sapiens
ucuccaagcugggcuccuu

SEQ ID NO: 1091072 - RNA, 19 nt, Homo sapiens
gaggauccgcgaguguauu

SEQ ID NO: 1091073 - RNA, 19 nt, Homo sapiens
ugaguucaccacaguuuca

SEQ ID NO: 1091074 - RNA, 19 nt, Homo sapiens
ccucuacaacgcagccuuu

SEQ ID NO: 1091075 - RNA, 19 nt, Homo sapiens
uauggaagcaccugacuac

SEQ ID NO: 1091076 - RNA, 19 nt, Homo sapiens
aaaaugggcguaacaaugu

SEQ ID NO: 1091077 - RNA, 19 nt, Homo sapiens
gaaccugaagugagcaacu

SEQ ID NO: 1091078 - RNA, 19 nt, Homo sapiens
uggaagcaccugacuacga

SEQ ID NO: 1091079 - RNA, 19 nt, Homo sapiens
ucauucagguuguacucau

SEQ ID NO: 1091080 - RNA, 19 nt, Homo sapiens
gagacaguggugacguuga

SEQ ID NO: 1091081 - RNA, 19 nt, Homo sapiens
aggagaugguuaaugugaa

SEQ ID NO: 1091082 - RNA, 19 nt, Homo sapiens
agggcaggcucgggagaua

SEQ ID NO: 1091083 - RNA, 19 nt, Homo sapiens
uucuauagcucuccacucu

SEQ ID NO: 1091084 - RNA, 19 nt, Homo sapiens
gacauggagcugcuacaca

SEQ ID NO: 1091085 - RNA, 19 nt, Homo sapiens
cuccugcccuucuccauca

SEQ ID NO: 1091086 - RNA, 19 nt, Homo sapiens
gcaccucggcuucagucau

SEQ ID NO: 1091087 - RNA, 19 nt, Homo sapiens
uacauuguguuccucuaca

SEQ ID NO: 1091088 - RNA, 19 nt, Homo sapiens
ccaugacgcagauaauugg

SEQ ID NO: 1091089 - RNA, 19 nt, Homo sapiens
cacaguuucauccuacaaa

SEQ ID NO: 1091090 - RNA, 19 nt, Homo sapiens
ccucaguugugggcuucua

SEQ ID NO: 1091091 - RNA, 19 nt, Homo sapiens
ucagguuguacucaucuuu

SEQ ID NO: 1091092 - RNA, 19 nt, Homo sapiens
uggaggagcagcuguacug

SEQ ID NO: 1091093 - RNA, 19 nt, Homo sapiens
gacaagaacaaggccaaca

SEQ ID NO: 1091094 - RNA, 19 nt, Homo sapiens
gaaagaacgugaaugcuua

SEQ ID NO: 1091095 - RNA, 19 nt, Homo sapiens
gcauaaagcugauguugua

SEQ ID NO: 1091096 - RNA, 19 nt, Homo sapiens
gcaaagacuuauugaauga

SEQ ID NO: 1091097 - RNA, 19 nt, Homo sapiens
ggaaguauggguaguauua

SEQ ID NO: 1091098 - RNA, 19 nt, Homo sapiens
ggacaaguuugacuaguuu

SEQ ID NO: 1091099 - RNA, 19 nt, Homo sapiens
uaaagaaacuguugcuuga

SEQ ID NO: 1091100 - RNA, 19 nt, Homo sapiens
gcagaaacauuuaaacuag

SEQ ID NO: 1091101 - RNA, 19 nt, Homo sapiens
gaacuugaaucuagaggaa

SEQ ID NO: 1091102 - RNA, 19 nt, Homo sapiens
uaaagaaucuccuccaaga

SEQ ID NO: 1091103 - RNA, 19 nt, Homo sapiens
gaacgugaaugcuuaagau

SEQ ID NO: 1091104 - RNA, 19 nt, Homo sapiens
cuugaaagccuucuuauua

SEQ ID NO: 1091105 - RNA, 19 nt, Homo sapiens
gaagagugacagcuuaaua

SEQ ID NO: 1091106 - RNA, 19 nt, Homo sapiens
ccaagaaagcucuaaauaa

SEQ ID NO: 1091107 - RNA, 19 nt, Homo sapiens
ggugaggucuuugauauuu

SEQ ID NO: 1091108 - RNA, 19 nt, Homo sapiens
gcagggagcaguucucuuu

SEQ ID NO: 1091109 - RNA, 19 nt, Homo sapiens
cacaacagcuccuaaagaa

SEQ ID NO: 1091110 - RNA, 19 nt, Homo sapiens
aaacaaggcagaaacauuu

SEQ ID NO: 1091111 - RNA, 19 nt, Homo sapiens
gcaucuauguugagaguaa

SEQ ID NO: 1091112 - RNA, 19 nt, Homo sapiens
gcagucguauucagagaua

SEQ ID NO: 1091113 - RNA, 19 nt, Homo sapiens
gaaaggugauacauuagug

SEQ ID NO: 1091114 - RNA, 19 nt, Homo sapiens
uuggaaaggugauacauua

SEQ ID NO: 1091115 - RNA, 19 nt, Homo sapiens
aagaagagcuaugcagaua

SEQ ID NO: 1091116 - RNA, 19 nt, Homo sapiens
caagagagauacaaacaag

SEQ ID NO: 1091117 - RNA, 19 nt, Homo sapiens
ggcaaagacuuauugaaug

SEQ ID NO: 1091118 - RNA, 19 nt, Homo sapiens
gcuaugacgugcucuguga

SEQ ID NO: 1091119 - RNA, 19 nt, Homo sapiens
gcaccaaacuauggaagaa

SEQ ID NO: 1091120 - RNA, 19 nt, Homo sapiens
gcacaacagcuccuaaaga

SEQ ID NO: 1091121 - RNA, 19 nt, Homo sapiens
ugauagagcagccuuauuu

SEQ ID NO: 1091122 - RNA, 19 nt, Homo sapiens
acacagagcugaguauugu

SEQ ID NO: 1091123 - RNA, 19 nt, Homo sapiens
gguauugaauggacaaguu

SEQ ID NO: 1091124 - RNA, 19 nt, Homo sapiens
gcagauaacauucuuucuu

SEQ ID NO: 1091125 - RNA, 19 nt, Homo sapiens
ggaaacaagugcagauaac

SEQ ID NO: 1091126 - RNA, 19 nt, Homo sapiens
aaugugaccuuucguauau

SEQ ID NO: 1091127 - RNA, 19 nt, Homo sapiens
gaagagcuaugcagauaac

SEQ ID NO: 1091128 - RNA, 19 nt, Homo sapiens
uaggagugcuacagaauaa

SEQ ID NO: 1091129 - RNA, 19 nt, Homo sapiens
gaaauucacggaacaguag

SEQ ID NO: 1091130 - RNA, 19 nt, Homo sapiens
gccaagaaagcucuaaaua

SEQ ID NO: 1091131 - RNA, 19 nt, Homo sapiens
ggauguagcagcaggagua

SEQ ID NO: 1091132 - RNA, 19 nt, Homo sapiens
acucaucacugcuauauau

SEQ ID NO: 1091133 - RNA, 19 nt, Homo sapiens
ccucaaguauggagcauuu

SEQ ID NO: 1091134 - RNA, 19 nt, Homo sapiens
guacaaugauggagcugaa

SEQ ID NO: 1091135 - RNA, 19 nt, Homo sapiens
gaaguugggugaggaagau

SEQ ID NO: 1091136 - RNA, 19 nt, Homo sapiens
ggagcuuaccuaugauuua

SEQ ID NO: 1091137 - RNA, 19 nt, Homo sapiens
gugaaacggucaacuuaug

SEQ ID NO: 1091138 - RNA, 19 nt, Homo sapiens
gcaacccacuggauauaug

SEQ ID NO: 1091139 - RNA, 19 nt, Homo sapiens
agugacagcuuaauaaaug

SEQ ID NO: 1091140 - RNA, 19 nt, Homo sapiens
uaggugaggucuuugauau

SEQ ID NO: 1091141 - RNA, 19 nt, Homo sapiens
ucaagagacugaaucacuu

SEQ ID NO: 1091142 - RNA, 19 nt, Homo sapiens
gagaaacucaucacugcua

SEQ ID NO: 1091143 - RNA, 19 nt, Homo sapiens
gugcagauaaccagcauua

SEQ ID NO: 1091144 - RNA, 19 nt, Homo sapiens
cuaaagagguucagauggu

SEQ ID NO: 1091145 - RNA, 19 nt, Homo sapiens
cagaguauccagaggaaua

SEQ ID NO: 1091146 - RNA, 19 nt, Homo sapiens
gccgcuaccugcagacaua

SEQ ID NO: 1091147 - RNA, 19 nt, Homo sapiens
gaaauguacagaccagcua

SEQ ID NO: 1091148 - RNA, 19 nt, Homo sapiens
ccagaccuuuccuuagaua

SEQ ID NO: 1091149 - RNA, 19 nt, Homo sapiens
uucaggagcuuaccuauga

SEQ ID NO: 1091150 - RNA, 19 nt, Homo sapiens
caaacaaggcagaaacauu

SEQ ID NO: 1091151 - RNA, 19 nt, Homo sapiens
gcaguucucuuugcuucaa

SEQ ID NO: 1091152 - RNA, 19 nt, Homo sapiens
ugaagagccugagaaagaa

SEQ ID NO: 1091153 - RNA, 19 nt, Homo sapiens
gaaaccuagugcugaauuc

SEQ ID NO: 1091154 - RNA, 19 nt, Homo sapiens
ggcagaaacauuuaaacua

SEQ ID NO: 1091155 - RNA, 19 nt, Homo sapiens
caagaacaguugaauucau

SEQ ID NO: 1091156 - RNA, 19 nt, Homo sapiens
gcaggaggcagaaaguaaa

SEQ ID NO: 1091157 - RNA, 19 nt, Homo sapiens
gagcaacccacuggauaua

SEQ ID NO: 1091158 - RNA, 19 nt, Homo sapiens
ggacuugaaaggcagagua

SEQ ID NO: 1091159 - RNA, 19 nt, Homo sapiens
gaacuuagucagaacaucu

SEQ ID NO: 1091160 - RNA, 19 nt, Homo sapiens
aacauuggcucaccauauu

SEQ ID NO: 1091161 - RNA, 19 nt, Homo sapiens
ggaagaacccauugaagag

SEQ ID NO: 1091162 - RNA, 19 nt, Homo sapiens
caaaggcucuccugguucu

SEQ ID NO: 1091163 - RNA, 19 nt, Homo sapiens
gaaagccuguuuagucacu

SEQ ID NO: 1091164 - RNA, 19 nt, Homo sapiens
uaaccagcauuauuacugu

SEQ ID NO: 1091165 - RNA, 19 nt, Homo sapiens
ugaaagaggcaaugaugaa

SEQ ID NO: 1091166 - RNA, 19 nt, Homo sapiens
gaauggacaaguuugacua

SEQ ID NO: 1091167 - RNA, 19 nt, Homo sapiens
gcaccacaguuugcuauuc

SEQ ID NO: 1091168 - RNA, 19 nt, Homo sapiens
gagcuuaccuaugauuuac

SEQ ID NO: 1091169 - RNA, 19 nt, Homo sapiens
ucagcgugaugguuuauuu

SEQ ID NO: 1091170 - RNA, 19 nt, Homo sapiens
uuugaucccucacauuuaa

SEQ ID NO: 1091171 - RNA, 19 nt, Homo sapiens
gagcuaugcagauaacauu

SEQ ID NO: 1091172 - RNA, 19 nt, Homo sapiens
gaagaagagcuaugcagau

SEQ ID NO: 1091173 - RNA, 19 nt, Homo sapiens
ucagaaauuucagcuagaa

SEQ ID NO: 1091174 - RNA, 19 nt, Homo sapiens
cauguugacuauccagaaa

SEQ ID NO: 1091175 - RNA, 19 nt, Homo sapiens
uagaauggaugaacaagag

SEQ ID NO: 1091176 - RNA, 19 nt, Homo sapiens
gcgauuuacugcuugcuau

SEQ ID NO: 1091177 - RNA, 19 nt, Homo sapiens
caagaugcuucccgcgauu

SEQ ID NO: 1091178 - RNA, 19 nt, Homo sapiens
uaacauuggcucaccauau

SEQ ID NO: 1091179 - RNA, 19 nt, Homo sapiens
guugaaguaugagauguaa

SEQ ID NO: 1091180 - RNA, 19 nt, Homo sapiens
gaagaacaucccagagguu

SEQ ID NO: 1091181 - RNA, 19 nt, Homo sapiens
agagaaaccuagugcugaa

SEQ ID NO: 1091182 - RNA, 19 nt, Homo sapiens
cauaggagguuuuaagauu

SEQ ID NO: 1091183 - RNA, 19 nt, Homo sapiens
caaggaagaacccauugaa

SEQ ID NO: 1091184 - RNA, 19 nt, Homo sapiens
gauuaugcccggaguuuga

SEQ ID NO: 1091185 - RNA, 19 nt, Homo sapiens
agcaugagauacuuugaua

SEQ ID NO: 1091186 - RNA, 19 nt, Homo sapiens
gaaggaaacucaguaaaag

SEQ ID NO: 1091187 - RNA, 19 nt, Homo sapiens
uaucucauuugaagcagua

SEQ ID NO: 1091188 - RNA, 19 nt, Homo sapiens
ccaguggucugcuacacaa

SEQ ID NO: 1091189 - RNA, 19 nt, Homo sapiens
ucccagaccuuuccuuaga

SEQ ID NO: 1091190 - RNA, 19 nt, Homo sapiens
gguagugauugauuccauu

SEQ ID NO: 1091191 - RNA, 19 nt, Homo sapiens
cuacugcucuugggucaaa

SEQ ID NO: 1091192 - RNA, 19 nt, Homo sapiens
gcugaagugugggauacua

SEQ ID NO: 1091193 - RNA, 19 nt, Homo sapiens
uguaucaucucacuguuga

SEQ ID NO: 1091194 - RNA, 19 nt, Homo sapiens
cuaaaggacugcuguguaa

SEQ ID NO: 1091195 - RNA, 19 nt, Homo sapiens
ggagguggauaaaguacua

SEQ ID NO: 1091196 - RNA, 19 nt, Homo sapiens
uaaagagaguguauacuga

SEQ ID NO: 1091197 - RNA, 19 nt, Homo sapiens
ggagaucgauguguacuug

SEQ ID NO: 1091198 - RNA, 19 nt, Homo sapiens
ggacugcuguguaagcuau

SEQ ID NO: 1091199 - RNA, 19 nt, Homo sapiens
guaaacaggagguggauaa

SEQ ID NO: 1091200 - RNA, 19 nt, Homo sapiens
gaagguagagcuugagaug

SEQ ID NO: 1091201 - RNA, 19 nt, Homo sapiens
gaagccggaugcacaauca

SEQ ID NO: 1091202 - RNA, 19 nt, Homo sapiens
ucaagauccugaugaagaa

SEQ ID NO: 1091203 - RNA, 19 nt, Homo sapiens
gguggcaugugguaccuua

SEQ ID NO: 1091204 - RNA, 19 nt, Homo sapiens
gcggagagaucgagcugaa

SEQ ID NO: 1091205 - RNA, 19 nt, Homo sapiens
acacggagcucgucaaguc

SEQ ID NO: 1091206 - RNA, 19 nt, Homo sapiens
gggaguucauucugccuua

SEQ ID NO: 1091207 - RNA, 19 nt, Homo sapiens
ccucgaagcugauggacaa

SEQ ID NO: 1091208 - RNA, 19 nt, Homo sapiens
ugaagaggaugacccaguu

SEQ ID NO: 1091209 - RNA, 19 nt, Homo sapiens
ggugaagagugacauccua

SEQ ID NO: 1091210 - RNA, 19 nt, Homo sapiens
uaaaggaaaccaugccaaa

SEQ ID NO: 1091211 - RNA, 19 nt, Homo sapiens
caacaaaggcugggaguuc

SEQ ID NO: 1091212 - RNA, 19 nt, Homo sapiens
gagaguguauacugacaug

SEQ ID NO: 1091213 - RNA, 19 nt, Homo sapiens
ggaacuggguggugaagag

SEQ ID NO: 1091214 - RNA, 19 nt, Homo sapiens
uuagaucacucccagaaga

SEQ ID NO: 1091215 - RNA, 19 nt, Homo sapiens
gcaaaucuaagcccaagga

SEQ ID NO: 1091216 - RNA, 19 nt, Homo sapiens
ccucuaguauggccaauga

SEQ ID NO: 1091217 - RNA, 19 nt, Homo sapiens
ggaacugaccaucucauga

SEQ ID NO: 1091218 - RNA, 19 nt, Homo sapiens
cagagccgcugggugguua

SEQ ID NO: 1091219 - RNA, 19 nt, Homo sapiens
cggaaaagcuguaucuauu

SEQ ID NO: 1091220 - RNA, 19 nt, Homo sapiens
gggagcagauugcgcugaa

SEQ ID NO: 1091221 - RNA, 19 nt, Homo sapiens
gaacucaagcgccucuuca

SEQ ID NO: 1091222 - RNA, 19 nt, Homo sapiens
ccuaugaguuccugcagaa

SEQ ID NO: 1091223 - RNA, 19 nt, Homo sapiens
gcagggucagcuuaaguua

SEQ ID NO: 1091224 - RNA, 19 nt, Homo sapiens
gaacugaccaucucaugac

SEQ ID NO: 1091225 - RNA, 19 nt, Homo sapiens
aaucuaagcccaaggaaga

SEQ ID NO: 1091226 - RNA, 19 nt, Homo sapiens
ucaagaguguggagaagau

SEQ ID NO: 1091227 - RNA, 19 nt, Homo sapiens
gaucagcaucgacagguuu

SEQ ID NO: 1091228 - RNA, 19 nt, Homo sapiens
cagcuuaaguuaguuagau

SEQ ID NO: 1091229 - RNA, 19 nt, Homo sapiens
ggcuggcucuccucuagua

SEQ ID NO: 1091230 - RNA, 19 nt, Homo sapiens
gaagagugacauccuauac

SEQ ID NO: 1091231 - RNA, 19 nt, Homo sapiens
gaccuucuuugcaguacaa

SEQ ID NO: 1091232 - RNA, 19 nt, Homo sapiens
ucaagaagcacccggaugu

SEQ ID NO: 1091233 - RNA, 19 nt, Homo sapiens
ggucagcuuaaguuaguua

SEQ ID NO: 1091234 - RNA, 19 nt, Homo sapiens
cgacacagagcaagaggaa

SEQ ID NO: 1091235 - RNA, 19 nt, Homo sapiens
ucaagcgccucuucaaucu

SEQ ID NO: 1091236 - RNA, 19 nt, Homo sapiens
gcaguggacagaagggauu

SEQ ID NO: 1091237 - RNA, 19 nt, Homo sapiens
aggaaaccaugccaaagaa

SEQ ID NO: 1091238 - RNA, 19 nt, Homo sapiens
gagacuucguuauguggaa

SEQ ID NO: 1091239 - RNA, 19 nt, Homo sapiens
gaacacggagcucgucaag

SEQ ID NO: 1091240 - RNA, 19 nt, Homo sapiens
ggguccaccugcauuacua

SEQ ID NO: 1091241 - RNA, 19 nt, Homo sapiens
guacagucuugacaauagu

SEQ ID NO: 1091242 - RNA, 19 nt, Homo sapiens
ggacaguacagucuugaca

SEQ ID NO: 1091243 - RNA, 19 nt, Homo sapiens
ggaaaagcuguaucuauuu

SEQ ID NO: 1091244 - RNA, 19 nt, Homo sapiens
uggauaaaguacuaaagga

SEQ ID NO: 1091245 - RNA, 19 nt, Homo sapiens
aacaggagguggauaaagu

SEQ ID NO: 1091246 - RNA, 19 nt, Homo sapiens
ccaagagucuggcggaaaa

SEQ ID NO: 1091247 - RNA, 19 nt, Homo sapiens
ugaagaaugugaaggucau

SEQ ID NO: 1091248 - RNA, 19 nt, Homo sapiens
gaugaccuacgaugacauu

SEQ ID NO: 1091249 - RNA, 19 nt, Homo sapiens
ggaggccaccuuucagaga

SEQ ID NO: 1091250 - RNA, 19 nt, Homo sapiens
ggccgagacuucguuaugu

SEQ ID NO: 1091251 - RNA, 19 nt, Homo sapiens
gacgagaccagcacguauu

SEQ ID NO: 1091252 - RNA, 19 nt, Homo sapiens
ggccucgacuugcuucaga

SEQ ID NO: 1091253 - RNA, 19 nt, Homo sapiens
aaaccaaggcccagcagaa

SEQ ID NO: 1091254 - RNA, 19 nt, Homo sapiens
ggaguucauucugccuuau

SEQ ID NO: 1091255 - RNA, 19 nt, Homo sapiens
ccaagcagcagaagguaga

SEQ ID NO: 1091256 - RNA, 19 nt, Homo sapiens
ccgaggaugugaaggacuu

SEQ ID NO: 1091257 - RNA, 19 nt, Homo sapiens
acaguacagucuugacaau

SEQ ID NO: 1091258 - RNA, 19 nt, Homo sapiens
agacaugagugaucagcau

SEQ ID NO: 1091259 - RNA, 19 nt, Homo sapiens
ugaagagugacauccuaua

SEQ ID NO: 1091260 - RNA, 19 nt, Homo sapiens
gaagaggaugacccaguug

SEQ ID NO: 1091261 - RNA, 19 nt, Homo sapiens
gugaguaccugaugaugcu

SEQ ID NO: 1091262 - RNA, 19 nt, Homo sapiens
gguuucauucccauaauaa

SEQ ID NO: 1091263 - RNA, 19 nt, Homo sapiens
ugguuucauucccauaaua

SEQ ID NO: 1091264 - RNA, 19 nt, Homo sapiens
aaggaaaccaugccaaaga

SEQ ID NO: 1091265 - RNA, 19 nt, Homo sapiens
gggccgagacuucguuaug

SEQ ID NO: 1091266 - RNA, 19 nt, Homo sapiens
uccagaagguggcgauguu

SEQ ID NO: 1091267 - RNA, 19 nt, Homo sapiens
cuucuuugcaguacaauuu

SEQ ID NO: 1091268 - RNA, 19 nt, Homo sapiens
aguacagucuugacaauag

SEQ ID NO: 1091269 - RNA, 19 nt, Homo sapiens
cgacagguuuugcuugaaa

SEQ ID NO: 1091270 - RNA, 19 nt, Homo sapiens
ggaccagcggauccaagua

SEQ ID NO: 1091271 - RNA, 19 nt, Homo sapiens
gccaggaggaggagaaaga

SEQ ID NO: 1091272 - RNA, 19 nt, Homo sapiens
auaaagagaguguauacug

SEQ ID NO: 1091273 - RNA, 19 nt, Homo sapiens
cuacuaacccagcaaaucu

SEQ ID NO: 1091274 - RNA, 19 nt, Homo sapiens
gcuaugguggcauguggua

SEQ ID NO: 1091275 - RNA, 19 nt, Homo sapiens
gccgagacuucguuaugug

SEQ ID NO: 1091276 - RNA, 19 nt, Homo sapiens
aagaggaacugaccaucuc

SEQ ID NO: 1091277 - RNA, 19 nt, Homo sapiens
caagaggaacugaccaucu

SEQ ID NO: 1091278 - RNA, 19 nt, Homo sapiens
cggguacgccgaaacauga

SEQ ID NO: 1091279 - RNA, 19 nt, Homo sapiens
gggaguucaucaagaagca

SEQ ID NO: 1091280 - RNA, 19 nt, Homo sapiens
cagccucgaugaccuacga

SEQ ID NO: 1091281 - RNA, 19 nt, Homo sapiens
aagaagggcggaaccagaa

SEQ ID NO: 1091282 - RNA, 19 nt, Homo sapiens
gcugggugguuaggaaaga

SEQ ID NO: 1091283 - RNA, 19 nt, Homo sapiens
ccagcaacguccugucgau

SEQ ID NO: 1091284 - RNA, 19 nt, Homo sapiens
cgaagcugauggacaagca

SEQ ID NO: 1091285 - RNA, 19 nt, Homo sapiens
gcaccucucagccaagauc

SEQ ID NO: 1091286 - RNA, 19 nt, Homo sapiens
ucucaugaccuguggcauu

SEQ ID NO: 1091287 - RNA, 19 nt, Homo sapiens
gacaguacagucuugacaa

SEQ ID NO: 1091288 - RNA, 19 nt, Homo sapiens
uaaagggacaguacagucu

SEQ ID NO: 1091289 - RNA, 19 nt, Homo sapiens
ccucuucaaucugcacuug

SEQ ID NO: 1091290 - RNA, 19 nt, Homo sapiens
gaccagcggauccaaguag

SEQ ID NO: 1091291 - RNA, 19 nt, Homo sapiens
gcacguauuccucgaagcu

SEQ ID NO: 1091292 - RNA, 19 nt, Homo sapiens
aaacuacuaacccagcaaa

SEQ ID NO: 1091293 - RNA, 19 nt, Homo sapiens
acuaaaggacugcugugua

SEQ ID NO: 1091294 - RNA, 19 nt, Homo sapiens
gcauaaaucucuucuguaa

SEQ ID NO: 1091295 - RNA, 19 nt, Homo sapiens
gcagacaccugaauucuuu

SEQ ID NO: 1091296 - RNA, 19 nt, Homo sapiens
gaacuaaggugaaagacuu

SEQ ID NO: 1091297 - RNA, 19 nt, Homo sapiens
gaaguuaguuguucucauu

SEQ ID NO: 1091298 - RNA, 19 nt, Homo sapiens
cuacugaguuggagaauua

SEQ ID NO: 1091299 - RNA, 19 nt, Homo sapiens
cuaaagaucuggacaaguu

SEQ ID NO: 1091300 - RNA, 19 nt, Homo sapiens
gaaacagauuccuuuagua

SEQ ID NO: 1091301 - RNA, 19 nt, Homo sapiens
gaaaugauaccuucaguga

SEQ ID NO: 1091302 - RNA, 19 nt, Homo sapiens
gagaugaagucacuaaaga

SEQ ID NO: 1091303 - RNA, 19 nt, Homo sapiens
uaaaugaacucuccaguca

SEQ ID NO: 1091304 - RNA, 19 nt, Homo sapiens
ggagagaguucaggaaauu

SEQ ID NO: 1091305 - RNA, 19 nt, Homo sapiens
uaaacaagcuacugaguug

SEQ ID NO: 1091306 - RNA, 19 nt, Homo sapiens
ccaagaaccuaaacugauu

SEQ ID NO: 1091307 - RNA, 19 nt, Homo sapiens
gagaaucuaugauaccaaa

SEQ ID NO: 1091308 - RNA, 19 nt, Homo sapiens
guaugaagcugguaaugaa

SEQ ID NO: 1091309 - RNA, 19 nt, Homo sapiens
gcucuaagcagaauaaauu

SEQ ID NO: 1091310 - RNA, 19 nt, Homo sapiens
ggaagucacuauucauuca

SEQ ID NO: 1091311 - RNA, 19 nt, Homo sapiens
gaagaaaguuuagguuaca

SEQ ID NO: 1091312 - RNA, 19 nt, Homo sapiens
ggaaaagucugcaauuaaa

SEQ ID NO: 1091313 - RNA, 19 nt, Homo sapiens
ggaguagaaaggauuauua

SEQ ID NO: 1091314 - RNA, 19 nt, Homo sapiens
gaacaaaggaaacagaaug

SEQ ID NO: 1091315 - RNA, 19 nt, Homo sapiens
uaaagucacuggaagaaau

SEQ ID NO: 1091316 - RNA, 19 nt, Homo sapiens
gauccaugguuauuccuua

SEQ ID NO: 1091317 - RNA, 19 nt, Homo sapiens
gacagaagcuugaaacucu

SEQ ID NO: 1091318 - RNA, 19 nt, Homo sapiens
aagcugacaucuucaauaa

SEQ ID NO: 1091319 - RNA, 19 nt, Homo sapiens
ccaguuaacuccucuuguu

SEQ ID NO: 1091320 - RNA, 19 nt, Homo sapiens
ucacuagccuccaaauauu

SEQ ID NO: 1091321 - RNA, 19 nt, Homo sapiens
ggacagagcaguuugaaag

SEQ ID NO: 1091322 - RNA, 19 nt, Homo sapiens
uaauguaucuucagggaaa

SEQ ID NO: 1091323 - RNA, 19 nt, Homo sapiens
gaacacaaagcaaagacua

SEQ ID NO: 1091324 - RNA, 19 nt, Homo sapiens
caagcagucuuuccuuaaa

SEQ ID NO: 1091325 - RNA, 19 nt, Homo sapiens
gaacagaaacuggacuuga

SEQ ID NO: 1091326 - RNA, 19 nt, Homo sapiens
ggagagccauccuuugguu

SEQ ID NO: 1091327 - RNA, 19 nt, Homo sapiens
ggaaagaaagugaagauuc

SEQ ID NO: 1091328 - RNA, 19 nt, Homo sapiens
gaacuaaagagguugagaa

SEQ ID NO: 1091329 - RNA, 19 nt, Homo sapiens
gcugacaucuucaauaaca

SEQ ID NO: 1091330 - RNA, 19 nt, Homo sapiens
uuuaagagguagcccauua

SEQ ID NO: 1091331 - RNA, 19 nt, Homo sapiens
gagguuaagcuguaaagua

SEQ ID NO: 1091332 - RNA, 19 nt, Homo sapiens
ucaauaagagccuuucaua

SEQ ID NO: 1091333 - RNA, 19 nt, Homo sapiens
caaaggagaugaagucacu

SEQ ID NO: 1091334 - RNA, 19 nt, Homo sapiens
gaaccgccaugaagagaga

SEQ ID NO: 1091335 - RNA, 19 nt, Homo sapiens
ggauauguauggcaaacuu

SEQ ID NO: 1091336 - RNA, 19 nt, Homo sapiens
caaaugugccacuugaaua

SEQ ID NO: 1091337 - RNA, 19 nt, Homo sapiens
uuaccaggaucgugaaaua

SEQ ID NO: 1091338 - RNA, 19 nt, Homo sapiens
gcaacuacaagaagacaua

SEQ ID NO: 1091339 - RNA, 19 nt, Homo sapiens
gagaaugucaggccacuuu

SEQ ID NO: 1091340 - RNA, 19 nt, Homo sapiens
gcauuuggguucucaugaa

SEQ ID NO: 1091341 - RNA, 19 nt, Homo sapiens
cagcaaaugugccacuuga

SEQ ID NO: 1091342 - RNA, 19 nt, Homo sapiens
caguauaccuuggauuuaa

SEQ ID NO: 1091343 - RNA, 19 nt, Homo sapiens
gaagaagacaguacagaug

SEQ ID NO: 1091344 - RNA, 19 nt, Homo sapiens
cuaauaaggccgauucuaa

SEQ ID NO: 1091345 - RNA, 19 nt, Homo sapiens
caaaggagaaggagacaaa

SEQ ID NO: 1091346 - RNA, 19 nt, Homo sapiens
cuaaagagguugagaaagg

SEQ ID NO: 1091347 - RNA, 19 nt, Homo sapiens
gacaggaagcagucaauua

SEQ ID NO: 1091348 - RNA, 19 nt, Homo sapiens
ggaagagguuaagcuguaa

SEQ ID NO: 1091349 - RNA, 19 nt, Homo sapiens
gguagaagcagaauaauag

SEQ ID NO: 1091350 - RNA, 19 nt, Homo sapiens
ugaaacagauuccuuuagu

SEQ ID NO: 1091351 - RNA, 19 nt, Homo sapiens
gaauauggcacuccuacaa

SEQ ID NO: 1091352 - RNA, 19 nt, Homo sapiens
uaaggccgauucuaaugua

SEQ ID NO: 1091353 - RNA, 19 nt, Homo sapiens
uaaauccaguuuccaagaa

SEQ ID NO: 1091354 - RNA, 19 nt, Homo sapiens
gaacaaccagauggcauua

SEQ ID NO: 1091355 - RNA, 19 nt, Homo sapiens
gaagaaauaauggcuuuga

SEQ ID NO: 1091356 - RNA, 19 nt, Homo sapiens
ugaggaagaggaaacauua

SEQ ID NO: 1091357 - RNA, 19 nt, Homo sapiens
ugauguagccguaaaguaa

SEQ ID NO: 1091358 - RNA, 19 nt, Homo sapiens
gcgcuuguaucuugaaguu

SEQ ID NO: 1091359 - RNA, 19 nt, Homo sapiens
gaaucuuggcuauaucuua

SEQ ID NO: 1091360 - RNA, 19 nt, Homo sapiens
cauauuaccugaccuacau

SEQ ID NO: 1091361 - RNA, 19 nt, Homo sapiens
gcacaaggaauuucuaaag

SEQ ID NO: 1091362 - RNA, 19 nt, Homo sapiens
gaacuuacacaaauaccuu

SEQ ID NO: 1091363 - RNA, 19 nt, Homo sapiens
gcaagcagucuuuccuuaa

SEQ ID NO: 1091364 - RNA, 19 nt, Homo sapiens
ugauagagaucgaggcaaa

SEQ ID NO: 1091365 - RNA, 19 nt, Homo sapiens
gauacaaaauggcguguua

SEQ ID NO: 1091366 - RNA, 19 nt, Homo sapiens
gaagagagaaccgccauga

SEQ ID NO: 1091367 - RNA, 19 nt, Homo sapiens
aauaagagccuuucauaga

SEQ ID NO: 1091368 - RNA, 19 nt, Homo sapiens
gguaccagauucuuaauag

SEQ ID NO: 1091369 - RNA, 19 nt, Homo sapiens
ggaaaagcauguuaaaugu

SEQ ID NO: 1091370 - RNA, 19 nt, Homo sapiens
uagaagagcacaaggaauu

SEQ ID NO: 1091371 - RNA, 19 nt, Homo sapiens
cacaagagaaucuaugaua

SEQ ID NO: 1091372 - RNA, 19 nt, Homo sapiens
caugaaagguguuaaagag

SEQ ID NO: 1091373 - RNA, 19 nt, Homo sapiens
aauaauguguggcgucuuu

SEQ ID NO: 1091374 - RNA, 19 nt, Homo sapiens
aggcuuaguuggaguauuu

SEQ ID NO: 1091375 - RNA, 19 nt, Homo sapiens
cugcuuauauugcuuguaa

SEQ ID NO: 1091376 - RNA, 19 nt, Homo sapiens
cagauggcauuauugauga

SEQ ID NO: 1091377 - RNA, 19 nt, Homo sapiens
cacaaggaauuucuaaaga

SEQ ID NO: 1091378 - RNA, 19 nt, Homo sapiens
gaugaagucacuaaagaaa

SEQ ID NO: 1091379 - RNA, 19 nt, Homo sapiens
caucaaauauggaggaagu

SEQ ID NO: 1091380 - RNA, 19 nt, Homo sapiens
aggaagagguuaagcugua

SEQ ID NO: 1091381 - RNA, 19 nt, Homo sapiens
gcaaaugugccacuugaau

SEQ ID NO: 1091382 - RNA, 19 nt, Homo sapiens
uuacagaacuaaggugaaa

SEQ ID NO: 1091383 - RNA, 19 nt, Homo sapiens
uuucaaagccuccugauaa

SEQ ID NO: 1091384 - RNA, 19 nt, Homo sapiens
ucauccaggugaagaaaua

SEQ ID NO: 1091385 - RNA, 19 nt, Homo sapiens
gaagaaugauagagaucga

SEQ ID NO: 1091386 - RNA, 19 nt, Homo sapiens
ccacuugaauaucuaguau

SEQ ID NO: 1091387 - RNA, 19 nt, Homo sapiens
ggacaaagugcuguagaaa

SEQ ID NO: 1091388 - RNA, 19 nt, Homo sapiens
aaucagaauuggagaagaa

SEQ ID NO: 1091389 - RNA, 19 nt, Homo sapiens
gcagagaacgagaacuaaa

SEQ ID NO: 1091390 - RNA, 19 nt, Homo sapiens
gcucuagugucuccaguug

SEQ ID NO: 1091391 - RNA, 19 nt, Homo sapiens
agacgugauucaugaagua

SEQ ID NO: 1091392 - RNA, 19 nt, Homo sapiens
aagcauaaaucucuucugu

SEQ ID NO: 1091393 - RNA, 19 nt, Homo sapiens
gcagaauaauagucauaug

SEQ ID NO: 1091394 - RNA, 19 nt, Homo sapiens
ggagagaguucaggaaauu

SEQ ID NO: 1091395 - RNA, 19 nt, Homo sapiens
gagaaucuaugauaccaaa

SEQ ID NO: 1091396 - RNA, 19 nt, Homo sapiens
gcucuaagcagaauaaauu

SEQ ID NO: 1091397 - RNA, 19 nt, Homo sapiens
gaagaaaguuuagguuaca

SEQ ID NO: 1091398 - RNA, 19 nt, Homo sapiens
ggaaaagucugcaauuaaa

SEQ ID NO: 1091399 - RNA, 19 nt, Homo sapiens
uaaagucacuggaagaaau

SEQ ID NO: 1091400 - RNA, 19 nt, Homo sapiens
uaauguaucuucagggaaa

SEQ ID NO: 1091401 - RNA, 19 nt, Homo sapiens
gaacacaaagcaaagacua

SEQ ID NO: 1091402 - RNA, 19 nt, Homo sapiens
ugucaacuguguuagaaua

SEQ ID NO: 1091403 - RNA, 19 nt, Homo sapiens
cuaauaaggccgauucuaa

SEQ ID NO: 1091404 - RNA, 19 nt, Homo sapiens
caaaggagaaggagacaaa

SEQ ID NO: 1091405 - RNA, 19 nt, Homo sapiens
gcucaugccuguaaucaca

SEQ ID NO: 1091406 - RNA, 19 nt, Homo sapiens
ggaagacacacaaagguuu

SEQ ID NO: 1091407 - RNA, 19 nt, Homo sapiens
gaauauggcacuccuacaa

SEQ ID NO: 1091408 - RNA, 19 nt, Homo sapiens
uaaggccgauucuaaugua

SEQ ID NO: 1091409 - RNA, 19 nt, Homo sapiens
gaagaaauaauggcuuuga

SEQ ID NO: 1091410 - RNA, 19 nt, Homo sapiens
ugaggaagaggaaacauua

SEQ ID NO: 1091411 - RNA, 19 nt, Homo sapiens
gacccagucucaaaugaaa

SEQ ID NO: 1091412 - RNA, 19 nt, Homo sapiens
gaacuuacacaaauaccuu

SEQ ID NO: 1091413 - RNA, 19 nt, Homo sapiens
cacaagagaaucuaugaua

SEQ ID NO: 1091414 - RNA, 19 nt, Homo sapiens
cgaggcagguggaucauga

SEQ ID NO: 1091415 - RNA, 19 nt, Homo sapiens
caacuguguuagaauaaga

SEQ ID NO: 1091416 - RNA, 19 nt, Homo sapiens
ggaaauggaagacacacaa

SEQ ID NO: 1091417 - RNA, 19 nt, Homo sapiens
aaagagcguuccucaucua

SEQ ID NO: 1091418 - RNA, 19 nt, Homo sapiens
uagaagauauauccaagga

SEQ ID NO: 1091419 - RNA, 19 nt, Homo sapiens
gaacgucuagugaaggaaa

SEQ ID NO: 1091420 - RNA, 19 nt, Homo sapiens
aauaauggcuuugaacuuc

SEQ ID NO: 1091421 - RNA, 19 nt, Homo sapiens
gaagaggaaacauuaaagu

SEQ ID NO: 1091422 - RNA, 19 nt, Homo sapiens
gagcguuccucaucuaaag

SEQ ID NO: 1091423 - RNA, 19 nt, Homo sapiens
ggagacccaggcaagauua

SEQ ID NO: 1091424 - RNA, 19 nt, Homo sapiens
gaaauggaagacacacaaa

SEQ ID NO: 1091425 - RNA, 19 nt, Homo sapiens
uggaagaaauaauggcuuu

SEQ ID NO: 1091426 - RNA, 19 nt, Homo sapiens
guuacaaccuagacaguga

SEQ ID NO: 1091427 - RNA, 19 nt, Homo sapiens
gaaccuacuucaggcucua

SEQ ID NO: 1091428 - RNA, 19 nt, Homo sapiens
gagaguccuuccuugagaa

SEQ ID NO: 1091429 - RNA, 19 nt, Homo sapiens
gcuuagaucucagucauca

SEQ ID NO: 1091430 - RNA, 19 nt, Homo sapiens
gaaauaauggcuuugaacu

SEQ ID NO: 1091431 - RNA, 19 nt, Homo sapiens
guagugagcugugauugag

SEQ ID NO: 1091432 - RNA, 19 nt, Homo sapiens
ugaagaaaguuuagguuac

SEQ ID NO: 1091433 - RNA, 19 nt, Homo sapiens
aaauggacaucucucaaga

SEQ ID NO: 1091434 - RNA, 19 nt, Homo sapiens
ccuggaacuuacacaaaua

SEQ ID NO: 1091435 - RNA, 19 nt, Homo sapiens
guguugcgcuuagaagaua

SEQ ID NO: 1091436 - RNA, 19 nt, Homo sapiens
gaccuuugcgcucagaaua

SEQ ID NO: 1091437 - RNA, 19 nt, Homo sapiens
ccaaggaaccgagugauga

SEQ ID NO: 1091438 - RNA, 19 nt, Homo sapiens
gggcuuagaucucagucau

SEQ ID NO: 1091439 - RNA, 19 nt, Homo sapiens
uaaagagcguuccucaucu

SEQ ID NO: 1091440 - RNA, 19 nt, Homo sapiens
caggaaaagucugcaauua

SEQ ID NO: 1091441 - RNA, 19 nt, Homo sapiens
guaauccaguacuuuagga

SEQ ID NO: 1091442 - RNA, 19 nt, Homo sapiens
aaauugugcucuuccaguu

SEQ ID NO: 1091443 - RNA, 19 nt, Homo sapiens
gaauagugaccaaauccaa

SEQ ID NO: 1091444 - RNA, 19 nt, Homo sapiens
gcacugaaaagaaaacuaa

SEQ ID NO: 1091445 - RNA, 19 nt, Homo sapiens
uaauaaggccgauucuaau

SEQ ID NO: 1091446 - RNA, 19 nt, Homo sapiens
ccuguaauccaguacuuua

SEQ ID NO: 1091447 - RNA, 19 nt, Homo sapiens
ggccaaagcaggcaaaucu

SEQ ID NO: 1091448 - RNA, 19 nt, Homo sapiens
ggaagaggaaacauuaaag

SEQ ID NO: 1091449 - RNA, 19 nt, Homo sapiens
gaaggagagaguucaggaa

SEQ ID NO: 1091450 - RNA, 19 nt, Homo sapiens
gaggaagaggaaacauuaa

SEQ ID NO: 1091451 - RNA, 19 nt, Homo sapiens
acaaggaacacaaagcaaa

SEQ ID NO: 1091452 - RNA, 19 nt, Homo sapiens
aaacauauugcacugaaga

SEQ ID NO: 1091453 - RNA, 19 nt, Homo sapiens
agagaguccuuccuugaga

SEQ ID NO: 1091454 - RNA, 19 nt, Homo sapiens
acaagagaaucuaugauac

SEQ ID NO: 1091455 - RNA, 19 nt, Homo sapiens
ccuguaaucacaacacuuu

SEQ ID NO: 1091456 - RNA, 19 nt, Homo sapiens
ggacauguucauccuggaa

SEQ ID NO: 1091457 - RNA, 19 nt, Homo sapiens
gaugaagaaaguuuagguu

SEQ ID NO: 1091458 - RNA, 19 nt, Homo sapiens
ugauagugaugaagaaagu

SEQ ID NO: 1091459 - RNA, 19 nt, Homo sapiens
ugcagcaccuucagauaaa

SEQ ID NO: 1091460 - RNA, 19 nt, Homo sapiens
cugcagcaccuucagauaa

SEQ ID NO: 1091461 - RNA, 19 nt, Homo sapiens
ccaaggagacuaagaugca

SEQ ID NO: 1091462 - RNA, 19 nt, Homo sapiens
gcaauucuggccaccauuc

SEQ ID NO: 1091463 - RNA, 19 nt, Homo sapiens
guucaaggcugcggugagu

SEQ ID NO: 1091464 - RNA, 19 nt, Homo sapiens
gaaggaaauggaagacaca

SEQ ID NO: 1091465 - RNA, 19 nt, Homo sapiens
caaacacaaggaacacaaa

SEQ ID NO: 1091466 - RNA, 19 nt, Homo sapiens
guaccaaggagacuaagau

SEQ ID NO: 1091467 - RNA, 19 nt, Homo sapiens
caaggaaccgagugaugaa

SEQ ID NO: 1091468 - RNA, 19 nt, Homo sapiens
ugagaagcguccugaugga

SEQ ID NO: 1091469 - RNA, 19 nt, Homo sapiens
ggugauguguugcgcuuag

SEQ ID NO: 1091470 - RNA, 19 nt, Homo sapiens
gaaaccccaucucuacaaa

SEQ ID NO: 1091471 - RNA, 19 nt, Homo sapiens
aaagucacuggaagaaaua

SEQ ID NO: 1091472 - RNA, 19 nt, Homo sapiens
ccuagacagugaugaggaa

SEQ ID NO: 1091473 - RNA, 19 nt, Homo sapiens
auaaagagcguuccucauc

SEQ ID NO: 1091474 - RNA, 19 nt, Homo sapiens
agacuaagaugcagaaacc

SEQ ID NO: 1091475 - RNA, 19 nt, Homo sapiens
gcccaggaguuugagacua

SEQ ID NO: 1091476 - RNA, 19 nt, Homo sapiens
auggacaucucucaagaaa

SEQ ID NO: 1091477 - RNA, 19 nt, Homo sapiens
cacaaagcaaagacuaaua

SEQ ID NO: 1091478 - RNA, 19 nt, Homo sapiens
ggaaccgagugaugaaacu

SEQ ID NO: 1091479 - RNA, 19 nt, Homo sapiens
ucgagaccaugcuggcuaa

SEQ ID NO: 1091480 - RNA, 19 nt, Homo sapiens
gggagacccaggcaagauu

SEQ ID NO: 1091481 - RNA, 19 nt, Homo sapiens
agaggaaacauuaaaguca

SEQ ID NO: 1091482 - RNA, 19 nt, Homo sapiens
gcacaagagaaucuaugau

SEQ ID NO: 1091483 - RNA, 19 nt, Homo sapiens
cuacagaauccaccaaaca

SEQ ID NO: 1091484 - RNA, 19 nt, Homo sapiens
guuccucucuaguaccauu

SEQ ID NO: 1091485 - RNA, 19 nt, Homo sapiens
ggagacaaaacuaccuuua

SEQ ID NO: 1091486 - RNA, 19 nt, Homo sapiens
caggaauagugaccaaauc

SEQ ID NO: 1091487 - RNA, 19 nt, Homo sapiens
ccagucauggugccacaua

SEQ ID NO: 1091488 - RNA, 19 nt, Homo sapiens
gagacuagccugggcaaca

SEQ ID NO: 1091489 - RNA, 19 nt, Homo sapiens
ggaccacaucagaaagaaa

SEQ ID NO: 1091490 - RNA, 19 nt, Homo sapiens
caaagcaggcaaaucucuu

SEQ ID NO: 1091491 - RNA, 19 nt, Homo sapiens
gaaguugugccauguaucc

SEQ ID NO: 1091492 - RNA, 19 nt, Homo sapiens
uggaaguugugccauguau

SEQ ID NO: 1091493 - RNA, 19 nt, Homo sapiens
ccaaacacaaggaacacaa

SEQ ID NO: 1091494 - RNA, 19 nt, Homo sapiens
gaaaugcagugucaacuaa

SEQ ID NO: 1091495 - RNA, 19 nt, Homo sapiens
ggaaggagaugaauaugaa

SEQ ID NO: 1091496 - RNA, 19 nt, Homo sapiens
gagaauacguguccaguuu

SEQ ID NO: 1091497 - RNA, 19 nt, Homo sapiens
gaagagauguuuccagaug

SEQ ID NO: 1091498 - RNA, 19 nt, Homo sapiens
gaaaguagaugaagaagcu

SEQ ID NO: 1091499 - RNA, 19 nt, Homo sapiens
ggaagaauaugaaacuaug

SEQ ID NO: 1091500 - RNA, 19 nt, Homo sapiens
gcauauaccuucacacuag

SEQ ID NO: 1091501 - RNA, 19 nt, Homo sapiens
gagcugagaucacaccaaa

SEQ ID NO: 1091502 - RNA, 19 nt, Homo sapiens
ggaaacacccagaacuuua

SEQ ID NO: 1091503 - RNA, 19 nt, Homo sapiens
gaacagaagaugucaguau

SEQ ID NO: 1091504 - RNA, 19 nt, Homo sapiens
gaacaguacacuugaauga

SEQ ID NO: 1091505 - RNA, 19 nt, Homo sapiens
ucaagaggguugucauuaa

SEQ ID NO: 1091506 - RNA, 19 nt, Homo sapiens
gaaacagacugauaagaag

SEQ ID NO: 1091507 - RNA, 19 nt, Homo sapiens
caaggaagagcucauauuu

SEQ ID NO: 1091508 - RNA, 19 nt, Homo sapiens
gucaauagguugcugcaua

SEQ ID NO: 1091509 - RNA, 19 nt, Homo sapiens
caaaggauuucuugaagga

SEQ ID NO: 1091510 - RNA, 19 nt, Homo sapiens
gaacacccuugauugcauu

SEQ ID NO: 1091511 - RNA, 19 nt, Homo sapiens
gagcugagguuggcuggua

SEQ ID NO: 1091512 - RNA, 19 nt, Homo sapiens
gaagaggaauauuaagaca

SEQ ID NO: 1091513 - RNA, 19 nt, Homo sapiens
gaauacguguccaguuuga

SEQ ID NO: 1091514 - RNA, 19 nt, Homo sapiens
gagguuggcugguauguca

SEQ ID NO: 1091515 - RNA, 19 nt, Homo sapiens
ggauaaagauugggcauca

SEQ ID NO: 1091516 - RNA, 19 nt, Homo sapiens
ccacugagcacaauacaaa

SEQ ID NO: 1091517 - RNA, 19 nt, Homo sapiens
gagguuaagucuacauuuc

SEQ ID NO: 1091518 - RNA, 19 nt, Homo sapiens
gagaggaugugcugugguu

SEQ ID NO: 1091519 - RNA, 19 nt, Homo sapiens
caagagaguuguucugagu

SEQ ID NO: 1091520 - RNA, 19 nt, Homo sapiens
aggaagagcucauauuuca

SEQ ID NO: 1091521 - RNA, 19 nt, Homo sapiens
gaagaugucaguauugaau

SEQ ID NO: 1091522 - RNA, 19 nt, Homo sapiens
cuaguugguuuaccuauaa

SEQ ID NO: 1091523 - RNA, 19 nt, Homo sapiens
aaacagaaacagacugaua

SEQ ID NO: 1091524 - RNA, 19 nt, Homo sapiens
gaaguuacaccaugcuuug

SEQ ID NO: 1091525 - RNA, 19 nt, Homo sapiens
caagaggguugucauuaau

SEQ ID NO: 1091526 - RNA, 19 nt, Homo sapiens
gaaauagccacucuccauu

SEQ ID NO: 1091527 - RNA, 19 nt, Homo sapiens
gagaggacauaucaaggaa

SEQ ID NO: 1091528 - RNA, 19 nt, Homo sapiens
ggagacccuuucccuuuaa

SEQ ID NO: 1091529 - RNA, 19 nt, Homo sapiens
uuaccaagcugaauggauu

SEQ ID NO: 1091530 - RNA, 19 nt, Homo sapiens
auaagaagcuggccuuuca

SEQ ID NO: 1091531 - RNA, 19 nt, Homo sapiens
cagaagaugucaguauuga

SEQ ID NO: 1091532 - RNA, 19 nt, Homo sapiens
ucaagauuaugcucgaaua

SEQ ID NO: 1091533 - RNA, 19 nt, Homo sapiens
cggagacccuuucccuuua

SEQ ID NO: 1091534 - RNA, 19 nt, Homo sapiens
ggaagaagcuaaguaaagc

SEQ ID NO: 1091535 - RNA, 19 nt, Homo sapiens
gcucgaauauuucaguuuc

SEQ ID NO: 1091536 - RNA, 19 nt, Homo sapiens
ccaaaggaacauccaguua

SEQ ID NO: 1091537 - RNA, 19 nt, Homo sapiens
gcacacuguugauauggaa

SEQ ID NO: 1091538 - RNA, 19 nt, Homo sapiens
gugaagauaucauccacaa

SEQ ID NO: 1091539 - RNA, 19 nt, Homo sapiens
gcaguuggcuaaccagaag

SEQ ID NO: 1091540 - RNA, 19 nt, Homo sapiens
gaaacacccagaacuuuau

SEQ ID NO: 1091541 - RNA, 19 nt, Homo sapiens
gcuguagguucaaugagua

SEQ ID NO: 1091542 - RNA, 19 nt, Homo sapiens
gaggaugugcugugguuua

SEQ ID NO: 1091543 - RNA, 19 nt, Homo sapiens
ugaagaagaggaagaauau

SEQ ID NO: 1091544 - RNA, 19 nt, Homo sapiens
caaauguucuuuacuucug

SEQ ID NO: 1091545 - RNA, 19 nt, Homo sapiens
gggagucugugcaugauga

SEQ ID NO: 1091546 - RNA, 19 nt, Homo sapiens
gaagaggaagaauaugaaa

SEQ ID NO: 1091547 - RNA, 19 nt, Homo sapiens
ucaauagguugcugcauau

SEQ ID NO: 1091548 - RNA, 19 nt, Homo sapiens
ucaagaccauccuggcuaa

SEQ ID NO: 1091549 - RNA, 19 nt, Homo sapiens
ggaguaggaauuagugaaa

SEQ ID NO: 1091550 - RNA, 19 nt, Homo sapiens
agaaacagacugauaagaa

SEQ ID NO: 1091551 - RNA, 19 nt, Homo sapiens
ugauguggcugcucgaauu

SEQ ID NO: 1091552 - RNA, 19 nt, Homo sapiens
ggaagguucuaagguggua

SEQ ID NO: 1091553 - RNA, 19 nt, Homo sapiens
caaaaugucuucaguaucu

SEQ ID NO: 1091554 - RNA, 19 nt, Homo sapiens
ccaugcagcugcuucaaga

SEQ ID NO: 1091555 - RNA, 19 nt, Homo sapiens
gaggaagaauaugaaacua

SEQ ID NO: 1091556 - RNA, 19 nt, Homo sapiens
ggucuuaaaguccuaauga

SEQ ID NO: 1091557 - RNA, 19 nt, Homo sapiens
ccaggaagaagcuaaguaa

SEQ ID NO: 1091558 - RNA, 19 nt, Homo sapiens
gggaagaggaauauuaaga

SEQ ID NO: 1091559 - RNA, 19 nt, Homo sapiens
ucaagccaaugcuggauuu

SEQ ID NO: 1091560 - RNA, 19 nt, Homo sapiens
gauaauaggccagguguuc

SEQ ID NO: 1091561 - RNA, 19 nt, Homo sapiens
ggagaggacauaucaagga

SEQ ID NO: 1091562 - RNA, 19 nt, Homo sapiens
ggaacacccuugauugcau

SEQ ID NO: 1091563 - RNA, 19 nt, Homo sapiens
gugaagaagaggaagaaua

SEQ ID NO: 1091564 - RNA, 19 nt, Homo sapiens
guagggagaucaagaccau

SEQ ID NO: 1091565 - RNA, 19 nt, Homo sapiens
ggacagcaccggugauuac

SEQ ID NO: 1091566 - RNA, 19 nt, Homo sapiens
aaagugagauuucuucaac

SEQ ID NO: 1091567 - RNA, 19 nt, Homo sapiens
caagaaagacuggaagaga

SEQ ID NO: 1091568 - RNA, 19 nt, Homo sapiens
ucaagaggcugagguagga

SEQ ID NO: 1091569 - RNA, 19 nt, Homo sapiens
aauagccacucuccauuaa

SEQ ID NO: 1091570 - RNA, 19 nt, Homo sapiens
gggcaaaguuuauuuucua

SEQ ID NO: 1091571 - RNA, 19 nt, Homo sapiens
gaugaucuguaugauaaga

SEQ ID NO: 1091572 - RNA, 19 nt, Homo sapiens
ggaugagaguagugaagaa

SEQ ID NO: 1091573 - RNA, 19 nt, Homo sapiens
ggcaaaggauuucuugaag

SEQ ID NO: 1091574 - RNA, 19 nt, Homo sapiens
acaccaugcuuugcuauuu

SEQ ID NO: 1091575 - RNA, 19 nt, Homo sapiens
aaauagccacucuccauua

SEQ ID NO: 1091576 - RNA, 19 nt, Homo sapiens
aguaauggauucaaagaga

SEQ ID NO: 1091577 - RNA, 19 nt, Homo sapiens
gucaguagauccagacaga

SEQ ID NO: 1091578 - RNA, 19 nt, Homo sapiens
gggaaacacccagaacuuu

SEQ ID NO: 1091579 - RNA, 19 nt, Homo sapiens
caacaaaccacaacauugc

SEQ ID NO: 1091580 - RNA, 19 nt, Homo sapiens
acaguacacuugaaugaau

SEQ ID NO: 1091581 - RNA, 19 nt, Homo sapiens
aaaccuuccucaagauuau

SEQ ID NO: 1091582 - RNA, 19 nt, Homo sapiens
uaugguuucuggaggauaa

SEQ ID NO: 1091583 - RNA, 19 nt, Homo sapiens
caaggucccugauaauagg

SEQ ID NO: 1091584 - RNA, 19 nt, Homo sapiens
uagccacucuccauuaaga

SEQ ID NO: 1091585 - RNA, 19 nt, Homo sapiens
guaauggauucaaagagau

SEQ ID NO: 1091586 - RNA, 19 nt, Homo sapiens
gcuaaaaucucaagacaca

SEQ ID NO: 1091587 - RNA, 19 nt, Homo sapiens
ggucauccuuucaaaauuu

SEQ ID NO: 1091588 - RNA, 19 nt, Homo sapiens
aacagaagaugucaguauu

SEQ ID NO: 1091589 - RNA, 19 nt, Homo sapiens
gggaaggagaugaauauga

SEQ ID NO: 1091590 - RNA, 19 nt, Homo sapiens
gcaauggagauuugugcua

SEQ ID NO: 1091591 - RNA, 19 nt, Homo sapiens
aaacuccucuuguuagaca

SEQ ID NO: 1091592 - RNA, 19 nt, Homo sapiens
ggaguaauggauucaaaga

SEQ ID NO: 1091593 - RNA, 19 nt, Homo sapiens
cacaugaaaugcagcuuug

SEQ ID NO: 1091594 - RNA, 19 nt, Homo sapiens
gauagaagcuccagagaug

SEQ ID NO: 1091595 - RNA, 19 nt, Homo sapiens
gcagagagcuggcaugagu

SEQ ID NO: 1091596 - RNA, 19 nt, Homo sapiens
ggagagagcucagcaaauc

SEQ ID NO: 1091597 - RNA, 19 nt, Homo sapiens
gagauucugucuucuacaa

SEQ ID NO: 1091598 - RNA, 19 nt, Homo sapiens
guaccuacuucuuaaacaa

SEQ ID NO: 1091599 - RNA, 19 nt, Homo sapiens
gggaggagauggugcugaa

SEQ ID NO: 1091600 - RNA, 19 nt, Homo sapiens
gaaggaggaaggacacauu

SEQ ID NO: 1091601 - RNA, 19 nt, Homo sapiens
ccaacauggugaaaugaaa

SEQ ID NO: 1091602 - RNA, 19 nt, Homo sapiens
gccuguagcucaauccaaa

SEQ ID NO: 1091603 - RNA, 19 nt, Homo sapiens
gagacaagaccucauccua

SEQ ID NO: 1091604 - RNA, 19 nt, Homo sapiens
gagaggaucagguuccaaa

SEQ ID NO: 1091605 - RNA, 19 nt, Homo sapiens
caccugagauucugucuuc

SEQ ID NO: 1091606 - RNA, 19 nt, Homo sapiens
ggagauggagauugcagua

SEQ ID NO: 1091607 - RNA, 19 nt, Homo sapiens
guagcucaauccaaauuug

SEQ ID NO: 1091608 - RNA, 19 nt, Homo sapiens
ggaccaccgucgucuauac

SEQ ID NO: 1091609 - RNA, 19 nt, Homo sapiens
ugagaggucuguugggaau

SEQ ID NO: 1091610 - RNA, 19 nt, Homo sapiens
ggacuaaaccacccaaagg

SEQ ID NO: 1091611 - RNA, 19 nt, Homo sapiens
gagcagagagcuggcauga

SEQ ID NO: 1091612 - RNA, 19 nt, Homo sapiens
gaacagucaggacacaaga

SEQ ID NO: 1091613 - RNA, 19 nt, Homo sapiens
ucaauagccguaaggagua

SEQ ID NO: 1091614 - RNA, 19 nt, Homo sapiens
gaaaccccaucucaacuaa

SEQ ID NO: 1091615 - RNA, 19 nt, Homo sapiens
caaagucaccugagauucu

SEQ ID NO: 1091616 - RNA, 19 nt, Homo sapiens
ccaggaaguuuggccacua

SEQ ID NO: 1091617 - RNA, 19 nt, Homo sapiens
caggaccacuggagagcua

SEQ ID NO: 1091618 - RNA, 19 nt, Homo sapiens
agaggucuguugggaauaa

SEQ ID NO: 1091619 - RNA, 19 nt, Homo sapiens
gggacaggcucaccaaagg

SEQ ID NO: 1091620 - RNA, 19 nt, Homo sapiens
gagcucagcaaaucaagga

SEQ ID NO: 1091621 - RNA, 19 nt, Homo sapiens
gaucaaagucaccugagau

SEQ ID NO: 1091622 - RNA, 19 nt, Homo sapiens
gauggaagacagaccuuug

SEQ ID NO: 1091623 - RNA, 19 nt, Homo sapiens
ccacuuggccauggaauug

SEQ ID NO: 1091624 - RNA, 19 nt, Homo sapiens
gaaaugaaaccccaucuca

SEQ ID NO: 1091625 - RNA, 19 nt, Homo sapiens
gaggagauggugcugaaga

SEQ ID NO: 1091626 - RNA, 19 nt, Homo sapiens
gaaguuuggccacuacaca

SEQ ID NO: 1091627 - RNA, 19 nt, Homo sapiens
gauucugucuucuacaaag

SEQ ID NO: 1091628 - RNA, 19 nt, Homo sapiens
gccaagagaagaccagaga

SEQ ID NO: 1091629 - RNA, 19 nt, Homo sapiens
ggaaacccagccaagagaa

SEQ ID NO: 1091630 - RNA, 19 nt, Homo sapiens
gaaagggcagugagacaag

SEQ ID NO: 1091631 - RNA, 19 nt, Homo sapiens
acagcugucugcacucuau

SEQ ID NO: 1091632 - RNA, 19 nt, Homo sapiens
gagaccagccugaccaaca

SEQ ID NO: 1091633 - RNA, 19 nt, Homo sapiens
cgucgucuauaccaucaaa

SEQ ID NO: 1091634 - RNA, 19 nt, Homo sapiens
caagagaagaccagagaca

SEQ ID NO: 1091635 - RNA, 19 nt, Homo sapiens
acuaauguguggcuaagga

SEQ ID NO: 1091636 - RNA, 19 nt, Homo sapiens
gcaguaggccaagaugaug

SEQ ID NO: 1091637 - RNA, 19 nt, Homo sapiens
gaacccaggagauggagau

SEQ ID NO: 1091638 - RNA, 19 nt, Homo sapiens
gaccaguccuacagagaca

SEQ ID NO: 1091639 - RNA, 19 nt, Homo sapiens
aaacuaauguguggcuaag

SEQ ID NO: 1091640 - RNA, 19 nt, Homo sapiens
gagccugacugccgaacag

SEQ ID NO: 1091641 - RNA, 19 nt, Homo sapiens
uucaagagcuucaguacca

SEQ ID NO: 1091642 - RNA, 19 nt, Homo sapiens
caggagagagcucagcaaa

SEQ ID NO: 1091643 - RNA, 19 nt, Homo sapiens
ggagacaggguagcaaauc

SEQ ID NO: 1091644 - RNA, 19 nt, Homo sapiens
caaagggccagacgaugga

SEQ ID NO: 1091645 - RNA, 19 nt, Homo sapiens
gaaccacuucccaugugaa

SEQ ID NO: 1091646 - RNA, 19 nt, Homo sapiens
ccagaaaacuagaccacaa

SEQ ID NO: 1091647 - RNA, 19 nt, Homo sapiens
ccagagacacgacaaggau

SEQ ID NO: 1091648 - RNA, 19 nt, Homo sapiens
cagccaaccucagcuucaa

SEQ ID NO: 1091649 - RNA, 19 nt, Homo sapiens
ccagaagccacagaucaaa

SEQ ID NO: 1091650 - RNA, 19 nt, Homo sapiens
gagauggugcugaagaagu

SEQ ID NO: 1091651 - RNA, 19 nt, Homo sapiens
ccuguaaucccagcacuuu

SEQ ID NO: 1091652 - RNA, 19 nt, Homo sapiens
agaugaagcagaacaggaa

SEQ ID NO: 1091653 - RNA, 19 nt, Homo sapiens
agaccagccugaccaacau

SEQ ID NO: 1091654 - RNA, 19 nt, Homo sapiens
gcaugaguauagggaagga

SEQ ID NO: 1091655 - RNA, 19 nt, Homo sapiens
aaagggcagugagacaaga

SEQ ID NO: 1091656 - RNA, 19 nt, Homo sapiens
uagaaugagaggucuguug

SEQ ID NO: 1091657 - RNA, 19 nt, Homo sapiens
ugaaagggcagugagacaa

SEQ ID NO: 1091658 - RNA, 19 nt, Homo sapiens
gccaggagaggaucagguu

SEQ ID NO: 1091659 - RNA, 19 nt, Homo sapiens
aaagucaccugagauucug

SEQ ID NO: 1091660 - RNA, 19 nt, Homo sapiens
agaucaaagucaccugaga

SEQ ID NO: 1091661 - RNA, 19 nt, Homo sapiens
cucgaucucuggaggacua

SEQ ID NO: 1091662 - RNA, 19 nt, Homo sapiens
gcagagaaccaugcuacag

SEQ ID NO: 1091663 - RNA, 19 nt, Homo sapiens
aggagauggugcugaagaa

SEQ ID NO: 1091664 - RNA, 19 nt, Homo sapiens
gagacaggguagcaaaucc

SEQ ID NO: 1091665 - RNA, 19 nt, Homo sapiens
gacaggagaaucgcuugaa

SEQ ID NO: 1091666 - RNA, 19 nt, Homo sapiens
gagagagcucagcaaauca

SEQ ID NO: 1091667 - RNA, 19 nt, Homo sapiens
gaugaagcagaacaggaaa

SEQ ID NO: 1091668 - RNA, 19 nt, Homo sapiens
gagcuggcaugaguauagg

SEQ ID NO: 1091669 - RNA, 19 nt, Homo sapiens
caggagacaggguagcaaa

SEQ ID NO: 1091670 - RNA, 19 nt, Homo sapiens
gaaacccagccaagagaag

SEQ ID NO: 1091671 - RNA, 19 nt, Homo sapiens
gaggucuguugggaauaaa

SEQ ID NO: 1091672 - RNA, 19 nt, Homo sapiens
agauggugcugaagaaguc

SEQ ID NO: 1091673 - RNA, 19 nt, Homo sapiens
aaaggggaaugcuaugaaa

SEQ ID NO: 1091674 - RNA, 19 nt, Homo sapiens
ccugagauucugucuucua

SEQ ID NO: 1091675 - RNA, 19 nt, Homo sapiens
agaagccacagaucaaaga

SEQ ID NO: 1091676 - RNA, 19 nt, Homo sapiens
cuucuuaaacaaacacuga

SEQ ID NO: 1091677 - RNA, 19 nt, Homo sapiens
gcaacaggccaucaauagc

SEQ ID NO: 1091678 - RNA, 19 nt, Homo sapiens
cugcaacaggccaucaaua

SEQ ID NO: 1091679 - RNA, 19 nt, Homo sapiens
cccaggagauggagauugc

SEQ ID NO: 1091680 - RNA, 19 nt, Homo sapiens
caacauggugaaaugaaac

SEQ ID NO: 1091681 - RNA, 19 nt, Homo sapiens
ggaaggacacauuuucaau

SEQ ID NO: 1091682 - RNA, 19 nt, Homo sapiens
gaccugggcacgcuucagu

SEQ ID NO: 1091683 - RNA, 19 nt, Homo sapiens
acuauaccauggagaucaa

SEQ ID NO: 1091684 - RNA, 19 nt, Homo sapiens
caggaaguuuggccacuac

SEQ ID NO: 1091685 - RNA, 19 nt, Homo sapiens
gcaguggcucacaccugua

SEQ ID NO: 1091686 - RNA, 19 nt, Homo sapiens
gaaggacacauuuucaauc

SEQ ID NO: 1091687 - RNA, 19 nt, Homo sapiens
ggaggaaggacacauuuuc

SEQ ID NO: 1091688 - RNA, 19 nt, Homo sapiens
ugauagaagcuccagagau

SEQ ID NO: 1091689 - RNA, 19 nt, Homo sapiens
agucaggacacaagaguug

SEQ ID NO: 1091690 - RNA, 19 nt, Homo sapiens
ggaaccauugucccaggaa

SEQ ID NO: 1091691 - RNA, 19 nt, Homo sapiens
ccacagccaaccucagcuu

SEQ ID NO: 1091692 - RNA, 19 nt, Homo sapiens
gguggugcaugccuguagu

SEQ ID NO: 1091693 - RNA, 19 nt, Homo sapiens
caguggcucacaccuguaa

SEQ ID NO: 1091694 - RNA, 19 nt, Homo sapiens
uaacaggucugaaaucuuu

SEQ ID NO: 1091695 - RNA, 19 nt, Homo sapiens
gagacaaacugacuauuaa

SEQ ID NO: 1091696 - RNA, 19 nt, Homo sapiens
acaaggagcuggaugauuu

SEQ ID NO: 1091697 - RNA, 19 nt, Homo sapiens
gaagagaacaguagguuaa

SEQ ID NO: 1091698 - RNA, 19 nt, Homo sapiens
gcagaucgcuggacuucaa

SEQ ID NO: 1091699 - RNA, 19 nt, Homo sapiens
gacauucucugaugaguuu

SEQ ID NO: 1091700 - RNA, 19 nt, Homo sapiens
gaaagagagcuauguauga

SEQ ID NO: 1091701 - RNA, 19 nt, Homo sapiens
gagaguaagucccugcaaa

SEQ ID NO: 1091702 - RNA, 19 nt, Homo sapiens
uaaccgagcucguggaugu

SEQ ID NO: 1091703 - RNA, 19 nt, Homo sapiens
ugagacaaacugacuauua

SEQ ID NO: 1091704 - RNA, 19 nt, Homo sapiens
cagaacacauugacauauu

SEQ ID NO: 1091705 - RNA, 19 nt, Homo sapiens
agagagcuauguaugauaa

SEQ ID NO: 1091706 - RNA, 19 nt, Homo sapiens
ugaaguaaaugcaguguuc

SEQ ID NO: 1091707 - RNA, 19 nt, Homo sapiens
gaacuuaccaagagaagau

SEQ ID NO: 1091708 - RNA, 19 nt, Homo sapiens
ggaagagaacaguagguua

SEQ ID NO: 1091709 - RNA, 19 nt, Homo sapiens
ggagcuggaugauuugaga

SEQ ID NO: 1091710 - RNA, 19 nt, Homo sapiens
gcaccuuuguacuucuuua

SEQ ID NO: 1091711 - RNA, 19 nt, Homo sapiens
gagcuucagucauugucua

SEQ ID NO: 1091712 - RNA, 19 nt, Homo sapiens
ucgcgcaacuccuugguua

SEQ ID NO: 1091713 - RNA, 19 nt, Homo sapiens
ucucuucuguugguaauua

SEQ ID NO: 1091714 - RNA, 19 nt, Homo sapiens
aagaaugccuguuggaaga

SEQ ID NO: 1091715 - RNA, 19 nt, Homo sapiens
aaagagagcuauguaugau

SEQ ID NO: 1091716 - RNA, 19 nt, Homo sapiens
gacagaacacauugacaua

SEQ ID NO: 1091717 - RNA, 19 nt, Homo sapiens
cgucccagcuucuuugaaa

SEQ ID NO: 1091718 - RNA, 19 nt, Homo sapiens
ugucaucuguugaagaauu

SEQ ID NO: 1091719 - RNA, 19 nt, Homo sapiens
gagccugacuaccgccuuu

SEQ ID NO: 1091720 - RNA, 19 nt, Homo sapiens
gagccgagguggagcagau

SEQ ID NO: 1091721 - RNA, 19 nt, Homo sapiens
ucacucgacuccaaagaga

SEQ ID NO: 1091722 - RNA, 19 nt, Homo sapiens
uaaagcaccucguaaaaug

SEQ ID NO: 1091723 - RNA, 19 nt, Homo sapiens
uaagcuuccugguaaaguu

SEQ ID NO: 1091724 - RNA, 19 nt, Homo sapiens
gaguuuaacaggucugaaa

SEQ ID NO: 1091725 - RNA, 19 nt, Homo sapiens
ugaaagagagcuauguaug

SEQ ID NO: 1091726 - RNA, 19 nt, Homo sapiens
cccuuaagcuuccugguaa

SEQ ID NO: 1091727 - RNA, 19 nt, Homo sapiens
gcccgcaguugguacagua

SEQ ID NO: 1091728 - RNA, 19 nt, Homo sapiens
guacuucuuuauugagugu

SEQ ID NO: 1091729 - RNA, 19 nt, Homo sapiens
gaggcugugugucgagauu

SEQ ID NO: 1091730 - RNA, 19 nt, Homo sapiens
gaaugccuguuggaagauu

SEQ ID NO: 1091731 - RNA, 19 nt, Homo sapiens
gauggugggugaagauguc

SEQ ID NO: 1091732 - RNA, 19 nt, Homo sapiens
cacccagacuccauggaua

SEQ ID NO: 1091733 - RNA, 19 nt, Homo sapiens
aaagagagcgucccagcuu

SEQ ID NO: 1091734 - RNA, 19 nt, Homo sapiens
uacauugucugcaccuuug

SEQ ID NO: 1091735 - RNA, 19 nt, Homo sapiens
gaagaccauggcccuguuu

SEQ ID NO: 1091736 - RNA, 19 nt, Homo sapiens
cuugucaucuguugaagaa

SEQ ID NO: 1091737 - RNA, 19 nt, Homo sapiens
gcacgagcuucagccagaa

SEQ ID NO: 1091738 - RNA, 19 nt, Homo sapiens
ucuacugccugaugugaaa

SEQ ID NO: 1091739 - RNA, 19 nt, Homo sapiens
ggacauucucugaugaguu

SEQ ID NO: 1091740 - RNA, 19 nt, Homo sapiens
gcucguggauguggacuuc

SEQ ID NO: 1091741 - RNA, 19 nt, Homo sapiens
ccuuuguacuucuuuauug

SEQ ID NO: 1091742 - RNA, 19 nt, Homo sapiens
caggacagcucagaaagca

SEQ ID NO: 1091743 - RNA, 19 nt, Homo sapiens
agacaggacagcucagaaa

SEQ ID NO: 1091744 - RNA, 19 nt, Homo sapiens
ggacucacucgacuccaaa

SEQ ID NO: 1091745 - RNA, 19 nt, Homo sapiens
gcacagcaacgaggcauuc

SEQ ID NO: 1091746 - RNA, 19 nt, Homo sapiens
gcaacuccuugguuagucu

SEQ ID NO: 1091747 - RNA, 19 nt, Homo sapiens
gacaaacugacuauuaauc

SEQ ID NO: 1091748 - RNA, 19 nt, Homo sapiens
ggugcugucuggagaagau

SEQ ID NO: 1091749 - RNA, 19 nt, Homo sapiens
cugcagccacguuaaauuu

SEQ ID NO: 1091750 - RNA, 19 nt, Homo sapiens
gauuugagacaacauuuag

SEQ ID NO: 1091751 - RNA, 19 nt, Homo sapiens
gagcgucccagcuucuuug

SEQ ID NO: 1091752 - RNA, 19 nt, Homo sapiens
ccugggacauucucugaug

SEQ ID NO: 1091753 - RNA, 19 nt, Homo sapiens
ucucagaaguuggauuugu

SEQ ID NO: 1091754 - RNA, 19 nt, Homo sapiens
gcagccacguuaaauuugc

SEQ ID NO: 1091755 - RNA, 19 nt, Homo sapiens
agacacugcagccacguua

SEQ ID NO: 1091756 - RNA, 19 nt, Homo sapiens
gaugauuugagacaacauu

SEQ ID NO: 1091757 - RNA, 19 nt, Homo sapiens
cuucagucauugucuauuc

SEQ ID NO: 1091758 - RNA, 19 nt, Homo sapiens
uccaggagcucacgcagau

SEQ ID NO: 1091759 - RNA, 19 nt, Homo sapiens
caucuugucaucuguugaa

SEQ ID NO: 1091760 - RNA, 19 nt, Homo sapiens
gaggccgacucucgugguu

SEQ ID NO: 1091761 - RNA, 19 nt, Homo sapiens
auccugagaugaaguaaau

SEQ ID NO: 1091762 - RNA, 19 nt, Homo sapiens
cgaagaaugccuguuggaa

SEQ ID NO: 1091763 - RNA, 19 nt, Homo sapiens
agacagaacacauugacau

SEQ ID NO: 1091764 - RNA, 19 nt, Homo sapiens
agaagaccauggcccuguu

SEQ ID NO: 1091765 - RNA, 19 nt, Homo sapiens
gcagacaggacagcucaga

SEQ ID NO: 1091766 - RNA, 19 nt, Homo sapiens
acaacugcaucuccucguu

SEQ ID NO: 1091767 - RNA, 19 nt, Homo sapiens
uauccaguauccugagaug

SEQ ID NO: 1091768 - RNA, 19 nt, Homo sapiens
ucgcuggacuucaaacaag

SEQ ID NO: 1091769 - RNA, 19 nt, Homo sapiens
gcucuacccgggaagaaga

SEQ ID NO: 1091770 - RNA, 19 nt, Homo sapiens
guguaacaagcaaucuuua

SEQ ID NO: 1091771 - RNA, 19 nt, Homo sapiens
gugaaagagagcuauguau

SEQ ID NO: 1091772 - RNA, 19 nt, Homo sapiens
gaagugaagagugcagaca

SEQ ID NO: 1091773 - RNA, 19 nt, Homo sapiens
gucucaaucucuacuacaa

SEQ ID NO: 1091774 - RNA, 19 nt, Homo sapiens
aagcgaagaaugccuguug

SEQ ID NO: 1091775 - RNA, 19 nt, Homo sapiens
ggagagcuuccgccacugu

SEQ ID NO: 1091776 - RNA, 19 nt, Homo sapiens
gaagcugggccaccccuua

SEQ ID NO: 1091777 - RNA, 19 nt, Homo sapiens
acacugcagccacguuaaa

SEQ ID NO: 1091778 - RNA, 19 nt, Homo sapiens
ugugaaagagagcuaugua

SEQ ID NO: 1091779 - RNA, 19 nt, Homo sapiens
gagcugcaccacacacaca

SEQ ID NO: 1091780 - RNA, 19 nt, Homo sapiens
gacucggccucuucucaga

SEQ ID NO: 1091781 - RNA, 19 nt, Homo sapiens
gagagcuuccgccacugua

SEQ ID NO: 1091782 - RNA, 19 nt, Homo sapiens
uguacuggcuggcaagagu

SEQ ID NO: 1091783 - RNA, 19 nt, Homo sapiens
uuacauugucugcaccuuu

SEQ ID NO: 1091784 - RNA, 19 nt, Homo sapiens
gcuaccaggagcucaagaa

SEQ ID NO: 1091785 - RNA, 19 nt, Homo sapiens
gaagguugagccugacuac

SEQ ID NO: 1091786 - RNA, 19 nt, Homo sapiens
uguguaacaagcaaucuuu

SEQ ID NO: 1091787 - RNA, 19 nt, Homo sapiens
aagcuuccugguaaaguua

SEQ ID NO: 1091788 - RNA, 19 nt, Homo sapiens
caacgaggcauuccuugcu

SEQ ID NO: 1091789 - RNA, 19 nt, Homo sapiens
ucucgugguucccaagaau

SEQ ID NO: 1091790 - RNA, 19 nt, Homo sapiens
uccaguauccugagaugaa

SEQ ID NO: 1091791 - RNA, 19 nt, Homo sapiens
caaggagcuggaugauuug

SEQ ID NO: 1091792 - RNA, 19 nt, Homo sapiens
cagcaacgaggcauuccuu

SEQ ID NO: 1091793 - RNA, 19 nt, Homo sapiens
uuuaacaggucugaaaucu

SEQ ID NO: 1091794 - RNA, 19 nt, Homo sapiens
guacuucaguucuaaauuc

SEQ ID NO: 1091795 - RNA, 19 nt, Homo sapiens
gaggaaccauguugccuuu

SEQ ID NO: 1091796 - RNA, 19 nt, Homo sapiens
ccacucaacugcacuccua

SEQ ID NO: 1091797 - RNA, 19 nt, Homo sapiens
gcagguacuucaguucuaa

SEQ ID NO: 1091798 - RNA, 19 nt, Homo sapiens
caacugcacuccuaucaag

SEQ ID NO: 1091799 - RNA, 19 nt, Homo sapiens
ggaccagggugauuucaag

SEQ ID NO: 1091800 - RNA, 19 nt, Homo sapiens
guuggaagaugguaucaga

SEQ ID NO: 1091801 - RNA, 19 nt, Homo sapiens
agacuuagaucccauuucu

SEQ ID NO: 1091802 - RNA, 19 nt, Homo sapiens
ccuguuaucuccuaaaugg

SEQ ID NO: 1091803 - RNA, 19 nt, Homo sapiens
gcagggagacacauguuug

SEQ ID NO: 1091804 - RNA, 19 nt, Homo sapiens
cauguugccuuuccuguca

SEQ ID NO: 1091805 - RNA, 19 nt, Homo sapiens
ugaguaccauugauccaaa

SEQ ID NO: 1091806 - RNA, 19 nt, Homo sapiens
uggaagaucauuuauguug

SEQ ID NO: 1091807 - RNA, 19 nt, Homo sapiens
aguggaagaucauuuaugu

SEQ ID NO: 1091808 - RNA, 19 nt, Homo sapiens
gaaggaugaucucgcuuuu

SEQ ID NO: 1091809 - RNA, 19 nt, Homo sapiens
gcuacuacgucaacaacga

SEQ ID NO: 1091810 - RNA, 19 nt, Homo sapiens
gaccuggaguggaagauca

SEQ ID NO: 1091811 - RNA, 19 nt, Homo sapiens
ucuaaauucugacuugugu

SEQ ID NO: 1091812 - RNA, 19 nt, Homo sapiens
caacugggacaacaacaug

SEQ ID NO: 1091813 - RNA, 19 nt, Homo sapiens
gugacccgcuuccauauca

SEQ ID NO: 1091814 - RNA, 19 nt, Homo sapiens
gcagacccacuccagcuuu

SEQ ID NO: 1091815 - RNA, 19 nt, Homo sapiens
gcuaggaccagggugauuu

SEQ ID NO: 1091816 - RNA, 19 nt, Homo sapiens
ccaccuagaggcuuucuug

SEQ ID NO: 1091817 - RNA, 19 nt, Homo sapiens
ccuggaggcugccaugguu

SEQ ID NO: 1091818 - RNA, 19 nt, Homo sapiens
gcaauccaggucugucaaa

SEQ ID NO: 1091819 - RNA, 19 nt, Homo sapiens
uggaguggaagaucauuua

SEQ ID NO: 1091820 - RNA, 19 nt, Homo sapiens
cggacgaccuggaguggaa

SEQ ID NO: 1091821 - RNA, 19 nt, Homo sapiens
uguggaugcuguugugauu

SEQ ID NO: 1091822 - RNA, 19 nt, Homo sapiens
gugaggaauuugaucagau

SEQ ID NO: 1091823 - RNA, 19 nt, Homo sapiens
uaaauucugacuuguguuc

SEQ ID NO: 1091824 - RNA, 19 nt, Homo sapiens
cauaucaacugggacaaca

SEQ ID NO: 1091825 - RNA, 19 nt, Homo sapiens
ggaacaucuuggccucgaa

SEQ ID NO: 1091826 - RNA, 19 nt, Homo sapiens
ccauguggaugcuguugug

SEQ ID NO: 1091827 - RNA, 19 nt, Homo sapiens
caacaacgaguaccucaac

SEQ ID NO: 1091828 - RNA, 19 nt, Homo sapiens
gcaggaugcugaggaacca

SEQ ID NO: 1091829 - RNA, 19 nt, Homo sapiens
gucacaggcgggaauguua

SEQ ID NO: 1091830 - RNA, 19 nt, Homo sapiens
agaaggaugaucucgcuuu

SEQ ID NO: 1091831 - RNA, 19 nt, Homo sapiens
uauguuggcucggcugaga

SEQ ID NO: 1091832 - RNA, 19 nt, Homo sapiens
ggaguggaagaucauuuau

SEQ ID NO: 1091833 - RNA, 19 nt, Homo sapiens
uaccauugauccaaagcuu

SEQ ID NO: 1091834 - RNA, 19 nt, Homo sapiens
cggcugagagugaggaauu

SEQ ID NO: 1091835 - RNA, 19 nt, Homo sapiens
auucuuagguccucuucaa

SEQ ID NO: 1091836 - RNA, 19 nt, Homo sapiens
gggcccaucuagaggacuu

SEQ ID NO: 1091837 - RNA, 19 nt, Homo sapiens
ggacaggcuggaggccaua

SEQ ID NO: 1091838 - RNA, 19 nt, Homo sapiens
cuaaauggaucuggcuuuu

SEQ ID NO: 1091839 - RNA, 19 nt, Homo sapiens
gaguggaagaucauuuaug

SEQ ID NO: 1091840 - RNA, 19 nt, Homo sapiens
ggcugagagugaggaauuu

SEQ ID NO: 1091841 - RNA, 19 nt, Homo sapiens
ggacuaggugcgcacuuca

SEQ ID NO: 1091842 - RNA, 19 nt, Homo sapiens
cuuaaccuguccucugcua

SEQ ID NO: 1091843 - RNA, 19 nt, Homo sapiens
ggagaacccgagcccuuuc

SEQ ID NO: 1091844 - RNA, 19 nt, Homo sapiens
cuccauggacugcaucuaa

SEQ ID NO: 1091845 - RNA, 19 nt, Homo sapiens
guucuaaauucugacuugu

SEQ ID NO: 1091846 - RNA, 19 nt, Homo sapiens
ccauugauccaaagcuuuc

SEQ ID NO: 1091847 - RNA, 19 nt, Homo sapiens
acccugagcugcgugagaa

SEQ ID NO: 1091848 - RNA, 19 nt, Homo sapiens
ccuaaauggaucuggcuuu

SEQ ID NO: 1091849 - RNA, 19 nt, Homo sapiens
gaguaccauugauccaaag

SEQ ID NO: 1091850 - RNA, 19 nt, Homo sapiens
gguacuucaguucuaaauu

SEQ ID NO: 1091851 - RNA, 19 nt, Homo sapiens
gaaccauguugccuuuccu

SEQ ID NO: 1091852 - RNA, 19 nt, Homo sapiens
cggacuaggugcgcacuuc

SEQ ID NO: 1091853 - RNA, 19 nt, Homo sapiens
cagacccacuccagcuuuc

SEQ ID NO: 1091854 - RNA, 19 nt, Homo sapiens
acacauguuugucuuucag

SEQ ID NO: 1091855 - RNA, 19 nt, Homo sapiens
gaggugugaucagcaggau

SEQ ID NO: 1091856 - RNA, 19 nt, Homo sapiens
uggcccaccuagaggcuuu

SEQ ID NO: 1091857 - RNA, 19 nt, Homo sapiens
auucugacuuguguucuuu

SEQ ID NO: 1091858 - RNA, 19 nt, Homo sapiens
aguucuaaauucugacuug

SEQ ID NO: 1091859 - RNA, 19 nt, Homo sapiens
aaacucagccccuaggaaa

SEQ ID NO: 1091860 - RNA, 19 nt, Homo sapiens
cagcagggagacacauguu

SEQ ID NO: 1091861 - RNA, 19 nt, Homo sapiens
uccaaagcuuucccacaga

SEQ ID NO: 1091862 - RNA, 19 nt, Homo sapiens
agagugaggaauuugauca

SEQ ID NO: 1091863 - RNA, 19 nt, Homo sapiens
uaggugcgcacuucaguuc

SEQ ID NO: 1091864 - RNA, 19 nt, Homo sapiens
acuuagaucccauuucugu

SEQ ID NO: 1091865 - RNA, 19 nt, Homo sapiens
guagacuuagaucccauuu

SEQ ID NO: 1091866 - RNA, 19 nt, Homo sapiens
ccacugugcacccuugagu

SEQ ID NO: 1091867 - RNA, 19 nt, Homo sapiens
agcagguacuucaguucua

SEQ ID NO: 1091868 - RNA, 19 nt, Homo sapiens
gagagugaggaauuugauc

SEQ ID NO: 1091869 - RNA, 19 nt, Homo sapiens
uggagaacccgagcccuuu

SEQ ID NO: 1091870 - RNA, 19 nt, Homo sapiens
gcccaugaagccagauuuc

SEQ ID NO: 1091871 - RNA, 19 nt, Homo sapiens
uaacagagcugaacuauau

SEQ ID NO: 1091872 - RNA, 19 nt, Homo sapiens
ggaaauagaggacgaauaa

SEQ ID NO: 1091873 - RNA, 19 nt, Homo sapiens
ucacaaagaugcacaugua

SEQ ID NO: 1091874 - RNA, 19 nt, Homo sapiens
gaaacucucugcaaaauua

SEQ ID NO: 1091875 - RNA, 19 nt, Homo sapiens
uaacacaucugccaauuau

SEQ ID NO: 1091876 - RNA, 19 nt, Homo sapiens
agaaagcagugaaagauua

SEQ ID NO: 1091877 - RNA, 19 nt, Homo sapiens
ggaauuugcuggacguuug

SEQ ID NO: 1091878 - RNA, 19 nt, Homo sapiens
gaaagauuaugaacaggaa

SEQ ID NO: 1091879 - RNA, 19 nt, Homo sapiens
ggaugaaacuccacaagug

SEQ ID NO: 1091880 - RNA, 19 nt, Homo sapiens
ggaccaggcacgaaaguua

SEQ ID NO: 1091881 - RNA, 19 nt, Homo sapiens
gacagaagaagauguguua

SEQ ID NO: 1091882 - RNA, 19 nt, Homo sapiens
gagcugaacuauaucaaca

SEQ ID NO: 1091883 - RNA, 19 nt, Homo sapiens
gauuucaccuguagaugua

SEQ ID NO: 1091884 - RNA, 19 nt, Homo sapiens
guggaucacugcccuuaua

SEQ ID NO: 1091885 - RNA, 19 nt, Homo sapiens
gaagaaagagggaagacaa

SEQ ID NO: 1091886 - RNA, 19 nt, Homo sapiens
gaaaacagauuaacuccuu

SEQ ID NO: 1091887 - RNA, 19 nt, Homo sapiens
gaggaagaguuacagacua

SEQ ID NO: 1091888 - RNA, 19 nt, Homo sapiens
gcaagacucagagagauua

SEQ ID NO: 1091889 - RNA, 19 nt, Homo sapiens
ccagagugcugcaguauuc

SEQ ID NO: 1091890 - RNA, 19 nt, Homo sapiens
gaauagaacccaaggaauc

SEQ ID NO: 1091891 - RNA, 19 nt, Homo sapiens
gcacgaaaguuaaaacaaa

SEQ ID NO: 1091892 - RNA, 19 nt, Homo sapiens
ggagcuacuucaucacaaa

SEQ ID NO: 1091893 - RNA, 19 nt, Homo sapiens
gaaagaaacgaggaagaaa

SEQ ID NO: 1091894 - RNA, 19 nt, Homo sapiens
gaaggcucguuuaaagaaa

SEQ ID NO: 1091895 - RNA, 19 nt, Homo sapiens
ccuccugccuuacuaauuu

SEQ ID NO: 1091896 - RNA, 19 nt, Homo sapiens
ggcugaagcugagauuaua

SEQ ID NO: 1091897 - RNA, 19 nt, Homo sapiens
gaaagagggaagacaaaga

SEQ ID NO: 1091898 - RNA, 19 nt, Homo sapiens
guuacagacuaccggauua

SEQ ID NO: 1091899 - RNA, 19 nt, Homo sapiens
ugaaggauguggaggaaga

SEQ ID NO: 1091900 - RNA, 19 nt, Homo sapiens
cguuugaacucuguuaaua

SEQ ID NO: 1091901 - RNA, 19 nt, Homo sapiens
ggauguggaggaagaguua

SEQ ID NO: 1091902 - RNA, 19 nt, Homo sapiens
gauccagagugcugcagua

SEQ ID NO: 1091903 - RNA, 19 nt, Homo sapiens
gguauaaaguguucucucu

SEQ ID NO: 1091904 - RNA, 19 nt, Homo sapiens
gcaagcgguaguuccauua

SEQ ID NO: 1091905 - RNA, 19 nt, Homo sapiens
guacaccaaggacaaauaa

SEQ ID NO: 1091906 - RNA, 19 nt, Homo sapiens
gcaucuugcuaccaaauug

SEQ ID NO: 1091907 - RNA, 19 nt, Homo sapiens
gauaugcuggugaagaaua

SEQ ID NO: 1091908 - RNA, 19 nt, Homo sapiens
cccagaaccuccaaacaaa

SEQ ID NO: 1091909 - RNA, 19 nt, Homo sapiens
gcuaacacaucugccaauu

SEQ ID NO: 1091910 - RNA, 19 nt, Homo sapiens
gcagaacguguuggaaaua

SEQ ID NO: 1091911 - RNA, 19 nt, Homo sapiens
gaacgaaagaaacgaggaa

SEQ ID NO: 1091912 - RNA, 19 nt, Homo sapiens
ccacgaaagucagguucua

SEQ ID NO: 1091913 - RNA, 19 nt, Homo sapiens
ggaaacgauucaugaacau

SEQ ID NO: 1091914 - RNA, 19 nt, Homo sapiens
cagcaugucggguuugaua

SEQ ID NO: 1091915 - RNA, 19 nt, Homo sapiens
gagaaagcagugaaagauu

SEQ ID NO: 1091916 - RNA, 19 nt, Homo sapiens
cauguggaaugaauuagaa

SEQ ID NO: 1091917 - RNA, 19 nt, Homo sapiens
gaaagucagguucuaaagu

SEQ ID NO: 1091918 - RNA, 19 nt, Homo sapiens
gagcacauguuuuaaauuc

SEQ ID NO: 1091919 - RNA, 19 nt, Homo sapiens
ggaauucgauauaaguacu

SEQ ID NO: 1091920 - RNA, 19 nt, Homo sapiens
gaaagcagugaaagauuau

SEQ ID NO: 1091921 - RNA, 19 nt, Homo sapiens
aagaagauguguuaaacug

SEQ ID NO: 1091922 - RNA, 19 nt, Homo sapiens
ggaacaaccacgaaaguca

SEQ ID NO: 1091923 - RNA, 19 nt, Homo sapiens
cuaaauggucguucuguuu

SEQ ID NO: 1091924 - RNA, 19 nt, Homo sapiens
gaaacgauucaugaacaua

SEQ ID NO: 1091925 - RNA, 19 nt, Homo sapiens
guacucuacucauggagaa

SEQ ID NO: 1091926 - RNA, 19 nt, Homo sapiens
gcaggaugguauaguuaug

SEQ ID NO: 1091927 - RNA, 19 nt, Homo sapiens
agagugacuugaagaacua

SEQ ID NO: 1091928 - RNA, 19 nt, Homo sapiens
gagaggcugugguccauag

SEQ ID NO: 1091929 - RNA, 19 nt, Homo sapiens
gaagaggaagaacgaaaga

SEQ ID NO: 1091930 - RNA, 19 nt, Homo sapiens
acacaucugccaauuauga

SEQ ID NO: 1091931 - RNA, 19 nt, Homo sapiens
gaagacagccuuguaucug

SEQ ID NO: 1091932 - RNA, 19 nt, Homo sapiens
cgaaagaaacgaggaagaa

SEQ ID NO: 1091933 - RNA, 19 nt, Homo sapiens
cagaagaagauguguuaaa

SEQ ID NO: 1091934 - RNA, 19 nt, Homo sapiens
aaagucagguucuaaaguc

SEQ ID NO: 1091935 - RNA, 19 nt, Homo sapiens
gagaaggcucguuuaaaga

SEQ ID NO: 1091936 - RNA, 19 nt, Homo sapiens
ugaagacuguguccaggaa

SEQ ID NO: 1091937 - RNA, 19 nt, Homo sapiens
gaggacgaauaaucuguau

SEQ ID NO: 1091938 - RNA, 19 nt, Homo sapiens
aaaguguucucucuggaaa

SEQ ID NO: 1091939 - RNA, 19 nt, Homo sapiens
ccaguguuauugugaaaga

SEQ ID NO: 1091940 - RNA, 19 nt, Homo sapiens
cagauuaacuccuuuucua

SEQ ID NO: 1091941 - RNA, 19 nt, Homo sapiens
uagcaguucucgauccauu

SEQ ID NO: 1091942 - RNA, 19 nt, Homo sapiens
gcgaaugcuugaagacugu

SEQ ID NO: 1091943 - RNA, 19 nt, Homo sapiens
ggacguuugaacucuguua

SEQ ID NO: 1091944 - RNA, 19 nt, Homo sapiens
cagaaaacaucaggaauuu

SEQ ID NO: 1091945 - RNA, 19 nt, Homo sapiens
ucagagagauuaaaaggaa

SEQ ID NO: 1091946 - RNA, 19 nt, Homo sapiens
gggaaggaccggugugcua

SEQ ID NO: 1091947 - RNA, 19 nt, Homo sapiens
gaccaggcacgaaaguuaa

SEQ ID NO: 1091948 - RNA, 19 nt, Homo sapiens
ccuaugaucauuucacaaa

SEQ ID NO: 1091949 - RNA, 19 nt, Homo sapiens
agaccuuccuccugccuua

SEQ ID NO: 1091950 - RNA, 19 nt, Homo sapiens
gcccuuauauggcagaauc

SEQ ID NO: 1091951 - RNA, 19 nt, Homo sapiens
acaaagaggacaagucaga

SEQ ID NO: 1091952 - RNA, 19 nt, Homo sapiens
cuaccuauuuccacaguug

SEQ ID NO: 1091953 - RNA, 19 nt, Homo sapiens
agaagaagauguguuaaac

SEQ ID NO: 1091954 - RNA, 19 nt, Homo sapiens
caaagaugcacauguagau

SEQ ID NO: 1091955 - RNA, 19 nt, Homo sapiens
ugacuuggcuucaacuacu

SEQ ID NO: 1091956 - RNA, 19 nt, Homo sapiens
cagcaggaugguauaguua

SEQ ID NO: 1091957 - RNA, 19 nt, Homo sapiens
gggccagugucguuauuau

SEQ ID NO: 1091958 - RNA, 19 nt, Homo sapiens
agacaaagaggacaaguca

SEQ ID NO: 1091959 - RNA, 19 nt, Homo sapiens
gauccaccuucaauuagug

SEQ ID NO: 1091960 - RNA, 19 nt, Homo sapiens
ggauuucaccuguagaugu

SEQ ID NO: 1091961 - RNA, 19 nt, Homo sapiens
gacggcaucuugcuaccaa

SEQ ID NO: 1091962 - RNA, 19 nt, Homo sapiens
aagacagccuuguaucuga

SEQ ID NO: 1091963 - RNA, 19 nt, Homo sapiens
gaucacugcccuuauaugg

SEQ ID NO: 1091964 - RNA, 19 nt, Homo sapiens
uaucaacaacucagagaaa

SEQ ID NO: 1091965 - RNA, 19 nt, Homo sapiens
uacuggagcuuaucggauu

SEQ ID NO: 1091966 - RNA, 19 nt, Homo sapiens
caaggacaaauaacauuga

SEQ ID NO: 1091967 - RNA, 19 nt, Homo sapiens
caaauauuccaaugaagga

SEQ ID NO: 1091968 - RNA, 19 nt, Homo sapiens
ggagaaugcagaacguguu

SEQ ID NO: 1091969 - RNA, 19 nt, Homo sapiens
acagcaggaugguauaguu

SEQ ID NO: 1091970 - RNA, 19 nt, Homo sapiens
cuaacacaucugccaauua

SEQ ID NO: 1091971 - RNA, 19 nt, Homo sapiens
gaggaaaucuagaaaguaa

SEQ ID NO: 1091972 - RNA, 19 nt, Homo sapiens
gcacuguucuuggaauuua

SEQ ID NO: 1091973 - RNA, 19 nt, Homo sapiens
gcaggaugcuauuaaagua

SEQ ID NO: 1091974 - RNA, 19 nt, Homo sapiens
gauacgaacuggugaagaa

SEQ ID NO: 1091975 - RNA, 19 nt, Homo sapiens
caaauucccuugauguaga

SEQ ID NO: 1091976 - RNA, 19 nt, Homo sapiens
ccacaaggcuguuauuucu

SEQ ID NO: 1091977 - RNA, 19 nt, Homo sapiens
aaucagaacuguuuagaug

SEQ ID NO: 1091978 - RNA, 19 nt, Homo sapiens
uggcugaucuuuaugagua

SEQ ID NO: 1091979 - RNA, 19 nt, Homo sapiens
gacaguaucuaaggaguaa

SEQ ID NO: 1091980 - RNA, 19 nt, Homo sapiens
ggucuaacaucuaacaaau

SEQ ID NO: 1091981 - RNA, 19 nt, Homo sapiens
ggacauugcagaaagauau

SEQ ID NO: 1091982 - RNA, 19 nt, Homo sapiens
cagcagagcuuucaaacag

SEQ ID NO: 1091983 - RNA, 19 nt, Homo sapiens
gggcagagauaauaaugga

SEQ ID NO: 1091984 - RNA, 19 nt, Homo sapiens
ggaaucagaugguauugag

SEQ ID NO: 1091985 - RNA, 19 nt, Homo sapiens
aaggauaacuggacauuug

SEQ ID NO: 1091986 - RNA, 19 nt, Homo sapiens
gugaaagucuccaaggaaa

SEQ ID NO: 1091987 - RNA, 19 nt, Homo sapiens
ggaggaagcagacaaugaa

SEQ ID NO: 1091988 - RNA, 19 nt, Homo sapiens
gaacaucagcauuaaagga

SEQ ID NO: 1091989 - RNA, 19 nt, Homo sapiens
gagggaacaucagcauuaa

SEQ ID NO: 1091990 - RNA, 19 nt, Homo sapiens
cggaagaaaucaauuacuu

SEQ ID NO: 1091991 - RNA, 19 nt, Homo sapiens
aagaagccauggaacuuua

SEQ ID NO: 1091992 - RNA, 19 nt, Homo sapiens
gaagaagccauggaacuuu

SEQ ID NO: 1091993 - RNA, 19 nt, Homo sapiens
guacugauguagacuuaau

SEQ ID NO: 1091994 - RNA, 19 nt, Homo sapiens
auaaaggccucugggauua

SEQ ID NO: 1091995 - RNA, 19 nt, Homo sapiens
cauggaacuuuaccacaua

SEQ ID NO: 1091996 - RNA, 19 nt, Homo sapiens
ugagggaacaucagcauua

SEQ ID NO: 1091997 - RNA, 19 nt, Homo sapiens
gaacaaagaagugaaggau

SEQ ID NO: 1091998 - RNA, 19 nt, Homo sapiens
agacagagaucagagcaaa

SEQ ID NO: 1091999 - RNA, 19 nt, Homo sapiens
gccucaaucuuaaauauga

SEQ ID NO: 1092000 - RNA, 19 nt, Homo sapiens
ccacauagcacuguucuug

SEQ ID NO: 1092001 - RNA, 19 nt, Homo sapiens
gcagggaagccaaacauga

SEQ ID NO: 1092002 - RNA, 19 nt, Homo sapiens
ucagaacuguuuagaugaa

SEQ ID NO: 1092003 - RNA, 19 nt, Homo sapiens
gaaagucuccaaggaaaga

SEQ ID NO: 1092004 - RNA, 19 nt, Homo sapiens
gaagugaaggaucuagaaa

SEQ ID NO: 1092005 - RNA, 19 nt, Homo sapiens
gggauuauacucugaagaa

SEQ ID NO: 1092006 - RNA, 19 nt, Homo sapiens
guauugauaugcccauguu

SEQ ID NO: 1092007 - RNA, 19 nt, Homo sapiens
uuagagaugucaaugcauu

SEQ ID NO: 1092008 - RNA, 19 nt, Homo sapiens
gaagagaagacaguaucua

SEQ ID NO: 1092009 - RNA, 19 nt, Homo sapiens
gaugaguggagacaaauaa

SEQ ID NO: 1092010 - RNA, 19 nt, Homo sapiens
cuaauuauccucauucaug

SEQ ID NO: 1092011 - RNA, 19 nt, Homo sapiens
acaaagaagugaaggaucu

SEQ ID NO: 1092012 - RNA, 19 nt, Homo sapiens
cauaaaggccucugggauu

SEQ ID NO: 1092013 - RNA, 19 nt, Homo sapiens
gaaaucagaacuguuuaga

SEQ ID NO: 1092014 - RNA, 19 nt, Homo sapiens
ugagaaaccacaagacaaa

SEQ ID NO: 1092015 - RNA, 19 nt, Homo sapiens
gaaagguacaguugaggaa

SEQ ID NO: 1092016 - RNA, 19 nt, Homo sapiens
guggaaaucagaacuguuu

SEQ ID NO: 1092017 - RNA, 19 nt, Homo sapiens
gcagcaagguguccauuuu

SEQ ID NO: 1092018 - RNA, 19 nt, Homo sapiens
gaaauucacaggcccaaca

SEQ ID NO: 1092019 - RNA, 19 nt, Homo sapiens
gaaaaugggugcuaaugca

SEQ ID NO: 1092020 - RNA, 19 nt, Homo sapiens
ucaaguguaaggcuaaaua

SEQ ID NO: 1092021 - RNA, 19 nt, Homo sapiens
caaauaguggcuuuagaaa

SEQ ID NO: 1092022 - RNA, 19 nt, Homo sapiens
agagaugaguggagacaaa

SEQ ID NO: 1092023 - RNA, 19 nt, Homo sapiens
gaacaccaaauucccuuga

SEQ ID NO: 1092024 - RNA, 19 nt, Homo sapiens
aaagaggugucucggaaga

SEQ ID NO: 1092025 - RNA, 19 nt, Homo sapiens
gaagcaaaccaagaacaaa

SEQ ID NO: 1092026 - RNA, 19 nt, Homo sapiens
gaauggaggacucaagguu

SEQ ID NO: 1092027 - RNA, 19 nt, Homo sapiens
gcagaaagauauggcugau

SEQ ID NO: 1092028 - RNA, 19 nt, Homo sapiens
ugacgaagcaaaccaagaa

SEQ ID NO: 1092029 - RNA, 19 nt, Homo sapiens
ugcguggacucuuugauua

SEQ ID NO: 1092030 - RNA, 19 nt, Homo sapiens
ggaggaauaugagggaaca

SEQ ID NO: 1092031 - RNA, 19 nt, Homo sapiens
acaaauaguggcuuuagaa

SEQ ID NO: 1092032 - RNA, 19 nt, Homo sapiens
aaaggccucugggauuaua

SEQ ID NO: 1092033 - RNA, 19 nt, Homo sapiens
acaauacagugaaguagug

SEQ ID NO: 1092034 - RNA, 19 nt, Homo sapiens
acaacugaauaccacaaua

SEQ ID NO: 1092035 - RNA, 19 nt, Homo sapiens
gaaauaggaaucagauggu

SEQ ID NO: 1092036 - RNA, 19 nt, Homo sapiens
gcuuacugccucaaucuua

SEQ ID NO: 1092037 - RNA, 19 nt, Homo sapiens
agauaugcguggacucuuu

SEQ ID NO: 1092038 - RNA, 19 nt, Homo sapiens
gcaucuaauuauccucauu

SEQ ID NO: 1092039 - RNA, 19 nt, Homo sapiens
caaaggaggauacgaacug

SEQ ID NO: 1092040 - RNA, 19 nt, Homo sapiens
aaauaggaaucagauggua

SEQ ID NO: 1092041 - RNA, 19 nt, Homo sapiens
caaagaaauaggaaucaga

SEQ ID NO: 1092042 - RNA, 19 nt, Homo sapiens
gcaaagaaauaggaaucag

SEQ ID NO: 1092043 - RNA, 19 nt, Homo sapiens
uaacuggacauuugaggaa

SEQ ID NO: 1092044 - RNA, 19 nt, Homo sapiens
ucagcuuagugaagaauuu

SEQ ID NO: 1092045 - RNA, 19 nt, Homo sapiens
caaguguaaggcuaaauaa

SEQ ID NO: 1092046 - RNA, 19 nt, Homo sapiens
aacagucaaucaaguguaa

SEQ ID NO: 1092047 - RNA, 19 nt, Homo sapiens
gaauaccacaauacaguga

SEQ ID NO: 1092048 - RNA, 19 nt, Homo sapiens
aagagaagacaguaucuaa

SEQ ID NO: 1092049 - RNA, 19 nt, Homo sapiens
gcauugaaagguacaguug

SEQ ID NO: 1092050 - RNA, 19 nt, Homo sapiens
gaaagcuuccaaauugaga

SEQ ID NO: 1092051 - RNA, 19 nt, Homo sapiens
ggugaaagucuccaaggaa

SEQ ID NO: 1092052 - RNA, 19 nt, Homo sapiens
gcaaaccaagaacaaagaa

SEQ ID NO: 1092053 - RNA, 19 nt, Homo sapiens
gagaagacaguaucuaagg

SEQ ID NO: 1092054 - RNA, 19 nt, Homo sapiens
ucuaacaaauaguggcuuu

SEQ ID NO: 1092055 - RNA, 19 nt, Homo sapiens
uggaaucagugagacauaa

SEQ ID NO: 1092056 - RNA, 19 nt, Homo sapiens
ccauggaacuuuaccacau

SEQ ID NO: 1092057 - RNA, 19 nt, Homo sapiens
gccaaacagucaaucaagu

SEQ ID NO: 1092058 - RNA, 19 nt, Homo sapiens
uagguuccaugcaaagaaa

SEQ ID NO: 1092059 - RNA, 19 nt, Homo sapiens
gaaaucacagaccgaacuu

SEQ ID NO: 1092060 - RNA, 19 nt, Homo sapiens
uuacaaaggaggauacgaa

SEQ ID NO: 1092061 - RNA, 19 nt, Homo sapiens
gggugaaagucuccaagga

SEQ ID NO: 1092062 - RNA, 19 nt, Homo sapiens
aaauuagguuccaugcaaa

SEQ ID NO: 1092063 - RNA, 19 nt, Homo sapiens
aaaauuagguuccaugcaa

SEQ ID NO: 1092064 - RNA, 19 nt, Homo sapiens
uuagaugaguccauuauac

SEQ ID NO: 1092065 - RNA, 19 nt, Homo sapiens
ggaaaucagaacuguuuag

SEQ ID NO: 1092066 - RNA, 19 nt, Homo sapiens
gggaacaucagcauuaaag

SEQ ID NO: 1092067 - RNA, 19 nt, Homo sapiens
ggaauaugagggaacauca

SEQ ID NO: 1092068 - RNA, 19 nt, Homo sapiens
uaauaggucugccgaucau

SEQ ID NO: 1092069 - RNA, 19 nt, Homo sapiens
ucucggaagaaaucaauua

SEQ ID NO: 1092070 - RNA, 19 nt, Homo sapiens
gcgaaucaaaguuguauag

SEQ ID NO: 1092071 - RNA, 19 nt, Homo sapiens
gaagaagacugaagaauuu

SEQ ID NO: 1092072 - RNA, 19 nt, Homo sapiens
gacaugagcuaucaaauuu

SEQ ID NO: 1092073 - RNA, 19 nt, Homo sapiens
gaaauugccuuacaggaaa

SEQ ID NO: 1092074 - RNA, 19 nt, Homo sapiens
ggucugagauuauauugua

SEQ ID NO: 1092075 - RNA, 19 nt, Homo sapiens
gaagaaagagcaacaguaa

SEQ ID NO: 1092076 - RNA, 19 nt, Homo sapiens
gaacacagaucaagaaugc

SEQ ID NO: 1092077 - RNA, 19 nt, Homo sapiens
gaaagaaaguugggucuga

SEQ ID NO: 1092078 - RNA, 19 nt, Homo sapiens
gaaagugauucaugagaaa

SEQ ID NO: 1092079 - RNA, 19 nt, Homo sapiens
gaaaugaaaccauauguug

SEQ ID NO: 1092080 - RNA, 19 nt, Homo sapiens
gcaauuccauauagaguaa

SEQ ID NO: 1092081 - RNA, 19 nt, Homo sapiens
gagagaguaucaccuagua

SEQ ID NO: 1092082 - RNA, 19 nt, Homo sapiens
ccacaacuauucauuagaa

SEQ ID NO: 1092083 - RNA, 19 nt, Homo sapiens
caacauacauucuccuuca

SEQ ID NO: 1092084 - RNA, 19 nt, Homo sapiens
ccaaaucucugaccauaga

SEQ ID NO: 1092085 - RNA, 19 nt, Homo sapiens
gaaagaagccaaucaccuu

SEQ ID NO: 1092086 - RNA, 19 nt, Homo sapiens
ggaugaagcucuagaacau

SEQ ID NO: 1092087 - RNA, 19 nt, Homo sapiens
gaaaccauauguugcuuug

SEQ ID NO: 1092088 - RNA, 19 nt, Homo sapiens
ccacuaaacuaaaggagaa

SEQ ID NO: 1092089 - RNA, 19 nt, Homo sapiens
gaauucugguucuacuuua

SEQ ID NO: 1092090 - RNA, 19 nt, Homo sapiens
gaaugaagaugagaaggaa

SEQ ID NO: 1092091 - RNA, 19 nt, Homo sapiens
ccaaguaggugcagcagaa

SEQ ID NO: 1092092 - RNA, 19 nt, Homo sapiens
ccauagagaucuuugagaa

SEQ ID NO: 1092093 - RNA, 19 nt, Homo sapiens
ggaccacaacuauucauua

SEQ ID NO: 1092094 - RNA, 19 nt, Homo sapiens
ugaaagucaugcuaaagua

SEQ ID NO: 1092095 - RNA, 19 nt, Homo sapiens
gggagacccuuauguuuga

SEQ ID NO: 1092096 - RNA, 19 nt, Homo sapiens
agaccuggauuccuuaaua

SEQ ID NO: 1092097 - RNA, 19 nt, Homo sapiens
ccagaagucuaaagagaaa

SEQ ID NO: 1092098 - RNA, 19 nt, Homo sapiens
ggacauacugggcuugaua

SEQ ID NO: 1092099 - RNA, 19 nt, Homo sapiens
gaacuggcuuuucaacuua

SEQ ID NO: 1092100 - RNA, 19 nt, Homo sapiens
gaaaugcugcucagugaaa

SEQ ID NO: 1092101 - RNA, 19 nt, Homo sapiens
gaaauauccuuaucuacag

SEQ ID NO: 1092102 - RNA, 19 nt, Homo sapiens
caacgaggaucuccacaug

SEQ ID NO: 1092103 - RNA, 19 nt, Homo sapiens
gaacauuugaugagaguuu

SEQ ID NO: 1092104 - RNA, 19 nt, Homo sapiens
caucugaaaugcuaccuuu

SEQ ID NO: 1092105 - RNA, 19 nt, Homo sapiens
ggccaaaucucugaccaua

SEQ ID NO: 1092106 - RNA, 19 nt, Homo sapiens
aaaguugggucugagauua

SEQ ID NO: 1092107 - RNA, 19 nt, Homo sapiens
cgaaagugauucaugagaa

SEQ ID NO: 1092108 - RNA, 19 nt, Homo sapiens
gaaugugauuucaaaguug

SEQ ID NO: 1092109 - RNA, 19 nt, Homo sapiens
ggacauaguagugguagua

SEQ ID NO: 1092110 - RNA, 19 nt, Homo sapiens
uaagauauuuccagccauu

SEQ ID NO: 1092111 - RNA, 19 nt, Homo sapiens
gagaaauaaugucagaaga

SEQ ID NO: 1092112 - RNA, 19 nt, Homo sapiens
ggaagaaagagcaacagua

SEQ ID NO: 1092113 - RNA, 19 nt, Homo sapiens
uaugaagguuuguagguua

SEQ ID NO: 1092114 - RNA, 19 nt, Homo sapiens
gaaagucaugcuaaaguaa

SEQ ID NO: 1092115 - RNA, 19 nt, Homo sapiens
caaaccagcugucauuaag

SEQ ID NO: 1092116 - RNA, 19 nt, Homo sapiens
augcaaauguuaccuguua

SEQ ID NO: 1092117 - RNA, 19 nt, Homo sapiens
gaucacaaauugggccuuu

SEQ ID NO: 1092118 - RNA, 19 nt, Homo sapiens
ccaaguggagucauucuua

SEQ ID NO: 1092119 - RNA, 19 nt, Homo sapiens
aacaagugcuuaucaagua

SEQ ID NO: 1092120 - RNA, 19 nt, Homo sapiens
cagguucucugaaauuaaa

SEQ ID NO: 1092121 - RNA, 19 nt, Homo sapiens
gaaauggaaagaaucugua

SEQ ID NO: 1092122 - RNA, 19 nt, Homo sapiens
ggaaaugaaggaaauucua

SEQ ID NO: 1092123 - RNA, 19 nt, Homo sapiens
gaacaagugcuuaucaagu

SEQ ID NO: 1092124 - RNA, 19 nt, Homo sapiens
ggauuuaagccgaaaguuu

SEQ ID NO: 1092125 - RNA, 19 nt, Homo sapiens
ggccagaagucuaaagaga

SEQ ID NO: 1092126 - RNA, 19 nt, Homo sapiens
gaacacacagugcaauuuc

SEQ ID NO: 1092127 - RNA, 19 nt, Homo sapiens
gaccacaacuauucauuag

SEQ ID NO: 1092128 - RNA, 19 nt, Homo sapiens
ucagugaaaugaccuguga

SEQ ID NO: 1092129 - RNA, 19 nt, Homo sapiens
gguggaaguuuaaaccaaa

SEQ ID NO: 1092130 - RNA, 19 nt, Homo sapiens
cagaagaaauugccuuaca

SEQ ID NO: 1092131 - RNA, 19 nt, Homo sapiens
ggaaagaaucuguaaugga

SEQ ID NO: 1092132 - RNA, 19 nt, Homo sapiens
caugagaaauggaaagaau

SEQ ID NO: 1092133 - RNA, 19 nt, Homo sapiens
caagaagcaauuccauaua

SEQ ID NO: 1092134 - RNA, 19 nt, Homo sapiens
gaaauuggaacaaaugaca

SEQ ID NO: 1092135 - RNA, 19 nt, Homo sapiens
gccaaagacugguuuaagu

SEQ ID NO: 1092136 - RNA, 19 nt, Homo sapiens
gaagaagauaucuccuaua

SEQ ID NO: 1092137 - RNA, 19 nt, Homo sapiens
uaugagaggugcaauaaag

SEQ ID NO: 1092138 - RNA, 19 nt, Homo sapiens
ggaaggaugugaguuacug

SEQ ID NO: 1092139 - RNA, 19 nt, Homo sapiens
gcauguggaugaagcucua

SEQ ID NO: 1092140 - RNA, 19 nt, Homo sapiens
ucagagaaauaaugucaga

SEQ ID NO: 1092141 - RNA, 19 nt, Homo sapiens
aagaggaacuuuagagaau

SEQ ID NO: 1092142 - RNA, 19 nt, Homo sapiens
ccacaaacguuagcugaau

SEQ ID NO: 1092143 - RNA, 19 nt, Homo sapiens
gccuucaucugauucuuua

SEQ ID NO: 1092144 - RNA, 19 nt, Homo sapiens
ggaaaugaaaccauauguu

SEQ ID NO: 1092145 - RNA, 19 nt, Homo sapiens
agaaucaucuucacaaagu

SEQ ID NO: 1092146 - RNA, 19 nt, Homo sapiens
ugcuauggauugucuauua

SEQ ID NO: 1092147 - RNA, 19 nt, Homo sapiens
gaaaguugggucugagauu

SEQ ID NO: 1092148 - RNA, 19 nt, Homo sapiens
agaagaagacugaagaauu

SEQ ID NO: 1092149 - RNA, 19 nt, Homo sapiens
gagcagaggcuuuccuuca

SEQ ID NO: 1092150 - RNA, 19 nt, Homo sapiens
caagugaacugucuuucca

SEQ ID NO: 1092151 - RNA, 19 nt, Homo sapiens
agaaggaaaugaaggaaau

SEQ ID NO: 1092152 - RNA, 19 nt, Homo sapiens
gaaucuugauguaaccaaa

SEQ ID NO: 1092153 - RNA, 19 nt, Homo sapiens
gacacaugguggaaguuua

SEQ ID NO: 1092154 - RNA, 19 nt, Homo sapiens
agaagaagauaucuccuau

SEQ ID NO: 1092155 - RNA, 19 nt, Homo sapiens
ggacuuugcaagaggauaa

SEQ ID NO: 1092156 - RNA, 19 nt, Homo sapiens
gaaccucaggcuuguuuaa

SEQ ID NO: 1092157 - RNA, 19 nt, Homo sapiens
gcaaauguuaccuguuaaa

SEQ ID NO: 1092158 - RNA, 19 nt, Homo sapiens
acacaaacauccugaacug

SEQ ID NO: 1092159 - RNA, 19 nt, Homo sapiens
caucaaaccagcugucauu

SEQ ID NO: 1092160 - RNA, 19 nt, Homo sapiens
agaagaggauggagugcua

SEQ ID NO: 1092161 - RNA, 19 nt, Homo sapiens
gaagaaacaccaagugaac

SEQ ID NO: 1092162 - RNA, 19 nt, Homo sapiens
gaaaugcuaccuuuauugg

SEQ ID NO: 1092163 - RNA, 19 nt, Homo sapiens
cugaaagacuuauaugaga

SEQ ID NO: 1092164 - RNA, 19 nt, Homo sapiens
gcaagauauuuaacccuau

SEQ ID NO: 1092165 - RNA, 19 nt, Homo sapiens
ugaaauaguggaagaaaga

SEQ ID NO: 1092166 - RNA, 19 nt, Homo sapiens
aagagacgaugaagauauu

SEQ ID NO: 1092167 - RNA, 19 nt, Homo sapiens
gagaagcacaugaauggaa

SEQ ID NO: 1092168 - RNA, 19 nt, Homo sapiens
caagugaguuuauaaaucc

SEQ ID NO: 1092169 - RNA, 19 nt, Homo sapiens
gucauuaaguaccucauaa

SEQ ID NO: 1092170 - RNA, 19 nt, Homo sapiens
ggauugugcaagauauuua

SEQ ID NO: 1092171 - RNA, 19 nt, Homo sapiens
ggaagaagagcaaguaaua

SEQ ID NO: 1092172 - RNA, 19 nt, Homo sapiens
caacagaccugaggaagaa

SEQ ID NO: 1092173 - RNA, 19 nt, Homo sapiens
gcauguaccuguugcagua

SEQ ID NO: 1092174 - RNA, 19 nt, Homo sapiens
ggacuuuggugacuaauca

SEQ ID NO: 1092175 - RNA, 19 nt, Homo sapiens
gcuaccaucucuaugcuua

SEQ ID NO: 1092176 - RNA, 19 nt, Homo sapiens
cagcagaaguagaaaguaa

SEQ ID NO: 1092177 - RNA, 19 nt, Homo sapiens
caacagcaauaauaacaug

SEQ ID NO: 1092178 - RNA, 19 nt, Homo sapiens
uaaaugaugucaacagcaa

SEQ ID NO: 1092179 - RNA, 19 nt, Homo sapiens
aaagaugagucugaaguua

SEQ ID NO: 1092180 - RNA, 19 nt, Homo sapiens
ggacagauguguguauaca

SEQ ID NO: 1092181 - RNA, 19 nt, Homo sapiens
gaacagaacagcaauacca

SEQ ID NO: 1092182 - RNA, 19 nt, Homo sapiens
gcaccaccauccuuucaaa

SEQ ID NO: 1092183 - RNA, 19 nt, Homo sapiens
gaugucaacagcaauaaua

SEQ ID NO: 1092184 - RNA, 19 nt, Homo sapiens
gaaguuauaucgcaaaaug

SEQ ID NO: 1092185 - RNA, 19 nt, Homo sapiens
gaugaaagaccuucugaga

SEQ ID NO: 1092186 - RNA, 19 nt, Homo sapiens
caaacaacguuccuucugu

SEQ ID NO: 1092187 - RNA, 19 nt, Homo sapiens
gcagugugcuguauuugau

SEQ ID NO: 1092188 - RNA, 19 nt, Homo sapiens
gaggcagaauuucaaguaa

SEQ ID NO: 1092189 - RNA, 19 nt, Homo sapiens
gaauguaacaagaggcaua

SEQ ID NO: 1092190 - RNA, 19 nt, Homo sapiens
agaugagucugaaguuaua

SEQ ID NO: 1092191 - RNA, 19 nt, Homo sapiens
acaugaagaugaugaaaga

SEQ ID NO: 1092192 - RNA, 19 nt, Homo sapiens
gauaagacuuuggcagaau

SEQ ID NO: 1092193 - RNA, 19 nt, Homo sapiens
gaagagcaaguaauacaug

SEQ ID NO: 1092194 - RNA, 19 nt, Homo sapiens
ccaacuaccgugaauguaa

SEQ ID NO: 1092195 - RNA, 19 nt, Homo sapiens
ccuuggagccuuuauauuu

SEQ ID NO: 1092196 - RNA, 19 nt, Homo sapiens
uaacucaggugaccacaag

SEQ ID NO: 1092197 - RNA, 19 nt, Homo sapiens
caacagcacacucuauugu

SEQ ID NO: 1092198 - RNA, 19 nt, Homo sapiens
gcugcagugugcuguauuu

SEQ ID NO: 1092199 - RNA, 19 nt, Homo sapiens
gcaguacgagccaaggaua

SEQ ID NO: 1092200 - RNA, 19 nt, Homo sapiens
guugauagcuaccaucucu

SEQ ID NO: 1092201 - RNA, 19 nt, Homo sapiens
uguaacacaucguccagua

SEQ ID NO: 1092202 - RNA, 19 nt, Homo sapiens
gaguggagcuucacaagac

SEQ ID NO: 1092203 - RNA, 19 nt, Homo sapiens
gcagaacagaacagcaaua

SEQ ID NO: 1092204 - RNA, 19 nt, Homo sapiens
caccacaagugcauacuga

SEQ ID NO: 1092205 - RNA, 19 nt, Homo sapiens
ucaaccaucuggcaauguu

SEQ ID NO: 1092206 - RNA, 19 nt, Homo sapiens
guuaaaccuuggagccuuu

SEQ ID NO: 1092207 - RNA, 19 nt, Homo sapiens
gauccucagucaacagaug

SEQ ID NO: 1092208 - RNA, 19 nt, Homo sapiens
gaaaagacaugaacaucca

SEQ ID NO: 1092209 - RNA, 19 nt, Homo sapiens
aaggagacauuaaccagaa

SEQ ID NO: 1092210 - RNA, 19 nt, Homo sapiens
cauguacucucacccaguu

SEQ ID NO: 1092211 - RNA, 19 nt, Homo sapiens
ggacuaacccugggaucaa

SEQ ID NO: 1092212 - RNA, 19 nt, Homo sapiens
uacaguaucuucaaccaau

SEQ ID NO: 1092213 - RNA, 19 nt, Homo sapiens
gaacuacaggccaagauag

SEQ ID NO: 1092214 - RNA, 19 nt, Homo sapiens
gacauuaaccagaaacuuc

SEQ ID NO: 1092215 - RNA, 19 nt, Homo sapiens
gucgauauauggaagaaga

SEQ ID NO: 1092216 - RNA, 19 nt, Homo sapiens
gcaaguaauacaugaagau

SEQ ID NO: 1092217 - RNA, 19 nt, Homo sapiens
ggacaacagaccugaggaa

SEQ ID NO: 1092218 - RNA, 19 nt, Homo sapiens
ucagaccaccauacacuua

SEQ ID NO: 1092219 - RNA, 19 nt, Homo sapiens
gaauucauuucugugcaaa

SEQ ID NO: 1092220 - RNA, 19 nt, Homo sapiens
caaguggugucauugaucu

SEQ ID NO: 1092221 - RNA, 19 nt, Homo sapiens
gcagaaguagaaaguaaug

SEQ ID NO: 1092222 - RNA, 19 nt, Homo sapiens
gaaguuagcacgcguucag

SEQ ID NO: 1092223 - RNA, 19 nt, Homo sapiens
cacaauggaugaugaagag

SEQ ID NO: 1092224 - RNA, 19 nt, Homo sapiens
ggcagaauuucaaguaaag

SEQ ID NO: 1092225 - RNA, 19 nt, Homo sapiens
agaagaauaugaggcagaa

SEQ ID NO: 1092226 - RNA, 19 nt, Homo sapiens
aaaucacacuccuguauca

SEQ ID NO: 1092227 - RNA, 19 nt, Homo sapiens
cuaaaucacacuccuguau

SEQ ID NO: 1092228 - RNA, 19 nt, Homo sapiens
uuacagccuuugccaguga

SEQ ID NO: 1092229 - RNA, 19 nt, Homo sapiens
ugaggcagaauuucaagua

SEQ ID NO: 1092230 - RNA, 19 nt, Homo sapiens
guacaagccacaaggacuu

SEQ ID NO: 1092231 - RNA, 19 nt, Homo sapiens
ccaaaucccacuaaaccaa

SEQ ID NO: 1092232 - RNA, 19 nt, Homo sapiens
ccaccaguaucaccaggaa

SEQ ID NO: 1092233 - RNA, 19 nt, Homo sapiens
caacuaccgugaauguaac

SEQ ID NO: 1092234 - RNA, 19 nt, Homo sapiens
ugauucaaguggugucauu

SEQ ID NO: 1092235 - RNA, 19 nt, Homo sapiens
ugaauucauuucugugcaa

SEQ ID NO: 1092236 - RNA, 19 nt, Homo sapiens
cagggacuuuggugacuaa

SEQ ID NO: 1092237 - RNA, 19 nt, Homo sapiens
ugauaagacuuuggcagaa

SEQ ID NO: 1092238 - RNA, 19 nt, Homo sapiens
aggcagaauuucaaguaaa

SEQ ID NO: 1092239 - RNA, 19 nt, Homo sapiens
gagccaaggauauuuaugg

SEQ ID NO: 1092240 - RNA, 19 nt, Homo sapiens
ggacuucuuuacccacagu

SEQ ID NO: 1092241 - RNA, 19 nt, Homo sapiens
caaaucccacuaaaccaaa

SEQ ID NO: 1092242 - RNA, 19 nt, Homo sapiens
ugaacuacaggccaagaua

SEQ ID NO: 1092243 - RNA, 19 nt, Homo sapiens
ucuaaacgucgucgauaua

SEQ ID NO: 1092244 - RNA, 19 nt, Homo sapiens
guacgagccaaggauauuu

SEQ ID NO: 1092245 - RNA, 19 nt, Homo sapiens
gaggaagaagagcaaguaa

SEQ ID NO: 1092246 - RNA, 19 nt, Homo sapiens
guaagaaagcagcugauag

SEQ ID NO: 1092247 - RNA, 19 nt, Homo sapiens
aaacaagaaaguagugaga

SEQ ID NO: 1092248 - RNA, 19 nt, Homo sapiens
gccaagauagccagguuaa

SEQ ID NO: 1092249 - RNA, 19 nt, Homo sapiens
agaauaugaggcagaauuu

SEQ ID NO: 1092250 - RNA, 19 nt, Homo sapiens
uggacaauguacagucuaa

SEQ ID NO: 1092251 - RNA, 19 nt, Homo sapiens
gaagcugugccacuguuga

SEQ ID NO: 1092252 - RNA, 19 nt, Homo sapiens
aagagcaaguaauacauga

SEQ ID NO: 1092253 - RNA, 19 nt, Homo sapiens
caaagcccaccuacaguga

SEQ ID NO: 1092254 - RNA, 19 nt, Homo sapiens
cagguuaaccaaacgcuuu

SEQ ID NO: 1092255 - RNA, 19 nt, Homo sapiens
uaaacgucgucgauauaug

SEQ ID NO: 1092256 - RNA, 19 nt, Homo sapiens
guaacacaucguccaguaa

SEQ ID NO: 1092257 - RNA, 19 nt, Homo sapiens
uaucaaccaugaguucuuc

SEQ ID NO: 1092258 - RNA, 19 nt, Homo sapiens
acaagaaaguagugagagu

SEQ ID NO: 1092259 - RNA, 19 nt, Homo sapiens
ugaagcagccaaagaagau

SEQ ID NO: 1092260 - RNA, 19 nt, Homo sapiens
caagagcuccugcaaacca

SEQ ID NO: 1092261 - RNA, 19 nt, Homo sapiens
uaagaaagcagcugauagc

SEQ ID NO: 1092262 - RNA, 19 nt, Homo sapiens
gugcaaagcccaccuacag

SEQ ID NO: 1092263 - RNA, 19 nt, Homo sapiens
caagaaaguagugagaguu

SEQ ID NO: 1092264 - RNA, 19 nt, Homo sapiens
ucaggugccuaguggaaau

SEQ ID NO: 1092265 - RNA, 19 nt, Homo sapiens
gaaaguagugagaguuugc

SEQ ID NO: 1092266 - RNA, 19 nt, Homo sapiens
gacuuuggcagaauugaaa

SEQ ID NO: 1092267 - RNA, 19 nt, Homo sapiens
auaagacuuuggcagaauu

SEQ ID NO: 1092268 - RNA, 19 nt, Homo sapiens
gucuaaacgucgucgauau

SEQ ID NO: 1092269 - RNA, 19 nt, Homo sapiens
gaagaagagcaaguaauac

SEQ ID NO: 1092270 - RNA, 19 nt, Homo sapiens
aagaauaugaggcagaauu

SEQ ID NO: 1092271 - RNA, 19 nt, Homo sapiens
ggacuaagaagcaagauuu

SEQ ID NO: 1092272 - RNA, 19 nt, Homo sapiens
gaauauugcucuacacugu

SEQ ID NO: 1092273 - RNA, 19 nt, Homo sapiens
cagaacagcuugaugcaaa

SEQ ID NO: 1092274 - RNA, 19 nt, Homo sapiens
ggaaguauuugaccauuuc

SEQ ID NO: 1092275 - RNA, 19 nt, Homo sapiens
gaagcaaugugacugaaga

SEQ ID NO: 1092276 - RNA, 19 nt, Homo sapiens
gcugaugguucuuauuuaa

SEQ ID NO: 1092277 - RNA, 19 nt, Homo sapiens
gcaaacaacccacugacua

SEQ ID NO: 1092278 - RNA, 19 nt, Homo sapiens
gaagaccaguuuuaaguua

SEQ ID NO: 1092279 - RNA, 19 nt, Homo sapiens
gaaauucucuagugaucug

SEQ ID NO: 1092280 - RNA, 19 nt, Homo sapiens
caaaugagcaugguucuaa

SEQ ID NO: 1092281 - RNA, 19 nt, Homo sapiens
ggaauuuggugggaucuaa

SEQ ID NO: 1092282 - RNA, 19 nt, Homo sapiens
ggaauuagguagguaagga

SEQ ID NO: 1092283 - RNA, 19 nt, Homo sapiens
acaauuaguuggcuagaaa

SEQ ID NO: 1092284 - RNA, 19 nt, Homo sapiens
gccuuaagcucuuugagua

SEQ ID NO: 1092285 - RNA, 19 nt, Homo sapiens
cggaggaucucaaaucaaa

SEQ ID NO: 1092286 - RNA, 19 nt, Homo sapiens
gcccuuaccuuuccucuug

SEQ ID NO: 1092287 - RNA, 19 nt, Homo sapiens
aaacaaacacaaagccuua

SEQ ID NO: 1092288 - RNA, 19 nt, Homo sapiens
cuaagaaggucgcaaacaa

SEQ ID NO: 1092289 - RNA, 19 nt, Homo sapiens
guacuuccuuuaccaaaug

SEQ ID NO: 1092290 - RNA, 19 nt, Homo sapiens
gaccauuucuugagauaug

SEQ ID NO: 1092291 - RNA, 19 nt, Homo sapiens
ccuccuagguuuagucuuu

SEQ ID NO: 1092292 - RNA, 19 nt, Homo sapiens
acacuggacuucagaaaug

SEQ ID NO: 1092293 - RNA, 19 nt, Homo sapiens
uguuaaagaugcagaauug

SEQ ID NO: 1092294 - RNA, 19 nt, Homo sapiens
gcaccauucuguuaaagau

SEQ ID NO: 1092295 - RNA, 19 nt, Homo sapiens
gcgcaguccuuccaucuga

SEQ ID NO: 1092296 - RNA, 19 nt, Homo sapiens
cuagugaucugaagcaaug

SEQ ID NO: 1092297 - RNA, 19 nt, Homo sapiens
cuggauaguuucaaaguuu

SEQ ID NO: 1092298 - RNA, 19 nt, Homo sapiens
gcaaacaguggauuaccua

SEQ ID NO: 1092299 - RNA, 19 nt, Homo sapiens
caggugcucugaaagcuaa

SEQ ID NO: 1092300 - RNA, 19 nt, Homo sapiens
acagugaccuuugagcaua

SEQ ID NO: 1092301 - RNA, 19 nt, Homo sapiens
ggugugggcugacggaaug

SEQ ID NO: 1092302 - RNA, 19 nt, Homo sapiens
gaacacuggacuucagaaa

SEQ ID NO: 1092303 - RNA, 19 nt, Homo sapiens
uaccuuacuugaggaauua

SEQ ID NO: 1092304 - RNA, 19 nt, Homo sapiens
cagcugaugguucuuauuu

SEQ ID NO: 1092305 - RNA, 19 nt, Homo sapiens
ugaguagcauuguguguga

SEQ ID NO: 1092306 - RNA, 19 nt, Homo sapiens
ucucuacacuggcuaagaa

SEQ ID NO: 1092307 - RNA, 19 nt, Homo sapiens
gaaagcuaauuacuuacuc

SEQ ID NO: 1092308 - RNA, 19 nt, Homo sapiens
gaagaugccagacucagau

SEQ ID NO: 1092309 - RNA, 19 nt, Homo sapiens
caaacaacccacugacuau

SEQ ID NO: 1092310 - RNA, 19 nt, Homo sapiens
gcugaggagucauggaaga

SEQ ID NO: 1092311 - RNA, 19 nt, Homo sapiens
ccacaccaaugccuucaug

SEQ ID NO: 1092312 - RNA, 19 nt, Homo sapiens
gagcugggccuacauugga

SEQ ID NO: 1092313 - RNA, 19 nt, Homo sapiens
cuaagaauauugcucuaca

SEQ ID NO: 1092314 - RNA, 19 nt, Homo sapiens
gaggagucauggaagaguu

SEQ ID NO: 1092315 - RNA, 19 nt, Homo sapiens
ggaagaugccagacucaga

SEQ ID NO: 1092316 - RNA, 19 nt, Homo sapiens
gggcaucuuggaaguauuu

SEQ ID NO: 1092317 - RNA, 19 nt, Homo sapiens
cagcuagucucuccaccuu

SEQ ID NO: 1092318 - RNA, 19 nt, Homo sapiens
gacaauuaguuggcuagaa

SEQ ID NO: 1092319 - RNA, 19 nt, Homo sapiens
uuacguuucuguaugaaug

SEQ ID NO: 1092320 - RNA, 19 nt, Homo sapiens
cuaccuuacuugaggaauu

SEQ ID NO: 1092321 - RNA, 19 nt, Homo sapiens
acaacccacugacuauaaa

SEQ ID NO: 1092322 - RNA, 19 nt, Homo sapiens
uuagguagguaaggaauga

SEQ ID NO: 1092323 - RNA, 19 nt, Homo sapiens
ccacgugcaacacaucaua

SEQ ID NO: 1092324 - RNA, 19 nt, Homo sapiens
cacaaagccuuaagcucuu

SEQ ID NO: 1092325 - RNA, 19 nt, Homo sapiens
gaacggccucgacacauca

SEQ ID NO: 1092326 - RNA, 19 nt, Homo sapiens
aaacaacccacugacuaua

SEQ ID NO: 1092327 - RNA, 19 nt, Homo sapiens
cauuggaguuugggauuaa

SEQ ID NO: 1092328 - RNA, 19 nt, Homo sapiens
cuucauauccuucaaguuc

SEQ ID NO: 1092329 - RNA, 19 nt, Homo sapiens
gaaacacguucgucguacu

SEQ ID NO: 1092330 - RNA, 19 nt, Homo sapiens
gcauuugguucucucuaca

SEQ ID NO: 1092331 - RNA, 19 nt, Homo sapiens
acauuggaguuugggauua

SEQ ID NO: 1092332 - RNA, 19 nt, Homo sapiens
guuauguguuggcaaguug

SEQ ID NO: 1092333 - RNA, 19 nt, Homo sapiens
gaauguaguguggguuuga

SEQ ID NO: 1092334 - RNA, 19 nt, Homo sapiens
gaauuagguagguaaggaa

SEQ ID NO: 1092335 - RNA, 19 nt, Homo sapiens
uggaaguauuugaccauuu

SEQ ID NO: 1092336 - RNA, 19 nt, Homo sapiens
gggccuacauuggaaacaa

SEQ ID NO: 1092337 - RNA, 19 nt, Homo sapiens
cgacacaggcugccaccaa

SEQ ID NO: 1092338 - RNA, 19 nt, Homo sapiens
cuucagaaaugggacacua

SEQ ID NO: 1092339 - RNA, 19 nt, Homo sapiens
uugaaucucuuccuguuuc

SEQ ID NO: 1092340 - RNA, 19 nt, Homo sapiens
ccagugugaucauucuuag

SEQ ID NO: 1092341 - RNA, 19 nt, Homo sapiens
cggaaacacguucgucgua

SEQ ID NO: 1092342 - RNA, 19 nt, Homo sapiens
aaaauacagugaccuuuga

SEQ ID NO: 1092343 - RNA, 19 nt, Homo sapiens
ugaacggccucgacacauc

SEQ ID NO: 1092344 - RNA, 19 nt, Homo sapiens
cuacacuggcuaagaauau

SEQ ID NO: 1092345 - RNA, 19 nt, Homo sapiens
caucggaggaucucaaauc

SEQ ID NO: 1092346 - RNA, 19 nt, Homo sapiens
gcaccagaucaaccaguuu

SEQ ID NO: 1092347 - RNA, 19 nt, Homo sapiens
ugcccucuguccauucuua

SEQ ID NO: 1092348 - RNA, 19 nt, Homo sapiens
gcagaugaacacuggacuu

SEQ ID NO: 1092349 - RNA, 19 nt, Homo sapiens
uauccacuacuguucguua

SEQ ID NO: 1092350 - RNA, 19 nt, Homo sapiens
guauuugaccauuucuuga

SEQ ID NO: 1092351 - RNA, 19 nt, Homo sapiens
gagaacugcucacuauccu

SEQ ID NO: 1092352 - RNA, 19 nt, Homo sapiens
ugcaacacaucauacauca

SEQ ID NO: 1092353 - RNA, 19 nt, Homo sapiens
aacaguggauuaccuaagu

SEQ ID NO: 1092354 - RNA, 19 nt, Homo sapiens
caaaaucuaccuuacuuga

SEQ ID NO: 1092355 - RNA, 19 nt, Homo sapiens
ucuugaaucucuuccuguu

SEQ ID NO: 1092356 - RNA, 19 nt, Homo sapiens
caucacccuccuagguuua

SEQ ID NO: 1092357 - RNA, 19 nt, Homo sapiens
acaucacccuccuagguuu

SEQ ID NO: 1092358 - RNA, 19 nt, Homo sapiens
gcacugucccacccucaga

SEQ ID NO: 1092359 - RNA, 19 nt, Homo sapiens
ggaugcguaugcuaagaag

SEQ ID NO: 1092360 - RNA, 19 nt, Homo sapiens
gacggaaugcccuaguuga

SEQ ID NO: 1092361 - RNA, 19 nt, Homo sapiens
gaauuggaugcguaugcua

SEQ ID NO: 1092362 - RNA, 19 nt, Homo sapiens
ugaugcaaacaguggauua

SEQ ID NO: 1092363 - RNA, 19 nt, Homo sapiens
caaacaguggauuaccuaa

SEQ ID NO: 1092364 - RNA, 19 nt, Homo sapiens
aaagcauacucaaggacuu

SEQ ID NO: 1092365 - RNA, 19 nt, Homo sapiens
gugcugaggagucauggaa

SEQ ID NO: 1092366 - RNA, 19 nt, Homo sapiens
gcauacccaagaucccuuu

SEQ ID NO: 1092367 - RNA, 19 nt, Homo sapiens
ccacccaucuuuucuugaa

SEQ ID NO: 1092368 - RNA, 19 nt, Homo sapiens
gcuccagugugaucauucu

SEQ ID NO: 1092369 - RNA, 19 nt, Homo sapiens
cgaccgugcugaggaguca

SEQ ID NO: 1092370 - RNA, 19 nt, Homo sapiens
caccaaugccuucaugugu

SEQ ID NO: 1092371 - RNA, 19 nt, Homo sapiens
caacagacauucagccuuu

SEQ ID NO: 1092372 - RNA, 19 nt, Homo sapiens
gaacuggguuugaugcuuu

SEQ ID NO: 1092373 - RNA, 19 nt, Homo sapiens
gcacuacgcuaaggaauuu

SEQ ID NO: 1092374 - RNA, 19 nt, Homo sapiens
cauaguggcucaucugaua

SEQ ID NO: 1092375 - RNA, 19 nt, Homo sapiens
guucaucuguguacauuua

SEQ ID NO: 1092376 - RNA, 19 nt, Homo sapiens
caggauaucucuacucaaa

SEQ ID NO: 1092377 - RNA, 19 nt, Homo sapiens
gaacaaaucaugaagagau

SEQ ID NO: 1092378 - RNA, 19 nt, Homo sapiens
ggagaagacuggguuugua

SEQ ID NO: 1092379 - RNA, 19 nt, Homo sapiens
gaacuagaaucucugaaca

SEQ ID NO: 1092380 - RNA, 19 nt, Homo sapiens
uugcagaccuugcuacuua

SEQ ID NO: 1092381 - RNA, 19 nt, Homo sapiens
uuacagggauuaaagagua

SEQ ID NO: 1092382 - RNA, 19 nt, Homo sapiens
ggucagcgcugcauacaau

SEQ ID NO: 1092383 - RNA, 19 nt, Homo sapiens
ggauaaugcugacuacaga

SEQ ID NO: 1092384 - RNA, 19 nt, Homo sapiens
gauaucugcucuguuauuu

SEQ ID NO: 1092385 - RNA, 19 nt, Homo sapiens
ggaagcaacugagucacua

SEQ ID NO: 1092386 - RNA, 19 nt, Homo sapiens
ggaguuggcugcuagaaca

SEQ ID NO: 1092387 - RNA, 19 nt, Homo sapiens
uuggauaucugcucuguua

SEQ ID NO: 1092388 - RNA, 19 nt, Homo sapiens
acacaggaauccaucauuu

SEQ ID NO: 1092389 - RNA, 19 nt, Homo sapiens
gaaauuauucgaugacaug

SEQ ID NO: 1092390 - RNA, 19 nt, Homo sapiens
ucagucagcugcucacauu

SEQ ID NO: 1092391 - RNA, 19 nt, Homo sapiens
gaaaggauggauaagcuaa

SEQ ID NO: 1092392 - RNA, 19 nt, Homo sapiens
uaaugugacuguagaagaa

SEQ ID NO: 1092393 - RNA, 19 nt, Homo sapiens
gagcaggagucguacuuug

SEQ ID NO: 1092394 - RNA, 19 nt, Homo sapiens
ggaacaaacuguccaugag

SEQ ID NO: 1092395 - RNA, 19 nt, Homo sapiens
uaugaucaccucuuuguua

SEQ ID NO: 1092396 - RNA, 19 nt, Homo sapiens
cuaauaugaucaccucuuu

SEQ ID NO: 1092397 - RNA, 19 nt, Homo sapiens
aaaguuggauugagcauau

SEQ ID NO: 1092398 - RNA, 19 nt, Homo sapiens
ggucaucuuuacagccuua

SEQ ID NO: 1092399 - RNA, 19 nt, Homo sapiens
aauuagagcuuccugacua

SEQ ID NO: 1092400 - RNA, 19 nt, Homo sapiens
caaccuguccuguauguuu

SEQ ID NO: 1092401 - RNA, 19 nt, Homo sapiens
gguagcagaucaaccuuau

SEQ ID NO: 1092402 - RNA, 19 nt, Homo sapiens
uggauaagcugccaucuca

SEQ ID NO: 1092403 - RNA, 19 nt, Homo sapiens
gacuacagauuauuucaga

SEQ ID NO: 1092404 - RNA, 19 nt, Homo sapiens
gcaggugcuuuccuaguga

SEQ ID NO: 1092405 - RNA, 19 nt, Homo sapiens
gaaauccagaccacucuaa

SEQ ID NO: 1092406 - RNA, 19 nt, Homo sapiens
gaaacgacaaccaggauau

SEQ ID NO: 1092407 - RNA, 19 nt, Homo sapiens
aagcaccaguccauaauaa

SEQ ID NO: 1092408 - RNA, 19 nt, Homo sapiens
caaaguggaacgugugaaa

SEQ ID NO: 1092409 - RNA, 19 nt, Homo sapiens
gaagagauaguuccacagu

SEQ ID NO: 1092410 - RNA, 19 nt, Homo sapiens
gcagaucaaccuuauguuc

SEQ ID NO: 1092411 - RNA, 19 nt, Homo sapiens
gcaauuaucgaaguuguga

SEQ ID NO: 1092412 - RNA, 19 nt, Homo sapiens
aauuagaccugccauguga

SEQ ID NO: 1092413 - RNA, 19 nt, Homo sapiens
agacuggguuuguagauga

SEQ ID NO: 1092414 - RNA, 19 nt, Homo sapiens
gggaacaaaucaugaagag

SEQ ID NO: 1092415 - RNA, 19 nt, Homo sapiens
ugagucagcuuugggcuuu

SEQ ID NO: 1092416 - RNA, 19 nt, Homo sapiens
uagaaucucugaacacagu

SEQ ID NO: 1092417 - RNA, 19 nt, Homo sapiens
ggagaauguuaucaacuca

SEQ ID NO: 1092418 - RNA, 19 nt, Homo sapiens
agagauaguuccacagugu

SEQ ID NO: 1092419 - RNA, 19 nt, Homo sapiens
gaccuugcuacuuaaauua

SEQ ID NO: 1092420 - RNA, 19 nt, Homo sapiens
gaaguugugagucagcuuu

SEQ ID NO: 1092421 - RNA, 19 nt, Homo sapiens
gcugaaugcuguacuuagu

SEQ ID NO: 1092422 - RNA, 19 nt, Homo sapiens
ggauaucugcucuguuauu

SEQ ID NO: 1092423 - RNA, 19 nt, Homo sapiens
agaccuugcuacuuaaauu

SEQ ID NO: 1092424 - RNA, 19 nt, Homo sapiens
caggauguguucagcauau

SEQ ID NO: 1092425 - RNA, 19 nt, Homo sapiens
gaaaguuggauugagcaua

SEQ ID NO: 1092426 - RNA, 19 nt, Homo sapiens
acaguuagcugagcagaug

SEQ ID NO: 1092427 - RNA, 19 nt, Homo sapiens
uagcuugugugaagacauu

SEQ ID NO: 1092428 - RNA, 19 nt, Homo sapiens
uuaaacagguagcagauca

SEQ ID NO: 1092429 - RNA, 19 nt, Homo sapiens
aaacugcaauuaucgaagu

SEQ ID NO: 1092430 - RNA, 19 nt, Homo sapiens
gggaacaaacuguccauga

SEQ ID NO: 1092431 - RNA, 19 nt, Homo sapiens
cccaucagcuggaguuuau

SEQ ID NO: 1092432 - RNA, 19 nt, Homo sapiens
gcucuguuauuuccaguau

SEQ ID NO: 1092433 - RNA, 19 nt, Homo sapiens
ucagauacacagcaaguuu

SEQ ID NO: 1092434 - RNA, 19 nt, Homo sapiens
ccauucuuguuuacaguua

SEQ ID NO: 1092435 - RNA, 19 nt, Homo sapiens
gcauggacccuuuaguaga

SEQ ID NO: 1092436 - RNA, 19 nt, Homo sapiens
gaacugcuggacaugguuu

SEQ ID NO: 1092437 - RNA, 19 nt, Homo sapiens
uggauaagcuaaaacguua

SEQ ID NO: 1092438 - RNA, 19 nt, Homo sapiens
gauccuaaacugauacuuc

SEQ ID NO: 1092439 - RNA, 19 nt, Homo sapiens
ggauaucucuacucaaagc

SEQ ID NO: 1092440 - RNA, 19 nt, Homo sapiens
cauggacccuuuaguagau

SEQ ID NO: 1092441 - RNA, 19 nt, Homo sapiens
guacuuugcaccaacugua

SEQ ID NO: 1092442 - RNA, 19 nt, Homo sapiens
ccagaccacucuaaggaau

SEQ ID NO: 1092443 - RNA, 19 nt, Homo sapiens
ucuagauccuaaacugaua

SEQ ID NO: 1092444 - RNA, 19 nt, Homo sapiens
ggaaaacaaacugcaauua

SEQ ID NO: 1092445 - RNA, 19 nt, Homo sapiens
ugaacucucucuaccuguu

SEQ ID NO: 1092446 - RNA, 19 nt, Homo sapiens
uaaauuagaccugccaugu

SEQ ID NO: 1092447 - RNA, 19 nt, Homo sapiens
uaauggaacugcuggacau

SEQ ID NO: 1092448 - RNA, 19 nt, Homo sapiens
ggaggccuauucucuucaa

SEQ ID NO: 1092449 - RNA, 19 nt, Homo sapiens
ccucaguccuucauauaau

SEQ ID NO: 1092450 - RNA, 19 nt, Homo sapiens
gggaacccuuugcuaaugu

SEQ ID NO: 1092451 - RNA, 19 nt, Homo sapiens
gaacgugugaaacaggaaa

SEQ ID NO: 1092452 - RNA, 19 nt, Homo sapiens
guagaugacaaugaugaua

SEQ ID NO: 1092453 - RNA, 19 nt, Homo sapiens
aaacaauggugcagcucuu

SEQ ID NO: 1092454 - RNA, 19 nt, Homo sapiens
gaugcuuugucaacugaaa

SEQ ID NO: 1092455 - RNA, 19 nt, Homo sapiens
ugacaggaguuggcugcua

SEQ ID NO: 1092456 - RNA, 19 nt, Homo sapiens
guuuggcaauguuggauuu

SEQ ID NO: 1092457 - RNA, 19 nt, Homo sapiens
ggcguuaccuccugagcuu

SEQ ID NO: 1092458 - RNA, 19 nt, Homo sapiens
gucaugcccuggagaaugu

SEQ ID NO: 1092459 - RNA, 19 nt, Homo sapiens
ccuccaagccuuuaugcua

SEQ ID NO: 1092460 - RNA, 19 nt, Homo sapiens
caaggaggccuauucucuu

SEQ ID NO: 1092461 - RNA, 19 nt, Homo sapiens
ggugcuuccuugcucgaua

SEQ ID NO: 1092462 - RNA, 19 nt, Homo sapiens
uuucaucccucacuguuug

SEQ ID NO: 1092463 - RNA, 19 nt, Homo sapiens
gacacuggauccacuuauc

SEQ ID NO: 1092464 - RNA, 19 nt, Homo sapiens
uaaagcacaccaagaggaa

SEQ ID NO: 1092465 - RNA, 19 nt, Homo sapiens
aaacugaagcugccaaagu

SEQ ID NO: 1092466 - RNA, 19 nt, Homo sapiens
gaagaaacuaagaacaaag

SEQ ID NO: 1092467 - RNA, 19 nt, Homo sapiens
uaagcaccaguccauaaua

SEQ ID NO: 1092468 - RNA, 19 nt, Homo sapiens
gagaagacuggguuuguag

SEQ ID NO: 1092469 - RNA, 19 nt, Homo sapiens
gaagcuauccaggacagaa

SEQ ID NO: 1092470 - RNA, 19 nt, Homo sapiens
acucaucaaccuaucaaua

SEQ ID NO: 1092471 - RNA, 19 nt, Homo sapiens
gaugggaacuggcacuuua

SEQ ID NO: 1092472 - RNA, 19 nt, Homo sapiens
caacagugauugaggauuu

SEQ ID NO: 1092473 - RNA, 19 nt, Homo sapiens
ggaagugucuaauguaugu

SEQ ID NO: 1092474 - RNA, 19 nt, Homo sapiens
agaaagggcuugcuaagaa

SEQ ID NO: 1092475 - RNA, 19 nt, Homo sapiens
gaaagggcuugcuaagaaa

SEQ ID NO: 1092476 - RNA, 19 nt, Homo sapiens
ggagugagcaccuaaauga

SEQ ID NO: 1092477 - RNA, 19 nt, Homo sapiens
ggaauaggaucuucauaca

SEQ ID NO: 1092478 - RNA, 19 nt, Homo sapiens
gaaagaaagggcuugcuaa

SEQ ID NO: 1092479 - RNA, 19 nt, Homo sapiens
gcuggagacugacacuuua

SEQ ID NO: 1092480 - RNA, 19 nt, Homo sapiens
uaagugaccuccuucauca

SEQ ID NO: 1092481 - RNA, 19 nt, Homo sapiens
cagaagacuuguuugaauu

SEQ ID NO: 1092482 - RNA, 19 nt, Homo sapiens
gcauggcccuuaugucuug

SEQ ID NO: 1092483 - RNA, 19 nt, Homo sapiens
cuucuaaucuggagucuuu

SEQ ID NO: 1092484 - RNA, 19 nt, Homo sapiens
gcugauggcucaccugaug

SEQ ID NO: 1092485 - RNA, 19 nt, Homo sapiens
ggaaagaaagggcuugcua

SEQ ID NO: 1092486 - RNA, 19 nt, Homo sapiens
ggcuuaagcuccuagagua

SEQ ID NO: 1092487 - RNA, 19 nt, Homo sapiens
gcagggugaucuacauuug

SEQ ID NO: 1092488 - RNA, 19 nt, Homo sapiens
ccacacugcuggcaagaaa

SEQ ID NO: 1092489 - RNA, 19 nt, Homo sapiens
guacguaaauuaaguuguc

SEQ ID NO: 1092490 - RNA, 19 nt, Homo sapiens
ucagaagacuuguuugaau

SEQ ID NO: 1092491 - RNA, 19 nt, Homo sapiens
ccacuucuauuccuucuau

SEQ ID NO: 1092492 - RNA, 19 nt, Homo sapiens
gaugcuggaucucauagaa

SEQ ID NO: 1092493 - RNA, 19 nt, Homo sapiens
gauuugaucugcucaucuu

SEQ ID NO: 1092494 - RNA, 19 nt, Homo sapiens
gggaaaaccuacuggaaua

SEQ ID NO: 1092495 - RNA, 19 nt, Homo sapiens
cuucauagcuucucugcuu

SEQ ID NO: 1092496 - RNA, 19 nt, Homo sapiens
gauguuggacugcauaauu

SEQ ID NO: 1092497 - RNA, 19 nt, Homo sapiens
gcccuuaugucuugaguug

SEQ ID NO: 1092498 - RNA, 19 nt, Homo sapiens
caacaucucaaguacguaa

SEQ ID NO: 1092499 - RNA, 19 nt, Homo sapiens
gcacuaggguuugaguuuc

SEQ ID NO: 1092500 - RNA, 19 nt, Homo sapiens
gaagacuuguuugaauuug

SEQ ID NO: 1092501 - RNA, 19 nt, Homo sapiens
gcgaugacauuugcauuug

SEQ ID NO: 1092502 - RNA, 19 nt, Homo sapiens
guacaugcaugccaucuac

SEQ ID NO: 1092503 - RNA, 19 nt, Homo sapiens
ggaacuggcacuuuaccua

SEQ ID NO: 1092504 - RNA, 19 nt, Homo sapiens
gaugcuggccuaugucuuu

SEQ ID NO: 1092505 - RNA, 19 nt, Homo sapiens
ugaauuacguagucgaaga

SEQ ID NO: 1092506 - RNA, 19 nt, Homo sapiens
aagagaaggugguacaaga

SEQ ID NO: 1092507 - RNA, 19 nt, Homo sapiens
aauuugagcuggagacuga

SEQ ID NO: 1092508 - RNA, 19 nt, Homo sapiens
uuacauagcauggcccuua

SEQ ID NO: 1092509 - RNA, 19 nt, Homo sapiens
ccaaaguucccaaguggua

SEQ ID NO: 1092510 - RNA, 19 nt, Homo sapiens
uagcagcccuguagcauuc

SEQ ID NO: 1092511 - RNA, 19 nt, Homo sapiens
ggagacugacacuuuauuu

SEQ ID NO: 1092512 - RNA, 19 nt, Homo sapiens
agagaaguauaacauggua

SEQ ID NO: 1092513 - RNA, 19 nt, Homo sapiens
agaauagaauguaguggaa

SEQ ID NO: 1092514 - RNA, 19 nt, Homo sapiens
aauaggaucuucauacaag

SEQ ID NO: 1092515 - RNA, 19 nt, Homo sapiens
gaaggaugcgaccgacuuu

SEQ ID NO: 1092516 - RNA, 19 nt, Homo sapiens
cacuuuauuuggaggauua

SEQ ID NO: 1092517 - RNA, 19 nt, Homo sapiens
gaugacauuugcauuugug

SEQ ID NO: 1092518 - RNA, 19 nt, Homo sapiens
cauaaugguucucaggaau

SEQ ID NO: 1092519 - RNA, 19 nt, Homo sapiens
ucacuaggcuuccacuucu

SEQ ID NO: 1092520 - RNA, 19 nt, Homo sapiens
uggauaggcuaccaaaguu

SEQ ID NO: 1092521 - RNA, 19 nt, Homo sapiens
gcaagaauagaauguagug

SEQ ID NO: 1092522 - RNA, 19 nt, Homo sapiens
gaauaggaucuucauacaa

SEQ ID NO: 1092523 - RNA, 19 nt, Homo sapiens
guucccaagugguagauaa

SEQ ID NO: 1092524 - RNA, 19 nt, Homo sapiens
gaaaccacaggauagugua

SEQ ID NO: 1092525 - RNA, 19 nt, Homo sapiens
aaaggaggcuuaaaauuug

SEQ ID NO: 1092526 - RNA, 19 nt, Homo sapiens
ggacagccucuaagggauu

SEQ ID NO: 1092527 - RNA, 19 nt, Homo sapiens
guggauauauuugaaagug

SEQ ID NO: 1092528 - RNA, 19 nt, Homo sapiens
gaucugcucaucuucaguu

SEQ ID NO: 1092529 - RNA, 19 nt, Homo sapiens
ugagcaccauguucaguuu

SEQ ID NO: 1092530 - RNA, 19 nt, Homo sapiens
ggaagcgucaguggauaua

SEQ ID NO: 1092531 - RNA, 19 nt, Homo sapiens
caggagaauuuacaacauc

SEQ ID NO: 1092532 - RNA, 19 nt, Homo sapiens
gagacugacacuuuauuug

SEQ ID NO: 1092533 - RNA, 19 nt, Homo sapiens
gaauuacguagucgaagaa

SEQ ID NO: 1092534 - RNA, 19 nt, Homo sapiens
uauccagucuuacacaaug

SEQ ID NO: 1092535 - RNA, 19 nt, Homo sapiens
cuaccaaaguucccaagug

SEQ ID NO: 1092536 - RNA, 19 nt, Homo sapiens
acagauggguguuaucaag

SEQ ID NO: 1092537 - RNA, 19 nt, Homo sapiens
acagcugucuuuugaauua

SEQ ID NO: 1092538 - RNA, 19 nt, Homo sapiens
gccagacaaucuucuaauc

SEQ ID NO: 1092539 - RNA, 19 nt, Homo sapiens
uggaagaaguuaagagaag

SEQ ID NO: 1092540 - RNA, 19 nt, Homo sapiens
ugaaagugguaauccugaa

SEQ ID NO: 1092541 - RNA, 19 nt, Homo sapiens
aagcgucaguggauauauu

SEQ ID NO: 1092542 - RNA, 19 nt, Homo sapiens
gaguugagguuaucaucuc

SEQ ID NO: 1092543 - RNA, 19 nt, Homo sapiens
gauuugcagagaaguauaa

SEQ ID NO: 1092544 - RNA, 19 nt, Homo sapiens
gacugacacuuuauuugga

SEQ ID NO: 1092545 - RNA, 19 nt, Homo sapiens
uggacugcauaauuucuua

SEQ ID NO: 1092546 - RNA, 19 nt, Homo sapiens
gaaggugguacaagacaga

SEQ ID NO: 1092547 - RNA, 19 nt, Homo sapiens
ucauaaugguucucaggaa

SEQ ID NO: 1092548 - RNA, 19 nt, Homo sapiens
gaaagugguaauccugaau

SEQ ID NO: 1092549 - RNA, 19 nt, Homo sapiens
auagggaagugucuaaugu

SEQ ID NO: 1092550 - RNA, 19 nt, Homo sapiens
gauagggaagugucuaaug

SEQ ID NO: 1092551 - RNA, 19 nt, Homo sapiens
caucucaaguacguaaauu

SEQ ID NO: 1092552 - RNA, 19 nt, Homo sapiens
gggagucacuguggagaau

SEQ ID NO: 1092553 - RNA, 19 nt, Homo sapiens
cacagacccuggauucuca

SEQ ID NO: 1092554 - RNA, 19 nt, Homo sapiens
gaauuuacaacaucucaag

SEQ ID NO: 1092555 - RNA, 19 nt, Homo sapiens
gauaguguacccacagaug

SEQ ID NO: 1092556 - RNA, 19 nt, Homo sapiens
agaagcagcacuaggguuu

SEQ ID NO: 1092557 - RNA, 19 nt, Homo sapiens
ggcgaugacauuugcauuu

SEQ ID NO: 1092558 - RNA, 19 nt, Homo sapiens
ccacggcgaugacauuugc

SEQ ID NO: 1092559 - RNA, 19 nt, Homo sapiens
ucucggaguucaucaaaca

SEQ ID NO: 1092560 - RNA, 19 nt, Homo sapiens
gaagcagaauuuagaaacc

SEQ ID NO: 1092561 - RNA, 19 nt, Homo sapiens
gacagccucuaagggauuu

SEQ ID NO: 1092562 - RNA, 19 nt, Homo sapiens
caaggcaaauagugcuuca

SEQ ID NO: 1092563 - RNA, 19 nt, Homo sapiens
gauccuguccaaccuggua

SEQ ID NO: 1092564 - RNA, 19 nt, Homo sapiens
gucaguggauauauuugaa

SEQ ID NO: 1092565 - RNA, 19 nt, Homo sapiens
uuugagcucuuccaaguau

SEQ ID NO: 1092566 - RNA, 19 nt, Homo sapiens
uaacaugguaguuccucua

SEQ ID NO: 1092567 - RNA, 19 nt, Homo sapiens
ggacugcauaauuucuuaa

SEQ ID NO: 1092568 - RNA, 19 nt, Homo sapiens
uggccuaugucuuuuauua

SEQ ID NO: 1092569 - RNA, 19 nt, Homo sapiens
ugacguggcucuguucucu

SEQ ID NO: 1092570 - RNA, 19 nt, Homo sapiens
gcacagacccuggauucuc

SEQ ID NO: 1092571 - RNA, 19 nt, Homo sapiens
gaacauggcuaucaaacuu

SEQ ID NO: 1092572 - RNA, 19 nt, Homo sapiens
guagugaacucauguguuu

SEQ ID NO: 1092573 - RNA, 19 nt, Homo sapiens
caucaugacuggcuaauuu

SEQ ID NO: 1092574 - RNA, 19 nt, Homo sapiens
gcaagcacaugaagaaguu

SEQ ID NO: 1092575 - RNA, 19 nt, Homo sapiens
gaacucauguguuuguuuc

SEQ ID NO: 1092576 - RNA, 19 nt, Homo sapiens
caaccuggaugccuuugua

SEQ ID NO: 1092577 - RNA, 19 nt, Homo sapiens
ggaaggcucuggcaaucaa

SEQ ID NO: 1092578 - RNA, 19 nt, Homo sapiens
ggacauggagcggcauuua

SEQ ID NO: 1092579 - RNA, 19 nt, Homo sapiens
gcaagcagcaguuuaacaa

SEQ ID NO: 1092580 - RNA, 19 nt, Homo sapiens
gggagaagccuuucaagug

SEQ ID NO: 1092581 - RNA, 19 nt, Homo sapiens
aauaugacauggauacuug

SEQ ID NO: 1092582 - RNA, 19 nt, Homo sapiens
ggcaaucaaacuuucauua

SEQ ID NO: 1092583 - RNA, 19 nt, Homo sapiens
agaaaaggcuuaacuguug

SEQ ID NO: 1092584 - RNA, 19 nt, Homo sapiens
ccgacuccauuccagauua

SEQ ID NO: 1092585 - RNA, 19 nt, Homo sapiens
caacaccaccugcucagaa

SEQ ID NO: 1092586 - RNA, 19 nt, Homo sapiens
aguuucagcuccagaauuu

SEQ ID NO: 1092587 - RNA, 19 nt, Homo sapiens
aagcagaccuacuccauca

SEQ ID NO: 1092588 - RNA, 19 nt, Homo sapiens
gcaaucaaacuuucauuac

SEQ ID NO: 1092589 - RNA, 19 nt, Homo sapiens
gcagcagccucaacaagca

SEQ ID NO: 1092590 - RNA, 19 nt, Homo sapiens
guaagucuguuggcaugaa

SEQ ID NO: 1092591 - RNA, 19 nt, Homo sapiens
ccaaagugcugggauuaca

SEQ ID NO: 1092592 - RNA, 19 nt, Homo sapiens
gaccacagguguacgacau

SEQ ID NO: 1092593 - RNA, 19 nt, Homo sapiens
gcagaccuacuccaucauu

SEQ ID NO: 1092594 - RNA, 19 nt, Homo sapiens
gggacaugguuaagacuga

SEQ ID NO: 1092595 - RNA, 19 nt, Homo sapiens
gcacagcgggaauaacuuc

SEQ ID NO: 1092596 - RNA, 19 nt, Homo sapiens
gugguuugcucuuaauguu

SEQ ID NO: 1092597 - RNA, 19 nt, Homo sapiens
ggccgugguuugcucuuaa

SEQ ID NO: 1092598 - RNA, 19 nt, Homo sapiens
ucuaaaagguuugcucuua

SEQ ID NO: 1092599 - RNA, 19 nt, Homo sapiens
uuaccaagaugauuccaau

SEQ ID NO: 1092600 - RNA, 19 nt, Homo sapiens
ccauaagugugaagucugu

SEQ ID NO: 1092601 - RNA, 19 nt, Homo sapiens
gagaagugcucggaaugca

SEQ ID NO: 1092602 - RNA, 19 nt, Homo sapiens
gacauggagcggcauuuaa

SEQ ID NO: 1092603 - RNA, 19 nt, Homo sapiens
ccucugaaucgucgcauua

SEQ ID NO: 1092604 - RNA, 19 nt, Homo sapiens
gaguuuccacugcgauaua

SEQ ID NO: 1092605 - RNA, 19 nt, Homo sapiens
ugagcaagcacaugaagaa

SEQ ID NO: 1092606 - RNA, 19 nt, Homo sapiens
cugaaucgucgcauuauaa

SEQ ID NO: 1092607 - RNA, 19 nt, Homo sapiens
caagcuggaugccaagaag

SEQ ID NO: 1092608 - RNA, 19 nt, Homo sapiens
cauggauacuugacccaaa

SEQ ID NO: 1092609 - RNA, 19 nt, Homo sapiens
ucugaaucgucgcauuaua

SEQ ID NO: 1092610 - RNA, 19 nt, Homo sapiens
gacggagucucgcucuguu

SEQ ID NO: 1092611 - RNA, 19 nt, Homo sapiens
aagguuugcucuuaauguu

SEQ ID NO: 1092612 - RNA, 19 nt, Homo sapiens
gcucuggcaaucaaacuuu

SEQ ID NO: 1092613 - RNA, 19 nt, Homo sapiens
aaagguuucuguccaucuu

SEQ ID NO: 1092614 - RNA, 19 nt, Homo sapiens
ggagugcaguggcgcuauc

SEQ ID NO: 1092615 - RNA, 19 nt, Homo sapiens
aauguccgcugcaccauga

SEQ ID NO: 1092616 - RNA, 19 nt, Homo sapiens
gcgugaagcccuacaagug

SEQ ID NO: 1092617 - RNA, 19 nt, Homo sapiens
ccaagaugauuccaaugag

SEQ ID NO: 1092618 - RNA, 19 nt, Homo sapiens
cuaaaagguuugcucuuaa

SEQ ID NO: 1092619 - RNA, 19 nt, Homo sapiens
caggaaggcucuggcaauc

SEQ ID NO: 1092620 - RNA, 19 nt, Homo sapiens
uaacaaccuggaugccuuu

SEQ ID NO: 1092621 - RNA, 19 nt, Homo sapiens
gcaccgaccgcccuuucaa

SEQ ID NO: 1092622 - RNA, 19 nt, Homo sapiens
gaacuccugaccucaagug

SEQ ID NO: 1092623 - RNA, 19 nt, Homo sapiens
gguauuacuugcacugacu

SEQ ID NO: 1092624 - RNA, 19 nt, Homo sapiens
cgugaccguucuccaguuu

SEQ ID NO: 1092625 - RNA, 19 nt, Homo sapiens
ucaagucgcacauccguau

SEQ ID NO: 1092626 - RNA, 19 nt, Homo sapiens
caagugcuuuagccggaaa

SEQ ID NO: 1092627 - RNA, 19 nt, Homo sapiens
ccagcacgguccaguuugu

SEQ ID NO: 1092628 - RNA, 19 nt, Homo sapiens
cauuccagauuagugcuua

SEQ ID NO: 1092629 - RNA, 19 nt, Homo sapiens
ccaguucggguauuacuug

SEQ ID NO: 1092630 - RNA, 19 nt, Homo sapiens
gguuaagacugaggcucua

SEQ ID NO: 1092631 - RNA, 19 nt, Homo sapiens
acauggagcggcauuuaaa

SEQ ID NO: 1092632 - RNA, 19 nt, Homo sapiens
gaaggaccauuuucuacau

SEQ ID NO: 1092633 - RNA, 19 nt, Homo sapiens
ccacagguguacgacauca

SEQ ID NO: 1092634 - RNA, 19 nt, Homo sapiens
ugaccguucuccaguuuca

SEQ ID NO: 1092635 - RNA, 19 nt, Homo sapiens
guuucuguccaucuuauua

SEQ ID NO: 1092636 - RNA, 19 nt, Homo sapiens
gguuggaauuaaaugcauu

SEQ ID NO: 1092637 - RNA, 19 nt, Homo sapiens
ccugagaagugcucggaau

SEQ ID NO: 1092638 - RNA, 19 nt, Homo sapiens
aaucagcucggacuugaaa

SEQ ID NO: 1092639 - RNA, 19 nt, Homo sapiens
aggcuuaacuguugcuauc

SEQ ID NO: 1092640 - RNA, 19 nt, Homo sapiens
caacucuaauaaagguuuc

SEQ ID NO: 1092641 - RNA, 19 nt, Homo sapiens
ccaacucuaauaaagguuu

SEQ ID NO: 1092642 - RNA, 19 nt, Homo sapiens
ggccuaaacgccuugauuc

SEQ ID NO: 1092643 - RNA, 19 nt, Homo sapiens
acaagagacagcacaguga

SEQ ID NO: 1092644 - RNA, 19 nt, Homo sapiens
aauaaagguuucuguccau

SEQ ID NO: 1092645 - RNA, 19 nt, Homo sapiens
cgacuccauuccagauuag

SEQ ID NO: 1092646 - RNA, 19 nt, Homo sapiens
caaucaaacuuucauuacc

SEQ ID NO: 1092647 - RNA, 19 nt, Homo sapiens
uuacuugcacugacuuuga

SEQ ID NO: 1092648 - RNA, 19 nt, Homo sapiens
agagacagcacagugagua

SEQ ID NO: 1092649 - RNA, 19 nt, Homo sapiens
gccaauucaagacugcuua

SEQ ID NO: 1092650 - RNA, 19 nt, Homo sapiens
cuauccagguugccaauuc

SEQ ID NO: 1092651 - RNA, 19 nt, Homo sapiens
gguuugcucuuaauguuuu

SEQ ID NO: 1092652 - RNA, 19 nt, Homo sapiens
gguuugcucuuaauguuuu

SEQ ID NO: 1092653 - RNA, 19 nt, Homo sapiens
ccagcaaccugagcaagca

SEQ ID NO: 1092654 - RNA, 19 nt, Homo sapiens
aaaaucagcucggacuuga

SEQ ID NO: 1092655 - RNA, 19 nt, Homo sapiens
ucaacaagcaccugaggau

SEQ ID NO: 1092656 - RNA, 19 nt, Homo sapiens
aacaccaccugcucagaaa

SEQ ID NO: 1092657 - RNA, 19 nt, Homo sapiens
uauccagguugccaauuca

SEQ ID NO: 1092658 - RNA, 19 nt, Homo sapiens
gugcaguggcgcuaucuug

SEQ ID NO: 1092659 - RNA, 19 nt, Homo sapiens
gaccuacuccaucauucaa

SEQ ID NO: 1092660 - RNA, 19 nt, Homo sapiens
gacagcagcagccucaaca

SEQ ID NO: 1092661 - RNA, 19 nt, Homo sapiens
cuccugaccucaagugauc

SEQ ID NO: 1092662 - RNA, 19 nt, Homo sapiens
ccauccagcuuugcucugu

SEQ ID NO: 1092663 - RNA, 19 nt, Homo sapiens
ggacagcagaagugacagu

SEQ ID NO: 1092664 - RNA, 19 nt, Homo sapiens
uacuugcacugacuuugaa

SEQ ID NO: 1092665 - RNA, 19 nt, Homo sapiens
ucaagcacagcgggaauaa

SEQ ID NO: 1092666 - RNA, 19 nt, Homo sapiens
caagugcgaguucugcaau

SEQ ID NO: 1092667 - RNA, 19 nt, Homo sapiens
ccucggagacccagacaau

SEQ ID NO: 1092668 - RNA, 19 nt, Homo sapiens
aagacaagcugaaaacuca

SEQ ID NO: 1092669 - RNA, 19 nt, Homo sapiens
ccagguugccaauucaaga

SEQ ID NO: 1092670 - RNA, 19 nt, Homo sapiens
gagcagaaaaugaaugguu

SEQ ID NO: 1092671 - RNA, 19 nt, Homo sapiens
gaacauggcuaucaaacuu

SEQ ID NO: 1092672 - RNA, 19 nt, Homo sapiens
caucaugacuggcuaauuu

SEQ ID NO: 1092673 - RNA, 19 nt, Homo sapiens
gcaagcacaugaagaaguu

SEQ ID NO: 1092674 - RNA, 19 nt, Homo sapiens
guagugaauucauguguuu

SEQ ID NO: 1092675 - RNA, 19 nt, Homo sapiens
caaccuggaugccuuugua

SEQ ID NO: 1092676 - RNA, 19 nt, Homo sapiens
ggaaggcucuggcaaucaa

SEQ ID NO: 1092677 - RNA, 19 nt, Homo sapiens
ggacauggagcggcauuua

SEQ ID NO: 1092678 - RNA, 19 nt, Homo sapiens
gcaagcagcaguuuaacaa

SEQ ID NO: 1092679 - RNA, 19 nt, Homo sapiens
gaauucauguguuuguuuc

SEQ ID NO: 1092680 - RNA, 19 nt, Homo sapiens
gggagaagccuuucaagug

SEQ ID NO: 1092681 - RNA, 19 nt, Homo sapiens
ggaagugcagcuugcuuua

SEQ ID NO: 1092682 - RNA, 19 nt, Homo sapiens
aauaugacauggauacuug

SEQ ID NO: 1092683 - RNA, 19 nt, Homo sapiens
ggcaaucaaacuuucauua

SEQ ID NO: 1092684 - RNA, 19 nt, Homo sapiens
agaaaaggcuuaacuguug

SEQ ID NO: 1092685 - RNA, 19 nt, Homo sapiens
ccgacuccauuccagauua

SEQ ID NO: 1092686 - RNA, 19 nt, Homo sapiens
caacaccaccugcucagaa

SEQ ID NO: 1092687 - RNA, 19 nt, Homo sapiens
aguuucagcuccagaauuu

SEQ ID NO: 1092688 - RNA, 19 nt, Homo sapiens
aagcagaccuacuccauca

SEQ ID NO: 1092689 - RNA, 19 nt, Homo sapiens
gcaaucaaacuuucauuac

SEQ ID NO: 1092690 - RNA, 19 nt, Homo sapiens
gcagcagccucaacaagca

SEQ ID NO: 1092691 - RNA, 19 nt, Homo sapiens
guaagucuguuggcaugaa

SEQ ID NO: 1092692 - RNA, 19 nt, Homo sapiens
ccaaagugcugggauuaca

SEQ ID NO: 1092693 - RNA, 19 nt, Homo sapiens
gaccacagguguacgacau

SEQ ID NO: 1092694 - RNA, 19 nt, Homo sapiens
gcagaccuacuccaucauu

SEQ ID NO: 1092695 - RNA, 19 nt, Homo sapiens
gggacaugguuaagacuga

SEQ ID NO: 1092696 - RNA, 19 nt, Homo sapiens
gcacagcgggaauaacuuc

SEQ ID NO: 1092697 - RNA, 19 nt, Homo sapiens
gugguuugcucuuaauguu

SEQ ID NO: 1092698 - RNA, 19 nt, Homo sapiens
ggccgugguuugcucuuaa

SEQ ID NO: 1092699 - RNA, 19 nt, Homo sapiens
ucuaaaagguuugcucuua

SEQ ID NO: 1092700 - RNA, 19 nt, Homo sapiens
uuaccaagaugauuccaau

SEQ ID NO: 1092701 - RNA, 19 nt, Homo sapiens
ccauaagugugaagucugu

SEQ ID NO: 1092702 - RNA, 19 nt, Homo sapiens
gagaagugcucggaaugca

SEQ ID NO: 1092703 - RNA, 19 nt, Homo sapiens
gacauggagcggcauuuaa

SEQ ID NO: 1092704 - RNA, 19 nt, Homo sapiens
ccucugaaucgucgcauua

SEQ ID NO: 1092705 - RNA, 19 nt, Homo sapiens
gaguuuccacugcgauaua

SEQ ID NO: 1092706 - RNA, 19 nt, Homo sapiens
ugagcaagcacaugaagaa

SEQ ID NO: 1092707 - RNA, 19 nt, Homo sapiens
cugaaucgucgcauuauaa

SEQ ID NO: 1092708 - RNA, 19 nt, Homo sapiens
caagcuggaugccaagaag

SEQ ID NO: 1092709 - RNA, 19 nt, Homo sapiens
cauggauacuugacccaaa

SEQ ID NO: 1092710 - RNA, 19 nt, Homo sapiens
ucugaaucgucgcauuaua

SEQ ID NO: 1092711 - RNA, 19 nt, Homo sapiens
gacggagucucgcucuguu

SEQ ID NO: 1092712 - RNA, 19 nt, Homo sapiens
aagguuugcucuuaauguu

SEQ ID NO: 1092713 - RNA, 19 nt, Homo sapiens
gcucuggcaaucaaacuuu

SEQ ID NO: 1092714 - RNA, 19 nt, Homo sapiens
aaagguuucuguccaucuu

SEQ ID NO: 1092715 - RNA, 19 nt, Homo sapiens
ggagugcaguggcgcuauc

SEQ ID NO: 1092716 - RNA, 19 nt, Homo sapiens
aauguccgcugcaccauga

SEQ ID NO: 1092717 - RNA, 19 nt, Homo sapiens
gcgugaagcccuacaagug

SEQ ID NO: 1092718 - RNA, 19 nt, Homo sapiens
ccaagaugauuccaaugag

SEQ ID NO: 1092719 - RNA, 19 nt, Homo sapiens
cuaaaagguuugcucuuaa

SEQ ID NO: 1092720 - RNA, 19 nt, Homo sapiens
uaacaaccuggaugccuuu

SEQ ID NO: 1092721 - RNA, 19 nt, Homo sapiens
caggaaggcucuggcaauc

SEQ ID NO: 1092722 - RNA, 19 nt, Homo sapiens
gcaccgaccgcccuuucaa

SEQ ID NO: 1092723 - RNA, 19 nt, Homo sapiens
gaacuccugaccucaagug

SEQ ID NO: 1092724 - RNA, 19 nt, Homo sapiens
gguauuacuugcacugacu

SEQ ID NO: 1092725 - RNA, 19 nt, Homo sapiens
cgugaccguucuccaguuu

SEQ ID NO: 1092726 - RNA, 19 nt, Homo sapiens
ucaagucgcacauccguau

SEQ ID NO: 1092727 - RNA, 19 nt, Homo sapiens
caagugcuuuagccggaaa

SEQ ID NO: 1092728 - RNA, 19 nt, Homo sapiens
cauuccagauuagugcuua

SEQ ID NO: 1092729 - RNA, 19 nt, Homo sapiens
ccaguucggguauuacuug

SEQ ID NO: 1092730 - RNA, 19 nt, Homo sapiens
gguuaagacugaggcucua

SEQ ID NO: 1092731 - RNA, 19 nt, Homo sapiens
ccagcacgguccaguuugu

SEQ ID NO: 1092732 - RNA, 19 nt, Homo sapiens
acauggagcggcauuuaaa

SEQ ID NO: 1092733 - RNA, 19 nt, Homo sapiens
gaaggaccauuuucuacau

SEQ ID NO: 1092734 - RNA, 19 nt, Homo sapiens
ugcauuaaguagugaauuc

SEQ ID NO: 1092735 - RNA, 19 nt, Homo sapiens
ccacagguguacgacauca

SEQ ID NO: 1092736 - RNA, 19 nt, Homo sapiens
ugaccguucuccaguuuca

SEQ ID NO: 1092737 - RNA, 19 nt, Homo sapiens
guuucuguccaucuuauua

SEQ ID NO: 1092738 - RNA, 19 nt, Homo sapiens
gguuggaauuaaaugcauu

SEQ ID NO: 1092739 - RNA, 19 nt, Homo sapiens
ccugagaagugcucggaau

SEQ ID NO: 1092740 - RNA, 19 nt, Homo sapiens
aaucagcucggacuugaaa

SEQ ID NO: 1092741 - RNA, 19 nt, Homo sapiens
aggcuuaacuguugcuauc

SEQ ID NO: 1092742 - RNA, 19 nt, Homo sapiens
caacucuaauaaagguuuc

SEQ ID NO: 1092743 - RNA, 19 nt, Homo sapiens
ccaacucuaauaaagguuu

SEQ ID NO: 1092744 - RNA, 19 nt, Homo sapiens
ggccuaaacgccuugauuc

SEQ ID NO: 1092745 - RNA, 19 nt, Homo sapiens
acaagagacagcacaguga

SEQ ID NO: 1092746 - RNA, 19 nt, Homo sapiens
aauaaagguuucuguccau

SEQ ID NO: 1092747 - RNA, 19 nt, Homo sapiens
cgacuccauuccagauuag

SEQ ID NO: 1092748 - RNA, 19 nt, Homo sapiens
caaucaaacuuucauuacc

SEQ ID NO: 1092749 - RNA, 19 nt, Homo sapiens
gugaauucauguguuuguu

SEQ ID NO: 1092750 - RNA, 19 nt, Homo sapiens
uuacuugcacugacuuuga

SEQ ID NO: 1092751 - RNA, 19 nt, Homo sapiens
agagacagcacagugagua

SEQ ID NO: 1092752 - RNA, 19 nt, Homo sapiens
gccaauucaagacugcuua

SEQ ID NO: 1092753 - RNA, 19 nt, Homo sapiens
cuauccagguugccaauuc

SEQ ID NO: 1092754 - RNA, 19 nt, Homo sapiens
gguuugcucuuaauguuuu

SEQ ID NO: 1092755 - RNA, 19 nt, Homo sapiens
gguuugcucuuaauguuuu

SEQ ID NO: 1092756 - RNA, 19 nt, Homo sapiens
ccagcaaccugagcaagca

SEQ ID NO: 1092757 - RNA, 19 nt, Homo sapiens
aaaaucagcucggacuuga

SEQ ID NO: 1092758 - RNA, 19 nt, Homo sapiens
ucaacaagcaccugaggau

SEQ ID NO: 1092759 - RNA, 19 nt, Homo sapiens
aacaccaccugcucagaaa

SEQ ID NO: 1092760 - RNA, 19 nt, Homo sapiens
cggaagugcagcuugcuuu

SEQ ID NO: 1092761 - RNA, 19 nt, Homo sapiens
uauccagguugccaauuca

SEQ ID NO: 1092762 - RNA, 19 nt, Homo sapiens
gugcaguggcgcuaucuug

SEQ ID NO: 1092763 - RNA, 19 nt, Homo sapiens
gaccuacuccaucauucaa

SEQ ID NO: 1092764 - RNA, 19 nt, Homo sapiens
aagugcagcuugcuuuaca

SEQ ID NO: 1092765 - RNA, 19 nt, Homo sapiens
gacagcagcagccucaaca

SEQ ID NO: 1092766 - RNA, 19 nt, Homo sapiens
gcauuaaguagugaauuca

SEQ ID NO: 1092767 - RNA, 19 nt, Homo sapiens
cuccugaccucaagugauc

SEQ ID NO: 1092768 - RNA, 19 nt, Homo sapiens
ccauccagcuuugcucugu

SEQ ID NO: 1092769 - RNA, 19 nt, Homo sapiens
ggacagcagaagugacagu

SEQ ID NO: 1092770 - RNA, 19 nt, Homo sapiens
uacuugcacugacuuugaa

SEQ ID NO: 1092771 - RNA, 19 nt, Homo sapiens
gcagauugcggguuuauaa

SEQ ID NO: 1092772 - RNA, 19 nt, Homo sapiens
gugguaccauuaucaauua

SEQ ID NO: 1092773 - RNA, 19 nt, Homo sapiens
gaaaggaucccucaaagca

SEQ ID NO: 1092774 - RNA, 19 nt, Homo sapiens
gaagauguguccggcagua

SEQ ID NO: 1092775 - RNA, 19 nt, Homo sapiens
ugaaagugcucuaucaguu

SEQ ID NO: 1092776 - RNA, 19 nt, Homo sapiens
ggccaucuaugauauauau

SEQ ID NO: 1092777 - RNA, 19 nt, Homo sapiens
gaucaucuaucagcacaaa

SEQ ID NO: 1092778 - RNA, 19 nt, Homo sapiens
gcacauaucccaguccauu

SEQ ID NO: 1092779 - RNA, 19 nt, Homo sapiens
aggaggagcuggacaauga

SEQ ID NO: 1092780 - RNA, 19 nt, Homo sapiens
gcagaagaguccagaaugg

SEQ ID NO: 1092781 - RNA, 19 nt, Homo sapiens
gaucagcguuggaguagau

SEQ ID NO: 1092782 - RNA, 19 nt, Homo sapiens
uauagaaggugguaccauu

SEQ ID NO: 1092783 - RNA, 19 nt, Homo sapiens
acaccaagaugcuuuguga

SEQ ID NO: 1092784 - RNA, 19 nt, Homo sapiens
gaagagaggacuggaaaug

SEQ ID NO: 1092785 - RNA, 19 nt, Homo sapiens
gcagggaggccucuucuga

SEQ ID NO: 1092786 - RNA, 19 nt, Homo sapiens
gaaucuguccgaaggauaa

SEQ ID NO: 1092787 - RNA, 19 nt, Homo sapiens
gaugggagguuguggaaag

SEQ ID NO: 1092788 - RNA, 19 nt, Homo sapiens
cagcacaaauuccaagaug

SEQ ID NO: 1092789 - RNA, 19 nt, Homo sapiens
ucaccaggcuuacgaagug

SEQ ID NO: 1092790 - RNA, 19 nt, Homo sapiens
agacauacuucuucccuau

SEQ ID NO: 1092791 - RNA, 19 nt, Homo sapiens
gcacccauccucugcguuu

SEQ ID NO: 1092792 - RNA, 19 nt, Homo sapiens
gaaagugcucuaucaguuc

SEQ ID NO: 1092793 - RNA, 19 nt, Homo sapiens
gaucgauacagauggauaa

SEQ ID NO: 1092794 - RNA, 19 nt, Homo sapiens
gcgagaaggugaaggugau

SEQ ID NO: 1092795 - RNA, 19 nt, Homo sapiens
gcuaugaugaggaguauga

SEQ ID NO: 1092796 - RNA, 19 nt, Homo sapiens
gagaaccccugcugaaauu

SEQ ID NO: 1092797 - RNA, 19 nt, Homo sapiens
gaccucggcugcaguaaag

SEQ ID NO: 1092798 - RNA, 19 nt, Homo sapiens
gaaggugguaccauuauca

SEQ ID NO: 1092799 - RNA, 19 nt, Homo sapiens
ccaccgaugugcugcagaa

SEQ ID NO: 1092800 - RNA, 19 nt, Homo sapiens
gcuggacaaugaagacuau

SEQ ID NO: 1092801 - RNA, 19 nt, Homo sapiens
gggaagagaggacuggaaa

SEQ ID NO: 1092802 - RNA, 19 nt, Homo sapiens
ccagggccaucuaugauau

SEQ ID NO: 1092803 - RNA, 19 nt, Homo sapiens
gaaggcacucaccacaaua

SEQ ID NO: 1092804 - RNA, 19 nt, Homo sapiens
agaaggcacucaccacaau

SEQ ID NO: 1092805 - RNA, 19 nt, Homo sapiens
ggugguaccauuaucaauu

SEQ ID NO: 1092806 - RNA, 19 nt, Homo sapiens
ccgaugugcugcagaagaa

SEQ ID NO: 1092807 - RNA, 19 nt, Homo sapiens
ccacagggcguuucucuca

SEQ ID NO: 1092808 - RNA, 19 nt, Homo sapiens
ggaggagguuccauuaacu

SEQ ID NO: 1092809 - RNA, 19 nt, Homo sapiens
caacagggccagucagaca

SEQ ID NO: 1092810 - RNA, 19 nt, Homo sapiens
gugaaaggaucccucaaag

SEQ ID NO: 1092811 - RNA, 19 nt, Homo sapiens
acaauaaaccuuuccugaa

SEQ ID NO: 1092812 - RNA, 19 nt, Homo sapiens
cgauacagauggauaaacu

SEQ ID NO: 1092813 - RNA, 19 nt, Homo sapiens
agagaggacuggaaaugga

SEQ ID NO: 1092814 - RNA, 19 nt, Homo sapiens
gggaagagaagaaccugaa

SEQ ID NO: 1092815 - RNA, 19 nt, Homo sapiens
cgaucagacucgugugaaa

SEQ ID NO: 1092816 - RNA, 19 nt, Homo sapiens
guccaauucuguaacauuc

SEQ ID NO: 1092817 - RNA, 19 nt, Homo sapiens
ggaccucggcugcaguaaa

SEQ ID NO: 1092818 - RNA, 19 nt, Homo sapiens
gaaugggccucaucaucgu

SEQ ID NO: 1092819 - RNA, 19 nt, Homo sapiens
ugauauauaugggaagaga

SEQ ID NO: 1092820 - RNA, 19 nt, Homo sapiens
aaaccagggccaucuauga

SEQ ID NO: 1092821 - RNA, 19 nt, Homo sapiens
ggagcagauugcggguuua

SEQ ID NO: 1092822 - RNA, 19 nt, Homo sapiens
uggagcagauugcggguuu

SEQ ID NO: 1092823 - RNA, 19 nt, Homo sapiens
ugauggugcuggacaguga

SEQ ID NO: 1092824 - RNA, 19 nt, Homo sapiens
gaagagaagaaccugaaag

SEQ ID NO: 1092825 - RNA, 19 nt, Homo sapiens
ggaagagaagaaccugaaa

SEQ ID NO: 1092826 - RNA, 19 nt, Homo sapiens
acgggaaguuugucaauga

SEQ ID NO: 1092827 - RNA, 19 nt, Homo sapiens
guaacauucaucuccauuu

SEQ ID NO: 1092828 - RNA, 19 nt, Homo sapiens
ggcuugagcuggccugugu

SEQ ID NO: 1092829 - RNA, 19 nt, Homo sapiens
ccugggagucuacaaauuu

SEQ ID NO: 1092830 - RNA, 19 nt, Homo sapiens
gaaggugauugacgugacu

SEQ ID NO: 1092831 - RNA, 19 nt, Homo sapiens
ggacaaugaagacuauuac

SEQ ID NO: 1092832 - RNA, 19 nt, Homo sapiens
agaaagagaaggaauugga

SEQ ID NO: 1092833 - RNA, 19 nt, Homo sapiens
gggcguuucucucaaaguc

SEQ ID NO: 1092834 - RNA, 19 nt, Homo sapiens
acagggcguuucucucaaa

SEQ ID NO: 1092835 - RNA, 19 nt, Homo sapiens
acccagagcucaagucaca

SEQ ID NO: 1092836 - RNA, 19 nt, Homo sapiens
gucucaagcuguuccguaa

SEQ ID NO: 1092837 - RNA, 19 nt, Homo sapiens
ccgcagauugaaauuaaua

SEQ ID NO: 1092838 - RNA, 19 nt, Homo sapiens
ggaaucuguccgaaggaua

SEQ ID NO: 1092839 - RNA, 19 nt, Homo sapiens
uuccgcagauugaaauuaa

SEQ ID NO: 1092840 - RNA, 19 nt, Homo sapiens
gcaguagcuuuccgcagau

SEQ ID NO: 1092841 - RNA, 19 nt, Homo sapiens
gcucuaccauccagacaag

SEQ ID NO: 1092842 - RNA, 19 nt, Homo sapiens
gcacaaauuccaagaugac

SEQ ID NO: 1092843 - RNA, 19 nt, Homo sapiens
gaugaggaguaugaagaug

SEQ ID NO: 1092844 - RNA, 19 nt, Homo sapiens
gcagagagagagagaagag

SEQ ID NO: 1092845 - RNA, 19 nt, Homo sapiens
gaaauucgagaggaguuug

SEQ ID NO: 1092846 - RNA, 19 nt, Homo sapiens
caggaucgauacagaugga

SEQ ID NO: 1092847 - RNA, 19 nt, Homo sapiens
gcaggaagagcgagaaggu

SEQ ID NO: 1092848 - RNA, 19 nt, Homo sapiens
agaaggaauuggagaagca

SEQ ID NO: 1092849 - RNA, 19 nt, Homo sapiens
gcucggaaccuagacaaga

SEQ ID NO: 1092850 - RNA, 19 nt, Homo sapiens
gagguuccauuaacuuugc

SEQ ID NO: 1092851 - RNA, 19 nt, Homo sapiens
gauaaacugccaagaacca

SEQ ID NO: 1092852 - RNA, 19 nt, Homo sapiens
uggauaaacugccaagaac

SEQ ID NO: 1092853 - RNA, 19 nt, Homo sapiens
ggaucgauacagauggaua

SEQ ID NO: 1092854 - RNA, 19 nt, Homo sapiens
cuucuucccuauucacuug

SEQ ID NO: 1092855 - RNA, 19 nt, Homo sapiens
uguccuagcucggaaccua

SEQ ID NO: 1092856 - RNA, 19 nt, Homo sapiens
cuuacgaagugcuuaguga

SEQ ID NO: 1092857 - RNA, 19 nt, Homo sapiens
ccaauucuguaacauucau

SEQ ID NO: 1092858 - RNA, 19 nt, Homo sapiens
ccuuugcacugaucaucua

SEQ ID NO: 1092859 - RNA, 19 nt, Homo sapiens
ggagguuccauuaacuuug

SEQ ID NO: 1092860 - RNA, 19 nt, Homo sapiens
ugaggaguaugaagaugug

SEQ ID NO: 1092861 - RNA, 19 nt, Homo sapiens
ggaaacaaccugaaaagca

SEQ ID NO: 1092862 - RNA, 19 nt, Homo sapiens
ucagaaagagaaggaauug

SEQ ID NO: 1092863 - RNA, 19 nt, Homo sapiens
gagaggacuggaaauggaa

SEQ ID NO: 1092864 - RNA, 19 nt, Homo sapiens
ccucagggcucagaaagag

SEQ ID NO: 1092865 - RNA, 19 nt, Homo sapiens
gcguuucucucaaagucaa

SEQ ID NO: 1092866 - RNA, 19 nt, Homo sapiens
gagagaagagaggagauug

SEQ ID NO: 1092867 - RNA, 19 nt, Homo sapiens
gaaugcagcggagcuagga

SEQ ID NO: 1092868 - RNA, 19 nt, Homo sapiens
gcagaaugcagcggagcua

SEQ ID NO: 1092869 - RNA, 19 nt, Homo sapiens
acagguggcuucccguauc

SEQ ID NO: 1092870 - RNA, 19 nt, Homo sapiens
auagaaggugguaccauua

SEQ ID NO: 1092871 - RNA, 19 nt, Homo sapiens
gaaagagcaugaguuguua

SEQ ID NO: 1092872 - RNA, 19 nt, Homo sapiens
ugacugaucugcaauuuaa

SEQ ID NO: 1092873 - RNA, 19 nt, Homo sapiens
ggaaauagcucaccauacu

SEQ ID NO: 1092874 - RNA, 19 nt, Homo sapiens
gaauugcccuuaagacuuu

SEQ ID NO: 1092875 - RNA, 19 nt, Homo sapiens
uuacaagucucucugauua

SEQ ID NO: 1092876 - RNA, 19 nt, Homo sapiens
gcagguggcuacagugaua

SEQ ID NO: 1092877 - RNA, 19 nt, Homo sapiens
gaagaaacagagcagauua

SEQ ID NO: 1092878 - RNA, 19 nt, Homo sapiens
gaucacaguuggaguugua

SEQ ID NO: 1092879 - RNA, 19 nt, Homo sapiens
gagaagaccucccgaaucu

SEQ ID NO: 1092880 - RNA, 19 nt, Homo sapiens
agaaauaucuuaccugaug

SEQ ID NO: 1092881 - RNA, 19 nt, Homo sapiens
gaacauauugcuaccagua

SEQ ID NO: 1092882 - RNA, 19 nt, Homo sapiens
aagcagagcuggcagaauu

SEQ ID NO: 1092883 - RNA, 19 nt, Homo sapiens
ugagguagguuucccauuu

SEQ ID NO: 1092884 - RNA, 19 nt, Homo sapiens
cagaggauguuguaucuuu

SEQ ID NO: 1092885 - RNA, 19 nt, Homo sapiens
gaaaagaaaugccagaaga

SEQ ID NO: 1092886 - RNA, 19 nt, Homo sapiens
ggacuauguugauaaaguu

SEQ ID NO: 1092887 - RNA, 19 nt, Homo sapiens
aaacaacaguggagauauu

SEQ ID NO: 1092888 - RNA, 19 nt, Homo sapiens
gcucuuggaugaagccaua

SEQ ID NO: 1092889 - RNA, 19 nt, Homo sapiens
aaacagagcagauuaacaa

SEQ ID NO: 1092890 - RNA, 19 nt, Homo sapiens
gacaagacaugccuucaga

SEQ ID NO: 1092891 - RNA, 19 nt, Homo sapiens
uaaaguggaugacaaaugg

SEQ ID NO: 1092892 - RNA, 19 nt, Homo sapiens
gaaggaaaguggcagaucu

SEQ ID NO: 1092893 - RNA, 19 nt, Homo sapiens
gguaaguguucaagucuuu

SEQ ID NO: 1092894 - RNA, 19 nt, Homo sapiens
guuguuaugugcuuaguaa

SEQ ID NO: 1092895 - RNA, 19 nt, Homo sapiens
uaucuuaccugaugaagga

SEQ ID NO: 1092896 - RNA, 19 nt, Homo sapiens
ggaaggauauuuugaaaga

SEQ ID NO: 1092897 - RNA, 19 nt, Homo sapiens
guucaagucuuucugauca

SEQ ID NO: 1092898 - RNA, 19 nt, Homo sapiens
acacagaaauugucucuca

SEQ ID NO: 1092899 - RNA, 19 nt, Homo sapiens
caaaggaacucaccagacu

SEQ ID NO: 1092900 - RNA, 19 nt, Homo sapiens
guguaaauguggaacguua

SEQ ID NO: 1092901 - RNA, 19 nt, Homo sapiens
gaccagcaguacuugauuu

SEQ ID NO: 1092902 - RNA, 19 nt, Homo sapiens
gagcaugaguuguuaugug

SEQ ID NO: 1092903 - RNA, 19 nt, Homo sapiens
gaaauaucuuaccugauga

SEQ ID NO: 1092904 - RNA, 19 nt, Homo sapiens
gcagaucucuacgaacuug

SEQ ID NO: 1092905 - RNA, 19 nt, Homo sapiens
aaauaccaguugacacuua

SEQ ID NO: 1092906 - RNA, 19 nt, Homo sapiens
gaagagaugccuggacaaa

SEQ ID NO: 1092907 - RNA, 19 nt, Homo sapiens
ggacauagccgagauagag

SEQ ID NO: 1092908 - RNA, 19 nt, Homo sapiens
guagguuucccauuucuua

SEQ ID NO: 1092909 - RNA, 19 nt, Homo sapiens
gaaaugcugagguagguuu

SEQ ID NO: 1092910 - RNA, 19 nt, Homo sapiens
ugauuaaucuugccaugaa

SEQ ID NO: 1092911 - RNA, 19 nt, Homo sapiens
gcucaacuuugcagaaaug

SEQ ID NO: 1092912 - RNA, 19 nt, Homo sapiens
gccaacagaugaagaaaca

SEQ ID NO: 1092913 - RNA, 19 nt, Homo sapiens
gaaaguggcagaucucuac

SEQ ID NO: 1092914 - RNA, 19 nt, Homo sapiens
agacaagaacugagaauuu

SEQ ID NO: 1092915 - RNA, 19 nt, Homo sapiens
cagagcagauuaacaaaca

SEQ ID NO: 1092916 - RNA, 19 nt, Homo sapiens
gugaagaacauaaucauug

SEQ ID NO: 1092917 - RNA, 19 nt, Homo sapiens
ucuacgaacuuguacagua

SEQ ID NO: 1092918 - RNA, 19 nt, Homo sapiens
agaaagagcaugaguuguu

SEQ ID NO: 1092919 - RNA, 19 nt, Homo sapiens
agaaacaacuggugacauc

SEQ ID NO: 1092920 - RNA, 19 nt, Homo sapiens
gacaagaacugagaauuuu

SEQ ID NO: 1092921 - RNA, 19 nt, Homo sapiens
guagugcaguuucaaagga

SEQ ID NO: 1092922 - RNA, 19 nt, Homo sapiens
caccaaagaguuacuauga

SEQ ID NO: 1092923 - RNA, 19 nt, Homo sapiens
uagcaugacugaucugcaa

SEQ ID NO: 1092924 - RNA, 19 nt, Homo sapiens
gaucagggccgagcuguga

SEQ ID NO: 1092925 - RNA, 19 nt, Homo sapiens
agaagacccugauccagaa

SEQ ID NO: 1092926 - RNA, 19 nt, Homo sapiens
ccagaaagagcaugaguug

SEQ ID NO: 1092927 - RNA, 19 nt, Homo sapiens
acaguaugcuggaaacauu

SEQ ID NO: 1092928 - RNA, 19 nt, Homo sapiens
cuacgaacuuguacaguau

SEQ ID NO: 1092929 - RNA, 19 nt, Homo sapiens
uaaaccagcuuauccaaaa

SEQ ID NO: 1092930 - RNA, 19 nt, Homo sapiens
gaacguuacaaacagauug

SEQ ID NO: 1092931 - RNA, 19 nt, Homo sapiens
ugacagaugaguuugcuaa

SEQ ID NO: 1092932 - RNA, 19 nt, Homo sapiens
gaacuccggacuucuaugu

SEQ ID NO: 1092933 - RNA, 19 nt, Homo sapiens
ccaaagaguuacuaugaac

SEQ ID NO: 1092934 - RNA, 19 nt, Homo sapiens
acuccggacuucuauguua

SEQ ID NO: 1092935 - RNA, 19 nt, Homo sapiens
gagguagguuucccauuuc

SEQ ID NO: 1092936 - RNA, 19 nt, Homo sapiens
auaacacacuggagcauuu

SEQ ID NO: 1092937 - RNA, 19 nt, Homo sapiens
gacagucgcauaugaauuc

SEQ ID NO: 1092938 - RNA, 19 nt, Homo sapiens
agacaugccuucagaggau

SEQ ID NO: 1092939 - RNA, 19 nt, Homo sapiens
ccaaguagcaugacugauc

SEQ ID NO: 1092940 - RNA, 19 nt, Homo sapiens
uuccauagauugugccuuu

SEQ ID NO: 1092941 - RNA, 19 nt, Homo sapiens
cugaugaacugcacuacuu

SEQ ID NO: 1092942 - RNA, 19 nt, Homo sapiens
cagaaauugucucucaaga

SEQ ID NO: 1092943 - RNA, 19 nt, Homo sapiens
agaggauguuguaucuuua

SEQ ID NO: 1092944 - RNA, 19 nt, Homo sapiens
gaauguaaaugugaagaac

SEQ ID NO: 1092945 - RNA, 19 nt, Homo sapiens
gaauuucaccuccagacuu

SEQ ID NO: 1092946 - RNA, 19 nt, Homo sapiens
guuggaagguguaaaugug

SEQ ID NO: 1092947 - RNA, 19 nt, Homo sapiens
gaaagacaagaacugagaa

SEQ ID NO: 1092948 - RNA, 19 nt, Homo sapiens
gaaggagagccaacagaug

SEQ ID NO: 1092949 - RNA, 19 nt, Homo sapiens
aaacaugcuucuaauaugc

SEQ ID NO: 1092950 - RNA, 19 nt, Homo sapiens
cagaugaguuugcuaaagg

SEQ ID NO: 1092951 - RNA, 19 nt, Homo sapiens
guacauccagugaggguuu

SEQ ID NO: 1092952 - RNA, 19 nt, Homo sapiens
ccauacuccuuuccaugua

SEQ ID NO: 1092953 - RNA, 19 nt, Homo sapiens
guuaugugcuuaguaaugu

SEQ ID NO: 1092954 - RNA, 19 nt, Homo sapiens
gaauaucucauggagugua

SEQ ID NO: 1092955 - RNA, 19 nt, Homo sapiens
caaguagcaugacugaucu

SEQ ID NO: 1092956 - RNA, 19 nt, Homo sapiens
gagcagauuaacaaacauu

SEQ ID NO: 1092957 - RNA, 19 nt, Homo sapiens
gaaacaacaguggagauau

SEQ ID NO: 1092958 - RNA, 19 nt, Homo sapiens
gaaaagcucuuggaugaag

SEQ ID NO: 1092959 - RNA, 19 nt, Homo sapiens
aaauuccugugaucuguaa

SEQ ID NO: 1092960 - RNA, 19 nt, Homo sapiens
gauuaaucuugccaugaaa

SEQ ID NO: 1092961 - RNA, 19 nt, Homo sapiens
caugaaauguuacccugau

SEQ ID NO: 1092962 - RNA, 19 nt, Homo sapiens
aauuucaccuccagacuuu

SEQ ID NO: 1092963 - RNA, 19 nt, Homo sapiens
ggugaacuccggacuucua

SEQ ID NO: 1092964 - RNA, 19 nt, Homo sapiens
caugacugaucugcaauuu

SEQ ID NO: 1092965 - RNA, 19 nt, Homo sapiens
gaaacagagcagauuaaca

SEQ ID NO: 1092966 - RNA, 19 nt, Homo sapiens
ucagccagaucaaccugua

SEQ ID NO: 1092967 - RNA, 19 nt, Homo sapiens
acaagucucucugauuaau

SEQ ID NO: 1092968 - RNA, 19 nt, Homo sapiens
aggaaaagcucuuggauga

SEQ ID NO: 1092969 - RNA, 19 nt, Homo sapiens
cauauuggagcaaguugua

SEQ ID NO: 1092970 - RNA, 19 nt, Homo sapiens
ggaaaguggcagaucucua

SEQ ID NO: 1092971 - RNA, 19 nt, Homo sapiens
ggagggcgcuacaaaguuu

SEQ ID NO: 1092972 - RNA, 19 nt, Homo sapiens
ggaaggacauugagcuuga

SEQ ID NO: 1092973 - RNA, 19 nt, Homo sapiens
gaugaaagcuggugggaau

SEQ ID NO: 1092974 - RNA, 19 nt, Homo sapiens
gagagugacuggaguggua

SEQ ID NO: 1092975 - RNA, 19 nt, Homo sapiens
ggaaaugcuggaaaugaua

SEQ ID NO: 1092976 - RNA, 19 nt, Homo sapiens
gcgcggaccugacagcauu

SEQ ID NO: 1092977 - RNA, 19 nt, Homo sapiens
gcccgaagcucgugcaguu

SEQ ID NO: 1092978 - RNA, 19 nt, Homo sapiens
gaacuugaccauccuggaa

SEQ ID NO: 1092979 - RNA, 19 nt, Homo sapiens
gaaagcagccagcacaaag

SEQ ID NO: 1092980 - RNA, 19 nt, Homo sapiens
acauugagcuugagaagau

SEQ ID NO: 1092981 - RNA, 19 nt, Homo sapiens
agacacggccuccacaaua

SEQ ID NO: 1092982 - RNA, 19 nt, Homo sapiens
aagacuggcugaaugauga

SEQ ID NO: 1092983 - RNA, 19 nt, Homo sapiens
ccugacagcauuccaauaa

SEQ ID NO: 1092984 - RNA, 19 nt, Homo sapiens
ccaccaaguucaccagguu

SEQ ID NO: 1092985 - RNA, 19 nt, Homo sapiens
ggacaaggcuuuugaagac

SEQ ID NO: 1092986 - RNA, 19 nt, Homo sapiens
ugacagcauuccaauaaag

SEQ ID NO: 1092987 - RNA, 19 nt, Homo sapiens
ggaaagcagccagcacaaa

SEQ ID NO: 1092988 - RNA, 19 nt, Homo sapiens
ggaacacccuggaagaaaa

SEQ ID NO: 1092989 - RNA, 19 nt, Homo sapiens
gacacggccuccacaauag

SEQ ID NO: 1092990 - RNA, 19 nt, Homo sapiens
ccaaggagggcgcuacaaa

SEQ ID NO: 1092991 - RNA, 19 nt, Homo sapiens
ucucagugcuggaacuuga

SEQ ID NO: 1092992 - RNA, 19 nt, Homo sapiens
ugacuggagugguaaagau

SEQ ID NO: 1092993 - RNA, 19 nt, Homo sapiens
gaacgagaacguccucaag

SEQ ID NO: 1092994 - RNA, 19 nt, Homo sapiens
gaagacuggcugaaugaug

SEQ ID NO: 1092995 - RNA, 19 nt, Homo sapiens
gaccucggcuccuaucaag

SEQ ID NO: 1092996 - RNA, 19 nt, Homo sapiens
uggaaaugcuggaaaugau

SEQ ID NO: 1092997 - RNA, 19 nt, Homo sapiens
gcacucugcccucgucguu

SEQ ID NO: 1092998 - RNA, 19 nt, Homo sapiens
ggugaaggagggaaagauu

SEQ ID NO: 1092999 - RNA, 19 nt, Homo sapiens
aagaugacuuccucaacaa

SEQ ID NO: 1093000 - RNA, 19 nt, Homo sapiens
caucauggccagcccaaga

SEQ ID NO: 1093001 - RNA, 19 nt, Homo sapiens
ccaccaugcucaucacucu

SEQ ID NO: 1093002 - RNA, 19 nt, Homo sapiens
gugaaggagggaaagauuu

SEQ ID NO: 1093003 - RNA, 19 nt, Homo sapiens
gccacagccugaacgagaa

SEQ ID NO: 1093004 - RNA, 19 nt, Homo sapiens
ggacauugagcuugagaag

SEQ ID NO: 1093005 - RNA, 19 nt, Homo sapiens
gaaaugcuggaaaugauac

SEQ ID NO: 1093006 - RNA, 19 nt, Homo sapiens
ccaguucacuacgcaguau

SEQ ID NO: 1093007 - RNA, 19 nt, Homo sapiens
ccauuugacccaagaauca

SEQ ID NO: 1093008 - RNA, 19 nt, Homo sapiens
uggagucucaggaggauua

SEQ ID NO: 1093009 - RNA, 19 nt, Homo sapiens
agauggaaaugcuggaaau

SEQ ID NO: 1093010 - RNA, 19 nt, Homo sapiens
gacgugaggugucccuucu

SEQ ID NO: 1093011 - RNA, 19 nt, Homo sapiens
gaugugcugccacguguga

SEQ ID NO: 1093012 - RNA, 19 nt, Homo sapiens
ggaccugacagcauuccaa

SEQ ID NO: 1093013 - RNA, 19 nt, Homo sapiens
ugacucgucucccuugucu

SEQ ID NO: 1093014 - RNA, 19 nt, Homo sapiens
ugggagaccuuuggaagug

SEQ ID NO: 1093015 - RNA, 19 nt, Homo sapiens
ccacggagggauuugauca

SEQ ID NO: 1093016 - RNA, 19 nt, Homo sapiens
uuugaagacuggcugaaug

SEQ ID NO: 1093017 - RNA, 19 nt, Homo sapiens
acaaguggaaggacauuga

SEQ ID NO: 1093018 - RNA, 19 nt, Homo sapiens
ggacaaguggaaggacauu

SEQ ID NO: 1093019 - RNA, 19 nt, Homo sapiens
ggccacaguuaucagaaca

SEQ ID NO: 1093020 - RNA, 19 nt, Homo sapiens
gugauggccuuucccuucu

SEQ ID NO: 1093021 - RNA, 19 nt, Homo sapiens
gcauggagccaaggucugu

SEQ ID NO: 1093022 - RNA, 19 nt, Homo sapiens
gaagugcugagcccaccaa

SEQ ID NO: 1093023 - RNA, 19 nt, Homo sapiens
uuugugcgcucuguuacua

SEQ ID NO: 1093024 - RNA, 19 nt, Homo sapiens
gaaggacauugagcuugag

SEQ ID NO: 1093025 - RNA, 19 nt, Homo sapiens
gaagcucgugcaguuugua

SEQ ID NO: 1093026 - RNA, 19 nt, Homo sapiens
cccgaggacuggaugaugu

SEQ ID NO: 1093027 - RNA, 19 nt, Homo sapiens
gaugcaggagggugcgaua

SEQ ID NO: 1093028 - RNA, 19 nt, Homo sapiens
uaacuuugguuuugcucua

SEQ ID NO: 1093029 - RNA, 19 nt, Homo sapiens
ugaggugucccuucucguu

SEQ ID NO: 1093030 - RNA, 19 nt, Homo sapiens
caaggagggcgcuacaaag

SEQ ID NO: 1093031 - RNA, 19 nt, Homo sapiens
gcauuccaauaaagcauac

SEQ ID NO: 1093032 - RNA, 19 nt, Homo sapiens
cugacagcauuccaauaaa

SEQ ID NO: 1093033 - RNA, 19 nt, Homo sapiens
ugugugacccucagucuug

SEQ ID NO: 1093034 - RNA, 19 nt, Homo sapiens
ggagugguaaagauggaaa

SEQ ID NO: 1093035 - RNA, 19 nt, Homo sapiens
ucaccagguucaccagaca

SEQ ID NO: 1093036 - RNA, 19 nt, Homo sapiens
uaaagcauacgggaacaug

SEQ ID NO: 1093037 - RNA, 19 nt, Homo sapiens
acagugggaugugguguuc

SEQ ID NO: 1093038 - RNA, 19 nt, Homo sapiens
cgaagcucgugcaguuugu

SEQ ID NO: 1093039 - RNA, 19 nt, Homo sapiens
gugcugagcccaccaagac

SEQ ID NO: 1093040 - RNA, 19 nt, Homo sapiens
ggaugggaccgagauuuca

SEQ ID NO: 1093041 - RNA, 19 nt, Homo sapiens
ggguucaccucagcuuugu

SEQ ID NO: 1093042 - RNA, 19 nt, Homo sapiens
ggagggugauggccuuucc

SEQ ID NO: 1093043 - RNA, 19 nt, Homo sapiens
caacguuuguuuugagugu

SEQ ID NO: 1093044 - RNA, 19 nt, Homo sapiens
cgccaccgccucagaagaa

SEQ ID NO: 1093045 - RNA, 19 nt, Homo sapiens
gaccugacagcauuccaau

SEQ ID NO: 1093046 - RNA, 19 nt, Homo sapiens
ccgaagcucgugcaguuug

SEQ ID NO: 1093047 - RNA, 19 nt, Homo sapiens
uggaacacccuggaagaaa

SEQ ID NO: 1093048 - RNA, 19 nt, Homo sapiens
gagcuucugggagaccuuu

SEQ ID NO: 1093049 - RNA, 19 nt, Homo sapiens
gagggccacaguuaucaga

SEQ ID NO: 1093050 - RNA, 19 nt, Homo sapiens
cugagaagccaccgggaaa

SEQ ID NO: 1093051 - RNA, 19 nt, Homo sapiens
caggaugggaccgagauuu

SEQ ID NO: 1093052 - RNA, 19 nt, Homo sapiens
gaaagcuggugggaaugcu

SEQ ID NO: 1093053 - RNA, 19 nt, Homo sapiens
ucccuugucugcccugugu

SEQ ID NO: 1093054 - RNA, 19 nt, Homo sapiens
gaguguggcgcguucaauc

SEQ ID NO: 1093055 - RNA, 19 nt, Homo sapiens
aucagcaacugcaguguga

SEQ ID NO: 1093056 - RNA, 19 nt, Homo sapiens
gggccacaguuaucagaac

SEQ ID NO: 1093057 - RNA, 19 nt, Homo sapiens
gcaggaugagaacaacguu

SEQ ID NO: 1093058 - RNA, 19 nt, Homo sapiens
agucaucaccugcccagaa

SEQ ID NO: 1093059 - RNA, 19 nt, Homo sapiens
gacauugagcuugagaaga

SEQ ID NO: 1093060 - RNA, 19 nt, Homo sapiens
gacagugggaugugguguu

SEQ ID NO: 1093061 - RNA, 19 nt, Homo sapiens
gggaaagcagccagcacaa

SEQ ID NO: 1093062 - RNA, 19 nt, Homo sapiens
ccuagggacucagccacuu

SEQ ID NO: 1093063 - RNA, 19 nt, Homo sapiens
gauggaaaugcuggaaaug

SEQ ID NO: 1093064 - RNA, 19 nt, Homo sapiens
augaugaccucggcuccua

SEQ ID NO: 1093065 - RNA, 19 nt, Homo sapiens
ccaguggggucucucaguu

SEQ ID NO: 1093066 - RNA, 19 nt, Homo sapiens
gccaccgccucagaagaaa

SEQ ID NO: 1093067 - RNA, 19 nt, Homo sapiens
ugguaaagauggaaaugcu

SEQ ID NO: 1093068 - RNA, 19 nt, Homo sapiens
uugcucuaguucuuucuuu

SEQ ID NO: 1093069 - RNA, 19 nt, Homo sapiens
gccaguucacuacgcagua

SEQ ID NO: 1093070 - RNA, 19 nt, Homo sapiens
ccaccaacaggaacagcaa

SEQ ID NO: 1093071 - RNA, 19 nt, Homo sapiens
ggagggcgcuacaaaguuu

SEQ ID NO: 1093072 - RNA, 19 nt, Homo sapiens
ggaaggacauugagcuuga

SEQ ID NO: 1093073 - RNA, 19 nt, Homo sapiens
gaugaaagcuggugggaau

SEQ ID NO: 1093074 - RNA, 19 nt, Homo sapiens
gagagugacuggaguggua

SEQ ID NO: 1093075 - RNA, 19 nt, Homo sapiens
ggaaaugcuggaaaugaua

SEQ ID NO: 1093076 - RNA, 19 nt, Homo sapiens
gcgcggaccugacagcauu

SEQ ID NO: 1093077 - RNA, 19 nt, Homo sapiens
gcccgaagcucgugcaguu

SEQ ID NO: 1093078 - RNA, 19 nt, Homo sapiens
gaacuugaccauccuggaa

SEQ ID NO: 1093079 - RNA, 19 nt, Homo sapiens
gaaagcagccagcacaaag

SEQ ID NO: 1093080 - RNA, 19 nt, Homo sapiens
acauugagcuugagaagau

SEQ ID NO: 1093081 - RNA, 19 nt, Homo sapiens
agacacggccuccacaaua

SEQ ID NO: 1093082 - RNA, 19 nt, Homo sapiens
aagacuggcugaaugauga

SEQ ID NO: 1093083 - RNA, 19 nt, Homo sapiens
ccugacagcauuccaauaa

SEQ ID NO: 1093084 - RNA, 19 nt, Homo sapiens
ccaccaaguucaccagguu

SEQ ID NO: 1093085 - RNA, 19 nt, Homo sapiens
ccaagggagucgguaguaa

SEQ ID NO: 1093086 - RNA, 19 nt, Homo sapiens
ggacaaggcuuuugaagac

SEQ ID NO: 1093087 - RNA, 19 nt, Homo sapiens
ugacagcauuccaauaaag

SEQ ID NO: 1093088 - RNA, 19 nt, Homo sapiens
ggaaagcagccagcacaaa

SEQ ID NO: 1093089 - RNA, 19 nt, Homo sapiens
ggaacacccuggaagaaaa

SEQ ID NO: 1093090 - RNA, 19 nt, Homo sapiens
gacacggccuccacaauag

SEQ ID NO: 1093091 - RNA, 19 nt, Homo sapiens
ccaaggagggcgcuacaaa

SEQ ID NO: 1093092 - RNA, 19 nt, Homo sapiens
ucucagugcuggaacuuga

SEQ ID NO: 1093093 - RNA, 19 nt, Homo sapiens
ugacuggagugguaaagau

SEQ ID NO: 1093094 - RNA, 19 nt, Homo sapiens
gaacgagaacguccucaag

SEQ ID NO: 1093095 - RNA, 19 nt, Homo sapiens
gaagacuggcugaaugaug

SEQ ID NO: 1093096 - RNA, 19 nt, Homo sapiens
ccaagcgagucagaaguuu

SEQ ID NO: 1093097 - RNA, 19 nt, Homo sapiens
gaccucggcuccuaucaag

SEQ ID NO: 1093098 - RNA, 19 nt, Homo sapiens
uggaaaugcuggaaaugau

SEQ ID NO: 1093099 - RNA, 19 nt, Homo sapiens
gcacucugcccucgucguu

SEQ ID NO: 1093100 - RNA, 19 nt, Homo sapiens
ggugaaggagggaaagauu

SEQ ID NO: 1093101 - RNA, 19 nt, Homo sapiens
aagaugacuuccucaacaa

SEQ ID NO: 1093102 - RNA, 19 nt, Homo sapiens
caucauggccagcccaaga

SEQ ID NO: 1093103 - RNA, 19 nt, Homo sapiens
ccaccaugcucaucacucu

SEQ ID NO: 1093104 - RNA, 19 nt, Homo sapiens
gugaaggagggaaagauuu

SEQ ID NO: 1093105 - RNA, 19 nt, Homo sapiens
gccacagccugaacgagaa

SEQ ID NO: 1093106 - RNA, 19 nt, Homo sapiens
ggacauugagcuugagaag

SEQ ID NO: 1093107 - RNA, 19 nt, Homo sapiens
gaaaugcuggaaaugauac

SEQ ID NO: 1093108 - RNA, 19 nt, Homo sapiens
ccaguucacuacgcaguau

SEQ ID NO: 1093109 - RNA, 19 nt, Homo sapiens
ccauuugacccaagaauca

SEQ ID NO: 1093110 - RNA, 19 nt, Homo sapiens
uggagucucaggaggauua

SEQ ID NO: 1093111 - RNA, 19 nt, Homo sapiens
agauggaaaugcuggaaau

SEQ ID NO: 1093112 - RNA, 19 nt, Homo sapiens
gacgugaggugucccuucu

SEQ ID NO: 1093113 - RNA, 19 nt, Homo sapiens
gaugugcugccacguguga

SEQ ID NO: 1093114 - RNA, 19 nt, Homo sapiens
ggaccugacagcauuccaa

SEQ ID NO: 1093115 - RNA, 19 nt, Homo sapiens
ugacucgucucccuugucu

SEQ ID NO: 1093116 - RNA, 19 nt, Homo sapiens
ugggagaccuuuggaagug

SEQ ID NO: 1093117 - RNA, 19 nt, Homo sapiens
ccacggagggauuugauca

SEQ ID NO: 1093118 - RNA, 19 nt, Homo sapiens
uuugaagacuggcugaaug

SEQ ID NO: 1093119 - RNA, 19 nt, Homo sapiens
acaaguggaaggacauuga

SEQ ID NO: 1093120 - RNA, 19 nt, Homo sapiens
ggacaaguggaaggacauu

SEQ ID NO: 1093121 - RNA, 19 nt, Homo sapiens
ggccacaguuaucagaaca

SEQ ID NO: 1093122 - RNA, 19 nt, Homo sapiens
gugauggccuuucccuucu

SEQ ID NO: 1093123 - RNA, 19 nt, Homo sapiens
gcauggagccaaggucugu

SEQ ID NO: 1093124 - RNA, 19 nt, Homo sapiens
gaagugcugagcccaccaa

SEQ ID NO: 1093125 - RNA, 19 nt, Homo sapiens
gaaggacauugagcuugag

SEQ ID NO: 1093126 - RNA, 19 nt, Homo sapiens
uuugugcgcucuguuacua

SEQ ID NO: 1093127 - RNA, 19 nt, Homo sapiens
gaagcucgugcaguuugua

SEQ ID NO: 1093128 - RNA, 19 nt, Homo sapiens
cccgaggacuggaugaugu

SEQ ID NO: 1093129 - RNA, 19 nt, Homo sapiens
gaugcaggagggugcgaua

SEQ ID NO: 1093130 - RNA, 19 nt, Homo sapiens
uaacuuugguuuugcucua

SEQ ID NO: 1093131 - RNA, 19 nt, Homo sapiens
ugaggugucccuucucguu

SEQ ID NO: 1093132 - RNA, 19 nt, Homo sapiens
caaggagggcgcuacaaag

SEQ ID NO: 1093133 - RNA, 19 nt, Homo sapiens
gcauuccaauaaagcauac

SEQ ID NO: 1093134 - RNA, 19 nt, Homo sapiens
cugacagcauuccaauaaa

SEQ ID NO: 1093135 - RNA, 19 nt, Homo sapiens
ugugugacccucagucuug

SEQ ID NO: 1093136 - RNA, 19 nt, Homo sapiens
ggagugguaaagauggaaa

SEQ ID NO: 1093137 - RNA, 19 nt, Homo sapiens
ucaccagguucaccagaca

SEQ ID NO: 1093138 - RNA, 19 nt, Homo sapiens
uaaagcauacgggaacaug

SEQ ID NO: 1093139 - RNA, 19 nt, Homo sapiens
acagugggaugugguguuc

SEQ ID NO: 1093140 - RNA, 19 nt, Homo sapiens
cgaagcucgugcaguuugu

SEQ ID NO: 1093141 - RNA, 19 nt, Homo sapiens
gugcugagcccaccaagac

SEQ ID NO: 1093142 - RNA, 19 nt, Homo sapiens
caagggagucgguaguaag

SEQ ID NO: 1093143 - RNA, 19 nt, Homo sapiens
ggaugggaccgagauuuca

SEQ ID NO: 1093144 - RNA, 19 nt, Homo sapiens
ggagggugauggccuuucc

SEQ ID NO: 1093145 - RNA, 19 nt, Homo sapiens
caacguuuguuuugagugu

SEQ ID NO: 1093146 - RNA, 19 nt, Homo sapiens
ggguucaccucagcuuugu

SEQ ID NO: 1093147 - RNA, 19 nt, Homo sapiens
cgccaccgccucagaagaa

SEQ ID NO: 1093148 - RNA, 19 nt, Homo sapiens
gaccugacagcauuccaau

SEQ ID NO: 1093149 - RNA, 19 nt, Homo sapiens
ccgaagcucgugcaguuug

SEQ ID NO: 1093150 - RNA, 19 nt, Homo sapiens
uggaacacccuggaagaaa

SEQ ID NO: 1093151 - RNA, 19 nt, Homo sapiens
gagcuucugggagaccuuu

SEQ ID NO: 1093152 - RNA, 19 nt, Homo sapiens
gagggccacaguuaucaga

SEQ ID NO: 1093153 - RNA, 19 nt, Homo sapiens
cugagaagccaccgggaaa

SEQ ID NO: 1093154 - RNA, 19 nt, Homo sapiens
caggaugggaccgagauuu

SEQ ID NO: 1093155 - RNA, 19 nt, Homo sapiens
ucccuugucugcccugugu

SEQ ID NO: 1093156 - RNA, 19 nt, Homo sapiens
gcaggaugagaacaacguu

SEQ ID NO: 1093157 - RNA, 19 nt, Homo sapiens
aucagcaacugcaguguga

SEQ ID NO: 1093158 - RNA, 19 nt, Homo sapiens
gaaagcuggugggaaugcu

SEQ ID NO: 1093159 - RNA, 19 nt, Homo sapiens
gggccacaguuaucagaac

SEQ ID NO: 1093160 - RNA, 19 nt, Homo sapiens
gaguguggcgcguucaauc

SEQ ID NO: 1093161 - RNA, 19 nt, Homo sapiens
agucaucaccugcccagaa

SEQ ID NO: 1093162 - RNA, 19 nt, Homo sapiens
gacagugggaugugguguu

SEQ ID NO: 1093163 - RNA, 19 nt, Homo sapiens
gggaaagcagccagcacaa

SEQ ID NO: 1093164 - RNA, 19 nt, Homo sapiens
ccuagggacucagccacuu

SEQ ID NO: 1093165 - RNA, 19 nt, Homo sapiens
gauggaaaugcuggaaaug

SEQ ID NO: 1093166 - RNA, 19 nt, Homo sapiens
gacauugagcuugagaaga

SEQ ID NO: 1093167 - RNA, 19 nt, Homo sapiens
augaugaccucggcuccua

SEQ ID NO: 1093168 - RNA, 19 nt, Homo sapiens
ccaguggggucucucaguu

SEQ ID NO: 1093169 - RNA, 19 nt, Homo sapiens
cccaagcgagucagaaguu

SEQ ID NO: 1093170 - RNA, 19 nt, Homo sapiens
gccaccgccucagaagaaa

SEQ ID NO: 1093171 - RNA, 19 nt, Homo sapiens
agacagaucugguuaauuu

SEQ ID NO: 1093172 - RNA, 19 nt, Homo sapiens
gcauuaggguguucucuua

SEQ ID NO: 1093173 - RNA, 19 nt, Homo sapiens
guacggugcuugccagauu

SEQ ID NO: 1093174 - RNA, 19 nt, Homo sapiens
cuagggacuuucaagauua

SEQ ID NO: 1093175 - RNA, 19 nt, Homo sapiens
guaaagcacauucgauaaa

SEQ ID NO: 1093176 - RNA, 19 nt, Homo sapiens
gauggauucuacuuucuuu

SEQ ID NO: 1093177 - RNA, 19 nt, Homo sapiens
gggcauaucagacuugaaa

SEQ ID NO: 1093178 - RNA, 19 nt, Homo sapiens
gaaaaucacaugagaauga

SEQ ID NO: 1093179 - RNA, 19 nt, Homo sapiens
gcacaaagggcaagaugga

SEQ ID NO: 1093180 - RNA, 19 nt, Homo sapiens
ccagauggauucuacuuuc

SEQ ID NO: 1093181 - RNA, 19 nt, Homo sapiens
cuacuaauuugacgccuaa

SEQ ID NO: 1093182 - RNA, 19 nt, Homo sapiens
gaacuuuccuuagcuccuu

SEQ ID NO: 1093183 - RNA, 19 nt, Homo sapiens
gauugucacuacuaauuug

SEQ ID NO: 1093184 - RNA, 19 nt, Homo sapiens
uaucauaccuccucugucu

SEQ ID NO: 1093185 - RNA, 19 nt, Homo sapiens
gagugacgcugacccuuga

SEQ ID NO: 1093186 - RNA, 19 nt, Homo sapiens
gaaaggagagcgcgacauc

SEQ ID NO: 1093187 - RNA, 19 nt, Homo sapiens
aaucucagcucucaaagug

SEQ ID NO: 1093188 - RNA, 19 nt, Homo sapiens
gcagcaaucucagcucuca

SEQ ID NO: 1093189 - RNA, 19 nt, Homo sapiens
gcacauucgauaaaggaua

SEQ ID NO: 1093190 - RNA, 19 nt, Homo sapiens
gguguucucuuauacuuuc

SEQ ID NO: 1093191 - RNA, 19 nt, Homo sapiens
gcauaucagacuugaaauu

SEQ ID NO: 1093192 - RNA, 19 nt, Homo sapiens
gcacagccguguccuuagg

SEQ ID NO: 1093193 - RNA, 19 nt, Homo sapiens
cagcacagccguguccuua

SEQ ID NO: 1093194 - RNA, 19 nt, Homo sapiens
gauguuauggcgacacuaa

SEQ ID NO: 1093195 - RNA, 19 nt, Homo sapiens
auaaauugguugccauuga

SEQ ID NO: 1093196 - RNA, 19 nt, Homo sapiens
ggucacguaugcuuaggaa

SEQ ID NO: 1093197 - RNA, 19 nt, Homo sapiens
ggaagacggaaaugaagaa

SEQ ID NO: 1093198 - RNA, 19 nt, Homo sapiens
ccauggaucugugcuaaga

SEQ ID NO: 1093199 - RNA, 19 nt, Homo sapiens
ggacgcaguuuuagaaaga

SEQ ID NO: 1093200 - RNA, 19 nt, Homo sapiens
aaagacagaucugguuaau

SEQ ID NO: 1093201 - RNA, 19 nt, Homo sapiens
guuagcuucuguugucuuu

SEQ ID NO: 1093202 - RNA, 19 nt, Homo sapiens
gcugguguuuggcuuauug

SEQ ID NO: 1093203 - RNA, 19 nt, Homo sapiens
acuagggacuuucaagauu

SEQ ID NO: 1093204 - RNA, 19 nt, Homo sapiens
uaaagcacauucgauaaag

SEQ ID NO: 1093205 - RNA, 19 nt, Homo sapiens
ucucuggucccaugucuua

SEQ ID NO: 1093206 - RNA, 19 nt, Homo sapiens
ucagcaagcucuuugaaac

SEQ ID NO: 1093207 - RNA, 19 nt, Homo sapiens
cacauucgauaaaggauau

SEQ ID NO: 1093208 - RNA, 19 nt, Homo sapiens
ggaagaauaggcguaguug

SEQ ID NO: 1093209 - RNA, 19 nt, Homo sapiens
gauguucgcguccaguaaa

SEQ ID NO: 1093210 - RNA, 19 nt, Homo sapiens
gaacagaaggaaacaugag

SEQ ID NO: 1093211 - RNA, 19 nt, Homo sapiens
uaaauugguugccauugag

SEQ ID NO: 1093212 - RNA, 19 nt, Homo sapiens
guaugacgcugugcucaga

SEQ ID NO: 1093213 - RNA, 19 nt, Homo sapiens
agggcaagauggaagaaua

SEQ ID NO: 1093214 - RNA, 19 nt, Homo sapiens
ggaacagaaggaaacauga

SEQ ID NO: 1093215 - RNA, 19 nt, Homo sapiens
gugacuagcuuggugguau

SEQ ID NO: 1093216 - RNA, 19 nt, Homo sapiens
aagcuucacugccuacaug

SEQ ID NO: 1093217 - RNA, 19 nt, Homo sapiens
uagggacuuucaagauuaa

SEQ ID NO: 1093218 - RNA, 19 nt, Homo sapiens
agaaggcucuggaggacuu

SEQ ID NO: 1093219 - RNA, 19 nt, Homo sapiens
cauaucagacuugaaauug

SEQ ID NO: 1093220 - RNA, 19 nt, Homo sapiens
cggguuagcuucuguuguc

SEQ ID NO: 1093221 - RNA, 19 nt, Homo sapiens
gggaacagaaggaaacaug

SEQ ID NO: 1093222 - RNA, 19 nt, Homo sapiens
guaucuggcugcugguguu

SEQ ID NO: 1093223 - RNA, 19 nt, Homo sapiens
uuaaaguggugacuagcuu

SEQ ID NO: 1093224 - RNA, 19 nt, Homo sapiens
cagcucaucuucuuuuaaa

SEQ ID NO: 1093225 - RNA, 19 nt, Homo sapiens
cacaugagaaugaagaauu

SEQ ID NO: 1093226 - RNA, 19 nt, Homo sapiens
uagcuucuguugucuuugu

SEQ ID NO: 1093227 - RNA, 19 nt, Homo sapiens
guaaagacacugguaacug

SEQ ID NO: 1093228 - RNA, 19 nt, Homo sapiens
gcagugauggcgcuaagga

SEQ ID NO: 1093229 - RNA, 19 nt, Homo sapiens
gcauaaauugguugccauu

SEQ ID NO: 1093230 - RNA, 19 nt, Homo sapiens
ucaaugaugacuuuguuug

SEQ ID NO: 1093231 - RNA, 19 nt, Homo sapiens
gcgcagaccagaaguaaac

SEQ ID NO: 1093232 - RNA, 19 nt, Homo sapiens
aaacuagggacuuucaaga

SEQ ID NO: 1093233 - RNA, 19 nt, Homo sapiens
auuaggguguucucuuaua

SEQ ID NO: 1093234 - RNA, 19 nt, Homo sapiens
ugaagaaaaucacaugaga

SEQ ID NO: 1093235 - RNA, 19 nt, Homo sapiens
gaagacggaaaugaagaaa

SEQ ID NO: 1093236 - RNA, 19 nt, Homo sapiens
gcacugacuggguccauca

SEQ ID NO: 1093237 - RNA, 19 nt, Homo sapiens
ugguugccauugagaauuu

SEQ ID NO: 1093238 - RNA, 19 nt, Homo sapiens
ggagagcgugugugugaug

SEQ ID NO: 1093239 - RNA, 19 nt, Homo sapiens
aagaauaggcguaguugga

SEQ ID NO: 1093240 - RNA, 19 nt, Homo sapiens
cagaaggaaacaugaguga

SEQ ID NO: 1093241 - RNA, 19 nt, Homo sapiens
uaacugggaagacggaaau

SEQ ID NO: 1093242 - RNA, 19 nt, Homo sapiens
gacacuaaacaaaguauuc

SEQ ID NO: 1093243 - RNA, 19 nt, Homo sapiens
cguaaagcacauucgauaa

SEQ ID NO: 1093244 - RNA, 19 nt, Homo sapiens
caaagggcaagauggaaga

SEQ ID NO: 1093245 - RNA, 19 nt, Homo sapiens
caugugaacuuuuccagaa

SEQ ID NO: 1093246 - RNA, 19 nt, Homo sapiens
cuuugcagcuggugagaaa

SEQ ID NO: 1093247 - RNA, 19 nt, Homo sapiens
uagcagcucaacagaguuu

SEQ ID NO: 1093248 - RNA, 19 nt, Homo sapiens
uaaaagacagaucugguua

SEQ ID NO: 1093249 - RNA, 19 nt, Homo sapiens
uagcaucuuuccacagcaa

SEQ ID NO: 1093250 - RNA, 19 nt, Homo sapiens
gggaagacggaaaugaaga

SEQ ID NO: 1093251 - RNA, 19 nt, Homo sapiens
acguaaagcacauucgaua

SEQ ID NO: 1093252 - RNA, 19 nt, Homo sapiens
gugccugacgcgugcauua

SEQ ID NO: 1093253 - RNA, 19 nt, Homo sapiens
agacggaaaugaagaaaau

SEQ ID NO: 1093254 - RNA, 19 nt, Homo sapiens
ggauguucgcguccaguaa

SEQ ID NO: 1093255 - RNA, 19 nt, Homo sapiens
aaugaugacuuuguuugga

SEQ ID NO: 1093256 - RNA, 19 nt, Homo sapiens
guguuuggcuuauugacau

SEQ ID NO: 1093257 - RNA, 19 nt, Homo sapiens
uuuagcagcucaacagagu

SEQ ID NO: 1093258 - RNA, 19 nt, Homo sapiens
aaacaaaguauuccugaac

SEQ ID NO: 1093259 - RNA, 19 nt, Homo sapiens
gcgugugugugaugggaaa

SEQ ID NO: 1093260 - RNA, 19 nt, Homo sapiens
uaucagacuugaaauugac

SEQ ID NO: 1093261 - RNA, 19 nt, Homo sapiens
ggugagaaauaucauaccu

SEQ ID NO: 1093262 - RNA, 19 nt, Homo sapiens
gcgcggucguugucgcauu

SEQ ID NO: 1093263 - RNA, 19 nt, Homo sapiens
ugagugauacccugugaug

SEQ ID NO: 1093264 - RNA, 19 nt, Homo sapiens
ugaugacuuuguuuggaaa

SEQ ID NO: 1093265 - RNA, 19 nt, Homo sapiens
agacuugucccacguguuc

SEQ ID NO: 1093266 - RNA, 19 nt, Homo sapiens
acuccaggguaaucaauga

SEQ ID NO: 1093267 - RNA, 19 nt, Homo sapiens
gaagaaaaucacaugagaa

SEQ ID NO: 1093268 - RNA, 19 nt, Homo sapiens
uggcgacacuaaacaaagu

SEQ ID NO: 1093269 - RNA, 19 nt, Homo sapiens
gguugccauugagaauuua

SEQ ID NO: 1093270 - RNA, 19 nt, Homo sapiens
caacuugagcauaaauugg

SEQ ID NO: 1093271 - RNA, 19 nt, Homo sapiens
gaacugagcaagucaaaua

SEQ ID NO: 1093272 - RNA, 19 nt, Homo sapiens
ucacagaaaucauuaggua

SEQ ID NO: 1093273 - RNA, 19 nt, Homo sapiens
ggaagagaaucauuuaaga

SEQ ID NO: 1093274 - RNA, 19 nt, Homo sapiens
ucaguuaccugcaugaaua

SEQ ID NO: 1093275 - RNA, 19 nt, Homo sapiens
gagaaaggcuuaggaaguu

SEQ ID NO: 1093276 - RNA, 19 nt, Homo sapiens
ggagaaauccuacauguug

SEQ ID NO: 1093277 - RNA, 19 nt, Homo sapiens
guccagaacuuaaagauuu

SEQ ID NO: 1093278 - RNA, 19 nt, Homo sapiens
caaguuugcuauuguauug

SEQ ID NO: 1093279 - RNA, 19 nt, Homo sapiens
gaaaagggaucaacaauag

SEQ ID NO: 1093280 - RNA, 19 nt, Homo sapiens
ucaauggucugaaacauga

SEQ ID NO: 1093281 - RNA, 19 nt, Homo sapiens
gaacaaauacaaugaaugg

SEQ ID NO: 1093282 - RNA, 19 nt, Homo sapiens
ggucaaauguaaacacuau

SEQ ID NO: 1093283 - RNA, 19 nt, Homo sapiens
ucuaaacgcugcaaauuug

SEQ ID NO: 1093284 - RNA, 19 nt, Homo sapiens
cggaaggacuugacuauga

SEQ ID NO: 1093285 - RNA, 19 nt, Homo sapiens
ggaaagaacaaauacaaug

SEQ ID NO: 1093286 - RNA, 19 nt, Homo sapiens
caauuaaggucacagaaau

SEQ ID NO: 1093287 - RNA, 19 nt, Homo sapiens
caucaugucuucagcuauu

SEQ ID NO: 1093288 - RNA, 19 nt, Homo sapiens
guaaagaauugagcaaguu

SEQ ID NO: 1093289 - RNA, 19 nt, Homo sapiens
gaacuccgccucaucuaaa

SEQ ID NO: 1093290 - RNA, 19 nt, Homo sapiens
gagaaucauuuaagaguuc

SEQ ID NO: 1093291 - RNA, 19 nt, Homo sapiens
gaucaacaauagaaacaga

SEQ ID NO: 1093292 - RNA, 19 nt, Homo sapiens
uaaauagucuguaguaggu

SEQ ID NO: 1093293 - RNA, 19 nt, Homo sapiens
gcaauuaaggucacagaaa

SEQ ID NO: 1093294 - RNA, 19 nt, Homo sapiens
gaagacaaucgcccuuuaa

SEQ ID NO: 1093295 - RNA, 19 nt, Homo sapiens
gugccuuggucuaauauua

SEQ ID NO: 1093296 - RNA, 19 nt, Homo sapiens
caaagaugcagcaagcuua

SEQ ID NO: 1093297 - RNA, 19 nt, Homo sapiens
gaaacaugauucugagcuu

SEQ ID NO: 1093298 - RNA, 19 nt, Homo sapiens
gaucagcccuauguaaguu

SEQ ID NO: 1093299 - RNA, 19 nt, Homo sapiens
aagauaaagucgcacauuu

SEQ ID NO: 1093300 - RNA, 19 nt, Homo sapiens
aaaccaaccuacucugaaa

SEQ ID NO: 1093301 - RNA, 19 nt, Homo sapiens
ggcagcaagucaccuguua

SEQ ID NO: 1093302 - RNA, 19 nt, Homo sapiens
guacaucucaguccauaaa

SEQ ID NO: 1093303 - RNA, 19 nt, Homo sapiens
gaaggaaggugggaagaag

SEQ ID NO: 1093304 - RNA, 19 nt, Homo sapiens
agaagacaaucgcccuuua

SEQ ID NO: 1093305 - RNA, 19 nt, Homo sapiens
agagagugcugguaaagaa

SEQ ID NO: 1093306 - RNA, 19 nt, Homo sapiens
ggagaaaggcuuaggaagu

SEQ ID NO: 1093307 - RNA, 19 nt, Homo sapiens
ccaaaucuaugacuucuac

SEQ ID NO: 1093308 - RNA, 19 nt, Homo sapiens
uaggaaguuucucgaguua

SEQ ID NO: 1093309 - RNA, 19 nt, Homo sapiens
uuuaugagcuguaagaaga

SEQ ID NO: 1093310 - RNA, 19 nt, Homo sapiens
gcaagucaaauacugcaua

SEQ ID NO: 1093311 - RNA, 19 nt, Homo sapiens
uggaugggcuaucauaauu

SEQ ID NO: 1093312 - RNA, 19 nt, Homo sapiens
gauuuaugcuugaguuguu

SEQ ID NO: 1093313 - RNA, 19 nt, Homo sapiens
gcauagaggaacagacuaa

SEQ ID NO: 1093314 - RNA, 19 nt, Homo sapiens
ugauguauguguaaacuga

SEQ ID NO: 1093315 - RNA, 19 nt, Homo sapiens
uaacaaugauggcagcaau

SEQ ID NO: 1093316 - RNA, 19 nt, Homo sapiens
gaugggcuaucauaauuca

SEQ ID NO: 1093317 - RNA, 19 nt, Homo sapiens
gguaaagaauugagcaagu

SEQ ID NO: 1093318 - RNA, 19 nt, Homo sapiens
cuauaaaucuggucagcaa

SEQ ID NO: 1093319 - RNA, 19 nt, Homo sapiens
gauacguguuccugaauga

SEQ ID NO: 1093320 - RNA, 19 nt, Homo sapiens
cauuaugacucuggugaua

SEQ ID NO: 1093321 - RNA, 19 nt, Homo sapiens
ggagagauaggacuuuaau

SEQ ID NO: 1093322 - RNA, 19 nt, Homo sapiens
uacaagugguccaaacuaa

SEQ ID NO: 1093323 - RNA, 19 nt, Homo sapiens
guacaagugguccaaacua

SEQ ID NO: 1093324 - RNA, 19 nt, Homo sapiens
agauuuagaugccuuccua

SEQ ID NO: 1093325 - RNA, 19 nt, Homo sapiens
uaauguuucucucagguuu

SEQ ID NO: 1093326 - RNA, 19 nt, Homo sapiens
ggaaugcuauuggugugaa

SEQ ID NO: 1093327 - RNA, 19 nt, Homo sapiens
ggagaagaauugcugaaaa

SEQ ID NO: 1093328 - RNA, 19 nt, Homo sapiens
gguccaaacuaagauaaga

SEQ ID NO: 1093329 - RNA, 19 nt, Homo sapiens
cgaguuagccuucaugcaa

SEQ ID NO: 1093330 - RNA, 19 nt, Homo sapiens
gacaaucgcccuuuaacug

SEQ ID NO: 1093331 - RNA, 19 nt, Homo sapiens
uaaagaggagaaaggcuua

SEQ ID NO: 1093332 - RNA, 19 nt, Homo sapiens
ucuaaggccucuucaacaa

SEQ ID NO: 1093333 - RNA, 19 nt, Homo sapiens
ggauaccucuuucccaagu

SEQ ID NO: 1093334 - RNA, 19 nt, Homo sapiens
gaaaucauuagguaaagga

SEQ ID NO: 1093335 - RNA, 19 nt, Homo sapiens
cagcaaaccccuacauuua

SEQ ID NO: 1093336 - RNA, 19 nt, Homo sapiens
aaggagagauaggacuuua

SEQ ID NO: 1093337 - RNA, 19 nt, Homo sapiens
gaagagaaucauuuaagag

SEQ ID NO: 1093338 - RNA, 19 nt, Homo sapiens
uagaugccuuccuaaauug

SEQ ID NO: 1093339 - RNA, 19 nt, Homo sapiens
ggacuuuaaucuggaggaa

SEQ ID NO: 1093340 - RNA, 19 nt, Homo sapiens
ggaacagacuaaggagaga

SEQ ID NO: 1093341 - RNA, 19 nt, Homo sapiens
caagucaaauacugcauag

SEQ ID NO: 1093342 - RNA, 19 nt, Homo sapiens
caagugguccaaacuaaga

SEQ ID NO: 1093343 - RNA, 19 nt, Homo sapiens
caaaauaguuccuguuucu

SEQ ID NO: 1093344 - RNA, 19 nt, Homo sapiens
gaaauggaccccuuccuuu

SEQ ID NO: 1093345 - RNA, 19 nt, Homo sapiens
acaaugauggcagcaauua

SEQ ID NO: 1093346 - RNA, 19 nt, Homo sapiens
uuagauacguguuccugaa

SEQ ID NO: 1093347 - RNA, 19 nt, Homo sapiens
auucugagcuucacauaau

SEQ ID NO: 1093348 - RNA, 19 nt, Homo sapiens
ggaaggacuugacuaugac

SEQ ID NO: 1093349 - RNA, 19 nt, Homo sapiens
ggaggcauuuucaucuuua

SEQ ID NO: 1093350 - RNA, 19 nt, Homo sapiens
caucuugauuuaugcuuga

SEQ ID NO: 1093351 - RNA, 19 nt, Homo sapiens
gaagaaggaauuagacacu

SEQ ID NO: 1093352 - RNA, 19 nt, Homo sapiens
uaaggucacagaaaucauu

SEQ ID NO: 1093353 - RNA, 19 nt, Homo sapiens
aaaguugauuucugcacua

SEQ ID NO: 1093354 - RNA, 19 nt, Homo sapiens
gaguuagccuucaugcaau

SEQ ID NO: 1093355 - RNA, 19 nt, Homo sapiens
ugagaucagcccuauguaa

SEQ ID NO: 1093356 - RNA, 19 nt, Homo sapiens
uaauugagaucagcccuau

SEQ ID NO: 1093357 - RNA, 19 nt, Homo sapiens
gaagauucagagccuguaa

SEQ ID NO: 1093358 - RNA, 19 nt, Homo sapiens
ggaaguuucucgaguuagc

SEQ ID NO: 1093359 - RNA, 19 nt, Homo sapiens
aauaguuccuguuucugua

SEQ ID NO: 1093360 - RNA, 19 nt, Homo sapiens
caaagcuuguugauagugu

SEQ ID NO: 1093361 - RNA, 19 nt, Homo sapiens
gagcuucacauaauaucuu

SEQ ID NO: 1093362 - RNA, 19 nt, Homo sapiens
ggaaggggaggaauaauuu

SEQ ID NO: 1093363 - RNA, 19 nt, Homo sapiens
gcaugucacacuaauaugu

SEQ ID NO: 1093364 - RNA, 19 nt, Homo sapiens
guaauuacaaucaccacaa

SEQ ID NO: 1093365 - RNA, 19 nt, Homo sapiens
guagauuuacuguagguuu

SEQ ID NO: 1093366 - RNA, 19 nt, Homo sapiens
gagaucagcccuauguaag

SEQ ID NO: 1093367 - RNA, 19 nt, Homo sapiens
gaggagaaaggcuuaggaa

SEQ ID NO: 1093368 - RNA, 19 nt, Homo sapiens
caagauaaagucgcacauu

SEQ ID NO: 1093369 - RNA, 19 nt, Homo sapiens
caccacgcauugaaauauu

SEQ ID NO: 1093370 - RNA, 19 nt, Homo sapiens
uuuaagaguuccuguaaca

SEQ ID NO: 1093371 - RNA, 19 nt, Homo sapiens
ggaccuuccucaacuacua

SEQ ID NO: 1093372 - RNA, 19 nt, Homo sapiens
gaacgccucuguguuugaa

SEQ ID NO: 1093373 - RNA, 19 nt, Homo sapiens
ggaauucuacucucucaaa

SEQ ID NO: 1093374 - RNA, 19 nt, Homo sapiens
ggccagaacuuauugaaag

SEQ ID NO: 1093375 - RNA, 19 nt, Homo sapiens
gaagagaugcuguggaauc

SEQ ID NO: 1093376 - RNA, 19 nt, Homo sapiens
cggaagagaugcuguggaa

SEQ ID NO: 1093377 - RNA, 19 nt, Homo sapiens
gccagaggcugaaggaaga

SEQ ID NO: 1093378 - RNA, 19 nt, Homo sapiens
gaacuacacccgcuucgau

SEQ ID NO: 1093379 - RNA, 19 nt, Homo sapiens
cgagagggcuacccacuuc

SEQ ID NO: 1093380 - RNA, 19 nt, Homo sapiens
ggacuuugauauugaugug

SEQ ID NO: 1093381 - RNA, 19 nt, Homo sapiens
ccacuucggccagaacuua

SEQ ID NO: 1093382 - RNA, 19 nt, Homo sapiens
ccauguuccuagaguauaa

SEQ ID NO: 1093383 - RNA, 19 nt, Homo sapiens
ugggagagccggucagaua

SEQ ID NO: 1093384 - RNA, 19 nt, Homo sapiens
caaccaacuucauccacaa

SEQ ID NO: 1093385 - RNA, 19 nt, Homo sapiens
cuggacaccuugcugauuu

SEQ ID NO: 1093386 - RNA, 19 nt, Homo sapiens
gaggaagccugccaaacag

SEQ ID NO: 1093387 - RNA, 19 nt, Homo sapiens
caagguggagugcggauuu

SEQ ID NO: 1093388 - RNA, 19 nt, Homo sapiens
gagccucauuggagacauu

SEQ ID NO: 1093389 - RNA, 19 nt, Homo sapiens
caacauuccucagggauac

SEQ ID NO: 1093390 - RNA, 19 nt, Homo sapiens
acaaagccauccggaacua

SEQ ID NO: 1093391 - RNA, 19 nt, Homo sapiens
ccaaagagugguugaagug

SEQ ID NO: 1093392 - RNA, 19 nt, Homo sapiens
gcguggacuuugauauuga

SEQ ID NO: 1093393 - RNA, 19 nt, Homo sapiens
ugugaacgccucuguguuu

SEQ ID NO: 1093394 - RNA, 19 nt, Homo sapiens
uggccgagacugugaaaua

SEQ ID NO: 1093395 - RNA, 19 nt, Homo sapiens
cagcguggacuuugauauu

SEQ ID NO: 1093396 - RNA, 19 nt, Homo sapiens
agaggaagccugccaaaca

SEQ ID NO: 1093397 - RNA, 19 nt, Homo sapiens
gaugugaacgccucugugu

SEQ ID NO: 1093398 - RNA, 19 nt, Homo sapiens
ggaagccugccaaacagaa

SEQ ID NO: 1093399 - RNA, 19 nt, Homo sapiens
guuccuagaguauaacaaa

SEQ ID NO: 1093400 - RNA, 19 nt, Homo sapiens
ggcguggacuccuacuuug

SEQ ID NO: 1093401 - RNA, 19 nt, Homo sapiens
gcucaucugcucuccaaga

SEQ ID NO: 1093402 - RNA, 19 nt, Homo sapiens
ggagaggaagccugccaaa

SEQ ID NO: 1093403 - RNA, 19 nt, Homo sapiens
gaauucuacucucucaaac

SEQ ID NO: 1093404 - RNA, 19 nt, Homo sapiens
ggagguggaggacuugaug

SEQ ID NO: 1093405 - RNA, 19 nt, Homo sapiens
ggauugggaccuucauugu

SEQ ID NO: 1093406 - RNA, 19 nt, Homo sapiens
aacaaacauucgaguggua

SEQ ID NO: 1093407 - RNA, 19 nt, Homo sapiens
gcaggucgaaauuucagaa

SEQ ID NO: 1093408 - RNA, 19 nt, Homo sapiens
caacuucauccacaacaau

SEQ ID NO: 1093409 - RNA, 19 nt, Homo sapiens
gggauugggaccuucauug

SEQ ID NO: 1093410 - RNA, 19 nt, Homo sapiens
ggacagcguggacuuugau

SEQ ID NO: 1093411 - RNA, 19 nt, Homo sapiens
guacaucuucaacacagaa

SEQ ID NO: 1093412 - RNA, 19 nt, Homo sapiens
ccaacuucauccacaacaa

SEQ ID NO: 1093413 - RNA, 19 nt, Homo sapiens
auugggaccuucauuguug

SEQ ID NO: 1093414 - RNA, 19 nt, Homo sapiens
gauugggaccuucauuguu

SEQ ID NO: 1093415 - RNA, 19 nt, Homo sapiens
gcccuucaccuccaaguug

SEQ ID NO: 1093416 - RNA, 19 nt, Homo sapiens
gagucaaggccauguucua

SEQ ID NO: 1093417 - RNA, 19 nt, Homo sapiens
ucgaagauguggccagagu

SEQ ID NO: 1093418 - RNA, 19 nt, Homo sapiens
gaggcuggauggcccuguu

SEQ ID NO: 1093419 - RNA, 19 nt, Homo sapiens
ucucagaauuccaaagagu

SEQ ID NO: 1093420 - RNA, 19 nt, Homo sapiens
caagaaggcugggguggaa

SEQ ID NO: 1093421 - RNA, 19 nt, Homo sapiens
gggagagccggucagauau

SEQ ID NO: 1093422 - RNA, 19 nt, Homo sapiens
ggacuccugucugcucauc

SEQ ID NO: 1093423 - RNA, 19 nt, Homo sapiens
gugaacgccucuguguuug

SEQ ID NO: 1093424 - RNA, 19 nt, Homo sapiens
ucaaggccauguucuacca

SEQ ID NO: 1093425 - RNA, 19 nt, Homo sapiens
gcauuacugggacagguuu

SEQ ID NO: 1093426 - RNA, 19 nt, Homo sapiens
acagcuaccuggagaaugc

SEQ ID NO: 1093427 - RNA, 19 nt, Homo sapiens
ugagggaauucuacucucu

SEQ ID NO: 1093428 - RNA, 19 nt, Homo sapiens
gaugagggaauucuacucu

SEQ ID NO: 1093429 - RNA, 19 nt, Homo sapiens
ggccgagacugugaaauac

SEQ ID NO: 1093430 - RNA, 19 nt, Homo sapiens
ggagugcggauuugcaaca

SEQ ID NO: 1093431 - RNA, 19 nt, Homo sapiens
gccaggaacacucuucuca

SEQ ID NO: 1093432 - RNA, 19 nt, Homo sapiens
gaaugccuuucccuucgau

SEQ ID NO: 1093433 - RNA, 19 nt, Homo sapiens
uggcguggacuccuacuuu

SEQ ID NO: 1093434 - RNA, 19 nt, Homo sapiens
uuuccuagacuccucauaa

SEQ ID NO: 1093435 - RNA, 19 nt, Homo sapiens
ggagagccggucagauauc

SEQ ID NO: 1093436 - RNA, 19 nt, Homo sapiens
cuagaacucggaagagaug

SEQ ID NO: 1093437 - RNA, 19 nt, Homo sapiens
ggucuucagagccucauug

SEQ ID NO: 1093438 - RNA, 19 nt, Homo sapiens
cugcucaucugcucuccaa

SEQ ID NO: 1093439 - RNA, 19 nt, Homo sapiens
gagugcggauuugcaacaa

SEQ ID NO: 1093440 - RNA, 19 nt, Homo sapiens
gagagccggucagauaucg

SEQ ID NO: 1093441 - RNA, 19 nt, Homo sapiens
aaacggugcaggucgaaau

SEQ ID NO: 1093442 - RNA, 19 nt, Homo sapiens
gcgagagggcuacccacuu

SEQ ID NO: 1093443 - RNA, 19 nt, Homo sapiens
acaacauuccucagggaua

SEQ ID NO: 1093444 - RNA, 19 nt, Homo sapiens
gcaaggccaggaacacucu

SEQ ID NO: 1093445 - RNA, 19 nt, Homo sapiens
gguacaucuucaacacaga

SEQ ID NO: 1093446 - RNA, 19 nt, Homo sapiens
ggaucccacccuccuagaa

SEQ ID NO: 1093447 - RNA, 19 nt, Homo sapiens
cuacuggccuggucuucag

SEQ ID NO: 1093448 - RNA, 19 nt, Homo sapiens
ggccauguuccuagaguau

SEQ ID NO: 1093449 - RNA, 19 nt, Homo sapiens
gugacccgguguucgaaga

SEQ ID NO: 1093450 - RNA, 19 nt, Homo sapiens
ggaacagugaacuuacuuc

SEQ ID NO: 1093451 - RNA, 19 nt, Homo sapiens
auauggaacagugaacuua

SEQ ID NO: 1093452 - RNA, 19 nt, Homo sapiens
cagcagcucccaggaugaa

SEQ ID NO: 1093453 - RNA, 19 nt, Homo sapiens
cggugcaggucgaaauuuc

SEQ ID NO: 1093454 - RNA, 19 nt, Homo sapiens
ugucucagaauuccaaaga

SEQ ID NO: 1093455 - RNA, 19 nt, Homo sapiens
uugcaacaaucaaagaucu

SEQ ID NO: 1093456 - RNA, 19 nt, Homo sapiens
caguuucucucugacucua

SEQ ID NO: 1093457 - RNA, 19 nt, Homo sapiens
cggcagggauugggaccuu

SEQ ID NO: 1093458 - RNA, 19 nt, Homo sapiens
uugaugcacuggacaccuu

SEQ ID NO: 1093459 - RNA, 19 nt, Homo sapiens
cgacagcuaccuggagaau

SEQ ID NO: 1093460 - RNA, 19 nt, Homo sapiens
gcagcagcucccaggauga

SEQ ID NO: 1093461 - RNA, 19 nt, Homo sapiens
agugggagguggaggacuu

SEQ ID NO: 1093462 - RNA, 19 nt, Homo sapiens
gcagggauugggaccuuca

SEQ ID NO: 1093463 - RNA, 19 nt, Homo sapiens
acacgagcucuaugccuuu

SEQ ID NO: 1093464 - RNA, 19 nt, Homo sapiens
ccaggacagcguggacuuu

SEQ ID NO: 1093465 - RNA, 19 nt, Homo sapiens
acaaugccaugaggaccuu

SEQ ID NO: 1093466 - RNA, 19 nt, Homo sapiens
gccauguuccuagaguaua

SEQ ID NO: 1093467 - RNA, 19 nt, Homo sapiens
cauauggaacagugaacuu

SEQ ID NO: 1093468 - RNA, 19 nt, Homo sapiens
cucaucugcucuccaagaa

SEQ ID NO: 1093469 - RNA, 19 nt, Homo sapiens
uccaaagagugguugaagu

SEQ ID NO: 1093470 - RNA, 19 nt, Homo sapiens
ggacagguuuuccuagacu

SEQ ID NO: 1093471 - RNA, 19 nt, Homo sapiens
ggaaggaaaucaucaauaa

SEQ ID NO: 1093472 - RNA, 19 nt, Homo sapiens
ggaaauaacugguaacaca

SEQ ID NO: 1093473 - RNA, 19 nt, Homo sapiens
gaacaaugguggauccaaa

SEQ ID NO: 1093474 - RNA, 19 nt, Homo sapiens
caaaggcaauguacuguuu

SEQ ID NO: 1093475 - RNA, 19 nt, Homo sapiens
gcuaaguccuguaagaaua

SEQ ID NO: 1093476 - RNA, 19 nt, Homo sapiens
gaagcaggaugaaguaaga

SEQ ID NO: 1093477 - RNA, 19 nt, Homo sapiens
cuacaugucuuugcucuua

SEQ ID NO: 1093478 - RNA, 19 nt, Homo sapiens
uaagugcucugcucugaua

SEQ ID NO: 1093479 - RNA, 19 nt, Homo sapiens
gauauuacaucucguuaug

SEQ ID NO: 1093480 - RNA, 19 nt, Homo sapiens
ggucagagcuuagugauuc

SEQ ID NO: 1093481 - RNA, 19 nt, Homo sapiens
ggagaaagaaucauuguga

SEQ ID NO: 1093482 - RNA, 19 nt, Homo sapiens
gaacagaaggucuugaaug

SEQ ID NO: 1093483 - RNA, 19 nt, Homo sapiens
ggaccaaccuagcaaugaa

SEQ ID NO: 1093484 - RNA, 19 nt, Homo sapiens
agaccuagcugaagauuug

SEQ ID NO: 1093485 - RNA, 19 nt, Homo sapiens
ugaaagaccuagcugaaga

SEQ ID NO: 1093486 - RNA, 19 nt, Homo sapiens
gagaaagaaucauugugaa

SEQ ID NO: 1093487 - RNA, 19 nt, Homo sapiens
ugacguagguguuucauuc

SEQ ID NO: 1093488 - RNA, 19 nt, Homo sapiens
gaaguaagaggaaugcauu

SEQ ID NO: 1093489 - RNA, 19 nt, Homo sapiens
ggaaucuccuacuuaauau

SEQ ID NO: 1093490 - RNA, 19 nt, Homo sapiens
gguagcaaaucaagauaaa

SEQ ID NO: 1093491 - RNA, 19 nt, Homo sapiens
uaugugaacuugacuuuga

SEQ ID NO: 1093492 - RNA, 19 nt, Homo sapiens
uaauggaaaugcccuauau

SEQ ID NO: 1093493 - RNA, 19 nt, Homo sapiens
ugaacaagcaccugaauaa

SEQ ID NO: 1093494 - RNA, 19 nt, Homo sapiens
gaacaagcaccugaauaaa

SEQ ID NO: 1093495 - RNA, 19 nt, Homo sapiens
gcaaauccaagaggaaaua

SEQ ID NO: 1093496 - RNA, 19 nt, Homo sapiens
caaguacccuccuccagaa

SEQ ID NO: 1093497 - RNA, 19 nt, Homo sapiens
guucuaaaguuguguaugu

SEQ ID NO: 1093498 - RNA, 19 nt, Homo sapiens
uggaaucuccuacuuaaua

SEQ ID NO: 1093499 - RNA, 19 nt, Homo sapiens
gaaugucuccuuugccuuu

SEQ ID NO: 1093500 - RNA, 19 nt, Homo sapiens
ggucuugaaugucuccuuu

SEQ ID NO: 1093501 - RNA, 19 nt, Homo sapiens
gguauuaauugacuggauu

SEQ ID NO: 1093502 - RNA, 19 nt, Homo sapiens
gaacuccuuucacauuuua

SEQ ID NO: 1093503 - RNA, 19 nt, Homo sapiens
gagauacucuaggcaugua

SEQ ID NO: 1093504 - RNA, 19 nt, Homo sapiens
caaagcccaucucugguuu

SEQ ID NO: 1093505 - RNA, 19 nt, Homo sapiens
gaaauuaggaaggaaauca

SEQ ID NO: 1093506 - RNA, 19 nt, Homo sapiens
ggacagcuuugaacagaag

SEQ ID NO: 1093507 - RNA, 19 nt, Homo sapiens
ucgagaaacuggagaguga

SEQ ID NO: 1093508 - RNA, 19 nt, Homo sapiens
gaccaaagccaagcaguuu

SEQ ID NO: 1093509 - RNA, 19 nt, Homo sapiens
gaacugaugaagguauuaa

SEQ ID NO: 1093510 - RNA, 19 nt, Homo sapiens
aaacaugcuuugcuuuaug

SEQ ID NO: 1093511 - RNA, 19 nt, Homo sapiens
ggaaggauuuuguuuagaa

SEQ ID NO: 1093512 - RNA, 19 nt, Homo sapiens
ucuggaaucuccuacuuaa

SEQ ID NO: 1093513 - RNA, 19 nt, Homo sapiens
guagacaccagcccaagua

SEQ ID NO: 1093514 - RNA, 19 nt, Homo sapiens
aaacugaaauuaggaagga

SEQ ID NO: 1093515 - RNA, 19 nt, Homo sapiens
gaaagaaucauugugaaag

SEQ ID NO: 1093516 - RNA, 19 nt, Homo sapiens
cagaaggucuugaaugucu

SEQ ID NO: 1093517 - RNA, 19 nt, Homo sapiens
agucagagauugcucagaa

SEQ ID NO: 1093518 - RNA, 19 nt, Homo sapiens
ugucaucuauacugucaua

SEQ ID NO: 1093519 - RNA, 19 nt, Homo sapiens
caaaggaugcuaacugugu

SEQ ID NO: 1093520 - RNA, 19 nt, Homo sapiens
agauuucccuccaugauuu

SEQ ID NO: 1093521 - RNA, 19 nt, Homo sapiens
ugucuuugcucuuagaauu

SEQ ID NO: 1093522 - RNA, 19 nt, Homo sapiens
caauugugcugauauuaca

SEQ ID NO: 1093523 - RNA, 19 nt, Homo sapiens
gaccugaaaucuacacuac

SEQ ID NO: 1093524 - RNA, 19 nt, Homo sapiens
uuaaaugacuugccagaag

SEQ ID NO: 1093525 - RNA, 19 nt, Homo sapiens
gauaguggaaacugaaauu

SEQ ID NO: 1093526 - RNA, 19 nt, Homo sapiens
caagaggaaauaacuggua

SEQ ID NO: 1093527 - RNA, 19 nt, Homo sapiens
aagaacuccuuucacauuu

SEQ ID NO: 1093528 - RNA, 19 nt, Homo sapiens
gcaagaaagaugauuccuu

SEQ ID NO: 1093529 - RNA, 19 nt, Homo sapiens
aaauagguaucuaguggaa

SEQ ID NO: 1093530 - RNA, 19 nt, Homo sapiens
uaagagugcuccuuuugua

SEQ ID NO: 1093531 - RNA, 19 nt, Homo sapiens
gaaagacagagcucuagug

SEQ ID NO: 1093532 - RNA, 19 nt, Homo sapiens
uuacagaugaggaaacuaa

SEQ ID NO: 1093533 - RNA, 19 nt, Homo sapiens
ccuuugagcucaugcaaga

SEQ ID NO: 1093534 - RNA, 19 nt, Homo sapiens
aacagaaggucuugaaugu

SEQ ID NO: 1093535 - RNA, 19 nt, Homo sapiens
gaauugucacucagcauaa

SEQ ID NO: 1093536 - RNA, 19 nt, Homo sapiens
uuacuuguaucuccucuau

SEQ ID NO: 1093537 - RNA, 19 nt, Homo sapiens
gauauacucaaggccauua

SEQ ID NO: 1093538 - RNA, 19 nt, Homo sapiens
gcucugcucugauauacuc

SEQ ID NO: 1093539 - RNA, 19 nt, Homo sapiens
gauccuaguuaccauucaa

SEQ ID NO: 1093540 - RNA, 19 nt, Homo sapiens
gaacugccuuacccugcuu

SEQ ID NO: 1093541 - RNA, 19 nt, Homo sapiens
cagaagacauagucaacug

SEQ ID NO: 1093542 - RNA, 19 nt, Homo sapiens
aagaggaaauaacugguaa

SEQ ID NO: 1093543 - RNA, 19 nt, Homo sapiens
gcugaagauuuguaugaug

SEQ ID NO: 1093544 - RNA, 19 nt, Homo sapiens
aaguaugcauuccucaaua

SEQ ID NO: 1093545 - RNA, 19 nt, Homo sapiens
ggaaaucaucaauaacuca

SEQ ID NO: 1093546 - RNA, 19 nt, Homo sapiens
acacgaugcuggaggagaa

SEQ ID NO: 1093547 - RNA, 19 nt, Homo sapiens
uauaugaccaugacuuuga

SEQ ID NO: 1093548 - RNA, 19 nt, Homo sapiens
guaauggaaaugcccuaua

SEQ ID NO: 1093549 - RNA, 19 nt, Homo sapiens
agaaugaggugcgaacaau

SEQ ID NO: 1093550 - RNA, 19 nt, Homo sapiens
guaagucauuuagaccaaa

SEQ ID NO: 1093551 - RNA, 19 nt, Homo sapiens
cccuugaacuuuaaagaaa

SEQ ID NO: 1093552 - RNA, 19 nt, Homo sapiens
ucaaggccauuaaucuuca

SEQ ID NO: 1093553 - RNA, 19 nt, Homo sapiens
caagauggaggguuggaaa

SEQ ID NO: 1093554 - RNA, 19 nt, Homo sapiens
acaagcaccugaauaaacu

SEQ ID NO: 1093555 - RNA, 19 nt, Homo sapiens
ccugaaaucuacacuacga

SEQ ID NO: 1093556 - RNA, 19 nt, Homo sapiens
ccaggagcaucaaguggaa

SEQ ID NO: 1093557 - RNA, 19 nt, Homo sapiens
uaagucugcccacauguaa

SEQ ID NO: 1093558 - RNA, 19 nt, Homo sapiens
gguaaccacuauucugagu

SEQ ID NO: 1093559 - RNA, 19 nt, Homo sapiens
cagagauaguggaaacuga

SEQ ID NO: 1093560 - RNA, 19 nt, Homo sapiens
gggauugaguucuuugucu

SEQ ID NO: 1093561 - RNA, 19 nt, Homo sapiens
gacaguacaacauguuuau

SEQ ID NO: 1093562 - RNA, 19 nt, Homo sapiens
ggaggucacagaacuggaa

SEQ ID NO: 1093563 - RNA, 19 nt, Homo sapiens
uagcugaagauuuguauga

SEQ ID NO: 1093564 - RNA, 19 nt, Homo sapiens
gagaaucaacacuucauag

SEQ ID NO: 1093565 - RNA, 19 nt, Homo sapiens
gaaaauacauuggaacacu

SEQ ID NO: 1093566 - RNA, 19 nt, Homo sapiens
uuacuaagagugcuccuuu

SEQ ID NO: 1093567 - RNA, 19 nt, Homo sapiens
gcaauguacuguuuugugu

SEQ ID NO: 1093568 - RNA, 19 nt, Homo sapiens
agaauugucacucagcaua

SEQ ID NO: 1093569 - RNA, 19 nt, Homo sapiens
uauuacaucucguuaugga

SEQ ID NO: 1093570 - RNA, 19 nt, Homo sapiens
gaccuugggcuaaauaauc

SEQ ID NO: 1093571 - RNA, 19 nt, Homo sapiens
ggagaucacuguagaauug

SEQ ID NO: 1093572 - RNA, 19 nt, Homo sapiens
gaaaucaccuguuauccuu

SEQ ID NO: 1093573 - RNA, 19 nt, Homo sapiens
cgacagcaguccaggauua

SEQ ID NO: 1093574 - RNA, 19 nt, Homo sapiens
caugucaucuggaauaaua

SEQ ID NO: 1093575 - RNA, 19 nt, Homo sapiens
gaugaagucuccagcuuug

SEQ ID NO: 1093576 - RNA, 19 nt, Homo sapiens
agacgaagccuuucuguaa

SEQ ID NO: 1093577 - RNA, 19 nt, Homo sapiens
cagacauccugaagaauua

SEQ ID NO: 1093578 - RNA, 19 nt, Homo sapiens
gaacagugauuaacaagcu

SEQ ID NO: 1093579 - RNA, 19 nt, Homo sapiens
gcagcaaucuguauuugug

SEQ ID NO: 1093580 - RNA, 19 nt, Homo sapiens
gguauaguaugguauuuga

SEQ ID NO: 1093581 - RNA, 19 nt, Homo sapiens
gagaagggagcauaaguuu

SEQ ID NO: 1093582 - RNA, 19 nt, Homo sapiens
gaagaagaugugcaaagua

SEQ ID NO: 1093583 - RNA, 19 nt, Homo sapiens
gaagggagcauaaguuuac

SEQ ID NO: 1093584 - RNA, 19 nt, Homo sapiens
aaagaaaccuuccaauguc

SEQ ID NO: 1093585 - RNA, 19 nt, Homo sapiens
aagaagaugugcaaaguau

SEQ ID NO: 1093586 - RNA, 19 nt, Homo sapiens
gcacaaccgcguagaaaug

SEQ ID NO: 1093587 - RNA, 19 nt, Homo sapiens
gcaagcacgucaagguguu

SEQ ID NO: 1093588 - RNA, 19 nt, Homo sapiens
ggaauaaaaucacucaaga

SEQ ID NO: 1093589 - RNA, 19 nt, Homo sapiens
gaagcagacaugcccuuua

SEQ ID NO: 1093590 - RNA, 19 nt, Homo sapiens
gagaagggcaaguuuauca

SEQ ID NO: 1093591 - RNA, 19 nt, Homo sapiens
caacguggcauaccucuau

SEQ ID NO: 1093592 - RNA, 19 nt, Homo sapiens
gaagcagcaaucuguauuu

SEQ ID NO: 1093593 - RNA, 19 nt, Homo sapiens
ggagaagggagcauaaguu

SEQ ID NO: 1093594 - RNA, 19 nt, Homo sapiens
cagcagagacgaagccuuu

SEQ ID NO: 1093595 - RNA, 19 nt, Homo sapiens
acacaagaauccuuugaga

SEQ ID NO: 1093596 - RNA, 19 nt, Homo sapiens
cuacaggacguacacaaua

SEQ ID NO: 1093597 - RNA, 19 nt, Homo sapiens
gaagggcaaguuuaucaaa

SEQ ID NO: 1093598 - RNA, 19 nt, Homo sapiens
caaccugggugacaagugu

SEQ ID NO: 1093599 - RNA, 19 nt, Homo sapiens
caaacuguagcacaaauaa

SEQ ID NO: 1093600 - RNA, 19 nt, Homo sapiens
ugaagaagaugugcaaagu

SEQ ID NO: 1093601 - RNA, 19 nt, Homo sapiens
uaaaaucacucaagacaug

SEQ ID NO: 1093602 - RNA, 19 nt, Homo sapiens
gauggugccuugcuguguu

SEQ ID NO: 1093603 - RNA, 19 nt, Homo sapiens
gcauaugcuucuguuuauu

SEQ ID NO: 1093604 - RNA, 19 nt, Homo sapiens
caacaacagcuacgaguca

SEQ ID NO: 1093605 - RNA, 19 nt, Homo sapiens
guagaauuguaguggauga

SEQ ID NO: 1093606 - RNA, 19 nt, Homo sapiens
uuaauagguuuggugcuua

SEQ ID NO: 1093607 - RNA, 19 nt, Homo sapiens
acaagaauccuuugagaug

SEQ ID NO: 1093608 - RNA, 19 nt, Homo sapiens
gaguguuucugcugucuga

SEQ ID NO: 1093609 - RNA, 19 nt, Homo sapiens
gaagaugugcaaaguaugg

SEQ ID NO: 1093610 - RNA, 19 nt, Homo sapiens
ccagagguuugacauggaa

SEQ ID NO: 1093611 - RNA, 19 nt, Homo sapiens
caagugauccucccaccuu

SEQ ID NO: 1093612 - RNA, 19 nt, Homo sapiens
guggaacagugauuaacaa

SEQ ID NO: 1093613 - RNA, 19 nt, Homo sapiens
gggagaagggcaaguuuau

SEQ ID NO: 1093614 - RNA, 19 nt, Homo sapiens
gagaagcagcaaucuguau

SEQ ID NO: 1093615 - RNA, 19 nt, Homo sapiens
caucuggaauaauacuuga

SEQ ID NO: 1093616 - RNA, 19 nt, Homo sapiens
gagacgaagccuuucugua

SEQ ID NO: 1093617 - RNA, 19 nt, Homo sapiens
gcaguguccugaguacaga

SEQ ID NO: 1093618 - RNA, 19 nt, Homo sapiens
gcugaagguuguuaagaag

SEQ ID NO: 1093619 - RNA, 19 nt, Homo sapiens
uuguugaaaucaccuguua

SEQ ID NO: 1093620 - RNA, 19 nt, Homo sapiens
ggaagucuguuuucaggaa

SEQ ID NO: 1093621 - RNA, 19 nt, Homo sapiens
acucuucuguggagcuuua

SEQ ID NO: 1093622 - RNA, 19 nt, Homo sapiens
uccgugagcugaccuauca

SEQ ID NO: 1093623 - RNA, 19 nt, Homo sapiens
agacaagagucgcagugaa

SEQ ID NO: 1093624 - RNA, 19 nt, Homo sapiens
gugaugaagucuccagcuu

SEQ ID NO: 1093625 - RNA, 19 nt, Homo sapiens
uacaggacguacacaauau

SEQ ID NO: 1093626 - RNA, 19 nt, Homo sapiens
uaauagguuuggugcuuau

SEQ ID NO: 1093627 - RNA, 19 nt, Homo sapiens
gacaugcccuuuacagacu

SEQ ID NO: 1093628 - RNA, 19 nt, Homo sapiens
uaauaaaugagccgcguuu

SEQ ID NO: 1093629 - RNA, 19 nt, Homo sapiens
guauggaugccaggaauaa

SEQ ID NO: 1093630 - RNA, 19 nt, Homo sapiens
agaaugaaccggaacacaa

SEQ ID NO: 1093631 - RNA, 19 nt, Homo sapiens
guuuggugcuuaucuucua

SEQ ID NO: 1093632 - RNA, 19 nt, Homo sapiens
uguuucugcugucugauua

SEQ ID NO: 1093633 - RNA, 19 nt, Homo sapiens
gauaccagcaccaguggaa

SEQ ID NO: 1093634 - RNA, 19 nt, Homo sapiens
aagcagacaugcccuuuac

SEQ ID NO: 1093635 - RNA, 19 nt, Homo sapiens
gccaugucaucuggaauaa

SEQ ID NO: 1093636 - RNA, 19 nt, Homo sapiens
gucacaaacuguagcacaa

SEQ ID NO: 1093637 - RNA, 19 nt, Homo sapiens
aagcagcaaucuguauuug

SEQ ID NO: 1093638 - RNA, 19 nt, Homo sapiens
aaacugagaagcagcaauc

SEQ ID NO: 1093639 - RNA, 19 nt, Homo sapiens
gucuugcucuugauagaaa

SEQ ID NO: 1093640 - RNA, 19 nt, Homo sapiens
gacgaagccuuucuguaac

SEQ ID NO: 1093641 - RNA, 19 nt, Homo sapiens
gaaugaaccggaacacaac

SEQ ID NO: 1093642 - RNA, 19 nt, Homo sapiens
agaagggagcauaaguuua

SEQ ID NO: 1093643 - RNA, 19 nt, Homo sapiens
gacaagagucgcagugaag

SEQ ID NO: 1093644 - RNA, 19 nt, Homo sapiens
gugcugcucccuuguguga

SEQ ID NO: 1093645 - RNA, 19 nt, Homo sapiens
cacaaacuguagcacaaau

SEQ ID NO: 1093646 - RNA, 19 nt, Homo sapiens
caagggagaagggcaaguu

SEQ ID NO: 1093647 - RNA, 19 nt, Homo sapiens
uuaaagcggaagucuguuu

SEQ ID NO: 1093648 - RNA, 19 nt, Homo sapiens
ucaaucauaucugugaaca

SEQ ID NO: 1093649 - RNA, 19 nt, Homo sapiens
acagaaagacugcguccuu

SEQ ID NO: 1093650 - RNA, 19 nt, Homo sapiens
aaaagaaaccuuccaaugu

SEQ ID NO: 1093651 - RNA, 19 nt, Homo sapiens
uuuaauagguuuggugcuu

SEQ ID NO: 1093652 - RNA, 19 nt, Homo sapiens
gaauuguaguggaugaaaa

SEQ ID NO: 1093653 - RNA, 19 nt, Homo sapiens
ugaagguuguuaagaagca

SEQ ID NO: 1093654 - RNA, 19 nt, Homo sapiens
ccaguggaacagugauuaa

SEQ ID NO: 1093655 - RNA, 19 nt, Homo sapiens
ggaagaaugaaccggaaca

SEQ ID NO: 1093656 - RNA, 19 nt, Homo sapiens
ccuguuauccuuguuugua

SEQ ID NO: 1093657 - RNA, 19 nt, Homo sapiens
guugaaaucaccuguuauc

SEQ ID NO: 1093658 - RNA, 19 nt, Homo sapiens
acaaacuguagcacaaaua

SEQ ID NO: 1093659 - RNA, 19 nt, Homo sapiens
ccacagcauuuuaucuauu

SEQ ID NO: 1093660 - RNA, 19 nt, Homo sapiens
acuguugucuugcucuuga

SEQ ID NO: 1093661 - RNA, 19 nt, Homo sapiens
ugccaugucaucuggaaua

SEQ ID NO: 1093662 - RNA, 19 nt, Homo sapiens
caggugacacuggaagaua

SEQ ID NO: 1093663 - RNA, 19 nt, Homo sapiens
gcagacaugcccuuuacag

SEQ ID NO: 1093664 - RNA, 19 nt, Homo sapiens
ugaugaagucuccagcuuu

SEQ ID NO: 1093665 - RNA, 19 nt, Homo sapiens
ugacacaagaauccuuuga

SEQ ID NO: 1093666 - RNA, 19 nt, Homo sapiens
gcaaggcaugacacaagaa

SEQ ID NO: 1093667 - RNA, 19 nt, Homo sapiens
cuguuauccuuguuuguaa

SEQ ID NO: 1093668 - RNA, 19 nt, Homo sapiens
ccguggagcggaucuguaa

SEQ ID NO: 1093669 - RNA, 19 nt, Homo sapiens
gaggagacgcugacaugca

SEQ ID NO: 1093670 - RNA, 19 nt, Homo sapiens
cccaggaucaggaggauuu

SEQ ID NO: 1093671 - RNA, 19 nt, Homo sapiens
aaacuucacuguugucuua

SEQ ID NO: 1093672 - RNA, 19 nt, Homo sapiens
uaacacugcugcucauuua

SEQ ID NO: 1093673 - RNA, 19 nt, Homo sapiens
gcacaugccuguaaucuca

SEQ ID NO: 1093674 - RNA, 19 nt, Homo sapiens
gaagugaaaucuuaacuag

SEQ ID NO: 1093675 - RNA, 19 nt, Homo sapiens
gcagcaaacuucacuguug

SEQ ID NO: 1093676 - RNA, 19 nt, Homo sapiens
gaagaacuaucaacuugug

SEQ ID NO: 1093677 - RNA, 19 nt, Homo sapiens
cagaagaacuaucaacuug

SEQ ID NO: 1093678 - RNA, 19 nt, Homo sapiens
caagagaguugugcuauga

SEQ ID NO: 1093679 - RNA, 19 nt, Homo sapiens
uaaagaagccaucuccaua

SEQ ID NO: 1093680 - RNA, 19 nt, Homo sapiens
ccaaagaaguccaugauag

SEQ ID NO: 1093681 - RNA, 19 nt, Homo sapiens
caacuugccuuugaugauu

SEQ ID NO: 1093682 - RNA, 19 nt, Homo sapiens
gcuuugccauuguguauua

SEQ ID NO: 1093683 - RNA, 19 nt, Homo sapiens
gaacugacaacuugccuuu

SEQ ID NO: 1093684 - RNA, 19 nt, Homo sapiens
uggagaagcuguagaaguu

SEQ ID NO: 1093685 - RNA, 19 nt, Homo sapiens
ugaggaagcugcaggagaa

SEQ ID NO: 1093686 - RNA, 19 nt, Homo sapiens
gaaaauagcaagagaacua

SEQ ID NO: 1093687 - RNA, 19 nt, Homo sapiens
caacauccauuaucucaag

SEQ ID NO: 1093688 - RNA, 19 nt, Homo sapiens
gaagugagacaaguucuuu

SEQ ID NO: 1093689 - RNA, 19 nt, Homo sapiens
acaaggagaugaauacugu

SEQ ID NO: 1093690 - RNA, 19 nt, Homo sapiens
caagagcucugauggagau

SEQ ID NO: 1093691 - RNA, 19 nt, Homo sapiens
ucuaggacuuucauaguua

SEQ ID NO: 1093692 - RNA, 19 nt, Homo sapiens
gaugauggccucccuauuc

SEQ ID NO: 1093693 - RNA, 19 nt, Homo sapiens
cuagagaugugaccgaauu

SEQ ID NO: 1093694 - RNA, 19 nt, Homo sapiens
ucacuguugucuuacuuua

SEQ ID NO: 1093695 - RNA, 19 nt, Homo sapiens
gaaguucuacuguggguaa

SEQ ID NO: 1093696 - RNA, 19 nt, Homo sapiens
gagcaaagaaggugauuuc

SEQ ID NO: 1093697 - RNA, 19 nt, Homo sapiens
ggugaaacccugucucaaa

SEQ ID NO: 1093698 - RNA, 19 nt, Homo sapiens
aaacuuguauggaugagaa

SEQ ID NO: 1093699 - RNA, 19 nt, Homo sapiens
aaacggugaugaagugaaa

SEQ ID NO: 1093700 - RNA, 19 nt, Homo sapiens
ggaucaaacuuguauggau

SEQ ID NO: 1093701 - RNA, 19 nt, Homo sapiens
gaaaggauucaccauucua

SEQ ID NO: 1093702 - RNA, 19 nt, Homo sapiens
ggaaaggauucaccauucu

SEQ ID NO: 1093703 - RNA, 19 nt, Homo sapiens
gcuuguauuugguuuauug

SEQ ID NO: 1093704 - RNA, 19 nt, Homo sapiens
ugacuuacuugcuuguauu

SEQ ID NO: 1093705 - RNA, 19 nt, Homo sapiens
gagcucugauggagaugua

SEQ ID NO: 1093706 - RNA, 19 nt, Homo sapiens
gcugugacuuucaguuaaa

SEQ ID NO: 1093707 - RNA, 19 nt, Homo sapiens
ggaaaacggugaugaagug

SEQ ID NO: 1093708 - RNA, 19 nt, Homo sapiens
gagcaagacugccucaaaa

SEQ ID NO: 1093709 - RNA, 19 nt, Homo sapiens
gcacgagaauuacuugaac

SEQ ID NO: 1093710 - RNA, 19 nt, Homo sapiens
aggaaucucucaugaaaga

SEQ ID NO: 1093711 - RNA, 19 nt, Homo sapiens
ggacuuucauaguuagaga

SEQ ID NO: 1093712 - RNA, 19 nt, Homo sapiens
cauguuauaugcaguggaa

SEQ ID NO: 1093713 - RNA, 19 nt, Homo sapiens
gaagaugcuaugaacauug

SEQ ID NO: 1093714 - RNA, 19 nt, Homo sapiens
ccagggcccuuaagauaug

SEQ ID NO: 1093715 - RNA, 19 nt, Homo sapiens
aaucuuaacuagagggaaa

SEQ ID NO: 1093716 - RNA, 19 nt, Homo sapiens
gaguuaugccuguauuuaa

SEQ ID NO: 1093717 - RNA, 19 nt, Homo sapiens
guggguaaaugcugucaaa

SEQ ID NO: 1093718 - RNA, 19 nt, Homo sapiens
ggaaucuacuccuggugaa

SEQ ID NO: 1093719 - RNA, 19 nt, Homo sapiens
ugauggagauguacaagga

SEQ ID NO: 1093720 - RNA, 19 nt, Homo sapiens
aaagaagccaucuccauaa

SEQ ID NO: 1093721 - RNA, 19 nt, Homo sapiens
gaaggaagugagacaaguu

SEQ ID NO: 1093722 - RNA, 19 nt, Homo sapiens
ugaguaagcccacuguuga

SEQ ID NO: 1093723 - RNA, 19 nt, Homo sapiens
aagaagccaucuccauaaa

SEQ ID NO: 1093724 - RNA, 19 nt, Homo sapiens
gaacucgucaugcucuuug

SEQ ID NO: 1093725 - RNA, 19 nt, Homo sapiens
gaugcguauuucugaguua

SEQ ID NO: 1093726 - RNA, 19 nt, Homo sapiens
guuaauaaaugcagcaaac

SEQ ID NO: 1093727 - RNA, 19 nt, Homo sapiens
uggaaaggauucaccauuc

SEQ ID NO: 1093728 - RNA, 19 nt, Homo sapiens
cagcugugacuuucaguua

SEQ ID NO: 1093729 - RNA, 19 nt, Homo sapiens
ggcuuuauauuacaaguug

SEQ ID NO: 1093730 - RNA, 19 nt, Homo sapiens
ugaguuaugccuguauuua

SEQ ID NO: 1093731 - RNA, 19 nt, Homo sapiens
agacacaacaguauugaaa

SEQ ID NO: 1093732 - RNA, 19 nt, Homo sapiens
gaagcuagcaguguucaug

SEQ ID NO: 1093733 - RNA, 19 nt, Homo sapiens
gaguagagacgacccagaa

SEQ ID NO: 1093734 - RNA, 19 nt, Homo sapiens
gaaagcaucaagaaagaag

SEQ ID NO: 1093735 - RNA, 19 nt, Homo sapiens
gcauaacacugcugcucau

SEQ ID NO: 1093736 - RNA, 19 nt, Homo sapiens
cagcaaacuucacuguugu

SEQ ID NO: 1093737 - RNA, 19 nt, Homo sapiens
ugaagaugcuaugaacauu

SEQ ID NO: 1093738 - RNA, 19 nt, Homo sapiens
gcggguggauugcuugaug

SEQ ID NO: 1093739 - RNA, 19 nt, Homo sapiens
ggagaagcuguagaaguua

SEQ ID NO: 1093740 - RNA, 19 nt, Homo sapiens
caugagauguaaguaaaga

SEQ ID NO: 1093741 - RNA, 19 nt, Homo sapiens
guauaaacgcaacaacaaa

SEQ ID NO: 1093742 - RNA, 19 nt, Homo sapiens
gcaguguucaugagaugua

SEQ ID NO: 1093743 - RNA, 19 nt, Homo sapiens
agacccagcuugcuucuag

SEQ ID NO: 1093744 - RNA, 19 nt, Homo sapiens
acugacaacuugccuuuga

SEQ ID NO: 1093745 - RNA, 19 nt, Homo sapiens
gaaguuacacagaagaucu

SEQ ID NO: 1093746 - RNA, 19 nt, Homo sapiens
gcagauuccuguguucaag

SEQ ID NO: 1093747 - RNA, 19 nt, Homo sapiens
gaugccaaguugaagauuc

SEQ ID NO: 1093748 - RNA, 19 nt, Homo sapiens
agugaaaucuuaacuagag

SEQ ID NO: 1093749 - RNA, 19 nt, Homo sapiens
ucaagagaguugugcuaug

SEQ ID NO: 1093750 - RNA, 19 nt, Homo sapiens
gcuguaaccucaggaucaa

SEQ ID NO: 1093751 - RNA, 19 nt, Homo sapiens
gagaagcuguagaaguuac

SEQ ID NO: 1093752 - RNA, 19 nt, Homo sapiens
guaaagaagccaucuccau

SEQ ID NO: 1093753 - RNA, 19 nt, Homo sapiens
guucaugagauguaaguaa

SEQ ID NO: 1093754 - RNA, 19 nt, Homo sapiens
caaggauggucagcagauu

SEQ ID NO: 1093755 - RNA, 19 nt, Homo sapiens
gucaaugccucugggagua

SEQ ID NO: 1093756 - RNA, 19 nt, Homo sapiens
ggcugaggcacgagaauua

SEQ ID NO: 1093757 - RNA, 19 nt, Homo sapiens
caagaaagaagugaaaucu

SEQ ID NO: 1093758 - RNA, 19 nt, Homo sapiens
ucccagggcccuuaagaua

SEQ ID NO: 1093759 - RNA, 19 nt, Homo sapiens
ccucaucucuaccauaugg

SEQ ID NO: 1093760 - RNA, 19 nt, Homo sapiens
uuaagaagcugagugaaac

SEQ ID NO: 1093761 - RNA, 19 nt, Homo sapiens
guaugaaccauguuauaug

SEQ ID NO: 1093762 - RNA, 19 nt, Homo sapiens
cucaaugccuggcuucaaa

SEQ ID NO: 1093763 - RNA, 19 nt, Homo sapiens
gcaggaagcaggcggucaa

SEQ ID NO: 1093764 - RNA, 19 nt, Homo sapiens
cauuguguauuaccucauu

SEQ ID NO: 1093765 - RNA, 19 nt, Homo sapiens
ggaagcaggcggucaaugc

SEQ ID NO: 1093766 - RNA, 19 nt, Homo sapiens
ccagaagaacuaucaacuu

SEQ ID NO: 1093767 - RNA, 19 nt, Homo sapiens
caucaagaaagaagugaaa

SEQ ID NO: 1093768 - RNA, 19 nt, Homo sapiens
ggucuggaacugaaaguga

SEQ ID NO: 1093769 - RNA, 19 nt, Homo sapiens
caguaugaaccauguuaua

SEQ ID NO: 1093770 - RNA, 19 nt, Homo sapiens
caaagaaguccaugauagg

SEQ ID NO: 1093771 - RNA, 19 nt, Homo sapiens
gagaugagcuaaugcuuua

SEQ ID NO: 1093772 - RNA, 19 nt, Homo sapiens
gcacugcucuuugaacuua

SEQ ID NO: 1093773 - RNA, 19 nt, Homo sapiens
gaacuauccuauugacuaa

SEQ ID NO: 1093774 - RNA, 19 nt, Homo sapiens
gcagauacauggcaaguug

SEQ ID NO: 1093775 - RNA, 19 nt, Homo sapiens
ggaaucaugccaaauguua

SEQ ID NO: 1093776 - RNA, 19 nt, Homo sapiens
gaaguagaauuuagaggaa

SEQ ID NO: 1093777 - RNA, 19 nt, Homo sapiens
ggagaaacagcauauuuaa

SEQ ID NO: 1093778 - RNA, 19 nt, Homo sapiens
gaguagagaguaucauuua

SEQ ID NO: 1093779 - RNA, 19 nt, Homo sapiens
aaucagaacuauccuauug

SEQ ID NO: 1093780 - RNA, 19 nt, Homo sapiens
gcauauaaccugugaguga

SEQ ID NO: 1093781 - RNA, 19 nt, Homo sapiens
gaaggaaucaugccaaaug

SEQ ID NO: 1093782 - RNA, 19 nt, Homo sapiens
gauaaagacuucguugaga

SEQ ID NO: 1093783 - RNA, 19 nt, Homo sapiens
aagcuaaugucuccaauuu

SEQ ID NO: 1093784 - RNA, 19 nt, Homo sapiens
caauagagguccaauuaca

SEQ ID NO: 1093785 - RNA, 19 nt, Homo sapiens
uacaauagagguccaauua

SEQ ID NO: 1093786 - RNA, 19 nt, Homo sapiens
gaucuccacuucaggauau

SEQ ID NO: 1093787 - RNA, 19 nt, Homo sapiens
acucugagcugaauacaaa

SEQ ID NO: 1093788 - RNA, 19 nt, Homo sapiens
ucacaaggcuuugaauuuc

SEQ ID NO: 1093789 - RNA, 19 nt, Homo sapiens
ggaggaagaaguacaacua

SEQ ID NO: 1093790 - RNA, 19 nt, Homo sapiens
ccacaaguuucuauuucua

SEQ ID NO: 1093791 - RNA, 19 nt, Homo sapiens
guacugagccuuggauaaa

SEQ ID NO: 1093792 - RNA, 19 nt, Homo sapiens
gagaaaagcuuauugaucu

SEQ ID NO: 1093793 - RNA, 19 nt, Homo sapiens
gaagaaguacaacuaagaa

SEQ ID NO: 1093794 - RNA, 19 nt, Homo sapiens
ggaagaaguacaacuaaga

SEQ ID NO: 1093795 - RNA, 19 nt, Homo sapiens
gcaauucugacuucuagua

SEQ ID NO: 1093796 - RNA, 19 nt, Homo sapiens
gaugccaacuuacagaauu

SEQ ID NO: 1093797 - RNA, 19 nt, Homo sapiens
gauaggaggugaagaacuc

SEQ ID NO: 1093798 - RNA, 19 nt, Homo sapiens
gcaguucauugucaaguug

SEQ ID NO: 1093799 - RNA, 19 nt, Homo sapiens
guauauaucuccuuaaagc

SEQ ID NO: 1093800 - RNA, 19 nt, Homo sapiens
gaagaugaucauaguguuu

SEQ ID NO: 1093801 - RNA, 19 nt, Homo sapiens
gcacaccggaaacuaauuu

SEQ ID NO: 1093802 - RNA, 19 nt, Homo sapiens
gagguccaauuacacauuu

SEQ ID NO: 1093803 - RNA, 19 nt, Homo sapiens
guggcgaccuuaauuauga

SEQ ID NO: 1093804 - RNA, 19 nt, Homo sapiens
gaugucaguagccauauua

SEQ ID NO: 1093805 - RNA, 19 nt, Homo sapiens
gcucgacgcuaccguguau

SEQ ID NO: 1093806 - RNA, 19 nt, Homo sapiens
guagauaaugugcaagaua

SEQ ID NO: 1093807 - RNA, 19 nt, Homo sapiens
gaaccgggaacuccacuuu

SEQ ID NO: 1093808 - RNA, 19 nt, Homo sapiens
gaugaaaucucacgaaccu

SEQ ID NO: 1093809 - RNA, 19 nt, Homo sapiens
acaacuacaucucuucaaa

SEQ ID NO: 1093810 - RNA, 19 nt, Homo sapiens
cuaaugcuuuacugacuua

SEQ ID NO: 1093811 - RNA, 19 nt, Homo sapiens
gagcgacucagaagcguua

SEQ ID NO: 1093812 - RNA, 19 nt, Homo sapiens
uaagugaccauucaagaaa

SEQ ID NO: 1093813 - RNA, 19 nt, Homo sapiens
gaaaccaucuagucaucau

SEQ ID NO: 1093814 - RNA, 19 nt, Homo sapiens
caugauauaugcuuguguu

SEQ ID NO: 1093815 - RNA, 19 nt, Homo sapiens
uauaagguguuguuacaga

SEQ ID NO: 1093816 - RNA, 19 nt, Homo sapiens
uggcagacauugcuaauca

SEQ ID NO: 1093817 - RNA, 19 nt, Homo sapiens
uagugggccuuacaaauuu

SEQ ID NO: 1093818 - RNA, 19 nt, Homo sapiens
ucugaagaaugacaugaua

SEQ ID NO: 1093819 - RNA, 19 nt, Homo sapiens
gagaguaucauuuaagcuu

SEQ ID NO: 1093820 - RNA, 19 nt, Homo sapiens
uggagaaacagcauauuua

SEQ ID NO: 1093821 - RNA, 19 nt, Homo sapiens
ggaugacucugcauuuagu

SEQ ID NO: 1093822 - RNA, 19 nt, Homo sapiens
uuaagagucugucugagaa

SEQ ID NO: 1093823 - RNA, 19 nt, Homo sapiens
caucuagucaucaucuuua

SEQ ID NO: 1093824 - RNA, 19 nt, Homo sapiens
auaguaagcuguucuucuu

SEQ ID NO: 1093825 - RNA, 19 nt, Homo sapiens
gaaggaggaagaaguacaa

SEQ ID NO: 1093826 - RNA, 19 nt, Homo sapiens
gcucuuugaacuuagauua

SEQ ID NO: 1093827 - RNA, 19 nt, Homo sapiens
gcuaaugucuccaauuuug

SEQ ID NO: 1093828 - RNA, 19 nt, Homo sapiens
ggaugcauauaaccuguga

SEQ ID NO: 1093829 - RNA, 19 nt, Homo sapiens
gaggaagaaguacaacuaa

SEQ ID NO: 1093830 - RNA, 19 nt, Homo sapiens
cauauaaccugugagugaa

SEQ ID NO: 1093831 - RNA, 19 nt, Homo sapiens
gaaacagccagcuuggaaa

SEQ ID NO: 1093832 - RNA, 19 nt, Homo sapiens
gauauaugcuuguguucca

SEQ ID NO: 1093833 - RNA, 19 nt, Homo sapiens
uccauucacuccaccuuua

SEQ ID NO: 1093834 - RNA, 19 nt, Homo sapiens
agaaugacaugauauaugc

SEQ ID NO: 1093835 - RNA, 19 nt, Homo sapiens
gcuguucacgcaucaauaa

SEQ ID NO: 1093836 - RNA, 19 nt, Homo sapiens
ccucagggcuucuguuaag

SEQ ID NO: 1093837 - RNA, 19 nt, Homo sapiens
ucagagcaguucauuguca

SEQ ID NO: 1093838 - RNA, 19 nt, Homo sapiens
ggaugucaguagccauauu

SEQ ID NO: 1093839 - RNA, 19 nt, Homo sapiens
gaaaggacauuuuaaaagc

SEQ ID NO: 1093840 - RNA, 19 nt, Homo sapiens
gaaacagcauauuuaaagc

SEQ ID NO: 1093841 - RNA, 19 nt, Homo sapiens
gcuaaugcuuuacugacuu

SEQ ID NO: 1093842 - RNA, 19 nt, Homo sapiens
cagaaaccaucuagucauc

SEQ ID NO: 1093843 - RNA, 19 nt, Homo sapiens
ccagagaccauguuagaga

SEQ ID NO: 1093844 - RNA, 19 nt, Homo sapiens
gcagccauuugacccaauu

SEQ ID NO: 1093845 - RNA, 19 nt, Homo sapiens
gcauaauucuacuuaaggu

SEQ ID NO: 1093846 - RNA, 19 nt, Homo sapiens
uuagugggccuuacaaauu

SEQ ID NO: 1093847 - RNA, 19 nt, Homo sapiens
ccaguugccugacuugcuu

SEQ ID NO: 1093848 - RNA, 19 nt, Homo sapiens
agaacuauccuauugacua

SEQ ID NO: 1093849 - RNA, 19 nt, Homo sapiens
gguaaauuucucaagguua

SEQ ID NO: 1093850 - RNA, 19 nt, Homo sapiens
uuuaaugucugcagccaaa

SEQ ID NO: 1093851 - RNA, 19 nt, Homo sapiens
gucaguagccauauuaaga

SEQ ID NO: 1093852 - RNA, 19 nt, Homo sapiens
aagcuguucuucuuaauca

SEQ ID NO: 1093853 - RNA, 19 nt, Homo sapiens
ccaguggguuguagauaau

SEQ ID NO: 1093854 - RNA, 19 nt, Homo sapiens
cagcauauuuaaagcuuca

SEQ ID NO: 1093855 - RNA, 19 nt, Homo sapiens
ccauuugacccaauuugua

SEQ ID NO: 1093856 - RNA, 19 nt, Homo sapiens
cuaguucacccuuguguaa

SEQ ID NO: 1093857 - RNA, 19 nt, Homo sapiens
ucugcaggcuuguccauuu

SEQ ID NO: 1093858 - RNA, 19 nt, Homo sapiens
ccucguccgccacuaauua

SEQ ID NO: 1093859 - RNA, 19 nt, Homo sapiens
ggaugaugauaaagacuuc

SEQ ID NO: 1093860 - RNA, 19 nt, Homo sapiens
cuaccugcuucugcaauua

SEQ ID NO: 1093861 - RNA, 19 nt, Homo sapiens
caacagagacaaaggaaaa

SEQ ID NO: 1093862 - RNA, 19 nt, Homo sapiens
guuaagagucugucugaga

SEQ ID NO: 1093863 - RNA, 19 nt, Homo sapiens
gagccagagucuucaaugg

SEQ ID NO: 1093864 - RNA, 19 nt, Homo sapiens
gaccuuaauuaugagauga

SEQ ID NO: 1093865 - RNA, 19 nt, Homo sapiens
aguauaagguguuguuaca

SEQ ID NO: 1093866 - RNA, 19 nt, Homo sapiens
gguuguagauaaugugcaa

SEQ ID NO: 1093867 - RNA, 19 nt, Homo sapiens
ggaagaaaauaccggaguu

SEQ ID NO: 1093868 - RNA, 19 nt, Homo sapiens
ccucaaaacuucauucaug

SEQ ID NO: 1093869 - RNA, 19 nt, Homo sapiens
ucacgaaccucaaaacuuc

SEQ ID NO: 1093870 - RNA, 19 nt, Homo sapiens
gugaagcccauauaccuuu

SEQ ID NO: 1093871 - RNA, 19 nt, Homo sapiens
ggaaaugucuaguaagaua

SEQ ID NO: 1093872 - RNA, 19 nt, Homo sapiens
gaaaguaacuaugaagcua

SEQ ID NO: 1093873 - RNA, 19 nt, Homo sapiens
gaucuucucuuccuguuaa

SEQ ID NO: 1093874 - RNA, 19 nt, Homo sapiens
gcaccuggguucagcaaua

SEQ ID NO: 1093875 - RNA, 19 nt, Homo sapiens
gauaaugguugccaaaugu

SEQ ID NO: 1093876 - RNA, 19 nt, Homo sapiens
aagagaagcucauuauuug

SEQ ID NO: 1093877 - RNA, 19 nt, Homo sapiens
gcaaagagaagcucauuau

SEQ ID NO: 1093878 - RNA, 19 nt, Homo sapiens
gaaauacugugacuuugau

SEQ ID NO: 1093879 - RNA, 19 nt, Homo sapiens
uaacgaaagugcugucuau

SEQ ID NO: 1093880 - RNA, 19 nt, Homo sapiens
caacacagccauauugauu

SEQ ID NO: 1093881 - RNA, 19 nt, Homo sapiens
gcaaagaugauccaauuga

SEQ ID NO: 1093882 - RNA, 19 nt, Homo sapiens
gaagagcuaaugaauauga

SEQ ID NO: 1093883 - RNA, 19 nt, Homo sapiens
uauggaaacucguuacuuu

SEQ ID NO: 1093884 - RNA, 19 nt, Homo sapiens
ucaguuaugugacuuguuu

SEQ ID NO: 1093885 - RNA, 19 nt, Homo sapiens
ggacuggugucuauuacuu

SEQ ID NO: 1093886 - RNA, 19 nt, Homo sapiens
gcauacaguugggauauaa

SEQ ID NO: 1093887 - RNA, 19 nt, Homo sapiens
caaagaugauccaauugaa

SEQ ID NO: 1093888 - RNA, 19 nt, Homo sapiens
uggcaaagaugauccaauu

SEQ ID NO: 1093889 - RNA, 19 nt, Homo sapiens
ugcauuagcuucagacuuu

SEQ ID NO: 1093890 - RNA, 19 nt, Homo sapiens
ggaagggucuuuagcaucu

SEQ ID NO: 1093891 - RNA, 19 nt, Homo sapiens
guagaagucacucaauaua

SEQ ID NO: 1093892 - RNA, 19 nt, Homo sapiens
ggaaagauucaucagcaua

SEQ ID NO: 1093893 - RNA, 19 nt, Homo sapiens
gcacaaggagauaguguuu

SEQ ID NO: 1093894 - RNA, 19 nt, Homo sapiens
gaucugaaaguaacuauga

SEQ ID NO: 1093895 - RNA, 19 nt, Homo sapiens
gaaucuaggguguuugaua

SEQ ID NO: 1093896 - RNA, 19 nt, Homo sapiens
caucucagcugguuacaug

SEQ ID NO: 1093897 - RNA, 19 nt, Homo sapiens
ggaaagcgaggcaaauuau

SEQ ID NO: 1093898 - RNA, 19 nt, Homo sapiens
gcacuagcuugucucuaaa

SEQ ID NO: 1093899 - RNA, 19 nt, Homo sapiens
gaggauaugcuacaagaaa

SEQ ID NO: 1093900 - RNA, 19 nt, Homo sapiens
gaacaauauucucaaggau

SEQ ID NO: 1093901 - RNA, 19 nt, Homo sapiens
cacaggaacugggaaauuu

SEQ ID NO: 1093902 - RNA, 19 nt, Homo sapiens
cgaaagugcugucuaugug

SEQ ID NO: 1093903 - RNA, 19 nt, Homo sapiens
caugugagcuugauaacug

SEQ ID NO: 1093904 - RNA, 19 nt, Homo sapiens
uaacauguauagcugaguu

SEQ ID NO: 1093905 - RNA, 19 nt, Homo sapiens
uaaauuggcugcauuagcu

SEQ ID NO: 1093906 - RNA, 19 nt, Homo sapiens
uaacugagucugugaacua

SEQ ID NO: 1093907 - RNA, 19 nt, Homo sapiens
gaaaggaaagcgaggcaaa

SEQ ID NO: 1093908 - RNA, 19 nt, Homo sapiens
agcaauacgucacugauua

SEQ ID NO: 1093909 - RNA, 19 nt, Homo sapiens
uaaagaaggagucaacauu

SEQ ID NO: 1093910 - RNA, 19 nt, Homo sapiens
aaagcgaggcaaauuauua

SEQ ID NO: 1093911 - RNA, 19 nt, Homo sapiens
ccaguaaucgggaaagaua

SEQ ID NO: 1093912 - RNA, 19 nt, Homo sapiens
auccaugucucaucuauua

SEQ ID NO: 1093913 - RNA, 19 nt, Homo sapiens
gaaagauucaucagcauau

SEQ ID NO: 1093914 - RNA, 19 nt, Homo sapiens
ggagguaucccaaguagau

SEQ ID NO: 1093915 - RNA, 19 nt, Homo sapiens
guguagaccugauggauga

SEQ ID NO: 1093916 - RNA, 19 nt, Homo sapiens
guucaaacaucaguaaaug

SEQ ID NO: 1093917 - RNA, 19 nt, Homo sapiens
gaacuucagcugccaccua

SEQ ID NO: 1093918 - RNA, 19 nt, Homo sapiens
uaaguuauccguuugcaaa

SEQ ID NO: 1093919 - RNA, 19 nt, Homo sapiens
gugaagaucuuacagaaac

SEQ ID NO: 1093920 - RNA, 19 nt, Homo sapiens
ggaauauauugaugaggaa

SEQ ID NO: 1093921 - RNA, 19 nt, Homo sapiens
cagaggauaugcuacaaga

SEQ ID NO: 1093922 - RNA, 19 nt, Homo sapiens
gagaaauacugugacuuug

SEQ ID NO: 1093923 - RNA, 19 nt, Homo sapiens
gaagauaaugguugccaaa

SEQ ID NO: 1093924 - RNA, 19 nt, Homo sapiens
gaacucauugggagcauuu

SEQ ID NO: 1093925 - RNA, 19 nt, Homo sapiens
ugaaguaucuaaagacagu

SEQ ID NO: 1093926 - RNA, 19 nt, Homo sapiens
gaaacucguuacuuugcaa

SEQ ID NO: 1093927 - RNA, 19 nt, Homo sapiens
cauccgaacgguaauaaua

SEQ ID NO: 1093928 - RNA, 19 nt, Homo sapiens
agagaagaaucacuagaaa

SEQ ID NO: 1093929 - RNA, 19 nt, Homo sapiens
gaaacucuuuguauagaag

SEQ ID NO: 1093930 - RNA, 19 nt, Homo sapiens
ugaacaauauucucaagga

SEQ ID NO: 1093931 - RNA, 19 nt, Homo sapiens
ucaucaaguuggcuuauuu

SEQ ID NO: 1093932 - RNA, 19 nt, Homo sapiens
aaugggaaaugucuaguaa

SEQ ID NO: 1093933 - RNA, 19 nt, Homo sapiens
ugcacuagcuugucucuaa

SEQ ID NO: 1093934 - RNA, 19 nt, Homo sapiens
gcuuaaaguccaauccuua

SEQ ID NO: 1093935 - RNA, 19 nt, Homo sapiens
gcaaauauggaaacucguu

SEQ ID NO: 1093936 - RNA, 19 nt, Homo sapiens
gguuauguuucucagcuua

SEQ ID NO: 1093937 - RNA, 19 nt, Homo sapiens
gacaguauauuugugaaga

SEQ ID NO: 1093938 - RNA, 19 nt, Homo sapiens
gauggaauaccuacagaaa

SEQ ID NO: 1093939 - RNA, 19 nt, Homo sapiens
gagucaacauucgauauuu

SEQ ID NO: 1093940 - RNA, 19 nt, Homo sapiens
ggagucaacauucgauauu

SEQ ID NO: 1093941 - RNA, 19 nt, Homo sapiens
ugaaaugugucaguuguug

SEQ ID NO: 1093942 - RNA, 19 nt, Homo sapiens
agagaaauacugugacuuu

SEQ ID NO: 1093943 - RNA, 19 nt, Homo sapiens
cagcuuaagucuguggaua

SEQ ID NO: 1093944 - RNA, 19 nt, Homo sapiens
ggauucugauucugaacua

SEQ ID NO: 1093945 - RNA, 19 nt, Homo sapiens
cauggaagcccuaacauug

SEQ ID NO: 1093946 - RNA, 19 nt, Homo sapiens
gaaaaugugucuauauugg

SEQ ID NO: 1093947 - RNA, 19 nt, Homo sapiens
guaaaugggaauuagauga

SEQ ID NO: 1093948 - RNA, 19 nt, Homo sapiens
gaugaccagcugaccauua

SEQ ID NO: 1093949 - RNA, 19 nt, Homo sapiens
gaguaaauuggcugcauua

SEQ ID NO: 1093950 - RNA, 19 nt, Homo sapiens
cuucuuggcuugaguaaau

SEQ ID NO: 1093951 - RNA, 19 nt, Homo sapiens
ccaguuugcugaucagaau

SEQ ID NO: 1093952 - RNA, 19 nt, Homo sapiens
gcagagaaauacugugacu

SEQ ID NO: 1093953 - RNA, 19 nt, Homo sapiens
gagauggaauaccuacaga

SEQ ID NO: 1093954 - RNA, 19 nt, Homo sapiens
gauggccacucgacuguug

SEQ ID NO: 1093955 - RNA, 19 nt, Homo sapiens
gggaaaaugugucuauauu

SEQ ID NO: 1093956 - RNA, 19 nt, Homo sapiens
ccacaccacuccauaacug

SEQ ID NO: 1093957 - RNA, 19 nt, Homo sapiens
ggaauuuuaucuccuagua

SEQ ID NO: 1093958 - RNA, 19 nt, Homo sapiens
ugggaaaugucuaguaaga

SEQ ID NO: 1093959 - RNA, 19 nt, Homo sapiens
aaucuaggguguuugauau

SEQ ID NO: 1093960 - RNA, 19 nt, Homo sapiens
ccagauacuuugcacugaa

SEQ ID NO: 1093961 - RNA, 19 nt, Homo sapiens
gaaguggugaucaauguga

SEQ ID NO: 1093962 - RNA, 19 nt, Homo sapiens
acaaggagauaguguuuua

SEQ ID NO: 1093963 - RNA, 19 nt, Homo sapiens
caacucauuggucuauaua

SEQ ID NO: 1093964 - RNA, 19 nt, Homo sapiens
gaacaucucagcugguuac

SEQ ID NO: 1093965 - RNA, 19 nt, Homo sapiens
gaaagcgaggcaaauuauu

SEQ ID NO: 1093966 - RNA, 19 nt, Homo sapiens
gggcugaaguggugaucaa

SEQ ID NO: 1093967 - RNA, 19 nt, Homo sapiens
gagaaucuaggguguuuga

SEQ ID NO: 1093968 - RNA, 19 nt, Homo sapiens
gguucuagcugcucacaug

SEQ ID NO: 1093969 - RNA, 19 nt, Homo sapiens
gcuuaagucuguggauaaa

SEQ ID NO: 1093970 - RNA, 19 nt, Homo sapiens
caaccugacuccugcagau

SEQ ID NO: 1093971 - RNA, 19 nt, Homo sapiens
gaaaggaaaugaggaaaga

SEQ ID NO: 1093972 - RNA, 19 nt, Homo sapiens
caacagguauaacuacaua

SEQ ID NO: 1093973 - RNA, 19 nt, Homo sapiens
acagagagcuugaugcuuu

SEQ ID NO: 1093974 - RNA, 19 nt, Homo sapiens
ucacuacccuguuuaagua

SEQ ID NO: 1093975 - RNA, 19 nt, Homo sapiens
cgacaucgacuuugacaua

SEQ ID NO: 1093976 - RNA, 19 nt, Homo sapiens
ccaaugaguucaaggugua

SEQ ID NO: 1093977 - RNA, 19 nt, Homo sapiens
gauccugucucuacaagaa

SEQ ID NO: 1093978 - RNA, 19 nt, Homo sapiens
gaggaucgcuugagaccaa

SEQ ID NO: 1093979 - RNA, 19 nt, Homo sapiens
caagcuaccuaacuaagaa

SEQ ID NO: 1093980 - RNA, 19 nt, Homo sapiens
gaagagccaugaagacagu

SEQ ID NO: 1093981 - RNA, 19 nt, Homo sapiens
gaaggugguuggcaaguuc

SEQ ID NO: 1093982 - RNA, 19 nt, Homo sapiens
gaauugggauaaacagaga

SEQ ID NO: 1093983 - RNA, 19 nt, Homo sapiens
gcaggaggaucgcuugaga

SEQ ID NO: 1093984 - RNA, 19 nt, Homo sapiens
gaggguugcuugagacuga

SEQ ID NO: 1093985 - RNA, 19 nt, Homo sapiens
caggaucgcuacauuaaga

SEQ ID NO: 1093986 - RNA, 19 nt, Homo sapiens
ugucuucucuuuaguauga

SEQ ID NO: 1093987 - RNA, 19 nt, Homo sapiens
ggaaaugaggaaagaaauu

SEQ ID NO: 1093988 - RNA, 19 nt, Homo sapiens
gaaaugagccagacauggu

SEQ ID NO: 1093989 - RNA, 19 nt, Homo sapiens
caacaaagaccuccauucu

SEQ ID NO: 1093990 - RNA, 19 nt, Homo sapiens
gcgagcaggucacaagcua

SEQ ID NO: 1093991 - RNA, 19 nt, Homo sapiens
gagguucgacugaugauaa

SEQ ID NO: 1093992 - RNA, 19 nt, Homo sapiens
guaggaggguugcuugaga

SEQ ID NO: 1093993 - RNA, 19 nt, Homo sapiens
ggaaggugguuggcaaguu

SEQ ID NO: 1093994 - RNA, 19 nt, Homo sapiens
caagaaagacauccucaug

SEQ ID NO: 1093995 - RNA, 19 nt, Homo sapiens
uuaaggauguggacuaugu

SEQ ID NO: 1093996 - RNA, 19 nt, Homo sapiens
gaagaagaccgugugcauu

SEQ ID NO: 1093997 - RNA, 19 nt, Homo sapiens
ccacggcucacaccuauaa

SEQ ID NO: 1093998 - RNA, 19 nt, Homo sapiens
gcaagauccugucucuaca

SEQ ID NO: 1093999 - RNA, 19 nt, Homo sapiens
gucacaagcuaccuaacua

SEQ ID NO: 1094000 - RNA, 19 nt, Homo sapiens
agaagaccgugugcauuua

SEQ ID NO: 1094001 - RNA, 19 nt, Homo sapiens
guacgacgacaucgacuuu

SEQ ID NO: 1094002 - RNA, 19 nt, Homo sapiens
gaaagaagaagcccugcau

SEQ ID NO: 1094003 - RNA, 19 nt, Homo sapiens
gagaagagaggcgaaauca

SEQ ID NO: 1094004 - RNA, 19 nt, Homo sapiens
gaagauacccaagguccaa

SEQ ID NO: 1094005 - RNA, 19 nt, Homo sapiens
ugagugaccuggagugaca

SEQ ID NO: 1094006 - RNA, 19 nt, Homo sapiens
ccaagaaccuucgagaucu

SEQ ID NO: 1094007 - RNA, 19 nt, Homo sapiens
aagaagaccgugugcauuu

SEQ ID NO: 1094008 - RNA, 19 nt, Homo sapiens
gcauugcacauuugggaua

SEQ ID NO: 1094009 - RNA, 19 nt, Homo sapiens
uagaggaguuugccaagga

SEQ ID NO: 1094010 - RNA, 19 nt, Homo sapiens
guagcaagauccugucucu

SEQ ID NO: 1094011 - RNA, 19 nt, Homo sapiens
agaaagacauccucaugca

SEQ ID NO: 1094012 - RNA, 19 nt, Homo sapiens
gagaagagccaugaagaca

SEQ ID NO: 1094013 - RNA, 19 nt, Homo sapiens
ugucucaggugaugcauug

SEQ ID NO: 1094014 - RNA, 19 nt, Homo sapiens
gcaccacggcucacaccua

SEQ ID NO: 1094015 - RNA, 19 nt, Homo sapiens
gaaaagcucaacagguaua

SEQ ID NO: 1094016 - RNA, 19 nt, Homo sapiens
caccacggcucacaccuau

SEQ ID NO: 1094017 - RNA, 19 nt, Homo sapiens
ccguugggcuuaugaguga

SEQ ID NO: 1094018 - RNA, 19 nt, Homo sapiens
ccagggaaguggagguuuc

SEQ ID NO: 1094019 - RNA, 19 nt, Homo sapiens
ggaaaggaaaugaggaaag

SEQ ID NO: 1094020 - RNA, 19 nt, Homo sapiens
gcacaaggucugcggaaag

SEQ ID NO: 1094021 - RNA, 19 nt, Homo sapiens
aaaucaggaucgcuacauu

SEQ ID NO: 1094022 - RNA, 19 nt, Homo sapiens
uuaagaaacucgcaaaaug

SEQ ID NO: 1094023 - RNA, 19 nt, Homo sapiens
gaaggaugauuuugucuca

SEQ ID NO: 1094024 - RNA, 19 nt, Homo sapiens
aaucaggaucgcuacauua

SEQ ID NO: 1094025 - RNA, 19 nt, Homo sapiens
gagcuacccguugggcuua

SEQ ID NO: 1094026 - RNA, 19 nt, Homo sapiens
gggagaagagccaugaaga

SEQ ID NO: 1094027 - RNA, 19 nt, Homo sapiens
gcaacaaagaccuccauuc

SEQ ID NO: 1094028 - RNA, 19 nt, Homo sapiens
ccucugaucucucgcuauc

SEQ ID NO: 1094029 - RNA, 19 nt, Homo sapiens
guacauagaugaaaaucag

SEQ ID NO: 1094030 - RNA, 19 nt, Homo sapiens
ucucccagcugaaggacua

SEQ ID NO: 1094031 - RNA, 19 nt, Homo sapiens
caguuuguacuccuaaaua

SEQ ID NO: 1094032 - RNA, 19 nt, Homo sapiens
caagaaccuucgagaucug

SEQ ID NO: 1094033 - RNA, 19 nt, Homo sapiens
ggcccucacuacccuguuu

SEQ ID NO: 1094034 - RNA, 19 nt, Homo sapiens
gacuaugucugcauuucug

SEQ ID NO: 1094035 - RNA, 19 nt, Homo sapiens
ggcgaaaucaggaggauga

SEQ ID NO: 1094036 - RNA, 19 nt, Homo sapiens
gcggugagcugugaaugca

SEQ ID NO: 1094037 - RNA, 19 nt, Homo sapiens
ucacaagcuaccuaacuaa

SEQ ID NO: 1094038 - RNA, 19 nt, Homo sapiens
ccuggaagcguaucagaaa

SEQ ID NO: 1094039 - RNA, 19 nt, Homo sapiens
ucaggaggaugauggaagu

SEQ ID NO: 1094040 - RNA, 19 nt, Homo sapiens
ugggauauuuggaaaggaa

SEQ ID NO: 1094041 - RNA, 19 nt, Homo sapiens
gaugcuuucugccuucugu

SEQ ID NO: 1094042 - RNA, 19 nt, Homo sapiens
ggcuugaccugcagaagau

SEQ ID NO: 1094043 - RNA, 19 nt, Homo sapiens
augaaaagcucaacaggua

SEQ ID NO: 1094044 - RNA, 19 nt, Homo sapiens
aagaggagcacaagcugua

SEQ ID NO: 1094045 - RNA, 19 nt, Homo sapiens
gagguggagugcagcaaca

SEQ ID NO: 1094046 - RNA, 19 nt, Homo sapiens
gaaaacaggccaggagauu

SEQ ID NO: 1094047 - RNA, 19 nt, Homo sapiens
ggagaagagaggcgaaauc

SEQ ID NO: 1094048 - RNA, 19 nt, Homo sapiens
ggauaaacagagagcuuga

SEQ ID NO: 1094049 - RNA, 19 nt, Homo sapiens
agacaagccuaggcaacaa

SEQ ID NO: 1094050 - RNA, 19 nt, Homo sapiens
caagacaggaggaucacuu

SEQ ID NO: 1094051 - RNA, 19 nt, Homo sapiens
gacaucgacuuugacauag

SEQ ID NO: 1094052 - RNA, 19 nt, Homo sapiens
cauuugggauauuuggaaa

SEQ ID NO: 1094053 - RNA, 19 nt, Homo sapiens
gagacaagccuaggcaaca

SEQ ID NO: 1094054 - RNA, 19 nt, Homo sapiens
ugugugccaucuccaauga

SEQ ID NO: 1094055 - RNA, 19 nt, Homo sapiens
gugcaugccuguaguucca

SEQ ID NO: 1094056 - RNA, 19 nt, Homo sapiens
gcuccgacccacagaagaa

SEQ ID NO: 1094057 - RNA, 19 nt, Homo sapiens
cuaacuggaaggaugauuu

SEQ ID NO: 1094058 - RNA, 19 nt, Homo sapiens
gaacuacgcagccccaaug

SEQ ID NO: 1094059 - RNA, 19 nt, Homo sapiens
ucacuaacuggaaggauga

SEQ ID NO: 1094060 - RNA, 19 nt, Homo sapiens
agccagacaugguggugua

SEQ ID NO: 1094061 - RNA, 19 nt, Homo sapiens
caaggucugcggaaaguuc

SEQ ID NO: 1094062 - RNA, 19 nt, Homo sapiens
cacaaggucugcggaaagu

SEQ ID NO: 1094063 - RNA, 19 nt, Homo sapiens
cuguggaacugguggauau

SEQ ID NO: 1094064 - RNA, 19 nt, Homo sapiens
caguugcucuuccuuccaa

SEQ ID NO: 1094065 - RNA, 19 nt, Homo sapiens
gcacauuugggauauuugg

SEQ ID NO: 1094066 - RNA, 19 nt, Homo sapiens
uugcacauuugggauauuu

SEQ ID NO: 1094067 - RNA, 19 nt, Homo sapiens
gucauugaauugggauaaa

SEQ ID NO: 1094068 - RNA, 19 nt, Homo sapiens
gcaguauucccgugaccuu

SEQ ID NO: 1094069 - RNA, 19 nt, Homo sapiens
guuggcaaguucuccauca

SEQ ID NO: 1094070 - RNA, 19 nt, Homo sapiens
ucaagaccuucaccauuac

SEQ ID NO: 1094071 - RNA, 19 nt, Homo sapiens
gaaacaaaguccaacauau

SEQ ID NO: 1094072 - RNA, 19 nt, Homo sapiens
gcacauaaauucgauggaa

SEQ ID NO: 1094073 - RNA, 19 nt, Homo sapiens
ucaagaagcucagguguuu

SEQ ID NO: 1094074 - RNA, 19 nt, Homo sapiens
ggaaacaaaguccaacaua

SEQ ID NO: 1094075 - RNA, 19 nt, Homo sapiens
gguauuaauucuuggauga

SEQ ID NO: 1094076 - RNA, 19 nt, Homo sapiens
ggagagaccaguaguuuga

SEQ ID NO: 1094077 - RNA, 19 nt, Homo sapiens
gaggcuaccuucaguaaga

SEQ ID NO: 1094078 - RNA, 19 nt, Homo sapiens
caagaauccuaucauaaug

SEQ ID NO: 1094079 - RNA, 19 nt, Homo sapiens
gagaacagaugcucacaag

SEQ ID NO: 1094080 - RNA, 19 nt, Homo sapiens
ccaggaagcugcaguucuu

SEQ ID NO: 1094081 - RNA, 19 nt, Homo sapiens
gagagcagccugucaagaa

SEQ ID NO: 1094082 - RNA, 19 nt, Homo sapiens
agagagaccucccaaugaa

SEQ ID NO: 1094083 - RNA, 19 nt, Homo sapiens
gcucuugcuuuaaguguuu

SEQ ID NO: 1094084 - RNA, 19 nt, Homo sapiens
caugggaaguuaaauaguu

SEQ ID NO: 1094085 - RNA, 19 nt, Homo sapiens
ggaauagaauuacguuaac

SEQ ID NO: 1094086 - RNA, 19 nt, Homo sapiens
ccaagaauccuaucauaau

SEQ ID NO: 1094087 - RNA, 19 nt, Homo sapiens
gagagacaguuccacuuga

SEQ ID NO: 1094088 - RNA, 19 nt, Homo sapiens
gaacagaugaggcuaccuu

SEQ ID NO: 1094089 - RNA, 19 nt, Homo sapiens
gcauggaugugacuauugu

SEQ ID NO: 1094090 - RNA, 19 nt, Homo sapiens
cuaaaugguuugcaugaga

SEQ ID NO: 1094091 - RNA, 19 nt, Homo sapiens
gaugcuggcgucaaaguua

SEQ ID NO: 1094092 - RNA, 19 nt, Homo sapiens
cagagaugcuggcgucaaa

SEQ ID NO: 1094093 - RNA, 19 nt, Homo sapiens
ggagagacaguuccacuug

SEQ ID NO: 1094094 - RNA, 19 nt, Homo sapiens
ccaagaaacuccuggaacu

SEQ ID NO: 1094095 - RNA, 19 nt, Homo sapiens
cgaaaucacuggaagaaaa

SEQ ID NO: 1094096 - RNA, 19 nt, Homo sapiens
ugacacccuucauucauuu

SEQ ID NO: 1094097 - RNA, 19 nt, Homo sapiens
aaacacggaugugaucauu

SEQ ID NO: 1094098 - RNA, 19 nt, Homo sapiens
cagaaccaauauuaucgua

SEQ ID NO: 1094099 - RNA, 19 nt, Homo sapiens
gcaaucggcuuccauuagc

SEQ ID NO: 1094100 - RNA, 19 nt, Homo sapiens
gccaagaauccuaucauaa

SEQ ID NO: 1094101 - RNA, 19 nt, Homo sapiens
caaauuggcuuuucuccuu

SEQ ID NO: 1094102 - RNA, 19 nt, Homo sapiens
agaugacgguguucuuuaa

SEQ ID NO: 1094103 - RNA, 19 nt, Homo sapiens
ucaguaagauucccauugg

SEQ ID NO: 1094104 - RNA, 19 nt, Homo sapiens
ucacaacacggaauaauca

SEQ ID NO: 1094105 - RNA, 19 nt, Homo sapiens
gaucaagggugaaaaggaa

SEQ ID NO: 1094106 - RNA, 19 nt, Homo sapiens
acacggaugugaucauugu

SEQ ID NO: 1094107 - RNA, 19 nt, Homo sapiens
gcuaguucuuuaguaguua

SEQ ID NO: 1094108 - RNA, 19 nt, Homo sapiens
gcaguaguccacaaaguau

SEQ ID NO: 1094109 - RNA, 19 nt, Homo sapiens
caacuguacuuggagaaau

SEQ ID NO: 1094110 - RNA, 19 nt, Homo sapiens
gaagacaagcacucugaga

SEQ ID NO: 1094111 - RNA, 19 nt, Homo sapiens
gugcagcuguccaccauug

SEQ ID NO: 1094112 - RNA, 19 nt, Homo sapiens
ucagcuguauuccuuguuu

SEQ ID NO: 1094113 - RNA, 19 nt, Homo sapiens
ccaucuaaguugauaucua

SEQ ID NO: 1094114 - RNA, 19 nt, Homo sapiens
ggagaaaucguguuuuaaa

SEQ ID NO: 1094115 - RNA, 19 nt, Homo sapiens
uacgaaggcuugcguccua

SEQ ID NO: 1094116 - RNA, 19 nt, Homo sapiens
guaagcacauaaauucgau

SEQ ID NO: 1094117 - RNA, 19 nt, Homo sapiens
ucacccaucuaaguugaua

SEQ ID NO: 1094118 - RNA, 19 nt, Homo sapiens
caaaguauucugcucaugu

SEQ ID NO: 1094119 - RNA, 19 nt, Homo sapiens
cagagagaccucccaauga

SEQ ID NO: 1094120 - RNA, 19 nt, Homo sapiens
gcaaugaccggccuucgau

SEQ ID NO: 1094121 - RNA, 19 nt, Homo sapiens
uaagauucccauuggauuu

SEQ ID NO: 1094122 - RNA, 19 nt, Homo sapiens
ggaugugacuauuguuaag

SEQ ID NO: 1094123 - RNA, 19 nt, Homo sapiens
uaaccucaguccagaaaca

SEQ ID NO: 1094124 - RNA, 19 nt, Homo sapiens
accaguaguuugagucaua

SEQ ID NO: 1094125 - RNA, 19 nt, Homo sapiens
gcuaggacucuauuugaaa

SEQ ID NO: 1094126 - RNA, 19 nt, Homo sapiens
gcauugacagugaggagua

SEQ ID NO: 1094127 - RNA, 19 nt, Homo sapiens
ugacuauuguuaagacaga

SEQ ID NO: 1094128 - RNA, 19 nt, Homo sapiens
agccaagaauccuaucaua

SEQ ID NO: 1094129 - RNA, 19 nt, Homo sapiens
gcccggaggucuggaaaga

SEQ ID NO: 1094130 - RNA, 19 nt, Homo sapiens
guaagauucccauuggauu

SEQ ID NO: 1094131 - RNA, 19 nt, Homo sapiens
ucuagaagaugacgguguu

SEQ ID NO: 1094132 - RNA, 19 nt, Homo sapiens
gugaagaaggccacuguuu

SEQ ID NO: 1094133 - RNA, 19 nt, Homo sapiens
acucugagaccacacuuua

SEQ ID NO: 1094134 - RNA, 19 nt, Homo sapiens
cugaauaucugcauugaac

SEQ ID NO: 1094135 - RNA, 19 nt, Homo sapiens
cgacaagcaaagaagauuu

SEQ ID NO: 1094136 - RNA, 19 nt, Homo sapiens
ugagcuaguucuuuaguag

SEQ ID NO: 1094137 - RNA, 19 nt, Homo sapiens
caucaagccucuaucucau

SEQ ID NO: 1094138 - RNA, 19 nt, Homo sapiens
aaguagugcuuccuaaaug

SEQ ID NO: 1094139 - RNA, 19 nt, Homo sapiens
gaagucgaaaggugagaaa

SEQ ID NO: 1094140 - RNA, 19 nt, Homo sapiens
ccggaggucuggaaagaug

SEQ ID NO: 1094141 - RNA, 19 nt, Homo sapiens
uaaagcaguaguccacaaa

SEQ ID NO: 1094142 - RNA, 19 nt, Homo sapiens
acauuuaucuggcauggau

SEQ ID NO: 1094143 - RNA, 19 nt, Homo sapiens
caauuugacacccuucauu

SEQ ID NO: 1094144 - RNA, 19 nt, Homo sapiens
gcuggugucguguaaauau

SEQ ID NO: 1094145 - RNA, 19 nt, Homo sapiens
aaaguauucugcucaugug

SEQ ID NO: 1094146 - RNA, 19 nt, Homo sapiens
uaaguagugcuuccuaaau

SEQ ID NO: 1094147 - RNA, 19 nt, Homo sapiens
gcgucaaaguuagcaagua

SEQ ID NO: 1094148 - RNA, 19 nt, Homo sapiens
ugccgaaaguggaaacaaa

SEQ ID NO: 1094149 - RNA, 19 nt, Homo sapiens
uauuaugcccgacaucuuu

SEQ ID NO: 1094150 - RNA, 19 nt, Homo sapiens
gaaaucguguuuuaaagca

SEQ ID NO: 1094151 - RNA, 19 nt, Homo sapiens
acagagagaccucccaaug

SEQ ID NO: 1094152 - RNA, 19 nt, Homo sapiens
aaccucagcuguauuccuu

SEQ ID NO: 1094153 - RNA, 19 nt, Homo sapiens
ccaaugcacaagugaagaa

SEQ ID NO: 1094154 - RNA, 19 nt, Homo sapiens
cacccuucauucauuuaua

SEQ ID NO: 1094155 - RNA, 19 nt, Homo sapiens
cgucaaaguuagcaaguac

SEQ ID NO: 1094156 - RNA, 19 nt, Homo sapiens
cagccuguauuugcaauga

SEQ ID NO: 1094157 - RNA, 19 nt, Homo sapiens
gaaaggagagacaguucca

SEQ ID NO: 1094158 - RNA, 19 nt, Homo sapiens
gcauugaaccugacaccau

SEQ ID NO: 1094159 - RNA, 19 nt, Homo sapiens
acacugugauaaccuccua

SEQ ID NO: 1094160 - RNA, 19 nt, Homo sapiens
gcucagguguuuggcaauc

SEQ ID NO: 1094161 - RNA, 19 nt, Homo sapiens
ccucacccaucuaaguuga

SEQ ID NO: 1094162 - RNA, 19 nt, Homo sapiens
ccagugcacuuugcuuauc

SEQ ID NO: 1094163 - RNA, 19 nt, Homo sapiens
uuaaagcaguaguccacaa

SEQ ID NO: 1094164 - RNA, 19 nt, Homo sapiens
gaugacgguguucuuuaaa

SEQ ID NO: 1094165 - RNA, 19 nt, Homo sapiens
aaagcuaggacucuauuug

SEQ ID NO: 1094166 - RNA, 19 nt, Homo sapiens
aagcuaggacucuauuuga

SEQ ID NO: 1094167 - RNA, 19 nt, Homo sapiens
guuuggcaaucaacucauu

SEQ ID NO: 1094168 - RNA, 19 nt, Homo sapiens
uuaaaacgcuucgaaauca

SEQ ID NO: 1094169 - RNA, 19 nt, Homo sapiens
uggcauggaugugacuauu

SEQ ID NO: 1094170 - RNA, 19 nt, Homo sapiens
gauggaauagaauuacguu

SEQ ID NO: 1094171 - RNA, 19 nt, Homo sapiens
gaagagggcucaugcuuug

SEQ ID NO: 1094172 - RNA, 19 nt, Homo sapiens
ggagaaguauugcuguuua

SEQ ID NO: 1094173 - RNA, 19 nt, Homo sapiens
gaugaaauccuuagugaua

SEQ ID NO: 1094174 - RNA, 19 nt, Homo sapiens
ggaauuaucagaaagcaua

SEQ ID NO: 1094175 - RNA, 19 nt, Homo sapiens
cauauaagcuuaccuaaca

SEQ ID NO: 1094176 - RNA, 19 nt, Homo sapiens
ggacagaccauaaaugaug

SEQ ID NO: 1094177 - RNA, 19 nt, Homo sapiens
gaagggaacuuuagcuuuu

SEQ ID NO: 1094178 - RNA, 19 nt, Homo sapiens
gcuaagauaucugaugaaa

SEQ ID NO: 1094179 - RNA, 19 nt, Homo sapiens
gagaugauauuucugaaca

SEQ ID NO: 1094180 - RNA, 19 nt, Homo sapiens
gaaacuggagguuggaaua

SEQ ID NO: 1094181 - RNA, 19 nt, Homo sapiens
gaaauacgaauuaguggaa

SEQ ID NO: 1094182 - RNA, 19 nt, Homo sapiens
cagcuaagauaucugauga

SEQ ID NO: 1094183 - RNA, 19 nt, Homo sapiens
gcagaaauacgaauuagug

SEQ ID NO: 1094184 - RNA, 19 nt, Homo sapiens
ccaaagugcuggaauuaca

SEQ ID NO: 1094185 - RNA, 19 nt, Homo sapiens
uaaacaacaugucacaguu

SEQ ID NO: 1094186 - RNA, 19 nt, Homo sapiens
ugggauuccuuaccaauua

SEQ ID NO: 1094187 - RNA, 19 nt, Homo sapiens
ugggaugucucagauauua

SEQ ID NO: 1094188 - RNA, 19 nt, Homo sapiens
ccaccggacuccaggauuu

SEQ ID NO: 1094189 - RNA, 19 nt, Homo sapiens
uaaaccauauguccaagaa

SEQ ID NO: 1094190 - RNA, 19 nt, Homo sapiens
aaacaugccuugcacuugu

SEQ ID NO: 1094191 - RNA, 19 nt, Homo sapiens
ucaaaugcuuggacuuauu

SEQ ID NO: 1094192 - RNA, 19 nt, Homo sapiens
gcuguugacuauuccuaua

SEQ ID NO: 1094193 - RNA, 19 nt, Homo sapiens
guuuauugcuggaaucuuu

SEQ ID NO: 1094194 - RNA, 19 nt, Homo sapiens
guacaacuacugcauuuau

SEQ ID NO: 1094195 - RNA, 19 nt, Homo sapiens
gaugguaccuauuuacagu

SEQ ID NO: 1094196 - RNA, 19 nt, Homo sapiens
gaacagggcuccccauuac

SEQ ID NO: 1094197 - RNA, 19 nt, Homo sapiens
gugcaaacuagguguauua

SEQ ID NO: 1094198 - RNA, 19 nt, Homo sapiens
guggauaccugcagagaau

SEQ ID NO: 1094199 - RNA, 19 nt, Homo sapiens
gacagggucucaccauguu

SEQ ID NO: 1094200 - RNA, 19 nt, Homo sapiens
uaacuaaccgguauccaaa

SEQ ID NO: 1094201 - RNA, 19 nt, Homo sapiens
caucguugcuuuaaucugu

SEQ ID NO: 1094202 - RNA, 19 nt, Homo sapiens
guauccaaaucugguauua

SEQ ID NO: 1094203 - RNA, 19 nt, Homo sapiens
caguuuagauaguuggaua

SEQ ID NO: 1094204 - RNA, 19 nt, Homo sapiens
ggugauauugcaacacuua

SEQ ID NO: 1094205 - RNA, 19 nt, Homo sapiens
gugcaacuacuacauuaua

SEQ ID NO: 1094206 - RNA, 19 nt, Homo sapiens
aaagcaaacugugcaacua

SEQ ID NO: 1094207 - RNA, 19 nt, Homo sapiens
gagaaugcuaugaagcuua

SEQ ID NO: 1094208 - RNA, 19 nt, Homo sapiens
ugaauggucuuaauuacuc

SEQ ID NO: 1094209 - RNA, 19 nt, Homo sapiens
uauuaaagguggcagcaaa

SEQ ID NO: 1094210 - RNA, 19 nt, Homo sapiens
agccaaagaucaacagaaa

SEQ ID NO: 1094211 - RNA, 19 nt, Homo sapiens
uuacacugcuuuaucaaga

SEQ ID NO: 1094212 - RNA, 19 nt, Homo sapiens
gcuccggaauuaucagaaa

SEQ ID NO: 1094213 - RNA, 19 nt, Homo sapiens
gacaguggauucgaccuuu

SEQ ID NO: 1094214 - RNA, 19 nt, Homo sapiens
caugugccauauaagcuua

SEQ ID NO: 1094215 - RNA, 19 nt, Homo sapiens
caacuaaaucuuccugaug

SEQ ID NO: 1094216 - RNA, 19 nt, Homo sapiens
gguaaaaguuggcguuauu

SEQ ID NO: 1094217 - RNA, 19 nt, Homo sapiens
gauuagaggcacagugaaa

SEQ ID NO: 1094218 - RNA, 19 nt, Homo sapiens
cugaugaaauccuuaguga

SEQ ID NO: 1094219 - RNA, 19 nt, Homo sapiens
ccaaagaucaacagaaaca

SEQ ID NO: 1094220 - RNA, 19 nt, Homo sapiens
ggguuucucuaauugcuaa

SEQ ID NO: 1094221 - RNA, 19 nt, Homo sapiens
gauaucugaugaaauccuu

SEQ ID NO: 1094222 - RNA, 19 nt, Homo sapiens
guuauugcuuuguugguaa

SEQ ID NO: 1094223 - RNA, 19 nt, Homo sapiens
gcuuggacuuauuugguua

SEQ ID NO: 1094224 - RNA, 19 nt, Homo sapiens
ucugugagcugcuugguau

SEQ ID NO: 1094225 - RNA, 19 nt, Homo sapiens
gagaaguauugcuguuuag

SEQ ID NO: 1094226 - RNA, 19 nt, Homo sapiens
aaacauuucccuccuuuau

SEQ ID NO: 1094227 - RNA, 19 nt, Homo sapiens
uuagauaguuggauagcuu

SEQ ID NO: 1094228 - RNA, 19 nt, Homo sapiens
aaagguggcagcaaaugua

SEQ ID NO: 1094229 - RNA, 19 nt, Homo sapiens
caucagugcuauuaaaggu

SEQ ID NO: 1094230 - RNA, 19 nt, Homo sapiens
uaguggaacuuaaucaugu

SEQ ID NO: 1094231 - RNA, 19 nt, Homo sapiens
gcucaugcuuugauuccuu

SEQ ID NO: 1094232 - RNA, 19 nt, Homo sapiens
agaaugcuaugaagcuuau

SEQ ID NO: 1094233 - RNA, 19 nt, Homo sapiens
ggagugcaguggcgcaauc

SEQ ID NO: 1094234 - RNA, 19 nt, Homo sapiens
guggauuccugaacaguau

SEQ ID NO: 1094235 - RNA, 19 nt, Homo sapiens
ccacagcuaagauaucuga

SEQ ID NO: 1094236 - RNA, 19 nt, Homo sapiens
gaugauauuucugaacaag

SEQ ID NO: 1094237 - RNA, 19 nt, Homo sapiens
cgaagggaacuuuagcuuu

SEQ ID NO: 1094238 - RNA, 19 nt, Homo sapiens
gaaauaucccggaauugca

SEQ ID NO: 1094239 - RNA, 19 nt, Homo sapiens
uaccacugcugcaugagua

SEQ ID NO: 1094240 - RNA, 19 nt, Homo sapiens
caccaucguugcuuuaauc

SEQ ID NO: 1094241 - RNA, 19 nt, Homo sapiens
ucaccaccaucguugcuuu

SEQ ID NO: 1094242 - RNA, 19 nt, Homo sapiens
guaccuauuuacaguuuag

SEQ ID NO: 1094243 - RNA, 19 nt, Homo sapiens
uacacaaccugaacuacaa

SEQ ID NO: 1094244 - RNA, 19 nt, Homo sapiens
acaguggauucgaccuuua

SEQ ID NO: 1094245 - RNA, 19 nt, Homo sapiens
gcugaauggucuuaauuac

SEQ ID NO: 1094246 - RNA, 19 nt, Homo sapiens
caccaugcccagcuaauuu

SEQ ID NO: 1094247 - RNA, 19 nt, Homo sapiens
ccaacuaaaucuuccugau

SEQ ID NO: 1094248 - RNA, 19 nt, Homo sapiens
gacuuagacuugauuucuu

SEQ ID NO: 1094249 - RNA, 19 nt, Homo sapiens
gugagcugcuugguauaua

SEQ ID NO: 1094250 - RNA, 19 nt, Homo sapiens
guauuacaguacacaguug

SEQ ID NO: 1094251 - RNA, 19 nt, Homo sapiens
uuugaaauaucccggaauu

SEQ ID NO: 1094252 - RNA, 19 nt, Homo sapiens
ggcugaauggucuuaauua

SEQ ID NO: 1094253 - RNA, 19 nt, Homo sapiens
cuaaaucuuccugauguua

SEQ ID NO: 1094254 - RNA, 19 nt, Homo sapiens
gaagcucgauccccaaaga

SEQ ID NO: 1094255 - RNA, 19 nt, Homo sapiens
ugaaagccagguacaacua

SEQ ID NO: 1094256 - RNA, 19 nt, Homo sapiens
gcaaacugugcaacuacua

SEQ ID NO: 1094257 - RNA, 19 nt, Homo sapiens
ggaauggcaaacuguagaa

SEQ ID NO: 1094258 - RNA, 19 nt, Homo sapiens
gauguuacacugcuuuauc

SEQ ID NO: 1094259 - RNA, 19 nt, Homo sapiens
ggcucgagcuguucguaaa

SEQ ID NO: 1094260 - RNA, 19 nt, Homo sapiens
ggaugucucagauauuaga

SEQ ID NO: 1094261 - RNA, 19 nt, Homo sapiens
gggauuccuuaccaauuau

SEQ ID NO: 1094262 - RNA, 19 nt, Homo sapiens
gcuaugaagcuuauguaau

SEQ ID NO: 1094263 - RNA, 19 nt, Homo sapiens
ggcagcaaauguaaaucuu

SEQ ID NO: 1094264 - RNA, 19 nt, Homo sapiens
aagaagaacugagcccaau

SEQ ID NO: 1094265 - RNA, 19 nt, Homo sapiens
ucaucuaccuggugucaau

SEQ ID NO: 1094266 - RNA, 19 nt, Homo sapiens
gcagcaaauguaaaucuug

SEQ ID NO: 1094267 - RNA, 19 nt, Homo sapiens
aacuaaaucuuccugaugu

SEQ ID NO: 1094268 - RNA, 19 nt, Homo sapiens
cugugcaacuacuacauua

SEQ ID NO: 1094269 - RNA, 19 nt, Homo sapiens
agaagagggcucaugcuuu

SEQ ID NO: 1094270 - RNA, 19 nt, Homo sapiens
ugugggaugucucagauau

SEQ ID NO: 1094271 - RNA, 19 nt, Homo sapiens
gaaagaagcugaacuuaag

SEQ ID NO: 1094272 - RNA, 19 nt, Homo sapiens
caagaggaauugaagauua

SEQ ID NO: 1094273 - RNA, 19 nt, Homo sapiens
gaaagcagcggcucaguua

SEQ ID NO: 1094274 - RNA, 19 nt, Homo sapiens
gcacgaagcaggccuguua

SEQ ID NO: 1094275 - RNA, 19 nt, Homo sapiens
agaaagagcuucacgagaa

SEQ ID NO: 1094276 - RNA, 19 nt, Homo sapiens
gaagaaagaagaagaaaug

SEQ ID NO: 1094277 - RNA, 19 nt, Homo sapiens
agaaugaacugcacaaauu

SEQ ID NO: 1094278 - RNA, 19 nt, Homo sapiens
gaaagaagaagaaaugaga

SEQ ID NO: 1094279 - RNA, 19 nt, Homo sapiens
gauuagaacuggcccauau

SEQ ID NO: 1094280 - RNA, 19 nt, Homo sapiens
caagguagauuuguacgua

SEQ ID NO: 1094281 - RNA, 19 nt, Homo sapiens
gcugaagucucaaaucauu

SEQ ID NO: 1094282 - RNA, 19 nt, Homo sapiens
gggaggaccugaugacuga

SEQ ID NO: 1094283 - RNA, 19 nt, Homo sapiens
ggaguagacugguaugaga

SEQ ID NO: 1094284 - RNA, 19 nt, Homo sapiens
gagauuaacgcaacaauga

SEQ ID NO: 1094285 - RNA, 19 nt, Homo sapiens
gaagguagacauuucauau

SEQ ID NO: 1094286 - RNA, 19 nt, Homo sapiens
gaagaaaugagacaaaugu

SEQ ID NO: 1094287 - RNA, 19 nt, Homo sapiens
gccagaaccuguacuaaau

SEQ ID NO: 1094288 - RNA, 19 nt, Homo sapiens
uagaacagcugaagucuca

SEQ ID NO: 1094289 - RNA, 19 nt, Homo sapiens
gaaagacaaggauaagaaa

SEQ ID NO: 1094290 - RNA, 19 nt, Homo sapiens
gcuguaagcuugaagagau

SEQ ID NO: 1094291 - RNA, 19 nt, Homo sapiens
agaguaagaucaugaguga

SEQ ID NO: 1094292 - RNA, 19 nt, Homo sapiens
gcaguaauaucguaucucu

SEQ ID NO: 1094293 - RNA, 19 nt, Homo sapiens
gaagaagaaaugagacaaa

SEQ ID NO: 1094294 - RNA, 19 nt, Homo sapiens
gauuaaacguucucucuuc

SEQ ID NO: 1094295 - RNA, 19 nt, Homo sapiens
gaagcaggccuguuacuug

SEQ ID NO: 1094296 - RNA, 19 nt, Homo sapiens
caaacaccaguaacuauua

SEQ ID NO: 1094297 - RNA, 19 nt, Homo sapiens
gcaaugggguccagauaua

SEQ ID NO: 1094298 - RNA, 19 nt, Homo sapiens
gagaccagauaaauaaaga

SEQ ID NO: 1094299 - RNA, 19 nt, Homo sapiens
guuaugagcuucaggaaag

SEQ ID NO: 1094300 - RNA, 19 nt, Homo sapiens
cagcugaagucucaaauca

SEQ ID NO: 1094301 - RNA, 19 nt, Homo sapiens
ggagaaagaagcugaacuu

SEQ ID NO: 1094302 - RNA, 19 nt, Homo sapiens
ucaagaagguagacauuuc

SEQ ID NO: 1094303 - RNA, 19 nt, Homo sapiens
ccaaggauguucccgcauu

SEQ ID NO: 1094304 - RNA, 19 nt, Homo sapiens
gaugacugauuccaggaua

SEQ ID NO: 1094305 - RNA, 19 nt, Homo sapiens
gaauagccaugacaagagu

SEQ ID NO: 1094306 - RNA, 19 nt, Homo sapiens
gugaacaucauuccaauaa

SEQ ID NO: 1094307 - RNA, 19 nt, Homo sapiens
ggauaacauuucucaugaa

SEQ ID NO: 1094308 - RNA, 19 nt, Homo sapiens
aaugcaagcuucacauaaa

SEQ ID NO: 1094309 - RNA, 19 nt, Homo sapiens
ccacguuaauggacacuuu

SEQ ID NO: 1094310 - RNA, 19 nt, Homo sapiens
gaacagcugaagucucaaa

SEQ ID NO: 1094311 - RNA, 19 nt, Homo sapiens
ugggagaacugcagaagaa

SEQ ID NO: 1094312 - RNA, 19 nt, Homo sapiens
gaacugcacaaauucaaga

SEQ ID NO: 1094313 - RNA, 19 nt, Homo sapiens
uaacauugcuuaguagaag

SEQ ID NO: 1094314 - RNA, 19 nt, Homo sapiens
ccaagaaagacaaggauaa

SEQ ID NO: 1094315 - RNA, 19 nt, Homo sapiens
agaaagaagcugaacuuaa

SEQ ID NO: 1094316 - RNA, 19 nt, Homo sapiens
gagaaagaagcugaacuua

SEQ ID NO: 1094317 - RNA, 19 nt, Homo sapiens
acagauacuucccuuagaa

SEQ ID NO: 1094318 - RNA, 19 nt, Homo sapiens
caggauacuuguacuucua

SEQ ID NO: 1094319 - RNA, 19 nt, Homo sapiens
gcaggccuguuacuuguau

SEQ ID NO: 1094320 - RNA, 19 nt, Homo sapiens
gcagaagaaagaagaagaa

SEQ ID NO: 1094321 - RNA, 19 nt, Homo sapiens
gaguguccaucucccauuu

SEQ ID NO: 1094322 - RNA, 19 nt, Homo sapiens
ugagugaacuggucagcaa

SEQ ID NO: 1094323 - RNA, 19 nt, Homo sapiens
gaagaaaguggaagacaag

SEQ ID NO: 1094324 - RNA, 19 nt, Homo sapiens
cggcugaaguuaaccauug

SEQ ID NO: 1094325 - RNA, 19 nt, Homo sapiens
ggagacauaugaagcaaaa

SEQ ID NO: 1094326 - RNA, 19 nt, Homo sapiens
gaaaguggaagacaagaag

SEQ ID NO: 1094327 - RNA, 19 nt, Homo sapiens
agaagaaaguggaagacaa

SEQ ID NO: 1094328 - RNA, 19 nt, Homo sapiens
gauaacauuucucaugaac

SEQ ID NO: 1094329 - RNA, 19 nt, Homo sapiens
aggauaacauuucucauga

SEQ ID NO: 1094330 - RNA, 19 nt, Homo sapiens
ucucaaggauucuguuuca

SEQ ID NO: 1094331 - RNA, 19 nt, Homo sapiens
gaaagaagaaauagaacag

SEQ ID NO: 1094332 - RNA, 19 nt, Homo sapiens
ccgaagaggugaagauugg

SEQ ID NO: 1094333 - RNA, 19 nt, Homo sapiens
gaaacgguggcagagauua

SEQ ID NO: 1094334 - RNA, 19 nt, Homo sapiens
cugcacaaauucaagagua

SEQ ID NO: 1094335 - RNA, 19 nt, Homo sapiens
acaccaaauuugaaaguga

SEQ ID NO: 1094336 - RNA, 19 nt, Homo sapiens
gcuauaaacucuguaucau

SEQ ID NO: 1094337 - RNA, 19 nt, Homo sapiens
ccauguguguucuuuaguu

SEQ ID NO: 1094338 - RNA, 19 nt, Homo sapiens
gaagauuggcaacaagaug

SEQ ID NO: 1094339 - RNA, 19 nt, Homo sapiens
cuucgaaacuugucuuugu

SEQ ID NO: 1094340 - RNA, 19 nt, Homo sapiens
gcaagaggaauugaagauu

SEQ ID NO: 1094341 - RNA, 19 nt, Homo sapiens
acaagauccucccagcuuu

SEQ ID NO: 1094342 - RNA, 19 nt, Homo sapiens
agaaagacaaggauaagaa

SEQ ID NO: 1094343 - RNA, 19 nt, Homo sapiens
gagaacugcagaagaaaga

SEQ ID NO: 1094344 - RNA, 19 nt, Homo sapiens
gcaauguacggcugaaguu

SEQ ID NO: 1094345 - RNA, 19 nt, Homo sapiens
gagcgaggcccugucaauu

SEQ ID NO: 1094346 - RNA, 19 nt, Homo sapiens
gauagaggucuuaaagguu

SEQ ID NO: 1094347 - RNA, 19 nt, Homo sapiens
agauagaggucuuaaaggu

SEQ ID NO: 1094348 - RNA, 19 nt, Homo sapiens
aagccaagguagauuugua

SEQ ID NO: 1094349 - RNA, 19 nt, Homo sapiens
ucaaacaccaguaacuauu

SEQ ID NO: 1094350 - RNA, 19 nt, Homo sapiens
cauguguguucuuuaguuu

SEQ ID NO: 1094351 - RNA, 19 nt, Homo sapiens
ucaaaucauugucuggaau

SEQ ID NO: 1094352 - RNA, 19 nt, Homo sapiens
auaagccgauaguagaaua

SEQ ID NO: 1094353 - RNA, 19 nt, Homo sapiens
ugacagcuauaagccgaua

SEQ ID NO: 1094354 - RNA, 19 nt, Homo sapiens
gaaauagaacagcugaagu

SEQ ID NO: 1094355 - RNA, 19 nt, Homo sapiens
uaucguaucucugccaugu

SEQ ID NO: 1094356 - RNA, 19 nt, Homo sapiens
gaagaaacgguggcagaga

SEQ ID NO: 1094357 - RNA, 19 nt, Homo sapiens
ugacccagcuacucacaau

SEQ ID NO: 1094358 - RNA, 19 nt, Homo sapiens
ccacagauacuucccuuag

SEQ ID NO: 1094359 - RNA, 19 nt, Homo sapiens
gaauuguaccgacgcugua

SEQ ID NO: 1094360 - RNA, 19 nt, Homo sapiens
gaaguuaaccauuguugac

SEQ ID NO: 1094361 - RNA, 19 nt, Homo sapiens
cuauacugcuccuuucuga

SEQ ID NO: 1094362 - RNA, 19 nt, Homo sapiens
gacaagaguuugcauuuuc

SEQ ID NO: 1094363 - RNA, 19 nt, Homo sapiens
uuacuuguaugucgcuuug

SEQ ID NO: 1094364 - RNA, 19 nt, Homo sapiens
gcauuuuccucacugguua

SEQ ID NO: 1094365 - RNA, 19 nt, Homo sapiens
caaaucauugucuggaauu

SEQ ID NO: 1094366 - RNA, 19 nt, Homo sapiens
gcgaggcccugucaauuuu

SEQ ID NO: 1094367 - RNA, 19 nt, Homo sapiens
caguaaggaaucuuucaua

SEQ ID NO: 1094368 - RNA, 19 nt, Homo sapiens
aggaggaggugaacaacuu

SEQ ID NO: 1094369 - RNA, 19 nt, Homo sapiens
ccucccagcuuucucucua

SEQ ID NO: 1094370 - RNA, 19 nt, Homo sapiens
caauguacggcugaaguua

SEQ ID NO: 1094371 - RNA, 19 nt, Homo sapiens
gcaaggaccuggagcagau

SEQ ID NO: 1094372 - RNA, 19 nt, Homo sapiens
aggaagaaauugccaaaua

SEQ ID NO: 1094373 - RNA, 19 nt, Homo sapiens
ggaagaaauugccaaauac

SEQ ID NO: 1094374 - RNA, 19 nt, Homo sapiens
gcaagccgcugauuaucuu

SEQ ID NO: 1094375 - RNA, 19 nt, Homo sapiens
gcaagaaggucauguccau

SEQ ID NO: 1094376 - RNA, 19 nt, Homo sapiens
gcucauguguaccaaagua

SEQ ID NO: 1094377 - RNA, 19 nt, Homo sapiens
cgggaaagguguacuauga

SEQ ID NO: 1094378 - RNA, 19 nt, Homo sapiens
ucaaagcgauguucucuuc

SEQ ID NO: 1094379 - RNA, 19 nt, Homo sapiens
gcgccuaucuuccauguga

SEQ ID NO: 1094380 - RNA, 19 nt, Homo sapiens
ggacgugugugccuaugaa

SEQ ID NO: 1094381 - RNA, 19 nt, Homo sapiens
gaaagguuccugcagauga

SEQ ID NO: 1094382 - RNA, 19 nt, Homo sapiens
guagggaguucagcaguaa

SEQ ID NO: 1094383 - RNA, 19 nt, Homo sapiens
gagcagaucucuccauucc

SEQ ID NO: 1094384 - RNA, 19 nt, Homo sapiens
gaaaugguccucagagaag

SEQ ID NO: 1094385 - RNA, 19 nt, Homo sapiens
ggaaaugguccucagagaa

SEQ ID NO: 1094386 - RNA, 19 nt, Homo sapiens
ugugucagcuucuguauga

SEQ ID NO: 1094387 - RNA, 19 nt, Homo sapiens
ccaagugggugcggcauaa

SEQ ID NO: 1094388 - RNA, 19 nt, Homo sapiens
ggaccaagaccagcaaauu

SEQ ID NO: 1094389 - RNA, 19 nt, Homo sapiens
cugauuaucuucacaccua

SEQ ID NO: 1094390 - RNA, 19 nt, Homo sapiens
ggagggcugugaagugaug

SEQ ID NO: 1094391 - RNA, 19 nt, Homo sapiens
gugcggacaugaccaagaa

SEQ ID NO: 1094392 - RNA, 19 nt, Homo sapiens
gauugagaaugucaucuug

SEQ ID NO: 1094393 - RNA, 19 nt, Homo sapiens
gcgcacggcccauauggua

SEQ ID NO: 1094394 - RNA, 19 nt, Homo sapiens
gcaacuggaucguggucaa

SEQ ID NO: 1094395 - RNA, 19 nt, Homo sapiens
gaccaagaccagcaaauug

SEQ ID NO: 1094396 - RNA, 19 nt, Homo sapiens
gaacaugggcuacuaugac

SEQ ID NO: 1094397 - RNA, 19 nt, Homo sapiens
cgacaaauccagcgagaug

SEQ ID NO: 1094398 - RNA, 19 nt, Homo sapiens
ucacaaccauugauaaacu

SEQ ID NO: 1094399 - RNA, 19 nt, Homo sapiens
acaagaacaugggcuacua

SEQ ID NO: 1094400 - RNA, 19 nt, Homo sapiens
cagaggcugugauauaugu

SEQ ID NO: 1094401 - RNA, 19 nt, Homo sapiens
uauggcagguccaaggaua

SEQ ID NO: 1094402 - RNA, 19 nt, Homo sapiens
ggaguuugaggaagaaauu

SEQ ID NO: 1094403 - RNA, 19 nt, Homo sapiens
gccagggcgugguauauga

SEQ ID NO: 1094404 - RNA, 19 nt, Homo sapiens
gcacgggaaagguguacua

SEQ ID NO: 1094405 - RNA, 19 nt, Homo sapiens
gaagaaguacgcagacaag

SEQ ID NO: 1094406 - RNA, 19 nt, Homo sapiens
uugauaaacuggccuucua

SEQ ID NO: 1094407 - RNA, 19 nt, Homo sapiens
ccaguuacauggaggagau

SEQ ID NO: 1094408 - RNA, 19 nt, Homo sapiens
acuaugaccuggugaagga

SEQ ID NO: 1094409 - RNA, 19 nt, Homo sapiens
gcaggaguuugaggaagaa

SEQ ID NO: 1094410 - RNA, 19 nt, Homo sapiens
gaugauuccugcccucaag

SEQ ID NO: 1094411 - RNA, 19 nt, Homo sapiens
gggcuacuaugacuacauc

SEQ ID NO: 1094412 - RNA, 19 nt, Homo sapiens
ugccugugcugaagaagua

SEQ ID NO: 1094413 - RNA, 19 nt, Homo sapiens
ucaagaccaucaucgacaa

SEQ ID NO: 1094414 - RNA, 19 nt, Homo sapiens
guacuucgccugguuggaa

SEQ ID NO: 1094415 - RNA, 19 nt, Homo sapiens
guucucuucugugcucuua

SEQ ID NO: 1094416 - RNA, 19 nt, Homo sapiens
gauccacacuggccucucu

SEQ ID NO: 1094417 - RNA, 19 nt, Homo sapiens
acaagcagauccacagaca

SEQ ID NO: 1094418 - RNA, 19 nt, Homo sapiens
ucacccagccgcucaugua

SEQ ID NO: 1094419 - RNA, 19 nt, Homo sapiens
cagaguacauggccuuugg

SEQ ID NO: 1094420 - RNA, 19 nt, Homo sapiens
cccagaggcugugauauau

SEQ ID NO: 1094421 - RNA, 19 nt, Homo sapiens
ccugcugggugauuuguuu

SEQ ID NO: 1094422 - RNA, 19 nt, Homo sapiens
ggauugagaaugucaucuu

SEQ ID NO: 1094423 - RNA, 19 nt, Homo sapiens
gcucccaucuugcuggaau

SEQ ID NO: 1094424 - RNA, 19 nt, Homo sapiens
agacaaaggcagagcaguu

SEQ ID NO: 1094425 - RNA, 19 nt, Homo sapiens
cggaaaugguccucagaga

SEQ ID NO: 1094426 - RNA, 19 nt, Homo sapiens
cgaaccugcugggugauuu

SEQ ID NO: 1094427 - RNA, 19 nt, Homo sapiens
cacccucgcuuaucuguag

SEQ ID NO: 1094428 - RNA, 19 nt, Homo sapiens
ggucauguccauccugguu

SEQ ID NO: 1094429 - RNA, 19 nt, Homo sapiens
acccagaggcugugauaua

SEQ ID NO: 1094430 - RNA, 19 nt, Homo sapiens
ggucaaugcgccuaucuuc

SEQ ID NO: 1094431 - RNA, 19 nt, Homo sapiens
caaaggcagagcaguucua

SEQ ID NO: 1094432 - RNA, 19 nt, Homo sapiens
ccaccuguaucucaagaca

SEQ ID NO: 1094433 - RNA, 19 nt, Homo sapiens
cagcgaggcccgaaagguu

SEQ ID NO: 1094434 - RNA, 19 nt, Homo sapiens
guacggaguccugggcuuu

SEQ ID NO: 1094435 - RNA, 19 nt, Homo sapiens
gcagccgaauggagaaaca

SEQ ID NO: 1094436 - RNA, 19 nt, Homo sapiens
ugauauaugugugcagugu

SEQ ID NO: 1094437 - RNA, 19 nt, Homo sapiens
caacaaccagauuggauuc

SEQ ID NO: 1094438 - RNA, 19 nt, Homo sapiens
ucaacaaccagauuggauu

SEQ ID NO: 1094439 - RNA, 19 nt, Homo sapiens
gauaaacuggccuucuaug

SEQ ID NO: 1094440 - RNA, 19 nt, Homo sapiens
gggcauuccugcgagaugu

SEQ ID NO: 1094441 - RNA, 19 nt, Homo sapiens
gcaguaacagccaggugaa

SEQ ID NO: 1094442 - RNA, 19 nt, Homo sapiens
gaggccaaguccagcuuug

SEQ ID NO: 1094443 - RNA, 19 nt, Homo sapiens
ccacaccggccaacuacuu

SEQ ID NO: 1094444 - RNA, 19 nt, Homo sapiens
caaauacgaccggaucugu

SEQ ID NO: 1094445 - RNA, 19 nt, Homo sapiens
gcacauuggccuggaguuc

SEQ ID NO: 1094446 - RNA, 19 nt, Homo sapiens
cagcucauguguaccaaag

SEQ ID NO: 1094447 - RNA, 19 nt, Homo sapiens
gaaccugcugggugauuug

SEQ ID NO: 1094448 - RNA, 19 nt, Homo sapiens
aguagggaguucagcagua

SEQ ID NO: 1094449 - RNA, 19 nt, Homo sapiens
gacuugaucacaaccauug

SEQ ID NO: 1094450 - RNA, 19 nt, Homo sapiens
gcuccacaccggccaacua

SEQ ID NO: 1094451 - RNA, 19 nt, Homo sapiens
gcuuugagcugggcuaugc

SEQ ID NO: 1094452 - RNA, 19 nt, Homo sapiens
ugacccagaggcugugaua

SEQ ID NO: 1094453 - RNA, 19 nt, Homo sapiens
cuggagggcugugaaguga

SEQ ID NO: 1094454 - RNA, 19 nt, Homo sapiens
ucucuucugugcucuuaga

SEQ ID NO: 1094455 - RNA, 19 nt, Homo sapiens
caagaacaugggcuacuau

SEQ ID NO: 1094456 - RNA, 19 nt, Homo sapiens
ccgaauggagaaacacuuu

SEQ ID NO: 1094457 - RNA, 19 nt, Homo sapiens
gacaaaggcagagcaguuc

SEQ ID NO: 1094458 - RNA, 19 nt, Homo sapiens
ccaugagguuugaagacuu

SEQ ID NO: 1094459 - RNA, 19 nt, Homo sapiens
uggugucacugaagaaguu

SEQ ID NO: 1094460 - RNA, 19 nt, Homo sapiens
cacaugacgucccgguguu

SEQ ID NO: 1094461 - RNA, 19 nt, Homo sapiens
ccgaaagguuccugcagau

SEQ ID NO: 1094462 - RNA, 19 nt, Homo sapiens
gaagaaauugccaaauacg

SEQ ID NO: 1094463 - RNA, 19 nt, Homo sapiens
augcagaccuggacuccuu

SEQ ID NO: 1094464 - RNA, 19 nt, Homo sapiens
aaagcgauguucucuucug

SEQ ID NO: 1094465 - RNA, 19 nt, Homo sapiens
ugcaggaguuugaggaaga

SEQ ID NO: 1094466 - RNA, 19 nt, Homo sapiens
guacgcagacaagcugauu

SEQ ID NO: 1094467 - RNA, 19 nt, Homo sapiens
guacaagcagauccacaga

SEQ ID NO: 1094468 - RNA, 19 nt, Homo sapiens
cccagccgcucauguacaa

SEQ ID NO: 1094469 - RNA, 19 nt, Homo sapiens
ggccuggaguucauguuca

SEQ ID NO: 1094470 - RNA, 19 nt, Homo sapiens
cgacaaccaccuucauugg

SEQ ID NO: 1094471 - RNA, 19 nt, Homo sapiens
gaagaacgauuuaaaggua

SEQ ID NO: 1094472 - RNA, 19 nt, Homo sapiens
gaagaaagaccauaucuaa

SEQ ID NO: 1094473 - RNA, 19 nt, Homo sapiens
gaacuccuguugcuaaaua

SEQ ID NO: 1094474 - RNA, 19 nt, Homo sapiens
gcacccagcuuaaguagaa

SEQ ID NO: 1094475 - RNA, 19 nt, Homo sapiens
gcaacguguuuauguauua

SEQ ID NO: 1094476 - RNA, 19 nt, Homo sapiens
guuaguauguccuauguua

SEQ ID NO: 1094477 - RNA, 19 nt, Homo sapiens
cagcugacauuaccauuua

SEQ ID NO: 1094478 - RNA, 19 nt, Homo sapiens
guagaagaaugccuguuua

SEQ ID NO: 1094479 - RNA, 19 nt, Homo sapiens
gcugauaucugguuaguau

SEQ ID NO: 1094480 - RNA, 19 nt, Homo sapiens
caaguuguaucgucuuaua

SEQ ID NO: 1094481 - RNA, 19 nt, Homo sapiens
aaucagagguggcuuaauu

SEQ ID NO: 1094482 - RNA, 19 nt, Homo sapiens
gcauauaggucaaauagca

SEQ ID NO: 1094483 - RNA, 19 nt, Homo sapiens
agagaaagaugaagaaaga

SEQ ID NO: 1094484 - RNA, 19 nt, Homo sapiens
acaauuacccuguacauua

SEQ ID NO: 1094485 - RNA, 19 nt, Homo sapiens
gaaaucauaaggcaguuua

SEQ ID NO: 1094486 - RNA, 19 nt, Homo sapiens
gaauguguguuucauaaug

SEQ ID NO: 1094487 - RNA, 19 nt, Homo sapiens
gaauaaaugcuguaacuug

SEQ ID NO: 1094488 - RNA, 19 nt, Homo sapiens
ccuugaagcuuauacuuua

SEQ ID NO: 1094489 - RNA, 19 nt, Homo sapiens
caacaaagccugugaacug

SEQ ID NO: 1094490 - RNA, 19 nt, Homo sapiens
gcacagaggaugucgcuaa

SEQ ID NO: 1094491 - RNA, 19 nt, Homo sapiens
gaucauaucaacacuguaa

SEQ ID NO: 1094492 - RNA, 19 nt, Homo sapiens
caacucacuuggaauguuu

SEQ ID NO: 1094493 - RNA, 19 nt, Homo sapiens
caaccuagcuuucgaaugc

SEQ ID NO: 1094494 - RNA, 19 nt, Homo sapiens
uaaggcaguuuaagcauaa

SEQ ID NO: 1094495 - RNA, 19 nt, Homo sapiens
cuagugaguuucuuuguaa

SEQ ID NO: 1094496 - RNA, 19 nt, Homo sapiens
cgauggcgaugaacuauaa

SEQ ID NO: 1094497 - RNA, 19 nt, Homo sapiens
gcuagugaguuucuuugua

SEQ ID NO: 1094498 - RNA, 19 nt, Homo sapiens
gcucaugucugcagugguu

SEQ ID NO: 1094499 - RNA, 19 nt, Homo sapiens
gaaagcaaaucaucugcau

SEQ ID NO: 1094500 - RNA, 19 nt, Homo sapiens
caauuacccuguacauuau

SEQ ID NO: 1094501 - RNA, 19 nt, Homo sapiens
gcuauggaacuuauucuua

SEQ ID NO: 1094502 - RNA, 19 nt, Homo sapiens
gcacgaaguacuugaugua

SEQ ID NO: 1094503 - RNA, 19 nt, Homo sapiens
ucauuucccuugaagcuua

SEQ ID NO: 1094504 - RNA, 19 nt, Homo sapiens
agaaagggauuacaagaug

SEQ ID NO: 1094505 - RNA, 19 nt, Homo sapiens
gaaaauuacuucagcuuug

SEQ ID NO: 1094506 - RNA, 19 nt, Homo sapiens
ucgaagaaaugaagacaaa

SEQ ID NO: 1094507 - RNA, 19 nt, Homo sapiens
agaaagaauucaggugaua

SEQ ID NO: 1094508 - RNA, 19 nt, Homo sapiens
cagaggaugucgcuaaaga

SEQ ID NO: 1094509 - RNA, 19 nt, Homo sapiens
gaaagggauuacaagaugu

SEQ ID NO: 1094510 - RNA, 19 nt, Homo sapiens
cggaugaucuugagcacua

SEQ ID NO: 1094511 - RNA, 19 nt, Homo sapiens
caucaucggucucaucuuc

SEQ ID NO: 1094512 - RNA, 19 nt, Homo sapiens
gaacauucauauagucucu

SEQ ID NO: 1094513 - RNA, 19 nt, Homo sapiens
gaaagcaguaaccuuaauu

SEQ ID NO: 1094514 - RNA, 19 nt, Homo sapiens
gaaugcugauaucugguua

SEQ ID NO: 1094515 - RNA, 19 nt, Homo sapiens
guucauguauccaguuuau

SEQ ID NO: 1094516 - RNA, 19 nt, Homo sapiens
aaauagcuguguacuacua

SEQ ID NO: 1094517 - RNA, 19 nt, Homo sapiens
gaaaugaagacaaaccaau

SEQ ID NO: 1094518 - RNA, 19 nt, Homo sapiens
gagaagagucaagugaaua

SEQ ID NO: 1094519 - RNA, 19 nt, Homo sapiens
gcaaugauucuuauccuau

SEQ ID NO: 1094520 - RNA, 19 nt, Homo sapiens
gaaaaucauucaaccaaga

SEQ ID NO: 1094521 - RNA, 19 nt, Homo sapiens
uaacuuguuugcuauggaa

SEQ ID NO: 1094522 - RNA, 19 nt, Homo sapiens
caagagaagagucaaguga

SEQ ID NO: 1094523 - RNA, 19 nt, Homo sapiens
cgaaguacuugauguaugg

SEQ ID NO: 1094524 - RNA, 19 nt, Homo sapiens
aagaaugccuguuuacuca

SEQ ID NO: 1094525 - RNA, 19 nt, Homo sapiens
gaagaaugccuguuuacuc

SEQ ID NO: 1094526 - RNA, 19 nt, Homo sapiens
gcaguaaccuuaauuuccu

SEQ ID NO: 1094527 - RNA, 19 nt, Homo sapiens
ggagaaagggauuacaaga

SEQ ID NO: 1094528 - RNA, 19 nt, Homo sapiens
gcuguguacuacuaauuaa

SEQ ID NO: 1094529 - RNA, 19 nt, Homo sapiens
gucauagucuccuuucaaa

SEQ ID NO: 1094530 - RNA, 19 nt, Homo sapiens
gauugagucugugcuguuu

SEQ ID NO: 1094531 - RNA, 19 nt, Homo sapiens
ugaagaguauggaacauuc

SEQ ID NO: 1094532 - RNA, 19 nt, Homo sapiens
gaggaugucgcuaaagaaa

SEQ ID NO: 1094533 - RNA, 19 nt, Homo sapiens
gaaugccuguuuacucaga

SEQ ID NO: 1094534 - RNA, 19 nt, Homo sapiens
gcacauucucuuuaguuaa

SEQ ID NO: 1094535 - RNA, 19 nt, Homo sapiens
gacauugaaggaugcauua

SEQ ID NO: 1094536 - RNA, 19 nt, Homo sapiens
uggaguauguacaugauaa

SEQ ID NO: 1094537 - RNA, 19 nt, Homo sapiens
ggucaaauagcaaugugua

SEQ ID NO: 1094538 - RNA, 19 nt, Homo sapiens
ugucaguccuucagaauau

SEQ ID NO: 1094539 - RNA, 19 nt, Homo sapiens
ggaaauacucaggcuguuu

SEQ ID NO: 1094540 - RNA, 19 nt, Homo sapiens
ccaguacaguuauuuguca

SEQ ID NO: 1094541 - RNA, 19 nt, Homo sapiens
auaaggcaguuuaagcaua

SEQ ID NO: 1094542 - RNA, 19 nt, Homo sapiens
ggauaacacggccuucaaa

SEQ ID NO: 1094543 - RNA, 19 nt, Homo sapiens
gagaaagggauuacaagau

SEQ ID NO: 1094544 - RNA, 19 nt, Homo sapiens
ggcaaugauucuuauccua

SEQ ID NO: 1094545 - RNA, 19 nt, Homo sapiens
gcacuuggcaguuuauuuu

SEQ ID NO: 1094546 - RNA, 19 nt, Homo sapiens
guaugguuauccugaaauu

SEQ ID NO: 1094547 - RNA, 19 nt, Homo sapiens
ugaaagcaguaaccuuaau

SEQ ID NO: 1094548 - RNA, 19 nt, Homo sapiens
caaccuggaagaacgauuu

SEQ ID NO: 1094549 - RNA, 19 nt, Homo sapiens
gauguaugguuauccugaa

SEQ ID NO: 1094550 - RNA, 19 nt, Homo sapiens
agagguggcuuaauuacau

SEQ ID NO: 1094551 - RNA, 19 nt, Homo sapiens
guuaaggcaccaauuguuu

SEQ ID NO: 1094552 - RNA, 19 nt, Homo sapiens
uaccuugucuggcauaaga

SEQ ID NO: 1094553 - RNA, 19 nt, Homo sapiens
ggacuaccauccugcaacu

SEQ ID NO: 1094554 - RNA, 19 nt, Homo sapiens
gcuguaacuuguuugcuau

SEQ ID NO: 1094555 - RNA, 19 nt, Homo sapiens
uuugaaagcaguaaccuua

SEQ ID NO: 1094556 - RNA, 19 nt, Homo sapiens
uacuucagcuuuggaaaua

SEQ ID NO: 1094557 - RNA, 19 nt, Homo sapiens
gaaagaauucaggugauau

SEQ ID NO: 1094558 - RNA, 19 nt, Homo sapiens
guauccaguuuauccagua

SEQ ID NO: 1094559 - RNA, 19 nt, Homo sapiens
ggaagaacgauuuaaaggu

SEQ ID NO: 1094560 - RNA, 19 nt, Homo sapiens
gaaugugaaccuuaucgaa

SEQ ID NO: 1094561 - RNA, 19 nt, Homo sapiens
gaaaagauucccaauugaa

SEQ ID NO: 1094562 - RNA, 19 nt, Homo sapiens
gcuuuaugcucaaauguca

SEQ ID NO: 1094563 - RNA, 19 nt, Homo sapiens
aaccacauguaaaugcuua

SEQ ID NO: 1094564 - RNA, 19 nt, Homo sapiens
guaugaguauaaugacuug

SEQ ID NO: 1094565 - RNA, 19 nt, Homo sapiens
ugacauaugaagcuguaua

SEQ ID NO: 1094566 - RNA, 19 nt, Homo sapiens
cacuguaacugcugaaaug

SEQ ID NO: 1094567 - RNA, 19 nt, Homo sapiens
caaagaauuguguugcauu

SEQ ID NO: 1094568 - RNA, 19 nt, Homo sapiens
gauugucccucuugcacuu

SEQ ID NO: 1094569 - RNA, 19 nt, Homo sapiens
guaaucauuucccuugaag

SEQ ID NO: 1094570 - RNA, 19 nt, Homo sapiens
uugcuaaccuuucaggauu

SEQ ID NO: 1094571 - RNA, 19 nt, Homo sapiens
gaaggagaaugacaaauua

SEQ ID NO: 1094572 - RNA, 19 nt, Homo sapiens
gaacuuaacucugaaauug

SEQ ID NO: 1094573 - RNA, 19 nt, Homo sapiens
gcaaggaucugaauuuguu

SEQ ID NO: 1094574 - RNA, 19 nt, Homo sapiens
gagaacaccuugaugguaa

SEQ ID NO: 1094575 - RNA, 19 nt, Homo sapiens
gaaagaagaugcucgaaag

SEQ ID NO: 1094576 - RNA, 19 nt, Homo sapiens
gaaauggucugcucccaaa

SEQ ID NO: 1094577 - RNA, 19 nt, Homo sapiens
gaucaaacaucuaacagaa

SEQ ID NO: 1094578 - RNA, 19 nt, Homo sapiens
gcucuuggauguuguauuu

SEQ ID NO: 1094579 - RNA, 19 nt, Homo sapiens
agaagaaggugcauucaua

SEQ ID NO: 1094580 - RNA, 19 nt, Homo sapiens
guucagagcuucauaguuc

SEQ ID NO: 1094581 - RNA, 19 nt, Homo sapiens
caagugugguuccuauuua

SEQ ID NO: 1094582 - RNA, 19 nt, Homo sapiens
gagaaagcguuuagaagaa

SEQ ID NO: 1094583 - RNA, 19 nt, Homo sapiens
caaagaagcuacgagauug

SEQ ID NO: 1094584 - RNA, 19 nt, Homo sapiens
uggaagaucuccuaacuaa

SEQ ID NO: 1094585 - RNA, 19 nt, Homo sapiens
gaagaacuuucagccaaua

SEQ ID NO: 1094586 - RNA, 19 nt, Homo sapiens
gcaaagaagcuacgagauu

SEQ ID NO: 1094587 - RNA, 19 nt, Homo sapiens
gagauugacucugagauuu

SEQ ID NO: 1094588 - RNA, 19 nt, Homo sapiens
gcaaugaagugaaugaaag

SEQ ID NO: 1094589 - RNA, 19 nt, Homo sapiens
ugagaaggccacauuauua

SEQ ID NO: 1094590 - RNA, 19 nt, Homo sapiens
gcucaggagugaaggcuua

SEQ ID NO: 1094591 - RNA, 19 nt, Homo sapiens
gaaaugaacacccagaaug

SEQ ID NO: 1094592 - RNA, 19 nt, Homo sapiens
gaaaagaaguugcaaaaca

SEQ ID NO: 1094593 - RNA, 19 nt, Homo sapiens
ugacaaauaucccauggaa

SEQ ID NO: 1094594 - RNA, 19 nt, Homo sapiens
gaaacaaucaucagacuau

SEQ ID NO: 1094595 - RNA, 19 nt, Homo sapiens
aaaguuggcuugagaguug

SEQ ID NO: 1094596 - RNA, 19 nt, Homo sapiens
caaacacgauggugacaaa

SEQ ID NO: 1094597 - RNA, 19 nt, Homo sapiens
gaagaaggugcauucauaa

SEQ ID NO: 1094598 - RNA, 19 nt, Homo sapiens
uccauaaucugcagaauaa

SEQ ID NO: 1094599 - RNA, 19 nt, Homo sapiens
aaagagaaauugcuacaga

SEQ ID NO: 1094600 - RNA, 19 nt, Homo sapiens
gaaauucgaacuuugagaa

SEQ ID NO: 1094601 - RNA, 19 nt, Homo sapiens
cagauacgauucauuaguu

SEQ ID NO: 1094602 - RNA, 19 nt, Homo sapiens
gcuacgagauugacucuga

SEQ ID NO: 1094603 - RNA, 19 nt, Homo sapiens
gaggaaaccuggagcuuag

SEQ ID NO: 1094604 - RNA, 19 nt, Homo sapiens
ggacagugaucagcaaaga

SEQ ID NO: 1094605 - RNA, 19 nt, Homo sapiens
ggucaaaucucugcaggaa

SEQ ID NO: 1094606 - RNA, 19 nt, Homo sapiens
gcaaaaccaucuucucuaa

SEQ ID NO: 1094607 - RNA, 19 nt, Homo sapiens
gaagaggaccugagagaga

SEQ ID NO: 1094608 - RNA, 19 nt, Homo sapiens
gaagcaagauaaugagaca

SEQ ID NO: 1094609 - RNA, 19 nt, Homo sapiens
aaggugaacuuguacauuu

SEQ ID NO: 1094610 - RNA, 19 nt, Homo sapiens
gaagagcacaggagacuga

SEQ ID NO: 1094611 - RNA, 19 nt, Homo sapiens
gugcugagcugcuggagaa

SEQ ID NO: 1094612 - RNA, 19 nt, Homo sapiens
uugaagaacuuaacucuga

SEQ ID NO: 1094613 - RNA, 19 nt, Homo sapiens
ucacugaauugaagaaaga

SEQ ID NO: 1094614 - RNA, 19 nt, Homo sapiens
gaacaugaaggacuuugaa

SEQ ID NO: 1094615 - RNA, 19 nt, Homo sapiens
gaagagaaaccgaucaaca

SEQ ID NO: 1094616 - RNA, 19 nt, Homo sapiens
guagaagcauuaagaagau

SEQ ID NO: 1094617 - RNA, 19 nt, Homo sapiens
gcucugcgcuugcaacuag

SEQ ID NO: 1094618 - RNA, 19 nt, Homo sapiens
uaaaggauccagagauaaa

SEQ ID NO: 1094619 - RNA, 19 nt, Homo sapiens
acaaggaaauggacaguga

SEQ ID NO: 1094620 - RNA, 19 nt, Homo sapiens
gagaagacaccuaagcaaa

SEQ ID NO: 1094621 - RNA, 19 nt, Homo sapiens
ucaaaucucugcaggaauc

SEQ ID NO: 1094622 - RNA, 19 nt, Homo sapiens
gucaagagcugggaacaaa

SEQ ID NO: 1094623 - RNA, 19 nt, Homo sapiens
cagaauaaguucagagauc

SEQ ID NO: 1094624 - RNA, 19 nt, Homo sapiens
gaagaucuccuaacuaaaa

SEQ ID NO: 1094625 - RNA, 19 nt, Homo sapiens
ccaaaugugucagaagaaa

SEQ ID NO: 1094626 - RNA, 19 nt, Homo sapiens
caaaugagacagaauacuu

SEQ ID NO: 1094627 - RNA, 19 nt, Homo sapiens
gcaccuggcugccuagaag

SEQ ID NO: 1094628 - RNA, 19 nt, Homo sapiens
uaacagaaaguaccaauca

SEQ ID NO: 1094629 - RNA, 19 nt, Homo sapiens
caagugaucaaacaucuaa

SEQ ID NO: 1094630 - RNA, 19 nt, Homo sapiens
gagaaagacagacugauug

SEQ ID NO: 1094631 - RNA, 19 nt, Homo sapiens
gauguuguauuucagauca

SEQ ID NO: 1094632 - RNA, 19 nt, Homo sapiens
gagauaaacagaaggagaa

SEQ ID NO: 1094633 - RNA, 19 nt, Homo sapiens
cucaugcgcucucugauua

SEQ ID NO: 1094634 - RNA, 19 nt, Homo sapiens
caacuuaaccuaccaacau

SEQ ID NO: 1094635 - RNA, 19 nt, Homo sapiens
ggagaacaccuugauggua

SEQ ID NO: 1094636 - RNA, 19 nt, Homo sapiens
agucuaagauuucagauug

SEQ ID NO: 1094637 - RNA, 19 nt, Homo sapiens
ugagaaagcguuuagaaga

SEQ ID NO: 1094638 - RNA, 19 nt, Homo sapiens
gaacugauggagaggauug

SEQ ID NO: 1094639 - RNA, 19 nt, Homo sapiens
agaaagagcaggacaucua

SEQ ID NO: 1094640 - RNA, 19 nt, Homo sapiens
gggagagacuggagaagga

SEQ ID NO: 1094641 - RNA, 19 nt, Homo sapiens
cauuugaucuguuugauuc

SEQ ID NO: 1094642 - RNA, 19 nt, Homo sapiens
gaaagagcaggacaucuau

SEQ ID NO: 1094643 - RNA, 19 nt, Homo sapiens
auuaaaggauccagagaua

SEQ ID NO: 1094644 - RNA, 19 nt, Homo sapiens
aauacaagcugcagaagga

SEQ ID NO: 1094645 - RNA, 19 nt, Homo sapiens
gcacacggagucuaagauu

SEQ ID NO: 1094646 - RNA, 19 nt, Homo sapiens
ucaaacaucuaacagaaag

SEQ ID NO: 1094647 - RNA, 19 nt, Homo sapiens
caucaaagccuccaaagca

SEQ ID NO: 1094648 - RNA, 19 nt, Homo sapiens
ggaaagaaugcaacaggaa

SEQ ID NO: 1094649 - RNA, 19 nt, Homo sapiens
ccacugagcaaguuuguga

SEQ ID NO: 1094650 - RNA, 19 nt, Homo sapiens
gaaagaaggcagcgagaag

SEQ ID NO: 1094651 - RNA, 19 nt, Homo sapiens
gaacacauacaggaaauuc

SEQ ID NO: 1094652 - RNA, 19 nt, Homo sapiens
aggaacagcugaaucaaug

SEQ ID NO: 1094653 - RNA, 19 nt, Homo sapiens
aaacugagaagacaccuaa

SEQ ID NO: 1094654 - RNA, 19 nt, Homo sapiens
aaagagggauaaagccauu

SEQ ID NO: 1094655 - RNA, 19 nt, Homo sapiens
gaaagaaugcaacaggaau

SEQ ID NO: 1094656 - RNA, 19 nt, Homo sapiens
cauggaaagugauaauuca

SEQ ID NO: 1094657 - RNA, 19 nt, Homo sapiens
acacgauggugacaaauau

SEQ ID NO: 1094658 - RNA, 19 nt, Homo sapiens
agaaggagaaugacaaauu

SEQ ID NO: 1094659 - RNA, 19 nt, Homo sapiens
uaucagaauuugcggaaga

SEQ ID NO: 1094660 - RNA, 19 nt, Homo sapiens
ggacaucuauacccaucug

SEQ ID NO: 1094661 - RNA, 19 nt, Homo sapiens
ccacugaacauaucuacaa

SEQ ID NO: 1094662 - RNA, 19 nt, Homo sapiens
cagcugcucucacagaaug

SEQ ID NO: 1094663 - RNA, 19 nt, Homo sapiens
gauugaggaagacaacuua

SEQ ID NO: 1094664 - RNA, 19 nt, Homo sapiens
caacagagaggcuaagaag

SEQ ID NO: 1094665 - RNA, 19 nt, Homo sapiens
gguuucaaguggaacauuu

SEQ ID NO: 1094666 - RNA, 19 nt, Homo sapiens
gagcagaucagcgaaauuc

SEQ ID NO: 1094667 - RNA, 19 nt, Homo sapiens
ucucaagacuuacuaaugg

SEQ ID NO: 1094668 - RNA, 19 nt, Homo sapiens
gaggaugacgagauuaauu

SEQ ID NO: 1094669 - RNA, 19 nt, Homo sapiens
gcacagacccaggaauuuc

SEQ ID NO: 1094670 - RNA, 19 nt, Homo sapiens
auaaagccauucaggguuu

SEQ ID NO: 1094671 - RNA, 19 nt, Homo sapiens
gaaauggucuggacuuauu

SEQ ID NO: 1094672 - RNA, 19 nt, Homo sapiens
gaagaagacucgacccaua

SEQ ID NO: 1094673 - RNA, 19 nt, Homo sapiens
ggaccaagcuucucucaaa

SEQ ID NO: 1094674 - RNA, 19 nt, Homo sapiens
ccaauaagcugaagcacua

SEQ ID NO: 1094675 - RNA, 19 nt, Homo sapiens
uggaagagcuggugaauuu

SEQ ID NO: 1094676 - RNA, 19 nt, Homo sapiens
gaaagugucuuaugucucu

SEQ ID NO: 1094677 - RNA, 19 nt, Homo sapiens
gaacccaucugucugcauu

SEQ ID NO: 1094678 - RNA, 19 nt, Homo sapiens
gcaaugugcucaaauucaa

SEQ ID NO: 1094679 - RNA, 19 nt, Homo sapiens
gaggugaacucugcccuua

SEQ ID NO: 1094680 - RNA, 19 nt, Homo sapiens
gcaagaacuuucccuuuca

SEQ ID NO: 1094681 - RNA, 19 nt, Homo sapiens
gaaacuguauugccuguca

SEQ ID NO: 1094682 - RNA, 19 nt, Homo sapiens
gggaaauggucuggacuua

SEQ ID NO: 1094683 - RNA, 19 nt, Homo sapiens
gaaagcgggugagcgauga

SEQ ID NO: 1094684 - RNA, 19 nt, Homo sapiens
gagaagaugcuauacaaug

SEQ ID NO: 1094685 - RNA, 19 nt, Homo sapiens
ggcaagaacuuucccuuuc

SEQ ID NO: 1094686 - RNA, 19 nt, Homo sapiens
gaacuuucccuuucaacuu

SEQ ID NO: 1094687 - RNA, 19 nt, Homo sapiens
ugacagggcuuacccagau

SEQ ID NO: 1094688 - RNA, 19 nt, Homo sapiens
acucugagcccauuuguua

SEQ ID NO: 1094689 - RNA, 19 nt, Homo sapiens
gagaaagugucuuaugucu

SEQ ID NO: 1094690 - RNA, 19 nt, Homo sapiens
gaacucugcccuuaguaaa

SEQ ID NO: 1094691 - RNA, 19 nt, Homo sapiens
gugcucgggucauguauuu

SEQ ID NO: 1094692 - RNA, 19 nt, Homo sapiens
gagaggccauuaacugugu

SEQ ID NO: 1094693 - RNA, 19 nt, Homo sapiens
ggauggaccucaugaucga

SEQ ID NO: 1094694 - RNA, 19 nt, Homo sapiens
gagcccauuuguuaauaaa

SEQ ID NO: 1094695 - RNA, 19 nt, Homo sapiens
ggacuggacaugacuucua

SEQ ID NO: 1094696 - RNA, 19 nt, Homo sapiens
uaagguguaucuuccagaa

SEQ ID NO: 1094697 - RNA, 19 nt, Homo sapiens
uggagaagaugcuauacaa

SEQ ID NO: 1094698 - RNA, 19 nt, Homo sapiens
caugcaaugugcucaaauu

SEQ ID NO: 1094699 - RNA, 19 nt, Homo sapiens
ugacuucuacccucaauuu

SEQ ID NO: 1094700 - RNA, 19 nt, Homo sapiens
caagaacuuucccuuucaa

SEQ ID NO: 1094701 - RNA, 19 nt, Homo sapiens
agacggagcuaauagaucu

SEQ ID NO: 1094702 - RNA, 19 nt, Homo sapiens
gccauuaacugugucuuug

SEQ ID NO: 1094703 - RNA, 19 nt, Homo sapiens
ugccagagcucgcagauuc

SEQ ID NO: 1094704 - RNA, 19 nt, Homo sapiens
ggucauguauuuguggauu

SEQ ID NO: 1094705 - RNA, 19 nt, Homo sapiens
ggagugcucgggucaugua

SEQ ID NO: 1094706 - RNA, 19 nt, Homo sapiens
caaaucaaccaccauuaug

SEQ ID NO: 1094707 - RNA, 19 nt, Homo sapiens
ggugaacucugcccuuagu

SEQ ID NO: 1094708 - RNA, 19 nt, Homo sapiens
gaauggaggaaacguguug

SEQ ID NO: 1094709 - RNA, 19 nt, Homo sapiens
ucucaaggaugcaguggaa

SEQ ID NO: 1094710 - RNA, 19 nt, Homo sapiens
ucaaaucaaccaccauuau

SEQ ID NO: 1094711 - RNA, 19 nt, Homo sapiens
cauaucaucugcgacaaug

SEQ ID NO: 1094712 - RNA, 19 nt, Homo sapiens
uggagugccuauaucagua

SEQ ID NO: 1094713 - RNA, 19 nt, Homo sapiens
ggaaauggucuggacuuau

SEQ ID NO: 1094714 - RNA, 19 nt, Homo sapiens
ccaaagauaacaagcacuu

SEQ ID NO: 1094715 - RNA, 19 nt, Homo sapiens
caccaaaaguccauuauga

SEQ ID NO: 1094716 - RNA, 19 nt, Homo sapiens
gggaaaaucuagucucaau

SEQ ID NO: 1094717 - RNA, 19 nt, Homo sapiens
cuucuggagugaucuauga

SEQ ID NO: 1094718 - RNA, 19 nt, Homo sapiens
acgagaaagugucuuaugu

SEQ ID NO: 1094719 - RNA, 19 nt, Homo sapiens
gugcucaaauucaaaucaa

SEQ ID NO: 1094720 - RNA, 19 nt, Homo sapiens
ugacguaccagacugcaaa

SEQ ID NO: 1094721 - RNA, 19 nt, Homo sapiens
gagcucauucagaccaaua

SEQ ID NO: 1094722 - RNA, 19 nt, Homo sapiens
acaaacagaguaaggugua

SEQ ID NO: 1094723 - RNA, 19 nt, Homo sapiens
ugagcccauuuguuaauaa

SEQ ID NO: 1094724 - RNA, 19 nt, Homo sapiens
ggagccagccuuugguuuc

SEQ ID NO: 1094725 - RNA, 19 nt, Homo sapiens
ggugagcgaugacguacca

SEQ ID NO: 1094726 - RNA, 19 nt, Homo sapiens
ccucugagcucuggcuaug

SEQ ID NO: 1094727 - RNA, 19 nt, Homo sapiens
ucuggauccuccuugcuua

SEQ ID NO: 1094728 - RNA, 19 nt, Homo sapiens
ggacauucagaggcuguua

SEQ ID NO: 1094729 - RNA, 19 nt, Homo sapiens
auaagaugaugaucccaaa

SEQ ID NO: 1094730 - RNA, 19 nt, Homo sapiens
caugagaggccauuaacug

SEQ ID NO: 1094731 - RNA, 19 nt, Homo sapiens
guccucaaauucuuacaga

SEQ ID NO: 1094732 - RNA, 19 nt, Homo sapiens
caaacagaguaagguguau

SEQ ID NO: 1094733 - RNA, 19 nt, Homo sapiens
gcuguacgcaauaagauga

SEQ ID NO: 1094734 - RNA, 19 nt, Homo sapiens
gcuggagggugacagaagu

SEQ ID NO: 1094735 - RNA, 19 nt, Homo sapiens
gagacgcucauccagauug

SEQ ID NO: 1094736 - RNA, 19 nt, Homo sapiens
guaaagugaacccaucugu

SEQ ID NO: 1094737 - RNA, 19 nt, Homo sapiens
ucauccagauugaagaaga

SEQ ID NO: 1094738 - RNA, 19 nt, Homo sapiens
aaacgucgguacgagaaga

SEQ ID NO: 1094739 - RNA, 19 nt, Homo sapiens
ugaacucugcccuuaguaa

SEQ ID NO: 1094740 - RNA, 19 nt, Homo sapiens
agaagaugcuauacaaugc

SEQ ID NO: 1094741 - RNA, 19 nt, Homo sapiens
ggagaagaugcuauacaau

SEQ ID NO: 1094742 - RNA, 19 nt, Homo sapiens
aaagugaacccaucugucu

SEQ ID NO: 1094743 - RNA, 19 nt, Homo sapiens
ggccauuaacugugucuuu

SEQ ID NO: 1094744 - RNA, 19 nt, Homo sapiens
gaacuucauccagguguca

SEQ ID NO: 1094745 - RNA, 19 nt, Homo sapiens
agacuucuccuaccuggaa

SEQ ID NO: 1094746 - RNA, 19 nt, Homo sapiens
cauuaacugugucuuugug

SEQ ID NO: 1094747 - RNA, 19 nt, Homo sapiens
gaaaaucuagucucaauac

SEQ ID NO: 1094748 - RNA, 19 nt, Homo sapiens
ugaaggauggaaaugcuuu

SEQ ID NO: 1094749 - RNA, 19 nt, Homo sapiens
gaagacucgacccauauca

SEQ ID NO: 1094750 - RNA, 19 nt, Homo sapiens
gcucauccagauugaagaa

SEQ ID NO: 1094751 - RNA, 19 nt, Homo sapiens
gcacaccaaagauaacaag

SEQ ID NO: 1094752 - RNA, 19 nt, Homo sapiens
gaucauccagucucauuac

SEQ ID NO: 1094753 - RNA, 19 nt, Homo sapiens
gguuugaggaguucaguga

SEQ ID NO: 1094754 - RNA, 19 nt, Homo sapiens
gacuggacaugacuucuac

SEQ ID NO: 1094755 - RNA, 19 nt, Homo sapiens
ccugaggaguggcaugaga

SEQ ID NO: 1094756 - RNA, 19 nt, Homo sapiens
gaccuuguccucaaauucu

SEQ ID NO: 1094757 - RNA, 19 nt, Homo sapiens
gaagaugcuauacaaugca

SEQ ID NO: 1094758 - RNA, 19 nt, Homo sapiens
cugagcccauuuguuaaua

SEQ ID NO: 1094759 - RNA, 19 nt, Homo sapiens
gugacuggcuggcugucuu

SEQ ID NO: 1094760 - RNA, 19 nt, Homo sapiens
gagcuacuucccugaaauc

SEQ ID NO: 1094761 - RNA, 19 nt, Homo sapiens
ucaaacgucgguacgagaa

SEQ ID NO: 1094762 - RNA, 19 nt, Homo sapiens
ccaaaaguccauuaugaaa

SEQ ID NO: 1094763 - RNA, 19 nt, Homo sapiens
cagaguaagguguaucuuc

SEQ ID NO: 1094764 - RNA, 19 nt, Homo sapiens
cggcaggcuucucauggaa

SEQ ID NO: 1094765 - RNA, 19 nt, Homo sapiens
gcucgggucauguauuugu

SEQ ID NO: 1094766 - RNA, 19 nt, Homo sapiens
ugagcuacuucccugaaau

SEQ ID NO: 1094767 - RNA, 19 nt, Homo sapiens
gaugcuauacaaugcaaga

SEQ ID NO: 1094768 - RNA, 19 nt, Homo sapiens
aaucaaccaccauuauguu

SEQ ID NO: 1094769 - RNA, 19 nt, Homo sapiens
caggagaaguuuuccaaga

SEQ ID NO: 1094770 - RNA, 19 nt, Homo sapiens
gguguccucuggcuuaagg

SEQ ID NO: 1094771 - RNA, 19 nt, Homo sapiens
gaagaaagcuggacaguuu

SEQ ID NO: 1094772 - RNA, 19 nt, Homo sapiens
gaacacagcuauuucuaga

SEQ ID NO: 1094773 - RNA, 19 nt, Homo sapiens
ggaugcaucuguauauuua

SEQ ID NO: 1094774 - RNA, 19 nt, Homo sapiens
gaaggacaaugcuuugaua

SEQ ID NO: 1094775 - RNA, 19 nt, Homo sapiens
gaagagaacacagcuauuu

SEQ ID NO: 1094776 - RNA, 19 nt, Homo sapiens
ggaguaugaugcugagaua

SEQ ID NO: 1094777 - RNA, 19 nt, Homo sapiens
gaaagacagaggauuauuu

SEQ ID NO: 1094778 - RNA, 19 nt, Homo sapiens
gaaaguugaugcccuuaug

SEQ ID NO: 1094779 - RNA, 19 nt, Homo sapiens
gaucacaaauuuccuacaa

SEQ ID NO: 1094780 - RNA, 19 nt, Homo sapiens
cagaauggguggaguauga

SEQ ID NO: 1094781 - RNA, 19 nt, Homo sapiens
gaugaugaauccaaacaaa

SEQ ID NO: 1094782 - RNA, 19 nt, Homo sapiens
ucacauggcuaaagaguau

SEQ ID NO: 1094783 - RNA, 19 nt, Homo sapiens
gggaagauaugagcaaauu

SEQ ID NO: 1094784 - RNA, 19 nt, Homo sapiens
uaaauuacguccuggagaa

SEQ ID NO: 1094785 - RNA, 19 nt, Homo sapiens
gaagauuucucuacuuucu

SEQ ID NO: 1094786 - RNA, 19 nt, Homo sapiens
uaagaucagugacauauuc

SEQ ID NO: 1094787 - RNA, 19 nt, Homo sapiens
gaagaaauugcuacaacua

SEQ ID NO: 1094788 - RNA, 19 nt, Homo sapiens
gcacgaaugcaauugauuu

SEQ ID NO: 1094789 - RNA, 19 nt, Homo sapiens
ggauaggaauaauguugua

SEQ ID NO: 1094790 - RNA, 19 nt, Homo sapiens
gaacuagaauacuuacuac

SEQ ID NO: 1094791 - RNA, 19 nt, Homo sapiens
gauauguucuucaauguca

SEQ ID NO: 1094792 - RNA, 19 nt, Homo sapiens
gacaguuucuagacaauuu

SEQ ID NO: 1094793 - RNA, 19 nt, Homo sapiens
acaguaagcuugcauaaag

SEQ ID NO: 1094794 - RNA, 19 nt, Homo sapiens
gagaaucacaguguuauaa

SEQ ID NO: 1094795 - RNA, 19 nt, Homo sapiens
ggugaacccuuuaaacaug

SEQ ID NO: 1094796 - RNA, 19 nt, Homo sapiens
cgaaguuccucuuagaauu

SEQ ID NO: 1094797 - RNA, 19 nt, Homo sapiens
acaaacaaaugaugccuuu

SEQ ID NO: 1094798 - RNA, 19 nt, Homo sapiens
gagaguaacaaacaaauga

SEQ ID NO: 1094799 - RNA, 19 nt, Homo sapiens
ggagcaagcuuuuauaaga

SEQ ID NO: 1094800 - RNA, 19 nt, Homo sapiens
ggaugagacugaaacaaau

SEQ ID NO: 1094801 - RNA, 19 nt, Homo sapiens
ggaaacugugcaagaauua

SEQ ID NO: 1094802 - RNA, 19 nt, Homo sapiens
gcacugguguauaugagaa

SEQ ID NO: 1094803 - RNA, 19 nt, Homo sapiens
ggaggcaagugaauuuaug

SEQ ID NO: 1094804 - RNA, 19 nt, Homo sapiens
ucacagaacuuccccauaa

SEQ ID NO: 1094805 - RNA, 19 nt, Homo sapiens
guucaaggauuucucuuug

SEQ ID NO: 1094806 - RNA, 19 nt, Homo sapiens
gaauuaugaugcuuucugu

SEQ ID NO: 1094807 - RNA, 19 nt, Homo sapiens
ccaagacgaugagaguaua

SEQ ID NO: 1094808 - RNA, 19 nt, Homo sapiens
cagaauugcuguaaaucaa

SEQ ID NO: 1094809 - RNA, 19 nt, Homo sapiens
gaaauucuguauguucuuc

SEQ ID NO: 1094810 - RNA, 19 nt, Homo sapiens
gugaaauucugguugcuaa

SEQ ID NO: 1094811 - RNA, 19 nt, Homo sapiens
gcgaaagcaugacaggaaa

SEQ ID NO: 1094812 - RNA, 19 nt, Homo sapiens
gaguauggauuccgauaug

SEQ ID NO: 1094813 - RNA, 19 nt, Homo sapiens
caaauaacaugagugacuu

SEQ ID NO: 1094814 - RNA, 19 nt, Homo sapiens
gaaguuccucuuagaauug

SEQ ID NO: 1094815 - RNA, 19 nt, Homo sapiens
ucacgaaguuccucuuaga

SEQ ID NO: 1094816 - RNA, 19 nt, Homo sapiens
aagcagaccuagaagauau

SEQ ID NO: 1094817 - RNA, 19 nt, Homo sapiens
aaacccaggugcuuggaua

SEQ ID NO: 1094818 - RNA, 19 nt, Homo sapiens
aagcacaccuguaaaauua

SEQ ID NO: 1094819 - RNA, 19 nt, Homo sapiens
ugaaggaacugacucucaa

SEQ ID NO: 1094820 - RNA, 19 nt, Homo sapiens
caacaugauuacuccagaa

SEQ ID NO: 1094821 - RNA, 19 nt, Homo sapiens
guguugauauggauguuua

SEQ ID NO: 1094822 - RNA, 19 nt, Homo sapiens
guguggagcuagcaauuaa

SEQ ID NO: 1094823 - RNA, 19 nt, Homo sapiens
gaucagugacauauucuuu

SEQ ID NO: 1094824 - RNA, 19 nt, Homo sapiens
gcaauaaucccaaaacaaa

SEQ ID NO: 1094825 - RNA, 19 nt, Homo sapiens
gcagaagaaaguaaugaaa

SEQ ID NO: 1094826 - RNA, 19 nt, Homo sapiens
ucaaauaguugggcaugaa

SEQ ID NO: 1094827 - RNA, 19 nt, Homo sapiens
gcaagauuaucaaccugaa

SEQ ID NO: 1094828 - RNA, 19 nt, Homo sapiens
gcaaauaacaugagugacu

SEQ ID NO: 1094829 - RNA, 19 nt, Homo sapiens
ggaaucaacgcaaauaaca

SEQ ID NO: 1094830 - RNA, 19 nt, Homo sapiens
ggaagaaauugcuacaacu

SEQ ID NO: 1094831 - RNA, 19 nt, Homo sapiens
gcagucacucucuggauua

SEQ ID NO: 1094832 - RNA, 19 nt, Homo sapiens
caacuauauugcagaagaa

SEQ ID NO: 1094833 - RNA, 19 nt, Homo sapiens
ucaacuauauugcagaaga

SEQ ID NO: 1094834 - RNA, 19 nt, Homo sapiens
ucacacauuugggaauaua

SEQ ID NO: 1094835 - RNA, 19 nt, Homo sapiens
ucaagagaaugauauguuc

SEQ ID NO: 1094836 - RNA, 19 nt, Homo sapiens
uauauuacauggccuacaa

SEQ ID NO: 1094837 - RNA, 19 nt, Homo sapiens
uaaauggccuucguguuga

SEQ ID NO: 1094838 - RNA, 19 nt, Homo sapiens
gcaauuaagaguacagaau

SEQ ID NO: 1094839 - RNA, 19 nt, Homo sapiens
cgaaauggguacuagaaca

SEQ ID NO: 1094840 - RNA, 19 nt, Homo sapiens
ggaagucucguuaagauca

SEQ ID NO: 1094841 - RNA, 19 nt, Homo sapiens
gaagauaaaguuguucaug

SEQ ID NO: 1094842 - RNA, 19 nt, Homo sapiens
gauaagagugcuguaauug

SEQ ID NO: 1094843 - RNA, 19 nt, Homo sapiens
gcaguaccucaauuuaaua

SEQ ID NO: 1094844 - RNA, 19 nt, Homo sapiens
uuacauggccuacaaguug

SEQ ID NO: 1094845 - RNA, 19 nt, Homo sapiens
gagauaagacaacuauuag

SEQ ID NO: 1094846 - RNA, 19 nt, Homo sapiens
acugugaccuugauaauau

SEQ ID NO: 1094847 - RNA, 19 nt, Homo sapiens
gaaucacaguguuauaaag

SEQ ID NO: 1094848 - RNA, 19 nt, Homo sapiens
ggagaaauggguauuguca

SEQ ID NO: 1094849 - RNA, 19 nt, Homo sapiens
uaagagugcuguaauugca

SEQ ID NO: 1094850 - RNA, 19 nt, Homo sapiens
cugcugauguugaagauuu

SEQ ID NO: 1094851 - RNA, 19 nt, Homo sapiens
caacauaugagagaagaaa

SEQ ID NO: 1094852 - RNA, 19 nt, Homo sapiens
uaaccagaauugcuguaaa

SEQ ID NO: 1094853 - RNA, 19 nt, Homo sapiens
ccagaucucuaaccagaau

SEQ ID NO: 1094854 - RNA, 19 nt, Homo sapiens
guaaugcauuugugguuau

SEQ ID NO: 1094855 - RNA, 19 nt, Homo sapiens
gaagcaagauacaauuuug

SEQ ID NO: 1094856 - RNA, 19 nt, Homo sapiens
ggacugugggauuccauua

SEQ ID NO: 1094857 - RNA, 19 nt, Homo sapiens
ccuagaagauaucauuguu

SEQ ID NO: 1094858 - RNA, 19 nt, Homo sapiens
gaaagucugggaacuacaa

SEQ ID NO: 1094859 - RNA, 19 nt, Homo sapiens
acaaagcacuggaugauac

SEQ ID NO: 1094860 - RNA, 19 nt, Homo sapiens
gaacauuuagugcauuuca

SEQ ID NO: 1094861 - RNA, 19 nt, Homo sapiens
uaguggaucucaagaaguu

SEQ ID NO: 1094862 - RNA, 19 nt, Homo sapiens
agacggaaauaccauauca

SEQ ID NO: 1094863 - RNA, 19 nt, Homo sapiens
cuuaggaccuuuagaugaa

SEQ ID NO: 1094864 - RNA, 19 nt, Homo sapiens
agauaagagugcuguaauu

SEQ ID NO: 1094865 - RNA, 19 nt, Homo sapiens
ggagaucacaaauuuccua

SEQ ID NO: 1094866 - RNA, 19 nt, Homo sapiens
auaagaagcacaccuguaa

SEQ ID NO: 1094867 - RNA, 19 nt, Homo sapiens
cagcaguaccucaauuuaa

SEQ ID NO: 1094868 - RNA, 19 nt, Homo sapiens
gauauucgacauucuucua

SEQ ID NO: 1094869 - RNA, 19 nt, Homo sapiens
gaugcucgucuauuuauaa

SEQ ID NO: 1094870 - RNA, 19 nt, Homo sapiens
guacuuaucuggguauggu

SEQ ID NO: 1094871 - RNA, 19 nt, Homo sapiens
gaagagcacugaugaagaa

SEQ ID NO: 1094872 - RNA, 19 nt, Homo sapiens
guacaggaauauugacuua

SEQ ID NO: 1094873 - RNA, 19 nt, Homo sapiens
gcauaucccuucuuucaaa

SEQ ID NO: 1094874 - RNA, 19 nt, Homo sapiens
ggacacagcugcaguaacu

SEQ ID NO: 1094875 - RNA, 19 nt, Homo sapiens
gaagagaguaucagaguuu

SEQ ID NO: 1094876 - RNA, 19 nt, Homo sapiens
gcauacaaaugaggacuua

SEQ ID NO: 1094877 - RNA, 19 nt, Homo sapiens
caacagccaccaucacuua

SEQ ID NO: 1094878 - RNA, 19 nt, Homo sapiens
ggaaugauagugauuauga

SEQ ID NO: 1094879 - RNA, 19 nt, Homo sapiens
gaagauaaaguccuauuug

SEQ ID NO: 1094880 - RNA, 19 nt, Homo sapiens
cuacuaacccuuuaacaua

SEQ ID NO: 1094881 - RNA, 19 nt, Homo sapiens
gaacaagccuuuaguuuuc

SEQ ID NO: 1094882 - RNA, 19 nt, Homo sapiens
guacacagauaaagacaau

SEQ ID NO: 1094883 - RNA, 19 nt, Homo sapiens
gcaagaauagccagcauuu

SEQ ID NO: 1094884 - RNA, 19 nt, Homo sapiens
ugacagugaugaugaugua

SEQ ID NO: 1094885 - RNA, 19 nt, Homo sapiens
gcagaguccuuguuuaaag

SEQ ID NO: 1094886 - RNA, 19 nt, Homo sapiens
gaacuucuuuguaaacuac

SEQ ID NO: 1094887 - RNA, 19 nt, Homo sapiens
gaguauauguucagcaaug

SEQ ID NO: 1094888 - RNA, 19 nt, Homo sapiens
gaaccagccuccaccacuu

SEQ ID NO: 1094889 - RNA, 19 nt, Homo sapiens
uugcugaucucccuaauuu

SEQ ID NO: 1094890 - RNA, 19 nt, Homo sapiens
gcuacaaaguacacagaua

SEQ ID NO: 1094891 - RNA, 19 nt, Homo sapiens
gcgcagaguccuuguuuaa

SEQ ID NO: 1094892 - RNA, 19 nt, Homo sapiens
gaacaaccuguccaaacua

SEQ ID NO: 1094893 - RNA, 19 nt, Homo sapiens
ugagaggauuggaagaaua

SEQ ID NO: 1094894 - RNA, 19 nt, Homo sapiens
ccaguuagccuccuuucua

SEQ ID NO: 1094895 - RNA, 19 nt, Homo sapiens
gcaaaugcuuccagauaag

SEQ ID NO: 1094896 - RNA, 19 nt, Homo sapiens
gagaggauuggaagaauaa

SEQ ID NO: 1094897 - RNA, 19 nt, Homo sapiens
caaaguacacagauaaaga

SEQ ID NO: 1094898 - RNA, 19 nt, Homo sapiens
uagcauaaguggaugucua

SEQ ID NO: 1094899 - RNA, 19 nt, Homo sapiens
gcaguggacuagcauaagu

SEQ ID NO: 1094900 - RNA, 19 nt, Homo sapiens
gaagaaacacauccaaugg

SEQ ID NO: 1094901 - RNA, 19 nt, Homo sapiens
uaucagaguuuacaacauc

SEQ ID NO: 1094902 - RNA, 19 nt, Homo sapiens
gcucguaaacuagcuaaua

SEQ ID NO: 1094903 - RNA, 19 nt, Homo sapiens
ggaagauaaaguccuauuu

SEQ ID NO: 1094904 - RNA, 19 nt, Homo sapiens
ccgcaaauaugguaaagau

SEQ ID NO: 1094905 - RNA, 19 nt, Homo sapiens
cuacaaaguacacagauaa

SEQ ID NO: 1094906 - RNA, 19 nt, Homo sapiens
guggaugucuaagaaauuu

SEQ ID NO: 1094907 - RNA, 19 nt, Homo sapiens
auaaguggaugucuaagaa

SEQ ID NO: 1094908 - RNA, 19 nt, Homo sapiens
ccuaagggcauguauuuaa

SEQ ID NO: 1094909 - RNA, 19 nt, Homo sapiens
ggaagaagagaguaucaga

SEQ ID NO: 1094910 - RNA, 19 nt, Homo sapiens
ccacaaagaauguacugaa

SEQ ID NO: 1094911 - RNA, 19 nt, Homo sapiens
uaacuuagaggagguauug

SEQ ID NO: 1094912 - RNA, 19 nt, Homo sapiens
gaagaugugguagcaguuu

SEQ ID NO: 1094913 - RNA, 19 nt, Homo sapiens
uaucccagaugccaaauug

SEQ ID NO: 1094914 - RNA, 19 nt, Homo sapiens
ggaagagcacugaugaaga

SEQ ID NO: 1094915 - RNA, 19 nt, Homo sapiens
gaacccaggcuucuaaugg

SEQ ID NO: 1094916 - RNA, 19 nt, Homo sapiens
acagugcacuuaaacagaa

SEQ ID NO: 1094917 - RNA, 19 nt, Homo sapiens
gauaaaguccuauuugaac

SEQ ID NO: 1094918 - RNA, 19 nt, Homo sapiens
gcauaaacauaacauugag

SEQ ID NO: 1094919 - RNA, 19 nt, Homo sapiens
uagaguauauguucagcaa

SEQ ID NO: 1094920 - RNA, 19 nt, Homo sapiens
ggcauaaacauaacauuga

SEQ ID NO: 1094921 - RNA, 19 nt, Homo sapiens
gaaccuacuaacccuuuaa

SEQ ID NO: 1094922 - RNA, 19 nt, Homo sapiens
caccaucacuuauuggaau

SEQ ID NO: 1094923 - RNA, 19 nt, Homo sapiens
aauggaagguggaauugaa

SEQ ID NO: 1094924 - RNA, 19 nt, Homo sapiens
gaaaauggaagguggaauu

SEQ ID NO: 1094925 - RNA, 19 nt, Homo sapiens
caccuaagggcauguauuu

SEQ ID NO: 1094926 - RNA, 19 nt, Homo sapiens
ugaacaaccuguccaaacu

SEQ ID NO: 1094927 - RNA, 19 nt, Homo sapiens
gaaauuauagcugcauauc

SEQ ID NO: 1094928 - RNA, 19 nt, Homo sapiens
cagccaccaucacuuauug

SEQ ID NO: 1094929 - RNA, 19 nt, Homo sapiens
gcaagguguccgcaaauau

SEQ ID NO: 1094930 - RNA, 19 nt, Homo sapiens
ucaaaccuccugagucaaa

SEQ ID NO: 1094931 - RNA, 19 nt, Homo sapiens
ggaugaauacauugcaauu

SEQ ID NO: 1094932 - RNA, 19 nt, Homo sapiens
aguaaacagugcacuuaaa

SEQ ID NO: 1094933 - RNA, 19 nt, Homo sapiens
gauuggacuuggaagaaga

SEQ ID NO: 1094934 - RNA, 19 nt, Homo sapiens
ucgccaggcucguaaacua

SEQ ID NO: 1094935 - RNA, 19 nt, Homo sapiens
gaacaggcacuuggcaugu

SEQ ID NO: 1094936 - RNA, 19 nt, Homo sapiens
ggaaaagcauggcuacaau

SEQ ID NO: 1094937 - RNA, 19 nt, Homo sapiens
caagguguccgcaaauaug

SEQ ID NO: 1094938 - RNA, 19 nt, Homo sapiens
gcauugcuuugcagauguu

SEQ ID NO: 1094939 - RNA, 19 nt, Homo sapiens
ugacuuaggaauugugaaa

SEQ ID NO: 1094940 - RNA, 19 nt, Homo sapiens
gagcacugaugaagaagag

SEQ ID NO: 1094941 - RNA, 19 nt, Homo sapiens
gcugaucucccuaauuuca

SEQ ID NO: 1094942 - RNA, 19 nt, Homo sapiens
uagccagcauuuccgauuu

SEQ ID NO: 1094943 - RNA, 19 nt, Homo sapiens
auucaaaccuccugaguca

SEQ ID NO: 1094944 - RNA, 19 nt, Homo sapiens
aagagaguaucagaguuua

SEQ ID NO: 1094945 - RNA, 19 nt, Homo sapiens
gcucggaucccugaauuug

SEQ ID NO: 1094946 - RNA, 19 nt, Homo sapiens
caaagaauguacugaaccu

SEQ ID NO: 1094947 - RNA, 19 nt, Homo sapiens
uguuaggagugcaagaaua

SEQ ID NO: 1094948 - RNA, 19 nt, Homo sapiens
guugauaucuucccaucca

SEQ ID NO: 1094949 - RNA, 19 nt, Homo sapiens
uggugaugcuucuacuuua

SEQ ID NO: 1094950 - RNA, 19 nt, Homo sapiens
uguccaaacuagcaagauu

SEQ ID NO: 1094951 - RNA, 19 nt, Homo sapiens
ugaugaugauguagaagaa

SEQ ID NO: 1094952 - RNA, 19 nt, Homo sapiens
gcauguuguucuggcauaa

SEQ ID NO: 1094953 - RNA, 19 nt, Homo sapiens
gcacuuggcauguuguucu

SEQ ID NO: 1094954 - RNA, 19 nt, Homo sapiens
gcagcaggcucgguucauc

SEQ ID NO: 1094955 - RNA, 19 nt, Homo sapiens
ggugaugcuucuacuuuag

SEQ ID NO: 1094956 - RNA, 19 nt, Homo sapiens
ugaggcaacuggacaugga

SEQ ID NO: 1094957 - RNA, 19 nt, Homo sapiens
ucacaggauucagcaaaug

SEQ ID NO: 1094958 - RNA, 19 nt, Homo sapiens
auacugaggcugcgaacua

SEQ ID NO: 1094959 - RNA, 19 nt, Homo sapiens
ccaggaagaugugguagca

SEQ ID NO: 1094960 - RNA, 19 nt, Homo sapiens
caacaucgccaucauucuc

SEQ ID NO: 1094961 - RNA, 19 nt, Homo sapiens
ggacuuggaagaagagagu

SEQ ID NO: 1094962 - RNA, 19 nt, Homo sapiens
agaagaaacacauccaaug

SEQ ID NO: 1094963 - RNA, 19 nt, Homo sapiens
agaagucccuugcugaucu

SEQ ID NO: 1094964 - RNA, 19 nt, Homo sapiens
ggcauguuguucuggcaua

SEQ ID NO: 1094965 - RNA, 19 nt, Homo sapiens
gaggauuggaagaauaauu

SEQ ID NO: 1094966 - RNA, 19 nt, Homo sapiens
ugaaccuacuaacccuuua

SEQ ID NO: 1094967 - RNA, 19 nt, Homo sapiens
gaauguacugaaccuacua

SEQ ID NO: 1094968 - RNA, 19 nt, Homo sapiens
agucaaggcucuuaguaca

SEQ ID NO: 1094969 - RNA, 19 nt, Homo sapiens
ggagugggaagcagaacaa

SEQ ID NO: 1094970 - RNA, 19 nt, Homo sapiens
gaugaauacauugcaauug

SEQ ID NO: 1094971 - RNA, 19 nt, Homo sapiens
gaaggaaagucaauaauga

SEQ ID NO: 1094972 - RNA, 19 nt, Homo sapiens
gcaugaaagugaacaauaa

SEQ ID NO: 1094973 - RNA, 19 nt, Homo sapiens
gaauggaucuugacugguu

SEQ ID NO: 1094974 - RNA, 19 nt, Homo sapiens
gaacaucucaucagaagaa

SEQ ID NO: 1094975 - RNA, 19 nt, Homo sapiens
gaaagaaacagaagacaga

SEQ ID NO: 1094976 - RNA, 19 nt, Homo sapiens
guagagaaccaugaaauua

SEQ ID NO: 1094977 - RNA, 19 nt, Homo sapiens
caagaaauaugccguagau

SEQ ID NO: 1094978 - RNA, 19 nt, Homo sapiens
cauaacagcuaacguauca

SEQ ID NO: 1094979 - RNA, 19 nt, Homo sapiens
gggauaagaugcuaaagau

SEQ ID NO: 1094980 - RNA, 19 nt, Homo sapiens
ggaucagacuauucucuua

SEQ ID NO: 1094981 - RNA, 19 nt, Homo sapiens
gaucuugacugguucuuau

SEQ ID NO: 1094982 - RNA, 19 nt, Homo sapiens
ggaguuugauuuccuuauu

SEQ ID NO: 1094983 - RNA, 19 nt, Homo sapiens
gacaggaaauaaaguguuu

SEQ ID NO: 1094984 - RNA, 19 nt, Homo sapiens
gaaauugccgaccuuagua

SEQ ID NO: 1094985 - RNA, 19 nt, Homo sapiens
gcagaggaauggaucuuga

SEQ ID NO: 1094986 - RNA, 19 nt, Homo sapiens
agaagaaguuguggaaaua

SEQ ID NO: 1094987 - RNA, 19 nt, Homo sapiens
guaaggcuccucucuauga

SEQ ID NO: 1094988 - RNA, 19 nt, Homo sapiens
ggaaggaaagucaauaaug

SEQ ID NO: 1094989 - RNA, 19 nt, Homo sapiens
cagaagaaguuguggaaau

SEQ ID NO: 1094990 - RNA, 19 nt, Homo sapiens
ggaguggaauguagagaga

SEQ ID NO: 1094991 - RNA, 19 nt, Homo sapiens
gaaauaugccguagaugau

SEQ ID NO: 1094992 - RNA, 19 nt, Homo sapiens
gauaagacuucucggaucu

SEQ ID NO: 1094993 - RNA, 19 nt, Homo sapiens
cuaaagaucuggucuacag

SEQ ID NO: 1094994 - RNA, 19 nt, Homo sapiens
uagaauacguggagaagug

SEQ ID NO: 1094995 - RNA, 19 nt, Homo sapiens
gaauguagagagaaacaaa

SEQ ID NO: 1094996 - RNA, 19 nt, Homo sapiens
gauagguuguguuuaugaa

SEQ ID NO: 1094997 - RNA, 19 nt, Homo sapiens
ccacaaaucgaccaagaaa

SEQ ID NO: 1094998 - RNA, 19 nt, Homo sapiens
guugauggcucaggaacua

SEQ ID NO: 1094999 - RNA, 19 nt, Homo sapiens
agacaaaguucugagugua

SEQ ID NO: 1095000 - RNA, 19 nt, Homo sapiens
gauauucaccuaccacuuc

SEQ ID NO: 1095001 - RNA, 19 nt, Homo sapiens
agaaauaugccguagauga

SEQ ID NO: 1095002 - RNA, 19 nt, Homo sapiens
guagagagaaacaaaguga

SEQ ID NO: 1095003 - RNA, 19 nt, Homo sapiens
acaaaucgaccaagaaaga

SEQ ID NO: 1095004 - RNA, 19 nt, Homo sapiens
gguagagaaccaugaaauu

SEQ ID NO: 1095005 - RNA, 19 nt, Homo sapiens
uaguuuguccugcuuauua

SEQ ID NO: 1095006 - RNA, 19 nt, Homo sapiens
uggcauacauucucuauac

SEQ ID NO: 1095007 - RNA, 19 nt, Homo sapiens
gaggagcagacaauaaauu

SEQ ID NO: 1095008 - RNA, 19 nt, Homo sapiens
gaacaguugggacuaacaa

SEQ ID NO: 1095009 - RNA, 19 nt, Homo sapiens
ggucuacagucccuacaga

SEQ ID NO: 1095010 - RNA, 19 nt, Homo sapiens
gauaguuuguccugcuuau

SEQ ID NO: 1095011 - RNA, 19 nt, Homo sapiens
aaacacgcuucuacacuga

SEQ ID NO: 1095012 - RNA, 19 nt, Homo sapiens
ggcaugaaagugaacaaua

SEQ ID NO: 1095013 - RNA, 19 nt, Homo sapiens
gacugcaguuccucgcuua

SEQ ID NO: 1095014 - RNA, 19 nt, Homo sapiens
caacuuugacaggaaauaa

SEQ ID NO: 1095015 - RNA, 19 nt, Homo sapiens
uaacaaggacucccauagu

SEQ ID NO: 1095016 - RNA, 19 nt, Homo sapiens
gcuuaccugugcagucuaa

SEQ ID NO: 1095017 - RNA, 19 nt, Homo sapiens
gaucagacuauucucuuau

SEQ ID NO: 1095018 - RNA, 19 nt, Homo sapiens
acagaacaguugggacuaa

SEQ ID NO: 1095019 - RNA, 19 nt, Homo sapiens
ugcaguggcuccugggaua

SEQ ID NO: 1095020 - RNA, 19 nt, Homo sapiens
ggacaaacacauggaagug

SEQ ID NO: 1095021 - RNA, 19 nt, Homo sapiens
cuacacugauaacaagaaa

SEQ ID NO: 1095022 - RNA, 19 nt, Homo sapiens
cuucauaacagcuaacgua

SEQ ID NO: 1095023 - RNA, 19 nt, Homo sapiens
ggaagcacagauaggcaua

SEQ ID NO: 1095024 - RNA, 19 nt, Homo sapiens
gcaguuuccucaguucugu

SEQ ID NO: 1095025 - RNA, 19 nt, Homo sapiens
gauguucccuucucaaucc

SEQ ID NO: 1095026 - RNA, 19 nt, Homo sapiens
gaccauacaauuagagugu

SEQ ID NO: 1095027 - RNA, 19 nt, Homo sapiens
agagaaccaugaaauuaca

SEQ ID NO: 1095028 - RNA, 19 nt, Homo sapiens
gacccucucuggccacaug

SEQ ID NO: 1095029 - RNA, 19 nt, Homo sapiens
ggcaggagcuucguguugu

SEQ ID NO: 1095030 - RNA, 19 nt, Homo sapiens
gcgaaugcccuuggacaaa

SEQ ID NO: 1095031 - RNA, 19 nt, Homo sapiens
gcauacauucucuauacaa

SEQ ID NO: 1095032 - RNA, 19 nt, Homo sapiens
aaauacaaacuguggcaua

SEQ ID NO: 1095033 - RNA, 19 nt, Homo sapiens
uggaggagcagacaauaaa

SEQ ID NO: 1095034 - RNA, 19 nt, Homo sapiens
aacaaggacucccauagug

SEQ ID NO: 1095035 - RNA, 19 nt, Homo sapiens
cuggaucaguucaauuaaa

SEQ ID NO: 1095036 - RNA, 19 nt, Homo sapiens
acacgcuucuacacugaua

SEQ ID NO: 1095037 - RNA, 19 nt, Homo sapiens
ugaucuggcugcucaugaa

SEQ ID NO: 1095038 - RNA, 19 nt, Homo sapiens
guccacaaaucgaccaaga

SEQ ID NO: 1095039 - RNA, 19 nt, Homo sapiens
cuacagucccuacagauga

SEQ ID NO: 1095040 - RNA, 19 nt, Homo sapiens
gcaggagcuucguguugug

SEQ ID NO: 1095041 - RNA, 19 nt, Homo sapiens
caucucaucagaagaaguu

SEQ ID NO: 1095042 - RNA, 19 nt, Homo sapiens
ccuauucuccacuuuguaa

SEQ ID NO: 1095043 - RNA, 19 nt, Homo sapiens
agagagaaacaaagugaaa

SEQ ID NO: 1095044 - RNA, 19 nt, Homo sapiens
gaaugcccuuggacaaaca

SEQ ID NO: 1095045 - RNA, 19 nt, Homo sapiens
guuaagcugugggauacaa

SEQ ID NO: 1095046 - RNA, 19 nt, Homo sapiens
cuacagaugaagaagauga

SEQ ID NO: 1095047 - RNA, 19 nt, Homo sapiens
gaaguuguggaaauagaau

SEQ ID NO: 1095048 - RNA, 19 nt, Homo sapiens
acagcuaacguaucacuuu

SEQ ID NO: 1095049 - RNA, 19 nt, Homo sapiens
ccaugaaauuacauagaug

SEQ ID NO: 1095050 - RNA, 19 nt, Homo sapiens
gaccaagaaagaaacagaa

SEQ ID NO: 1095051 - RNA, 19 nt, Homo sapiens
aagaaguuguggaaauaga

SEQ ID NO: 1095052 - RNA, 19 nt, Homo sapiens
gaagaaguuguggaaauag

SEQ ID NO: 1095053 - RNA, 19 nt, Homo sapiens
aaaaugaguuccacaaaca

SEQ ID NO: 1095054 - RNA, 19 nt, Homo sapiens
ugaaauugccgaccuuagu

SEQ ID NO: 1095055 - RNA, 19 nt, Homo sapiens
gacacagggcuacuucuga

SEQ ID NO: 1095056 - RNA, 19 nt, Homo sapiens
acaaaguucugaguguaga

SEQ ID NO: 1095057 - RNA, 19 nt, Homo sapiens
aagacaaaguucugagugu

SEQ ID NO: 1095058 - RNA, 19 nt, Homo sapiens
uuguaaggcuccucucuau

SEQ ID NO: 1095059 - RNA, 19 nt, Homo sapiens
acagaagacagaacaguug

SEQ ID NO: 1095060 - RNA, 19 nt, Homo sapiens
uugacugguucuuaugaua

SEQ ID NO: 1095061 - RNA, 19 nt, Homo sapiens
uggaucaguucaauuaaag

SEQ ID NO: 1095062 - RNA, 19 nt, Homo sapiens
cugccucuuuguagucuua

SEQ ID NO: 1095063 - RNA, 19 nt, Homo sapiens
ccaagaaagaaacagaaga

SEQ ID NO: 1095064 - RNA, 19 nt, Homo sapiens
caaaucgaccaagaaagaa

SEQ ID NO: 1095065 - RNA, 19 nt, Homo sapiens
gaaccaugaaauuacauag

SEQ ID NO: 1095066 - RNA, 19 nt, Homo sapiens
gcugugggauacaagaagu

SEQ ID NO: 1095067 - RNA, 19 nt, Homo sapiens
caagaaagaaacagaagac

SEQ ID NO: 1095068 - RNA, 19 nt, Homo sapiens
uaccugugcagucuaauuu

SEQ ID NO: 1095069 - RNA, 19 nt, Homo sapiens
ggaucuugacugguucuua

SEQ ID NO: 1095070 - RNA, 19 nt, Homo sapiens
cuucuacacugauaacaag

SEQ ID NO: 1095071 - RNA, 19 nt, Homo sapiens
gaacugaagcucauaauua

SEQ ID NO: 1095072 - RNA, 19 nt, Homo sapiens
gcugaacucuuagaaauua

SEQ ID NO: 1095073 - RNA, 19 nt, Homo sapiens
gaaaugauguccaauccuu

SEQ ID NO: 1095074 - RNA, 19 nt, Homo sapiens
ggaaaacacucuaaacaua

SEQ ID NO: 1095075 - RNA, 19 nt, Homo sapiens
ucagcaaacucaauucuua

SEQ ID NO: 1095076 - RNA, 19 nt, Homo sapiens
gaacugaagucuuagagau

SEQ ID NO: 1095077 - RNA, 19 nt, Homo sapiens
gagcugaacucuuagaaau

SEQ ID NO: 1095078 - RNA, 19 nt, Homo sapiens
ugagaaaggugacauugua

SEQ ID NO: 1095079 - RNA, 19 nt, Homo sapiens
gaaacuugcuuguggaaug

SEQ ID NO: 1095080 - RNA, 19 nt, Homo sapiens
agaaaucucuccugaacua

SEQ ID NO: 1095081 - RNA, 19 nt, Homo sapiens
gaacagaccagcaccagaa

SEQ ID NO: 1095082 - RNA, 19 nt, Homo sapiens
gagaacagaugcagguuug

SEQ ID NO: 1095083 - RNA, 19 nt, Homo sapiens
gaaacaauccugagguauu

SEQ ID NO: 1095084 - RNA, 19 nt, Homo sapiens
gcacacagguccacaagca

SEQ ID NO: 1095085 - RNA, 19 nt, Homo sapiens
uaucaaggaucuaaccuaa

SEQ ID NO: 1095086 - RNA, 19 nt, Homo sapiens
ccacaacucucgaagucua

SEQ ID NO: 1095087 - RNA, 19 nt, Homo sapiens
aaacgugccugucauagaa

SEQ ID NO: 1095088 - RNA, 19 nt, Homo sapiens
uauucgagcugaacucuua

SEQ ID NO: 1095089 - RNA, 19 nt, Homo sapiens
gaacugcuguaccaacgaa

SEQ ID NO: 1095090 - RNA, 19 nt, Homo sapiens
gaagagugguguuaacuac

SEQ ID NO: 1095091 - RNA, 19 nt, Homo sapiens
cauugcaacugauguguua

SEQ ID NO: 1095092 - RNA, 19 nt, Homo sapiens
gaaucgagcuucccuaugc

SEQ ID NO: 1095093 - RNA, 19 nt, Homo sapiens
gagcaacucagucagauuu

SEQ ID NO: 1095094 - RNA, 19 nt, Homo sapiens
uaacauuggucaugagguu

SEQ ID NO: 1095095 - RNA, 19 nt, Homo sapiens
ccuguacacugaagaauuu

SEQ ID NO: 1095096 - RNA, 19 nt, Homo sapiens
gaaacugucuaucaaggau

SEQ ID NO: 1095097 - RNA, 19 nt, Homo sapiens
acacaacucugaauucuag

SEQ ID NO: 1095098 - RNA, 19 nt, Homo sapiens
aaagaagcauugcaacuga

SEQ ID NO: 1095099 - RNA, 19 nt, Homo sapiens
gaacaacuacaucaggauu

SEQ ID NO: 1095100 - RNA, 19 nt, Homo sapiens
gguaacagcuccaaauugc

SEQ ID NO: 1095101 - RNA, 19 nt, Homo sapiens
gaauuugacuguguagaug

SEQ ID NO: 1095102 - RNA, 19 nt, Homo sapiens
uggcagcacuggauaauga

SEQ ID NO: 1095103 - RNA, 19 nt, Homo sapiens
aaagagaaaugauguccaa

SEQ ID NO: 1095104 - RNA, 19 nt, Homo sapiens
uagaggaacuuaaucugaa

SEQ ID NO: 1095105 - RNA, 19 nt, Homo sapiens
gaacagcaaaugugugaga

SEQ ID NO: 1095106 - RNA, 19 nt, Homo sapiens
gaaaaguggugucgugauu

SEQ ID NO: 1095107 - RNA, 19 nt, Homo sapiens
gaaagaagcauugcaacug

SEQ ID NO: 1095108 - RNA, 19 nt, Homo sapiens
gagaaagucugugaaacug

SEQ ID NO: 1095109 - RNA, 19 nt, Homo sapiens
gcagauugcucgggauguu

SEQ ID NO: 1095110 - RNA, 19 nt, Homo sapiens
cggaugaaauggauguuaa

SEQ ID NO: 1095111 - RNA, 19 nt, Homo sapiens
uggaucagguaacuacuua

SEQ ID NO: 1095112 - RNA, 19 nt, Homo sapiens
uaaacaccagccuaaauua

SEQ ID NO: 1095113 - RNA, 19 nt, Homo sapiens
ggauaaugauggaaaucuu

SEQ ID NO: 1095114 - RNA, 19 nt, Homo sapiens
gcaggaagccaaccuaaca

SEQ ID NO: 1095115 - RNA, 19 nt, Homo sapiens
cagacaagauggaagaaga

SEQ ID NO: 1095116 - RNA, 19 nt, Homo sapiens
gcaaguaguggaucaccua

SEQ ID NO: 1095117 - RNA, 19 nt, Homo sapiens
gaaacgugccugucauaga

SEQ ID NO: 1095118 - RNA, 19 nt, Homo sapiens
cagaauggcagauguuauu

SEQ ID NO: 1095119 - RNA, 19 nt, Homo sapiens
gaaauuaucaagcgaaucg

SEQ ID NO: 1095120 - RNA, 19 nt, Homo sapiens
caaacucgcucgucaugca

SEQ ID NO: 1095121 - RNA, 19 nt, Homo sapiens
gaccagaacugaagcucau

SEQ ID NO: 1095122 - RNA, 19 nt, Homo sapiens
gugaggauuuggaacuuaa

SEQ ID NO: 1095123 - RNA, 19 nt, Homo sapiens
guagaggaacuuaaucuga

SEQ ID NO: 1095124 - RNA, 19 nt, Homo sapiens
uggcugaacugcuggauau

SEQ ID NO: 1095125 - RNA, 19 nt, Homo sapiens
caaagaagagugguguuaa

SEQ ID NO: 1095126 - RNA, 19 nt, Homo sapiens
ucaaagaagagugguguua

SEQ ID NO: 1095127 - RNA, 19 nt, Homo sapiens
ucaaggaucuaaccuaaac

SEQ ID NO: 1095128 - RNA, 19 nt, Homo sapiens
uagaugaagugcuaacaau

SEQ ID NO: 1095129 - RNA, 19 nt, Homo sapiens
gaccagcaccagaaaguuu

SEQ ID NO: 1095130 - RNA, 19 nt, Homo sapiens
ccaaguuuaucaaagaaga

SEQ ID NO: 1095131 - RNA, 19 nt, Homo sapiens
agaaacccguuaacagaaa

SEQ ID NO: 1095132 - RNA, 19 nt, Homo sapiens
aaacccagaucuuggagaa

SEQ ID NO: 1095133 - RNA, 19 nt, Homo sapiens
gaacccaccaaacuuuaaa

SEQ ID NO: 1095134 - RNA, 19 nt, Homo sapiens
gaacuuaaccccuuugaug

SEQ ID NO: 1095135 - RNA, 19 nt, Homo sapiens
ggauaugggagauacauga

SEQ ID NO: 1095136 - RNA, 19 nt, Homo sapiens
uuacaaggcuuaccaagac

SEQ ID NO: 1095137 - RNA, 19 nt, Homo sapiens
guacaacccgagaauaaga

SEQ ID NO: 1095138 - RNA, 19 nt, Homo sapiens
gaugcuaaaugugguaaga

SEQ ID NO: 1095139 - RNA, 19 nt, Homo sapiens
ucuuagagauuggaacaua

SEQ ID NO: 1095140 - RNA, 19 nt, Homo sapiens
gcuaaaaccuugaacugaa

SEQ ID NO: 1095141 - RNA, 19 nt, Homo sapiens
gaugcagguuugaggaauu

SEQ ID NO: 1095142 - RNA, 19 nt, Homo sapiens
gcaggcauuggaagacuua

SEQ ID NO: 1095143 - RNA, 19 nt, Homo sapiens
agagugguguuaacuacua

SEQ ID NO: 1095144 - RNA, 19 nt, Homo sapiens
aaucucuccugaacuauuu

SEQ ID NO: 1095145 - RNA, 19 nt, Homo sapiens
uuaaacaccagccuaaauu

SEQ ID NO: 1095146 - RNA, 19 nt, Homo sapiens
cagcagaaaugacagaaac

SEQ ID NO: 1095147 - RNA, 19 nt, Homo sapiens
gagaaaugauguccaaucc

SEQ ID NO: 1095148 - RNA, 19 nt, Homo sapiens
ggagaacagaugcagguuu

SEQ ID NO: 1095149 - RNA, 19 nt, Homo sapiens
ugucaacaaugaauaagga

SEQ ID NO: 1095150 - RNA, 19 nt, Homo sapiens
acagaaacccguuaacaga

SEQ ID NO: 1095151 - RNA, 19 nt, Homo sapiens
ggaacccaccaaacuuuaa

SEQ ID NO: 1095152 - RNA, 19 nt, Homo sapiens
guauuguacugaugauaug

SEQ ID NO: 1095153 - RNA, 19 nt, Homo sapiens
gaauaaggaacagcaaaug

SEQ ID NO: 1095154 - RNA, 19 nt, Homo sapiens
gaaaguaaggacauucuac

SEQ ID NO: 1095155 - RNA, 19 nt, Homo sapiens
ucagguaacuacuuaaugc

SEQ ID NO: 1095156 - RNA, 19 nt, Homo sapiens
caagacacaacucugaauu

SEQ ID NO: 1095157 - RNA, 19 nt, Homo sapiens
ccaaauugcuuuucacaug

SEQ ID NO: 1095158 - RNA, 19 nt, Homo sapiens
gaauuuggaaucaucaugu

SEQ ID NO: 1095159 - RNA, 19 nt, Homo sapiens
ccauauucaucacguuauu

SEQ ID NO: 1095160 - RNA, 19 nt, Homo sapiens
accuugaacugaagucuua

SEQ ID NO: 1095161 - RNA, 19 nt, Homo sapiens
guaaucugccuccuaguga

SEQ ID NO: 1095162 - RNA, 19 nt, Homo sapiens
ggaaucaucaugucagagu

SEQ ID NO: 1095163 - RNA, 19 nt, Homo sapiens
guguacaacccgagaauaa

SEQ ID NO: 1095164 - RNA, 19 nt, Homo sapiens
cgccuuaucuuugaaauuc

SEQ ID NO: 1095165 - RNA, 19 nt, Homo sapiens
acgaaacaauccugaggua

SEQ ID NO: 1095166 - RNA, 19 nt, Homo sapiens
acuuaaugcugacacauaa

SEQ ID NO: 1095167 - RNA, 19 nt, Homo sapiens
uaacagcuccaaauugcuu

SEQ ID NO: 1095168 - RNA, 19 nt, Homo sapiens
gcaacucagucagauuugu

SEQ ID NO: 1095169 - RNA, 19 nt, Homo sapiens
acaccagccuaaauuauuc

SEQ ID NO: 1095170 - RNA, 19 nt, Homo sapiens
gguauuguacugaugauau

SEQ ID NO: 1095171 - RNA, 19 nt, Homo sapiens
caaaggagaucauaagaaa

SEQ ID NO: 1095172 - RNA, 19 nt, Homo sapiens
gaauuuagcuccacuucaa

SEQ ID NO: 1095173 - RNA, 19 nt, Homo sapiens
ggucaaacguguaaagaaa

SEQ ID NO: 1095174 - RNA, 19 nt, Homo sapiens
ucagagggcuuugaauuua

SEQ ID NO: 1095175 - RNA, 19 nt, Homo sapiens
gaaauuaaccaccaaaugu

SEQ ID NO: 1095176 - RNA, 19 nt, Homo sapiens
gaacagagacauaauaaag

SEQ ID NO: 1095177 - RNA, 19 nt, Homo sapiens
agacaggccuugaaauuaa

SEQ ID NO: 1095178 - RNA, 19 nt, Homo sapiens
gcacauacauaacuuugga

SEQ ID NO: 1095179 - RNA, 19 nt, Homo sapiens
ccacuaagcugcuacuuca

SEQ ID NO: 1095180 - RNA, 19 nt, Homo sapiens
gaauacgggugcugaagaa

SEQ ID NO: 1095181 - RNA, 19 nt, Homo sapiens
caaugaagcuggacuauac

SEQ ID NO: 1095182 - RNA, 19 nt, Homo sapiens
gacccaaucuucacauauu

SEQ ID NO: 1095183 - RNA, 19 nt, Homo sapiens
ucacagaacacauagauuu

SEQ ID NO: 1095184 - RNA, 19 nt, Homo sapiens
gaagcaugcuguccuaugu

SEQ ID NO: 1095185 - RNA, 19 nt, Homo sapiens
gaauuaagaaugagccaua

SEQ ID NO: 1095186 - RNA, 19 nt, Homo sapiens
ggacggcgcucuccuuagu

SEQ ID NO: 1095187 - RNA, 19 nt, Homo sapiens
ggacaaacagcauauucua

SEQ ID NO: 1095188 - RNA, 19 nt, Homo sapiens
gcacuggugugguaugaau

SEQ ID NO: 1095189 - RNA, 19 nt, Homo sapiens
cagaagaaauacuggcuuu

SEQ ID NO: 1095190 - RNA, 19 nt, Homo sapiens
gaacucagcagugaugauu

SEQ ID NO: 1095191 - RNA, 19 nt, Homo sapiens
gaguauagaugacauaggu

SEQ ID NO: 1095192 - RNA, 19 nt, Homo sapiens
gcuauugccugucuucaga

SEQ ID NO: 1095193 - RNA, 19 nt, Homo sapiens
gaagcaacagaauggauua

SEQ ID NO: 1095194 - RNA, 19 nt, Homo sapiens
gaagcauccucaugaccua

SEQ ID NO: 1095195 - RNA, 19 nt, Homo sapiens
ggagagaguuaaucuuucu

SEQ ID NO: 1095196 - RNA, 19 nt, Homo sapiens
ugacaucacagaacacaua

SEQ ID NO: 1095197 - RNA, 19 nt, Homo sapiens
ggacaucguuaccaagcaa

SEQ ID NO: 1095198 - RNA, 19 nt, Homo sapiens
gccagaagcucuugcuaug

SEQ ID NO: 1095199 - RNA, 19 nt, Homo sapiens
gauguucaaucaaaucaga

SEQ ID NO: 1095200 - RNA, 19 nt, Homo sapiens
ggagauaucuuugaaaaug

SEQ ID NO: 1095201 - RNA, 19 nt, Homo sapiens
ggaccagccuguacgcuau

SEQ ID NO: 1095202 - RNA, 19 nt, Homo sapiens
gccaacaucuugcacaaug

SEQ ID NO: 1095203 - RNA, 19 nt, Homo sapiens
gaaaacagccugaaguuga

SEQ ID NO: 1095204 - RNA, 19 nt, Homo sapiens
gggaauugccaacguauuu

SEQ ID NO: 1095205 - RNA, 19 nt, Homo sapiens
ggaccuggaucuauaugau

SEQ ID NO: 1095206 - RNA, 19 nt, Homo sapiens
gaacacugaaugaguuaaa

SEQ ID NO: 1095207 - RNA, 19 nt, Homo sapiens
guaccuggcuugcaguuuc

SEQ ID NO: 1095208 - RNA, 19 nt, Homo sapiens
gcacuucacuucucuucca

SEQ ID NO: 1095209 - RNA, 19 nt, Homo sapiens
ucaguuaacagagguauua

SEQ ID NO: 1095210 - RNA, 19 nt, Homo sapiens
agaaacaggucagauagaa

SEQ ID NO: 1095211 - RNA, 19 nt, Homo sapiens
cagaagcucuugcuaugga

SEQ ID NO: 1095212 - RNA, 19 nt, Homo sapiens
ggacuggaacagagacaua

SEQ ID NO: 1095213 - RNA, 19 nt, Homo sapiens
uaugaugucugugaacuuu

SEQ ID NO: 1095214 - RNA, 19 nt, Homo sapiens
gaaugagccauaucaggua

SEQ ID NO: 1095215 - RNA, 19 nt, Homo sapiens
ccucguggguacuguauaa

SEQ ID NO: 1095216 - RNA, 19 nt, Homo sapiens
caggagagaguuaaucuuu

SEQ ID NO: 1095217 - RNA, 19 nt, Homo sapiens
gcaacagaauggauuacau

SEQ ID NO: 1095218 - RNA, 19 nt, Homo sapiens
uaacuauacuaucccagaa

SEQ ID NO: 1095219 - RNA, 19 nt, Homo sapiens
uguauaacauggcuucauu

SEQ ID NO: 1095220 - RNA, 19 nt, Homo sapiens
uaagaaaacuccugggaaa

SEQ ID NO: 1095221 - RNA, 19 nt, Homo sapiens
gaagaaagguccccaggau

SEQ ID NO: 1095222 - RNA, 19 nt, Homo sapiens
cugaugagauggagaauuc

SEQ ID NO: 1095223 - RNA, 19 nt, Homo sapiens
agacaagaagcaacaguua

SEQ ID NO: 1095224 - RNA, 19 nt, Homo sapiens
ggagagcaaugguucugau

SEQ ID NO: 1095225 - RNA, 19 nt, Homo sapiens
ccaaauguccagaguguga

SEQ ID NO: 1095226 - RNA, 19 nt, Homo sapiens
gcaaccugauuguacuaaa

SEQ ID NO: 1095227 - RNA, 19 nt, Homo sapiens
gaaacaggucagauagaaa

SEQ ID NO: 1095228 - RNA, 19 nt, Homo sapiens
cgucuagacuuacaaggaa

SEQ ID NO: 1095229 - RNA, 19 nt, Homo sapiens
acagaaagcuacccuagag

SEQ ID NO: 1095230 - RNA, 19 nt, Homo sapiens
gcagggacucugaugcaua

SEQ ID NO: 1095231 - RNA, 19 nt, Homo sapiens
gacaagaagcaacaguuaa

SEQ ID NO: 1095232 - RNA, 19 nt, Homo sapiens
ggaugacagugacuucuuc

SEQ ID NO: 1095233 - RNA, 19 nt, Homo sapiens
uaacauggcuucauuuuac

SEQ ID NO: 1095234 - RNA, 19 nt, Homo sapiens
ccucaaagaauuagagaaa

SEQ ID NO: 1095235 - RNA, 19 nt, Homo sapiens
uagacaggccuugaaauua

SEQ ID NO: 1095236 - RNA, 19 nt, Homo sapiens
cagggacucugaugcauau

SEQ ID NO: 1095237 - RNA, 19 nt, Homo sapiens
ggcaaacguucuacacaga

SEQ ID NO: 1095238 - RNA, 19 nt, Homo sapiens
caauggagccucuuugcaa

SEQ ID NO: 1095239 - RNA, 19 nt, Homo sapiens
ggaauacgggugcugaaga

SEQ ID NO: 1095240 - RNA, 19 nt, Homo sapiens
caccaaauguccagagugu

SEQ ID NO: 1095241 - RNA, 19 nt, Homo sapiens
gcuccuaucuggcucauac

SEQ ID NO: 1095242 - RNA, 19 nt, Homo sapiens
gcacacuucucugcugaug

SEQ ID NO: 1095243 - RNA, 19 nt, Homo sapiens
cauaucagguaguagaaug

SEQ ID NO: 1095244 - RNA, 19 nt, Homo sapiens
gcaauggaagaauuugaaa

SEQ ID NO: 1095245 - RNA, 19 nt, Homo sapiens
ggagagcaguaggaaauag

SEQ ID NO: 1095246 - RNA, 19 nt, Homo sapiens
ucaggaggagcaaaucuua

SEQ ID NO: 1095247 - RNA, 19 nt, Homo sapiens
gaaggaguauagaugacau

SEQ ID NO: 1095248 - RNA, 19 nt, Homo sapiens
ccaaaggagaucauaagaa

SEQ ID NO: 1095249 - RNA, 19 nt, Homo sapiens
gaagaaauacuggcuuugg

SEQ ID NO: 1095250 - RNA, 19 nt, Homo sapiens
gagcaaugguucugaugag

SEQ ID NO: 1095251 - RNA, 19 nt, Homo sapiens
ccacuucaauaccaagaug

SEQ ID NO: 1095252 - RNA, 19 nt, Homo sapiens
aagagcagauuguacagaa

SEQ ID NO: 1095253 - RNA, 19 nt, Homo sapiens
agagaucgcaccacacuuu

SEQ ID NO: 1095254 - RNA, 19 nt, Homo sapiens
cagauuggcacccgaauug

SEQ ID NO: 1095255 - RNA, 19 nt, Homo sapiens
ggaacagagacauaauaaa

SEQ ID NO: 1095256 - RNA, 19 nt, Homo sapiens
caaugguucugaugagaug

SEQ ID NO: 1095257 - RNA, 19 nt, Homo sapiens
caugaaggccuacagaaga

SEQ ID NO: 1095258 - RNA, 19 nt, Homo sapiens
gauggcacauacauaacuu

SEQ ID NO: 1095259 - RNA, 19 nt, Homo sapiens
caaccagcagcauaguuua

SEQ ID NO: 1095260 - RNA, 19 nt, Homo sapiens
ucaaccagcagcauaguuu

SEQ ID NO: 1095261 - RNA, 19 nt, Homo sapiens
caccagcuauuacacuuug

SEQ ID NO: 1095262 - RNA, 19 nt, Homo sapiens
uuagacaggccuugaaauu

SEQ ID NO: 1095263 - RNA, 19 nt, Homo sapiens
ggcaaaagaggcacaauua

SEQ ID NO: 1095264 - RNA, 19 nt, Homo sapiens
gaggagcaaaucuuaagaa

SEQ ID NO: 1095265 - RNA, 19 nt, Homo sapiens
ggacgaaugccucaaacuc

SEQ ID NO: 1095266 - RNA, 19 nt, Homo sapiens
gagacaagaagcaacaguu

SEQ ID NO: 1095267 - RNA, 19 nt, Homo sapiens
ccuucucucuuucucuuua

SEQ ID NO: 1095268 - RNA, 19 nt, Homo sapiens
gcacccgaauugccaaagu

SEQ ID NO: 1095269 - RNA, 19 nt, Homo sapiens
ccacaacagucgcuugaac

SEQ ID NO: 1095270 - RNA, 19 nt, Homo sapiens
ugaagaugaugaagcaaca

SEQ ID NO: 1095271 - RNA, 19 nt, Homo sapiens
gaaaggaacuguacaagug

SEQ ID NO: 1095272 - RNA, 19 nt, Homo sapiens
cacaaagucuucaguaaua

SEQ ID NO: 1095273 - RNA, 19 nt, Homo sapiens
ggagagaaaucuuacaaau

SEQ ID NO: 1095274 - RNA, 19 nt, Homo sapiens
ggacagaaaucuuacaaac

SEQ ID NO: 1095275 - RNA, 19 nt, Homo sapiens
agagaaaccuuacaaaugu

SEQ ID NO: 1095276 - RNA, 19 nt, Homo sapiens
agagaaaccuuacaaaugu

SEQ ID NO: 1095277 - RNA, 19 nt, Homo sapiens
gcaaggacuuucaucagaa

SEQ ID NO: 1095278 - RNA, 19 nt, Homo sapiens
gagagaaaccuuacaaaug

SEQ ID NO: 1095279 - RNA, 19 nt, Homo sapiens
gagagaaaccuuacaaaug

SEQ ID NO: 1095280 - RNA, 19 nt, Homo sapiens
caacgaugcuuucucaguu

SEQ ID NO: 1095281 - RNA, 19 nt, Homo sapiens
ggugugaaauucucaguuu

SEQ ID NO: 1095282 - RNA, 19 nt, Homo sapiens
ugaagaaugugacaaaguu

SEQ ID NO: 1095283 - RNA, 19 nt, Homo sapiens
caauguggguuguauauau

SEQ ID NO: 1095284 - RNA, 19 nt, Homo sapiens
gcaaauacaugcaagucau

SEQ ID NO: 1095285 - RNA, 19 nt, Homo sapiens
agaauugacuugaguuuga

SEQ ID NO: 1095286 - RNA, 19 nt, Homo sapiens
gguggucagucaacacuua

SEQ ID NO: 1095287 - RNA, 19 nt, Homo sapiens
aaugguagcucacucuuaa

SEQ ID NO: 1095288 - RNA, 19 nt, Homo sapiens
gguauuguguugaaucuga

SEQ ID NO: 1095289 - RNA, 19 nt, Homo sapiens
agagaaaccuuacaagugu

SEQ ID NO: 1095290 - RNA, 19 nt, Homo sapiens
aaucaaaccuugcauguca

SEQ ID NO: 1095291 - RNA, 19 nt, Homo sapiens
agagaaaccuuacaagugu

SEQ ID NO: 1095292 - RNA, 19 nt, Homo sapiens
agagaaaccuuacaagugu

SEQ ID NO: 1095293 - RNA, 19 nt, Homo sapiens
gaaguacacacaagagaaa

SEQ ID NO: 1095294 - RNA, 19 nt, Homo sapiens
gagaauccauaaugaagga

SEQ ID NO: 1095295 - RNA, 19 nt, Homo sapiens
gagagaaaccuuacaagug

SEQ ID NO: 1095296 - RNA, 19 nt, Homo sapiens
gagagaaaccuuacaagug

SEQ ID NO: 1095297 - RNA, 19 nt, Homo sapiens
gagagaaaccuuacaagug

SEQ ID NO: 1095298 - RNA, 19 nt, Homo sapiens
ccaaaugcaugaugaagau

SEQ ID NO: 1095299 - RNA, 19 nt, Homo sapiens
gagagaaaccauacaaaug

SEQ ID NO: 1095300 - RNA, 19 nt, Homo sapiens
gagagaaaccauacaaaug

SEQ ID NO: 1095301 - RNA, 19 nt, Homo sapiens
caaauccacugaauguguu

SEQ ID NO: 1095302 - RNA, 19 nt, Homo sapiens
agagaaaccucacaagugu

SEQ ID NO: 1095303 - RNA, 19 nt, Homo sapiens
uagggaaacuugacuaaug

SEQ ID NO: 1095304 - RNA, 19 nt, Homo sapiens
ggagagaaaccauacaaau

SEQ ID NO: 1095305 - RNA, 19 nt, Homo sapiens
ggagagaaaccuuacaaau

SEQ ID NO: 1095306 - RNA, 19 nt, Homo sapiens
ggagagaaaccauacaaau

SEQ ID NO: 1095307 - RNA, 19 nt, Homo sapiens
ggagagaaaccuuacaaau

SEQ ID NO: 1095308 - RNA, 19 nt, Homo sapiens
gcuggaaacaaaccuauua

SEQ ID NO: 1095309 - RNA, 19 nt, Homo sapiens
gagagaaaccucacaagug

SEQ ID NO: 1095310 - RNA, 19 nt, Homo sapiens
ggcaaggacuuucaucaga

SEQ ID NO: 1095311 - RNA, 19 nt, Homo sapiens
ugaaacaaauggccaugaa

SEQ ID NO: 1095312 - RNA, 19 nt, Homo sapiens
uaagaucucuagcaaaugg

SEQ ID NO: 1095313 - RNA, 19 nt, Homo sapiens
ugaaggaggucuuacaagu

SEQ ID NO: 1095314 - RNA, 19 nt, Homo sapiens
gcaaauccacugaaugugu

SEQ ID NO: 1095315 - RNA, 19 nt, Homo sapiens
gaaucacauuggcuuauau

SEQ ID NO: 1095316 - RNA, 19 nt, Homo sapiens
ugaaucacauuggcuuaua

SEQ ID NO: 1095317 - RNA, 19 nt, Homo sapiens
guacagagcgacaugauca

SEQ ID NO: 1095318 - RNA, 19 nt, Homo sapiens
uuacaaacguccuaugugu

SEQ ID NO: 1095319 - RNA, 19 nt, Homo sapiens
guauaaaugugauguaugc

SEQ ID NO: 1095320 - RNA, 19 nt, Homo sapiens
gaguuugaguugacuuaaa

SEQ ID NO: 1095321 - RNA, 19 nt, Homo sapiens
gagagaaaucuuacaaaug

SEQ ID NO: 1095322 - RNA, 19 nt, Homo sapiens
agacaucauucauaacuug

SEQ ID NO: 1095323 - RNA, 19 nt, Homo sapiens
gagagaaacguuacaagug

SEQ ID NO: 1095324 - RNA, 19 nt, Homo sapiens
ugaaagacauaggagaauu

SEQ ID NO: 1095325 - RNA, 19 nt, Homo sapiens
caaaucacaccuugaaaga

SEQ ID NO: 1095326 - RNA, 19 nt, Homo sapiens
acagaaaucuuacaaacgu

SEQ ID NO: 1095327 - RNA, 19 nt, Homo sapiens
guucacaccacauuagaua

SEQ ID NO: 1095328 - RNA, 19 nt, Homo sapiens
caucauagacuuuauacug

SEQ ID NO: 1095329 - RNA, 19 nt, Homo sapiens
agucaaaccuugcauguca

SEQ ID NO: 1095330 - RNA, 19 nt, Homo sapiens
agagaaacguuacaagugu

SEQ ID NO: 1095331 - RNA, 19 nt, Homo sapiens
ggaaguacacacaagagaa

SEQ ID NO: 1095332 - RNA, 19 nt, Homo sapiens
uaaugaauguggcaagguu

SEQ ID NO: 1095333 - RNA, 19 nt, Homo sapiens
ggagagaaaccuuacaagu

SEQ ID NO: 1095334 - RNA, 19 nt, Homo sapiens
uaaugaauguggcaagguu

SEQ ID NO: 1095335 - RNA, 19 nt, Homo sapiens
ggagagaaacguuacaagu

SEQ ID NO: 1095336 - RNA, 19 nt, Homo sapiens
ggagagaaaccuuacaagu

SEQ ID NO: 1095337 - RNA, 19 nt, Homo sapiens
gcaaaucacaccuugaaag

SEQ ID NO: 1095338 - RNA, 19 nt, Homo sapiens
uaaugaauguggcaagguu

SEQ ID NO: 1095339 - RNA, 19 nt, Homo sapiens
ggagagaaaccuuacaagu

SEQ ID NO: 1095340 - RNA, 19 nt, Homo sapiens
ucacaauucagcccuguua

SEQ ID NO: 1095341 - RNA, 19 nt, Homo sapiens
gacauucagucacaauuca

SEQ ID NO: 1095342 - RNA, 19 nt, Homo sapiens
ggucuucaguccgagguua

SEQ ID NO: 1095343 - RNA, 19 nt, Homo sapiens
gaaagacauaggagaauuc

SEQ ID NO: 1095344 - RNA, 19 nt, Homo sapiens
cacuugaggucaugaguuu

SEQ ID NO: 1095345 - RNA, 19 nt, Homo sapiens
ggaaaggaacuguacaagu

SEQ ID NO: 1095346 - RNA, 19 nt, Homo sapiens
caucauagacuucauacug

SEQ ID NO: 1095347 - RNA, 19 nt, Homo sapiens
ggcaagacauucagucaca

SEQ ID NO: 1095348 - RNA, 19 nt, Homo sapiens
gguuacuccuugcagaaua

SEQ ID NO: 1095349 - RNA, 19 nt, Homo sapiens
ggagagaaaccucacaagu

SEQ ID NO: 1095350 - RNA, 19 nt, Homo sapiens
gaaggaggucuuacaagug

SEQ ID NO: 1095351 - RNA, 19 nt, Homo sapiens
gucacaaagucuucaguaa

SEQ ID NO: 1095352 - RNA, 19 nt, Homo sapiens
ggaaacuugacuaauguaa

SEQ ID NO: 1095353 - RNA, 19 nt, Homo sapiens
ggauaccucuuccaaaugc

SEQ ID NO: 1095354 - RNA, 19 nt, Homo sapiens
gaagaaugugacaaaguuu

SEQ ID NO: 1095355 - RNA, 19 nt, Homo sapiens
caagguggauagaucacuu

SEQ ID NO: 1095356 - RNA, 19 nt, Homo sapiens
ggcacaacauacuguaauu

SEQ ID NO: 1095357 - RNA, 19 nt, Homo sapiens
ggacaaggcaauacagaag

SEQ ID NO: 1095358 - RNA, 19 nt, Homo sapiens
ggauguggccauagaauuc

SEQ ID NO: 1095359 - RNA, 19 nt, Homo sapiens
cagcaaaccaucaaggauu

SEQ ID NO: 1095360 - RNA, 19 nt, Homo sapiens
guucauuggcgaucuuaua

SEQ ID NO: 1095361 - RNA, 19 nt, Homo sapiens
aaucacaccuugaaagaca

SEQ ID NO: 1095362 - RNA, 19 nt, Homo sapiens
ggucaugaguuugagauca

SEQ ID NO: 1095363 - RNA, 19 nt, Homo sapiens
ggcaaggucuucagucaag

SEQ ID NO: 1095364 - RNA, 19 nt, Homo sapiens
gagaaaccuuacaaaugug

SEQ ID NO: 1095365 - RNA, 19 nt, Homo sapiens
guguaaauuugcaagguuu

SEQ ID NO: 1095366 - RNA, 19 nt, Homo sapiens
gagaaaccuuacaaaugug

SEQ ID NO: 1095367 - RNA, 19 nt, Homo sapiens
gugcaaauccacugaaugu

SEQ ID NO: 1095368 - RNA, 19 nt, Homo sapiens
cagaauaucauaacguuca

SEQ ID NO: 1095369 - RNA, 19 nt, Homo sapiens
auacuggacagaaaucuua

SEQ ID NO: 1095370 - RNA, 19 nt, Homo sapiens
agagaaaccauacaaaugu

SEQ ID NO: 1095371 - RNA, 19 nt, Homo sapiens
gaagagggcucaugugaug

SEQ ID NO: 1095372 - RNA, 19 nt, Homo sapiens
cagaucaccuucagucuua

SEQ ID NO: 1095373 - RNA, 19 nt, Homo sapiens
uaagggagauuucuacaaa

SEQ ID NO: 1095374 - RNA, 19 nt, Homo sapiens
gaaauuaacuggaucuacu

SEQ ID NO: 1095375 - RNA, 19 nt, Homo sapiens
gaaaugcuccaaaguguaa

SEQ ID NO: 1095376 - RNA, 19 nt, Homo sapiens
gauaugauccgccaaauga

SEQ ID NO: 1095377 - RNA, 19 nt, Homo sapiens
caaagaugcuaucaaagaa

SEQ ID NO: 1095378 - RNA, 19 nt, Homo sapiens
gacaggaggugaugaagaa

SEQ ID NO: 1095379 - RNA, 19 nt, Homo sapiens
gaaauugaaucagcgauau

SEQ ID NO: 1095380 - RNA, 19 nt, Homo sapiens
guaaagucauuaaggagua

SEQ ID NO: 1095381 - RNA, 19 nt, Homo sapiens
gaacugacuuuacccaauc

SEQ ID NO: 1095382 - RNA, 19 nt, Homo sapiens
uaaauaagcucaguguuca

SEQ ID NO: 1095383 - RNA, 19 nt, Homo sapiens
ggaguacccuggaaaggaa

SEQ ID NO: 1095384 - RNA, 19 nt, Homo sapiens
gagauagaguuccuuguga

SEQ ID NO: 1095385 - RNA, 19 nt, Homo sapiens
ggagguagaucagauugaa

SEQ ID NO: 1095386 - RNA, 19 nt, Homo sapiens
ggauaaagcauacaccaaa

SEQ ID NO: 1095387 - RNA, 19 nt, Homo sapiens
gaaagcaaccaccuaauuc

SEQ ID NO: 1095388 - RNA, 19 nt, Homo sapiens
cagcagcgauucagugauu

SEQ ID NO: 1095389 - RNA, 19 nt, Homo sapiens
ggccaaaggucauauaaag

SEQ ID NO: 1095390 - RNA, 19 nt, Homo sapiens
uaagaucuuugaacaggua

SEQ ID NO: 1095391 - RNA, 19 nt, Homo sapiens
ccaaagaugcuaucaaaga

SEQ ID NO: 1095392 - RNA, 19 nt, Homo sapiens
gcacaccacugccuguuuc

SEQ ID NO: 1095393 - RNA, 19 nt, Homo sapiens
ggaccaaauuugauaagau

SEQ ID NO: 1095394 - RNA, 19 nt, Homo sapiens
gaucauuugugaacuuaga

SEQ ID NO: 1095395 - RNA, 19 nt, Homo sapiens
gagaagagggcucauguga

SEQ ID NO: 1095396 - RNA, 19 nt, Homo sapiens
cauacuaacuuaagcauuc

SEQ ID NO: 1095397 - RNA, 19 nt, Homo sapiens
uaacagacacuauaccaaa

SEQ ID NO: 1095398 - RNA, 19 nt, Homo sapiens
gcauucaugucaccauaaa

SEQ ID NO: 1095399 - RNA, 19 nt, Homo sapiens
guuaccaacuugcauuuaa

SEQ ID NO: 1095400 - RNA, 19 nt, Homo sapiens
gauggaaggcugugaauau

SEQ ID NO: 1095401 - RNA, 19 nt, Homo sapiens
gaacaggauaucgaaauaa

SEQ ID NO: 1095402 - RNA, 19 nt, Homo sapiens
ggaaauugaaucagcgaua

SEQ ID NO: 1095403 - RNA, 19 nt, Homo sapiens
ggaucuacuucuagucuaa

SEQ ID NO: 1095404 - RNA, 19 nt, Homo sapiens
agaacaggauaucgaaaua

SEQ ID NO: 1095405 - RNA, 19 nt, Homo sapiens
gcacuuugaagguuugaua

SEQ ID NO: 1095406 - RNA, 19 nt, Homo sapiens
caucuucccuguuggauau

SEQ ID NO: 1095407 - RNA, 19 nt, Homo sapiens
cagauugaauugaaacuga

SEQ ID NO: 1095408 - RNA, 19 nt, Homo sapiens
gcaacucuuucucgauuga

SEQ ID NO: 1095409 - RNA, 19 nt, Homo sapiens
gaguaaaguuggaauucuu

SEQ ID NO: 1095410 - RNA, 19 nt, Homo sapiens
gcaaauggaagaaguaaag

SEQ ID NO: 1095411 - RNA, 19 nt, Homo sapiens
gaccaaauuugauaagauc

SEQ ID NO: 1095412 - RNA, 19 nt, Homo sapiens
gcuaaagaguacagauuau

SEQ ID NO: 1095413 - RNA, 19 nt, Homo sapiens
ccagucaccucaacaaugu

SEQ ID NO: 1095414 - RNA, 19 nt, Homo sapiens
uaaaggagguagaucagau

SEQ ID NO: 1095415 - RNA, 19 nt, Homo sapiens
ugccaaagaugcuaucaaa

SEQ ID NO: 1095416 - RNA, 19 nt, Homo sapiens
gaugaucauuugugaacuu

SEQ ID NO: 1095417 - RNA, 19 nt, Homo sapiens
cacuaaaccuugugaaaga

SEQ ID NO: 1095418 - RNA, 19 nt, Homo sapiens
gaaaguagcaaaugaaagc

SEQ ID NO: 1095419 - RNA, 19 nt, Homo sapiens
ggacccugcuucuuuccua

SEQ ID NO: 1095420 - RNA, 19 nt, Homo sapiens
gagcugaacaaccuaauug

SEQ ID NO: 1095421 - RNA, 19 nt, Homo sapiens
ggagaaaguagcaaaugaa

SEQ ID NO: 1095422 - RNA, 19 nt, Homo sapiens
ugaacaaccuaauugcauu

SEQ ID NO: 1095423 - RNA, 19 nt, Homo sapiens
ucagucaucuucccuguug

SEQ ID NO: 1095424 - RNA, 19 nt, Homo sapiens
gggcuaacauccagucaau

SEQ ID NO: 1095425 - RNA, 19 nt, Homo sapiens
aggauuaugugacuaguaa

SEQ ID NO: 1095426 - RNA, 19 nt, Homo sapiens
ccuauagguugcauacuaa

SEQ ID NO: 1095427 - RNA, 19 nt, Homo sapiens
gaucugguguuacaaugga

SEQ ID NO: 1095428 - RNA, 19 nt, Homo sapiens
gggaggaggaaguaaguua

SEQ ID NO: 1095429 - RNA, 19 nt, Homo sapiens
gagaaaguagcaaaugaaa

SEQ ID NO: 1095430 - RNA, 19 nt, Homo sapiens
gaaggacuaacaaagaauu

SEQ ID NO: 1095431 - RNA, 19 nt, Homo sapiens
ggaaaugcuccaaagugua

SEQ ID NO: 1095432 - RNA, 19 nt, Homo sapiens
gaacccagacuuaaaauuu

SEQ ID NO: 1095433 - RNA, 19 nt, Homo sapiens
gacaggaccaaauuugaua

SEQ ID NO: 1095434 - RNA, 19 nt, Homo sapiens
aaggagaucuugcuucuuc

SEQ ID NO: 1095435 - RNA, 19 nt, Homo sapiens
gauaaccucuacaagaaag

SEQ ID NO: 1095436 - RNA, 19 nt, Homo sapiens
caacuugcauuuaacaaac

SEQ ID NO: 1095437 - RNA, 19 nt, Homo sapiens
gaaaaucucaugucuagaa

SEQ ID NO: 1095438 - RNA, 19 nt, Homo sapiens
ggaccuggauggaggaaca

SEQ ID NO: 1095439 - RNA, 19 nt, Homo sapiens
aaacaugucugccucugau

SEQ ID NO: 1095440 - RNA, 19 nt, Homo sapiens
caagaugacuggcacaacu

SEQ ID NO: 1095441 - RNA, 19 nt, Homo sapiens
ugaaagcaaccaccuaauu

SEQ ID NO: 1095442 - RNA, 19 nt, Homo sapiens
ggaaggcugugaauaugca

SEQ ID NO: 1095443 - RNA, 19 nt, Homo sapiens
gcaaaugaaagccagaaga

SEQ ID NO: 1095444 - RNA, 19 nt, Homo sapiens
ucagaggaguauuuguuaa

SEQ ID NO: 1095445 - RNA, 19 nt, Homo sapiens
ggcuaaagaguacagauua

SEQ ID NO: 1095446 - RNA, 19 nt, Homo sapiens
agaguuaaaugcaagagaa

SEQ ID NO: 1095447 - RNA, 19 nt, Homo sapiens
gagaaaagaugacagcaau

SEQ ID NO: 1095448 - RNA, 19 nt, Homo sapiens
uagguugcauacuaacuua

SEQ ID NO: 1095449 - RNA, 19 nt, Homo sapiens
caaacaagaacuucguaaa

SEQ ID NO: 1095450 - RNA, 19 nt, Homo sapiens
ccaaauaaggcaaauggaa

SEQ ID NO: 1095451 - RNA, 19 nt, Homo sapiens
caaaguaugccuggaacua

SEQ ID NO: 1095452 - RNA, 19 nt, Homo sapiens
gaacagguacuaagugaac

SEQ ID NO: 1095453 - RNA, 19 nt, Homo sapiens
gcggaagccuuugcagaaa

SEQ ID NO: 1095454 - RNA, 19 nt, Homo sapiens
uauaagcacuuugaagguu

SEQ ID NO: 1095455 - RNA, 19 nt, Homo sapiens
gcaaccaccuaauucaucu

SEQ ID NO: 1095456 - RNA, 19 nt, Homo sapiens
caggauaucgaaauaauga

SEQ ID NO: 1095457 - RNA, 19 nt, Homo sapiens
gagcaaugcauuuggaguu

SEQ ID NO: 1095458 - RNA, 19 nt, Homo sapiens
gauuauuguuccagcauug

SEQ ID NO: 1095459 - RNA, 19 nt, Homo sapiens
uuugauagcucgcuguuau

SEQ ID NO: 1095460 - RNA, 19 nt, Homo sapiens
gaggaguauuuguuaaugu

SEQ ID NO: 1095461 - RNA, 19 nt, Homo sapiens
aaagaaagcaagaaguuug

SEQ ID NO: 1095462 - RNA, 19 nt, Homo sapiens
gaggaaaugcuccaaagug

SEQ ID NO: 1095463 - RNA, 19 nt, Homo sapiens
gagcaguuaugaggaaaug

SEQ ID NO: 1095464 - RNA, 19 nt, Homo sapiens
gagaagaacaggauaucga

SEQ ID NO: 1095465 - RNA, 19 nt, Homo sapiens
gcucacagcuuuuggaaga

SEQ ID NO: 1095466 - RNA, 19 nt, Homo sapiens
uggagaaaguagcaaauga

SEQ ID NO: 1095467 - RNA, 19 nt, Homo sapiens
gcagaacaggacuucauaa

SEQ ID NO: 1095468 - RNA, 19 nt, Homo sapiens
cuaaagaaagcaagaaguu

SEQ ID NO: 1095469 - RNA, 19 nt, Homo sapiens
gauuauuuaucccgacuau

SEQ ID NO: 1095470 - RNA, 19 nt, Homo sapiens
gcuaacauccagucaauca

SEQ ID NO: 1095471 - RNA, 19 nt, Homo sapiens
gaaggagaauaaagaguua

SEQ ID NO: 1095472 - RNA, 19 nt, Homo sapiens
gcagauuacugguuuauga

SEQ ID NO: 1095473 - RNA, 19 nt, Homo sapiens
ggaagcagauuacugguuu

SEQ ID NO: 1095474 - RNA, 19 nt, Homo sapiens
gcacaaugaugcuauacaa

SEQ ID NO: 1095475 - RNA, 19 nt, Homo sapiens
gcagaaaguucggauuaaa

SEQ ID NO: 1095476 - RNA, 19 nt, Homo sapiens
gagcagaaaguucggauua

SEQ ID NO: 1095477 - RNA, 19 nt, Homo sapiens
guacaucccugccagauuc

SEQ ID NO: 1095478 - RNA, 19 nt, Homo sapiens
gaagaugggugaccucaag

SEQ ID NO: 1095479 - RNA, 19 nt, Homo sapiens
gaaaccggauuccaacuau

SEQ ID NO: 1095480 - RNA, 19 nt, Homo sapiens
gagagcagguuuaaugaug

SEQ ID NO: 1095481 - RNA, 19 nt, Homo sapiens
caaggaagccuaccagauu

SEQ ID NO: 1095482 - RNA, 19 nt, Homo sapiens
gggcaucucuaaagugaaa

SEQ ID NO: 1095483 - RNA, 19 nt, Homo sapiens
uacaagaccuccgauauuu

SEQ ID NO: 1095484 - RNA, 19 nt, Homo sapiens
guacaagaccuccgauauu

SEQ ID NO: 1095485 - RNA, 19 nt, Homo sapiens
ugagaagcauccugaguuu

SEQ ID NO: 1095486 - RNA, 19 nt, Homo sapiens
gaaacaaagaugcuaauca

SEQ ID NO: 1095487 - RNA, 19 nt, Homo sapiens
gaaccucgcgcuugaaaug

SEQ ID NO: 1095488 - RNA, 19 nt, Homo sapiens
guuauuaucuggacaucaa

SEQ ID NO: 1095489 - RNA, 19 nt, Homo sapiens
gaagcagauuacugguuua

SEQ ID NO: 1095490 - RNA, 19 nt, Homo sapiens
gaaaggaucgggcacugaa

SEQ ID NO: 1095491 - RNA, 19 nt, Homo sapiens
ugauggaacucaacugauu

SEQ ID NO: 1095492 - RNA, 19 nt, Homo sapiens
ggaugacccuggcccauga

SEQ ID NO: 1095493 - RNA, 19 nt, Homo sapiens
gcuagaagguuuagauuuu

SEQ ID NO: 1095494 - RNA, 19 nt, Homo sapiens
uggagucucucauucguua

SEQ ID NO: 1095495 - RNA, 19 nt, Homo sapiens
gcugagaccuaccugaaga

SEQ ID NO: 1095496 - RNA, 19 nt, Homo sapiens
caaagaugcuaaucaccaa

SEQ ID NO: 1095497 - RNA, 19 nt, Homo sapiens
ggacaaaugauggucagua

SEQ ID NO: 1095498 - RNA, 19 nt, Homo sapiens
aggagaagauuaucaagaa

SEQ ID NO: 1095499 - RNA, 19 nt, Homo sapiens
gccgagcacuguauaaaug

SEQ ID NO: 1095500 - RNA, 19 nt, Homo sapiens
gcagauggagucucucauu

SEQ ID NO: 1095501 - RNA, 19 nt, Homo sapiens
gaaaacagauuggaaagga

SEQ ID NO: 1095502 - RNA, 19 nt, Homo sapiens
uggaaggcauucugaagua

SEQ ID NO: 1095503 - RNA, 19 nt, Homo sapiens
gcagagcuguaccaugguu

SEQ ID NO: 1095504 - RNA, 19 nt, Homo sapiens
gcggagagcagguuuaaug

SEQ ID NO: 1095505 - RNA, 19 nt, Homo sapiens
gggaugaggccuuugcuuu

SEQ ID NO: 1095506 - RNA, 19 nt, Homo sapiens
ugaaguacacgcacaauga

SEQ ID NO: 1095507 - RNA, 19 nt, Homo sapiens
gcgcuuugcuucuggauca

SEQ ID NO: 1095508 - RNA, 19 nt, Homo sapiens
aaacaaagaugcuaaucac

SEQ ID NO: 1095509 - RNA, 19 nt, Homo sapiens
uggaagcgcuagaagguuu

SEQ ID NO: 1095510 - RNA, 19 nt, Homo sapiens
caaugaugcuauacaaugu

SEQ ID NO: 1095511 - RNA, 19 nt, Homo sapiens
ucagaggacuuaucagaca

SEQ ID NO: 1095512 - RNA, 19 nt, Homo sapiens
agaagcauccugaguuuaa

SEQ ID NO: 1095513 - RNA, 19 nt, Homo sapiens
gcaguccgcucccauguac

SEQ ID NO: 1095514 - RNA, 19 nt, Homo sapiens
caaugugucuccuacaauc

SEQ ID NO: 1095515 - RNA, 19 nt, Homo sapiens
gcagagaacgaucgcuuug

SEQ ID NO: 1095516 - RNA, 19 nt, Homo sapiens
uaacgcagguagccaaagu

SEQ ID NO: 1095517 - RNA, 19 nt, Homo sapiens
auaggaaacuguucaagga

SEQ ID NO: 1095518 - RNA, 19 nt, Homo sapiens
cuccaugucuucuccauuu

SEQ ID NO: 1095519 - RNA, 19 nt, Homo sapiens
aacaacagcucccagauuc

SEQ ID NO: 1095520 - RNA, 19 nt, Homo sapiens
ggaugaggccuuugcuuug

SEQ ID NO: 1095521 - RNA, 19 nt, Homo sapiens
gaccauggcuggguugaca

SEQ ID NO: 1095522 - RNA, 19 nt, Homo sapiens
ucuaugaguuguauucaga

SEQ ID NO: 1095523 - RNA, 19 nt, Homo sapiens
gacaagcaaguaucucuuu

SEQ ID NO: 1095524 - RNA, 19 nt, Homo sapiens
guguugacguggagagaua

SEQ ID NO: 1095525 - RNA, 19 nt, Homo sapiens
ggacuuaucagacaugcau

SEQ ID NO: 1095526 - RNA, 19 nt, Homo sapiens
gcacaguccaugggcuuua

SEQ ID NO: 1095527 - RNA, 19 nt, Homo sapiens
ugaaggagaauaaagaguu

SEQ ID NO: 1095528 - RNA, 19 nt, Homo sapiens
gaggacccguucacagcua

SEQ ID NO: 1095529 - RNA, 19 nt, Homo sapiens
aaacaacagcucccagauu

SEQ ID NO: 1095530 - RNA, 19 nt, Homo sapiens
ugacagacagcuagagauu

SEQ ID NO: 1095531 - RNA, 19 nt, Homo sapiens
gaacgaucgcuuugaggaa

SEQ ID NO: 1095532 - RNA, 19 nt, Homo sapiens
gacaaaugauggucaguac

SEQ ID NO: 1095533 - RNA, 19 nt, Homo sapiens
gagcucaucagcagcauug

SEQ ID NO: 1095534 - RNA, 19 nt, Homo sapiens
uacaauggcuccaagaucu

SEQ ID NO: 1095535 - RNA, 19 nt, Homo sapiens
ggagaagauuaucaagaag

SEQ ID NO: 1095536 - RNA, 19 nt, Homo sapiens
gagaagcauccugaguuua

SEQ ID NO: 1095537 - RNA, 19 nt, Homo sapiens
gauaaagccgagcacugua

SEQ ID NO: 1095538 - RNA, 19 nt, Homo sapiens
gagaaccucgcgcuugaaa

SEQ ID NO: 1095539 - RNA, 19 nt, Homo sapiens
gacaaucucuuugcuaucg

SEQ ID NO: 1095540 - RNA, 19 nt, Homo sapiens
ugcaucagcuacuuuacua

SEQ ID NO: 1095541 - RNA, 19 nt, Homo sapiens
gaaguacacgcacaaugau

SEQ ID NO: 1095542 - RNA, 19 nt, Homo sapiens
cgauauagcucaagauccu

SEQ ID NO: 1095543 - RNA, 19 nt, Homo sapiens
ccagaaagcguuccacaag

SEQ ID NO: 1095544 - RNA, 19 nt, Homo sapiens
gcgcugggaugaggccuuu

SEQ ID NO: 1095545 - RNA, 19 nt, Homo sapiens
caaagaaacaaagaugcua

SEQ ID NO: 1095546 - RNA, 19 nt, Homo sapiens
gcugaagaauggacagauc

SEQ ID NO: 1095547 - RNA, 19 nt, Homo sapiens
cagauggagucucucauuc

SEQ ID NO: 1095548 - RNA, 19 nt, Homo sapiens
gaugaggccuuugcuuugg

SEQ ID NO: 1095549 - RNA, 19 nt, Homo sapiens
caagaccuccgauauuuag

SEQ ID NO: 1095550 - RNA, 19 nt, Homo sapiens
uggacaaucucuuugcuau

SEQ ID NO: 1095551 - RNA, 19 nt, Homo sapiens
cgaaaccggauuccaacua

SEQ ID NO: 1095552 - RNA, 19 nt, Homo sapiens
gcuggaacccuucaagaga

SEQ ID NO: 1095553 - RNA, 19 nt, Homo sapiens
gugagaagcauccugaguu

SEQ ID NO: 1095554 - RNA, 19 nt, Homo sapiens
acaagaccuccgauauuua

SEQ ID NO: 1095555 - RNA, 19 nt, Homo sapiens
gauggaacucaacugauuu

SEQ ID NO: 1095556 - RNA, 19 nt, Homo sapiens
guaaaggagaagauuauca

SEQ ID NO: 1095557 - RNA, 19 nt, Homo sapiens
ucaaugggaucaucagcau

SEQ ID NO: 1095558 - RNA, 19 nt, Homo sapiens
agaagucugucuccaaaca

SEQ ID NO: 1095559 - RNA, 19 nt, Homo sapiens
gcaagguggcucagaguuc

SEQ ID NO: 1095560 - RNA, 19 nt, Homo sapiens
ccacgacagugaggaguug

SEQ ID NO: 1095561 - RNA, 19 nt, Homo sapiens
uacaaugugucuccuacaa

SEQ ID NO: 1095562 - RNA, 19 nt, Homo sapiens
acaaugaugcuauacaaug

SEQ ID NO: 1095563 - RNA, 19 nt, Homo sapiens
gggcugugaaggagaauaa

SEQ ID NO: 1095564 - RNA, 19 nt, Homo sapiens
gaugacagacagcuagaga

SEQ ID NO: 1095565 - RNA, 19 nt, Homo sapiens
ucgggcaucucuaaaguga

SEQ ID NO: 1095566 - RNA, 19 nt, Homo sapiens
gugaggacaugcucugcuu

SEQ ID NO: 1095567 - RNA, 19 nt, Homo sapiens
ggguaaaggagaagauuau

SEQ ID NO: 1095568 - RNA, 19 nt, Homo sapiens
uaaagccgagcacuguaua

SEQ ID NO: 1095569 - RNA, 19 nt, Homo sapiens
ccugaucacugagcagaaa

SEQ ID NO: 1095570 - RNA, 19 nt, Homo sapiens
uccaugggcuuuacaagga

SEQ ID NO: 1095571 - RNA, 19 nt, Homo sapiens
gaaggagaauaaagaguua

SEQ ID NO: 1095572 - RNA, 19 nt, Homo sapiens
gcagauuacugguuuauga

SEQ ID NO: 1095573 - RNA, 19 nt, Homo sapiens
ggaagcagauuacugguuu

SEQ ID NO: 1095574 - RNA, 19 nt, Homo sapiens
caacagauauauucaggaa

SEQ ID NO: 1095575 - RNA, 19 nt, Homo sapiens
gcacaaugaugcuauacaa

SEQ ID NO: 1095576 - RNA, 19 nt, Homo sapiens
gcagaaaguucggauuaaa

SEQ ID NO: 1095577 - RNA, 19 nt, Homo sapiens
gagcagaaaguucggauua

SEQ ID NO: 1095578 - RNA, 19 nt, Homo sapiens
guacaucccugccagauuc

SEQ ID NO: 1095579 - RNA, 19 nt, Homo sapiens
gaagaugggugaccucaag

SEQ ID NO: 1095580 - RNA, 19 nt, Homo sapiens
gaaaccggauuccaacuau

SEQ ID NO: 1095581 - RNA, 19 nt, Homo sapiens
gcaccuccaucuuccauuu

SEQ ID NO: 1095582 - RNA, 19 nt, Homo sapiens
gagagcagguuuaaugaug

SEQ ID NO: 1095583 - RNA, 19 nt, Homo sapiens
caaggaagccuaccagauu

SEQ ID NO: 1095584 - RNA, 19 nt, Homo sapiens
gggcaucucuaaagugaaa

SEQ ID NO: 1095585 - RNA, 19 nt, Homo sapiens
uacaagaccuccgauauuu

SEQ ID NO: 1095586 - RNA, 19 nt, Homo sapiens
guacaagaccuccgauauu

SEQ ID NO: 1095587 - RNA, 19 nt, Homo sapiens
gaaaucccuuccacucuga

SEQ ID NO: 1095588 - RNA, 19 nt, Homo sapiens
ugagaagcauccugaguuu

SEQ ID NO: 1095589 - RNA, 19 nt, Homo sapiens
gaaacaaagaugcuaauca

SEQ ID NO: 1095590 - RNA, 19 nt, Homo sapiens
gaaccucgcgcuugaaaug

SEQ ID NO: 1095591 - RNA, 19 nt, Homo sapiens
guuauuaucuggacaucaa

SEQ ID NO: 1095592 - RNA, 19 nt, Homo sapiens
gaagcagauuacugguuua

SEQ ID NO: 1095593 - RNA, 19 nt, Homo sapiens
gaaaggaucgggcacugaa

SEQ ID NO: 1095594 - RNA, 19 nt, Homo sapiens
ugauggaacucaacugauu

SEQ ID NO: 1095595 - RNA, 19 nt, Homo sapiens
ggaugacccuggcccauga

SEQ ID NO: 1095596 - RNA, 19 nt, Homo sapiens
gcuagaagguuuagauuuu

SEQ ID NO: 1095597 - RNA, 19 nt, Homo sapiens
uggagucucucauucguua

SEQ ID NO: 1095598 - RNA, 19 nt, Homo sapiens
gcugagaccuaccugaaga

SEQ ID NO: 1095599 - RNA, 19 nt, Homo sapiens
caaagaugcuaaucaccaa

SEQ ID NO: 1095600 - RNA, 19 nt, Homo sapiens
gaacagagagaaugaggau

SEQ ID NO: 1095601 - RNA, 19 nt, Homo sapiens
ggacaaaugauggucagua

SEQ ID NO: 1095602 - RNA, 19 nt, Homo sapiens
aggagaagauuaucaagaa

SEQ ID NO: 1095603 - RNA, 19 nt, Homo sapiens
gccgagcacuguauaaaug

SEQ ID NO: 1095604 - RNA, 19 nt, Homo sapiens
gcagauggagucucucauu

SEQ ID NO: 1095605 - RNA, 19 nt, Homo sapiens
gaaaacagauuggaaagga

SEQ ID NO: 1095606 - RNA, 19 nt, Homo sapiens
ggucugugaugucuucauu

SEQ ID NO: 1095607 - RNA, 19 nt, Homo sapiens
uggaaggcauucugaagua

SEQ ID NO: 1095608 - RNA, 19 nt, Homo sapiens
gcagagcuguaccaugguu

SEQ ID NO: 1095609 - RNA, 19 nt, Homo sapiens
gcggagagcagguuuaaug

SEQ ID NO: 1095610 - RNA, 19 nt, Homo sapiens
gggaugaggccuuugcuuu

SEQ ID NO: 1095611 - RNA, 19 nt, Homo sapiens
gaaugaggaugccgaggau

SEQ ID NO: 1095612 - RNA, 19 nt, Homo sapiens
gcgcuuugcuucuggauca

SEQ ID NO: 1095613 - RNA, 19 nt, Homo sapiens
aaacaaagaugcuaaucac

SEQ ID NO: 1095614 - RNA, 19 nt, Homo sapiens
uggaagcgcuagaagguuu

SEQ ID NO: 1095615 - RNA, 19 nt, Homo sapiens
caaugaugcuauacaaugu

SEQ ID NO: 1095616 - RNA, 19 nt, Homo sapiens
ucagaggacuuaucagaca

SEQ ID NO: 1095617 - RNA, 19 nt, Homo sapiens
gagaguuucuggaugaaca

SEQ ID NO: 1095618 - RNA, 19 nt, Homo sapiens
agaagcauccugaguuuaa

SEQ ID NO: 1095619 - RNA, 19 nt, Homo sapiens
gcaguccgcucccauguac

SEQ ID NO: 1095620 - RNA, 19 nt, Homo sapiens
ggacgacaacuuagaggaa

SEQ ID NO: 1095621 - RNA, 19 nt, Homo sapiens
caaugugucuccuacaauc

SEQ ID NO: 1095622 - RNA, 19 nt, Homo sapiens
gcagagaacgaucgcuuug

SEQ ID NO: 1095623 - RNA, 19 nt, Homo sapiens
auaggaaacuguucaagga

SEQ ID NO: 1095624 - RNA, 19 nt, Homo sapiens
cuccaugucuucuccauuu

SEQ ID NO: 1095625 - RNA, 19 nt, Homo sapiens
uaacgcagguagccaaagu

SEQ ID NO: 1095626 - RNA, 19 nt, Homo sapiens
ggaggaagaaccagaggaa

SEQ ID NO: 1095627 - RNA, 19 nt, Homo sapiens
aacaacagcucccagauuc

SEQ ID NO: 1095628 - RNA, 19 nt, Homo sapiens
ggaugaggccuuugcuuug

SEQ ID NO: 1095629 - RNA, 19 nt, Homo sapiens
gaccauggcuggguugaca

SEQ ID NO: 1095630 - RNA, 19 nt, Homo sapiens
guguugacguggagagaua

SEQ ID NO: 1095631 - RNA, 19 nt, Homo sapiens
ucuaugaguuguauucaga

SEQ ID NO: 1095632 - RNA, 19 nt, Homo sapiens
gacaagcaaguaucucuuu

SEQ ID NO: 1095633 - RNA, 19 nt, Homo sapiens
caacuuagaggaacguaau

SEQ ID NO: 1095634 - RNA, 19 nt, Homo sapiens
ggacuuaucagacaugcau

SEQ ID NO: 1095635 - RNA, 19 nt, Homo sapiens
gcacaguccaugggcuuua

SEQ ID NO: 1095636 - RNA, 19 nt, Homo sapiens
ugaaggagaauaaagaguu

SEQ ID NO: 1095637 - RNA, 19 nt, Homo sapiens
gaggacccguucacagcua

SEQ ID NO: 1095638 - RNA, 19 nt, Homo sapiens
aaacaacagcucccagauu

SEQ ID NO: 1095639 - RNA, 19 nt, Homo sapiens
ugacagacagcuagagauu

SEQ ID NO: 1095640 - RNA, 19 nt, Homo sapiens
gaacgaucgcuuugaggaa

SEQ ID NO: 1095641 - RNA, 19 nt, Homo sapiens
ugggagaguuucuggauga

SEQ ID NO: 1095642 - RNA, 19 nt, Homo sapiens
gacaaaugauggucaguac

SEQ ID NO: 1095643 - RNA, 19 nt, Homo sapiens
gaguaacagccacagauaa

SEQ ID NO: 1095644 - RNA, 19 nt, Homo sapiens
gagcucaucagcagcauug

SEQ ID NO: 1095645 - RNA, 19 nt, Homo sapiens
uacaauggcuccaagaucu

SEQ ID NO: 1095646 - RNA, 19 nt, Homo sapiens
ggagaagauuaucaagaag

SEQ ID NO: 1095647 - RNA, 19 nt, Homo sapiens
ggaugucauugucaacaga

SEQ ID NO: 1095648 - RNA, 19 nt, Homo sapiens
gagaagcauccugaguuua

SEQ ID NO: 1095649 - RNA, 19 nt, Homo sapiens
gagaaccucgcgcuugaaa

SEQ ID NO: 1095650 - RNA, 19 nt, Homo sapiens
gacaaucucuuugcuaucg

SEQ ID NO: 1095651 - RNA, 19 nt, Homo sapiens
ugcaucagcuacuuuacua

SEQ ID NO: 1095652 - RNA, 19 nt, Homo sapiens
gauaaagccgagcacugua

SEQ ID NO: 1095653 - RNA, 19 nt, Homo sapiens
ccacagauaaagcaccuaa

SEQ ID NO: 1095654 - RNA, 19 nt, Homo sapiens
cgauauagcucaagauccu

SEQ ID NO: 1095655 - RNA, 19 nt, Homo sapiens
ccagaaagcguuccacaag

SEQ ID NO: 1095656 - RNA, 19 nt, Homo sapiens
gcgcugggaugaggccuuu

SEQ ID NO: 1095657 - RNA, 19 nt, Homo sapiens
caaagaaacaaagaugcua

SEQ ID NO: 1095658 - RNA, 19 nt, Homo sapiens
gcugaagaauggacagauc

SEQ ID NO: 1095659 - RNA, 19 nt, Homo sapiens
cagauggagucucucauuc

SEQ ID NO: 1095660 - RNA, 19 nt, Homo sapiens
gaugaggccuuugcuuugg

SEQ ID NO: 1095661 - RNA, 19 nt, Homo sapiens
caagaccuccgauauuuag

SEQ ID NO: 1095662 - RNA, 19 nt, Homo sapiens
uggacaaucucuuugcuau

SEQ ID NO: 1095663 - RNA, 19 nt, Homo sapiens
cgaaaccggauuccaacua

SEQ ID NO: 1095664 - RNA, 19 nt, Homo sapiens
gugagaagcauccugaguu

SEQ ID NO: 1095665 - RNA, 19 nt, Homo sapiens
acaagaccuccgauauuua

SEQ ID NO: 1095666 - RNA, 19 nt, Homo sapiens
gauggaacucaacugauuu

SEQ ID NO: 1095667 - RNA, 19 nt, Homo sapiens
guaaaggagaagauuauca

SEQ ID NO: 1095668 - RNA, 19 nt, Homo sapiens
ucaaugggaucaucagcau

SEQ ID NO: 1095669 - RNA, 19 nt, Homo sapiens
agaagucugucuccaaaca

SEQ ID NO: 1095670 - RNA, 19 nt, Homo sapiens
ccacaaaacaguaagagua

SEQ ID NO: 1095671 - RNA, 19 nt, Homo sapiens
gaaggagaauaaagaguua

SEQ ID NO: 1095672 - RNA, 19 nt, Homo sapiens
gcagauuacugguuuauga

SEQ ID NO: 1095673 - RNA, 19 nt, Homo sapiens
ggaagcagauuacugguuu

SEQ ID NO: 1095674 - RNA, 19 nt, Homo sapiens
caacagauauauucaggaa

SEQ ID NO: 1095675 - RNA, 19 nt, Homo sapiens
gcacaaugaugcuauacaa

SEQ ID NO: 1095676 - RNA, 19 nt, Homo sapiens
gcagaaaguucggauuaaa

SEQ ID NO: 1095677 - RNA, 19 nt, Homo sapiens
gagcagaaaguucggauua

SEQ ID NO: 1095678 - RNA, 19 nt, Homo sapiens
guacaucccugccagauuc

SEQ ID NO: 1095679 - RNA, 19 nt, Homo sapiens
gaagaugggugaccucaag

SEQ ID NO: 1095680 - RNA, 19 nt, Homo sapiens
gaaaccggauuccaacuau

SEQ ID NO: 1095681 - RNA, 19 nt, Homo sapiens
gagagcagguuuaaugaug

SEQ ID NO: 1095682 - RNA, 19 nt, Homo sapiens
caaggaagccuaccagauu

SEQ ID NO: 1095683 - RNA, 19 nt, Homo sapiens
gggcaucucuaaagugaaa

SEQ ID NO: 1095684 - RNA, 19 nt, Homo sapiens
uacaagaccuccgauauuu

SEQ ID NO: 1095685 - RNA, 19 nt, Homo sapiens
guacaagaccuccgauauu

SEQ ID NO: 1095686 - RNA, 19 nt, Homo sapiens
gaaaucccuuccacucuga

SEQ ID NO: 1095687 - RNA, 19 nt, Homo sapiens
ugagaagcauccugaguuu

SEQ ID NO: 1095688 - RNA, 19 nt, Homo sapiens
gaaacaaagaugcuaauca

SEQ ID NO: 1095689 - RNA, 19 nt, Homo sapiens
gaaccucgcgcuugaaaug

SEQ ID NO: 1095690 - RNA, 19 nt, Homo sapiens
guuauuaucuggacaucaa

SEQ ID NO: 1095691 - RNA, 19 nt, Homo sapiens
gaagcagauuacugguuua

SEQ ID NO: 1095692 - RNA, 19 nt, Homo sapiens
gaaaggaucgggcacugaa

SEQ ID NO: 1095693 - RNA, 19 nt, Homo sapiens
ugauggaacucaacugauu

SEQ ID NO: 1095694 - RNA, 19 nt, Homo sapiens
ggaugacccuggcccauga

SEQ ID NO: 1095695 - RNA, 19 nt, Homo sapiens
gcuagaagguuuagauuuu

SEQ ID NO: 1095696 - RNA, 19 nt, Homo sapiens
uggagucucucauucguua

SEQ ID NO: 1095697 - RNA, 19 nt, Homo sapiens
gcugagaccuaccugaaga

SEQ ID NO: 1095698 - RNA, 19 nt, Homo sapiens
caaagaugcuaaucaccaa

SEQ ID NO: 1095699 - RNA, 19 nt, Homo sapiens
gaacagagagaaugaggau

SEQ ID NO: 1095700 - RNA, 19 nt, Homo sapiens
ggacaaaugauggucagua

SEQ ID NO: 1095701 - RNA, 19 nt, Homo sapiens
aggagaagauuaucaagaa

SEQ ID NO: 1095702 - RNA, 19 nt, Homo sapiens
gccgagcacuguauaaaug

SEQ ID NO: 1095703 - RNA, 19 nt, Homo sapiens
gcagauggagucucucauu

SEQ ID NO: 1095704 - RNA, 19 nt, Homo sapiens
gaaaacagauuggaaagga

SEQ ID NO: 1095705 - RNA, 19 nt, Homo sapiens
uggaaggcauucugaagua

SEQ ID NO: 1095706 - RNA, 19 nt, Homo sapiens
gcagagcuguaccaugguu

SEQ ID NO: 1095707 - RNA, 19 nt, Homo sapiens
gcggagagcagguuuaaug

SEQ ID NO: 1095708 - RNA, 19 nt, Homo sapiens
gggaugaggccuuugcuuu

SEQ ID NO: 1095709 - RNA, 19 nt, Homo sapiens
gaaugaggaugccgaggau

SEQ ID NO: 1095710 - RNA, 19 nt, Homo sapiens
ugaaguacacgcacaauga

SEQ ID NO: 1095711 - RNA, 19 nt, Homo sapiens
gcgcuuugcuucuggauca

SEQ ID NO: 1095712 - RNA, 19 nt, Homo sapiens
aaacaaagaugcuaaucac

SEQ ID NO: 1095713 - RNA, 19 nt, Homo sapiens
uggaagcgcuagaagguuu

SEQ ID NO: 1095714 - RNA, 19 nt, Homo sapiens
caaugaugcuauacaaugu

SEQ ID NO: 1095715 - RNA, 19 nt, Homo sapiens
ucagaggacuuaucagaca

SEQ ID NO: 1095716 - RNA, 19 nt, Homo sapiens
gagaguuucuggaugaaca

SEQ ID NO: 1095717 - RNA, 19 nt, Homo sapiens
agaagcauccugaguuuaa

SEQ ID NO: 1095718 - RNA, 19 nt, Homo sapiens
gcaguccgcucccauguac

SEQ ID NO: 1095719 - RNA, 19 nt, Homo sapiens
ggacgacaacuuagaggaa

SEQ ID NO: 1095720 - RNA, 19 nt, Homo sapiens
caaugugucuccuacaauc

SEQ ID NO: 1095721 - RNA, 19 nt, Homo sapiens
gcagagaacgaucgcuuug

SEQ ID NO: 1095722 - RNA, 19 nt, Homo sapiens
auaggaaacuguucaagga

SEQ ID NO: 1095723 - RNA, 19 nt, Homo sapiens
cuccaugucuucuccauuu

SEQ ID NO: 1095724 - RNA, 19 nt, Homo sapiens
ggaggaagaaccagaggaa

SEQ ID NO: 1095725 - RNA, 19 nt, Homo sapiens
uaacgcagguagccaaagu

SEQ ID NO: 1095726 - RNA, 19 nt, Homo sapiens
aacaacagcucccagauuc

SEQ ID NO: 1095727 - RNA, 19 nt, Homo sapiens
ggaugaggccuuugcuuug

SEQ ID NO: 1095728 - RNA, 19 nt, Homo sapiens
gaccauggcuggguugaca

SEQ ID NO: 1095729 - RNA, 19 nt, Homo sapiens
ucuaugaguuguauucaga

SEQ ID NO: 1095730 - RNA, 19 nt, Homo sapiens
gacaagcaaguaucucuuu

SEQ ID NO: 1095731 - RNA, 19 nt, Homo sapiens
caacuuagaggaacguaau

SEQ ID NO: 1095732 - RNA, 19 nt, Homo sapiens
guguugacguggagagaua

SEQ ID NO: 1095733 - RNA, 19 nt, Homo sapiens
ggacuuaucagacaugcau

SEQ ID NO: 1095734 - RNA, 19 nt, Homo sapiens
gcacaguccaugggcuuua

SEQ ID NO: 1095735 - RNA, 19 nt, Homo sapiens
ugaaggagaauaaagaguu

SEQ ID NO: 1095736 - RNA, 19 nt, Homo sapiens
gaggacccguucacagcua

SEQ ID NO: 1095737 - RNA, 19 nt, Homo sapiens
aaacaacagcucccagauu

SEQ ID NO: 1095738 - RNA, 19 nt, Homo sapiens
ugacagacagcuagagauu

SEQ ID NO: 1095739 - RNA, 19 nt, Homo sapiens
gaacgaucgcuuugaggaa

SEQ ID NO: 1095740 - RNA, 19 nt, Homo sapiens
ugggagaguuucuggauga

SEQ ID NO: 1095741 - RNA, 19 nt, Homo sapiens
gacaaaugauggucaguac

SEQ ID NO: 1095742 - RNA, 19 nt, Homo sapiens
gagcucaucagcagcauug

SEQ ID NO: 1095743 - RNA, 19 nt, Homo sapiens
uacaauggcuccaagaucu

SEQ ID NO: 1095744 - RNA, 19 nt, Homo sapiens
ggagaagauuaucaagaag

SEQ ID NO: 1095745 - RNA, 19 nt, Homo sapiens
ggaugucauugucaacaga

SEQ ID NO: 1095746 - RNA, 19 nt, Homo sapiens
gagaagcauccugaguuua

SEQ ID NO: 1095747 - RNA, 19 nt, Homo sapiens
gagaaccucgcgcuugaaa

SEQ ID NO: 1095748 - RNA, 19 nt, Homo sapiens
gacaaucucuuugcuaucg

SEQ ID NO: 1095749 - RNA, 19 nt, Homo sapiens
ugcaucagcuacuuuacua

SEQ ID NO: 1095750 - RNA, 19 nt, Homo sapiens
gauaaagccgagcacugua

SEQ ID NO: 1095751 - RNA, 19 nt, Homo sapiens
gaaguacacgcacaaugau

SEQ ID NO: 1095752 - RNA, 19 nt, Homo sapiens
cgauauagcucaagauccu

SEQ ID NO: 1095753 - RNA, 19 nt, Homo sapiens
ccagaaagcguuccacaag

SEQ ID NO: 1095754 - RNA, 19 nt, Homo sapiens
gcgcugggaugaggccuuu

SEQ ID NO: 1095755 - RNA, 19 nt, Homo sapiens
caaagaaacaaagaugcua

SEQ ID NO: 1095756 - RNA, 19 nt, Homo sapiens
gcugaagaauggacagauc

SEQ ID NO: 1095757 - RNA, 19 nt, Homo sapiens
cagauggagucucucauuc

SEQ ID NO: 1095758 - RNA, 19 nt, Homo sapiens
gaugaggccuuugcuuugg

SEQ ID NO: 1095759 - RNA, 19 nt, Homo sapiens
caagaccuccgauauuuag

SEQ ID NO: 1095760 - RNA, 19 nt, Homo sapiens
uggacaaucucuuugcuau

SEQ ID NO: 1095761 - RNA, 19 nt, Homo sapiens
cgaaaccggauuccaacua

SEQ ID NO: 1095762 - RNA, 19 nt, Homo sapiens
gauggaacucaacugauuu

SEQ ID NO: 1095763 - RNA, 19 nt, Homo sapiens
gugagaagcauccugaguu

SEQ ID NO: 1095764 - RNA, 19 nt, Homo sapiens
acaagaccuccgauauuua

SEQ ID NO: 1095765 - RNA, 19 nt, Homo sapiens
guaaaggagaagauuauca

SEQ ID NO: 1095766 - RNA, 19 nt, Homo sapiens
ucaaugggaucaucagcau

SEQ ID NO: 1095767 - RNA, 19 nt, Homo sapiens
agaagucugucuccaaaca

SEQ ID NO: 1095768 - RNA, 19 nt, Homo sapiens
gcaagguggcucagaguuc

SEQ ID NO: 1095769 - RNA, 19 nt, Homo sapiens
ccacgacagugaggaguug

SEQ ID NO: 1095770 - RNA, 19 nt, Homo sapiens
ggaugaacagagagaauga

SEQ ID NO: 1095771 - RNA, 19 nt, Homo sapiens
gaaggagaauaaagaguua

SEQ ID NO: 1095772 - RNA, 19 nt, Homo sapiens
gcagauuacugguuuauga

SEQ ID NO: 1095773 - RNA, 19 nt, Homo sapiens
ggaagcagauuacugguuu

SEQ ID NO: 1095774 - RNA, 19 nt, Homo sapiens
gcagaaaguucggauuaaa

SEQ ID NO: 1095775 - RNA, 19 nt, Homo sapiens
gagcagaaaguucggauua

SEQ ID NO: 1095776 - RNA, 19 nt, Homo sapiens
guacaucccugccagauuc

SEQ ID NO: 1095777 - RNA, 19 nt, Homo sapiens
gaagaugggugaccucaag

SEQ ID NO: 1095778 - RNA, 19 nt, Homo sapiens
gaaaccggauuccaacuau

SEQ ID NO: 1095779 - RNA, 19 nt, Homo sapiens
gagagcagguuuaaugaug

SEQ ID NO: 1095780 - RNA, 19 nt, Homo sapiens
caaggaagccuaccagauu

SEQ ID NO: 1095781 - RNA, 19 nt, Homo sapiens
gggcaucucuaaagugaaa

SEQ ID NO: 1095782 - RNA, 19 nt, Homo sapiens
cgauauagcucaagcagau

SEQ ID NO: 1095783 - RNA, 19 nt, Homo sapiens
uacaagaccuccgauauuu

SEQ ID NO: 1095784 - RNA, 19 nt, Homo sapiens
guacaagaccuccgauauu

SEQ ID NO: 1095785 - RNA, 19 nt, Homo sapiens
ugagaagcauccugaguuu

SEQ ID NO: 1095786 - RNA, 19 nt, Homo sapiens
gaaacaaagaugcuaauca

SEQ ID NO: 1095787 - RNA, 19 nt, Homo sapiens
gaaccucgcgcuugaaaug

SEQ ID NO: 1095788 - RNA, 19 nt, Homo sapiens
gaagcagauuacugguuua

SEQ ID NO: 1095789 - RNA, 19 nt, Homo sapiens
gaaaggaucgggcacugaa

SEQ ID NO: 1095790 - RNA, 19 nt, Homo sapiens
ugauggaacucaacugauu

SEQ ID NO: 1095791 - RNA, 19 nt, Homo sapiens
ggaugacccuggcccauga

SEQ ID NO: 1095792 - RNA, 19 nt, Homo sapiens
gcuagaagguuuagauuuu

SEQ ID NO: 1095793 - RNA, 19 nt, Homo sapiens
uggagucucucauucguua

SEQ ID NO: 1095794 - RNA, 19 nt, Homo sapiens
gcugagaccuaccugaaga

SEQ ID NO: 1095795 - RNA, 19 nt, Homo sapiens
caaagaugcuaaucaccaa

SEQ ID NO: 1095796 - RNA, 19 nt, Homo sapiens
ggacaaaugauggucagua

SEQ ID NO: 1095797 - RNA, 19 nt, Homo sapiens
aggagaagauuaucaagaa

SEQ ID NO: 1095798 - RNA, 19 nt, Homo sapiens
gccgagcacuguauaaaug

SEQ ID NO: 1095799 - RNA, 19 nt, Homo sapiens
gcagauggagucucucauu

SEQ ID NO: 1095800 - RNA, 19 nt, Homo sapiens
gaaaacagauuggaaagga

SEQ ID NO: 1095801 - RNA, 19 nt, Homo sapiens
gcagagcuguaccaugguu

SEQ ID NO: 1095802 - RNA, 19 nt, Homo sapiens
gcggagagcagguuuaaug

SEQ ID NO: 1095803 - RNA, 19 nt, Homo sapiens
gggaugaggccuuugcuuu

SEQ ID NO: 1095804 - RNA, 19 nt, Homo sapiens
aaacaaagaugcuaaucac

SEQ ID NO: 1095805 - RNA, 19 nt, Homo sapiens
uggaagcgcuagaagguuu

SEQ ID NO: 1095806 - RNA, 19 nt, Homo sapiens
ucagaggacuuaucagaca

SEQ ID NO: 1095807 - RNA, 19 nt, Homo sapiens
agaagcauccugaguuuaa

SEQ ID NO: 1095808 - RNA, 19 nt, Homo sapiens
gcaguccgcucccauguac

SEQ ID NO: 1095809 - RNA, 19 nt, Homo sapiens
gcagagaacgaucgcuuug

SEQ ID NO: 1095810 - RNA, 19 nt, Homo sapiens
auaggaaacuguucaagga

SEQ ID NO: 1095811 - RNA, 19 nt, Homo sapiens
cuccaugucuucuccauuu

SEQ ID NO: 1095812 - RNA, 19 nt, Homo sapiens
uaacgcagguagccaaagu

SEQ ID NO: 1095813 - RNA, 19 nt, Homo sapiens
aacaacagcucccagauuc

SEQ ID NO: 1095814 - RNA, 19 nt, Homo sapiens
ggaugaggccuuugcuuug

SEQ ID NO: 1095815 - RNA, 19 nt, Homo sapiens
guguugacguggagagaua

SEQ ID NO: 1095816 - RNA, 19 nt, Homo sapiens
gaccauggcuggguugaca

SEQ ID NO: 1095817 - RNA, 19 nt, Homo sapiens
ucuaugaguuguauucaga

SEQ ID NO: 1095818 - RNA, 19 nt, Homo sapiens
gacaagcaaguaucucuuu

SEQ ID NO: 1095819 - RNA, 19 nt, Homo sapiens
ggacuuaucagacaugcau

SEQ ID NO: 1095820 - RNA, 19 nt, Homo sapiens
gcacaguccaugggcuuua

SEQ ID NO: 1095821 - RNA, 19 nt, Homo sapiens
ugaaggagaauaaagaguu

SEQ ID NO: 1095822 - RNA, 19 nt, Homo sapiens
gaggacccguucacagcua

SEQ ID NO: 1095823 - RNA, 19 nt, Homo sapiens
aaacaacagcucccagauu

SEQ ID NO: 1095824 - RNA, 19 nt, Homo sapiens
ugacagacagcuagagauu

SEQ ID NO: 1095825 - RNA, 19 nt, Homo sapiens
gaacgaucgcuuugaggaa

SEQ ID NO: 1095826 - RNA, 19 nt, Homo sapiens
gacaaaugauggucaguac

SEQ ID NO: 1095827 - RNA, 19 nt, Homo sapiens
gagcucaucagcagcauug

SEQ ID NO: 1095828 - RNA, 19 nt, Homo sapiens
uacaauggcuccaagaucu

SEQ ID NO: 1095829 - RNA, 19 nt, Homo sapiens
ggagaagauuaucaagaag

SEQ ID NO: 1095830 - RNA, 19 nt, Homo sapiens
gagaagcauccugaguuua

SEQ ID NO: 1095831 - RNA, 19 nt, Homo sapiens
gagaaccucgcgcuugaaa

SEQ ID NO: 1095832 - RNA, 19 nt, Homo sapiens
gacaaucucuuugcuaucg

SEQ ID NO: 1095833 - RNA, 19 nt, Homo sapiens
gauaaagccgagcacugua

SEQ ID NO: 1095834 - RNA, 19 nt, Homo sapiens
ugcaucagcuacuuuacua

SEQ ID NO: 1095835 - RNA, 19 nt, Homo sapiens
ccagaaagcguuccacaag

SEQ ID NO: 1095836 - RNA, 19 nt, Homo sapiens
gcgcugggaugaggccuuu

SEQ ID NO: 1095837 - RNA, 19 nt, Homo sapiens
caaagaaacaaagaugcua

SEQ ID NO: 1095838 - RNA, 19 nt, Homo sapiens
gcugaagaauggacagauc

SEQ ID NO: 1095839 - RNA, 19 nt, Homo sapiens
cagauggagucucucauuc

SEQ ID NO: 1095840 - RNA, 19 nt, Homo sapiens
gaugaggccuuugcuuugg

SEQ ID NO: 1095841 - RNA, 19 nt, Homo sapiens
caagaccuccgauauuuag

SEQ ID NO: 1095842 - RNA, 19 nt, Homo sapiens
uggacaaucucuuugcuau

SEQ ID NO: 1095843 - RNA, 19 nt, Homo sapiens
cgaaaccggauuccaacua

SEQ ID NO: 1095844 - RNA, 19 nt, Homo sapiens
gcuggaacccuucaagaga

SEQ ID NO: 1095845 - RNA, 19 nt, Homo sapiens
gugagaagcauccugaguu

SEQ ID NO: 1095846 - RNA, 19 nt, Homo sapiens
acaagaccuccgauauuua

SEQ ID NO: 1095847 - RNA, 19 nt, Homo sapiens
gauggaacucaacugauuu

SEQ ID NO: 1095848 - RNA, 19 nt, Homo sapiens
guaaaggagaagauuauca

SEQ ID NO: 1095849 - RNA, 19 nt, Homo sapiens
ucaaugggaucaucagcau

SEQ ID NO: 1095850 - RNA, 19 nt, Homo sapiens
agaagucugucuccaaaca

SEQ ID NO: 1095851 - RNA, 19 nt, Homo sapiens
gcaagguggcucagaguuc

SEQ ID NO: 1095852 - RNA, 19 nt, Homo sapiens
ccacgacagugaggaguug

SEQ ID NO: 1095853 - RNA, 19 nt, Homo sapiens
gggcugugaaggagaauaa

SEQ ID NO: 1095854 - RNA, 19 nt, Homo sapiens
uaaagccgagcacuguaua

SEQ ID NO: 1095855 - RNA, 19 nt, Homo sapiens
gaugacagacagcuagaga

SEQ ID NO: 1095856 - RNA, 19 nt, Homo sapiens
ucgggcaucucuaaaguga

SEQ ID NO: 1095857 - RNA, 19 nt, Homo sapiens
gugaggacaugcucugcuu

SEQ ID NO: 1095858 - RNA, 19 nt, Homo sapiens
ggguaaaggagaagauuau

SEQ ID NO: 1095859 - RNA, 19 nt, Homo sapiens
ccugaucacugagcagaaa

SEQ ID NO: 1095860 - RNA, 19 nt, Homo sapiens
uccaugggcuuuacaagga

SEQ ID NO: 1095861 - RNA, 19 nt, Homo sapiens
ggaagcgcuagaagguuua

SEQ ID NO: 1095862 - RNA, 19 nt, Homo sapiens
ggcgugaacuggccaugga

SEQ ID NO: 1095863 - RNA, 19 nt, Homo sapiens
aaggaagccuaccagauug

SEQ ID NO: 1095864 - RNA, 19 nt, Homo sapiens
gagaagauuaucaagaagu

SEQ ID NO: 1095865 - RNA, 19 nt, Homo sapiens
gaaaucgauuggcuaucca

SEQ ID NO: 1095866 - RNA, 19 nt, Homo sapiens
gcugggcugugaaggagaa

SEQ ID NO: 1095867 - RNA, 19 nt, Homo sapiens
acaacccgcugcucaacaa

SEQ ID NO: 1095868 - RNA, 19 nt, Homo sapiens
gauggagucucucauucgu

SEQ ID NO: 1095869 - RNA, 19 nt, Homo sapiens
gagaaaauccucaucuaug

SEQ ID NO: 1095870 - RNA, 19 nt, Homo sapiens
gaucgggcacugaacuuug

SEQ ID NO: 1095871 - RNA, 19 nt, Homo sapiens
caagaacucuggugucuga

SEQ ID NO: 1095872 - RNA, 19 nt, Homo sapiens
cuacagagcuggaauugug

SEQ ID NO: 1095873 - RNA, 19 nt, Homo sapiens
cugagaaggugguuauuua

SEQ ID NO: 1095874 - RNA, 19 nt, Homo sapiens
cugaugagaugcugaauuu

SEQ ID NO: 1095875 - RNA, 19 nt, Homo sapiens
gagcuaagaccuuuuauua

SEQ ID NO: 1095876 - RNA, 19 nt, Homo sapiens
gaucggagcggcuuacaaa

SEQ ID NO: 1095877 - RNA, 19 nt, Homo sapiens
gagaaggugguuauuuaua

SEQ ID NO: 1095878 - RNA, 19 nt, Homo sapiens
gcaccaccaugccugcuaa

SEQ ID NO: 1095879 - RNA, 19 nt, Homo sapiens
gcccugaccuaaggauuua

SEQ ID NO: 1095880 - RNA, 19 nt, Homo sapiens
gaagcugccugugcuaaga

SEQ ID NO: 1095881 - RNA, 19 nt, Homo sapiens
gaaggugguuauuuauaca

SEQ ID NO: 1095882 - RNA, 19 nt, Homo sapiens
ggucaaaggucaguauauc

SEQ ID NO: 1095883 - RNA, 19 nt, Homo sapiens
uaagcguccuuuacauuaa

SEQ ID NO: 1095884 - RNA, 19 nt, Homo sapiens
cauguuaccuggacuggaa

SEQ ID NO: 1095885 - RNA, 19 nt, Homo sapiens
ugagaaagcaacugaauug

SEQ ID NO: 1095886 - RNA, 19 nt, Homo sapiens
gacagccucuaucuccuua

SEQ ID NO: 1095887 - RNA, 19 nt, Homo sapiens
gcaagucuuuguaccugaa

SEQ ID NO: 1095888 - RNA, 19 nt, Homo sapiens
gccucuaucuccuuauaua

SEQ ID NO: 1095889 - RNA, 19 nt, Homo sapiens
cuaagcguccuuuacauua

SEQ ID NO: 1095890 - RNA, 19 nt, Homo sapiens
cagccucuaucuccuuaua

SEQ ID NO: 1095891 - RNA, 19 nt, Homo sapiens
ccaccaugccugcuaauuu

SEQ ID NO: 1095892 - RNA, 19 nt, Homo sapiens
ggaccugcuucaaugagaa

SEQ ID NO: 1095893 - RNA, 19 nt, Homo sapiens
ggacagcagccacccuuug

SEQ ID NO: 1095894 - RNA, 19 nt, Homo sapiens
cccaagggcugaugagaug

SEQ ID NO: 1095895 - RNA, 19 nt, Homo sapiens
gaucaucagccagguguaa

SEQ ID NO: 1095896 - RNA, 19 nt, Homo sapiens
gcaccuggcauuucucuca

SEQ ID NO: 1095897 - RNA, 19 nt, Homo sapiens
gagcugaguucugacuuca

SEQ ID NO: 1095898 - RNA, 19 nt, Homo sapiens
cagaagcccugaccuaagg

SEQ ID NO: 1095899 - RNA, 19 nt, Homo sapiens
ggaagaggaaucccaagug

SEQ ID NO: 1095900 - RNA, 19 nt, Homo sapiens
ccugugauaugauuauguu

SEQ ID NO: 1095901 - RNA, 19 nt, Homo sapiens
gcaaaugccgaaguuaaau

SEQ ID NO: 1095902 - RNA, 19 nt, Homo sapiens
ggagagggagucacaguuc

SEQ ID NO: 1095903 - RNA, 19 nt, Homo sapiens
gcucugugcucugguucua

SEQ ID NO: 1095904 - RNA, 19 nt, Homo sapiens
agggagagcugaguucuga

SEQ ID NO: 1095905 - RNA, 19 nt, Homo sapiens
gaagauggccuggacaaac

SEQ ID NO: 1095906 - RNA, 19 nt, Homo sapiens
agaaggugguuauuuauac

SEQ ID NO: 1095907 - RNA, 19 nt, Homo sapiens
ucaaagugcugggauuaca

SEQ ID NO: 1095908 - RNA, 19 nt, Homo sapiens
ucaaugagaaagcaacuga

SEQ ID NO: 1095909 - RNA, 19 nt, Homo sapiens
uuucuaaugugcucuguga

SEQ ID NO: 1095910 - RNA, 19 nt, Homo sapiens
gacagcagccacccuuuga

SEQ ID NO: 1095911 - RNA, 19 nt, Homo sapiens
gugaauacccugcuuggau

SEQ ID NO: 1095912 - RNA, 19 nt, Homo sapiens
ugacuucaccugugcagaa

SEQ ID NO: 1095913 - RNA, 19 nt, Homo sapiens
aagauggccuggacaaaca

SEQ ID NO: 1095914 - RNA, 19 nt, Homo sapiens
gcaccuugccagcggagua

SEQ ID NO: 1095915 - RNA, 19 nt, Homo sapiens
ucuggugucugaccuagaa

SEQ ID NO: 1095916 - RNA, 19 nt, Homo sapiens
ucaguggcaucacaguuug

SEQ ID NO: 1095917 - RNA, 19 nt, Homo sapiens
uagcagaagguuccaagaa

SEQ ID NO: 1095918 - RNA, 19 nt, Homo sapiens
gagaaagcaacugaauuga

SEQ ID NO: 1095919 - RNA, 19 nt, Homo sapiens
gcucugagaaggugguuau

SEQ ID NO: 1095920 - RNA, 19 nt, Homo sapiens
caccaugccugcuaauuuu

SEQ ID NO: 1095921 - RNA, 19 nt, Homo sapiens
gcucugacgucuccagcau

SEQ ID NO: 1095922 - RNA, 19 nt, Homo sapiens
ggaagauggccuggacaaa

SEQ ID NO: 1095923 - RNA, 19 nt, Homo sapiens
gcuccaggcuaccuacaca

SEQ ID NO: 1095924 - RNA, 19 nt, Homo sapiens
gggaccugcuucaaugaga

SEQ ID NO: 1095925 - RNA, 19 nt, Homo sapiens
ccuagggccuucuuugcuu

SEQ ID NO: 1095926 - RNA, 19 nt, Homo sapiens
auacaaacauggacauacu

SEQ ID NO: 1095927 - RNA, 19 nt, Homo sapiens
gcuggaggcuggacauggu

SEQ ID NO: 1095928 - RNA, 19 nt, Homo sapiens
gcucuuaccgcaucagcaa

SEQ ID NO: 1095929 - RNA, 19 nt, Homo sapiens
ccauggagaguaaggauga

SEQ ID NO: 1095930 - RNA, 19 nt, Homo sapiens
gaacuccugaccucaagug

SEQ ID NO: 1095931 - RNA, 19 nt, Homo sapiens
gguccaugcuugugguuag

SEQ ID NO: 1095932 - RNA, 19 nt, Homo sapiens
caaaugccgaaguuaaaug

SEQ ID NO: 1095933 - RNA, 19 nt, Homo sapiens
ccacugcuccuucuaacau

SEQ ID NO: 1095934 - RNA, 19 nt, Homo sapiens
gucaguggcaucacaguuu

SEQ ID NO: 1095935 - RNA, 19 nt, Homo sapiens
cugcaaaugccgaaguuaa

SEQ ID NO: 1095936 - RNA, 19 nt, Homo sapiens
ccuaagcguccuuuacauu

SEQ ID NO: 1095937 - RNA, 19 nt, Homo sapiens
ccgaugaccuggagcuaag

SEQ ID NO: 1095938 - RNA, 19 nt, Homo sapiens
gagaagcccaggaagucuu

SEQ ID NO: 1095939 - RNA, 19 nt, Homo sapiens
cggagcggcuuacaaacug

SEQ ID NO: 1095940 - RNA, 19 nt, Homo sapiens
gcugaugagaugcugaauu

SEQ ID NO: 1095941 - RNA, 19 nt, Homo sapiens
gcaccuggcccuucuaacg

SEQ ID NO: 1095942 - RNA, 19 nt, Homo sapiens
cugaguagcugggauuaca

SEQ ID NO: 1095943 - RNA, 19 nt, Homo sapiens
ucucucuacuggaaagaaa

SEQ ID NO: 1095944 - RNA, 19 nt, Homo sapiens
ugagaaggugguuauuuau

SEQ ID NO: 1095945 - RNA, 19 nt, Homo sapiens
gcuagacccugcuauuuuc

SEQ ID NO: 1095946 - RNA, 19 nt, Homo sapiens
gggaagauggccuggacaa

SEQ ID NO: 1095947 - RNA, 19 nt, Homo sapiens
ugacugggccuugcacaga

SEQ ID NO: 1095948 - RNA, 19 nt, Homo sapiens
ggaagcuccaggcuaccua

SEQ ID NO: 1095949 - RNA, 19 nt, Homo sapiens
caccuaagcguccuuuaca

SEQ ID NO: 1095950 - RNA, 19 nt, Homo sapiens
gaggcacaguucucucuac

SEQ ID NO: 1095951 - RNA, 19 nt, Homo sapiens
ugcaaaugccgaaguuaaa

SEQ ID NO: 1095952 - RNA, 19 nt, Homo sapiens
augccgaaguuaaaugaaa

SEQ ID NO: 1095953 - RNA, 19 nt, Homo sapiens
gguguauugucuugcuaga

SEQ ID NO: 1095954 - RNA, 19 nt, Homo sapiens
guaggucaaaggucaguau

SEQ ID NO: 1095955 - RNA, 19 nt, Homo sapiens
ggacaugguacauacucau

SEQ ID NO: 1095956 - RNA, 19 nt, Homo sapiens
gaacagccccuggaaggaa

SEQ ID NO: 1095957 - RNA, 19 nt, Homo sapiens
ggcugugccuggaggagaa

SEQ ID NO: 1095958 - RNA, 19 nt, Homo sapiens
gccgaaguuaaaugaaaua

SEQ ID NO: 1095959 - RNA, 19 nt, Homo sapiens
gggagagggagucacaguu

SEQ ID NO: 1095960 - RNA, 19 nt, Homo sapiens
cuccugaccucaagugauc

SEQ ID NO: 1095961 - RNA, 19 nt, Homo sapiens
gguacauacucaugcacau

SEQ ID NO: 1095962 - RNA, 19 nt, Homo sapiens
caauaccccugugauauga

SEQ ID NO: 1095963 - RNA, 19 nt, Homo sapiens
ccuagaagaggcacaguuc

SEQ ID NO: 1095964 - RNA, 19 nt, Homo sapiens
ggaagcugccugugcuaag

SEQ ID NO: 1095965 - RNA, 19 nt, Homo sapiens
gaugagaugcugaauuuuc

SEQ ID NO: 1095966 - RNA, 19 nt, Homo sapiens
uuucaaagugcugggauua

SEQ ID NO: 1095967 - RNA, 19 nt, Homo sapiens
ccaccugccuuggccuuuc

SEQ ID NO: 1095968 - RNA, 19 nt, Homo sapiens
aaaugccgaaguuaaauga

SEQ ID NO: 1095969 - RNA, 19 nt, Homo sapiens
ccucuaucuccuuauauaa

SEQ ID NO: 1095970 - RNA, 19 nt, Homo sapiens
ccuaugagaagcccaggaa

SEQ ID NO: 1095971 - RNA, 19 nt, Homo sapiens
gaaauaggcucaaugaaua

SEQ ID NO: 1095972 - RNA, 19 nt, Homo sapiens
ggauugagauuguucauuu

SEQ ID NO: 1095973 - RNA, 19 nt, Homo sapiens
ggaaagauaggaccaaaua

SEQ ID NO: 1095974 - RNA, 19 nt, Homo sapiens
acacuaagauucccauaua

SEQ ID NO: 1095975 - RNA, 19 nt, Homo sapiens
uaaaggacauccacaauuc

SEQ ID NO: 1095976 - RNA, 19 nt, Homo sapiens
ggauucaucuuuccuguga

SEQ ID NO: 1095977 - RNA, 19 nt, Homo sapiens
ggguauggguuuauccuua

SEQ ID NO: 1095978 - RNA, 19 nt, Homo sapiens
gagaucagcuucuguuagu

SEQ ID NO: 1095979 - RNA, 19 nt, Homo sapiens
ggaagugucugcggccaua

SEQ ID NO: 1095980 - RNA, 19 nt, Homo sapiens
ggaauuacuucucccaugu

SEQ ID NO: 1095981 - RNA, 19 nt, Homo sapiens
gauccugucuucaucauau

SEQ ID NO: 1095982 - RNA, 19 nt, Homo sapiens
ggaguaacuuuccgucuug

SEQ ID NO: 1095983 - RNA, 19 nt, Homo sapiens
ucucggagcucacuuuauu

SEQ ID NO: 1095984 - RNA, 19 nt, Homo sapiens
aaagugauguugucaaguu

SEQ ID NO: 1095985 - RNA, 19 nt, Homo sapiens
gguagcggcuggcccauuu

SEQ ID NO: 1095986 - RNA, 19 nt, Homo sapiens
gauaggaccaaauauguaa

SEQ ID NO: 1095987 - RNA, 19 nt, Homo sapiens
gagaaucgguuugacuuug

SEQ ID NO: 1095988 - RNA, 19 nt, Homo sapiens
guacacaccucuguuagga

SEQ ID NO: 1095989 - RNA, 19 nt, Homo sapiens
gaccaggaauccacauuga

SEQ ID NO: 1095990 - RNA, 19 nt, Homo sapiens
ccacuagccugaagcaaug

SEQ ID NO: 1095991 - RNA, 19 nt, Homo sapiens
ucaaguuucuagcuucaua

SEQ ID NO: 1095992 - RNA, 19 nt, Homo sapiens
guucuuacccaacaaauaa

SEQ ID NO: 1095993 - RNA, 19 nt, Homo sapiens
gguuuauccuuauagguua

SEQ ID NO: 1095994 - RNA, 19 nt, Homo sapiens
guaaacagcauucuagcaa

SEQ ID NO: 1095995 - RNA, 19 nt, Homo sapiens
gaaggaaacguucaauaag

SEQ ID NO: 1095996 - RNA, 19 nt, Homo sapiens
gaaugaggccaaccagauu

SEQ ID NO: 1095997 - RNA, 19 nt, Homo sapiens
ggaguagagcugugaauga

SEQ ID NO: 1095998 - RNA, 19 nt, Homo sapiens
guacaaagugauaggagua

SEQ ID NO: 1095999 - RNA, 19 nt, Homo sapiens
ccuaguagcugcugugcuu

SEQ ID NO: 1096000 - RNA, 19 nt, Homo sapiens
cgagauguucugcuauuua

SEQ ID NO: 1096001 - RNA, 19 nt, Homo sapiens
agaaauaggcucaaugaau

SEQ ID NO: 1096002 - RNA, 19 nt, Homo sapiens
gguauggguuuauccuuau

SEQ ID NO: 1096003 - RNA, 19 nt, Homo sapiens
gagauguucugcuauuuac

SEQ ID NO: 1096004 - RNA, 19 nt, Homo sapiens
guaccucucugcugugugu

SEQ ID NO: 1096005 - RNA, 19 nt, Homo sapiens
ggaccaaguucugggaaga

SEQ ID NO: 1096006 - RNA, 19 nt, Homo sapiens
guggaugaaugauggaauu

SEQ ID NO: 1096007 - RNA, 19 nt, Homo sapiens
ggacauccacaauucaaug

SEQ ID NO: 1096008 - RNA, 19 nt, Homo sapiens
gauuucacaucuuuggauu

SEQ ID NO: 1096009 - RNA, 19 nt, Homo sapiens
uaguuuaccucauagaguu

SEQ ID NO: 1096010 - RNA, 19 nt, Homo sapiens
gcuauuuacucugugguuu

SEQ ID NO: 1096011 - RNA, 19 nt, Homo sapiens
guuaggaggcaaauuauug

SEQ ID NO: 1096012 - RNA, 19 nt, Homo sapiens
uaacauugcagcgccuuua

SEQ ID NO: 1096013 - RNA, 19 nt, Homo sapiens
ucuguuaggaggcaaauua

SEQ ID NO: 1096014 - RNA, 19 nt, Homo sapiens
gaguagagcugugaaugag

SEQ ID NO: 1096015 - RNA, 19 nt, Homo sapiens
ccaggaauccacauugaaa

SEQ ID NO: 1096016 - RNA, 19 nt, Homo sapiens
aaagauaggaccaaauaug

SEQ ID NO: 1096017 - RNA, 19 nt, Homo sapiens
caagaagaccaggauaauu

SEQ ID NO: 1096018 - RNA, 19 nt, Homo sapiens
aaacagcauucuagcaauc

SEQ ID NO: 1096019 - RNA, 19 nt, Homo sapiens
caacaagaagaccaggaua

SEQ ID NO: 1096020 - RNA, 19 nt, Homo sapiens
ggaacaaaaugcauauaug

SEQ ID NO: 1096021 - RNA, 19 nt, Homo sapiens
gagagaucagcuucuguua

SEQ ID NO: 1096022 - RNA, 19 nt, Homo sapiens
gcaacgacgaggaguuaaa

SEQ ID NO: 1096023 - RNA, 19 nt, Homo sapiens
cauccacaauucaauguau

SEQ ID NO: 1096024 - RNA, 19 nt, Homo sapiens
guauggguuuauccuuaua

SEQ ID NO: 1096025 - RNA, 19 nt, Homo sapiens
gguucgagauguucugcua

SEQ ID NO: 1096026 - RNA, 19 nt, Homo sapiens
gaaagauaggaccaaauau

SEQ ID NO: 1096027 - RNA, 19 nt, Homo sapiens
aaggaaacguucaauaagu

SEQ ID NO: 1096028 - RNA, 19 nt, Homo sapiens
gcaaauuauugggcagguu

SEQ ID NO: 1096029 - RNA, 19 nt, Homo sapiens
gaugaaugauggaauuacu

SEQ ID NO: 1096030 - RNA, 19 nt, Homo sapiens
gccaggcucuguacaaagu

SEQ ID NO: 1096031 - RNA, 19 nt, Homo sapiens
ucacaucuuuggauucauc

SEQ ID NO: 1096032 - RNA, 19 nt, Homo sapiens
ggcacaauauugcuuuaau

SEQ ID NO: 1096033 - RNA, 19 nt, Homo sapiens
uaaacagcauucuagcaau

SEQ ID NO: 1096034 - RNA, 19 nt, Homo sapiens
aagaagaccaggauaauuc

SEQ ID NO: 1096035 - RNA, 19 nt, Homo sapiens
gucaugagguuggaaauuc

SEQ ID NO: 1096036 - RNA, 19 nt, Homo sapiens
caacuugagauucuuccua

SEQ ID NO: 1096037 - RNA, 19 nt, Homo sapiens
cuagcaauccuucgacuuu

SEQ ID NO: 1096038 - RNA, 19 nt, Homo sapiens
ugaaacagguaaacagcau

SEQ ID NO: 1096039 - RNA, 19 nt, Homo sapiens
guucugcuauuuacucugu

SEQ ID NO: 1096040 - RNA, 19 nt, Homo sapiens
ggaaacguucaauaaguga

SEQ ID NO: 1096041 - RNA, 19 nt, Homo sapiens
uuaaaggacauccacaauu

SEQ ID NO: 1096042 - RNA, 19 nt, Homo sapiens
ugacacuccuauuuauuuc

SEQ ID NO: 1096043 - RNA, 19 nt, Homo sapiens
ggguuuauccuuauagguu

SEQ ID NO: 1096044 - RNA, 19 nt, Homo sapiens
ccaaccagauuuccacucu

SEQ ID NO: 1096045 - RNA, 19 nt, Homo sapiens
caucuucugcccuuaauug

SEQ ID NO: 1096046 - RNA, 19 nt, Homo sapiens
gaagauaccgucggaucga

SEQ ID NO: 1096047 - RNA, 19 nt, Homo sapiens
ggcgagaggugaucauguc

SEQ ID NO: 1096048 - RNA, 19 nt, Homo sapiens
cagcuucuguuaguacuug

SEQ ID NO: 1096049 - RNA, 19 nt, Homo sapiens
uuaaagugauguugucaag

SEQ ID NO: 1096050 - RNA, 19 nt, Homo sapiens
acagucauauugcauaaca

SEQ ID NO: 1096051 - RNA, 19 nt, Homo sapiens
cuaagauucccauauagaa

SEQ ID NO: 1096052 - RNA, 19 nt, Homo sapiens
gaaauucguuccccugaca

SEQ ID NO: 1096053 - RNA, 19 nt, Homo sapiens
uggaguaacuuuccgucuu

SEQ ID NO: 1096054 - RNA, 19 nt, Homo sapiens
ccgcaacgacgaggaguua

SEQ ID NO: 1096055 - RNA, 19 nt, Homo sapiens
ugagauuguucauuuacug

SEQ ID NO: 1096056 - RNA, 19 nt, Homo sapiens
gccguacacaccucuguua

SEQ ID NO: 1096057 - RNA, 19 nt, Homo sapiens
gaagacgggacaaggaaca

SEQ ID NO: 1096058 - RNA, 19 nt, Homo sapiens
ugaaugaggccaaccagau

SEQ ID NO: 1096059 - RNA, 19 nt, Homo sapiens
uuacauaugcuugagcuuu

SEQ ID NO: 1096060 - RNA, 19 nt, Homo sapiens
aggaaacguucaauaagug

SEQ ID NO: 1096061 - RNA, 19 nt, Homo sapiens
uagcugcugugcuuucaug

SEQ ID NO: 1096062 - RNA, 19 nt, Homo sapiens
ugugauagcaaaccauaaa

SEQ ID NO: 1096063 - RNA, 19 nt, Homo sapiens
auagaaauaggcucaauga

SEQ ID NO: 1096064 - RNA, 19 nt, Homo sapiens
ugagugaauuaaugugugu

SEQ ID NO: 1096065 - RNA, 19 nt, Homo sapiens
gaauuacuucucccauguu

SEQ ID NO: 1096066 - RNA, 19 nt, Homo sapiens
ugagagaucagcuucuguu

SEQ ID NO: 1096067 - RNA, 19 nt, Homo sapiens
ugaacucucuuauauucuc

SEQ ID NO: 1096068 - RNA, 19 nt, Homo sapiens
auaagugagucaugagguu

SEQ ID NO: 1096069 - RNA, 19 nt, Homo sapiens
gaaacagguaaacagcauu

SEQ ID NO: 1096070 - RNA, 19 nt, Homo sapiens
caaugaauaguagcuguuu

SEQ ID NO: 1096071 - RNA, 19 nt, Homo sapiens
gcaagaagcuuuccuaugu

SEQ ID NO: 1096072 - RNA, 19 nt, Homo sapiens
cagaggagcuguugaaugu

SEQ ID NO: 1096073 - RNA, 19 nt, Homo sapiens
gaacuucuccagaggauaa

SEQ ID NO: 1096074 - RNA, 19 nt, Homo sapiens
gaaguagucuguugguuca

SEQ ID NO: 1096075 - RNA, 19 nt, Homo sapiens
gaggagcuguugaauguuu

SEQ ID NO: 1096076 - RNA, 19 nt, Homo sapiens
caaaggaaguggaagauca

SEQ ID NO: 1096077 - RNA, 19 nt, Homo sapiens
cuaaacagcuccaccuuug

SEQ ID NO: 1096078 - RNA, 19 nt, Homo sapiens
agaaacacaucucaucuuu

SEQ ID NO: 1096079 - RNA, 19 nt, Homo sapiens
gcaaucgauucccaagaua

SEQ ID NO: 1096080 - RNA, 19 nt, Homo sapiens
ugaaaugggucuacagaga

SEQ ID NO: 1096081 - RNA, 19 nt, Homo sapiens
gaagaacuaagguuaaaga

SEQ ID NO: 1096082 - RNA, 19 nt, Homo sapiens
ggagcuuguugaauuuaua

SEQ ID NO: 1096083 - RNA, 19 nt, Homo sapiens
cagaagaacuaagguuaaa

SEQ ID NO: 1096084 - RNA, 19 nt, Homo sapiens
aauaagagccacaaaguaa

SEQ ID NO: 1096085 - RNA, 19 nt, Homo sapiens
ucagaaacccuaaugauga

SEQ ID NO: 1096086 - RNA, 19 nt, Homo sapiens
gaaaugggucuacagagaa

SEQ ID NO: 1096087 - RNA, 19 nt, Homo sapiens
caauauaagugaugaggau

SEQ ID NO: 1096088 - RNA, 19 nt, Homo sapiens
gcacugugaugcaugugaa

SEQ ID NO: 1096089 - RNA, 19 nt, Homo sapiens
acaagccacuccuuuauga

SEQ ID NO: 1096090 - RNA, 19 nt, Homo sapiens
cagaaacccuaaugaugaa

SEQ ID NO: 1096091 - RNA, 19 nt, Homo sapiens
gaauggaaauugcgaucug

SEQ ID NO: 1096092 - RNA, 19 nt, Homo sapiens
gaaagaucguuauguucga

SEQ ID NO: 1096093 - RNA, 19 nt, Homo sapiens
gagaguagcccgaggugaa

SEQ ID NO: 1096094 - RNA, 19 nt, Homo sapiens
gcuguugaauguuuauuug

SEQ ID NO: 1096095 - RNA, 19 nt, Homo sapiens
ugugaaagaucguuauguu

SEQ ID NO: 1096096 - RNA, 19 nt, Homo sapiens
caaauaagagccacaaagu

SEQ ID NO: 1096097 - RNA, 19 nt, Homo sapiens
cuggauggcucaaauaaga

SEQ ID NO: 1096098 - RNA, 19 nt, Homo sapiens
gaaccugaacauuauagaa

SEQ ID NO: 1096099 - RNA, 19 nt, Homo sapiens
guuugaagcucgcuauguu

SEQ ID NO: 1096100 - RNA, 19 nt, Homo sapiens
uuugagaaccugaacauua

SEQ ID NO: 1096101 - RNA, 19 nt, Homo sapiens
gccagaagaacuaagguua

SEQ ID NO: 1096102 - RNA, 19 nt, Homo sapiens
gaaaaguuaucgagagcua

SEQ ID NO: 1096103 - RNA, 19 nt, Homo sapiens
gccacuccuuuaugaaaua

SEQ ID NO: 1096104 - RNA, 19 nt, Homo sapiens
gcgagugggccaauuguuu

SEQ ID NO: 1096105 - RNA, 19 nt, Homo sapiens
gauauaauaacccugagaa

SEQ ID NO: 1096106 - RNA, 19 nt, Homo sapiens
ccaagcugcugcucaccua

SEQ ID NO: 1096107 - RNA, 19 nt, Homo sapiens
uugagaaccugaacauuau

SEQ ID NO: 1096108 - RNA, 19 nt, Homo sapiens
aagcuuaaaugaccaugaa

SEQ ID NO: 1096109 - RNA, 19 nt, Homo sapiens
gaauuaagcagaggagaug

SEQ ID NO: 1096110 - RNA, 19 nt, Homo sapiens
gaugucacuuggcgauauu

SEQ ID NO: 1096111 - RNA, 19 nt, Homo sapiens
uaauaacccugagaaacuu

SEQ ID NO: 1096112 - RNA, 19 nt, Homo sapiens
uagaaaagcuggcaauaau

SEQ ID NO: 1096113 - RNA, 19 nt, Homo sapiens
ccagaagaacuaagguuaa

SEQ ID NO: 1096114 - RNA, 19 nt, Homo sapiens
gugacaagccacuccuuua

SEQ ID NO: 1096115 - RNA, 19 nt, Homo sapiens
ugacucagccauucuagaa

SEQ ID NO: 1096116 - RNA, 19 nt, Homo sapiens
guacccagcuuccuacaac

SEQ ID NO: 1096117 - RNA, 19 nt, Homo sapiens
aaacacaucucaucuuucc

SEQ ID NO: 1096118 - RNA, 19 nt, Homo sapiens
uuacuucgagacacuauua

SEQ ID NO: 1096119 - RNA, 19 nt, Homo sapiens
caucucaucuuuccuaaaa

SEQ ID NO: 1096120 - RNA, 19 nt, Homo sapiens
cagaggagauggugauguc

SEQ ID NO: 1096121 - RNA, 19 nt, Homo sapiens
gaaauugcgaucugauaca

SEQ ID NO: 1096122 - RNA, 19 nt, Homo sapiens
cgauauuccugcaaacaug

SEQ ID NO: 1096123 - RNA, 19 nt, Homo sapiens
cugccgagcuguaggguuu

SEQ ID NO: 1096124 - RNA, 19 nt, Homo sapiens
gaaguggggugcaaaggaa

SEQ ID NO: 1096125 - RNA, 19 nt, Homo sapiens
gcacugguuuaaggaagaa

SEQ ID NO: 1096126 - RNA, 19 nt, Homo sapiens
cuacaacaccaucuucaaa

SEQ ID NO: 1096127 - RNA, 19 nt, Homo sapiens
aaauaagagccacaaagua

SEQ ID NO: 1096128 - RNA, 19 nt, Homo sapiens
uaacagucuucacuccuau

SEQ ID NO: 1096129 - RNA, 19 nt, Homo sapiens
aaaugggucuacagagaaa

SEQ ID NO: 1096130 - RNA, 19 nt, Homo sapiens
gaacugacaggcgauaaca

SEQ ID NO: 1096131 - RNA, 19 nt, Homo sapiens
gucaguggcuuggagagua

SEQ ID NO: 1096132 - RNA, 19 nt, Homo sapiens
uggaagaucauuacuguga

SEQ ID NO: 1096133 - RNA, 19 nt, Homo sapiens
caagggcagucaucagauc

SEQ ID NO: 1096134 - RNA, 19 nt, Homo sapiens
acacccagcuguuuagaca

SEQ ID NO: 1096135 - RNA, 19 nt, Homo sapiens
aagaugagguaguugaugu

SEQ ID NO: 1096136 - RNA, 19 nt, Homo sapiens
gaaauaggauggggcaaga

SEQ ID NO: 1096137 - RNA, 19 nt, Homo sapiens
ugacaagccacuccuuuau

SEQ ID NO: 1096138 - RNA, 19 nt, Homo sapiens
guucuucaguccaacauuc

SEQ ID NO: 1096139 - RNA, 19 nt, Homo sapiens
gaagagggagaaacacauc

SEQ ID NO: 1096140 - RNA, 19 nt, Homo sapiens
ugauacagcacaaguagaa

SEQ ID NO: 1096141 - RNA, 19 nt, Homo sapiens
gaacaguagaauggaaauu

SEQ ID NO: 1096142 - RNA, 19 nt, Homo sapiens
uuguggagcuuguugaauu

SEQ ID NO: 1096143 - RNA, 19 nt, Homo sapiens
gaggauaauuguggagcuu

SEQ ID NO: 1096144 - RNA, 19 nt, Homo sapiens
acacaucucaucuuuccua

SEQ ID NO: 1096145 - RNA, 19 nt, Homo sapiens
caagaagcuuuccuauguc

SEQ ID NO: 1096146 - RNA, 19 nt, Homo sapiens
ggaaguggaagaucauuac

SEQ ID NO: 1096147 - RNA, 19 nt, Homo sapiens
auaacagucuucacuccua

SEQ ID NO: 1096148 - RNA, 19 nt, Homo sapiens
ggaaauugcgaucugauac

SEQ ID NO: 1096149 - RNA, 19 nt, Homo sapiens
uaaaccagcacacaaggaa

SEQ ID NO: 1096150 - RNA, 19 nt, Homo sapiens
acuggcacaugguauauuu

SEQ ID NO: 1096151 - RNA, 19 nt, Homo sapiens
ggauaauuguggagcuugu

SEQ ID NO: 1096152 - RNA, 19 nt, Homo sapiens
gguuaaagaagcauuacuu

SEQ ID NO: 1096153 - RNA, 19 nt, Homo sapiens
caaaugugguggacagacu

SEQ ID NO: 1096154 - RNA, 19 nt, Homo sapiens
gaaaagcuggcaauaauca

SEQ ID NO: 1096155 - RNA, 19 nt, Homo sapiens
cagacuggauggcucaaau

SEQ ID NO: 1096156 - RNA, 19 nt, Homo sapiens
guucgaguuucaaauaaca

SEQ ID NO: 1096157 - RNA, 19 nt, Homo sapiens
aaacagaaggaaagaacuu

SEQ ID NO: 1096158 - RNA, 19 nt, Homo sapiens
ugaaaugggcuuugaagag

SEQ ID NO: 1096159 - RNA, 19 nt, Homo sapiens
cuagcuauccaucauguaa

SEQ ID NO: 1096160 - RNA, 19 nt, Homo sapiens
ggcaauaaucaaggacuua

SEQ ID NO: 1096161 - RNA, 19 nt, Homo sapiens
ucagaaaaguugaaacaga

SEQ ID NO: 1096162 - RNA, 19 nt, Homo sapiens
gagaauggcguguggaaaa

SEQ ID NO: 1096163 - RNA, 19 nt, Homo sapiens
gacuggauggcucaaauaa

SEQ ID NO: 1096164 - RNA, 19 nt, Homo sapiens
uguggagcuuguugaauuu

SEQ ID NO: 1096165 - RNA, 19 nt, Homo sapiens
gauauuccugcaaacauga

SEQ ID NO: 1096166 - RNA, 19 nt, Homo sapiens
gacaagccacuccuuuaug

SEQ ID NO: 1096167 - RNA, 19 nt, Homo sapiens
aguggaagaucauuacugu

SEQ ID NO: 1096168 - RNA, 19 nt, Homo sapiens
cagacuggcacaugguaua

SEQ ID NO: 1096169 - RNA, 19 nt, Homo sapiens
cccuaaaccuggagaacuu

SEQ ID NO: 1096170 - RNA, 19 nt, Homo sapiens
gugauugccagaagaacua

SEQ ID NO: 1096171 - RNA, 19 nt, Homo sapiens
guaaaucacuggagaauuc

SEQ ID NO: 1096172 - RNA, 19 nt, Homo sapiens
ggcaaggucuuccauaaua

SEQ ID NO: 1096173 - RNA, 19 nt, Homo sapiens
gacagaaacuuuacuaaug

SEQ ID NO: 1096174 - RNA, 19 nt, Homo sapiens
gagaguaacuacacaaaga

SEQ ID NO: 1096175 - RNA, 19 nt, Homo sapiens
ggaaagaaaucuaacacau

SEQ ID NO: 1096176 - RNA, 19 nt, Homo sapiens
ggacagaacacuacaaaug

SEQ ID NO: 1096177 - RNA, 19 nt, Homo sapiens
gaacaucacaggguuuaua

SEQ ID NO: 1096178 - RNA, 19 nt, Homo sapiens
gagagaaaccuuauaaaug

SEQ ID NO: 1096179 - RNA, 19 nt, Homo sapiens
gagaagccauauaaaugua

SEQ ID NO: 1096180 - RNA, 19 nt, Homo sapiens
agagaaaccuuacaaaugu

SEQ ID NO: 1096181 - RNA, 19 nt, Homo sapiens
ugagaaaccuuauaagugu

SEQ ID NO: 1096182 - RNA, 19 nt, Homo sapiens
agagaaaccuuacaaaugu

SEQ ID NO: 1096183 - RNA, 19 nt, Homo sapiens
agagaaaccuuacaaaugu

SEQ ID NO: 1096184 - RNA, 19 nt, Homo sapiens
agagaaaccuuacaaaugu

SEQ ID NO: 1096185 - RNA, 19 nt, Homo sapiens
caacaucggacaauucaua

SEQ ID NO: 1096186 - RNA, 19 nt, Homo sapiens
caucaaggcuuacauuuua

SEQ ID NO: 1096187 - RNA, 19 nt, Homo sapiens
gagagaaaccuuacaaaug

SEQ ID NO: 1096188 - RNA, 19 nt, Homo sapiens
gagagaaaccuuacaaaug

SEQ ID NO: 1096189 - RNA, 19 nt, Homo sapiens
gagagaaaccuuacaaaug

SEQ ID NO: 1096190 - RNA, 19 nt, Homo sapiens
gagagaaaccuuacaaaug

SEQ ID NO: 1096191 - RNA, 19 nt, Homo sapiens
ggcaaggucuuuaaucaaa

SEQ ID NO: 1096192 - RNA, 19 nt, Homo sapiens
ccacauuucucauacauau

SEQ ID NO: 1096193 - RNA, 19 nt, Homo sapiens
guaauaagccuuucagugu

SEQ ID NO: 1096194 - RNA, 19 nt, Homo sapiens
gagagaagccauauaaaug

SEQ ID NO: 1096195 - RNA, 19 nt, Homo sapiens
ggagagaaaccuuauaaau

SEQ ID NO: 1096196 - RNA, 19 nt, Homo sapiens
ggagagaaaccauauaaau

SEQ ID NO: 1096197 - RNA, 19 nt, Homo sapiens
ugagaaaccuaacaaaugu

SEQ ID NO: 1096198 - RNA, 19 nt, Homo sapiens
ggcaaagucuucagucaaa

SEQ ID NO: 1096199 - RNA, 19 nt, Homo sapiens
caacaucacagaauccaua

SEQ ID NO: 1096200 - RNA, 19 nt, Homo sapiens
gacaaagcauucagucaaa

SEQ ID NO: 1096201 - RNA, 19 nt, Homo sapiens
caacaguaguuccuuaguu

SEQ ID NO: 1096202 - RNA, 19 nt, Homo sapiens
gaaauauuccagacaguaa

SEQ ID NO: 1096203 - RNA, 19 nt, Homo sapiens
uaauaagccuuucagugua

SEQ ID NO: 1096204 - RNA, 19 nt, Homo sapiens
gaaagaaaucuaacacaug

SEQ ID NO: 1096205 - RNA, 19 nt, Homo sapiens
caacaucugaucauucaua

SEQ ID NO: 1096206 - RNA, 19 nt, Homo sapiens
ggagagaagccauauaaau

SEQ ID NO: 1096207 - RNA, 19 nt, Homo sapiens
gaauguagcagagccuuua

SEQ ID NO: 1096208 - RNA, 19 nt, Homo sapiens
guucaagccucacuaauca

SEQ ID NO: 1096209 - RNA, 19 nt, Homo sapiens
guggcaagaucuucaauaa

SEQ ID NO: 1096210 - RNA, 19 nt, Homo sapiens
ggacagaaacuuuacuaau

SEQ ID NO: 1096211 - RNA, 19 nt, Homo sapiens
gagagaaaccauauaaaug

SEQ ID NO: 1096212 - RNA, 19 nt, Homo sapiens
gaaaggucuuccaucauau

SEQ ID NO: 1096213 - RNA, 19 nt, Homo sapiens
agagaaaccuuacagaugu

SEQ ID NO: 1096214 - RNA, 19 nt, Homo sapiens
gcacagcauugcaggauuc

SEQ ID NO: 1096215 - RNA, 19 nt, Homo sapiens
aaucaaaccuugcaaguca

SEQ ID NO: 1096216 - RNA, 19 nt, Homo sapiens
gaugaaaccauacaaaugu

SEQ ID NO: 1096217 - RNA, 19 nt, Homo sapiens
gagagaaaccuuacagaug

SEQ ID NO: 1096218 - RNA, 19 nt, Homo sapiens
ggcaaggucuuaagguaaa

SEQ ID NO: 1096219 - RNA, 19 nt, Homo sapiens
gcaaggucuuccauaauau

SEQ ID NO: 1096220 - RNA, 19 nt, Homo sapiens
gggaaaccauuaugacuuc

SEQ ID NO: 1096221 - RNA, 19 nt, Homo sapiens
gcauaucauuggagaauuc

SEQ ID NO: 1096222 - RNA, 19 nt, Homo sapiens
ggagagaaaccuuacaaau

SEQ ID NO: 1096223 - RNA, 19 nt, Homo sapiens
ggagagaaaccuuacaaau

SEQ ID NO: 1096224 - RNA, 19 nt, Homo sapiens
ggagagaaaccuuacaaau

SEQ ID NO: 1096225 - RNA, 19 nt, Homo sapiens
ggagagaaaccuuacaaau

SEQ ID NO: 1096226 - RNA, 19 nt, Homo sapiens
ggcaagaucuucaauaaaa

SEQ ID NO: 1096227 - RNA, 19 nt, Homo sapiens
caacguauuucuucuacug

SEQ ID NO: 1096228 - RNA, 19 nt, Homo sapiens
gcagucacaucuaccagaa

SEQ ID NO: 1096229 - RNA, 19 nt, Homo sapiens
guaaaucacuggagaaucc

SEQ ID NO: 1096230 - RNA, 19 nt, Homo sapiens
caucagagaauccauacua

SEQ ID NO: 1096231 - RNA, 19 nt, Homo sapiens
caacaucagagaauccaua

SEQ ID NO: 1096232 - RNA, 19 nt, Homo sapiens
ggucuucggucuaaacuca

SEQ ID NO: 1096233 - RNA, 19 nt, Homo sapiens
gaaagucucauugguagaa

SEQ ID NO: 1096234 - RNA, 19 nt, Homo sapiens
ucacaagucaucccuagua

SEQ ID NO: 1096235 - RNA, 19 nt, Homo sapiens
ucacaagucaucccuagua

SEQ ID NO: 1096236 - RNA, 19 nt, Homo sapiens
gaaaggucuuccaucaaau

SEQ ID NO: 1096237 - RNA, 19 nt, Homo sapiens
uaccagaacugcagcuauu

SEQ ID NO: 1096238 - RNA, 19 nt, Homo sapiens
aauguaacgugcaugcuua

SEQ ID NO: 1096239 - RNA, 19 nt, Homo sapiens
gcaaguauaaugaauguag

SEQ ID NO: 1096240 - RNA, 19 nt, Homo sapiens
ggaaugggguguauugauu

SEQ ID NO: 1096241 - RNA, 19 nt, Homo sapiens
guggaaacaugauugaaga

SEQ ID NO: 1096242 - RNA, 19 nt, Homo sapiens
aaugugagaucaaggaauu

SEQ ID NO: 1096243 - RNA, 19 nt, Homo sapiens
cggauuauguggagugaaa

SEQ ID NO: 1096244 - RNA, 19 nt, Homo sapiens
gaaacaugauugaagacau

SEQ ID NO: 1096245 - RNA, 19 nt, Homo sapiens
auucauaccuugcauauca

SEQ ID NO: 1096246 - RNA, 19 nt, Homo sapiens
ggucuuccaucauauuuca

SEQ ID NO: 1096247 - RNA, 19 nt, Homo sapiens
gcacaacaucggacaauuc

SEQ ID NO: 1096248 - RNA, 19 nt, Homo sapiens
ggucuuccaucaaauuuca

SEQ ID NO: 1096249 - RNA, 19 nt, Homo sapiens
guggcaaggucuuccauaa

SEQ ID NO: 1096250 - RNA, 19 nt, Homo sapiens
cgucaacaguaguuccuua

SEQ ID NO: 1096251 - RNA, 19 nt, Homo sapiens
gugagaaaccuaacaaaug

SEQ ID NO: 1096252 - RNA, 19 nt, Homo sapiens
caagucaucccuaguaaau

SEQ ID NO: 1096253 - RNA, 19 nt, Homo sapiens
caagucaucccuaguaaau

SEQ ID NO: 1096254 - RNA, 19 nt, Homo sapiens
gcaaaggcgucaggaaugg

SEQ ID NO: 1096255 - RNA, 19 nt, Homo sapiens
uagaaaggaugaugcacaa

SEQ ID NO: 1096256 - RNA, 19 nt, Homo sapiens
aauaagccuuucaguguaa

SEQ ID NO: 1096257 - RNA, 19 nt, Homo sapiens
gagaauccauacuaaagag

SEQ ID NO: 1096258 - RNA, 19 nt, Homo sapiens
ggagagaaaccuuacagau

SEQ ID NO: 1096259 - RNA, 19 nt, Homo sapiens
uacaacaucugaucauuca

SEQ ID NO: 1096260 - RNA, 19 nt, Homo sapiens
gcaaggucuuuaaucaaau

SEQ ID NO: 1096261 - RNA, 19 nt, Homo sapiens
aacaguaguuccuuaguuu

SEQ ID NO: 1096262 - RNA, 19 nt, Homo sapiens
guggcaaggucuuaaggua

SEQ ID NO: 1096263 - RNA, 19 nt, Homo sapiens
gcauuaaagcccuguaaga

SEQ ID NO: 1096264 - RNA, 19 nt, Homo sapiens
gagaauucauacuggagaa

SEQ ID NO: 1096265 - RNA, 19 nt, Homo sapiens
cagcauugcaggauucaua

SEQ ID NO: 1096266 - RNA, 19 nt, Homo sapiens
gcacaaaagcagccuguua

SEQ ID NO: 1096267 - RNA, 19 nt, Homo sapiens
gaguaauacaggagaaaua

SEQ ID NO: 1096268 - RNA, 19 nt, Homo sapiens
caacaucugauaauucaug

SEQ ID NO: 1096269 - RNA, 19 nt, Homo sapiens
gcacaacaucaaagaauuc

SEQ ID NO: 1096270 - RNA, 19 nt, Homo sapiens
gaacugcagcuauuucaag

SEQ ID NO: 1096271 - RNA, 19 nt, Homo sapiens
ugaaagaucugaaagguaa

SEQ ID NO: 1096272 - RNA, 19 nt, Homo sapiens
gaaagcagaucccaucguu

SEQ ID NO: 1096273 - RNA, 19 nt, Homo sapiens
gaacaaugcugcugucaca

SEQ ID NO: 1096274 - RNA, 19 nt, Homo sapiens
gaaucugccuuuaauguaa

SEQ ID NO: 1096275 - RNA, 19 nt, Homo sapiens
ugaaggaucuugcucagua

SEQ ID NO: 1096276 - RNA, 19 nt, Homo sapiens
aaacaaggauugaagcuuu

SEQ ID NO: 1096277 - RNA, 19 nt, Homo sapiens
cgucacaccuuccuaaaua

SEQ ID NO: 1096278 - RNA, 19 nt, Homo sapiens
gauugaagcuuuaagagaa

SEQ ID NO: 1096279 - RNA, 19 nt, Homo sapiens
gcacacggcggaagaaaua

SEQ ID NO: 1096280 - RNA, 19 nt, Homo sapiens
gaaagcaagucaaguuuua

SEQ ID NO: 1096281 - RNA, 19 nt, Homo sapiens
cagcuaagcaucaauauaa

SEQ ID NO: 1096282 - RNA, 19 nt, Homo sapiens
gaauggaugucugcaagua

SEQ ID NO: 1096283 - RNA, 19 nt, Homo sapiens
aaagaagacuggauuguug

SEQ ID NO: 1096284 - RNA, 19 nt, Homo sapiens
cuaaguauguuaacuguug

SEQ ID NO: 1096285 - RNA, 19 nt, Homo sapiens
ggaauggcguggcacauau

SEQ ID NO: 1096286 - RNA, 19 nt, Homo sapiens
caacaggugucagaaacua

SEQ ID NO: 1096287 - RNA, 19 nt, Homo sapiens
gaacgucacaccuuccuaa

SEQ ID NO: 1096288 - RNA, 19 nt, Homo sapiens
gaaaggcggucucaguaca

SEQ ID NO: 1096289 - RNA, 19 nt, Homo sapiens
gcagaaggacuuagaaaug

SEQ ID NO: 1096290 - RNA, 19 nt, Homo sapiens
uggaagagcuccugaacaa

SEQ ID NO: 1096291 - RNA, 19 nt, Homo sapiens
gaaagaacuagaucaaaga

SEQ ID NO: 1096292 - RNA, 19 nt, Homo sapiens
cuacacaucucucuguuga

SEQ ID NO: 1096293 - RNA, 19 nt, Homo sapiens
guaucuaacucaacuguga

SEQ ID NO: 1096294 - RNA, 19 nt, Homo sapiens
aagaagcacuggugaauau

SEQ ID NO: 1096295 - RNA, 19 nt, Homo sapiens
ugaaagaacuagaucaaag

SEQ ID NO: 1096296 - RNA, 19 nt, Homo sapiens
caaccuuccucuaaauauu

SEQ ID NO: 1096297 - RNA, 19 nt, Homo sapiens
gaauugucuuuccuaagua

SEQ ID NO: 1096298 - RNA, 19 nt, Homo sapiens
gauccuguaugacuuuaaa

SEQ ID NO: 1096299 - RNA, 19 nt, Homo sapiens
caucuuggaucuccgagua

SEQ ID NO: 1096300 - RNA, 19 nt, Homo sapiens
ucagcagccugguaucuua

SEQ ID NO: 1096301 - RNA, 19 nt, Homo sapiens
caugguaacuggaaaugaa

SEQ ID NO: 1096302 - RNA, 19 nt, Homo sapiens
gaaaugcccaggaaguauu

SEQ ID NO: 1096303 - RNA, 19 nt, Homo sapiens
gcagacacauuguuucaag

SEQ ID NO: 1096304 - RNA, 19 nt, Homo sapiens
aaacugcaaucaugaaugu

SEQ ID NO: 1096305 - RNA, 19 nt, Homo sapiens
ggacgaaggucacaaucag

SEQ ID NO: 1096306 - RNA, 19 nt, Homo sapiens
gcaaagagggcuacgugaa

SEQ ID NO: 1096307 - RNA, 19 nt, Homo sapiens
ugacaaaggagacauuauu

SEQ ID NO: 1096308 - RNA, 19 nt, Homo sapiens
ccaggugucugugauuuaa

SEQ ID NO: 1096309 - RNA, 19 nt, Homo sapiens
uaaaagaaguccaggaaaa

SEQ ID NO: 1096310 - RNA, 19 nt, Homo sapiens
gaagagcuccugaacaagu

SEQ ID NO: 1096311 - RNA, 19 nt, Homo sapiens
ggaggagguuugccagcua

SEQ ID NO: 1096312 - RNA, 19 nt, Homo sapiens
cggaagaaauaaagagauu

SEQ ID NO: 1096313 - RNA, 19 nt, Homo sapiens
caaagagggcuacgugaaa

SEQ ID NO: 1096314 - RNA, 19 nt, Homo sapiens
ggaaagacaaggcagauuc

SEQ ID NO: 1096315 - RNA, 19 nt, Homo sapiens
gauggagugugaaugugua

SEQ ID NO: 1096316 - RNA, 19 nt, Homo sapiens
gaagcacuggugaauauaa

SEQ ID NO: 1096317 - RNA, 19 nt, Homo sapiens
gaaaaugauucaggaagua

SEQ ID NO: 1096318 - RNA, 19 nt, Homo sapiens
ucaaugugcuucagcgauu

SEQ ID NO: 1096319 - RNA, 19 nt, Homo sapiens
cuaacaggaucaccaguuu

SEQ ID NO: 1096320 - RNA, 19 nt, Homo sapiens
agaauugucuuuccuaagu

SEQ ID NO: 1096321 - RNA, 19 nt, Homo sapiens
gaauauaauugccgugcau

SEQ ID NO: 1096322 - RNA, 19 nt, Homo sapiens
cuuagaaccuggaauuuau

SEQ ID NO: 1096323 - RNA, 19 nt, Homo sapiens
caaggcagauuccacuaga

SEQ ID NO: 1096324 - RNA, 19 nt, Homo sapiens
caacugggguagauuauuu

SEQ ID NO: 1096325 - RNA, 19 nt, Homo sapiens
uagcauggccucauugaaa

SEQ ID NO: 1096326 - RNA, 19 nt, Homo sapiens
ccugguaucuuauagagaa

SEQ ID NO: 1096327 - RNA, 19 nt, Homo sapiens
cggcaucucuccaaaugaa

SEQ ID NO: 1096328 - RNA, 19 nt, Homo sapiens
cacagucucuucucugaaa

SEQ ID NO: 1096329 - RNA, 19 nt, Homo sapiens
gggacacuguggcuguuua

SEQ ID NO: 1096330 - RNA, 19 nt, Homo sapiens
gcaggacggcuggagauua

SEQ ID NO: 1096331 - RNA, 19 nt, Homo sapiens
gaggagguuugccagcuaa

SEQ ID NO: 1096332 - RNA, 19 nt, Homo sapiens
uguuggaucuugauaauga

SEQ ID NO: 1096333 - RNA, 19 nt, Homo sapiens
gaaguagaaacaaggauug

SEQ ID NO: 1096334 - RNA, 19 nt, Homo sapiens
gaaccucaacagucucuuu

SEQ ID NO: 1096335 - RNA, 19 nt, Homo sapiens
uaauaagacuguucacucu

SEQ ID NO: 1096336 - RNA, 19 nt, Homo sapiens
gaacagcgccuuuugauag

SEQ ID NO: 1096337 - RNA, 19 nt, Homo sapiens
ggacugacuucucuaccau

SEQ ID NO: 1096338 - RNA, 19 nt, Homo sapiens
ugagacaccaucaacuuua

SEQ ID NO: 1096339 - RNA, 19 nt, Homo sapiens
gguauacauuucaaccaaa

SEQ ID NO: 1096340 - RNA, 19 nt, Homo sapiens
cucauaggcuugaccauuu

SEQ ID NO: 1096341 - RNA, 19 nt, Homo sapiens
cacauuguuucaagaagua

SEQ ID NO: 1096342 - RNA, 19 nt, Homo sapiens
gcacuggugaauauaauug

SEQ ID NO: 1096343 - RNA, 19 nt, Homo sapiens
caagccugaugcagauaua

SEQ ID NO: 1096344 - RNA, 19 nt, Homo sapiens
cgcagaaacuggagaaugu

SEQ ID NO: 1096345 - RNA, 19 nt, Homo sapiens
ccauguacaguuuccauua

SEQ ID NO: 1096346 - RNA, 19 nt, Homo sapiens
gagcuuucauucucacuca

SEQ ID NO: 1096347 - RNA, 19 nt, Homo sapiens
cuaaagguauuugguguau

SEQ ID NO: 1096348 - RNA, 19 nt, Homo sapiens
acuguucacucucuaagua

SEQ ID NO: 1096349 - RNA, 19 nt, Homo sapiens
cauguuggaucuugauaau

SEQ ID NO: 1096350 - RNA, 19 nt, Homo sapiens
ggauugaagcuuuaagaga

SEQ ID NO: 1096351 - RNA, 19 nt, Homo sapiens
gcagauuccacuagaaaug

SEQ ID NO: 1096352 - RNA, 19 nt, Homo sapiens
gugaaaggcggucucagua

SEQ ID NO: 1096353 - RNA, 19 nt, Homo sapiens
gagacaggcuaacaagaag

SEQ ID NO: 1096354 - RNA, 19 nt, Homo sapiens
ggacuuagaaaugcuauuc

SEQ ID NO: 1096355 - RNA, 19 nt, Homo sapiens
gacaaaggagacauuauug

SEQ ID NO: 1096356 - RNA, 19 nt, Homo sapiens
cauguacaguuuccauuau

SEQ ID NO: 1096357 - RNA, 19 nt, Homo sapiens
gaggaauucucuuuguagu

SEQ ID NO: 1096358 - RNA, 19 nt, Homo sapiens
ccugaggcccuguguguua

SEQ ID NO: 1096359 - RNA, 19 nt, Homo sapiens
guugagugcugcaggaaga

SEQ ID NO: 1096360 - RNA, 19 nt, Homo sapiens
gguauuugguguauuaaac

SEQ ID NO: 1096361 - RNA, 19 nt, Homo sapiens
cuaaauaucgcagaacauu

SEQ ID NO: 1096362 - RNA, 19 nt, Homo sapiens
gaccauuuguggacauaau

SEQ ID NO: 1096363 - RNA, 19 nt, Homo sapiens
aacaaggauugaagcuuua

SEQ ID NO: 1096364 - RNA, 19 nt, Homo sapiens
cucaguagcuggaacaaug

SEQ ID NO: 1096365 - RNA, 19 nt, Homo sapiens
gaaggaucuugcucaguag

SEQ ID NO: 1096366 - RNA, 19 nt, Homo sapiens
uaucugugauggaguguga

SEQ ID NO: 1096367 - RNA, 19 nt, Homo sapiens
ucauauaaauggccuuaag

SEQ ID NO: 1096368 - RNA, 19 nt, Homo sapiens
caaccaugaugaaaacaua

SEQ ID NO: 1096369 - RNA, 19 nt, Homo sapiens
cuugaaaucugugcuuuga

SEQ ID NO: 1096370 - RNA, 19 nt, Homo sapiens
gaagucaggccagauugaa

SEQ ID NO: 1096371 - RNA, 19 nt, Homo sapiens
guagugacguuaagagaua

SEQ ID NO: 1096372 - RNA, 19 nt, Homo sapiens
gaauaaagcaguugaguau

SEQ ID NO: 1096373 - RNA, 19 nt, Homo sapiens
gaaaucccaucucuacuga

SEQ ID NO: 1096374 - RNA, 19 nt, Homo sapiens
gcacggaauccacuaguua

SEQ ID NO: 1096375 - RNA, 19 nt, Homo sapiens
ggaauaaucacugagaaua

SEQ ID NO: 1096376 - RNA, 19 nt, Homo sapiens
caacgaagacgaaagcuaa

SEQ ID NO: 1096377 - RNA, 19 nt, Homo sapiens
uuaaagaucugcugacugu

SEQ ID NO: 1096378 - RNA, 19 nt, Homo sapiens
gcagugagcugagauugug

SEQ ID NO: 1096379 - RNA, 19 nt, Homo sapiens
uaaagaagacacagaguuu

SEQ ID NO: 1096380 - RNA, 19 nt, Homo sapiens
aaaccuaacuccaaagugu

SEQ ID NO: 1096381 - RNA, 19 nt, Homo sapiens
gaagcuggcuaacaucauc

SEQ ID NO: 1096382 - RNA, 19 nt, Homo sapiens
gaaccccucuuaccaauaa

SEQ ID NO: 1096383 - RNA, 19 nt, Homo sapiens
acacagaguuuagaugaaa

SEQ ID NO: 1096384 - RNA, 19 nt, Homo sapiens
gacuugagcucaggaguuu

SEQ ID NO: 1096385 - RNA, 19 nt, Homo sapiens
ucacaugagugguaaacuu

SEQ ID NO: 1096386 - RNA, 19 nt, Homo sapiens
agccaaagccgaaagauua

SEQ ID NO: 1096387 - RNA, 19 nt, Homo sapiens
uccaugagaugauccauaa

SEQ ID NO: 1096388 - RNA, 19 nt, Homo sapiens
gcaccuguguugcucagaa

SEQ ID NO: 1096389 - RNA, 19 nt, Homo sapiens
gagaugauccauaacaaau

SEQ ID NO: 1096390 - RNA, 19 nt, Homo sapiens
ccaccacccucaccagaaa

SEQ ID NO: 1096391 - RNA, 19 nt, Homo sapiens
gaugauccauaacaaauac

SEQ ID NO: 1096392 - RNA, 19 nt, Homo sapiens
ccagaaagagucgguauuu

SEQ ID NO: 1096393 - RNA, 19 nt, Homo sapiens
caaggcagguggaugacuu

SEQ ID NO: 1096394 - RNA, 19 nt, Homo sapiens
gaaaguucuuccuguccaa

SEQ ID NO: 1096395 - RNA, 19 nt, Homo sapiens
ccugaaaccuaacuccaaa

SEQ ID NO: 1096396 - RNA, 19 nt, Homo sapiens
caaagcagaagcuggcuaa

SEQ ID NO: 1096397 - RNA, 19 nt, Homo sapiens
ugaccauucuugugggaua

SEQ ID NO: 1096398 - RNA, 19 nt, Homo sapiens
aaagaucugcugacuguaa

SEQ ID NO: 1096399 - RNA, 19 nt, Homo sapiens
uuaaauggguagugacguu

SEQ ID NO: 1096400 - RNA, 19 nt, Homo sapiens
gggauaagagaucauuaaa

SEQ ID NO: 1096401 - RNA, 19 nt, Homo sapiens
aaaccacuguguacucuau

SEQ ID NO: 1096402 - RNA, 19 nt, Homo sapiens
gaucugcggaaacugcuua

SEQ ID NO: 1096403 - RNA, 19 nt, Homo sapiens
gaagcuagagcacgagaau

SEQ ID NO: 1096404 - RNA, 19 nt, Homo sapiens
cacaugagugguaaacuua

SEQ ID NO: 1096405 - RNA, 19 nt, Homo sapiens
gagccgagauugcaacacu

SEQ ID NO: 1096406 - RNA, 19 nt, Homo sapiens
gccgaaagauuauucaaaa

SEQ ID NO: 1096407 - RNA, 19 nt, Homo sapiens
gcuagcuacauuuacauua

SEQ ID NO: 1096408 - RNA, 19 nt, Homo sapiens
uaaaccugcuagcuacauu

SEQ ID NO: 1096409 - RNA, 19 nt, Homo sapiens
aaucccaucucuacugaaa

SEQ ID NO: 1096410 - RNA, 19 nt, Homo sapiens
cauguuacccugaaaccua

SEQ ID NO: 1096411 - RNA, 19 nt, Homo sapiens
gacacagaguuuagaugaa

SEQ ID NO: 1096412 - RNA, 19 nt, Homo sapiens
agacacagaguuuagauga

SEQ ID NO: 1096413 - RNA, 19 nt, Homo sapiens
guaaaccacuguguacucu

SEQ ID NO: 1096414 - RNA, 19 nt, Homo sapiens
gaaagcacggaauccacua

SEQ ID NO: 1096415 - RNA, 19 nt, Homo sapiens
aaagaagacacagaguuua

SEQ ID NO: 1096416 - RNA, 19 nt, Homo sapiens
ggugaaaucccaucucuac

SEQ ID NO: 1096417 - RNA, 19 nt, Homo sapiens
gagauugugccacuguauu

SEQ ID NO: 1096418 - RNA, 19 nt, Homo sapiens
gcaguugaguauuuauaac

SEQ ID NO: 1096419 - RNA, 19 nt, Homo sapiens
agaauaaagcaguugagua

SEQ ID NO: 1096420 - RNA, 19 nt, Homo sapiens
gaaacaggaacaggacuga

SEQ ID NO: 1096421 - RNA, 19 nt, Homo sapiens
ugcggaaacugcuuagaaa

SEQ ID NO: 1096422 - RNA, 19 nt, Homo sapiens
gaagacacagaguuuagau

SEQ ID NO: 1096423 - RNA, 19 nt, Homo sapiens
uguccaagcuguggucaaa

SEQ ID NO: 1096424 - RNA, 19 nt, Homo sapiens
cugcauaacccagaguuua

SEQ ID NO: 1096425 - RNA, 19 nt, Homo sapiens
ggccaaggcagguggauga

SEQ ID NO: 1096426 - RNA, 19 nt, Homo sapiens
acgcaggccuuaaggagaa

SEQ ID NO: 1096427 - RNA, 19 nt, Homo sapiens
ugaagaccaucucagaaag

SEQ ID NO: 1096428 - RNA, 19 nt, Homo sapiens
cauccuggaacuucaauuu

SEQ ID NO: 1096429 - RNA, 19 nt, Homo sapiens
gaccauucuugugggauaa

SEQ ID NO: 1096430 - RNA, 19 nt, Homo sapiens
acuucaggcuggaccauua

SEQ ID NO: 1096431 - RNA, 19 nt, Homo sapiens
agcuagagcacgagaauua

SEQ ID NO: 1096432 - RNA, 19 nt, Homo sapiens
ccuagaagcccaacuccaa

SEQ ID NO: 1096433 - RNA, 19 nt, Homo sapiens
gaaaauauggaaacaggaa

SEQ ID NO: 1096434 - RNA, 19 nt, Homo sapiens
guuacaaacgucuuaauca

SEQ ID NO: 1096435 - RNA, 19 nt, Homo sapiens
gaaaagaggaagcuuauac

SEQ ID NO: 1096436 - RNA, 19 nt, Homo sapiens
gaagaccaucucagaaagu

SEQ ID NO: 1096437 - RNA, 19 nt, Homo sapiens
uaaauggguagugacguua

SEQ ID NO: 1096438 - RNA, 19 nt, Homo sapiens
gcagugagccgagauugca

SEQ ID NO: 1096439 - RNA, 19 nt, Homo sapiens
ucagcuggcucacccuaga

SEQ ID NO: 1096440 - RNA, 19 nt, Homo sapiens
gagaggaggccagguggaa

SEQ ID NO: 1096441 - RNA, 19 nt, Homo sapiens
gaugaaaacuccgucucua

SEQ ID NO: 1096442 - RNA, 19 nt, Homo sapiens
gcagcauguuacccugaaa

SEQ ID NO: 1096443 - RNA, 19 nt, Homo sapiens
caaagccgaaagauuauuc

SEQ ID NO: 1096444 - RNA, 19 nt, Homo sapiens
ugagaugauccauaacaaa

SEQ ID NO: 1096445 - RNA, 19 nt, Homo sapiens
gaugaaaagaggaagcuua

SEQ ID NO: 1096446 - RNA, 19 nt, Homo sapiens
uuaaagaagacacagaguu

SEQ ID NO: 1096447 - RNA, 19 nt, Homo sapiens
aagaucugcugacuguaaa

SEQ ID NO: 1096448 - RNA, 19 nt, Homo sapiens
ugaaaucccaucucuacug

SEQ ID NO: 1096449 - RNA, 19 nt, Homo sapiens
accgagaacuuuacagugu

SEQ ID NO: 1096450 - RNA, 19 nt, Homo sapiens
aacccagaguuuagaagua

SEQ ID NO: 1096451 - RNA, 19 nt, Homo sapiens
caaguucaaacaacgaaga

SEQ ID NO: 1096452 - RNA, 19 nt, Homo sapiens
ugggauaagagaucauuaa

SEQ ID NO: 1096453 - RNA, 19 nt, Homo sapiens
ggaaacugcuuagaaaagu

SEQ ID NO: 1096454 - RNA, 19 nt, Homo sapiens
gagucgguauuucuucaau

SEQ ID NO: 1096455 - RNA, 19 nt, Homo sapiens
gcaauaaaacuuuggacaa

SEQ ID NO: 1096456 - RNA, 19 nt, Homo sapiens
gagaauaaagcaguugagu

SEQ ID NO: 1096457 - RNA, 19 nt, Homo sapiens
ccugcuagcuacauuuaca

SEQ ID NO: 1096458 - RNA, 19 nt, Homo sapiens
agcagaagcuggcuaacau

SEQ ID NO: 1096459 - RNA, 19 nt, Homo sapiens
uuacaaacgucuuaaucac

SEQ ID NO: 1096460 - RNA, 19 nt, Homo sapiens
gaacuucaauuuuccuaac

SEQ ID NO: 1096461 - RNA, 19 nt, Homo sapiens
ucugcugacuguaaaauua

SEQ ID NO: 1096462 - RNA, 19 nt, Homo sapiens
gcauaacccagaguuuaga

SEQ ID NO: 1096463 - RNA, 19 nt, Homo sapiens
caugagaugauccauaaca

SEQ ID NO: 1096464 - RNA, 19 nt, Homo sapiens
ggccuuaaggagaaaguuu

SEQ ID NO: 1096465 - RNA, 19 nt, Homo sapiens
aagaccaucucagaaaguu

SEQ ID NO: 1096466 - RNA, 19 nt, Homo sapiens
ccuguaaucccagcacuuu

SEQ ID NO: 1096467 - RNA, 19 nt, Homo sapiens
acuguguacucuauucauu

SEQ ID NO: 1096468 - RNA, 19 nt, Homo sapiens
gcgccuguggucccaguua

SEQ ID NO: 1096469 - RNA, 19 nt, Homo sapiens
ccuguaaucccagcacuuu

SEQ ID NO: 1096470 - RNA, 19 nt, Homo sapiens
gaaaccuaacuccaaagug

SEQ ID NO: 1096471 - RNA, 19 nt, Homo sapiens
ggaaugaaaucacuaguaa

SEQ ID NO: 1096472 - RNA, 19 nt, Homo sapiens
ggagaaggcagcagaauua

SEQ ID NO: 1096473 - RNA, 19 nt, Homo sapiens
ccuaauggcucaagugaua

SEQ ID NO: 1096474 - RNA, 19 nt, Homo sapiens
ggaaaggauuggcuuauau

SEQ ID NO: 1096475 - RNA, 19 nt, Homo sapiens
gaagaagacauguauauga

SEQ ID NO: 1096476 - RNA, 19 nt, Homo sapiens
gcacucaacuggcuuggaa

SEQ ID NO: 1096477 - RNA, 19 nt, Homo sapiens
gaauagaaaucuuggcaau

SEQ ID NO: 1096478 - RNA, 19 nt, Homo sapiens
gaaaggauuggcuuauaua

SEQ ID NO: 1096479 - RNA, 19 nt, Homo sapiens
gaacagaacacuauucaca

SEQ ID NO: 1096480 - RNA, 19 nt, Homo sapiens
gaagauugcucugaauguu

SEQ ID NO: 1096481 - RNA, 19 nt, Homo sapiens
gacaagcgcugaauucugu

SEQ ID NO: 1096482 - RNA, 19 nt, Homo sapiens
gaaaagagguuguaaacau

SEQ ID NO: 1096483 - RNA, 19 nt, Homo sapiens
gaagacauguauaugaaca

SEQ ID NO: 1096484 - RNA, 19 nt, Homo sapiens
aaauauagcacaucccuua

SEQ ID NO: 1096485 - RNA, 19 nt, Homo sapiens
ggauggauaucuacaacaa

SEQ ID NO: 1096486 - RNA, 19 nt, Homo sapiens
ucagguugcucauccaaua

SEQ ID NO: 1096487 - RNA, 19 nt, Homo sapiens
cuugaaacguugagaaaua

SEQ ID NO: 1096488 - RNA, 19 nt, Homo sapiens
ggaugcaacuaaagccaua

SEQ ID NO: 1096489 - RNA, 19 nt, Homo sapiens
aaacaaaccagaugucaaa

SEQ ID NO: 1096490 - RNA, 19 nt, Homo sapiens
gcugaauucuguaguuaaa

SEQ ID NO: 1096491 - RNA, 19 nt, Homo sapiens
gcgcugaauucuguaguua

SEQ ID NO: 1096492 - RNA, 19 nt, Homo sapiens
cagcagaucaugaaaguuu

SEQ ID NO: 1096493 - RNA, 19 nt, Homo sapiens
ugaagucacucaggcaaua

SEQ ID NO: 1096494 - RNA, 19 nt, Homo sapiens
gaucugagggccaaaguuu

SEQ ID NO: 1096495 - RNA, 19 nt, Homo sapiens
gaaggcagcagaauuacuu

SEQ ID NO: 1096496 - RNA, 19 nt, Homo sapiens
gcacagaagcaguccauug

SEQ ID NO: 1096497 - RNA, 19 nt, Homo sapiens
ucaaggagcaguaucaauu

SEQ ID NO: 1096498 - RNA, 19 nt, Homo sapiens
aaagauugccugcaguuua

SEQ ID NO: 1096499 - RNA, 19 nt, Homo sapiens
cagaugaaauugacaguuc

SEQ ID NO: 1096500 - RNA, 19 nt, Homo sapiens
gauggugaaucuccuaaug

SEQ ID NO: 1096501 - RNA, 19 nt, Homo sapiens
gagcuuuguucuuaucuug

SEQ ID NO: 1096502 - RNA, 19 nt, Homo sapiens
gaaagguauuugauuccaa

SEQ ID NO: 1096503 - RNA, 19 nt, Homo sapiens
gaacacuauucacaaagau

SEQ ID NO: 1096504 - RNA, 19 nt, Homo sapiens
guugugaucuugaaacguu

SEQ ID NO: 1096505 - RNA, 19 nt, Homo sapiens
cggaaaggauuggcuuaua

SEQ ID NO: 1096506 - RNA, 19 nt, Homo sapiens
ggaggaagaagacauguau

SEQ ID NO: 1096507 - RNA, 19 nt, Homo sapiens
gaaggaguccgguucuuug

SEQ ID NO: 1096508 - RNA, 19 nt, Homo sapiens
acagaacacuauucacaaa

SEQ ID NO: 1096509 - RNA, 19 nt, Homo sapiens
ggauauggccauuggauug

SEQ ID NO: 1096510 - RNA, 19 nt, Homo sapiens
ggaaggaguccgguucuuu

SEQ ID NO: 1096511 - RNA, 19 nt, Homo sapiens
agccugagcuuuguucuua

SEQ ID NO: 1096512 - RNA, 19 nt, Homo sapiens
ugaagaagcucuggaagca

SEQ ID NO: 1096513 - RNA, 19 nt, Homo sapiens
gauaaucaccaucucuuug

SEQ ID NO: 1096514 - RNA, 19 nt, Homo sapiens
guucuucaaugucagauga

SEQ ID NO: 1096515 - RNA, 19 nt, Homo sapiens
caacugcuuuccacucaga

SEQ ID NO: 1096516 - RNA, 19 nt, Homo sapiens
guacuuuguugggaauuaa

SEQ ID NO: 1096517 - RNA, 19 nt, Homo sapiens
gcaaaacaccggcuucuuu

SEQ ID NO: 1096518 - RNA, 19 nt, Homo sapiens
gaagauauagaagaccuuu

SEQ ID NO: 1096519 - RNA, 19 nt, Homo sapiens
caaagaagaaguuaucaag

SEQ ID NO: 1096520 - RNA, 19 nt, Homo sapiens
acaacaagcagauccauuu

SEQ ID NO: 1096521 - RNA, 19 nt, Homo sapiens
ggagcaguaucaauucugu

SEQ ID NO: 1096522 - RNA, 19 nt, Homo sapiens
cauccagucugaauauaga

SEQ ID NO: 1096523 - RNA, 19 nt, Homo sapiens
gcaaagaagaaguuaucaa

SEQ ID NO: 1096524 - RNA, 19 nt, Homo sapiens
gcaggagguugugaucuug

SEQ ID NO: 1096525 - RNA, 19 nt, Homo sapiens
cgacacagaugaaauugac

SEQ ID NO: 1096526 - RNA, 19 nt, Homo sapiens
uaauguggauggaccagaa

SEQ ID NO: 1096527 - RNA, 19 nt, Homo sapiens
ggaagaagacauguauaug

SEQ ID NO: 1096528 - RNA, 19 nt, Homo sapiens
agaagaaguuaucaaguuc

SEQ ID NO: 1096529 - RNA, 19 nt, Homo sapiens
aagauugccugcaguuuau

SEQ ID NO: 1096530 - RNA, 19 nt, Homo sapiens
ccagaaagggagaccauuu

SEQ ID NO: 1096531 - RNA, 19 nt, Homo sapiens
cauugagucuggcuccaua

SEQ ID NO: 1096532 - RNA, 19 nt, Homo sapiens
cuggauacaucuacugaaa

SEQ ID NO: 1096533 - RNA, 19 nt, Homo sapiens
ggauaaucaccaucucuuu

SEQ ID NO: 1096534 - RNA, 19 nt, Homo sapiens
agaacacuauucacaaaga

SEQ ID NO: 1096535 - RNA, 19 nt, Homo sapiens
gcaccuggcagacauuaau

SEQ ID NO: 1096536 - RNA, 19 nt, Homo sapiens
ggauugccguccugcagaa

SEQ ID NO: 1096537 - RNA, 19 nt, Homo sapiens
gcaaucgaaagguauuuga

SEQ ID NO: 1096538 - RNA, 19 nt, Homo sapiens
aaacauccugaacucauua

SEQ ID NO: 1096539 - RNA, 19 nt, Homo sapiens
ggaagauugcucugaaugu

SEQ ID NO: 1096540 - RNA, 19 nt, Homo sapiens
cacagaagcaguccauuga

SEQ ID NO: 1096541 - RNA, 19 nt, Homo sapiens
gggcauuuaucaacugcuu

SEQ ID NO: 1096542 - RNA, 19 nt, Homo sapiens
gaagaauacgacacagaug

SEQ ID NO: 1096543 - RNA, 19 nt, Homo sapiens
gcuaguaccucaggcucaa

SEQ ID NO: 1096544 - RNA, 19 nt, Homo sapiens
cagaagcaguccauugagu

SEQ ID NO: 1096545 - RNA, 19 nt, Homo sapiens
ggaaggauaaucaccaucu

SEQ ID NO: 1096546 - RNA, 19 nt, Homo sapiens
ucccuuagcuggauacauc

SEQ ID NO: 1096547 - RNA, 19 nt, Homo sapiens
aaugucagaugaugauaga

SEQ ID NO: 1096548 - RNA, 19 nt, Homo sapiens
cagcaaagaagaaguuauc

SEQ ID NO: 1096549 - RNA, 19 nt, Homo sapiens
ccagucaucuguugguuac

SEQ ID NO: 1096550 - RNA, 19 nt, Homo sapiens
gccauuggauugcuaguac

SEQ ID NO: 1096551 - RNA, 19 nt, Homo sapiens
uaaggaugaugaugcagau

SEQ ID NO: 1096552 - RNA, 19 nt, Homo sapiens
gaauacgacacagaugaaa

SEQ ID NO: 1096553 - RNA, 19 nt, Homo sapiens
gaaggauaaucaccaucuc

SEQ ID NO: 1096554 - RNA, 19 nt, Homo sapiens
caacuggcuuggaagucuu

SEQ ID NO: 1096555 - RNA, 19 nt, Homo sapiens
gaggaagaagacauguaua

SEQ ID NO: 1096556 - RNA, 19 nt, Homo sapiens
gcagcgauuuauacaacug

SEQ ID NO: 1096557 - RNA, 19 nt, Homo sapiens
gaucuugaaacguugagaa

SEQ ID NO: 1096558 - RNA, 19 nt, Homo sapiens
agaaaguggacacauguuu

SEQ ID NO: 1096559 - RNA, 19 nt, Homo sapiens
aaaugacuguggcuuugaa

SEQ ID NO: 1096560 - RNA, 19 nt, Homo sapiens
cagaacagaacacuauuca

SEQ ID NO: 1096561 - RNA, 19 nt, Homo sapiens
guaguacuuuguugggaau

SEQ ID NO: 1096562 - RNA, 19 nt, Homo sapiens
aaagggagaccauuucauc

SEQ ID NO: 1096563 - RNA, 19 nt, Homo sapiens
ggauacaucuacugaaacc

SEQ ID NO: 1096564 - RNA, 19 nt, Homo sapiens
gaacucauuaccuucaagu

SEQ ID NO: 1096565 - RNA, 19 nt, Homo sapiens
ugaagaagaauacgacaca

SEQ ID NO: 1096566 - RNA, 19 nt, Homo sapiens
uaaaaugacuguggcuuug

SEQ ID NO: 1096567 - RNA, 19 nt, Homo sapiens
caaggagcaguaucaauuc

SEQ ID NO: 1096568 - RNA, 19 nt, Homo sapiens
gcaguuuauugaccagcuu

SEQ ID NO: 1096569 - RNA, 19 nt, Homo sapiens
gaaaucuuggcaaucgaaa

SEQ ID NO: 1096570 - RNA, 19 nt, Homo sapiens
cucauuaccuucaaguaug

SEQ ID NO: 1096571 - RNA, 19 nt, Homo sapiens
gcacacagcuguauuaaaa

SEQ ID NO: 1096572 - RNA, 19 nt, Homo sapiens
gcaaugccaugccacauau

SEQ ID NO: 1096573 - RNA, 19 nt, Homo sapiens
gaguuaagccaaaguauaa

SEQ ID NO: 1096574 - RNA, 19 nt, Homo sapiens
ccagaaagcugcacacaag

SEQ ID NO: 1096575 - RNA, 19 nt, Homo sapiens
ggauagaugucauucacaa

SEQ ID NO: 1096576 - RNA, 19 nt, Homo sapiens
ccagaaaacucaaggaaua

SEQ ID NO: 1096577 - RNA, 19 nt, Homo sapiens
ggaguuaagccaaaguaua

SEQ ID NO: 1096578 - RNA, 19 nt, Homo sapiens
gaaucaaagugguuauguu

SEQ ID NO: 1096579 - RNA, 19 nt, Homo sapiens
aaacagaauuggcugcauu

SEQ ID NO: 1096580 - RNA, 19 nt, Homo sapiens
ccaggacgcuuucaaggaa

SEQ ID NO: 1096581 - RNA, 19 nt, Homo sapiens
ucaguuacuugauggcuua

SEQ ID NO: 1096582 - RNA, 19 nt, Homo sapiens
ggagcacacagcuguauua

SEQ ID NO: 1096583 - RNA, 19 nt, Homo sapiens
ccacaaacauggaaucucu

SEQ ID NO: 1096584 - RNA, 19 nt, Homo sapiens
gagagucgccaacacauuu

SEQ ID NO: 1096585 - RNA, 19 nt, Homo sapiens
ccaaaggucacucuuauga

SEQ ID NO: 1096586 - RNA, 19 nt, Homo sapiens
gaucuauccuucuguggaa

SEQ ID NO: 1096587 - RNA, 19 nt, Homo sapiens
gaagcaggcugagaaagug

SEQ ID NO: 1096588 - RNA, 19 nt, Homo sapiens
gugguuauguucugaguuu

SEQ ID NO: 1096589 - RNA, 19 nt, Homo sapiens
gaggcacugugaaauuuaa

SEQ ID NO: 1096590 - RNA, 19 nt, Homo sapiens
cauggaaucucuucuuugu

SEQ ID NO: 1096591 - RNA, 19 nt, Homo sapiens
gaauggauguugguuauac

SEQ ID NO: 1096592 - RNA, 19 nt, Homo sapiens
aaaggucacucuuaugaau

SEQ ID NO: 1096593 - RNA, 19 nt, Homo sapiens
cuagacaguuucaaaguga

SEQ ID NO: 1096594 - RNA, 19 nt, Homo sapiens
gaccauaucuaguagugau

SEQ ID NO: 1096595 - RNA, 19 nt, Homo sapiens
guuacuugauggcuuauaa

SEQ ID NO: 1096596 - RNA, 19 nt, Homo sapiens
aaaguuggauauugcguuu

SEQ ID NO: 1096597 - RNA, 19 nt, Homo sapiens
ggaccaguuuagaaggaua

SEQ ID NO: 1096598 - RNA, 19 nt, Homo sapiens
gacguggacuggcucguaa

SEQ ID NO: 1096599 - RNA, 19 nt, Homo sapiens
ugccacauauuaagacaua

SEQ ID NO: 1096600 - RNA, 19 nt, Homo sapiens
caaagugguuauguucuga

SEQ ID NO: 1096601 - RNA, 19 nt, Homo sapiens
gcaaggagcagcaaaugag

SEQ ID NO: 1096602 - RNA, 19 nt, Homo sapiens
guaaagaucggccauggau

SEQ ID NO: 1096603 - RNA, 19 nt, Homo sapiens
ccagaacuguauggaagua

SEQ ID NO: 1096604 - RNA, 19 nt, Homo sapiens
gaaagcaagacuccaggaa

SEQ ID NO: 1096605 - RNA, 19 nt, Homo sapiens
agacaucucugcucccaau

SEQ ID NO: 1096606 - RNA, 19 nt, Homo sapiens
gaucucaucaguuacuuga

SEQ ID NO: 1096607 - RNA, 19 nt, Homo sapiens
gaugguggaugccuguaau

SEQ ID NO: 1096608 - RNA, 19 nt, Homo sapiens
agucuuauuugcacccuua

SEQ ID NO: 1096609 - RNA, 19 nt, Homo sapiens
caagcacgaucucucugaa

SEQ ID NO: 1096610 - RNA, 19 nt, Homo sapiens
gaccucggcuggugucugu

SEQ ID NO: 1096611 - RNA, 19 nt, Homo sapiens
gaaauucagcaauacagau

SEQ ID NO: 1096612 - RNA, 19 nt, Homo sapiens
ccaucuaccucuucucuuc

SEQ ID NO: 1096613 - RNA, 19 nt, Homo sapiens
cauuuggucuagacaguuu

SEQ ID NO: 1096614 - RNA, 19 nt, Homo sapiens
gcagaagcaggcugagaaa

SEQ ID NO: 1096615 - RNA, 19 nt, Homo sapiens
aaagaucggccauggauau

SEQ ID NO: 1096616 - RNA, 19 nt, Homo sapiens
caccagaguucaggaagaa

SEQ ID NO: 1096617 - RNA, 19 nt, Homo sapiens
ggagguggaccauaucuag

SEQ ID NO: 1096618 - RNA, 19 nt, Homo sapiens
uaaggaguauaaugucuca

SEQ ID NO: 1096619 - RNA, 19 nt, Homo sapiens
uggaaucucuucuuuguac

SEQ ID NO: 1096620 - RNA, 19 nt, Homo sapiens
ucaaagugguuauguucug

SEQ ID NO: 1096621 - RNA, 19 nt, Homo sapiens
ccaaagaacugaaaaucau

SEQ ID NO: 1096622 - RNA, 19 nt, Homo sapiens
aacauggaaucucuucuuu

SEQ ID NO: 1096623 - RNA, 19 nt, Homo sapiens
cgaggcggcugaaucacuu

SEQ ID NO: 1096624 - RNA, 19 nt, Homo sapiens
gaacacaccacacgaaaau

SEQ ID NO: 1096625 - RNA, 19 nt, Homo sapiens
ggaagacgaguaugagaca

SEQ ID NO: 1096626 - RNA, 19 nt, Homo sapiens
gacaagccaucuaccucuu

SEQ ID NO: 1096627 - RNA, 19 nt, Homo sapiens
gcuaaggaguauaaugucu

SEQ ID NO: 1096628 - RNA, 19 nt, Homo sapiens
gggaggcuaaggaguauaa

SEQ ID NO: 1096629 - RNA, 19 nt, Homo sapiens
ccaccagaguucaggaaga

SEQ ID NO: 1096630 - RNA, 19 nt, Homo sapiens
gagcacacagcuguauuaa

SEQ ID NO: 1096631 - RNA, 19 nt, Homo sapiens
cagcaaaugagcccaggua

SEQ ID NO: 1096632 - RNA, 19 nt, Homo sapiens
ugaaagaccaugccucauc

SEQ ID NO: 1096633 - RNA, 19 nt, Homo sapiens
ggagagucgccaacacauu

SEQ ID NO: 1096634 - RNA, 19 nt, Homo sapiens
ugaugcugcugcucuauga

SEQ ID NO: 1096635 - RNA, 19 nt, Homo sapiens
gugauaagcgagaggcuaa

SEQ ID NO: 1096636 - RNA, 19 nt, Homo sapiens
uugaggcacugugaaauuu

SEQ ID NO: 1096637 - RNA, 19 nt, Homo sapiens
agaacuguauggaaguaaa

SEQ ID NO: 1096638 - RNA, 19 nt, Homo sapiens
aaccagaaaugccgcagaa

SEQ ID NO: 1096639 - RNA, 19 nt, Homo sapiens
gcaaaugagcccagguaca

SEQ ID NO: 1096640 - RNA, 19 nt, Homo sapiens
aaacauggaaucucuucuu

SEQ ID NO: 1096641 - RNA, 19 nt, Homo sapiens
gcggaccaguuuagaagga

SEQ ID NO: 1096642 - RNA, 19 nt, Homo sapiens
gauaauuggggacauuuua

SEQ ID NO: 1096643 - RNA, 19 nt, Homo sapiens
cgaucucucugaaacaaau

SEQ ID NO: 1096644 - RNA, 19 nt, Homo sapiens
aaaugaugcugcugcucua

SEQ ID NO: 1096645 - RNA, 19 nt, Homo sapiens
caggcaaaguuggauauug

SEQ ID NO: 1096646 - RNA, 19 nt, Homo sapiens
ugaugaaagugaggaagaa

SEQ ID NO: 1096647 - RNA, 19 nt, Homo sapiens
caaaggucacucuuaugaa

SEQ ID NO: 1096648 - RNA, 19 nt, Homo sapiens
uuccaaaggucacucuuau

SEQ ID NO: 1096649 - RNA, 19 nt, Homo sapiens
gggagccgaugaaucaaag

SEQ ID NO: 1096650 - RNA, 19 nt, Homo sapiens
ggccaagccuuacgagaac

SEQ ID NO: 1096651 - RNA, 19 nt, Homo sapiens
cugaaucacuugagguuag

SEQ ID NO: 1096652 - RNA, 19 nt, Homo sapiens
cacuugagguuaggaguuu

SEQ ID NO: 1096653 - RNA, 19 nt, Homo sapiens
ccacaucaaggauauuuua

SEQ ID NO: 1096654 - RNA, 19 nt, Homo sapiens
uuugggacaugcuggauaa

SEQ ID NO: 1096655 - RNA, 19 nt, Homo sapiens
gaugagcugcaaccagaaa

SEQ ID NO: 1096656 - RNA, 19 nt, Homo sapiens
gaaaaugugcggaccaguu

SEQ ID NO: 1096657 - RNA, 19 nt, Homo sapiens
gggacaugcuggauaaagg

SEQ ID NO: 1096658 - RNA, 19 nt, Homo sapiens
gagguuaggaguuugagau

SEQ ID NO: 1096659 - RNA, 19 nt, Homo sapiens
ucuagacaguuucaaagug

SEQ ID NO: 1096660 - RNA, 19 nt, Homo sapiens
uuuccucccuucagcauuu

SEQ ID NO: 1096661 - RNA, 19 nt, Homo sapiens
aaagcaagacuccaggaaa

SEQ ID NO: 1096662 - RNA, 19 nt, Homo sapiens
gguuauguucugaguuuaa

SEQ ID NO: 1096663 - RNA, 19 nt, Homo sapiens
ggauauugcguuuggaaca

SEQ ID NO: 1096664 - RNA, 19 nt, Homo sapiens
augaauggauguugguuau

SEQ ID NO: 1096665 - RNA, 19 nt, Homo sapiens
cacgaucucucugaaacaa

SEQ ID NO: 1096666 - RNA, 19 nt, Homo sapiens
gaggaagacgaguaugaga

SEQ ID NO: 1096667 - RNA, 19 nt, Homo sapiens
gaaaccccgucucuacaaa

SEQ ID NO: 1096668 - RNA, 19 nt, Homo sapiens
gcacacaagaggaaaauau

SEQ ID NO: 1096669 - RNA, 19 nt, Homo sapiens
ggauguugguuauacuuuu

SEQ ID NO: 1096670 - RNA, 19 nt, Homo sapiens
uaugaauggauguugguua

SEQ ID NO: 1096671 - RNA, 19 nt, Homo sapiens
gaguuuagguugcaaguuu

SEQ ID NO: 1096672 - RNA, 19 nt, Homo sapiens
caucuccucuucagaaaua

SEQ ID NO: 1096673 - RNA, 19 nt, Homo sapiens
caucagggcugcauuguca

SEQ ID NO: 1096674 - RNA, 19 nt, Homo sapiens
gguuagggcuucucucauu

SEQ ID NO: 1096675 - RNA, 19 nt, Homo sapiens
ugucugaacugaacaugua

SEQ ID NO: 1096676 - RNA, 19 nt, Homo sapiens
acagaugaaucccuauuaa

SEQ ID NO: 1096677 - RNA, 19 nt, Homo sapiens
agaaauaggucccucuuca

SEQ ID NO: 1096678 - RNA, 19 nt, Homo sapiens
gcaguuugaaguaugauua

SEQ ID NO: 1096679 - RNA, 19 nt, Homo sapiens
gggcuucucucauuccauu

SEQ ID NO: 1096680 - RNA, 19 nt, Homo sapiens
caagaaguguugagugugu

SEQ ID NO: 1096681 - RNA, 19 nt, Homo sapiens
gcaguuggagcgcgaguua

SEQ ID NO: 1096682 - RNA, 19 nt, Homo sapiens
gaagguaggaagagacaaa

SEQ ID NO: 1096683 - RNA, 19 nt, Homo sapiens
gaagaaagagggagagaag

SEQ ID NO: 1096684 - RNA, 19 nt, Homo sapiens
cuaaagcgguuccugguau

SEQ ID NO: 1096685 - RNA, 19 nt, Homo sapiens
gaaucccuauuaaacauga

SEQ ID NO: 1096686 - RNA, 19 nt, Homo sapiens
aaacaucuccucuucagaa

SEQ ID NO: 1096687 - RNA, 19 nt, Homo sapiens
caagaagggagaccuguuu

SEQ ID NO: 1096688 - RNA, 19 nt, Homo sapiens
cugcuugaguuguuucuua

SEQ ID NO: 1096689 - RNA, 19 nt, Homo sapiens
aagggcagcuugcggguua

SEQ ID NO: 1096690 - RNA, 19 nt, Homo sapiens
gaagggagaccuguuuguu

SEQ ID NO: 1096691 - RNA, 19 nt, Homo sapiens
gaauuuggccuggcauauu

SEQ ID NO: 1096692 - RNA, 19 nt, Homo sapiens
gauggucuguucuaucuca

SEQ ID NO: 1096693 - RNA, 19 nt, Homo sapiens
ccaguacaauguuagaguu

SEQ ID NO: 1096694 - RNA, 19 nt, Homo sapiens
ggauuugauuucaggugua

SEQ ID NO: 1096695 - RNA, 19 nt, Homo sapiens
ggaagagacaaacgccuaa

SEQ ID NO: 1096696 - RNA, 19 nt, Homo sapiens
gaaguaugauuagguacau

SEQ ID NO: 1096697 - RNA, 19 nt, Homo sapiens
ucacagcccuuuggccauu

SEQ ID NO: 1096698 - RNA, 19 nt, Homo sapiens
aauuuggccuggcauauuu

SEQ ID NO: 1096699 - RNA, 19 nt, Homo sapiens
gcugaaaauucuucugaua

SEQ ID NO: 1096700 - RNA, 19 nt, Homo sapiens
ucaauguucucuuuaaguc

SEQ ID NO: 1096701 - RNA, 19 nt, Homo sapiens
gcagcagucccuaaccuuu

SEQ ID NO: 1096702 - RNA, 19 nt, Homo sapiens
gaaaggcacuggggagauu

SEQ ID NO: 1096703 - RNA, 19 nt, Homo sapiens
ucaugcagcuaaccucuga

SEQ ID NO: 1096704 - RNA, 19 nt, Homo sapiens
gagcgcgaguuacaguuga

SEQ ID NO: 1096705 - RNA, 19 nt, Homo sapiens
gaugaaucccuauuaaaca

SEQ ID NO: 1096706 - RNA, 19 nt, Homo sapiens
uggcuaaccuuacuguguu

SEQ ID NO: 1096707 - RNA, 19 nt, Homo sapiens
ugaccaauaucaccuucuu

SEQ ID NO: 1096708 - RNA, 19 nt, Homo sapiens
gcauuagagucucauaagg

SEQ ID NO: 1096709 - RNA, 19 nt, Homo sapiens
ccagcaguuugaaguauga

SEQ ID NO: 1096710 - RNA, 19 nt, Homo sapiens
agaccuguuuguuucauuu

SEQ ID NO: 1096711 - RNA, 19 nt, Homo sapiens
caucagagacaccauggaa

SEQ ID NO: 1096712 - RNA, 19 nt, Homo sapiens
gaagcagcagcgacucuaa

SEQ ID NO: 1096713 - RNA, 19 nt, Homo sapiens
guaaaggaagguaggaaga

SEQ ID NO: 1096714 - RNA, 19 nt, Homo sapiens
aaauaggucccucuucauu

SEQ ID NO: 1096715 - RNA, 19 nt, Homo sapiens
gaaauaggucccucuucau

SEQ ID NO: 1096716 - RNA, 19 nt, Homo sapiens
guacaucagggcugcauug

SEQ ID NO: 1096717 - RNA, 19 nt, Homo sapiens
gcagcuaaccucugaugug

SEQ ID NO: 1096718 - RNA, 19 nt, Homo sapiens
gaguuuggguucauuaaaa

SEQ ID NO: 1096719 - RNA, 19 nt, Homo sapiens
cagaugaaucccuauuaaa

SEQ ID NO: 1096720 - RNA, 19 nt, Homo sapiens
guacaauguuagaguuugg

SEQ ID NO: 1096721 - RNA, 19 nt, Homo sapiens
aaaggaagguaggaagaga

SEQ ID NO: 1096722 - RNA, 19 nt, Homo sapiens
gcuaaagcgguuccuggua

SEQ ID NO: 1096723 - RNA, 19 nt, Homo sapiens
gauuugauuucagguguau

SEQ ID NO: 1096724 - RNA, 19 nt, Homo sapiens
gggagggauuucacaagug

SEQ ID NO: 1096725 - RNA, 19 nt, Homo sapiens
agucauuacugguauugaa

SEQ ID NO: 1096726 - RNA, 19 nt, Homo sapiens
gagaccuguuuguuucauu

SEQ ID NO: 1096727 - RNA, 19 nt, Homo sapiens
uaaagcgguuccugguaug

SEQ ID NO: 1096728 - RNA, 19 nt, Homo sapiens
ggaagcagcagcgacucua

SEQ ID NO: 1096729 - RNA, 19 nt, Homo sapiens
aaacagaugaaucccuauu

SEQ ID NO: 1096730 - RNA, 19 nt, Homo sapiens
ccucagaucaucaggcauu

SEQ ID NO: 1096731 - RNA, 19 nt, Homo sapiens
cuuccacucuccuauuauu

SEQ ID NO: 1096732 - RNA, 19 nt, Homo sapiens
agggagaccuguuuguuuc

SEQ ID NO: 1096733 - RNA, 19 nt, Homo sapiens
agucuuuccugaccaauau

SEQ ID NO: 1096734 - RNA, 19 nt, Homo sapiens
auaaggagcacgcaaccua

SEQ ID NO: 1096735 - RNA, 19 nt, Homo sapiens
ggaauuuggccuggcauau

SEQ ID NO: 1096736 - RNA, 19 nt, Homo sapiens
ggugaaacucucuaaaaua

SEQ ID NO: 1096737 - RNA, 19 nt, Homo sapiens
gcucugugacugcauaguu

SEQ ID NO: 1096738 - RNA, 19 nt, Homo sapiens
gugggccucuggugagaaa

SEQ ID NO: 1096739 - RNA, 19 nt, Homo sapiens
gugaaacucucuaaaauac

SEQ ID NO: 1096740 - RNA, 19 nt, Homo sapiens
ggagcgcgaguuacaguug

SEQ ID NO: 1096741 - RNA, 19 nt, Homo sapiens
gaucaucaggcauuagagu

SEQ ID NO: 1096742 - RNA, 19 nt, Homo sapiens
gggagggcuggaaguguua

SEQ ID NO: 1096743 - RNA, 19 nt, Homo sapiens
cauuagagucucauaagga

SEQ ID NO: 1096744 - RNA, 19 nt, Homo sapiens
aaacuuccaccucagauca

SEQ ID NO: 1096745 - RNA, 19 nt, Homo sapiens
cccguuggcugcuugaguu

SEQ ID NO: 1096746 - RNA, 19 nt, Homo sapiens
uuagcucugugacugcaua

SEQ ID NO: 1096747 - RNA, 19 nt, Homo sapiens
ggacacgaggcccugaaga

SEQ ID NO: 1096748 - RNA, 19 nt, Homo sapiens
guuagggcuucucucauuc

SEQ ID NO: 1096749 - RNA, 19 nt, Homo sapiens
gcaugcgcaguucacaaua

SEQ ID NO: 1096750 - RNA, 19 nt, Homo sapiens
guccuguccuuguucuauu

SEQ ID NO: 1096751 - RNA, 19 nt, Homo sapiens
gaaacuuccaccucagauc

SEQ ID NO: 1096752 - RNA, 19 nt, Homo sapiens
agcaagaaguguugagugu

SEQ ID NO: 1096753 - RNA, 19 nt, Homo sapiens
uuggguuucuuguuuguuu

SEQ ID NO: 1096754 - RNA, 19 nt, Homo sapiens
aagggagaccuguuuguuu

SEQ ID NO: 1096755 - RNA, 19 nt, Homo sapiens
gagagaagagcgccuacuc

SEQ ID NO: 1096756 - RNA, 19 nt, Homo sapiens
gcacaaaccccaggagaga

SEQ ID NO: 1096757 - RNA, 19 nt, Homo sapiens
ucagagacaccauggaaca

SEQ ID NO: 1096758 - RNA, 19 nt, Homo sapiens
cagaucaucaggcauuaga

SEQ ID NO: 1096759 - RNA, 19 nt, Homo sapiens
cuaaagcagcagucccuaa

SEQ ID NO: 1096760 - RNA, 19 nt, Homo sapiens
gcccugaagagaagaaaga

SEQ ID NO: 1096761 - RNA, 19 nt, Homo sapiens
ggagaccuguuuguuucau

SEQ ID NO: 1096762 - RNA, 19 nt, Homo sapiens
ggcuauggauuugauuuca

SEQ ID NO: 1096763 - RNA, 19 nt, Homo sapiens
aacagaugaaucccuauua

SEQ ID NO: 1096764 - RNA, 19 nt, Homo sapiens
guuagaguuuggguucauu

SEQ ID NO: 1096765 - RNA, 19 nt, Homo sapiens
ggguggugguggaggauga

SEQ ID NO: 1096766 - RNA, 19 nt, Homo sapiens
guuggcugcuugaguuguu

SEQ ID NO: 1096767 - RNA, 19 nt, Homo sapiens
ccaauaucaccuucuugaa

SEQ ID NO: 1096768 - RNA, 19 nt, Homo sapiens
ggcuaaccuuacuguguuu

SEQ ID NO: 1096769 - RNA, 19 nt, Homo sapiens
cuuccugcuuuaauucuuu

SEQ ID NO: 1096770 - RNA, 19 nt, Homo sapiens
gggcagcacaucagagaca

SEQ ID NO: 1096771 - RNA, 19 nt, Homo sapiens
gcacaaugcugccuccuuu

SEQ ID NO: 1096772 - RNA, 19 nt, Homo sapiens
ggauaucccuaacccauua

SEQ ID NO: 1096773 - RNA, 19 nt, Homo sapiens
ggacauagcacuuuaaaca

SEQ ID NO: 1096774 - RNA, 19 nt, Homo sapiens
gauauuggcuacucccuuu

SEQ ID NO: 1096775 - RNA, 19 nt, Homo sapiens
ggaaguaguucuguaaaga

SEQ ID NO: 1096776 - RNA, 19 nt, Homo sapiens
agaaguaggugaauggaua

SEQ ID NO: 1096777 - RNA, 19 nt, Homo sapiens
gggcauggcuuuaggaaau

SEQ ID NO: 1096778 - RNA, 19 nt, Homo sapiens
gaacagaaguaggugaaug

SEQ ID NO: 1096779 - RNA, 19 nt, Homo sapiens
gagcagcacuaagagauaa

SEQ ID NO: 1096780 - RNA, 19 nt, Homo sapiens
ugaaggacauagcacuuua

SEQ ID NO: 1096781 - RNA, 19 nt, Homo sapiens
ggaccugacuugcuaagga

SEQ ID NO: 1096782 - RNA, 19 nt, Homo sapiens
ggaaugccuuuaaaucaga

SEQ ID NO: 1096783 - RNA, 19 nt, Homo sapiens
ccaccucagucaagaauuu

SEQ ID NO: 1096784 - RNA, 19 nt, Homo sapiens
gaaguuguacgaaguagaa

SEQ ID NO: 1096785 - RNA, 19 nt, Homo sapiens
gaauauuguucgacuuuca

SEQ ID NO: 1096786 - RNA, 19 nt, Homo sapiens
gcacagcuagcaaaucaaa

SEQ ID NO: 1096787 - RNA, 19 nt, Homo sapiens
cuacgacaguguugaguuu

SEQ ID NO: 1096788 - RNA, 19 nt, Homo sapiens
gcuagggauuugucuauug

SEQ ID NO: 1096789 - RNA, 19 nt, Homo sapiens
uaaaucagaucuugaacca

SEQ ID NO: 1096790 - RNA, 19 nt, Homo sapiens
aagcacagcuagcaaauca

SEQ ID NO: 1096791 - RNA, 19 nt, Homo sapiens
cuaagaggauuucaugugu

SEQ ID NO: 1096792 - RNA, 19 nt, Homo sapiens
guaggugaauggauaggaa

SEQ ID NO: 1096793 - RNA, 19 nt, Homo sapiens
aagaggauuucauguguuu

SEQ ID NO: 1096794 - RNA, 19 nt, Homo sapiens
ucaaacaaguucugaagca

SEQ ID NO: 1096795 - RNA, 19 nt, Homo sapiens
caacaugcuucucccaaca

SEQ ID NO: 1096796 - RNA, 19 nt, Homo sapiens
gaccugacuugcuaaggaa

SEQ ID NO: 1096797 - RNA, 19 nt, Homo sapiens
gaaggacauagcacuuuaa

SEQ ID NO: 1096798 - RNA, 19 nt, Homo sapiens
gauuucauguguuuccauu

SEQ ID NO: 1096799 - RNA, 19 nt, Homo sapiens
cccauuaauugcuggaaua

SEQ ID NO: 1096800 - RNA, 19 nt, Homo sapiens
gggaaugccuuuaaaucag

SEQ ID NO: 1096801 - RNA, 19 nt, Homo sapiens
uaagaggauuucauguguu

SEQ ID NO: 1096802 - RNA, 19 nt, Homo sapiens
cuucagaacauaccuuuaa

SEQ ID NO: 1096803 - RNA, 19 nt, Homo sapiens
uaaagagucagccugguuu

SEQ ID NO: 1096804 - RNA, 19 nt, Homo sapiens
cuaguuugcuauccuuauu

SEQ ID NO: 1096805 - RNA, 19 nt, Homo sapiens
aaaacaaacuugcugguaa

SEQ ID NO: 1096806 - RNA, 19 nt, Homo sapiens
guaaagagucagccugguu

SEQ ID NO: 1096807 - RNA, 19 nt, Homo sapiens
gcuaagaggauuucaugug

SEQ ID NO: 1096808 - RNA, 19 nt, Homo sapiens
caucuugcagguuuaauaa

SEQ ID NO: 1096809 - RNA, 19 nt, Homo sapiens
caaacuugcugguaacaac

SEQ ID NO: 1096810 - RNA, 19 nt, Homo sapiens
ccaaagcacagcuagcaaa

SEQ ID NO: 1096811 - RNA, 19 nt, Homo sapiens
uuacuacagucuaugaguu

SEQ ID NO: 1096812 - RNA, 19 nt, Homo sapiens
ucaguucaaugucucaguu

SEQ ID NO: 1096813 - RNA, 19 nt, Homo sapiens
guaguucuguaaagaguca

SEQ ID NO: 1096814 - RNA, 19 nt, Homo sapiens
cuaacuuuguucacaguaa

SEQ ID NO: 1096815 - RNA, 19 nt, Homo sapiens
gcuauaaucaaacaaguuc

SEQ ID NO: 1096816 - RNA, 19 nt, Homo sapiens
gcugucuucuaauguguuu

SEQ ID NO: 1096817 - RNA, 19 nt, Homo sapiens
ccaccaucuugcagguuua

SEQ ID NO: 1096818 - RNA, 19 nt, Homo sapiens
gaagcagggucaggguuca

SEQ ID NO: 1096819 - RNA, 19 nt, Homo sapiens
uagcaauucuggagcuguu

SEQ ID NO: 1096820 - RNA, 19 nt, Homo sapiens
aaacaaacuugcugguaac

SEQ ID NO: 1096821 - RNA, 19 nt, Homo sapiens
cagcuaagaggauuucaug

SEQ ID NO: 1096822 - RNA, 19 nt, Homo sapiens
uugggaagauuaacagcua

SEQ ID NO: 1096823 - RNA, 19 nt, Homo sapiens
guguuuccauuauuuguug

SEQ ID NO: 1096824 - RNA, 19 nt, Homo sapiens
uuacagaucccaguaugaa

SEQ ID NO: 1096825 - RNA, 19 nt, Homo sapiens
gaaguaguucuguaaagag

SEQ ID NO: 1096826 - RNA, 19 nt, Homo sapiens
caaugcaaacacuaacuuu

SEQ ID NO: 1096827 - RNA, 19 nt, Homo sapiens
gcuagcaaaucaaaacaaa

SEQ ID NO: 1096828 - RNA, 19 nt, Homo sapiens
acccaaagguacuaaacuu

SEQ ID NO: 1096829 - RNA, 19 nt, Homo sapiens
ccaucuugcagguuuaaua

SEQ ID NO: 1096830 - RNA, 19 nt, Homo sapiens
gccgugcacugccacaaug

SEQ ID NO: 1096831 - RNA, 19 nt, Homo sapiens
guucgacuuucacuugguu

SEQ ID NO: 1096832 - RNA, 19 nt, Homo sapiens
acagaaugcuagggauuug

SEQ ID NO: 1096833 - RNA, 19 nt, Homo sapiens
cgagcagcacuaagagaua

SEQ ID NO: 1096834 - RNA, 19 nt, Homo sapiens
caaagcacagcuagcaaau

SEQ ID NO: 1096835 - RNA, 19 nt, Homo sapiens
acuccaaacugcaaaauaa

SEQ ID NO: 1096836 - RNA, 19 nt, Homo sapiens
ggcauggcuuuaggaaauu

SEQ ID NO: 1096837 - RNA, 19 nt, Homo sapiens
gaaguaggugaauggauag

SEQ ID NO: 1096838 - RNA, 19 nt, Homo sapiens
gccuuuaaaucagaucuug

SEQ ID NO: 1096839 - RNA, 19 nt, Homo sapiens
gaagauuaacagcuaagag

SEQ ID NO: 1096840 - RNA, 19 nt, Homo sapiens
caauccaccucagucaaga

SEQ ID NO: 1096841 - RNA, 19 nt, Homo sapiens
ucacuugaguagcaauagu

SEQ ID NO: 1096842 - RNA, 19 nt, Homo sapiens
uucaaugucucaguuacua

SEQ ID NO: 1096843 - RNA, 19 nt, Homo sapiens
gcagggucaggguucauuu

SEQ ID NO: 1096844 - RNA, 19 nt, Homo sapiens
acuaagagauaagcugaug

SEQ ID NO: 1096845 - RNA, 19 nt, Homo sapiens
cgaaguagaaggcugucuu

SEQ ID NO: 1096846 - RNA, 19 nt, Homo sapiens
ugaagcagguaugguuuua

SEQ ID NO: 1096847 - RNA, 19 nt, Homo sapiens
cagcuauaaucaaacaagu

SEQ ID NO: 1096848 - RNA, 19 nt, Homo sapiens
cugcuaaccagcugcauuu

SEQ ID NO: 1096849 - RNA, 19 nt, Homo sapiens
guucauuucccaucaguuc

SEQ ID NO: 1096850 - RNA, 19 nt, Homo sapiens
uggcaacacugaaggacau

SEQ ID NO: 1096851 - RNA, 19 nt, Homo sapiens
cggaaguaguucuguaaag

SEQ ID NO: 1096852 - RNA, 19 nt, Homo sapiens
cuagaaguuguacgaagua

SEQ ID NO: 1096853 - RNA, 19 nt, Homo sapiens
acuagaaguuguacgaagu

SEQ ID NO: 1096854 - RNA, 19 nt, Homo sapiens
gaauggauaggaaaaggua

SEQ ID NO: 1096855 - RNA, 19 nt, Homo sapiens
cuagggauuugucuauugg

SEQ ID NO: 1096856 - RNA, 19 nt, Homo sapiens
gcagcuauaaucaaacaag

SEQ ID NO: 1096857 - RNA, 19 nt, Homo sapiens
gccacaaugcaaacacuaa

SEQ ID NO: 1096858 - RNA, 19 nt, Homo sapiens
cagaacauaccuuuaagag

SEQ ID NO: 1096859 - RNA, 19 nt, Homo sapiens
ugggaaugccuuuaaauca

SEQ ID NO: 1096860 - RNA, 19 nt, Homo sapiens
gccggaaguaguucuguaa

SEQ ID NO: 1096861 - RNA, 19 nt, Homo sapiens
agucucaaauggauaguuc

SEQ ID NO: 1096862 - RNA, 19 nt, Homo sapiens
uaagagauaagcugauguc

SEQ ID NO: 1096863 - RNA, 19 nt, Homo sapiens
gaaugccuuuaaaucagau

SEQ ID NO: 1096864 - RNA, 19 nt, Homo sapiens
ggaagauuaacagcuaaga

SEQ ID NO: 1096865 - RNA, 19 nt, Homo sapiens
uaacuuuguucacaguaac

SEQ ID NO: 1096866 - RNA, 19 nt, Homo sapiens
gcaucugccggaaguaguu

SEQ ID NO: 1096867 - RNA, 19 nt, Homo sapiens
gacauguccuuggucuaug

SEQ ID NO: 1096868 - RNA, 19 nt, Homo sapiens
gcauggcuuuaggaaauuc

SEQ ID NO: 1096869 - RNA, 19 nt, Homo sapiens
uaacagcuaagaggauuuc

SEQ ID NO: 1096870 - RNA, 19 nt, Homo sapiens
gauuaacagcuaagaggau

SEQ ID NO: 1096871 - RNA, 19 nt, Homo sapiens
ccacauggaucacuauuga

SEQ ID NO: 1096872 - RNA, 19 nt, Homo sapiens
gaagaaagccauacaacga

SEQ ID NO: 1096873 - RNA, 19 nt, Homo sapiens
uaagguugcugagucauua

SEQ ID NO: 1096874 - RNA, 19 nt, Homo sapiens
ggagucagauccuagauuc

SEQ ID NO: 1096875 - RNA, 19 nt, Homo sapiens
gagaagcccuguccaacga

SEQ ID NO: 1096876 - RNA, 19 nt, Homo sapiens
ccaccagacuugcuccaua

SEQ ID NO: 1096877 - RNA, 19 nt, Homo sapiens
gaaggucuauggcaagcaa

SEQ ID NO: 1096878 - RNA, 19 nt, Homo sapiens
gaaguggagucagauccua

SEQ ID NO: 1096879 - RNA, 19 nt, Homo sapiens
gaagagaagcccuguccaa

SEQ ID NO: 1096880 - RNA, 19 nt, Homo sapiens
gaagcccuguccaacgaua

SEQ ID NO: 1096881 - RNA, 19 nt, Homo sapiens
gaguagcacugcacuguca

SEQ ID NO: 1096882 - RNA, 19 nt, Homo sapiens
uagcagauauuaccugauc

SEQ ID NO: 1096883 - RNA, 19 nt, Homo sapiens
caagauuaccucaguaguu

SEQ ID NO: 1096884 - RNA, 19 nt, Homo sapiens
gagcuugucauaauaauag

SEQ ID NO: 1096885 - RNA, 19 nt, Homo sapiens
gauuggcccugcuccguuu

SEQ ID NO: 1096886 - RNA, 19 nt, Homo sapiens
ucagugggcugccuguuug

SEQ ID NO: 1096887 - RNA, 19 nt, Homo sapiens
cauuaggaaucacagaauu

SEQ ID NO: 1096888 - RNA, 19 nt, Homo sapiens
gucugacgcucaugaguuu

SEQ ID NO: 1096889 - RNA, 19 nt, Homo sapiens
gagagaaugcuuuggaaca

SEQ ID NO: 1096890 - RNA, 19 nt, Homo sapiens
aagauuaccucaguaguuc

SEQ ID NO: 1096891 - RNA, 19 nt, Homo sapiens
acagugaaguggagucaga

SEQ ID NO: 1096892 - RNA, 19 nt, Homo sapiens
uauaggugcugcucucuca

SEQ ID NO: 1096893 - RNA, 19 nt, Homo sapiens
aggagacccuggaaauaaa

SEQ ID NO: 1096894 - RNA, 19 nt, Homo sapiens
ggagcuugucauaauaaua

SEQ ID NO: 1096895 - RNA, 19 nt, Homo sapiens
cggcaagguuugugacuuc

SEQ ID NO: 1096896 - RNA, 19 nt, Homo sapiens
ggcaagcaauguauauuuu

SEQ ID NO: 1096897 - RNA, 19 nt, Homo sapiens
gauccuagauucgucugau

SEQ ID NO: 1096898 - RNA, 19 nt, Homo sapiens
cagacuugcuccauacuag

SEQ ID NO: 1096899 - RNA, 19 nt, Homo sapiens
gugccaagauuaccucagu

SEQ ID NO: 1096900 - RNA, 19 nt, Homo sapiens
ccgaugggcuuaucuuguc

SEQ ID NO: 1096901 - RNA, 19 nt, Homo sapiens
ugauaagguugcugaguca

SEQ ID NO: 1096902 - RNA, 19 nt, Homo sapiens
gaaaaggcccagaagagaa

SEQ ID NO: 1096903 - RNA, 19 nt, Homo sapiens
uggcaagcaauguauauuu

SEQ ID NO: 1096904 - RNA, 19 nt, Homo sapiens
aagaaaaugugccaagauu

SEQ ID NO: 1096905 - RNA, 19 nt, Homo sapiens
ggaucacuauugacugaag

SEQ ID NO: 1096906 - RNA, 19 nt, Homo sapiens
cgauaccacugaaucucuu

SEQ ID NO: 1096907 - RNA, 19 nt, Homo sapiens
ggagcuagcagcgagaaga

SEQ ID NO: 1096908 - RNA, 19 nt, Homo sapiens
uggagagaaugcuuuggaa

SEQ ID NO: 1096909 - RNA, 19 nt, Homo sapiens
gcugagucauuaggaauca

SEQ ID NO: 1096910 - RNA, 19 nt, Homo sapiens
guccaacgauaccacugaa

SEQ ID NO: 1096911 - RNA, 19 nt, Homo sapiens
gaaaaugugccaagauuac

SEQ ID NO: 1096912 - RNA, 19 nt, Homo sapiens
gcaccucagccgagacaug

SEQ ID NO: 1096913 - RNA, 19 nt, Homo sapiens
caccagacuugcuccauac

SEQ ID NO: 1096914 - RNA, 19 nt, Homo sapiens
gcacugucaccugaugauu

SEQ ID NO: 1096915 - RNA, 19 nt, Homo sapiens
caguaguucuggucugugu

SEQ ID NO: 1096916 - RNA, 19 nt, Homo sapiens
caacgauaccacugaaucu

SEQ ID NO: 1096917 - RNA, 19 nt, Homo sapiens
cccuggaaauaaacaauga

SEQ ID NO: 1096918 - RNA, 19 nt, Homo sapiens
cagguacaauagugucuca

SEQ ID NO: 1096919 - RNA, 19 nt, Homo sapiens
gagaaugcuuuggaacacu

SEQ ID NO: 1096920 - RNA, 19 nt, Homo sapiens
ccaggcccuugcaugcuuu

SEQ ID NO: 1096921 - RNA, 19 nt, Homo sapiens
ccaacgauaccacugaauc

SEQ ID NO: 1096922 - RNA, 19 nt, Homo sapiens
aaagaaauacacccagaca

SEQ ID NO: 1096923 - RNA, 19 nt, Homo sapiens
gcacagaugaaccuuuuau

SEQ ID NO: 1096924 - RNA, 19 nt, Homo sapiens
auggaucacuauugacuga

SEQ ID NO: 1096925 - RNA, 19 nt, Homo sapiens
ccagcguccugccuacaga

SEQ ID NO: 1096926 - RNA, 19 nt, Homo sapiens
gucagugggcugccuguuu

SEQ ID NO: 1096927 - RNA, 19 nt, Homo sapiens
ucaggcacuggcuaacuua

SEQ ID NO: 1096928 - RNA, 19 nt, Homo sapiens
gacgguuucugguggcaau

SEQ ID NO: 1096929 - RNA, 19 nt, Homo sapiens
agaaauacacccagacaac

SEQ ID NO: 1096930 - RNA, 19 nt, Homo sapiens
guugcugagucauuaggaa

SEQ ID NO: 1096931 - RNA, 19 nt, Homo sapiens
gacuugcuccauacuagaa

SEQ ID NO: 1096932 - RNA, 19 nt, Homo sapiens
ccagacuugcuccauacua

SEQ ID NO: 1096933 - RNA, 19 nt, Homo sapiens
gcccugcugucuacauuuu

SEQ ID NO: 1096934 - RNA, 19 nt, Homo sapiens
guaguucuggucuguguuc

SEQ ID NO: 1096935 - RNA, 19 nt, Homo sapiens
gcaaugggagcguguucca

SEQ ID NO: 1096936 - RNA, 19 nt, Homo sapiens
ugccaagauuaccucagua

SEQ ID NO: 1096937 - RNA, 19 nt, Homo sapiens
gcagauauuaccugaucag

SEQ ID NO: 1096938 - RNA, 19 nt, Homo sapiens
cccaggcccuugcaugcuu

SEQ ID NO: 1096939 - RNA, 19 nt, Homo sapiens
gggugucucagaagccuuu

SEQ ID NO: 1096940 - RNA, 19 nt, Homo sapiens
uggcccacauggaucacua

SEQ ID NO: 1096941 - RNA, 19 nt, Homo sapiens
gcacagguggcagcguuuc

SEQ ID NO: 1096942 - RNA, 19 nt, Homo sapiens
cuagauucgucugauuuua

SEQ ID NO: 1096943 - RNA, 19 nt, Homo sapiens
gccaagauuaccucaguag

SEQ ID NO: 1096944 - RNA, 19 nt, Homo sapiens
gagauaugcugcuuuucca

SEQ ID NO: 1096945 - RNA, 19 nt, Homo sapiens
ugggagauaugcugcuuuu

SEQ ID NO: 1096946 - RNA, 19 nt, Homo sapiens
gucauuaggaaucacagaa

SEQ ID NO: 1096947 - RNA, 19 nt, Homo sapiens
uauggcaagcaauguauau

SEQ ID NO: 1096948 - RNA, 19 nt, Homo sapiens
ccuacggaagaaagaaaua

SEQ ID NO: 1096949 - RNA, 19 nt, Homo sapiens
uucaggcacuggcuaacuu

SEQ ID NO: 1096950 - RNA, 19 nt, Homo sapiens
gccauuaccugaaauauuu

SEQ ID NO: 1096951 - RNA, 19 nt, Homo sapiens
gaaagaagugggagaaaua

SEQ ID NO: 1096952 - RNA, 19 nt, Homo sapiens
gaagagccauuaccugaaa

SEQ ID NO: 1096953 - RNA, 19 nt, Homo sapiens
ugacacagaugaaacauuu

SEQ ID NO: 1096954 - RNA, 19 nt, Homo sapiens
gaaagaagaacaacccaua

SEQ ID NO: 1096955 - RNA, 19 nt, Homo sapiens
caaagcauaugcaguuuaa

SEQ ID NO: 1096956 - RNA, 19 nt, Homo sapiens
gaagagagagcaaaucaaa

SEQ ID NO: 1096957 - RNA, 19 nt, Homo sapiens
gaacaugacaaguuaauga

SEQ ID NO: 1096958 - RNA, 19 nt, Homo sapiens
gaaaauggcuauauucuug

SEQ ID NO: 1096959 - RNA, 19 nt, Homo sapiens
gugaaucucuucucuauga

SEQ ID NO: 1096960 - RNA, 19 nt, Homo sapiens
gaagaacaacccauacuaa

SEQ ID NO: 1096961 - RNA, 19 nt, Homo sapiens
ggaaggaucauauuuagaa

SEQ ID NO: 1096962 - RNA, 19 nt, Homo sapiens
agacacugcugauguaaua

SEQ ID NO: 1096963 - RNA, 19 nt, Homo sapiens
gggaagaaauaaaguagaa

SEQ ID NO: 1096964 - RNA, 19 nt, Homo sapiens
gauguagucuccuaugaaa

SEQ ID NO: 1096965 - RNA, 19 nt, Homo sapiens
gaagggauaugcuuaugug

SEQ ID NO: 1096966 - RNA, 19 nt, Homo sapiens
aagagaacaugacaaguua

SEQ ID NO: 1096967 - RNA, 19 nt, Homo sapiens
ucagagagcuucuucuaug

SEQ ID NO: 1096968 - RNA, 19 nt, Homo sapiens
gagagcaaaucaaagcuuu

SEQ ID NO: 1096969 - RNA, 19 nt, Homo sapiens
gaacaacccauacuaagga

SEQ ID NO: 1096970 - RNA, 19 nt, Homo sapiens
gaacaguaagccuaauaua

SEQ ID NO: 1096971 - RNA, 19 nt, Homo sapiens
gaaugaaacuggaaauaac

SEQ ID NO: 1096972 - RNA, 19 nt, Homo sapiens
gaaucaagaucuccuguuc

SEQ ID NO: 1096973 - RNA, 19 nt, Homo sapiens
gaguaaagaucaaacuguu

SEQ ID NO: 1096974 - RNA, 19 nt, Homo sapiens
ggacugcucuguucgaauc

SEQ ID NO: 1096975 - RNA, 19 nt, Homo sapiens
gaugaaacauuuaccaaag

SEQ ID NO: 1096976 - RNA, 19 nt, Homo sapiens
ggacgacaguaucgccaua

SEQ ID NO: 1096977 - RNA, 19 nt, Homo sapiens
gaaggaaguuugaguucau

SEQ ID NO: 1096978 - RNA, 19 nt, Homo sapiens
ggagaaaucaguuacauca

SEQ ID NO: 1096979 - RNA, 19 nt, Homo sapiens
ucaaagacaugugcauaaa

SEQ ID NO: 1096980 - RNA, 19 nt, Homo sapiens
ggaccugugugucaguuaa

SEQ ID NO: 1096981 - RNA, 19 nt, Homo sapiens
gaaaucaguuacaucaaag

SEQ ID NO: 1096982 - RNA, 19 nt, Homo sapiens
cauaugcuauuucuggaua

SEQ ID NO: 1096983 - RNA, 19 nt, Homo sapiens
gaaauaaaggcacggaaga

SEQ ID NO: 1096984 - RNA, 19 nt, Homo sapiens
ggaggaagaagagccauua

SEQ ID NO: 1096985 - RNA, 19 nt, Homo sapiens
gcaaaacaaucacuacuga

SEQ ID NO: 1096986 - RNA, 19 nt, Homo sapiens
gcagugauuucaaagaaca

SEQ ID NO: 1096987 - RNA, 19 nt, Homo sapiens
gagagcuucuucuaugauu

SEQ ID NO: 1096988 - RNA, 19 nt, Homo sapiens
ggaggaaguuaagaagaaa

SEQ ID NO: 1096989 - RNA, 19 nt, Homo sapiens
ggaaggaaguuugaguuca

SEQ ID NO: 1096990 - RNA, 19 nt, Homo sapiens
ggaagguggucugaucaaa

SEQ ID NO: 1096991 - RNA, 19 nt, Homo sapiens
gaagaugacacagaugaaa

SEQ ID NO: 1096992 - RNA, 19 nt, Homo sapiens
aauagacacugcugaugua

SEQ ID NO: 1096993 - RNA, 19 nt, Homo sapiens
ggaaccagaugaucaggau

SEQ ID NO: 1096994 - RNA, 19 nt, Homo sapiens
caagaucuccuguucaaga

SEQ ID NO: 1096995 - RNA, 19 nt, Homo sapiens
aaagagaacaugacaaguu

SEQ ID NO: 1096996 - RNA, 19 nt, Homo sapiens
aaacuucacuggagcacaa

SEQ ID NO: 1096997 - RNA, 19 nt, Homo sapiens
agauugagccuauuaauga

SEQ ID NO: 1096998 - RNA, 19 nt, Homo sapiens
ugaaggaauuggcgucauu

SEQ ID NO: 1096999 - RNA, 19 nt, Homo sapiens
ucucugaggucuucuaaau

SEQ ID NO: 1097000 - RNA, 19 nt, Homo sapiens
gaucaggccacaucaaguu

SEQ ID NO: 1097001 - RNA, 19 nt, Homo sapiens
cagcagagaugggagaaga

SEQ ID NO: 1097002 - RNA, 19 nt, Homo sapiens
aaagggaguugaaggagaa

SEQ ID NO: 1097003 - RNA, 19 nt, Homo sapiens
gaacuggaaagaagaacaa

SEQ ID NO: 1097004 - RNA, 19 nt, Homo sapiens
ggaagaagcagaggaggaa

SEQ ID NO: 1097005 - RNA, 19 nt, Homo sapiens
cauaugcaguuuaaacgaa

SEQ ID NO: 1097006 - RNA, 19 nt, Homo sapiens
gagaagggauaugcuuaug

SEQ ID NO: 1097007 - RNA, 19 nt, Homo sapiens
ugaaagaagugggagaaau

SEQ ID NO: 1097008 - RNA, 19 nt, Homo sapiens
gacaaucccauccaaacua

SEQ ID NO: 1097009 - RNA, 19 nt, Homo sapiens
gaaaugaaggaaccagaug

SEQ ID NO: 1097010 - RNA, 19 nt, Homo sapiens
gaaugugaaucucuucucu

SEQ ID NO: 1097011 - RNA, 19 nt, Homo sapiens
gaucuccuguucaagaaga

SEQ ID NO: 1097012 - RNA, 19 nt, Homo sapiens
agauggauauguuaggaua

SEQ ID NO: 1097013 - RNA, 19 nt, Homo sapiens
ggaaccaacuaaucuuucu

SEQ ID NO: 1097014 - RNA, 19 nt, Homo sapiens
gacucuggauucaaacaua

SEQ ID NO: 1097015 - RNA, 19 nt, Homo sapiens
gagucuauguccuaaauca

SEQ ID NO: 1097016 - RNA, 19 nt, Homo sapiens
aagcagugauuucaaagaa

SEQ ID NO: 1097017 - RNA, 19 nt, Homo sapiens
uauggaagcuugaccuuag

SEQ ID NO: 1097018 - RNA, 19 nt, Homo sapiens
gagauugagccuauuaaug

SEQ ID NO: 1097019 - RNA, 19 nt, Homo sapiens
cagagagcuucuucuauga

SEQ ID NO: 1097020 - RNA, 19 nt, Homo sapiens
gcaaagcacuacaguaccu

SEQ ID NO: 1097021 - RNA, 19 nt, Homo sapiens
gauugagccuauuaaugaa

SEQ ID NO: 1097022 - RNA, 19 nt, Homo sapiens
ucugaggucuucuaaauca

SEQ ID NO: 1097023 - RNA, 19 nt, Homo sapiens
uagcaguggugaaggaauu

SEQ ID NO: 1097024 - RNA, 19 nt, Homo sapiens
auacauagcugggaaccaa

SEQ ID NO: 1097025 - RNA, 19 nt, Homo sapiens
auuauaagccgauugguua

SEQ ID NO: 1097026 - RNA, 19 nt, Homo sapiens
gaagagcagcuuacuacau

SEQ ID NO: 1097027 - RNA, 19 nt, Homo sapiens
guaacuugcuggccucugu

SEQ ID NO: 1097028 - RNA, 19 nt, Homo sapiens
gaauuuaugcuaaggaaag

SEQ ID NO: 1097029 - RNA, 19 nt, Homo sapiens
gaaguggaaagggauuaua

SEQ ID NO: 1097030 - RNA, 19 nt, Homo sapiens
gaagauggaguuguucgaa

SEQ ID NO: 1097031 - RNA, 19 nt, Homo sapiens
ccaaagcauaugcaguuua

SEQ ID NO: 1097032 - RNA, 19 nt, Homo sapiens
ucacugcuuuagcuuauga

SEQ ID NO: 1097033 - RNA, 19 nt, Homo sapiens
gaaaagagggagagacaaa

SEQ ID NO: 1097034 - RNA, 19 nt, Homo sapiens
gaaucucuucucuaugaua

SEQ ID NO: 1097035 - RNA, 19 nt, Homo sapiens
aagagcagcuuacuacauc

SEQ ID NO: 1097036 - RNA, 19 nt, Homo sapiens
aaacgaacaguaagccuaa

SEQ ID NO: 1097037 - RNA, 19 nt, Homo sapiens
caaacuaucacuuucaaca

SEQ ID NO: 1097038 - RNA, 19 nt, Homo sapiens
agaggaugaucaugaugua

SEQ ID NO: 1097039 - RNA, 19 nt, Homo sapiens
gcaagaagaggaugaucau

SEQ ID NO: 1097040 - RNA, 19 nt, Homo sapiens
gauuauaagccgauugguu

SEQ ID NO: 1097041 - RNA, 19 nt, Homo sapiens
ggaguaaagaucaaacugu

SEQ ID NO: 1097042 - RNA, 19 nt, Homo sapiens
uaacuacagcgguaacuug

SEQ ID NO: 1097043 - RNA, 19 nt, Homo sapiens
uaucagagagcuucuucua

SEQ ID NO: 1097044 - RNA, 19 nt, Homo sapiens
aggaggaaguuaagaagaa

SEQ ID NO: 1097045 - RNA, 19 nt, Homo sapiens
gaaguuugaguucauuuca

SEQ ID NO: 1097046 - RNA, 19 nt, Homo sapiens
gaaggaucauauuuagaag

SEQ ID NO: 1097047 - RNA, 19 nt, Homo sapiens
gaggaacguuuggaaggaa

SEQ ID NO: 1097048 - RNA, 19 nt, Homo sapiens
gaaguucuggguuucuuug

SEQ ID NO: 1097049 - RNA, 19 nt, Homo sapiens
agaagaggaugaucaugau

SEQ ID NO: 1097050 - RNA, 19 nt, Homo sapiens
ccaaggcuaucauauauua

SEQ ID NO: 1097051 - RNA, 19 nt, Homo sapiens
gaaaggagaagcaaauaua

SEQ ID NO: 1097052 - RNA, 19 nt, Homo sapiens
ggaagaaccucguuucgaa

SEQ ID NO: 1097053 - RNA, 19 nt, Homo sapiens
gaacggaacugucuagaag

SEQ ID NO: 1097054 - RNA, 19 nt, Homo sapiens
ggacaacaauuugcauuaa

SEQ ID NO: 1097055 - RNA, 19 nt, Homo sapiens
gaagaaccaugaaauuguu

SEQ ID NO: 1097056 - RNA, 19 nt, Homo sapiens
caaucaagcuuuagaagaa

SEQ ID NO: 1097057 - RNA, 19 nt, Homo sapiens
gaaccucguuucgaaauuu

SEQ ID NO: 1097058 - RNA, 19 nt, Homo sapiens
ugaaugcccucaucuaauu

SEQ ID NO: 1097059 - RNA, 19 nt, Homo sapiens
ggaagacaguuuaucagaa

SEQ ID NO: 1097060 - RNA, 19 nt, Homo sapiens
gaaggaauuugccuauaug

SEQ ID NO: 1097061 - RNA, 19 nt, Homo sapiens
gaagacaguuuaucagaag

SEQ ID NO: 1097062 - RNA, 19 nt, Homo sapiens
aaacaacucuguaacugaa

SEQ ID NO: 1097063 - RNA, 19 nt, Homo sapiens
ugacagagauguuaaaugc

SEQ ID NO: 1097064 - RNA, 19 nt, Homo sapiens
gaagaaggacaacaauuug

SEQ ID NO: 1097065 - RNA, 19 nt, Homo sapiens
ggaacuaauugucaaacuu

SEQ ID NO: 1097066 - RNA, 19 nt, Homo sapiens
gaacuaauugucaaacuug

SEQ ID NO: 1097067 - RNA, 19 nt, Homo sapiens
gcaguuugauugcuucuau

SEQ ID NO: 1097068 - RNA, 19 nt, Homo sapiens
uggagacccugaacaaaua

SEQ ID NO: 1097069 - RNA, 19 nt, Homo sapiens
ugaaggaauuugccuauau

SEQ ID NO: 1097070 - RNA, 19 nt, Homo sapiens
ugaagaaggacaacaauuu

SEQ ID NO: 1097071 - RNA, 19 nt, Homo sapiens
ggcaaagaaucagauauuu

SEQ ID NO: 1097072 - RNA, 19 nt, Homo sapiens
caaagccaauugauuacaa

SEQ ID NO: 1097073 - RNA, 19 nt, Homo sapiens
ccagauggguguuggcaaa

SEQ ID NO: 1097074 - RNA, 19 nt, Homo sapiens
gcaaguaguugagucuguu

SEQ ID NO: 1097075 - RNA, 19 nt, Homo sapiens
gcaggcagaugaugaacug

SEQ ID NO: 1097076 - RNA, 19 nt, Homo sapiens
ugaagauccugcaucagua

SEQ ID NO: 1097077 - RNA, 19 nt, Homo sapiens
gcagaaaggagaagcaaau

SEQ ID NO: 1097078 - RNA, 19 nt, Homo sapiens
aaacaugguggcuguaaua

SEQ ID NO: 1097079 - RNA, 19 nt, Homo sapiens
caaaugcaggauaugauua

SEQ ID NO: 1097080 - RNA, 19 nt, Homo sapiens
gggaaaacaugcaaaauau

SEQ ID NO: 1097081 - RNA, 19 nt, Homo sapiens
ggaacugucuagaagaauc

SEQ ID NO: 1097082 - RNA, 19 nt, Homo sapiens
agagggaucugaauucuca

SEQ ID NO: 1097083 - RNA, 19 nt, Homo sapiens
ggaugaaagugaccauauc

SEQ ID NO: 1097084 - RNA, 19 nt, Homo sapiens
caugguggcuguaauaaag

SEQ ID NO: 1097085 - RNA, 19 nt, Homo sapiens
ggaauuugccuauaugaag

SEQ ID NO: 1097086 - RNA, 19 nt, Homo sapiens
ugacgaguaugaagaugaa

SEQ ID NO: 1097087 - RNA, 19 nt, Homo sapiens
ucauggaacucauaaaugg

SEQ ID NO: 1097088 - RNA, 19 nt, Homo sapiens
gaagaaccucguuucgaaa

SEQ ID NO: 1097089 - RNA, 19 nt, Homo sapiens
gcaagauggucagagaguu

SEQ ID NO: 1097090 - RNA, 19 nt, Homo sapiens
gcacggaguuuugaaauga

SEQ ID NO: 1097091 - RNA, 19 nt, Homo sapiens
gaaaacaacucuguaacug

SEQ ID NO: 1097092 - RNA, 19 nt, Homo sapiens
gaagcuauggaacuaauug

SEQ ID NO: 1097093 - RNA, 19 nt, Homo sapiens
ugaugaagcuauggaacua

SEQ ID NO: 1097094 - RNA, 19 nt, Homo sapiens
gauacaccauguugaagau

SEQ ID NO: 1097095 - RNA, 19 nt, Homo sapiens
cauuaaagcuucacagacu

SEQ ID NO: 1097096 - RNA, 19 nt, Homo sapiens
uuccaaagccaauugauua

SEQ ID NO: 1097097 - RNA, 19 nt, Homo sapiens
ugucuuggcuuuauuuauc

SEQ ID NO: 1097098 - RNA, 19 nt, Homo sapiens
gaaucaguauagaacaaga

SEQ ID NO: 1097099 - RNA, 19 nt, Homo sapiens
ucagagggcugcuauugca

SEQ ID NO: 1097100 - RNA, 19 nt, Homo sapiens
caaugugucuuggcuuuau

SEQ ID NO: 1097101 - RNA, 19 nt, Homo sapiens
guugacaaaugcaggauau

SEQ ID NO: 1097102 - RNA, 19 nt, Homo sapiens
gaaggugaaacgucaguug

SEQ ID NO: 1097103 - RNA, 19 nt, Homo sapiens
ggucauggaacucauaaau

SEQ ID NO: 1097104 - RNA, 19 nt, Homo sapiens
gauaugauuaccuagcuuu

SEQ ID NO: 1097105 - RNA, 19 nt, Homo sapiens
aauaaacccucuuucaucu

SEQ ID NO: 1097106 - RNA, 19 nt, Homo sapiens
ccacagaugguuucaacuu

SEQ ID NO: 1097107 - RNA, 19 nt, Homo sapiens
gaagauccugcaucaguau

SEQ ID NO: 1097108 - RNA, 19 nt, Homo sapiens
gauggguguuggcaaagaa

SEQ ID NO: 1097109 - RNA, 19 nt, Homo sapiens
ggcuaucgguugacaaaug

SEQ ID NO: 1097110 - RNA, 19 nt, Homo sapiens
aaaggaagacaguuuauca

SEQ ID NO: 1097111 - RNA, 19 nt, Homo sapiens
ugaagaaccaugaaauugu

SEQ ID NO: 1097112 - RNA, 19 nt, Homo sapiens
gaacaaauaaaggaagaca

SEQ ID NO: 1097113 - RNA, 19 nt, Homo sapiens
ucagauacaccauguugaa

SEQ ID NO: 1097114 - RNA, 19 nt, Homo sapiens
gaaauuuccaguuccaaag

SEQ ID NO: 1097115 - RNA, 19 nt, Homo sapiens
aaauaaacccucuuucauc

SEQ ID NO: 1097116 - RNA, 19 nt, Homo sapiens
cagaacuggugaaacagaa

SEQ ID NO: 1097117 - RNA, 19 nt, Homo sapiens
ugggagcuaugaaucagua

SEQ ID NO: 1097118 - RNA, 19 nt, Homo sapiens
caggcaagauggucagaga

SEQ ID NO: 1097119 - RNA, 19 nt, Homo sapiens
gaaaugacugaauucaauc

SEQ ID NO: 1097120 - RNA, 19 nt, Homo sapiens
acagagauguuaaaugcau

SEQ ID NO: 1097121 - RNA, 19 nt, Homo sapiens
gaugaaagugaccauauca

SEQ ID NO: 1097122 - RNA, 19 nt, Homo sapiens
guccagggcuaucgguuga

SEQ ID NO: 1097123 - RNA, 19 nt, Homo sapiens
uggcaaagaaucagauauu

SEQ ID NO: 1097124 - RNA, 19 nt, Homo sapiens
ugacaaaugcaggauauga

SEQ ID NO: 1097125 - RNA, 19 nt, Homo sapiens
agacgucgauugcagaaag

SEQ ID NO: 1097126 - RNA, 19 nt, Homo sapiens
gccuugucgucauuaaaua

SEQ ID NO: 1097127 - RNA, 19 nt, Homo sapiens
uaauugccuugucgucauu

SEQ ID NO: 1097128 - RNA, 19 nt, Homo sapiens
guaguugagucuguuggaa

SEQ ID NO: 1097129 - RNA, 19 nt, Homo sapiens
cagaaaggagaagcaaaua

SEQ ID NO: 1097130 - RNA, 19 nt, Homo sapiens
ggagcuaugaaucaguaua

SEQ ID NO: 1097131 - RNA, 19 nt, Homo sapiens
gaacugucuagaagaauca

SEQ ID NO: 1097132 - RNA, 19 nt, Homo sapiens
ggaaaugcaggcagaugau

SEQ ID NO: 1097133 - RNA, 19 nt, Homo sapiens
uuaaggauaucaggagaga

SEQ ID NO: 1097134 - RNA, 19 nt, Homo sapiens
aaacaaacgcgauuaucau

SEQ ID NO: 1097135 - RNA, 19 nt, Homo sapiens
ggauaugauuaccuagcuu

SEQ ID NO: 1097136 - RNA, 19 nt, Homo sapiens
ugcaggauaugauuaccua

SEQ ID NO: 1097137 - RNA, 19 nt, Homo sapiens
ucaaucaagcuuuagaaga

SEQ ID NO: 1097138 - RNA, 19 nt, Homo sapiens
gaucugaauucucauuuuc

SEQ ID NO: 1097139 - RNA, 19 nt, Homo sapiens
gaacugcuucauccauuag

SEQ ID NO: 1097140 - RNA, 19 nt, Homo sapiens
ucucugccaugaaggaauu

SEQ ID NO: 1097141 - RNA, 19 nt, Homo sapiens
aacaaacgcgauuaucaua

SEQ ID NO: 1097142 - RNA, 19 nt, Homo sapiens
uuuaggaucuuggauaugu

SEQ ID NO: 1097143 - RNA, 19 nt, Homo sapiens
aaagagggaucugaauucu

SEQ ID NO: 1097144 - RNA, 19 nt, Homo sapiens
uaaacaugguggcuguaau

SEQ ID NO: 1097145 - RNA, 19 nt, Homo sapiens
gcuauggaacuaauuguca

SEQ ID NO: 1097146 - RNA, 19 nt, Homo sapiens
gauccugcaucaguauaug

SEQ ID NO: 1097147 - RNA, 19 nt, Homo sapiens
acaaaugcaggauaugauu

SEQ ID NO: 1097148 - RNA, 19 nt, Homo sapiens
uauagaacaagaacucuga

SEQ ID NO: 1097149 - RNA, 19 nt, Homo sapiens
acaacucuguaacugaauu

SEQ ID NO: 1097150 - RNA, 19 nt, Homo sapiens
gaaagaaacugccaaaggu

SEQ ID NO: 1097151 - RNA, 19 nt, Homo sapiens
gcaagccacuuaauaauga

SEQ ID NO: 1097152 - RNA, 19 nt, Homo sapiens
gaaauaaucugugaaugga

SEQ ID NO: 1097153 - RNA, 19 nt, Homo sapiens
gcacuuugcucaacucuga

SEQ ID NO: 1097154 - RNA, 19 nt, Homo sapiens
gaaugaugguucagaauuu

SEQ ID NO: 1097155 - RNA, 19 nt, Homo sapiens
gaacauaugcuuucugaga

SEQ ID NO: 1097156 - RNA, 19 nt, Homo sapiens
ugacuggacuucagaauuu

SEQ ID NO: 1097157 - RNA, 19 nt, Homo sapiens
cgaauacucugaauccaua

SEQ ID NO: 1097158 - RNA, 19 nt, Homo sapiens
gaaaggaaaugaguaaauc

SEQ ID NO: 1097159 - RNA, 19 nt, Homo sapiens
cagcugaacucacaacuuu

SEQ ID NO: 1097160 - RNA, 19 nt, Homo sapiens
gaacaagaagcuuuaguuu

SEQ ID NO: 1097161 - RNA, 19 nt, Homo sapiens
caacuaauuuccucucauu

SEQ ID NO: 1097162 - RNA, 19 nt, Homo sapiens
guaaaucacuguucagcaa

SEQ ID NO: 1097163 - RNA, 19 nt, Homo sapiens
ugaagaacaugguguauau

SEQ ID NO: 1097164 - RNA, 19 nt, Homo sapiens
gaagaacucccuaaaugaa

SEQ ID NO: 1097165 - RNA, 19 nt, Homo sapiens
ccaaagaucauguuuagaa

SEQ ID NO: 1097166 - RNA, 19 nt, Homo sapiens
acacugaacuuaaugcauu

SEQ ID NO: 1097167 - RNA, 19 nt, Homo sapiens
caacacugauuuccguuaa

SEQ ID NO: 1097168 - RNA, 19 nt, Homo sapiens
ggccauccauccucuguua

SEQ ID NO: 1097169 - RNA, 19 nt, Homo sapiens
gagaagaaauuaucaacag

SEQ ID NO: 1097170 - RNA, 19 nt, Homo sapiens
aaacuaguaugcuguugua

SEQ ID NO: 1097171 - RNA, 19 nt, Homo sapiens
gcacacugcuuucacuaau

SEQ ID NO: 1097172 - RNA, 19 nt, Homo sapiens
gaacuuaaugcauuucuug

SEQ ID NO: 1097173 - RNA, 19 nt, Homo sapiens
cuaguaugcuguuguauga

SEQ ID NO: 1097174 - RNA, 19 nt, Homo sapiens
ccacagccaugcuuaccua

SEQ ID NO: 1097175 - RNA, 19 nt, Homo sapiens
uggaaucuaugcaaugaua

SEQ ID NO: 1097176 - RNA, 19 nt, Homo sapiens
caagauuuauggcugguuu

SEQ ID NO: 1097177 - RNA, 19 nt, Homo sapiens
ugaagaauguuguguguuc

SEQ ID NO: 1097178 - RNA, 19 nt, Homo sapiens
ggaaauaaucugugaaugg

SEQ ID NO: 1097179 - RNA, 19 nt, Homo sapiens
gauaacaugccauucauug

SEQ ID NO: 1097180 - RNA, 19 nt, Homo sapiens
uacaggagauguuaugauu

SEQ ID NO: 1097181 - RNA, 19 nt, Homo sapiens
gaacagcuuccaaucuuga

SEQ ID NO: 1097182 - RNA, 19 nt, Homo sapiens
acacugcuuucacuaauaa

SEQ ID NO: 1097183 - RNA, 19 nt, Homo sapiens
gaaaauagcacuuuaccaa

SEQ ID NO: 1097184 - RNA, 19 nt, Homo sapiens
ggaaaggaaaugaguaaau

SEQ ID NO: 1097185 - RNA, 19 nt, Homo sapiens
gaggaaaggaaaugaguaa

SEQ ID NO: 1097186 - RNA, 19 nt, Homo sapiens
uagaagcccuuucauggaa

SEQ ID NO: 1097187 - RNA, 19 nt, Homo sapiens
uugaagaacucccuaaaug

SEQ ID NO: 1097188 - RNA, 19 nt, Homo sapiens
agaaaacgcuucagacuuu

SEQ ID NO: 1097189 - RNA, 19 nt, Homo sapiens
ggaaaaccauccauucuga

SEQ ID NO: 1097190 - RNA, 19 nt, Homo sapiens
ggacugccuucuacauuca

SEQ ID NO: 1097191 - RNA, 19 nt, Homo sapiens
gaaguucgacuccuagaau

SEQ ID NO: 1097192 - RNA, 19 nt, Homo sapiens
ggaaagaaacugccaaagg

SEQ ID NO: 1097193 - RNA, 19 nt, Homo sapiens
aaacccaggugaacaagaa

SEQ ID NO: 1097194 - RNA, 19 nt, Homo sapiens
gguggaaucuaugcaauga

SEQ ID NO: 1097195 - RNA, 19 nt, Homo sapiens
gaacaugguguauaucauc

SEQ ID NO: 1097196 - RNA, 19 nt, Homo sapiens
uaucaacagccuucaguua

SEQ ID NO: 1097197 - RNA, 19 nt, Homo sapiens
agaaucagcugaacucaca

SEQ ID NO: 1097198 - RNA, 19 nt, Homo sapiens
guacccagcaaucaaauaa

SEQ ID NO: 1097199 - RNA, 19 nt, Homo sapiens
gcaguauucuuguucuugu

SEQ ID NO: 1097200 - RNA, 19 nt, Homo sapiens
gggaaaggcggaacaagaa

SEQ ID NO: 1097201 - RNA, 19 nt, Homo sapiens
ggacugaaaugaaaaggaa

SEQ ID NO: 1097202 - RNA, 19 nt, Homo sapiens
uaacacuggugauaucaug

SEQ ID NO: 1097203 - RNA, 19 nt, Homo sapiens
gaaaugaguaaaucacugu

SEQ ID NO: 1097204 - RNA, 19 nt, Homo sapiens
acuuggaacuccuuuauaa

SEQ ID NO: 1097205 - RNA, 19 nt, Homo sapiens
gcacuuggaacuccuuuau

SEQ ID NO: 1097206 - RNA, 19 nt, Homo sapiens
cuucagacuuucagaauga

SEQ ID NO: 1097207 - RNA, 19 nt, Homo sapiens
gagugugaaugaauuguug

SEQ ID NO: 1097208 - RNA, 19 nt, Homo sapiens
uuuaagggauugugcuaua

SEQ ID NO: 1097209 - RNA, 19 nt, Homo sapiens
ggacuucagaauuucauaa

SEQ ID NO: 1097210 - RNA, 19 nt, Homo sapiens
ugaauucucuacaccuuug

SEQ ID NO: 1097211 - RNA, 19 nt, Homo sapiens
aaccaaagaucauguuuag

SEQ ID NO: 1097212 - RNA, 19 nt, Homo sapiens
aauaucagcuagagacuau

SEQ ID NO: 1097213 - RNA, 19 nt, Homo sapiens
gcaggaaacuccgaagucu

SEQ ID NO: 1097214 - RNA, 19 nt, Homo sapiens
ggaacuccuuuauaagugu

SEQ ID NO: 1097215 - RNA, 19 nt, Homo sapiens
ggaguuggguagcgaauac

SEQ ID NO: 1097216 - RNA, 19 nt, Homo sapiens
gcaacacugauuuccguua

SEQ ID NO: 1097217 - RNA, 19 nt, Homo sapiens
gcauccuguugcucuauua

SEQ ID NO: 1097218 - RNA, 19 nt, Homo sapiens
caacuuaccagcguuuauu

SEQ ID NO: 1097219 - RNA, 19 nt, Homo sapiens
uaaaguagccaaaggauac

SEQ ID NO: 1097220 - RNA, 19 nt, Homo sapiens
gaaaggaagaugcuagaag

SEQ ID NO: 1097221 - RNA, 19 nt, Homo sapiens
cagaaauaauuggcuagua

SEQ ID NO: 1097222 - RNA, 19 nt, Homo sapiens
gcuagagacuauuucugaa

SEQ ID NO: 1097223 - RNA, 19 nt, Homo sapiens
ucagaaugaugguucagaa

SEQ ID NO: 1097224 - RNA, 19 nt, Homo sapiens
gcagaaagacaccaguuca

SEQ ID NO: 1097225 - RNA, 19 nt, Homo sapiens
cgggacagcuuuaaaccaa

SEQ ID NO: 1097226 - RNA, 19 nt, Homo sapiens
caacagccuucaguuacaa

SEQ ID NO: 1097227 - RNA, 19 nt, Homo sapiens
ucaaagagagagagaagaa

SEQ ID NO: 1097228 - RNA, 19 nt, Homo sapiens
ggccaacauuugcaucauu

SEQ ID NO: 1097229 - RNA, 19 nt, Homo sapiens
cuaagaugaccuugaauuu

SEQ ID NO: 1097230 - RNA, 19 nt, Homo sapiens
ugaagaacucccuaaauga

SEQ ID NO: 1097231 - RNA, 19 nt, Homo sapiens
ugaccacacugaacuuaau

SEQ ID NO: 1097232 - RNA, 19 nt, Homo sapiens
agagagagagaagaaauua

SEQ ID NO: 1097233 - RNA, 19 nt, Homo sapiens
gcauauaccguuggaaguu

SEQ ID NO: 1097234 - RNA, 19 nt, Homo sapiens
gggcagaggaacaaauauu

SEQ ID NO: 1097235 - RNA, 19 nt, Homo sapiens
ccacaccauccaacuauaa

SEQ ID NO: 1097236 - RNA, 19 nt, Homo sapiens
cugaacauaugcuuucuga

SEQ ID NO: 1097237 - RNA, 19 nt, Homo sapiens
gaaagauaaaguagccaaa

SEQ ID NO: 1097238 - RNA, 19 nt, Homo sapiens
ggcagaggaacaaauauuu

SEQ ID NO: 1097239 - RNA, 19 nt, Homo sapiens
ggaaaggcggaacaagaaa

SEQ ID NO: 1097240 - RNA, 19 nt, Homo sapiens
caugaagaauguugugugu

SEQ ID NO: 1097241 - RNA, 19 nt, Homo sapiens
cauccucuguuaucuaaga

SEQ ID NO: 1097242 - RNA, 19 nt, Homo sapiens
gugcagcuuuccacuuauu

SEQ ID NO: 1097243 - RNA, 19 nt, Homo sapiens
uugugcagcuuuccacuua

SEQ ID NO: 1097244 - RNA, 19 nt, Homo sapiens
gcugugagauuuuaauuug

SEQ ID NO: 1097245 - RNA, 19 nt, Homo sapiens
gauaguguuuagucucaug

SEQ ID NO: 1097246 - RNA, 19 nt, Homo sapiens
ugagguguguguaugugua

SEQ ID NO: 1097247 - RNA, 19 nt, Homo sapiens
guuggaaguucgacuccua

SEQ ID NO: 1097248 - RNA, 19 nt, Homo sapiens
ugauguaccugcuaaacug

SEQ ID NO: 1097249 - RNA, 19 nt, Homo sapiens
gaaguugucacugcucuga

SEQ ID NO: 1097250 - RNA, 19 nt, Homo sapiens
agaauuagcucaaaccuuu

SEQ ID NO: 1097251 - RNA, 19 nt, Homo sapiens
ccacacuccuuucagauua

SEQ ID NO: 1097252 - RNA, 19 nt, Homo sapiens
gcacagacauacacacaug

SEQ ID NO: 1097253 - RNA, 19 nt, Homo sapiens
ggaaauagcuucuuuugga

SEQ ID NO: 1097254 - RNA, 19 nt, Homo sapiens
gagauggaccuuauauaua

SEQ ID NO: 1097255 - RNA, 19 nt, Homo sapiens
gaauccacauuaagaagua

SEQ ID NO: 1097256 - RNA, 19 nt, Homo sapiens
ggaugaagaugacaaggaa

SEQ ID NO: 1097257 - RNA, 19 nt, Homo sapiens
ccagaguccucauuugaua

SEQ ID NO: 1097258 - RNA, 19 nt, Homo sapiens
uaacaaggcugccauggau

SEQ ID NO: 1097259 - RNA, 19 nt, Homo sapiens
gaucagagguauaaaagua

SEQ ID NO: 1097260 - RNA, 19 nt, Homo sapiens
guauuucccugccauguaa

SEQ ID NO: 1097261 - RNA, 19 nt, Homo sapiens
ccacugcgguacaucauuu

SEQ ID NO: 1097262 - RNA, 19 nt, Homo sapiens
gaagaccgagagacuaaua

SEQ ID NO: 1097263 - RNA, 19 nt, Homo sapiens
agagaucacucacuugaaa

SEQ ID NO: 1097264 - RNA, 19 nt, Homo sapiens
caacagacucucauuaaga

SEQ ID NO: 1097265 - RNA, 19 nt, Homo sapiens
agacuaacauccauucuga

SEQ ID NO: 1097266 - RNA, 19 nt, Homo sapiens
ugaugaagauggagauaaa

SEQ ID NO: 1097267 - RNA, 19 nt, Homo sapiens
agagauguuuguccaguua

SEQ ID NO: 1097268 - RNA, 19 nt, Homo sapiens
ggaguuauuuacuuagaga

SEQ ID NO: 1097269 - RNA, 19 nt, Homo sapiens
ccaagacugugaaagacua

SEQ ID NO: 1097270 - RNA, 19 nt, Homo sapiens
ggaggaagcaugacagaga

SEQ ID NO: 1097271 - RNA, 19 nt, Homo sapiens
gaaagacgucggcauucua

SEQ ID NO: 1097272 - RNA, 19 nt, Homo sapiens
ccaggaaggucccuagaga

SEQ ID NO: 1097273 - RNA, 19 nt, Homo sapiens
aaaggcagcagaucucuua

SEQ ID NO: 1097274 - RNA, 19 nt, Homo sapiens
uaacaagucuuugguaguc

SEQ ID NO: 1097275 - RNA, 19 nt, Homo sapiens
gauauuguuucaacuguuc

SEQ ID NO: 1097276 - RNA, 19 nt, Homo sapiens
gagaaaggauuaagaacac

SEQ ID NO: 1097277 - RNA, 19 nt, Homo sapiens
ggagaaaggauuaagaaca

SEQ ID NO: 1097278 - RNA, 19 nt, Homo sapiens
uuacagaacucccugaaag

SEQ ID NO: 1097279 - RNA, 19 nt, Homo sapiens
gucauccucuguccaaaua

SEQ ID NO: 1097280 - RNA, 19 nt, Homo sapiens
gggcguaagucucuucuca

SEQ ID NO: 1097281 - RNA, 19 nt, Homo sapiens
gaaagacuaacauccauuc

SEQ ID NO: 1097282 - RNA, 19 nt, Homo sapiens
gaagugacaguguuugaug

SEQ ID NO: 1097283 - RNA, 19 nt, Homo sapiens
gcagauuucucagggaaga

SEQ ID NO: 1097284 - RNA, 19 nt, Homo sapiens
ggggagaaaugaaugaaua

SEQ ID NO: 1097285 - RNA, 19 nt, Homo sapiens
ggacagcagcacccaauau

SEQ ID NO: 1097286 - RNA, 19 nt, Homo sapiens
gcaguaugcagaauugaaa

SEQ ID NO: 1097287 - RNA, 19 nt, Homo sapiens
gaaucacuauggcaauaug

SEQ ID NO: 1097288 - RNA, 19 nt, Homo sapiens
gcguaagucucuucucaga

SEQ ID NO: 1097289 - RNA, 19 nt, Homo sapiens
uuucaucucuggccuguuu

SEQ ID NO: 1097290 - RNA, 19 nt, Homo sapiens
auaaugagcuacuagacuu

SEQ ID NO: 1097291 - RNA, 19 nt, Homo sapiens
cgacaauaaugagcuacua

SEQ ID NO: 1097292 - RNA, 19 nt, Homo sapiens
aagaaucacuauggcaaua

SEQ ID NO: 1097293 - RNA, 19 nt, Homo sapiens
guauuugguugccuucuga

SEQ ID NO: 1097294 - RNA, 19 nt, Homo sapiens
uaagcaggaaguagaaaua

SEQ ID NO: 1097295 - RNA, 19 nt, Homo sapiens
aaaugagggucccaugaaa

SEQ ID NO: 1097296 - RNA, 19 nt, Homo sapiens
gaucuuucagccaugauua

SEQ ID NO: 1097297 - RNA, 19 nt, Homo sapiens
ugacaguguuugaugaaga

SEQ ID NO: 1097298 - RNA, 19 nt, Homo sapiens
gaggaagcaugacagagau

SEQ ID NO: 1097299 - RNA, 19 nt, Homo sapiens
ggauauuguuucaacuguu

SEQ ID NO: 1097300 - RNA, 19 nt, Homo sapiens
ugacaaggaaucugagaaa

SEQ ID NO: 1097301 - RNA, 19 nt, Homo sapiens
agagauggaccuuauauau

SEQ ID NO: 1097302 - RNA, 19 nt, Homo sapiens
caaccgaauuguuauguac

SEQ ID NO: 1097303 - RNA, 19 nt, Homo sapiens
uggaggaaauagcuucuuu

SEQ ID NO: 1097304 - RNA, 19 nt, Homo sapiens
ggagagcacagacauagau

SEQ ID NO: 1097305 - RNA, 19 nt, Homo sapiens
gaauuagcucaaaccuuua

SEQ ID NO: 1097306 - RNA, 19 nt, Homo sapiens
ccaacagacucucauuaag

SEQ ID NO: 1097307 - RNA, 19 nt, Homo sapiens
gaacaccaccuuccuugag

SEQ ID NO: 1097308 - RNA, 19 nt, Homo sapiens
gacagcagcacccaauauu

SEQ ID NO: 1097309 - RNA, 19 nt, Homo sapiens
cauccucuguccaaauauu

SEQ ID NO: 1097310 - RNA, 19 nt, Homo sapiens
caagagugacuuugaacuu

SEQ ID NO: 1097311 - RNA, 19 nt, Homo sapiens
ugaaauaggagauaacaag

SEQ ID NO: 1097312 - RNA, 19 nt, Homo sapiens
gagauggacaaccgaauug

SEQ ID NO: 1097313 - RNA, 19 nt, Homo sapiens
gggagaaaugaaugaauaa

SEQ ID NO: 1097314 - RNA, 19 nt, Homo sapiens
caucgacaauaaugagcua

SEQ ID NO: 1097315 - RNA, 19 nt, Homo sapiens
gcagcagccaccaucauuu

SEQ ID NO: 1097316 - RNA, 19 nt, Homo sapiens
gguacaggauauuguuuca

SEQ ID NO: 1097317 - RNA, 19 nt, Homo sapiens
ccggugaaagcaaguauua

SEQ ID NO: 1097318 - RNA, 19 nt, Homo sapiens
cagauuacccagcgauauu

SEQ ID NO: 1097319 - RNA, 19 nt, Homo sapiens
cuaagaagcuucgaaaucc

SEQ ID NO: 1097320 - RNA, 19 nt, Homo sapiens
gacaguguuugaugaagau

SEQ ID NO: 1097321 - RNA, 19 nt, Homo sapiens
agaacucccugaaagaugu

SEQ ID NO: 1097322 - RNA, 19 nt, Homo sapiens
ccucaucauuccacaguau

SEQ ID NO: 1097323 - RNA, 19 nt, Homo sapiens
aagagugacuuugaacuug

SEQ ID NO: 1097324 - RNA, 19 nt, Homo sapiens
cuagaaagauaagaaacug

SEQ ID NO: 1097325 - RNA, 19 nt, Homo sapiens
cuagagaucacucacuuga

SEQ ID NO: 1097326 - RNA, 19 nt, Homo sapiens
cauccauucugaaauagga

SEQ ID NO: 1097327 - RNA, 19 nt, Homo sapiens
cagcagcacccaauauugu

SEQ ID NO: 1097328 - RNA, 19 nt, Homo sapiens
ucucuggccuguuugauuc

SEQ ID NO: 1097329 - RNA, 19 nt, Homo sapiens
ugucuacaauuucaucaga

SEQ ID NO: 1097330 - RNA, 19 nt, Homo sapiens
ggcaaugaccgacuucaga

SEQ ID NO: 1097331 - RNA, 19 nt, Homo sapiens
cgauauugcuuacagaacu

SEQ ID NO: 1097332 - RNA, 19 nt, Homo sapiens
uagcagaccucagcgaaag

SEQ ID NO: 1097333 - RNA, 19 nt, Homo sapiens
gaaaauaccaccccagagu

SEQ ID NO: 1097334 - RNA, 19 nt, Homo sapiens
cagccaugauuauuaagga

SEQ ID NO: 1097335 - RNA, 19 nt, Homo sapiens
gugaaagacuaacauccau

SEQ ID NO: 1097336 - RNA, 19 nt, Homo sapiens
ccaauguuauggcuguuuc

SEQ ID NO: 1097337 - RNA, 19 nt, Homo sapiens
ggaauccacauuaagaagu

SEQ ID NO: 1097338 - RNA, 19 nt, Homo sapiens
ugaaagacgucggcauucu

SEQ ID NO: 1097339 - RNA, 19 nt, Homo sapiens
gcagauuacccagcgauau

SEQ ID NO: 1097340 - RNA, 19 nt, Homo sapiens
ugacuuugugcguauauaa

SEQ ID NO: 1097341 - RNA, 19 nt, Homo sapiens
gagggucccaugaaaguau

SEQ ID NO: 1097342 - RNA, 19 nt, Homo sapiens
aacagacucucauuaagau

SEQ ID NO: 1097343 - RNA, 19 nt, Homo sapiens
gagugacuuugaacuuguu

SEQ ID NO: 1097344 - RNA, 19 nt, Homo sapiens
aaaguaaggaugggcauuu

SEQ ID NO: 1097345 - RNA, 19 nt, Homo sapiens
gcacguguaaaguggauau

SEQ ID NO: 1097346 - RNA, 19 nt, Homo sapiens
uuacuaagaagcuucgaaa

SEQ ID NO: 1097347 - RNA, 19 nt, Homo sapiens
gaaggucccuagagaucac

SEQ ID NO: 1097348 - RNA, 19 nt, Homo sapiens
guagucauccucuguccaa

SEQ ID NO: 1097349 - RNA, 19 nt, Homo sapiens
uccaacagacucucauuaa

SEQ ID NO: 1097350 - RNA, 19 nt, Homo sapiens
ccaaagagguggaauuuca

SEQ ID NO: 1097351 - RNA, 19 nt, Homo sapiens
gagacacacugaauucuaa

SEQ ID NO: 1097352 - RNA, 19 nt, Homo sapiens
gaugcaaccucgaauguuu

SEQ ID NO: 1097353 - RNA, 19 nt, Homo sapiens
ugaagaaucucauagaaga

SEQ ID NO: 1097354 - RNA, 19 nt, Homo sapiens
aaacuugggugaauauuug

SEQ ID NO: 1097355 - RNA, 19 nt, Homo sapiens
ucacaaaucuccuucaagu

SEQ ID NO: 1097356 - RNA, 19 nt, Homo sapiens
gagcaaauuuccacaaagu

SEQ ID NO: 1097357 - RNA, 19 nt, Homo sapiens
gauagaagcauuucaggaa

SEQ ID NO: 1097358 - RNA, 19 nt, Homo sapiens
caaauucaguacagcuuaa

SEQ ID NO: 1097359 - RNA, 19 nt, Homo sapiens
gaacguuccuucauucucu

SEQ ID NO: 1097360 - RNA, 19 nt, Homo sapiens
uccaagaacugcagaaauu

SEQ ID NO: 1097361 - RNA, 19 nt, Homo sapiens
caagaagccuaucagaaug

SEQ ID NO: 1097362 - RNA, 19 nt, Homo sapiens
gaagcaaggagacaacuuu

SEQ ID NO: 1097363 - RNA, 19 nt, Homo sapiens
caauaaacuugggugaaua

SEQ ID NO: 1097364 - RNA, 19 nt, Homo sapiens
ccacaaagugcuugguuua

SEQ ID NO: 1097365 - RNA, 19 nt, Homo sapiens
aaugaacacugccaagaua

SEQ ID NO: 1097366 - RNA, 19 nt, Homo sapiens
ucaaagaaguaucagcaaa

SEQ ID NO: 1097367 - RNA, 19 nt, Homo sapiens
ugacauaguucacacuguu

SEQ ID NO: 1097368 - RNA, 19 nt, Homo sapiens
ccaagaagccuaucagaau

SEQ ID NO: 1097369 - RNA, 19 nt, Homo sapiens
ggagagucagccuuuauua

SEQ ID NO: 1097370 - RNA, 19 nt, Homo sapiens
gcaaauucaguacagcuua

SEQ ID NO: 1097371 - RNA, 19 nt, Homo sapiens
gauuggaucuccuggaaau

SEQ ID NO: 1097372 - RNA, 19 nt, Homo sapiens
uggcuuagauuaccugaaa

SEQ ID NO: 1097373 - RNA, 19 nt, Homo sapiens
caagcuuguucgucuaaua

SEQ ID NO: 1097374 - RNA, 19 nt, Homo sapiens
guagaacguuccuucauuc

SEQ ID NO: 1097375 - RNA, 19 nt, Homo sapiens
ucaauaaacuugggugaau

SEQ ID NO: 1097376 - RNA, 19 nt, Homo sapiens
gcucagaaguggauagaag

SEQ ID NO: 1097377 - RNA, 19 nt, Homo sapiens
caaagugcuugguuuagga

SEQ ID NO: 1097378 - RNA, 19 nt, Homo sapiens
cauagaagaugcuggagau

SEQ ID NO: 1097379 - RNA, 19 nt, Homo sapiens
gcugacagauuauuugaag

SEQ ID NO: 1097380 - RNA, 19 nt, Homo sapiens
gagguggaauuucaucaga

SEQ ID NO: 1097381 - RNA, 19 nt, Homo sapiens
gguuucaucucuucuguga

SEQ ID NO: 1097382 - RNA, 19 nt, Homo sapiens
gaauuccgagucuaaagua

SEQ ID NO: 1097383 - RNA, 19 nt, Homo sapiens
agaagaguaugccaagaaa

SEQ ID NO: 1097384 - RNA, 19 nt, Homo sapiens
gaaguuaguccucuuggau

SEQ ID NO: 1097385 - RNA, 19 nt, Homo sapiens
gaagcugucucggaaagug

SEQ ID NO: 1097386 - RNA, 19 nt, Homo sapiens
uuucaucucuucugugauu

SEQ ID NO: 1097387 - RNA, 19 nt, Homo sapiens
uagaagaugcuggagauua

SEQ ID NO: 1097388 - RNA, 19 nt, Homo sapiens
acagaggauucuucuauga

SEQ ID NO: 1097389 - RNA, 19 nt, Homo sapiens
ggaguaaaugcaauucaaa

SEQ ID NO: 1097390 - RNA, 19 nt, Homo sapiens
gaaguggauagaagcauuu

SEQ ID NO: 1097391 - RNA, 19 nt, Homo sapiens
uaucaucagucuuacauag

SEQ ID NO: 1097392 - RNA, 19 nt, Homo sapiens
uguagaacguuccuucauu

SEQ ID NO: 1097393 - RNA, 19 nt, Homo sapiens
cacacugaauucuaaagua

SEQ ID NO: 1097394 - RNA, 19 nt, Homo sapiens
ccaagaacugcagaaauua

SEQ ID NO: 1097395 - RNA, 19 nt, Homo sapiens
acacagaggauucuucuau

SEQ ID NO: 1097396 - RNA, 19 nt, Homo sapiens
ggaaaucacaaaucuccuu

SEQ ID NO: 1097397 - RNA, 19 nt, Homo sapiens
gugaggacguggccgcuuu

SEQ ID NO: 1097398 - RNA, 19 nt, Homo sapiens
aaucccagcugcucucaaa

SEQ ID NO: 1097399 - RNA, 19 nt, Homo sapiens
ccagggcaauagaagagua

SEQ ID NO: 1097400 - RNA, 19 nt, Homo sapiens
gaauggaguaaaugcaauu

SEQ ID NO: 1097401 - RNA, 19 nt, Homo sapiens
gguggaauuucaucagaau

SEQ ID NO: 1097402 - RNA, 19 nt, Homo sapiens
agaaguggauagaagcauu

SEQ ID NO: 1097403 - RNA, 19 nt, Homo sapiens
gaugagaauuccgagucua

SEQ ID NO: 1097404 - RNA, 19 nt, Homo sapiens
gagucagccuuuauuagga

SEQ ID NO: 1097405 - RNA, 19 nt, Homo sapiens
gugcuaaucuggcccucaa

SEQ ID NO: 1097406 - RNA, 19 nt, Homo sapiens
ggagcaaauuuccacaaag

SEQ ID NO: 1097407 - RNA, 19 nt, Homo sapiens
ucaggaaggcacaauauug

SEQ ID NO: 1097408 - RNA, 19 nt, Homo sapiens
cagcugcucucaaagaagu

SEQ ID NO: 1097409 - RNA, 19 nt, Homo sapiens
ccacagaaagggaugaaug

SEQ ID NO: 1097410 - RNA, 19 nt, Homo sapiens
ggaauuucaucagaaugga

SEQ ID NO: 1097411 - RNA, 19 nt, Homo sapiens
auacauaugcugcaaguga

SEQ ID NO: 1097412 - RNA, 19 nt, Homo sapiens
cagaaaaccuacccaagaa

SEQ ID NO: 1097413 - RNA, 19 nt, Homo sapiens
gugcuugguuuaggaauug

SEQ ID NO: 1097414 - RNA, 19 nt, Homo sapiens
ccagacccuucaucaaaga

SEQ ID NO: 1097415 - RNA, 19 nt, Homo sapiens
aaagaaguaucagcaaaca

SEQ ID NO: 1097416 - RNA, 19 nt, Homo sapiens
ugccuuaucaucagucuua

SEQ ID NO: 1097417 - RNA, 19 nt, Homo sapiens
agaagaugcuggagauuac

SEQ ID NO: 1097418 - RNA, 19 nt, Homo sapiens
acacugaauucuaaaguac

SEQ ID NO: 1097419 - RNA, 19 nt, Homo sapiens
aaccagacccuucaucaaa

SEQ ID NO: 1097420 - RNA, 19 nt, Homo sapiens
uggaguaaaugcaauucaa

SEQ ID NO: 1097421 - RNA, 19 nt, Homo sapiens
aaucacaaaucuccuucaa

SEQ ID NO: 1097422 - RNA, 19 nt, Homo sapiens
uagaagaguaugccaagaa

SEQ ID NO: 1097423 - RNA, 19 nt, Homo sapiens
gauugaaaguguagaacgu

SEQ ID NO: 1097424 - RNA, 19 nt, Homo sapiens
gaacacugccaagauaaag

SEQ ID NO: 1097425 - RNA, 19 nt, Homo sapiens
gagagucagccuuuauuag

SEQ ID NO: 1097426 - RNA, 19 nt, Homo sapiens
cacagaggauucuucuaug

SEQ ID NO: 1097427 - RNA, 19 nt, Homo sapiens
gaucgaaggcucccaucug

SEQ ID NO: 1097428 - RNA, 19 nt, Homo sapiens
gaacugcagaaauuagauc

SEQ ID NO: 1097429 - RNA, 19 nt, Homo sapiens
gaucugcacaagcgaauuc

SEQ ID NO: 1097430 - RNA, 19 nt, Homo sapiens
ugagacacacugaauucua

SEQ ID NO: 1097431 - RNA, 19 nt, Homo sapiens
caaccagacccuucaucaa

SEQ ID NO: 1097432 - RNA, 19 nt, Homo sapiens
guauugguuucaucucuuc

SEQ ID NO: 1097433 - RNA, 19 nt, Homo sapiens
uuccgagucuaaaguauuu

SEQ ID NO: 1097434 - RNA, 19 nt, Homo sapiens
ucaagugccuuaucaucag

SEQ ID NO: 1097435 - RNA, 19 nt, Homo sapiens
ccaaugacaccaugaagca

SEQ ID NO: 1097436 - RNA, 19 nt, Homo sapiens
aggagcaaauuuccacaaa

SEQ ID NO: 1097437 - RNA, 19 nt, Homo sapiens
ucucuucugugauuccaaa

SEQ ID NO: 1097438 - RNA, 19 nt, Homo sapiens
aggauucacuguuauucaa

SEQ ID NO: 1097439 - RNA, 19 nt, Homo sapiens
uuacagagacacucaagau

SEQ ID NO: 1097440 - RNA, 19 nt, Homo sapiens
ugcccuugcuguuguuaua

SEQ ID NO: 1097441 - RNA, 19 nt, Homo sapiens
aaugaugcccugcuguaua

SEQ ID NO: 1097442 - RNA, 19 nt, Homo sapiens
gcaaggagacaacuuucag

SEQ ID NO: 1097443 - RNA, 19 nt, Homo sapiens
caucagggaggaaacagaa

SEQ ID NO: 1097444 - RNA, 19 nt, Homo sapiens
caagaacugcagaaauuag

SEQ ID NO: 1097445 - RNA, 19 nt, Homo sapiens
ucugggauguauaaacuga

SEQ ID NO: 1097446 - RNA, 19 nt, Homo sapiens
cagaauggaguaaaugcaa

SEQ ID NO: 1097447 - RNA, 19 nt, Homo sapiens
gauaccagagccacaaugu

SEQ ID NO: 1097448 - RNA, 19 nt, Homo sapiens
gagauuacagagacacuca

SEQ ID NO: 1097449 - RNA, 19 nt, Homo sapiens
gaggcagacucagaaaaua

SEQ ID NO: 1097450 - RNA, 19 nt, Homo sapiens
gaacagaaaucaugcauua

SEQ ID NO: 1097451 - RNA, 19 nt, Homo sapiens
gaaagaaaccuuacaaaug

SEQ ID NO: 1097452 - RNA, 19 nt, Homo sapiens
gcaagaaaccuuacaaaug

SEQ ID NO: 1097453 - RNA, 19 nt, Homo sapiens
gagagaagccuuacaaaug

SEQ ID NO: 1097454 - RNA, 19 nt, Homo sapiens
caagaaaccuuacaaaugc

SEQ ID NO: 1097455 - RNA, 19 nt, Homo sapiens
ggaaaugccugaacucuac

SEQ ID NO: 1097456 - RNA, 19 nt, Homo sapiens
gaaagaaauugcaacaaag

SEQ ID NO: 1097457 - RNA, 19 nt, Homo sapiens
ggagaaaccuuauaaaaga

SEQ ID NO: 1097458 - RNA, 19 nt, Homo sapiens
ggaaacaagucuauuaaac

SEQ ID NO: 1097459 - RNA, 19 nt, Homo sapiens
gagagaaaccauacaagua

SEQ ID NO: 1097460 - RNA, 19 nt, Homo sapiens
ggucuucagucaaaguuua

SEQ ID NO: 1097461 - RNA, 19 nt, Homo sapiens
gguaaagucuucagucaga

SEQ ID NO: 1097462 - RNA, 19 nt, Homo sapiens
agagaaaccuuacaaaugu

SEQ ID NO: 1097463 - RNA, 19 nt, Homo sapiens
ggaaagaaaccuuacaaau

SEQ ID NO: 1097464 - RNA, 19 nt, Homo sapiens
gagagaaaccuuacaaaug

SEQ ID NO: 1097465 - RNA, 19 nt, Homo sapiens
gagagaaaccuuacaaaug

SEQ ID NO: 1097466 - RNA, 19 nt, Homo sapiens
ggacugauuucaucuguuc

SEQ ID NO: 1097467 - RNA, 19 nt, Homo sapiens
gacaaagccuugaaucaug

SEQ ID NO: 1097468 - RNA, 19 nt, Homo sapiens
ggcaaggucuuuagucaaa

SEQ ID NO: 1097469 - RNA, 19 nt, Homo sapiens
gacaaggucuucagucgaa

SEQ ID NO: 1097470 - RNA, 19 nt, Homo sapiens
guggagagaugaugaaaga

SEQ ID NO: 1097471 - RNA, 19 nt, Homo sapiens
gagaaaggauauaaaugug

SEQ ID NO: 1097472 - RNA, 19 nt, Homo sapiens
ggcaaggucuucagucaaa

SEQ ID NO: 1097473 - RNA, 19 nt, Homo sapiens
gaacuuaacuacccaucag

SEQ ID NO: 1097474 - RNA, 19 nt, Homo sapiens
gcaaggcauuggagaauuc

SEQ ID NO: 1097475 - RNA, 19 nt, Homo sapiens
agagaaaccuuacaagugu

SEQ ID NO: 1097476 - RNA, 19 nt, Homo sapiens
uaauaaauguggcaagguu

SEQ ID NO: 1097477 - RNA, 19 nt, Homo sapiens
gagagaaaccuuacaagug

SEQ ID NO: 1097478 - RNA, 19 nt, Homo sapiens
ggagagaugaugaaagaaa

SEQ ID NO: 1097479 - RNA, 19 nt, Homo sapiens
gagagaaaccauacaaaug

SEQ ID NO: 1097480 - RNA, 19 nt, Homo sapiens
ggagagaaaggauauaaau

SEQ ID NO: 1097481 - RNA, 19 nt, Homo sapiens
ggagagaaaccuuacaaau

SEQ ID NO: 1097482 - RNA, 19 nt, Homo sapiens
ggagaaaccauacaagugu

SEQ ID NO: 1097483 - RNA, 19 nt, Homo sapiens
ggagagaaaccuuacaaau

SEQ ID NO: 1097484 - RNA, 19 nt, Homo sapiens
ggagagaaaccauacaaau

SEQ ID NO: 1097485 - RNA, 19 nt, Homo sapiens
agagaagccuuacaaaugu

SEQ ID NO: 1097486 - RNA, 19 nt, Homo sapiens
ggauauaaaugugaucugu

SEQ ID NO: 1097487 - RNA, 19 nt, Homo sapiens
gagagaugaugaaagaaau

SEQ ID NO: 1097488 - RNA, 19 nt, Homo sapiens
caaugaaugugguaagguu

SEQ ID NO: 1097489 - RNA, 19 nt, Homo sapiens
ggacguggccaucgaauuc

SEQ ID NO: 1097490 - RNA, 19 nt, Homo sapiens
gcccaaaccucuucagaca

SEQ ID NO: 1097491 - RNA, 19 nt, Homo sapiens
gcccaaaccucacuagaca

SEQ ID NO: 1097492 - RNA, 19 nt, Homo sapiens
ggagagaagccuuacaaau

SEQ ID NO: 1097493 - RNA, 19 nt, Homo sapiens
gaagagguauaggaaacaa

SEQ ID NO: 1097494 - RNA, 19 nt, Homo sapiens
gagaaaucauauacaccua

SEQ ID NO: 1097495 - RNA, 19 nt, Homo sapiens
caucacaaguucaagcauu

SEQ ID NO: 1097496 - RNA, 19 nt, Homo sapiens
agagaaaccuuacaaaugc

SEQ ID NO: 1097497 - RNA, 19 nt, Homo sapiens
gauagaagagguauaggaa

SEQ ID NO: 1097498 - RNA, 19 nt, Homo sapiens
gcaaaggagucaggaaugg

SEQ ID NO: 1097499 - RNA, 19 nt, Homo sapiens
gaacaaaugcaagcccaaa

SEQ ID NO: 1097500 - RNA, 19 nt, Homo sapiens
ccaaaccucuucagacauc

SEQ ID NO: 1097501 - RNA, 19 nt, Homo sapiens
gagaaaccuuacaaauguu

SEQ ID NO: 1097502 - RNA, 19 nt, Homo sapiens
ggucaacacuuaccaacca

SEQ ID NO: 1097503 - RNA, 19 nt, Homo sapiens
cuacacagaggacuuuaua

SEQ ID NO: 1097504 - RNA, 19 nt, Homo sapiens
caaauuauccauacuaagg

SEQ ID NO: 1097505 - RNA, 19 nt, Homo sapiens
ggagagaaaccuuacaagu

SEQ ID NO: 1097506 - RNA, 19 nt, Homo sapiens
gaaaucauauacaccuaac

SEQ ID NO: 1097507 - RNA, 19 nt, Homo sapiens
ggucuucagucgaaauuca

SEQ ID NO: 1097508 - RNA, 19 nt, Homo sapiens
gugguaagguuuucaguua

SEQ ID NO: 1097509 - RNA, 19 nt, Homo sapiens
gaucaaaacuguaacacau

SEQ ID NO: 1097510 - RNA, 19 nt, Homo sapiens
gcagaggcuucauuuaggu

SEQ ID NO: 1097511 - RNA, 19 nt, Homo sapiens
gaaguauuccacacaguga

SEQ ID NO: 1097512 - RNA, 19 nt, Homo sapiens
uaaugaaugugguaaaguc

SEQ ID NO: 1097513 - RNA, 19 nt, Homo sapiens
ggaucugucucguaacugu

SEQ ID NO: 1097514 - RNA, 19 nt, Homo sapiens
gggaugugauguuggagaa

SEQ ID NO: 1097515 - RNA, 19 nt, Homo sapiens
gcaaacccuucaucacaag

SEQ ID NO: 1097516 - RNA, 19 nt, Homo sapiens
gacaucaaauuauccauac

SEQ ID NO: 1097517 - RNA, 19 nt, Homo sapiens
gagcaaaggagucaggaau

SEQ ID NO: 1097518 - RNA, 19 nt, Homo sapiens
ggcaagguguucagucaga

SEQ ID NO: 1097519 - RNA, 19 nt, Homo sapiens
caacucaugccuugcacua

SEQ ID NO: 1097520 - RNA, 19 nt, Homo sapiens
gagagaaaggauauaaaug

SEQ ID NO: 1097521 - RNA, 19 nt, Homo sapiens
ucucguaacuguguaauca

SEQ ID NO: 1097522 - RNA, 19 nt, Homo sapiens
aaacucacacaacaugaua

SEQ ID NO: 1097523 - RNA, 19 nt, Homo sapiens
caucagaguccaugcuaaa

SEQ ID NO: 1097524 - RNA, 19 nt, Homo sapiens
cagcaaacccuucaucaca

SEQ ID NO: 1097525 - RNA, 19 nt, Homo sapiens
gaaugugacagaaguuuca

SEQ ID NO: 1097526 - RNA, 19 nt, Homo sapiens
uaaugaaugugacagaagu

SEQ ID NO: 1097527 - RNA, 19 nt, Homo sapiens
agagaaaccauacaaaugu

SEQ ID NO: 1097528 - RNA, 19 nt, Homo sapiens
aaagacuccuggcacauga

SEQ ID NO: 1097529 - RNA, 19 nt, Homo sapiens
aaacaucagcuuggauuaa

SEQ ID NO: 1097530 - RNA, 19 nt, Homo sapiens
aaacucauauuggagagaa

SEQ ID NO: 1097531 - RNA, 19 nt, Homo sapiens
guaacuguguaaucaagga

SEQ ID NO: 1097532 - RNA, 19 nt, Homo sapiens
cuucagacaucaaauuauc

SEQ ID NO: 1097533 - RNA, 19 nt, Homo sapiens
gacaucagauaauccauac

SEQ ID NO: 1097534 - RNA, 19 nt, Homo sapiens
gugguaaagucuucaguca

SEQ ID NO: 1097535 - RNA, 19 nt, Homo sapiens
cgacaaagccuugaaucau

SEQ ID NO: 1097536 - RNA, 19 nt, Homo sapiens
ugagaagucugucaaccau

SEQ ID NO: 1097537 - RNA, 19 nt, Homo sapiens
guaaccauguugagaaguc

SEQ ID NO: 1097538 - RNA, 19 nt, Homo sapiens
gaauguaaccauguugaga

SEQ ID NO: 1097539 - RNA, 19 nt, Homo sapiens
gaagguaacccaggagaag

SEQ ID NO: 1097540 - RNA, 19 nt, Homo sapiens
ucucacaacucacuagaca

SEQ ID NO: 1097541 - RNA, 19 nt, Homo sapiens
gaguguggcaaauccuuua

SEQ ID NO: 1097542 - RNA, 19 nt, Homo sapiens
gggagaaaccauacaagug

SEQ ID NO: 1097543 - RNA, 19 nt, Homo sapiens
gauuucaucuguucuucau

SEQ ID NO: 1097544 - RNA, 19 nt, Homo sapiens
auacagggaugugauguug

SEQ ID NO: 1097545 - RNA, 19 nt, Homo sapiens
uagaagagguauaggaaac

SEQ ID NO: 1097546 - RNA, 19 nt, Homo sapiens
cuacacagcaucagagaau

SEQ ID NO: 1097547 - RNA, 19 nt, Homo sapiens
ggcaagaaaccuuacaaau

SEQ ID NO: 1097548 - RNA, 19 nt, Homo sapiens
caaaugcaagcccaaaugu

SEQ ID NO: 1097549 - RNA, 19 nt, Homo sapiens
ggcagaggcuucauuuagg

SEQ ID NO: 1097550 - RNA, 19 nt, Homo sapiens
gcaaauggcugaagagaaa

SEQ ID NO: 1097551 - RNA, 19 nt, Homo sapiens
ggaagaagcuggaauuugu

SEQ ID NO: 1097552 - RNA, 19 nt, Homo sapiens
gaacagggauuuagcaaca

SEQ ID NO: 1097553 - RNA, 19 nt, Homo sapiens
gauaagguguucaaacgua

SEQ ID NO: 1097554 - RNA, 19 nt, Homo sapiens
uaaagaagcucaucgaaca

SEQ ID NO: 1097555 - RNA, 19 nt, Homo sapiens
gcacaaauacgaacaaaug

SEQ ID NO: 1097556 - RNA, 19 nt, Homo sapiens
gcaaugaacuguuuacaac

SEQ ID NO: 1097557 - RNA, 19 nt, Homo sapiens
gggaagagcacauugauaa

SEQ ID NO: 1097558 - RNA, 19 nt, Homo sapiens
gaacuucagcgucacaaua

SEQ ID NO: 1097559 - RNA, 19 nt, Homo sapiens
gaaauaugcugaucuucug

SEQ ID NO: 1097560 - RNA, 19 nt, Homo sapiens
uaacaagcauucauuggaa

SEQ ID NO: 1097561 - RNA, 19 nt, Homo sapiens
gcagauauguuguguaacu

SEQ ID NO: 1097562 - RNA, 19 nt, Homo sapiens
aagcagauauguuguguaa

SEQ ID NO: 1097563 - RNA, 19 nt, Homo sapiens
acaaggagcugaacacuuc

SEQ ID NO: 1097564 - RNA, 19 nt, Homo sapiens
gcagggcucuucaaacaga

SEQ ID NO: 1097565 - RNA, 19 nt, Homo sapiens
gcaaacgacacaacugaua

SEQ ID NO: 1097566 - RNA, 19 nt, Homo sapiens
gaagcaagcuagaaucucu

SEQ ID NO: 1097567 - RNA, 19 nt, Homo sapiens
gcagugacuuuauaacaga

SEQ ID NO: 1097568 - RNA, 19 nt, Homo sapiens
ugaaggcagugacuuuaua

SEQ ID NO: 1097569 - RNA, 19 nt, Homo sapiens
cuacuggacuuauguggua

SEQ ID NO: 1097570 - RNA, 19 nt, Homo sapiens
gggagaagcucgaacagau

SEQ ID NO: 1097571 - RNA, 19 nt, Homo sapiens
uaacagagaacaggaauuu

SEQ ID NO: 1097572 - RNA, 19 nt, Homo sapiens
caucaaggcucaaauugug

SEQ ID NO: 1097573 - RNA, 19 nt, Homo sapiens
cagauuaccuuagaugaaa

SEQ ID NO: 1097574 - RNA, 19 nt, Homo sapiens
guacugcccuggauucuca

SEQ ID NO: 1097575 - RNA, 19 nt, Homo sapiens
ggauaaguuugaagaauuc

SEQ ID NO: 1097576 - RNA, 19 nt, Homo sapiens
cagcagcuuucucuuuaua

SEQ ID NO: 1097577 - RNA, 19 nt, Homo sapiens
gaaagcagauauguugugu

SEQ ID NO: 1097578 - RNA, 19 nt, Homo sapiens
aacagcagcuuucucuuua

SEQ ID NO: 1097579 - RNA, 19 nt, Homo sapiens
ugacuaagaugagguguga

SEQ ID NO: 1097580 - RNA, 19 nt, Homo sapiens
gcugaacacuuccucgaaa

SEQ ID NO: 1097581 - RNA, 19 nt, Homo sapiens
ggugaaagcagauauguug

SEQ ID NO: 1097582 - RNA, 19 nt, Homo sapiens
gugcagggcucuucaaaca

SEQ ID NO: 1097583 - RNA, 19 nt, Homo sapiens
ggaagaagaacgacguaaa

SEQ ID NO: 1097584 - RNA, 19 nt, Homo sapiens
caucaaagcggccaucaaa

SEQ ID NO: 1097585 - RNA, 19 nt, Homo sapiens
gcagcucucuguaagaaau

SEQ ID NO: 1097586 - RNA, 19 nt, Homo sapiens
caacaucaaggcucaaauu

SEQ ID NO: 1097587 - RNA, 19 nt, Homo sapiens
cagaaucgaggcacaaaua

SEQ ID NO: 1097588 - RNA, 19 nt, Homo sapiens
gaagaacgacguaaagaag

SEQ ID NO: 1097589 - RNA, 19 nt, Homo sapiens
gcaagaagcaagcuagaau

SEQ ID NO: 1097590 - RNA, 19 nt, Homo sapiens
gaaggcagugacuuuauaa

SEQ ID NO: 1097591 - RNA, 19 nt, Homo sapiens
gagcagguauccaucaaag

SEQ ID NO: 1097592 - RNA, 19 nt, Homo sapiens
gaagguggaaguccugaaa

SEQ ID NO: 1097593 - RNA, 19 nt, Homo sapiens
aaacagcagcuuucucuuu

SEQ ID NO: 1097594 - RNA, 19 nt, Homo sapiens
gaagaagaacgacguaaag

SEQ ID NO: 1097595 - RNA, 19 nt, Homo sapiens
aaaugaagauccugcagaa

SEQ ID NO: 1097596 - RNA, 19 nt, Homo sapiens
gaugaaggcagugacuuua

SEQ ID NO: 1097597 - RNA, 19 nt, Homo sapiens
gaugaggugugaucacugu

SEQ ID NO: 1097598 - RNA, 19 nt, Homo sapiens
cggcagaaguuugaaauug

SEQ ID NO: 1097599 - RNA, 19 nt, Homo sapiens
cgacacaacugauaaaaga

SEQ ID NO: 1097600 - RNA, 19 nt, Homo sapiens
ugaagauccugcagaagaa

SEQ ID NO: 1097601 - RNA, 19 nt, Homo sapiens
gcaagaaucaagagaggaa

SEQ ID NO: 1097602 - RNA, 19 nt, Homo sapiens
gcagcuuucucuuuauaug

SEQ ID NO: 1097603 - RNA, 19 nt, Homo sapiens
gaagaagcaagcccagauu

SEQ ID NO: 1097604 - RNA, 19 nt, Homo sapiens
gaggagagcaggaguguuc

SEQ ID NO: 1097605 - RNA, 19 nt, Homo sapiens
auaaagcacuucugcaaau

SEQ ID NO: 1097606 - RNA, 19 nt, Homo sapiens
agaagcaacugcacauuuc

SEQ ID NO: 1097607 - RNA, 19 nt, Homo sapiens
gagcaggaguguucagaag

SEQ ID NO: 1097608 - RNA, 19 nt, Homo sapiens
ggaugaaggcagugacuuu

SEQ ID NO: 1097609 - RNA, 19 nt, Homo sapiens
guguauaacuuucucuguu

SEQ ID NO: 1097610 - RNA, 19 nt, Homo sapiens
caaacgacacaacugauaa

SEQ ID NO: 1097611 - RNA, 19 nt, Homo sapiens
gcacauugauaagguguuc

SEQ ID NO: 1097612 - RNA, 19 nt, Homo sapiens
gcacaaguaacaagcauuc

SEQ ID NO: 1097613 - RNA, 19 nt, Homo sapiens
acaauaagacguuaaagga

SEQ ID NO: 1097614 - RNA, 19 nt, Homo sapiens
caaguaacaagcauucauu

SEQ ID NO: 1097615 - RNA, 19 nt, Homo sapiens
gaggugugaucacuguauu

SEQ ID NO: 1097616 - RNA, 19 nt, Homo sapiens
uaauaaagcacuucugcaa

SEQ ID NO: 1097617 - RNA, 19 nt, Homo sapiens
guaacaagcauucauugga

SEQ ID NO: 1097618 - RNA, 19 nt, Homo sapiens
gcaggaguguucagaagca

SEQ ID NO: 1097619 - RNA, 19 nt, Homo sapiens
gaaaacaguccgugauaaa

SEQ ID NO: 1097620 - RNA, 19 nt, Homo sapiens
gaugguuccuugaugugaa

SEQ ID NO: 1097621 - RNA, 19 nt, Homo sapiens
ccacuggaaugcauguguu

SEQ ID NO: 1097622 - RNA, 19 nt, Homo sapiens
ugugaucacuguauugaga

SEQ ID NO: 1097623 - RNA, 19 nt, Homo sapiens
gcucguggaugccaaacug

SEQ ID NO: 1097624 - RNA, 19 nt, Homo sapiens
gacgaugguuccuugaugu

SEQ ID NO: 1097625 - RNA, 19 nt, Homo sapiens
guguaacucucaaucaaau

SEQ ID NO: 1097626 - RNA, 19 nt, Homo sapiens
gaagcaagcccagauugug

SEQ ID NO: 1097627 - RNA, 19 nt, Homo sapiens
ucagagagagagagaguuu

SEQ ID NO: 1097628 - RNA, 19 nt, Homo sapiens
ugacgaugguuccuugaug

SEQ ID NO: 1097629 - RNA, 19 nt, Homo sapiens
gaaaggaaugagcucaaug

SEQ ID NO: 1097630 - RNA, 19 nt, Homo sapiens
uaaagcacuucugcaaaug

SEQ ID NO: 1097631 - RNA, 19 nt, Homo sapiens
ggcagaaguuugaaauugg

SEQ ID NO: 1097632 - RNA, 19 nt, Homo sapiens
guaacucucaaucaaauga

SEQ ID NO: 1097633 - RNA, 19 nt, Homo sapiens
ugaaagagcagguauccau

SEQ ID NO: 1097634 - RNA, 19 nt, Homo sapiens
aaaggaaugagcucaauga

SEQ ID NO: 1097635 - RNA, 19 nt, Homo sapiens
gaaacagcaggaaguacaa

SEQ ID NO: 1097636 - RNA, 19 nt, Homo sapiens
aaacaguccgugauaaaga

SEQ ID NO: 1097637 - RNA, 19 nt, Homo sapiens
uggaaaagaugacaaagaa

SEQ ID NO: 1097638 - RNA, 19 nt, Homo sapiens
cagcaggaaguacaacuaa

SEQ ID NO: 1097639 - RNA, 19 nt, Homo sapiens
cagcaaacgacacaacuga

SEQ ID NO: 1097640 - RNA, 19 nt, Homo sapiens
uggcagcucucuguaagaa

SEQ ID NO: 1097641 - RNA, 19 nt, Homo sapiens
gagaaaacaguccgugaua

SEQ ID NO: 1097642 - RNA, 19 nt, Homo sapiens
ccagauuaccuuagaugaa

SEQ ID NO: 1097643 - RNA, 19 nt, Homo sapiens
aagcccagauugugaaaga

SEQ ID NO: 1097644 - RNA, 19 nt, Homo sapiens
ugacagggccgaccauuac

SEQ ID NO: 1097645 - RNA, 19 nt, Homo sapiens
uagaacuacuggacuuaug

SEQ ID NO: 1097646 - RNA, 19 nt, Homo sapiens
gaagagcacauugauaagg

SEQ ID NO: 1097647 - RNA, 19 nt, Homo sapiens
gccaaacuccgacaggaaa

SEQ ID NO: 1097648 - RNA, 19 nt, Homo sapiens
aagaagcaacugcacauuu

SEQ ID NO: 1097649 - RNA, 19 nt, Homo sapiens
ggcagugacuuuauaacag

SEQ ID NO: 1097650 - RNA, 19 nt, Homo sapiens
gaaguugucuccaccauaa

SEQ ID NO: 1097651 - RNA, 19 nt, Homo sapiens
ggacauaccuauuccuuca

SEQ ID NO: 1097652 - RNA, 19 nt, Homo sapiens
gaagaaaucgguuauugaa

SEQ ID NO: 1097653 - RNA, 19 nt, Homo sapiens
cuaacuagcuuucaucaaa

SEQ ID NO: 1097654 - RNA, 19 nt, Homo sapiens
gaaagguuacgaacacuua

SEQ ID NO: 1097655 - RNA, 19 nt, Homo sapiens
gaagaaagguuacgaacac

SEQ ID NO: 1097656 - RNA, 19 nt, Homo sapiens
gagcauggcuauaagacaa

SEQ ID NO: 1097657 - RNA, 19 nt, Homo sapiens
gggaagaaaucgguuauug

SEQ ID NO: 1097658 - RNA, 19 nt, Homo sapiens
gaagagagagaggcauuua

SEQ ID NO: 1097659 - RNA, 19 nt, Homo sapiens
ggaaaacacugaagacauu

SEQ ID NO: 1097660 - RNA, 19 nt, Homo sapiens
gaaaacagcugguggacaa

SEQ ID NO: 1097661 - RNA, 19 nt, Homo sapiens
agauaaagcucuucauuca

SEQ ID NO: 1097662 - RNA, 19 nt, Homo sapiens
gaacaacacauucaaacga

SEQ ID NO: 1097663 - RNA, 19 nt, Homo sapiens
ggacugggcuaaugcuaau

SEQ ID NO: 1097664 - RNA, 19 nt, Homo sapiens
gcauugcuguuuguaauuu

SEQ ID NO: 1097665 - RNA, 19 nt, Homo sapiens
caacacauucaaacgauua

SEQ ID NO: 1097666 - RNA, 19 nt, Homo sapiens
gaaaucgguuauugaagga

SEQ ID NO: 1097667 - RNA, 19 nt, Homo sapiens
ggaagaaaucgguuauuga

SEQ ID NO: 1097668 - RNA, 19 nt, Homo sapiens
ugaagacauugaagaagua

SEQ ID NO: 1097669 - RNA, 19 nt, Homo sapiens
cacacuagcuacaugauuu

SEQ ID NO: 1097670 - RNA, 19 nt, Homo sapiens
gagagaggcauuuagaauu

SEQ ID NO: 1097671 - RNA, 19 nt, Homo sapiens
aaagugaagucccuauuug

SEQ ID NO: 1097672 - RNA, 19 nt, Homo sapiens
gcaggaauucgaaauauug

SEQ ID NO: 1097673 - RNA, 19 nt, Homo sapiens
aaacggcacucaaguauac

SEQ ID NO: 1097674 - RNA, 19 nt, Homo sapiens
gauugaggacacuguauua

SEQ ID NO: 1097675 - RNA, 19 nt, Homo sapiens
gaugagcccucugucuauu

SEQ ID NO: 1097676 - RNA, 19 nt, Homo sapiens
aaagagaugugaugcagau

SEQ ID NO: 1097677 - RNA, 19 nt, Homo sapiens
ugaagucccuauuugaaga

SEQ ID NO: 1097678 - RNA, 19 nt, Homo sapiens
gugcauauucggccucuua

SEQ ID NO: 1097679 - RNA, 19 nt, Homo sapiens
ucucugaccuugauuggaa

SEQ ID NO: 1097680 - RNA, 19 nt, Homo sapiens
caauugcacuuaucacauc

SEQ ID NO: 1097681 - RNA, 19 nt, Homo sapiens
ggcaggaauucgaaauauu

SEQ ID NO: 1097682 - RNA, 19 nt, Homo sapiens
agagaggcauuuagaauuc

SEQ ID NO: 1097683 - RNA, 19 nt, Homo sapiens
gcaugauacuucugcuuau

SEQ ID NO: 1097684 - RNA, 19 nt, Homo sapiens
ggagcuaaccugaguaauc

SEQ ID NO: 1097685 - RNA, 19 nt, Homo sapiens
uguaauuucucucuucuug

SEQ ID NO: 1097686 - RNA, 19 nt, Homo sapiens
gggauaaacgcgccuuaaa

SEQ ID NO: 1097687 - RNA, 19 nt, Homo sapiens
gcauucugcuggauauaug

SEQ ID NO: 1097688 - RNA, 19 nt, Homo sapiens
gcaauucaacccuuucugu

SEQ ID NO: 1097689 - RNA, 19 nt, Homo sapiens
gugaucggcuggugcauau

SEQ ID NO: 1097690 - RNA, 19 nt, Homo sapiens
gaccuugauuggaauguug

SEQ ID NO: 1097691 - RNA, 19 nt, Homo sapiens
ugaguaauccacugaauau

SEQ ID NO: 1097692 - RNA, 19 nt, Homo sapiens
agacauaagugaugaugag

SEQ ID NO: 1097693 - RNA, 19 nt, Homo sapiens
uggaaguagucaugguuua

SEQ ID NO: 1097694 - RNA, 19 nt, Homo sapiens
cuucagugcugcuuacuau

SEQ ID NO: 1097695 - RNA, 19 nt, Homo sapiens
cccaauauguuauguaugg

SEQ ID NO: 1097696 - RNA, 19 nt, Homo sapiens
cuagcuacaugauuuauag

SEQ ID NO: 1097697 - RNA, 19 nt, Homo sapiens
cauauucggccucuuacua

SEQ ID NO: 1097698 - RNA, 19 nt, Homo sapiens
gagcuaaccugaguaaucc

SEQ ID NO: 1097699 - RNA, 19 nt, Homo sapiens
agaaguagaacaacacauu

SEQ ID NO: 1097700 - RNA, 19 nt, Homo sapiens
cugaauaucuguuaugcau

SEQ ID NO: 1097701 - RNA, 19 nt, Homo sapiens
gaaguagaacaacacauuc

SEQ ID NO: 1097702 - RNA, 19 nt, Homo sapiens
ccucuaauguauaauagug

SEQ ID NO: 1097703 - RNA, 19 nt, Homo sapiens
ucagugcugcuuacuauuu

SEQ ID NO: 1097704 - RNA, 19 nt, Homo sapiens
caugauacuucugcuuauu

SEQ ID NO: 1097705 - RNA, 19 nt, Homo sapiens
guagaacaacacauucaaa

SEQ ID NO: 1097706 - RNA, 19 nt, Homo sapiens
cuggauauauguucguaaa

SEQ ID NO: 1097707 - RNA, 19 nt, Homo sapiens
gauuaauuguauccuguug

SEQ ID NO: 1097708 - RNA, 19 nt, Homo sapiens
uaauuucucucuucuuguc

SEQ ID NO: 1097709 - RNA, 19 nt, Homo sapiens
ugguuuagcugcauuguca

SEQ ID NO: 1097710 - RNA, 19 nt, Homo sapiens
gagagagaggcauuuagaa

SEQ ID NO: 1097711 - RNA, 19 nt, Homo sapiens
gaacacuuaagaagagaga

SEQ ID NO: 1097712 - RNA, 19 nt, Homo sapiens
ugaauaugcuuuugccuuu

SEQ ID NO: 1097713 - RNA, 19 nt, Homo sapiens
uaagacuacuggcuuugug

SEQ ID NO: 1097714 - RNA, 19 nt, Homo sapiens
gcugacugaauaucuguua

SEQ ID NO: 1097715 - RNA, 19 nt, Homo sapiens
gaauaugcuuuugccuuua

SEQ ID NO: 1097716 - RNA, 19 nt, Homo sapiens
gagaggcauuuagaauuca

SEQ ID NO: 1097717 - RNA, 19 nt, Homo sapiens
guaauccacugaauaugcu

SEQ ID NO: 1097718 - RNA, 19 nt, Homo sapiens
guucguaaauaccaaaguc

SEQ ID NO: 1097719 - RNA, 19 nt, Homo sapiens
ucucucuucuugucaaauu

SEQ ID NO: 1097720 - RNA, 19 nt, Homo sapiens
cugaagacauugaagaagu

SEQ ID NO: 1097721 - RNA, 19 nt, Homo sapiens
gcaauugcacuuaucacau

SEQ ID NO: 1097722 - RNA, 19 nt, Homo sapiens
gcaugucugcguuaccuuu

SEQ ID NO: 1097723 - RNA, 19 nt, Homo sapiens
ggaauguuggcagcuauaa

SEQ ID NO: 1097724 - RNA, 19 nt, Homo sapiens
gaugaugaugauacuagua

SEQ ID NO: 1097725 - RNA, 19 nt, Homo sapiens
uggcaggaauucgaaauau

SEQ ID NO: 1097726 - RNA, 19 nt, Homo sapiens
gaagaaguagaacaacaca

SEQ ID NO: 1097727 - RNA, 19 nt, Homo sapiens
gcguuaccuuuaaaucuga

SEQ ID NO: 1097728 - RNA, 19 nt, Homo sapiens
auauaagacuacuggcuuu

SEQ ID NO: 1097729 - RNA, 19 nt, Homo sapiens
aaagggaagaaaucgguua

SEQ ID NO: 1097730 - RNA, 19 nt, Homo sapiens
uagauaaagcucuucauuc

SEQ ID NO: 1097731 - RNA, 19 nt, Homo sapiens
uuacgaacacuuaagaaga

SEQ ID NO: 1097732 - RNA, 19 nt, Homo sapiens
uaucacaucagcacuucua

SEQ ID NO: 1097733 - RNA, 19 nt, Homo sapiens
ggaugaugaugauacuagu

SEQ ID NO: 1097734 - RNA, 19 nt, Homo sapiens
gcgggaaagugaaguuguc

SEQ ID NO: 1097735 - RNA, 19 nt, Homo sapiens
cacaaguucugguucuuca

SEQ ID NO: 1097736 - RNA, 19 nt, Homo sapiens
acacuagcuacaugauuua

SEQ ID NO: 1097737 - RNA, 19 nt, Homo sapiens
agagagagaggcauuuaga

SEQ ID NO: 1097738 - RNA, 19 nt, Homo sapiens
ggauaaacgcgccuuaaaa

SEQ ID NO: 1097739 - RNA, 19 nt, Homo sapiens
uaacuuacacagccuaugg

SEQ ID NO: 1097740 - RNA, 19 nt, Homo sapiens
cagaugcuccugaagauca

SEQ ID NO: 1097741 - RNA, 19 nt, Homo sapiens
gcuacaugauuuauagucu

SEQ ID NO: 1097742 - RNA, 19 nt, Homo sapiens
ggaaguagucaugguuuag

SEQ ID NO: 1097743 - RNA, 19 nt, Homo sapiens
gaucggcuggugcauauuc

SEQ ID NO: 1097744 - RNA, 19 nt, Homo sapiens
gaagucccuauuugaagaa

SEQ ID NO: 1097745 - RNA, 19 nt, Homo sapiens
aaugggagcauggcuauaa

SEQ ID NO: 1097746 - RNA, 19 nt, Homo sapiens
gaagauucagacauaagug

SEQ ID NO: 1097747 - RNA, 19 nt, Homo sapiens
ugcaugauacuucugcuua

SEQ ID NO: 1097748 - RNA, 19 nt, Homo sapiens
uuaguugcauugcuguuug

SEQ ID NO: 1097749 - RNA, 19 nt, Homo sapiens
uacgaacacuuaagaagag

SEQ ID NO: 1097750 - RNA, 19 nt, Homo sapiens
ggacuuggaugaguuauua

SEQ ID NO: 1097751 - RNA, 19 nt, Homo sapiens
gaagagauauggaagucua

SEQ ID NO: 1097752 - RNA, 19 nt, Homo sapiens
gagacuacuuccuuuauaa

SEQ ID NO: 1097753 - RNA, 19 nt, Homo sapiens
gaagugacccgcaaacaaa

SEQ ID NO: 1097754 - RNA, 19 nt, Homo sapiens
ugaagacaaucgucacuua

SEQ ID NO: 1097755 - RNA, 19 nt, Homo sapiens
gcagauuuauuggauguua

SEQ ID NO: 1097756 - RNA, 19 nt, Homo sapiens
ggagaaaguuacagcuauu

SEQ ID NO: 1097757 - RNA, 19 nt, Homo sapiens
caaaagaacuuccucauug

SEQ ID NO: 1097758 - RNA, 19 nt, Homo sapiens
gauaaagauugccuuaguu

SEQ ID NO: 1097759 - RNA, 19 nt, Homo sapiens
gaaagacacuggguacugu

SEQ ID NO: 1097760 - RNA, 19 nt, Homo sapiens
guacaagcgucacaguauu

SEQ ID NO: 1097761 - RNA, 19 nt, Homo sapiens
ggaagucuaugacauuauc

SEQ ID NO: 1097762 - RNA, 19 nt, Homo sapiens
gcagggaguuguuauucuu

SEQ ID NO: 1097763 - RNA, 19 nt, Homo sapiens
gaaauccuauccugaaguc

SEQ ID NO: 1097764 - RNA, 19 nt, Homo sapiens
caagagaacaucccaguga

SEQ ID NO: 1097765 - RNA, 19 nt, Homo sapiens
gaaaccauauccaaagaag

SEQ ID NO: 1097766 - RNA, 19 nt, Homo sapiens
guacuggguuuguuacaga

SEQ ID NO: 1097767 - RNA, 19 nt, Homo sapiens
cgaaguucaucauccauaa

SEQ ID NO: 1097768 - RNA, 19 nt, Homo sapiens
ugagacuacuuccuuuaua

SEQ ID NO: 1097769 - RNA, 19 nt, Homo sapiens
uuacagcuauugaugauga

SEQ ID NO: 1097770 - RNA, 19 nt, Homo sapiens
gaaaguggcaguugaagca

SEQ ID NO: 1097771 - RNA, 19 nt, Homo sapiens
cagaggaauuugaauauca

SEQ ID NO: 1097772 - RNA, 19 nt, Homo sapiens
gcaaugguauaauuucagu

SEQ ID NO: 1097773 - RNA, 19 nt, Homo sapiens
cuacagaauuuaaggguau

SEQ ID NO: 1097774 - RNA, 19 nt, Homo sapiens
caacuguucugauuugaag

SEQ ID NO: 1097775 - RNA, 19 nt, Homo sapiens
ugucagcuaugaaguguuu

SEQ ID NO: 1097776 - RNA, 19 nt, Homo sapiens
ugaagaaucacguuauuga

SEQ ID NO: 1097777 - RNA, 19 nt, Homo sapiens
gauggacaauuaccaggaa

SEQ ID NO: 1097778 - RNA, 19 nt, Homo sapiens
gcccaacuguucugauuug

SEQ ID NO: 1097779 - RNA, 19 nt, Homo sapiens
gaagaaucacguuauugaa

SEQ ID NO: 1097780 - RNA, 19 nt, Homo sapiens
uaacguuucugauggacaa

SEQ ID NO: 1097781 - RNA, 19 nt, Homo sapiens
gaagcagccuauguacuug

SEQ ID NO: 1097782 - RNA, 19 nt, Homo sapiens
gaauggugguuaggagaaa

SEQ ID NO: 1097783 - RNA, 19 nt, Homo sapiens
cuacgaagaguccagauaa

SEQ ID NO: 1097784 - RNA, 19 nt, Homo sapiens
ggagaaaguggcaguugaa

SEQ ID NO: 1097785 - RNA, 19 nt, Homo sapiens
gaagacaaucgucacuuau

SEQ ID NO: 1097786 - RNA, 19 nt, Homo sapiens
agaaucacguuauugaaga

SEQ ID NO: 1097787 - RNA, 19 nt, Homo sapiens
cuaccaggcuguggaauga

SEQ ID NO: 1097788 - RNA, 19 nt, Homo sapiens
caagaacgauuuccuacac

SEQ ID NO: 1097789 - RNA, 19 nt, Homo sapiens
gccaaacucuccaacaaag

SEQ ID NO: 1097790 - RNA, 19 nt, Homo sapiens
cauaacagaugccaaacuc

SEQ ID NO: 1097791 - RNA, 19 nt, Homo sapiens
ucaaauuaguccagaggaa

SEQ ID NO: 1097792 - RNA, 19 nt, Homo sapiens
gaagaguccagauaaaaua

SEQ ID NO: 1097793 - RNA, 19 nt, Homo sapiens
ugaagcagccuauguacuu

SEQ ID NO: 1097794 - RNA, 19 nt, Homo sapiens
cauccuagcuacugauauc

SEQ ID NO: 1097795 - RNA, 19 nt, Homo sapiens
uuacuauggucacuugaaa

SEQ ID NO: 1097796 - RNA, 19 nt, Homo sapiens
ugacagaggccaauguaga

SEQ ID NO: 1097797 - RNA, 19 nt, Homo sapiens
aaaugagacuacuuccuuu

SEQ ID NO: 1097798 - RNA, 19 nt, Homo sapiens
agauaaagauugccuuagu

SEQ ID NO: 1097799 - RNA, 19 nt, Homo sapiens
ugaagucuaucaagaacga

SEQ ID NO: 1097800 - RNA, 19 nt, Homo sapiens
caagagcuaugagcauugu

SEQ ID NO: 1097801 - RNA, 19 nt, Homo sapiens
gacagaggccaauguagaa

SEQ ID NO: 1097802 - RNA, 19 nt, Homo sapiens
gguacaagcgucacaguau

SEQ ID NO: 1097803 - RNA, 19 nt, Homo sapiens
ccugaagaaucacguuauu

SEQ ID NO: 1097804 - RNA, 19 nt, Homo sapiens
gaaaguuacagcuauugau

SEQ ID NO: 1097805 - RNA, 19 nt, Homo sapiens
gaguuguuauucuugauga

SEQ ID NO: 1097806 - RNA, 19 nt, Homo sapiens
gaggaagucauaacagaug

SEQ ID NO: 1097807 - RNA, 19 nt, Homo sapiens
ccuagcuacugauaucuuu

SEQ ID NO: 1097808 - RNA, 19 nt, Homo sapiens
agagaccacuguuguuguu

SEQ ID NO: 1097809 - RNA, 19 nt, Homo sapiens
aauaauacuuccacagcaa

SEQ ID NO: 1097810 - RNA, 19 nt, Homo sapiens
uggaggaagucauaacaga

SEQ ID NO: 1097811 - RNA, 19 nt, Homo sapiens
cccaggagcugauauggau

SEQ ID NO: 1097812 - RNA, 19 nt, Homo sapiens
ucaaacuugucaauucgaa

SEQ ID NO: 1097813 - RNA, 19 nt, Homo sapiens
ggccaguugugaugaauuc

SEQ ID NO: 1097814 - RNA, 19 nt, Homo sapiens
guccagaggaauuugaaua

SEQ ID NO: 1097815 - RNA, 19 nt, Homo sapiens
ugauuacuauggucacuug

SEQ ID NO: 1097816 - RNA, 19 nt, Homo sapiens
ucaucugccugcaauggua

SEQ ID NO: 1097817 - RNA, 19 nt, Homo sapiens
gcguguggcucaucuacga

SEQ ID NO: 1097818 - RNA, 19 nt, Homo sapiens
cguuucugauggacaauua

SEQ ID NO: 1097819 - RNA, 19 nt, Homo sapiens
aaucgucacuuauacagau

SEQ ID NO: 1097820 - RNA, 19 nt, Homo sapiens
ugacuuaguagccaauuau

SEQ ID NO: 1097821 - RNA, 19 nt, Homo sapiens
gcugacagaggccaaugua

SEQ ID NO: 1097822 - RNA, 19 nt, Homo sapiens
aagacaaucgucacuuaua

SEQ ID NO: 1097823 - RNA, 19 nt, Homo sapiens
gaacuggauaaauucuuug

SEQ ID NO: 1097824 - RNA, 19 nt, Homo sapiens
uggauguuaugacagauuu

SEQ ID NO: 1097825 - RNA, 19 nt, Homo sapiens
uauuggauguuaugacaga

SEQ ID NO: 1097826 - RNA, 19 nt, Homo sapiens
ugaagugacccgcaaacaa

SEQ ID NO: 1097827 - RNA, 19 nt, Homo sapiens
agacuuuggugguggaaga

SEQ ID NO: 1097828 - RNA, 19 nt, Homo sapiens
caaacgguccagcugcuaa

SEQ ID NO: 1097829 - RNA, 19 nt, Homo sapiens
uaucaagaacgauuuccua

SEQ ID NO: 1097830 - RNA, 19 nt, Homo sapiens
cacuuuaucugcuccauca

SEQ ID NO: 1097831 - RNA, 19 nt, Homo sapiens
uacgaagaguccagauaaa

SEQ ID NO: 1097832 - RNA, 19 nt, Homo sapiens
guucaucauccauaaugua

SEQ ID NO: 1097833 - RNA, 19 nt, Homo sapiens
uagaagagauauggaaguc

SEQ ID NO: 1097834 - RNA, 19 nt, Homo sapiens
agacaaucgucacuuauac

SEQ ID NO: 1097835 - RNA, 19 nt, Homo sapiens
gaaaauggggugaggaaga

SEQ ID NO: 1097836 - RNA, 19 nt, Homo sapiens
ccagaggaauuugaauauc

SEQ ID NO: 1097837 - RNA, 19 nt, Homo sapiens
uuuaucugcuccaucauuu

SEQ ID NO: 1097838 - RNA, 19 nt, Homo sapiens
gaaaauaggagaaaguuac

SEQ ID NO: 1097839 - RNA, 19 nt, Homo sapiens
gagauauggaagucuauga

SEQ ID NO: 1097840 - RNA, 19 nt, Homo sapiens
cagauuuccuccuucuuca

SEQ ID NO: 1097841 - RNA, 19 nt, Homo sapiens
ggccgaagcuguggauugg

SEQ ID NO: 1097842 - RNA, 19 nt, Homo sapiens
gguauaauuucagucuuag

SEQ ID NO: 1097843 - RNA, 19 nt, Homo sapiens
ugccugcaaugguauaauu

SEQ ID NO: 1097844 - RNA, 19 nt, Homo sapiens
gcaagcagggaguuguuau

SEQ ID NO: 1097845 - RNA, 19 nt, Homo sapiens
caguugugaugaauucuga

SEQ ID NO: 1097846 - RNA, 19 nt, Homo sapiens
uuauacagauuuccuccuu

SEQ ID NO: 1097847 - RNA, 19 nt, Homo sapiens
aggagaaaguuacagcuau

SEQ ID NO: 1097848 - RNA, 19 nt, Homo sapiens
uggcccaacuguucugauu

SEQ ID NO: 1097849 - RNA, 19 nt, Homo sapiens
ugaauucugagauguggua

SEQ ID NO: 1097850 - RNA, 19 nt, Homo sapiens
guacaauccuggcauaaua

SEQ ID NO: 1097851 - RNA, 19 nt, Homo sapiens
ggaaugguuuguacuaaua

SEQ ID NO: 1097852 - RNA, 19 nt, Homo sapiens
acaguaagcucauuguuua

SEQ ID NO: 1097853 - RNA, 19 nt, Homo sapiens
ggagauaggcuuauuauga

SEQ ID NO: 1097854 - RNA, 19 nt, Homo sapiens
ccacaaacaugaauucaaa

SEQ ID NO: 1097855 - RNA, 19 nt, Homo sapiens
gcagaaugcuugugagauu

SEQ ID NO: 1097856 - RNA, 19 nt, Homo sapiens
gagaggaugugcaccuuua

SEQ ID NO: 1097857 - RNA, 19 nt, Homo sapiens
gcaaguaucuccacagcaa

SEQ ID NO: 1097858 - RNA, 19 nt, Homo sapiens
ccauaaauaucgugucaua

SEQ ID NO: 1097859 - RNA, 19 nt, Homo sapiens
gagauaggcuuauuaugau

SEQ ID NO: 1097860 - RNA, 19 nt, Homo sapiens
ucaaacggcucaucuuauu

SEQ ID NO: 1097861 - RNA, 19 nt, Homo sapiens
ggucagacuucaucaauau

SEQ ID NO: 1097862 - RNA, 19 nt, Homo sapiens
ccaacacgcuuaucaaugu

SEQ ID NO: 1097863 - RNA, 19 nt, Homo sapiens
gaagauacuuugagaugca

SEQ ID NO: 1097864 - RNA, 19 nt, Homo sapiens
gaaggaaugguuuguacua

SEQ ID NO: 1097865 - RNA, 19 nt, Homo sapiens
gaacaauccugcagagaac

SEQ ID NO: 1097866 - RNA, 19 nt, Homo sapiens
aagcauauuucuccucaua

SEQ ID NO: 1097867 - RNA, 19 nt, Homo sapiens
gagaggagauaggcuuauu

SEQ ID NO: 1097868 - RNA, 19 nt, Homo sapiens
uaauacagacguacagaua

SEQ ID NO: 1097869 - RNA, 19 nt, Homo sapiens
gaaugaaggugaaaacuug

SEQ ID NO: 1097870 - RNA, 19 nt, Homo sapiens
ggaaagggacuugauguug

SEQ ID NO: 1097871 - RNA, 19 nt, Homo sapiens
gaagggaucuaccgaacag

SEQ ID NO: 1097872 - RNA, 19 nt, Homo sapiens
cagaaugcuugugagauua

SEQ ID NO: 1097873 - RNA, 19 nt, Homo sapiens
aaaugacacuuucugcuuu

SEQ ID NO: 1097874 - RNA, 19 nt, Homo sapiens
ccagcugaauggagaauuu

SEQ ID NO: 1097875 - RNA, 19 nt, Homo sapiens
gaacagaaagggacaaagg

SEQ ID NO: 1097876 - RNA, 19 nt, Homo sapiens
ccugcaagaucauccuuua

SEQ ID NO: 1097877 - RNA, 19 nt, Homo sapiens
cagcagggcucuaguuucu

SEQ ID NO: 1097878 - RNA, 19 nt, Homo sapiens
ggaaggcugugaugggaau

SEQ ID NO: 1097879 - RNA, 19 nt, Homo sapiens
ccagaugcaugagcuaauu

SEQ ID NO: 1097880 - RNA, 19 nt, Homo sapiens
uguaugagcucaccuucaa

SEQ ID NO: 1097881 - RNA, 19 nt, Homo sapiens
ucaccaagaugcuucugaa

SEQ ID NO: 1097882 - RNA, 19 nt, Homo sapiens
gcaccuuuaucgcaaguau

SEQ ID NO: 1097883 - RNA, 19 nt, Homo sapiens
gaaggaaacuggauuuugg

SEQ ID NO: 1097884 - RNA, 19 nt, Homo sapiens
ucaguacaauccuggcaua

SEQ ID NO: 1097885 - RNA, 19 nt, Homo sapiens
gaaaagacuuccauaaagg

SEQ ID NO: 1097886 - RNA, 19 nt, Homo sapiens
gagaaaagacuuccauaaa

SEQ ID NO: 1097887 - RNA, 19 nt, Homo sapiens
caauauagguggguuugau

SEQ ID NO: 1097888 - RNA, 19 nt, Homo sapiens
gguggaaguaacugaauua

SEQ ID NO: 1097889 - RNA, 19 nt, Homo sapiens
ccaaggacaugccaaaugc

SEQ ID NO: 1097890 - RNA, 19 nt, Homo sapiens
ucagggagaugugcauuga

SEQ ID NO: 1097891 - RNA, 19 nt, Homo sapiens
ggcaguucaugcagaauuu

SEQ ID NO: 1097892 - RNA, 19 nt, Homo sapiens
caucuuauuucgaccauuc

SEQ ID NO: 1097893 - RNA, 19 nt, Homo sapiens
ggacaagcgggaugaguug

SEQ ID NO: 1097894 - RNA, 19 nt, Homo sapiens
gcuucuggcuuccauaaga

SEQ ID NO: 1097895 - RNA, 19 nt, Homo sapiens
gaggagauaggcuuauuau

SEQ ID NO: 1097896 - RNA, 19 nt, Homo sapiens
gaaggcaggagaggagaua

SEQ ID NO: 1097897 - RNA, 19 nt, Homo sapiens
agauuucacuucagucauu

SEQ ID NO: 1097898 - RNA, 19 nt, Homo sapiens
gggaaggaaugguuuguac

SEQ ID NO: 1097899 - RNA, 19 nt, Homo sapiens
gaagguauuuuauccaguu

SEQ ID NO: 1097900 - RNA, 19 nt, Homo sapiens
ggacaucuacuucacaucu

SEQ ID NO: 1097901 - RNA, 19 nt, Homo sapiens
gguggaagccauugaauca

SEQ ID NO: 1097902 - RNA, 19 nt, Homo sapiens
gcaagaucauccuuuaaaa

SEQ ID NO: 1097903 - RNA, 19 nt, Homo sapiens
gagcuaauuaucucuuuga

SEQ ID NO: 1097904 - RNA, 19 nt, Homo sapiens
aaugacacuuucugcuuua

SEQ ID NO: 1097905 - RNA, 19 nt, Homo sapiens
gaaugcuugugagauuaua

SEQ ID NO: 1097906 - RNA, 19 nt, Homo sapiens
ggacaaggcagaggugaau

SEQ ID NO: 1097907 - RNA, 19 nt, Homo sapiens
acuuugagaugcauuauga

SEQ ID NO: 1097908 - RNA, 19 nt, Homo sapiens
gcacaaguuggccuacauu

SEQ ID NO: 1097909 - RNA, 19 nt, Homo sapiens
caaaagaauuggacugaug

SEQ ID NO: 1097910 - RNA, 19 nt, Homo sapiens
ggugaaaacuuggagauuu

SEQ ID NO: 1097911 - RNA, 19 nt, Homo sapiens
caucugaauuccucaauac

SEQ ID NO: 1097912 - RNA, 19 nt, Homo sapiens
aacaugaacucccagagaa

SEQ ID NO: 1097913 - RNA, 19 nt, Homo sapiens
ggagagacuuuggauuugg

SEQ ID NO: 1097914 - RNA, 19 nt, Homo sapiens
uuccaaagcugccaacuuc

SEQ ID NO: 1097915 - RNA, 19 nt, Homo sapiens
uaaagaaggaaacuggauu

SEQ ID NO: 1097916 - RNA, 19 nt, Homo sapiens
gcgucaagcuggccacaga

SEQ ID NO: 1097917 - RNA, 19 nt, Homo sapiens
acgcauggcugauucugaa

SEQ ID NO: 1097918 - RNA, 19 nt, Homo sapiens
cacaguaagcucauuguuu

SEQ ID NO: 1097919 - RNA, 19 nt, Homo sapiens
cacggccucugauuucaua

SEQ ID NO: 1097920 - RNA, 19 nt, Homo sapiens
uagagugguuucuucauuc

SEQ ID NO: 1097921 - RNA, 19 nt, Homo sapiens
cuagugaguacauuaagua

SEQ ID NO: 1097922 - RNA, 19 nt, Homo sapiens
acacugagaccuguuguuu

SEQ ID NO: 1097923 - RNA, 19 nt, Homo sapiens
ugaacaauccugcagagaa

SEQ ID NO: 1097924 - RNA, 19 nt, Homo sapiens
ggugaaugcuggcgucaag

SEQ ID NO: 1097925 - RNA, 19 nt, Homo sapiens
ccaagaggcagaacucguu

SEQ ID NO: 1097926 - RNA, 19 nt, Homo sapiens
auagagugguuucuucauu

SEQ ID NO: 1097927 - RNA, 19 nt, Homo sapiens
uaacauagagugguuucuu

SEQ ID NO: 1097928 - RNA, 19 nt, Homo sapiens
caacugaacacuggaggaa

SEQ ID NO: 1097929 - RNA, 19 nt, Homo sapiens
gauacuuugagaugcauua

SEQ ID NO: 1097930 - RNA, 19 nt, Homo sapiens
gaugagaaagccuccgauu

SEQ ID NO: 1097931 - RNA, 19 nt, Homo sapiens
aaacaugaacucccagaga

SEQ ID NO: 1097932 - RNA, 19 nt, Homo sapiens
aaagaaggaaacuggauuu

SEQ ID NO: 1097933 - RNA, 19 nt, Homo sapiens
ggagauuucacuucaguca

SEQ ID NO: 1097934 - RNA, 19 nt, Homo sapiens
uugcaagccuuacaagaga

SEQ ID NO: 1097935 - RNA, 19 nt, Homo sapiens
guagccaccuccuaaccuu

SEQ ID NO: 1097936 - RNA, 19 nt, Homo sapiens
ugacaaaggcagaaugcuu

SEQ ID NO: 1097937 - RNA, 19 nt, Homo sapiens
aaacagaaacagaagacaa

SEQ ID NO: 1097938 - RNA, 19 nt, Homo sapiens
ccaagaugcuucugaaaau

SEQ ID NO: 1097939 - RNA, 19 nt, Homo sapiens
cuggugauaucgugaugua

SEQ ID NO: 1097940 - RNA, 19 nt, Homo sapiens
gaagaggagcaacugaaca

SEQ ID NO: 1097941 - RNA, 19 nt, Homo sapiens
gcaugaaaggcaagcauau

SEQ ID NO: 1097942 - RNA, 19 nt, Homo sapiens
ccacagcaaccucauagug

SEQ ID NO: 1097943 - RNA, 19 nt, Homo sapiens
ggaccacaaacaugaauuc

SEQ ID NO: 1097944 - RNA, 19 nt, Homo sapiens
gcagcagugccuuucgaua

SEQ ID NO: 1097945 - RNA, 19 nt, Homo sapiens
caaaguauaccgugugaac

SEQ ID NO: 1097946 - RNA, 19 nt, Homo sapiens
aguagggaccgcuuucuua

SEQ ID NO: 1097947 - RNA, 19 nt, Homo sapiens
aagaagauacuuugagaug

SEQ ID NO: 1097948 - RNA, 19 nt, Homo sapiens
cggucagacuucaucaaua

SEQ ID NO: 1097949 - RNA, 19 nt, Homo sapiens
uaauauacggccaccauga

SEQ ID NO: 1097950 - RNA, 19 nt, Homo sapiens
gaaaucagcuccaaacuua

SEQ ID NO: 1097951 - RNA, 19 nt, Homo sapiens
gaacugagauggaauacua

SEQ ID NO: 1097952 - RNA, 19 nt, Homo sapiens
gaagagugaugcugaauuu

SEQ ID NO: 1097953 - RNA, 19 nt, Homo sapiens
gaagauggaucacauaaag

SEQ ID NO: 1097954 - RNA, 19 nt, Homo sapiens
ccagagagguuguaaauau

SEQ ID NO: 1097955 - RNA, 19 nt, Homo sapiens
caaauaauguggcuucaaa

SEQ ID NO: 1097956 - RNA, 19 nt, Homo sapiens
gaaagauucucaaggaaga

SEQ ID NO: 1097957 - RNA, 19 nt, Homo sapiens
gagcaacauuuguaacuuu

SEQ ID NO: 1097958 - RNA, 19 nt, Homo sapiens
caaagaauguugcuacaga

SEQ ID NO: 1097959 - RNA, 19 nt, Homo sapiens
cuaaauugcucaggcauua

SEQ ID NO: 1097960 - RNA, 19 nt, Homo sapiens
gaagaaaugcguaagaaga

SEQ ID NO: 1097961 - RNA, 19 nt, Homo sapiens
gaagaaaugacaagaaaga

SEQ ID NO: 1097962 - RNA, 19 nt, Homo sapiens
ccacacaaauuccaaagaa

SEQ ID NO: 1097963 - RNA, 19 nt, Homo sapiens
gaagaaaccauucgagaug

SEQ ID NO: 1097964 - RNA, 19 nt, Homo sapiens
guacauacguuacugagau

SEQ ID NO: 1097965 - RNA, 19 nt, Homo sapiens
uaauguggcuucaaagauu

SEQ ID NO: 1097966 - RNA, 19 nt, Homo sapiens
guacuugcuuuaucucuuu

SEQ ID NO: 1097967 - RNA, 19 nt, Homo sapiens
aaccaaagauccauaauga

SEQ ID NO: 1097968 - RNA, 19 nt, Homo sapiens
ccuguuaagucuucaaaua

SEQ ID NO: 1097969 - RNA, 19 nt, Homo sapiens
gaaaugacaagaaagauuc

SEQ ID NO: 1097970 - RNA, 19 nt, Homo sapiens
gaacaaagucauuucuuca

SEQ ID NO: 1097971 - RNA, 19 nt, Homo sapiens
gaaaauaaguuccucuguu

SEQ ID NO: 1097972 - RNA, 19 nt, Homo sapiens
gaauucaaaugcagcuuau

SEQ ID NO: 1097973 - RNA, 19 nt, Homo sapiens
gagugaugcugaauuuaaa

SEQ ID NO: 1097974 - RNA, 19 nt, Homo sapiens
caggaaaccaguucaguua

SEQ ID NO: 1097975 - RNA, 19 nt, Homo sapiens
aaagagaacugagauggaa

SEQ ID NO: 1097976 - RNA, 19 nt, Homo sapiens
gaagauauuuucccaguga

SEQ ID NO: 1097977 - RNA, 19 nt, Homo sapiens
ucacagaaauauccagaga

SEQ ID NO: 1097978 - RNA, 19 nt, Homo sapiens
ccaaagauccauaaugaga

SEQ ID NO: 1097979 - RNA, 19 nt, Homo sapiens
gaaccaaagauccauaaug

SEQ ID NO: 1097980 - RNA, 19 nt, Homo sapiens
gaguaagacuuuauucaca

SEQ ID NO: 1097981 - RNA, 19 nt, Homo sapiens
ggaaaucagcuccaaacuu

SEQ ID NO: 1097982 - RNA, 19 nt, Homo sapiens
guaagaagaugcaccaaaa

SEQ ID NO: 1097983 - RNA, 19 nt, Homo sapiens
aaaugcagcuuaugaacaa

SEQ ID NO: 1097984 - RNA, 19 nt, Homo sapiens
ccacaaauccacauaugaa

SEQ ID NO: 1097985 - RNA, 19 nt, Homo sapiens
gaaagggaauccaggaaac

SEQ ID NO: 1097986 - RNA, 19 nt, Homo sapiens
agacagaguuuauggugaa

SEQ ID NO: 1097987 - RNA, 19 nt, Homo sapiens
cauuacaucugaagaguga

SEQ ID NO: 1097988 - RNA, 19 nt, Homo sapiens
cuaaauaccacacaaauuc

SEQ ID NO: 1097989 - RNA, 19 nt, Homo sapiens
gaaauagcaaagccaguaa

SEQ ID NO: 1097990 - RNA, 19 nt, Homo sapiens
ggaguuagaagaaaccauu

SEQ ID NO: 1097991 - RNA, 19 nt, Homo sapiens
gaagaaguaauaaggcauu

SEQ ID NO: 1097992 - RNA, 19 nt, Homo sapiens
cagagagguuguaaauauu

SEQ ID NO: 1097993 - RNA, 19 nt, Homo sapiens
ucaguucaauugcccauuu

SEQ ID NO: 1097994 - RNA, 19 nt, Homo sapiens
aggaagaaaugacaagaaa

SEQ ID NO: 1097995 - RNA, 19 nt, Homo sapiens
ugaacaaagucauuucuuc

SEQ ID NO: 1097996 - RNA, 19 nt, Homo sapiens
aauaaggcauuacaucuga

SEQ ID NO: 1097997 - RNA, 19 nt, Homo sapiens
uaacagccgucauuuaugc

SEQ ID NO: 1097998 - RNA, 19 nt, Homo sapiens
caaaaucacuuuccaauac

SEQ ID NO: 1097999 - RNA, 19 nt, Homo sapiens
guucugccaucacaaauug

SEQ ID NO: 1098000 - RNA, 19 nt, Homo sapiens
aauccaaucuuuccaguug

SEQ ID NO: 1098001 - RNA, 19 nt, Homo sapiens
uaacuagaauucuccaagu

SEQ ID NO: 1098002 - RNA, 19 nt, Homo sapiens
gauuugagagugugccuua

SEQ ID NO: 1098003 - RNA, 19 nt, Homo sapiens
aaucuucagucaugucuaa

SEQ ID NO: 1098004 - RNA, 19 nt, Homo sapiens
cuuuaucucuuuacccuua

SEQ ID NO: 1098005 - RNA, 19 nt, Homo sapiens
cauaugaaccaauccagua

SEQ ID NO: 1098006 - RNA, 19 nt, Homo sapiens
gggcaucauuuacagauuc

SEQ ID NO: 1098007 - RNA, 19 nt, Homo sapiens
ccaaguaguucagacgauu

SEQ ID NO: 1098008 - RNA, 19 nt, Homo sapiens
aguagauccugaacaguua

SEQ ID NO: 1098009 - RNA, 19 nt, Homo sapiens
gaauucaggccauuugaug

SEQ ID NO: 1098010 - RNA, 19 nt, Homo sapiens
aaagagugguacuuacaaa

SEQ ID NO: 1098011 - RNA, 19 nt, Homo sapiens
gaaccaauccaguaacuac

SEQ ID NO: 1098012 - RNA, 19 nt, Homo sapiens
cuauaaauaugccaccauu

SEQ ID NO: 1098013 - RNA, 19 nt, Homo sapiens
ucaagcugcuccagugaaa

SEQ ID NO: 1098014 - RNA, 19 nt, Homo sapiens
gaauguugcuacagagaca

SEQ ID NO: 1098015 - RNA, 19 nt, Homo sapiens
gauagugacuguguauuac

SEQ ID NO: 1098016 - RNA, 19 nt, Homo sapiens
agauaaaggugcccaagga

SEQ ID NO: 1098017 - RNA, 19 nt, Homo sapiens
gccaggagccuuccgguuu

SEQ ID NO: 1098018 - RNA, 19 nt, Homo sapiens
acaaagagacagaguuuau

SEQ ID NO: 1098019 - RNA, 19 nt, Homo sapiens
ucucaaggaagaaguaaua

SEQ ID NO: 1098020 - RNA, 19 nt, Homo sapiens
caucacaaauugaccaaca

SEQ ID NO: 1098021 - RNA, 19 nt, Homo sapiens
gagaggaaaucagcuccaa

SEQ ID NO: 1098022 - RNA, 19 nt, Homo sapiens
guagguguguucugaaagu

SEQ ID NO: 1098023 - RNA, 19 nt, Homo sapiens
caacuccuaagcaguauuu

SEQ ID NO: 1098024 - RNA, 19 nt, Homo sapiens
gggcagagaagaauaaagu

SEQ ID NO: 1098025 - RNA, 19 nt, Homo sapiens
ccugaacaguuaucacauu

SEQ ID NO: 1098026 - RNA, 19 nt, Homo sapiens
agauagugacuguguauua

SEQ ID NO: 1098027 - RNA, 19 nt, Homo sapiens
cuagaauucuccaaguuug

SEQ ID NO: 1098028 - RNA, 19 nt, Homo sapiens
uuacaaagagacagaguuu

SEQ ID NO: 1098029 - RNA, 19 nt, Homo sapiens
aaagauccauaaugagaug

SEQ ID NO: 1098030 - RNA, 19 nt, Homo sapiens
gaaguguccuccagagcau

SEQ ID NO: 1098031 - RNA, 19 nt, Homo sapiens
guuccucccucaacacaaa

SEQ ID NO: 1098032 - RNA, 19 nt, Homo sapiens
agaaauauccagagagguu

SEQ ID NO: 1098033 - RNA, 19 nt, Homo sapiens
gaaagguggucagcauucu

SEQ ID NO: 1098034 - RNA, 19 nt, Homo sapiens
cuacagagacacaauugaa

SEQ ID NO: 1098035 - RNA, 19 nt, Homo sapiens
caguggauuuguauaugua

SEQ ID NO: 1098036 - RNA, 19 nt, Homo sapiens
ccaguggauuuguauaugu

SEQ ID NO: 1098037 - RNA, 19 nt, Homo sapiens
aaagguugauucacauaug

SEQ ID NO: 1098038 - RNA, 19 nt, Homo sapiens
ugaauucaaaugcagcuua

SEQ ID NO: 1098039 - RNA, 19 nt, Homo sapiens
agagugaugcugaauuuaa

SEQ ID NO: 1098040 - RNA, 19 nt, Homo sapiens
cugaacaguuaucacauuu

SEQ ID NO: 1098041 - RNA, 19 nt, Homo sapiens
ggaauacuauacccaugag

SEQ ID NO: 1098042 - RNA, 19 nt, Homo sapiens
uaagaagauggaucacaua

SEQ ID NO: 1098043 - RNA, 19 nt, Homo sapiens
ucgaauuccugaccauuug

SEQ ID NO: 1098044 - RNA, 19 nt, Homo sapiens
uaaaggugcccaaggaaga

SEQ ID NO: 1098045 - RNA, 19 nt, Homo sapiens
aaaauaaguuccucuguug

SEQ ID NO: 1098046 - RNA, 19 nt, Homo sapiens
uaagggcagagaagaauaa

SEQ ID NO: 1098047 - RNA, 19 nt, Homo sapiens
auaaauaugccaccauuga

SEQ ID NO: 1098048 - RNA, 19 nt, Homo sapiens
gccaaccguuauuuaugua

SEQ ID NO: 1098049 - RNA, 19 nt, Homo sapiens
ucagagucauggugugaaa

SEQ ID NO: 1098050 - RNA, 19 nt, Homo sapiens
gaaauuagcugggacuaca

SEQ ID NO: 1098051 - RNA, 19 nt, Homo sapiens
ccuguaaucucaacaauuu

SEQ ID NO: 1098052 - RNA, 19 nt, Homo sapiens
ggacacagaugcaagagau

SEQ ID NO: 1098053 - RNA, 19 nt, Homo sapiens
gaacagacacccaucauca

SEQ ID NO: 1098054 - RNA, 19 nt, Homo sapiens
gaauguggaugaugcaaug

SEQ ID NO: 1098055 - RNA, 19 nt, Homo sapiens
gagaugugcuggauaacuu

SEQ ID NO: 1098056 - RNA, 19 nt, Homo sapiens
gaugagagcaggcaacaaa

SEQ ID NO: 1098057 - RNA, 19 nt, Homo sapiens
ucacaggcgucucugauuu

SEQ ID NO: 1098058 - RNA, 19 nt, Homo sapiens
gaaugcaucucuucugcuu

SEQ ID NO: 1098059 - RNA, 19 nt, Homo sapiens
cagagggacuucagcuuaa

SEQ ID NO: 1098060 - RNA, 19 nt, Homo sapiens
ggguuucuaucucuuauuu

SEQ ID NO: 1098061 - RNA, 19 nt, Homo sapiens
gcccuucuguuuacacaua

SEQ ID NO: 1098062 - RNA, 19 nt, Homo sapiens
ccugagaugugcuggauaa

SEQ ID NO: 1098063 - RNA, 19 nt, Homo sapiens
gggagagccugcacaaugu

SEQ ID NO: 1098064 - RNA, 19 nt, Homo sapiens
uaccauggcuggcuuguug

SEQ ID NO: 1098065 - RNA, 19 nt, Homo sapiens
gaaacugccuccuguccau

SEQ ID NO: 1098066 - RNA, 19 nt, Homo sapiens
ccacaggucuggaugucaa

SEQ ID NO: 1098067 - RNA, 19 nt, Homo sapiens
ccacugauuuccuucuuau

SEQ ID NO: 1098068 - RNA, 19 nt, Homo sapiens
ucagagggacuucagcuua

SEQ ID NO: 1098069 - RNA, 19 nt, Homo sapiens
gcaccaugacuaagcauaa

SEQ ID NO: 1098070 - RNA, 19 nt, Homo sapiens
acacguauguacagacuga

SEQ ID NO: 1098071 - RNA, 19 nt, Homo sapiens
caaugacagugcugccuaa

SEQ ID NO: 1098072 - RNA, 19 nt, Homo sapiens
gcaagucccugagguuagu

SEQ ID NO: 1098073 - RNA, 19 nt, Homo sapiens
gagacgguuucgccacuuu

SEQ ID NO: 1098074 - RNA, 19 nt, Homo sapiens
gaacccuccuucucaaucu

SEQ ID NO: 1098075 - RNA, 19 nt, Homo sapiens
acaccaaccucgugacaga

SEQ ID NO: 1098076 - RNA, 19 nt, Homo sapiens
ugacagugcugccuaaacu

SEQ ID NO: 1098077 - RNA, 19 nt, Homo sapiens
gcaggccugucuccaguug

SEQ ID NO: 1098078 - RNA, 19 nt, Homo sapiens
ggagacagcugcuuuugug

SEQ ID NO: 1098079 - RNA, 19 nt, Homo sapiens
gaagcagucaucccugaaa

SEQ ID NO: 1098080 - RNA, 19 nt, Homo sapiens
cuaccugucauuucuaaua

SEQ ID NO: 1098081 - RNA, 19 nt, Homo sapiens
cagaggcuauggcuaguug

SEQ ID NO: 1098082 - RNA, 19 nt, Homo sapiens
gcucacuccuguaaucuca

SEQ ID NO: 1098083 - RNA, 19 nt, Homo sapiens
agaaggaagugaucacauc

SEQ ID NO: 1098084 - RNA, 19 nt, Homo sapiens
ggacacugccugaaguaga

SEQ ID NO: 1098085 - RNA, 19 nt, Homo sapiens
ggucagacuugguaauguc

SEQ ID NO: 1098086 - RNA, 19 nt, Homo sapiens
gcugaacccuccuucucaa

SEQ ID NO: 1098087 - RNA, 19 nt, Homo sapiens
ggauggagacagcugcuuu

SEQ ID NO: 1098088 - RNA, 19 nt, Homo sapiens
ccagauuucuacuguguca

SEQ ID NO: 1098089 - RNA, 19 nt, Homo sapiens
ccagcuaccugucauuucu

SEQ ID NO: 1098090 - RNA, 19 nt, Homo sapiens
ccaguuguuucagagcuua

SEQ ID NO: 1098091 - RNA, 19 nt, Homo sapiens
ccgaagugcuggaauuaca

SEQ ID NO: 1098092 - RNA, 19 nt, Homo sapiens
caucaugaacauccucuuu

SEQ ID NO: 1098093 - RNA, 19 nt, Homo sapiens
uagccagccuucuacacua

SEQ ID NO: 1098094 - RNA, 19 nt, Homo sapiens
caaguuagagguggaaaga

SEQ ID NO: 1098095 - RNA, 19 nt, Homo sapiens
ggaugcuccugaucaccua

SEQ ID NO: 1098096 - RNA, 19 nt, Homo sapiens
cccagcagcuucagcaaga

SEQ ID NO: 1098097 - RNA, 19 nt, Homo sapiens
acacauauacugcccauag

SEQ ID NO: 1098098 - RNA, 19 nt, Homo sapiens
gagcuuaauuuggguuucu

SEQ ID NO: 1098099 - RNA, 19 nt, Homo sapiens
ugaauagucacacguaugu

SEQ ID NO: 1098100 - RNA, 19 nt, Homo sapiens
cgaaacaaccacuuuagca

SEQ ID NO: 1098101 - RNA, 19 nt, Homo sapiens
ccacugcgcccagcugauu

SEQ ID NO: 1098102 - RNA, 19 nt, Homo sapiens
ugagccagauuucuacugu

SEQ ID NO: 1098103 - RNA, 19 nt, Homo sapiens
gggugaacuuagcgucuuu

SEQ ID NO: 1098104 - RNA, 19 nt, Homo sapiens
ggaugucaaugugcgauuc

SEQ ID NO: 1098105 - RNA, 19 nt, Homo sapiens
ggagaacagacacccauca

SEQ ID NO: 1098106 - RNA, 19 nt, Homo sapiens
gacacugccugaaguagag

SEQ ID NO: 1098107 - RNA, 19 nt, Homo sapiens
ugaggucccuauccagaau

SEQ ID NO: 1098108 - RNA, 19 nt, Homo sapiens
gaacauccucuuucuucag

SEQ ID NO: 1098109 - RNA, 19 nt, Homo sapiens
ccaagacuuuucuggguua

SEQ ID NO: 1098110 - RNA, 19 nt, Homo sapiens
ggccgaagcacgagucaga

SEQ ID NO: 1098111 - RNA, 19 nt, Homo sapiens
gaucaucaccugcaaacac

SEQ ID NO: 1098112 - RNA, 19 nt, Homo sapiens
uaauuuggguuucuaucuc

SEQ ID NO: 1098113 - RNA, 19 nt, Homo sapiens
gcaagaggaguaucaacag

SEQ ID NO: 1098114 - RNA, 19 nt, Homo sapiens
ugggagagccugcacaaug

SEQ ID NO: 1098115 - RNA, 19 nt, Homo sapiens
cccacugauuuccuucuua

SEQ ID NO: 1098116 - RNA, 19 nt, Homo sapiens
aaaagcagcugcagguaga

SEQ ID NO: 1098117 - RNA, 19 nt, Homo sapiens
ucaggcuggucuugaauuc

SEQ ID NO: 1098118 - RNA, 19 nt, Homo sapiens
gccaggaguuacugcacaa

SEQ ID NO: 1098119 - RNA, 19 nt, Homo sapiens
gaaaccccgucucuacuga

SEQ ID NO: 1098120 - RNA, 19 nt, Homo sapiens
ucaugaacauccucuuucu

SEQ ID NO: 1098121 - RNA, 19 nt, Homo sapiens
ccugucauuucuaauauag

SEQ ID NO: 1098122 - RNA, 19 nt, Homo sapiens
guggcucacuccuguaauc

SEQ ID NO: 1098123 - RNA, 19 nt, Homo sapiens
ucacacguauguacagacu

SEQ ID NO: 1098124 - RNA, 19 nt, Homo sapiens
gagaacagacacccaucau

SEQ ID NO: 1098125 - RNA, 19 nt, Homo sapiens
gaauagucacacguaugua

SEQ ID NO: 1098126 - RNA, 19 nt, Homo sapiens
gacuucagcuuaauuuuca

SEQ ID NO: 1098127 - RNA, 19 nt, Homo sapiens
gagggacuucagcuuaauu

SEQ ID NO: 1098128 - RNA, 19 nt, Homo sapiens
gcagaaggaagugaucaca

SEQ ID NO: 1098129 - RNA, 19 nt, Homo sapiens
gcccacugauuuccuucuu

SEQ ID NO: 1098130 - RNA, 19 nt, Homo sapiens
caaggggccuggagcagaa

SEQ ID NO: 1098131 - RNA, 19 nt, Homo sapiens
uauaccuacuggucacuga

SEQ ID NO: 1098132 - RNA, 19 nt, Homo sapiens
ccagcccacugauuuccuu

SEQ ID NO: 1098133 - RNA, 19 nt, Homo sapiens
cuacauuccuuuuccaaga

SEQ ID NO: 1098134 - RNA, 19 nt, Homo sapiens
gcccagcuaccugucauuu

SEQ ID NO: 1098135 - RNA, 19 nt, Homo sapiens
gggcaacacuaggauuggu

SEQ ID NO: 1098136 - RNA, 19 nt, Homo sapiens
gagagcaggcaacaaaugc

SEQ ID NO: 1098137 - RNA, 19 nt, Homo sapiens
ugagagcaggcaacaaaug

SEQ ID NO: 1098138 - RNA, 19 nt, Homo sapiens
ugacuccacccauguguuc

SEQ ID NO: 1098139 - RNA, 19 nt, Homo sapiens
cacuuuagcaccaugacua

SEQ ID NO: 1098140 - RNA, 19 nt, Homo sapiens
cuucuacacuacauuccuu

SEQ ID NO: 1098141 - RNA, 19 nt, Homo sapiens
ggacuucagcuuaauuuuc

SEQ ID NO: 1098142 - RNA, 19 nt, Homo sapiens
ugaaguagagacaauaagg

SEQ ID NO: 1098143 - RNA, 19 nt, Homo sapiens
ccugaaguagagacaauaa

SEQ ID NO: 1098144 - RNA, 19 nt, Homo sapiens
gccagcagaccaagcuuug

SEQ ID NO: 1098145 - RNA, 19 nt, Homo sapiens
ucccugagguuaguaaaca

SEQ ID NO: 1098146 - RNA, 19 nt, Homo sapiens
acugauuuccuucuuauug

SEQ ID NO: 1098147 - RNA, 19 nt, Homo sapiens
ccugaauagucacacguau

SEQ ID NO: 1098148 - RNA, 19 nt, Homo sapiens
ggaggagcaagucguaugg

SEQ ID NO: 1098149 - RNA, 19 nt, Homo sapiens
aggcaagucccugagguua

SEQ ID NO: 1098150 - RNA, 19 nt, Homo sapiens
gaagagcucccgagacaua

SEQ ID NO: 1098151 - RNA, 19 nt, Homo sapiens
gaccagggcuacaugauaa

SEQ ID NO: 1098152 - RNA, 19 nt, Homo sapiens
gggaugaacugcuuuguga

SEQ ID NO: 1098153 - RNA, 19 nt, Homo sapiens
ccucgcagcugaacucuua

SEQ ID NO: 1098154 - RNA, 19 nt, Homo sapiens
gcuccaagcuccacuguau

SEQ ID NO: 1098155 - RNA, 19 nt, Homo sapiens
gaccuuaucucccacuuga

SEQ ID NO: 1098156 - RNA, 19 nt, Homo sapiens
ccacguacuugaucacuuu

SEQ ID NO: 1098157 - RNA, 19 nt, Homo sapiens
gagcauggcuuucuguagu

SEQ ID NO: 1098158 - RNA, 19 nt, Homo sapiens
guucugguguucuguaaua

SEQ ID NO: 1098159 - RNA, 19 nt, Homo sapiens
cagaagagcucccgagaca

SEQ ID NO: 1098160 - RNA, 19 nt, Homo sapiens
ugcgaaagcucucgucuaa

SEQ ID NO: 1098161 - RNA, 19 nt, Homo sapiens
ugacccaacuugaaauaaa

SEQ ID NO: 1098162 - RNA, 19 nt, Homo sapiens
ggucgcagcacccuucuua

SEQ ID NO: 1098163 - RNA, 19 nt, Homo sapiens
cgaaagcucucgucuaagg

SEQ ID NO: 1098164 - RNA, 19 nt, Homo sapiens
gcaagacacaaguggauuu

SEQ ID NO: 1098165 - RNA, 19 nt, Homo sapiens
ccagaucuaugacuucaga

SEQ ID NO: 1098166 - RNA, 19 nt, Homo sapiens
gagagugaaccuuggcuua

SEQ ID NO: 1098167 - RNA, 19 nt, Homo sapiens
gcaaaugccagccuugaug

SEQ ID NO: 1098168 - RNA, 19 nt, Homo sapiens
guaggccaguugcugaaua

SEQ ID NO: 1098169 - RNA, 19 nt, Homo sapiens
gagugaaccuuggcuuaaa

SEQ ID NO: 1098170 - RNA, 19 nt, Homo sapiens
ggagcugguugucaauuau

SEQ ID NO: 1098171 - RNA, 19 nt, Homo sapiens
gcaaugaggaacaacuaaa

SEQ ID NO: 1098172 - RNA, 19 nt, Homo sapiens
ugaacuggcugggauauau

SEQ ID NO: 1098173 - RNA, 19 nt, Homo sapiens
gcacccuucuuacuacuau

SEQ ID NO: 1098174 - RNA, 19 nt, Homo sapiens
ugggauauauucuggauga

SEQ ID NO: 1098175 - RNA, 19 nt, Homo sapiens
ccacaaccgugcagucuag

SEQ ID NO: 1098176 - RNA, 19 nt, Homo sapiens
gaacacaucugggaaaaca

SEQ ID NO: 1098177 - RNA, 19 nt, Homo sapiens
gaucauucauucaaacucu

SEQ ID NO: 1098178 - RNA, 19 nt, Homo sapiens
gagcccagaucuaugacuu

SEQ ID NO: 1098179 - RNA, 19 nt, Homo sapiens
cagacacacugcuggauga

SEQ ID NO: 1098180 - RNA, 19 nt, Homo sapiens
gaugacccaacuugaaaua

SEQ ID NO: 1098181 - RNA, 19 nt, Homo sapiens
uggagcugguugucaauua

SEQ ID NO: 1098182 - RNA, 19 nt, Homo sapiens
gaacuggcugggauauauu

SEQ ID NO: 1098183 - RNA, 19 nt, Homo sapiens
gaagagccacauagcagaa

SEQ ID NO: 1098184 - RNA, 19 nt, Homo sapiens
gcagcacccuucuuacuac

SEQ ID NO: 1098185 - RNA, 19 nt, Homo sapiens
gccaguugcugaauaaagu

SEQ ID NO: 1098186 - RNA, 19 nt, Homo sapiens
gaggaacaacuaaagagaa

SEQ ID NO: 1098187 - RNA, 19 nt, Homo sapiens
aaagaugacccaacuugaa

SEQ ID NO: 1098188 - RNA, 19 nt, Homo sapiens
gaaaagaugacccaacuug

SEQ ID NO: 1098189 - RNA, 19 nt, Homo sapiens
gaugugagccugguucaga

SEQ ID NO: 1098190 - RNA, 19 nt, Homo sapiens
cuaaagagaaucccaggaa

SEQ ID NO: 1098191 - RNA, 19 nt, Homo sapiens
ccccaacgcugcaagauua

SEQ ID NO: 1098192 - RNA, 19 nt, Homo sapiens
ggccagcauuggagaagaa

SEQ ID NO: 1098193 - RNA, 19 nt, Homo sapiens
ugaccagggcuacaugaua

SEQ ID NO: 1098194 - RNA, 19 nt, Homo sapiens
gcugguaggagccacauuu

SEQ ID NO: 1098195 - RNA, 19 nt, Homo sapiens
caaaugccagccuugauga

SEQ ID NO: 1098196 - RNA, 19 nt, Homo sapiens
ucccaaagcucaguuagug

SEQ ID NO: 1098197 - RNA, 19 nt, Homo sapiens
ggaaccagguaaccaaucg

SEQ ID NO: 1098198 - RNA, 19 nt, Homo sapiens
ccucaagcaucgugacaga

SEQ ID NO: 1098199 - RNA, 19 nt, Homo sapiens
uaggccaguugcugaauaa

SEQ ID NO: 1098200 - RNA, 19 nt, Homo sapiens
gaaggaaaauaacugugaa

SEQ ID NO: 1098201 - RNA, 19 nt, Homo sapiens
gagccugguucagaagauu

SEQ ID NO: 1098202 - RNA, 19 nt, Homo sapiens
gguugucaauuaugauuuc

SEQ ID NO: 1098203 - RNA, 19 nt, Homo sapiens
caagcuaucucagggcaau

SEQ ID NO: 1098204 - RNA, 19 nt, Homo sapiens
gauaagccacguacuugau

SEQ ID NO: 1098205 - RNA, 19 nt, Homo sapiens
gaucuuucccaguaucuug

SEQ ID NO: 1098206 - RNA, 19 nt, Homo sapiens
cguacuugaucacuuugua

SEQ ID NO: 1098207 - RNA, 19 nt, Homo sapiens
gggcaaugaggaacaacua

SEQ ID NO: 1098208 - RNA, 19 nt, Homo sapiens
ugaacugcuuugugacuug

SEQ ID NO: 1098209 - RNA, 19 nt, Homo sapiens
gcccagaucuaugacuuca

SEQ ID NO: 1098210 - RNA, 19 nt, Homo sapiens
caugauaagccacguacuu

SEQ ID NO: 1098211 - RNA, 19 nt, Homo sapiens
acacacugcuggaugaaag

SEQ ID NO: 1098212 - RNA, 19 nt, Homo sapiens
gcaagacucucagcuaccu

SEQ ID NO: 1098213 - RNA, 19 nt, Homo sapiens
aggaacaacuaaagagaau

SEQ ID NO: 1098214 - RNA, 19 nt, Homo sapiens
guugagcccagaucuauga

SEQ ID NO: 1098215 - RNA, 19 nt, Homo sapiens
caggcaccgucaucaguuu

SEQ ID NO: 1098216 - RNA, 19 nt, Homo sapiens
guguggagcugguugucaa

SEQ ID NO: 1098217 - RNA, 19 nt, Homo sapiens
gcugggauauauucuggau

SEQ ID NO: 1098218 - RNA, 19 nt, Homo sapiens
uggacuacaucuuagagaa

SEQ ID NO: 1098219 - RNA, 19 nt, Homo sapiens
gguaaccaaucgccagaag

SEQ ID NO: 1098220 - RNA, 19 nt, Homo sapiens
aagaugacccaacuugaaa

SEQ ID NO: 1098221 - RNA, 19 nt, Homo sapiens
ggaaggaaaauaacuguga

SEQ ID NO: 1098222 - RNA, 19 nt, Homo sapiens
agacauuucugagacugaa

SEQ ID NO: 1098223 - RNA, 19 nt, Homo sapiens
ggacuacaucuuagagaag

SEQ ID NO: 1098224 - RNA, 19 nt, Homo sapiens
gaacaacuaaagagaaucc

SEQ ID NO: 1098225 - RNA, 19 nt, Homo sapiens
caauaaacacggauuacca

SEQ ID NO: 1098226 - RNA, 19 nt, Homo sapiens
uaaagucgccagcccagau

SEQ ID NO: 1098227 - RNA, 19 nt, Homo sapiens
gagagaagaagcugaaagc

SEQ ID NO: 1098228 - RNA, 19 nt, Homo sapiens
agacacaaguggauuuuga

SEQ ID NO: 1098229 - RNA, 19 nt, Homo sapiens
gcaagauuacauccacaga

SEQ ID NO: 1098230 - RNA, 19 nt, Homo sapiens
acugguggacuacaucuua

SEQ ID NO: 1098231 - RNA, 19 nt, Homo sapiens
cagacagccuucagcagau

SEQ ID NO: 1098232 - RNA, 19 nt, Homo sapiens
ggaaaauaacugugaagaa

SEQ ID NO: 1098233 - RNA, 19 nt, Homo sapiens
aauaaaaccugaagaccuu

SEQ ID NO: 1098234 - RNA, 19 nt, Homo sapiens
gacccaacuugaaauaaaa

SEQ ID NO: 1098235 - RNA, 19 nt, Homo sapiens
gaugaggguaggaaucuuc

SEQ ID NO: 1098236 - RNA, 19 nt, Homo sapiens
uauucuggaugaccacaaa

SEQ ID NO: 1098237 - RNA, 19 nt, Homo sapiens
agagugaaccuuggcuuaa

SEQ ID NO: 1098238 - RNA, 19 nt, Homo sapiens
gaaaccggcaguggcaaga

SEQ ID NO: 1098239 - RNA, 19 nt, Homo sapiens
ccaggaaccagguaaccaa

SEQ ID NO: 1098240 - RNA, 19 nt, Homo sapiens
ucucaauaaacacggauua

SEQ ID NO: 1098241 - RNA, 19 nt, Homo sapiens
ggccugaucauucauucaa

SEQ ID NO: 1098242 - RNA, 19 nt, Homo sapiens
ggguugagcccagaucuau

SEQ ID NO: 1098243 - RNA, 19 nt, Homo sapiens
uaagccacguacuugauca

SEQ ID NO: 1098244 - RNA, 19 nt, Homo sapiens
ggcaaugaggaacaacuaa

SEQ ID NO: 1098245 - RNA, 19 nt, Homo sapiens
agagagagaagaagcugaa

SEQ ID NO: 1098246 - RNA, 19 nt, Homo sapiens
uuugugacuuggaaaggua

SEQ ID NO: 1098247 - RNA, 19 nt, Homo sapiens
aggcccagcugacuuggaa

SEQ ID NO: 1098248 - RNA, 19 nt, Homo sapiens
gcagaaggcccagcugacu

SEQ ID NO: 1098249 - RNA, 19 nt, Homo sapiens
gaacugguggacuacaucu

SEQ ID NO: 1098250 - RNA, 19 nt, Homo sapiens
gaacacaugcaguggauua

SEQ ID NO: 1098251 - RNA, 19 nt, Homo sapiens
caugguauguucuucauua

SEQ ID NO: 1098252 - RNA, 19 nt, Homo sapiens
ggaugauucugaucuauuu

SEQ ID NO: 1098253 - RNA, 19 nt, Homo sapiens
gcacgaggccuucuucauu

SEQ ID NO: 1098254 - RNA, 19 nt, Homo sapiens
gaucaacaaacuccauuua

SEQ ID NO: 1098255 - RNA, 19 nt, Homo sapiens
gugcagaguuggugucuuu

SEQ ID NO: 1098256 - RNA, 19 nt, Homo sapiens
ccugaaggcugucuuugua

SEQ ID NO: 1098257 - RNA, 19 nt, Homo sapiens
gaaggaggcuuugcgugaa

SEQ ID NO: 1098258 - RNA, 19 nt, Homo sapiens
ucaacaaacuccauuuaug

SEQ ID NO: 1098259 - RNA, 19 nt, Homo sapiens
gaaaguguauuuguuacug

SEQ ID NO: 1098260 - RNA, 19 nt, Homo sapiens
caacaaacuccauuuaugu

SEQ ID NO: 1098261 - RNA, 19 nt, Homo sapiens
gcacagagaguaacauaca

SEQ ID NO: 1098262 - RNA, 19 nt, Homo sapiens
uauggaugcuccucaauuu

SEQ ID NO: 1098263 - RNA, 19 nt, Homo sapiens
ggagaagugucaacaaguc

SEQ ID NO: 1098264 - RNA, 19 nt, Homo sapiens
gcucauuucugcaguuaga

SEQ ID NO: 1098265 - RNA, 19 nt, Homo sapiens
gaaaggaaugacaguguuu

SEQ ID NO: 1098266 - RNA, 19 nt, Homo sapiens
gcagcagaguuacugauga

SEQ ID NO: 1098267 - RNA, 19 nt, Homo sapiens
gaggagaagugucaacaag

SEQ ID NO: 1098268 - RNA, 19 nt, Homo sapiens
gagaguaacauacaaauac

SEQ ID NO: 1098269 - RNA, 19 nt, Homo sapiens
gaaguaaccagagcuguga

SEQ ID NO: 1098270 - RNA, 19 nt, Homo sapiens
uuacagcacugcacagaga

SEQ ID NO: 1098271 - RNA, 19 nt, Homo sapiens
cgacacccgugcugguaua

SEQ ID NO: 1098272 - RNA, 19 nt, Homo sapiens
gcaaacccacgacuucaaa

SEQ ID NO: 1098273 - RNA, 19 nt, Homo sapiens
aaaggaugauucugaucua

SEQ ID NO: 1098274 - RNA, 19 nt, Homo sapiens
ugacgaaguucaguguauu

SEQ ID NO: 1098275 - RNA, 19 nt, Homo sapiens
agaaaggaaugacaguguu

SEQ ID NO: 1098276 - RNA, 19 nt, Homo sapiens
ggacguggacauugacgaa

SEQ ID NO: 1098277 - RNA, 19 nt, Homo sapiens
ucuauuugcuuccaguaaa

SEQ ID NO: 1098278 - RNA, 19 nt, Homo sapiens
uauucuggcuaacuugaua

SEQ ID NO: 1098279 - RNA, 19 nt, Homo sapiens
gaggaguaccugucauuug

SEQ ID NO: 1098280 - RNA, 19 nt, Homo sapiens
uggcgcacauuaccauuaa

SEQ ID NO: 1098281 - RNA, 19 nt, Homo sapiens
uggagaagcugaagaucau

SEQ ID NO: 1098282 - RNA, 19 nt, Homo sapiens
gcagcugucccgcauagaa

SEQ ID NO: 1098283 - RNA, 19 nt, Homo sapiens
uggaggacguggacauuga

SEQ ID NO: 1098284 - RNA, 19 nt, Homo sapiens
acauuaccauuaaccagua

SEQ ID NO: 1098285 - RNA, 19 nt, Homo sapiens
uaagcaagcugaggaguac

SEQ ID NO: 1098286 - RNA, 19 nt, Homo sapiens
ggaugcuccucaauuuaug

SEQ ID NO: 1098287 - RNA, 19 nt, Homo sapiens
cacgaggccuucuucauuc

SEQ ID NO: 1098288 - RNA, 19 nt, Homo sapiens
guaccugucauuugccuuu

SEQ ID NO: 1098289 - RNA, 19 nt, Homo sapiens
caauauccuuugucguuca

SEQ ID NO: 1098290 - RNA, 19 nt, Homo sapiens
guauggaugcuccucaauu

SEQ ID NO: 1098291 - RNA, 19 nt, Homo sapiens
caaaaugcuugguuaacuu

SEQ ID NO: 1098292 - RNA, 19 nt, Homo sapiens
ggacgcaaggcuauguuug

SEQ ID NO: 1098293 - RNA, 19 nt, Homo sapiens
gacgcaaggcuauguuuga

SEQ ID NO: 1098294 - RNA, 19 nt, Homo sapiens
ugacagcucaaaccugaaa

SEQ ID NO: 1098295 - RNA, 19 nt, Homo sapiens
ugaaccagcuguuuaaaau

SEQ ID NO: 1098296 - RNA, 19 nt, Homo sapiens
gaacagaagcucguuucag

SEQ ID NO: 1098297 - RNA, 19 nt, Homo sapiens
uagaacacaugcaguggau

SEQ ID NO: 1098298 - RNA, 19 nt, Homo sapiens
agaccgugauaguccaaua

SEQ ID NO: 1098299 - RNA, 19 nt, Homo sapiens
gcuugaccuucgaguguuu

SEQ ID NO: 1098300 - RNA, 19 nt, Homo sapiens
gaaugacaguguuuuggaa

SEQ ID NO: 1098301 - RNA, 19 nt, Homo sapiens
cacaugcaguggauuacuu

SEQ ID NO: 1098302 - RNA, 19 nt, Homo sapiens
gaugcaguuugcggaagua

SEQ ID NO: 1098303 - RNA, 19 nt, Homo sapiens
cagcagaguuacugaugag

SEQ ID NO: 1098304 - RNA, 19 nt, Homo sapiens
uccaauauccuuugucguu

SEQ ID NO: 1098305 - RNA, 19 nt, Homo sapiens
guuugcagcucauuuaagg

SEQ ID NO: 1098306 - RNA, 19 nt, Homo sapiens
ugacagcgauuuuaagcaa

SEQ ID NO: 1098307 - RNA, 19 nt, Homo sapiens
gcgcuugaccuucgagugu

SEQ ID NO: 1098308 - RNA, 19 nt, Homo sapiens
gggcucugccugucaugua

SEQ ID NO: 1098309 - RNA, 19 nt, Homo sapiens
ucagcucuuucacuuggua

SEQ ID NO: 1098310 - RNA, 19 nt, Homo sapiens
cguuucagcucuuucacuu

SEQ ID NO: 1098311 - RNA, 19 nt, Homo sapiens
acacgucaaaggcuacaua

SEQ ID NO: 1098312 - RNA, 19 nt, Homo sapiens
ccaauaaugcagaucaaca

SEQ ID NO: 1098313 - RNA, 19 nt, Homo sapiens
gggguuacaucccaauaaa

SEQ ID NO: 1098314 - RNA, 19 nt, Homo sapiens
gcucccauggcgcacauua

SEQ ID NO: 1098315 - RNA, 19 nt, Homo sapiens
ggcugguucuggagucuuu

SEQ ID NO: 1098316 - RNA, 19 nt, Homo sapiens
cgucaaaggcuacauaucg

SEQ ID NO: 1098317 - RNA, 19 nt, Homo sapiens
ucauuugccuuugagcauu

SEQ ID NO: 1098318 - RNA, 19 nt, Homo sapiens
auacaaauacuacguugga

SEQ ID NO: 1098319 - RNA, 19 nt, Homo sapiens
guggauuacuugggacuug

SEQ ID NO: 1098320 - RNA, 19 nt, Homo sapiens
ucagcaagcagaacccauu

SEQ ID NO: 1098321 - RNA, 19 nt, Homo sapiens
cuacauaucgcaucagcau

SEQ ID NO: 1098322 - RNA, 19 nt, Homo sapiens
ggacauugacgaaguucag

SEQ ID NO: 1098323 - RNA, 19 nt, Homo sapiens
gagaagcugaagaucauca

SEQ ID NO: 1098324 - RNA, 19 nt, Homo sapiens
uuaagcaagcugaggagua

SEQ ID NO: 1098325 - RNA, 19 nt, Homo sapiens
caaaccugaaagacgauua

SEQ ID NO: 1098326 - RNA, 19 nt, Homo sapiens
cuucgaguguuugccaaua

SEQ ID NO: 1098327 - RNA, 19 nt, Homo sapiens
gagcaucuugugcagaguu

SEQ ID NO: 1098328 - RNA, 19 nt, Homo sapiens
caagugccagaccgugaua

SEQ ID NO: 1098329 - RNA, 19 nt, Homo sapiens
cacagagaguaacauacaa

SEQ ID NO: 1098330 - RNA, 19 nt, Homo sapiens
ggaacagaagcucguuuca

SEQ ID NO: 1098331 - RNA, 19 nt, Homo sapiens
cagaguuggugucuuuuaa

SEQ ID NO: 1098332 - RNA, 19 nt, Homo sapiens
ucauagaggcauacaagug

SEQ ID NO: 1098333 - RNA, 19 nt, Homo sapiens
uggaugcuccucaauuuau

SEQ ID NO: 1098334 - RNA, 19 nt, Homo sapiens
auacaugggacacgucaaa

SEQ ID NO: 1098335 - RNA, 19 nt, Homo sapiens
gagcauugucaccguucua

SEQ ID NO: 1098336 - RNA, 19 nt, Homo sapiens
acagagaguaacauacaaa

SEQ ID NO: 1098337 - RNA, 19 nt, Homo sapiens
uagaaaggaaugacagugu

SEQ ID NO: 1098338 - RNA, 19 nt, Homo sapiens
cagcaagcagaacccauuu

SEQ ID NO: 1098339 - RNA, 19 nt, Homo sapiens
uggcuaacuugauauacau

SEQ ID NO: 1098340 - RNA, 19 nt, Homo sapiens
aaacacaccagcugucucu

SEQ ID NO: 1098341 - RNA, 19 nt, Homo sapiens
gaucuauuugcuuccagua

SEQ ID NO: 1098342 - RNA, 19 nt, Homo sapiens
ugucaccguucuagucaga

SEQ ID NO: 1098343 - RNA, 19 nt, Homo sapiens
ugaaauguuugcagcucau

SEQ ID NO: 1098344 - RNA, 19 nt, Homo sapiens
gauuacagcacugcacaga

SEQ ID NO: 1098345 - RNA, 19 nt, Homo sapiens
uugacgaaguucaguguau

SEQ ID NO: 1098346 - RNA, 19 nt, Homo sapiens
cauuugccuuugagcauug

SEQ ID NO: 1098347 - RNA, 19 nt, Homo sapiens
aggaguaccugucauuugc

SEQ ID NO: 1098348 - RNA, 19 nt, Homo sapiens
cccuuaugaugaaauguuu

SEQ ID NO: 1098349 - RNA, 19 nt, Homo sapiens
gguuacaucccaauaaacu

SEQ ID NO: 1098350 - RNA, 19 nt, Homo sapiens
gaucugauguugcauaaua

SEQ ID NO: 1098351 - RNA, 19 nt, Homo sapiens
gaaagcaccugugauauau

SEQ ID NO: 1098352 - RNA, 19 nt, Homo sapiens
ggagaaagcaccugugaua

SEQ ID NO: 1098353 - RNA, 19 nt, Homo sapiens
aaacgcagcuggagauuaa

SEQ ID NO: 1098354 - RNA, 19 nt, Homo sapiens
gagaauugguugcaaauga

SEQ ID NO: 1098355 - RNA, 19 nt, Homo sapiens
gcaaauggcucaugcucuu

SEQ ID NO: 1098356 - RNA, 19 nt, Homo sapiens
gcucaaaugucaucacuug

SEQ ID NO: 1098357 - RNA, 19 nt, Homo sapiens
gggaagcacuuacaauuau

SEQ ID NO: 1098358 - RNA, 19 nt, Homo sapiens
gcaaucagcugaaauucug

SEQ ID NO: 1098359 - RNA, 19 nt, Homo sapiens
gcacaaaaccugcucauua

SEQ ID NO: 1098360 - RNA, 19 nt, Homo sapiens
caaauaugcucucuuucuu

SEQ ID NO: 1098361 - RNA, 19 nt, Homo sapiens
gaaagaugguuguaguugu

SEQ ID NO: 1098362 - RNA, 19 nt, Homo sapiens
guaacgugcucauuagauu

SEQ ID NO: 1098363 - RNA, 19 nt, Homo sapiens
gaauauuucuguagguuuc

SEQ ID NO: 1098364 - RNA, 19 nt, Homo sapiens
gcacaaagcagagaacuuc

SEQ ID NO: 1098365 - RNA, 19 nt, Homo sapiens
gcagaguuauggaguauca

SEQ ID NO: 1098366 - RNA, 19 nt, Homo sapiens
aaauacaccuguucugauu

SEQ ID NO: 1098367 - RNA, 19 nt, Homo sapiens
ggaagcacuuacaauuauu

SEQ ID NO: 1098368 - RNA, 19 nt, Homo sapiens
agaaagcaccugugauaua

SEQ ID NO: 1098369 - RNA, 19 nt, Homo sapiens
guacaggcuuggagaaaug

SEQ ID NO: 1098370 - RNA, 19 nt, Homo sapiens
gaaagagaauugguugcaa

SEQ ID NO: 1098371 - RNA, 19 nt, Homo sapiens
ggagaaugauugccgcuau

SEQ ID NO: 1098372 - RNA, 19 nt, Homo sapiens
gcagaacuuguaccaaaua

SEQ ID NO: 1098373 - RNA, 19 nt, Homo sapiens
gcaaauaagacuuuaccuu

SEQ ID NO: 1098374 - RNA, 19 nt, Homo sapiens
gcaaauaugcucucuuucu

SEQ ID NO: 1098375 - RNA, 19 nt, Homo sapiens
guauaugugugguguuuga

SEQ ID NO: 1098376 - RNA, 19 nt, Homo sapiens
aaagagaauugguugcaaa

SEQ ID NO: 1098377 - RNA, 19 nt, Homo sapiens
agaagucuguagagaauuu

SEQ ID NO: 1098378 - RNA, 19 nt, Homo sapiens
uaacuaccauccauccuau

SEQ ID NO: 1098379 - RNA, 19 nt, Homo sapiens
cugcagaacuuguaccaaa

SEQ ID NO: 1098380 - RNA, 19 nt, Homo sapiens
gaacagggaagcacuuaca

SEQ ID NO: 1098381 - RNA, 19 nt, Homo sapiens
caaagcagagaacuucaua

SEQ ID NO: 1098382 - RNA, 19 nt, Homo sapiens
ggaaagaugguuguaguug

SEQ ID NO: 1098383 - RNA, 19 nt, Homo sapiens
gccagcaaauucaaauaaa

SEQ ID NO: 1098384 - RNA, 19 nt, Homo sapiens
caaaugucaucacuugguu

SEQ ID NO: 1098385 - RNA, 19 nt, Homo sapiens
gcagagaacuucauaaaac

SEQ ID NO: 1098386 - RNA, 19 nt, Homo sapiens
gcagaucugauguugcaua

SEQ ID NO: 1098387 - RNA, 19 nt, Homo sapiens
ggagaaaugcaaguacuuu

SEQ ID NO: 1098388 - RNA, 19 nt, Homo sapiens
cugcauggauuacaucaaa

SEQ ID NO: 1098389 - RNA, 19 nt, Homo sapiens
acagugagcuuuuggcuua

SEQ ID NO: 1098390 - RNA, 19 nt, Homo sapiens
ccaaaacgcucaaauguca

SEQ ID NO: 1098391 - RNA, 19 nt, Homo sapiens
gcacuuacaauuauuccuu

SEQ ID NO: 1098392 - RNA, 19 nt, Homo sapiens
gaaauaauuaccugcacaa

SEQ ID NO: 1098393 - RNA, 19 nt, Homo sapiens
uaccauuucuuguguugua

SEQ ID NO: 1098394 - RNA, 19 nt, Homo sapiens
gcacccgcuucaaauauug

SEQ ID NO: 1098395 - RNA, 19 nt, Homo sapiens
ugucaucacuugguucuuu

SEQ ID NO: 1098396 - RNA, 19 nt, Homo sapiens
cagacccucucacaucaua

SEQ ID NO: 1098397 - RNA, 19 nt, Homo sapiens
cacaaaaccugcucauuaa

SEQ ID NO: 1098398 - RNA, 19 nt, Homo sapiens
augcaaauaugcucucuuu

SEQ ID NO: 1098399 - RNA, 19 nt, Homo sapiens
uuagaagucuguagagaau

SEQ ID NO: 1098400 - RNA, 19 nt, Homo sapiens
aagcagaacaugaccauaa

SEQ ID NO: 1098401 - RNA, 19 nt, Homo sapiens
aaucccaucuccuaaauug

SEQ ID NO: 1098402 - RNA, 19 nt, Homo sapiens
cagaucugauguugcauaa

SEQ ID NO: 1098403 - RNA, 19 nt, Homo sapiens
uaauaaccaugcuaagugu

SEQ ID NO: 1098404 - RNA, 19 nt, Homo sapiens
ucucguaugucuuauucua

SEQ ID NO: 1098405 - RNA, 19 nt, Homo sapiens
gagaaugauugccgcuaug

SEQ ID NO: 1098406 - RNA, 19 nt, Homo sapiens
ggacuucccuccccaaaug

SEQ ID NO: 1098407 - RNA, 19 nt, Homo sapiens
gccaacaggcucugacuaa

SEQ ID NO: 1098408 - RNA, 19 nt, Homo sapiens
aaacccaccucuugcaaug

SEQ ID NO: 1098409 - RNA, 19 nt, Homo sapiens
uaaagaggguacauuggau

SEQ ID NO: 1098410 - RNA, 19 nt, Homo sapiens
ccaaauacaccuguucuga

SEQ ID NO: 1098411 - RNA, 19 nt, Homo sapiens
ccacaguaauauuguccua

SEQ ID NO: 1098412 - RNA, 19 nt, Homo sapiens
caaaagaacugggaaagau

SEQ ID NO: 1098413 - RNA, 19 nt, Homo sapiens
caacugauaccaaagagau

SEQ ID NO: 1098414 - RNA, 19 nt, Homo sapiens
ggagguuugccgagaauuu

SEQ ID NO: 1098415 - RNA, 19 nt, Homo sapiens
uaugugugguguuugauuu

SEQ ID NO: 1098416 - RNA, 19 nt, Homo sapiens
gcuuuuggcuuacuauaua

SEQ ID NO: 1098417 - RNA, 19 nt, Homo sapiens
uaccauccauccuauuuga

SEQ ID NO: 1098418 - RNA, 19 nt, Homo sapiens
guaacuaccauccauccua

SEQ ID NO: 1098419 - RNA, 19 nt, Homo sapiens
ccauggcuuucaauccuua

SEQ ID NO: 1098420 - RNA, 19 nt, Homo sapiens
cagggaagcacuuacaauu

SEQ ID NO: 1098421 - RNA, 19 nt, Homo sapiens
guggauaaauuguucaucu

SEQ ID NO: 1098422 - RNA, 19 nt, Homo sapiens
caaggcagcucaucaucag

SEQ ID NO: 1098423 - RNA, 19 nt, Homo sapiens
ucacccuccuccacacuua

SEQ ID NO: 1098424 - RNA, 19 nt, Homo sapiens
gaggguacauuggauuuua

SEQ ID NO: 1098425 - RNA, 19 nt, Homo sapiens
gaaguguuaccuuacuauu

SEQ ID NO: 1098426 - RNA, 19 nt, Homo sapiens
ggcacccgcuucaaauauu

SEQ ID NO: 1098427 - RNA, 19 nt, Homo sapiens
aaagagaucagcacuggaa

SEQ ID NO: 1098428 - RNA, 19 nt, Homo sapiens
ggcuuucaauccuuacaua

SEQ ID NO: 1098429 - RNA, 19 nt, Homo sapiens
uuauguaacgugcucauua

SEQ ID NO: 1098430 - RNA, 19 nt, Homo sapiens
aagcagagaacuucauaaa

SEQ ID NO: 1098431 - RNA, 19 nt, Homo sapiens
guaauauuguccuaaagag

SEQ ID NO: 1098432 - RNA, 19 nt, Homo sapiens
gauucaggauguaacaaau

SEQ ID NO: 1098433 - RNA, 19 nt, Homo sapiens
caaauauugugcccaugau

SEQ ID NO: 1098434 - RNA, 19 nt, Homo sapiens
caucagacccucucacauc

SEQ ID NO: 1098435 - RNA, 19 nt, Homo sapiens
acagaaguauaugugcuua

SEQ ID NO: 1098436 - RNA, 19 nt, Homo sapiens
cagcagaguuauggaguau

SEQ ID NO: 1098437 - RNA, 19 nt, Homo sapiens
gcauggcacccgcuucaaa

SEQ ID NO: 1098438 - RNA, 19 nt, Homo sapiens
gauaauacugugacaaucu

SEQ ID NO: 1098439 - RNA, 19 nt, Homo sapiens
ccauggcaaugucaccuuu

SEQ ID NO: 1098440 - RNA, 19 nt, Homo sapiens
gauguugcauaauacaauc

SEQ ID NO: 1098441 - RNA, 19 nt, Homo sapiens
guagguuucuugggacuga

SEQ ID NO: 1098442 - RNA, 19 nt, Homo sapiens
ucaaauauugugcccauga

SEQ ID NO: 1098443 - RNA, 19 nt, Homo sapiens
caaauacaccuguucugau

SEQ ID NO: 1098444 - RNA, 19 nt, Homo sapiens
ugugauauauggcaagugu

SEQ ID NO: 1098445 - RNA, 19 nt, Homo sapiens
uaaaucaaacggagagaug

SEQ ID NO: 1098446 - RNA, 19 nt, Homo sapiens
guugugcuguguuagguuu

SEQ ID NO: 1098447 - RNA, 19 nt, Homo sapiens
ucaguaccauuucuugugu

SEQ ID NO: 1098448 - RNA, 19 nt, Homo sapiens
cuaauaaccaugcuaagug

SEQ ID NO: 1098449 - RNA, 19 nt, Homo sapiens
aaagaugguuguaguuguc

SEQ ID NO: 1098450 - RNA, 19 nt, Homo sapiens
ggauggaccugguuuaaua

SEQ ID NO: 1098451 - RNA, 19 nt, Homo sapiens
ggaagaaucagaucagaua

SEQ ID NO: 1098452 - RNA, 19 nt, Homo sapiens
cgaagagccuugaacauaa

SEQ ID NO: 1098453 - RNA, 19 nt, Homo sapiens
gaagagccuugaacauaaa

SEQ ID NO: 1098454 - RNA, 19 nt, Homo sapiens
ccacaaugccuguugauua

SEQ ID NO: 1098455 - RNA, 19 nt, Homo sapiens
gaagcaagcugggaagaau

SEQ ID NO: 1098456 - RNA, 19 nt, Homo sapiens
uaaaugaggucucguugau

SEQ ID NO: 1098457 - RNA, 19 nt, Homo sapiens
gaaccagaguuuacuucuu

SEQ ID NO: 1098458 - RNA, 19 nt, Homo sapiens
gagagacccugaaucugaa

SEQ ID NO: 1098459 - RNA, 19 nt, Homo sapiens
gcuaggcaauugcaguuaa

SEQ ID NO: 1098460 - RNA, 19 nt, Homo sapiens
cgagagacccugaaucuga

SEQ ID NO: 1098461 - RNA, 19 nt, Homo sapiens
uuagugaccuggaaauuug

SEQ ID NO: 1098462 - RNA, 19 nt, Homo sapiens
cacaaugccuguugauuau

SEQ ID NO: 1098463 - RNA, 19 nt, Homo sapiens
ggaccugguuuaauaaugg

SEQ ID NO: 1098464 - RNA, 19 nt, Homo sapiens
ugagaucaaugcccacaaa

SEQ ID NO: 1098465 - RNA, 19 nt, Homo sapiens
gaucaaugcccacaaauac

SEQ ID NO: 1098466 - RNA, 19 nt, Homo sapiens
ccaggacucuuuguuuauu

SEQ ID NO: 1098467 - RNA, 19 nt, Homo sapiens
ucgaagagccuugaacaua

SEQ ID NO: 1098468 - RNA, 19 nt, Homo sapiens
caaugccuguugauuauga

SEQ ID NO: 1098469 - RNA, 19 nt, Homo sapiens
aaacacagucuuuccaauu

SEQ ID NO: 1098470 - RNA, 19 nt, Homo sapiens
gugaugaagagaagaguua

SEQ ID NO: 1098471 - RNA, 19 nt, Homo sapiens
acccaggacucuuuguuua

SEQ ID NO: 1098472 - RNA, 19 nt, Homo sapiens
ggagaacaagagugaagua

SEQ ID NO: 1098473 - RNA, 19 nt, Homo sapiens
ggaaauuugugcugaugag

SEQ ID NO: 1098474 - RNA, 19 nt, Homo sapiens
ggaaugacuucuacaaaau

SEQ ID NO: 1098475 - RNA, 19 nt, Homo sapiens
ccaauuuauuuccauguga

SEQ ID NO: 1098476 - RNA, 19 nt, Homo sapiens
aacacagucuuuccaauuu

SEQ ID NO: 1098477 - RNA, 19 nt, Homo sapiens
gaaaauuagugaccuggaa

SEQ ID NO: 1098478 - RNA, 19 nt, Homo sapiens
guuagugaagggcuuauua

SEQ ID NO: 1098479 - RNA, 19 nt, Homo sapiens
ggaagaacagcacaagugu

SEQ ID NO: 1098480 - RNA, 19 nt, Homo sapiens
uggcucagcuucgguuuaa

SEQ ID NO: 1098481 - RNA, 19 nt, Homo sapiens
gaggauggaccugguuuaa

SEQ ID NO: 1098482 - RNA, 19 nt, Homo sapiens
gacccugaaucugaaagua

SEQ ID NO: 1098483 - RNA, 19 nt, Homo sapiens
aaccagaguuuacuucuuc

SEQ ID NO: 1098484 - RNA, 19 nt, Homo sapiens
ggugauggaaccagaguuu

SEQ ID NO: 1098485 - RNA, 19 nt, Homo sapiens
guaucaggauucuaacaau

SEQ ID NO: 1098486 - RNA, 19 nt, Homo sapiens
gacuugaaccuuaaaccua

SEQ ID NO: 1098487 - RNA, 19 nt, Homo sapiens
aauuugugcugaugaguuu

SEQ ID NO: 1098488 - RNA, 19 nt, Homo sapiens
cugcaauccucgccgauaa

SEQ ID NO: 1098489 - RNA, 19 nt, Homo sapiens
gaugcaagcccguuguguu

SEQ ID NO: 1098490 - RNA, 19 nt, Homo sapiens
gacccaggacucuuuguuu

SEQ ID NO: 1098491 - RNA, 19 nt, Homo sapiens
ccaccacaaugccuguuga

SEQ ID NO: 1098492 - RNA, 19 nt, Homo sapiens
gcugaugaguuuccuggau

SEQ ID NO: 1098493 - RNA, 19 nt, Homo sapiens
gauggaccugguuuaauaa

SEQ ID NO: 1098494 - RNA, 19 nt, Homo sapiens
gaagaaucagaucagauau

SEQ ID NO: 1098495 - RNA, 19 nt, Homo sapiens
ggaagcaagcugggaagaa

SEQ ID NO: 1098496 - RNA, 19 nt, Homo sapiens
gcaauugcaguuaauacau

SEQ ID NO: 1098497 - RNA, 19 nt, Homo sapiens
aaccuuaaaccaccaauuu

SEQ ID NO: 1098498 - RNA, 19 nt, Homo sapiens
gaguuuacuucuucacaca

SEQ ID NO: 1098499 - RNA, 19 nt, Homo sapiens
caaugacccaggacucuuu

SEQ ID NO: 1098500 - RNA, 19 nt, Homo sapiens
gcaccuagccaaaaucaaa

SEQ ID NO: 1098501 - RNA, 19 nt, Homo sapiens
gcccacaaauacuggaaug

SEQ ID NO: 1098502 - RNA, 19 nt, Homo sapiens
cagcacaaguguucuucga

SEQ ID NO: 1098503 - RNA, 19 nt, Homo sapiens
ucaaaggaauuguaaaccu

SEQ ID NO: 1098504 - RNA, 19 nt, Homo sapiens
gugucuaucuggaaauuuc

SEQ ID NO: 1098505 - RNA, 19 nt, Homo sapiens
gaggagaauguaacucaga

SEQ ID NO: 1098506 - RNA, 19 nt, Homo sapiens
ggguuuggauucagugcaa

SEQ ID NO: 1098507 - RNA, 19 nt, Homo sapiens
caccacugcuggacuggaa

SEQ ID NO: 1098508 - RNA, 19 nt, Homo sapiens
gucagugucuaucuggaaa

SEQ ID NO: 1098509 - RNA, 19 nt, Homo sapiens
uggaaugacuucuacaaaa

SEQ ID NO: 1098510 - RNA, 19 nt, Homo sapiens
gaaccuuaaaccuaggaaa

SEQ ID NO: 1098511 - RNA, 19 nt, Homo sapiens
aaggauagacauuggcuuu

SEQ ID NO: 1098512 - RNA, 19 nt, Homo sapiens
gagaacaagagugaaguau

SEQ ID NO: 1098513 - RNA, 19 nt, Homo sapiens
uuagugaagggcuuauuaa

SEQ ID NO: 1098514 - RNA, 19 nt, Homo sapiens
agaucaaugcccacaaaua

SEQ ID NO: 1098515 - RNA, 19 nt, Homo sapiens
gcaauccucgccgauaaga

SEQ ID NO: 1098516 - RNA, 19 nt, Homo sapiens
caggacucuuuguuuauug

SEQ ID NO: 1098517 - RNA, 19 nt, Homo sapiens
ggagaauguaacucagaaa

SEQ ID NO: 1098518 - RNA, 19 nt, Homo sapiens
caaauacuggaaugacuuc

SEQ ID NO: 1098519 - RNA, 19 nt, Homo sapiens
cgaccugugugaugaagag

SEQ ID NO: 1098520 - RNA, 19 nt, Homo sapiens
uagaaacaaugaggaugga

SEQ ID NO: 1098521 - RNA, 19 nt, Homo sapiens
gggcuaggcaauugcaguu

SEQ ID NO: 1098522 - RNA, 19 nt, Homo sapiens
cagugucuaucuggaaauu

SEQ ID NO: 1098523 - RNA, 19 nt, Homo sapiens
aaaggucagugucuaucug

SEQ ID NO: 1098524 - RNA, 19 nt, Homo sapiens
aggagaauguaacucagaa

SEQ ID NO: 1098525 - RNA, 19 nt, Homo sapiens
uggaagaacagcacaagug

SEQ ID NO: 1098526 - RNA, 19 nt, Homo sapiens
gaccugguuuaauaaugga

SEQ ID NO: 1098527 - RNA, 19 nt, Homo sapiens
ggaauuguaaaccuuaaac

SEQ ID NO: 1098528 - RNA, 19 nt, Homo sapiens
cucaaucugucuuagcauu

SEQ ID NO: 1098529 - RNA, 19 nt, Homo sapiens
gcagggaggauccauugag

SEQ ID NO: 1098530 - RNA, 19 nt, Homo sapiens
ggucagugucuaucuggaa

SEQ ID NO: 1098531 - RNA, 19 nt, Homo sapiens
ucaaucugucuuagcauuu

SEQ ID NO: 1098532 - RNA, 19 nt, Homo sapiens
caauguaccggguuuggau

SEQ ID NO: 1098533 - RNA, 19 nt, Homo sapiens
gaacuggacacgcuuuuca

SEQ ID NO: 1098534 - RNA, 19 nt, Homo sapiens
gcugagcaggcuucugaaa

SEQ ID NO: 1098535 - RNA, 19 nt, Homo sapiens
cacaaauacuggaaugacu

SEQ ID NO: 1098536 - RNA, 19 nt, Homo sapiens
cuaggcaauugcaguuaau

SEQ ID NO: 1098537 - RNA, 19 nt, Homo sapiens
ucauauuugugaaguccuu

SEQ ID NO: 1098538 - RNA, 19 nt, Homo sapiens
gcaagcccguuguguuucc

SEQ ID NO: 1098539 - RNA, 19 nt, Homo sapiens
gugauggaaccagaguuua

SEQ ID NO: 1098540 - RNA, 19 nt, Homo sapiens
aggcugagcaggcuucuga

SEQ ID NO: 1098541 - RNA, 19 nt, Homo sapiens
cacagucuuuccaauuuua

SEQ ID NO: 1098542 - RNA, 19 nt, Homo sapiens
ggcaauugcaguuaauaca

SEQ ID NO: 1098543 - RNA, 19 nt, Homo sapiens
ucaaugcccacaaauacug

SEQ ID NO: 1098544 - RNA, 19 nt, Homo sapiens
gaggaacuggacacgcuuu

SEQ ID NO: 1098545 - RNA, 19 nt, Homo sapiens
aagggcagucuugauauua

SEQ ID NO: 1098546 - RNA, 19 nt, Homo sapiens
auacuggaaugacuucuac

SEQ ID NO: 1098547 - RNA, 19 nt, Homo sapiens
ugaggauggaccugguuua

SEQ ID NO: 1098548 - RNA, 19 nt, Homo sapiens
ccgauaagaggcagcaguu

SEQ ID NO: 1098549 - RNA, 19 nt, Homo sapiens
augcaagcccguuguguuu

SEQ ID NO: 1098550 - RNA, 19 nt, Homo sapiens
uaaagaagcuggcaaagaa

SEQ ID NO: 1098551 - RNA, 19 nt, Homo sapiens
gaagagauguuucacaaga

SEQ ID NO: 1098552 - RNA, 19 nt, Homo sapiens
gaaagacguugccauagaa

SEQ ID NO: 1098553 - RNA, 19 nt, Homo sapiens
gaauuacccuuuaugacua

SEQ ID NO: 1098554 - RNA, 19 nt, Homo sapiens
caaacagucucauccauuu

SEQ ID NO: 1098555 - RNA, 19 nt, Homo sapiens
gaaggaaaccuaacuauag

SEQ ID NO: 1098556 - RNA, 19 nt, Homo sapiens
gagaugacguguugagaaa

SEQ ID NO: 1098557 - RNA, 19 nt, Homo sapiens
caacaaagacccugcaauu

SEQ ID NO: 1098558 - RNA, 19 nt, Homo sapiens
gcacagaugucccagugaa

SEQ ID NO: 1098559 - RNA, 19 nt, Homo sapiens
caacgaacauguacaacaa

SEQ ID NO: 1098560 - RNA, 19 nt, Homo sapiens
ugaauuugaugcagacuua

SEQ ID NO: 1098561 - RNA, 19 nt, Homo sapiens
caaaggaauuggaauguug

SEQ ID NO: 1098562 - RNA, 19 nt, Homo sapiens
gagcugugaugaacaaauu

SEQ ID NO: 1098563 - RNA, 19 nt, Homo sapiens
ggaaaggaauucaucuuag

SEQ ID NO: 1098564 - RNA, 19 nt, Homo sapiens
cgauuaagcucuaccuaaa

SEQ ID NO: 1098565 - RNA, 19 nt, Homo sapiens
gaugacaaaugacuacuau

SEQ ID NO: 1098566 - RNA, 19 nt, Homo sapiens
gaauuggaauguuggauau

SEQ ID NO: 1098567 - RNA, 19 nt, Homo sapiens
gaugacuucuucaacauaa

SEQ ID NO: 1098568 - RNA, 19 nt, Homo sapiens
gggaaaggaauucaucuua

SEQ ID NO: 1098569 - RNA, 19 nt, Homo sapiens
gaaaugcuauggugaaucg

SEQ ID NO: 1098570 - RNA, 19 nt, Homo sapiens
gaugaugacuucuucaaca

SEQ ID NO: 1098571 - RNA, 19 nt, Homo sapiens
caaagaacauggaagagau

SEQ ID NO: 1098572 - RNA, 19 nt, Homo sapiens
gaauuuaaccucugcaguu

SEQ ID NO: 1098573 - RNA, 19 nt, Homo sapiens
gcacgggccucuccagaau

SEQ ID NO: 1098574 - RNA, 19 nt, Homo sapiens
ggaauuggaauguuggaua

SEQ ID NO: 1098575 - RNA, 19 nt, Homo sapiens
gaauauugcuugugaagac

SEQ ID NO: 1098576 - RNA, 19 nt, Homo sapiens
gaauguaaccaucgaagaa

SEQ ID NO: 1098577 - RNA, 19 nt, Homo sapiens
gguggaggcugcagaagaa

SEQ ID NO: 1098578 - RNA, 19 nt, Homo sapiens
gaauauaguccaaccauca

SEQ ID NO: 1098579 - RNA, 19 nt, Homo sapiens
gcccagaaauugaaacaga

SEQ ID NO: 1098580 - RNA, 19 nt, Homo sapiens
ggacaccuaugauacaauc

SEQ ID NO: 1098581 - RNA, 19 nt, Homo sapiens
gaauggaacuuuggugcaa

SEQ ID NO: 1098582 - RNA, 19 nt, Homo sapiens
gcaggagaaugucauggaa

SEQ ID NO: 1098583 - RNA, 19 nt, Homo sapiens
agaaagacguugccauaga

SEQ ID NO: 1098584 - RNA, 19 nt, Homo sapiens
ccauugaaaucagguauaa

SEQ ID NO: 1098585 - RNA, 19 nt, Homo sapiens
cgaaggaaaccuaacuaua

SEQ ID NO: 1098586 - RNA, 19 nt, Homo sapiens
ggauauagcucugaaugag

SEQ ID NO: 1098587 - RNA, 19 nt, Homo sapiens
gcaaacagucucauccauu

SEQ ID NO: 1098588 - RNA, 19 nt, Homo sapiens
aagcacaccugaaacauga

SEQ ID NO: 1098589 - RNA, 19 nt, Homo sapiens
ugagaaagacguugccaua

SEQ ID NO: 1098590 - RNA, 19 nt, Homo sapiens
gaaaggaauucaucuuagc

SEQ ID NO: 1098591 - RNA, 19 nt, Homo sapiens
gcaaagaacauggaagaga

SEQ ID NO: 1098592 - RNA, 19 nt, Homo sapiens
caaagacccugcaauuguc

SEQ ID NO: 1098593 - RNA, 19 nt, Homo sapiens
ucaaugcugugcugauaaa

SEQ ID NO: 1098594 - RNA, 19 nt, Homo sapiens
gaugacguguugagaaaug

SEQ ID NO: 1098595 - RNA, 19 nt, Homo sapiens
cagggaauauugcuuguga

SEQ ID NO: 1098596 - RNA, 19 nt, Homo sapiens
gguggcagcuguaggcauu

SEQ ID NO: 1098597 - RNA, 19 nt, Homo sapiens
ggaccgaagcuuacauuga

SEQ ID NO: 1098598 - RNA, 19 nt, Homo sapiens
gaaccuugccugaauggaa

SEQ ID NO: 1098599 - RNA, 19 nt, Homo sapiens
cgaaagacguggucauuuu

SEQ ID NO: 1098600 - RNA, 19 nt, Homo sapiens
gaagaaggccugcaugacu

SEQ ID NO: 1098601 - RNA, 19 nt, Homo sapiens
gaagaagacaguggacaaa

SEQ ID NO: 1098602 - RNA, 19 nt, Homo sapiens
aggagaaugucauggaaua

SEQ ID NO: 1098603 - RNA, 19 nt, Homo sapiens
uggaagagauguuucacaa

SEQ ID NO: 1098604 - RNA, 19 nt, Homo sapiens
aaucauggauaaacuguga

SEQ ID NO: 1098605 - RNA, 19 nt, Homo sapiens
gcaguaaaauggaucauga

SEQ ID NO: 1098606 - RNA, 19 nt, Homo sapiens
gaccgaagcuuacauugac

SEQ ID NO: 1098607 - RNA, 19 nt, Homo sapiens
agaccgagaugacguguug

SEQ ID NO: 1098608 - RNA, 19 nt, Homo sapiens
uaaaugaaagggacaaaga

SEQ ID NO: 1098609 - RNA, 19 nt, Homo sapiens
gauaaacugugaaccaaaa

SEQ ID NO: 1098610 - RNA, 19 nt, Homo sapiens
ccugaaagcuggugacaag

SEQ ID NO: 1098611 - RNA, 19 nt, Homo sapiens
gcgauuaagcucuaccuaa

SEQ ID NO: 1098612 - RNA, 19 nt, Homo sapiens
gagaaaugcuauggugaau

SEQ ID NO: 1098613 - RNA, 19 nt, Homo sapiens
cacaaaagcugacugauga

SEQ ID NO: 1098614 - RNA, 19 nt, Homo sapiens
ggaauaccuucacgugcuu

SEQ ID NO: 1098615 - RNA, 19 nt, Homo sapiens
agaagaagcacaccugaaa

SEQ ID NO: 1098616 - RNA, 19 nt, Homo sapiens
guaaagaagcuggcaaaga

SEQ ID NO: 1098617 - RNA, 19 nt, Homo sapiens
gcagcaaccuguucauggu

SEQ ID NO: 1098618 - RNA, 19 nt, Homo sapiens
uaaaauggaucaugacaga

SEQ ID NO: 1098619 - RNA, 19 nt, Homo sapiens
uaacaaugggcuccuuuaa

SEQ ID NO: 1098620 - RNA, 19 nt, Homo sapiens
agaaaucgauggccuccaa

SEQ ID NO: 1098621 - RNA, 19 nt, Homo sapiens
ccagugugauaaagaauug

SEQ ID NO: 1098622 - RNA, 19 nt, Homo sapiens
ggacaaacuuuucgccaaa

SEQ ID NO: 1098623 - RNA, 19 nt, Homo sapiens
gcuaaagcccagaaauuga

SEQ ID NO: 1098624 - RNA, 19 nt, Homo sapiens
gcuccagugugauaaagaa

SEQ ID NO: 1098625 - RNA, 19 nt, Homo sapiens
gaagcacaccugaaacaug

SEQ ID NO: 1098626 - RNA, 19 nt, Homo sapiens
cagcuaaagcccagaaauu

SEQ ID NO: 1098627 - RNA, 19 nt, Homo sapiens
acaaugggcuccuuuaaaa

SEQ ID NO: 1098628 - RNA, 19 nt, Homo sapiens
uaaaauccauugcugcuaa

SEQ ID NO: 1098629 - RNA, 19 nt, Homo sapiens
ggguacuccuuucaguuua

SEQ ID NO: 1098630 - RNA, 19 nt, Homo sapiens
gauucacgguuaugccuuu

SEQ ID NO: 1098631 - RNA, 19 nt, Homo sapiens
ggcagcaacuucuccgaaa

SEQ ID NO: 1098632 - RNA, 19 nt, Homo sapiens
gaggucaugggaaauauuu

SEQ ID NO: 1098633 - RNA, 19 nt, Homo sapiens
gaaagacguggucauuuua

SEQ ID NO: 1098634 - RNA, 19 nt, Homo sapiens
gucugaaucucuaaacaaa

SEQ ID NO: 1098635 - RNA, 19 nt, Homo sapiens
ugaaaccuauugaaaccaa

SEQ ID NO: 1098636 - RNA, 19 nt, Homo sapiens
gagacuacagggaauauug

SEQ ID NO: 1098637 - RNA, 19 nt, Homo sapiens
cacacagacuggagacuuu

SEQ ID NO: 1098638 - RNA, 19 nt, Homo sapiens
gcuccuggaugaacggaaa

SEQ ID NO: 1098639 - RNA, 19 nt, Homo sapiens
augaggagcuucacuaugu

SEQ ID NO: 1098640 - RNA, 19 nt, Homo sapiens
ggaaccagaugagaaugga

SEQ ID NO: 1098641 - RNA, 19 nt, Homo sapiens
ggacaaagacgggaauuuu

SEQ ID NO: 1098642 - RNA, 19 nt, Homo sapiens
gaugcagacuuacaguaug

SEQ ID NO: 1098643 - RNA, 19 nt, Homo sapiens
acaaagaguaugagaaaga

SEQ ID NO: 1098644 - RNA, 19 nt, Homo sapiens
cuucaaugcugugcugaua

SEQ ID NO: 1098645 - RNA, 19 nt, Homo sapiens
ccagaggucaugggaaaua

SEQ ID NO: 1098646 - RNA, 19 nt, Homo sapiens
gguuaugccuuugcaauca

SEQ ID NO: 1098647 - RNA, 19 nt, Homo sapiens
gagcaucuggacaaacuuu

SEQ ID NO: 1098648 - RNA, 19 nt, Homo sapiens
gggagcaucuggacaaacu

SEQ ID NO: 1098649 - RNA, 19 nt, Homo sapiens
uaaucacccuucaucagaa

SEQ ID NO: 1098650 - RNA, 19 nt, Homo sapiens
gguaggugcuuuccaaaua

SEQ ID NO: 1098651 - RNA, 19 nt, Homo sapiens
ggacugaaauuccugaguu

SEQ ID NO: 1098652 - RNA, 19 nt, Homo sapiens
ccaaauacuucgccuauga

SEQ ID NO: 1098653 - RNA, 19 nt, Homo sapiens
gagaauggaagucuuaaua

SEQ ID NO: 1098654 - RNA, 19 nt, Homo sapiens
ugagauggaucauaaguaa

SEQ ID NO: 1098655 - RNA, 19 nt, Homo sapiens
gaugauauauugcuacaga

SEQ ID NO: 1098656 - RNA, 19 nt, Homo sapiens
gaauggaagucuuaauaga

SEQ ID NO: 1098657 - RNA, 19 nt, Homo sapiens
gaaggaagcaggagugauu

SEQ ID NO: 1098658 - RNA, 19 nt, Homo sapiens
gaacugagaagccaacauu

SEQ ID NO: 1098659 - RNA, 19 nt, Homo sapiens
caucugagacugauauuua

SEQ ID NO: 1098660 - RNA, 19 nt, Homo sapiens
gaacuuggauucccugaag

SEQ ID NO: 1098661 - RNA, 19 nt, Homo sapiens
gagggaaucucucugugua

SEQ ID NO: 1098662 - RNA, 19 nt, Homo sapiens
ggucaacucugauagauuc

SEQ ID NO: 1098663 - RNA, 19 nt, Homo sapiens
caccaugccuggcuaauuu

SEQ ID NO: 1098664 - RNA, 19 nt, Homo sapiens
gggcugaggucaacucuga

SEQ ID NO: 1098665 - RNA, 19 nt, Homo sapiens
gaacgacucuggccucuac

SEQ ID NO: 1098666 - RNA, 19 nt, Homo sapiens
gaaagaccauauuccauag

SEQ ID NO: 1098667 - RNA, 19 nt, Homo sapiens
gaaauaagggagaggauau

SEQ ID NO: 1098668 - RNA, 19 nt, Homo sapiens
gcaauaaauucaagacucu

SEQ ID NO: 1098669 - RNA, 19 nt, Homo sapiens
gaacuugucuauggcaaug

SEQ ID NO: 1098670 - RNA, 19 nt, Homo sapiens
gaucugugacucugaaaua

SEQ ID NO: 1098671 - RNA, 19 nt, Homo sapiens
ucucagaaaucaugaugua

SEQ ID NO: 1098672 - RNA, 19 nt, Homo sapiens
cacaaucccucugaaauaa

SEQ ID NO: 1098673 - RNA, 19 nt, Homo sapiens
gcaccucccucugcccuua

SEQ ID NO: 1098674 - RNA, 19 nt, Homo sapiens
guuuagggcuuuaccuuaa

SEQ ID NO: 1098675 - RNA, 19 nt, Homo sapiens
gucaauaucucguguuuca

SEQ ID NO: 1098676 - RNA, 19 nt, Homo sapiens
gcacaccaccugggcauua

SEQ ID NO: 1098677 - RNA, 19 nt, Homo sapiens
agucugagauggaucauaa

SEQ ID NO: 1098678 - RNA, 19 nt, Homo sapiens
ccagaccguuaacacauua

SEQ ID NO: 1098679 - RNA, 19 nt, Homo sapiens
cgguaaagauuuccuuauu

SEQ ID NO: 1098680 - RNA, 19 nt, Homo sapiens
cccaauagcucguguaucu

SEQ ID NO: 1098681 - RNA, 19 nt, Homo sapiens
acacaaucccucugaaaua

SEQ ID NO: 1098682 - RNA, 19 nt, Homo sapiens
gaacaugagguagacuuaa

SEQ ID NO: 1098683 - RNA, 19 nt, Homo sapiens
gagaagaacaugagguaga

SEQ ID NO: 1098684 - RNA, 19 nt, Homo sapiens
auacagggcucaacugaau

SEQ ID NO: 1098685 - RNA, 19 nt, Homo sapiens
aagccaacauuucuacaua

SEQ ID NO: 1098686 - RNA, 19 nt, Homo sapiens
caauagcucguguaucuaa

SEQ ID NO: 1098687 - RNA, 19 nt, Homo sapiens
ccaguauuauuccucauuu

SEQ ID NO: 1098688 - RNA, 19 nt, Homo sapiens
guucauucauucauccaua

SEQ ID NO: 1098689 - RNA, 19 nt, Homo sapiens
gcucguguaucuaaguuga

SEQ ID NO: 1098690 - RNA, 19 nt, Homo sapiens
agacaggguuugacuaugu

SEQ ID NO: 1098691 - RNA, 19 nt, Homo sapiens
acagaaagauccugaagca

SEQ ID NO: 1098692 - RNA, 19 nt, Homo sapiens
gaagaggcagcccaagaaa

SEQ ID NO: 1098693 - RNA, 19 nt, Homo sapiens
gggagaagaacaugaggua

SEQ ID NO: 1098694 - RNA, 19 nt, Homo sapiens
ggauaacuuuguuucugaa

SEQ ID NO: 1098695 - RNA, 19 nt, Homo sapiens
gagaugauauauugcuaca

SEQ ID NO: 1098696 - RNA, 19 nt, Homo sapiens
gaccauauuccauagguuu

SEQ ID NO: 1098697 - RNA, 19 nt, Homo sapiens
gaugcuuuauggaauguaa

SEQ ID NO: 1098698 - RNA, 19 nt, Homo sapiens
caccacgccuggcuaaauu

SEQ ID NO: 1098699 - RNA, 19 nt, Homo sapiens
gggcucaacugaauaagag

SEQ ID NO: 1098700 - RNA, 19 nt, Homo sapiens
agagaaggauugcugauca

SEQ ID NO: 1098701 - RNA, 19 nt, Homo sapiens
caauaucucguguuucauu

SEQ ID NO: 1098702 - RNA, 19 nt, Homo sapiens
ccaaagugcugagauuaca

SEQ ID NO: 1098703 - RNA, 19 nt, Homo sapiens
gaagcaggagugauuaguu

SEQ ID NO: 1098704 - RNA, 19 nt, Homo sapiens
aaagaucugugacucugaa

SEQ ID NO: 1098705 - RNA, 19 nt, Homo sapiens
gagguagacuuaaagaacu

SEQ ID NO: 1098706 - RNA, 19 nt, Homo sapiens
ggacugggcugaggucaac

SEQ ID NO: 1098707 - RNA, 19 nt, Homo sapiens
agauucagaugacuagaaa

SEQ ID NO: 1098708 - RNA, 19 nt, Homo sapiens
aggauaaacuggagcagaa

SEQ ID NO: 1098709 - RNA, 19 nt, Homo sapiens
aaauuucugugcaccagua

SEQ ID NO: 1098710 - RNA, 19 nt, Homo sapiens
gugauuaguucggguuaaa

SEQ ID NO: 1098711 - RNA, 19 nt, Homo sapiens
gcgcaucggcccuuuguga

SEQ ID NO: 1098712 - RNA, 19 nt, Homo sapiens
agacucuucuuauugguaa

SEQ ID NO: 1098713 - RNA, 19 nt, Homo sapiens
gaggucaacucugauagau

SEQ ID NO: 1098714 - RNA, 19 nt, Homo sapiens
acauugaacuugucuaugg

SEQ ID NO: 1098715 - RNA, 19 nt, Homo sapiens
agacugacauugaacuugu

SEQ ID NO: 1098716 - RNA, 19 nt, Homo sapiens
uggauaacuuuguuucuga

SEQ ID NO: 1098717 - RNA, 19 nt, Homo sapiens
cgaagaggcagcccaagaa

SEQ ID NO: 1098718 - RNA, 19 nt, Homo sapiens
gaucagcucccucgaacug

SEQ ID NO: 1098719 - RNA, 19 nt, Homo sapiens
ugaaauuccugaguucuuc

SEQ ID NO: 1098720 - RNA, 19 nt, Homo sapiens
aacaugagguagacuuaaa

SEQ ID NO: 1098721 - RNA, 19 nt, Homo sapiens
ugaaaagacugacauugaa

SEQ ID NO: 1098722 - RNA, 19 nt, Homo sapiens
gaacuccugaccucaaaug

SEQ ID NO: 1098723 - RNA, 19 nt, Homo sapiens
gacaugagguggccugaac

SEQ ID NO: 1098724 - RNA, 19 nt, Homo sapiens
gaacaggagcagugugaca

SEQ ID NO: 1098725 - RNA, 19 nt, Homo sapiens
ggagaacucugcgguacca

SEQ ID NO: 1098726 - RNA, 19 nt, Homo sapiens
gguuuagggcuuuaccuua

SEQ ID NO: 1098727 - RNA, 19 nt, Homo sapiens
ucagaugacuagaaauugg

SEQ ID NO: 1098728 - RNA, 19 nt, Homo sapiens
gcuuaguacuccagagcua

SEQ ID NO: 1098729 - RNA, 19 nt, Homo sapiens
gaagcacgccugucuaggu

SEQ ID NO: 1098730 - RNA, 19 nt, Homo sapiens
gggagaggauauagaccuu

SEQ ID NO: 1098731 - RNA, 19 nt, Homo sapiens
ucaaagugcugggauuaca

SEQ ID NO: 1098732 - RNA, 19 nt, Homo sapiens
cuuaggugcugcccaguuu

SEQ ID NO: 1098733 - RNA, 19 nt, Homo sapiens
aaacgcgucugacuaccuu

SEQ ID NO: 1098734 - RNA, 19 nt, Homo sapiens
guacauccuucuggucuuc

SEQ ID NO: 1098735 - RNA, 19 nt, Homo sapiens
gacaggguuugacuauguu

SEQ ID NO: 1098736 - RNA, 19 nt, Homo sapiens
uaaacuggagcagaaauaa

SEQ ID NO: 1098737 - RNA, 19 nt, Homo sapiens
acacguuccugauccuauu

SEQ ID NO: 1098738 - RNA, 19 nt, Homo sapiens
ucucuaagguucccuccaa

SEQ ID NO: 1098739 - RNA, 19 nt, Homo sapiens
aagcaggagugauuaguuc

SEQ ID NO: 1098740 - RNA, 19 nt, Homo sapiens
ccaccugccucugagcuuu

SEQ ID NO: 1098741 - RNA, 19 nt, Homo sapiens
gagaggauauagaccuuuu

SEQ ID NO: 1098742 - RNA, 19 nt, Homo sapiens
ugaaauaagggagaggaua

SEQ ID NO: 1098743 - RNA, 19 nt, Homo sapiens
ccacacaaucccucugaaa

SEQ ID NO: 1098744 - RNA, 19 nt, Homo sapiens
uagucaauaucucguguuu

SEQ ID NO: 1098745 - RNA, 19 nt, Homo sapiens
guaaaugagcagugugaga

SEQ ID NO: 1098746 - RNA, 19 nt, Homo sapiens
cccaaaggguuuccucgaa

SEQ ID NO: 1098747 - RNA, 19 nt, Homo sapiens
gcugaggucaacucugaua

SEQ ID NO: 1098748 - RNA, 19 nt, Homo sapiens
cgagggcgguaaagauuuc

SEQ ID NO: 1098749 - RNA, 19 nt, Homo sapiens
caaauacuucgccuaugaa

SEQ ID NO: 1098750 - RNA, 19 nt, Homo sapiens
ggaaugcaauguaauguua

SEQ ID NO: 1098751 - RNA, 19 nt, Homo sapiens
ggauauaaguugucacuaa

SEQ ID NO: 1098752 - RNA, 19 nt, Homo sapiens
gaagggaaaugcuggugaa

SEQ ID NO: 1098753 - RNA, 19 nt, Homo sapiens
gaauagacaagaaggauuu

SEQ ID NO: 1098754 - RNA, 19 nt, Homo sapiens
gaaauugagccacuguauu

SEQ ID NO: 1098755 - RNA, 19 nt, Homo sapiens
cauguuaggugauucagaa

SEQ ID NO: 1098756 - RNA, 19 nt, Homo sapiens
gaacuggauauucuucuuu

SEQ ID NO: 1098757 - RNA, 19 nt, Homo sapiens
gaacuuaguacuuaacaca

SEQ ID NO: 1098758 - RNA, 19 nt, Homo sapiens
gagaugaaauccauuacca

SEQ ID NO: 1098759 - RNA, 19 nt, Homo sapiens
agugugaacuuaguacuua

SEQ ID NO: 1098760 - RNA, 19 nt, Homo sapiens
gaacauguuuugucauuca

SEQ ID NO: 1098761 - RNA, 19 nt, Homo sapiens
gacaagaaggauuuaguaa

SEQ ID NO: 1098762 - RNA, 19 nt, Homo sapiens
aagcaacgauuccagaaga

SEQ ID NO: 1098763 - RNA, 19 nt, Homo sapiens
cuagagagaugaaauccau

SEQ ID NO: 1098764 - RNA, 19 nt, Homo sapiens
uaaauuggguuuccuucuc

SEQ ID NO: 1098765 - RNA, 19 nt, Homo sapiens
caauaagaacugcuagaaa

SEQ ID NO: 1098766 - RNA, 19 nt, Homo sapiens
cuacaaagccaucagugaa

SEQ ID NO: 1098767 - RNA, 19 nt, Homo sapiens
gaaacaaaggaaucuacaa

SEQ ID NO: 1098768 - RNA, 19 nt, Homo sapiens
agacaagaaggauuuagua

SEQ ID NO: 1098769 - RNA, 19 nt, Homo sapiens
gaacugcuagaaauauguu

SEQ ID NO: 1098770 - RNA, 19 nt, Homo sapiens
caaagcagcauggcucaaa

SEQ ID NO: 1098771 - RNA, 19 nt, Homo sapiens
agagagaugaaauccauua

SEQ ID NO: 1098772 - RNA, 19 nt, Homo sapiens
ccaaagccaaguacauuga

SEQ ID NO: 1098773 - RNA, 19 nt, Homo sapiens
gauugucuguuuaaguguu

SEQ ID NO: 1098774 - RNA, 19 nt, Homo sapiens
guacauugugucaacuuaa

SEQ ID NO: 1098775 - RNA, 19 nt, Homo sapiens
gucacuaauuugcacauuu

SEQ ID NO: 1098776 - RNA, 19 nt, Homo sapiens
uaauacugacggcauguua

SEQ ID NO: 1098777 - RNA, 19 nt, Homo sapiens
gcaaucuuccuucaccaaa

SEQ ID NO: 1098778 - RNA, 19 nt, Homo sapiens
uuaauuaugcccaguguga

SEQ ID NO: 1098779 - RNA, 19 nt, Homo sapiens
uuucuggaaugcaauguaa

SEQ ID NO: 1098780 - RNA, 19 nt, Homo sapiens
ggaaacaaaggaaucuaca

SEQ ID NO: 1098781 - RNA, 19 nt, Homo sapiens
caaagcaacgauuccagaa

SEQ ID NO: 1098782 - RNA, 19 nt, Homo sapiens
acaaaggaaucuacaaagc

SEQ ID NO: 1098783 - RNA, 19 nt, Homo sapiens
ggaaagcagucaguaaacc

SEQ ID NO: 1098784 - RNA, 19 nt, Homo sapiens
ugaacuggauauucuucuu

SEQ ID NO: 1098785 - RNA, 19 nt, Homo sapiens
gcuguugacgcucucuaua

SEQ ID NO: 1098786 - RNA, 19 nt, Homo sapiens
cacaagcaaucuuccuuca

SEQ ID NO: 1098787 - RNA, 19 nt, Homo sapiens
aaagccaaguacauugauu

SEQ ID NO: 1098788 - RNA, 19 nt, Homo sapiens
gaaagcagucaguaaacca

SEQ ID NO: 1098789 - RNA, 19 nt, Homo sapiens
auucuucuuuccuggauua

SEQ ID NO: 1098790 - RNA, 19 nt, Homo sapiens
cagcuucuguccuucuuca

SEQ ID NO: 1098791 - RNA, 19 nt, Homo sapiens
aagaacugcuagaaauaug

SEQ ID NO: 1098792 - RNA, 19 nt, Homo sapiens
aguacauugugucaacuua

SEQ ID NO: 1098793 - RNA, 19 nt, Homo sapiens
acaauaagaacugcuagaa

SEQ ID NO: 1098794 - RNA, 19 nt, Homo sapiens
guauguaaccugaauuaac

SEQ ID NO: 1098795 - RNA, 19 nt, Homo sapiens
gacggcauguuaggugauu

SEQ ID NO: 1098796 - RNA, 19 nt, Homo sapiens
augauugucuguuuaagug

SEQ ID NO: 1098797 - RNA, 19 nt, Homo sapiens
ccaaguacauugauuuuac

SEQ ID NO: 1098798 - RNA, 19 nt, Homo sapiens
gcagaaauugagccacugu

SEQ ID NO: 1098799 - RNA, 19 nt, Homo sapiens
ggacuuucauagccuuagg

SEQ ID NO: 1098800 - RNA, 19 nt, Homo sapiens
gugugaacuuaguacuuaa

SEQ ID NO: 1098801 - RNA, 19 nt, Homo sapiens
gguguggguugcuguuagu

SEQ ID NO: 1098802 - RNA, 19 nt, Homo sapiens
aaccaaagccaaguacauu

SEQ ID NO: 1098803 - RNA, 19 nt, Homo sapiens
gagguguggguugcuguua

SEQ ID NO: 1098804 - RNA, 19 nt, Homo sapiens
agaaauugagccacuguau

SEQ ID NO: 1098805 - RNA, 19 nt, Homo sapiens
gcaagaaaauacgcuuugu

SEQ ID NO: 1098806 - RNA, 19 nt, Homo sapiens
guuagucacucugucucuu

SEQ ID NO: 1098807 - RNA, 19 nt, Homo sapiens
ccaagcacaagcaaucuuc

SEQ ID NO: 1098808 - RNA, 19 nt, Homo sapiens
uuggaaagcagucaguaaa

SEQ ID NO: 1098809 - RNA, 19 nt, Homo sapiens
uguugacgcucucuauauc

SEQ ID NO: 1098810 - RNA, 19 nt, Homo sapiens
aagccaaguacauugauuu

SEQ ID NO: 1098811 - RNA, 19 nt, Homo sapiens
aaaccaaagccaaguacau

SEQ ID NO: 1098812 - RNA, 19 nt, Homo sapiens
gacgcucucuauaucaaag

SEQ ID NO: 1098813 - RNA, 19 nt, Homo sapiens
cagaauagacaagaaggau

SEQ ID NO: 1098814 - RNA, 19 nt, Homo sapiens
acugagacuuaaauagaug

SEQ ID NO: 1098815 - RNA, 19 nt, Homo sapiens
agaauagacaagaaggauu

SEQ ID NO: 1098816 - RNA, 19 nt, Homo sapiens
gauuccagaagaccgcaua

SEQ ID NO: 1098817 - RNA, 19 nt, Homo sapiens
uaugcccagugugaacuua

SEQ ID NO: 1098818 - RNA, 19 nt, Homo sapiens
uaaguugucacuaauuugc

SEQ ID NO: 1098819 - RNA, 19 nt, Homo sapiens
gcaaggcugcaagaaaaua

SEQ ID NO: 1098820 - RNA, 19 nt, Homo sapiens
guaaaccaaagccaaguac

SEQ ID NO: 1098821 - RNA, 19 nt, Homo sapiens
ucuacaaagccaucaguga

SEQ ID NO: 1098822 - RNA, 19 nt, Homo sapiens
aaagcagcauggcucaaag

SEQ ID NO: 1098823 - RNA, 19 nt, Homo sapiens
caaagccaaguacauugau

SEQ ID NO: 1098824 - RNA, 19 nt, Homo sapiens
gaggacuuucauagccuua

SEQ ID NO: 1098825 - RNA, 19 nt, Homo sapiens
gcagcauggcucaaagcaa

SEQ ID NO: 1098826 - RNA, 19 nt, Homo sapiens
acaaagccaucagugaacu

SEQ ID NO: 1098827 - RNA, 19 nt, Homo sapiens
ggauuggaaacaaaggaau

SEQ ID NO: 1098828 - RNA, 19 nt, Homo sapiens
cagaaauugagccacugua

SEQ ID NO: 1098829 - RNA, 19 nt, Homo sapiens
caaguacauugugucaacu

SEQ ID NO: 1098830 - RNA, 19 nt, Homo sapiens
cugaacauguuuugucauu

SEQ ID NO: 1098831 - RNA, 19 nt, Homo sapiens
cagcuagagagaugaaauc

SEQ ID NO: 1098832 - RNA, 19 nt, Homo sapiens
ggagaagacugauauagaa

SEQ ID NO: 1098833 - RNA, 19 nt, Homo sapiens
gagaaagccuuccauuauu

SEQ ID NO: 1098834 - RNA, 19 nt, Homo sapiens
gcacucagcucuccaaucu

SEQ ID NO: 1098835 - RNA, 19 nt, Homo sapiens
caagugacauucucaguga

SEQ ID NO: 1098836 - RNA, 19 nt, Homo sapiens
agaaagagcccaauucauu

SEQ ID NO: 1098837 - RNA, 19 nt, Homo sapiens
gcuccaggauacauuaaua

SEQ ID NO: 1098838 - RNA, 19 nt, Homo sapiens
gcaagcuugucgauauaua

SEQ ID NO: 1098839 - RNA, 19 nt, Homo sapiens
guagaagaguuauuuggaa

SEQ ID NO: 1098840 - RNA, 19 nt, Homo sapiens
gaaauugagccuaugagaa

SEQ ID NO: 1098841 - RNA, 19 nt, Homo sapiens
cagaagaaauggagagguu

SEQ ID NO: 1098842 - RNA, 19 nt, Homo sapiens
gauuccagcuuccucagua

SEQ ID NO: 1098843 - RNA, 19 nt, Homo sapiens
cagagaaagccuuccauua

SEQ ID NO: 1098844 - RNA, 19 nt, Homo sapiens
gaaagagcccaauucauuc

SEQ ID NO: 1098845 - RNA, 19 nt, Homo sapiens
acucauggcugauguggua

SEQ ID NO: 1098846 - RNA, 19 nt, Homo sapiens
gaacaaagacaaccacaac

SEQ ID NO: 1098847 - RNA, 19 nt, Homo sapiens
gaacauugaguuugagaau

SEQ ID NO: 1098848 - RNA, 19 nt, Homo sapiens
agagaaagccuuccauuau

SEQ ID NO: 1098849 - RNA, 19 nt, Homo sapiens
ugggaaaggugcaauggua

SEQ ID NO: 1098850 - RNA, 19 nt, Homo sapiens
aaauugagccuaugagaaa

SEQ ID NO: 1098851 - RNA, 19 nt, Homo sapiens
ggauaagucugcuccaucu

SEQ ID NO: 1098852 - RNA, 19 nt, Homo sapiens
gcaccgagacucuagaaga

SEQ ID NO: 1098853 - RNA, 19 nt, Homo sapiens
caggauacauuaauacauc

SEQ ID NO: 1098854 - RNA, 19 nt, Homo sapiens
acaaauaggcuucaucaug

SEQ ID NO: 1098855 - RNA, 19 nt, Homo sapiens
ucagaugggugacucaaau

SEQ ID NO: 1098856 - RNA, 19 nt, Homo sapiens
gagccaaggaugaguauga

SEQ ID NO: 1098857 - RNA, 19 nt, Homo sapiens
gcaagcugcucgggacaaa

SEQ ID NO: 1098858 - RNA, 19 nt, Homo sapiens
gggagaagacugauauaga

SEQ ID NO: 1098859 - RNA, 19 nt, Homo sapiens
agaaagccuuccauuauuc

SEQ ID NO: 1098860 - RNA, 19 nt, Homo sapiens
caccgagacucuagaagaa

SEQ ID NO: 1098861 - RNA, 19 nt, Homo sapiens
aaugcaagcuugucgauau

SEQ ID NO: 1098862 - RNA, 19 nt, Homo sapiens
gacuaaauaugcacaaucu

SEQ ID NO: 1098863 - RNA, 19 nt, Homo sapiens
ccaauucauuccuaccauu

SEQ ID NO: 1098864 - RNA, 19 nt, Homo sapiens
caaagacaaccacaaccua

SEQ ID NO: 1098865 - RNA, 19 nt, Homo sapiens
gcagacaguuacaagaucu

SEQ ID NO: 1098866 - RNA, 19 nt, Homo sapiens
gagcagaacauugaguuug

SEQ ID NO: 1098867 - RNA, 19 nt, Homo sapiens
gcagagccaaggaugagua

SEQ ID NO: 1098868 - RNA, 19 nt, Homo sapiens
uaagacagcagcagcaaga

SEQ ID NO: 1098869 - RNA, 19 nt, Homo sapiens
gggcuaggcucugggauuc

SEQ ID NO: 1098870 - RNA, 19 nt, Homo sapiens
caugaaccauuucuucugu

SEQ ID NO: 1098871 - RNA, 19 nt, Homo sapiens
acaagcaucugacgguaga

SEQ ID NO: 1098872 - RNA, 19 nt, Homo sapiens
gaaccauuucuucuguaua

SEQ ID NO: 1098873 - RNA, 19 nt, Homo sapiens
ucagcuccaugaaccauuu

SEQ ID NO: 1098874 - RNA, 19 nt, Homo sapiens
cuucggaccuugagaggaa

SEQ ID NO: 1098875 - RNA, 19 nt, Homo sapiens
ccagaaagagcccaauuca

SEQ ID NO: 1098876 - RNA, 19 nt, Homo sapiens
gcuugucgauauauaguau

SEQ ID NO: 1098877 - RNA, 19 nt, Homo sapiens
gaaccagugaauaaagauu

SEQ ID NO: 1098878 - RNA, 19 nt, Homo sapiens
guuugagaauccugaaauu

SEQ ID NO: 1098879 - RNA, 19 nt, Homo sapiens
gguagaagaguuauuugga

SEQ ID NO: 1098880 - RNA, 19 nt, Homo sapiens
gacgguagaagaguuauuu

SEQ ID NO: 1098881 - RNA, 19 nt, Homo sapiens
gaaaugcaagcuugucgau

SEQ ID NO: 1098882 - RNA, 19 nt, Homo sapiens
uggcugaugugguagaaga

SEQ ID NO: 1098883 - RNA, 19 nt, Homo sapiens
aaccauuucuucuguauag

SEQ ID NO: 1098884 - RNA, 19 nt, Homo sapiens
ugaaccauuucuucuguau

SEQ ID NO: 1098885 - RNA, 19 nt, Homo sapiens
uaguugaaccagugaauaa

SEQ ID NO: 1098886 - RNA, 19 nt, Homo sapiens
cccacagcaugaccaaaua

SEQ ID NO: 1098887 - RNA, 19 nt, Homo sapiens
uacaagaucuucggaccuu

SEQ ID NO: 1098888 - RNA, 19 nt, Homo sapiens
cagcaugaccaaauacaga

SEQ ID NO: 1098889 - RNA, 19 nt, Homo sapiens
caauucauuccuaccauuu

SEQ ID NO: 1098890 - RNA, 19 nt, Homo sapiens
gcuaggcucugggauucaa

SEQ ID NO: 1098891 - RNA, 19 nt, Homo sapiens
cuaaauaugcacaaucuag

SEQ ID NO: 1098892 - RNA, 19 nt, Homo sapiens
agacaaauaggcuucauca

SEQ ID NO: 1098893 - RNA, 19 nt, Homo sapiens
agacaaccacaaccuauga

SEQ ID NO: 1098894 - RNA, 19 nt, Homo sapiens
cauugugaaucgacuaaau

SEQ ID NO: 1098895 - RNA, 19 nt, Homo sapiens
uugagaauccugaaauuga

SEQ ID NO: 1098896 - RNA, 19 nt, Homo sapiens
agcagaacauugaguuuga

SEQ ID NO: 1098897 - RNA, 19 nt, Homo sapiens
ccgagacucuagaagaaau

SEQ ID NO: 1098898 - RNA, 19 nt, Homo sapiens
gugacauucucagugauaa

SEQ ID NO: 1098899 - RNA, 19 nt, Homo sapiens
agagacucauuucuuaaga

SEQ ID NO: 1098900 - RNA, 19 nt, Homo sapiens
ugagaauccugaaauugag

SEQ ID NO: 1098901 - RNA, 19 nt, Homo sapiens
gagaugccucccagaaaga

SEQ ID NO: 1098902 - RNA, 19 nt, Homo sapiens
gugaaucgacuaaauaugc

SEQ ID NO: 1098903 - RNA, 19 nt, Homo sapiens
aaagacaaccacaaccuau

SEQ ID NO: 1098904 - RNA, 19 nt, Homo sapiens
cagcagacaguuacaagau

SEQ ID NO: 1098905 - RNA, 19 nt, Homo sapiens
ccucgaaacagcaccauga

SEQ ID NO: 1098906 - RNA, 19 nt, Homo sapiens
ggaagcaccgagacucuag

SEQ ID NO: 1098907 - RNA, 19 nt, Homo sapiens
ggagcagaauaagucuaaa

SEQ ID NO: 1098908 - RNA, 19 nt, Homo sapiens
ucagagaaagccuuccauu

SEQ ID NO: 1098909 - RNA, 19 nt, Homo sapiens
gacacaaccacuugggaaa

SEQ ID NO: 1098910 - RNA, 19 nt, Homo sapiens
gaaacagcaccaugaugca

SEQ ID NO: 1098911 - RNA, 19 nt, Homo sapiens
cagaugggugacucaaaua

SEQ ID NO: 1098912 - RNA, 19 nt, Homo sapiens
augcaagcuugucgauaua

SEQ ID NO: 1098913 - RNA, 19 nt, Homo sapiens
ugaaucgacuaaauaugca

SEQ ID NO: 1098914 - RNA, 19 nt, Homo sapiens
ugaaauugagccuaugaga

SEQ ID NO: 1098915 - RNA, 19 nt, Homo sapiens
gcagaacauugaguuugag

SEQ ID NO: 1098916 - RNA, 19 nt, Homo sapiens
gagcagaauaagucuaaag

SEQ ID NO: 1098917 - RNA, 19 nt, Homo sapiens
gaaagccuuccauuauucu

SEQ ID NO: 1098918 - RNA, 19 nt, Homo sapiens
uugaaccagugaauaaaga

SEQ ID NO: 1098919 - RNA, 19 nt, Homo sapiens
ggucuccacuccugaacca

SEQ ID NO: 1098920 - RNA, 19 nt, Homo sapiens
gcaguugugggucuggauu

SEQ ID NO: 1098921 - RNA, 19 nt, Homo sapiens
gaagaguuauuuggaaccu

SEQ ID NO: 1098922 - RNA, 19 nt, Homo sapiens
gagcagagccaaggaugag

SEQ ID NO: 1098923 - RNA, 19 nt, Homo sapiens
aaauaggcuucaucaugga

SEQ ID NO: 1098924 - RNA, 19 nt, Homo sapiens
uggagcagaauaagucuaa

SEQ ID NO: 1098925 - RNA, 19 nt, Homo sapiens
agucucagcuccaggauac

SEQ ID NO: 1098926 - RNA, 19 nt, Homo sapiens
gcuccaaccuacacaaucc

SEQ ID NO: 1098927 - RNA, 19 nt, Homo sapiens
ggaugaguaugagaggaau

SEQ ID NO: 1098928 - RNA, 19 nt, Homo sapiens
ucagcuccaggauacauua

SEQ ID NO: 1098929 - RNA, 19 nt, Homo sapiens
ggaccuuauucguauaucg

SEQ ID NO: 1098930 - RNA, 19 nt, Homo sapiens
auacagacacaaccacuug

SEQ ID NO: 1098931 - RNA, 19 nt, Homo sapiens
uaugcacaaucuaguugaa

SEQ ID NO: 1098932 - RNA, 19 nt, Homo sapiens
gagaaggccuccugaagua

SEQ ID NO: 1098933 - RNA, 19 nt, Homo sapiens
aaacaaggcuucauggaaa

SEQ ID NO: 1098934 - RNA, 19 nt, Homo sapiens
gcagugagauugcgccauu

SEQ ID NO: 1098935 - RNA, 19 nt, Homo sapiens
gaaauacacuggauguucu

SEQ ID NO: 1098936 - RNA, 19 nt, Homo sapiens
uaauaaagguacagucuug

SEQ ID NO: 1098937 - RNA, 19 nt, Homo sapiens
aggaauggcuggaaaguuu

SEQ ID NO: 1098938 - RNA, 19 nt, Homo sapiens
gcugggaggucucuuaaga

SEQ ID NO: 1098939 - RNA, 19 nt, Homo sapiens
ggaacugaaugaaaucuca

SEQ ID NO: 1098940 - RNA, 19 nt, Homo sapiens
ggagauuuguccucacuug

SEQ ID NO: 1098941 - RNA, 19 nt, Homo sapiens
gggaugaggaaauuaauaa

SEQ ID NO: 1098942 - RNA, 19 nt, Homo sapiens
gaacaauggauucgagcua

SEQ ID NO: 1098943 - RNA, 19 nt, Homo sapiens
gaaauaaucagacaaaucc

SEQ ID NO: 1098944 - RNA, 19 nt, Homo sapiens
ggaggcugcucuauuacaa

SEQ ID NO: 1098945 - RNA, 19 nt, Homo sapiens
ggaacaaggagcagggaua

SEQ ID NO: 1098946 - RNA, 19 nt, Homo sapiens
aagaggaacugaaugaaau

SEQ ID NO: 1098947 - RNA, 19 nt, Homo sapiens
ggaaauaaucagacaaauc

SEQ ID NO: 1098948 - RNA, 19 nt, Homo sapiens
gaggaaauaaucagacaaa

SEQ ID NO: 1098949 - RNA, 19 nt, Homo sapiens
ggaagcaccuugaaaaugu

SEQ ID NO: 1098950 - RNA, 19 nt, Homo sapiens
gaacaaggagcagggauau

SEQ ID NO: 1098951 - RNA, 19 nt, Homo sapiens
caaacaaggcuucauggaa

SEQ ID NO: 1098952 - RNA, 19 nt, Homo sapiens
guacagucuugccuucaaa

SEQ ID NO: 1098953 - RNA, 19 nt, Homo sapiens
gaagagccugggcaacaua

SEQ ID NO: 1098954 - RNA, 19 nt, Homo sapiens
gguguacucugcuaaguuc

SEQ ID NO: 1098955 - RNA, 19 nt, Homo sapiens
gauaugaagccuacgaaga

SEQ ID NO: 1098956 - RNA, 19 nt, Homo sapiens
agcggaggcugcucuauua

SEQ ID NO: 1098957 - RNA, 19 nt, Homo sapiens
uaugagagacgggaauuua

SEQ ID NO: 1098958 - RNA, 19 nt, Homo sapiens
uuacuugucugccucuuug

SEQ ID NO: 1098959 - RNA, 19 nt, Homo sapiens
gagaagagccugggcaaca

SEQ ID NO: 1098960 - RNA, 19 nt, Homo sapiens
ggagcugggaggucucuua

SEQ ID NO: 1098961 - RNA, 19 nt, Homo sapiens
gcagaaauacacuggaugu

SEQ ID NO: 1098962 - RNA, 19 nt, Homo sapiens
agucugagcucgugccauu

SEQ ID NO: 1098963 - RNA, 19 nt, Homo sapiens
caacgacugccuggucuua

SEQ ID NO: 1098964 - RNA, 19 nt, Homo sapiens
ucagacaaauccacauuag

SEQ ID NO: 1098965 - RNA, 19 nt, Homo sapiens
caagcaccacgcagaaaua

SEQ ID NO: 1098966 - RNA, 19 nt, Homo sapiens
ccaucucgcucccagguaa

SEQ ID NO: 1098967 - RNA, 19 nt, Homo sapiens
ucacaaaggaacaggguaa

SEQ ID NO: 1098968 - RNA, 19 nt, Homo sapiens
uggcugaaauguuagagaa

SEQ ID NO: 1098969 - RNA, 19 nt, Homo sapiens
aaagaggaacugaaugaaa

SEQ ID NO: 1098970 - RNA, 19 nt, Homo sapiens
gguacagucuugccuucaa

SEQ ID NO: 1098971 - RNA, 19 nt, Homo sapiens
gguaaugaaugccuguagu

SEQ ID NO: 1098972 - RNA, 19 nt, Homo sapiens
gagcugggaggucucuuaa

SEQ ID NO: 1098973 - RNA, 19 nt, Homo sapiens
gaaagccggacucaccauu

SEQ ID NO: 1098974 - RNA, 19 nt, Homo sapiens
ggaaccuguuuguguauca

SEQ ID NO: 1098975 - RNA, 19 nt, Homo sapiens
ccgaggaaaucgcuggaaa

SEQ ID NO: 1098976 - RNA, 19 nt, Homo sapiens
caccguaacuucccugaca

SEQ ID NO: 1098977 - RNA, 19 nt, Homo sapiens
gcaggugacccauuaacug

SEQ ID NO: 1098978 - RNA, 19 nt, Homo sapiens
agcagcaggugacccauua

SEQ ID NO: 1098979 - RNA, 19 nt, Homo sapiens
acaaggagcagggauauga

SEQ ID NO: 1098980 - RNA, 19 nt, Homo sapiens
cgacaguauuguggaguuu

SEQ ID NO: 1098981 - RNA, 19 nt, Homo sapiens
cacuggauguucucucuuu

SEQ ID NO: 1098982 - RNA, 19 nt, Homo sapiens
gaccaccugugaacucugu

SEQ ID NO: 1098983 - RNA, 19 nt, Homo sapiens
guaugggacuuuccuuugg

SEQ ID NO: 1098984 - RNA, 19 nt, Homo sapiens
gaccaggaguucgagaaga

SEQ ID NO: 1098985 - RNA, 19 nt, Homo sapiens
gaagagugaaagauaaagu

SEQ ID NO: 1098986 - RNA, 19 nt, Homo sapiens
cuugcuggguugugcauua

SEQ ID NO: 1098987 - RNA, 19 nt, Homo sapiens
cuucucgacugcccagaua

SEQ ID NO: 1098988 - RNA, 19 nt, Homo sapiens
gagauugcgccauugcauu

SEQ ID NO: 1098989 - RNA, 19 nt, Homo sapiens
cugaggaucuggugcauag

SEQ ID NO: 1098990 - RNA, 19 nt, Homo sapiens
aaucaaaggauaagcaaug

SEQ ID NO: 1098991 - RNA, 19 nt, Homo sapiens
cauugcaccacuuuacuua

SEQ ID NO: 1098992 - RNA, 19 nt, Homo sapiens
ggauucgagcuaaguauga

SEQ ID NO: 1098993 - RNA, 19 nt, Homo sapiens
cgacugggccucuuacaag

SEQ ID NO: 1098994 - RNA, 19 nt, Homo sapiens
cagcuacuccggacacuga

SEQ ID NO: 1098995 - RNA, 19 nt, Homo sapiens
aaaauuagcuggacauggu

SEQ ID NO: 1098996 - RNA, 19 nt, Homo sapiens
ugacaucagcagaguuaaa

SEQ ID NO: 1098997 - RNA, 19 nt, Homo sapiens
aacaauggauucgagcuaa

SEQ ID NO: 1098998 - RNA, 19 nt, Homo sapiens
uuaaaucugugcgacuuga

SEQ ID NO: 1098999 - RNA, 19 nt, Homo sapiens
aagauaaaguagucaaugg

SEQ ID NO: 1099000 - RNA, 19 nt, Homo sapiens
gagauggccacaccaggaa

SEQ ID NO: 1099001 - RNA, 19 nt, Homo sapiens
gcugaaauguuagagaaac

SEQ ID NO: 1099002 - RNA, 19 nt, Homo sapiens
caggugacccauuaacuga

SEQ ID NO: 1099003 - RNA, 19 nt, Homo sapiens
auaguggacugguucaaug

SEQ ID NO: 1099004 - RNA, 19 nt, Homo sapiens
caagagaaggccuccugaa

SEQ ID NO: 1099005 - RNA, 19 nt, Homo sapiens
ccaagggcauccgaggaaa

SEQ ID NO: 1099006 - RNA, 19 nt, Homo sapiens
gacaucagcagaguuaaau

SEQ ID NO: 1099007 - RNA, 19 nt, Homo sapiens
gcucccagguaaccgagaa

SEQ ID NO: 1099008 - RNA, 19 nt, Homo sapiens
ggauugagaccaggaguuc

SEQ ID NO: 1099009 - RNA, 19 nt, Homo sapiens
agugaaagauaaaguaguc

SEQ ID NO: 1099010 - RNA, 19 nt, Homo sapiens
gaaucuaaccaugaggaaa

SEQ ID NO: 1099011 - RNA, 19 nt, Homo sapiens
ggaacuccuugugggaaga

SEQ ID NO: 1099012 - RNA, 19 nt, Homo sapiens
agaaggaacagcaggaaug

SEQ ID NO: 1099013 - RNA, 19 nt, Homo sapiens
gauaguggacugguucaau

SEQ ID NO: 1099014 - RNA, 19 nt, Homo sapiens
ggucuuaaaggaacaaugg

SEQ ID NO: 1099015 - RNA, 19 nt, Homo sapiens
gcuguggcuuuauccauca

SEQ ID NO: 1099016 - RNA, 19 nt, Homo sapiens
ggaauggcuggaaaguuug

SEQ ID NO: 1099017 - RNA, 19 nt, Homo sapiens
aauggaaaccuccguguga

SEQ ID NO: 1099018 - RNA, 19 nt, Homo sapiens
gcauuaagggccaguuuac

SEQ ID NO: 1099019 - RNA, 19 nt, Homo sapiens
agaaauacacuggauguuc

SEQ ID NO: 1099020 - RNA, 19 nt, Homo sapiens
gacaguauuguggaguuua

SEQ ID NO: 1099021 - RNA, 19 nt, Homo sapiens
acaguauuguggaguuuau

SEQ ID NO: 1099022 - RNA, 19 nt, Homo sapiens
gaaggaacagcaggaaugg

SEQ ID NO: 1099023 - RNA, 19 nt, Homo sapiens
gaaccuguuuguguaucau

SEQ ID NO: 1099024 - RNA, 19 nt, Homo sapiens
ugagagacgggaauuuaug

SEQ ID NO: 1099025 - RNA, 19 nt, Homo sapiens
ggaaaagacugggccaaag

SEQ ID NO: 1099026 - RNA, 19 nt, Homo sapiens
gaaagugggaaggagauag

SEQ ID NO: 1099027 - RNA, 19 nt, Homo sapiens
acgacugccuggucuuaaa

SEQ ID NO: 1099028 - RNA, 19 nt, Homo sapiens
aaucugaaucuaaccauga

SEQ ID NO: 1099029 - RNA, 19 nt, Homo sapiens
gcggagauuuguccucacu

SEQ ID NO: 1099030 - RNA, 19 nt, Homo sapiens
agacugggccaaagcagaa

SEQ ID NO: 1099031 - RNA, 19 nt, Homo sapiens
caccaggaacuaccucaaa

SEQ ID NO: 1099032 - RNA, 19 nt, Homo sapiens
gaacuucacuccuuacuua

SEQ ID NO: 1099033 - RNA, 19 nt, Homo sapiens
gaaagcagaugucacguuu

SEQ ID NO: 1099034 - RNA, 19 nt, Homo sapiens
gcaagaaucugugaaauug

SEQ ID NO: 1099035 - RNA, 19 nt, Homo sapiens
caacaaagaucaucaaugc

SEQ ID NO: 1099036 - RNA, 19 nt, Homo sapiens
gagacacucuggcauauuu

SEQ ID NO: 1099037 - RNA, 19 nt, Homo sapiens
gacaagugcuuuaauuuga

SEQ ID NO: 1099038 - RNA, 19 nt, Homo sapiens
gcuggaagcuuguuucuga

SEQ ID NO: 1099039 - RNA, 19 nt, Homo sapiens
ggaaucucguggaguauua

SEQ ID NO: 1099040 - RNA, 19 nt, Homo sapiens
cggaagagcuuauuaugaa

SEQ ID NO: 1099041 - RNA, 19 nt, Homo sapiens
gcaagaaugucaacagugu

SEQ ID NO: 1099042 - RNA, 19 nt, Homo sapiens
gcagaugucacguuuguua

SEQ ID NO: 1099043 - RNA, 19 nt, Homo sapiens
gaauuuagaccacaaugua

SEQ ID NO: 1099044 - RNA, 19 nt, Homo sapiens
gaagagggaugguaugaag

SEQ ID NO: 1099045 - RNA, 19 nt, Homo sapiens
gaagacaaaccaaugcaua

SEQ ID NO: 1099046 - RNA, 19 nt, Homo sapiens
uaaaguguauucccaggua

SEQ ID NO: 1099047 - RNA, 19 nt, Homo sapiens
ugaaaccaaucaacaagua

SEQ ID NO: 1099048 - RNA, 19 nt, Homo sapiens
uaucuucccuaaagucuua

SEQ ID NO: 1099049 - RNA, 19 nt, Homo sapiens
gguaauauuucuuccuuga

SEQ ID NO: 1099050 - RNA, 19 nt, Homo sapiens
gcugaaagacuguggcuua

SEQ ID NO: 1099051 - RNA, 19 nt, Homo sapiens
ggaugaaguugaccaguga

SEQ ID NO: 1099052 - RNA, 19 nt, Homo sapiens
ucaaggaagugguuaauca

SEQ ID NO: 1099053 - RNA, 19 nt, Homo sapiens
gcaaacgagacaagaaaua

SEQ ID NO: 1099054 - RNA, 19 nt, Homo sapiens
caaagaucaucaaugcuaa

SEQ ID NO: 1099055 - RNA, 19 nt, Homo sapiens
ccagagagcuuugcccauu

SEQ ID NO: 1099056 - RNA, 19 nt, Homo sapiens
ggaaaacacuuuaacaguu

SEQ ID NO: 1099057 - RNA, 19 nt, Homo sapiens
gaaagacuguggcuuaucg

SEQ ID NO: 1099058 - RNA, 19 nt, Homo sapiens
gcaagacacuuaaaauuug

SEQ ID NO: 1099059 - RNA, 19 nt, Homo sapiens
ucaagcaacuuaccagcua

SEQ ID NO: 1099060 - RNA, 19 nt, Homo sapiens
aaacaggucucauggugaa

SEQ ID NO: 1099061 - RNA, 19 nt, Homo sapiens
ggagugauguacuaugaug

SEQ ID NO: 1099062 - RNA, 19 nt, Homo sapiens
ggccaguauugcuuuauua

SEQ ID NO: 1099063 - RNA, 19 nt, Homo sapiens
gagcaggguuagugugaaa

SEQ ID NO: 1099064 - RNA, 19 nt, Homo sapiens
gaaaguaagccauaacagu

SEQ ID NO: 1099065 - RNA, 19 nt, Homo sapiens
aaaugcagcuuuccaauca

SEQ ID NO: 1099066 - RNA, 19 nt, Homo sapiens
gaaagaccaucaagcaacu

SEQ ID NO: 1099067 - RNA, 19 nt, Homo sapiens
ggagaaagaccaucaagca

SEQ ID NO: 1099068 - RNA, 19 nt, Homo sapiens
caacugugauccaucuuau

SEQ ID NO: 1099069 - RNA, 19 nt, Homo sapiens
ucauuuaucugguagcaaa

SEQ ID NO: 1099070 - RNA, 19 nt, Homo sapiens
ggaaaagacugguacaaau

SEQ ID NO: 1099071 - RNA, 19 nt, Homo sapiens
gaugagagaaggaugcuuu

SEQ ID NO: 1099072 - RNA, 19 nt, Homo sapiens
ccaaggagcccaaggaguu

SEQ ID NO: 1099073 - RNA, 19 nt, Homo sapiens
gaagaagcauuagaacagu

SEQ ID NO: 1099074 - RNA, 19 nt, Homo sapiens
gguagcaaaucgucaguga

SEQ ID NO: 1099075 - RNA, 19 nt, Homo sapiens
gagcaaacgagacaagaaa

SEQ ID NO: 1099076 - RNA, 19 nt, Homo sapiens
caguagcuauguuugguua

SEQ ID NO: 1099077 - RNA, 19 nt, Homo sapiens
uacaaaguguguugcauuu

SEQ ID NO: 1099078 - RNA, 19 nt, Homo sapiens
ccuacgaggucaacuauau

SEQ ID NO: 1099079 - RNA, 19 nt, Homo sapiens
gaaggaaagaauacugaaa

SEQ ID NO: 1099080 - RNA, 19 nt, Homo sapiens
caaacgagacaagaaauaa

SEQ ID NO: 1099081 - RNA, 19 nt, Homo sapiens
ugaaugcgaugcuguggaa

SEQ ID NO: 1099082 - RNA, 19 nt, Homo sapiens
ggaagcuuguuucugauug

SEQ ID NO: 1099083 - RNA, 19 nt, Homo sapiens
caaagaauuuagaccacaa

SEQ ID NO: 1099084 - RNA, 19 nt, Homo sapiens
cuaagggucucucuauuuc

SEQ ID NO: 1099085 - RNA, 19 nt, Homo sapiens
acaaagaucaucaaugcua

SEQ ID NO: 1099086 - RNA, 19 nt, Homo sapiens
aagggaaucucguggagua

SEQ ID NO: 1099087 - RNA, 19 nt, Homo sapiens
ccgaguggcugggauuaua

SEQ ID NO: 1099088 - RNA, 19 nt, Homo sapiens
gaaaacacuuuaacaguuc

SEQ ID NO: 1099089 - RNA, 19 nt, Homo sapiens
uaggagugauguacuauga

SEQ ID NO: 1099090 - RNA, 19 nt, Homo sapiens
ggaaugagcacuagaaagc

SEQ ID NO: 1099091 - RNA, 19 nt, Homo sapiens
gggauggguugcucauuug

SEQ ID NO: 1099092 - RNA, 19 nt, Homo sapiens
aaaccaaugcauagacuua

SEQ ID NO: 1099093 - RNA, 19 nt, Homo sapiens
gaauacacauugcagaaaa

SEQ ID NO: 1099094 - RNA, 19 nt, Homo sapiens
gccaaggaguaaauacaaa

SEQ ID NO: 1099095 - RNA, 19 nt, Homo sapiens
gagcuaaggaggccaguug

SEQ ID NO: 1099096 - RNA, 19 nt, Homo sapiens
guagcuauguuugguuauu

SEQ ID NO: 1099097 - RNA, 19 nt, Homo sapiens
caaccgcuaaacacuauua

SEQ ID NO: 1099098 - RNA, 19 nt, Homo sapiens
acccagcccugcacuguua

SEQ ID NO: 1099099 - RNA, 19 nt, Homo sapiens
uaccuuaucuucccuaaag

SEQ ID NO: 1099100 - RNA, 19 nt, Homo sapiens
gagcuuugcccauugaaga

SEQ ID NO: 1099101 - RNA, 19 nt, Homo sapiens
uauuuaagcuucccuugga

SEQ ID NO: 1099102 - RNA, 19 nt, Homo sapiens
ugaagacacugauuuacca

SEQ ID NO: 1099103 - RNA, 19 nt, Homo sapiens
aaacaaccgcuaaacacua

SEQ ID NO: 1099104 - RNA, 19 nt, Homo sapiens
cagguaauauuucuuccuu

SEQ ID NO: 1099105 - RNA, 19 nt, Homo sapiens
aagcagaugucacguuugu

SEQ ID NO: 1099106 - RNA, 19 nt, Homo sapiens
gcuuauagaauacacauug

SEQ ID NO: 1099107 - RNA, 19 nt, Homo sapiens
caucacaaauuacacuauc

SEQ ID NO: 1099108 - RNA, 19 nt, Homo sapiens
ucaggaaccuuugcuggaa

SEQ ID NO: 1099109 - RNA, 19 nt, Homo sapiens
guaugaagaagcauuagaa

SEQ ID NO: 1099110 - RNA, 19 nt, Homo sapiens
cauugcagcucuugaagga

SEQ ID NO: 1099111 - RNA, 19 nt, Homo sapiens
uaacauggcaauccaauac

SEQ ID NO: 1099112 - RNA, 19 nt, Homo sapiens
gguguuaaacgaucaaaug

SEQ ID NO: 1099113 - RNA, 19 nt, Homo sapiens
ggaagagcuuauuaugaag

SEQ ID NO: 1099114 - RNA, 19 nt, Homo sapiens
ucccaaagcaagacacuua

SEQ ID NO: 1099115 - RNA, 19 nt, Homo sapiens
gagaaagaccaucaagcaa

SEQ ID NO: 1099116 - RNA, 19 nt, Homo sapiens
ggaaugccaaggaguaaau

SEQ ID NO: 1099117 - RNA, 19 nt, Homo sapiens
uuacacccaugcuaauuug

SEQ ID NO: 1099118 - RNA, 19 nt, Homo sapiens
cagauuacacccaugcuaa

SEQ ID NO: 1099119 - RNA, 19 nt, Homo sapiens
gauggaauuccuuaccuuu

SEQ ID NO: 1099120 - RNA, 19 nt, Homo sapiens
uuaaggacaugcuucuaga

SEQ ID NO: 1099121 - RNA, 19 nt, Homo sapiens
gaaacaaccgcuaaacacu

SEQ ID NO: 1099122 - RNA, 19 nt, Homo sapiens
ccaaaaggaucgcugacua

SEQ ID NO: 1099123 - RNA, 19 nt, Homo sapiens
ugugaaggcucaaaguaug

SEQ ID NO: 1099124 - RNA, 19 nt, Homo sapiens
gagauggaguuucgcucuu

SEQ ID NO: 1099125 - RNA, 19 nt, Homo sapiens
agggauggguugcucauuu

SEQ ID NO: 1099126 - RNA, 19 nt, Homo sapiens
ucacguuuguuaaagagaa

SEQ ID NO: 1099127 - RNA, 19 nt, Homo sapiens
agacaagugcuuuaauuug

SEQ ID NO: 1099128 - RNA, 19 nt, Homo sapiens
ggaaacgucuaugcucaag

SEQ ID NO: 1099129 - RNA, 19 nt, Homo sapiens
ccaccaaucaggaaccuuu

SEQ ID NO: 1099130 - RNA, 19 nt, Homo sapiens
gcacuagaaagcaagaaug

SEQ ID NO: 1099131 - RNA, 19 nt, Homo sapiens
caaguauuguuuguuguug

SEQ ID NO: 1099132 - RNA, 19 nt, Homo sapiens
gaaggaaucaacacagaaa

SEQ ID NO: 1099133 - RNA, 19 nt, Homo sapiens
ggacugggcuguguuccaa

SEQ ID NO: 1099134 - RNA, 19 nt, Homo sapiens
gcacugcccuuuccuucug

SEQ ID NO: 1099135 - RNA, 19 nt, Homo sapiens
ggaccaagagcaucaaaga

SEQ ID NO: 1099136 - RNA, 19 nt, Homo sapiens
ccagagggauggagagaug

SEQ ID NO: 1099137 - RNA, 19 nt, Homo sapiens
cagaaggaaucaacacaga

SEQ ID NO: 1099138 - RNA, 19 nt, Homo sapiens
gaacaaagggcucauucuc

SEQ ID NO: 1099139 - RNA, 19 nt, Homo sapiens
ccauuaaagucuguuguuu

SEQ ID NO: 1099140 - RNA, 19 nt, Homo sapiens
ccagagcgcccaucacuga

SEQ ID NO: 1099141 - RNA, 19 nt, Homo sapiens
ggagagugauggagaguac

SEQ ID NO: 1099142 - RNA, 19 nt, Homo sapiens
caugaccucuccagacauu

SEQ ID NO: 1099143 - RNA, 19 nt, Homo sapiens
ccacaaccuuccugcaaug

SEQ ID NO: 1099144 - RNA, 19 nt, Homo sapiens
ccgcuucccuccuucauga

SEQ ID NO: 1099145 - RNA, 19 nt, Homo sapiens
ggccugagcuucgcccaaa

SEQ ID NO: 1099146 - RNA, 19 nt, Homo sapiens
gguggaagauggcaaagag

SEQ ID NO: 1099147 - RNA, 19 nt, Homo sapiens
cuacaaggauccgagcauu

SEQ ID NO: 1099148 - RNA, 19 nt, Homo sapiens
ggaaggaggccaugcuuac

SEQ ID NO: 1099149 - RNA, 19 nt, Homo sapiens
caaaagaucuggggagugu

SEQ ID NO: 1099150 - RNA, 19 nt, Homo sapiens
ggaccaagaaccucugugu

SEQ ID NO: 1099151 - RNA, 19 nt, Homo sapiens
guacugcgcccuccaugga

SEQ ID NO: 1099152 - RNA, 19 nt, Homo sapiens
acaccaagcugaagaagac

SEQ ID NO: 1099153 - RNA, 19 nt, Homo sapiens
gcucacaccuguccuucuc

SEQ ID NO: 1099154 - RNA, 19 nt, Homo sapiens
cauuacaggaggccaaaua

SEQ ID NO: 1099155 - RNA, 19 nt, Homo sapiens
gcgaacugcuggcuucuac

SEQ ID NO: 1099156 - RNA, 19 nt, Homo sapiens
gaaucacgggcuccuguuu

SEQ ID NO: 1099157 - RNA, 19 nt, Homo sapiens
gaagaagacauggcucaca

SEQ ID NO: 1099158 - RNA, 19 nt, Homo sapiens
gaacccagcgaggaaguga

SEQ ID NO: 1099159 - RNA, 19 nt, Homo sapiens
guggccaucucaagaguga

SEQ ID NO: 1099160 - RNA, 19 nt, Homo sapiens
caugagggcaggagaguga

SEQ ID NO: 1099161 - RNA, 19 nt, Homo sapiens
gcaccacucugggcacaag

SEQ ID NO: 1099162 - RNA, 19 nt, Homo sapiens
gaggacagcccaggcauuc

SEQ ID NO: 1099163 - RNA, 19 nt, Homo sapiens
acacaucgauagggaacaa

SEQ ID NO: 1099164 - RNA, 19 nt, Homo sapiens
cauccuacccacccacuaa

SEQ ID NO: 1099165 - RNA, 19 nt, Homo sapiens
gggcuuggcaccuauagug

SEQ ID NO: 1099166 - RNA, 19 nt, Homo sapiens
ggacaugcucccacuugug

SEQ ID NO: 1099167 - RNA, 19 nt, Homo sapiens
cagcgucacucagcacuuc

SEQ ID NO: 1099168 - RNA, 19 nt, Homo sapiens
cauucuggcuuaaacaaca

SEQ ID NO: 1099169 - RNA, 19 nt, Homo sapiens
gcagccaggucagcacugu

SEQ ID NO: 1099170 - RNA, 19 nt, Homo sapiens
caacauccuggacagcauu

SEQ ID NO: 1099171 - RNA, 19 nt, Homo sapiens
aacggaagauccaggagaa

SEQ ID NO: 1099172 - RNA, 19 nt, Homo sapiens
cccaugaccucuccagaca

SEQ ID NO: 1099173 - RNA, 19 nt, Homo sapiens
gcaagggcuuuuacuacaa

SEQ ID NO: 1099174 - RNA, 19 nt, Homo sapiens
gggaaacuugggaaucauu

SEQ ID NO: 1099175 - RNA, 19 nt, Homo sapiens
cagauggacugggcugugu

SEQ ID NO: 1099176 - RNA, 19 nt, Homo sapiens
gcccucugccuucagcuua

SEQ ID NO: 1099177 - RNA, 19 nt, Homo sapiens
cuucugcccuccugccaaa

SEQ ID NO: 1099178 - RNA, 19 nt, Homo sapiens
gcacagucagcgucacuca

SEQ ID NO: 1099179 - RNA, 19 nt, Homo sapiens
gagcugagcacugcaaugc

SEQ ID NO: 1099180 - RNA, 19 nt, Homo sapiens
caacuccagcucugaggaa

SEQ ID NO: 1099181 - RNA, 19 nt, Homo sapiens
gcucaaugccaaaguugug

SEQ ID NO: 1099182 - RNA, 19 nt, Homo sapiens
cugcaggcaugcugaacaa

SEQ ID NO: 1099183 - RNA, 19 nt, Homo sapiens
ggaacaaagggcucauucu

SEQ ID NO: 1099184 - RNA, 19 nt, Homo sapiens
gggaacaaagggcucauuc

SEQ ID NO: 1099185 - RNA, 19 nt, Homo sapiens
ggacagcccaggcauucca

SEQ ID NO: 1099186 - RNA, 19 nt, Homo sapiens
gcauagugguggccaucuc

SEQ ID NO: 1099187 - RNA, 19 nt, Homo sapiens
gaagacacagccaccaacu

SEQ ID NO: 1099188 - RNA, 19 nt, Homo sapiens
cagcgaacccagcgaggaa

SEQ ID NO: 1099189 - RNA, 19 nt, Homo sapiens
uaaagucuguuguuuugug

SEQ ID NO: 1099190 - RNA, 19 nt, Homo sapiens
ccuucaugauuuccauuaa

SEQ ID NO: 1099191 - RNA, 19 nt, Homo sapiens
aaagugcccucugccuuca

SEQ ID NO: 1099192 - RNA, 19 nt, Homo sapiens
gccuggcucucccugcaaa

SEQ ID NO: 1099193 - RNA, 19 nt, Homo sapiens
agacaaacagcccuuccuu

SEQ ID NO: 1099194 - RNA, 19 nt, Homo sapiens
ugaccucuccagacauuug

SEQ ID NO: 1099195 - RNA, 19 nt, Homo sapiens
acucggagcaguuugaaug

SEQ ID NO: 1099196 - RNA, 19 nt, Homo sapiens
uggaaggaggccaugcuua

SEQ ID NO: 1099197 - RNA, 19 nt, Homo sapiens
caccauggacucuucaaca

SEQ ID NO: 1099198 - RNA, 19 nt, Homo sapiens
cugcaaaacuggcucaaug

SEQ ID NO: 1099199 - RNA, 19 nt, Homo sapiens
gcacucggagcaguuugaa

SEQ ID NO: 1099200 - RNA, 19 nt, Homo sapiens
ccaacauccuggacagcau

SEQ ID NO: 1099201 - RNA, 19 nt, Homo sapiens
gcagaaaggaccccaagau

SEQ ID NO: 1099202 - RNA, 19 nt, Homo sapiens
gcagcaagggcuuuuacua

SEQ ID NO: 1099203 - RNA, 19 nt, Homo sapiens
aagagggacugcgcuggaa

SEQ ID NO: 1099204 - RNA, 19 nt, Homo sapiens
gacagcaugaugagcagaa

SEQ ID NO: 1099205 - RNA, 19 nt, Homo sapiens
cgauagggaacaaggaugu

SEQ ID NO: 1099206 - RNA, 19 nt, Homo sapiens
ggcaauugacuuccuccaa

SEQ ID NO: 1099207 - RNA, 19 nt, Homo sapiens
cuucccuccuucaugauuu

SEQ ID NO: 1099208 - RNA, 19 nt, Homo sapiens
ccgagacccaggagacaaa

SEQ ID NO: 1099209 - RNA, 19 nt, Homo sapiens
uuacaggaggccaaauaga

SEQ ID NO: 1099210 - RNA, 19 nt, Homo sapiens
ggaagauccaggagaaagc

SEQ ID NO: 1099211 - RNA, 19 nt, Homo sapiens
uccacaaccuuccugcaau

SEQ ID NO: 1099212 - RNA, 19 nt, Homo sapiens
agaaggaaucaacacagaa

SEQ ID NO: 1099213 - RNA, 19 nt, Homo sapiens
gccaggcgaugggaaccuu

SEQ ID NO: 1099214 - RNA, 19 nt, Homo sapiens
agaacggcaucgugagaca

SEQ ID NO: 1099215 - RNA, 19 nt, Homo sapiens
gacauuacaggaggccaaa

SEQ ID NO: 1099216 - RNA, 19 nt, Homo sapiens
ggccaugagcgaauacaca

SEQ ID NO: 1099217 - RNA, 19 nt, Homo sapiens
gcagcaggaggaagacaca

SEQ ID NO: 1099218 - RNA, 19 nt, Homo sapiens
agagaacggcaucgugaga

SEQ ID NO: 1099219 - RNA, 19 nt, Homo sapiens
gggagaggaaggucaacug

SEQ ID NO: 1099220 - RNA, 19 nt, Homo sapiens
gauuuccauuaaagucugu

SEQ ID NO: 1099221 - RNA, 19 nt, Homo sapiens
caagcagggcacucuguuc

SEQ ID NO: 1099222 - RNA, 19 nt, Homo sapiens
gauggacugggcuguguuc

SEQ ID NO: 1099223 - RNA, 19 nt, Homo sapiens
aacucaaccuggcuuccua

SEQ ID NO: 1099224 - RNA, 19 nt, Homo sapiens
gucugccacuuccggagua

SEQ ID NO: 1099225 - RNA, 19 nt, Homo sapiens
gaccaagagcaucaaagag

SEQ ID NO: 1099226 - RNA, 19 nt, Homo sapiens
caacacccacuggcgaugu

SEQ ID NO: 1099227 - RNA, 19 nt, Homo sapiens
ggugcgggacacaucgaua

SEQ ID NO: 1099228 - RNA, 19 nt, Homo sapiens
gaaggaaucaacacagaaa

SEQ ID NO: 1099229 - RNA, 19 nt, Homo sapiens
ggacugggcuguguuccaa

SEQ ID NO: 1099230 - RNA, 19 nt, Homo sapiens
gcacugcccuuuccuucug

SEQ ID NO: 1099231 - RNA, 19 nt, Homo sapiens
ggaccaagagcaucaaaga

SEQ ID NO: 1099232 - RNA, 19 nt, Homo sapiens
ccagagggauggagagaug

SEQ ID NO: 1099233 - RNA, 19 nt, Homo sapiens
cagaaggaaucaacacaga

SEQ ID NO: 1099234 - RNA, 19 nt, Homo sapiens
gaacaaagggcucauucuc

SEQ ID NO: 1099235 - RNA, 19 nt, Homo sapiens
ccauuaaagucuguuguuu

SEQ ID NO: 1099236 - RNA, 19 nt, Homo sapiens
ccagagcgcccaucacuga

SEQ ID NO: 1099237 - RNA, 19 nt, Homo sapiens
ggagagugauggagaguac

SEQ ID NO: 1099238 - RNA, 19 nt, Homo sapiens
caugaccucuccagacauu

SEQ ID NO: 1099239 - RNA, 19 nt, Homo sapiens
ccacaaccuuccugcaaug

SEQ ID NO: 1099240 - RNA, 19 nt, Homo sapiens
ccgcuucccuccuucauga

SEQ ID NO: 1099241 - RNA, 19 nt, Homo sapiens
ggccugagcuucgcccaaa

SEQ ID NO: 1099242 - RNA, 19 nt, Homo sapiens
gguggaagauggcaaagag

SEQ ID NO: 1099243 - RNA, 19 nt, Homo sapiens
cuacaaggauccgagcauu

SEQ ID NO: 1099244 - RNA, 19 nt, Homo sapiens
ggaaggaggccaugcuuac

SEQ ID NO: 1099245 - RNA, 19 nt, Homo sapiens
caaaagaucuggggagugu

SEQ ID NO: 1099246 - RNA, 19 nt, Homo sapiens
ggaccaagaaccucugugu

SEQ ID NO: 1099247 - RNA, 19 nt, Homo sapiens
guacugcgcccuccaugga

SEQ ID NO: 1099248 - RNA, 19 nt, Homo sapiens
acaccaagcugaagaagac

SEQ ID NO: 1099249 - RNA, 19 nt, Homo sapiens
gcucacaccuguccuucuc

SEQ ID NO: 1099250 - RNA, 19 nt, Homo sapiens
cauuacaggaggccaaaua

SEQ ID NO: 1099251 - RNA, 19 nt, Homo sapiens
gcgaacugcuggcuucuac

SEQ ID NO: 1099252 - RNA, 19 nt, Homo sapiens
gaaucacgggcuccuguuu

SEQ ID NO: 1099253 - RNA, 19 nt, Homo sapiens
gaagaagacauggcucaca

SEQ ID NO: 1099254 - RNA, 19 nt, Homo sapiens
gaacccagcgaggaaguga

SEQ ID NO: 1099255 - RNA, 19 nt, Homo sapiens
guggccaucucaagaguga

SEQ ID NO: 1099256 - RNA, 19 nt, Homo sapiens
caugagggcaggagaguga

SEQ ID NO: 1099257 - RNA, 19 nt, Homo sapiens
gcaccacucugggcacaag

SEQ ID NO: 1099258 - RNA, 19 nt, Homo sapiens
gaggacagcccaggcauuc

SEQ ID NO: 1099259 - RNA, 19 nt, Homo sapiens
acacaucgauagggaacaa

SEQ ID NO: 1099260 - RNA, 19 nt, Homo sapiens
cauccuacccacccacuaa

SEQ ID NO: 1099261 - RNA, 19 nt, Homo sapiens
gggcuuggcaccuauagug

SEQ ID NO: 1099262 - RNA, 19 nt, Homo sapiens
ggacaugcucccacuugug

SEQ ID NO: 1099263 - RNA, 19 nt, Homo sapiens
cagcgucacucagcacuuc

SEQ ID NO: 1099264 - RNA, 19 nt, Homo sapiens
cauucuggcuuaaacaaca

SEQ ID NO: 1099265 - RNA, 19 nt, Homo sapiens
gcagccaggucagcacugu

SEQ ID NO: 1099266 - RNA, 19 nt, Homo sapiens
caacauccuggacagcauu

SEQ ID NO: 1099267 - RNA, 19 nt, Homo sapiens
aacggaagauccaggagaa

SEQ ID NO: 1099268 - RNA, 19 nt, Homo sapiens
cccaugaccucuccagaca

SEQ ID NO: 1099269 - RNA, 19 nt, Homo sapiens
gcaagggcuuuuacuacaa

SEQ ID NO: 1099270 - RNA, 19 nt, Homo sapiens
gggaaacuugggaaucauu

SEQ ID NO: 1099271 - RNA, 19 nt, Homo sapiens
cagauggacugggcugugu

SEQ ID NO: 1099272 - RNA, 19 nt, Homo sapiens
gcccucugccuucagcuua

SEQ ID NO: 1099273 - RNA, 19 nt, Homo sapiens
cuucugcccuccugccaaa

SEQ ID NO: 1099274 - RNA, 19 nt, Homo sapiens
gcacagucagcgucacuca

SEQ ID NO: 1099275 - RNA, 19 nt, Homo sapiens
gagcugagcacugcaaugc

SEQ ID NO: 1099276 - RNA, 19 nt, Homo sapiens
caacuccagcucugaggaa

SEQ ID NO: 1099277 - RNA, 19 nt, Homo sapiens
gcucaaugccaaaguugug

SEQ ID NO: 1099278 - RNA, 19 nt, Homo sapiens
cugcaggcaugcugaacaa

SEQ ID NO: 1099279 - RNA, 19 nt, Homo sapiens
ggaacaaagggcucauucu

SEQ ID NO: 1099280 - RNA, 19 nt, Homo sapiens
gggaacaaagggcucauuc

SEQ ID NO: 1099281 - RNA, 19 nt, Homo sapiens
ggacagcccaggcauucca

SEQ ID NO: 1099282 - RNA, 19 nt, Homo sapiens
gcauagugguggccaucuc

SEQ ID NO: 1099283 - RNA, 19 nt, Homo sapiens
gaagacacagccaccaacu

SEQ ID NO: 1099284 - RNA, 19 nt, Homo sapiens
cagcgaacccagcgaggaa

SEQ ID NO: 1099285 - RNA, 19 nt, Homo sapiens
uaaagucuguuguuuugug

SEQ ID NO: 1099286 - RNA, 19 nt, Homo sapiens
ccuucaugauuuccauuaa

SEQ ID NO: 1099287 - RNA, 19 nt, Homo sapiens
aaagugcccucugccuuca

SEQ ID NO: 1099288 - RNA, 19 nt, Homo sapiens
gccuggcucucccugcaaa

SEQ ID NO: 1099289 - RNA, 19 nt, Homo sapiens
agacaaacagcccuuccuu

SEQ ID NO: 1099290 - RNA, 19 nt, Homo sapiens
ugaccucuccagacauuug

SEQ ID NO: 1099291 - RNA, 19 nt, Homo sapiens
acucggagcaguuugaaug

SEQ ID NO: 1099292 - RNA, 19 nt, Homo sapiens
uggaaggaggccaugcuua

SEQ ID NO: 1099293 - RNA, 19 nt, Homo sapiens
caccauggacucuucaaca

SEQ ID NO: 1099294 - RNA, 19 nt, Homo sapiens
cugcaaaacuggcucaaug

SEQ ID NO: 1099295 - RNA, 19 nt, Homo sapiens
gcacucggagcaguuugaa

SEQ ID NO: 1099296 - RNA, 19 nt, Homo sapiens
ccaacauccuggacagcau

SEQ ID NO: 1099297 - RNA, 19 nt, Homo sapiens
gcagaaaggaccccaagau

SEQ ID NO: 1099298 - RNA, 19 nt, Homo sapiens
gcagcaagggcuuuuacua

SEQ ID NO: 1099299 - RNA, 19 nt, Homo sapiens
aagagggacugcgcuggaa

SEQ ID NO: 1099300 - RNA, 19 nt, Homo sapiens
gacagcaugaugagcagaa

SEQ ID NO: 1099301 - RNA, 19 nt, Homo sapiens
cgauagggaacaaggaugu

SEQ ID NO: 1099302 - RNA, 19 nt, Homo sapiens
ggcaauugacuuccuccaa

SEQ ID NO: 1099303 - RNA, 19 nt, Homo sapiens
cuucccuccuucaugauuu

SEQ ID NO: 1099304 - RNA, 19 nt, Homo sapiens
ccgagacccaggagacaaa

SEQ ID NO: 1099305 - RNA, 19 nt, Homo sapiens
uuacaggaggccaaauaga

SEQ ID NO: 1099306 - RNA, 19 nt, Homo sapiens
ggaagauccaggagaaagc

SEQ ID NO: 1099307 - RNA, 19 nt, Homo sapiens
uccacaaccuuccugcaau

SEQ ID NO: 1099308 - RNA, 19 nt, Homo sapiens
agaaggaaucaacacagaa

SEQ ID NO: 1099309 - RNA, 19 nt, Homo sapiens
gccaggcgaugggaaccuu

SEQ ID NO: 1099310 - RNA, 19 nt, Homo sapiens
agaacggcaucgugagaca

SEQ ID NO: 1099311 - RNA, 19 nt, Homo sapiens
gacauuacaggaggccaaa

SEQ ID NO: 1099312 - RNA, 19 nt, Homo sapiens
ggccaugagcgaauacaca

SEQ ID NO: 1099313 - RNA, 19 nt, Homo sapiens
gcagcaggaggaagacaca

SEQ ID NO: 1099314 - RNA, 19 nt, Homo sapiens
agagaacggcaucgugaga

SEQ ID NO: 1099315 - RNA, 19 nt, Homo sapiens
gggagaggaaggucaacug

SEQ ID NO: 1099316 - RNA, 19 nt, Homo sapiens
gauuuccauuaaagucugu

SEQ ID NO: 1099317 - RNA, 19 nt, Homo sapiens
caagcagggcacucuguuc

SEQ ID NO: 1099318 - RNA, 19 nt, Homo sapiens
gauggacugggcuguguuc

SEQ ID NO: 1099319 - RNA, 19 nt, Homo sapiens
aacucaaccuggcuuccua

SEQ ID NO: 1099320 - RNA, 19 nt, Homo sapiens
gucugccacuuccggagua

SEQ ID NO: 1099321 - RNA, 19 nt, Homo sapiens
gaccaagagcaucaaagag

SEQ ID NO: 1099322 - RNA, 19 nt, Homo sapiens
caacacccacuggcgaugu

SEQ ID NO: 1099323 - RNA, 19 nt, Homo sapiens
ggugcgggacacaucgaua

SEQ ID NO: 1099324 - RNA, 19 nt, Homo sapiens
ggacaagacucucucaaga

SEQ ID NO: 1099325 - RNA, 19 nt, Homo sapiens
ggaguuaucugauucuaga

SEQ ID NO: 1099326 - RNA, 19 nt, Homo sapiens
gcacagagaacauuaaaga

SEQ ID NO: 1099327 - RNA, 19 nt, Homo sapiens
ggaagcggcugaucuuuua

SEQ ID NO: 1099328 - RNA, 19 nt, Homo sapiens
uaauugagguucugaaguu

SEQ ID NO: 1099329 - RNA, 19 nt, Homo sapiens
ggaagcggcuacacgauga

SEQ ID NO: 1099330 - RNA, 19 nt, Homo sapiens
gagccuggauuuacagaaa

SEQ ID NO: 1099331 - RNA, 19 nt, Homo sapiens
gauggcaaauggcuaauug

SEQ ID NO: 1099332 - RNA, 19 nt, Homo sapiens
gaacaaugcccucaacaca

SEQ ID NO: 1099333 - RNA, 19 nt, Homo sapiens
ggacagaggcacaaucaug

SEQ ID NO: 1099334 - RNA, 19 nt, Homo sapiens
aaagaaaggucucuacagu

SEQ ID NO: 1099335 - RNA, 19 nt, Homo sapiens
gaagaccuuucuaggaguu

SEQ ID NO: 1099336 - RNA, 19 nt, Homo sapiens
uaacuucacuacagauugu

SEQ ID NO: 1099337 - RNA, 19 nt, Homo sapiens
gcuacacgaugaagggaua

SEQ ID NO: 1099338 - RNA, 19 nt, Homo sapiens
gaaauaggaggccuucaga

SEQ ID NO: 1099339 - RNA, 19 nt, Homo sapiens
uuaaggagccucaaacaaa

SEQ ID NO: 1099340 - RNA, 19 nt, Homo sapiens
ggaaggacguccgcuacuu

SEQ ID NO: 1099341 - RNA, 19 nt, Homo sapiens
aaauacagcuucgaaauag

SEQ ID NO: 1099342 - RNA, 19 nt, Homo sapiens
ugugaaaucuugaagguau

SEQ ID NO: 1099343 - RNA, 19 nt, Homo sapiens
ggaagagccaggacacaaa

SEQ ID NO: 1099344 - RNA, 19 nt, Homo sapiens
caagauggcaaauggcuaa

SEQ ID NO: 1099345 - RNA, 19 nt, Homo sapiens
acaagacucucucaagaug

SEQ ID NO: 1099346 - RNA, 19 nt, Homo sapiens
gggaagcccugcacaugga

SEQ ID NO: 1099347 - RNA, 19 nt, Homo sapiens
caaagacgacccaaggaaa

SEQ ID NO: 1099348 - RNA, 19 nt, Homo sapiens
cagagaacauuaaagaaag

SEQ ID NO: 1099349 - RNA, 19 nt, Homo sapiens
acauauagaucugguuuga

SEQ ID NO: 1099350 - RNA, 19 nt, Homo sapiens
caacgcacagagaacauua

SEQ ID NO: 1099351 - RNA, 19 nt, Homo sapiens
gaaggacguccgcuacuug

SEQ ID NO: 1099352 - RNA, 19 nt, Homo sapiens
uaaggagccucaaacaaag

SEQ ID NO: 1099353 - RNA, 19 nt, Homo sapiens
ggugauggguggccaauac

SEQ ID NO: 1099354 - RNA, 19 nt, Homo sapiens
ccaggacggugucagagaa

SEQ ID NO: 1099355 - RNA, 19 nt, Homo sapiens
uuacuuaacuucacuacag

SEQ ID NO: 1099356 - RNA, 19 nt, Homo sapiens
gcggagcucucauuaaagg

SEQ ID NO: 1099357 - RNA, 19 nt, Homo sapiens
ccacaugggccaggagaua

SEQ ID NO: 1099358 - RNA, 19 nt, Homo sapiens
ggagcagugucaacaagga

SEQ ID NO: 1099359 - RNA, 19 nt, Homo sapiens
uuacaguugugaaaucuug

SEQ ID NO: 1099360 - RNA, 19 nt, Homo sapiens
cauaaaccaugacuucaag

SEQ ID NO: 1099361 - RNA, 19 nt, Homo sapiens
cggcugaucuuuuacauaa

SEQ ID NO: 1099362 - RNA, 19 nt, Homo sapiens
cagagaaaccaaagacuga

SEQ ID NO: 1099363 - RNA, 19 nt, Homo sapiens
caacaaggacgagacagaa

SEQ ID NO: 1099364 - RNA, 19 nt, Homo sapiens
cacuacagauugucuagaa

SEQ ID NO: 1099365 - RNA, 19 nt, Homo sapiens
gaacugccaaagccaagaa

SEQ ID NO: 1099366 - RNA, 19 nt, Homo sapiens
gccaggagauagacaguca

SEQ ID NO: 1099367 - RNA, 19 nt, Homo sapiens
cccagucacuccuuauauu

SEQ ID NO: 1099368 - RNA, 19 nt, Homo sapiens
ucauggagcucaacuacuc

SEQ ID NO: 1099369 - RNA, 19 nt, Homo sapiens
cagcagucaucccaccuaa

SEQ ID NO: 1099370 - RNA, 19 nt, Homo sapiens
gcaaggaggacaaccaucu

SEQ ID NO: 1099371 - RNA, 19 nt, Homo sapiens
guccuugucuuuaagcuau

SEQ ID NO: 1099372 - RNA, 19 nt, Homo sapiens
ggaucgaguuuacaguugu

SEQ ID NO: 1099373 - RNA, 19 nt, Homo sapiens
uuacauaaaccaugacuuc

SEQ ID NO: 1099374 - RNA, 19 nt, Homo sapiens
acaaugcccucaacacaca

SEQ ID NO: 1099375 - RNA, 19 nt, Homo sapiens
ggucuauacuuguccuugu

SEQ ID NO: 1099376 - RNA, 19 nt, Homo sapiens
gcaccacccuuuggcuuca

SEQ ID NO: 1099377 - RNA, 19 nt, Homo sapiens
gaggcacaaucauggaaga

SEQ ID NO: 1099378 - RNA, 19 nt, Homo sapiens
gugggaaucuugagacucu

SEQ ID NO: 1099379 - RNA, 19 nt, Homo sapiens
ggaaggcacccgggacuau

SEQ ID NO: 1099380 - RNA, 19 nt, Homo sapiens
gugaccaggugagugcuua

SEQ ID NO: 1099381 - RNA, 19 nt, Homo sapiens
gcacagagggcagcaugga

SEQ ID NO: 1099382 - RNA, 19 nt, Homo sapiens
gagacucuuuggccauuuc

SEQ ID NO: 1099383 - RNA, 19 nt, Homo sapiens
ggauacagugggaaucuug

SEQ ID NO: 1099384 - RNA, 19 nt, Homo sapiens
ggacucggacauccuucua

SEQ ID NO: 1099385 - RNA, 19 nt, Homo sapiens
guugugaaaucuugaaggu

SEQ ID NO: 1099386 - RNA, 19 nt, Homo sapiens
gacaagacucucucaagau

SEQ ID NO: 1099387 - RNA, 19 nt, Homo sapiens
gacccagucacuccuuaua

SEQ ID NO: 1099388 - RNA, 19 nt, Homo sapiens
gccuugcccucuuuuauua

SEQ ID NO: 1099389 - RNA, 19 nt, Homo sapiens
cgacuugcccugacucugu

SEQ ID NO: 1099390 - RNA, 19 nt, Homo sapiens
gcagucaucccaccuaagg

SEQ ID NO: 1099391 - RNA, 19 nt, Homo sapiens
gaagagccaggacacaaag

SEQ ID NO: 1099392 - RNA, 19 nt, Homo sapiens
gcauggaagagcccagaaa

SEQ ID NO: 1099393 - RNA, 19 nt, Homo sapiens
caaggaggacaaccaucua

SEQ ID NO: 1099394 - RNA, 19 nt, Homo sapiens
gaucgaguuuacaguugug

SEQ ID NO: 1099395 - RNA, 19 nt, Homo sapiens
gcacugcuuaugaaucaga

SEQ ID NO: 1099396 - RNA, 19 nt, Homo sapiens
gacuacguguuccgauuga

SEQ ID NO: 1099397 - RNA, 19 nt, Homo sapiens
ccacaccaccggagacaga

SEQ ID NO: 1099398 - RNA, 19 nt, Homo sapiens
uaagcuauuugacaacucu

SEQ ID NO: 1099399 - RNA, 19 nt, Homo sapiens
ucuaggaguuaucugauuc

SEQ ID NO: 1099400 - RNA, 19 nt, Homo sapiens
gugaaaucuugaagguauu

SEQ ID NO: 1099401 - RNA, 19 nt, Homo sapiens
uccaagcccuucaggaguu

SEQ ID NO: 1099402 - RNA, 19 nt, Homo sapiens
gggcugccauggucuccuu

SEQ ID NO: 1099403 - RNA, 19 nt, Homo sapiens
acagguuucugaggucuaa

SEQ ID NO: 1099404 - RNA, 19 nt, Homo sapiens
ccgccaacuucaaaucuga

SEQ ID NO: 1099405 - RNA, 19 nt, Homo sapiens
auacuuguccuugucuuua

SEQ ID NO: 1099406 - RNA, 19 nt, Homo sapiens
uuucugaucacuacuauga

SEQ ID NO: 1099407 - RNA, 19 nt, Homo sapiens
gcagagccagugccagaga

SEQ ID NO: 1099408 - RNA, 19 nt, Homo sapiens
gacuuucuccgauacauga

SEQ ID NO: 1099409 - RNA, 19 nt, Homo sapiens
ccagucacuccuuauauug

SEQ ID NO: 1099410 - RNA, 19 nt, Homo sapiens
ggucgacccaccaccauga

SEQ ID NO: 1099411 - RNA, 19 nt, Homo sapiens
acccagacuuucuccgaua

SEQ ID NO: 1099412 - RNA, 19 nt, Homo sapiens
cuacagauugucuagaaga

SEQ ID NO: 1099413 - RNA, 19 nt, Homo sapiens
gguauuacuuaacuucacu

SEQ ID NO: 1099414 - RNA, 19 nt, Homo sapiens
acaaagacgacccaaggaa

SEQ ID NO: 1099415 - RNA, 19 nt, Homo sapiens
ccauggaaaggcaaauaaa

SEQ ID NO: 1099416 - RNA, 19 nt, Homo sapiens
agaagggucuauacuuguc

SEQ ID NO: 1099417 - RNA, 19 nt, Homo sapiens
ggugcccacuggaggauau

SEQ ID NO: 1099418 - RNA, 19 nt, Homo sapiens
gaaggcacccgggacuaug

SEQ ID NO: 1099419 - RNA, 19 nt, Homo sapiens
cgacuacguguuccgauug

SEQ ID NO: 1099420 - RNA, 19 nt, Homo sapiens
caggagcagugucaacaag

SEQ ID NO: 1099421 - RNA, 19 nt, Homo sapiens
cauggaaaggcaaauaaau

SEQ ID NO: 1099422 - RNA, 19 nt, Homo sapiens
uacuuguccuugucuuuaa

SEQ ID NO: 1099423 - RNA, 19 nt, Homo sapiens
cgaguuuacaguugugaaa

SEQ ID NO: 1099424 - RNA, 19 nt, Homo sapiens
gaauucaggucaacaauau

SEQ ID NO: 1099425 - RNA, 19 nt, Homo sapiens
ggacaccgaucuucucuug

SEQ ID NO: 1099426 - RNA, 19 nt, Homo sapiens
ggaagaggcugaaguugug

SEQ ID NO: 1099427 - RNA, 19 nt, Homo sapiens
ggagaaugcugaaggaaga

SEQ ID NO: 1099428 - RNA, 19 nt, Homo sapiens
acaaagcacuagccacuua

SEQ ID NO: 1099429 - RNA, 19 nt, Homo sapiens
ggacgacccugaaagauuc

SEQ ID NO: 1099430 - RNA, 19 nt, Homo sapiens
ugaagaagaagaagaguua

SEQ ID NO: 1099431 - RNA, 19 nt, Homo sapiens
ggacacgccuggcagaaau

SEQ ID NO: 1099432 - RNA, 19 nt, Homo sapiens
gaaccugccugcccugaau

SEQ ID NO: 1099433 - RNA, 19 nt, Homo sapiens
ggaccucccuagaaagaaa

SEQ ID NO: 1099434 - RNA, 19 nt, Homo sapiens
gaaccacgcaucaacauug

SEQ ID NO: 1099435 - RNA, 19 nt, Homo sapiens
ggccaaaggugaugugaug

SEQ ID NO: 1099436 - RNA, 19 nt, Homo sapiens
uacacaagcuggacucuuu

SEQ ID NO: 1099437 - RNA, 19 nt, Homo sapiens
gaaggaagaagacgcagaa

SEQ ID NO: 1099438 - RNA, 19 nt, Homo sapiens
gcaacaaauucgcccauca

SEQ ID NO: 1099439 - RNA, 19 nt, Homo sapiens
gaagauaggaaauccacaa

SEQ ID NO: 1099440 - RNA, 19 nt, Homo sapiens
ggaagaagacgcagaagca

SEQ ID NO: 1099441 - RNA, 19 nt, Homo sapiens
agaaaucccugaacuccaa

SEQ ID NO: 1099442 - RNA, 19 nt, Homo sapiens
acagucagcugaagaccua

SEQ ID NO: 1099443 - RNA, 19 nt, Homo sapiens
caaugcagauaccucagua

SEQ ID NO: 1099444 - RNA, 19 nt, Homo sapiens
ccacugauggcuaccaaua

SEQ ID NO: 1099445 - RNA, 19 nt, Homo sapiens
cccaagggcaccuguauua

SEQ ID NO: 1099446 - RNA, 19 nt, Homo sapiens
gaucaaacccaucaaggau

SEQ ID NO: 1099447 - RNA, 19 nt, Homo sapiens
gacuguagaugucauguca

SEQ ID NO: 1099448 - RNA, 19 nt, Homo sapiens
gcaccuguauuaugacuac

SEQ ID NO: 1099449 - RNA, 19 nt, Homo sapiens
gaugguugcucuggaaaug

SEQ ID NO: 1099450 - RNA, 19 nt, Homo sapiens
gaccuacucuagugacaga

SEQ ID NO: 1099451 - RNA, 19 nt, Homo sapiens
aagggcaccuguauuauga

SEQ ID NO: 1099452 - RNA, 19 nt, Homo sapiens
caaguggaccucccuagaa

SEQ ID NO: 1099453 - RNA, 19 nt, Homo sapiens
cgaauucaggucaacaaua

SEQ ID NO: 1099454 - RNA, 19 nt, Homo sapiens
guugggaggugucauggaa

SEQ ID NO: 1099455 - RNA, 19 nt, Homo sapiens
cagcaugggugaccagcaa

SEQ ID NO: 1099456 - RNA, 19 nt, Homo sapiens
ggaagaagauaggaaaucc

SEQ ID NO: 1099457 - RNA, 19 nt, Homo sapiens
caaaggugaugugaugguu

SEQ ID NO: 1099458 - RNA, 19 nt, Homo sapiens
acacaaggccacacuggua

SEQ ID NO: 1099459 - RNA, 19 nt, Homo sapiens
acaccgaucuucucuugga

SEQ ID NO: 1099460 - RNA, 19 nt, Homo sapiens
ucccugaacuccaagauau

SEQ ID NO: 1099461 - RNA, 19 nt, Homo sapiens
gagagcagacuguagaugu

SEQ ID NO: 1099462 - RNA, 19 nt, Homo sapiens
gggugacgcagaacuauaa

SEQ ID NO: 1099463 - RNA, 19 nt, Homo sapiens
ucaagaccgugcaggagaa

SEQ ID NO: 1099464 - RNA, 19 nt, Homo sapiens
caagggcaccuguauuaug

SEQ ID NO: 1099465 - RNA, 19 nt, Homo sapiens
caaggaguguggcaaaguc

SEQ ID NO: 1099466 - RNA, 19 nt, Homo sapiens
gcuuugcacucucuguuug

SEQ ID NO: 1099467 - RNA, 19 nt, Homo sapiens
cugaagaccuacucuagug

SEQ ID NO: 1099468 - RNA, 19 nt, Homo sapiens
ggaagcaucagccgagugu

SEQ ID NO: 1099469 - RNA, 19 nt, Homo sapiens
ugugacaagugaagaagaa

SEQ ID NO: 1099470 - RNA, 19 nt, Homo sapiens
uacagaagauggugaaguc

SEQ ID NO: 1099471 - RNA, 19 nt, Homo sapiens
ccagggagaggaugugaaa

SEQ ID NO: 1099472 - RNA, 19 nt, Homo sapiens
gauaggaaauccacaaaag

SEQ ID NO: 1099473 - RNA, 19 nt, Homo sapiens
aaguggaccucccuagaaa

SEQ ID NO: 1099474 - RNA, 19 nt, Homo sapiens
gcaguuugaugccaagaac

SEQ ID NO: 1099475 - RNA, 19 nt, Homo sapiens
ggauccaccucaacaacau

SEQ ID NO: 1099476 - RNA, 19 nt, Homo sapiens
ugcagcagcaccaguauua

SEQ ID NO: 1099477 - RNA, 19 nt, Homo sapiens
guacaagaccaaccaugug

SEQ ID NO: 1099478 - RNA, 19 nt, Homo sapiens
gucauccuuuagcaaauua

SEQ ID NO: 1099479 - RNA, 19 nt, Homo sapiens
cggccuccaucuucauuaa

SEQ ID NO: 1099480 - RNA, 19 nt, Homo sapiens
uauaaagcccuguguguca

SEQ ID NO: 1099481 - RNA, 19 nt, Homo sapiens
agagugaggugccgaaguc

SEQ ID NO: 1099482 - RNA, 19 nt, Homo sapiens
gacaagugaagaagaagaa

SEQ ID NO: 1099483 - RNA, 19 nt, Homo sapiens
ucacagcacaugcaacaga

SEQ ID NO: 1099484 - RNA, 19 nt, Homo sapiens
gaccagcaacuguacaaga

SEQ ID NO: 1099485 - RNA, 19 nt, Homo sapiens
gacuguagauguugaacca

SEQ ID NO: 1099486 - RNA, 19 nt, Homo sapiens
gaacuauaaagcccugugu

SEQ ID NO: 1099487 - RNA, 19 nt, Homo sapiens
caacauuggcuugagauuc

SEQ ID NO: 1099488 - RNA, 19 nt, Homo sapiens
gcaguugggaggugucaug

SEQ ID NO: 1099489 - RNA, 19 nt, Homo sapiens
agagcagacuguagauguu

SEQ ID NO: 1099490 - RNA, 19 nt, Homo sapiens
ccaagaacaagcugacaug

SEQ ID NO: 1099491 - RNA, 19 nt, Homo sapiens
caucuucauuaaucaggaa

SEQ ID NO: 1099492 - RNA, 19 nt, Homo sapiens
ucaugucacucccuuucuu

SEQ ID NO: 1099493 - RNA, 19 nt, Homo sapiens
ggaggacccggaagaagau

SEQ ID NO: 1099494 - RNA, 19 nt, Homo sapiens
ggaggaggacccggaagaa

SEQ ID NO: 1099495 - RNA, 19 nt, Homo sapiens
agaagauggugaaguccaa

SEQ ID NO: 1099496 - RNA, 19 nt, Homo sapiens
ugucauccuuuagcaaauu

SEQ ID NO: 1099497 - RNA, 19 nt, Homo sapiens
ugaauuugcuuugcacucu

SEQ ID NO: 1099498 - RNA, 19 nt, Homo sapiens
guggagggaccaauucuga

SEQ ID NO: 1099499 - RNA, 19 nt, Homo sapiens
agacgcagccgcaacaaau

SEQ ID NO: 1099500 - RNA, 19 nt, Homo sapiens
cauggaagaggcugaaguu

SEQ ID NO: 1099501 - RNA, 19 nt, Homo sapiens
ccgaaaugcacacaugaaa

SEQ ID NO: 1099502 - RNA, 19 nt, Homo sapiens
gagcagacuguagauguug

SEQ ID NO: 1099503 - RNA, 19 nt, Homo sapiens
ccaucugccugaaggaguu

SEQ ID NO: 1099504 - RNA, 19 nt, Homo sapiens
gcuggacguucacaaccaa

SEQ ID NO: 1099505 - RNA, 19 nt, Homo sapiens
ccgaucuucucuuggauga

SEQ ID NO: 1099506 - RNA, 19 nt, Homo sapiens
caagugaagaagaagaaga

SEQ ID NO: 1099507 - RNA, 19 nt, Homo sapiens
ccacuuacagcaaagacuu

SEQ ID NO: 1099508 - RNA, 19 nt, Homo sapiens
aagcagaaaucccugaacu

SEQ ID NO: 1099509 - RNA, 19 nt, Homo sapiens
gucggaaccucucuucauc

SEQ ID NO: 1099510 - RNA, 19 nt, Homo sapiens
cagaugcaccuaccugaug

SEQ ID NO: 1099511 - RNA, 19 nt, Homo sapiens
gagcagcagcagcaacaga

SEQ ID NO: 1099512 - RNA, 19 nt, Homo sapiens
gcuuaccagcggugucuua

SEQ ID NO: 1099513 - RNA, 19 nt, Homo sapiens
ggucggaaccucucuucau

SEQ ID NO: 1099514 - RNA, 19 nt, Homo sapiens
guaucuccaugcaagaaau

SEQ ID NO: 1099515 - RNA, 19 nt, Homo sapiens
gaggaacaacagaggcaaa

SEQ ID NO: 1099516 - RNA, 19 nt, Homo sapiens
aagccgaaaugcacacaug

SEQ ID NO: 1099517 - RNA, 19 nt, Homo sapiens
gcaaggaguguggcaaagu

SEQ ID NO: 1099518 - RNA, 19 nt, Homo sapiens
ugucagccguggaguagug

SEQ ID NO: 1099519 - RNA, 19 nt, Homo sapiens
ugugaugguugcucuggaa

SEQ ID NO: 1099520 - RNA, 19 nt, Homo sapiens
gauugcccaugcacuuguu

SEQ ID NO: 1099521 - RNA, 19 nt, Homo sapiens
ucucaggguuucaguccuu

SEQ ID NO: 1099522 - RNA, 19 nt, Homo sapiens
ccagcugagucugaucaaa

SEQ ID NO: 1099523 - RNA, 19 nt, Homo sapiens
gcccugcacaugaguggua

SEQ ID NO: 1099524 - RNA, 19 nt, Homo sapiens
gaauucaggucaacaauau

SEQ ID NO: 1099525 - RNA, 19 nt, Homo sapiens
ggacaccgaucuucucuug

SEQ ID NO: 1099526 - RNA, 19 nt, Homo sapiens
ggaagaggcugaaguugug

SEQ ID NO: 1099527 - RNA, 19 nt, Homo sapiens
ggagaaugcugaaggaaga

SEQ ID NO: 1099528 - RNA, 19 nt, Homo sapiens
acaaagcacuagccacuua

SEQ ID NO: 1099529 - RNA, 19 nt, Homo sapiens
ggacgacccugaaagauuc

SEQ ID NO: 1099530 - RNA, 19 nt, Homo sapiens
ugaagaagaagaagaguua

SEQ ID NO: 1099531 - RNA, 19 nt, Homo sapiens
ggacacgccuggcagaaau

SEQ ID NO: 1099532 - RNA, 19 nt, Homo sapiens
gaaccugccugcccugaau

SEQ ID NO: 1099533 - RNA, 19 nt, Homo sapiens
ggaccucccuagaaagaaa

SEQ ID NO: 1099534 - RNA, 19 nt, Homo sapiens
gaaccacgcaucaacauug

SEQ ID NO: 1099535 - RNA, 19 nt, Homo sapiens
ggccaaaggugaugugaug

SEQ ID NO: 1099536 - RNA, 19 nt, Homo sapiens
uacacaagcuggacucuuu

SEQ ID NO: 1099537 - RNA, 19 nt, Homo sapiens
gaaggaagaagacgcagaa

SEQ ID NO: 1099538 - RNA, 19 nt, Homo sapiens
gcaacaaauucgcccauca

SEQ ID NO: 1099539 - RNA, 19 nt, Homo sapiens
gaagauaggaaauccacaa

SEQ ID NO: 1099540 - RNA, 19 nt, Homo sapiens
ggaagaagacgcagaagca

SEQ ID NO: 1099541 - RNA, 19 nt, Homo sapiens
agaaaucccugaacuccaa

SEQ ID NO: 1099542 - RNA, 19 nt, Homo sapiens
acagucagcugaagaccua

SEQ ID NO: 1099543 - RNA, 19 nt, Homo sapiens
caaugcagauaccucagua

SEQ ID NO: 1099544 - RNA, 19 nt, Homo sapiens
ccacugauggcuaccaaua

SEQ ID NO: 1099545 - RNA, 19 nt, Homo sapiens
cccaagggcaccuguauua

SEQ ID NO: 1099546 - RNA, 19 nt, Homo sapiens
gaucaaacccaucaaggau

SEQ ID NO: 1099547 - RNA, 19 nt, Homo sapiens
gcaccuguauuaugacuac

SEQ ID NO: 1099548 - RNA, 19 nt, Homo sapiens
gaugguugcucuggaaaug

SEQ ID NO: 1099549 - RNA, 19 nt, Homo sapiens
gaccuacucuagugacaga

SEQ ID NO: 1099550 - RNA, 19 nt, Homo sapiens
aagggcaccuguauuauga

SEQ ID NO: 1099551 - RNA, 19 nt, Homo sapiens
caaguggaccucccuagaa

SEQ ID NO: 1099552 - RNA, 19 nt, Homo sapiens
cgaauucaggucaacaaua

SEQ ID NO: 1099553 - RNA, 19 nt, Homo sapiens
guugggaggugucauggaa

SEQ ID NO: 1099554 - RNA, 19 nt, Homo sapiens
cagcaugggugaccagcaa

SEQ ID NO: 1099555 - RNA, 19 nt, Homo sapiens
ggaagaagauaggaaaucc

SEQ ID NO: 1099556 - RNA, 19 nt, Homo sapiens
caaaggugaugugaugguu

SEQ ID NO: 1099557 - RNA, 19 nt, Homo sapiens
acacaaggccacacuggua

SEQ ID NO: 1099558 - RNA, 19 nt, Homo sapiens
acaccgaucuucucuugga

SEQ ID NO: 1099559 - RNA, 19 nt, Homo sapiens
ucccugaacuccaagauau

SEQ ID NO: 1099560 - RNA, 19 nt, Homo sapiens
gagagcagacuguagaugu

SEQ ID NO: 1099561 - RNA, 19 nt, Homo sapiens
gggugacgcagaacuauaa

SEQ ID NO: 1099562 - RNA, 19 nt, Homo sapiens
ucaagaccgugcaggagaa

SEQ ID NO: 1099563 - RNA, 19 nt, Homo sapiens
caagggcaccuguauuaug

SEQ ID NO: 1099564 - RNA, 19 nt, Homo sapiens
caaggaguguggcaaaguc

SEQ ID NO: 1099565 - RNA, 19 nt, Homo sapiens
gcuuugcacucucuguuug

SEQ ID NO: 1099566 - RNA, 19 nt, Homo sapiens
cugaagaccuacucuagug

SEQ ID NO: 1099567 - RNA, 19 nt, Homo sapiens
ggaagcaucagccgagugu

SEQ ID NO: 1099568 - RNA, 19 nt, Homo sapiens
ugugacaagugaagaagaa

SEQ ID NO: 1099569 - RNA, 19 nt, Homo sapiens
uacagaagauggugaaguc

SEQ ID NO: 1099570 - RNA, 19 nt, Homo sapiens
ccagggagaggaugugaaa

SEQ ID NO: 1099571 - RNA, 19 nt, Homo sapiens
gauaggaaauccacaaaag

SEQ ID NO: 1099572 - RNA, 19 nt, Homo sapiens
aaguggaccucccuagaaa

SEQ ID NO: 1099573 - RNA, 19 nt, Homo sapiens
gcaguuugaugccaagaac

SEQ ID NO: 1099574 - RNA, 19 nt, Homo sapiens
ggauccaccucaacaacau

SEQ ID NO: 1099575 - RNA, 19 nt, Homo sapiens
ugcagcagcaccaguauua

SEQ ID NO: 1099576 - RNA, 19 nt, Homo sapiens
guacaagaccaaccaugug

SEQ ID NO: 1099577 - RNA, 19 nt, Homo sapiens
gucauccuuuagcaaauua

SEQ ID NO: 1099578 - RNA, 19 nt, Homo sapiens
cggccuccaucuucauuaa

SEQ ID NO: 1099579 - RNA, 19 nt, Homo sapiens
uauaaagcccuguguguca

SEQ ID NO: 1099580 - RNA, 19 nt, Homo sapiens
agagugaggugccgaaguc

SEQ ID NO: 1099581 - RNA, 19 nt, Homo sapiens
gacaagugaagaagaagaa

SEQ ID NO: 1099582 - RNA, 19 nt, Homo sapiens
ucacagcacaugcaacaga

SEQ ID NO: 1099583 - RNA, 19 nt, Homo sapiens
gaccagcaacuguacaaga

SEQ ID NO: 1099584 - RNA, 19 nt, Homo sapiens
gacuguagauguugaacca

SEQ ID NO: 1099585 - RNA, 19 nt, Homo sapiens
gaacuauaaagcccugugu

SEQ ID NO: 1099586 - RNA, 19 nt, Homo sapiens
caacauuggcuugagauuc

SEQ ID NO: 1099587 - RNA, 19 nt, Homo sapiens
gcaguugggaggugucaug

SEQ ID NO: 1099588 - RNA, 19 nt, Homo sapiens
agagcagacuguagauguu

SEQ ID NO: 1099589 - RNA, 19 nt, Homo sapiens
ccaagaacaagcugacaug

SEQ ID NO: 1099590 - RNA, 19 nt, Homo sapiens
caucuucauuaaucaggaa

SEQ ID NO: 1099591 - RNA, 19 nt, Homo sapiens
ggaggacccggaagaagau

SEQ ID NO: 1099592 - RNA, 19 nt, Homo sapiens
ggaggaggacccggaagaa

SEQ ID NO: 1099593 - RNA, 19 nt, Homo sapiens
agaagauggugaaguccaa

SEQ ID NO: 1099594 - RNA, 19 nt, Homo sapiens
ugucauccuuuagcaaauu

SEQ ID NO: 1099595 - RNA, 19 nt, Homo sapiens
ugaauuugcuuugcacucu

SEQ ID NO: 1099596 - RNA, 19 nt, Homo sapiens
guggagggaccaauucuga

SEQ ID NO: 1099597 - RNA, 19 nt, Homo sapiens
agacgcagccgcaacaaau

SEQ ID NO: 1099598 - RNA, 19 nt, Homo sapiens
cauggaagaggcugaaguu

SEQ ID NO: 1099599 - RNA, 19 nt, Homo sapiens
ccgaaaugcacacaugaaa

SEQ ID NO: 1099600 - RNA, 19 nt, Homo sapiens
gagcagacuguagauguug

SEQ ID NO: 1099601 - RNA, 19 nt, Homo sapiens
ccaucugccugaaggaguu

SEQ ID NO: 1099602 - RNA, 19 nt, Homo sapiens
gcuggacguucacaaccaa

SEQ ID NO: 1099603 - RNA, 19 nt, Homo sapiens
ccgaucuucucuuggauga

SEQ ID NO: 1099604 - RNA, 19 nt, Homo sapiens
caagugaagaagaagaaga

SEQ ID NO: 1099605 - RNA, 19 nt, Homo sapiens
ccacuuacagcaaagacuu

SEQ ID NO: 1099606 - RNA, 19 nt, Homo sapiens
aagcagaaaucccugaacu

SEQ ID NO: 1099607 - RNA, 19 nt, Homo sapiens
gucggaaccucucuucauc

SEQ ID NO: 1099608 - RNA, 19 nt, Homo sapiens
cagaugcaccuaccugaug

SEQ ID NO: 1099609 - RNA, 19 nt, Homo sapiens
gagcagcagcagcaacaga

SEQ ID NO: 1099610 - RNA, 19 nt, Homo sapiens
gcuuaccagcggugucuua

SEQ ID NO: 1099611 - RNA, 19 nt, Homo sapiens
ggucggaaccucucuucau

SEQ ID NO: 1099612 - RNA, 19 nt, Homo sapiens
guaucuccaugcaagaaau

SEQ ID NO: 1099613 - RNA, 19 nt, Homo sapiens
gaggaacaacagaggcaaa

SEQ ID NO: 1099614 - RNA, 19 nt, Homo sapiens
aagccgaaaugcacacaug

SEQ ID NO: 1099615 - RNA, 19 nt, Homo sapiens
gcaaggaguguggcaaagu

SEQ ID NO: 1099616 - RNA, 19 nt, Homo sapiens
ugucagccguggaguagug

SEQ ID NO: 1099617 - RNA, 19 nt, Homo sapiens
ugugaugguugcucuggaa

SEQ ID NO: 1099618 - RNA, 19 nt, Homo sapiens
gauugcccaugcacuuguu

SEQ ID NO: 1099619 - RNA, 19 nt, Homo sapiens
ucucaggguuucaguccuu

SEQ ID NO: 1099620 - RNA, 19 nt, Homo sapiens
ccagcugagucugaucaaa

SEQ ID NO: 1099621 - RNA, 19 nt, Homo sapiens
gcccugcacaugaguggua

SEQ ID NO: 1099622 - RNA, 19 nt, Homo sapiens
aagcugacaugcuccaucu

SEQ ID NO: 1099623 - RNA, 19 nt, Homo sapiens
guggcaaagucuucuucaa

SEQ ID NO: 1099624 - RNA, 19 nt, Homo sapiens
gaauucaggucaacaauau

SEQ ID NO: 1099625 - RNA, 19 nt, Homo sapiens
ggacaccgaucuucucuug

SEQ ID NO: 1099626 - RNA, 19 nt, Homo sapiens
ggaagaggcugaaguugug

SEQ ID NO: 1099627 - RNA, 19 nt, Homo sapiens
ggagaaugcugaaggaaga

SEQ ID NO: 1099628 - RNA, 19 nt, Homo sapiens
acaaagcacuagccacuua

SEQ ID NO: 1099629 - RNA, 19 nt, Homo sapiens
ggacgacccugaaagauuc

SEQ ID NO: 1099630 - RNA, 19 nt, Homo sapiens
ugaagaagaagaagaguua

SEQ ID NO: 1099631 - RNA, 19 nt, Homo sapiens
ggucugggcuugccuguug

SEQ ID NO: 1099632 - RNA, 19 nt, Homo sapiens
ggacacgccuggcagaaau

SEQ ID NO: 1099633 - RNA, 19 nt, Homo sapiens
gaaccugccugcccugaau

SEQ ID NO: 1099634 - RNA, 19 nt, Homo sapiens
ggaccucccuagaaagaaa

SEQ ID NO: 1099635 - RNA, 19 nt, Homo sapiens
gaaccacgcaucaacauug

SEQ ID NO: 1099636 - RNA, 19 nt, Homo sapiens
ggccaaaggugaugugaug

SEQ ID NO: 1099637 - RNA, 19 nt, Homo sapiens
uacacaagcuggacucuuu

SEQ ID NO: 1099638 - RNA, 19 nt, Homo sapiens
gaaggaagaagacgcagaa

SEQ ID NO: 1099639 - RNA, 19 nt, Homo sapiens
gcaacaaauucgcccauca

SEQ ID NO: 1099640 - RNA, 19 nt, Homo sapiens
gaagauaggaaauccacaa

SEQ ID NO: 1099641 - RNA, 19 nt, Homo sapiens
ggaagaagacgcagaagca

SEQ ID NO: 1099642 - RNA, 19 nt, Homo sapiens
agaaaucccugaacuccaa

SEQ ID NO: 1099643 - RNA, 19 nt, Homo sapiens
cagaaagccucacgccuau

SEQ ID NO: 1099644 - RNA, 19 nt, Homo sapiens
acagucagcugaagaccua

SEQ ID NO: 1099645 - RNA, 19 nt, Homo sapiens
caaugcagauaccucagua

SEQ ID NO: 1099646 - RNA, 19 nt, Homo sapiens
ccacuucccucaagauaca

SEQ ID NO: 1099647 - RNA, 19 nt, Homo sapiens
ccacugauggcuaccaaua

SEQ ID NO: 1099648 - RNA, 19 nt, Homo sapiens
cccaagggcaccuguauua

SEQ ID NO: 1099649 - RNA, 19 nt, Homo sapiens
gaucaaacccaucaaggau

SEQ ID NO: 1099650 - RNA, 19 nt, Homo sapiens
gcaccuguauuaugacuac

SEQ ID NO: 1099651 - RNA, 19 nt, Homo sapiens
gaugguugcucuggaaaug

SEQ ID NO: 1099652 - RNA, 19 nt, Homo sapiens
gaccuacucuagugacaga

SEQ ID NO: 1099653 - RNA, 19 nt, Homo sapiens
aagggcaccuguauuauga

SEQ ID NO: 1099654 - RNA, 19 nt, Homo sapiens
caaguggaccucccuagaa

SEQ ID NO: 1099655 - RNA, 19 nt, Homo sapiens
cgaauucaggucaacaaua

SEQ ID NO: 1099656 - RNA, 19 nt, Homo sapiens
guugggaggugucauggaa

SEQ ID NO: 1099657 - RNA, 19 nt, Homo sapiens
cagcaugggugaccagcaa

SEQ ID NO: 1099658 - RNA, 19 nt, Homo sapiens
ggaagaagauaggaaaucc

SEQ ID NO: 1099659 - RNA, 19 nt, Homo sapiens
caaaggugaugugaugguu

SEQ ID NO: 1099660 - RNA, 19 nt, Homo sapiens
acacaaggccacacuggua

SEQ ID NO: 1099661 - RNA, 19 nt, Homo sapiens
acaccgaucuucucuugga

SEQ ID NO: 1099662 - RNA, 19 nt, Homo sapiens
ucccugaacuccaagauau

SEQ ID NO: 1099663 - RNA, 19 nt, Homo sapiens
gagagcagacuguagaugu

SEQ ID NO: 1099664 - RNA, 19 nt, Homo sapiens
gggugacgcagaacuauaa

SEQ ID NO: 1099665 - RNA, 19 nt, Homo sapiens
ucaagaccgugcaggagaa

SEQ ID NO: 1099666 - RNA, 19 nt, Homo sapiens
caagggcaccuguauuaug

SEQ ID NO: 1099667 - RNA, 19 nt, Homo sapiens
caaggaguguggcaaaguc

SEQ ID NO: 1099668 - RNA, 19 nt, Homo sapiens
gcuuugcacucucuguuug

SEQ ID NO: 1099669 - RNA, 19 nt, Homo sapiens
cugaagaccuacucuagug

SEQ ID NO: 1099670 - RNA, 19 nt, Homo sapiens
ggaagcaucagccgagugu

SEQ ID NO: 1099671 - RNA, 19 nt, Homo sapiens
ugugacaagugaagaagaa

SEQ ID NO: 1099672 - RNA, 19 nt, Homo sapiens
uacagaagauggugaaguc

SEQ ID NO: 1099673 - RNA, 19 nt, Homo sapiens
gaaaccuggccaacucaaa

SEQ ID NO: 1099674 - RNA, 19 nt, Homo sapiens
ccagggagaggaugugaaa

SEQ ID NO: 1099675 - RNA, 19 nt, Homo sapiens
gauaggaaauccacaaaag

SEQ ID NO: 1099676 - RNA, 19 nt, Homo sapiens
aaguggaccucccuagaaa

SEQ ID NO: 1099677 - RNA, 19 nt, Homo sapiens
gccggaaccucucuucauc

SEQ ID NO: 1099678 - RNA, 19 nt, Homo sapiens
gaaagccucacgccuaugg

SEQ ID NO: 1099679 - RNA, 19 nt, Homo sapiens
gcaguuugaugccaagaac

SEQ ID NO: 1099680 - RNA, 19 nt, Homo sapiens
ggauccaccucaacaacau

SEQ ID NO: 1099681 - RNA, 19 nt, Homo sapiens
ugcagcagcaccaguauua

SEQ ID NO: 1099682 - RNA, 19 nt, Homo sapiens
guggaaaccuggccaacuc

SEQ ID NO: 1099683 - RNA, 19 nt, Homo sapiens
gaaccacaacuaugggaau

SEQ ID NO: 1099684 - RNA, 19 nt, Homo sapiens
guacaagaccaaccaugug

SEQ ID NO: 1099685 - RNA, 19 nt, Homo sapiens
gucauccuuuagcaaauua

SEQ ID NO: 1099686 - RNA, 19 nt, Homo sapiens
ccucaggccucgccaaucu

SEQ ID NO: 1099687 - RNA, 19 nt, Homo sapiens
cggccuccaucuucauuaa

SEQ ID NO: 1099688 - RNA, 19 nt, Homo sapiens
uauaaagcccuguguguca

SEQ ID NO: 1099689 - RNA, 19 nt, Homo sapiens
agagugaggugccgaaguc

SEQ ID NO: 1099690 - RNA, 19 nt, Homo sapiens
gacaagugaagaagaagaa

SEQ ID NO: 1099691 - RNA, 19 nt, Homo sapiens
ucacagcacaugcaacaga

SEQ ID NO: 1099692 - RNA, 19 nt, Homo sapiens
gaccagcaacuguacaaga

SEQ ID NO: 1099693 - RNA, 19 nt, Homo sapiens
gacuguagauguugaacca

SEQ ID NO: 1099694 - RNA, 19 nt, Homo sapiens
gaacuauaaagcccugugu

SEQ ID NO: 1099695 - RNA, 19 nt, Homo sapiens
caacauuggcuugagauuc

SEQ ID NO: 1099696 - RNA, 19 nt, Homo sapiens
gcaguugggaggugucaug

SEQ ID NO: 1099697 - RNA, 19 nt, Homo sapiens
agagcagacuguagauguu

SEQ ID NO: 1099698 - RNA, 19 nt, Homo sapiens
ccaagaacaagcugacaug

SEQ ID NO: 1099699 - RNA, 19 nt, Homo sapiens
caucuucauuaaucaggaa

SEQ ID NO: 1099700 - RNA, 19 nt, Homo sapiens
ggaggacccggaagaagau

SEQ ID NO: 1099701 - RNA, 19 nt, Homo sapiens
ggaggaggacccggaagaa

SEQ ID NO: 1099702 - RNA, 19 nt, Homo sapiens
agaagauggugaaguccaa

SEQ ID NO: 1099703 - RNA, 19 nt, Homo sapiens
ugucauccuuuagcaaauu

SEQ ID NO: 1099704 - RNA, 19 nt, Homo sapiens
ugaauuugcuuugcacucu

SEQ ID NO: 1099705 - RNA, 19 nt, Homo sapiens
guggagggaccaauucuga

SEQ ID NO: 1099706 - RNA, 19 nt, Homo sapiens
agacgcagccgcaacaaau

SEQ ID NO: 1099707 - RNA, 19 nt, Homo sapiens
cauggaagaggcugaaguu

SEQ ID NO: 1099708 - RNA, 19 nt, Homo sapiens
ccgaaaugcacacaugaaa

SEQ ID NO: 1099709 - RNA, 19 nt, Homo sapiens
gagcagacuguagauguug

SEQ ID NO: 1099710 - RNA, 19 nt, Homo sapiens
ccaucugccugaaggaguu

SEQ ID NO: 1099711 - RNA, 19 nt, Homo sapiens
gcuggacguucacaaccaa

SEQ ID NO: 1099712 - RNA, 19 nt, Homo sapiens
ccgaucuucucuuggauga

SEQ ID NO: 1099713 - RNA, 19 nt, Homo sapiens
caagugaagaagaagaaga

SEQ ID NO: 1099714 - RNA, 19 nt, Homo sapiens
ccacuuacagcaaagacuu

SEQ ID NO: 1099715 - RNA, 19 nt, Homo sapiens
aagcagaaaucccugaacu

SEQ ID NO: 1099716 - RNA, 19 nt, Homo sapiens
cagaugcaccuaccugaug

SEQ ID NO: 1099717 - RNA, 19 nt, Homo sapiens
gagcagcagcagcaacaga

SEQ ID NO: 1099718 - RNA, 19 nt, Homo sapiens
gcuuaccagcggugucuua

SEQ ID NO: 1099719 - RNA, 19 nt, Homo sapiens
ccacaacuaugggaaugca

SEQ ID NO: 1099720 - RNA, 19 nt, Homo sapiens
gggcugaaccacaacuaug

SEQ ID NO: 1099721 - RNA, 19 nt, Homo sapiens
guaucuccaugcaagaaau

SEQ ID NO: 1099722 - RNA, 19 nt, Homo sapiens
gaggaacaacagaggcaaa

SEQ ID NO: 1099723 - RNA, 19 nt, Homo sapiens
aagccgaaaugcacacaug

SEQ ID NO: 1099724 - RNA, 19 nt, Homo sapiens
gaaagggucugaaacauua

SEQ ID NO: 1099725 - RNA, 19 nt, Homo sapiens
ggagcuaacucaucucuuu

SEQ ID NO: 1099726 - RNA, 19 nt, Homo sapiens
gcucuaauauugacucuuu

SEQ ID NO: 1099727 - RNA, 19 nt, Homo sapiens
gcaaaguacucaguguaua

SEQ ID NO: 1099728 - RNA, 19 nt, Homo sapiens
gaacaacuacuacauguau

SEQ ID NO: 1099729 - RNA, 19 nt, Homo sapiens
caugauagcuacagagaaa

SEQ ID NO: 1099730 - RNA, 19 nt, Homo sapiens
ggagaucccugaugacuuc

SEQ ID NO: 1099731 - RNA, 19 nt, Homo sapiens
aaacuagucucaugaagaa

SEQ ID NO: 1099732 - RNA, 19 nt, Homo sapiens
gcaggagggugacaauaaa

SEQ ID NO: 1099733 - RNA, 19 nt, Homo sapiens
gacauaauauuucccauug

SEQ ID NO: 1099734 - RNA, 19 nt, Homo sapiens
gaagacacccuccagauga

SEQ ID NO: 1099735 - RNA, 19 nt, Homo sapiens
ggagaugauuccaacuuaa

SEQ ID NO: 1099736 - RNA, 19 nt, Homo sapiens
uggaagggauggaauauaa

SEQ ID NO: 1099737 - RNA, 19 nt, Homo sapiens
gcaagaugcugccgaagau

SEQ ID NO: 1099738 - RNA, 19 nt, Homo sapiens
caucaguucuccucaauau

SEQ ID NO: 1099739 - RNA, 19 nt, Homo sapiens
uagcagagccaaaccuuua

SEQ ID NO: 1099740 - RNA, 19 nt, Homo sapiens
gaauauaagucagugugaa

SEQ ID NO: 1099741 - RNA, 19 nt, Homo sapiens
gaauagacaaggccacuuu

SEQ ID NO: 1099742 - RNA, 19 nt, Homo sapiens
aaacucugcuucuauggua

SEQ ID NO: 1099743 - RNA, 19 nt, Homo sapiens
aguauacacugccauguua

SEQ ID NO: 1099744 - RNA, 19 nt, Homo sapiens
uggagaaacucaaugcuaa

SEQ ID NO: 1099745 - RNA, 19 nt, Homo sapiens
gaagagccacugaggauga

SEQ ID NO: 1099746 - RNA, 19 nt, Homo sapiens
uauauggucucacaaguug

SEQ ID NO: 1099747 - RNA, 19 nt, Homo sapiens
gcagaugcuucucuuggaa

SEQ ID NO: 1099748 - RNA, 19 nt, Homo sapiens
gacuggagauuggccauua

SEQ ID NO: 1099749 - RNA, 19 nt, Homo sapiens
gaagcucacugccuauaag

SEQ ID NO: 1099750 - RNA, 19 nt, Homo sapiens
ggucuuccuugucccuuua

SEQ ID NO: 1099751 - RNA, 19 nt, Homo sapiens
uaccauggcuucugaccua

SEQ ID NO: 1099752 - RNA, 19 nt, Homo sapiens
gaagagacaacuccugguu

SEQ ID NO: 1099753 - RNA, 19 nt, Homo sapiens
ucagaaagauccaguuugg

SEQ ID NO: 1099754 - RNA, 19 nt, Homo sapiens
gagaguaaauaaucuagag

SEQ ID NO: 1099755 - RNA, 19 nt, Homo sapiens
gaggccacauuaccaagua

SEQ ID NO: 1099756 - RNA, 19 nt, Homo sapiens
ggaagaugaagccaugaua

SEQ ID NO: 1099757 - RNA, 19 nt, Homo sapiens
caaaguguagucauuauug

SEQ ID NO: 1099758 - RNA, 19 nt, Homo sapiens
cgagagggaagaacaauuu

SEQ ID NO: 1099759 - RNA, 19 nt, Homo sapiens
ggacucagcaggauacaau

SEQ ID NO: 1099760 - RNA, 19 nt, Homo sapiens
agacaaggccacuuucuuu

SEQ ID NO: 1099761 - RNA, 19 nt, Homo sapiens
gaagauaggauugguuuua

SEQ ID NO: 1099762 - RNA, 19 nt, Homo sapiens
ugagccaagugaacucuua

SEQ ID NO: 1099763 - RNA, 19 nt, Homo sapiens
gaacaggaggcaagcaaga

SEQ ID NO: 1099764 - RNA, 19 nt, Homo sapiens
gacuggugcucuaauauug

SEQ ID NO: 1099765 - RNA, 19 nt, Homo sapiens
gcuugaaucucccaugaug

SEQ ID NO: 1099766 - RNA, 19 nt, Homo sapiens
acucagagaucaacuuuca

SEQ ID NO: 1099767 - RNA, 19 nt, Homo sapiens
caccaaccaugacuuuaaa

SEQ ID NO: 1099768 - RNA, 19 nt, Homo sapiens
caggguagcugaaguuugg

SEQ ID NO: 1099769 - RNA, 19 nt, Homo sapiens
uaacaccaaccaugacuuu

SEQ ID NO: 1099770 - RNA, 19 nt, Homo sapiens
caaaguacucaguguauau

SEQ ID NO: 1099771 - RNA, 19 nt, Homo sapiens
agaaauggauagggaauau

SEQ ID NO: 1099772 - RNA, 19 nt, Homo sapiens
agccaaaccuuuaguguug

SEQ ID NO: 1099773 - RNA, 19 nt, Homo sapiens
ccgcagaugucacuucaga

SEQ ID NO: 1099774 - RNA, 19 nt, Homo sapiens
ggaaauaagagagaaagug

SEQ ID NO: 1099775 - RNA, 19 nt, Homo sapiens
cauuaggccuccugagauu

SEQ ID NO: 1099776 - RNA, 19 nt, Homo sapiens
gaaaagcugugggacaaaa

SEQ ID NO: 1099777 - RNA, 19 nt, Homo sapiens
guauggagcuaacucaucu

SEQ ID NO: 1099778 - RNA, 19 nt, Homo sapiens
ggaggagaguaaauaaucu

SEQ ID NO: 1099779 - RNA, 19 nt, Homo sapiens
guagaaagggucugaaaca

SEQ ID NO: 1099780 - RNA, 19 nt, Homo sapiens
aaacaggagucagccauga

SEQ ID NO: 1099781 - RNA, 19 nt, Homo sapiens
gcacaaccuuucucucaac

SEQ ID NO: 1099782 - RNA, 19 nt, Homo sapiens
caaacuagucucaugaaga

SEQ ID NO: 1099783 - RNA, 19 nt, Homo sapiens
gaagaugaagccaugauag

SEQ ID NO: 1099784 - RNA, 19 nt, Homo sapiens
ggcauugguuggaagaauu

SEQ ID NO: 1099785 - RNA, 19 nt, Homo sapiens
gaucacuucucuuuucuaa

SEQ ID NO: 1099786 - RNA, 19 nt, Homo sapiens
gaugaagccaugauagcua

SEQ ID NO: 1099787 - RNA, 19 nt, Homo sapiens
gcaaacuagucucaugaag

SEQ ID NO: 1099788 - RNA, 19 nt, Homo sapiens
caaggccacuuucuuugug

SEQ ID NO: 1099789 - RNA, 19 nt, Homo sapiens
gaggaaccuuggagacaga

SEQ ID NO: 1099790 - RNA, 19 nt, Homo sapiens
gcacuuuauuucuuugaag

SEQ ID NO: 1099791 - RNA, 19 nt, Homo sapiens
ggacaaaauguauggaaua

SEQ ID NO: 1099792 - RNA, 19 nt, Homo sapiens
gagccaaaccuuuaguguu

SEQ ID NO: 1099793 - RNA, 19 nt, Homo sapiens
gugauaacuuccccuauua

SEQ ID NO: 1099794 - RNA, 19 nt, Homo sapiens
gagacagaacccagaagua

SEQ ID NO: 1099795 - RNA, 19 nt, Homo sapiens
ccagugaggcugaaguaaa

SEQ ID NO: 1099796 - RNA, 19 nt, Homo sapiens
caacuauucagcaugguuu

SEQ ID NO: 1099797 - RNA, 19 nt, Homo sapiens
gaggacaacuauucagcau

SEQ ID NO: 1099798 - RNA, 19 nt, Homo sapiens
gagaagccacugcaagaug

SEQ ID NO: 1099799 - RNA, 19 nt, Homo sapiens
caacacuggcuuugccuuu

SEQ ID NO: 1099800 - RNA, 19 nt, Homo sapiens
caaccaugacuuuaaauuc

SEQ ID NO: 1099801 - RNA, 19 nt, Homo sapiens
gagaagacacccuccagau

SEQ ID NO: 1099802 - RNA, 19 nt, Homo sapiens
ccuauaagaggaaauaaga

SEQ ID NO: 1099803 - RNA, 19 nt, Homo sapiens
uuacuucuguccuuauuuc

SEQ ID NO: 1099804 - RNA, 19 nt, Homo sapiens
ggaauauaagucaguguga

SEQ ID NO: 1099805 - RNA, 19 nt, Homo sapiens
gaagggauggaauauaagu

SEQ ID NO: 1099806 - RNA, 19 nt, Homo sapiens
gacuggagaggccacauua

SEQ ID NO: 1099807 - RNA, 19 nt, Homo sapiens
caaccuuucucucaacaag

SEQ ID NO: 1099808 - RNA, 19 nt, Homo sapiens
cacaaaguguagucauuau

SEQ ID NO: 1099809 - RNA, 19 nt, Homo sapiens
ucaguucuccucaauauuc

SEQ ID NO: 1099810 - RNA, 19 nt, Homo sapiens
agauagggcaguuaacuaa

SEQ ID NO: 1099811 - RNA, 19 nt, Homo sapiens
gaggagaguaaauaaucua

SEQ ID NO: 1099812 - RNA, 19 nt, Homo sapiens
ggagaggccacauuaccaa

SEQ ID NO: 1099813 - RNA, 19 nt, Homo sapiens
cagagaagccacugcaaga

SEQ ID NO: 1099814 - RNA, 19 nt, Homo sapiens
acugggacuugaucacuua

SEQ ID NO: 1099815 - RNA, 19 nt, Homo sapiens
uaaaggaaagcuucaagau

SEQ ID NO: 1099816 - RNA, 19 nt, Homo sapiens
acaccaaccaugacuuuaa

SEQ ID NO: 1099817 - RNA, 19 nt, Homo sapiens
gaaguaaaggggcaagaua

SEQ ID NO: 1099818 - RNA, 19 nt, Homo sapiens
cagugaggcugaaguaaag

SEQ ID NO: 1099819 - RNA, 19 nt, Homo sapiens
gaguauacacugccauguu

SEQ ID NO: 1099820 - RNA, 19 nt, Homo sapiens
agaaagggucugaaacauu

SEQ ID NO: 1099821 - RNA, 19 nt, Homo sapiens
ucugacuggugcucuaaua

SEQ ID NO: 1099822 - RNA, 19 nt, Homo sapiens
guauauggucucacaaguu

SEQ ID NO: 1099823 - RNA, 19 nt, Homo sapiens
gguauauggucucacaagu

SEQ ID NO: 1099824 - RNA, 19 nt, Homo sapiens
ggaauaaccuguucaagua

SEQ ID NO: 1099825 - RNA, 19 nt, Homo sapiens
ccaaagaacuggacucgua

SEQ ID NO: 1099826 - RNA, 19 nt, Homo sapiens
uuaaagagcuuccaaagaa

SEQ ID NO: 1099827 - RNA, 19 nt, Homo sapiens
gaacauggcucagaugaau

SEQ ID NO: 1099828 - RNA, 19 nt, Homo sapiens
cagaauagcagcucauuua

SEQ ID NO: 1099829 - RNA, 19 nt, Homo sapiens
ggugaggucuguuucaaua

SEQ ID NO: 1099830 - RNA, 19 nt, Homo sapiens
ggaauauacuggagaaaug

SEQ ID NO: 1099831 - RNA, 19 nt, Homo sapiens
gcucaacgcuuuagacaug

SEQ ID NO: 1099832 - RNA, 19 nt, Homo sapiens
gaaauaaagucaugacacu

SEQ ID NO: 1099833 - RNA, 19 nt, Homo sapiens
gcagaaauguggccucuuc

SEQ ID NO: 1099834 - RNA, 19 nt, Homo sapiens
guacgaccuucaugcauua

SEQ ID NO: 1099835 - RNA, 19 nt, Homo sapiens
gggaggagcuacucaagaa

SEQ ID NO: 1099836 - RNA, 19 nt, Homo sapiens
gcauugaaaucguggcaua

SEQ ID NO: 1099837 - RNA, 19 nt, Homo sapiens
ggaaugugcuauggauaua

SEQ ID NO: 1099838 - RNA, 19 nt, Homo sapiens
ccacauaagugcaauagug

SEQ ID NO: 1099839 - RNA, 19 nt, Homo sapiens
ccacugaguuguuguuuga

SEQ ID NO: 1099840 - RNA, 19 nt, Homo sapiens
agacaaagcagaagagaua

SEQ ID NO: 1099841 - RNA, 19 nt, Homo sapiens
gaagacaucugacgaagac

SEQ ID NO: 1099842 - RNA, 19 nt, Homo sapiens
uaacagcagccaagucuua

SEQ ID NO: 1099843 - RNA, 19 nt, Homo sapiens
caaagaaaguuaugaaagg

SEQ ID NO: 1099844 - RNA, 19 nt, Homo sapiens
gaacauuugucuugaacau

SEQ ID NO: 1099845 - RNA, 19 nt, Homo sapiens
gaacaugaacaaagaauca

SEQ ID NO: 1099846 - RNA, 19 nt, Homo sapiens
ggagacauccugaaauuug

SEQ ID NO: 1099847 - RNA, 19 nt, Homo sapiens
gagcgacccuuuauggauu

SEQ ID NO: 1099848 - RNA, 19 nt, Homo sapiens
ggauuuggccauugaguua

SEQ ID NO: 1099849 - RNA, 19 nt, Homo sapiens
cuuccuaucuucaucauua

SEQ ID NO: 1099850 - RNA, 19 nt, Homo sapiens
cgaccuucaugcauuauua

SEQ ID NO: 1099851 - RNA, 19 nt, Homo sapiens
gagaaaugcuggcugaaca

SEQ ID NO: 1099852 - RNA, 19 nt, Homo sapiens
gagaaagucauguuuggua

SEQ ID NO: 1099853 - RNA, 19 nt, Homo sapiens
ucagcugucuucagaauaa

SEQ ID NO: 1099854 - RNA, 19 nt, Homo sapiens
caacuuaaucuccuuguuu

SEQ ID NO: 1099855 - RNA, 19 nt, Homo sapiens
gaagcagauugauaacaaa

SEQ ID NO: 1099856 - RNA, 19 nt, Homo sapiens
gaaccaugacacuuacuua

SEQ ID NO: 1099857 - RNA, 19 nt, Homo sapiens
ccaccuggcuggcuacaaa

SEQ ID NO: 1099858 - RNA, 19 nt, Homo sapiens
ugaagcagauugauaacaa

SEQ ID NO: 1099859 - RNA, 19 nt, Homo sapiens
gcuuacgucuguauauuaa

SEQ ID NO: 1099860 - RNA, 19 nt, Homo sapiens
agaagaaccaugacacuua

SEQ ID NO: 1099861 - RNA, 19 nt, Homo sapiens
ugacaaagccuuauauuac

SEQ ID NO: 1099862 - RNA, 19 nt, Homo sapiens
caaauaggaccuggaauaa

SEQ ID NO: 1099863 - RNA, 19 nt, Homo sapiens
agaccaaccuucgaaauaa

SEQ ID NO: 1099864 - RNA, 19 nt, Homo sapiens
aagaucagcuuccaucaaa

SEQ ID NO: 1099865 - RNA, 19 nt, Homo sapiens
gcagccaagucuuaaugua

SEQ ID NO: 1099866 - RNA, 19 nt, Homo sapiens
ggacaaucauuucuaacau

SEQ ID NO: 1099867 - RNA, 19 nt, Homo sapiens
ccaugacacuuacuuacua

SEQ ID NO: 1099868 - RNA, 19 nt, Homo sapiens
gaagaaccaugacacuuac

SEQ ID NO: 1099869 - RNA, 19 nt, Homo sapiens
gcaguuaugaugcaaauga

SEQ ID NO: 1099870 - RNA, 19 nt, Homo sapiens
ccauuaagcuaacagagaa

SEQ ID NO: 1099871 - RNA, 19 nt, Homo sapiens
acaaauaggaccuggaaua

SEQ ID NO: 1099872 - RNA, 19 nt, Homo sapiens
gagaucaacuacuucaugu

SEQ ID NO: 1099873 - RNA, 19 nt, Homo sapiens
ucgcaguccugaagaaaua

SEQ ID NO: 1099874 - RNA, 19 nt, Homo sapiens
uaaagagcuuccaaagaaa

SEQ ID NO: 1099875 - RNA, 19 nt, Homo sapiens
gaaauugcaucugcuuauc

SEQ ID NO: 1099876 - RNA, 19 nt, Homo sapiens
agaagaagaugcccacaga

SEQ ID NO: 1099877 - RNA, 19 nt, Homo sapiens
gagggaagcugugggauuc

SEQ ID NO: 1099878 - RNA, 19 nt, Homo sapiens
cauguucaguucccuauuu

SEQ ID NO: 1099879 - RNA, 19 nt, Homo sapiens
ccaaaucaauaaagucuuc

SEQ ID NO: 1099880 - RNA, 19 nt, Homo sapiens
ggagcaugauugaaauuga

SEQ ID NO: 1099881 - RNA, 19 nt, Homo sapiens
gcuuggacauccugcuuua

SEQ ID NO: 1099882 - RNA, 19 nt, Homo sapiens
gcagauacccgcaauugau

SEQ ID NO: 1099883 - RNA, 19 nt, Homo sapiens
gaccaaccuucgaaauaaa

SEQ ID NO: 1099884 - RNA, 19 nt, Homo sapiens
gaucaacuacuucauguau

SEQ ID NO: 1099885 - RNA, 19 nt, Homo sapiens
gcacaacuuuaccggcaaa

SEQ ID NO: 1099886 - RNA, 19 nt, Homo sapiens
ggaagaaggccuagacauc

SEQ ID NO: 1099887 - RNA, 19 nt, Homo sapiens
gaucuugagucucccauca

SEQ ID NO: 1099888 - RNA, 19 nt, Homo sapiens
ggcuaugucucauggauuu

SEQ ID NO: 1099889 - RNA, 19 nt, Homo sapiens
gaaaagccaugcacuugaa

SEQ ID NO: 1099890 - RNA, 19 nt, Homo sapiens
gcaacagaaaggaggauua

SEQ ID NO: 1099891 - RNA, 19 nt, Homo sapiens
ugaaagguguugcagauuc

SEQ ID NO: 1099892 - RNA, 19 nt, Homo sapiens
uaaaagaccuagucccuaa

SEQ ID NO: 1099893 - RNA, 19 nt, Homo sapiens
gaccggagcaugauugaaa

SEQ ID NO: 1099894 - RNA, 19 nt, Homo sapiens
gacaaucauuucuaacaug

SEQ ID NO: 1099895 - RNA, 19 nt, Homo sapiens
gacaaagccuuauauuacu

SEQ ID NO: 1099896 - RNA, 19 nt, Homo sapiens
cuaguggaaucuaacauuu

SEQ ID NO: 1099897 - RNA, 19 nt, Homo sapiens
ucacagugguaauuaaaug

SEQ ID NO: 1099898 - RNA, 19 nt, Homo sapiens
gaaaggcgagggcauugaa

SEQ ID NO: 1099899 - RNA, 19 nt, Homo sapiens
gaauuucuuugaccacguu

SEQ ID NO: 1099900 - RNA, 19 nt, Homo sapiens
uaaggaaagugaagaaguc

SEQ ID NO: 1099901 - RNA, 19 nt, Homo sapiens
ccaggaugaugauguacua

SEQ ID NO: 1099902 - RNA, 19 nt, Homo sapiens
ucaaagaacagucagagaa

SEQ ID NO: 1099903 - RNA, 19 nt, Homo sapiens
caacagaauccucaaguuc

SEQ ID NO: 1099904 - RNA, 19 nt, Homo sapiens
gaaagguguugcagauucu

SEQ ID NO: 1099905 - RNA, 19 nt, Homo sapiens
gacccuuuauggauuauuu

SEQ ID NO: 1099906 - RNA, 19 nt, Homo sapiens
gcaucuauagcuacaguua

SEQ ID NO: 1099907 - RNA, 19 nt, Homo sapiens
ccauauccaugucgagaaa

SEQ ID NO: 1099908 - RNA, 19 nt, Homo sapiens
gugaagaaauccuagagau

SEQ ID NO: 1099909 - RNA, 19 nt, Homo sapiens
gaacaccaccuacauuguc

SEQ ID NO: 1099910 - RNA, 19 nt, Homo sapiens
ucuacugucuucuuaauga

SEQ ID NO: 1099911 - RNA, 19 nt, Homo sapiens
gggcugcucuuuccucugu

SEQ ID NO: 1099912 - RNA, 19 nt, Homo sapiens
gcugaagccugauccugaa

SEQ ID NO: 1099913 - RNA, 19 nt, Homo sapiens
cagaccaaccuucgaaaua

SEQ ID NO: 1099914 - RNA, 19 nt, Homo sapiens
uaugaaagguguugcagau

SEQ ID NO: 1099915 - RNA, 19 nt, Homo sapiens
ucagagagcaguuaagguu

SEQ ID NO: 1099916 - RNA, 19 nt, Homo sapiens
cuaauaccguggacaauca

SEQ ID NO: 1099917 - RNA, 19 nt, Homo sapiens
acauuugucuugaacauga

SEQ ID NO: 1099918 - RNA, 19 nt, Homo sapiens
ucaaccgaaucuuuccuua

SEQ ID NO: 1099919 - RNA, 19 nt, Homo sapiens
gagcuuccaaagaaaguua

SEQ ID NO: 1099920 - RNA, 19 nt, Homo sapiens
ccugauggcuuacgucugu

SEQ ID NO: 1099921 - RNA, 19 nt, Homo sapiens
gaaaaguucuacugucuuc

SEQ ID NO: 1099922 - RNA, 19 nt, Homo sapiens
gauccucaacuaccacaua

SEQ ID NO: 1099923 - RNA, 19 nt, Homo sapiens
ccuggaacaucaugaggua

SEQ ID NO: 1099924 - RNA, 19 nt, Homo sapiens
gaagaacuguuguaucuga

SEQ ID NO: 1099925 - RNA, 19 nt, Homo sapiens
gggaugagauuaaggauga

SEQ ID NO: 1099926 - RNA, 19 nt, Homo sapiens
ucacauggcuguucacuau

SEQ ID NO: 1099927 - RNA, 19 nt, Homo sapiens
caacaugggaugagauuaa

SEQ ID NO: 1099928 - RNA, 19 nt, Homo sapiens
gcaaugcgagccaauuaua

SEQ ID NO: 1099929 - RNA, 19 nt, Homo sapiens
ccaguaaagucaucacaaa

SEQ ID NO: 1099930 - RNA, 19 nt, Homo sapiens
gcaggaacgucaacaauac

SEQ ID NO: 1099931 - RNA, 19 nt, Homo sapiens
cuaauugugugacauauga

SEQ ID NO: 1099932 - RNA, 19 nt, Homo sapiens
cuacauaaauccaguaaag

SEQ ID NO: 1099933 - RNA, 19 nt, Homo sapiens
gaaagugaaguaacaauuc

SEQ ID NO: 1099934 - RNA, 19 nt, Homo sapiens
caugacagauucagaaaug

SEQ ID NO: 1099935 - RNA, 19 nt, Homo sapiens
aagaagaacuguuguaucu

SEQ ID NO: 1099936 - RNA, 19 nt, Homo sapiens
ggacugcccuuuggauguu

SEQ ID NO: 1099937 - RNA, 19 nt, Homo sapiens
ggauaaacauucugaacuc

SEQ ID NO: 1099938 - RNA, 19 nt, Homo sapiens
caaauggcccugagaagaa

SEQ ID NO: 1099939 - RNA, 19 nt, Homo sapiens
gguccaccgugccuauuua

SEQ ID NO: 1099940 - RNA, 19 nt, Homo sapiens
uaacagaucgggaaacuuc

SEQ ID NO: 1099941 - RNA, 19 nt, Homo sapiens
cagacugaauuaagcuuua

SEQ ID NO: 1099942 - RNA, 19 nt, Homo sapiens
ucaaauggccaguaacaaa

SEQ ID NO: 1099943 - RNA, 19 nt, Homo sapiens
gacauaugaugccaaagaa

SEQ ID NO: 1099944 - RNA, 19 nt, Homo sapiens
gaagcacauucccaaauuc

SEQ ID NO: 1099945 - RNA, 19 nt, Homo sapiens
agaagcacauucccaaauu

SEQ ID NO: 1099946 - RNA, 19 nt, Homo sapiens
aaucuacucugaugaagaa

SEQ ID NO: 1099947 - RNA, 19 nt, Homo sapiens
ucagagagacuacaccuaa

SEQ ID NO: 1099948 - RNA, 19 nt, Homo sapiens
guaaagucaucacaaaugg

SEQ ID NO: 1099949 - RNA, 19 nt, Homo sapiens
acaccuaagucuacauaaa

SEQ ID NO: 1099950 - RNA, 19 nt, Homo sapiens
gaacgucaacaauaccaaa

SEQ ID NO: 1099951 - RNA, 19 nt, Homo sapiens
aauugaggaugacauguua

SEQ ID NO: 1099952 - RNA, 19 nt, Homo sapiens
gauauucccuucaccaacu

SEQ ID NO: 1099953 - RNA, 19 nt, Homo sapiens
uaaagcaggcaucuaauug

SEQ ID NO: 1099954 - RNA, 19 nt, Homo sapiens
ggugaaugaugaaacaaau

SEQ ID NO: 1099955 - RNA, 19 nt, Homo sapiens
acauaaagcaggcaucuaa

SEQ ID NO: 1099956 - RNA, 19 nt, Homo sapiens
gcaaaaugauguugauaug

SEQ ID NO: 1099957 - RNA, 19 nt, Homo sapiens
ggaauucagaaccaaauga

SEQ ID NO: 1099958 - RNA, 19 nt, Homo sapiens
gaagauguaacagaugaaa

SEQ ID NO: 1099959 - RNA, 19 nt, Homo sapiens
caagggcaaugugucagua

SEQ ID NO: 1099960 - RNA, 19 nt, Homo sapiens
gaagaagaacuguuguauc

SEQ ID NO: 1099961 - RNA, 19 nt, Homo sapiens
gauuaaggaugaugcucuu

SEQ ID NO: 1099962 - RNA, 19 nt, Homo sapiens
ugacauaugaugccaaaga

SEQ ID NO: 1099963 - RNA, 19 nt, Homo sapiens
aaacaugacagauucagaa

SEQ ID NO: 1099964 - RNA, 19 nt, Homo sapiens
gcaaauugaggaugacaug

SEQ ID NO: 1099965 - RNA, 19 nt, Homo sapiens
acauggcuguucacuauaa

SEQ ID NO: 1099966 - RNA, 19 nt, Homo sapiens
ugacuccucuucucucaga

SEQ ID NO: 1099967 - RNA, 19 nt, Homo sapiens
ccaaguauuucagacaguu

SEQ ID NO: 1099968 - RNA, 19 nt, Homo sapiens
aaacuucaacuuuggauga

SEQ ID NO: 1099969 - RNA, 19 nt, Homo sapiens
aaauagcuccuuuaccuuu

SEQ ID NO: 1099970 - RNA, 19 nt, Homo sapiens
guucaguucuccaguguca

SEQ ID NO: 1099971 - RNA, 19 nt, Homo sapiens
ucagacaguuuaacagauc

SEQ ID NO: 1099972 - RNA, 19 nt, Homo sapiens
aauagcuccuuuaccuuua

SEQ ID NO: 1099973 - RNA, 19 nt, Homo sapiens
caacgaagagagaaacuca

SEQ ID NO: 1099974 - RNA, 19 nt, Homo sapiens
gaacauaaagcaggcaucu

SEQ ID NO: 1099975 - RNA, 19 nt, Homo sapiens
uaccucaaauggccaguaa

SEQ ID NO: 1099976 - RNA, 19 nt, Homo sapiens
cauugaagauguaacagau

SEQ ID NO: 1099977 - RNA, 19 nt, Homo sapiens
caucuaauugugugacaua

SEQ ID NO: 1099978 - RNA, 19 nt, Homo sapiens
ugaaacccagacugaauua

SEQ ID NO: 1099979 - RNA, 19 nt, Homo sapiens
uugaagauguaacagauga

SEQ ID NO: 1099980 - RNA, 19 nt, Homo sapiens
cuacucugaugaagaagaa

SEQ ID NO: 1099981 - RNA, 19 nt, Homo sapiens
ggaaacuucugugaauguc

SEQ ID NO: 1099982 - RNA, 19 nt, Homo sapiens
ucgggaaacuucugugaau

SEQ ID NO: 1099983 - RNA, 19 nt, Homo sapiens
gauaaacauucugaacucu

SEQ ID NO: 1099984 - RNA, 19 nt, Homo sapiens
caaugcgagccaauuauaa

SEQ ID NO: 1099985 - RNA, 19 nt, Homo sapiens
ucacaguaucgcuauuaua

SEQ ID NO: 1099986 - RNA, 19 nt, Homo sapiens
uaacaaacaauugccauuc

SEQ ID NO: 1099987 - RNA, 19 nt, Homo sapiens
guggggaucuuuuggauaa

SEQ ID NO: 1099988 - RNA, 19 nt, Homo sapiens
gaucgggaaacuucuguga

SEQ ID NO: 1099989 - RNA, 19 nt, Homo sapiens
gcugaaacccagacugaau

SEQ ID NO: 1099990 - RNA, 19 nt, Homo sapiens
ucacaaauggcccugagaa

SEQ ID NO: 1099991 - RNA, 19 nt, Homo sapiens
gaccaacaacgaagagaga

SEQ ID NO: 1099992 - RNA, 19 nt, Homo sapiens
ucaaaggcgacaauaauca

SEQ ID NO: 1099993 - RNA, 19 nt, Homo sapiens
gggaaacuucugugaaugu

SEQ ID NO: 1099994 - RNA, 19 nt, Homo sapiens
acaggugaaugaugaaaca

SEQ ID NO: 1099995 - RNA, 19 nt, Homo sapiens
caaaggaugagaacgagau

SEQ ID NO: 1099996 - RNA, 19 nt, Homo sapiens
acaaauggcccugagaaga

SEQ ID NO: 1099997 - RNA, 19 nt, Homo sapiens
uaaauccaguaaagucauc

SEQ ID NO: 1099998 - RNA, 19 nt, Homo sapiens
gcacugacuccucuucucu

SEQ ID NO: 1099999 - RNA, 19 nt, Homo sapiens
gagauauucccuucaccaa

SEQ ID NO: 1100000 - RNA, 19 nt, Homo sapiens
ugaagaagaacuguuguau

SEQ ID NO: 1100001 - RNA, 19 nt, Homo sapiens
ugugacauaugaugccaaa

SEQ ID NO: 1100002 - RNA, 19 nt, Homo sapiens
aacaaacaauugccauuca

SEQ ID NO: 1100003 - RNA, 19 nt, Homo sapiens
agaaucacauggcuguuca

SEQ ID NO: 1100004 - RNA, 19 nt, Homo sapiens
caccuaagucuacauaaau

SEQ ID NO: 1100005 - RNA, 19 nt, Homo sapiens
cuacaccuaagucuacaua

SEQ ID NO: 1100006 - RNA, 19 nt, Homo sapiens
cagaagggguuauaauuca

SEQ ID NO: 1100007 - RNA, 19 nt, Homo sapiens
ugaguaccagcauaaagua

SEQ ID NO: 1100008 - RNA, 19 nt, Homo sapiens
gaacgagauauucccuuca

SEQ ID NO: 1100009 - RNA, 19 nt, Homo sapiens
aagcaggcaucuaauugug

SEQ ID NO: 1100010 - RNA, 19 nt, Homo sapiens
aaacuucugugaaugucau

SEQ ID NO: 1100011 - RNA, 19 nt, Homo sapiens
uaaaguaugcagaccaaca

SEQ ID NO: 1100012 - RNA, 19 nt, Homo sapiens
uaaaauccuuucagccaaa

SEQ ID NO: 1100013 - RNA, 19 nt, Homo sapiens
gaaacccagacugaauuaa

SEQ ID NO: 1100014 - RNA, 19 nt, Homo sapiens
cagaagcacauucccaaau

SEQ ID NO: 1100015 - RNA, 19 nt, Homo sapiens
cugcaaugcgagccaauua

SEQ ID NO: 1100016 - RNA, 19 nt, Homo sapiens
ugaugaagaagaacuguug

SEQ ID NO: 1100017 - RNA, 19 nt, Homo sapiens
agaagggcaugacucaaca

SEQ ID NO: 1100018 - RNA, 19 nt, Homo sapiens
gcauugaggacugcccuuu

SEQ ID NO: 1100019 - RNA, 19 nt, Homo sapiens
auaaagcaggcaucuaauu

SEQ ID NO: 1100020 - RNA, 19 nt, Homo sapiens
guuagucacuucgaaagca

SEQ ID NO: 1100021 - RNA, 19 nt, Homo sapiens
aaccgcaaauugaggauga

SEQ ID NO: 1100022 - RNA, 19 nt, Homo sapiens
caggcgaaccgcaaauuga

SEQ ID NO: 1100023 - RNA, 19 nt, Homo sapiens
ucaguucuccagugucaaa

SEQ ID NO: 1100024 - RNA, 19 nt, Homo sapiens
gaaagacgauguucaacuu

SEQ ID NO: 1100025 - RNA, 19 nt, Homo sapiens
caagauggcugucugguuu

SEQ ID NO: 1100026 - RNA, 19 nt, Homo sapiens
gaacugaauuguuuagaga

SEQ ID NO: 1100027 - RNA, 19 nt, Homo sapiens
gagcaagaauccugcaaua

SEQ ID NO: 1100028 - RNA, 19 nt, Homo sapiens
gaaagaaccaugacuguau

SEQ ID NO: 1100029 - RNA, 19 nt, Homo sapiens
gcaucagacuggccauuua

SEQ ID NO: 1100030 - RNA, 19 nt, Homo sapiens
gaagaacacgcauuggaua

SEQ ID NO: 1100031 - RNA, 19 nt, Homo sapiens
gagauuaaggcuaucauua

SEQ ID NO: 1100032 - RNA, 19 nt, Homo sapiens
gcaagaauccugcaauaug

SEQ ID NO: 1100033 - RNA, 19 nt, Homo sapiens
ggccagagcuguguuuaaa

SEQ ID NO: 1100034 - RNA, 19 nt, Homo sapiens
caguaacccugaagaauaa

SEQ ID NO: 1100035 - RNA, 19 nt, Homo sapiens
gggaagagguuggaaagaa

SEQ ID NO: 1100036 - RNA, 19 nt, Homo sapiens
gaacacgcauuggauauuc

SEQ ID NO: 1100037 - RNA, 19 nt, Homo sapiens
ggaaggagaaggaagaauu

SEQ ID NO: 1100038 - RNA, 19 nt, Homo sapiens
gguauucucugccauguug

SEQ ID NO: 1100039 - RNA, 19 nt, Homo sapiens
caacagaggccauguggaa

SEQ ID NO: 1100040 - RNA, 19 nt, Homo sapiens
ggaaauggaagaucgauug

SEQ ID NO: 1100041 - RNA, 19 nt, Homo sapiens
ggaaagauuuacuaagaag

SEQ ID NO: 1100042 - RNA, 19 nt, Homo sapiens
gaaggagaaggaagaauuu

SEQ ID NO: 1100043 - RNA, 19 nt, Homo sapiens
gcacagcuauuugacuuug

SEQ ID NO: 1100044 - RNA, 19 nt, Homo sapiens
gagcugauccggagaagaa

SEQ ID NO: 1100045 - RNA, 19 nt, Homo sapiens
gaagaauaccguccgcuuu

SEQ ID NO: 1100046 - RNA, 19 nt, Homo sapiens
ggaaagaaccaugacugua

SEQ ID NO: 1100047 - RNA, 19 nt, Homo sapiens
ucaaauaguggguuccuua

SEQ ID NO: 1100048 - RNA, 19 nt, Homo sapiens
caagaauccugcaauaugg

SEQ ID NO: 1100049 - RNA, 19 nt, Homo sapiens
ggauugggcuuaucgaagu

SEQ ID NO: 1100050 - RNA, 19 nt, Homo sapiens
gagggaagcucuggaagug

SEQ ID NO: 1100051 - RNA, 19 nt, Homo sapiens
gagacacacacuuuaauuu

SEQ ID NO: 1100052 - RNA, 19 nt, Homo sapiens
ggaaaaugauucaguuuga

SEQ ID NO: 1100053 - RNA, 19 nt, Homo sapiens
gaucgauugucuucagaaa

SEQ ID NO: 1100054 - RNA, 19 nt, Homo sapiens
aaaccagcuuuguggauua

SEQ ID NO: 1100055 - RNA, 19 nt, Homo sapiens
gcagaggcauuuguagcua

SEQ ID NO: 1100056 - RNA, 19 nt, Homo sapiens
gaaggcacaugaacugaag

SEQ ID NO: 1100057 - RNA, 19 nt, Homo sapiens
caaggaagacuuuaucaau

SEQ ID NO: 1100058 - RNA, 19 nt, Homo sapiens
guaagaagugggcuacuaa

SEQ ID NO: 1100059 - RNA, 19 nt, Homo sapiens
aaagaaccaugacuguauu

SEQ ID NO: 1100060 - RNA, 19 nt, Homo sapiens
cgcauuggauauucauuua

SEQ ID NO: 1100061 - RNA, 19 nt, Homo sapiens
gggcaaauuuguauugagu

SEQ ID NO: 1100062 - RNA, 19 nt, Homo sapiens
ggagaaggaagaauuugaa

SEQ ID NO: 1100063 - RNA, 19 nt, Homo sapiens
ggaacugaauuguuuagag

SEQ ID NO: 1100064 - RNA, 19 nt, Homo sapiens
uacaagcaguugaguguuu

SEQ ID NO: 1100065 - RNA, 19 nt, Homo sapiens
aggaugagauugagaauuc

SEQ ID NO: 1100066 - RNA, 19 nt, Homo sapiens
cagaugauccucucacuug

SEQ ID NO: 1100067 - RNA, 19 nt, Homo sapiens
gcaaggcaacuauuucuuc

SEQ ID NO: 1100068 - RNA, 19 nt, Homo sapiens
ugucauaggugccgacuca

SEQ ID NO: 1100069 - RNA, 19 nt, Homo sapiens
ucucuuagcugucauaggu

SEQ ID NO: 1100070 - RNA, 19 nt, Homo sapiens
ggaagagguuggaaagaac

SEQ ID NO: 1100071 - RNA, 19 nt, Homo sapiens
guauugaguccaucuguaa

SEQ ID NO: 1100072 - RNA, 19 nt, Homo sapiens
gaggugcugugcuguguau

SEQ ID NO: 1100073 - RNA, 19 nt, Homo sapiens
gaagaucggcucccggaau

SEQ ID NO: 1100074 - RNA, 19 nt, Homo sapiens
ucaaagagcccugacauag

SEQ ID NO: 1100075 - RNA, 19 nt, Homo sapiens
guguuucguugcuguguua

SEQ ID NO: 1100076 - RNA, 19 nt, Homo sapiens
gaagagcagccuacaacga

SEQ ID NO: 1100077 - RNA, 19 nt, Homo sapiens
uggcauggaucaucuacaa

SEQ ID NO: 1100078 - RNA, 19 nt, Homo sapiens
gaacagcuggagcgcauug

SEQ ID NO: 1100079 - RNA, 19 nt, Homo sapiens
aagaauaaguaccuggauu

SEQ ID NO: 1100080 - RNA, 19 nt, Homo sapiens
gcucagugauggcagacaa

SEQ ID NO: 1100081 - RNA, 19 nt, Homo sapiens
cagaggcauuuguagcuaa

SEQ ID NO: 1100082 - RNA, 19 nt, Homo sapiens
ggaaggcacaugaacugaa

SEQ ID NO: 1100083 - RNA, 19 nt, Homo sapiens
gagaaggaagaauuugaaa

SEQ ID NO: 1100084 - RNA, 19 nt, Homo sapiens
uguaagaagugggcuacua

SEQ ID NO: 1100085 - RNA, 19 nt, Homo sapiens
ugucugccauuguggauuu

SEQ ID NO: 1100086 - RNA, 19 nt, Homo sapiens
gauaauucaggaacgcaua

SEQ ID NO: 1100087 - RNA, 19 nt, Homo sapiens
aagaucggcucccggaauu

SEQ ID NO: 1100088 - RNA, 19 nt, Homo sapiens
gcugugcuguguaugaaga

SEQ ID NO: 1100089 - RNA, 19 nt, Homo sapiens
gagaggugcugugcugugu

SEQ ID NO: 1100090 - RNA, 19 nt, Homo sapiens
ggccauuuaugaagaugaa

SEQ ID NO: 1100091 - RNA, 19 nt, Homo sapiens
ggaaagacgauguucaacu

SEQ ID NO: 1100092 - RNA, 19 nt, Homo sapiens
gagauugagaauucuauug

SEQ ID NO: 1100093 - RNA, 19 nt, Homo sapiens
uuaagaaggaugagauuga

SEQ ID NO: 1100094 - RNA, 19 nt, Homo sapiens
ggagauuaaggcuaucauu

SEQ ID NO: 1100095 - RNA, 19 nt, Homo sapiens
gaguuuggauccgcagauu

SEQ ID NO: 1100096 - RNA, 19 nt, Homo sapiens
ggcgagaauuagagauuga

SEQ ID NO: 1100097 - RNA, 19 nt, Homo sapiens
gcaaggcgagaauuagaga

SEQ ID NO: 1100098 - RNA, 19 nt, Homo sapiens
gaaagcgcaaggcaacuau

SEQ ID NO: 1100099 - RNA, 19 nt, Homo sapiens
gaaauggaagaucgauugu

SEQ ID NO: 1100100 - RNA, 19 nt, Homo sapiens
agaagaagaacacgcauug

SEQ ID NO: 1100101 - RNA, 19 nt, Homo sapiens
gagaagaagaacacgcauu

SEQ ID NO: 1100102 - RNA, 19 nt, Homo sapiens
ucgaagugguggcuacaaa

SEQ ID NO: 1100103 - RNA, 19 nt, Homo sapiens
cauaggugccgacucagua

SEQ ID NO: 1100104 - RNA, 19 nt, Homo sapiens
uuucguugcuguguuauaa

SEQ ID NO: 1100105 - RNA, 19 nt, Homo sapiens
gaaguguuacaucaccuuu

SEQ ID NO: 1100106 - RNA, 19 nt, Homo sapiens
aauuagagauugagucaca

SEQ ID NO: 1100107 - RNA, 19 nt, Homo sapiens
ggauggauuauaugaaaga

SEQ ID NO: 1100108 - RNA, 19 nt, Homo sapiens
gagagagcuuugagagagu

SEQ ID NO: 1100109 - RNA, 19 nt, Homo sapiens
ugagacacacacuuuaauu

SEQ ID NO: 1100110 - RNA, 19 nt, Homo sapiens
uguauugaguccaucugua

SEQ ID NO: 1100111 - RNA, 19 nt, Homo sapiens
gaucuuuggauggauuaua

SEQ ID NO: 1100112 - RNA, 19 nt, Homo sapiens
gagcuguguuuaaaaguuu

SEQ ID NO: 1100113 - RNA, 19 nt, Homo sapiens
guaccuggauugggcuuau

SEQ ID NO: 1100114 - RNA, 19 nt, Homo sapiens
cacaugaacugaagcuucu

SEQ ID NO: 1100115 - RNA, 19 nt, Homo sapiens
ggcgauucauuccaacaaa

SEQ ID NO: 1100116 - RNA, 19 nt, Homo sapiens
gaagugggcuacuaaaacu

SEQ ID NO: 1100117 - RNA, 19 nt, Homo sapiens
uaagaaggaugagauugag

SEQ ID NO: 1100118 - RNA, 19 nt, Homo sapiens
uggcgaacauaagagaaua

SEQ ID NO: 1100119 - RNA, 19 nt, Homo sapiens
ggaccucauggcagagaua

SEQ ID NO: 1100120 - RNA, 19 nt, Homo sapiens
ccucauggcagagauaauu

SEQ ID NO: 1100121 - RNA, 19 nt, Homo sapiens
ccaaaugggaaauggaaga

SEQ ID NO: 1100122 - RNA, 19 nt, Homo sapiens
aagacgauguucaacuuug

SEQ ID NO: 1100123 - RNA, 19 nt, Homo sapiens
ucuguaauuugcucaguga

SEQ ID NO: 1100124 - RNA, 19 nt, Homo sapiens
aaacaaagcuccaguauuu

SEQ ID NO: 1100125 - RNA, 19 nt, Homo sapiens
ggaagaagcuggaagaaga

SEQ ID NO: 1100126 - RNA, 19 nt, Homo sapiens
ggaagaaacugaaagagaa

SEQ ID NO: 1100127 - RNA, 19 nt, Homo sapiens
ggaagaaacugaaagagaa

SEQ ID NO: 1100128 - RNA, 19 nt, Homo sapiens
ggaagaaacugaaagagaa

SEQ ID NO: 1100129 - RNA, 19 nt, Homo sapiens
ggaagaaacuggaagaaga

SEQ ID NO: 1100130 - RNA, 19 nt, Homo sapiens
ggaagaaacuggaagaaga

SEQ ID NO: 1100131 - RNA, 19 nt, Homo sapiens
cagcagagauuaauacuaa

SEQ ID NO: 1100132 - RNA, 19 nt, Homo sapiens
gaagagcaauaucucaaua

SEQ ID NO: 1100133 - RNA, 19 nt, Homo sapiens
ggagagaaauuuccucaaa

SEQ ID NO: 1100134 - RNA, 19 nt, Homo sapiens
ccaacaggcuugaugauua

SEQ ID NO: 1100135 - RNA, 19 nt, Homo sapiens
agaggaagaugucauauua

SEQ ID NO: 1100136 - RNA, 19 nt, Homo sapiens
gagagaaacuguaagacua

SEQ ID NO: 1100137 - RNA, 19 nt, Homo sapiens
gagcaaggauagaaauuaa

SEQ ID NO: 1100138 - RNA, 19 nt, Homo sapiens
gaaguaaaccuaacugaaa

SEQ ID NO: 1100139 - RNA, 19 nt, Homo sapiens
gaagaacgauauuaccaaa

SEQ ID NO: 1100140 - RNA, 19 nt, Homo sapiens
gaacagaagccacuugaaa

SEQ ID NO: 1100141 - RNA, 19 nt, Homo sapiens
gaaagaaacuggaaaagaa

SEQ ID NO: 1100142 - RNA, 19 nt, Homo sapiens
ggaaauugaucaaacagaa

SEQ ID NO: 1100143 - RNA, 19 nt, Homo sapiens
gaaaugaaggaaaguguua

SEQ ID NO: 1100144 - RNA, 19 nt, Homo sapiens
gaacacagaauguaugaaa

SEQ ID NO: 1100145 - RNA, 19 nt, Homo sapiens
gaauaaaugucaggcuaua

SEQ ID NO: 1100146 - RNA, 19 nt, Homo sapiens
gaagagaucuguguuacug

SEQ ID NO: 1100147 - RNA, 19 nt, Homo sapiens
gaaggaaaguguuauccaa

SEQ ID NO: 1100148 - RNA, 19 nt, Homo sapiens
ccaaacugcucgacaagua

SEQ ID NO: 1100149 - RNA, 19 nt, Homo sapiens
ggagacagauuugaaagaa

SEQ ID NO: 1100150 - RNA, 19 nt, Homo sapiens
gaaguagaccuaaaucaaa

SEQ ID NO: 1100151 - RNA, 19 nt, Homo sapiens
ggaaagaucucagaaggau

SEQ ID NO: 1100152 - RNA, 19 nt, Homo sapiens
gaaacaaucagacaugaaa

SEQ ID NO: 1100153 - RNA, 19 nt, Homo sapiens
gaaaguaucaggaaagaug

SEQ ID NO: 1100154 - RNA, 19 nt, Homo sapiens
gaagaucaaucgcguaaag

SEQ ID NO: 1100155 - RNA, 19 nt, Homo sapiens
caauaaacuucaccucuuu

SEQ ID NO: 1100156 - RNA, 19 nt, Homo sapiens
aaagauggcuguuguugaa

SEQ ID NO: 1100157 - RNA, 19 nt, Homo sapiens
aaacauagauggcauugug

SEQ ID NO: 1100158 - RNA, 19 nt, Homo sapiens
gaaagcaacuggaaaugag

SEQ ID NO: 1100159 - RNA, 19 nt, Homo sapiens
agacaaaggugaagccaaa

SEQ ID NO: 1100160 - RNA, 19 nt, Homo sapiens
agaaagaaauguugaccua

SEQ ID NO: 1100161 - RNA, 19 nt, Homo sapiens
cgaaacaaguuacucuaaa

SEQ ID NO: 1100162 - RNA, 19 nt, Homo sapiens
gaagagagauuugucuaag

SEQ ID NO: 1100163 - RNA, 19 nt, Homo sapiens
ggucaagccuguagguaaa

SEQ ID NO: 1100164 - RNA, 19 nt, Homo sapiens
ggucaagccuguagaugaa

SEQ ID NO: 1100165 - RNA, 19 nt, Homo sapiens
ggucaagccuguagaugaa

SEQ ID NO: 1100166 - RNA, 19 nt, Homo sapiens
gaagcaagauggagcuaau

SEQ ID NO: 1100167 - RNA, 19 nt, Homo sapiens
gaaacugagggaaauguua

SEQ ID NO: 1100168 - RNA, 19 nt, Homo sapiens
gaauaaggaucagagcaaa

SEQ ID NO: 1100169 - RNA, 19 nt, Homo sapiens
caacaggcuugaugauuau

SEQ ID NO: 1100170 - RNA, 19 nt, Homo sapiens
gaaguuggaccaucaagaa

SEQ ID NO: 1100171 - RNA, 19 nt, Homo sapiens
ucuaaaccauggucaaaua

SEQ ID NO: 1100172 - RNA, 19 nt, Homo sapiens
gggcagaaauggaaacuca

SEQ ID NO: 1100173 - RNA, 19 nt, Homo sapiens
gaagccaaaggcauaauua

SEQ ID NO: 1100174 - RNA, 19 nt, Homo sapiens
ugaugaagcuucccuaaug

SEQ ID NO: 1100175 - RNA, 19 nt, Homo sapiens
gagagagacuacagaauca

SEQ ID NO: 1100176 - RNA, 19 nt, Homo sapiens
ggagauugauuugaaagaa

SEQ ID NO: 1100177 - RNA, 19 nt, Homo sapiens
cuaaagaaaugcagucaga

SEQ ID NO: 1100178 - RNA, 19 nt, Homo sapiens
gugaaggagugaauaauga

SEQ ID NO: 1100179 - RNA, 19 nt, Homo sapiens
ugacaaugauguugaagaa

SEQ ID NO: 1100180 - RNA, 19 nt, Homo sapiens
gaacaugagcuaccaaaca

SEQ ID NO: 1100181 - RNA, 19 nt, Homo sapiens
gaugaagcuucccuaauga

SEQ ID NO: 1100182 - RNA, 19 nt, Homo sapiens
gaacauuagcagugaagua

SEQ ID NO: 1100183 - RNA, 19 nt, Homo sapiens
agacaaagaucuggaagaa

SEQ ID NO: 1100184 - RNA, 19 nt, Homo sapiens
acaaauggauggagaauag

SEQ ID NO: 1100185 - RNA, 19 nt, Homo sapiens
gcugugauauugccaugua

SEQ ID NO: 1100186 - RNA, 19 nt, Homo sapiens
ggaggcagauuugaaagaa

SEQ ID NO: 1100187 - RNA, 19 nt, Homo sapiens
gagaaaguaucaggaaaga

SEQ ID NO: 1100188 - RNA, 19 nt, Homo sapiens
ccaaagaccuaaacccaau

SEQ ID NO: 1100189 - RNA, 19 nt, Homo sapiens
gaagaaagcgaauaucaag

SEQ ID NO: 1100190 - RNA, 19 nt, Homo sapiens
ggaagaagaugaugaugcu

SEQ ID NO: 1100191 - RNA, 19 nt, Homo sapiens
gaagccacuugaaauuaaa

SEQ ID NO: 1100192 - RNA, 19 nt, Homo sapiens
gaaaccaaagccaaauaua

SEQ ID NO: 1100193 - RNA, 19 nt, Homo sapiens
ggaagggagucaacuaaag

SEQ ID NO: 1100194 - RNA, 19 nt, Homo sapiens
caagagagcaagaagguaa

SEQ ID NO: 1100195 - RNA, 19 nt, Homo sapiens
gauaaaggacucuaaagga

SEQ ID NO: 1100196 - RNA, 19 nt, Homo sapiens
ggacagaggcaaauaguag

SEQ ID NO: 1100197 - RNA, 19 nt, Homo sapiens
agaagccacuugaaauuaa

SEQ ID NO: 1100198 - RNA, 19 nt, Homo sapiens
gaagaaacuggaagaagaa

SEQ ID NO: 1100199 - RNA, 19 nt, Homo sapiens
ggaccaguauuucuucaga

SEQ ID NO: 1100200 - RNA, 19 nt, Homo sapiens
gcacaaaugacaagaagga

SEQ ID NO: 1100201 - RNA, 19 nt, Homo sapiens
guagaaaaccuucauguua

SEQ ID NO: 1100202 - RNA, 19 nt, Homo sapiens
ggaaggaagaacgauauua

SEQ ID NO: 1100203 - RNA, 19 nt, Homo sapiens
gaagagagagacuacagaa

SEQ ID NO: 1100204 - RNA, 19 nt, Homo sapiens
gaaggaugcucagacaguu

SEQ ID NO: 1100205 - RNA, 19 nt, Homo sapiens
gagaagaaauccaccaaac

SEQ ID NO: 1100206 - RNA, 19 nt, Homo sapiens
gugaacauauccaagauga

SEQ ID NO: 1100207 - RNA, 19 nt, Homo sapiens
ggugaaaggagaagucaua

SEQ ID NO: 1100208 - RNA, 19 nt, Homo sapiens
gcuaugccuucacuagaua

SEQ ID NO: 1100209 - RNA, 19 nt, Homo sapiens
agagauagauuuggaagaa

SEQ ID NO: 1100210 - RNA, 19 nt, Homo sapiens
aaugggagaucuaguauug

SEQ ID NO: 1100211 - RNA, 19 nt, Homo sapiens
gagaagaaagcgaauauca

SEQ ID NO: 1100212 - RNA, 19 nt, Homo sapiens
gaaacuggaagaagagaaa

SEQ ID NO: 1100213 - RNA, 19 nt, Homo sapiens
ggucaagccucuaggugaa

SEQ ID NO: 1100214 - RNA, 19 nt, Homo sapiens
ggaagagagauuugucuaa

SEQ ID NO: 1100215 - RNA, 19 nt, Homo sapiens
gcagguugcauuagaagua

SEQ ID NO: 1100216 - RNA, 19 nt, Homo sapiens
ucagacagauaccgaauau

SEQ ID NO: 1100217 - RNA, 19 nt, Homo sapiens
gaaaggagaagucauaaaa

SEQ ID NO: 1100218 - RNA, 19 nt, Homo sapiens
ggaauuagaagaaguugga

SEQ ID NO: 1100219 - RNA, 19 nt, Homo sapiens
guacacagacugaaaggaa

SEQ ID NO: 1100220 - RNA, 19 nt, Homo sapiens
gauugaugcugcugaggua

SEQ ID NO: 1100221 - RNA, 19 nt, Homo sapiens
guaaagcugcugaaagaaa

SEQ ID NO: 1100222 - RNA, 19 nt, Homo sapiens
ggaacugacuuuucuauga

SEQ ID NO: 1100223 - RNA, 19 nt, Homo sapiens
ugacaucucuggagguuuc

SEQ ID NO: 1100224 - RNA, 19 nt, Homo sapiens
ggaggacccugugaaguua

SEQ ID NO: 1100225 - RNA, 19 nt, Homo sapiens
gaacuuggcugaggaguac

SEQ ID NO: 1100226 - RNA, 19 nt, Homo sapiens
ccagauuucuucuucaauu

SEQ ID NO: 1100227 - RNA, 19 nt, Homo sapiens
aaagagacguucccagauu

SEQ ID NO: 1100228 - RNA, 19 nt, Homo sapiens
gagcugaggagaaauauga

SEQ ID NO: 1100229 - RNA, 19 nt, Homo sapiens
caugagagcugaggagaaa

SEQ ID NO: 1100230 - RNA, 19 nt, Homo sapiens
gaccauagacgaauccuuu

SEQ ID NO: 1100231 - RNA, 19 nt, Homo sapiens
ccaacgagguuaugaguca

SEQ ID NO: 1100232 - RNA, 19 nt, Homo sapiens
gcacgcagauggaacucaa

SEQ ID NO: 1100233 - RNA, 19 nt, Homo sapiens
ggaagaagccgugguggaa

SEQ ID NO: 1100234 - RNA, 19 nt, Homo sapiens
ggccugggcuuauacuauu

SEQ ID NO: 1100235 - RNA, 19 nt, Homo sapiens
ugaaggagaugacaaaugc

SEQ ID NO: 1100236 - RNA, 19 nt, Homo sapiens
caacaugaaggccaacuuu

SEQ ID NO: 1100237 - RNA, 19 nt, Homo sapiens
ggagugagaauguguaugu

SEQ ID NO: 1100238 - RNA, 19 nt, Homo sapiens
gcaggagcuuggcauagaa

SEQ ID NO: 1100239 - RNA, 19 nt, Homo sapiens
caacuaccgcucacuguuu

SEQ ID NO: 1100240 - RNA, 19 nt, Homo sapiens
cagcagcaaugcagacuug

SEQ ID NO: 1100241 - RNA, 19 nt, Homo sapiens
gaaggaacgggaccaauuc

SEQ ID NO: 1100242 - RNA, 19 nt, Homo sapiens
ugaccaaacugaggaagaa

SEQ ID NO: 1100243 - RNA, 19 nt, Homo sapiens
gggaggacccugugaaguu

SEQ ID NO: 1100244 - RNA, 19 nt, Homo sapiens
gagaagaugaacuugcuaa

SEQ ID NO: 1100245 - RNA, 19 nt, Homo sapiens
gaugacaaaugcugacagu

SEQ ID NO: 1100246 - RNA, 19 nt, Homo sapiens
gaaagcggagugagaaugu

SEQ ID NO: 1100247 - RNA, 19 nt, Homo sapiens
gaaagagacguucccagau

SEQ ID NO: 1100248 - RNA, 19 nt, Homo sapiens
ugagaaggacgaguacuua

SEQ ID NO: 1100249 - RNA, 19 nt, Homo sapiens
aacaauacauggaugagaa

SEQ ID NO: 1100250 - RNA, 19 nt, Homo sapiens
gaacaauacauggaugaga

SEQ ID NO: 1100251 - RNA, 19 nt, Homo sapiens
guucaacacuguccucaag

SEQ ID NO: 1100252 - RNA, 19 nt, Homo sapiens
ucaguucuaugcagucuug

SEQ ID NO: 1100253 - RNA, 19 nt, Homo sapiens
gagaggauccuggccauga

SEQ ID NO: 1100254 - RNA, 19 nt, Homo sapiens
gacaagagcacccagaauc

SEQ ID NO: 1100255 - RNA, 19 nt, Homo sapiens
gccauggccugggcuuaua

SEQ ID NO: 1100256 - RNA, 19 nt, Homo sapiens
agaaagagaagaugaacuu

SEQ ID NO: 1100257 - RNA, 19 nt, Homo sapiens
gaaaucucccugcucaaga

SEQ ID NO: 1100258 - RNA, 19 nt, Homo sapiens
gaggagaaauaugaaaucu

SEQ ID NO: 1100259 - RNA, 19 nt, Homo sapiens
aagagacguucccagauuu

SEQ ID NO: 1100260 - RNA, 19 nt, Homo sapiens
ugaaggaacgggaccaauu

SEQ ID NO: 1100261 - RNA, 19 nt, Homo sapiens
ggagggacuuugaaaugca

SEQ ID NO: 1100262 - RNA, 19 nt, Homo sapiens
ggaacgggaccaauucuuc

SEQ ID NO: 1100263 - RNA, 19 nt, Homo sapiens
aaugaggacugcaaugaga

SEQ ID NO: 1100264 - RNA, 19 nt, Homo sapiens
gaagaagccgugguggaaa

SEQ ID NO: 1100265 - RNA, 19 nt, Homo sapiens
ugaaugagcugcgguacca

SEQ ID NO: 1100266 - RNA, 19 nt, Homo sapiens
ugagagcugaggagaaaua

SEQ ID NO: 1100267 - RNA, 19 nt, Homo sapiens
gcaagaaggacguggucaa

SEQ ID NO: 1100268 - RNA, 19 nt, Homo sapiens
gaaguuaacccuggcucuu

SEQ ID NO: 1100269 - RNA, 19 nt, Homo sapiens
guucccagauuucuucuuc

SEQ ID NO: 1100270 - RNA, 19 nt, Homo sapiens
aaaucucccugcucaagaa

SEQ ID NO: 1100271 - RNA, 19 nt, Homo sapiens
aacuaccgcucacuguuua

SEQ ID NO: 1100272 - RNA, 19 nt, Homo sapiens
ggaaagcggagugagaaug

SEQ ID NO: 1100273 - RNA, 19 nt, Homo sapiens
guacuuggaggaacuggaa

SEQ ID NO: 1100274 - RNA, 19 nt, Homo sapiens
ggagaagaccaacaaggau

SEQ ID NO: 1100275 - RNA, 19 nt, Homo sapiens
ugaaugaggacugcaauga

SEQ ID NO: 1100276 - RNA, 19 nt, Homo sapiens
gggaccaauucuucucuga

SEQ ID NO: 1100277 - RNA, 19 nt, Homo sapiens
gaacgggaccaauucuucu

SEQ ID NO: 1100278 - RNA, 19 nt, Homo sapiens
caggagggacuuugaaaug

SEQ ID NO: 1100279 - RNA, 19 nt, Homo sapiens
ggaccaagugcaaagaugu

SEQ ID NO: 1100280 - RNA, 19 nt, Homo sapiens
agauggaacucaacaacau

SEQ ID NO: 1100281 - RNA, 19 nt, Homo sapiens
gaaagagaagaugaacuug

SEQ ID NO: 1100282 - RNA, 19 nt, Homo sapiens
acaagaagccaagcaagaa

SEQ ID NO: 1100283 - RNA, 19 nt, Homo sapiens
ucaagaaagagaagaugaa

SEQ ID NO: 1100284 - RNA, 19 nt, Homo sapiens
agacgaauccuuucucaca

SEQ ID NO: 1100285 - RNA, 19 nt, Homo sapiens
acagugaacaccuacauga

SEQ ID NO: 1100286 - RNA, 19 nt, Homo sapiens
agaaugaggagaagauuuc

SEQ ID NO: 1100287 - RNA, 19 nt, Homo sapiens
aggccaagcuugucacugu

SEQ ID NO: 1100288 - RNA, 19 nt, Homo sapiens
gguuaugagucaguucuau

SEQ ID NO: 1100289 - RNA, 19 nt, Homo sapiens
gaagaugaacuugcuaaaa

SEQ ID NO: 1100290 - RNA, 19 nt, Homo sapiens
aagaagccgugguggaaau

SEQ ID NO: 1100291 - RNA, 19 nt, Homo sapiens
gaaggacgaguacuuacag

SEQ ID NO: 1100292 - RNA, 19 nt, Homo sapiens
augcagacuugcucaacua

SEQ ID NO: 1100293 - RNA, 19 nt, Homo sapiens
gggaggacaugucauuagc

SEQ ID NO: 1100294 - RNA, 19 nt, Homo sapiens
gggaacaauacauggauga

SEQ ID NO: 1100295 - RNA, 19 nt, Homo sapiens
cuucaggagugaccauaga

SEQ ID NO: 1100296 - RNA, 19 nt, Homo sapiens
gcaaauccaggagcugaug

SEQ ID NO: 1100297 - RNA, 19 nt, Homo sapiens
uggaggaacuggaaaacua

SEQ ID NO: 1100298 - RNA, 19 nt, Homo sapiens
gcagauggaacucaacaac

SEQ ID NO: 1100299 - RNA, 19 nt, Homo sapiens
aggagaagauuucauugca

SEQ ID NO: 1100300 - RNA, 19 nt, Homo sapiens
gcagagcgaggugaccaaa

SEQ ID NO: 1100301 - RNA, 19 nt, Homo sapiens
gaaugaggacugcaaugag

SEQ ID NO: 1100302 - RNA, 19 nt, Homo sapiens
cagaggagggugacgagaa

SEQ ID NO: 1100303 - RNA, 19 nt, Homo sapiens
uggaugagaaggacgagua

SEQ ID NO: 1100304 - RNA, 19 nt, Homo sapiens
caagacagaagagcaaauc

SEQ ID NO: 1100305 - RNA, 19 nt, Homo sapiens
aacccuggcucuuaagaug

SEQ ID NO: 1100306 - RNA, 19 nt, Homo sapiens
gcuaaaacccaucgacaaa

SEQ ID NO: 1100307 - RNA, 19 nt, Homo sapiens
agccagagccugcaagcua

SEQ ID NO: 1100308 - RNA, 19 nt, Homo sapiens
cauagaacuccaugaggaa

SEQ ID NO: 1100309 - RNA, 19 nt, Homo sapiens
uaccuucccucucaagaca

SEQ ID NO: 1100310 - RNA, 19 nt, Homo sapiens
acacuguccucaagaguac

SEQ ID NO: 1100311 - RNA, 19 nt, Homo sapiens
ccacggccuucaggaguga

SEQ ID NO: 1100312 - RNA, 19 nt, Homo sapiens
ggagugaccauagacgaau

SEQ ID NO: 1100313 - RNA, 19 nt, Homo sapiens
gcgggaggacaugucauua

SEQ ID NO: 1100314 - RNA, 19 nt, Homo sapiens
gcgagaugccuguaagauc

SEQ ID NO: 1100315 - RNA, 19 nt, Homo sapiens
aagagaagaugaacuugcu

SEQ ID NO: 1100316 - RNA, 19 nt, Homo sapiens
ccucaucgcagaccugaau

SEQ ID NO: 1100317 - RNA, 19 nt, Homo sapiens
accccuagcuuuuaauaua

SEQ ID NO: 1100318 - RNA, 19 nt, Homo sapiens
ggagcggcuucaggugauu

SEQ ID NO: 1100319 - RNA, 19 nt, Homo sapiens
aaguuaacccuggcucuua

SEQ ID NO: 1100320 - RNA, 19 nt, Homo sapiens
ugagcgagaugccuguaag

SEQ ID NO: 1100321 - RNA, 19 nt, Homo sapiens
ucaacacuguccucaagag

SEQ ID NO: 1100322 - RNA, 19 nt, Homo sapiens
ucccagauuucuucuucaa

SEQ ID NO: 1100323 - RNA, 19 nt, Homo sapiens
caaggaugccuggaaggaa

SEQ ID NO: 1100324 - RNA, 19 nt, Homo sapiens
gaaacgugcucuauagaua

SEQ ID NO: 1100325 - RNA, 19 nt, Homo sapiens
gaaugugccuugcagauua

SEQ ID NO: 1100326 - RNA, 19 nt, Homo sapiens
gcagacgccucgggauuua

SEQ ID NO: 1100327 - RNA, 19 nt, Homo sapiens
gaacacggaucaaugacau

SEQ ID NO: 1100328 - RNA, 19 nt, Homo sapiens
cuacagaucugagcacuga

SEQ ID NO: 1100329 - RNA, 19 nt, Homo sapiens
gaagggcuguuuaucuuuc

SEQ ID NO: 1100330 - RNA, 19 nt, Homo sapiens
ggaaaacucugcaauacaa

SEQ ID NO: 1100331 - RNA, 19 nt, Homo sapiens
gaaaugacgaccaagagaa

SEQ ID NO: 1100332 - RNA, 19 nt, Homo sapiens
gugaagggcuguuuaucuu

SEQ ID NO: 1100333 - RNA, 19 nt, Homo sapiens
gacgauaccuccaagacuu

SEQ ID NO: 1100334 - RNA, 19 nt, Homo sapiens
uuaaaguccuggcuaauug

SEQ ID NO: 1100335 - RNA, 19 nt, Homo sapiens
caaagaacccguuaguguu

SEQ ID NO: 1100336 - RNA, 19 nt, Homo sapiens
gagauucaauguguauuug

SEQ ID NO: 1100337 - RNA, 19 nt, Homo sapiens
gaacagagugagagauuca

SEQ ID NO: 1100338 - RNA, 19 nt, Homo sapiens
caagggaaaugacgaccaa

SEQ ID NO: 1100339 - RNA, 19 nt, Homo sapiens
gagaacagagugagagauu

SEQ ID NO: 1100340 - RNA, 19 nt, Homo sapiens
ucaaagaacccguuagugu

SEQ ID NO: 1100341 - RNA, 19 nt, Homo sapiens
gaagaacguagcucgauug

SEQ ID NO: 1100342 - RNA, 19 nt, Homo sapiens
uuacugugguucugauuaa

SEQ ID NO: 1100343 - RNA, 19 nt, Homo sapiens
gauacuacgugguucacuu

SEQ ID NO: 1100344 - RNA, 19 nt, Homo sapiens
ccauagggauuuauuucaa

SEQ ID NO: 1100345 - RNA, 19 nt, Homo sapiens
gugcuucgacucacucuua

SEQ ID NO: 1100346 - RNA, 19 nt, Homo sapiens
ggaaaugacgaccaagaga

SEQ ID NO: 1100347 - RNA, 19 nt, Homo sapiens
gcagauuacauaugaguau

SEQ ID NO: 1100348 - RNA, 19 nt, Homo sapiens
ggugcgcgcucuuggguaa

SEQ ID NO: 1100349 - RNA, 19 nt, Homo sapiens
ggacagagaaagugaugug

SEQ ID NO: 1100350 - RNA, 19 nt, Homo sapiens
acucuuaucuguucuguuc

SEQ ID NO: 1100351 - RNA, 19 nt, Homo sapiens
ugaagaacguagcucgauu

SEQ ID NO: 1100352 - RNA, 19 nt, Homo sapiens
cugcauauuucagguguua

SEQ ID NO: 1100353 - RNA, 19 nt, Homo sapiens
cuauagauauugacucugu

SEQ ID NO: 1100354 - RNA, 19 nt, Homo sapiens
cacgagcgcuugcuacaga

SEQ ID NO: 1100355 - RNA, 19 nt, Homo sapiens
gggaggccaucuaucagaa

SEQ ID NO: 1100356 - RNA, 19 nt, Homo sapiens
gaaacaugccauagggauu

SEQ ID NO: 1100357 - RNA, 19 nt, Homo sapiens
ucaauaaugugaagaacgu

SEQ ID NO: 1100358 - RNA, 19 nt, Homo sapiens
gagcagacgccucgggauu

SEQ ID NO: 1100359 - RNA, 19 nt, Homo sapiens
guucggagucucuucauaa

SEQ ID NO: 1100360 - RNA, 19 nt, Homo sapiens
gccaagaauuguuaacaca

SEQ ID NO: 1100361 - RNA, 19 nt, Homo sapiens
gcagggaggaugugugaga

SEQ ID NO: 1100362 - RNA, 19 nt, Homo sapiens
ccuugcagauuacauauga

SEQ ID NO: 1100363 - RNA, 19 nt, Homo sapiens
ugaacgugcugcauauuuc

SEQ ID NO: 1100364 - RNA, 19 nt, Homo sapiens
gaugaguggugcaaaguac

SEQ ID NO: 1100365 - RNA, 19 nt, Homo sapiens
agugagagauucaaugugu

SEQ ID NO: 1100366 - RNA, 19 nt, Homo sapiens
aaacaugccauagggauuu

SEQ ID NO: 1100367 - RNA, 19 nt, Homo sapiens
ugaugaacgugcugcauau

SEQ ID NO: 1100368 - RNA, 19 nt, Homo sapiens
aaagaacccguuaguguug

SEQ ID NO: 1100369 - RNA, 19 nt, Homo sapiens
gauggaguguguaggaaca

SEQ ID NO: 1100370 - RNA, 19 nt, Homo sapiens
gaacgugcugcauauuuca

SEQ ID NO: 1100371 - RNA, 19 nt, Homo sapiens
cugauuaacuacuggaaau

SEQ ID NO: 1100372 - RNA, 19 nt, Homo sapiens
gugagagauucaaugugua

SEQ ID NO: 1100373 - RNA, 19 nt, Homo sapiens
guaggaacacggaucaaug

SEQ ID NO: 1100374 - RNA, 19 nt, Homo sapiens
ccaaguguuucaguuguau

SEQ ID NO: 1100375 - RNA, 19 nt, Homo sapiens
gaccaagagaagaagcuua

SEQ ID NO: 1100376 - RNA, 19 nt, Homo sapiens
caagaauuguuaacacacu

SEQ ID NO: 1100377 - RNA, 19 nt, Homo sapiens
ggacagaaagaagucaaug

SEQ ID NO: 1100378 - RNA, 19 nt, Homo sapiens
cccaggaggucacagaaug

SEQ ID NO: 1100379 - RNA, 19 nt, Homo sapiens
gggauggcuuccaauuuua

SEQ ID NO: 1100380 - RNA, 19 nt, Homo sapiens
uaggaacacggaucaauga

SEQ ID NO: 1100381 - RNA, 19 nt, Homo sapiens
gcugaugaguggugcaaag

SEQ ID NO: 1100382 - RNA, 19 nt, Homo sapiens
uuaaugacauagugaagca

SEQ ID NO: 1100383 - RNA, 19 nt, Homo sapiens
cccuauuccucaguuauua

SEQ ID NO: 1100384 - RNA, 19 nt, Homo sapiens
gguuacaguuucucucaca

SEQ ID NO: 1100385 - RNA, 19 nt, Homo sapiens
cuaauuguguggucauugg

SEQ ID NO: 1100386 - RNA, 19 nt, Homo sapiens
caagagaagaagcuuaaag

SEQ ID NO: 1100387 - RNA, 19 nt, Homo sapiens
gacucacucuuaucuguuc

SEQ ID NO: 1100388 - RNA, 19 nt, Homo sapiens
ggugaagggcuguuuaucu

SEQ ID NO: 1100389 - RNA, 19 nt, Homo sapiens
cgaaugugccuugcagauu

SEQ ID NO: 1100390 - RNA, 19 nt, Homo sapiens
gacucuguguucccucuuu

SEQ ID NO: 1100391 - RNA, 19 nt, Homo sapiens
gcugguuaguauucaagaa

SEQ ID NO: 1100392 - RNA, 19 nt, Homo sapiens
ugggauggcuuccaauuuu

SEQ ID NO: 1100393 - RNA, 19 nt, Homo sapiens
ccagauggaguguguagga

SEQ ID NO: 1100394 - RNA, 19 nt, Homo sapiens
caguuucucucacaugcuu

SEQ ID NO: 1100395 - RNA, 19 nt, Homo sapiens
aaacgugcucuauagauau

SEQ ID NO: 1100396 - RNA, 19 nt, Homo sapiens
guaauugaaacgugcucua

SEQ ID NO: 1100397 - RNA, 19 nt, Homo sapiens
gagagaacagagugagaga

SEQ ID NO: 1100398 - RNA, 19 nt, Homo sapiens
gaggccaucuaucagaaag

SEQ ID NO: 1100399 - RNA, 19 nt, Homo sapiens
ggaacacggaucaaugaca

SEQ ID NO: 1100400 - RNA, 19 nt, Homo sapiens
gaugugcgccuucuaaagc

SEQ ID NO: 1100401 - RNA, 19 nt, Homo sapiens
guuuacaggguuacaguuu

SEQ ID NO: 1100402 - RNA, 19 nt, Homo sapiens
uccaaguguuucaguugua

SEQ ID NO: 1100403 - RNA, 19 nt, Homo sapiens
auugaaacgugcucuauag

SEQ ID NO: 1100404 - RNA, 19 nt, Homo sapiens
acucgaugcuccagaugaa

SEQ ID NO: 1100405 - RNA, 19 nt, Homo sapiens
ccagaaucccagagucaaa

SEQ ID NO: 1100406 - RNA, 19 nt, Homo sapiens
ugagagauucaauguguau

SEQ ID NO: 1100407 - RNA, 19 nt, Homo sapiens
gagagagaacagagugaga

SEQ ID NO: 1100408 - RNA, 19 nt, Homo sapiens
ccuuggagagccugacuua

SEQ ID NO: 1100409 - RNA, 19 nt, Homo sapiens
cagauggaguguguaggaa

SEQ ID NO: 1100410 - RNA, 19 nt, Homo sapiens
acagaacucaauaauguga

SEQ ID NO: 1100411 - RNA, 19 nt, Homo sapiens
ucgacucacucuuaucugu

SEQ ID NO: 1100412 - RNA, 19 nt, Homo sapiens
gaugcugguuaguauucaa

SEQ ID NO: 1100413 - RNA, 19 nt, Homo sapiens
gacagaaagaagucaaugu

SEQ ID NO: 1100414 - RNA, 19 nt, Homo sapiens
ggaggccaucuaucagaaa

SEQ ID NO: 1100415 - RNA, 19 nt, Homo sapiens
ugaagggcuguuuaucuuu

SEQ ID NO: 1100416 - RNA, 19 nt, Homo sapiens
gugccuugcagauuacaua

SEQ ID NO: 1100417 - RNA, 19 nt, Homo sapiens
cugaugaacgugcugcaua

SEQ ID NO: 1100418 - RNA, 19 nt, Homo sapiens
uggagagccugacuuacug

SEQ ID NO: 1100419 - RNA, 19 nt, Homo sapiens
gugcaaaguacuccagaug

SEQ ID NO: 1100420 - RNA, 19 nt, Homo sapiens
gcgaugcugguuaguauuc

SEQ ID NO: 1100421 - RNA, 19 nt, Homo sapiens
ccaagaaacaugccauagg

SEQ ID NO: 1100422 - RNA, 19 nt, Homo sapiens
gaucauucuucacccaaaa

SEQ ID NO: 1100423 - RNA, 19 nt, Homo sapiens
cuuaaaguccuggcuaauu

SEQ ID NO: 1100424 - RNA, 19 nt, Homo sapiens
caacaaaucuucacuuaga

SEQ ID NO: 1100425 - RNA, 19 nt, Homo sapiens
gaucaaagcugguauuuag

SEQ ID NO: 1100426 - RNA, 19 nt, Homo sapiens
gaacgaaagucaccugaaa

SEQ ID NO: 1100427 - RNA, 19 nt, Homo sapiens
gguagaaccuucagcuuua

SEQ ID NO: 1100428 - RNA, 19 nt, Homo sapiens
gcauaggacuggcauuaua

SEQ ID NO: 1100429 - RNA, 19 nt, Homo sapiens
uaagacgacuucugauuua

SEQ ID NO: 1100430 - RNA, 19 nt, Homo sapiens
gaagcuaugucaacuauug

SEQ ID NO: 1100431 - RNA, 19 nt, Homo sapiens
gaaaucaacuacuguacaa

SEQ ID NO: 1100432 - RNA, 19 nt, Homo sapiens
ccaaugguguugaaacuua

SEQ ID NO: 1100433 - RNA, 19 nt, Homo sapiens
gcacauauaugcugcaaag

SEQ ID NO: 1100434 - RNA, 19 nt, Homo sapiens
uaucagcucuggaacaaua

SEQ ID NO: 1100435 - RNA, 19 nt, Homo sapiens
gaaauuucuuccugucuaa

SEQ ID NO: 1100436 - RNA, 19 nt, Homo sapiens
caacuuagauuggguuuau

SEQ ID NO: 1100437 - RNA, 19 nt, Homo sapiens
gaacaugcauccuuaaacu

SEQ ID NO: 1100438 - RNA, 19 nt, Homo sapiens
gaaagcaggugucaauagu

SEQ ID NO: 1100439 - RNA, 19 nt, Homo sapiens
ggagaccacuucugucaaa

SEQ ID NO: 1100440 - RNA, 19 nt, Homo sapiens
gaagguguguguggaauuu

SEQ ID NO: 1100441 - RNA, 19 nt, Homo sapiens
aaacacugcuucuggcuua

SEQ ID NO: 1100442 - RNA, 19 nt, Homo sapiens
gaagcgagcugucaaaggu

SEQ ID NO: 1100443 - RNA, 19 nt, Homo sapiens
guauuuagaccgaucauua

SEQ ID NO: 1100444 - RNA, 19 nt, Homo sapiens
gcacaguccuccauacguu

SEQ ID NO: 1100445 - RNA, 19 nt, Homo sapiens
ggagaaaguuggccgguau

SEQ ID NO: 1100446 - RNA, 19 nt, Homo sapiens
gcaauuggcuugugguuac

SEQ ID NO: 1100447 - RNA, 19 nt, Homo sapiens
ccuaauaacuguucaggaa

SEQ ID NO: 1100448 - RNA, 19 nt, Homo sapiens
gacaaacacugaucaggaa

SEQ ID NO: 1100449 - RNA, 19 nt, Homo sapiens
gaaaauggacucaagaaua

SEQ ID NO: 1100450 - RNA, 19 nt, Homo sapiens
cuacaaaggcuucuucuaa

SEQ ID NO: 1100451 - RNA, 19 nt, Homo sapiens
caaaguggcugaagauuuu

SEQ ID NO: 1100452 - RNA, 19 nt, Homo sapiens
ggaaguagaccuaguuaau

SEQ ID NO: 1100453 - RNA, 19 nt, Homo sapiens
uaagaggccucaaggacua

SEQ ID NO: 1100454 - RNA, 19 nt, Homo sapiens
caacaacaauucugguuuc

SEQ ID NO: 1100455 - RNA, 19 nt, Homo sapiens
gaaaagcacucuaugaugu

SEQ ID NO: 1100456 - RNA, 19 nt, Homo sapiens
guacucagccuaagacaaa

SEQ ID NO: 1100457 - RNA, 19 nt, Homo sapiens
gauuggaacuggagacuug

SEQ ID NO: 1100458 - RNA, 19 nt, Homo sapiens
gaaguagaccuaguuaauu

SEQ ID NO: 1100459 - RNA, 19 nt, Homo sapiens
gaaagcuguuguucaagaa

SEQ ID NO: 1100460 - RNA, 19 nt, Homo sapiens
gaagagcaauggaggaagu

SEQ ID NO: 1100461 - RNA, 19 nt, Homo sapiens
gaacaauaccugcaguuau

SEQ ID NO: 1100462 - RNA, 19 nt, Homo sapiens
ggaaauauggaacaacaaa

SEQ ID NO: 1100463 - RNA, 19 nt, Homo sapiens
ucaaggaugucauaaacaa

SEQ ID NO: 1100464 - RNA, 19 nt, Homo sapiens
gaaggacucaccuguguuu

SEQ ID NO: 1100465 - RNA, 19 nt, Homo sapiens
ggacuggcauuauauagca

SEQ ID NO: 1100466 - RNA, 19 nt, Homo sapiens
guucaaggcugggcuauug

SEQ ID NO: 1100467 - RNA, 19 nt, Homo sapiens
ucaaaguccucucagauug

SEQ ID NO: 1100468 - RNA, 19 nt, Homo sapiens
ggaacaauaccugcaguua

SEQ ID NO: 1100469 - RNA, 19 nt, Homo sapiens
gaagaagaaguccuuaaga

SEQ ID NO: 1100470 - RNA, 19 nt, Homo sapiens
ccucuaggcugccaaacua

SEQ ID NO: 1100471 - RNA, 19 nt, Homo sapiens
gcagaaaucaacuacugua

SEQ ID NO: 1100472 - RNA, 19 nt, Homo sapiens
gaagugacagcuaauguug

SEQ ID NO: 1100473 - RNA, 19 nt, Homo sapiens
gcacaucuccucuaaacug

SEQ ID NO: 1100474 - RNA, 19 nt, Homo sapiens
gaacaucguggcacaguug

SEQ ID NO: 1100475 - RNA, 19 nt, Homo sapiens
gacuuucucuuacggauaa

SEQ ID NO: 1100476 - RNA, 19 nt, Homo sapiens
uacagaacaugcauccuua

SEQ ID NO: 1100477 - RNA, 19 nt, Homo sapiens
gaagagcaaggucaagaaa

SEQ ID NO: 1100478 - RNA, 19 nt, Homo sapiens
ugucaaagguguucgagaa

SEQ ID NO: 1100479 - RNA, 19 nt, Homo sapiens
gaacaacaaaucuucacuu

SEQ ID NO: 1100480 - RNA, 19 nt, Homo sapiens
caaccaacaaugccaauuu

SEQ ID NO: 1100481 - RNA, 19 nt, Homo sapiens
caaagguguucgagaaaug

SEQ ID NO: 1100482 - RNA, 19 nt, Homo sapiens
aaaugacgcuuugcuaauu

SEQ ID NO: 1100483 - RNA, 19 nt, Homo sapiens
uaugaugccuuccagguuu

SEQ ID NO: 1100484 - RNA, 19 nt, Homo sapiens
gaucacagaauuuaaagga

SEQ ID NO: 1100485 - RNA, 19 nt, Homo sapiens
ggauggauuugaagauguu

SEQ ID NO: 1100486 - RNA, 19 nt, Homo sapiens
caaacaaguaugacaauga

SEQ ID NO: 1100487 - RNA, 19 nt, Homo sapiens
cagaaggacucaccugugu

SEQ ID NO: 1100488 - RNA, 19 nt, Homo sapiens
gcaagaagaagaaguccuu

SEQ ID NO: 1100489 - RNA, 19 nt, Homo sapiens
ggagaagauuuuagagaua

SEQ ID NO: 1100490 - RNA, 19 nt, Homo sapiens
cauguuaccucaucuucuu

SEQ ID NO: 1100491 - RNA, 19 nt, Homo sapiens
uuauauagcugcaucaaag

SEQ ID NO: 1100492 - RNA, 19 nt, Homo sapiens
gaagaucggaaauauggaa

SEQ ID NO: 1100493 - RNA, 19 nt, Homo sapiens
gaagauguuccaaaucguu

SEQ ID NO: 1100494 - RNA, 19 nt, Homo sapiens
guaugacaaugaagcaauu

SEQ ID NO: 1100495 - RNA, 19 nt, Homo sapiens
uagcagaaaucaacuacug

SEQ ID NO: 1100496 - RNA, 19 nt, Homo sapiens
ggaagugacagcuaauguu

SEQ ID NO: 1100497 - RNA, 19 nt, Homo sapiens
cagcuaaugucauggucua

SEQ ID NO: 1100498 - RNA, 19 nt, Homo sapiens
aaguagaccuaguuaauug

SEQ ID NO: 1100499 - RNA, 19 nt, Homo sapiens
gcaacaacaauucugguuu

SEQ ID NO: 1100500 - RNA, 19 nt, Homo sapiens
gcaggugucaauagugaua

SEQ ID NO: 1100501 - RNA, 19 nt, Homo sapiens
cauaacuucuguucgcuuu

SEQ ID NO: 1100502 - RNA, 19 nt, Homo sapiens
gacaguaaauguguauaug

SEQ ID NO: 1100503 - RNA, 19 nt, Homo sapiens
gaaagaugcaguugcuaug

SEQ ID NO: 1100504 - RNA, 19 nt, Homo sapiens
gcagaaucccucaguguug

SEQ ID NO: 1100505 - RNA, 19 nt, Homo sapiens
gagaaagaauugccaacag

SEQ ID NO: 1100506 - RNA, 19 nt, Homo sapiens
gaguauguguggacugcua

SEQ ID NO: 1100507 - RNA, 19 nt, Homo sapiens
aaacgcaagucuucugaga

SEQ ID NO: 1100508 - RNA, 19 nt, Homo sapiens
ucaaaguggcugaagauuu

SEQ ID NO: 1100509 - RNA, 19 nt, Homo sapiens
gcaucaaaguggcugaaga

SEQ ID NO: 1100510 - RNA, 19 nt, Homo sapiens
acuauuggcuuugugauaa

SEQ ID NO: 1100511 - RNA, 19 nt, Homo sapiens
cagcacaucuccucuaaac

SEQ ID NO: 1100512 - RNA, 19 nt, Homo sapiens
gccagcacaucuccucuaa

SEQ ID NO: 1100513 - RNA, 19 nt, Homo sapiens
ggaugaagagaaagaauug

SEQ ID NO: 1100514 - RNA, 19 nt, Homo sapiens
cagcaaccguuauaaaugg

SEQ ID NO: 1100515 - RNA, 19 nt, Homo sapiens
ugaagaauguuaucuacca

SEQ ID NO: 1100516 - RNA, 19 nt, Homo sapiens
uuagaccgaucauuaagaa

SEQ ID NO: 1100517 - RNA, 19 nt, Homo sapiens
gaucggaaauauggaacaa

SEQ ID NO: 1100518 - RNA, 19 nt, Homo sapiens
gcgggaaugucaacaagga

SEQ ID NO: 1100519 - RNA, 19 nt, Homo sapiens
acagacagguugcuuggaa

SEQ ID NO: 1100520 - RNA, 19 nt, Homo sapiens
agacccagcuaaacucaaa

SEQ ID NO: 1100521 - RNA, 19 nt, Homo sapiens
gguacucugucuaauguau

SEQ ID NO: 1100522 - RNA, 19 nt, Homo sapiens
uaucuaccaugcagugaaa

SEQ ID NO: 1100523 - RNA, 19 nt, Homo sapiens
agacauuguucauucugua

SEQ ID NO: 1100524 - RNA, 19 nt, Homo sapiens
aaacaucucuguacaaaug

SEQ ID NO: 1100525 - RNA, 19 nt, Homo sapiens
cagcauggcucauauucua

SEQ ID NO: 1100526 - RNA, 19 nt, Homo sapiens
gacaauagcuguuggaacu

SEQ ID NO: 1100527 - RNA, 19 nt, Homo sapiens
gaaaucaacauugcaguaa

SEQ ID NO: 1100528 - RNA, 19 nt, Homo sapiens
caagaaagccaucaguaaa

SEQ ID NO: 1100529 - RNA, 19 nt, Homo sapiens
uaacguagcauucgauaug

SEQ ID NO: 1100530 - RNA, 19 nt, Homo sapiens
aaagaagggugacaaggaa

SEQ ID NO: 1100531 - RNA, 19 nt, Homo sapiens
ccaagaaagccaucaguaa

SEQ ID NO: 1100532 - RNA, 19 nt, Homo sapiens
uguccuaugugcaaacuua

SEQ ID NO: 1100533 - RNA, 19 nt, Homo sapiens
cuaaugagguagaaugguu

SEQ ID NO: 1100534 - RNA, 19 nt, Homo sapiens
ggaaacugacccagacuuu

SEQ ID NO: 1100535 - RNA, 19 nt, Homo sapiens
gcuauaagcagaaugaugu

SEQ ID NO: 1100536 - RNA, 19 nt, Homo sapiens
agaaagccaucaguaaauu

SEQ ID NO: 1100537 - RNA, 19 nt, Homo sapiens
gcucauauucuacuucauu

SEQ ID NO: 1100538 - RNA, 19 nt, Homo sapiens
gccauguacugauaacgua

SEQ ID NO: 1100539 - RNA, 19 nt, Homo sapiens
cauuguaccuguccuaugu

SEQ ID NO: 1100540 - RNA, 19 nt, Homo sapiens
gaacauuguaccuguccua

SEQ ID NO: 1100541 - RNA, 19 nt, Homo sapiens
gaagaucagguacacaaau

SEQ ID NO: 1100542 - RNA, 19 nt, Homo sapiens
aaacugacccagacuuuga

SEQ ID NO: 1100543 - RNA, 19 nt, Homo sapiens
uaaagaagggugacaagga

SEQ ID NO: 1100544 - RNA, 19 nt, Homo sapiens
gugcaucauuuaccaauca

SEQ ID NO: 1100545 - RNA, 19 nt, Homo sapiens
gaaagccaucaguaaauug

SEQ ID NO: 1100546 - RNA, 19 nt, Homo sapiens
gauaacguagcauucgaua

SEQ ID NO: 1100547 - RNA, 19 nt, Homo sapiens
guacugauaacguagcauu

SEQ ID NO: 1100548 - RNA, 19 nt, Homo sapiens
ccacaaugcaguugcugua

SEQ ID NO: 1100549 - RNA, 19 nt, Homo sapiens
guggaucccuggcuuagug

SEQ ID NO: 1100550 - RNA, 19 nt, Homo sapiens
gacccagacuuugaucauu

SEQ ID NO: 1100551 - RNA, 19 nt, Homo sapiens
gaaacugacccagacuuug

SEQ ID NO: 1100552 - RNA, 19 nt, Homo sapiens
agaaugaugucguccgaau

SEQ ID NO: 1100553 - RNA, 19 nt, Homo sapiens
caaaugcacgcgacaggaa

SEQ ID NO: 1100554 - RNA, 19 nt, Homo sapiens
gguuuauuauugccaguuu

SEQ ID NO: 1100555 - RNA, 19 nt, Homo sapiens
ccacggaguugcugaucau

SEQ ID NO: 1100556 - RNA, 19 nt, Homo sapiens
gccaagaaagccaucagua

SEQ ID NO: 1100557 - RNA, 19 nt, Homo sapiens
caaaugacaauagcuguug

SEQ ID NO: 1100558 - RNA, 19 nt, Homo sapiens
gaacaggagaaaucaacau

SEQ ID NO: 1100559 - RNA, 19 nt, Homo sapiens
caaccaggacaguaaagaa

SEQ ID NO: 1100560 - RNA, 19 nt, Homo sapiens
aagaucagguacacaaaug

SEQ ID NO: 1100561 - RNA, 19 nt, Homo sapiens
cagaagaucagguacacaa

SEQ ID NO: 1100562 - RNA, 19 nt, Homo sapiens
aaaccugcuuucugacuga

SEQ ID NO: 1100563 - RNA, 19 nt, Homo sapiens
guagaaugguuuugaagaa

SEQ ID NO: 1100564 - RNA, 19 nt, Homo sapiens
gugccgaauuugccaugua

SEQ ID NO: 1100565 - RNA, 19 nt, Homo sapiens
cuugaaugcuaaugaggua

SEQ ID NO: 1100566 - RNA, 19 nt, Homo sapiens
agaaaucaacauugcagua

SEQ ID NO: 1100567 - RNA, 19 nt, Homo sapiens
caggagaaaucaacauugc

SEQ ID NO: 1100568 - RNA, 19 nt, Homo sapiens
gaaugccaccgaagaacuu

SEQ ID NO: 1100569 - RNA, 19 nt, Homo sapiens
aauuugccauguacugaua

SEQ ID NO: 1100570 - RNA, 19 nt, Homo sapiens
ccuaugugcaaacuuaaua

SEQ ID NO: 1100571 - RNA, 19 nt, Homo sapiens
acacggcgcucaucaacgu

SEQ ID NO: 1100572 - RNA, 19 nt, Homo sapiens
aaucaacauugcaguaaca

SEQ ID NO: 1100573 - RNA, 19 nt, Homo sapiens
uggaaaggcucaccagaac

SEQ ID NO: 1100574 - RNA, 19 nt, Homo sapiens
ugaaggcccugggaauugu

SEQ ID NO: 1100575 - RNA, 19 nt, Homo sapiens
gaaugaugucguccgaauu

SEQ ID NO: 1100576 - RNA, 19 nt, Homo sapiens
gaggagccaguuaccauga

SEQ ID NO: 1100577 - RNA, 19 nt, Homo sapiens
caaugcaguugcuguaguc

SEQ ID NO: 1100578 - RNA, 19 nt, Homo sapiens
gaaugcuaaugagguagaa

SEQ ID NO: 1100579 - RNA, 19 nt, Homo sapiens
caacauugcaguaacaaaa

SEQ ID NO: 1100580 - RNA, 19 nt, Homo sapiens
gcaagcauguuuuccacaa

SEQ ID NO: 1100581 - RNA, 19 nt, Homo sapiens
gauauuauugcugucauga

SEQ ID NO: 1100582 - RNA, 19 nt, Homo sapiens
gaauugagggguaaggaua

SEQ ID NO: 1100583 - RNA, 19 nt, Homo sapiens
gagaacaggagaaaucaac

SEQ ID NO: 1100584 - RNA, 19 nt, Homo sapiens
ccagaacccaagcuguuaa

SEQ ID NO: 1100585 - RNA, 19 nt, Homo sapiens
caccagaacccaagcuguu

SEQ ID NO: 1100586 - RNA, 19 nt, Homo sapiens
guaccuguccuaugugcaa

SEQ ID NO: 1100587 - RNA, 19 nt, Homo sapiens
uaacagaauugagggguaa

SEQ ID NO: 1100588 - RNA, 19 nt, Homo sapiens
ccugcuuucugacugauuu

SEQ ID NO: 1100589 - RNA, 19 nt, Homo sapiens
ccaaagaggagccaguuac

SEQ ID NO: 1100590 - RNA, 19 nt, Homo sapiens
aagaaagccaucaguaaau

SEQ ID NO: 1100591 - RNA, 19 nt, Homo sapiens
ggagauauuauugcuguca

SEQ ID NO: 1100592 - RNA, 19 nt, Homo sapiens
acccagacuuugaucauug

SEQ ID NO: 1100593 - RNA, 19 nt, Homo sapiens
gagauauuauugcugucau

SEQ ID NO: 1100594 - RNA, 19 nt, Homo sapiens
acacucugcuacaugauca

SEQ ID NO: 1100595 - RNA, 19 nt, Homo sapiens
gaauuugccauguacugau

SEQ ID NO: 1100596 - RNA, 19 nt, Homo sapiens
ugacaaccaggacaguaaa

SEQ ID NO: 1100597 - RNA, 19 nt, Homo sapiens
cgaauuugccauguacuga

SEQ ID NO: 1100598 - RNA, 19 nt, Homo sapiens
aaagccaucaguaaauuga

SEQ ID NO: 1100599 - RNA, 19 nt, Homo sapiens
gccacacaagcauuuauuu

SEQ ID NO: 1100600 - RNA, 19 nt, Homo sapiens
ggagaugcagccaagaaag

SEQ ID NO: 1100601 - RNA, 19 nt, Homo sapiens
gcacuggagauauuauugc

SEQ ID NO: 1100602 - RNA, 19 nt, Homo sapiens
cugaucaucugggcuguga

SEQ ID NO: 1100603 - RNA, 19 nt, Homo sapiens
gagguagaaugguuuugaa

SEQ ID NO: 1100604 - RNA, 19 nt, Homo sapiens
agccacagcuagcuugaau

SEQ ID NO: 1100605 - RNA, 19 nt, Homo sapiens
acaaugcaguugcuguagu

SEQ ID NO: 1100606 - RNA, 19 nt, Homo sapiens
cggaguugcugaucaucug

SEQ ID NO: 1100607 - RNA, 19 nt, Homo sapiens
ucauucagaagaucaggua

SEQ ID NO: 1100608 - RNA, 19 nt, Homo sapiens
uggcucauauucuacuuca

SEQ ID NO: 1100609 - RNA, 19 nt, Homo sapiens
acaacucccuuggccuuga

SEQ ID NO: 1100610 - RNA, 19 nt, Homo sapiens
gaucagguacacaaaugca

SEQ ID NO: 1100611 - RNA, 19 nt, Homo sapiens
uaaugagguagaaugguuu

SEQ ID NO: 1100612 - RNA, 19 nt, Homo sapiens
agagcuauaagcagaauga

SEQ ID NO: 1100613 - RNA, 19 nt, Homo sapiens
ccacacaagcauuuauuuu

SEQ ID NO: 1100614 - RNA, 19 nt, Homo sapiens
ugacugauuuugccuugaa

SEQ ID NO: 1100615 - RNA, 19 nt, Homo sapiens
gaaugguuuugaagaagaa

SEQ ID NO: 1100616 - RNA, 19 nt, Homo sapiens
cucacacucugcuacauga

SEQ ID NO: 1100617 - RNA, 19 nt, Homo sapiens
aaugaugucguccgaauuc

SEQ ID NO: 1100618 - RNA, 19 nt, Homo sapiens
acaaaugacaauagcuguu

SEQ ID NO: 1100619 - RNA, 19 nt, Homo sapiens
ccaagcuguuaaccgaaga

SEQ ID NO: 1100620 - RNA, 19 nt, Homo sapiens
ccguggcucucuagucuuc

SEQ ID NO: 1100621 - RNA, 19 nt, Homo sapiens
uugcuaaugccaaagcuuu

SEQ ID NO: 1100622 - RNA, 19 nt, Homo sapiens
ccacagcuagcuugaaugc

SEQ ID NO: 1100623 - RNA, 19 nt, Homo sapiens
caguugcuguagucaucua

SEQ ID NO: 1100624 - RNA, 19 nt, Homo sapiens
caaagaaccugcagaccua

SEQ ID NO: 1100625 - RNA, 19 nt, Homo sapiens
gauuagagcucuggaguaa

SEQ ID NO: 1100626 - RNA, 19 nt, Homo sapiens
gcagugggcuuguuguauu

SEQ ID NO: 1100627 - RNA, 19 nt, Homo sapiens
gcacgaaacauuaucugua

SEQ ID NO: 1100628 - RNA, 19 nt, Homo sapiens
ggaccggccaccaauauua

SEQ ID NO: 1100629 - RNA, 19 nt, Homo sapiens
gaagugaacaacacaggua

SEQ ID NO: 1100630 - RNA, 19 nt, Homo sapiens
ggcaagacuuccauuguuu

SEQ ID NO: 1100631 - RNA, 19 nt, Homo sapiens
caaccaaagucaucuguuc

SEQ ID NO: 1100632 - RNA, 19 nt, Homo sapiens
ggagacaacuucagagcau

SEQ ID NO: 1100633 - RNA, 19 nt, Homo sapiens
cuacaaggauuucgcauuc

SEQ ID NO: 1100634 - RNA, 19 nt, Homo sapiens
gcacccaaacaauauaaua

SEQ ID NO: 1100635 - RNA, 19 nt, Homo sapiens
aaacuucaaugccuacuau

SEQ ID NO: 1100636 - RNA, 19 nt, Homo sapiens
ggaggguccuguaguguau

SEQ ID NO: 1100637 - RNA, 19 nt, Homo sapiens
gggagaagcccauguugaa

SEQ ID NO: 1100638 - RNA, 19 nt, Homo sapiens
ggacacacagcaguaauuu

SEQ ID NO: 1100639 - RNA, 19 nt, Homo sapiens
uaaguggucuggccuacaa

SEQ ID NO: 1100640 - RNA, 19 nt, Homo sapiens
ccuuggaguuguucauuua

SEQ ID NO: 1100641 - RNA, 19 nt, Homo sapiens
cacgaaacauuaucuguau

SEQ ID NO: 1100642 - RNA, 19 nt, Homo sapiens
uaagcagggugguguugua

SEQ ID NO: 1100643 - RNA, 19 nt, Homo sapiens
aaagucaucuguucgauag

SEQ ID NO: 1100644 - RNA, 19 nt, Homo sapiens
uuagagcucuggaguaaau

SEQ ID NO: 1100645 - RNA, 19 nt, Homo sapiens
guacagaagugaacaacac

SEQ ID NO: 1100646 - RNA, 19 nt, Homo sapiens
ggcacauccuggaguaaua

SEQ ID NO: 1100647 - RNA, 19 nt, Homo sapiens
ggaaaguuguucugguaca

SEQ ID NO: 1100648 - RNA, 19 nt, Homo sapiens
ugggaaaguuguucuggua

SEQ ID NO: 1100649 - RNA, 19 nt, Homo sapiens
cagcgaugcuuauuucuag

SEQ ID NO: 1100650 - RNA, 19 nt, Homo sapiens
caaagucaucuguucgaua

SEQ ID NO: 1100651 - RNA, 19 nt, Homo sapiens
gcacauccuggaguaauaa

SEQ ID NO: 1100652 - RNA, 19 nt, Homo sapiens
ggucuggccuacaaggauu

SEQ ID NO: 1100653 - RNA, 19 nt, Homo sapiens
caagagugguacagaagug

SEQ ID NO: 1100654 - RNA, 19 nt, Homo sapiens
gccaaagccuaccaagaga

SEQ ID NO: 1100655 - RNA, 19 nt, Homo sapiens
gcagguggguguggccaaa

SEQ ID NO: 1100656 - RNA, 19 nt, Homo sapiens
gcucuggaguaaauaacaa

SEQ ID NO: 1100657 - RNA, 19 nt, Homo sapiens
gggugucuguguaggauuu

SEQ ID NO: 1100658 - RNA, 19 nt, Homo sapiens
ggagggaggagacaacuuc

SEQ ID NO: 1100659 - RNA, 19 nt, Homo sapiens
uguguaggauuuaguaaug

SEQ ID NO: 1100660 - RNA, 19 nt, Homo sapiens
auacaagagugguacagaa

SEQ ID NO: 1100661 - RNA, 19 nt, Homo sapiens
aggcaagacuuccauuguu

SEQ ID NO: 1100662 - RNA, 19 nt, Homo sapiens
ggccaaagccuaccaagag

SEQ ID NO: 1100663 - RNA, 19 nt, Homo sapiens
auaagguucucuugucuga

SEQ ID NO: 1100664 - RNA, 19 nt, Homo sapiens
agaaucagaugcugugagu

SEQ ID NO: 1100665 - RNA, 19 nt, Homo sapiens
agucagcgaugcuuauuuc

SEQ ID NO: 1100666 - RNA, 19 nt, Homo sapiens
guucucagcagcaauuuga

SEQ ID NO: 1100667 - RNA, 19 nt, Homo sapiens
gcaguaauuucccagucau

SEQ ID NO: 1100668 - RNA, 19 nt, Homo sapiens
gguggaauugcacgacuua

SEQ ID NO: 1100669 - RNA, 19 nt, Homo sapiens
gcagggugguguuguaaaa

SEQ ID NO: 1100670 - RNA, 19 nt, Homo sapiens
agaagcccauguugaaguu

SEQ ID NO: 1100671 - RNA, 19 nt, Homo sapiens
gagaagcccauguugaagu

SEQ ID NO: 1100672 - RNA, 19 nt, Homo sapiens
cccuagagcuccaagaugu

SEQ ID NO: 1100673 - RNA, 19 nt, Homo sapiens
ggaauugcacgacuuagag

SEQ ID NO: 1100674 - RNA, 19 nt, Homo sapiens
aaucagaugcugugaguug

SEQ ID NO: 1100675 - RNA, 19 nt, Homo sapiens
uuggagagcugggaaaguu

SEQ ID NO: 1100676 - RNA, 19 nt, Homo sapiens
caccuucuagcaauuaaua

SEQ ID NO: 1100677 - RNA, 19 nt, Homo sapiens
cagaugcugugaguugauu

SEQ ID NO: 1100678 - RNA, 19 nt, Homo sapiens
cagugggcuuguuguauuu

SEQ ID NO: 1100679 - RNA, 19 nt, Homo sapiens
gggaggagacaacuucaga

SEQ ID NO: 1100680 - RNA, 19 nt, Homo sapiens
aaacauaagguucucuugu

SEQ ID NO: 1100681 - RNA, 19 nt, Homo sapiens
cuucaaagcaaacccuuaa

SEQ ID NO: 1100682 - RNA, 19 nt, Homo sapiens
ugacagcuguaaaguggau

SEQ ID NO: 1100683 - RNA, 19 nt, Homo sapiens
gguaauaucaagugcaaag

SEQ ID NO: 1100684 - RNA, 19 nt, Homo sapiens
gugaggaacauaaguaauc

SEQ ID NO: 1100685 - RNA, 19 nt, Homo sapiens
gaucacucauuuucacuaa

SEQ ID NO: 1100686 - RNA, 19 nt, Homo sapiens
gagaugacacuggagaaga

SEQ ID NO: 1100687 - RNA, 19 nt, Homo sapiens
gaaaguuguucugguacag

SEQ ID NO: 1100688 - RNA, 19 nt, Homo sapiens
gcaugagagggaagacuuu

SEQ ID NO: 1100689 - RNA, 19 nt, Homo sapiens
gaggcaagacuuccauugu

SEQ ID NO: 1100690 - RNA, 19 nt, Homo sapiens
aaaguggucgucucacaaa

SEQ ID NO: 1100691 - RNA, 19 nt, Homo sapiens
ggagucagcgaugcuuauu

SEQ ID NO: 1100692 - RNA, 19 nt, Homo sapiens
cccaaacaauauaauagga

SEQ ID NO: 1100693 - RNA, 19 nt, Homo sapiens
gggcacccaaacaauauaa

SEQ ID NO: 1100694 - RNA, 19 nt, Homo sapiens
gguccuguaguguaugaua

SEQ ID NO: 1100695 - RNA, 19 nt, Homo sapiens
ggaguaaauaacaaagaga

SEQ ID NO: 1100696 - RNA, 19 nt, Homo sapiens
uaaaguggucgucucacaa

SEQ ID NO: 1100697 - RNA, 19 nt, Homo sapiens
uaauaaaguggucgucuca

SEQ ID NO: 1100698 - RNA, 19 nt, Homo sapiens
caaagccuaccaagagaug

SEQ ID NO: 1100699 - RNA, 19 nt, Homo sapiens
gggcagugggcuuguugua

SEQ ID NO: 1100700 - RNA, 19 nt, Homo sapiens
gguacaggguaauaucaag

SEQ ID NO: 1100701 - RNA, 19 nt, Homo sapiens
uauagggcauguuuuagua

SEQ ID NO: 1100702 - RNA, 19 nt, Homo sapiens
guagagacgauacaagagu

SEQ ID NO: 1100703 - RNA, 19 nt, Homo sapiens
gaaacauuaucuguauggu

SEQ ID NO: 1100704 - RNA, 19 nt, Homo sapiens
gguugugaaugggcaguuu

SEQ ID NO: 1100705 - RNA, 19 nt, Homo sapiens
aacauaagguucucuuguc

SEQ ID NO: 1100706 - RNA, 19 nt, Homo sapiens
aaagcaaacccuuaacaca

SEQ ID NO: 1100707 - RNA, 19 nt, Homo sapiens
ucaaagcaaacccuuaaca

SEQ ID NO: 1100708 - RNA, 19 nt, Homo sapiens
ucgauagccugacccuaga

SEQ ID NO: 1100709 - RNA, 19 nt, Homo sapiens
caaaacauucguucuacua

SEQ ID NO: 1100710 - RNA, 19 nt, Homo sapiens
gauuucgcauucuggguau

SEQ ID NO: 1100711 - RNA, 19 nt, Homo sapiens
acaaggauuucgcauucug

SEQ ID NO: 1100712 - RNA, 19 nt, Homo sapiens
gauacaagagugguacaga

SEQ ID NO: 1100713 - RNA, 19 nt, Homo sapiens
auaaaguggucgucucaca

SEQ ID NO: 1100714 - RNA, 19 nt, Homo sapiens
ccaaagucaucuguucgau

SEQ ID NO: 1100715 - RNA, 19 nt, Homo sapiens
ggagagcugggaaaguugu

SEQ ID NO: 1100716 - RNA, 19 nt, Homo sapiens
gauuuuagcaggaacuuaa

SEQ ID NO: 1100717 - RNA, 19 nt, Homo sapiens
gaauuucccgaaugcuguu

SEQ ID NO: 1100718 - RNA, 19 nt, Homo sapiens
ucagcgaugcuuauuucua

SEQ ID NO: 1100719 - RNA, 19 nt, Homo sapiens
ggugcauccugacaacuca

SEQ ID NO: 1100720 - RNA, 19 nt, Homo sapiens
ugaggaacauaaguaaucu

SEQ ID NO: 1100721 - RNA, 19 nt, Homo sapiens
uggaguaaauaacaaagag

SEQ ID NO: 1100722 - RNA, 19 nt, Homo sapiens
cgaaacauuaucuguaugg

SEQ ID NO: 1100723 - RNA, 19 nt, Homo sapiens
agcaaacccuuaacacaca

SEQ ID NO: 1100724 - RNA, 19 nt, Homo sapiens
gacaauagcugcuuucuuc

SEQ ID NO: 1100725 - RNA, 19 nt, Homo sapiens
gaagagagaugguggcaau

SEQ ID NO: 1100726 - RNA, 19 nt, Homo sapiens
gaaacgagaucuccaugau

SEQ ID NO: 1100727 - RNA, 19 nt, Homo sapiens
gcucgaagcuggaggaguu

SEQ ID NO: 1100728 - RNA, 19 nt, Homo sapiens
gaacguccaguccuauaua

SEQ ID NO: 1100729 - RNA, 19 nt, Homo sapiens
aaagaccacucacuuguuu

SEQ ID NO: 1100730 - RNA, 19 nt, Homo sapiens
acaaggagcuggugaagga

SEQ ID NO: 1100731 - RNA, 19 nt, Homo sapiens
gaagguuucucccaaguca

SEQ ID NO: 1100732 - RNA, 19 nt, Homo sapiens
ucacagcccucagaacuaa

SEQ ID NO: 1100733 - RNA, 19 nt, Homo sapiens
gagaugcuguuuaagaaga

SEQ ID NO: 1100734 - RNA, 19 nt, Homo sapiens
aaacagagccagcagauug

SEQ ID NO: 1100735 - RNA, 19 nt, Homo sapiens
gggcuccacucucaucuaa

SEQ ID NO: 1100736 - RNA, 19 nt, Homo sapiens
caacugaagcagcacaaua

SEQ ID NO: 1100737 - RNA, 19 nt, Homo sapiens
gaggcuaccuuaucauugu

SEQ ID NO: 1100738 - RNA, 19 nt, Homo sapiens
uauuugagauggcgauuaa

SEQ ID NO: 1100739 - RNA, 19 nt, Homo sapiens
gaaagaccacucacuuguu

SEQ ID NO: 1100740 - RNA, 19 nt, Homo sapiens
ggaaagaccacucacuugu

SEQ ID NO: 1100741 - RNA, 19 nt, Homo sapiens
gaacugggcccacgagaag

SEQ ID NO: 1100742 - RNA, 19 nt, Homo sapiens
gcuccacucucaucuaaug

SEQ ID NO: 1100743 - RNA, 19 nt, Homo sapiens
caagagaacagacacaaug

SEQ ID NO: 1100744 - RNA, 19 nt, Homo sapiens
ggaugagugugucuacuug

SEQ ID NO: 1100745 - RNA, 19 nt, Homo sapiens
caacacugcuuugagaguu

SEQ ID NO: 1100746 - RNA, 19 nt, Homo sapiens
ugugauugcugacuacuuu

SEQ ID NO: 1100747 - RNA, 19 nt, Homo sapiens
gaagggacuuuguacugau

SEQ ID NO: 1100748 - RNA, 19 nt, Homo sapiens
ugaagggacuuuguacuga

SEQ ID NO: 1100749 - RNA, 19 nt, Homo sapiens
cagagaacguccaguccua

SEQ ID NO: 1100750 - RNA, 19 nt, Homo sapiens
caccaacacugcuuugaga

SEQ ID NO: 1100751 - RNA, 19 nt, Homo sapiens
ucaagcauaucgagaacaa

SEQ ID NO: 1100752 - RNA, 19 nt, Homo sapiens
gaugguguccuuuaccuuu

SEQ ID NO: 1100753 - RNA, 19 nt, Homo sapiens
gacaaucccuggccaaugc

SEQ ID NO: 1100754 - RNA, 19 nt, Homo sapiens
gcucauugcccacugguuu

SEQ ID NO: 1100755 - RNA, 19 nt, Homo sapiens
gcagcuguccucaagcaua

SEQ ID NO: 1100756 - RNA, 19 nt, Homo sapiens
ggagaaccaugcacaucau

SEQ ID NO: 1100757 - RNA, 19 nt, Homo sapiens
agaagaaccuauuugagau

SEQ ID NO: 1100758 - RNA, 19 nt, Homo sapiens
aagaagaaccuauuugaga

SEQ ID NO: 1100759 - RNA, 19 nt, Homo sapiens
caaggccaguccuaagauu

SEQ ID NO: 1100760 - RNA, 19 nt, Homo sapiens
gagaggagaccacccguau

SEQ ID NO: 1100761 - RNA, 19 nt, Homo sapiens
gaaaguuggagccauccua

SEQ ID NO: 1100762 - RNA, 19 nt, Homo sapiens
uggagaugcuguuuaagaa

SEQ ID NO: 1100763 - RNA, 19 nt, Homo sapiens
gcugaaagccuuccuagag

SEQ ID NO: 1100764 - RNA, 19 nt, Homo sapiens
uggaggaguucaucaagaa

SEQ ID NO: 1100765 - RNA, 19 nt, Homo sapiens
gagaacguccaguccuaua

SEQ ID NO: 1100766 - RNA, 19 nt, Homo sapiens
ccacguucccuacagcuua

SEQ ID NO: 1100767 - RNA, 19 nt, Homo sapiens
gcaaggaggaggacugcaa

SEQ ID NO: 1100768 - RNA, 19 nt, Homo sapiens
acaagcagauucuaaacau

SEQ ID NO: 1100769 - RNA, 19 nt, Homo sapiens
acucgaaucuucccugcua

SEQ ID NO: 1100770 - RNA, 19 nt, Homo sapiens
ugacacaccuguaccaacu

SEQ ID NO: 1100771 - RNA, 19 nt, Homo sapiens
uaagcagccuggaggaaga

SEQ ID NO: 1100772 - RNA, 19 nt, Homo sapiens
cagcuguccucaagcauau

SEQ ID NO: 1100773 - RNA, 19 nt, Homo sapiens
gcuagaagacauuaagaau

SEQ ID NO: 1100774 - RNA, 19 nt, Homo sapiens
gaagaaccuauuugagaug

SEQ ID NO: 1100775 - RNA, 19 nt, Homo sapiens
ugaaggagccgcugagcaa

SEQ ID NO: 1100776 - RNA, 19 nt, Homo sapiens
guccaguccuauauaguuu

SEQ ID NO: 1100777 - RNA, 19 nt, Homo sapiens
gggcaacuauccuguaacu

SEQ ID NO: 1100778 - RNA, 19 nt, Homo sapiens
uaacagugccuuggaguug

SEQ ID NO: 1100779 - RNA, 19 nt, Homo sapiens
gcaacgcgaccuacucaug

SEQ ID NO: 1100780 - RNA, 19 nt, Homo sapiens
gagggagccuggucuuugg

SEQ ID NO: 1100781 - RNA, 19 nt, Homo sapiens
acaauauucuggcaucugu

SEQ ID NO: 1100782 - RNA, 19 nt, Homo sapiens
ggacaauagcugcuuucuu

SEQ ID NO: 1100783 - RNA, 19 nt, Homo sapiens
acagaaggcuggcugacau

SEQ ID NO: 1100784 - RNA, 19 nt, Homo sapiens
ccaagugcagcaucuguaa

SEQ ID NO: 1100785 - RNA, 19 nt, Homo sapiens
aacuggagaugcuguuuaa

SEQ ID NO: 1100786 - RNA, 19 nt, Homo sapiens
aagggcaacuauccuguaa

SEQ ID NO: 1100787 - RNA, 19 nt, Homo sapiens
gccauugguuucacagaug

SEQ ID NO: 1100788 - RNA, 19 nt, Homo sapiens
gaaacagagccagcagauu

SEQ ID NO: 1100789 - RNA, 19 nt, Homo sapiens
gaaggacacacagaccaaa

SEQ ID NO: 1100790 - RNA, 19 nt, Homo sapiens
ucuaugaccugugcaacaa

SEQ ID NO: 1100791 - RNA, 19 nt, Homo sapiens
uuuagaggcuaccuuauca

SEQ ID NO: 1100792 - RNA, 19 nt, Homo sapiens
guaccagccugaugaacgu

SEQ ID NO: 1100793 - RNA, 19 nt, Homo sapiens
cuuccaagccuacaaacua

SEQ ID NO: 1100794 - RNA, 19 nt, Homo sapiens
caagggcaacuauccugua

SEQ ID NO: 1100795 - RNA, 19 nt, Homo sapiens
uucccugccuucuuauuua

SEQ ID NO: 1100796 - RNA, 19 nt, Homo sapiens
ccacucacuuguuuguugu

SEQ ID NO: 1100797 - RNA, 19 nt, Homo sapiens
ccaugaaaaucucaacuuu

SEQ ID NO: 1100798 - RNA, 19 nt, Homo sapiens
uagcugcuuucuucucuau

SEQ ID NO: 1100799 - RNA, 19 nt, Homo sapiens
acacaccuguaccaacuga

SEQ ID NO: 1100800 - RNA, 19 nt, Homo sapiens
caacaguggaggaccaaga

SEQ ID NO: 1100801 - RNA, 19 nt, Homo sapiens
gugcuccaaugacagcuuu

SEQ ID NO: 1100802 - RNA, 19 nt, Homo sapiens
caggaaagaccacucacuu

SEQ ID NO: 1100803 - RNA, 19 nt, Homo sapiens
uaccagagcagacaacuca

SEQ ID NO: 1100804 - RNA, 19 nt, Homo sapiens
guaacuggauuggccuuuc

SEQ ID NO: 1100805 - RNA, 19 nt, Homo sapiens
ggccauugguuucacagau

SEQ ID NO: 1100806 - RNA, 19 nt, Homo sapiens
gcaauauauccgaaccauu

SEQ ID NO: 1100807 - RNA, 19 nt, Homo sapiens
ccacucucaucuaauguca

SEQ ID NO: 1100808 - RNA, 19 nt, Homo sapiens
caugccaccucuucuagug

SEQ ID NO: 1100809 - RNA, 19 nt, Homo sapiens
cgagggagccuggucuuug

SEQ ID NO: 1100810 - RNA, 19 nt, Homo sapiens
ccauuucccugcugaagag

SEQ ID NO: 1100811 - RNA, 19 nt, Homo sapiens
caagcagauucuaaacauc

SEQ ID NO: 1100812 - RNA, 19 nt, Homo sapiens
gaguuuaccagcagggauu

SEQ ID NO: 1100813 - RNA, 19 nt, Homo sapiens
gauggcaguguuacauuga

SEQ ID NO: 1100814 - RNA, 19 nt, Homo sapiens
gaaaaucucaacuuuaugg

SEQ ID NO: 1100815 - RNA, 19 nt, Homo sapiens
acucugcacucgaaucuuc

SEQ ID NO: 1100816 - RNA, 19 nt, Homo sapiens
ucuggcaucuguuggagaa

SEQ ID NO: 1100817 - RNA, 19 nt, Homo sapiens
gaaggauccacaggucaaa

SEQ ID NO: 1100818 - RNA, 19 nt, Homo sapiens
gaagauccagcuagaagac

SEQ ID NO: 1100819 - RNA, 19 nt, Homo sapiens
cuacucccaugcccuguau

SEQ ID NO: 1100820 - RNA, 19 nt, Homo sapiens
ggaggaguucaucaagaaa

SEQ ID NO: 1100821 - RNA, 19 nt, Homo sapiens
ggagccauccuaugugauc

SEQ ID NO: 1100822 - RNA, 19 nt, Homo sapiens
aauccacucugcacucgaa

SEQ ID NO: 1100823 - RNA, 19 nt, Homo sapiens
gacaagcagauucuaaaca

SEQ ID NO: 1100824 - RNA, 19 nt, Homo sapiens
gguaugaucucuaaaguaa

SEQ ID NO: 1100825 - RNA, 19 nt, Homo sapiens
uaacagccaugucaucuua

SEQ ID NO: 1100826 - RNA, 19 nt, Homo sapiens
aaauaaaccuggacaguua

SEQ ID NO: 1100827 - RNA, 19 nt, Homo sapiens
acaaggagcuguuaucuuu

SEQ ID NO: 1100828 - RNA, 19 nt, Homo sapiens
gaagagaucucagcuaugu

SEQ ID NO: 1100829 - RNA, 19 nt, Homo sapiens
ggacacagaccacauauuu

SEQ ID NO: 1100830 - RNA, 19 nt, Homo sapiens
ggacaaacauuuccuccaa

SEQ ID NO: 1100831 - RNA, 19 nt, Homo sapiens
gaagaugucgugugcauaa

SEQ ID NO: 1100832 - RNA, 19 nt, Homo sapiens
cagagagccuuaaucuuua

SEQ ID NO: 1100833 - RNA, 19 nt, Homo sapiens
gcagaauacccuuggauua

SEQ ID NO: 1100834 - RNA, 19 nt, Homo sapiens
gaacgugccuucagacaag

SEQ ID NO: 1100835 - RNA, 19 nt, Homo sapiens
ggucucaucucauuaguga

SEQ ID NO: 1100836 - RNA, 19 nt, Homo sapiens
gaagugcuauuaugagugu

SEQ ID NO: 1100837 - RNA, 19 nt, Homo sapiens
acagagagccuuaaucuuu

SEQ ID NO: 1100838 - RNA, 19 nt, Homo sapiens
ggacagcuccucccaagaa

SEQ ID NO: 1100839 - RNA, 19 nt, Homo sapiens
guagugacauccuuuauag

SEQ ID NO: 1100840 - RNA, 19 nt, Homo sapiens
gaugagagguggcugugaa

SEQ ID NO: 1100841 - RNA, 19 nt, Homo sapiens
gagagguggcugugaauua

SEQ ID NO: 1100842 - RNA, 19 nt, Homo sapiens
gaggacugcuuguaugaaa

SEQ ID NO: 1100843 - RNA, 19 nt, Homo sapiens
gaaaguagguaugaucucu

SEQ ID NO: 1100844 - RNA, 19 nt, Homo sapiens
gaagggcuguggacaugaa

SEQ ID NO: 1100845 - RNA, 19 nt, Homo sapiens
gaagugacacaaaccuaua

SEQ ID NO: 1100846 - RNA, 19 nt, Homo sapiens
caagagauuuagcucauug

SEQ ID NO: 1100847 - RNA, 19 nt, Homo sapiens
gcacugcuuugcuggauga

SEQ ID NO: 1100848 - RNA, 19 nt, Homo sapiens
gcauuucucugaauucuag

SEQ ID NO: 1100849 - RNA, 19 nt, Homo sapiens
gagaguauccuuggaaauu

SEQ ID NO: 1100850 - RNA, 19 nt, Homo sapiens
cacauaagcuagaucacua

SEQ ID NO: 1100851 - RNA, 19 nt, Homo sapiens
gauacagacucucaacaga

SEQ ID NO: 1100852 - RNA, 19 nt, Homo sapiens
aagcugaguuugcugaaua

SEQ ID NO: 1100853 - RNA, 19 nt, Homo sapiens
gagccuaguugaagugcua

SEQ ID NO: 1100854 - RNA, 19 nt, Homo sapiens
gagaagaagugacacaaac

SEQ ID NO: 1100855 - RNA, 19 nt, Homo sapiens
cagcaaggcagagauauua

SEQ ID NO: 1100856 - RNA, 19 nt, Homo sapiens
caaauugccuauuggaauc

SEQ ID NO: 1100857 - RNA, 19 nt, Homo sapiens
uguggcaucucauaaguua

SEQ ID NO: 1100858 - RNA, 19 nt, Homo sapiens
aagaagagaucucagcuau

SEQ ID NO: 1100859 - RNA, 19 nt, Homo sapiens
gaauucuagucucucauaa

SEQ ID NO: 1100860 - RNA, 19 nt, Homo sapiens
uaggaaacuuguucacuuu

SEQ ID NO: 1100861 - RNA, 19 nt, Homo sapiens
ugaaauagcucagaguaag

SEQ ID NO: 1100862 - RNA, 19 nt, Homo sapiens
ucucauaaguuaacugcua

SEQ ID NO: 1100863 - RNA, 19 nt, Homo sapiens
gaagaucacagcagaauac

SEQ ID NO: 1100864 - RNA, 19 nt, Homo sapiens
ggacgucccuggagucucu

SEQ ID NO: 1100865 - RNA, 19 nt, Homo sapiens
ucaguggucucaucucauu

SEQ ID NO: 1100866 - RNA, 19 nt, Homo sapiens
gagaggcccugucgacugu

SEQ ID NO: 1100867 - RNA, 19 nt, Homo sapiens
gagcuccugauucaaauua

SEQ ID NO: 1100868 - RNA, 19 nt, Homo sapiens
cuacugacuuuaaggcuuu

SEQ ID NO: 1100869 - RNA, 19 nt, Homo sapiens
gaucucagcuauguacuca

SEQ ID NO: 1100870 - RNA, 19 nt, Homo sapiens
ccauaaagcacauaagcua

SEQ ID NO: 1100871 - RNA, 19 nt, Homo sapiens
uggagucucuucugucuuu

SEQ ID NO: 1100872 - RNA, 19 nt, Homo sapiens
gaagaagagaucucagcua

SEQ ID NO: 1100873 - RNA, 19 nt, Homo sapiens
aagccaagcuguauggaaa

SEQ ID NO: 1100874 - RNA, 19 nt, Homo sapiens
gaacgacuacgagagcaua

SEQ ID NO: 1100875 - RNA, 19 nt, Homo sapiens
ccacagacacgaccaguga

SEQ ID NO: 1100876 - RNA, 19 nt, Homo sapiens
ggaagggcccuaugaagug

SEQ ID NO: 1100877 - RNA, 19 nt, Homo sapiens
cagccugguuugaauuuaa

SEQ ID NO: 1100878 - RNA, 19 nt, Homo sapiens
gaaauagcucagaguaaga

SEQ ID NO: 1100879 - RNA, 19 nt, Homo sapiens
uaagcuagaucacuacaag

SEQ ID NO: 1100880 - RNA, 19 nt, Homo sapiens
gccagagccugauuaugaa

SEQ ID NO: 1100881 - RNA, 19 nt, Homo sapiens
uaaauaaaccuggacaguu

SEQ ID NO: 1100882 - RNA, 19 nt, Homo sapiens
uuucaugccuuacuuauca

SEQ ID NO: 1100883 - RNA, 19 nt, Homo sapiens
guucguaccuugcauuucu

SEQ ID NO: 1100884 - RNA, 19 nt, Homo sapiens
uaagcacaaucaucacuga

SEQ ID NO: 1100885 - RNA, 19 nt, Homo sapiens
uuaggaaacuuguucacuu

SEQ ID NO: 1100886 - RNA, 19 nt, Homo sapiens
caauauagguguuuuagga

SEQ ID NO: 1100887 - RNA, 19 nt, Homo sapiens
acacaaaccuauacuucau

SEQ ID NO: 1100888 - RNA, 19 nt, Homo sapiens
ccucggaucugcuggauuc

SEQ ID NO: 1100889 - RNA, 19 nt, Homo sapiens
cugcuuugcuggaugauuu

SEQ ID NO: 1100890 - RNA, 19 nt, Homo sapiens
caaaggagccuaguugaag

SEQ ID NO: 1100891 - RNA, 19 nt, Homo sapiens
aaacagagagccuuaaucu

SEQ ID NO: 1100892 - RNA, 19 nt, Homo sapiens
gaggaaagccaagcuguau

SEQ ID NO: 1100893 - RNA, 19 nt, Homo sapiens
ggacaguuagugaauaaau

SEQ ID NO: 1100894 - RNA, 19 nt, Homo sapiens
gaagagagugccacagaca

SEQ ID NO: 1100895 - RNA, 19 nt, Homo sapiens
uuacuagccuggcaacaga

SEQ ID NO: 1100896 - RNA, 19 nt, Homo sapiens
gggaggaugaagugucuua

SEQ ID NO: 1100897 - RNA, 19 nt, Homo sapiens
gaaaagauaccauaaagca

SEQ ID NO: 1100898 - RNA, 19 nt, Homo sapiens
guacuucuagacuuguuua

SEQ ID NO: 1100899 - RNA, 19 nt, Homo sapiens
caaaggagaacgacuacga

SEQ ID NO: 1100900 - RNA, 19 nt, Homo sapiens
ccuaugaagugcucaagga

SEQ ID NO: 1100901 - RNA, 19 nt, Homo sapiens
ugaauucuagucucucaua

SEQ ID NO: 1100902 - RNA, 19 nt, Homo sapiens
guacuuggagcuccugauu

SEQ ID NO: 1100903 - RNA, 19 nt, Homo sapiens
ggccuuugcccucaauaua

SEQ ID NO: 1100904 - RNA, 19 nt, Homo sapiens
gcagcaaggcagagauauu

SEQ ID NO: 1100905 - RNA, 19 nt, Homo sapiens
agccagagccugauuauga

SEQ ID NO: 1100906 - RNA, 19 nt, Homo sapiens
ugagcuauguugagguaaa

SEQ ID NO: 1100907 - RNA, 19 nt, Homo sapiens
uaagagcucagccugguuu

SEQ ID NO: 1100908 - RNA, 19 nt, Homo sapiens
gagccuuaaucuuuauguu

SEQ ID NO: 1100909 - RNA, 19 nt, Homo sapiens
gacaguuagugaauaaauc

SEQ ID NO: 1100910 - RNA, 19 nt, Homo sapiens
auacaagucucgggaagaa

SEQ ID NO: 1100911 - RNA, 19 nt, Homo sapiens
aaguagguaugaucucuaa

SEQ ID NO: 1100912 - RNA, 19 nt, Homo sapiens
gaaguucguaccuugcauu

SEQ ID NO: 1100913 - RNA, 19 nt, Homo sapiens
agaauacccuuggauuaga

SEQ ID NO: 1100914 - RNA, 19 nt, Homo sapiens
gaggaugaagugucuuaaa

SEQ ID NO: 1100915 - RNA, 19 nt, Homo sapiens
agagguggcugugaauuau

SEQ ID NO: 1100916 - RNA, 19 nt, Homo sapiens
gaagagaagaagugacaca

SEQ ID NO: 1100917 - RNA, 19 nt, Homo sapiens
agacguuucuucuguggaa

SEQ ID NO: 1100918 - RNA, 19 nt, Homo sapiens
cagugaaacuaacaagaga

SEQ ID NO: 1100919 - RNA, 19 nt, Homo sapiens
gaguauccuuggaaauuca

SEQ ID NO: 1100920 - RNA, 19 nt, Homo sapiens
uagagaguauccuuggaaa

SEQ ID NO: 1100921 - RNA, 19 nt, Homo sapiens
guagagaguauccuuggaa

SEQ ID NO: 1100922 - RNA, 19 nt, Homo sapiens
gagcucagccugguuugaa

SEQ ID NO: 1100923 - RNA, 19 nt, Homo sapiens
cagaacucauuccuucaaa

SEQ ID NO: 1100924 - RNA, 19 nt, Homo sapiens
gaggaucuaucgucaauau

SEQ ID NO: 1100925 - RNA, 19 nt, Homo sapiens
gaaacaagguguccuccau

SEQ ID NO: 1100926 - RNA, 19 nt, Homo sapiens
gaauacggaucaauugugu

SEQ ID NO: 1100927 - RNA, 19 nt, Homo sapiens
ggaccuuucuguugucaaa

SEQ ID NO: 1100928 - RNA, 19 nt, Homo sapiens
aggaggaggugaauaauuu

SEQ ID NO: 1100929 - RNA, 19 nt, Homo sapiens
gaaugggccugcaguggaa

SEQ ID NO: 1100930 - RNA, 19 nt, Homo sapiens
gaaagagcauggaggaucu

SEQ ID NO: 1100931 - RNA, 19 nt, Homo sapiens
gcaaauacuuuaggagcaa

SEQ ID NO: 1100932 - RNA, 19 nt, Homo sapiens
ggaggaggccaguuucuuu

SEQ ID NO: 1100933 - RNA, 19 nt, Homo sapiens
caaccuaccucccacaaag

SEQ ID NO: 1100934 - RNA, 19 nt, Homo sapiens
gcuuauaguugguauggaa

SEQ ID NO: 1100935 - RNA, 19 nt, Homo sapiens
guuuacagcuccuggauga

SEQ ID NO: 1100936 - RNA, 19 nt, Homo sapiens
caaccucaccaaaucuuua

SEQ ID NO: 1100937 - RNA, 19 nt, Homo sapiens
gaaaagccaucgugaagga

SEQ ID NO: 1100938 - RNA, 19 nt, Homo sapiens
ggauaugcuucuguacuuu

SEQ ID NO: 1100939 - RNA, 19 nt, Homo sapiens
cuucacaucuugaggauau

SEQ ID NO: 1100940 - RNA, 19 nt, Homo sapiens
uaggagcaauaaugccuua

SEQ ID NO: 1100941 - RNA, 19 nt, Homo sapiens
agacugcuguggagaacua

SEQ ID NO: 1100942 - RNA, 19 nt, Homo sapiens
ggaaugaggaggaggugaa

SEQ ID NO: 1100943 - RNA, 19 nt, Homo sapiens
gagcugagaucgugcuacu

SEQ ID NO: 1100944 - RNA, 19 nt, Homo sapiens
gcaggaggaucgcuugaac

SEQ ID NO: 1100945 - RNA, 19 nt, Homo sapiens
gaggaggaggugaauaauu

SEQ ID NO: 1100946 - RNA, 19 nt, Homo sapiens
ggaauacggaucaauugug

SEQ ID NO: 1100947 - RNA, 19 nt, Homo sapiens
ggaucuaucgucaauauca

SEQ ID NO: 1100948 - RNA, 19 nt, Homo sapiens
caauggaggaggccaguuu

SEQ ID NO: 1100949 - RNA, 19 nt, Homo sapiens
cguaugagguaccagauca

SEQ ID NO: 1100950 - RNA, 19 nt, Homo sapiens
ccagugccuucacaucuug

SEQ ID NO: 1100951 - RNA, 19 nt, Homo sapiens
gaaaauccccgcuaaacga

SEQ ID NO: 1100952 - RNA, 19 nt, Homo sapiens
uggaggaucuaucgucaau

SEQ ID NO: 1100953 - RNA, 19 nt, Homo sapiens
gcacgagucauucccauac

SEQ ID NO: 1100954 - RNA, 19 nt, Homo sapiens
gaucaugaacucccagaag

SEQ ID NO: 1100955 - RNA, 19 nt, Homo sapiens
uugaggauaugcuucugua

SEQ ID NO: 1100956 - RNA, 19 nt, Homo sapiens
caagagcagguguuuacaa

SEQ ID NO: 1100957 - RNA, 19 nt, Homo sapiens
gaucuaucgucaauaucau

SEQ ID NO: 1100958 - RNA, 19 nt, Homo sapiens
gguggcaaauacuuuagga

SEQ ID NO: 1100959 - RNA, 19 nt, Homo sapiens
aggauaugcuucuguacuu

SEQ ID NO: 1100960 - RNA, 19 nt, Homo sapiens
gcucacgccuguaauucca

SEQ ID NO: 1100961 - RNA, 19 nt, Homo sapiens
ucaccaaaucuuuagcuuu

SEQ ID NO: 1100962 - RNA, 19 nt, Homo sapiens
ucaauuucuuggugaacaa

SEQ ID NO: 1100963 - RNA, 19 nt, Homo sapiens
cccguaaguuggagagauu

SEQ ID NO: 1100964 - RNA, 19 nt, Homo sapiens
uuuacaaccucaccaaauc

SEQ ID NO: 1100965 - RNA, 19 nt, Homo sapiens
gagcauggaggaucuaucg

SEQ ID NO: 1100966 - RNA, 19 nt, Homo sapiens
ccugaaauauauacagucu

SEQ ID NO: 1100967 - RNA, 19 nt, Homo sapiens
gguaccagaucaugacaac

SEQ ID NO: 1100968 - RNA, 19 nt, Homo sapiens
acggguaccuucuacaugu

SEQ ID NO: 1100969 - RNA, 19 nt, Homo sapiens
ggaggaggugaauaauuug

SEQ ID NO: 1100970 - RNA, 19 nt, Homo sapiens
aacccugucucuacugaaa

SEQ ID NO: 1100971 - RNA, 19 nt, Homo sapiens
uuacagcuccuggaugaaa

SEQ ID NO: 1100972 - RNA, 19 nt, Homo sapiens
gaggaggccaguuucuuuc

SEQ ID NO: 1100973 - RNA, 19 nt, Homo sapiens
caugaacucccagaagauu

SEQ ID NO: 1100974 - RNA, 19 nt, Homo sapiens
gcaguggaauacggaucaa

SEQ ID NO: 1100975 - RNA, 19 nt, Homo sapiens
gcuaaacgaauugguguuc

SEQ ID NO: 1100976 - RNA, 19 nt, Homo sapiens
aaagcaggcacgagucauu

SEQ ID NO: 1100977 - RNA, 19 nt, Homo sapiens
caaauacuuuaggagcaau

SEQ ID NO: 1100978 - RNA, 19 nt, Homo sapiens
caguugaggucaggaguuc

SEQ ID NO: 1100979 - RNA, 19 nt, Homo sapiens
guggaauacggaucaauug

SEQ ID NO: 1100980 - RNA, 19 nt, Homo sapiens
aucaugaacucccagaaga

SEQ ID NO: 1100981 - RNA, 19 nt, Homo sapiens
gaggauaugcuucuguacu

SEQ ID NO: 1100982 - RNA, 19 nt, Homo sapiens
caaugcaacauccggaaug

SEQ ID NO: 1100983 - RNA, 19 nt, Homo sapiens
gccuuaugguaauuauuga

SEQ ID NO: 1100984 - RNA, 19 nt, Homo sapiens
gucauugcaucccguaagu

SEQ ID NO: 1100985 - RNA, 19 nt, Homo sapiens
cccagugccuucacaucuu

SEQ ID NO: 1100986 - RNA, 19 nt, Homo sapiens
auacggaucaauuguguug

SEQ ID NO: 1100987 - RNA, 19 nt, Homo sapiens
aagagcagguguuuacaac

SEQ ID NO: 1100988 - RNA, 19 nt, Homo sapiens
augaggaggaggugaauaa

SEQ ID NO: 1100989 - RNA, 19 nt, Homo sapiens
aaugcaacauccggaauga

SEQ ID NO: 1100990 - RNA, 19 nt, Homo sapiens
cauugcaucccguaaguug

SEQ ID NO: 1100991 - RNA, 19 nt, Homo sapiens
uccauuagcugugcauucu

SEQ ID NO: 1100992 - RNA, 19 nt, Homo sapiens
cuacaugugcaaagcaguu

SEQ ID NO: 1100993 - RNA, 19 nt, Homo sapiens
ugccuuaugguaauuauug

SEQ ID NO: 1100994 - RNA, 19 nt, Homo sapiens
guaaaacccugucucuacu

SEQ ID NO: 1100995 - RNA, 19 nt, Homo sapiens
gcaggggaccuuucuguug

SEQ ID NO: 1100996 - RNA, 19 nt, Homo sapiens
uaccagaucaugacaacug

SEQ ID NO: 1100997 - RNA, 19 nt, Homo sapiens
guggucugcuuccuacugu

SEQ ID NO: 1100998 - RNA, 19 nt, Homo sapiens
gggcuaagggcaggagcua

SEQ ID NO: 1100999 - RNA, 19 nt, Homo sapiens
guuuacaaccucaccaaau

SEQ ID NO: 1101000 - RNA, 19 nt, Homo sapiens
gaaugaggaggaggugaau

SEQ ID NO: 1101001 - RNA, 19 nt, Homo sapiens
gaagcagagguugcaguga

SEQ ID NO: 1101002 - RNA, 19 nt, Homo sapiens
uaucauugucccuacuaaa

SEQ ID NO: 1101003 - RNA, 19 nt, Homo sapiens
caggcuggccaacauggua

SEQ ID NO: 1101004 - RNA, 19 nt, Homo sapiens
acgcugugcuugagaccaa

SEQ ID NO: 1101005 - RNA, 19 nt, Homo sapiens
gguaaaacccugucucuac

SEQ ID NO: 1101006 - RNA, 19 nt, Homo sapiens
ggcacgagucauucccaua

SEQ ID NO: 1101007 - RNA, 19 nt, Homo sapiens
auaauucuagggaucauga

SEQ ID NO: 1101008 - RNA, 19 nt, Homo sapiens
uaaacgaauugguguuccu

SEQ ID NO: 1101009 - RNA, 19 nt, Homo sapiens
gcaagagcagguguuuaca

SEQ ID NO: 1101010 - RNA, 19 nt, Homo sapiens
ggucauugcaucccguaag

SEQ ID NO: 1101011 - RNA, 19 nt, Homo sapiens
guaaguuggagagauugaa

SEQ ID NO: 1101012 - RNA, 19 nt, Homo sapiens
acaaagcaggcacgaguca

SEQ ID NO: 1101013 - RNA, 19 nt, Homo sapiens
aguggaauacggaucaauu

SEQ ID NO: 1101014 - RNA, 19 nt, Homo sapiens
ugcaagagcagguguuuac

SEQ ID NO: 1101015 - RNA, 19 nt, Homo sapiens
ggaggaucuaucgucaaua

SEQ ID NO: 1101016 - RNA, 19 nt, Homo sapiens
ccaaccuaccucccacaaa

SEQ ID NO: 1101017 - RNA, 19 nt, Homo sapiens
gacggguaccuucuacaug

SEQ ID NO: 1101018 - RNA, 19 nt, Homo sapiens
ggaaagaaauggaagaauu

SEQ ID NO: 1101019 - RNA, 19 nt, Homo sapiens
gcacuuaaauguucugaaa

SEQ ID NO: 1101020 - RNA, 19 nt, Homo sapiens
gaaacuagaaacaccauua

SEQ ID NO: 1101021 - RNA, 19 nt, Homo sapiens
aaacugaacuuuacagaug

SEQ ID NO: 1101022 - RNA, 19 nt, Homo sapiens
caacagacaaugccaauuu

SEQ ID NO: 1101023 - RNA, 19 nt, Homo sapiens
uuacagagcuuuagugcaa

SEQ ID NO: 1101024 - RNA, 19 nt, Homo sapiens
gaaagaaauggaagaauug

SEQ ID NO: 1101025 - RNA, 19 nt, Homo sapiens
agaauguccugauauguua

SEQ ID NO: 1101026 - RNA, 19 nt, Homo sapiens
gauguuggcuucacuuaau

SEQ ID NO: 1101027 - RNA, 19 nt, Homo sapiens
ccaaugacccuuacacuuu

SEQ ID NO: 1101028 - RNA, 19 nt, Homo sapiens
gaacaagucaaucagauau

SEQ ID NO: 1101029 - RNA, 19 nt, Homo sapiens
gauagacgcucugcuguug

SEQ ID NO: 1101030 - RNA, 19 nt, Homo sapiens
ggacacagaugacagugau

SEQ ID NO: 1101031 - RNA, 19 nt, Homo sapiens
ggaacuacuuaugagauua

SEQ ID NO: 1101032 - RNA, 19 nt, Homo sapiens
gagcaaggccggagaguga

SEQ ID NO: 1101033 - RNA, 19 nt, Homo sapiens
gagugaaacugcaauggaa

SEQ ID NO: 1101034 - RNA, 19 nt, Homo sapiens
gaaggaguaucugcagaaa

SEQ ID NO: 1101035 - RNA, 19 nt, Homo sapiens
agaaagaaaugaccucaau

SEQ ID NO: 1101036 - RNA, 19 nt, Homo sapiens
gagaauguccugauauguu

SEQ ID NO: 1101037 - RNA, 19 nt, Homo sapiens
ggcaagcacuuaaauguuc

SEQ ID NO: 1101038 - RNA, 19 nt, Homo sapiens
ggaacaagucaaucagaua

SEQ ID NO: 1101039 - RNA, 19 nt, Homo sapiens
caagugagguugcacaaag

SEQ ID NO: 1101040 - RNA, 19 nt, Homo sapiens
gcaacaggauaacaauaau

SEQ ID NO: 1101041 - RNA, 19 nt, Homo sapiens
caauuuacgugucauuaug

SEQ ID NO: 1101042 - RNA, 19 nt, Homo sapiens
gacaucaucucccacagaa

SEQ ID NO: 1101043 - RNA, 19 nt, Homo sapiens
ggugcuaacuuuguaauga

SEQ ID NO: 1101044 - RNA, 19 nt, Homo sapiens
uggaagaauuggauacuuu

SEQ ID NO: 1101045 - RNA, 19 nt, Homo sapiens
gaaauggaagaauuggaua

SEQ ID NO: 1101046 - RNA, 19 nt, Homo sapiens
ccacgucuguugcuauuug

SEQ ID NO: 1101047 - RNA, 19 nt, Homo sapiens
gaauuugggagauuguaua

SEQ ID NO: 1101048 - RNA, 19 nt, Homo sapiens
uuagaagagucaaggauuu

SEQ ID NO: 1101049 - RNA, 19 nt, Homo sapiens
gccagagaauguccugaua

SEQ ID NO: 1101050 - RNA, 19 nt, Homo sapiens
ugacagcucaguacgaaua

SEQ ID NO: 1101051 - RNA, 19 nt, Homo sapiens
ucagauauuucaacucuuc

SEQ ID NO: 1101052 - RNA, 19 nt, Homo sapiens
gagagaaggagaagaguug

SEQ ID NO: 1101053 - RNA, 19 nt, Homo sapiens
acuguuaggugguuugaua

SEQ ID NO: 1101054 - RNA, 19 nt, Homo sapiens
cagagaauguccugauaug

SEQ ID NO: 1101055 - RNA, 19 nt, Homo sapiens
ugaagauggucaagagauu

SEQ ID NO: 1101056 - RNA, 19 nt, Homo sapiens
gauuaugacuguacccaau

SEQ ID NO: 1101057 - RNA, 19 nt, Homo sapiens
aaaugaggaugaggaauaa

SEQ ID NO: 1101058 - RNA, 19 nt, Homo sapiens
gcaucaaguucuagaggaa

SEQ ID NO: 1101059 - RNA, 19 nt, Homo sapiens
acagaugaauggagcagua

SEQ ID NO: 1101060 - RNA, 19 nt, Homo sapiens
ggaaugauugugugcauga

SEQ ID NO: 1101061 - RNA, 19 nt, Homo sapiens
gaacucaugcuggaagaaa

SEQ ID NO: 1101062 - RNA, 19 nt, Homo sapiens
agaaaugaccucaaucuug

SEQ ID NO: 1101063 - RNA, 19 nt, Homo sapiens
guuaguuacucuucagauu

SEQ ID NO: 1101064 - RNA, 19 nt, Homo sapiens
cagaggaugugacaaaaua

SEQ ID NO: 1101065 - RNA, 19 nt, Homo sapiens
gagcaacaggauaacaaua

SEQ ID NO: 1101066 - RNA, 19 nt, Homo sapiens
aacagacaaugccaauuua

SEQ ID NO: 1101067 - RNA, 19 nt, Homo sapiens
uggcuucacuuaaucauau

SEQ ID NO: 1101068 - RNA, 19 nt, Homo sapiens
gaucccaggugcaagguau

SEQ ID NO: 1101069 - RNA, 19 nt, Homo sapiens
ggaaggaguaucugcagaa

SEQ ID NO: 1101070 - RNA, 19 nt, Homo sapiens
caagagcuacagggaauua

SEQ ID NO: 1101071 - RNA, 19 nt, Homo sapiens
cacaagagcuacagggaau

SEQ ID NO: 1101072 - RNA, 19 nt, Homo sapiens
gcagaaaccaacagacaau

SEQ ID NO: 1101073 - RNA, 19 nt, Homo sapiens
gaacuuuacagaugaaugg

SEQ ID NO: 1101074 - RNA, 19 nt, Homo sapiens
guuaagcguuugagacuuc

SEQ ID NO: 1101075 - RNA, 19 nt, Homo sapiens
cuuaugagauuaugacugu

SEQ ID NO: 1101076 - RNA, 19 nt, Homo sapiens
caacuacaagcacaauaaa

SEQ ID NO: 1101077 - RNA, 19 nt, Homo sapiens
ccacacacaucaucagucu

SEQ ID NO: 1101078 - RNA, 19 nt, Homo sapiens
gagcuuuagugcaauuuua

SEQ ID NO: 1101079 - RNA, 19 nt, Homo sapiens
ggaagaauuggauacuuug

SEQ ID NO: 1101080 - RNA, 19 nt, Homo sapiens
aaacugcaauggaaguaga

SEQ ID NO: 1101081 - RNA, 19 nt, Homo sapiens
aauaaguccugcagaguga

SEQ ID NO: 1101082 - RNA, 19 nt, Homo sapiens
gcauguuuguugcuuucua

SEQ ID NO: 1101083 - RNA, 19 nt, Homo sapiens
gcaugaauuugggagauug

SEQ ID NO: 1101084 - RNA, 19 nt, Homo sapiens
gggauaaccuaacauuggu

SEQ ID NO: 1101085 - RNA, 19 nt, Homo sapiens
ugagagugcuaccaaugaa

SEQ ID NO: 1101086 - RNA, 19 nt, Homo sapiens
cauguuuguugcuuucuaa

SEQ ID NO: 1101087 - RNA, 19 nt, Homo sapiens
aaacaaaacuagcagaaug

SEQ ID NO: 1101088 - RNA, 19 nt, Homo sapiens
gaauggagcaguauagcau

SEQ ID NO: 1101089 - RNA, 19 nt, Homo sapiens
caucgcaacuccaggacaa

SEQ ID NO: 1101090 - RNA, 19 nt, Homo sapiens
ccaaggaaccagaaacuuc

SEQ ID NO: 1101091 - RNA, 19 nt, Homo sapiens
gaaggaacaacuacaagca

SEQ ID NO: 1101092 - RNA, 19 nt, Homo sapiens
ccagaaacuucagaucaga

SEQ ID NO: 1101093 - RNA, 19 nt, Homo sapiens
caacucaggagaaagaaau

SEQ ID NO: 1101094 - RNA, 19 nt, Homo sapiens
gaugaggaauaauaaacuc

SEQ ID NO: 1101095 - RNA, 19 nt, Homo sapiens
gaagaauuggauacuuuga

SEQ ID NO: 1101096 - RNA, 19 nt, Homo sapiens
gaacaacuacaagcacaau

SEQ ID NO: 1101097 - RNA, 19 nt, Homo sapiens
uacuccagcugaacaauuu

SEQ ID NO: 1101098 - RNA, 19 nt, Homo sapiens
caauagaggacgaggaaga

SEQ ID NO: 1101099 - RNA, 19 nt, Homo sapiens
gauacagcacgagaacuua

SEQ ID NO: 1101100 - RNA, 19 nt, Homo sapiens
gcucugcuguugcccguau

SEQ ID NO: 1101101 - RNA, 19 nt, Homo sapiens
caaggaaccagaaacuuca

SEQ ID NO: 1101102 - RNA, 19 nt, Homo sapiens
aacaaaagcuccugaagaa

SEQ ID NO: 1101103 - RNA, 19 nt, Homo sapiens
acaacuacaagcacaauaa

SEQ ID NO: 1101104 - RNA, 19 nt, Homo sapiens
ggugaagauggaacuguua

SEQ ID NO: 1101105 - RNA, 19 nt, Homo sapiens
ccacagaaagcccucauuc

SEQ ID NO: 1101106 - RNA, 19 nt, Homo sapiens
ugaagaagcaagugagguu

SEQ ID NO: 1101107 - RNA, 19 nt, Homo sapiens
ggagagaaggagaagaguu

SEQ ID NO: 1101108 - RNA, 19 nt, Homo sapiens
uuuauuccuucccaucuua

SEQ ID NO: 1101109 - RNA, 19 nt, Homo sapiens
uuucuacacuugccauuug

SEQ ID NO: 1101110 - RNA, 19 nt, Homo sapiens
uggaacuacuuaugagauu

SEQ ID NO: 1101111 - RNA, 19 nt, Homo sapiens
gaaggagacagugaaacaa

SEQ ID NO: 1101112 - RNA, 19 nt, Homo sapiens
gcucaguacgaauauauga

SEQ ID NO: 1101113 - RNA, 19 nt, Homo sapiens
aaaacuagcugcacaaaag

SEQ ID NO: 1101114 - RNA, 19 nt, Homo sapiens
uuagaaggccgcuaguaaa

SEQ ID NO: 1101115 - RNA, 19 nt, Homo sapiens
gaaagaaaugaccucaauc

SEQ ID NO: 1101116 - RNA, 19 nt, Homo sapiens
gcacagaaggaacaacuac

SEQ ID NO: 1101117 - RNA, 19 nt, Homo sapiens
ggacaccacacacaucauc

SEQ ID NO: 1101118 - RNA, 19 nt, Homo sapiens
gaaacaacuugaagaagaa

SEQ ID NO: 1101119 - RNA, 19 nt, Homo sapiens
ugaaacaacuugaagaaga

SEQ ID NO: 1101120 - RNA, 19 nt, Homo sapiens
guaaaggccucuagaugau

SEQ ID NO: 1101121 - RNA, 19 nt, Homo sapiens
gguaaaggccucuagauga

SEQ ID NO: 1101122 - RNA, 19 nt, Homo sapiens
caaaggaaaugcaaagaag

SEQ ID NO: 1101123 - RNA, 19 nt, Homo sapiens
gacagaagauugaaaugug

SEQ ID NO: 1101124 - RNA, 19 nt, Homo sapiens
ugaaugaugucuuccuuau

SEQ ID NO: 1101125 - RNA, 19 nt, Homo sapiens
aaaggccucuagaugauua

SEQ ID NO: 1101126 - RNA, 19 nt, Homo sapiens
ggucauuggucacauucua

SEQ ID NO: 1101127 - RNA, 19 nt, Homo sapiens
uuagcaagaugaacccuua

SEQ ID NO: 1101128 - RNA, 19 nt, Homo sapiens
ggagauuuauggacuucaa

SEQ ID NO: 1101129 - RNA, 19 nt, Homo sapiens
uaacuacaccugcauaugu

SEQ ID NO: 1101130 - RNA, 19 nt, Homo sapiens
aaagaggccuaguaauguu

SEQ ID NO: 1101131 - RNA, 19 nt, Homo sapiens
gugauugcauucauugauu

SEQ ID NO: 1101132 - RNA, 19 nt, Homo sapiens
gacagugauugcauucauu

SEQ ID NO: 1101133 - RNA, 19 nt, Homo sapiens
ggagacagaagauugaaau

SEQ ID NO: 1101134 - RNA, 19 nt, Homo sapiens
gauaaaagaggccuaguaa

SEQ ID NO: 1101135 - RNA, 19 nt, Homo sapiens
aaacggaaaucggacagaa

SEQ ID NO: 1101136 - RNA, 19 nt, Homo sapiens
ugauuucuguuccuaacua

SEQ ID NO: 1101137 - RNA, 19 nt, Homo sapiens
ggaaccugauguuguuguu

SEQ ID NO: 1101138 - RNA, 19 nt, Homo sapiens
ggacuucaauuugucuauc

SEQ ID NO: 1101139 - RNA, 19 nt, Homo sapiens
aaccugauguuguuguuaa

SEQ ID NO: 1101140 - RNA, 19 nt, Homo sapiens
gaaccugauguuguuguua

SEQ ID NO: 1101141 - RNA, 19 nt, Homo sapiens
gaaaaugcaagaagaacua

SEQ ID NO: 1101142 - RNA, 19 nt, Homo sapiens
uaaaagaggccuaguaaug

SEQ ID NO: 1101143 - RNA, 19 nt, Homo sapiens
caaggagauuuauggacuu

SEQ ID NO: 1101144 - RNA, 19 nt, Homo sapiens
uguggaaccugauguuguu

SEQ ID NO: 1101145 - RNA, 19 nt, Homo sapiens
ugaggucauuggucacauu

SEQ ID NO: 1101146 - RNA, 19 nt, Homo sapiens
ggacagcaugcaagaagga

SEQ ID NO: 1101147 - RNA, 19 nt, Homo sapiens
ugugacagguugcguugaa

SEQ ID NO: 1101148 - RNA, 19 nt, Homo sapiens
caugguuaauugcuaguug

SEQ ID NO: 1101149 - RNA, 19 nt, Homo sapiens
acaaaggaaaugcaaagaa

SEQ ID NO: 1101150 - RNA, 19 nt, Homo sapiens
aaaggagacagaagauuga

SEQ ID NO: 1101151 - RNA, 19 nt, Homo sapiens
gacuucaauuugucuauca

SEQ ID NO: 1101152 - RNA, 19 nt, Homo sapiens
uagcaucuuuauucaagga

SEQ ID NO: 1101153 - RNA, 19 nt, Homo sapiens
guugaaugaugucuuccuu

SEQ ID NO: 1101154 - RNA, 19 nt, Homo sapiens
cagguugcguugaaugaug

SEQ ID NO: 1101155 - RNA, 19 nt, Homo sapiens
guaauguucuuuugagguu

SEQ ID NO: 1101156 - RNA, 19 nt, Homo sapiens
ccuuaacccucgauucaau

SEQ ID NO: 1101157 - RNA, 19 nt, Homo sapiens
uuagaaauccuugcugcua

SEQ ID NO: 1101158 - RNA, 19 nt, Homo sapiens
agacagugauugcauucau

SEQ ID NO: 1101159 - RNA, 19 nt, Homo sapiens
gacagguugcguugaauga

SEQ ID NO: 1101160 - RNA, 19 nt, Homo sapiens
ggagacagugauugcauuc

SEQ ID NO: 1101161 - RNA, 19 nt, Homo sapiens
uggagacagugauugcauu

SEQ ID NO: 1101162 - RNA, 19 nt, Homo sapiens
cggaugaggcuaagaaucu

SEQ ID NO: 1101163 - RNA, 19 nt, Homo sapiens
gccucuagaugauuagcaa

SEQ ID NO: 1101164 - RNA, 19 nt, Homo sapiens
agacagaagauugaaaugu

SEQ ID NO: 1101165 - RNA, 19 nt, Homo sapiens
aaacugaaacaacuugaag

SEQ ID NO: 1101166 - RNA, 19 nt, Homo sapiens
gaugucuuccuuaucaaug

SEQ ID NO: 1101167 - RNA, 19 nt, Homo sapiens
guagguaaaggccucuaga

SEQ ID NO: 1101168 - RNA, 19 nt, Homo sapiens
ggguugauuucuguuccua

SEQ ID NO: 1101169 - RNA, 19 nt, Homo sapiens
gaaugaugucuuccuuauc

SEQ ID NO: 1101170 - RNA, 19 nt, Homo sapiens
gcugguacaucgucuucag

SEQ ID NO: 1101171 - RNA, 19 nt, Homo sapiens
ucagcugcauccuucucua

SEQ ID NO: 1101172 - RNA, 19 nt, Homo sapiens
gaaacggaaaucggacaga

SEQ ID NO: 1101173 - RNA, 19 nt, Homo sapiens
uaaaggccucuagaugauu

SEQ ID NO: 1101174 - RNA, 19 nt, Homo sapiens
ggguuuguuucuguauauu

SEQ ID NO: 1101175 - RNA, 19 nt, Homo sapiens
cuacuuggagacagugauu

SEQ ID NO: 1101176 - RNA, 19 nt, Homo sapiens
cccguugucuggugaagga

SEQ ID NO: 1101177 - RNA, 19 nt, Homo sapiens
uuacaaaggaaaugcaaag

SEQ ID NO: 1101178 - RNA, 19 nt, Homo sapiens
gagacagaagauugaaaug

SEQ ID NO: 1101179 - RNA, 19 nt, Homo sapiens
ggucauggaacgccaagag

SEQ ID NO: 1101180 - RNA, 19 nt, Homo sapiens
uuaaacgacaagaagcuuu

SEQ ID NO: 1101181 - RNA, 19 nt, Homo sapiens
uaaaugcgcaaguugaaaa

SEQ ID NO: 1101182 - RNA, 19 nt, Homo sapiens
guccugggccuuccacuuc

SEQ ID NO: 1101183 - RNA, 19 nt, Homo sapiens
aaaaggagacagaagauug

SEQ ID NO: 1101184 - RNA, 19 nt, Homo sapiens
guugauuucuguuccuaac

SEQ ID NO: 1101185 - RNA, 19 nt, Homo sapiens
acugaaacaacuugaagaa

SEQ ID NO: 1101186 - RNA, 19 nt, Homo sapiens
cuaaaugcgcaaguugaaa

SEQ ID NO: 1101187 - RNA, 19 nt, Homo sapiens
ugauguuguuguuaaacga

SEQ ID NO: 1101188 - RNA, 19 nt, Homo sapiens
acagugauugcauucauug

SEQ ID NO: 1101189 - RNA, 19 nt, Homo sapiens
ucuacguggucuuucagaa

SEQ ID NO: 1101190 - RNA, 19 nt, Homo sapiens
gaugggguuuguuucugua

SEQ ID NO: 1101191 - RNA, 19 nt, Homo sapiens
ugacagguugcguugaaug

SEQ ID NO: 1101192 - RNA, 19 nt, Homo sapiens
ugcauucauugauuucaug

SEQ ID NO: 1101193 - RNA, 19 nt, Homo sapiens
auugcuaguugguagguaa

SEQ ID NO: 1101194 - RNA, 19 nt, Homo sapiens
acuaaaugcgcaaguugaa

SEQ ID NO: 1101195 - RNA, 19 nt, Homo sapiens
gcaaaagguauagauguug

SEQ ID NO: 1101196 - RNA, 19 nt, Homo sapiens
ccucgauucaauugccuua

SEQ ID NO: 1101197 - RNA, 19 nt, Homo sapiens
gacugaaaaugcaagaaga

SEQ ID NO: 1101198 - RNA, 19 nt, Homo sapiens
uguaaaggcugccaaguua

SEQ ID NO: 1101199 - RNA, 19 nt, Homo sapiens
caugaaaccuuuaaccuuu

SEQ ID NO: 1101200 - RNA, 19 nt, Homo sapiens
gaauauaacuaaccaacug

SEQ ID NO: 1101201 - RNA, 19 nt, Homo sapiens
ggaaagaauucguaagcuu

SEQ ID NO: 1101202 - RNA, 19 nt, Homo sapiens
caacagugauucccugaaa

SEQ ID NO: 1101203 - RNA, 19 nt, Homo sapiens
gcacaacacucgcuccaau

SEQ ID NO: 1101204 - RNA, 19 nt, Homo sapiens
ggccugaucuguaaauaaa

SEQ ID NO: 1101205 - RNA, 19 nt, Homo sapiens
gaauggaaacgacagaaua

SEQ ID NO: 1101206 - RNA, 19 nt, Homo sapiens
caggaaaccaguacaauua

SEQ ID NO: 1101207 - RNA, 19 nt, Homo sapiens
ggaugaaacucaauguaga

SEQ ID NO: 1101208 - RNA, 19 nt, Homo sapiens
ggucaucgcugcaucugaa

SEQ ID NO: 1101209 - RNA, 19 nt, Homo sapiens
gggaauccaugaaaccuuu

SEQ ID NO: 1101210 - RNA, 19 nt, Homo sapiens
ucacaucacuuuccgauca

SEQ ID NO: 1101211 - RNA, 19 nt, Homo sapiens
gcagucagcuucccagaca

SEQ ID NO: 1101212 - RNA, 19 nt, Homo sapiens
gcgcaaagaaggccauaua

SEQ ID NO: 1101213 - RNA, 19 nt, Homo sapiens
gaaacucaauguagaagag

SEQ ID NO: 1101214 - RNA, 19 nt, Homo sapiens
gguccuggcucaacaguga

SEQ ID NO: 1101215 - RNA, 19 nt, Homo sapiens
gcaggaaaccaguacaauu

SEQ ID NO: 1101216 - RNA, 19 nt, Homo sapiens
gugauauucuugcccuuua

SEQ ID NO: 1101217 - RNA, 19 nt, Homo sapiens
uuacuacaaugcugaauga

SEQ ID NO: 1101218 - RNA, 19 nt, Homo sapiens
gaagagggacuguauagca

SEQ ID NO: 1101219 - RNA, 19 nt, Homo sapiens
gaaagaagaacugauaugg

SEQ ID NO: 1101220 - RNA, 19 nt, Homo sapiens
gaacuguaagcaagcauuu

SEQ ID NO: 1101221 - RNA, 19 nt, Homo sapiens
caaagaaggccauauacau

SEQ ID NO: 1101222 - RNA, 19 nt, Homo sapiens
ggcuguugcucucuucuua

SEQ ID NO: 1101223 - RNA, 19 nt, Homo sapiens
ggaaagaagaacugauaug

SEQ ID NO: 1101224 - RNA, 19 nt, Homo sapiens
accgagaucucaaacauaa

SEQ ID NO: 1101225 - RNA, 19 nt, Homo sapiens
ggaaaccaguacaauuaca

SEQ ID NO: 1101226 - RNA, 19 nt, Homo sapiens
cauggaugaugauguaauu

SEQ ID NO: 1101227 - RNA, 19 nt, Homo sapiens
gcaaagaaggccauauaca

SEQ ID NO: 1101228 - RNA, 19 nt, Homo sapiens
gauauucaccucaguuugu

SEQ ID NO: 1101229 - RNA, 19 nt, Homo sapiens
ccagacagacuauagacua

SEQ ID NO: 1101230 - RNA, 19 nt, Homo sapiens
ccuguggccugaucuguaa

SEQ ID NO: 1101231 - RNA, 19 nt, Homo sapiens
uuggcuaucuugacuauaa

SEQ ID NO: 1101232 - RNA, 19 nt, Homo sapiens
gcucucuucuuacugguuu

SEQ ID NO: 1101233 - RNA, 19 nt, Homo sapiens
aaccuaauccgaagauaua

SEQ ID NO: 1101234 - RNA, 19 nt, Homo sapiens
caacaccuccucugcuuau

SEQ ID NO: 1101235 - RNA, 19 nt, Homo sapiens
gaucucaaacauaaaguga

SEQ ID NO: 1101236 - RNA, 19 nt, Homo sapiens
acaggcaaauucaaccuaa

SEQ ID NO: 1101237 - RNA, 19 nt, Homo sapiens
gaugaaacucaauguagaa

SEQ ID NO: 1101238 - RNA, 19 nt, Homo sapiens
uugcaaaccugacggaaug

SEQ ID NO: 1101239 - RNA, 19 nt, Homo sapiens
ggaugaugauguaauugug

SEQ ID NO: 1101240 - RNA, 19 nt, Homo sapiens
gaugucauuccguaaagua

SEQ ID NO: 1101241 - RNA, 19 nt, Homo sapiens
uggaaacgacagaauauaa

SEQ ID NO: 1101242 - RNA, 19 nt, Homo sapiens
aaagaaggccauauacaug

SEQ ID NO: 1101243 - RNA, 19 nt, Homo sapiens
uagcaugcgugggaaguaa

SEQ ID NO: 1101244 - RNA, 19 nt, Homo sapiens
uaaacagcauucagcacaa

SEQ ID NO: 1101245 - RNA, 19 nt, Homo sapiens
gcaguuuguuaaggaauga

SEQ ID NO: 1101246 - RNA, 19 nt, Homo sapiens
gauauaccgagaucucaaa

SEQ ID NO: 1101247 - RNA, 19 nt, Homo sapiens
guagaagagggacuguaua

SEQ ID NO: 1101248 - RNA, 19 nt, Homo sapiens
ggagauuccuguggucauc

SEQ ID NO: 1101249 - RNA, 19 nt, Homo sapiens
auaaauaugucuccaucug

SEQ ID NO: 1101250 - RNA, 19 nt, Homo sapiens
gaauuugaacuguaagcaa

SEQ ID NO: 1101251 - RNA, 19 nt, Homo sapiens
caaccuaauccgaagauau

SEQ ID NO: 1101252 - RNA, 19 nt, Homo sapiens
cacaacaccuccucugcuu

SEQ ID NO: 1101253 - RNA, 19 nt, Homo sapiens
gacagaauauaacuaacca

SEQ ID NO: 1101254 - RNA, 19 nt, Homo sapiens
ggacugcuucauauacuga

SEQ ID NO: 1101255 - RNA, 19 nt, Homo sapiens
gagggacuguauagcagaa

SEQ ID NO: 1101256 - RNA, 19 nt, Homo sapiens
cagcuugagcaguuuguua

SEQ ID NO: 1101257 - RNA, 19 nt, Homo sapiens
aaagaugucauuccguaaa

SEQ ID NO: 1101258 - RNA, 19 nt, Homo sapiens
gauucagccucuacuaaag

SEQ ID NO: 1101259 - RNA, 19 nt, Homo sapiens
ggaauggaaacgacagaau

SEQ ID NO: 1101260 - RNA, 19 nt, Homo sapiens
gcacugaagccaggacaug

SEQ ID NO: 1101261 - RNA, 19 nt, Homo sapiens
gccucaaccuauagacuuu

SEQ ID NO: 1101262 - RNA, 19 nt, Homo sapiens
cuggaaagaagaacugaua

SEQ ID NO: 1101263 - RNA, 19 nt, Homo sapiens
gagcaggaaaccaguacaa

SEQ ID NO: 1101264 - RNA, 19 nt, Homo sapiens
aacacucgcuccaauguga

SEQ ID NO: 1101265 - RNA, 19 nt, Homo sapiens
ugaaacagaauuugaacug

SEQ ID NO: 1101266 - RNA, 19 nt, Homo sapiens
ggaaacgacagaauauaac

SEQ ID NO: 1101267 - RNA, 19 nt, Homo sapiens
gugauucagccucuacuaa

SEQ ID NO: 1101268 - RNA, 19 nt, Homo sapiens
guaauugugcaaggugaua

SEQ ID NO: 1101269 - RNA, 19 nt, Homo sapiens
cugaaugacuggaaagaag

SEQ ID NO: 1101270 - RNA, 19 nt, Homo sapiens
ccgaagauauaccgagauc

SEQ ID NO: 1101271 - RNA, 19 nt, Homo sapiens
gaaaccaguacaauuacau

SEQ ID NO: 1101272 - RNA, 19 nt, Homo sapiens
ccaugaaaccuuuaaccuu

SEQ ID NO: 1101273 - RNA, 19 nt, Homo sapiens
gaaacgacagaauauaacu

SEQ ID NO: 1101274 - RNA, 19 nt, Homo sapiens
uucguaagcuuuccaugaa

SEQ ID NO: 1101275 - RNA, 19 nt, Homo sapiens
uaaggaaugagguuacaga

SEQ ID NO: 1101276 - RNA, 19 nt, Homo sapiens
ugauucagccucuacuaaa

SEQ ID NO: 1101277 - RNA, 19 nt, Homo sapiens
ggaauccaugaaaccuuua

SEQ ID NO: 1101278 - RNA, 19 nt, Homo sapiens
gaaugacuggaaagaagaa

SEQ ID NO: 1101279 - RNA, 19 nt, Homo sapiens
cauuggcuaucuugacuau

SEQ ID NO: 1101280 - RNA, 19 nt, Homo sapiens
ccaucugccuuaccaagug

SEQ ID NO: 1101281 - RNA, 19 nt, Homo sapiens
auaccgagaucucaaacau

SEQ ID NO: 1101282 - RNA, 19 nt, Homo sapiens
uucagaagauugugauuca

SEQ ID NO: 1101283 - RNA, 19 nt, Homo sapiens
cuucauauacugauguuug

SEQ ID NO: 1101284 - RNA, 19 nt, Homo sapiens
gcugccaaguuacuccauu

SEQ ID NO: 1101285 - RNA, 19 nt, Homo sapiens
uagaagagggacuguauag

SEQ ID NO: 1101286 - RNA, 19 nt, Homo sapiens
gaauccaugaaaccuuuaa

SEQ ID NO: 1101287 - RNA, 19 nt, Homo sapiens
gaaaagcaucagauacaaa

SEQ ID NO: 1101288 - RNA, 19 nt, Homo sapiens
guuaaggaaugagguuaca

SEQ ID NO: 1101289 - RNA, 19 nt, Homo sapiens
agguaaagaugacaaacug

SEQ ID NO: 1101290 - RNA, 19 nt, Homo sapiens
ccaaaugcucuccgacaug

SEQ ID NO: 1101291 - RNA, 19 nt, Homo sapiens
auucuugcccuuuacaaua

SEQ ID NO: 1101292 - RNA, 19 nt, Homo sapiens
gcuccaaugugauuuucua

SEQ ID NO: 1101293 - RNA, 19 nt, Homo sapiens
gauauggcuaguucagcua

SEQ ID NO: 1101294 - RNA, 19 nt, Homo sapiens
cgagaucucaaacauaaag

SEQ ID NO: 1101295 - RNA, 19 nt, Homo sapiens
ccaucgauccuauguggaa

SEQ ID NO: 1101296 - RNA, 19 nt, Homo sapiens
ggugauauucuugcccuuu

SEQ ID NO: 1101297 - RNA, 19 nt, Homo sapiens
gcuguugguuuuaauuuug

SEQ ID NO: 1101298 - RNA, 19 nt, Homo sapiens
uguaaaggcugccaaguua

SEQ ID NO: 1101299 - RNA, 19 nt, Homo sapiens
caugaaaccuuuaaccuuu

SEQ ID NO: 1101300 - RNA, 19 nt, Homo sapiens
gaauauaacuaaccaacug

SEQ ID NO: 1101301 - RNA, 19 nt, Homo sapiens
ggaaagaauucguaagcuu

SEQ ID NO: 1101302 - RNA, 19 nt, Homo sapiens
caacagugauucccugaaa

SEQ ID NO: 1101303 - RNA, 19 nt, Homo sapiens
gcacaacacucgcuccaau

SEQ ID NO: 1101304 - RNA, 19 nt, Homo sapiens
ggccugaucuguaaauaaa

SEQ ID NO: 1101305 - RNA, 19 nt, Homo sapiens
gaauggaaacgacagaaua

SEQ ID NO: 1101306 - RNA, 19 nt, Homo sapiens
caggaaaccaguacaauua

SEQ ID NO: 1101307 - RNA, 19 nt, Homo sapiens
ggaugaaacucaauguaga

SEQ ID NO: 1101308 - RNA, 19 nt, Homo sapiens
ggucaucgcugcaucugaa

SEQ ID NO: 1101309 - RNA, 19 nt, Homo sapiens
gggaauccaugaaaccuuu

SEQ ID NO: 1101310 - RNA, 19 nt, Homo sapiens
gcagucagcuucccagaca

SEQ ID NO: 1101311 - RNA, 19 nt, Homo sapiens
gcgcaaagaaggccauaua

SEQ ID NO: 1101312 - RNA, 19 nt, Homo sapiens
gaaacucaauguagaagag

SEQ ID NO: 1101313 - RNA, 19 nt, Homo sapiens
gguccuggcucaacaguga

SEQ ID NO: 1101314 - RNA, 19 nt, Homo sapiens
gcaggaaaccaguacaauu

SEQ ID NO: 1101315 - RNA, 19 nt, Homo sapiens
gugauauucuugcccuuua

SEQ ID NO: 1101316 - RNA, 19 nt, Homo sapiens
uuacuacaaugcugaauga

SEQ ID NO: 1101317 - RNA, 19 nt, Homo sapiens
gaagagggacuguauagca

SEQ ID NO: 1101318 - RNA, 19 nt, Homo sapiens
gaaagaagaacugauaugg

SEQ ID NO: 1101319 - RNA, 19 nt, Homo sapiens
gaacuguaagcaagcauuu

SEQ ID NO: 1101320 - RNA, 19 nt, Homo sapiens
caaagaaggccauauacau

SEQ ID NO: 1101321 - RNA, 19 nt, Homo sapiens
ggcuguugcucucuucuua

SEQ ID NO: 1101322 - RNA, 19 nt, Homo sapiens
ggaaagaagaacugauaug

SEQ ID NO: 1101323 - RNA, 19 nt, Homo sapiens
accgagaucucaaacauaa

SEQ ID NO: 1101324 - RNA, 19 nt, Homo sapiens
ggaaaccaguacaauuaca

SEQ ID NO: 1101325 - RNA, 19 nt, Homo sapiens
cauggaugaugauguaauu

SEQ ID NO: 1101326 - RNA, 19 nt, Homo sapiens
gcaaagaaggccauauaca

SEQ ID NO: 1101327 - RNA, 19 nt, Homo sapiens
gauauucaccucaguuugu

SEQ ID NO: 1101328 - RNA, 19 nt, Homo sapiens
ccagacagacuauagacua

SEQ ID NO: 1101329 - RNA, 19 nt, Homo sapiens
ccuguggccugaucuguaa

SEQ ID NO: 1101330 - RNA, 19 nt, Homo sapiens
uuggcuaucuugacuauaa

SEQ ID NO: 1101331 - RNA, 19 nt, Homo sapiens
gcucucuucuuacugguuu

SEQ ID NO: 1101332 - RNA, 19 nt, Homo sapiens
aaccuaauccgaagauaua

SEQ ID NO: 1101333 - RNA, 19 nt, Homo sapiens
caacaccuccucugcuuau

SEQ ID NO: 1101334 - RNA, 19 nt, Homo sapiens
gaucucaaacauaaaguga

SEQ ID NO: 1101335 - RNA, 19 nt, Homo sapiens
acaggcaaauucaaccuaa

SEQ ID NO: 1101336 - RNA, 19 nt, Homo sapiens
gaugaaacucaauguagaa

SEQ ID NO: 1101337 - RNA, 19 nt, Homo sapiens
uugcaaaccugacggaaug

SEQ ID NO: 1101338 - RNA, 19 nt, Homo sapiens
ggaugaugauguaauugug

SEQ ID NO: 1101339 - RNA, 19 nt, Homo sapiens
uggaaacgacagaauauaa

SEQ ID NO: 1101340 - RNA, 19 nt, Homo sapiens
aaagaaggccauauacaug

SEQ ID NO: 1101341 - RNA, 19 nt, Homo sapiens
gaugucauuccguaaagua

SEQ ID NO: 1101342 - RNA, 19 nt, Homo sapiens
uagcaugcgugggaaguaa

SEQ ID NO: 1101343 - RNA, 19 nt, Homo sapiens
uaaacagcauucagcacaa

SEQ ID NO: 1101344 - RNA, 19 nt, Homo sapiens
gcaguuuguuaaggaauga

SEQ ID NO: 1101345 - RNA, 19 nt, Homo sapiens
gauauaccgagaucucaaa

SEQ ID NO: 1101346 - RNA, 19 nt, Homo sapiens
guagaagagggacuguaua

SEQ ID NO: 1101347 - RNA, 19 nt, Homo sapiens
ggagauuccuguggucauc

SEQ ID NO: 1101348 - RNA, 19 nt, Homo sapiens
auaaauaugucuccaucug

SEQ ID NO: 1101349 - RNA, 19 nt, Homo sapiens
gaauuugaacuguaagcaa

SEQ ID NO: 1101350 - RNA, 19 nt, Homo sapiens
caaccuaauccgaagauau

SEQ ID NO: 1101351 - RNA, 19 nt, Homo sapiens
cacaacaccuccucugcuu

SEQ ID NO: 1101352 - RNA, 19 nt, Homo sapiens
gacagaauauaacuaacca

SEQ ID NO: 1101353 - RNA, 19 nt, Homo sapiens
ggacugcuucauauacuga

SEQ ID NO: 1101354 - RNA, 19 nt, Homo sapiens
gagggacuguauagcagaa

SEQ ID NO: 1101355 - RNA, 19 nt, Homo sapiens
cagcuugagcaguuuguua

SEQ ID NO: 1101356 - RNA, 19 nt, Homo sapiens
aaagaugucauuccguaaa

SEQ ID NO: 1101357 - RNA, 19 nt, Homo sapiens
gauucagccucuacuaaag

SEQ ID NO: 1101358 - RNA, 19 nt, Homo sapiens
ggaauggaaacgacagaau

SEQ ID NO: 1101359 - RNA, 19 nt, Homo sapiens
gcacugaagccaggacaug

SEQ ID NO: 1101360 - RNA, 19 nt, Homo sapiens
gccucaaccuauagacuuu

SEQ ID NO: 1101361 - RNA, 19 nt, Homo sapiens
cuggaaagaagaacugaua

SEQ ID NO: 1101362 - RNA, 19 nt, Homo sapiens
gagcaggaaaccaguacaa

SEQ ID NO: 1101363 - RNA, 19 nt, Homo sapiens
aacacucgcuccaauguga

SEQ ID NO: 1101364 - RNA, 19 nt, Homo sapiens
ugaaacagaauuugaacug

SEQ ID NO: 1101365 - RNA, 19 nt, Homo sapiens
ggaaacgacagaauauaac

SEQ ID NO: 1101366 - RNA, 19 nt, Homo sapiens
gugauucagccucuacuaa

SEQ ID NO: 1101367 - RNA, 19 nt, Homo sapiens
guaauugugcaaggugaua

SEQ ID NO: 1101368 - RNA, 19 nt, Homo sapiens
cugaaugacuggaaagaag

SEQ ID NO: 1101369 - RNA, 19 nt, Homo sapiens
ccgaagauauaccgagauc

SEQ ID NO: 1101370 - RNA, 19 nt, Homo sapiens
gaaaccaguacaauuacau

SEQ ID NO: 1101371 - RNA, 19 nt, Homo sapiens
ccaugaaaccuuuaaccuu

SEQ ID NO: 1101372 - RNA, 19 nt, Homo sapiens
gaaacgacagaauauaacu

SEQ ID NO: 1101373 - RNA, 19 nt, Homo sapiens
uucguaagcuuuccaugaa

SEQ ID NO: 1101374 - RNA, 19 nt, Homo sapiens
ugauucagccucuacuaaa

SEQ ID NO: 1101375 - RNA, 19 nt, Homo sapiens
ggaauccaugaaaccuuua

SEQ ID NO: 1101376 - RNA, 19 nt, Homo sapiens
uaaggaaugagguuacaga

SEQ ID NO: 1101377 - RNA, 19 nt, Homo sapiens
gaaugacuggaaagaagaa

SEQ ID NO: 1101378 - RNA, 19 nt, Homo sapiens
cauuggcuaucuugacuau

SEQ ID NO: 1101379 - RNA, 19 nt, Homo sapiens
ccaucugccuuaccaagug

SEQ ID NO: 1101380 - RNA, 19 nt, Homo sapiens
auaccgagaucucaaacau

SEQ ID NO: 1101381 - RNA, 19 nt, Homo sapiens
uucagaagauugugauuca

SEQ ID NO: 1101382 - RNA, 19 nt, Homo sapiens
cuucauauacugauguuug

SEQ ID NO: 1101383 - RNA, 19 nt, Homo sapiens
gcugccaaguuacuccauu

SEQ ID NO: 1101384 - RNA, 19 nt, Homo sapiens
uagaagagggacuguauag

SEQ ID NO: 1101385 - RNA, 19 nt, Homo sapiens
gaauccaugaaaccuuuaa

SEQ ID NO: 1101386 - RNA, 19 nt, Homo sapiens
gaaaagcaucagauacaaa

SEQ ID NO: 1101387 - RNA, 19 nt, Homo sapiens
agguaaagaugacaaacug

SEQ ID NO: 1101388 - RNA, 19 nt, Homo sapiens
guuaaggaaugagguuaca

SEQ ID NO: 1101389 - RNA, 19 nt, Homo sapiens
ccaaaugcucuccgacaug

SEQ ID NO: 1101390 - RNA, 19 nt, Homo sapiens
auucuugcccuuuacaaua

SEQ ID NO: 1101391 - RNA, 19 nt, Homo sapiens
gcuccaaugugauuuucua

SEQ ID NO: 1101392 - RNA, 19 nt, Homo sapiens
gauauggcuaguucagcua

SEQ ID NO: 1101393 - RNA, 19 nt, Homo sapiens
cgagaucucaaacauaaag

SEQ ID NO: 1101394 - RNA, 19 nt, Homo sapiens
ccaucgauccuauguggaa

SEQ ID NO: 1101395 - RNA, 19 nt, Homo sapiens
ggugauauucuugcccuuu

SEQ ID NO: 1101396 - RNA, 19 nt, Homo sapiens
gcuguugguuuuaauuuug

SEQ ID NO: 1101397 - RNA, 19 nt, Homo sapiens
ugaaugacuggaaagaaga

SEQ ID NO: 1101398 - RNA, 19 nt, Homo sapiens
aaacaaagcuuucaagaca

SEQ ID NO: 1101399 - RNA, 19 nt, Homo sapiens
gaaagggaauguaacaaau

SEQ ID NO: 1101400 - RNA, 19 nt, Homo sapiens
gaaucgagcuacucacauu

SEQ ID NO: 1101401 - RNA, 19 nt, Homo sapiens
gcuggcaccucuugaaaua

SEQ ID NO: 1101402 - RNA, 19 nt, Homo sapiens
uaacaaauguccucccuau

SEQ ID NO: 1101403 - RNA, 19 nt, Homo sapiens
uaucaucacuuucuucgua

SEQ ID NO: 1101404 - RNA, 19 nt, Homo sapiens
gaaaauacauucccaaaca

SEQ ID NO: 1101405 - RNA, 19 nt, Homo sapiens
ccaaagaccuccacuucga

SEQ ID NO: 1101406 - RNA, 19 nt, Homo sapiens
gcaguaagcucggcucaca

SEQ ID NO: 1101407 - RNA, 19 nt, Homo sapiens
gcacuuaaccuuguaacuu

SEQ ID NO: 1101408 - RNA, 19 nt, Homo sapiens
caaacagucuuucuugaca

SEQ ID NO: 1101409 - RNA, 19 nt, Homo sapiens
cacuuaaccuuguaacuuu

SEQ ID NO: 1101410 - RNA, 19 nt, Homo sapiens
gaauuacagaccucuauuu

SEQ ID NO: 1101411 - RNA, 19 nt, Homo sapiens
acaaauguccucccuauga

SEQ ID NO: 1101412 - RNA, 19 nt, Homo sapiens
ugacagacaugaugaaagg

SEQ ID NO: 1101413 - RNA, 19 nt, Homo sapiens
aagagaagcucgcccauuc

SEQ ID NO: 1101414 - RNA, 19 nt, Homo sapiens
gagcagggauuagcugugu

SEQ ID NO: 1101415 - RNA, 19 nt, Homo sapiens
gaagaccgagcagggauua

SEQ ID NO: 1101416 - RNA, 19 nt, Homo sapiens
gcugaccaaucacgaauga

SEQ ID NO: 1101417 - RNA, 19 nt, Homo sapiens
uagaugaugucgaagaaga

SEQ ID NO: 1101418 - RNA, 19 nt, Homo sapiens
ugacugauccuacuauguu

SEQ ID NO: 1101419 - RNA, 19 nt, Homo sapiens
caaauguccucccuaugau

SEQ ID NO: 1101420 - RNA, 19 nt, Homo sapiens
uaaugccgcugaccaauca

SEQ ID NO: 1101421 - RNA, 19 nt, Homo sapiens
ugaaagggaauguaacaaa

SEQ ID NO: 1101422 - RNA, 19 nt, Homo sapiens
ggcacuagaugaugucgaa

SEQ ID NO: 1101423 - RNA, 19 nt, Homo sapiens
gaagagaagcucgcccauu

SEQ ID NO: 1101424 - RNA, 19 nt, Homo sapiens
uggcaccucuugaaauaaa

SEQ ID NO: 1101425 - RNA, 19 nt, Homo sapiens
gagcauuuacucucugauu

SEQ ID NO: 1101426 - RNA, 19 nt, Homo sapiens
guacuuccucaauguauuu

SEQ ID NO: 1101427 - RNA, 19 nt, Homo sapiens
ggaauuacagaccucuauu

SEQ ID NO: 1101428 - RNA, 19 nt, Homo sapiens
acaaagcuuucaagacaga

SEQ ID NO: 1101429 - RNA, 19 nt, Homo sapiens
caacccagaggauggauuu

SEQ ID NO: 1101430 - RNA, 19 nt, Homo sapiens
ccacugacccuccguuuua

SEQ ID NO: 1101431 - RNA, 19 nt, Homo sapiens
gaguugcacuuaaccuugu

SEQ ID NO: 1101432 - RNA, 19 nt, Homo sapiens
gguacuuccucaauguauu

SEQ ID NO: 1101433 - RNA, 19 nt, Homo sapiens
gagcuacucacauuagaug

SEQ ID NO: 1101434 - RNA, 19 nt, Homo sapiens
gaugaaagggaauguaaca

SEQ ID NO: 1101435 - RNA, 19 nt, Homo sapiens
gagcuggcaccucuugaaa

SEQ ID NO: 1101436 - RNA, 19 nt, Homo sapiens
ggccaaagaccuccacuuc

SEQ ID NO: 1101437 - RNA, 19 nt, Homo sapiens
caaccaaggucccauuucc

SEQ ID NO: 1101438 - RNA, 19 nt, Homo sapiens
agacagagugggaagcuuu

SEQ ID NO: 1101439 - RNA, 19 nt, Homo sapiens
cccaaacagucuuucuuga

SEQ ID NO: 1101440 - RNA, 19 nt, Homo sapiens
ggagcuggcaccucuugaa

SEQ ID NO: 1101441 - RNA, 19 nt, Homo sapiens
caaggaaucgagcuacuca

SEQ ID NO: 1101442 - RNA, 19 nt, Homo sapiens
gcucacccaggaacaagua

SEQ ID NO: 1101443 - RNA, 19 nt, Homo sapiens
caaagaccuccacuucgaa

SEQ ID NO: 1101444 - RNA, 19 nt, Homo sapiens
gggaaccagcuuucaguga

SEQ ID NO: 1101445 - RNA, 19 nt, Homo sapiens
aagggaauguaacaaaugu

SEQ ID NO: 1101446 - RNA, 19 nt, Homo sapiens
caccuucuccuaugacuga

SEQ ID NO: 1101447 - RNA, 19 nt, Homo sapiens
ggaacaaguaucugacagu

SEQ ID NO: 1101448 - RNA, 19 nt, Homo sapiens
gaagcucacccaggaacaa

SEQ ID NO: 1101449 - RNA, 19 nt, Homo sapiens
ccaucguuaucaucacuuu

SEQ ID NO: 1101450 - RNA, 19 nt, Homo sapiens
gaagagcucauggccaaag

SEQ ID NO: 1101451 - RNA, 19 nt, Homo sapiens
acuagaugaugucgaagaa

SEQ ID NO: 1101452 - RNA, 19 nt, Homo sapiens
cuuuggagcugacggauca

SEQ ID NO: 1101453 - RNA, 19 nt, Homo sapiens
ggaucaacaugacauucuc

SEQ ID NO: 1101454 - RNA, 19 nt, Homo sapiens
ccacuucgaaggcauguuc

SEQ ID NO: 1101455 - RNA, 19 nt, Homo sapiens
caaacaaagcuuucaagac

SEQ ID NO: 1101456 - RNA, 19 nt, Homo sapiens
acaaacaaagcuuucaaga

SEQ ID NO: 1101457 - RNA, 19 nt, Homo sapiens
ccugguacuuccucaaugu

SEQ ID NO: 1101458 - RNA, 19 nt, Homo sapiens
gugccaccuucuccuauga

SEQ ID NO: 1101459 - RNA, 19 nt, Homo sapiens
guagugccaccuucuccua

SEQ ID NO: 1101460 - RNA, 19 nt, Homo sapiens
ccuacuauguugacagaca

SEQ ID NO: 1101461 - RNA, 19 nt, Homo sapiens
gacagucaaguccuaauuc

SEQ ID NO: 1101462 - RNA, 19 nt, Homo sapiens
gcagggauuagcuguguca

SEQ ID NO: 1101463 - RNA, 19 nt, Homo sapiens
aaagggaauguaacaaaug

SEQ ID NO: 1101464 - RNA, 19 nt, Homo sapiens
gacugauccuacuauguug

SEQ ID NO: 1101465 - RNA, 19 nt, Homo sapiens
caacaacccagaggaugga

SEQ ID NO: 1101466 - RNA, 19 nt, Homo sapiens
agucaaguccuaauucgaa

SEQ ID NO: 1101467 - RNA, 19 nt, Homo sapiens
gaaugaugcaggagcagau

SEQ ID NO: 1101468 - RNA, 19 nt, Homo sapiens
gcagaguccucagggaaaa

SEQ ID NO: 1101469 - RNA, 19 nt, Homo sapiens
gagcuggcaggcaugcaaa

SEQ ID NO: 1101470 - RNA, 19 nt, Homo sapiens
gaggcgaagccgaagagaa

SEQ ID NO: 1101471 - RNA, 19 nt, Homo sapiens
gcagacacaaacaaagcuu

SEQ ID NO: 1101472 - RNA, 19 nt, Homo sapiens
gauaaugccgcugaccaau

SEQ ID NO: 1101473 - RNA, 19 nt, Homo sapiens
ucacaaccaaggucccauu

SEQ ID NO: 1101474 - RNA, 19 nt, Homo sapiens
gcauuuacucucugauucu

SEQ ID NO: 1101475 - RNA, 19 nt, Homo sapiens
caugacauucucaggcuuu

SEQ ID NO: 1101476 - RNA, 19 nt, Homo sapiens
gaucaacaugacauucuca

SEQ ID NO: 1101477 - RNA, 19 nt, Homo sapiens
ccuuguaacuuuguuugga

SEQ ID NO: 1101478 - RNA, 19 nt, Homo sapiens
gcccgcagacacaaacaaa

SEQ ID NO: 1101479 - RNA, 19 nt, Homo sapiens
cggagcauuuacucucuga

SEQ ID NO: 1101480 - RNA, 19 nt, Homo sapiens
guggauggaucaacaugac

SEQ ID NO: 1101481 - RNA, 19 nt, Homo sapiens
aaucgagcuacucacauua

SEQ ID NO: 1101482 - RNA, 19 nt, Homo sapiens
gagaagcucgcccauucca

SEQ ID NO: 1101483 - RNA, 19 nt, Homo sapiens
acacaaacaaagcuuucaa

SEQ ID NO: 1101484 - RNA, 19 nt, Homo sapiens
gaugcauccugggugaguu

SEQ ID NO: 1101485 - RNA, 19 nt, Homo sapiens
ggaaucgagcuacucacau

SEQ ID NO: 1101486 - RNA, 19 nt, Homo sapiens
gauggaucaacaugacauu

SEQ ID NO: 1101487 - RNA, 19 nt, Homo sapiens
uaugacugauccuacuaug

SEQ ID NO: 1101488 - RNA, 19 nt, Homo sapiens
ggcagggccagaacuguug

SEQ ID NO: 1101489 - RNA, 19 nt, Homo sapiens
gguccuacccaucguuauc

SEQ ID NO: 1101490 - RNA, 19 nt, Homo sapiens
caagaagcucacccaggaa

SEQ ID NO: 1101491 - RNA, 19 nt, Homo sapiens
ccaaacagucuuucuugac

SEQ ID NO: 1101492 - RNA, 19 nt, Homo sapiens
ugaguucugcauccuggua

SEQ ID NO: 1101493 - RNA, 19 nt, Homo sapiens
ucgagcuacucacauuaga

SEQ ID NO: 1101494 - RNA, 19 nt, Homo sapiens
aaggucccauuuccacuga

SEQ ID NO: 1101495 - RNA, 19 nt, Homo sapiens
gcaaggaaucgagcuacuc

SEQ ID NO: 1101496 - RNA, 19 nt, Homo sapiens
ggauggaucaacaugacau

SEQ ID NO: 1101497 - RNA, 19 nt, Homo sapiens
gguggauggaucaacauga

SEQ ID NO: 1101498 - RNA, 19 nt, Homo sapiens
gaaaggagcuuauaagaga

SEQ ID NO: 1101499 - RNA, 19 nt, Homo sapiens
gcacuaauauccagauuua

SEQ ID NO: 1101500 - RNA, 19 nt, Homo sapiens
gcacagcucuuacucauaa

SEQ ID NO: 1101501 - RNA, 19 nt, Homo sapiens
uaacugagcugguaaaugu

SEQ ID NO: 1101502 - RNA, 19 nt, Homo sapiens
gcacugaauugacagguua

SEQ ID NO: 1101503 - RNA, 19 nt, Homo sapiens
gacaaggacuuuagguuua

SEQ ID NO: 1101504 - RNA, 19 nt, Homo sapiens
gcacuaacaugcuuucuga

SEQ ID NO: 1101505 - RNA, 19 nt, Homo sapiens
gaaauuaccagguuaacua

SEQ ID NO: 1101506 - RNA, 19 nt, Homo sapiens
gaagaucgaugcuuuguca

SEQ ID NO: 1101507 - RNA, 19 nt, Homo sapiens
guuaugagcuguggaaaua

SEQ ID NO: 1101508 - RNA, 19 nt, Homo sapiens
gaaaguauccagaaagauu

SEQ ID NO: 1101509 - RNA, 19 nt, Homo sapiens
gaagcaaacucguccugua

SEQ ID NO: 1101510 - RNA, 19 nt, Homo sapiens
ggaaguauauccucauguu

SEQ ID NO: 1101511 - RNA, 19 nt, Homo sapiens
gaaggaccauuaugauauu

SEQ ID NO: 1101512 - RNA, 19 nt, Homo sapiens
caaaucagcugcauccuau

SEQ ID NO: 1101513 - RNA, 19 nt, Homo sapiens
gcagaaagauuccaucaag

SEQ ID NO: 1101514 - RNA, 19 nt, Homo sapiens
cuauuuaccuguaccauua

SEQ ID NO: 1101515 - RNA, 19 nt, Homo sapiens
caacuaagguaaaggcaaa

SEQ ID NO: 1101516 - RNA, 19 nt, Homo sapiens
guaaaggcauugacacuga

SEQ ID NO: 1101517 - RNA, 19 nt, Homo sapiens
gaaugaaauuaccagguua

SEQ ID NO: 1101518 - RNA, 19 nt, Homo sapiens
uaacaaugcuucagaguca

SEQ ID NO: 1101519 - RNA, 19 nt, Homo sapiens
gcaagcuggucauagaaua

SEQ ID NO: 1101520 - RNA, 19 nt, Homo sapiens
gaggacuucuuguuaauuu

SEQ ID NO: 1101521 - RNA, 19 nt, Homo sapiens
cuagaagccuuggauauua

SEQ ID NO: 1101522 - RNA, 19 nt, Homo sapiens
ugacggaacugcagaaaga

SEQ ID NO: 1101523 - RNA, 19 nt, Homo sapiens
gaaggaaccagaaauguug

SEQ ID NO: 1101524 - RNA, 19 nt, Homo sapiens
gaugagcucccaccucuua

SEQ ID NO: 1101525 - RNA, 19 nt, Homo sapiens
guacaaaguuggcuaugug

SEQ ID NO: 1101526 - RNA, 19 nt, Homo sapiens
caauguagaugaugaugaa

SEQ ID NO: 1101527 - RNA, 19 nt, Homo sapiens
gaaauguuguugcugaaug

SEQ ID NO: 1101528 - RNA, 19 nt, Homo sapiens
gugaauaccuugagaagau

SEQ ID NO: 1101529 - RNA, 19 nt, Homo sapiens
gacaugaguuggaaaguga

SEQ ID NO: 1101530 - RNA, 19 nt, Homo sapiens
guaagaagauguccuaagg

SEQ ID NO: 1101531 - RNA, 19 nt, Homo sapiens
cauaagacauggaaagaga

SEQ ID NO: 1101532 - RNA, 19 nt, Homo sapiens
gcccgaagcucagugguua

SEQ ID NO: 1101533 - RNA, 19 nt, Homo sapiens
agaaacaccuuuaacaaug

SEQ ID NO: 1101534 - RNA, 19 nt, Homo sapiens
gauaauuccuuugguggua

SEQ ID NO: 1101535 - RNA, 19 nt, Homo sapiens
cacauuaucuggagagaaa

SEQ ID NO: 1101536 - RNA, 19 nt, Homo sapiens
ucagagaguuuggcaauuu

SEQ ID NO: 1101537 - RNA, 19 nt, Homo sapiens
aaagauaaguggauccauu

SEQ ID NO: 1101538 - RNA, 19 nt, Homo sapiens
gagaaagaaaggagaauuu

SEQ ID NO: 1101539 - RNA, 19 nt, Homo sapiens
ugacuuaaguggacaguug

SEQ ID NO: 1101540 - RNA, 19 nt, Homo sapiens
gagaagaguccacugauga

SEQ ID NO: 1101541 - RNA, 19 nt, Homo sapiens
aaacaucugggccuuauua

SEQ ID NO: 1101542 - RNA, 19 nt, Homo sapiens
guauaucccuccucccuuu

SEQ ID NO: 1101543 - RNA, 19 nt, Homo sapiens
aaaucaagcucaucgaauu

SEQ ID NO: 1101544 - RNA, 19 nt, Homo sapiens
ggagaaacaccuuuaacaa

SEQ ID NO: 1101545 - RNA, 19 nt, Homo sapiens
gaagcuuucucaucuccua

SEQ ID NO: 1101546 - RNA, 19 nt, Homo sapiens
gaaguugggcaucauauug

SEQ ID NO: 1101547 - RNA, 19 nt, Homo sapiens
gaacuuauuggacuuguga

SEQ ID NO: 1101548 - RNA, 19 nt, Homo sapiens
guaauccucuguaaccauu

SEQ ID NO: 1101549 - RNA, 19 nt, Homo sapiens
uguuaaagcucuucacaaa

SEQ ID NO: 1101550 - RNA, 19 nt, Homo sapiens
ccucauguuucuaccauua

SEQ ID NO: 1101551 - RNA, 19 nt, Homo sapiens
ucaaaugucuugguccuuu

SEQ ID NO: 1101552 - RNA, 19 nt, Homo sapiens
acacauuccuguacuugua

SEQ ID NO: 1101553 - RNA, 19 nt, Homo sapiens
gagaaacaccuuuaacaau

SEQ ID NO: 1101554 - RNA, 19 nt, Homo sapiens
cgagacauuucaaguauug

SEQ ID NO: 1101555 - RNA, 19 nt, Homo sapiens
cuaacaugcuuucugauaa

SEQ ID NO: 1101556 - RNA, 19 nt, Homo sapiens
guagauacccucugcacua

SEQ ID NO: 1101557 - RNA, 19 nt, Homo sapiens
gaaagaauaccaaguagag

SEQ ID NO: 1101558 - RNA, 19 nt, Homo sapiens
caaaugucuugguccuuua

SEQ ID NO: 1101559 - RNA, 19 nt, Homo sapiens
ggaaggaaccagaaauguu

SEQ ID NO: 1101560 - RNA, 19 nt, Homo sapiens
ccagagagcuuugaaacug

SEQ ID NO: 1101561 - RNA, 19 nt, Homo sapiens
caauuuggguucugacuug

SEQ ID NO: 1101562 - RNA, 19 nt, Homo sapiens
uauuauggcugauauguug

SEQ ID NO: 1101563 - RNA, 19 nt, Homo sapiens
gaugauggucuggauauua

SEQ ID NO: 1101564 - RNA, 19 nt, Homo sapiens
cgacaaggacuuuagguuu

SEQ ID NO: 1101565 - RNA, 19 nt, Homo sapiens
gaaagugauaugcauguuu

SEQ ID NO: 1101566 - RNA, 19 nt, Homo sapiens
uuaaagcucuucacaaaca

SEQ ID NO: 1101567 - RNA, 19 nt, Homo sapiens
uaugagcuguggaaauaua

SEQ ID NO: 1101568 - RNA, 19 nt, Homo sapiens
gaacaacuucgagacauuu

SEQ ID NO: 1101569 - RNA, 19 nt, Homo sapiens
ucacagguuuguuagcuaa

SEQ ID NO: 1101570 - RNA, 19 nt, Homo sapiens
ggaaagagaagugucuaaa

SEQ ID NO: 1101571 - RNA, 19 nt, Homo sapiens
gaaagauuccaucaaguug

SEQ ID NO: 1101572 - RNA, 19 nt, Homo sapiens
ggacacuaguuagauguuu

SEQ ID NO: 1101573 - RNA, 19 nt, Homo sapiens
agaaugaaauuaccagguu

SEQ ID NO: 1101574 - RNA, 19 nt, Homo sapiens
gguucugacuugccuaaua

SEQ ID NO: 1101575 - RNA, 19 nt, Homo sapiens
gaacagcgccgucguuagg

SEQ ID NO: 1101576 - RNA, 19 nt, Homo sapiens
ugcaguaccuuauauugua

SEQ ID NO: 1101577 - RNA, 19 nt, Homo sapiens
ccacaucuuuacaaugaaa

SEQ ID NO: 1101578 - RNA, 19 nt, Homo sapiens
gguuacggcugugaaauuu

SEQ ID NO: 1101579 - RNA, 19 nt, Homo sapiens
gggcaaccuuccugaauau

SEQ ID NO: 1101580 - RNA, 19 nt, Homo sapiens
gucaagaacucaaggucua

SEQ ID NO: 1101581 - RNA, 19 nt, Homo sapiens
gcagggagaaacaccuuua

SEQ ID NO: 1101582 - RNA, 19 nt, Homo sapiens
gaccaugaauuucuuucuu

SEQ ID NO: 1101583 - RNA, 19 nt, Homo sapiens
caaguuggaugaugauagu

SEQ ID NO: 1101584 - RNA, 19 nt, Homo sapiens
caucugggccuuauuacua

SEQ ID NO: 1101585 - RNA, 19 nt, Homo sapiens
ggcccuaacucaacacauu

SEQ ID NO: 1101586 - RNA, 19 nt, Homo sapiens
gaccgucucuccugcacua

SEQ ID NO: 1101587 - RNA, 19 nt, Homo sapiens
ugaaaugcuuccagaauuc

SEQ ID NO: 1101588 - RNA, 19 nt, Homo sapiens
gaugaugaauuaagagagu

SEQ ID NO: 1101589 - RNA, 19 nt, Homo sapiens
gagcucauuucacacugua

SEQ ID NO: 1101590 - RNA, 19 nt, Homo sapiens
ccuaauacacuucagauuu

SEQ ID NO: 1101591 - RNA, 19 nt, Homo sapiens
cauguuaacugagcuggua

SEQ ID NO: 1101592 - RNA, 19 nt, Homo sapiens
uaaagagcgugaagagaau

SEQ ID NO: 1101593 - RNA, 19 nt, Homo sapiens
ugaugaagaugaagaugaa

SEQ ID NO: 1101594 - RNA, 19 nt, Homo sapiens
acaagaaccuacauacaau

SEQ ID NO: 1101595 - RNA, 19 nt, Homo sapiens
gcucuuggccaucugguua

SEQ ID NO: 1101596 - RNA, 19 nt, Homo sapiens
gcagagaagaguccacuga

SEQ ID NO: 1101597 - RNA, 19 nt, Homo sapiens
gcuagaagccuuggauauu

SEQ ID NO: 1101598 - RNA, 19 nt, Homo sapiens
guacagaacuccacauaua

SEQ ID NO: 1101599 - RNA, 19 nt, Homo sapiens
gaacugaacuggcaucaaa

SEQ ID NO: 1101600 - RNA, 19 nt, Homo sapiens
gcaaagcauugaucuggua

SEQ ID NO: 1101601 - RNA, 19 nt, Homo sapiens
caacacaucuccauucuag

SEQ ID NO: 1101602 - RNA, 19 nt, Homo sapiens
gaagccaacuccuuugaaa

SEQ ID NO: 1101603 - RNA, 19 nt, Homo sapiens
ggacaaaccuucagaucgu

SEQ ID NO: 1101604 - RNA, 19 nt, Homo sapiens
cgacuugucucacuccuuu

SEQ ID NO: 1101605 - RNA, 19 nt, Homo sapiens
caacauagcucaggaucug

SEQ ID NO: 1101606 - RNA, 19 nt, Homo sapiens
gaugggagccuagcuaaua

SEQ ID NO: 1101607 - RNA, 19 nt, Homo sapiens
gagacuggcugaccaugaa

SEQ ID NO: 1101608 - RNA, 19 nt, Homo sapiens
gaacuggcaucaaauacuc

SEQ ID NO: 1101609 - RNA, 19 nt, Homo sapiens
ggcaacagcugaacagaug

SEQ ID NO: 1101610 - RNA, 19 nt, Homo sapiens
acacuggucuucccuacua

SEQ ID NO: 1101611 - RNA, 19 nt, Homo sapiens
cagcagaugucacaggauu

SEQ ID NO: 1101612 - RNA, 19 nt, Homo sapiens
ggacugaagaucuuucuga

SEQ ID NO: 1101613 - RNA, 19 nt, Homo sapiens
ccagugcccuuuccuagaa

SEQ ID NO: 1101614 - RNA, 19 nt, Homo sapiens
gaauucugcuaguccagua

SEQ ID NO: 1101615 - RNA, 19 nt, Homo sapiens
ggaagggaauucagacaca

SEQ ID NO: 1101616 - RNA, 19 nt, Homo sapiens
uaagugagccuuugaauac

SEQ ID NO: 1101617 - RNA, 19 nt, Homo sapiens
ccacuggucuaccugauau

SEQ ID NO: 1101618 - RNA, 19 nt, Homo sapiens
gcacaaccaguaccucgua

SEQ ID NO: 1101619 - RNA, 19 nt, Homo sapiens
uaauggagaugugaacaaa

SEQ ID NO: 1101620 - RNA, 19 nt, Homo sapiens
ucaugucccuagagacuua

SEQ ID NO: 1101621 - RNA, 19 nt, Homo sapiens
gaucaucgcaggcaccaaa

SEQ ID NO: 1101622 - RNA, 19 nt, Homo sapiens
gaacacacgagcacguauu

SEQ ID NO: 1101623 - RNA, 19 nt, Homo sapiens
guugaaagcuccgaguuug

SEQ ID NO: 1101624 - RNA, 19 nt, Homo sapiens
gaagucagcagacacuaga

SEQ ID NO: 1101625 - RNA, 19 nt, Homo sapiens
gauuaaaugugcaguuugg

SEQ ID NO: 1101626 - RNA, 19 nt, Homo sapiens
ccaaguacacagcagaaua

SEQ ID NO: 1101627 - RNA, 19 nt, Homo sapiens
gaagaauucuguggaagag

SEQ ID NO: 1101628 - RNA, 19 nt, Homo sapiens
ggaagaauucuguggaaga

SEQ ID NO: 1101629 - RNA, 19 nt, Homo sapiens
gcagaugucacaggauuaa

SEQ ID NO: 1101630 - RNA, 19 nt, Homo sapiens
gcacgaccauugaaaauau

SEQ ID NO: 1101631 - RNA, 19 nt, Homo sapiens
gcuacuguauguaauguau

SEQ ID NO: 1101632 - RNA, 19 nt, Homo sapiens
acaauaagacacagacuuu

SEQ ID NO: 1101633 - RNA, 19 nt, Homo sapiens
cugacaagcucaucacuga

SEQ ID NO: 1101634 - RNA, 19 nt, Homo sapiens
gaauuuagaggugaagaaa

SEQ ID NO: 1101635 - RNA, 19 nt, Homo sapiens
gaagggaauucagacacaa

SEQ ID NO: 1101636 - RNA, 19 nt, Homo sapiens
aaacaagucugcagguucu

SEQ ID NO: 1101637 - RNA, 19 nt, Homo sapiens
cagcagagccaaucacaga

SEQ ID NO: 1101638 - RNA, 19 nt, Homo sapiens
gagccuagcuaauaaucca

SEQ ID NO: 1101639 - RNA, 19 nt, Homo sapiens
gcaaugucuuccucuuaug

SEQ ID NO: 1101640 - RNA, 19 nt, Homo sapiens
gaauuugggucagaaccuu

SEQ ID NO: 1101641 - RNA, 19 nt, Homo sapiens
caaauucgcaacacaacaa

SEQ ID NO: 1101642 - RNA, 19 nt, Homo sapiens
gacugaagaucuuucugaa

SEQ ID NO: 1101643 - RNA, 19 nt, Homo sapiens
aaaucaggaugaaugcaua

SEQ ID NO: 1101644 - RNA, 19 nt, Homo sapiens
ccaaacaagucugcagguu

SEQ ID NO: 1101645 - RNA, 19 nt, Homo sapiens
ccaguggacuacuauggaa

SEQ ID NO: 1101646 - RNA, 19 nt, Homo sapiens
ccaaagcccugugaguuca

SEQ ID NO: 1101647 - RNA, 19 nt, Homo sapiens
caaagagaauagagagaag

SEQ ID NO: 1101648 - RNA, 19 nt, Homo sapiens
cagacuggcuacuguaugu

SEQ ID NO: 1101649 - RNA, 19 nt, Homo sapiens
uauacaacuuccgucauua

SEQ ID NO: 1101650 - RNA, 19 nt, Homo sapiens
ggucuucacugccucaucu

SEQ ID NO: 1101651 - RNA, 19 nt, Homo sapiens
agacuggacugaagaucuu

SEQ ID NO: 1101652 - RNA, 19 nt, Homo sapiens
gugaacaaagcuaucaaua

SEQ ID NO: 1101653 - RNA, 19 nt, Homo sapiens
ccagucagcuccccuuuaa

SEQ ID NO: 1101654 - RNA, 19 nt, Homo sapiens
ucaaggcuguuuggguaua

SEQ ID NO: 1101655 - RNA, 19 nt, Homo sapiens
gagaugggagccuagcuaa

SEQ ID NO: 1101656 - RNA, 19 nt, Homo sapiens
auauacaacuuccgucauu

SEQ ID NO: 1101657 - RNA, 19 nt, Homo sapiens
acaagucacccuacaacua

SEQ ID NO: 1101658 - RNA, 19 nt, Homo sapiens
caacagaagacuggacuga

SEQ ID NO: 1101659 - RNA, 19 nt, Homo sapiens
gaaaggaagaggcggcaau

SEQ ID NO: 1101660 - RNA, 19 nt, Homo sapiens
caaguauggccaccuguuu

SEQ ID NO: 1101661 - RNA, 19 nt, Homo sapiens
gaggcacauuggcagauuu

SEQ ID NO: 1101662 - RNA, 19 nt, Homo sapiens
cuacaacuacuacuucuug

SEQ ID NO: 1101663 - RNA, 19 nt, Homo sapiens
aaugaagaaucacgacuug

SEQ ID NO: 1101664 - RNA, 19 nt, Homo sapiens
aaacuaaacccagaagaga

SEQ ID NO: 1101665 - RNA, 19 nt, Homo sapiens
ggacaaacuaaacccagaa

SEQ ID NO: 1101666 - RNA, 19 nt, Homo sapiens
uagcaaugucuuccucuua

SEQ ID NO: 1101667 - RNA, 19 nt, Homo sapiens
aaccuucucucucugaauu

SEQ ID NO: 1101668 - RNA, 19 nt, Homo sapiens
ggaauucagacacaacuuc

SEQ ID NO: 1101669 - RNA, 19 nt, Homo sapiens
acacaucuccauucuaguu

SEQ ID NO: 1101670 - RNA, 19 nt, Homo sapiens
cugguucugucuacaauaa

SEQ ID NO: 1101671 - RNA, 19 nt, Homo sapiens
uuaagugagccuuugaaua

SEQ ID NO: 1101672 - RNA, 19 nt, Homo sapiens
aaacacaucaaacuugcua

SEQ ID NO: 1101673 - RNA, 19 nt, Homo sapiens
caaguacacagcagaauag

SEQ ID NO: 1101674 - RNA, 19 nt, Homo sapiens
agcagagaaucacaucuua

SEQ ID NO: 1101675 - RNA, 19 nt, Homo sapiens
gcaaucaaguggacaaacc

SEQ ID NO: 1101676 - RNA, 19 nt, Homo sapiens
ccuguguaauuacuucaua

SEQ ID NO: 1101677 - RNA, 19 nt, Homo sapiens
gagaacacacgagcacgua

SEQ ID NO: 1101678 - RNA, 19 nt, Homo sapiens
gaguaucagugucuucaag

SEQ ID NO: 1101679 - RNA, 19 nt, Homo sapiens
caacgcaaccacagaaaca

SEQ ID NO: 1101680 - RNA, 19 nt, Homo sapiens
acagaagacuggacugaag

SEQ ID NO: 1101681 - RNA, 19 nt, Homo sapiens
gcauaguggcccuacauga

SEQ ID NO: 1101682 - RNA, 19 nt, Homo sapiens
ggucagguaccaaugaaga

SEQ ID NO: 1101683 - RNA, 19 nt, Homo sapiens
ugacuucagugagcaguga

SEQ ID NO: 1101684 - RNA, 19 nt, Homo sapiens
aggauuaaaugugcaguuu

SEQ ID NO: 1101685 - RNA, 19 nt, Homo sapiens
caucaaauacucacaacau

SEQ ID NO: 1101686 - RNA, 19 nt, Homo sapiens
gaucagcuccaagcaguga

SEQ ID NO: 1101687 - RNA, 19 nt, Homo sapiens
caacaucccaguccucagu

SEQ ID NO: 1101688 - RNA, 19 nt, Homo sapiens
ggaaacaacaaccggaaag

SEQ ID NO: 1101689 - RNA, 19 nt, Homo sapiens
ccaggaaccaucaugaaug

SEQ ID NO: 1101690 - RNA, 19 nt, Homo sapiens
guagcaaugucuuccucuu

SEQ ID NO: 1101691 - RNA, 19 nt, Homo sapiens
gacaagcucaucacugaau

SEQ ID NO: 1101692 - RNA, 19 nt, Homo sapiens
gccuuugaauacaucuuua

SEQ ID NO: 1101693 - RNA, 19 nt, Homo sapiens
cucaggaucugucaaacaa

SEQ ID NO: 1101694 - RNA, 19 nt, Homo sapiens
cgaccuccgucucaaguuc

SEQ ID NO: 1101695 - RNA, 19 nt, Homo sapiens
ccaacuccuuugaaacuuc

SEQ ID NO: 1101696 - RNA, 19 nt, Homo sapiens
cagcagagaaucacaucuu

SEQ ID NO: 1101697 - RNA, 19 nt, Homo sapiens
ggagaugugaacaaagcua

SEQ ID NO: 1101698 - RNA, 19 nt, Homo sapiens
guacagaacuccacauaua

SEQ ID NO: 1101699 - RNA, 19 nt, Homo sapiens
guagagaacuggcaucaaa

SEQ ID NO: 1101700 - RNA, 19 nt, Homo sapiens
gcaaagcauugaucuggua

SEQ ID NO: 1101701 - RNA, 19 nt, Homo sapiens
caacacaucuccauucuag

SEQ ID NO: 1101702 - RNA, 19 nt, Homo sapiens
gaagccaacuccuuugaaa

SEQ ID NO: 1101703 - RNA, 19 nt, Homo sapiens
ggacaaaccuucagaucgu

SEQ ID NO: 1101704 - RNA, 19 nt, Homo sapiens
cgacuugucucacuccuuu

SEQ ID NO: 1101705 - RNA, 19 nt, Homo sapiens
caacauagcucaggaucug

SEQ ID NO: 1101706 - RNA, 19 nt, Homo sapiens
gaugggagccuagcuaaua

SEQ ID NO: 1101707 - RNA, 19 nt, Homo sapiens
gagacuggcugaccaugaa

SEQ ID NO: 1101708 - RNA, 19 nt, Homo sapiens
gaacuggcaucaaauacuc

SEQ ID NO: 1101709 - RNA, 19 nt, Homo sapiens
ggcaacagcugaacagaug

SEQ ID NO: 1101710 - RNA, 19 nt, Homo sapiens
acacuggucuucccuacua

SEQ ID NO: 1101711 - RNA, 19 nt, Homo sapiens
cagcagaugucacaggauu

SEQ ID NO: 1101712 - RNA, 19 nt, Homo sapiens
ggacugaagaucuuucuga

SEQ ID NO: 1101713 - RNA, 19 nt, Homo sapiens
ccagugcccuuuccuagaa

SEQ ID NO: 1101714 - RNA, 19 nt, Homo sapiens
gaauucugcuaguccagua

SEQ ID NO: 1101715 - RNA, 19 nt, Homo sapiens
ggaagggaauucagacaca

SEQ ID NO: 1101716 - RNA, 19 nt, Homo sapiens
uaagugagccuuugaauac

SEQ ID NO: 1101717 - RNA, 19 nt, Homo sapiens
ccacuggucuaccugauau

SEQ ID NO: 1101718 - RNA, 19 nt, Homo sapiens
gcacaaccaguaccucgua

SEQ ID NO: 1101719 - RNA, 19 nt, Homo sapiens
uaauggagaugugaacaaa

SEQ ID NO: 1101720 - RNA, 19 nt, Homo sapiens
ucaugucccuagagacuua

SEQ ID NO: 1101721 - RNA, 19 nt, Homo sapiens
gaucaucgcaggcaccaaa

SEQ ID NO: 1101722 - RNA, 19 nt, Homo sapiens
gaacacacgagcacguauu

SEQ ID NO: 1101723 - RNA, 19 nt, Homo sapiens
guugaaagcuccgaguuug

SEQ ID NO: 1101724 - RNA, 19 nt, Homo sapiens
gaagucagcagacacuaga

SEQ ID NO: 1101725 - RNA, 19 nt, Homo sapiens
gauuaaaugugcaguuugg

SEQ ID NO: 1101726 - RNA, 19 nt, Homo sapiens
ccaaguacacagcagaaua

SEQ ID NO: 1101727 - RNA, 19 nt, Homo sapiens
gaagaauucuguggaagag

SEQ ID NO: 1101728 - RNA, 19 nt, Homo sapiens
ggaagaauucuguggaaga

SEQ ID NO: 1101729 - RNA, 19 nt, Homo sapiens
gcagaugucacaggauuaa

SEQ ID NO: 1101730 - RNA, 19 nt, Homo sapiens
gcacgaccauugaaaauau

SEQ ID NO: 1101731 - RNA, 19 nt, Homo sapiens
gcuacuguauguaauguau

SEQ ID NO: 1101732 - RNA, 19 nt, Homo sapiens
acaauaagacacagacuuu

SEQ ID NO: 1101733 - RNA, 19 nt, Homo sapiens
cugacaagcucaucacuga

SEQ ID NO: 1101734 - RNA, 19 nt, Homo sapiens
gaauuuagaggugaagaaa

SEQ ID NO: 1101735 - RNA, 19 nt, Homo sapiens
gaagggaauucagacacaa

SEQ ID NO: 1101736 - RNA, 19 nt, Homo sapiens
aaacaagucugcagguucu

SEQ ID NO: 1101737 - RNA, 19 nt, Homo sapiens
cagcagagccaaucacaga

SEQ ID NO: 1101738 - RNA, 19 nt, Homo sapiens
gagccuagcuaauaaucca

SEQ ID NO: 1101739 - RNA, 19 nt, Homo sapiens
gcaaugucuuccucuuaug

SEQ ID NO: 1101740 - RNA, 19 nt, Homo sapiens
gaauuugggucagaaccuu

SEQ ID NO: 1101741 - RNA, 19 nt, Homo sapiens
caaauucgcaacacaacaa

SEQ ID NO: 1101742 - RNA, 19 nt, Homo sapiens
gacugaagaucuuucugaa

SEQ ID NO: 1101743 - RNA, 19 nt, Homo sapiens
aaaucaggaugaaugcaua

SEQ ID NO: 1101744 - RNA, 19 nt, Homo sapiens
ccaaacaagucugcagguu

SEQ ID NO: 1101745 - RNA, 19 nt, Homo sapiens
ccaguggacuacuauggaa

SEQ ID NO: 1101746 - RNA, 19 nt, Homo sapiens
ccaaagcccugugaguuca

SEQ ID NO: 1101747 - RNA, 19 nt, Homo sapiens
caaagagaauagagagaag

SEQ ID NO: 1101748 - RNA, 19 nt, Homo sapiens
cagacuggcuacuguaugu

SEQ ID NO: 1101749 - RNA, 19 nt, Homo sapiens
uauacaacuuccgucauua

SEQ ID NO: 1101750 - RNA, 19 nt, Homo sapiens
ggucuucacugccucaucu

SEQ ID NO: 1101751 - RNA, 19 nt, Homo sapiens
agacuggacugaagaucuu

SEQ ID NO: 1101752 - RNA, 19 nt, Homo sapiens
gugaacaaagcuaucaaua

SEQ ID NO: 1101753 - RNA, 19 nt, Homo sapiens
ccagucagcuccccuuuaa

SEQ ID NO: 1101754 - RNA, 19 nt, Homo sapiens
ucaaggcuguuuggguaua

SEQ ID NO: 1101755 - RNA, 19 nt, Homo sapiens
gagaugggagccuagcuaa

SEQ ID NO: 1101756 - RNA, 19 nt, Homo sapiens
auauacaacuuccgucauu

SEQ ID NO: 1101757 - RNA, 19 nt, Homo sapiens
acaagucacccuacaacua

SEQ ID NO: 1101758 - RNA, 19 nt, Homo sapiens
caacagaagacuggacuga

SEQ ID NO: 1101759 - RNA, 19 nt, Homo sapiens
gaaaggaagaggcggcaau

SEQ ID NO: 1101760 - RNA, 19 nt, Homo sapiens
caaguauggccaccuguuu

SEQ ID NO: 1101761 - RNA, 19 nt, Homo sapiens
gaggcacauuggcagauuu

SEQ ID NO: 1101762 - RNA, 19 nt, Homo sapiens
cuacaacuacuacuucuug

SEQ ID NO: 1101763 - RNA, 19 nt, Homo sapiens
aaugaagaaucacgacuug

SEQ ID NO: 1101764 - RNA, 19 nt, Homo sapiens
aaacuaaacccagaagaga

SEQ ID NO: 1101765 - RNA, 19 nt, Homo sapiens
ggacaaacuaaacccagaa

SEQ ID NO: 1101766 - RNA, 19 nt, Homo sapiens
uagcaaugucuuccucuua

SEQ ID NO: 1101767 - RNA, 19 nt, Homo sapiens
aaccuucucucucugaauu

SEQ ID NO: 1101768 - RNA, 19 nt, Homo sapiens
ggaauucagacacaacuuc

SEQ ID NO: 1101769 - RNA, 19 nt, Homo sapiens
acacaucuccauucuaguu

SEQ ID NO: 1101770 - RNA, 19 nt, Homo sapiens
cugguucugucuacaauaa

SEQ ID NO: 1101771 - RNA, 19 nt, Homo sapiens
uuaagugagccuuugaaua

SEQ ID NO: 1101772 - RNA, 19 nt, Homo sapiens
aaacacaucaaacuugcua

SEQ ID NO: 1101773 - RNA, 19 nt, Homo sapiens
caaguacacagcagaauag

SEQ ID NO: 1101774 - RNA, 19 nt, Homo sapiens
agcagagaaucacaucuua

SEQ ID NO: 1101775 - RNA, 19 nt, Homo sapiens
agagaacuggcaucaaaua

SEQ ID NO: 1101776 - RNA, 19 nt, Homo sapiens
gcaaucaaguggacaaacc

SEQ ID NO: 1101777 - RNA, 19 nt, Homo sapiens
ccuguguaauuacuucaua

SEQ ID NO: 1101778 - RNA, 19 nt, Homo sapiens
gagaacacacgagcacgua

SEQ ID NO: 1101779 - RNA, 19 nt, Homo sapiens
gaguaucagugucuucaag

SEQ ID NO: 1101780 - RNA, 19 nt, Homo sapiens
caacgcaaccacagaaaca

SEQ ID NO: 1101781 - RNA, 19 nt, Homo sapiens
acagaagacuggacugaag

SEQ ID NO: 1101782 - RNA, 19 nt, Homo sapiens
gcauaguggcccuacauga

SEQ ID NO: 1101783 - RNA, 19 nt, Homo sapiens
ggucagguaccaaugaaga

SEQ ID NO: 1101784 - RNA, 19 nt, Homo sapiens
ugacuucagugagcaguga

SEQ ID NO: 1101785 - RNA, 19 nt, Homo sapiens
aggauuaaaugugcaguuu

SEQ ID NO: 1101786 - RNA, 19 nt, Homo sapiens
caucaaauacucacaacau

SEQ ID NO: 1101787 - RNA, 19 nt, Homo sapiens
gaucagcuccaagcaguga

SEQ ID NO: 1101788 - RNA, 19 nt, Homo sapiens
caacaucccaguccucagu

SEQ ID NO: 1101789 - RNA, 19 nt, Homo sapiens
ggaaacaacaaccggaaag

SEQ ID NO: 1101790 - RNA, 19 nt, Homo sapiens
ccaggaaccaucaugaaug

SEQ ID NO: 1101791 - RNA, 19 nt, Homo sapiens
guagcaaugucuuccucuu

SEQ ID NO: 1101792 - RNA, 19 nt, Homo sapiens
gacaagcucaucacugaau

SEQ ID NO: 1101793 - RNA, 19 nt, Homo sapiens
gccuuugaauacaucuuua

SEQ ID NO: 1101794 - RNA, 19 nt, Homo sapiens
cucaggaucugucaaacaa

SEQ ID NO: 1101795 - RNA, 19 nt, Homo sapiens
cgaccuccgucucaaguuc

SEQ ID NO: 1101796 - RNA, 19 nt, Homo sapiens
ggagaugugaacaaagcua

SEQ ID NO: 1101797 - RNA, 19 nt, Homo sapiens
ccaacuccuuugaaacuuc

SEQ ID NO: 1101798 - RNA, 19 nt, Homo sapiens
guacagaacuccacauaua

SEQ ID NO: 1101799 - RNA, 19 nt, Homo sapiens
gaacugaacuggcaucaaa

SEQ ID NO: 1101800 - RNA, 19 nt, Homo sapiens
caacacaucuccauucuag

SEQ ID NO: 1101801 - RNA, 19 nt, Homo sapiens
gaagccaacuccuuugaaa

SEQ ID NO: 1101802 - RNA, 19 nt, Homo sapiens
ggacaaaccuucagaucgu

SEQ ID NO: 1101803 - RNA, 19 nt, Homo sapiens
cgacuugucucacuccuuu

SEQ ID NO: 1101804 - RNA, 19 nt, Homo sapiens
caacauagcucaggaucug

SEQ ID NO: 1101805 - RNA, 19 nt, Homo sapiens
gaugggagccuagcuaaua

SEQ ID NO: 1101806 - RNA, 19 nt, Homo sapiens
gagacuggcugaccaugaa

SEQ ID NO: 1101807 - RNA, 19 nt, Homo sapiens
gaacuggcaucaaauacuc

SEQ ID NO: 1101808 - RNA, 19 nt, Homo sapiens
ggcaacagcugaacagaug

SEQ ID NO: 1101809 - RNA, 19 nt, Homo sapiens
acacuggucuucccuacua

SEQ ID NO: 1101810 - RNA, 19 nt, Homo sapiens
cagcagaugucacaggauu

SEQ ID NO: 1101811 - RNA, 19 nt, Homo sapiens
ccagugcccuuuccuagaa

SEQ ID NO: 1101812 - RNA, 19 nt, Homo sapiens
gaauucugcuaguccagua

SEQ ID NO: 1101813 - RNA, 19 nt, Homo sapiens
ggaagggaauucagacaca

SEQ ID NO: 1101814 - RNA, 19 nt, Homo sapiens
uaagugagccuuugaauac

SEQ ID NO: 1101815 - RNA, 19 nt, Homo sapiens
ccacuggucuaccugauau

SEQ ID NO: 1101816 - RNA, 19 nt, Homo sapiens
gcacaaccaguaccucgua

SEQ ID NO: 1101817 - RNA, 19 nt, Homo sapiens
uaauggagaugugaacaaa

SEQ ID NO: 1101818 - RNA, 19 nt, Homo sapiens
ucaugucccuagagacuua

SEQ ID NO: 1101819 - RNA, 19 nt, Homo sapiens
gaucaucgcaggcaccaaa

SEQ ID NO: 1101820 - RNA, 19 nt, Homo sapiens
gaacacacgagcacguauu

SEQ ID NO: 1101821 - RNA, 19 nt, Homo sapiens
guugaaagcuccgaguuug

SEQ ID NO: 1101822 - RNA, 19 nt, Homo sapiens
gaagucagcagacacuaga

SEQ ID NO: 1101823 - RNA, 19 nt, Homo sapiens
gauuaaaugugcaguuugg

SEQ ID NO: 1101824 - RNA, 19 nt, Homo sapiens
ccaaguacacagcagaaua

SEQ ID NO: 1101825 - RNA, 19 nt, Homo sapiens
gaagaauucuguggaagag

SEQ ID NO: 1101826 - RNA, 19 nt, Homo sapiens
ggaagaauucuguggaaga

SEQ ID NO: 1101827 - RNA, 19 nt, Homo sapiens
gcagaugucacaggauuaa

SEQ ID NO: 1101828 - RNA, 19 nt, Homo sapiens
gcacgaccauugaaaauau

SEQ ID NO: 1101829 - RNA, 19 nt, Homo sapiens
gcuacuguauguaauguau

SEQ ID NO: 1101830 - RNA, 19 nt, Homo sapiens
acaauaagacacagacuuu

SEQ ID NO: 1101831 - RNA, 19 nt, Homo sapiens
cugacaagcucaucacuga

SEQ ID NO: 1101832 - RNA, 19 nt, Homo sapiens
gaauuuagaggugaagaaa

SEQ ID NO: 1101833 - RNA, 19 nt, Homo sapiens
gaagggaauucagacacaa

SEQ ID NO: 1101834 - RNA, 19 nt, Homo sapiens
aaacaagucugcagguucu

SEQ ID NO: 1101835 - RNA, 19 nt, Homo sapiens
cagcagagccaaucacaga

SEQ ID NO: 1101836 - RNA, 19 nt, Homo sapiens
gagccuagcuaauaaucca

SEQ ID NO: 1101837 - RNA, 19 nt, Homo sapiens
gcaaugucuuccucuuaug

SEQ ID NO: 1101838 - RNA, 19 nt, Homo sapiens
gaauuugggucagaaccuu

SEQ ID NO: 1101839 - RNA, 19 nt, Homo sapiens
caaauucgcaacacaacaa

SEQ ID NO: 1101840 - RNA, 19 nt, Homo sapiens
aaaucaggaugaaugcaua

SEQ ID NO: 1101841 - RNA, 19 nt, Homo sapiens
ccaaacaagucugcagguu

SEQ ID NO: 1101842 - RNA, 19 nt, Homo sapiens
ccaguggacuacuauggaa

SEQ ID NO: 1101843 - RNA, 19 nt, Homo sapiens
ccaaagcccugugaguuca

SEQ ID NO: 1101844 - RNA, 19 nt, Homo sapiens
caaagagaauagagagaag

SEQ ID NO: 1101845 - RNA, 19 nt, Homo sapiens
cagacuggcuacuguaugu

SEQ ID NO: 1101846 - RNA, 19 nt, Homo sapiens
uauacaacuuccgucauua

SEQ ID NO: 1101847 - RNA, 19 nt, Homo sapiens
gugaacaaagcuaucaaua

SEQ ID NO: 1101848 - RNA, 19 nt, Homo sapiens
ccagucagcuccccuuuaa

SEQ ID NO: 1101849 - RNA, 19 nt, Homo sapiens
ucaaggcuguuuggguaua

SEQ ID NO: 1101850 - RNA, 19 nt, Homo sapiens
gagaugggagccuagcuaa

SEQ ID NO: 1101851 - RNA, 19 nt, Homo sapiens
auauacaacuuccgucauu

SEQ ID NO: 1101852 - RNA, 19 nt, Homo sapiens
acaagucacccuacaacua

SEQ ID NO: 1101853 - RNA, 19 nt, Homo sapiens
caacagaagacuggacuga

SEQ ID NO: 1101854 - RNA, 19 nt, Homo sapiens
gaaaggaagaggcggcaau

SEQ ID NO: 1101855 - RNA, 19 nt, Homo sapiens
caaguauggccaccuguuu

SEQ ID NO: 1101856 - RNA, 19 nt, Homo sapiens
cuacaacuacuacuucuug

SEQ ID NO: 1101857 - RNA, 19 nt, Homo sapiens
gaggcacauuggcagauuu

SEQ ID NO: 1101858 - RNA, 19 nt, Homo sapiens
aaugaagaaucacgacuug

SEQ ID NO: 1101859 - RNA, 19 nt, Homo sapiens
aaacuaaacccagaagaga

SEQ ID NO: 1101860 - RNA, 19 nt, Homo sapiens
ggacaaacuaaacccagaa

SEQ ID NO: 1101861 - RNA, 19 nt, Homo sapiens
uagcaaugucuuccucuua

SEQ ID NO: 1101862 - RNA, 19 nt, Homo sapiens
aaccuucucucucugaauu

SEQ ID NO: 1101863 - RNA, 19 nt, Homo sapiens
ggaauucagacacaacuuc

SEQ ID NO: 1101864 - RNA, 19 nt, Homo sapiens
acacaucuccauucuaguu

SEQ ID NO: 1101865 - RNA, 19 nt, Homo sapiens
cugguucugucuacaauaa

SEQ ID NO: 1101866 - RNA, 19 nt, Homo sapiens
uuaagugagccuuugaaua

SEQ ID NO: 1101867 - RNA, 19 nt, Homo sapiens
aaacacaucaaacuugcua

SEQ ID NO: 1101868 - RNA, 19 nt, Homo sapiens
caaguacacagcagaauag

SEQ ID NO: 1101869 - RNA, 19 nt, Homo sapiens
gcaaucaaguggacaaacc

SEQ ID NO: 1101870 - RNA, 19 nt, Homo sapiens
ccuguguaauuacuucaua

SEQ ID NO: 1101871 - RNA, 19 nt, Homo sapiens
gagaacacacgagcacgua

SEQ ID NO: 1101872 - RNA, 19 nt, Homo sapiens
gaguaucagugucuucaag

SEQ ID NO: 1101873 - RNA, 19 nt, Homo sapiens
acagaagacuggacugaag

SEQ ID NO: 1101874 - RNA, 19 nt, Homo sapiens
caacgcaaccacagaaaca

SEQ ID NO: 1101875 - RNA, 19 nt, Homo sapiens
gcauaguggcccuacauga

SEQ ID NO: 1101876 - RNA, 19 nt, Homo sapiens
ugacuucagugagcaguga

SEQ ID NO: 1101877 - RNA, 19 nt, Homo sapiens
ggucagguaccaaugaaga

SEQ ID NO: 1101878 - RNA, 19 nt, Homo sapiens
aggauuaaaugugcaguuu

SEQ ID NO: 1101879 - RNA, 19 nt, Homo sapiens
caucaaauacucacaacau

SEQ ID NO: 1101880 - RNA, 19 nt, Homo sapiens
gaucagcuccaagcaguga

SEQ ID NO: 1101881 - RNA, 19 nt, Homo sapiens
caacaucccaguccucagu

SEQ ID NO: 1101882 - RNA, 19 nt, Homo sapiens
ggaaacaacaaccggaaag

SEQ ID NO: 1101883 - RNA, 19 nt, Homo sapiens
ccaggaaccaucaugaaug

SEQ ID NO: 1101884 - RNA, 19 nt, Homo sapiens
guagcaaugucuuccucuu

SEQ ID NO: 1101885 - RNA, 19 nt, Homo sapiens
gacaagcucaucacugaau

SEQ ID NO: 1101886 - RNA, 19 nt, Homo sapiens
gccuuugaauacaucuuua

SEQ ID NO: 1101887 - RNA, 19 nt, Homo sapiens
cucaggaucugucaaacaa

SEQ ID NO: 1101888 - RNA, 19 nt, Homo sapiens
cgaccuccgucucaaguuc

SEQ ID NO: 1101889 - RNA, 19 nt, Homo sapiens
ccaacuccuuugaaacuuc

SEQ ID NO: 1101890 - RNA, 19 nt, Homo sapiens
cauuuaauccugcagacua

SEQ ID NO: 1101891 - RNA, 19 nt, Homo sapiens
aaucguggcagagaauuua

SEQ ID NO: 1101892 - RNA, 19 nt, Homo sapiens
gggagacuguaggguguaa

SEQ ID NO: 1101893 - RNA, 19 nt, Homo sapiens
ggagaugugaacaaagcua

SEQ ID NO: 1101894 - RNA, 19 nt, Homo sapiens
gcaacacaucuccauucua

SEQ ID NO: 1101895 - RNA, 19 nt, Homo sapiens
gaagaaucacgacuugucu

SEQ ID NO: 1101896 - RNA, 19 nt, Homo sapiens
gguucugucuacaauaaga

SEQ ID NO: 1101897 - RNA, 19 nt, Homo sapiens
gaacuccacauauacaacu

SEQ ID NO: 1101898 - RNA, 19 nt, Homo sapiens
ggacugaccuugaagagaa

SEQ ID NO: 1101899 - RNA, 19 nt, Homo sapiens
gaagagagcagaagccaua

SEQ ID NO: 1101900 - RNA, 19 nt, Homo sapiens
ccaaacaacuucauucauu

SEQ ID NO: 1101901 - RNA, 19 nt, Homo sapiens
agaauuagcucgaauagaa

SEQ ID NO: 1101902 - RNA, 19 nt, Homo sapiens
ggaaagaaauugcagacuu

SEQ ID NO: 1101903 - RNA, 19 nt, Homo sapiens
gaaagaaauugcagacuuc

SEQ ID NO: 1101904 - RNA, 19 nt, Homo sapiens
aaaggaacgugaagaaaua

SEQ ID NO: 1101905 - RNA, 19 nt, Homo sapiens
gagaaaguaucuuauguug

SEQ ID NO: 1101906 - RNA, 19 nt, Homo sapiens
gcacaggucuccaggaaau

SEQ ID NO: 1101907 - RNA, 19 nt, Homo sapiens
gcagacaacccuauccuua

SEQ ID NO: 1101908 - RNA, 19 nt, Homo sapiens
aaacagaccuuugaagauu

SEQ ID NO: 1101909 - RNA, 19 nt, Homo sapiens
ggaggaagaccaagacaua

SEQ ID NO: 1101910 - RNA, 19 nt, Homo sapiens
gaaaugugaugggcaguuu

SEQ ID NO: 1101911 - RNA, 19 nt, Homo sapiens
gaagaaaggcccauuaaag

SEQ ID NO: 1101912 - RNA, 19 nt, Homo sapiens
ggacauuucuaccagcuuu

SEQ ID NO: 1101913 - RNA, 19 nt, Homo sapiens
ucuaccagcuuuccuauua

SEQ ID NO: 1101914 - RNA, 19 nt, Homo sapiens
ggacuaagauguuccugau

SEQ ID NO: 1101915 - RNA, 19 nt, Homo sapiens
gaucuggauuugucugaua

SEQ ID NO: 1101916 - RNA, 19 nt, Homo sapiens
ggaauaagacacaagguaa

SEQ ID NO: 1101917 - RNA, 19 nt, Homo sapiens
aagaaugggugccguguua

SEQ ID NO: 1101918 - RNA, 19 nt, Homo sapiens
gaaagugacagaacagauu

SEQ ID NO: 1101919 - RNA, 19 nt, Homo sapiens
caaagaaaguaaacuagug

SEQ ID NO: 1101920 - RNA, 19 nt, Homo sapiens
ggaaacagaccuuugaaga

SEQ ID NO: 1101921 - RNA, 19 nt, Homo sapiens
gaacagaaguuggagucaa

SEQ ID NO: 1101922 - RNA, 19 nt, Homo sapiens
gugaagaaauacagacuuu

SEQ ID NO: 1101923 - RNA, 19 nt, Homo sapiens
aaacauaagucaagaccaa

SEQ ID NO: 1101924 - RNA, 19 nt, Homo sapiens
caauggaacucgaaaggaa

SEQ ID NO: 1101925 - RNA, 19 nt, Homo sapiens
caaacaacuucauucauug

SEQ ID NO: 1101926 - RNA, 19 nt, Homo sapiens
gaacuuggacugaccuuga

SEQ ID NO: 1101927 - RNA, 19 nt, Homo sapiens
acaagcugcugaugaaaua

SEQ ID NO: 1101928 - RNA, 19 nt, Homo sapiens
ggauuugucugauaaagau

SEQ ID NO: 1101929 - RNA, 19 nt, Homo sapiens
ccucagaaguggcuaauau

SEQ ID NO: 1101930 - RNA, 19 nt, Homo sapiens
gagcaaagcaacuucugua

SEQ ID NO: 1101931 - RNA, 19 nt, Homo sapiens
gaagaagcaggaacaauug

SEQ ID NO: 1101932 - RNA, 19 nt, Homo sapiens
ccacugaacuucccagauc

SEQ ID NO: 1101933 - RNA, 19 nt, Homo sapiens
ugaaagaaguacaacagaa

SEQ ID NO: 1101934 - RNA, 19 nt, Homo sapiens
gagaacgcaucuuuagcua

SEQ ID NO: 1101935 - RNA, 19 nt, Homo sapiens
agaacaagcugcugaugaa

SEQ ID NO: 1101936 - RNA, 19 nt, Homo sapiens
cauuaaagcugcuauugga

SEQ ID NO: 1101937 - RNA, 19 nt, Homo sapiens
aaacgugcgucuccuaauu

SEQ ID NO: 1101938 - RNA, 19 nt, Homo sapiens
gaucaugaaguaacaguaa

SEQ ID NO: 1101939 - RNA, 19 nt, Homo sapiens
gaagccagauacaaauguu

SEQ ID NO: 1101940 - RNA, 19 nt, Homo sapiens
gcaagaacuuuuccagaua

SEQ ID NO: 1101941 - RNA, 19 nt, Homo sapiens
guccucagcugaugaauug

SEQ ID NO: 1101942 - RNA, 19 nt, Homo sapiens
gagcagcuguggacauuuc

SEQ ID NO: 1101943 - RNA, 19 nt, Homo sapiens
agacaacccuauccuuaaa

SEQ ID NO: 1101944 - RNA, 19 nt, Homo sapiens
gaagguuuagcuagauuua

SEQ ID NO: 1101945 - RNA, 19 nt, Homo sapiens
gaacugcucauggagauuu

SEQ ID NO: 1101946 - RNA, 19 nt, Homo sapiens
gaccaucacugucacuuuc

SEQ ID NO: 1101947 - RNA, 19 nt, Homo sapiens
gggaaugaauccacuuaug

SEQ ID NO: 1101948 - RNA, 19 nt, Homo sapiens
gaugaagguguuccaaaua

SEQ ID NO: 1101949 - RNA, 19 nt, Homo sapiens
gcagaucccauuagucauu

SEQ ID NO: 1101950 - RNA, 19 nt, Homo sapiens
gaaacagaccuuugaagau

SEQ ID NO: 1101951 - RNA, 19 nt, Homo sapiens
gagaagguuuagcuagauu

SEQ ID NO: 1101952 - RNA, 19 nt, Homo sapiens
agaaguggcuaauauugaa

SEQ ID NO: 1101953 - RNA, 19 nt, Homo sapiens
ggauaagaguuaaggacaa

SEQ ID NO: 1101954 - RNA, 19 nt, Homo sapiens
ggacaagaagaaagcauuu

SEQ ID NO: 1101955 - RNA, 19 nt, Homo sapiens
gagcagaaguccuccuaca

SEQ ID NO: 1101956 - RNA, 19 nt, Homo sapiens
gaaugcacgugacgaugaa

SEQ ID NO: 1101957 - RNA, 19 nt, Homo sapiens
gaauaagacacaagguaaa

SEQ ID NO: 1101958 - RNA, 19 nt, Homo sapiens
ggagaaaguaucuuauguu

SEQ ID NO: 1101959 - RNA, 19 nt, Homo sapiens
aaacaacccuuacaaacca

SEQ ID NO: 1101960 - RNA, 19 nt, Homo sapiens
cagacaugcuacccuaaua

SEQ ID NO: 1101961 - RNA, 19 nt, Homo sapiens
gaagagaauuuguguaacc

SEQ ID NO: 1101962 - RNA, 19 nt, Homo sapiens
ggaaugcacgugacgauga

SEQ ID NO: 1101963 - RNA, 19 nt, Homo sapiens
ggaagcaaaugauaagaac

SEQ ID NO: 1101964 - RNA, 19 nt, Homo sapiens
uagcuaaacuucgcauuga

SEQ ID NO: 1101965 - RNA, 19 nt, Homo sapiens
gaacagccuuguaaaauca

SEQ ID NO: 1101966 - RNA, 19 nt, Homo sapiens
uaagggagaccaugaaaga

SEQ ID NO: 1101967 - RNA, 19 nt, Homo sapiens
gcgagcagcuguggacauu

SEQ ID NO: 1101968 - RNA, 19 nt, Homo sapiens
gaaugggugccguguuaua

SEQ ID NO: 1101969 - RNA, 19 nt, Homo sapiens
ucccagauccugaauauaa

SEQ ID NO: 1101970 - RNA, 19 nt, Homo sapiens
gaggauagcccacaagucu

SEQ ID NO: 1101971 - RNA, 19 nt, Homo sapiens
caaaagagcacuucugaaa

SEQ ID NO: 1101972 - RNA, 19 nt, Homo sapiens
gcaaagcaacuucuguaga

SEQ ID NO: 1101973 - RNA, 19 nt, Homo sapiens
agaagaagcaggaacaauu

SEQ ID NO: 1101974 - RNA, 19 nt, Homo sapiens
gaaagaaguacaacagaag

SEQ ID NO: 1101975 - RNA, 19 nt, Homo sapiens
gaacuucccagauccugaa

SEQ ID NO: 1101976 - RNA, 19 nt, Homo sapiens
cgaugaagguguuccaaau

SEQ ID NO: 1101977 - RNA, 19 nt, Homo sapiens
gaaguguaguaacaggaaa

SEQ ID NO: 1101978 - RNA, 19 nt, Homo sapiens
ggagaagguuuagcuagau

SEQ ID NO: 1101979 - RNA, 19 nt, Homo sapiens
ggaagcagaaggaccauug

SEQ ID NO: 1101980 - RNA, 19 nt, Homo sapiens
gaagauuacuuagaagaac

SEQ ID NO: 1101981 - RNA, 19 nt, Homo sapiens
aaacuuauuuccugaugga

SEQ ID NO: 1101982 - RNA, 19 nt, Homo sapiens
gaagacaaauccggcagau

SEQ ID NO: 1101983 - RNA, 19 nt, Homo sapiens
gggagaaagugacagaaca

SEQ ID NO: 1101984 - RNA, 19 nt, Homo sapiens
caaggaggguaauguguca

SEQ ID NO: 1101985 - RNA, 19 nt, Homo sapiens
aaagaaaggagaccaaaug

SEQ ID NO: 1101986 - RNA, 19 nt, Homo sapiens
gacacaagguaaagacaga

SEQ ID NO: 1101987 - RNA, 19 nt, Homo sapiens
gcaaagaaaguaaacuagu

SEQ ID NO: 1101988 - RNA, 19 nt, Homo sapiens
gagcaagaacugaagcaaa

SEQ ID NO: 1101989 - RNA, 19 nt, Homo sapiens
ggccaaagagaacuacaua

SEQ ID NO: 1101990 - RNA, 19 nt, Homo sapiens
acacagaccuccgggaaga

SEQ ID NO: 1101991 - RNA, 19 nt, Homo sapiens
gcagaaguccuccuacauc

SEQ ID NO: 1101992 - RNA, 19 nt, Homo sapiens
ggaaugaauccacuuaugg

SEQ ID NO: 1101993 - RNA, 19 nt, Homo sapiens
agacagacuuccucuuuca

SEQ ID NO: 1101994 - RNA, 19 nt, Homo sapiens
gaccuuugaagauuacuua

SEQ ID NO: 1101995 - RNA, 19 nt, Homo sapiens
ucauggagauuuugucuua

SEQ ID NO: 1101996 - RNA, 19 nt, Homo sapiens
aaacauacccguccaacau

SEQ ID NO: 1101997 - RNA, 19 nt, Homo sapiens
gagaugaggaagcuacaaa

SEQ ID NO: 1101998 - RNA, 19 nt, Homo sapiens
gaagagaucuguaggcuuu

SEQ ID NO: 1101999 - RNA, 19 nt, Homo sapiens
gaggaaaugugauggaauu

SEQ ID NO: 1102000 - RNA, 19 nt, Homo sapiens
ccaccugucuggaguguua

SEQ ID NO: 1102001 - RNA, 19 nt, Homo sapiens
ggaaaggauugugaaauug

SEQ ID NO: 1102002 - RNA, 19 nt, Homo sapiens
guaacuaaaucuccucuga

SEQ ID NO: 1102003 - RNA, 19 nt, Homo sapiens
guacggagucccaauauaa

SEQ ID NO: 1102004 - RNA, 19 nt, Homo sapiens
gcacuuuacucguuugaug

SEQ ID NO: 1102005 - RNA, 19 nt, Homo sapiens
gaacuugaauaucaguaga

SEQ ID NO: 1102006 - RNA, 19 nt, Homo sapiens
uaucuuggguugaguauga

SEQ ID NO: 1102007 - RNA, 19 nt, Homo sapiens
agucagaacuugaauauca

SEQ ID NO: 1102008 - RNA, 19 nt, Homo sapiens
gcacagauggaaauuuaaa

SEQ ID NO: 1102009 - RNA, 19 nt, Homo sapiens
gaaucuagguuccucugaa

SEQ ID NO: 1102010 - RNA, 19 nt, Homo sapiens
ggaagucuuauucugauua

SEQ ID NO: 1102011 - RNA, 19 nt, Homo sapiens
gaaugucccuggauaugga

SEQ ID NO: 1102012 - RNA, 19 nt, Homo sapiens
caaaugagaugagcaugga

SEQ ID NO: 1102013 - RNA, 19 nt, Homo sapiens
gaaagaguguccuaauacu

SEQ ID NO: 1102014 - RNA, 19 nt, Homo sapiens
caucuggaauucauaugua

SEQ ID NO: 1102015 - RNA, 19 nt, Homo sapiens
gagccuuucuugucaauau

SEQ ID NO: 1102016 - RNA, 19 nt, Homo sapiens
gugauggaauuucaaguuu

SEQ ID NO: 1102017 - RNA, 19 nt, Homo sapiens
cugaaagaguguccuaaua

SEQ ID NO: 1102018 - RNA, 19 nt, Homo sapiens
guaaucagcaucuggaauu

SEQ ID NO: 1102019 - RNA, 19 nt, Homo sapiens
gaagagaggaaaugugaug

SEQ ID NO: 1102020 - RNA, 19 nt, Homo sapiens
augcacagauggaaauuua

SEQ ID NO: 1102021 - RNA, 19 nt, Homo sapiens
cagcuccaauugcaucuua

SEQ ID NO: 1102022 - RNA, 19 nt, Homo sapiens
gagaaugccuagugguuuc

SEQ ID NO: 1102023 - RNA, 19 nt, Homo sapiens
aggaaaggauugugaaauu

SEQ ID NO: 1102024 - RNA, 19 nt, Homo sapiens
gucaauauguccagagaaa

SEQ ID NO: 1102025 - RNA, 19 nt, Homo sapiens
gaaaggaaaggauugugaa

SEQ ID NO: 1102026 - RNA, 19 nt, Homo sapiens
gagaggaaaugugauggaa

SEQ ID NO: 1102027 - RNA, 19 nt, Homo sapiens
cagaggaggccuagacaua

SEQ ID NO: 1102028 - RNA, 19 nt, Homo sapiens
cuggaaagcuuuaggaguu

SEQ ID NO: 1102029 - RNA, 19 nt, Homo sapiens
gagaaaucauuguuaacug

SEQ ID NO: 1102030 - RNA, 19 nt, Homo sapiens
ucacacacaugcuaguuau

SEQ ID NO: 1102031 - RNA, 19 nt, Homo sapiens
aaugcuagcuggauuuauu

SEQ ID NO: 1102032 - RNA, 19 nt, Homo sapiens
ccagaggcauauuguuaaa

SEQ ID NO: 1102033 - RNA, 19 nt, Homo sapiens
gaggaggccuagacauaug

SEQ ID NO: 1102034 - RNA, 19 nt, Homo sapiens
uaccagaggcauauuguua

SEQ ID NO: 1102035 - RNA, 19 nt, Homo sapiens
agacauauguugcugaaag

SEQ ID NO: 1102036 - RNA, 19 nt, Homo sapiens
ggaaugcuagcuggauuua

SEQ ID NO: 1102037 - RNA, 19 nt, Homo sapiens
ucacugccuuucauuugua

SEQ ID NO: 1102038 - RNA, 19 nt, Homo sapiens
ucagcaaucagguuuaaua

SEQ ID NO: 1102039 - RNA, 19 nt, Homo sapiens
cacacaugcuaguuauuua

SEQ ID NO: 1102040 - RNA, 19 nt, Homo sapiens
acugcaaugugucuaauua

SEQ ID NO: 1102041 - RNA, 19 nt, Homo sapiens
caauaguacugcaaugugu

SEQ ID NO: 1102042 - RNA, 19 nt, Homo sapiens
gaggaaacauugaaaucca

SEQ ID NO: 1102043 - RNA, 19 nt, Homo sapiens
ugucauccgucuucaauau

SEQ ID NO: 1102044 - RNA, 19 nt, Homo sapiens
ugucucaguugucaaagua

SEQ ID NO: 1102045 - RNA, 19 nt, Homo sapiens
ucugaacacugacaauuug

SEQ ID NO: 1102046 - RNA, 19 nt, Homo sapiens
gaagucuuauucugauuag

SEQ ID NO: 1102047 - RNA, 19 nt, Homo sapiens
ggagaaugccuagugguuu

SEQ ID NO: 1102048 - RNA, 19 nt, Homo sapiens
uaaauguggucugugcuuu

SEQ ID NO: 1102049 - RNA, 19 nt, Homo sapiens
gacauauguugcugaaaga

SEQ ID NO: 1102050 - RNA, 19 nt, Homo sapiens
gcucucggguccuaaaugu

SEQ ID NO: 1102051 - RNA, 19 nt, Homo sapiens
gagacaccaugacagcaaa

SEQ ID NO: 1102052 - RNA, 19 nt, Homo sapiens
ccaacucccuccugucuuc

SEQ ID NO: 1102053 - RNA, 19 nt, Homo sapiens
uuacaacgaugcacuuuac

SEQ ID NO: 1102054 - RNA, 19 nt, Homo sapiens
gggcaccgccugauccuuu

SEQ ID NO: 1102055 - RNA, 19 nt, Homo sapiens
ucauccgucuucaauauuu

SEQ ID NO: 1102056 - RNA, 19 nt, Homo sapiens
gaugagcauggaugaauuu

SEQ ID NO: 1102057 - RNA, 19 nt, Homo sapiens
caguagauuucgucauuug

SEQ ID NO: 1102058 - RNA, 19 nt, Homo sapiens
gaaguaaugcacagaugga

SEQ ID NO: 1102059 - RNA, 19 nt, Homo sapiens
gaaaggauugugaaauugg

SEQ ID NO: 1102060 - RNA, 19 nt, Homo sapiens
gaacagguuuucguccaua

SEQ ID NO: 1102061 - RNA, 19 nt, Homo sapiens
ggagucccaauauaaagua

SEQ ID NO: 1102062 - RNA, 19 nt, Homo sapiens
ccagaaagucaccugagua

SEQ ID NO: 1102063 - RNA, 19 nt, Homo sapiens
gcaauaguacugcaaugug

SEQ ID NO: 1102064 - RNA, 19 nt, Homo sapiens
gagaugagcauggaugaau

SEQ ID NO: 1102065 - RNA, 19 nt, Homo sapiens
guauugagcucugaauguc

SEQ ID NO: 1102066 - RNA, 19 nt, Homo sapiens
aaacagauggagaauaaug

SEQ ID NO: 1102067 - RNA, 19 nt, Homo sapiens
ccaggaacaugggcagauu

SEQ ID NO: 1102068 - RNA, 19 nt, Homo sapiens
ggagaaaucauuguuaacu

SEQ ID NO: 1102069 - RNA, 19 nt, Homo sapiens
ugaaauuggucagugaaug

SEQ ID NO: 1102070 - RNA, 19 nt, Homo sapiens
cuacuugccuaggcucuaa

SEQ ID NO: 1102071 - RNA, 19 nt, Homo sapiens
cuggaucucugaacacuga

SEQ ID NO: 1102072 - RNA, 19 nt, Homo sapiens
cuugaaggcccuauaaauu

SEQ ID NO: 1102073 - RNA, 19 nt, Homo sapiens
acacacaugcuaguuauuu

SEQ ID NO: 1102074 - RNA, 19 nt, Homo sapiens
caaugugucuaauuaaagg

SEQ ID NO: 1102075 - RNA, 19 nt, Homo sapiens
gugauuagcuucgcagucu

SEQ ID NO: 1102076 - RNA, 19 nt, Homo sapiens
gaggcgaccuaaacaugga

SEQ ID NO: 1102077 - RNA, 19 nt, Homo sapiens
guaaugcacagauggaaau

SEQ ID NO: 1102078 - RNA, 19 nt, Homo sapiens
cuagacauauguugcugaa

SEQ ID NO: 1102079 - RNA, 19 nt, Homo sapiens
cuagcuggauuuauuacaa

SEQ ID NO: 1102080 - RNA, 19 nt, Homo sapiens
gcaaugugucuaauuaaag

SEQ ID NO: 1102081 - RNA, 19 nt, Homo sapiens
ggagacaccaugacagcaa

SEQ ID NO: 1102082 - RNA, 19 nt, Homo sapiens
ucaaaaugcuuguuacaga

SEQ ID NO: 1102083 - RNA, 19 nt, Homo sapiens
gaggcauauuguuaaauug

SEQ ID NO: 1102084 - RNA, 19 nt, Homo sapiens
gaauaucaguagauuucgu

SEQ ID NO: 1102085 - RNA, 19 nt, Homo sapiens
ggacaaauucccuaaaaga

SEQ ID NO: 1102086 - RNA, 19 nt, Homo sapiens
gcacagaggaggccuagac

SEQ ID NO: 1102087 - RNA, 19 nt, Homo sapiens
cagcaaucagguuuaauaa

SEQ ID NO: 1102088 - RNA, 19 nt, Homo sapiens
guugugcaauuucuuccua

SEQ ID NO: 1102089 - RNA, 19 nt, Homo sapiens
uguaacaguugaagcaaau

SEQ ID NO: 1102090 - RNA, 19 nt, Homo sapiens
gauggaauuucaaguuugc

SEQ ID NO: 1102091 - RNA, 19 nt, Homo sapiens
uuucauagauggagaaugc

SEQ ID NO: 1102092 - RNA, 19 nt, Homo sapiens
gagauggcccucaaaccuu

SEQ ID NO: 1102093 - RNA, 19 nt, Homo sapiens
gaaauuggucagugaaugc

SEQ ID NO: 1102094 - RNA, 19 nt, Homo sapiens
ugaaaggaaaggauuguga

SEQ ID NO: 1102095 - RNA, 19 nt, Homo sapiens
acaaagcuguuaggguaaa

SEQ ID NO: 1102096 - RNA, 19 nt, Homo sapiens
ugaaggcccuauaaauucu

SEQ ID NO: 1102097 - RNA, 19 nt, Homo sapiens
caaaaugcuuguuacagaa

SEQ ID NO: 1102098 - RNA, 19 nt, Homo sapiens
ggauauagcuuugauguaa

SEQ ID NO: 1102099 - RNA, 19 nt, Homo sapiens
gauggaagcugaauuaaau

SEQ ID NO: 1102100 - RNA, 19 nt, Homo sapiens
cgacaaggaugaagucuuu

SEQ ID NO: 1102101 - RNA, 19 nt, Homo sapiens
ggagauggaagcugaauua

SEQ ID NO: 1102102 - RNA, 19 nt, Homo sapiens
gaaagugaaucaucuagug

SEQ ID NO: 1102103 - RNA, 19 nt, Homo sapiens
ggacugauauucauucugu

SEQ ID NO: 1102104 - RNA, 19 nt, Homo sapiens
gaagaaacaacacaagauu

SEQ ID NO: 1102105 - RNA, 19 nt, Homo sapiens
aagaggagguucuaagaua

SEQ ID NO: 1102106 - RNA, 19 nt, Homo sapiens
aggcaaauauggacaguua

SEQ ID NO: 1102107 - RNA, 19 nt, Homo sapiens
caacagcuccgacaaggua

SEQ ID NO: 1102108 - RNA, 19 nt, Homo sapiens
uccaacaaaugacgaauua

SEQ ID NO: 1102109 - RNA, 19 nt, Homo sapiens
gagcaauguuuguaaugaa

SEQ ID NO: 1102110 - RNA, 19 nt, Homo sapiens
agacagauguggaagaaau

SEQ ID NO: 1102111 - RNA, 19 nt, Homo sapiens
ggaagaugcugccgagaag

SEQ ID NO: 1102112 - RNA, 19 nt, Homo sapiens
ccacagagaucacgucaac

SEQ ID NO: 1102113 - RNA, 19 nt, Homo sapiens
ggaagcaguguuucucuuu

SEQ ID NO: 1102114 - RNA, 19 nt, Homo sapiens
gacaguuacuuuccucuug

SEQ ID NO: 1102115 - RNA, 19 nt, Homo sapiens
cagcccaacuggcauuuaa

SEQ ID NO: 1102116 - RNA, 19 nt, Homo sapiens
auaagaagaugaggucuaa

SEQ ID NO: 1102117 - RNA, 19 nt, Homo sapiens
gauauaaagccucagagaa

SEQ ID NO: 1102118 - RNA, 19 nt, Homo sapiens
aaacagagacgcugcaaau

SEQ ID NO: 1102119 - RNA, 19 nt, Homo sapiens
ggcauuuaauuacccaaua

SEQ ID NO: 1102120 - RNA, 19 nt, Homo sapiens
caaagaggagguucuaaga

SEQ ID NO: 1102121 - RNA, 19 nt, Homo sapiens
gaggagguucuaagauaua

SEQ ID NO: 1102122 - RNA, 19 nt, Homo sapiens
caauauagagcaauguuug

SEQ ID NO: 1102123 - RNA, 19 nt, Homo sapiens
ggaugaagacagagcagua

SEQ ID NO: 1102124 - RNA, 19 nt, Homo sapiens
gcacugaauguuccacuga

SEQ ID NO: 1102125 - RNA, 19 nt, Homo sapiens
ggagaaagugaaucaucua

SEQ ID NO: 1102126 - RNA, 19 nt, Homo sapiens
uaacaaagaggagguucua

SEQ ID NO: 1102127 - RNA, 19 nt, Homo sapiens
caguacaggugaccaagaa

SEQ ID NO: 1102128 - RNA, 19 nt, Homo sapiens
caacacaagauuccaacaa

SEQ ID NO: 1102129 - RNA, 19 nt, Homo sapiens
gguacuacgaugauauaua

SEQ ID NO: 1102130 - RNA, 19 nt, Homo sapiens
gcauuuaauuacccaauac

SEQ ID NO: 1102131 - RNA, 19 nt, Homo sapiens
aaaggcggguccauaagaa

SEQ ID NO: 1102132 - RNA, 19 nt, Homo sapiens
caaaugacgaauuacugua

SEQ ID NO: 1102133 - RNA, 19 nt, Homo sapiens
agagacagauguggaagaa

SEQ ID NO: 1102134 - RNA, 19 nt, Homo sapiens
aacacaagauuccaacaaa

SEQ ID NO: 1102135 - RNA, 19 nt, Homo sapiens
aaccuucauucaucucuua

SEQ ID NO: 1102136 - RNA, 19 nt, Homo sapiens
acagagacgcugcaaauug

SEQ ID NO: 1102137 - RNA, 19 nt, Homo sapiens
gggaagaugcugccgagaa

SEQ ID NO: 1102138 - RNA, 19 nt, Homo sapiens
acacaagauuccaacaaau

SEQ ID NO: 1102139 - RNA, 19 nt, Homo sapiens
guucuggaauuauaagcaa

SEQ ID NO: 1102140 - RNA, 19 nt, Homo sapiens
agaggagguucuaagauau

SEQ ID NO: 1102141 - RNA, 19 nt, Homo sapiens
agagcaauguuuguaauga

SEQ ID NO: 1102142 - RNA, 19 nt, Homo sapiens
gagaucacgucaacaacag

SEQ ID NO: 1102143 - RNA, 19 nt, Homo sapiens
cgacaagguacuacgauga

SEQ ID NO: 1102144 - RNA, 19 nt, Homo sapiens
gaagcaguguuucucuuuu

SEQ ID NO: 1102145 - RNA, 19 nt, Homo sapiens
ugaaguggaugugcuuuua

SEQ ID NO: 1102146 - RNA, 19 nt, Homo sapiens
caacaaaugacgaauuacu

SEQ ID NO: 1102147 - RNA, 19 nt, Homo sapiens
aacaauggaggacaaguua

SEQ ID NO: 1102148 - RNA, 19 nt, Homo sapiens
uaaaggagaauaguuguca

SEQ ID NO: 1102149 - RNA, 19 nt, Homo sapiens
uauaaagccucagagaaca

SEQ ID NO: 1102150 - RNA, 19 nt, Homo sapiens
uaagcaaucuuuguuucug

SEQ ID NO: 1102151 - RNA, 19 nt, Homo sapiens
ccucuugccuguucauauc

SEQ ID NO: 1102152 - RNA, 19 nt, Homo sapiens
acaagguacuacgaugaua

SEQ ID NO: 1102153 - RNA, 19 nt, Homo sapiens
acauggaacuccugaccaa

SEQ ID NO: 1102154 - RNA, 19 nt, Homo sapiens
aaacaauggaggacaaguu

SEQ ID NO: 1102155 - RNA, 19 nt, Homo sapiens
ucauucaucucuuacaucu

SEQ ID NO: 1102156 - RNA, 19 nt, Homo sapiens
gcccaacuggcauuuaauu

SEQ ID NO: 1102157 - RNA, 19 nt, Homo sapiens
cauaagaagaugaggucua

SEQ ID NO: 1102158 - RNA, 19 nt, Homo sapiens
uaagauauaaagccucaga

SEQ ID NO: 1102159 - RNA, 19 nt, Homo sapiens
ccacacucuugccuugauu

SEQ ID NO: 1102160 - RNA, 19 nt, Homo sapiens
acagagaucacgucaacaa

SEQ ID NO: 1102161 - RNA, 19 nt, Homo sapiens
gagauggaagcugaauuaa

SEQ ID NO: 1102162 - RNA, 19 nt, Homo sapiens
cggagaaagugaaucaucu

SEQ ID NO: 1102163 - RNA, 19 nt, Homo sapiens
gcaaauauggacaguuacu

SEQ ID NO: 1102164 - RNA, 19 nt, Homo sapiens
ccucagagaacaaggaaga

SEQ ID NO: 1102165 - RNA, 19 nt, Homo sapiens
cacaagauuccaacaaaug

SEQ ID NO: 1102166 - RNA, 19 nt, Homo sapiens
caagguacuacgaugauau

SEQ ID NO: 1102167 - RNA, 19 nt, Homo sapiens
aagcaaucuuuguuucuga

SEQ ID NO: 1102168 - RNA, 19 nt, Homo sapiens
gaugaacauuuggaaacug

SEQ ID NO: 1102169 - RNA, 19 nt, Homo sapiens
ggacaguuacuuuccucuu

SEQ ID NO: 1102170 - RNA, 19 nt, Homo sapiens
caacuggcauuuaauuacc

SEQ ID NO: 1102171 - RNA, 19 nt, Homo sapiens
gacuugcaguguaaacaga

SEQ ID NO: 1102172 - RNA, 19 nt, Homo sapiens
acaagauuccaacaaauga

SEQ ID NO: 1102173 - RNA, 19 nt, Homo sapiens
gcaagccauuccuaaacag

SEQ ID NO: 1102174 - RNA, 19 nt, Homo sapiens
aaacaacacaagauuccaa

SEQ ID NO: 1102175 - RNA, 19 nt, Homo sapiens
cuagugaagaugaauuuga

SEQ ID NO: 1102176 - RNA, 19 nt, Homo sapiens
caaccuucauucaucucuu

SEQ ID NO: 1102177 - RNA, 19 nt, Homo sapiens
ugaugcuggucuugaauug

SEQ ID NO: 1102178 - RNA, 19 nt, Homo sapiens
gaagaugaauuugaaaagg

SEQ ID NO: 1102179 - RNA, 19 nt, Homo sapiens
gcaguacaggugaccaaga

SEQ ID NO: 1102180 - RNA, 19 nt, Homo sapiens
gagaaagugaaucaucuag

SEQ ID NO: 1102181 - RNA, 19 nt, Homo sapiens
uuuccugaauugucuguaa

SEQ ID NO: 1102182 - RNA, 19 nt, Homo sapiens
ccaacuggcauuuaauuac

SEQ ID NO: 1102183 - RNA, 19 nt, Homo sapiens
gaaggcagagacagaugug

SEQ ID NO: 1102184 - RNA, 19 nt, Homo sapiens
guaauuaaacuggaaacuc

SEQ ID NO: 1102185 - RNA, 19 nt, Homo sapiens
aaagugaaucaucuaguga

SEQ ID NO: 1102186 - RNA, 19 nt, Homo sapiens
aaacagcccaacuggcauu

SEQ ID NO: 1102187 - RNA, 19 nt, Homo sapiens
uagugaugcuggucuugaa

SEQ ID NO: 1102188 - RNA, 19 nt, Homo sapiens
gagaucaggccuggguuga

SEQ ID NO: 1102189 - RNA, 19 nt, Homo sapiens
aagaagaaacaacacaaga

SEQ ID NO: 1102190 - RNA, 19 nt, Homo sapiens
gacaagguacuacgaugau

SEQ ID NO: 1102191 - RNA, 19 nt, Homo sapiens
caauggaggacaaguuauc

SEQ ID NO: 1102192 - RNA, 19 nt, Homo sapiens
agauggaagcugaauuaaa

SEQ ID NO: 1102193 - RNA, 19 nt, Homo sapiens
ucagagaacaaggaagaaa

SEQ ID NO: 1102194 - RNA, 19 nt, Homo sapiens
acaaaugacgaauuacugu

SEQ ID NO: 1102195 - RNA, 19 nt, Homo sapiens
agaagaaacaacacaagau

SEQ ID NO: 1102196 - RNA, 19 nt, Homo sapiens
gagcaguacaggugaccaa

SEQ ID NO: 1102197 - RNA, 19 nt, Homo sapiens
aagguacuacgaugauaua

SEQ ID NO: 1102198 - RNA, 19 nt, Homo sapiens
gaagaaagcuugcaauuag

SEQ ID NO: 1102199 - RNA, 19 nt, Homo sapiens
uaacggagccuauguguaa

SEQ ID NO: 1102200 - RNA, 19 nt, Homo sapiens
ugaaugaacugacaacaau

SEQ ID NO: 1102201 - RNA, 19 nt, Homo sapiens
guuagaagcuacugggaaa

SEQ ID NO: 1102202 - RNA, 19 nt, Homo sapiens
acacaaagccaaaccagua

SEQ ID NO: 1102203 - RNA, 19 nt, Homo sapiens
ugaagaaagcuugcaauua

SEQ ID NO: 1102204 - RNA, 19 nt, Homo sapiens
acagucagcuucagagaaa

SEQ ID NO: 1102205 - RNA, 19 nt, Homo sapiens
gagaaaggaaucuguaguu

SEQ ID NO: 1102206 - RNA, 19 nt, Homo sapiens
gcaauuagugaacaugaaa

SEQ ID NO: 1102207 - RNA, 19 nt, Homo sapiens
gaaaggaaucuguaguuca

SEQ ID NO: 1102208 - RNA, 19 nt, Homo sapiens
cagugaugcugcccuguua

SEQ ID NO: 1102209 - RNA, 19 nt, Homo sapiens
gcacauaagccagguccua

SEQ ID NO: 1102210 - RNA, 19 nt, Homo sapiens
gauauuaccgaaaugaaga

SEQ ID NO: 1102211 - RNA, 19 nt, Homo sapiens
cuaccuacgugguguacua

SEQ ID NO: 1102212 - RNA, 19 nt, Homo sapiens
guaaauuuccgacagagaa

SEQ ID NO: 1102213 - RNA, 19 nt, Homo sapiens
ccagaaaguuugggauguu

SEQ ID NO: 1102214 - RNA, 19 nt, Homo sapiens
caagguugcacacuucuaa

SEQ ID NO: 1102215 - RNA, 19 nt, Homo sapiens
cagagaaacugaggagaau

SEQ ID NO: 1102216 - RNA, 19 nt, Homo sapiens
caucagcaccagaaaguuu

SEQ ID NO: 1102217 - RNA, 19 nt, Homo sapiens
ggucaggaguuagaagcua

SEQ ID NO: 1102218 - RNA, 19 nt, Homo sapiens
ccaaaccaguacaaaccua

SEQ ID NO: 1102219 - RNA, 19 nt, Homo sapiens
ggagaaugcagucuggauu

SEQ ID NO: 1102220 - RNA, 19 nt, Homo sapiens
gaggagaucauuuuagaua

SEQ ID NO: 1102221 - RNA, 19 nt, Homo sapiens
cagaaaguuugggauguuu

SEQ ID NO: 1102222 - RNA, 19 nt, Homo sapiens
uaaaggaccaggugaagau

SEQ ID NO: 1102223 - RNA, 19 nt, Homo sapiens
ccacaagccgagcacauaa

SEQ ID NO: 1102224 - RNA, 19 nt, Homo sapiens
aaaggaaucuguaguucag

SEQ ID NO: 1102225 - RNA, 19 nt, Homo sapiens
cgacaagaggagaucauuu

SEQ ID NO: 1102226 - RNA, 19 nt, Homo sapiens
agaaaggaaucuguaguuc

SEQ ID NO: 1102227 - RNA, 19 nt, Homo sapiens
gaaagcuugcaauuaguga

SEQ ID NO: 1102228 - RNA, 19 nt, Homo sapiens
gugaagauguugaccuuuu

SEQ ID NO: 1102229 - RNA, 19 nt, Homo sapiens
uagugaacaugaaaggaaa

SEQ ID NO: 1102230 - RNA, 19 nt, Homo sapiens
gcuucugggucaggaguua

SEQ ID NO: 1102231 - RNA, 19 nt, Homo sapiens
gccacaagccgagcacaua

SEQ ID NO: 1102232 - RNA, 19 nt, Homo sapiens
gagugagacugcaggagau

SEQ ID NO: 1102233 - RNA, 19 nt, Homo sapiens
gcacuugauccaucugugu

SEQ ID NO: 1102234 - RNA, 19 nt, Homo sapiens
caacugcagacuguaaauu

SEQ ID NO: 1102235 - RNA, 19 nt, Homo sapiens
gacacagccugaugcuugu

SEQ ID NO: 1102236 - RNA, 19 nt, Homo sapiens
gacaagaggagaucauuuu

SEQ ID NO: 1102237 - RNA, 19 nt, Homo sapiens
gaaaagcgugcaaguauca

SEQ ID NO: 1102238 - RNA, 19 nt, Homo sapiens
guaaaggaccaggugaaga

SEQ ID NO: 1102239 - RNA, 19 nt, Homo sapiens
gaguaaaggaccaggugaa

SEQ ID NO: 1102240 - RNA, 19 nt, Homo sapiens
gaaaaucuaccuccgacaa

SEQ ID NO: 1102241 - RNA, 19 nt, Homo sapiens
gcagucuggauucgaauug

SEQ ID NO: 1102242 - RNA, 19 nt, Homo sapiens
ggaaaagcgugcaaguauc

SEQ ID NO: 1102243 - RNA, 19 nt, Homo sapiens
aaaaucaacugcagacugu

SEQ ID NO: 1102244 - RNA, 19 nt, Homo sapiens
aaaucuaccuccgacaaga

SEQ ID NO: 1102245 - RNA, 19 nt, Homo sapiens
ggaacacaguacacaaagc

SEQ ID NO: 1102246 - RNA, 19 nt, Homo sapiens
agagauggaugagacuguu

SEQ ID NO: 1102247 - RNA, 19 nt, Homo sapiens
gcaauugguggcuuugaag

SEQ ID NO: 1102248 - RNA, 19 nt, Homo sapiens
uuagugaacaugaaaggaa

SEQ ID NO: 1102249 - RNA, 19 nt, Homo sapiens
gacagucagcuucagagaa

SEQ ID NO: 1102250 - RNA, 19 nt, Homo sapiens
ggcgggaacugcaauuggu

SEQ ID NO: 1102251 - RNA, 19 nt, Homo sapiens
aaucaacugcagacuguaa

SEQ ID NO: 1102252 - RNA, 19 nt, Homo sapiens
cacauaagccagguccuaa

SEQ ID NO: 1102253 - RNA, 19 nt, Homo sapiens
aagaggagaucauuuuaga

SEQ ID NO: 1102254 - RNA, 19 nt, Homo sapiens
gagaaacugaggagaaugc

SEQ ID NO: 1102255 - RNA, 19 nt, Homo sapiens
ccuguuagacaucauuuau

SEQ ID NO: 1102256 - RNA, 19 nt, Homo sapiens
gaaaauccccaugaaugaa

SEQ ID NO: 1102257 - RNA, 19 nt, Homo sapiens
aagaaagcuugcaauuagu

SEQ ID NO: 1102258 - RNA, 19 nt, Homo sapiens
aaugcagucuggauucgaa

SEQ ID NO: 1102259 - RNA, 19 nt, Homo sapiens
caaagccaaaccaguacaa

SEQ ID NO: 1102260 - RNA, 19 nt, Homo sapiens
ugcaauugguggcuuugaa

SEQ ID NO: 1102261 - RNA, 19 nt, Homo sapiens
gaaaugaagaaagcuugca

SEQ ID NO: 1102262 - RNA, 19 nt, Homo sapiens
guugcugaguucaucaaga

SEQ ID NO: 1102263 - RNA, 19 nt, Homo sapiens
uuaccgaaaugaagaaagc

SEQ ID NO: 1102264 - RNA, 19 nt, Homo sapiens
ugaaaauccccaugaauga

SEQ ID NO: 1102265 - RNA, 19 nt, Homo sapiens
ugagacuguugcugaguuc

SEQ ID NO: 1102266 - RNA, 19 nt, Homo sapiens
ugcaauuagugaacaugaa

SEQ ID NO: 1102267 - RNA, 19 nt, Homo sapiens
ccacuacuggugcaagguu

SEQ ID NO: 1102268 - RNA, 19 nt, Homo sapiens
gaggaaaagcgugcaagua

SEQ ID NO: 1102269 - RNA, 19 nt, Homo sapiens
gggaacacaguacacaaag

SEQ ID NO: 1102270 - RNA, 19 nt, Homo sapiens
gaugcugcccuguuagaca

SEQ ID NO: 1102271 - RNA, 19 nt, Homo sapiens
gaaugaacugacaacaauc

SEQ ID NO: 1102272 - RNA, 19 nt, Homo sapiens
aggaccaggugaagauguu

SEQ ID NO: 1102273 - RNA, 19 nt, Homo sapiens
acugcagacuguaaauuuc

SEQ ID NO: 1102274 - RNA, 19 nt, Homo sapiens
aacugcagacuguaaauuu

SEQ ID NO: 1102275 - RNA, 19 nt, Homo sapiens
uugcugaguucaucaagag

SEQ ID NO: 1102276 - RNA, 19 nt, Homo sapiens
gaccaggugaagauguuga

SEQ ID NO: 1102277 - RNA, 19 nt, Homo sapiens
ucagugaugcugcccuguu

SEQ ID NO: 1102278 - RNA, 19 nt, Homo sapiens
gugccaaagagauggauga

SEQ ID NO: 1102279 - RNA, 19 nt, Homo sapiens
gagauggaugagacuguug

SEQ ID NO: 1102280 - RNA, 19 nt, Homo sapiens
gaugugggccgugccaaag

SEQ ID NO: 1102281 - RNA, 19 nt, Homo sapiens
agaaagcuugcaauuagug

SEQ ID NO: 1102282 - RNA, 19 nt, Homo sapiens
cacaguacacaaagccaaa

SEQ ID NO: 1102283 - RNA, 19 nt, Homo sapiens
augaagaaagcuugcaauu

SEQ ID NO: 1102284 - RNA, 19 nt, Homo sapiens
cuaacggagccuaugugua

SEQ ID NO: 1102285 - RNA, 19 nt, Homo sapiens
gugaugcugcccuguuaga

SEQ ID NO: 1102286 - RNA, 19 nt, Homo sapiens
aaucuguaguucagcacuu

SEQ ID NO: 1102287 - RNA, 19 nt, Homo sapiens
gacuguugcugaguucauc

SEQ ID NO: 1102288 - RNA, 19 nt, Homo sapiens
cauaauagauuucgagaca

SEQ ID NO: 1102289 - RNA, 19 nt, Homo sapiens
ccauaacucugccaaauau

SEQ ID NO: 1102290 - RNA, 19 nt, Homo sapiens
gaacaacagcaacaacaaa

SEQ ID NO: 1102291 - RNA, 19 nt, Homo sapiens
ggagaguaauuaugaauag

SEQ ID NO: 1102292 - RNA, 19 nt, Homo sapiens
ggcagaagcuagucuaaug

SEQ ID NO: 1102293 - RNA, 19 nt, Homo sapiens
agugaugacugaagaaaua

SEQ ID NO: 1102294 - RNA, 19 nt, Homo sapiens
caaagcaggagaguaauua

SEQ ID NO: 1102295 - RNA, 19 nt, Homo sapiens
gcagcaacaucacuguaaa

SEQ ID NO: 1102296 - RNA, 19 nt, Homo sapiens
gaccauaacucugccaaau

SEQ ID NO: 1102297 - RNA, 19 nt, Homo sapiens
caacaaauguggaauucag

SEQ ID NO: 1102298 - RNA, 19 nt, Homo sapiens
gcaaauccucuacuucuga

SEQ ID NO: 1102299 - RNA, 19 nt, Homo sapiens
cuucaaaccugcuucuauu

SEQ ID NO: 1102300 - RNA, 19 nt, Homo sapiens
uagaugauaucgaaagaga

SEQ ID NO: 1102301 - RNA, 19 nt, Homo sapiens
caacaacaaauguggaauu

SEQ ID NO: 1102302 - RNA, 19 nt, Homo sapiens
cgagcggguucucaaguua

SEQ ID NO: 1102303 - RNA, 19 nt, Homo sapiens
gcaggagaguaauuaugaa

SEQ ID NO: 1102304 - RNA, 19 nt, Homo sapiens
uccaauagaugauaucgaa

SEQ ID NO: 1102305 - RNA, 19 nt, Homo sapiens
gaggauaguucuagugacu

SEQ ID NO: 1102306 - RNA, 19 nt, Homo sapiens
gaaggaagcaguaaaauuc

SEQ ID NO: 1102307 - RNA, 19 nt, Homo sapiens
ggauaguucuagugacuca

SEQ ID NO: 1102308 - RNA, 19 nt, Homo sapiens
agucaaagcaggagaguaa

SEQ ID NO: 1102309 - RNA, 19 nt, Homo sapiens
gaacugaaggcagaagcua

SEQ ID NO: 1102310 - RNA, 19 nt, Homo sapiens
caacagcaacaacaaaugu

SEQ ID NO: 1102311 - RNA, 19 nt, Homo sapiens
gcgagcggguucucaaguu

SEQ ID NO: 1102312 - RNA, 19 nt, Homo sapiens
cagaugaguaguugugaua

SEQ ID NO: 1102313 - RNA, 19 nt, Homo sapiens
gaaggcagaagcuagucua

SEQ ID NO: 1102314 - RNA, 19 nt, Homo sapiens
guaaagaacaacagcaaca

SEQ ID NO: 1102315 - RNA, 19 nt, Homo sapiens
gauauagaugccagucaua

SEQ ID NO: 1102316 - RNA, 19 nt, Homo sapiens
caacaguggccuucugaug

SEQ ID NO: 1102317 - RNA, 19 nt, Homo sapiens
auagaugccagucauaaua

SEQ ID NO: 1102318 - RNA, 19 nt, Homo sapiens
gaagaugaagauugcaaau

SEQ ID NO: 1102319 - RNA, 19 nt, Homo sapiens
ggagaaugucggcuagaaa

SEQ ID NO: 1102320 - RNA, 19 nt, Homo sapiens
acaguggccuucugaugaa

SEQ ID NO: 1102321 - RNA, 19 nt, Homo sapiens
aaacucagcagcaacauca

SEQ ID NO: 1102322 - RNA, 19 nt, Homo sapiens
gaacaggugaccauaacuc

SEQ ID NO: 1102323 - RNA, 19 nt, Homo sapiens
caaauccucuacuucugau

SEQ ID NO: 1102324 - RNA, 19 nt, Homo sapiens
gaugaguaguugugauagu

SEQ ID NO: 1102325 - RNA, 19 nt, Homo sapiens
ugagggaaauaugucuuaa

SEQ ID NO: 1102326 - RNA, 19 nt, Homo sapiens
ccaugauacuggagaaugu

SEQ ID NO: 1102327 - RNA, 19 nt, Homo sapiens
cuaauggaccagaugagua

SEQ ID NO: 1102328 - RNA, 19 nt, Homo sapiens
uggcggaguuaaagucaaa

SEQ ID NO: 1102329 - RNA, 19 nt, Homo sapiens
uaaccaugauacuggagaa

SEQ ID NO: 1102330 - RNA, 19 nt, Homo sapiens
gugaacaggugaccauaac

SEQ ID NO: 1102331 - RNA, 19 nt, Homo sapiens
uaauagauuucgagacaac

SEQ ID NO: 1102332 - RNA, 19 nt, Homo sapiens
ugauauagaugccagucau

SEQ ID NO: 1102333 - RNA, 19 nt, Homo sapiens
ggugaacaggugaccauaa

SEQ ID NO: 1102334 - RNA, 19 nt, Homo sapiens
ucaaagcaggagaguaauu

SEQ ID NO: 1102335 - RNA, 19 nt, Homo sapiens
gacaacaguggccuucuga

SEQ ID NO: 1102336 - RNA, 19 nt, Homo sapiens
gaguaguugugauaguuca

SEQ ID NO: 1102337 - RNA, 19 nt, Homo sapiens
gcaguaaaauucaguaucg

SEQ ID NO: 1102338 - RNA, 19 nt, Homo sapiens
gugaggauaguucuaguga

SEQ ID NO: 1102339 - RNA, 19 nt, Homo sapiens
ggacucccaaucuuguaaa

SEQ ID NO: 1102340 - RNA, 19 nt, Homo sapiens
caauagaugauaucgaaag

SEQ ID NO: 1102341 - RNA, 19 nt, Homo sapiens
uaacucugccaaauauaga

SEQ ID NO: 1102342 - RNA, 19 nt, Homo sapiens
aggcugagguggcagauag

SEQ ID NO: 1102343 - RNA, 19 nt, Homo sapiens
uauugacacuucuucugaa

SEQ ID NO: 1102344 - RNA, 19 nt, Homo sapiens
agacaacaguggccuucug

SEQ ID NO: 1102345 - RNA, 19 nt, Homo sapiens
gaccagaugaguaguugug

SEQ ID NO: 1102346 - RNA, 19 nt, Homo sapiens
gaugauaucgaaagagaac

SEQ ID NO: 1102347 - RNA, 19 nt, Homo sapiens
uaaagaacaacagcaacaa

SEQ ID NO: 1102348 - RNA, 19 nt, Homo sapiens
uggagaaugucggcuagaa

SEQ ID NO: 1102349 - RNA, 19 nt, Homo sapiens
gggagaguuucgagaagca

SEQ ID NO: 1102350 - RNA, 19 nt, Homo sapiens
gagaaugucggcuagaaaa

SEQ ID NO: 1102351 - RNA, 19 nt, Homo sapiens
aacaguggccuucugauga

SEQ ID NO: 1102352 - RNA, 19 nt, Homo sapiens
ugacucagaagaugaagau

SEQ ID NO: 1102353 - RNA, 19 nt, Homo sapiens
ccagaugaguaguugugau

SEQ ID NO: 1102354 - RNA, 19 nt, Homo sapiens
uaauggaccagaugaguag

SEQ ID NO: 1102355 - RNA, 19 nt, Homo sapiens
gauaagauguccccagcau

SEQ ID NO: 1102356 - RNA, 19 nt, Homo sapiens
aacaacaaauguggaauuc

SEQ ID NO: 1102357 - RNA, 19 nt, Homo sapiens
ugagguuggugaaggugaa

SEQ ID NO: 1102358 - RNA, 19 nt, Homo sapiens
cuauugacacuucuucuga

SEQ ID NO: 1102359 - RNA, 19 nt, Homo sapiens
agggaaauaugucuuaacu

SEQ ID NO: 1102360 - RNA, 19 nt, Homo sapiens
gccuucugaugaauacuuu

SEQ ID NO: 1102361 - RNA, 19 nt, Homo sapiens
uacagggaauugugucuca

SEQ ID NO: 1102362 - RNA, 19 nt, Homo sapiens
ucuagugacucagaagaug

SEQ ID NO: 1102363 - RNA, 19 nt, Homo sapiens
caaguagugaggauaguuc

SEQ ID NO: 1102364 - RNA, 19 nt, Homo sapiens
gcagaagcuagucuaaugg

SEQ ID NO: 1102365 - RNA, 19 nt, Homo sapiens
caaaccugcuucuauugac

SEQ ID NO: 1102366 - RNA, 19 nt, Homo sapiens
cugcuucuauugacacuuc

SEQ ID NO: 1102367 - RNA, 19 nt, Homo sapiens
aaaccugcuucuauugaca

SEQ ID NO: 1102368 - RNA, 19 nt, Homo sapiens
cugagggaaauaugucuua

SEQ ID NO: 1102369 - RNA, 19 nt, Homo sapiens
ugccagucauaauagauuu

SEQ ID NO: 1102370 - RNA, 19 nt, Homo sapiens
guagugaggauaguucuag

SEQ ID NO: 1102371 - RNA, 19 nt, Homo sapiens
cagcagcaacaucacugua

SEQ ID NO: 1102372 - RNA, 19 nt, Homo sapiens
agguucaacuccaccagua

SEQ ID NO: 1102373 - RNA, 19 nt, Homo sapiens
acucagaagaugaagauug

SEQ ID NO: 1102374 - RNA, 19 nt, Homo sapiens
ucaguaucguaaagaacaa

SEQ ID NO: 1102375 - RNA, 19 nt, Homo sapiens
agcaggagaguaauuauga

SEQ ID NO: 1102376 - RNA, 19 nt, Homo sapiens
ccaggacucccaaucuugu

SEQ ID NO: 1102377 - RNA, 19 nt, Homo sapiens
cagaagaugaagauugcaa

SEQ ID NO: 1102378 - RNA, 19 nt, Homo sapiens
gccaggacucccaaucuug

SEQ ID NO: 1102379 - RNA, 19 nt, Homo sapiens
accauaacucugccaaaua

SEQ ID NO: 1102380 - RNA, 19 nt, Homo sapiens
aaucaggaagugacaguga

SEQ ID NO: 1102381 - RNA, 19 nt, Homo sapiens
guucaucaucuucaaguag

SEQ ID NO: 1102382 - RNA, 19 nt, Homo sapiens
augaguaguugugauaguu

SEQ ID NO: 1102383 - RNA, 19 nt, Homo sapiens
uagcgcagcgggauucuca

SEQ ID NO: 1102384 - RNA, 19 nt, Homo sapiens
ccaaauauagaagguucaa

SEQ ID NO: 1102385 - RNA, 19 nt, Homo sapiens
cagaagcuagucuaaugga

SEQ ID NO: 1102386 - RNA, 19 nt, Homo sapiens
uaaaacauucuccaucuga

SEQ ID NO: 1102387 - RNA, 19 nt, Homo sapiens
gauuugcagcugagugaau

SEQ ID NO: 1102388 - RNA, 19 nt, Homo sapiens
ggacuucccucaccaugua

SEQ ID NO: 1102389 - RNA, 19 nt, Homo sapiens
gcacgaagccaguauguuu

SEQ ID NO: 1102390 - RNA, 19 nt, Homo sapiens
gaacugcaguacaaagaaa

SEQ ID NO: 1102391 - RNA, 19 nt, Homo sapiens
aagaacagcugcuccguua

SEQ ID NO: 1102392 - RNA, 19 nt, Homo sapiens
ggauaggcuuuccagauua

SEQ ID NO: 1102393 - RNA, 19 nt, Homo sapiens
gggauaggcuuuccagauu

SEQ ID NO: 1102394 - RNA, 19 nt, Homo sapiens
ccgcaugucugucggauua

SEQ ID NO: 1102395 - RNA, 19 nt, Homo sapiens
gauaggcuuuccagauuaa

SEQ ID NO: 1102396 - RNA, 19 nt, Homo sapiens
gaaagagagucgccaacau

SEQ ID NO: 1102397 - RNA, 19 nt, Homo sapiens
gaguuugucuuugaugaua

SEQ ID NO: 1102398 - RNA, 19 nt, Homo sapiens
ggaauugucuacuuaugca

SEQ ID NO: 1102399 - RNA, 19 nt, Homo sapiens
gaucggaagaugucaagua

SEQ ID NO: 1102400 - RNA, 19 nt, Homo sapiens
uuucagcccucgccucuua

SEQ ID NO: 1102401 - RNA, 19 nt, Homo sapiens
gcaccucccuggacuugga

SEQ ID NO: 1102402 - RNA, 19 nt, Homo sapiens
cugagaagaugcugaagaa

SEQ ID NO: 1102403 - RNA, 19 nt, Homo sapiens
ucaugaaguucuuagacua

SEQ ID NO: 1102404 - RNA, 19 nt, Homo sapiens
ugaagaagccagaaagaga

SEQ ID NO: 1102405 - RNA, 19 nt, Homo sapiens
gcauugugcacaugaagua

SEQ ID NO: 1102406 - RNA, 19 nt, Homo sapiens
agauuaaccuggcugacua

SEQ ID NO: 1102407 - RNA, 19 nt, Homo sapiens
acaaagagcccauccaagu

SEQ ID NO: 1102408 - RNA, 19 nt, Homo sapiens
gggaguuugucuuugauga

SEQ ID NO: 1102409 - RNA, 19 nt, Homo sapiens
uagacuagcugaauuuguc

SEQ ID NO: 1102410 - RNA, 19 nt, Homo sapiens
caccagcucugaaccauca

SEQ ID NO: 1102411 - RNA, 19 nt, Homo sapiens
gcaggcggcugagaagaug

SEQ ID NO: 1102412 - RNA, 19 nt, Homo sapiens
gaagaacugcugggcauug

SEQ ID NO: 1102413 - RNA, 19 nt, Homo sapiens
gauagcggcuguagcaacu

SEQ ID NO: 1102414 - RNA, 19 nt, Homo sapiens
caagcggacucgguggaua

SEQ ID NO: 1102415 - RNA, 19 nt, Homo sapiens
ccacaaagagcccauccaa

SEQ ID NO: 1102416 - RNA, 19 nt, Homo sapiens
ugaagaaggccuccaagga

SEQ ID NO: 1102417 - RNA, 19 nt, Homo sapiens
gcacacaccaucuccaucu

SEQ ID NO: 1102418 - RNA, 19 nt, Homo sapiens
gcaugucugucggauuauu

SEQ ID NO: 1102419 - RNA, 19 nt, Homo sapiens
caguauguuugcagacuuu

SEQ ID NO: 1102420 - RNA, 19 nt, Homo sapiens
uaugacaguuugagugaga

SEQ ID NO: 1102421 - RNA, 19 nt, Homo sapiens
ggaacugcaguacaaagaa

SEQ ID NO: 1102422 - RNA, 19 nt, Homo sapiens
ggcgggaccugaugcauag

SEQ ID NO: 1102423 - RNA, 19 nt, Homo sapiens
caaagagcccauccaagug

SEQ ID NO: 1102424 - RNA, 19 nt, Homo sapiens
ggcagaggcagcugaauga

SEQ ID NO: 1102425 - RNA, 19 nt, Homo sapiens
uaaccuggcugacuaugac

SEQ ID NO: 1102426 - RNA, 19 nt, Homo sapiens
uuaacgaaguguucagaau

SEQ ID NO: 1102427 - RNA, 19 nt, Homo sapiens
caaguacucacaccagcua

SEQ ID NO: 1102428 - RNA, 19 nt, Homo sapiens
ccacauccgagucuauuug

SEQ ID NO: 1102429 - RNA, 19 nt, Homo sapiens
uggccaagcugaccgauag

SEQ ID NO: 1102430 - RNA, 19 nt, Homo sapiens
cggaagaugucaaguacuc

SEQ ID NO: 1102431 - RNA, 19 nt, Homo sapiens
gggccaagcuggaguacac

SEQ ID NO: 1102432 - RNA, 19 nt, Homo sapiens
ggcugcagcucaucaagga

SEQ ID NO: 1102433 - RNA, 19 nt, Homo sapiens
aacgagagcugacccagau

SEQ ID NO: 1102434 - RNA, 19 nt, Homo sapiens
accgauagcuucaagaaca

SEQ ID NO: 1102435 - RNA, 19 nt, Homo sapiens
cuagcugaauuugucuuua

SEQ ID NO: 1102436 - RNA, 19 nt, Homo sapiens
gcacaugaaguauuuaucc

SEQ ID NO: 1102437 - RNA, 19 nt, Homo sapiens
guggagacccugcaagaga

SEQ ID NO: 1102438 - RNA, 19 nt, Homo sapiens
cagccagccucgugaagga

SEQ ID NO: 1102439 - RNA, 19 nt, Homo sapiens
gcugggcauugcucagauu

SEQ ID NO: 1102440 - RNA, 19 nt, Homo sapiens
uaacgaaguguucagaauc

SEQ ID NO: 1102441 - RNA, 19 nt, Homo sapiens
gagaagacagugccaagag

SEQ ID NO: 1102442 - RNA, 19 nt, Homo sapiens
gcccucgccucuuaagguu

SEQ ID NO: 1102443 - RNA, 19 nt, Homo sapiens
aagugccgcugguguuuaa

SEQ ID NO: 1102444 - RNA, 19 nt, Homo sapiens
aacagugacucuucgagaa

SEQ ID NO: 1102445 - RNA, 19 nt, Homo sapiens
ccucgccucuuaagguuga

SEQ ID NO: 1102446 - RNA, 19 nt, Homo sapiens
gggcauugcucagauuaac

SEQ ID NO: 1102447 - RNA, 19 nt, Homo sapiens
caagugccgcugguguuua

SEQ ID NO: 1102448 - RNA, 19 nt, Homo sapiens
gcugagaagaugcugaaga

SEQ ID NO: 1102449 - RNA, 19 nt, Homo sapiens
cggagaggauucugcuuca

SEQ ID NO: 1102450 - RNA, 19 nt, Homo sapiens
ggugaaggaagacugcaaa

SEQ ID NO: 1102451 - RNA, 19 nt, Homo sapiens
aaagagagucgccaacauc

SEQ ID NO: 1102452 - RNA, 19 nt, Homo sapiens
gacaagacagaccaaacuu

SEQ ID NO: 1102453 - RNA, 19 nt, Homo sapiens
ucuacggccucccgcagua

SEQ ID NO: 1102454 - RNA, 19 nt, Homo sapiens
cgagcaagucgucgggaua

SEQ ID NO: 1102455 - RNA, 19 nt, Homo sapiens
ugagugagcuccggaccau

SEQ ID NO: 1102456 - RNA, 19 nt, Homo sapiens
gagauugaucggaagaugu

SEQ ID NO: 1102457 - RNA, 19 nt, Homo sapiens
cgcaggcuaucaugaguga

SEQ ID NO: 1102458 - RNA, 19 nt, Homo sapiens
ccaagugccgcugguguuu

SEQ ID NO: 1102459 - RNA, 19 nt, Homo sapiens
guagugacagcgacaguuc

SEQ ID NO: 1102460 - RNA, 19 nt, Homo sapiens
ccaguauguuugcagacuu

SEQ ID NO: 1102461 - RNA, 19 nt, Homo sapiens
gagcacgaagccaguaugu

SEQ ID NO: 1102462 - RNA, 19 nt, Homo sapiens
uuauacguguguucaguga

SEQ ID NO: 1102463 - RNA, 19 nt, Homo sapiens
caagagauugaucggaaga

SEQ ID NO: 1102464 - RNA, 19 nt, Homo sapiens
ugaccgauagcuucaagaa

SEQ ID NO: 1102465 - RNA, 19 nt, Homo sapiens
guuugcagacuuuaucgua

SEQ ID NO: 1102466 - RNA, 19 nt, Homo sapiens
gaaaccaacacggaagauc

SEQ ID NO: 1102467 - RNA, 19 nt, Homo sapiens
guggauagcggcuguagca

SEQ ID NO: 1102468 - RNA, 19 nt, Homo sapiens
ggauucugcuucaggaaaa

SEQ ID NO: 1102469 - RNA, 19 nt, Homo sapiens
guucuuagacuagcugaau

SEQ ID NO: 1102470 - RNA, 19 nt, Homo sapiens
uugugcacaugaaguauuu

SEQ ID NO: 1102471 - RNA, 19 nt, Homo sapiens
gcagacaagacagaccaaa

SEQ ID NO: 1102472 - RNA, 19 nt, Homo sapiens
gagcaagucgucgggauag

SEQ ID NO: 1102473 - RNA, 19 nt, Homo sapiens
ggcauuccgugcagguguu

SEQ ID NO: 1102474 - RNA, 19 nt, Homo sapiens
cgagagcugacccagauga

SEQ ID NO: 1102475 - RNA, 19 nt, Homo sapiens
agagauugaucggaagaug

SEQ ID NO: 1102476 - RNA, 19 nt, Homo sapiens
cuccgcagcugcaggaaga

SEQ ID NO: 1102477 - RNA, 19 nt, Homo sapiens
uggagacccugcaagagau

SEQ ID NO: 1102478 - RNA, 19 nt, Homo sapiens
cuaccuccagucccaguua

SEQ ID NO: 1102479 - RNA, 19 nt, Homo sapiens
aaggaauugucuacuuaug

SEQ ID NO: 1102480 - RNA, 19 nt, Homo sapiens
gccuggcgaugcuggugua

SEQ ID NO: 1102481 - RNA, 19 nt, Homo sapiens
gaacagcugcuccguuacc

SEQ ID NO: 1102482 - RNA, 19 nt, Homo sapiens
gcugaccgauagcuucaag

SEQ ID NO: 1102483 - RNA, 19 nt, Homo sapiens
ggagacccugcaagagauu

SEQ ID NO: 1102484 - RNA, 19 nt, Homo sapiens
gagcggcagacaagacaga

SEQ ID NO: 1102485 - RNA, 19 nt, Homo sapiens
uguccgaaauacuuuggaa

SEQ ID NO: 1102486 - RNA, 19 nt, Homo sapiens
ggaagaacugcugggcauu

SEQ ID NO: 1102487 - RNA, 19 nt, Homo sapiens
ucacaaggccaaggaucaa

SEQ ID NO: 1102488 - RNA, 19 nt, Homo sapiens
gaagaugccugucggguuu

SEQ ID NO: 1102489 - RNA, 19 nt, Homo sapiens
uaacaaagcuacugcaaga

SEQ ID NO: 1102490 - RNA, 19 nt, Homo sapiens
gaaagauguucacgucuaa

SEQ ID NO: 1102491 - RNA, 19 nt, Homo sapiens
gaacauuugucuuucagaa

SEQ ID NO: 1102492 - RNA, 19 nt, Homo sapiens
gaaggaaggccagcauuua

SEQ ID NO: 1102493 - RNA, 19 nt, Homo sapiens
gaaaccgguuagucaauuu

SEQ ID NO: 1102494 - RNA, 19 nt, Homo sapiens
gaaacuggguuagaggauu

SEQ ID NO: 1102495 - RNA, 19 nt, Homo sapiens
gagauuagaaacuggguua

SEQ ID NO: 1102496 - RNA, 19 nt, Homo sapiens
ugacaauucuguaaaguuc

SEQ ID NO: 1102497 - RNA, 19 nt, Homo sapiens
caacgaugagcauuucuua

SEQ ID NO: 1102498 - RNA, 19 nt, Homo sapiens
agaaagauguucacgucua

SEQ ID NO: 1102499 - RNA, 19 nt, Homo sapiens
ggaagaugcgguaaugaaa

SEQ ID NO: 1102500 - RNA, 19 nt, Homo sapiens
cuacauuuguccuuggaua

SEQ ID NO: 1102501 - RNA, 19 nt, Homo sapiens
gugaugagcugagaaagau

SEQ ID NO: 1102502 - RNA, 19 nt, Homo sapiens
guuagaggauugcagaaga

SEQ ID NO: 1102503 - RNA, 19 nt, Homo sapiens
ugaaaccgguuagucaauu

SEQ ID NO: 1102504 - RNA, 19 nt, Homo sapiens
gaccaacgaugagcauuuc

SEQ ID NO: 1102505 - RNA, 19 nt, Homo sapiens
gggaagaugcgguaaugaa

SEQ ID NO: 1102506 - RNA, 19 nt, Homo sapiens
aaacuggguuagaggauug

SEQ ID NO: 1102507 - RNA, 19 nt, Homo sapiens
gagcauuucuuaggcuuca

SEQ ID NO: 1102508 - RNA, 19 nt, Homo sapiens
cacaaagccuguucuaguc

SEQ ID NO: 1102509 - RNA, 19 nt, Homo sapiens
acacaaagccuguucuagu

SEQ ID NO: 1102510 - RNA, 19 nt, Homo sapiens
uaaugaaaccgguuaguca

SEQ ID NO: 1102511 - RNA, 19 nt, Homo sapiens
acaaagcuacugcaagaaa

SEQ ID NO: 1102512 - RNA, 19 nt, Homo sapiens
gagaaaaugugacacuugu

SEQ ID NO: 1102513 - RNA, 19 nt, Homo sapiens
gcacccagcgcuccauaga

SEQ ID NO: 1102514 - RNA, 19 nt, Homo sapiens
guggagacaguauuucuuu

SEQ ID NO: 1102515 - RNA, 19 nt, Homo sapiens
gaaaaugugacacuuguga

SEQ ID NO: 1102516 - RNA, 19 nt, Homo sapiens
gagacaguauuucuuucug

SEQ ID NO: 1102517 - RNA, 19 nt, Homo sapiens
ccuagaggcccuacauuug

SEQ ID NO: 1102518 - RNA, 19 nt, Homo sapiens
ggugaugagcugagaaaga

SEQ ID NO: 1102519 - RNA, 19 nt, Homo sapiens
ugaccuaccugaacugacu

SEQ ID NO: 1102520 - RNA, 19 nt, Homo sapiens
ugaaauccuucccuuuuaa

SEQ ID NO: 1102521 - RNA, 19 nt, Homo sapiens
gcaauuaacaaagcuacug

SEQ ID NO: 1102522 - RNA, 19 nt, Homo sapiens
agaaggaaggccagcauuu

SEQ ID NO: 1102523 - RNA, 19 nt, Homo sapiens
gaagaugcgguaaugaaac

SEQ ID NO: 1102524 - RNA, 19 nt, Homo sapiens
aagcauuucugucugaaca

SEQ ID NO: 1102525 - RNA, 19 nt, Homo sapiens
gagcugagaaagauguuca

SEQ ID NO: 1102526 - RNA, 19 nt, Homo sapiens
ugaccaacgaugagcauuu

SEQ ID NO: 1102527 - RNA, 19 nt, Homo sapiens
gacccagccugaccaacga

SEQ ID NO: 1102528 - RNA, 19 nt, Homo sapiens
gcuccucccuaggcuguuu

SEQ ID NO: 1102529 - RNA, 19 nt, Homo sapiens
caaagcuacugcaagaaaa

SEQ ID NO: 1102530 - RNA, 19 nt, Homo sapiens
uaagcuauuucaccuuucu

SEQ ID NO: 1102531 - RNA, 19 nt, Homo sapiens
ggagacaguauuucuuucu

SEQ ID NO: 1102532 - RNA, 19 nt, Homo sapiens
ggaaggccagcauuuacga

SEQ ID NO: 1102533 - RNA, 19 nt, Homo sapiens
gggcuuggaauguugcaaa

SEQ ID NO: 1102534 - RNA, 19 nt, Homo sapiens
ccacuggauucccuacaag

SEQ ID NO: 1102535 - RNA, 19 nt, Homo sapiens
gcauuucugucugaacaca

SEQ ID NO: 1102536 - RNA, 19 nt, Homo sapiens
uagcacaguucauuucacu

SEQ ID NO: 1102537 - RNA, 19 nt, Homo sapiens
gauuagaaacuggguuaga

SEQ ID NO: 1102538 - RNA, 19 nt, Homo sapiens
gaaaagagacuggcagagu

SEQ ID NO: 1102539 - RNA, 19 nt, Homo sapiens
guaaugaaaccgguuaguc

SEQ ID NO: 1102540 - RNA, 19 nt, Homo sapiens
uugaagcauuucugucuga

SEQ ID NO: 1102541 - RNA, 19 nt, Homo sapiens
gaaggccagcauuuacgaa

SEQ ID NO: 1102542 - RNA, 19 nt, Homo sapiens
cuagaggcccuacauuugu

SEQ ID NO: 1102543 - RNA, 19 nt, Homo sapiens
gaugagcugagaaagaugu

SEQ ID NO: 1102544 - RNA, 19 nt, Homo sapiens
aaaugugacacuugugaaa

SEQ ID NO: 1102545 - RNA, 19 nt, Homo sapiens
gcagagucccgagaagaug

SEQ ID NO: 1102546 - RNA, 19 nt, Homo sapiens
ccauagacgccuuugugaa

SEQ ID NO: 1102547 - RNA, 19 nt, Homo sapiens
ucccuaggcuguuuuagua

SEQ ID NO: 1102548 - RNA, 19 nt, Homo sapiens
cauagacgccuuugugaac

SEQ ID NO: 1102549 - RNA, 19 nt, Homo sapiens
uugaaauccuucccuuuua

SEQ ID NO: 1102550 - RNA, 19 nt, Homo sapiens
uauauaggguggccacacu

SEQ ID NO: 1102551 - RNA, 19 nt, Homo sapiens
gcagaaggaaggccagcau

SEQ ID NO: 1102552 - RNA, 19 nt, Homo sapiens
ggccugaccuaccugaacu

SEQ ID NO: 1102553 - RNA, 19 nt, Homo sapiens
gggcgcuccuuucuguuuc

SEQ ID NO: 1102554 - RNA, 19 nt, Homo sapiens
gguaauuaagguugugaau

SEQ ID NO: 1102555 - RNA, 19 nt, Homo sapiens
caggugaugagcugagaaa

SEQ ID NO: 1102556 - RNA, 19 nt, Homo sapiens
aguacagacuccagacaga

SEQ ID NO: 1102557 - RNA, 19 nt, Homo sapiens
gagaacugggccugaccua

SEQ ID NO: 1102558 - RNA, 19 nt, Homo sapiens
ugaagcauuucugucugaa

SEQ ID NO: 1102559 - RNA, 19 nt, Homo sapiens
guucauuucacugggauuu

SEQ ID NO: 1102560 - RNA, 19 nt, Homo sapiens
uagaggcccuacauuuguc

SEQ ID NO: 1102561 - RNA, 19 nt, Homo sapiens
ggagaaaaugugacacuug

SEQ ID NO: 1102562 - RNA, 19 nt, Homo sapiens
ggcagagucccgagaagau

SEQ ID NO: 1102563 - RNA, 19 nt, Homo sapiens
cccacuggauucccuacaa

SEQ ID NO: 1102564 - RNA, 19 nt, Homo sapiens
guugacaauucuguaaagu

SEQ ID NO: 1102565 - RNA, 19 nt, Homo sapiens
cagaaggaaggccagcauu

SEQ ID NO: 1102566 - RNA, 19 nt, Homo sapiens
uccuagaggcccuacauuu

SEQ ID NO: 1102567 - RNA, 19 nt, Homo sapiens
ucacugggauuuugaagca

SEQ ID NO: 1102568 - RNA, 19 nt, Homo sapiens
ccaacgaugagcauuucuu

SEQ ID NO: 1102569 - RNA, 19 nt, Homo sapiens
ucacagcuuuggccccuuu

SEQ ID NO: 1102570 - RNA, 19 nt, Homo sapiens
cccaagggaugucaguuuu

SEQ ID NO: 1102571 - RNA, 19 nt, Homo sapiens
aaaguuacccaagggaugu

SEQ ID NO: 1102572 - RNA, 19 nt, Homo sapiens
aaugaaaccgguuagucaa

SEQ ID NO: 1102573 - RNA, 19 nt, Homo sapiens
uggagacaguauuucuuuc

SEQ ID NO: 1102574 - RNA, 19 nt, Homo sapiens
caagaaaccuggaauuauu

SEQ ID NO: 1102575 - RNA, 19 nt, Homo sapiens
gaaaugaguuccuucuaca

SEQ ID NO: 1102576 - RNA, 19 nt, Homo sapiens
gaugcaauauaucgaguua

SEQ ID NO: 1102577 - RNA, 19 nt, Homo sapiens
gcacugaauugcuaaguca

SEQ ID NO: 1102578 - RNA, 19 nt, Homo sapiens
gaaccuauauccagacaca

SEQ ID NO: 1102579 - RNA, 19 nt, Homo sapiens
gaaaagaggucuagaugug

SEQ ID NO: 1102580 - RNA, 19 nt, Homo sapiens
cauugaagcuguugagaaa

SEQ ID NO: 1102581 - RNA, 19 nt, Homo sapiens
caagacaagcuacugaaua

SEQ ID NO: 1102582 - RNA, 19 nt, Homo sapiens
gaggaagacugacagacaa

SEQ ID NO: 1102583 - RNA, 19 nt, Homo sapiens
aagagaagcugaauuugga

SEQ ID NO: 1102584 - RNA, 19 nt, Homo sapiens
gaagagaagcugaauuugg

SEQ ID NO: 1102585 - RNA, 19 nt, Homo sapiens
gacaacaacacaagaauug

SEQ ID NO: 1102586 - RNA, 19 nt, Homo sapiens
gcaaacaauacagaaguua

SEQ ID NO: 1102587 - RNA, 19 nt, Homo sapiens
caaagugugugaacgugaa

SEQ ID NO: 1102588 - RNA, 19 nt, Homo sapiens
aagaagagaagcugaauuu

SEQ ID NO: 1102589 - RNA, 19 nt, Homo sapiens
gcucucaucugcacaaagu

SEQ ID NO: 1102590 - RNA, 19 nt, Homo sapiens
gcucuucccuuacaguuuc

SEQ ID NO: 1102591 - RNA, 19 nt, Homo sapiens
gauggcaguuucaauaaca

SEQ ID NO: 1102592 - RNA, 19 nt, Homo sapiens
ucacagugcuuccgauaca

SEQ ID NO: 1102593 - RNA, 19 nt, Homo sapiens
ggaaagaaacuaaggaaaa

SEQ ID NO: 1102594 - RNA, 19 nt, Homo sapiens
cacaagaauugaagcugua

SEQ ID NO: 1102595 - RNA, 19 nt, Homo sapiens
ggauucaaguuguccauca

SEQ ID NO: 1102596 - RNA, 19 nt, Homo sapiens
caacaacacaagaauugaa

SEQ ID NO: 1102597 - RNA, 19 nt, Homo sapiens
ugaaaacucugcaagaaaa

SEQ ID NO: 1102598 - RNA, 19 nt, Homo sapiens
ucacaacaguaucaggaaa

SEQ ID NO: 1102599 - RNA, 19 nt, Homo sapiens
gccaaaggauucaaguugu

SEQ ID NO: 1102600 - RNA, 19 nt, Homo sapiens
agauguggaugcaauauau

SEQ ID NO: 1102601 - RNA, 19 nt, Homo sapiens
acaguuccgugguuuguaa

SEQ ID NO: 1102602 - RNA, 19 nt, Homo sapiens
gcacuauaauaugcagaaa

SEQ ID NO: 1102603 - RNA, 19 nt, Homo sapiens
caaguuguccaucaagaaa

SEQ ID NO: 1102604 - RNA, 19 nt, Homo sapiens
aaagaagguuaucugcaaa

SEQ ID NO: 1102605 - RNA, 19 nt, Homo sapiens
caagacaacaacacaagaa

SEQ ID NO: 1102606 - RNA, 19 nt, Homo sapiens
cagaaaguguggauuugug

SEQ ID NO: 1102607 - RNA, 19 nt, Homo sapiens
gaucuucggcucagaggaa

SEQ ID NO: 1102608 - RNA, 19 nt, Homo sapiens
gaggaaagaaacuaaggaa

SEQ ID NO: 1102609 - RNA, 19 nt, Homo sapiens
gcauugaagcuguugagaa

SEQ ID NO: 1102610 - RNA, 19 nt, Homo sapiens
ucaagaaaccuggaauuau

SEQ ID NO: 1102611 - RNA, 19 nt, Homo sapiens
gggaggacauccacguugu

SEQ ID NO: 1102612 - RNA, 19 nt, Homo sapiens
gaaguuuauuacccgaaga

SEQ ID NO: 1102613 - RNA, 19 nt, Homo sapiens
ugacagacaagacaagcua

SEQ ID NO: 1102614 - RNA, 19 nt, Homo sapiens
gggauuguauuuggaccua

SEQ ID NO: 1102615 - RNA, 19 nt, Homo sapiens
gcaagacaacaacacaaga

SEQ ID NO: 1102616 - RNA, 19 nt, Homo sapiens
gcacagaaaaucuuuaaug

SEQ ID NO: 1102617 - RNA, 19 nt, Homo sapiens
uggaaacacugaauucuac

SEQ ID NO: 1102618 - RNA, 19 nt, Homo sapiens
aagacaagcuacugaauac

SEQ ID NO: 1102619 - RNA, 19 nt, Homo sapiens
ccggagcacugaagauguu

SEQ ID NO: 1102620 - RNA, 19 nt, Homo sapiens
guggcaaucugcaaacaau

SEQ ID NO: 1102621 - RNA, 19 nt, Homo sapiens
cuacaaauucugauacuuc

SEQ ID NO: 1102622 - RNA, 19 nt, Homo sapiens
ccaaaggauucaaguuguc

SEQ ID NO: 1102623 - RNA, 19 nt, Homo sapiens
gauggaggaaagaaacuaa

SEQ ID NO: 1102624 - RNA, 19 nt, Homo sapiens
agacacagaaggaaucauu

SEQ ID NO: 1102625 - RNA, 19 nt, Homo sapiens
aaaagaagguuaucugcaa

SEQ ID NO: 1102626 - RNA, 19 nt, Homo sapiens
guggaaacacugaauucua

SEQ ID NO: 1102627 - RNA, 19 nt, Homo sapiens
gauucaaguuguccaucaa

SEQ ID NO: 1102628 - RNA, 19 nt, Homo sapiens
caggcucuguccaauauga

SEQ ID NO: 1102629 - RNA, 19 nt, Homo sapiens
gauuuauugucaaccaaga

SEQ ID NO: 1102630 - RNA, 19 nt, Homo sapiens
uuacaaagaauccaagcaa

SEQ ID NO: 1102631 - RNA, 19 nt, Homo sapiens
ggccaaagccuccaagaac

SEQ ID NO: 1102632 - RNA, 19 nt, Homo sapiens
ggaggaaagaaacuaagga

SEQ ID NO: 1102633 - RNA, 19 nt, Homo sapiens
acaagcuacugaauacguu

SEQ ID NO: 1102634 - RNA, 19 nt, Homo sapiens
gacaagacaagcuacugaa

SEQ ID NO: 1102635 - RNA, 19 nt, Homo sapiens
caagaagagaagcugaauu

SEQ ID NO: 1102636 - RNA, 19 nt, Homo sapiens
caucacagugcuuccgaua

SEQ ID NO: 1102637 - RNA, 19 nt, Homo sapiens
caucaagaaaccuggaauu

SEQ ID NO: 1102638 - RNA, 19 nt, Homo sapiens
agcgacagaugccucauuu

SEQ ID NO: 1102639 - RNA, 19 nt, Homo sapiens
agacaacaacacaagaauu

SEQ ID NO: 1102640 - RNA, 19 nt, Homo sapiens
ugcaauauaucgaguuagu

SEQ ID NO: 1102641 - RNA, 19 nt, Homo sapiens
gaaugucuuucagaucaca

SEQ ID NO: 1102642 - RNA, 19 nt, Homo sapiens
gcagauggaggaaagaaac

SEQ ID NO: 1102643 - RNA, 19 nt, Homo sapiens
agacaagacaagcuacuga

SEQ ID NO: 1102644 - RNA, 19 nt, Homo sapiens
aaaugaaacaggaaacaug

SEQ ID NO: 1102645 - RNA, 19 nt, Homo sapiens
ccaaaucgugacaccauga

SEQ ID NO: 1102646 - RNA, 19 nt, Homo sapiens
ugcaaacaauacagaaguu

SEQ ID NO: 1102647 - RNA, 19 nt, Homo sapiens
gagaaaagaggucuagaug

SEQ ID NO: 1102648 - RNA, 19 nt, Homo sapiens
ugaguuccuucuacaguca

SEQ ID NO: 1102649 - RNA, 19 nt, Homo sapiens
gucuugaugccuaauauuu

SEQ ID NO: 1102650 - RNA, 19 nt, Homo sapiens
ggucuaccagaaccagaua

SEQ ID NO: 1102651 - RNA, 19 nt, Homo sapiens
uagauguggaugcaauaua

SEQ ID NO: 1102652 - RNA, 19 nt, Homo sapiens
acaggucauugccgagaaa

SEQ ID NO: 1102653 - RNA, 19 nt, Homo sapiens
gauccucuagcacugaauu

SEQ ID NO: 1102654 - RNA, 19 nt, Homo sapiens
ucagaucacaacaguauca

SEQ ID NO: 1102655 - RNA, 19 nt, Homo sapiens
uuucagaucacaacaguau

SEQ ID NO: 1102656 - RNA, 19 nt, Homo sapiens
aaccagaaaguguggauuu

SEQ ID NO: 1102657 - RNA, 19 nt, Homo sapiens
gagcacagaaaaucuuuaa

SEQ ID NO: 1102658 - RNA, 19 nt, Homo sapiens
gaauugcuaagucacuaug

SEQ ID NO: 1102659 - RNA, 19 nt, Homo sapiens
cuucuacagucagauauug

SEQ ID NO: 1102660 - RNA, 19 nt, Homo sapiens
cgacagaugccucauuuug

SEQ ID NO: 1102661 - RNA, 19 nt, Homo sapiens
caggaaacauggcgaucca

SEQ ID NO: 1102662 - RNA, 19 nt, Homo sapiens
ccaugauccucaccgaugu

SEQ ID NO: 1102663 - RNA, 19 nt, Homo sapiens
gaaaccagagcacagaaaa

SEQ ID NO: 1102664 - RNA, 19 nt, Homo sapiens
ucaaguuguccaucaagaa

SEQ ID NO: 1102665 - RNA, 19 nt, Homo sapiens
acaacaguaucaggaaaug

SEQ ID NO: 1102666 - RNA, 19 nt, Homo sapiens
aaaucgagcagaaagaaug

SEQ ID NO: 1102667 - RNA, 19 nt, Homo sapiens
acaaagaauccaagcaaca

SEQ ID NO: 1102668 - RNA, 19 nt, Homo sapiens
ggaagacugacagacaaga

SEQ ID NO: 1102669 - RNA, 19 nt, Homo sapiens
gaaacauggcgauccacau

SEQ ID NO: 1102670 - RNA, 19 nt, Homo sapiens
gaauugaagcuguaaaauc

SEQ ID NO: 1102671 - RNA, 19 nt, Homo sapiens
gagcugugcaaaugagaau

SEQ ID NO: 1102672 - RNA, 19 nt, Homo sapiens
ugccaaaggauucaaguug

SEQ ID NO: 1102673 - RNA, 19 nt, Homo sapiens
caaaucgugacaccaugaa

SEQ ID NO: 1102674 - RNA, 19 nt, Homo sapiens
gagaacgacugcaucuuug

SEQ ID NO: 1102675 - RNA, 19 nt, Homo sapiens
cgacagacacuccaaguuu

SEQ ID NO: 1102676 - RNA, 19 nt, Homo sapiens
caucaagccugcuaacaug

SEQ ID NO: 1102677 - RNA, 19 nt, Homo sapiens
ggucauuacucagaauaaa

SEQ ID NO: 1102678 - RNA, 19 nt, Homo sapiens
cggaugaccugagaauuaa

SEQ ID NO: 1102679 - RNA, 19 nt, Homo sapiens
ggaaagacgagaucagugu

SEQ ID NO: 1102680 - RNA, 19 nt, Homo sapiens
agacuuaccugucggugaa

SEQ ID NO: 1102681 - RNA, 19 nt, Homo sapiens
aaucacagauagaagcuuu

SEQ ID NO: 1102682 - RNA, 19 nt, Homo sapiens
ugagaacgacugcaucuuu

SEQ ID NO: 1102683 - RNA, 19 nt, Homo sapiens
caugaugaccagagacuua

SEQ ID NO: 1102684 - RNA, 19 nt, Homo sapiens
acggaugaccugagaauua

SEQ ID NO: 1102685 - RNA, 19 nt, Homo sapiens
gacggacacugcucccaaa

SEQ ID NO: 1102686 - RNA, 19 nt, Homo sapiens
guacauauuccaggacaaa

SEQ ID NO: 1102687 - RNA, 19 nt, Homo sapiens
gaagaucccagcaguaggu

SEQ ID NO: 1102688 - RNA, 19 nt, Homo sapiens
cuacuucccuucacagaca

SEQ ID NO: 1102689 - RNA, 19 nt, Homo sapiens
agucuugucuugcauaguu

SEQ ID NO: 1102690 - RNA, 19 nt, Homo sapiens
gcacuuagaaaucacagau

SEQ ID NO: 1102691 - RNA, 19 nt, Homo sapiens
cugcaucuuugacaaguuu

SEQ ID NO: 1102692 - RNA, 19 nt, Homo sapiens
cgagacccauuuaggauca

SEQ ID NO: 1102693 - RNA, 19 nt, Homo sapiens
uggaggagcugaccgaagu

SEQ ID NO: 1102694 - RNA, 19 nt, Homo sapiens
gaugaccugagaauuaauu

SEQ ID NO: 1102695 - RNA, 19 nt, Homo sapiens
gcucugcucucucuaugag

SEQ ID NO: 1102696 - RNA, 19 nt, Homo sapiens
guagguccuucuucucaga

SEQ ID NO: 1102697 - RNA, 19 nt, Homo sapiens
gguacaugaugaccagaga

SEQ ID NO: 1102698 - RNA, 19 nt, Homo sapiens
cauagugggcgguacauga

SEQ ID NO: 1102699 - RNA, 19 nt, Homo sapiens
gacagacacuccaaguuuu

SEQ ID NO: 1102700 - RNA, 19 nt, Homo sapiens
agacuucgagacccauuua

SEQ ID NO: 1102701 - RNA, 19 nt, Homo sapiens
acagauagaagcuuuaaca

SEQ ID NO: 1102702 - RNA, 19 nt, Homo sapiens
ucggauagcgccaucauga

SEQ ID NO: 1102703 - RNA, 19 nt, Homo sapiens
ucacagauagaagcuuuaa

SEQ ID NO: 1102704 - RNA, 19 nt, Homo sapiens
gaggaaagacgagaucagu

SEQ ID NO: 1102705 - RNA, 19 nt, Homo sapiens
ucaggauguuugauagaga

SEQ ID NO: 1102706 - RNA, 19 nt, Homo sapiens
ccugagaauuaauuuaugg

SEQ ID NO: 1102707 - RNA, 19 nt, Homo sapiens
uugacaaguuugaguguug

SEQ ID NO: 1102708 - RNA, 19 nt, Homo sapiens
caaaaggucauuacucaga

SEQ ID NO: 1102709 - RNA, 19 nt, Homo sapiens
ggaccauccgccuguguga

SEQ ID NO: 1102710 - RNA, 19 nt, Homo sapiens
ggacacugcucccaaaagg

SEQ ID NO: 1102711 - RNA, 19 nt, Homo sapiens
caacuucuucaggauguuu

SEQ ID NO: 1102712 - RNA, 19 nt, Homo sapiens
uuauggcacuuagaaauca

SEQ ID NO: 1102713 - RNA, 19 nt, Homo sapiens
acuuagaaaucacagauag

SEQ ID NO: 1102714 - RNA, 19 nt, Homo sapiens
gcuuuaacaucguggacau

SEQ ID NO: 1102715 - RNA, 19 nt, Homo sapiens
uaacaucguggacaucaag

SEQ ID NO: 1102716 - RNA, 19 nt, Homo sapiens
cuggaggccucgagagaga

SEQ ID NO: 1102717 - RNA, 19 nt, Homo sapiens
caagcucugcucucucuau

SEQ ID NO: 1102718 - RNA, 19 nt, Homo sapiens
cauauccgauguaaaauuc

SEQ ID NO: 1102719 - RNA, 19 nt, Homo sapiens
aaaggucauuacucagaau

SEQ ID NO: 1102720 - RNA, 19 nt, Homo sapiens
cgagaucaguguggacagu

SEQ ID NO: 1102721 - RNA, 19 nt, Homo sapiens
gaaaucacagauagaagcu

SEQ ID NO: 1102722 - RNA, 19 nt, Homo sapiens
cccaccagguccacgagua

SEQ ID NO: 1102723 - RNA, 19 nt, Homo sapiens
ggugugggaccucaacaug

SEQ ID NO: 1102724 - RNA, 19 nt, Homo sapiens
gcgacagacacuccaaguu

SEQ ID NO: 1102725 - RNA, 19 nt, Homo sapiens
gcaacguguucgucuacag

SEQ ID NO: 1102726 - RNA, 19 nt, Homo sapiens
ggacaaaaucaacuagaga

SEQ ID NO: 1102727 - RNA, 19 nt, Homo sapiens
cccaaaaggucauuacuca

SEQ ID NO: 1102728 - RNA, 19 nt, Homo sapiens
gaacgugaggaccaagucu

SEQ ID NO: 1102729 - RNA, 19 nt, Homo sapiens
caguagguccuucuucuca

SEQ ID NO: 1102730 - RNA, 19 nt, Homo sapiens
auuguccgcuccauuaaga

SEQ ID NO: 1102731 - RNA, 19 nt, Homo sapiens
agauagaagcuuuaacauc

SEQ ID NO: 1102732 - RNA, 19 nt, Homo sapiens
gaacgacugcaucuuugac

SEQ ID NO: 1102733 - RNA, 19 nt, Homo sapiens
guguucgucuacagcagua

SEQ ID NO: 1102734 - RNA, 19 nt, Homo sapiens
caccaauaacuuguacaua

SEQ ID NO: 1102735 - RNA, 19 nt, Homo sapiens
gucuggacuucaacaagaa

SEQ ID NO: 1102736 - RNA, 19 nt, Homo sapiens
ggacaucaagccugcuaac

SEQ ID NO: 1102737 - RNA, 19 nt, Homo sapiens
aagcucugcucucucuaug

SEQ ID NO: 1102738 - RNA, 19 nt, Homo sapiens
aucauuguccgcuccauua

SEQ ID NO: 1102739 - RNA, 19 nt, Homo sapiens
caucauuguccgcuccauu

SEQ ID NO: 1102740 - RNA, 19 nt, Homo sapiens
gucuugucuugcauaguua

SEQ ID NO: 1102741 - RNA, 19 nt, Homo sapiens
cuacggaugaccugagaau

SEQ ID NO: 1102742 - RNA, 19 nt, Homo sapiens
ccaccaauaacuuguacau

SEQ ID NO: 1102743 - RNA, 19 nt, Homo sapiens
aacaacuucuucaggaugu

SEQ ID NO: 1102744 - RNA, 19 nt, Homo sapiens
gguccuauaacaacuucuu

SEQ ID NO: 1102745 - RNA, 19 nt, Homo sapiens
gacugcaucuuugacaagu

SEQ ID NO: 1102746 - RNA, 19 nt, Homo sapiens
auaacaacuucuucaggau

SEQ ID NO: 1102747 - RNA, 19 nt, Homo sapiens
agugggcgguacaugauga

SEQ ID NO: 1102748 - RNA, 19 nt, Homo sapiens
uaguuaagccggacauuuu

SEQ ID NO: 1102749 - RNA, 19 nt, Homo sapiens
auaguuaagccggacauuu

SEQ ID NO: 1102750 - RNA, 19 nt, Homo sapiens
cuucgagacccauuuagga

SEQ ID NO: 1102751 - RNA, 19 nt, Homo sapiens
acgaguaccugcgcagcaa

SEQ ID NO: 1102752 - RNA, 19 nt, Homo sapiens
gcaguagguccuucuucuc

SEQ ID NO: 1102753 - RNA, 19 nt, Homo sapiens
caacagggcuuauucuugu

SEQ ID NO: 1102754 - RNA, 19 nt, Homo sapiens
cuaauaaacuccucaacuu

SEQ ID NO: 1102755 - RNA, 19 nt, Homo sapiens
gggaagaaguucagaggaa

SEQ ID NO: 1102756 - RNA, 19 nt, Homo sapiens
cagagaauguuguugcuaa

SEQ ID NO: 1102757 - RNA, 19 nt, Homo sapiens
gagaauagaguacauugaa

SEQ ID NO: 1102758 - RNA, 19 nt, Homo sapiens
gaaauugacagcccuugaa

SEQ ID NO: 1102759 - RNA, 19 nt, Homo sapiens
gggaguacauugagauaau

SEQ ID NO: 1102760 - RNA, 19 nt, Homo sapiens
gcuccuuccuuucuccuua

SEQ ID NO: 1102761 - RNA, 19 nt, Homo sapiens
gcaacagggcuuauucuug

SEQ ID NO: 1102762 - RNA, 19 nt, Homo sapiens
cgauaugucuugucguuca

SEQ ID NO: 1102763 - RNA, 19 nt, Homo sapiens
gccuucagcuccuuccuuu

SEQ ID NO: 1102764 - RNA, 19 nt, Homo sapiens
uuucucaacucguucgaua

SEQ ID NO: 1102765 - RNA, 19 nt, Homo sapiens
gcugggaaguugcuuuaca

SEQ ID NO: 1102766 - RNA, 19 nt, Homo sapiens
ggaguacauugagauaauc

SEQ ID NO: 1102767 - RNA, 19 nt, Homo sapiens
ggagaauagaguacauuga

SEQ ID NO: 1102768 - RNA, 19 nt, Homo sapiens
gaacggagaauagaguaca

SEQ ID NO: 1102769 - RNA, 19 nt, Homo sapiens
acacuaaacgagaaauuga

SEQ ID NO: 1102770 - RNA, 19 nt, Homo sapiens
caacacuaaacgagaaauu

SEQ ID NO: 1102771 - RNA, 19 nt, Homo sapiens
ccaguuucuuguugauuug

SEQ ID NO: 1102772 - RNA, 19 nt, Homo sapiens
guugcuaacccaccaguuu

SEQ ID NO: 1102773 - RNA, 19 nt, Homo sapiens
gauaugucuugucguucaa

SEQ ID NO: 1102774 - RNA, 19 nt, Homo sapiens
ucaccucuaucuuucuuuc

SEQ ID NO: 1102775 - RNA, 19 nt, Homo sapiens
cagacuuucucaacucguu

SEQ ID NO: 1102776 - RNA, 19 nt, Homo sapiens
accaguuucuuguugauuu

SEQ ID NO: 1102777 - RNA, 19 nt, Homo sapiens
uaaagagcaacagggcuua

SEQ ID NO: 1102778 - RNA, 19 nt, Homo sapiens
uugcaacacuaaacgagaa

SEQ ID NO: 1102779 - RNA, 19 nt, Homo sapiens
gaagggacauuuucagacu

SEQ ID NO: 1102780 - RNA, 19 nt, Homo sapiens
caagaaaaucgcagacuuu

SEQ ID NO: 1102781 - RNA, 19 nt, Homo sapiens
gggcaguccuggucaagac

SEQ ID NO: 1102782 - RNA, 19 nt, Homo sapiens
ccucucauauuucccuaau

SEQ ID NO: 1102783 - RNA, 19 nt, Homo sapiens
ccuccucaccucuaucuuu

SEQ ID NO: 1102784 - RNA, 19 nt, Homo sapiens
cauugaagcucgggugaca

SEQ ID NO: 1102785 - RNA, 19 nt, Homo sapiens
ccucaccucuaucuuucuu

SEQ ID NO: 1102786 - RNA, 19 nt, Homo sapiens
acacaggccacaugggaaa

SEQ ID NO: 1102787 - RNA, 19 nt, Homo sapiens
agaauagaguacauugaag

SEQ ID NO: 1102788 - RNA, 19 nt, Homo sapiens
ucagaggaaccguuggaaa

SEQ ID NO: 1102789 - RNA, 19 nt, Homo sapiens
acacaacacaggccacaug

SEQ ID NO: 1102790 - RNA, 19 nt, Homo sapiens
gggcuaaccgggaguacau

SEQ ID NO: 1102791 - RNA, 19 nt, Homo sapiens
ccaccaguuucuuguugau

SEQ ID NO: 1102792 - RNA, 19 nt, Homo sapiens
ggugugguaugugggaaga

SEQ ID NO: 1102793 - RNA, 19 nt, Homo sapiens
gagcaacagggcuuauucu

SEQ ID NO: 1102794 - RNA, 19 nt, Homo sapiens
ucucucaaacuuuccuuaa

SEQ ID NO: 1102795 - RNA, 19 nt, Homo sapiens
cagaggaaccguuggaaac

SEQ ID NO: 1102796 - RNA, 19 nt, Homo sapiens
ucaagaaaaucgcagacuu

SEQ ID NO: 1102797 - RNA, 19 nt, Homo sapiens
ucaacucguucgauauguc

SEQ ID NO: 1102798 - RNA, 19 nt, Homo sapiens
gccugggacucuuugugaa

SEQ ID NO: 1102799 - RNA, 19 nt, Homo sapiens
gcuaaccgggaguacauug

SEQ ID NO: 1102800 - RNA, 19 nt, Homo sapiens
gggaaguugcuuuacacaa

SEQ ID NO: 1102801 - RNA, 19 nt, Homo sapiens
ucgcagacuuucucaacuc

SEQ ID NO: 1102802 - RNA, 19 nt, Homo sapiens
gagacacucaccuagaaca

SEQ ID NO: 1102803 - RNA, 19 nt, Homo sapiens
uucgauaugucuugucguu

SEQ ID NO: 1102804 - RNA, 19 nt, Homo sapiens
cucucaaacuuuccuuaaa

SEQ ID NO: 1102805 - RNA, 19 nt, Homo sapiens
ucucaacucguucgauaug

SEQ ID NO: 1102806 - RNA, 19 nt, Homo sapiens
cugcugggaaguugcuuua

SEQ ID NO: 1102807 - RNA, 19 nt, Homo sapiens
ccuaauaaacuccucaacu

SEQ ID NO: 1102808 - RNA, 19 nt, Homo sapiens
gcccuugaacggagaauag

SEQ ID NO: 1102809 - RNA, 19 nt, Homo sapiens
uaacccaccaguuucuugu

SEQ ID NO: 1102810 - RNA, 19 nt, Homo sapiens
ccagagaauguuguugcua

SEQ ID NO: 1102811 - RNA, 19 nt, Homo sapiens
gcauuuuaccuuuucagua

SEQ ID NO: 1102812 - RNA, 19 nt, Homo sapiens
agaaauugacagcccuuga

SEQ ID NO: 1102813 - RNA, 19 nt, Homo sapiens
caucuacuugucaauguau

SEQ ID NO: 1102814 - RNA, 19 nt, Homo sapiens
caccagcagcaucaagaaa

SEQ ID NO: 1102815 - RNA, 19 nt, Homo sapiens
cuccucaccucuaucuuuc

SEQ ID NO: 1102816 - RNA, 19 nt, Homo sapiens
cggagaauagaguacauug

SEQ ID NO: 1102817 - RNA, 19 nt, Homo sapiens
acccaccaguuucuuguug

SEQ ID NO: 1102818 - RNA, 19 nt, Homo sapiens
ggacagacauauaucauug

SEQ ID NO: 1102819 - RNA, 19 nt, Homo sapiens
gaaggugucuguguauaaa

SEQ ID NO: 1102820 - RNA, 19 nt, Homo sapiens
ccaagacaauagacauuua

SEQ ID NO: 1102821 - RNA, 19 nt, Homo sapiens
ccucauagcuggugaagga

SEQ ID NO: 1102822 - RNA, 19 nt, Homo sapiens
ggauagggaauaugcauua

SEQ ID NO: 1102823 - RNA, 19 nt, Homo sapiens
aaagguaucugugguauug

SEQ ID NO: 1102824 - RNA, 19 nt, Homo sapiens
gaaagaagagacaaguuga

SEQ ID NO: 1102825 - RNA, 19 nt, Homo sapiens
ggaauaugcauuacagaaa

SEQ ID NO: 1102826 - RNA, 19 nt, Homo sapiens
ugaaggaucuuucuacagu

SEQ ID NO: 1102827 - RNA, 19 nt, Homo sapiens
ggaaggugucuguguauaa

SEQ ID NO: 1102828 - RNA, 19 nt, Homo sapiens
ggccauggcucaccuguuc

SEQ ID NO: 1102829 - RNA, 19 nt, Homo sapiens
gcgggaaggugucugugua

SEQ ID NO: 1102830 - RNA, 19 nt, Homo sapiens
ggagacguguguaauaaag

SEQ ID NO: 1102831 - RNA, 19 nt, Homo sapiens
cagaagcccugcucccauu

SEQ ID NO: 1102832 - RNA, 19 nt, Homo sapiens
uagcuguacuugccucaua

SEQ ID NO: 1102833 - RNA, 19 nt, Homo sapiens
gaaggcugguuucauuugu

SEQ ID NO: 1102834 - RNA, 19 nt, Homo sapiens
gggaaggugucuguguaua

SEQ ID NO: 1102835 - RNA, 19 nt, Homo sapiens
caacgggcaugaggaggua

SEQ ID NO: 1102836 - RNA, 19 nt, Homo sapiens
acaagaaugucuccacuca

SEQ ID NO: 1102837 - RNA, 19 nt, Homo sapiens
uagcaacccugagaugauu

SEQ ID NO: 1102838 - RNA, 19 nt, Homo sapiens
ugaaagaagagacaaguug

SEQ ID NO: 1102839 - RNA, 19 nt, Homo sapiens
gggaauaugcauuacagaa

SEQ ID NO: 1102840 - RNA, 19 nt, Homo sapiens
ugaaacugcuggagaccaa

SEQ ID NO: 1102841 - RNA, 19 nt, Homo sapiens
cacugaagcucauggaaga

SEQ ID NO: 1102842 - RNA, 19 nt, Homo sapiens
gggauggacagacauauau

SEQ ID NO: 1102843 - RNA, 19 nt, Homo sapiens
guucuugacguuaguaauu

SEQ ID NO: 1102844 - RNA, 19 nt, Homo sapiens
ugucuccacucaccuaauu

SEQ ID NO: 1102845 - RNA, 19 nt, Homo sapiens
gaaugucuccacucaccua

SEQ ID NO: 1102846 - RNA, 19 nt, Homo sapiens
gaccacaaucagaauuaua

SEQ ID NO: 1102847 - RNA, 19 nt, Homo sapiens
gcucauggaagaaauggaa

SEQ ID NO: 1102848 - RNA, 19 nt, Homo sapiens
uuaaaggaauggcaaacug

SEQ ID NO: 1102849 - RNA, 19 nt, Homo sapiens
guggacagccucucaguga

SEQ ID NO: 1102850 - RNA, 19 nt, Homo sapiens
cagaccacaaucagaauua

SEQ ID NO: 1102851 - RNA, 19 nt, Homo sapiens
accagaagaucuaugugua

SEQ ID NO: 1102852 - RNA, 19 nt, Homo sapiens
ccucguauaugucacuuuc

SEQ ID NO: 1102853 - RNA, 19 nt, Homo sapiens
ggagcagcguccagucuuc

SEQ ID NO: 1102854 - RNA, 19 nt, Homo sapiens
guuggagacguguguaaua

SEQ ID NO: 1102855 - RNA, 19 nt, Homo sapiens
gccagggaaugcugacuug

SEQ ID NO: 1102856 - RNA, 19 nt, Homo sapiens
uaaaggaaagaaccuguug

SEQ ID NO: 1102857 - RNA, 19 nt, Homo sapiens
cuaaagguaucugugguau

SEQ ID NO: 1102858 - RNA, 19 nt, Homo sapiens
uaguggcucuggccucuuu

SEQ ID NO: 1102859 - RNA, 19 nt, Homo sapiens
gaagggcccacggauggua

SEQ ID NO: 1102860 - RNA, 19 nt, Homo sapiens
uuggagacguguguaauaa

SEQ ID NO: 1102861 - RNA, 19 nt, Homo sapiens
gagaugauuuucuuccauu

SEQ ID NO: 1102862 - RNA, 19 nt, Homo sapiens
aaauauccgugccuucugu

SEQ ID NO: 1102863 - RNA, 19 nt, Homo sapiens
gcuggugucccucaagaaa

SEQ ID NO: 1102864 - RNA, 19 nt, Homo sapiens
cagcuggugucccucaaga

SEQ ID NO: 1102865 - RNA, 19 nt, Homo sapiens
gucagugccuucucacguu

SEQ ID NO: 1102866 - RNA, 19 nt, Homo sapiens
caucuuaagcucugucuuc

SEQ ID NO: 1102867 - RNA, 19 nt, Homo sapiens
gauggagucuaccaaucug

SEQ ID NO: 1102868 - RNA, 19 nt, Homo sapiens
ggaagaaauggaagaagca

SEQ ID NO: 1102869 - RNA, 19 nt, Homo sapiens
gaucagcgacaucgaugga

SEQ ID NO: 1102870 - RNA, 19 nt, Homo sapiens
agacguguguaauaaagga

SEQ ID NO: 1102871 - RNA, 19 nt, Homo sapiens
gguauuagucagcuucaga

SEQ ID NO: 1102872 - RNA, 19 nt, Homo sapiens
ucacguugccguauucuuc

SEQ ID NO: 1102873 - RNA, 19 nt, Homo sapiens
ggauggagucuaccaaucu

SEQ ID NO: 1102874 - RNA, 19 nt, Homo sapiens
ugucuuccguggcacaauu

SEQ ID NO: 1102875 - RNA, 19 nt, Homo sapiens
gcccuagggugaccgugaa

SEQ ID NO: 1102876 - RNA, 19 nt, Homo sapiens
gccguauucuucagguauu

SEQ ID NO: 1102877 - RNA, 19 nt, Homo sapiens
uuucuacagucuggucuua

SEQ ID NO: 1102878 - RNA, 19 nt, Homo sapiens
cauaaggaaaccaggcuuu

SEQ ID NO: 1102879 - RNA, 19 nt, Homo sapiens
caacagccccugccucgua

SEQ ID NO: 1102880 - RNA, 19 nt, Homo sapiens
gauggacagacauauauca

SEQ ID NO: 1102881 - RNA, 19 nt, Homo sapiens
ucaccuaauuggcaacauc

SEQ ID NO: 1102882 - RNA, 19 nt, Homo sapiens
guaugcaauucuacugugu

SEQ ID NO: 1102883 - RNA, 19 nt, Homo sapiens
ggucuuacccauguuccua

SEQ ID NO: 1102884 - RNA, 19 nt, Homo sapiens
gggugaccgugaacuauag

SEQ ID NO: 1102885 - RNA, 19 nt, Homo sapiens
acaccaaggucaugcugau

SEQ ID NO: 1102886 - RNA, 19 nt, Homo sapiens
aggcugguuucauuuguuu

SEQ ID NO: 1102887 - RNA, 19 nt, Homo sapiens
gauccagaccacaaucaga

SEQ ID NO: 1102888 - RNA, 19 nt, Homo sapiens
uaaaggaauggcaaacugu

SEQ ID NO: 1102889 - RNA, 19 nt, Homo sapiens
ggucagugcagguggauca

SEQ ID NO: 1102890 - RNA, 19 nt, Homo sapiens
gaagcucauggaagaaaug

SEQ ID NO: 1102891 - RNA, 19 nt, Homo sapiens
ucagccagguugugcguau

SEQ ID NO: 1102892 - RNA, 19 nt, Homo sapiens
agucuggucuuacccaugu

SEQ ID NO: 1102893 - RNA, 19 nt, Homo sapiens
cauagcuggugaaggauuc

SEQ ID NO: 1102894 - RNA, 19 nt, Homo sapiens
ucguauaugucacuuucaa

SEQ ID NO: 1102895 - RNA, 19 nt, Homo sapiens
ccaaguggaugaaaauauc

SEQ ID NO: 1102896 - RNA, 19 nt, Homo sapiens
ggccguauccacaacaaga

SEQ ID NO: 1102897 - RNA, 19 nt, Homo sapiens
gggcaccacgagacacuaa

SEQ ID NO: 1102898 - RNA, 19 nt, Homo sapiens
guauuagucagcuucagaa

SEQ ID NO: 1102899 - RNA, 19 nt, Homo sapiens
auaaggaaaccaggcuuua

SEQ ID NO: 1102900 - RNA, 19 nt, Homo sapiens
gauagggaauaugcauuac

SEQ ID NO: 1102901 - RNA, 19 nt, Homo sapiens
ccuaaagguaucuguggua

SEQ ID NO: 1102902 - RNA, 19 nt, Homo sapiens
gcucuuugcccuggagaaa

SEQ ID NO: 1102903 - RNA, 19 nt, Homo sapiens
auaggacccuggccuuguu

SEQ ID NO: 1102904 - RNA, 19 nt, Homo sapiens
cagaagaucuauguguacu

SEQ ID NO: 1102905 - RNA, 19 nt, Homo sapiens
agaccacaaucagaauuau

SEQ ID NO: 1102906 - RNA, 19 nt, Homo sapiens
uagggaauaugcauuacag

SEQ ID NO: 1102907 - RNA, 19 nt, Homo sapiens
guucagggaauauuuacug

SEQ ID NO: 1102908 - RNA, 19 nt, Homo sapiens
gacagacauauaucauuga

SEQ ID NO: 1102909 - RNA, 19 nt, Homo sapiens
ugggauggacagacauaua

SEQ ID NO: 1102910 - RNA, 19 nt, Homo sapiens
ccacggcacugagaguagu

SEQ ID NO: 1102911 - RNA, 19 nt, Homo sapiens
gccacugggucuuccugaa

SEQ ID NO: 1102912 - RNA, 19 nt, Homo sapiens
uggugucccucaagaaaug

SEQ ID NO: 1102913 - RNA, 19 nt, Homo sapiens
ccguauucuucagguauua

SEQ ID NO: 1102914 - RNA, 19 nt, Homo sapiens
gcaccacgagacacuaauc

SEQ ID NO: 1102915 - RNA, 19 nt, Homo sapiens
ucaaccagaagaucuaugu

SEQ ID NO: 1102916 - RNA, 19 nt, Homo sapiens
gaaaauauccgugccuucu

SEQ ID NO: 1102917 - RNA, 19 nt, Homo sapiens
ugaagcucauggaagaaau

SEQ ID NO: 1102918 - RNA, 19 nt, Homo sapiens
gaaguuaccugauuguuua

SEQ ID NO: 1102919 - RNA, 19 nt, Homo sapiens
caaaucagcuugucgugaa

SEQ ID NO: 1102920 - RNA, 19 nt, Homo sapiens
caccuucgcuggauucuaa

SEQ ID NO: 1102921 - RNA, 19 nt, Homo sapiens
ggacagcugcaauugguua

SEQ ID NO: 1102922 - RNA, 19 nt, Homo sapiens
guacgccgcuggcaccuuu

SEQ ID NO: 1102923 - RNA, 19 nt, Homo sapiens
gaauggaucgcagcaguua

SEQ ID NO: 1102924 - RNA, 19 nt, Homo sapiens
cgaagagacuggagacaau

SEQ ID NO: 1102925 - RNA, 19 nt, Homo sapiens
cggagucggugcuuuagua

SEQ ID NO: 1102926 - RNA, 19 nt, Homo sapiens
gcaauugguuaucuagcuu

SEQ ID NO: 1102927 - RNA, 19 nt, Homo sapiens
gcauuugucuuguugaaac

SEQ ID NO: 1102928 - RNA, 19 nt, Homo sapiens
gaucaucgaaauaaagcua

SEQ ID NO: 1102929 - RNA, 19 nt, Homo sapiens
gaucgcagcaguuaccauu

SEQ ID NO: 1102930 - RNA, 19 nt, Homo sapiens
ugaaguuaccugauuguuu

SEQ ID NO: 1102931 - RNA, 19 nt, Homo sapiens
ucacauuuauggcauuugu

SEQ ID NO: 1102932 - RNA, 19 nt, Homo sapiens
gaaagacaaccccaagaua

SEQ ID NO: 1102933 - RNA, 19 nt, Homo sapiens
gagauaaagcuguguacug

SEQ ID NO: 1102934 - RNA, 19 nt, Homo sapiens
ccaagauaguacaugcuuu

SEQ ID NO: 1102935 - RNA, 19 nt, Homo sapiens
aacugcagcuuucacauuu

SEQ ID NO: 1102936 - RNA, 19 nt, Homo sapiens
aaacugcagcuuucacauu

SEQ ID NO: 1102937 - RNA, 19 nt, Homo sapiens
ugauaaaccuucacaucca

SEQ ID NO: 1102938 - RNA, 19 nt, Homo sapiens
gucgugaaguuaccugauu

SEQ ID NO: 1102939 - RNA, 19 nt, Homo sapiens
gcaaacugcagcuuucaca

SEQ ID NO: 1102940 - RNA, 19 nt, Homo sapiens
gaaacaucguggugcacau

SEQ ID NO: 1102941 - RNA, 19 nt, Homo sapiens
gcuguguacugccguuguu

SEQ ID NO: 1102942 - RNA, 19 nt, Homo sapiens
gaaugacuaccaccucugu

SEQ ID NO: 1102943 - RNA, 19 nt, Homo sapiens
gaagagacuggagacaaug

SEQ ID NO: 1102944 - RNA, 19 nt, Homo sapiens
uaccaccucugucugauuc

SEQ ID NO: 1102945 - RNA, 19 nt, Homo sapiens
guggugcacauuuguuuaa

SEQ ID NO: 1102946 - RNA, 19 nt, Homo sapiens
caauugguuaucuagcuua

SEQ ID NO: 1102947 - RNA, 19 nt, Homo sapiens
uauggcauuugucuuguug

SEQ ID NO: 1102948 - RNA, 19 nt, Homo sapiens
uggaggauuugggagauaa

SEQ ID NO: 1102949 - RNA, 19 nt, Homo sapiens
cugcagcuuucacauuuau

SEQ ID NO: 1102950 - RNA, 19 nt, Homo sapiens
gacaaugugggcccucuga

SEQ ID NO: 1102951 - RNA, 19 nt, Homo sapiens
uggcauuugucuuguugaa

SEQ ID NO: 1102952 - RNA, 19 nt, Homo sapiens
ucgcggagucggugcuuua

SEQ ID NO: 1102953 - RNA, 19 nt, Homo sapiens
ugugguauauugcaaacug

SEQ ID NO: 1102954 - RNA, 19 nt, Homo sapiens
uaugauaaaccuucacauc

SEQ ID NO: 1102955 - RNA, 19 nt, Homo sapiens
uugguuaucuagcuuacaa

SEQ ID NO: 1102956 - RNA, 19 nt, Homo sapiens
caagauaguacaugcuuuu

SEQ ID NO: 1102957 - RNA, 19 nt, Homo sapiens
ugggacagcugcaauuggu

SEQ ID NO: 1102958 - RNA, 19 nt, Homo sapiens
cagcugcaauugguuaucu

SEQ ID NO: 1102959 - RNA, 19 nt, Homo sapiens
gacuaccaccucugucuga

SEQ ID NO: 1102960 - RNA, 19 nt, Homo sapiens
ugauggggcucacacaaaa

SEQ ID NO: 1102961 - RNA, 19 nt, Homo sapiens
aaacaucguggugcacauu

SEQ ID NO: 1102962 - RNA, 19 nt, Homo sapiens
acugcagcuuucacauuua

SEQ ID NO: 1102963 - RNA, 19 nt, Homo sapiens
ugagcucgguauccuagug

SEQ ID NO: 1102964 - RNA, 19 nt, Homo sapiens
gcagcuuucacauuuaugg

SEQ ID NO: 1102965 - RNA, 19 nt, Homo sapiens
gauucaccuucgcuggauu

SEQ ID NO: 1102966 - RNA, 19 nt, Homo sapiens
acacaaaacauaacgaaga

SEQ ID NO: 1102967 - RNA, 19 nt, Homo sapiens
ggaggauuugggagauaaa

SEQ ID NO: 1102968 - RNA, 19 nt, Homo sapiens
gcguacgaguugaauggau

SEQ ID NO: 1102969 - RNA, 19 nt, Homo sapiens
ucgugaaguuaccugauug

SEQ ID NO: 1102970 - RNA, 19 nt, Homo sapiens
caaugugggcccucugauc

SEQ ID NO: 1102971 - RNA, 19 nt, Homo sapiens
cauggaggauuugggagau

SEQ ID NO: 1102972 - RNA, 19 nt, Homo sapiens
gauaguacaugcuuuugac

SEQ ID NO: 1102973 - RNA, 19 nt, Homo sapiens
gcuaugauaaaccuucaca

SEQ ID NO: 1102974 - RNA, 19 nt, Homo sapiens
ucaucgaaauaaagcuaug

SEQ ID NO: 1102975 - RNA, 19 nt, Homo sapiens
cagcguacgaguugaaugg

SEQ ID NO: 1102976 - RNA, 19 nt, Homo sapiens
ggauucuaaaugugguaua

SEQ ID NO: 1102977 - RNA, 19 nt, Homo sapiens
aaugugggcccucugauca

SEQ ID NO: 1102978 - RNA, 19 nt, Homo sapiens
ggugcacauuuguuuaaac

SEQ ID NO: 1102979 - RNA, 19 nt, Homo sapiens
cguggugcacauuuguuua

SEQ ID NO: 1102980 - RNA, 19 nt, Homo sapiens
ugaauggaucgcagcaguu

SEQ ID NO: 1102981 - RNA, 19 nt, Homo sapiens
aagcuaugauaaaccuuca

SEQ ID NO: 1102982 - RNA, 19 nt, Homo sapiens
cuaaaugugguauauugca

SEQ ID NO: 1102983 - RNA, 19 nt, Homo sapiens
gggaauuccucaaauauuu

SEQ ID NO: 1102984 - RNA, 19 nt, Homo sapiens
gcacagaauuauugacuug

SEQ ID NO: 1102985 - RNA, 19 nt, Homo sapiens
caagaggaaugaucacuuu

SEQ ID NO: 1102986 - RNA, 19 nt, Homo sapiens
gaaaugagggaaagacaaa

SEQ ID NO: 1102987 - RNA, 19 nt, Homo sapiens
gaaaggaacagaguagauu

SEQ ID NO: 1102988 - RNA, 19 nt, Homo sapiens
cagaguagauucuucauag

SEQ ID NO: 1102989 - RNA, 19 nt, Homo sapiens
gaacagaguagauucuuca

SEQ ID NO: 1102990 - RNA, 19 nt, Homo sapiens
caaaaggaguucaugcuua

SEQ ID NO: 1102991 - RNA, 19 nt, Homo sapiens
ucaaagcacagaauuauug

SEQ ID NO: 1102992 - RNA, 19 nt, Homo sapiens
ccagugugguuucccauaa

SEQ ID NO: 1102993 - RNA, 19 nt, Homo sapiens
gaaaucaugcuuaccaauc

SEQ ID NO: 1102994 - RNA, 19 nt, Homo sapiens
ggacauacuggaaacagaa

SEQ ID NO: 1102995 - RNA, 19 nt, Homo sapiens
ccaaucaaaucucaaagca

SEQ ID NO: 1102996 - RNA, 19 nt, Homo sapiens
ggaacagaguagauucuuc

SEQ ID NO: 1102997 - RNA, 19 nt, Homo sapiens
uuuaacagcuggagcgauu

SEQ ID NO: 1102998 - RNA, 19 nt, Homo sapiens
caaauggccaugcggauug

SEQ ID NO: 1102999 - RNA, 19 nt, Homo sapiens
cugcuuggcuuccaccuuu

SEQ ID NO: 1103000 - RNA, 19 nt, Homo sapiens
ggaaugaucacuuuugaaa

SEQ ID NO: 1103001 - RNA, 19 nt, Homo sapiens
ggaaaggcagcucaucaug

SEQ ID NO: 1103002 - RNA, 19 nt, Homo sapiens
ggucccgauuguuccauua

SEQ ID NO: 1103003 - RNA, 19 nt, Homo sapiens
aaaggcagcucaucaugca

SEQ ID NO: 1103004 - RNA, 19 nt, Homo sapiens
gcagccaucucuuuaacag

SEQ ID NO: 1103005 - RNA, 19 nt, Homo sapiens
aaaucaugcuuaccaauca

SEQ ID NO: 1103006 - RNA, 19 nt, Homo sapiens
ggagagcaaggcccagaaa

SEQ ID NO: 1103007 - RNA, 19 nt, Homo sapiens
uaacagcuggagcgauuaa

SEQ ID NO: 1103008 - RNA, 19 nt, Homo sapiens
gugcauuaccaauaucuaa

SEQ ID NO: 1103009 - RNA, 19 nt, Homo sapiens
caaagcacagaauuauuga

SEQ ID NO: 1103010 - RNA, 19 nt, Homo sapiens
guagauucuucauagacaa

SEQ ID NO: 1103011 - RNA, 19 nt, Homo sapiens
gaggaaugaucacuuuuga

SEQ ID NO: 1103012 - RNA, 19 nt, Homo sapiens
aggugaagcugaggacaua

SEQ ID NO: 1103013 - RNA, 19 nt, Homo sapiens
gagcaaggcccagaaagag

SEQ ID NO: 1103014 - RNA, 19 nt, Homo sapiens
gcaagauaguuuugagcua

SEQ ID NO: 1103015 - RNA, 19 nt, Homo sapiens
gagcguccucuaacacauu

SEQ ID NO: 1103016 - RNA, 19 nt, Homo sapiens
gcuuaugaaugcucgacuu

SEQ ID NO: 1103017 - RNA, 19 nt, Homo sapiens
ucucaaagcacagaauuau

SEQ ID NO: 1103018 - RNA, 19 nt, Homo sapiens
gcuuaccaaucaaaucuca

SEQ ID NO: 1103019 - RNA, 19 nt, Homo sapiens
gcugaggacauacuggaaa

SEQ ID NO: 1103020 - RNA, 19 nt, Homo sapiens
uaagcuuuauccucaccua

SEQ ID NO: 1103021 - RNA, 19 nt, Homo sapiens
uaacacauucagacuacaa

SEQ ID NO: 1103022 - RNA, 19 nt, Homo sapiens
cucgggaauuccucaaaua

SEQ ID NO: 1103023 - RNA, 19 nt, Homo sapiens
aaaaggaguucaugcuuau

SEQ ID NO: 1103024 - RNA, 19 nt, Homo sapiens
ucuaacacauucagacuac

SEQ ID NO: 1103025 - RNA, 19 nt, Homo sapiens
agaguagauucuucauaga

SEQ ID NO: 1103026 - RNA, 19 nt, Homo sapiens
ugacuugaaucaugguuuu

SEQ ID NO: 1103027 - RNA, 19 nt, Homo sapiens
ccagaaaggaacagaguag

SEQ ID NO: 1103028 - RNA, 19 nt, Homo sapiens
ccaagaggaaugaucacuu

SEQ ID NO: 1103029 - RNA, 19 nt, Homo sapiens
gaaagaaugaaaggugaag

SEQ ID NO: 1103030 - RNA, 19 nt, Homo sapiens
ggagcguccucuaacacau

SEQ ID NO: 1103031 - RNA, 19 nt, Homo sapiens
gcauuaccaauaucuaagu

SEQ ID NO: 1103032 - RNA, 19 nt, Homo sapiens
gauuguuccauuaagcuuu

SEQ ID NO: 1103033 - RNA, 19 nt, Homo sapiens
ucucgggaauuccucaaau

SEQ ID NO: 1103034 - RNA, 19 nt, Homo sapiens
ugaaaugagggaaagacaa

SEQ ID NO: 1103035 - RNA, 19 nt, Homo sapiens
acagaguagauucuucaua

SEQ ID NO: 1103036 - RNA, 19 nt, Homo sapiens
agagcaaggcccagaaaga

SEQ ID NO: 1103037 - RNA, 19 nt, Homo sapiens
cgggaauuccucaaauauu

SEQ ID NO: 1103038 - RNA, 19 nt, Homo sapiens
ucaccuaccaguaugacuu

SEQ ID NO: 1103039 - RNA, 19 nt, Homo sapiens
ccuugcagccaucucuuua

SEQ ID NO: 1103040 - RNA, 19 nt, Homo sapiens
acaaauggccaugcggauu

SEQ ID NO: 1103041 - RNA, 19 nt, Homo sapiens
ccagaaagaggucaaaaug

SEQ ID NO: 1103042 - RNA, 19 nt, Homo sapiens
gccagaaaggaacagagua

SEQ ID NO: 1103043 - RNA, 19 nt, Homo sapiens
gacauacuggaaacagaaa

SEQ ID NO: 1103044 - RNA, 19 nt, Homo sapiens
uauccucaccuaccaguau

SEQ ID NO: 1103045 - RNA, 19 nt, Homo sapiens
ucugugugcauuaccaaua

SEQ ID NO: 1103046 - RNA, 19 nt, Homo sapiens
gauucuucauagacaaaug

SEQ ID NO: 1103047 - RNA, 19 nt, Homo sapiens
caguaugacuugggcuaug

SEQ ID NO: 1103048 - RNA, 19 nt, Homo sapiens
caucaugcagagugaaaug

SEQ ID NO: 1103049 - RNA, 19 nt, Homo sapiens
cauuaccaauaucuaagug

SEQ ID NO: 1103050 - RNA, 19 nt, Homo sapiens
aguagauucuucauagaca

SEQ ID NO: 1103051 - RNA, 19 nt, Homo sapiens
cugugugcauuaccaauau

SEQ ID NO: 1103052 - RNA, 19 nt, Homo sapiens
aaucaugcuuaccaaucaa

SEQ ID NO: 1103053 - RNA, 19 nt, Homo sapiens
agaaaggaacagaguagau

SEQ ID NO: 1103054 - RNA, 19 nt, Homo sapiens
agagugaaaugagggaaag

SEQ ID NO: 1103055 - RNA, 19 nt, Homo sapiens
ucaaaucucaaagcacaga

SEQ ID NO: 1103056 - RNA, 19 nt, Homo sapiens
gaguagauucuucauagac

SEQ ID NO: 1103057 - RNA, 19 nt, Homo sapiens
cagagugaaaugagggaaa

SEQ ID NO: 1103058 - RNA, 19 nt, Homo sapiens
aaaggaacagaguagauuc

SEQ ID NO: 1103059 - RNA, 19 nt, Homo sapiens
uuagauuuccucucucugu

SEQ ID NO: 1103060 - RNA, 19 nt, Homo sapiens
aaucucaaagcacagaauu

SEQ ID NO: 1103061 - RNA, 19 nt, Homo sapiens
gggagcguccucuaacaca

SEQ ID NO: 1103062 - RNA, 19 nt, Homo sapiens
gcuuggcuuccaccuuuaa

SEQ ID NO: 1103063 - RNA, 19 nt, Homo sapiens
ugaaaucaugcuuaccaau

SEQ ID NO: 1103064 - RNA, 19 nt, Homo sapiens
gcagcugccaagaggaaug

SEQ ID NO: 1103065 - RNA, 19 nt, Homo sapiens
uaaauugcagcugccaaga

SEQ ID NO: 1103066 - RNA, 19 nt, Homo sapiens
ucgggaauuccucaaauau

SEQ ID NO: 1103067 - RNA, 19 nt, Homo sapiens
ggauaaaguuguuggauua

SEQ ID NO: 1103068 - RNA, 19 nt, Homo sapiens
gaaagcagaucuuguuauu

SEQ ID NO: 1103069 - RNA, 19 nt, Homo sapiens
ggucaucucuucuauugua

SEQ ID NO: 1103070 - RNA, 19 nt, Homo sapiens
gaaagaagacauucagaaa

SEQ ID NO: 1103071 - RNA, 19 nt, Homo sapiens
caaagcagcuacacaaaga

SEQ ID NO: 1103072 - RNA, 19 nt, Homo sapiens
guuagcaucuuuagcuuua

SEQ ID NO: 1103073 - RNA, 19 nt, Homo sapiens
cgacuuauccugcaaauug

SEQ ID NO: 1103074 - RNA, 19 nt, Homo sapiens
caaccuauguaaugugauu

SEQ ID NO: 1103075 - RNA, 19 nt, Homo sapiens
gaacagaguggaguggaua

SEQ ID NO: 1103076 - RNA, 19 nt, Homo sapiens
ggacuuaucaacacugaaa

SEQ ID NO: 1103077 - RNA, 19 nt, Homo sapiens
aagcagaucuuguuauuag

SEQ ID NO: 1103078 - RNA, 19 nt, Homo sapiens
acuaaacucucaacacuuu

SEQ ID NO: 1103079 - RNA, 19 nt, Homo sapiens
gaacaaucaucagcuggaa

SEQ ID NO: 1103080 - RNA, 19 nt, Homo sapiens
ccuagaaucucaaguggaa

SEQ ID NO: 1103081 - RNA, 19 nt, Homo sapiens
ucagaaagcagaucuuguu

SEQ ID NO: 1103082 - RNA, 19 nt, Homo sapiens
cguuuacucuggauguuua

SEQ ID NO: 1103083 - RNA, 19 nt, Homo sapiens
gauggauuaugcucuguga

SEQ ID NO: 1103084 - RNA, 19 nt, Homo sapiens
acacuaaacucucaacacu

SEQ ID NO: 1103085 - RNA, 19 nt, Homo sapiens
uaguugaucucuuguacuu

SEQ ID NO: 1103086 - RNA, 19 nt, Homo sapiens
uggauaaaguuguuggauu

SEQ ID NO: 1103087 - RNA, 19 nt, Homo sapiens
gcaaagcagcuacacaaag

SEQ ID NO: 1103088 - RNA, 19 nt, Homo sapiens
ggauuaugcucugugaaau

SEQ ID NO: 1103089 - RNA, 19 nt, Homo sapiens
ucacagugguaaugaaaca

SEQ ID NO: 1103090 - RNA, 19 nt, Homo sapiens
aaucgugccuaaugucaaa

SEQ ID NO: 1103091 - RNA, 19 nt, Homo sapiens
ccaaauucaaccuauguaa

SEQ ID NO: 1103092 - RNA, 19 nt, Homo sapiens
cagaaagcagaucuuguua

SEQ ID NO: 1103093 - RNA, 19 nt, Homo sapiens
agaguggaguggauauauu

SEQ ID NO: 1103094 - RNA, 19 nt, Homo sapiens
agggucaucucuucuauug

SEQ ID NO: 1103095 - RNA, 19 nt, Homo sapiens
gaguuagcaucuuuagcuu

SEQ ID NO: 1103096 - RNA, 19 nt, Homo sapiens
aaguggaauuggaaucaua

SEQ ID NO: 1103097 - RNA, 19 nt, Homo sapiens
ucaauggacuuaucaacac

SEQ ID NO: 1103098 - RNA, 19 nt, Homo sapiens
aaauaaucgugccuaaugu

SEQ ID NO: 1103099 - RNA, 19 nt, Homo sapiens
gguuugagaagaauaauca

SEQ ID NO: 1103100 - RNA, 19 nt, Homo sapiens
gcaguuuagugaaauuacu

SEQ ID NO: 1103101 - RNA, 19 nt, Homo sapiens
gaagcuguuuggagacucu

SEQ ID NO: 1103102 - RNA, 19 nt, Homo sapiens
aagaagacauucagaaagc

SEQ ID NO: 1103103 - RNA, 19 nt, Homo sapiens
ugucaaaacuuuacugguu

SEQ ID NO: 1103104 - RNA, 19 nt, Homo sapiens
guagggaccaccagcuuug

SEQ ID NO: 1103105 - RNA, 19 nt, Homo sapiens
caaccgacuuauccugcaa

SEQ ID NO: 1103106 - RNA, 19 nt, Homo sapiens
aaacugaugcauauaaugg

SEQ ID NO: 1103107 - RNA, 19 nt, Homo sapiens
uaugcucugugaaaugaaa

SEQ ID NO: 1103108 - RNA, 19 nt, Homo sapiens
guuuacagguacaaggauu

SEQ ID NO: 1103109 - RNA, 19 nt, Homo sapiens
gaucucuuguacuuggaaa

SEQ ID NO: 1103110 - RNA, 19 nt, Homo sapiens
gccaugaagugcguguuug

SEQ ID NO: 1103111 - RNA, 19 nt, Homo sapiens
aaaucgagagccuugguua

SEQ ID NO: 1103112 - RNA, 19 nt, Homo sapiens
gaguggaguggauauauuc

SEQ ID NO: 1103113 - RNA, 19 nt, Homo sapiens
guuaguugaucucuuguac

SEQ ID NO: 1103114 - RNA, 19 nt, Homo sapiens
gauuaugcucugugaaaug

SEQ ID NO: 1103115 - RNA, 19 nt, Homo sapiens
uggauuaugcucugugaaa

SEQ ID NO: 1103116 - RNA, 19 nt, Homo sapiens
uagaaucucaaguggaauu

SEQ ID NO: 1103117 - RNA, 19 nt, Homo sapiens
ugaagugcguguuuguuac

SEQ ID NO: 1103118 - RNA, 19 nt, Homo sapiens
uggcaaagcagcuacacaa

SEQ ID NO: 1103119 - RNA, 19 nt, Homo sapiens
cguagugguuauaaacgaa

SEQ ID NO: 1103120 - RNA, 19 nt, Homo sapiens
auuaugcucugugaaauga

SEQ ID NO: 1103121 - RNA, 19 nt, Homo sapiens
caaauccuaauugcaguuu

SEQ ID NO: 1103122 - RNA, 19 nt, Homo sapiens
gcagaucuuguuauuaguc

SEQ ID NO: 1103123 - RNA, 19 nt, Homo sapiens
augaagugcguguuuguua

SEQ ID NO: 1103124 - RNA, 19 nt, Homo sapiens
aaucucaaguggaauugga

SEQ ID NO: 1103125 - RNA, 19 nt, Homo sapiens
aaagaagacauucagaaag

SEQ ID NO: 1103126 - RNA, 19 nt, Homo sapiens
aagaugaucaaguuaguug

SEQ ID NO: 1103127 - RNA, 19 nt, Homo sapiens
cuuccuacaucuauagaau

SEQ ID NO: 1103128 - RNA, 19 nt, Homo sapiens
cagaucuuguuauuaguca

SEQ ID NO: 1103129 - RNA, 19 nt, Homo sapiens
ggcaaagcagcuacacaaa

SEQ ID NO: 1103130 - RNA, 19 nt, Homo sapiens
aaaauaaucgugccuaaug

SEQ ID NO: 1103131 - RNA, 19 nt, Homo sapiens
caaguggaauuggaaucau

SEQ ID NO: 1103132 - RNA, 19 nt, Homo sapiens
cagcuuugacgaccucauu

SEQ ID NO: 1103133 - RNA, 19 nt, Homo sapiens
gcgaucagggcuugaggaa

SEQ ID NO: 1103134 - RNA, 19 nt, Homo sapiens
ggaacuggcaaagcagcua

SEQ ID NO: 1103135 - RNA, 19 nt, Homo sapiens
guuaguuugauacuccuua

SEQ ID NO: 1103136 - RNA, 19 nt, Homo sapiens
guuugauacuccuuagaau

SEQ ID NO: 1103137 - RNA, 19 nt, Homo sapiens
gucaauggacuuaucaaca

SEQ ID NO: 1103138 - RNA, 19 nt, Homo sapiens
ucgagagccuugguuacaa

SEQ ID NO: 1103139 - RNA, 19 nt, Homo sapiens
agaaagcagaucuuguuau

SEQ ID NO: 1103140 - RNA, 19 nt, Homo sapiens
cgagagccuugguuacaac

SEQ ID NO: 1103141 - RNA, 19 nt, Homo sapiens
ucaaguggaauuggaauca

SEQ ID NO: 1103142 - RNA, 19 nt, Homo sapiens
gagggucaucucuucuauu

SEQ ID NO: 1103143 - RNA, 19 nt, Homo sapiens
uuuacugguuugagaagaa

SEQ ID NO: 1103144 - RNA, 19 nt, Homo sapiens
cagaguggaguggauauau

SEQ ID NO: 1103145 - RNA, 19 nt, Homo sapiens
aaucuucaguauguaguga

SEQ ID NO: 1103146 - RNA, 19 nt, Homo sapiens
aaacuuccuacaucuauag

SEQ ID NO: 1103147 - RNA, 19 nt, Homo sapiens
gaacaauaaacugaugcau

SEQ ID NO: 1103148 - RNA, 19 nt, Homo sapiens
ucucacagugguaaugaaa

SEQ ID NO: 1103149 - RNA, 19 nt, Homo sapiens
gacuuauccugcaaauugg

SEQ ID NO: 1103150 - RNA, 19 nt, Homo sapiens
uucaaccuauguaauguga

SEQ ID NO: 1103151 - RNA, 19 nt, Homo sapiens
guagugguuauaaacgaaa

SEQ ID NO: 1103152 - RNA, 19 nt, Homo sapiens
auaccaauaggacuuacua

SEQ ID NO: 1103153 - RNA, 19 nt, Homo sapiens
agaguuagcaucuuuagcu

SEQ ID NO: 1103154 - RNA, 19 nt, Homo sapiens
caauggacuuaucaacacu

SEQ ID NO: 1103155 - RNA, 19 nt, Homo sapiens
ugccuaaugucaaaacuuu

SEQ ID NO: 1103156 - RNA, 19 nt, Homo sapiens
agaacagaguggaguggau

SEQ ID NO: 1103157 - RNA, 19 nt, Homo sapiens
gcaggugcaggaagcuguu

SEQ ID NO: 1103158 - RNA, 19 nt, Homo sapiens
ccaaauccuaauugcaguu

SEQ ID NO: 1103159 - RNA, 19 nt, Homo sapiens
cucuggauguuuacaggua

SEQ ID NO: 1103160 - RNA, 19 nt, Homo sapiens
acacaaagagggucaucuc

SEQ ID NO: 1103161 - RNA, 19 nt, Homo sapiens
acgaaaaguugaugaacaa

SEQ ID NO: 1103162 - RNA, 19 nt, Homo sapiens
cacgcuuccugggcuguua

SEQ ID NO: 1103163 - RNA, 19 nt, Homo sapiens
cguagggaccaccagcuuu

SEQ ID NO: 1103164 - RNA, 19 nt, Homo sapiens
uuacugguuugagaagaau

SEQ ID NO: 1103165 - RNA, 19 nt, Homo sapiens
gguuauaaacgaaaaguug

SEQ ID NO: 1103166 - RNA, 19 nt, Homo sapiens
aaucaugccuaaacucaaa

SEQ ID NO: 1103167 - RNA, 19 nt, Homo sapiens
caucagaaccuccaggaaa

SEQ ID NO: 1103168 - RNA, 19 nt, Homo sapiens
cgucgaggcuggagcuaaa

SEQ ID NO: 1103169 - RNA, 19 nt, Homo sapiens
ccacaaagacggugcaucu

SEQ ID NO: 1103170 - RNA, 19 nt, Homo sapiens
ugccuaaacucaaauaaag

SEQ ID NO: 1103171 - RNA, 19 nt, Homo sapiens
cugaggugaucaaugaaua

SEQ ID NO: 1103172 - RNA, 19 nt, Homo sapiens
gagauggacguaaggaaga

SEQ ID NO: 1103173 - RNA, 19 nt, Homo sapiens
agaaagcacuggccaacca

SEQ ID NO: 1103174 - RNA, 19 nt, Homo sapiens
gaagguggauuuucugaag

SEQ ID NO: 1103175 - RNA, 19 nt, Homo sapiens
ccagcgagaugcggaguga

SEQ ID NO: 1103176 - RNA, 19 nt, Homo sapiens
cgaaucaugccuaaacuca

SEQ ID NO: 1103177 - RNA, 19 nt, Homo sapiens
cgagcaaaccggccucuga

SEQ ID NO: 1103178 - RNA, 19 nt, Homo sapiens
gaccuccuccucagagaaa

SEQ ID NO: 1103179 - RNA, 19 nt, Homo sapiens
gagcagcacacgcagaagu

SEQ ID NO: 1103180 - RNA, 19 nt, Homo sapiens
gaugcggagugagcuacua

SEQ ID NO: 1103181 - RNA, 19 nt, Homo sapiens
gaggugaucaaugaauauu

SEQ ID NO: 1103182 - RNA, 19 nt, Homo sapiens
ucauucgaaucaugccuaa

SEQ ID NO: 1103183 - RNA, 19 nt, Homo sapiens
cccagagugucaucaagaa

SEQ ID NO: 1103184 - RNA, 19 nt, Homo sapiens
cugcagagccugagaugga

SEQ ID NO: 1103185 - RNA, 19 nt, Homo sapiens
gaaucaugccuaaacucaa

SEQ ID NO: 1103186 - RNA, 19 nt, Homo sapiens
ggucccagccagugaguga

SEQ ID NO: 1103187 - RNA, 19 nt, Homo sapiens
ggugaucaaugaauauucc

SEQ ID NO: 1103188 - RNA, 19 nt, Homo sapiens
gaagguccacgcgagcaaa

SEQ ID NO: 1103189 - RNA, 19 nt, Homo sapiens
ccucuucauucgaaucaug

SEQ ID NO: 1103190 - RNA, 19 nt, Homo sapiens
gcccagagugucaucaaga

SEQ ID NO: 1103191 - RNA, 19 nt, Homo sapiens
gaaccuggagaaacugaag

SEQ ID NO: 1103192 - RNA, 19 nt, Homo sapiens
aggaaaagcuggcggaaga

SEQ ID NO: 1103193 - RNA, 19 nt, Homo sapiens
gcucugggccaugcucauu

SEQ ID NO: 1103194 - RNA, 19 nt, Homo sapiens
gaaaauggcggaccagaac

SEQ ID NO: 1103195 - RNA, 19 nt, Homo sapiens
aguggcgccuggagaagua

SEQ ID NO: 1103196 - RNA, 19 nt, Homo sapiens
agagugucaucaagaagga

SEQ ID NO: 1103197 - RNA, 19 nt, Homo sapiens
ucugggccaugcucauuau

SEQ ID NO: 1103198 - RNA, 19 nt, Homo sapiens
gggccaugcucauuaucgu

SEQ ID NO: 1103199 - RNA, 19 nt, Homo sapiens
uaucgucugcuucaucuuc

SEQ ID NO: 1103200 - RNA, 19 nt, Homo sapiens
aaagcuggcggaagagaug

SEQ ID NO: 1103201 - RNA, 19 nt, Homo sapiens
guacgugggagcccuagag

SEQ ID NO: 1103202 - RNA, 19 nt, Homo sapiens
gccuaaacucaaauaaaga

SEQ ID NO: 1103203 - RNA, 19 nt, Homo sapiens
ugaggugaucaaugaauau

SEQ ID NO: 1103204 - RNA, 19 nt, Homo sapiens
gaacagagccaaaucaaag

SEQ ID NO: 1103205 - RNA, 19 nt, Homo sapiens
gcgcaaacguccauaacug

SEQ ID NO: 1103206 - RNA, 19 nt, Homo sapiens
caauaaaggacccuaacuu

SEQ ID NO: 1103207 - RNA, 19 nt, Homo sapiens
caaagaagacuacaaucuc

SEQ ID NO: 1103208 - RNA, 19 nt, Homo sapiens
gcaaacguccauaacugaa

SEQ ID NO: 1103209 - RNA, 19 nt, Homo sapiens
gugcucaccuccuggauca

SEQ ID NO: 1103210 - RNA, 19 nt, Homo sapiens
ccaaagaagacuacaaucu

SEQ ID NO: 1103211 - RNA, 19 nt, Homo sapiens
gcccaaagaagacuacaau

SEQ ID NO: 1103212 - RNA, 19 nt, Homo sapiens
ggacaggcuccuuaaagca

SEQ ID NO: 1103213 - RNA, 19 nt, Homo sapiens
acuacaaucuccagggaaa

SEQ ID NO: 1103214 - RNA, 19 nt, Homo sapiens
gcugugggcuuccucuucu

SEQ ID NO: 1103215 - RNA, 19 nt, Homo sapiens
cuaccucuccuucaccaua

SEQ ID NO: 1103216 - RNA, 19 nt, Homo sapiens
caaacguccauaacugaaa

SEQ ID NO: 1103217 - RNA, 19 nt, Homo sapiens
aaacguccauaacugaaag

SEQ ID NO: 1103218 - RNA, 19 nt, Homo sapiens
gucaacaucuucugguucu

SEQ ID NO: 1103219 - RNA, 19 nt, Homo sapiens
caacaucuucugguucuuc

SEQ ID NO: 1103220 - RNA, 19 nt, Homo sapiens
gguuugcuuuccugccuuu

SEQ ID NO: 1103221 - RNA, 19 nt, Homo sapiens
ccugacaacuucugcacau

SEQ ID NO: 1103222 - RNA, 19 nt, Homo sapiens
cagaacagagccaaaucaa

SEQ ID NO: 1103223 - RNA, 19 nt, Homo sapiens
gacaacuucugcacauacu

SEQ ID NO: 1103224 - RNA, 19 nt, Homo sapiens
caaaucaaaggcuaugucu

SEQ ID NO: 1103225 - RNA, 19 nt, Homo sapiens
gggcgugguuguucgugau

SEQ ID NO: 1103226 - RNA, 19 nt, Homo sapiens
cacguucucugcugacauc

SEQ ID NO: 1103227 - RNA, 19 nt, Homo sapiens
acacagaacagagccaaau

SEQ ID NO: 1103228 - RNA, 19 nt, Homo sapiens
cucaaacuccuaagacuug

SEQ ID NO: 1103229 - RNA, 19 nt, Homo sapiens
gggacuaccucuccuucac

SEQ ID NO: 1103230 - RNA, 19 nt, Homo sapiens
agaacagagccaaaucaaa

SEQ ID NO: 1103231 - RNA, 19 nt, Homo sapiens
ccuccuggaucaccaucuu

SEQ ID NO: 1103232 - RNA, 19 nt, Homo sapiens
ccaaaucaaaggcuauguc

SEQ ID NO: 1103233 - RNA, 19 nt, Homo sapiens
cgcaaacguccauaacuga

SEQ ID NO: 1103234 - RNA, 19 nt, Homo sapiens
cugacaacuucugcacaua

SEQ ID NO: 1103235 - RNA, 19 nt, Homo sapiens
ccuugcaucuguuacuuag

SEQ ID NO: 1103236 - RNA, 19 nt, Homo sapiens
ccuaagacuuguuuucaug

SEQ ID NO: 1103237 - RNA, 19 nt, Homo sapiens
acagaacagagccaaauca

SEQ ID NO: 1103238 - RNA, 19 nt, Homo sapiens
gugauccuugcaucuguua

SEQ ID NO: 1103239 - RNA, 19 nt, Homo sapiens
ugacaacuucugcacauac

SEQ ID NO: 1103240 - RNA, 19 nt, Homo sapiens
uaacugaaaguagcuaagg

SEQ ID NO: 1103241 - RNA, 19 nt, Homo sapiens
cgugauccuugcaucuguu

SEQ ID NO: 1103242 - RNA, 19 nt, Homo sapiens
uguccaaugaggagaaauu

SEQ ID NO: 1103243 - RNA, 19 nt, Homo sapiens
cauaacugaaaguagcuaa

SEQ ID NO: 1103244 - RNA, 19 nt, Homo sapiens
ucucaaacuccuaagacuu

SEQ ID NO: 1103245 - RNA, 19 nt, Homo sapiens
ugucccagccuacacagaa

SEQ ID NO: 1103246 - RNA, 19 nt, Homo sapiens
gaaccugugccggaaguac

SEQ ID NO: 1103247 - RNA, 19 nt, Homo sapiens
gaacugcucucuuuaauua

SEQ ID NO: 1103248 - RNA, 19 nt, Homo sapiens
gagcaaagcugaacaacuu

SEQ ID NO: 1103249 - RNA, 19 nt, Homo sapiens
ggucugaucuggugucuaa

SEQ ID NO: 1103250 - RNA, 19 nt, Homo sapiens
caaguaagauuaugagguu

SEQ ID NO: 1103251 - RNA, 19 nt, Homo sapiens
caaggacucuggauugauu

SEQ ID NO: 1103252 - RNA, 19 nt, Homo sapiens
cuaagaagauccaaaugaa

SEQ ID NO: 1103253 - RNA, 19 nt, Homo sapiens
caacagagacagaguuuau

SEQ ID NO: 1103254 - RNA, 19 nt, Homo sapiens
agaagaaacuggagcaaga

SEQ ID NO: 1103255 - RNA, 19 nt, Homo sapiens
gaaguaaaccuaauaccau

SEQ ID NO: 1103256 - RNA, 19 nt, Homo sapiens
caaaggagaccauggaaga

SEQ ID NO: 1103257 - RNA, 19 nt, Homo sapiens
gaucuggugucuaagaaga

SEQ ID NO: 1103258 - RNA, 19 nt, Homo sapiens
gagaaauacuggucugauc

SEQ ID NO: 1103259 - RNA, 19 nt, Homo sapiens
gaagcaaguagccauagua

SEQ ID NO: 1103260 - RNA, 19 nt, Homo sapiens
gcugcucacuguugaagua

SEQ ID NO: 1103261 - RNA, 19 nt, Homo sapiens
ugacggaacuugacaugug

SEQ ID NO: 1103262 - RNA, 19 nt, Homo sapiens
caaaugaaacucagccaaa

SEQ ID NO: 1103263 - RNA, 19 nt, Homo sapiens
gugaaugccuugcuuggaa

SEQ ID NO: 1103264 - RNA, 19 nt, Homo sapiens
gacaggagcguaugugaaa

SEQ ID NO: 1103265 - RNA, 19 nt, Homo sapiens
caucgaacaaguaagauua

SEQ ID NO: 1103266 - RNA, 19 nt, Homo sapiens
gcaaaugagcacaguaaga

SEQ ID NO: 1103267 - RNA, 19 nt, Homo sapiens
caacuugccuccucuacuc

SEQ ID NO: 1103268 - RNA, 19 nt, Homo sapiens
uacaauggguccuuucuga

SEQ ID NO: 1103269 - RNA, 19 nt, Homo sapiens
caucaaacacugcacauga

SEQ ID NO: 1103270 - RNA, 19 nt, Homo sapiens
caugaugggugaugucaga

SEQ ID NO: 1103271 - RNA, 19 nt, Homo sapiens
gcaccuugccugaacauga

SEQ ID NO: 1103272 - RNA, 19 nt, Homo sapiens
guaaggacagugggauuua

SEQ ID NO: 1103273 - RNA, 19 nt, Homo sapiens
acagagacagaguuuauua

SEQ ID NO: 1103274 - RNA, 19 nt, Homo sapiens
caaaccaucccaagccuuu

SEQ ID NO: 1103275 - RNA, 19 nt, Homo sapiens
gaaugucagugugcaaugu

SEQ ID NO: 1103276 - RNA, 19 nt, Homo sapiens
cagcaaaugagcacaguaa

SEQ ID NO: 1103277 - RNA, 19 nt, Homo sapiens
caugguggauccagaaguu

SEQ ID NO: 1103278 - RNA, 19 nt, Homo sapiens
gaaauuggcaaagaagguu

SEQ ID NO: 1103279 - RNA, 19 nt, Homo sapiens
ccugaagguuggagaaauu

SEQ ID NO: 1103280 - RNA, 19 nt, Homo sapiens
ggucaucgaacaaguaaga

SEQ ID NO: 1103281 - RNA, 19 nt, Homo sapiens
ggaggucaucgaacaagua

SEQ ID NO: 1103282 - RNA, 19 nt, Homo sapiens
gaaacucagccaaauaaag

SEQ ID NO: 1103283 - RNA, 19 nt, Homo sapiens
guuuaaagcugcauucaac

SEQ ID NO: 1103284 - RNA, 19 nt, Homo sapiens
ccaagccuuucaccaauga

SEQ ID NO: 1103285 - RNA, 19 nt, Homo sapiens
gaccgaguaugguaugguu

SEQ ID NO: 1103286 - RNA, 19 nt, Homo sapiens
gaacaaguaagauuaugag

SEQ ID NO: 1103287 - RNA, 19 nt, Homo sapiens
ggaagcaaguagccauagu

SEQ ID NO: 1103288 - RNA, 19 nt, Homo sapiens
ggacagcgaugaggaaucc

SEQ ID NO: 1103289 - RNA, 19 nt, Homo sapiens
gcaaguagccauaguacac

SEQ ID NO: 1103290 - RNA, 19 nt, Homo sapiens
gaacaacuugccuccucua

SEQ ID NO: 1103291 - RNA, 19 nt, Homo sapiens
cgacugaccgaguauggua

SEQ ID NO: 1103292 - RNA, 19 nt, Homo sapiens
gccugaacaugacuuuaaa

SEQ ID NO: 1103293 - RNA, 19 nt, Homo sapiens
gaugggugaugucagaugu

SEQ ID NO: 1103294 - RNA, 19 nt, Homo sapiens
gcauucaacgucaaaauua

SEQ ID NO: 1103295 - RNA, 19 nt, Homo sapiens
gcuaucagcuuggguaagg

SEQ ID NO: 1103296 - RNA, 19 nt, Homo sapiens
aaauaaagcuccccuacuu

SEQ ID NO: 1103297 - RNA, 19 nt, Homo sapiens
gcagauuucccuuccugaa

SEQ ID NO: 1103298 - RNA, 19 nt, Homo sapiens
caaaugagcacaguaagag

SEQ ID NO: 1103299 - RNA, 19 nt, Homo sapiens
cagacuggauagagaagaa

SEQ ID NO: 1103300 - RNA, 19 nt, Homo sapiens
uggagaaauuggcaaagaa

SEQ ID NO: 1103301 - RNA, 19 nt, Homo sapiens
aaaugaaacucagccaaau

SEQ ID NO: 1103302 - RNA, 19 nt, Homo sapiens
acagugggauuuaugugaa

SEQ ID NO: 1103303 - RNA, 19 nt, Homo sapiens
ucauuucggugacagaaga

SEQ ID NO: 1103304 - RNA, 19 nt, Homo sapiens
gugacagacuggauagaga

SEQ ID NO: 1103305 - RNA, 19 nt, Homo sapiens
gaggucaucgaacaaguaa

SEQ ID NO: 1103306 - RNA, 19 nt, Homo sapiens
ucuaagaagauccaaauga

SEQ ID NO: 1103307 - RNA, 19 nt, Homo sapiens
gacagugggauuuauguga

SEQ ID NO: 1103308 - RNA, 19 nt, Homo sapiens
uaaggacagugggauuuau

SEQ ID NO: 1103309 - RNA, 19 nt, Homo sapiens
gguaaggacagugggauuu

SEQ ID NO: 1103310 - RNA, 19 nt, Homo sapiens
gaagaaguugccagagguu

SEQ ID NO: 1103311 - RNA, 19 nt, Homo sapiens
gcucacuguugaaguacaa

SEQ ID NO: 1103312 - RNA, 19 nt, Homo sapiens
gacuuuaguucaugugaca

SEQ ID NO: 1103313 - RNA, 19 nt, Homo sapiens
gaaauacuggucugaucug

SEQ ID NO: 1103314 - RNA, 19 nt, Homo sapiens
cgaacaaguaagauuauga

SEQ ID NO: 1103315 - RNA, 19 nt, Homo sapiens
gucagaauguuuaguuuac

SEQ ID NO: 1103316 - RNA, 19 nt, Homo sapiens
gcuagcuaaucuugaaugu

SEQ ID NO: 1103317 - RNA, 19 nt, Homo sapiens
ccacagcugggaagaaguu

SEQ ID NO: 1103318 - RNA, 19 nt, Homo sapiens
cagagacagaguuuauuaa

SEQ ID NO: 1103319 - RNA, 19 nt, Homo sapiens
ucuguguccuccagguuua

SEQ ID NO: 1103320 - RNA, 19 nt, Homo sapiens
cagcuacuguuucuuaagg

SEQ ID NO: 1103321 - RNA, 19 nt, Homo sapiens
cgaagaagucuccaacaca

SEQ ID NO: 1103322 - RNA, 19 nt, Homo sapiens
aaaagaagaucgaagaagu

SEQ ID NO: 1103323 - RNA, 19 nt, Homo sapiens
gcaacagagacagaguuua

SEQ ID NO: 1103324 - RNA, 19 nt, Homo sapiens
guaagauuaugagguuugu

SEQ ID NO: 1103325 - RNA, 19 nt, Homo sapiens
uuacguugaucaccaagga

SEQ ID NO: 1103326 - RNA, 19 nt, Homo sapiens
gagacaggagcguauguga

SEQ ID NO: 1103327 - RNA, 19 nt, Homo sapiens
ggagaaauuggcaaagaag

SEQ ID NO: 1103328 - RNA, 19 nt, Homo sapiens
caauggguccuuucugaug

SEQ ID NO: 1103329 - RNA, 19 nt, Homo sapiens
caccaaggacucuggauug

SEQ ID NO: 1103330 - RNA, 19 nt, Homo sapiens
aaugaaacucagccaaaua

SEQ ID NO: 1103331 - RNA, 19 nt, Homo sapiens
gugucagaauguuuaguuu

SEQ ID NO: 1103332 - RNA, 19 nt, Homo sapiens
cauggaugauguuuauauc

SEQ ID NO: 1103333 - RNA, 19 nt, Homo sapiens
ugaugacucucgagaccaa

SEQ ID NO: 1103334 - RNA, 19 nt, Homo sapiens
uuggaaauguccuacaaug

SEQ ID NO: 1103335 - RNA, 19 nt, Homo sapiens
cauguuugaacccuuauuu

SEQ ID NO: 1103336 - RNA, 19 nt, Homo sapiens
ucgagaaguaaaccuaaua

SEQ ID NO: 1103337 - RNA, 19 nt, Homo sapiens
uaagagcaaagcugaacaa

SEQ ID NO: 1103338 - RNA, 19 nt, Homo sapiens
gguggauccagaaguuaua

SEQ ID NO: 1103339 - RNA, 19 nt, Homo sapiens
ugacagacuggauagagaa

SEQ ID NO: 1103340 - RNA, 19 nt, Homo sapiens
aauggguccuuucugauga

SEQ ID NO: 1103341 - RNA, 19 nt, Homo sapiens
gcaucacacuacaucucaa

SEQ ID NO: 1103342 - RNA, 19 nt, Homo sapiens
augaaacucagccaaauaa

SEQ ID NO: 1103343 - RNA, 19 nt, Homo sapiens
ugccugaacaugacuuuaa

SEQ ID NO: 1103344 - RNA, 19 nt, Homo sapiens
ggauggguccucucauaca

SEQ ID NO: 1103345 - RNA, 19 nt, Homo sapiens
gaaccuuggcggucaacau

SEQ ID NO: 1103346 - RNA, 19 nt, Homo sapiens
gaggaaccuuggcggucaa

SEQ ID NO: 1103347 - RNA, 19 nt, Homo sapiens
acaaaucgcuuuacaagaa

SEQ ID NO: 1103348 - RNA, 19 nt, Homo sapiens
ggaaaugccuacacaaauc

SEQ ID NO: 1103349 - RNA, 19 nt, Homo sapiens
cuaaugaccacacuauuua

SEQ ID NO: 1103350 - RNA, 19 nt, Homo sapiens
ggucucagcuccaauuuua

SEQ ID NO: 1103351 - RNA, 19 nt, Homo sapiens
gcuaaugaccacacuauuu

SEQ ID NO: 1103352 - RNA, 19 nt, Homo sapiens
gaagagaaaucgcuguaac

SEQ ID NO: 1103353 - RNA, 19 nt, Homo sapiens
gcagucaaguucccuauca

SEQ ID NO: 1103354 - RNA, 19 nt, Homo sapiens
gaaguuggccgucgaagug

SEQ ID NO: 1103355 - RNA, 19 nt, Homo sapiens
ugucugaucuguucuagaa

SEQ ID NO: 1103356 - RNA, 19 nt, Homo sapiens
ggcaugaagugaagagaaa

SEQ ID NO: 1103357 - RNA, 19 nt, Homo sapiens
caaaucgcuuuacaagaaa

SEQ ID NO: 1103358 - RNA, 19 nt, Homo sapiens
gaacuggaaccaacgagaa

SEQ ID NO: 1103359 - RNA, 19 nt, Homo sapiens
ucuccacucucuagaaaua

SEQ ID NO: 1103360 - RNA, 19 nt, Homo sapiens
caaaaugucugaucuguuc

SEQ ID NO: 1103361 - RNA, 19 nt, Homo sapiens
uaacaggcaugaagugaag

SEQ ID NO: 1103362 - RNA, 19 nt, Homo sapiens
gacauucaguucucggaaa

SEQ ID NO: 1103363 - RNA, 19 nt, Homo sapiens
gcacuuccuugaacagagu

SEQ ID NO: 1103364 - RNA, 19 nt, Homo sapiens
gcauggcuauggugaggaa

SEQ ID NO: 1103365 - RNA, 19 nt, Homo sapiens
uaucaggauucgauucuug

SEQ ID NO: 1103366 - RNA, 19 nt, Homo sapiens
cuacacaaaucgcuuuaca

SEQ ID NO: 1103367 - RNA, 19 nt, Homo sapiens
gaacggacucaccaggaaa

SEQ ID NO: 1103368 - RNA, 19 nt, Homo sapiens
ugaacggacucaccaggaa

SEQ ID NO: 1103369 - RNA, 19 nt, Homo sapiens
gaacccuaauauuaaagga

SEQ ID NO: 1103370 - RNA, 19 nt, Homo sapiens
gcagcaccuuucucaaugu

SEQ ID NO: 1103371 - RNA, 19 nt, Homo sapiens
gaagacagcaaagcagaug

SEQ ID NO: 1103372 - RNA, 19 nt, Homo sapiens
uuucaggcaucauuacaaa

SEQ ID NO: 1103373 - RNA, 19 nt, Homo sapiens
gcaccuuucucaauguucu

SEQ ID NO: 1103374 - RNA, 19 nt, Homo sapiens
cgaggugguuaguguuuau

SEQ ID NO: 1103375 - RNA, 19 nt, Homo sapiens
aggcuaggcugcugcugua

SEQ ID NO: 1103376 - RNA, 19 nt, Homo sapiens
ucucuccacucucuagaaa

SEQ ID NO: 1103377 - RNA, 19 nt, Homo sapiens
gcucugcacugggcaagga

SEQ ID NO: 1103378 - RNA, 19 nt, Homo sapiens
acacaaaucgcuuuacaag

SEQ ID NO: 1103379 - RNA, 19 nt, Homo sapiens
ucaaggacauucaguucuc

SEQ ID NO: 1103380 - RNA, 19 nt, Homo sapiens
ugaccacacuauuuaacga

SEQ ID NO: 1103381 - RNA, 19 nt, Homo sapiens
gcacugggcaaggaaguug

SEQ ID NO: 1103382 - RNA, 19 nt, Homo sapiens
guaacaggcaugaagugaa

SEQ ID NO: 1103383 - RNA, 19 nt, Homo sapiens
ggugguuaguguuuauuuc

SEQ ID NO: 1103384 - RNA, 19 nt, Homo sapiens
caauaaggauacacaucuc

SEQ ID NO: 1103385 - RNA, 19 nt, Homo sapiens
aaucggaaaugccuacaca

SEQ ID NO: 1103386 - RNA, 19 nt, Homo sapiens
gugaagagaaaucgcugua

SEQ ID NO: 1103387 - RNA, 19 nt, Homo sapiens
ucaauaaggauacacaucu

SEQ ID NO: 1103388 - RNA, 19 nt, Homo sapiens
cagcaccuuucucaauguu

SEQ ID NO: 1103389 - RNA, 19 nt, Homo sapiens
agacugcacuuccuugaac

SEQ ID NO: 1103390 - RNA, 19 nt, Homo sapiens
uaaacaagacaacgcugaa

SEQ ID NO: 1103391 - RNA, 19 nt, Homo sapiens
ccacucucuagaaauauua

SEQ ID NO: 1103392 - RNA, 19 nt, Homo sapiens
ugaaggaaauggugaugcu

SEQ ID NO: 1103393 - RNA, 19 nt, Homo sapiens
gcacuuccacuccugucaa

SEQ ID NO: 1103394 - RNA, 19 nt, Homo sapiens
guaacaggaagacagcaaa

SEQ ID NO: 1103395 - RNA, 19 nt, Homo sapiens
cuaggcugcugcuguaugu

SEQ ID NO: 1103396 - RNA, 19 nt, Homo sapiens
ucgaggugguuaguguuua

SEQ ID NO: 1103397 - RNA, 19 nt, Homo sapiens
cggaaaugccuacacaaau

SEQ ID NO: 1103398 - RNA, 19 nt, Homo sapiens
gaaaugccuacacaaaucg

SEQ ID NO: 1103399 - RNA, 19 nt, Homo sapiens
uaucaaggacauucaguuc

SEQ ID NO: 1103400 - RNA, 19 nt, Homo sapiens
ucaaguucccuaucaagga

SEQ ID NO: 1103401 - RNA, 19 nt, Homo sapiens
ggaaguuggccgucgaagu

SEQ ID NO: 1103402 - RNA, 19 nt, Homo sapiens
aagcagcaccuuucucaau

SEQ ID NO: 1103403 - RNA, 19 nt, Homo sapiens
ucggaaaugccuacacaaa

SEQ ID NO: 1103404 - RNA, 19 nt, Homo sapiens
ggaagacagcaaagcagau

SEQ ID NO: 1103405 - RNA, 19 nt, Homo sapiens
gauucgauucuugguguua

SEQ ID NO: 1103406 - RNA, 19 nt, Homo sapiens
ccacuccugucaagucucu

SEQ ID NO: 1103407 - RNA, 19 nt, Homo sapiens
gaugcaguggccagaagua

SEQ ID NO: 1103408 - RNA, 19 nt, Homo sapiens
ggugacaauucuucuuggu

SEQ ID NO: 1103409 - RNA, 19 nt, Homo sapiens
caggugacaauucuucuug

SEQ ID NO: 1103410 - RNA, 19 nt, Homo sapiens
ggauucgauucuugguguu

SEQ ID NO: 1103411 - RNA, 19 nt, Homo sapiens
gaccacacuauuuaacgaa

SEQ ID NO: 1103412 - RNA, 19 nt, Homo sapiens
caccaggaaacgugacuuu

SEQ ID NO: 1103413 - RNA, 19 nt, Homo sapiens
ugaagaagccgaguaacag

SEQ ID NO: 1103414 - RNA, 19 nt, Homo sapiens
ccucugcuguaucaggauu

SEQ ID NO: 1103415 - RNA, 19 nt, Homo sapiens
uguccgaccucugcuguau

SEQ ID NO: 1103416 - RNA, 19 nt, Homo sapiens
ugaagagaaaucgcuguaa

SEQ ID NO: 1103417 - RNA, 19 nt, Homo sapiens
agcagcaccuuucucaaug

SEQ ID NO: 1103418 - RNA, 19 nt, Homo sapiens
uccacucucuagaaauauu

SEQ ID NO: 1103419 - RNA, 19 nt, Homo sapiens
guucaggugacaauucuuc

SEQ ID NO: 1103420 - RNA, 19 nt, Homo sapiens
guaucaggauucgauucuu

SEQ ID NO: 1103421 - RNA, 19 nt, Homo sapiens
gugguuaguguuuauuuca

SEQ ID NO: 1103422 - RNA, 19 nt, Homo sapiens
uccgaccucugcuguauca

SEQ ID NO: 1103423 - RNA, 19 nt, Homo sapiens
gaguaacaggcaugaagug

SEQ ID NO: 1103424 - RNA, 19 nt, Homo sapiens
cugaagaagccgaguaaca

SEQ ID NO: 1103425 - RNA, 19 nt, Homo sapiens
cagucaaguucccuaucaa

SEQ ID NO: 1103426 - RNA, 19 nt, Homo sapiens
ggaguugaaccuguugcuu

SEQ ID NO: 1103427 - RNA, 19 nt, Homo sapiens
cuaguccccucuucuauga

SEQ ID NO: 1103428 - RNA, 19 nt, Homo sapiens
aguugaaccuguugcuugu

SEQ ID NO: 1103429 - RNA, 19 nt, Homo sapiens
uuuccuggccaaucugaua

SEQ ID NO: 1103430 - RNA, 19 nt, Homo sapiens
uaacaggaagacagcaaag

SEQ ID NO: 1103431 - RNA, 19 nt, Homo sapiens
cgaguaacaggcaugaagu

SEQ ID NO: 1103432 - RNA, 19 nt, Homo sapiens
gcuaggcugcugcuguaug

SEQ ID NO: 1103433 - RNA, 19 nt, Homo sapiens
caagaugcaguggccagaa

SEQ ID NO: 1103434 - RNA, 19 nt, Homo sapiens
cacaaaucgcuuuacaaga

SEQ ID NO: 1103435 - RNA, 19 nt, Homo sapiens
ccacacuauuuaacgaacu

SEQ ID NO: 1103436 - RNA, 19 nt, Homo sapiens
aagaugcaguggccagaag

SEQ ID NO: 1103437 - RNA, 19 nt, Homo sapiens
gcacauauacuucagauaa

SEQ ID NO: 1103438 - RNA, 19 nt, Homo sapiens
caacaaguauggcugguuu

SEQ ID NO: 1103439 - RNA, 19 nt, Homo sapiens
gaagaaggaugacaagaag

SEQ ID NO: 1103440 - RNA, 19 nt, Homo sapiens
caucuucucuucugacuuu

SEQ ID NO: 1103441 - RNA, 19 nt, Homo sapiens
aaggaaagcugacuucaaa

SEQ ID NO: 1103442 - RNA, 19 nt, Homo sapiens
ggauuuggaugaacuagaa

SEQ ID NO: 1103443 - RNA, 19 nt, Homo sapiens
gaaagauucagcacauaua

SEQ ID NO: 1103444 - RNA, 19 nt, Homo sapiens
gcaaagcaacagaaguuua

SEQ ID NO: 1103445 - RNA, 19 nt, Homo sapiens
cagaguaguucaugauaaa

SEQ ID NO: 1103446 - RNA, 19 nt, Homo sapiens
guaugcagauucaguauug

SEQ ID NO: 1103447 - RNA, 19 nt, Homo sapiens
caaauagugugcaagcauu

SEQ ID NO: 1103448 - RNA, 19 nt, Homo sapiens
gagcaaagcaacagaaguu

SEQ ID NO: 1103449 - RNA, 19 nt, Homo sapiens
ggagauaaguguaaguucu

SEQ ID NO: 1103450 - RNA, 19 nt, Homo sapiens
guccugaacuggucaauga

SEQ ID NO: 1103451 - RNA, 19 nt, Homo sapiens
uaaaugagcuguucaaacc

SEQ ID NO: 1103452 - RNA, 19 nt, Homo sapiens
caaauuaagugaagcuucu

SEQ ID NO: 1103453 - RNA, 19 nt, Homo sapiens
gugaugagguugaugauuc

SEQ ID NO: 1103454 - RNA, 19 nt, Homo sapiens
gcacuguacuucauaaagg

SEQ ID NO: 1103455 - RNA, 19 nt, Homo sapiens
gaucaguggucgugaagug

SEQ ID NO: 1103456 - RNA, 19 nt, Homo sapiens
guguaucuuuggacaauua

SEQ ID NO: 1103457 - RNA, 19 nt, Homo sapiens
ucagaguaguucaugauaa

SEQ ID NO: 1103458 - RNA, 19 nt, Homo sapiens
cauaguaaguucagaguag

SEQ ID NO: 1103459 - RNA, 19 nt, Homo sapiens
gaagaaguagugaacaaga

SEQ ID NO: 1103460 - RNA, 19 nt, Homo sapiens
gcuacaaugcccuguguua

SEQ ID NO: 1103461 - RNA, 19 nt, Homo sapiens
cccaagagauguagaugaa

SEQ ID NO: 1103462 - RNA, 19 nt, Homo sapiens
gaguguaaaugacauagau

SEQ ID NO: 1103463 - RNA, 19 nt, Homo sapiens
aaagcgaaguguuuacauu

SEQ ID NO: 1103464 - RNA, 19 nt, Homo sapiens
caaagcaacagaaguuuau

SEQ ID NO: 1103465 - RNA, 19 nt, Homo sapiens
guagaugaaacagguauua

SEQ ID NO: 1103466 - RNA, 19 nt, Homo sapiens
gcaaggacaguguacuaaa

SEQ ID NO: 1103467 - RNA, 19 nt, Homo sapiens
ggaaagcacuagugaucag

SEQ ID NO: 1103468 - RNA, 19 nt, Homo sapiens
caaaaucacucuagaaucu

SEQ ID NO: 1103469 - RNA, 19 nt, Homo sapiens
gagugaagcugaaaagaaa

SEQ ID NO: 1103470 - RNA, 19 nt, Homo sapiens
gaagauuaucgaagacaaa

SEQ ID NO: 1103471 - RNA, 19 nt, Homo sapiens
caaggacaguguacuaaag

SEQ ID NO: 1103472 - RNA, 19 nt, Homo sapiens
cagcacgaguugaaauuga

SEQ ID NO: 1103473 - RNA, 19 nt, Homo sapiens
gaagagaaagaagaugaaa

SEQ ID NO: 1103474 - RNA, 19 nt, Homo sapiens
ugucacacaucaaguuaaa

SEQ ID NO: 1103475 - RNA, 19 nt, Homo sapiens
caagagauguagaugaaac

SEQ ID NO: 1103476 - RNA, 19 nt, Homo sapiens
ugcaagagaugaagaacuu

SEQ ID NO: 1103477 - RNA, 19 nt, Homo sapiens
ugaagaaggaugacaagaa

SEQ ID NO: 1103478 - RNA, 19 nt, Homo sapiens
uaucaaggcugucacacau

SEQ ID NO: 1103479 - RNA, 19 nt, Homo sapiens
gaacaagauauggaaagaa

SEQ ID NO: 1103480 - RNA, 19 nt, Homo sapiens
caugugcuauuaccagaaa

SEQ ID NO: 1103481 - RNA, 19 nt, Homo sapiens
gaguugaaauugacuacau

SEQ ID NO: 1103482 - RNA, 19 nt, Homo sapiens
aggagaagauuaucgaaga

SEQ ID NO: 1103483 - RNA, 19 nt, Homo sapiens
gcagggaaagcacuaguga

SEQ ID NO: 1103484 - RNA, 19 nt, Homo sapiens
uuaauuuccuuuccaccua

SEQ ID NO: 1103485 - RNA, 19 nt, Homo sapiens
caaugaugaugaugaggaa

SEQ ID NO: 1103486 - RNA, 19 nt, Homo sapiens
ugaacaagauauggaaaga

SEQ ID NO: 1103487 - RNA, 19 nt, Homo sapiens
gcuccucgcuacccacuau

SEQ ID NO: 1103488 - RNA, 19 nt, Homo sapiens
uaucugccuuuccaucuuu

SEQ ID NO: 1103489 - RNA, 19 nt, Homo sapiens
uggaugaacuagaagaaga

SEQ ID NO: 1103490 - RNA, 19 nt, Homo sapiens
acaaugcccuguguuaaau

SEQ ID NO: 1103491 - RNA, 19 nt, Homo sapiens
cagauucaguauuguguau

SEQ ID NO: 1103492 - RNA, 19 nt, Homo sapiens
uaagaaaggagcaaagcaa

SEQ ID NO: 1103493 - RNA, 19 nt, Homo sapiens
gcccuagguccaaauguua

SEQ ID NO: 1103494 - RNA, 19 nt, Homo sapiens
cuaaaggagauaaguguaa

SEQ ID NO: 1103495 - RNA, 19 nt, Homo sapiens
guucaaaccuguaguugcu

SEQ ID NO: 1103496 - RNA, 19 nt, Homo sapiens
ucaaggcugucacacauca

SEQ ID NO: 1103497 - RNA, 19 nt, Homo sapiens
gggaacagguggugaugag

SEQ ID NO: 1103498 - RNA, 19 nt, Homo sapiens
uguaguaugugcauucuuc

SEQ ID NO: 1103499 - RNA, 19 nt, Homo sapiens
gagaggauuuggaugaacu

SEQ ID NO: 1103500 - RNA, 19 nt, Homo sapiens
gucgugaaguguuugaauu

SEQ ID NO: 1103501 - RNA, 19 nt, Homo sapiens
ucccaagucuguaguaugu

SEQ ID NO: 1103502 - RNA, 19 nt, Homo sapiens
aagaaguagugaacaagaa

SEQ ID NO: 1103503 - RNA, 19 nt, Homo sapiens
uggaagaaguagugaacaa

SEQ ID NO: 1103504 - RNA, 19 nt, Homo sapiens
gcacagagugaagcugaaa

SEQ ID NO: 1103505 - RNA, 19 nt, Homo sapiens
gacaggaucagcuacaaug

SEQ ID NO: 1103506 - RNA, 19 nt, Homo sapiens
gcuauuaccagaaacaaca

SEQ ID NO: 1103507 - RNA, 19 nt, Homo sapiens
ggucaaugaugaugaugag

SEQ ID NO: 1103508 - RNA, 19 nt, Homo sapiens
caagauauggaaagaagga

SEQ ID NO: 1103509 - RNA, 19 nt, Homo sapiens
aaacucaaauagugugcaa

SEQ ID NO: 1103510 - RNA, 19 nt, Homo sapiens
gcgaaguguuuacauugau

SEQ ID NO: 1103511 - RNA, 19 nt, Homo sapiens
uaaaggagauaaguguaag

SEQ ID NO: 1103512 - RNA, 19 nt, Homo sapiens
caaguuaaauuuggucaac

SEQ ID NO: 1103513 - RNA, 19 nt, Homo sapiens
ccagaaacaacaaacuuau

SEQ ID NO: 1103514 - RNA, 19 nt, Homo sapiens
gaugaaacagguauuacug

SEQ ID NO: 1103515 - RNA, 19 nt, Homo sapiens
gcugucacacaucaaguua

SEQ ID NO: 1103516 - RNA, 19 nt, Homo sapiens
cgaaguguuuacauugaug

SEQ ID NO: 1103517 - RNA, 19 nt, Homo sapiens
gaucccaagucuguaguau

SEQ ID NO: 1103518 - RNA, 19 nt, Homo sapiens
gcagauucaguauugugua

SEQ ID NO: 1103519 - RNA, 19 nt, Homo sapiens
gaugauucagugaguguaa

SEQ ID NO: 1103520 - RNA, 19 nt, Homo sapiens
gaaagcugacuucaaagca

SEQ ID NO: 1103521 - RNA, 19 nt, Homo sapiens
uuacauugaugcaagagau

SEQ ID NO: 1103522 - RNA, 19 nt, Homo sapiens
uacaaugcccuguguuaaa

SEQ ID NO: 1103523 - RNA, 19 nt, Homo sapiens
gaaggagaagauuaucgaa

SEQ ID NO: 1103524 - RNA, 19 nt, Homo sapiens
gaacuucuuuuaucugaca

SEQ ID NO: 1103525 - RNA, 19 nt, Homo sapiens
uaaaggaaacugcguaugc

SEQ ID NO: 1103526 - RNA, 19 nt, Homo sapiens
ugagcacuguacuucauaa

SEQ ID NO: 1103527 - RNA, 19 nt, Homo sapiens
gaacuggucaaugaugaug

SEQ ID NO: 1103528 - RNA, 19 nt, Homo sapiens
gcccuguguuaaauuguuu

SEQ ID NO: 1103529 - RNA, 19 nt, Homo sapiens
cagcuacaaugcccugugu

SEQ ID NO: 1103530 - RNA, 19 nt, Homo sapiens
cagcacauauacuucagau

SEQ ID NO: 1103531 - RNA, 19 nt, Homo sapiens
gaugaggaagcagaugaua

SEQ ID NO: 1103532 - RNA, 19 nt, Homo sapiens
gaaaggagcaaagcaacag

SEQ ID NO: 1103533 - RNA, 19 nt, Homo sapiens
caaagcagggaaagcacua

SEQ ID NO: 1103534 - RNA, 19 nt, Homo sapiens
aacaagauauggaaagaag

SEQ ID NO: 1103535 - RNA, 19 nt, Homo sapiens
ccucuguauuuguauguuu

SEQ ID NO: 1103536 - RNA, 19 nt, Homo sapiens
ggaugaacuagaagaagaa

SEQ ID NO: 1103537 - RNA, 19 nt, Homo sapiens
ggacacaaauggagaaguu

SEQ ID NO: 1103538 - RNA, 19 nt, Homo sapiens
ggcauaagcuaaugguuua

SEQ ID NO: 1103539 - RNA, 19 nt, Homo sapiens
ggaccauccuucacucuua

SEQ ID NO: 1103540 - RNA, 19 nt, Homo sapiens
gaccagaccucuaugaugu

SEQ ID NO: 1103541 - RNA, 19 nt, Homo sapiens
ucaaagacauuguaucuca

SEQ ID NO: 1103542 - RNA, 19 nt, Homo sapiens
gaggaacucuacuuucuga

SEQ ID NO: 1103543 - RNA, 19 nt, Homo sapiens
uuacgucgcuggauuugua

SEQ ID NO: 1103544 - RNA, 19 nt, Homo sapiens
cagagaaacuguuauaucu

SEQ ID NO: 1103545 - RNA, 19 nt, Homo sapiens
gaaaagagaguccuuaauu

SEQ ID NO: 1103546 - RNA, 19 nt, Homo sapiens
caacagaccagaccucuau

SEQ ID NO: 1103547 - RNA, 19 nt, Homo sapiens
gaaaugggucagcuaauug

SEQ ID NO: 1103548 - RNA, 19 nt, Homo sapiens
ggaacugucuagaagauca

SEQ ID NO: 1103549 - RNA, 19 nt, Homo sapiens
agaaaugggucagcuaauu

SEQ ID NO: 1103550 - RNA, 19 nt, Homo sapiens
ggaaccugcugcugagaaa

SEQ ID NO: 1103551 - RNA, 19 nt, Homo sapiens
ccugaaacguugcuuugua

SEQ ID NO: 1103552 - RNA, 19 nt, Homo sapiens
aaugauggguguuguguuu

SEQ ID NO: 1103553 - RNA, 19 nt, Homo sapiens
ucuagaagaucauucaaga

SEQ ID NO: 1103554 - RNA, 19 nt, Homo sapiens
gagccaaacugcuaauuuu

SEQ ID NO: 1103555 - RNA, 19 nt, Homo sapiens
gaaagcugccugaaacguu

SEQ ID NO: 1103556 - RNA, 19 nt, Homo sapiens
uaauugaaguuccagauuc

SEQ ID NO: 1103557 - RNA, 19 nt, Homo sapiens
aaagagaguccuuaauuug

SEQ ID NO: 1103558 - RNA, 19 nt, Homo sapiens
gacauuguaucucaguuug

SEQ ID NO: 1103559 - RNA, 19 nt, Homo sapiens
gaaaagaauugugguguau

SEQ ID NO: 1103560 - RNA, 19 nt, Homo sapiens
gcaguugcacuuucucgua

SEQ ID NO: 1103561 - RNA, 19 nt, Homo sapiens
ggagaguuauauugcaguu

SEQ ID NO: 1103562 - RNA, 19 nt, Homo sapiens
aaacggcucuuuccuuagu

SEQ ID NO: 1103563 - RNA, 19 nt, Homo sapiens
gacagaaccguaucacuga

SEQ ID NO: 1103564 - RNA, 19 nt, Homo sapiens
uagaagcgguccaggaguu

SEQ ID NO: 1103565 - RNA, 19 nt, Homo sapiens
aaagaauugugguguauca

SEQ ID NO: 1103566 - RNA, 19 nt, Homo sapiens
gaauggaaacuguuaucuu

SEQ ID NO: 1103567 - RNA, 19 nt, Homo sapiens
guacagaagaacaugguuu

SEQ ID NO: 1103568 - RNA, 19 nt, Homo sapiens
ggauggcccuccacaaugg

SEQ ID NO: 1103569 - RNA, 19 nt, Homo sapiens
agaccucuaugauguguuu

SEQ ID NO: 1103570 - RNA, 19 nt, Homo sapiens
gaaaucagagagccacguu

SEQ ID NO: 1103571 - RNA, 19 nt, Homo sapiens
gcaaacugcacaaagaaau

SEQ ID NO: 1103572 - RNA, 19 nt, Homo sapiens
acuaggauauuguguagaa

SEQ ID NO: 1103573 - RNA, 19 nt, Homo sapiens
ucacuaggauauuguguag

SEQ ID NO: 1103574 - RNA, 19 nt, Homo sapiens
caguugcacuuucucguaa

SEQ ID NO: 1103575 - RNA, 19 nt, Homo sapiens
uagaagaucauucaagaga

SEQ ID NO: 1103576 - RNA, 19 nt, Homo sapiens
gaaacguugcuuuguauuc

SEQ ID NO: 1103577 - RNA, 19 nt, Homo sapiens
caacagaaaacuuccuuua

SEQ ID NO: 1103578 - RNA, 19 nt, Homo sapiens
ugcagaagauccagagaaa

SEQ ID NO: 1103579 - RNA, 19 nt, Homo sapiens
gauauuguguagaauguac

SEQ ID NO: 1103580 - RNA, 19 nt, Homo sapiens
gcggaacugucuagaagau

SEQ ID NO: 1103581 - RNA, 19 nt, Homo sapiens
uaacauuacagaacagcua

SEQ ID NO: 1103582 - RNA, 19 nt, Homo sapiens
uacaggauauugcucuaaa

SEQ ID NO: 1103583 - RNA, 19 nt, Homo sapiens
cagaagauccagagaaauc

SEQ ID NO: 1103584 - RNA, 19 nt, Homo sapiens
aaagaaaugggucagcuaa

SEQ ID NO: 1103585 - RNA, 19 nt, Homo sapiens
caucaaagacauuguaucu

SEQ ID NO: 1103586 - RNA, 19 nt, Homo sapiens
guuaauagugccaaaguug

SEQ ID NO: 1103587 - RNA, 19 nt, Homo sapiens
agaaaucuuuaccaaccua

SEQ ID NO: 1103588 - RNA, 19 nt, Homo sapiens
caaagaaaugggucagcua

SEQ ID NO: 1103589 - RNA, 19 nt, Homo sapiens
cagguuacgucgcuggauu

SEQ ID NO: 1103590 - RNA, 19 nt, Homo sapiens
gcacugaugcuaaagaaaa

SEQ ID NO: 1103591 - RNA, 19 nt, Homo sapiens
cugaaacguugcuuuguau

SEQ ID NO: 1103592 - RNA, 19 nt, Homo sapiens
ugaaacacaugaacacacu

SEQ ID NO: 1103593 - RNA, 19 nt, Homo sapiens
ucuaugauguguuugugaa

SEQ ID NO: 1103594 - RNA, 19 nt, Homo sapiens
caacgccgaugagcuggaa

SEQ ID NO: 1103595 - RNA, 19 nt, Homo sapiens
gauggagaguuauauugca

SEQ ID NO: 1103596 - RNA, 19 nt, Homo sapiens
cuaggaagaacuuuaauuc

SEQ ID NO: 1103597 - RNA, 19 nt, Homo sapiens
caguuugucucgcugugua

SEQ ID NO: 1103598 - RNA, 19 nt, Homo sapiens
uugcaaguauugagauuug

SEQ ID NO: 1103599 - RNA, 19 nt, Homo sapiens
gagagugagauuaccauug

SEQ ID NO: 1103600 - RNA, 19 nt, Homo sapiens
gagggaugcuacuaaacau

SEQ ID NO: 1103601 - RNA, 19 nt, Homo sapiens
agagaguccuuaauuugga

SEQ ID NO: 1103602 - RNA, 19 nt, Homo sapiens
gggcaaacugcacaaagaa

SEQ ID NO: 1103603 - RNA, 19 nt, Homo sapiens
guuccagauucuuccauuu

SEQ ID NO: 1103604 - RNA, 19 nt, Homo sapiens
aaacguugcuuuguauucu

SEQ ID NO: 1103605 - RNA, 19 nt, Homo sapiens
ugggcaaacugcacaaaga

SEQ ID NO: 1103606 - RNA, 19 nt, Homo sapiens
agagugagauuaccauugc

SEQ ID NO: 1103607 - RNA, 19 nt, Homo sapiens
cagaaaacuuccuuuauca

SEQ ID NO: 1103608 - RNA, 19 nt, Homo sapiens
uggaaacuguuaucuuaca

SEQ ID NO: 1103609 - RNA, 19 nt, Homo sapiens
cugaggaacucuacuuucu

SEQ ID NO: 1103610 - RNA, 19 nt, Homo sapiens
ugaacacacuuccgauuuu

SEQ ID NO: 1103611 - RNA, 19 nt, Homo sapiens
gaaaauaacagagaaacug

SEQ ID NO: 1103612 - RNA, 19 nt, Homo sapiens
ggagucgggcugaucgaaa

SEQ ID NO: 1103613 - RNA, 19 nt, Homo sapiens
ugagccaaacugcuaauuu

SEQ ID NO: 1103614 - RNA, 19 nt, Homo sapiens
aggcauaagcuaaugguuu

SEQ ID NO: 1103615 - RNA, 19 nt, Homo sapiens
aaaagcacaucacaacaaa

SEQ ID NO: 1103616 - RNA, 19 nt, Homo sapiens
caugaaguccugaaaauaa

SEQ ID NO: 1103617 - RNA, 19 nt, Homo sapiens
cgaacaaaaugcugaaaau

SEQ ID NO: 1103618 - RNA, 19 nt, Homo sapiens
caaacugcacaaagaaaug

SEQ ID NO: 1103619 - RNA, 19 nt, Homo sapiens
gcaacagaccagaccucua

SEQ ID NO: 1103620 - RNA, 19 nt, Homo sapiens
uggaagcccugcagaugug

SEQ ID NO: 1103621 - RNA, 19 nt, Homo sapiens
caggauggcccuccacaau

SEQ ID NO: 1103622 - RNA, 19 nt, Homo sapiens
aaugcugccuuacagauga

SEQ ID NO: 1103623 - RNA, 19 nt, Homo sapiens
aagcacaucacaacaaaug

SEQ ID NO: 1103624 - RNA, 19 nt, Homo sapiens
gaacacacuuccgauuuuc

SEQ ID NO: 1103625 - RNA, 19 nt, Homo sapiens
aaacuucuccaucccuuug

SEQ ID NO: 1103626 - RNA, 19 nt, Homo sapiens
cgacagccacauuaaggaa

SEQ ID NO: 1103627 - RNA, 19 nt, Homo sapiens
cugcggaacugucuagaag

SEQ ID NO: 1103628 - RNA, 19 nt, Homo sapiens
ucacaaaugauggguguug

SEQ ID NO: 1103629 - RNA, 19 nt, Homo sapiens
uauuacacguuccaguuug

SEQ ID NO: 1103630 - RNA, 19 nt, Homo sapiens
acagaaaacuuccuuuauc

SEQ ID NO: 1103631 - RNA, 19 nt, Homo sapiens
cauuguaucucaguuugga

SEQ ID NO: 1103632 - RNA, 19 nt, Homo sapiens
agaguuauauugcaguucu

SEQ ID NO: 1103633 - RNA, 19 nt, Homo sapiens
gaacaugguuuuauaucac

SEQ ID NO: 1103634 - RNA, 19 nt, Homo sapiens
ucuccucgcugauuagcuu

SEQ ID NO: 1103635 - RNA, 19 nt, Homo sapiens
gagaaaagagaguccuuaa

SEQ ID NO: 1103636 - RNA, 19 nt, Homo sapiens
uauacaggauauugcucua

SEQ ID NO: 1103637 - RNA, 19 nt, Homo sapiens
uaaagaaacccaacaauga

SEQ ID NO: 1103638 - RNA, 19 nt, Homo sapiens
gagaagauauagugauuac

SEQ ID NO: 1103639 - RNA, 19 nt, Homo sapiens
gcagaaugaccuaaagaaa

SEQ ID NO: 1103640 - RNA, 19 nt, Homo sapiens
gaccaaggcucgcaauuuu

SEQ ID NO: 1103641 - RNA, 19 nt, Homo sapiens
ugagagaacagcagaauga

SEQ ID NO: 1103642 - RNA, 19 nt, Homo sapiens
gaaaguagaagaagagcau

SEQ ID NO: 1103643 - RNA, 19 nt, Homo sapiens
caugucaccugcaaaauua

SEQ ID NO: 1103644 - RNA, 19 nt, Homo sapiens
ucacuaacuucuggacuuu

SEQ ID NO: 1103645 - RNA, 19 nt, Homo sapiens
gcacaaggaagacacacaa

SEQ ID NO: 1103646 - RNA, 19 nt, Homo sapiens
gaagauauagugauuacag

SEQ ID NO: 1103647 - RNA, 19 nt, Homo sapiens
ggaaaaccguccacgauga

SEQ ID NO: 1103648 - RNA, 19 nt, Homo sapiens
ggagaagauauagugauua

SEQ ID NO: 1103649 - RNA, 19 nt, Homo sapiens
gaagaagagcauaccaaug

SEQ ID NO: 1103650 - RNA, 19 nt, Homo sapiens
aaagaaacccaacaaugaa

SEQ ID NO: 1103651 - RNA, 19 nt, Homo sapiens
gcucugcuaugcacggaaa

SEQ ID NO: 1103652 - RNA, 19 nt, Homo sapiens
cuaaagaaacccaacaaug

SEQ ID NO: 1103653 - RNA, 19 nt, Homo sapiens
aggagaagauauagugauu

SEQ ID NO: 1103654 - RNA, 19 nt, Homo sapiens
gaaacccaacaaugaauau

SEQ ID NO: 1103655 - RNA, 19 nt, Homo sapiens
gaaaugaaaguagaagaag

SEQ ID NO: 1103656 - RNA, 19 nt, Homo sapiens
gaacagcagaaugaccuaa

SEQ ID NO: 1103657 - RNA, 19 nt, Homo sapiens
cagcacauguucugaagca

SEQ ID NO: 1103658 - RNA, 19 nt, Homo sapiens
gggaaagugauuugugaaa

SEQ ID NO: 1103659 - RNA, 19 nt, Homo sapiens
ccaacaaggccacaggaaa

SEQ ID NO: 1103660 - RNA, 19 nt, Homo sapiens
ugaccaaggcucgcaauuu

SEQ ID NO: 1103661 - RNA, 19 nt, Homo sapiens
gaaauaaacuagcaaaacc

SEQ ID NO: 1103662 - RNA, 19 nt, Homo sapiens
caacaauggcucugcuaug

SEQ ID NO: 1103663 - RNA, 19 nt, Homo sapiens
cagccacguuaguagauaa

SEQ ID NO: 1103664 - RNA, 19 nt, Homo sapiens
caacaaggccacaggaaaa

SEQ ID NO: 1103665 - RNA, 19 nt, Homo sapiens
cugggaaagugauuuguga

SEQ ID NO: 1103666 - RNA, 19 nt, Homo sapiens
agaaacccaacaaugaaua

SEQ ID NO: 1103667 - RNA, 19 nt, Homo sapiens
gagucagugucgauaugaa

SEQ ID NO: 1103668 - RNA, 19 nt, Homo sapiens
ggagucagugucgauauga

SEQ ID NO: 1103669 - RNA, 19 nt, Homo sapiens
ugauaaaggccaugaccaa

SEQ ID NO: 1103670 - RNA, 19 nt, Homo sapiens
cagaaugaccuaaagaaac

SEQ ID NO: 1103671 - RNA, 19 nt, Homo sapiens
agaaugaccuaaagaaacc

SEQ ID NO: 1103672 - RNA, 19 nt, Homo sapiens
auuaauagcacaaggaaga

SEQ ID NO: 1103673 - RNA, 19 nt, Homo sapiens
cggagucagugucgauaug

SEQ ID NO: 1103674 - RNA, 19 nt, Homo sapiens
caaaacaccugggaaacug

SEQ ID NO: 1103675 - RNA, 19 nt, Homo sapiens
caaggccacaggaaaauua

SEQ ID NO: 1103676 - RNA, 19 nt, Homo sapiens
gauuacagcacauguucug

SEQ ID NO: 1103677 - RNA, 19 nt, Homo sapiens
ugacagccacguuaguaga

SEQ ID NO: 1103678 - RNA, 19 nt, Homo sapiens
guacaugucaccugcaaaa

SEQ ID NO: 1103679 - RNA, 19 nt, Homo sapiens
acagccacguuaguagaua

SEQ ID NO: 1103680 - RNA, 19 nt, Homo sapiens
agaagaagagcauaccaau

SEQ ID NO: 1103681 - RNA, 19 nt, Homo sapiens
cuguggaucugaccaacaa

SEQ ID NO: 1103682 - RNA, 19 nt, Homo sapiens
uuacagcacauguucugaa

SEQ ID NO: 1103683 - RNA, 19 nt, Homo sapiens
uagaagaagagcauaccaa

SEQ ID NO: 1103684 - RNA, 19 nt, Homo sapiens
cagcagaaugaccuaaaga

SEQ ID NO: 1103685 - RNA, 19 nt, Homo sapiens
gugauuacagcacauguuc

SEQ ID NO: 1103686 - RNA, 19 nt, Homo sapiens
aacaauggcucugcuaugc

SEQ ID NO: 1103687 - RNA, 19 nt, Homo sapiens
acccaacaaugaauaucaa

SEQ ID NO: 1103688 - RNA, 19 nt, Homo sapiens
caaguauagauuugacuca

SEQ ID NO: 1103689 - RNA, 19 nt, Homo sapiens
acagcagaaugaccuaaag

SEQ ID NO: 1103690 - RNA, 19 nt, Homo sapiens
uacagcacauguucugaag

SEQ ID NO: 1103691 - RNA, 19 nt, Homo sapiens
gcaaaauuaggagaagaua

SEQ ID NO: 1103692 - RNA, 19 nt, Homo sapiens
ucaacaauggcucugcuau

SEQ ID NO: 1103693 - RNA, 19 nt, Homo sapiens
ggccacaggaaaauuaaua

SEQ ID NO: 1103694 - RNA, 19 nt, Homo sapiens
gacagccacguuaguagau

SEQ ID NO: 1103695 - RNA, 19 nt, Homo sapiens
ccuaaagaaacccaacaau

SEQ ID NO: 1103696 - RNA, 19 nt, Homo sapiens
ccaaugcaauaggcacucu

SEQ ID NO: 1103697 - RNA, 19 nt, Homo sapiens
uucacuaacuucuggacuu

SEQ ID NO: 1103698 - RNA, 19 nt, Homo sapiens
gaacagaaccacugauuua

SEQ ID NO: 1103699 - RNA, 19 nt, Homo sapiens
gcagugaccuuaccauuuc

SEQ ID NO: 1103700 - RNA, 19 nt, Homo sapiens
gacaguaacucagaaauug

SEQ ID NO: 1103701 - RNA, 19 nt, Homo sapiens
gaaugacaauaguggaaua

SEQ ID NO: 1103702 - RNA, 19 nt, Homo sapiens
gaccuuaccauuucaauaa

SEQ ID NO: 1103703 - RNA, 19 nt, Homo sapiens
gaaaagcccuuacagaaga

SEQ ID NO: 1103704 - RNA, 19 nt, Homo sapiens
ggagggagaagauggaaua

SEQ ID NO: 1103705 - RNA, 19 nt, Homo sapiens
caacagcauuauugagaaa

SEQ ID NO: 1103706 - RNA, 19 nt, Homo sapiens
gcaacagcauuauugagaa

SEQ ID NO: 1103707 - RNA, 19 nt, Homo sapiens
gggaacauauugaaguuga

SEQ ID NO: 1103708 - RNA, 19 nt, Homo sapiens
agaaacccgugaucaauuu

SEQ ID NO: 1103709 - RNA, 19 nt, Homo sapiens
gaacaagaaguuucaagug

SEQ ID NO: 1103710 - RNA, 19 nt, Homo sapiens
gacaagagcaagaaagaaa

SEQ ID NO: 1103711 - RNA, 19 nt, Homo sapiens
gaaaauaaguggucucaag

SEQ ID NO: 1103712 - RNA, 19 nt, Homo sapiens
gggagaagauggaauagag

SEQ ID NO: 1103713 - RNA, 19 nt, Homo sapiens
gaauagaggccuuaaaauu

SEQ ID NO: 1103714 - RNA, 19 nt, Homo sapiens
gggaagguguuucagauca

SEQ ID NO: 1103715 - RNA, 19 nt, Homo sapiens
gagaacagaaccacugauu

SEQ ID NO: 1103716 - RNA, 19 nt, Homo sapiens
cgauaccaguuucagaaua

SEQ ID NO: 1103717 - RNA, 19 nt, Homo sapiens
ggucagcuauucacaguag

SEQ ID NO: 1103718 - RNA, 19 nt, Homo sapiens
cagaaccacugauuuaaag

SEQ ID NO: 1103719 - RNA, 19 nt, Homo sapiens
aaacagaagccuaucaguu

SEQ ID NO: 1103720 - RNA, 19 nt, Homo sapiens
gacaaagacagcuaacaaa

SEQ ID NO: 1103721 - RNA, 19 nt, Homo sapiens
aagagaaccuggacaaaca

SEQ ID NO: 1103722 - RNA, 19 nt, Homo sapiens
ccuaagcucuccugauuca

SEQ ID NO: 1103723 - RNA, 19 nt, Homo sapiens
ggaugagucugaugacagu

SEQ ID NO: 1103724 - RNA, 19 nt, Homo sapiens
gagaaaagcccuuacagaa

SEQ ID NO: 1103725 - RNA, 19 nt, Homo sapiens
uaacaccgaugauucugau

SEQ ID NO: 1103726 - RNA, 19 nt, Homo sapiens
gagacaagagcaagaaaga

SEQ ID NO: 1103727 - RNA, 19 nt, Homo sapiens
gauaccaguuucagaauac

SEQ ID NO: 1103728 - RNA, 19 nt, Homo sapiens
gaaaccauaacaccgauga

SEQ ID NO: 1103729 - RNA, 19 nt, Homo sapiens
agaagaggcaacagcauua

SEQ ID NO: 1103730 - RNA, 19 nt, Homo sapiens
ugacuaacgugcugugaca

SEQ ID NO: 1103731 - RNA, 19 nt, Homo sapiens
gaaacccgugaucaauuua

SEQ ID NO: 1103732 - RNA, 19 nt, Homo sapiens
acccuaagcucuccugauu

SEQ ID NO: 1103733 - RNA, 19 nt, Homo sapiens
ugacaauaguggaauaaag

SEQ ID NO: 1103734 - RNA, 19 nt, Homo sapiens
gaguugcccuauccacuga

SEQ ID NO: 1103735 - RNA, 19 nt, Homo sapiens
aaauguggcugcagauauc

SEQ ID NO: 1103736 - RNA, 19 nt, Homo sapiens
ggaacaagaaguuucaagu

SEQ ID NO: 1103737 - RNA, 19 nt, Homo sapiens
ggccguaggucagcuauuc

SEQ ID NO: 1103738 - RNA, 19 nt, Homo sapiens
gaacaugauaauucuguca

SEQ ID NO: 1103739 - RNA, 19 nt, Homo sapiens
gauuuaaagugugacaguu

SEQ ID NO: 1103740 - RNA, 19 nt, Homo sapiens
ugacaguaacucagaaauu

SEQ ID NO: 1103741 - RNA, 19 nt, Homo sapiens
cuaaugcccucugggauga

SEQ ID NO: 1103742 - RNA, 19 nt, Homo sapiens
agacaaagacagcuaacaa

SEQ ID NO: 1103743 - RNA, 19 nt, Homo sapiens
ggcaacagcauuauugaga

SEQ ID NO: 1103744 - RNA, 19 nt, Homo sapiens
agaauacugugaaucugaa

SEQ ID NO: 1103745 - RNA, 19 nt, Homo sapiens
agaaauugaggcugcuuua

SEQ ID NO: 1103746 - RNA, 19 nt, Homo sapiens
aacagaagccuaucaguug

SEQ ID NO: 1103747 - RNA, 19 nt, Homo sapiens
ucaaguggcuguggagaca

SEQ ID NO: 1103748 - RNA, 19 nt, Homo sapiens
gaagguguuucagaucauc

SEQ ID NO: 1103749 - RNA, 19 nt, Homo sapiens
ggaagguguuucagaucau

SEQ ID NO: 1103750 - RNA, 19 nt, Homo sapiens
cggaucagagggagaaaua

SEQ ID NO: 1103751 - RNA, 19 nt, Homo sapiens
gaagaggcaacagcauuau

SEQ ID NO: 1103752 - RNA, 19 nt, Homo sapiens
gacaaacaccagacucaga

SEQ ID NO: 1103753 - RNA, 19 nt, Homo sapiens
agaaagaguugcccuaucc

SEQ ID NO: 1103754 - RNA, 19 nt, Homo sapiens
caagaaagaguugcccuau

SEQ ID NO: 1103755 - RNA, 19 nt, Homo sapiens
caagauggagggagaagau

SEQ ID NO: 1103756 - RNA, 19 nt, Homo sapiens
agauuaagcuccagagaac

SEQ ID NO: 1103757 - RNA, 19 nt, Homo sapiens
aaagaaacccgugaucaau

SEQ ID NO: 1103758 - RNA, 19 nt, Homo sapiens
gcggugcauucgagacaaa

SEQ ID NO: 1103759 - RNA, 19 nt, Homo sapiens
ugucacacuugucagguuu

SEQ ID NO: 1103760 - RNA, 19 nt, Homo sapiens
ccgaugauucugaugauuu

SEQ ID NO: 1103761 - RNA, 19 nt, Homo sapiens
gcauguugccaccuugaaa

SEQ ID NO: 1103762 - RNA, 19 nt, Homo sapiens
acagaaccacugauuuaaa

SEQ ID NO: 1103763 - RNA, 19 nt, Homo sapiens
agccaaaccugcuguaugg

SEQ ID NO: 1103764 - RNA, 19 nt, Homo sapiens
gacaauaguggaauaaagg

SEQ ID NO: 1103765 - RNA, 19 nt, Homo sapiens
gcccagaaccacagccaaa

SEQ ID NO: 1103766 - RNA, 19 nt, Homo sapiens
gcugugacauugguuucaa

SEQ ID NO: 1103767 - RNA, 19 nt, Homo sapiens
aagaaacccgugaucaauu

SEQ ID NO: 1103768 - RNA, 19 nt, Homo sapiens
aggccacccuucaggauaa

SEQ ID NO: 1103769 - RNA, 19 nt, Homo sapiens
ucacagggaaccaaaguca

SEQ ID NO: 1103770 - RNA, 19 nt, Homo sapiens
cuaacgugcugugacauug

SEQ ID NO: 1103771 - RNA, 19 nt, Homo sapiens
gaugacaguaacucagaaa

SEQ ID NO: 1103772 - RNA, 19 nt, Homo sapiens
gauaucccaaucacagaaa

SEQ ID NO: 1103773 - RNA, 19 nt, Homo sapiens
gaaaauguggcugcagaua

SEQ ID NO: 1103774 - RNA, 19 nt, Homo sapiens
ucuugcagcuugccaucua

SEQ ID NO: 1103775 - RNA, 19 nt, Homo sapiens
gaggcaacagcauuauuga

SEQ ID NO: 1103776 - RNA, 19 nt, Homo sapiens
gaaacagaagccuaucagu

SEQ ID NO: 1103777 - RNA, 19 nt, Homo sapiens
caagggaacaagaaguuuc

SEQ ID NO: 1103778 - RNA, 19 nt, Homo sapiens
caagagaaccuggacaaac

SEQ ID NO: 1103779 - RNA, 19 nt, Homo sapiens
ugaccuuaccauuucaaua

SEQ ID NO: 1103780 - RNA, 19 nt, Homo sapiens
cacaaaagcccuucagaaa

SEQ ID NO: 1103781 - RNA, 19 nt, Homo sapiens
gaaccaaagucacaaaagc

SEQ ID NO: 1103782 - RNA, 19 nt, Homo sapiens
ggaagccaaaccugcugua

SEQ ID NO: 1103783 - RNA, 19 nt, Homo sapiens
uaggucagcuauucacagu

SEQ ID NO: 1103784 - RNA, 19 nt, Homo sapiens
agaggcaacagcauuauug

SEQ ID NO: 1103785 - RNA, 19 nt, Homo sapiens
gaucagagggagaaauacu

SEQ ID NO: 1103786 - RNA, 19 nt, Homo sapiens
aagaagaggcaacagcauu

SEQ ID NO: 1103787 - RNA, 19 nt, Homo sapiens
uaacgcaccaacaagagaa

SEQ ID NO: 1103788 - RNA, 19 nt, Homo sapiens
agaacagaaccacugauuu

SEQ ID NO: 1103789 - RNA, 19 nt, Homo sapiens
ggagacaagagcaagaaag

SEQ ID NO: 1103790 - RNA, 19 nt, Homo sapiens
caugauaauucugucaaag

SEQ ID NO: 1103791 - RNA, 19 nt, Homo sapiens
aaauccagguggcaagaug

SEQ ID NO: 1103792 - RNA, 19 nt, Homo sapiens
cagcagugaccuuaccauu

SEQ ID NO: 1103793 - RNA, 19 nt, Homo sapiens
ucacacuugucagguuuga

SEQ ID NO: 1103794 - RNA, 19 nt, Homo sapiens
gaagccaaaccugcuguau

SEQ ID NO: 1103795 - RNA, 19 nt, Homo sapiens
aagauuaagcuccagagaa

SEQ ID NO: 1103796 - RNA, 19 nt, Homo sapiens
gaaauugaggcugcuuuac

SEQ ID NO: 1103797 - RNA, 19 nt, Homo sapiens
uacaagggaacaagaaguu

SEQ ID NO: 1103798 - RNA, 19 nt, Homo sapiens
ggugaucgcucucaacuaa

SEQ ID NO: 1103799 - RNA, 19 nt, Homo sapiens
gaagaaugauagcacagaa

SEQ ID NO: 1103800 - RNA, 19 nt, Homo sapiens
uaacauggcacaacaagaa

SEQ ID NO: 1103801 - RNA, 19 nt, Homo sapiens
uguucaagcucuuacauua

SEQ ID NO: 1103802 - RNA, 19 nt, Homo sapiens
gaaccaaacuuuuaaaugg

SEQ ID NO: 1103803 - RNA, 19 nt, Homo sapiens
cgggaaggcuuaaagauga

SEQ ID NO: 1103804 - RNA, 19 nt, Homo sapiens
guaauuggaggaagaauga

SEQ ID NO: 1103805 - RNA, 19 nt, Homo sapiens
ugaaacggguacaagcaua

SEQ ID NO: 1103806 - RNA, 19 nt, Homo sapiens
gcucuuacauuaacauucu

SEQ ID NO: 1103807 - RNA, 19 nt, Homo sapiens
gaaacggguacaagcauaa

SEQ ID NO: 1103808 - RNA, 19 nt, Homo sapiens
ucaauaacauggcacaaca

SEQ ID NO: 1103809 - RNA, 19 nt, Homo sapiens
gcugccauaucaguuauua

SEQ ID NO: 1103810 - RNA, 19 nt, Homo sapiens
gcucucaacuaacuacaau

SEQ ID NO: 1103811 - RNA, 19 nt, Homo sapiens
caagcugaauuaaagaaga

SEQ ID NO: 1103812 - RNA, 19 nt, Homo sapiens
ugaauugggugauaagaca

SEQ ID NO: 1103813 - RNA, 19 nt, Homo sapiens
gcauaacaguaccucagaa

SEQ ID NO: 1103814 - RNA, 19 nt, Homo sapiens
uauuaugucuggaggauau

SEQ ID NO: 1103815 - RNA, 19 nt, Homo sapiens
cuucaucacuuagguguuu

SEQ ID NO: 1103816 - RNA, 19 nt, Homo sapiens
gcuguuuguucaucuauau

SEQ ID NO: 1103817 - RNA, 19 nt, Homo sapiens
ggugcugacugcucccuaa

SEQ ID NO: 1103818 - RNA, 19 nt, Homo sapiens
gcacgggauuggcaguaau

SEQ ID NO: 1103819 - RNA, 19 nt, Homo sapiens
aagaggaacuggaagaagu

SEQ ID NO: 1103820 - RNA, 19 nt, Homo sapiens
ggacuaaugacaugcuugu

SEQ ID NO: 1103821 - RNA, 19 nt, Homo sapiens
ggcaguaauuggaggaaga

SEQ ID NO: 1103822 - RNA, 19 nt, Homo sapiens
guucaagcucuuacauuaa

SEQ ID NO: 1103823 - RNA, 19 nt, Homo sapiens
gaagauccugcuacccaaa

SEQ ID NO: 1103824 - RNA, 19 nt, Homo sapiens
ggaagaaugauagcacaga

SEQ ID NO: 1103825 - RNA, 19 nt, Homo sapiens
gaggauauaaucauuggau

SEQ ID NO: 1103826 - RNA, 19 nt, Homo sapiens
caaauuuucuccuucauca

SEQ ID NO: 1103827 - RNA, 19 nt, Homo sapiens
ugaugagggucaagaggaa

SEQ ID NO: 1103828 - RNA, 19 nt, Homo sapiens
ucauggcaaugcgcuauaa

SEQ ID NO: 1103829 - RNA, 19 nt, Homo sapiens
gggauuggcaguaauugga

SEQ ID NO: 1103830 - RNA, 19 nt, Homo sapiens
cauaacaguaccucagaaa

SEQ ID NO: 1103831 - RNA, 19 nt, Homo sapiens
caacgaaccaaacuuuuaa

SEQ ID NO: 1103832 - RNA, 19 nt, Homo sapiens
gaccuuagccaccggaaca

SEQ ID NO: 1103833 - RNA, 19 nt, Homo sapiens
uaaagaugagcccugauga

SEQ ID NO: 1103834 - RNA, 19 nt, Homo sapiens
acccuugguucccauauuu

SEQ ID NO: 1103835 - RNA, 19 nt, Homo sapiens
ucuggaggauauaaucauu

SEQ ID NO: 1103836 - RNA, 19 nt, Homo sapiens
ucagaacugugacaaucau

SEQ ID NO: 1103837 - RNA, 19 nt, Homo sapiens
cagggucuauacauacuau

SEQ ID NO: 1103838 - RNA, 19 nt, Homo sapiens
ucauuggauuccuaucuug

SEQ ID NO: 1103839 - RNA, 19 nt, Homo sapiens
aaucauaggaggcaucguu

SEQ ID NO: 1103840 - RNA, 19 nt, Homo sapiens
gguaggacaccccauauaa

SEQ ID NO: 1103841 - RNA, 19 nt, Homo sapiens
acauuucccugagccagua

SEQ ID NO: 1103842 - RNA, 19 nt, Homo sapiens
gaacugugacaaucauagg

SEQ ID NO: 1103843 - RNA, 19 nt, Homo sapiens
gcaguaauuggaggaagaa

SEQ ID NO: 1103844 - RNA, 19 nt, Homo sapiens
ucucaacuaacuacaauug

SEQ ID NO: 1103845 - RNA, 19 nt, Homo sapiens
ucaacgaaccaaacuuuua

SEQ ID NO: 1103846 - RNA, 19 nt, Homo sapiens
guucauaccaauaaagaag

SEQ ID NO: 1103847 - RNA, 19 nt, Homo sapiens
gguaguauuaucuuucugu

SEQ ID NO: 1103848 - RNA, 19 nt, Homo sapiens
uaaauggaccgggagaugu

SEQ ID NO: 1103849 - RNA, 19 nt, Homo sapiens
uuucaacgaaccaaacuuu

SEQ ID NO: 1103850 - RNA, 19 nt, Homo sapiens
gaauuucaacgaaccaaac

SEQ ID NO: 1103851 - RNA, 19 nt, Homo sapiens
uuaaagaugagcccugaug

SEQ ID NO: 1103852 - RNA, 19 nt, Homo sapiens
cgugcuggcuggugcaaug

SEQ ID NO: 1103853 - RNA, 19 nt, Homo sapiens
cagcuccaguucauaccaa

SEQ ID NO: 1103854 - RNA, 19 nt, Homo sapiens
uaacgcuguuuguucaucu

SEQ ID NO: 1103855 - RNA, 19 nt, Homo sapiens
ggguacaagcauaacagua

SEQ ID NO: 1103856 - RNA, 19 nt, Homo sapiens
gguuuaauaugguccucau

SEQ ID NO: 1103857 - RNA, 19 nt, Homo sapiens
uggaggauauaaucauugg

SEQ ID NO: 1103858 - RNA, 19 nt, Homo sapiens
ccugcuacccaaacuaauu

SEQ ID NO: 1103859 - RNA, 19 nt, Homo sapiens
caggucauucuuccucuuu

SEQ ID NO: 1103860 - RNA, 19 nt, Homo sapiens
gcauuugucgcugccauau

SEQ ID NO: 1103861 - RNA, 19 nt, Homo sapiens
aaauggaccgggagauguu

SEQ ID NO: 1103862 - RNA, 19 nt, Homo sapiens
ucaagaggaacuggaagaa

SEQ ID NO: 1103863 - RNA, 19 nt, Homo sapiens
gccauaucaguuauuauug

SEQ ID NO: 1103864 - RNA, 19 nt, Homo sapiens
caguucauaccaauaaaga

SEQ ID NO: 1103865 - RNA, 19 nt, Homo sapiens
ccaggucauucuuccucuu

SEQ ID NO: 1103866 - RNA, 19 nt, Homo sapiens
ggucuaccaugcaauuuuc

SEQ ID NO: 1103867 - RNA, 19 nt, Homo sapiens
ugaguuugaccccuuauua

SEQ ID NO: 1103868 - RNA, 19 nt, Homo sapiens
gcuccaguucauaccaaua

SEQ ID NO: 1103869 - RNA, 19 nt, Homo sapiens
gggaaggcuuaaagaugag

SEQ ID NO: 1103870 - RNA, 19 nt, Homo sapiens
augcuugccuugggacuaa

SEQ ID NO: 1103871 - RNA, 19 nt, Homo sapiens
cugcuacccaaacuaauuu

SEQ ID NO: 1103872 - RNA, 19 nt, Homo sapiens
cggcccagaugaagaccuu

SEQ ID NO: 1103873 - RNA, 19 nt, Homo sapiens
caauaacauggcacaacaa

SEQ ID NO: 1103874 - RNA, 19 nt, Homo sapiens
uucccaaccuuaauuaugg

SEQ ID NO: 1103875 - RNA, 19 nt, Homo sapiens
cuauuuauaagcccugauu

SEQ ID NO: 1103876 - RNA, 19 nt, Homo sapiens
gauccugcuacccaaacua

SEQ ID NO: 1103877 - RNA, 19 nt, Homo sapiens
auuugucgcugccauauca

SEQ ID NO: 1103878 - RNA, 19 nt, Homo sapiens
guaggacaccccauauaaa

SEQ ID NO: 1103879 - RNA, 19 nt, Homo sapiens
ggaccgggagauguugaaa

SEQ ID NO: 1103880 - RNA, 19 nt, Homo sapiens
cagcagcuccaguucauac

SEQ ID NO: 1103881 - RNA, 19 nt, Homo sapiens
ucgggaaggcuuaaagaug

SEQ ID NO: 1103882 - RNA, 19 nt, Homo sapiens
gagccaguaaacaguaguu

SEQ ID NO: 1103883 - RNA, 19 nt, Homo sapiens
ccugagccaguaaacagua

SEQ ID NO: 1103884 - RNA, 19 nt, Homo sapiens
ucucuucccaaccuuaauu

SEQ ID NO: 1103885 - RNA, 19 nt, Homo sapiens
aauuggaggaagaaugaua

SEQ ID NO: 1103886 - RNA, 19 nt, Homo sapiens
ugaucgcucucaacuaacu

SEQ ID NO: 1103887 - RNA, 19 nt, Homo sapiens
uuaaauggaccgggagaug

SEQ ID NO: 1103888 - RNA, 19 nt, Homo sapiens
gucaagaggaacuggaaga

SEQ ID NO: 1103889 - RNA, 19 nt, Homo sapiens
cuccaguucauaccaauaa

SEQ ID NO: 1103890 - RNA, 19 nt, Homo sapiens
gcacuggauuuugugaguu

SEQ ID NO: 1103891 - RNA, 19 nt, Homo sapiens
caagaggaacuggaagaag

SEQ ID NO: 1103892 - RNA, 19 nt, Homo sapiens
gucgcugccauaucaguua

SEQ ID NO: 1103893 - RNA, 19 nt, Homo sapiens
ccuugggacuaaugacaug

SEQ ID NO: 1103894 - RNA, 19 nt, Homo sapiens
uaggacaccccauauaaaa

SEQ ID NO: 1103895 - RNA, 19 nt, Homo sapiens
ucgcugccauaucaguuau

SEQ ID NO: 1103896 - RNA, 19 nt, Homo sapiens
aagaaugauagcacagaaa

SEQ ID NO: 1103897 - RNA, 19 nt, Homo sapiens
uucaagcucuuacauuaac

SEQ ID NO: 1103898 - RNA, 19 nt, Homo sapiens
gaaagaugcucauuauagu

SEQ ID NO: 1103899 - RNA, 19 nt, Homo sapiens
uuacgugggucuccuauua

SEQ ID NO: 1103900 - RNA, 19 nt, Homo sapiens
gaaaagcaguugagucaua

SEQ ID NO: 1103901 - RNA, 19 nt, Homo sapiens
ggaaagaugcucauuauag

SEQ ID NO: 1103902 - RNA, 19 nt, Homo sapiens
gagaauauggaaaggauug

SEQ ID NO: 1103903 - RNA, 19 nt, Homo sapiens
cauggaaagaugcucauua

SEQ ID NO: 1103904 - RNA, 19 nt, Homo sapiens
ugagacagcugauggaaaa

SEQ ID NO: 1103905 - RNA, 19 nt, Homo sapiens
gauaggcccaggaguaaug

SEQ ID NO: 1103906 - RNA, 19 nt, Homo sapiens
auggaaagaugcucauuau

SEQ ID NO: 1103907 - RNA, 19 nt, Homo sapiens
gcgagaaucgggagaagga

SEQ ID NO: 1103908 - RNA, 19 nt, Homo sapiens
ccuauugcauggaaagaug

SEQ ID NO: 1103909 - RNA, 19 nt, Homo sapiens
aaggauaggcccaggagua

SEQ ID NO: 1103910 - RNA, 19 nt, Homo sapiens
ggucuccuauuaccagcuu

SEQ ID NO: 1103911 - RNA, 19 nt, Homo sapiens
uggaaaagcugagggaaaa

SEQ ID NO: 1103912 - RNA, 19 nt, Homo sapiens
cagcccauccugcaguaua

SEQ ID NO: 1103913 - RNA, 19 nt, Homo sapiens
aagaugcucauuauaguga

SEQ ID NO: 1103914 - RNA, 19 nt, Homo sapiens
gaagaaaaggagcaaguug

SEQ ID NO: 1103915 - RNA, 19 nt, Homo sapiens
ugaauacugugugccuaga

SEQ ID NO: 1103916 - RNA, 19 nt, Homo sapiens
gggaaaagcaguugaguca

SEQ ID NO: 1103917 - RNA, 19 nt, Homo sapiens
gcucauuauagugaaguua

SEQ ID NO: 1103918 - RNA, 19 nt, Homo sapiens
ccugaauccugaugguuuc

SEQ ID NO: 1103919 - RNA, 19 nt, Homo sapiens
uggaaagaugcucauuaua

SEQ ID NO: 1103920 - RNA, 19 nt, Homo sapiens
gugagacagcugauggaaa

SEQ ID NO: 1103921 - RNA, 19 nt, Homo sapiens
aggauaggcccaggaguaa

SEQ ID NO: 1103922 - RNA, 19 nt, Homo sapiens
gaaguuaauaaagcaccuu

SEQ ID NO: 1103923 - RNA, 19 nt, Homo sapiens
aaagaugcucauuauagug

SEQ ID NO: 1103924 - RNA, 19 nt, Homo sapiens
gaugcucauuauagugaag

SEQ ID NO: 1103925 - RNA, 19 nt, Homo sapiens
ggugagacagcugauggaa

SEQ ID NO: 1103926 - RNA, 19 nt, Homo sapiens
gaaggaaucccaguucuaa

SEQ ID NO: 1103927 - RNA, 19 nt, Homo sapiens
gguccaagauguauaauuc

SEQ ID NO: 1103928 - RNA, 19 nt, Homo sapiens
ggaagcaacuagcagagaa

SEQ ID NO: 1103929 - RNA, 19 nt, Homo sapiens
caaaguauguaggauguuu

SEQ ID NO: 1103930 - RNA, 19 nt, Homo sapiens
aaaucaaccuugcuucaua

SEQ ID NO: 1103931 - RNA, 19 nt, Homo sapiens
gugaaagcauucuguguuu

SEQ ID NO: 1103932 - RNA, 19 nt, Homo sapiens
ggagaggccuuuaccaagu

SEQ ID NO: 1103933 - RNA, 19 nt, Homo sapiens
gcgcguacuugcuuuguaa

SEQ ID NO: 1103934 - RNA, 19 nt, Homo sapiens
gguccuagauuguggauau

SEQ ID NO: 1103935 - RNA, 19 nt, Homo sapiens
cagauugcuugcagaaaua

SEQ ID NO: 1103936 - RNA, 19 nt, Homo sapiens
ucagaguuguucaguauaa

SEQ ID NO: 1103937 - RNA, 19 nt, Homo sapiens
gagauucaguuguggaaau

SEQ ID NO: 1103938 - RNA, 19 nt, Homo sapiens
gaaacugguccaagaugua

SEQ ID NO: 1103939 - RNA, 19 nt, Homo sapiens
caaccuugcuucauaucaa

SEQ ID NO: 1103940 - RNA, 19 nt, Homo sapiens
ugaaagcauucuguguuua

SEQ ID NO: 1103941 - RNA, 19 nt, Homo sapiens
gcagagaauuugguaguca

SEQ ID NO: 1103942 - RNA, 19 nt, Homo sapiens
gaaucccaguucuaaauug

SEQ ID NO: 1103943 - RNA, 19 nt, Homo sapiens
ggaauucauccacauacua

SEQ ID NO: 1103944 - RNA, 19 nt, Homo sapiens
gcaacuagcagagaauuug

SEQ ID NO: 1103945 - RNA, 19 nt, Homo sapiens
ugucagaguuguucaguau

SEQ ID NO: 1103946 - RNA, 19 nt, Homo sapiens
aaagcaagcaguuugauuu

SEQ ID NO: 1103947 - RNA, 19 nt, Homo sapiens
ggacuauaguggaagugaa

SEQ ID NO: 1103948 - RNA, 19 nt, Homo sapiens
gaauucauccacauacuau

SEQ ID NO: 1103949 - RNA, 19 nt, Homo sapiens
aaugguagcuggugcuuau

SEQ ID NO: 1103950 - RNA, 19 nt, Homo sapiens
gauguuugaugucgggaaa

SEQ ID NO: 1103951 - RNA, 19 nt, Homo sapiens
caggauuucuccacagauu

SEQ ID NO: 1103952 - RNA, 19 nt, Homo sapiens
uaacccaccuuuggaaaug

SEQ ID NO: 1103953 - RNA, 19 nt, Homo sapiens
acagauugcuugcagaaau

SEQ ID NO: 1103954 - RNA, 19 nt, Homo sapiens
aaacucaacuauuggaaca

SEQ ID NO: 1103955 - RNA, 19 nt, Homo sapiens
gaucugaagcgaggacuaa

SEQ ID NO: 1103956 - RNA, 19 nt, Homo sapiens
ggaaucccaguucuaaauu

SEQ ID NO: 1103957 - RNA, 19 nt, Homo sapiens
gaaucgguauuauguccuu

SEQ ID NO: 1103958 - RNA, 19 nt, Homo sapiens
uaaaggaauucauccacau

SEQ ID NO: 1103959 - RNA, 19 nt, Homo sapiens
ccacugagaaauagaaguu

SEQ ID NO: 1103960 - RNA, 19 nt, Homo sapiens
ggagagaagauuuuacaua

SEQ ID NO: 1103961 - RNA, 19 nt, Homo sapiens
gagaggccuuuaccaagug

SEQ ID NO: 1103962 - RNA, 19 nt, Homo sapiens
gauuguggauauagggaaa

SEQ ID NO: 1103963 - RNA, 19 nt, Homo sapiens
gguagcuggugcuuauuga

SEQ ID NO: 1103964 - RNA, 19 nt, Homo sapiens
ugaacaagauaaugaagag

SEQ ID NO: 1103965 - RNA, 19 nt, Homo sapiens
gauguauaauuccuagugu

SEQ ID NO: 1103966 - RNA, 19 nt, Homo sapiens
gaaagcauucuguguuuac

SEQ ID NO: 1103967 - RNA, 19 nt, Homo sapiens
gaagacggcggucgugauc

SEQ ID NO: 1103968 - RNA, 19 nt, Homo sapiens
gcacuuggcacuaagacau

SEQ ID NO: 1103969 - RNA, 19 nt, Homo sapiens
aggaaaagcucuucacaaa

SEQ ID NO: 1103970 - RNA, 19 nt, Homo sapiens
cuaauuguguggccugguu

SEQ ID NO: 1103971 - RNA, 19 nt, Homo sapiens
cacaaguguugcuaaagaa

SEQ ID NO: 1103972 - RNA, 19 nt, Homo sapiens
uaucgaaucgguauuaugu

SEQ ID NO: 1103973 - RNA, 19 nt, Homo sapiens
aaucaaccuugcuucauau

SEQ ID NO: 1103974 - RNA, 19 nt, Homo sapiens
uaaagcaagcaguuugauu

SEQ ID NO: 1103975 - RNA, 19 nt, Homo sapiens
ggaagugaaagcauucugu

SEQ ID NO: 1103976 - RNA, 19 nt, Homo sapiens
ccacuuuaauauuggauuc

SEQ ID NO: 1103977 - RNA, 19 nt, Homo sapiens
gguguuacccauauaugaa

SEQ ID NO: 1103978 - RNA, 19 nt, Homo sapiens
uggaaaugauguuugaugu

SEQ ID NO: 1103979 - RNA, 19 nt, Homo sapiens
gagaaacugguccaagaug

SEQ ID NO: 1103980 - RNA, 19 nt, Homo sapiens
gccaggauuucuccacaga

SEQ ID NO: 1103981 - RNA, 19 nt, Homo sapiens
ucaguugccacuuuaauau

SEQ ID NO: 1103982 - RNA, 19 nt, Homo sapiens
gcaaauuguacaaaguaug

SEQ ID NO: 1103983 - RNA, 19 nt, Homo sapiens
caauaacccaccuuuggaa

SEQ ID NO: 1103984 - RNA, 19 nt, Homo sapiens
ggagaaacugguccaagau

SEQ ID NO: 1103985 - RNA, 19 nt, Homo sapiens
aaaggaauucauccacaua

SEQ ID NO: 1103986 - RNA, 19 nt, Homo sapiens
gccuaagccugucagaguu

SEQ ID NO: 1103987 - RNA, 19 nt, Homo sapiens
cauucuguguuuacucuuu

SEQ ID NO: 1103988 - RNA, 19 nt, Homo sapiens
gagccguucuguuucaaag

SEQ ID NO: 1103989 - RNA, 19 nt, Homo sapiens
cuugggagccguucuguuu

SEQ ID NO: 1103990 - RNA, 19 nt, Homo sapiens
uaaugaagagcaaucaguu

SEQ ID NO: 1103991 - RNA, 19 nt, Homo sapiens
acaauguacuguugacaca

SEQ ID NO: 1103992 - RNA, 19 nt, Homo sapiens
caucuaauggcucuucuga

SEQ ID NO: 1103993 - RNA, 19 nt, Homo sapiens
guguuuacucuuugcauua

SEQ ID NO: 1103994 - RNA, 19 nt, Homo sapiens
ccacagauugcuugcagaa

SEQ ID NO: 1103995 - RNA, 19 nt, Homo sapiens
ucaggcaucuauuggugaa

SEQ ID NO: 1103996 - RNA, 19 nt, Homo sapiens
ucaauaacccaccuuugga

SEQ ID NO: 1103997 - RNA, 19 nt, Homo sapiens
uuuggagcauuacaagaua

SEQ ID NO: 1103998 - RNA, 19 nt, Homo sapiens
agaaacugguccaagaugu

SEQ ID NO: 1103999 - RNA, 19 nt, Homo sapiens
uaguggaagugaaagcauu

SEQ ID NO: 1104000 - RNA, 19 nt, Homo sapiens
gacuauaguggaagugaaa

SEQ ID NO: 1104001 - RNA, 19 nt, Homo sapiens
ugaaggaaucccaguucua

SEQ ID NO: 1104002 - RNA, 19 nt, Homo sapiens
cuucugacgcuuggaauua

SEQ ID NO: 1104003 - RNA, 19 nt, Homo sapiens
ugacuuuguuucucuugug

SEQ ID NO: 1104004 - RNA, 19 nt, Homo sapiens
gccguucuguuucaaagga

SEQ ID NO: 1104005 - RNA, 19 nt, Homo sapiens
gacauuaaagcgcguacuu

SEQ ID NO: 1104006 - RNA, 19 nt, Homo sapiens
ggaaacucaacuauuggaa

SEQ ID NO: 1104007 - RNA, 19 nt, Homo sapiens
gcuggugcuuauugagauu

SEQ ID NO: 1104008 - RNA, 19 nt, Homo sapiens
ggaaaugauguuugauguc

SEQ ID NO: 1104009 - RNA, 19 nt, Homo sapiens
cuuuggaaaugauguuuga

SEQ ID NO: 1104010 - RNA, 19 nt, Homo sapiens
uuacuaccaugccgcucua

SEQ ID NO: 1104011 - RNA, 19 nt, Homo sapiens
gcaagcaguuugauuuugg

SEQ ID NO: 1104012 - RNA, 19 nt, Homo sapiens
acugagaaauagaaguuug

SEQ ID NO: 1104013 - RNA, 19 nt, Homo sapiens
ccugauugguguucucuca

SEQ ID NO: 1104014 - RNA, 19 nt, Homo sapiens
acaagauaaugaagagcaa

SEQ ID NO: 1104015 - RNA, 19 nt, Homo sapiens
agucauagguggcacuucu

SEQ ID NO: 1104016 - RNA, 19 nt, Homo sapiens
gaagcaacuagcagagaau

SEQ ID NO: 1104017 - RNA, 19 nt, Homo sapiens
gggaaagccugguguuacc

SEQ ID NO: 1104018 - RNA, 19 nt, Homo sapiens
agauucaguuguggaaauu

SEQ ID NO: 1104019 - RNA, 19 nt, Homo sapiens
uuagauggagagaagauuu

SEQ ID NO: 1104020 - RNA, 19 nt, Homo sapiens
acccauauaugaaggaauc

SEQ ID NO: 1104021 - RNA, 19 nt, Homo sapiens
uagggaaagccugguguua

SEQ ID NO: 1104022 - RNA, 19 nt, Homo sapiens
aaagagcugggaugccuaa

SEQ ID NO: 1104023 - RNA, 19 nt, Homo sapiens
uauaguaaagcaagcaguu

SEQ ID NO: 1104024 - RNA, 19 nt, Homo sapiens
uguguuuacucuuugcauu

SEQ ID NO: 1104025 - RNA, 19 nt, Homo sapiens
cugcgacccucuucucuca

SEQ ID NO: 1104026 - RNA, 19 nt, Homo sapiens
gaacagagcacgguauaaa

SEQ ID NO: 1104027 - RNA, 19 nt, Homo sapiens
gagcugacauggacccaaa

SEQ ID NO: 1104028 - RNA, 19 nt, Homo sapiens
gagcacgguauaaauaaua

SEQ ID NO: 1104029 - RNA, 19 nt, Homo sapiens
gaugugaacuccuuaacuc

SEQ ID NO: 1104030 - RNA, 19 nt, Homo sapiens
ggagagagaagaugagguu

SEQ ID NO: 1104031 - RNA, 19 nt, Homo sapiens
cuccuuaacucaucaagua

SEQ ID NO: 1104032 - RNA, 19 nt, Homo sapiens
ugucuucucuuucgacuuu

SEQ ID NO: 1104033 - RNA, 19 nt, Homo sapiens
gagagaagaugagguugga

SEQ ID NO: 1104034 - RNA, 19 nt, Homo sapiens
gacaagaugccacugcuuu

SEQ ID NO: 1104035 - RNA, 19 nt, Homo sapiens
acagagcacgguauaaaua

SEQ ID NO: 1104036 - RNA, 19 nt, Homo sapiens
agaccagacucuuuacuug

SEQ ID NO: 1104037 - RNA, 19 nt, Homo sapiens
gaguuugucuuuccucugu

SEQ ID NO: 1104038 - RNA, 19 nt, Homo sapiens
acaagugucucuagaugga

SEQ ID NO: 1104039 - RNA, 19 nt, Homo sapiens
gcaacccucccaccaguuu

SEQ ID NO: 1104040 - RNA, 19 nt, Homo sapiens
uuaacccucuccugcuuua

SEQ ID NO: 1104041 - RNA, 19 nt, Homo sapiens
gggauuguguaccuuucua

SEQ ID NO: 1104042 - RNA, 19 nt, Homo sapiens
ccugagauaugauuugcaa

SEQ ID NO: 1104043 - RNA, 19 nt, Homo sapiens
aagccaugcugccuccuua

SEQ ID NO: 1104044 - RNA, 19 nt, Homo sapiens
cagagcacgguauaaauaa

SEQ ID NO: 1104045 - RNA, 19 nt, Homo sapiens
caaaugaggagagagaaga

SEQ ID NO: 1104046 - RNA, 19 nt, Homo sapiens
gaugggugcggguaacuuu

SEQ ID NO: 1104047 - RNA, 19 nt, Homo sapiens
gaaggauggugggauugug

SEQ ID NO: 1104048 - RNA, 19 nt, Homo sapiens
gaaggaugggugcggguaa

SEQ ID NO: 1104049 - RNA, 19 nt, Homo sapiens
ugaccacgcuggcuauucu

SEQ ID NO: 1104050 - RNA, 19 nt, Homo sapiens
ggacacacuggagcaagua

SEQ ID NO: 1104051 - RNA, 19 nt, Homo sapiens
aagaugagguuggacaaga

SEQ ID NO: 1104052 - RNA, 19 nt, Homo sapiens
gacaggaccacaucuagga

SEQ ID NO: 1104053 - RNA, 19 nt, Homo sapiens
ggaugcagcagauguguuc

SEQ ID NO: 1104054 - RNA, 19 nt, Homo sapiens
ggacccggaugcagcagau

SEQ ID NO: 1104055 - RNA, 19 nt, Homo sapiens
cugcauagcccaaauccaa

SEQ ID NO: 1104056 - RNA, 19 nt, Homo sapiens
caaccugcauagcccaaau

SEQ ID NO: 1104057 - RNA, 19 nt, Homo sapiens
ggaacagagcacgguauaa

SEQ ID NO: 1104058 - RNA, 19 nt, Homo sapiens
ugggaaggauggugggauu

SEQ ID NO: 1104059 - RNA, 19 nt, Homo sapiens
gcccaaauccaagugauga

SEQ ID NO: 1104060 - RNA, 19 nt, Homo sapiens
ccuaaaccaucccguaguc

SEQ ID NO: 1104061 - RNA, 19 nt, Homo sapiens
ucucauccauggaagugaa

SEQ ID NO: 1104062 - RNA, 19 nt, Homo sapiens
gugaacuccuuaacucauc

SEQ ID NO: 1104063 - RNA, 19 nt, Homo sapiens
gcuuacuccugagauauga

SEQ ID NO: 1104064 - RNA, 19 nt, Homo sapiens
cgacuuugcagcuguacuu

SEQ ID NO: 1104065 - RNA, 19 nt, Homo sapiens
ggacaagaugccacugcuu

SEQ ID NO: 1104066 - RNA, 19 nt, Homo sapiens
ggauuguguaccuuucuaa

SEQ ID NO: 1104067 - RNA, 19 nt, Homo sapiens
ggaaggauggugggauugu

SEQ ID NO: 1104068 - RNA, 19 nt, Homo sapiens
ucagacaggaccacaucua

SEQ ID NO: 1104069 - RNA, 19 nt, Homo sapiens
gcaaaugaggagagagaag

SEQ ID NO: 1104070 - RNA, 19 nt, Homo sapiens
gauacgcccuuggcacagu

SEQ ID NO: 1104071 - RNA, 19 nt, Homo sapiens
uggaacagagcacgguaua

SEQ ID NO: 1104072 - RNA, 19 nt, Homo sapiens
agauggaugugaacuccuu

SEQ ID NO: 1104073 - RNA, 19 nt, Homo sapiens
cuuugcagcuguacuuguu

SEQ ID NO: 1104074 - RNA, 19 nt, Homo sapiens
aauuaacccucuccugcuu

SEQ ID NO: 1104075 - RNA, 19 nt, Homo sapiens
caugcugccuccuuacauc

SEQ ID NO: 1104076 - RNA, 19 nt, Homo sapiens
agagcacgguauaaauaau

SEQ ID NO: 1104077 - RNA, 19 nt, Homo sapiens
uaaaccaucccguagucuu

SEQ ID NO: 1104078 - RNA, 19 nt, Homo sapiens
gaagaugagguuggacaag

SEQ ID NO: 1104079 - RNA, 19 nt, Homo sapiens
caucagacaggaccacauc

SEQ ID NO: 1104080 - RNA, 19 nt, Homo sapiens
ggugggauuguguaccuuu

SEQ ID NO: 1104081 - RNA, 19 nt, Homo sapiens
ugaacuccuuaacucauca

SEQ ID NO: 1104082 - RNA, 19 nt, Homo sapiens
gauggaugugaacuccuua

SEQ ID NO: 1104083 - RNA, 19 nt, Homo sapiens
gaugagguuggacaagaug

SEQ ID NO: 1104084 - RNA, 19 nt, Homo sapiens
ccaaauccaagugaugaug

SEQ ID NO: 1104085 - RNA, 19 nt, Homo sapiens
ggaugugaacuccuuaacu

SEQ ID NO: 1104086 - RNA, 19 nt, Homo sapiens
agaugagguuggacaagau

SEQ ID NO: 1104087 - RNA, 19 nt, Homo sapiens
gcauagcccaaauccaagu

SEQ ID NO: 1104088 - RNA, 19 nt, Homo sapiens
ucuccugcuuuacugcuaa

SEQ ID NO: 1104089 - RNA, 19 nt, Homo sapiens
ugcagcagauguguucuug

SEQ ID NO: 1104090 - RNA, 19 nt, Homo sapiens
gaacuccuuaacucaucaa

SEQ ID NO: 1104091 - RNA, 19 nt, Homo sapiens
uuggcuuacuccugagaua

SEQ ID NO: 1104092 - RNA, 19 nt, Homo sapiens
gucucuagauggaugugaa

SEQ ID NO: 1104093 - RNA, 19 nt, Homo sapiens
cagacaggaccacaucuag

SEQ ID NO: 1104094 - RNA, 19 nt, Homo sapiens
uagguaguaucucauccau

SEQ ID NO: 1104095 - RNA, 19 nt, Homo sapiens
gcagagagcuauauuugga

SEQ ID NO: 1104096 - RNA, 19 nt, Homo sapiens
gaacucauuuaccucauuu

SEQ ID NO: 1104097 - RNA, 19 nt, Homo sapiens
caaacaggauugucacuuu

SEQ ID NO: 1104098 - RNA, 19 nt, Homo sapiens
ccucauuucuugccaauua

SEQ ID NO: 1104099 - RNA, 19 nt, Homo sapiens
gaaaggagagcgugggaua

SEQ ID NO: 1104100 - RNA, 19 nt, Homo sapiens
gaaacuaaaucucuagaag

SEQ ID NO: 1104101 - RNA, 19 nt, Homo sapiens
aaacaggauugucacuuua

SEQ ID NO: 1104102 - RNA, 19 nt, Homo sapiens
ggauaaaguucccggagaa

SEQ ID NO: 1104103 - RNA, 19 nt, Homo sapiens
ucauuuaccucauuucuug

SEQ ID NO: 1104104 - RNA, 19 nt, Homo sapiens
ggaaguaauuagagcuuug

SEQ ID NO: 1104105 - RNA, 19 nt, Homo sapiens
guaaagcuccagugacuaa

SEQ ID NO: 1104106 - RNA, 19 nt, Homo sapiens
gggugggccugcaaauuua

SEQ ID NO: 1104107 - RNA, 19 nt, Homo sapiens
aagaauggcuaaagcaauu

SEQ ID NO: 1104108 - RNA, 19 nt, Homo sapiens
gacaagcucucaaaguguu

SEQ ID NO: 1104109 - RNA, 19 nt, Homo sapiens
gcacaagaauggcuaaagc

SEQ ID NO: 1104110 - RNA, 19 nt, Homo sapiens
uagacaagcucucaaagug

SEQ ID NO: 1104111 - RNA, 19 nt, Homo sapiens
gaaauaaucggaaguagac

SEQ ID NO: 1104112 - RNA, 19 nt, Homo sapiens
gaucagauucguccacaaa

SEQ ID NO: 1104113 - RNA, 19 nt, Homo sapiens
caaagagaugggcauaaua

SEQ ID NO: 1104114 - RNA, 19 nt, Homo sapiens
acaaagagaugggcauaau

SEQ ID NO: 1104115 - RNA, 19 nt, Homo sapiens
gcaugugauuucagguuaa

SEQ ID NO: 1104116 - RNA, 19 nt, Homo sapiens
ggagagcgugggauaguaa

SEQ ID NO: 1104117 - RNA, 19 nt, Homo sapiens
ggacaaaauugcuacauca

SEQ ID NO: 1104118 - RNA, 19 nt, Homo sapiens
gaacaauccaaguagaaug

SEQ ID NO: 1104119 - RNA, 19 nt, Homo sapiens
gauugucacuuuauaguac

SEQ ID NO: 1104120 - RNA, 19 nt, Homo sapiens
ggaaacaaaggcacgcaaa

SEQ ID NO: 1104121 - RNA, 19 nt, Homo sapiens
uagaggcuauugcuaagaa

SEQ ID NO: 1104122 - RNA, 19 nt, Homo sapiens
gagaugggcauaauaccaa

SEQ ID NO: 1104123 - RNA, 19 nt, Homo sapiens
gaggagaggaccuacaaga

SEQ ID NO: 1104124 - RNA, 19 nt, Homo sapiens
ggaggaagcauuacagaac

SEQ ID NO: 1104125 - RNA, 19 nt, Homo sapiens
ggauugucacuuuauagua

SEQ ID NO: 1104126 - RNA, 19 nt, Homo sapiens
acaggauugucacuuuaua

SEQ ID NO: 1104127 - RNA, 19 nt, Homo sapiens
cugcguaauuggaacauuu

SEQ ID NO: 1104128 - RNA, 19 nt, Homo sapiens
ccaaguaaagcuccaguga

SEQ ID NO: 1104129 - RNA, 19 nt, Homo sapiens
ucagauucguccacaaaga

SEQ ID NO: 1104130 - RNA, 19 nt, Homo sapiens
gagaagaggagaggaccua

SEQ ID NO: 1104131 - RNA, 19 nt, Homo sapiens
gaaguaauuagagcuuuga

SEQ ID NO: 1104132 - RNA, 19 nt, Homo sapiens
ggaaguagacaagcucuca

SEQ ID NO: 1104133 - RNA, 19 nt, Homo sapiens
ugaacucauuuaccucauu

SEQ ID NO: 1104134 - RNA, 19 nt, Homo sapiens
gagaagacgcggagaagag

SEQ ID NO: 1104135 - RNA, 19 nt, Homo sapiens
cccuuaaacuggauucaaa

SEQ ID NO: 1104136 - RNA, 19 nt, Homo sapiens
gcauuggcauucuuacucu

SEQ ID NO: 1104137 - RNA, 19 nt, Homo sapiens
ggagaggaccuacaagaac

SEQ ID NO: 1104138 - RNA, 19 nt, Homo sapiens
ccacaaagagaugggcaua

SEQ ID NO: 1104139 - RNA, 19 nt, Homo sapiens
ugaaauaaucggaaguaga

SEQ ID NO: 1104140 - RNA, 19 nt, Homo sapiens
ggguggaggagcagaauuu

SEQ ID NO: 1104141 - RNA, 19 nt, Homo sapiens
uagaagaggcacaagaaug

SEQ ID NO: 1104142 - RNA, 19 nt, Homo sapiens
acauaggaaugguugaaga

SEQ ID NO: 1104143 - RNA, 19 nt, Homo sapiens
guagacaagcucucaaagu

SEQ ID NO: 1104144 - RNA, 19 nt, Homo sapiens
ccacccggcuaguugaaau

SEQ ID NO: 1104145 - RNA, 19 nt, Homo sapiens
ggagcagaauuuacuacag

SEQ ID NO: 1104146 - RNA, 19 nt, Homo sapiens
ggaggagcagaauuuacua

SEQ ID NO: 1104147 - RNA, 19 nt, Homo sapiens
guuaugaugcuacaacuuc

SEQ ID NO: 1104148 - RNA, 19 nt, Homo sapiens
caauuacucccuuggguau

SEQ ID NO: 1104149 - RNA, 19 nt, Homo sapiens
aagcuccagugacuaauau

SEQ ID NO: 1104150 - RNA, 19 nt, Homo sapiens
caagaauggcuaaagcaau

SEQ ID NO: 1104151 - RNA, 19 nt, Homo sapiens
agaauuuacuacagcaugu

SEQ ID NO: 1104152 - RNA, 19 nt, Homo sapiens
gaaaaucaccauaggaauc

SEQ ID NO: 1104153 - RNA, 19 nt, Homo sapiens
aaucugaacucauuuaccu

SEQ ID NO: 1104154 - RNA, 19 nt, Homo sapiens
aaguaaagcuccagugacu

SEQ ID NO: 1104155 - RNA, 19 nt, Homo sapiens
gcaccacccggcuaguuga

SEQ ID NO: 1104156 - RNA, 19 nt, Homo sapiens
gauaaaguucccggagaaa

SEQ ID NO: 1104157 - RNA, 19 nt, Homo sapiens
guugaaauaaucggaagua

SEQ ID NO: 1104158 - RNA, 19 nt, Homo sapiens
aaagagaugggcauaauac

SEQ ID NO: 1104159 - RNA, 19 nt, Homo sapiens
agcaugugauuucagguua

SEQ ID NO: 1104160 - RNA, 19 nt, Homo sapiens
gguggaggagcagaauuua

SEQ ID NO: 1104161 - RNA, 19 nt, Homo sapiens
ggagacuuccuuuaauaag

SEQ ID NO: 1104162 - RNA, 19 nt, Homo sapiens
aaagcuccagugacuaaua

SEQ ID NO: 1104163 - RNA, 19 nt, Homo sapiens
gcaaauuuagaggcuauug

SEQ ID NO: 1104164 - RNA, 19 nt, Homo sapiens
aaacauaggaaugguugaa

SEQ ID NO: 1104165 - RNA, 19 nt, Homo sapiens
uuacucccuuggguauuua

SEQ ID NO: 1104166 - RNA, 19 nt, Homo sapiens
uccagugacuaauauguau

SEQ ID NO: 1104167 - RNA, 19 nt, Homo sapiens
aaagagaagacgcggagaa

SEQ ID NO: 1104168 - RNA, 19 nt, Homo sapiens
aggcagagagcuauauuug

SEQ ID NO: 1104169 - RNA, 19 nt, Homo sapiens
gaaguagacaagcucucaa

SEQ ID NO: 1104170 - RNA, 19 nt, Homo sapiens
gguucaagguugggcauug

SEQ ID NO: 1104171 - RNA, 19 nt, Homo sapiens
ugaucugaaugcugugaaa

SEQ ID NO: 1104172 - RNA, 19 nt, Homo sapiens
guggauccauugaccuuca

SEQ ID NO: 1104173 - RNA, 19 nt, Homo sapiens
cggaaguaauuagagcuuu

SEQ ID NO: 1104174 - RNA, 19 nt, Homo sapiens
ccaagggccaccggaagua

SEQ ID NO: 1104175 - RNA, 19 nt, Homo sapiens
gcuaaagcaauucauccaa

SEQ ID NO: 1104176 - RNA, 19 nt, Homo sapiens
ucuagaagaggcacaagaa

SEQ ID NO: 1104177 - RNA, 19 nt, Homo sapiens
gaagaggagaggaccuaca

SEQ ID NO: 1104178 - RNA, 19 nt, Homo sapiens
gaaacaaaggcacgcaaaa

SEQ ID NO: 1104179 - RNA, 19 nt, Homo sapiens
caaaauugcuacaucaaac

SEQ ID NO: 1104180 - RNA, 19 nt, Homo sapiens
agaagaggcacaagaaugg

SEQ ID NO: 1104181 - RNA, 19 nt, Homo sapiens
gcucuaaacauaggaaugg

SEQ ID NO: 1104182 - RNA, 19 nt, Homo sapiens
ccggcuaguugaaauaauc

SEQ ID NO: 1104183 - RNA, 19 nt, Homo sapiens
caagggccaccggaaguaa

SEQ ID NO: 1104184 - RNA, 19 nt, Homo sapiens
caauccaaguagaaugaau

SEQ ID NO: 1104185 - RNA, 19 nt, Homo sapiens
ucugaacaauccaaguaga

SEQ ID NO: 1104186 - RNA, 19 nt, Homo sapiens
acucugaacaauccaagua

SEQ ID NO: 1104187 - RNA, 19 nt, Homo sapiens
ccagugacuaauauguaua

SEQ ID NO: 1104188 - RNA, 19 nt, Homo sapiens
gaugaaacuaaaucucuag

SEQ ID NO: 1104189 - RNA, 19 nt, Homo sapiens
cagagaguaagaucagauu

SEQ ID NO: 1104190 - RNA, 19 nt, Homo sapiens
cugcaaauuuagaggcuau

SEQ ID NO: 1104191 - RNA, 19 nt, Homo sapiens
ggggugggccugcaaauuu

SEQ ID NO: 1104192 - RNA, 19 nt, Homo sapiens
uuacagaacgaaagagauc

SEQ ID NO: 1104193 - RNA, 19 nt, Homo sapiens
auauuuggaggaagcauua

SEQ ID NO: 1104194 - RNA, 19 nt, Homo sapiens
caugugauuucagguuaau

SEQ ID NO: 1104195 - RNA, 19 nt, Homo sapiens
gaagacauaugcaucauug

SEQ ID NO: 1104196 - RNA, 19 nt, Homo sapiens
ccucuagucuuucagauua

SEQ ID NO: 1104197 - RNA, 19 nt, Homo sapiens
ggauagagaugucaauaag

SEQ ID NO: 1104198 - RNA, 19 nt, Homo sapiens
gguuaaacaugaugcuuug

SEQ ID NO: 1104199 - RNA, 19 nt, Homo sapiens
agacgcugcuucaagguua

SEQ ID NO: 1104200 - RNA, 19 nt, Homo sapiens
gcuucaagguuaaacauga

SEQ ID NO: 1104201 - RNA, 19 nt, Homo sapiens
ggucauagaaaucauagaa

SEQ ID NO: 1104202 - RNA, 19 nt, Homo sapiens
ggacuaagccauguggauu

SEQ ID NO: 1104203 - RNA, 19 nt, Homo sapiens
ggucuuaucuccugauggu

SEQ ID NO: 1104204 - RNA, 19 nt, Homo sapiens
aaagaggacucaggcauug

SEQ ID NO: 1104205 - RNA, 19 nt, Homo sapiens
ggacuaagccaagggauuc

SEQ ID NO: 1104206 - RNA, 19 nt, Homo sapiens
augaaugguugcuaacuua

SEQ ID NO: 1104207 - RNA, 19 nt, Homo sapiens
ggcgauuccucuagucuuu

SEQ ID NO: 1104208 - RNA, 19 nt, Homo sapiens
ccugguauauaacagauaa

SEQ ID NO: 1104209 - RNA, 19 nt, Homo sapiens
gaacuuaaucuuucaugag

SEQ ID NO: 1104210 - RNA, 19 nt, Homo sapiens
gaggauagagaugucaaua

SEQ ID NO: 1104211 - RNA, 19 nt, Homo sapiens
ucuauaccauuaugcagua

SEQ ID NO: 1104212 - RNA, 19 nt, Homo sapiens
uaaagaggacucaggcauu

SEQ ID NO: 1104213 - RNA, 19 nt, Homo sapiens
gguaugaggcugggacuaa

SEQ ID NO: 1104214 - RNA, 19 nt, Homo sapiens
ggaugacggugggaacuga

SEQ ID NO: 1104215 - RNA, 19 nt, Homo sapiens
gaugcuuuguauucagaua

SEQ ID NO: 1104216 - RNA, 19 nt, Homo sapiens
ucaauaagcagccacuguu

SEQ ID NO: 1104217 - RNA, 19 nt, Homo sapiens
ugaagagacacuugagaaa

SEQ ID NO: 1104218 - RNA, 19 nt, Homo sapiens
uggcauaguuugugguguu

SEQ ID NO: 1104219 - RNA, 19 nt, Homo sapiens
ugucuacuguuguuacuga

SEQ ID NO: 1104220 - RNA, 19 nt, Homo sapiens
gagaaacugaggauagaga

SEQ ID NO: 1104221 - RNA, 19 nt, Homo sapiens
uauccagugucaauaaaug

SEQ ID NO: 1104222 - RNA, 19 nt, Homo sapiens
aggcauugcugaaagaguu

SEQ ID NO: 1104223 - RNA, 19 nt, Homo sapiens
uaaacaugaugcuuugaag

SEQ ID NO: 1104224 - RNA, 19 nt, Homo sapiens
gaggaagcgcccaagguuu

SEQ ID NO: 1104225 - RNA, 19 nt, Homo sapiens
caauaagcagccacuguuu

SEQ ID NO: 1104226 - RNA, 19 nt, Homo sapiens
auagagaugucaauaagca

SEQ ID NO: 1104227 - RNA, 19 nt, Homo sapiens
ucacugauuggcauaguuu

SEQ ID NO: 1104228 - RNA, 19 nt, Homo sapiens
cagauaauauaagcaagga

SEQ ID NO: 1104229 - RNA, 19 nt, Homo sapiens
gcugguuucucuggaauau

SEQ ID NO: 1104230 - RNA, 19 nt, Homo sapiens
aacaacagcugguuucucu

SEQ ID NO: 1104231 - RNA, 19 nt, Homo sapiens
gcugaaagaguuaaaagua

SEQ ID NO: 1104232 - RNA, 19 nt, Homo sapiens
gcuaggagcgcccaagcuu

SEQ ID NO: 1104233 - RNA, 19 nt, Homo sapiens
gaagagacacuugagaaaa

SEQ ID NO: 1104234 - RNA, 19 nt, Homo sapiens
ugaggaagcgcccaaggaa

SEQ ID NO: 1104235 - RNA, 19 nt, Homo sapiens
cauuuugccugguauauaa

SEQ ID NO: 1104236 - RNA, 19 nt, Homo sapiens
aaugaaugguugcuaacuu

SEQ ID NO: 1104237 - RNA, 19 nt, Homo sapiens
ggaaggguuuuaauccauu

SEQ ID NO: 1104238 - RNA, 19 nt, Homo sapiens
ugaggaagcgcccaagguu

SEQ ID NO: 1104239 - RNA, 19 nt, Homo sapiens
guucugagcucggacuaag

SEQ ID NO: 1104240 - RNA, 19 nt, Homo sapiens
gaggaagcgcccaaggaaa

SEQ ID NO: 1104241 - RNA, 19 nt, Homo sapiens
ucucuggaauauucucaaa

SEQ ID NO: 1104242 - RNA, 19 nt, Homo sapiens
caugagaaacugaggauag

SEQ ID NO: 1104243 - RNA, 19 nt, Homo sapiens
ggcauaguuugugguguuu

SEQ ID NO: 1104244 - RNA, 19 nt, Homo sapiens
ugguuucucuggaauauuc

SEQ ID NO: 1104245 - RNA, 19 nt, Homo sapiens
ccaauggucauagaaauca

SEQ ID NO: 1104246 - RNA, 19 nt, Homo sapiens
gaaacugaggauagagaug

SEQ ID NO: 1104247 - RNA, 19 nt, Homo sapiens
uaauggcgauuccucuagu

SEQ ID NO: 1104248 - RNA, 19 nt, Homo sapiens
aaacaugaugcuuugaaga

SEQ ID NO: 1104249 - RNA, 19 nt, Homo sapiens
gaacaacagcugguuucuc

SEQ ID NO: 1104250 - RNA, 19 nt, Homo sapiens
aaacucagaagaccaaugg

SEQ ID NO: 1104251 - RNA, 19 nt, Homo sapiens
ccagugucaauaaauguaa

SEQ ID NO: 1104252 - RNA, 19 nt, Homo sapiens
gggacuaagccaagggauu

SEQ ID NO: 1104253 - RNA, 19 nt, Homo sapiens
gaagcgcccaaggaaauga

SEQ ID NO: 1104254 - RNA, 19 nt, Homo sapiens
augaugcuuugaagacaua

SEQ ID NO: 1104255 - RNA, 19 nt, Homo sapiens
aaacugaggauagagaugu

SEQ ID NO: 1104256 - RNA, 19 nt, Homo sapiens
gacgcugcuucaagguuaa

SEQ ID NO: 1104257 - RNA, 19 nt, Homo sapiens
cgauuccucuagucuuuca

SEQ ID NO: 1104258 - RNA, 19 nt, Homo sapiens
uggaauauucucaaacuuc

SEQ ID NO: 1104259 - RNA, 19 nt, Homo sapiens
ucuggaauauucucaaacu

SEQ ID NO: 1104260 - RNA, 19 nt, Homo sapiens
gcaaaacucagaagaccaa

SEQ ID NO: 1104261 - RNA, 19 nt, Homo sapiens
ggaagcgcccaaggaaaug

SEQ ID NO: 1104262 - RNA, 19 nt, Homo sapiens
guucagacgcugcuucaag

SEQ ID NO: 1104263 - RNA, 19 nt, Homo sapiens
guaugaggcugggacuaag

SEQ ID NO: 1104264 - RNA, 19 nt, Homo sapiens
uaauuuguucugugccuuu

SEQ ID NO: 1104265 - RNA, 19 nt, Homo sapiens
ccauuaugcaguauuugaa

SEQ ID NO: 1104266 - RNA, 19 nt, Homo sapiens
augagaaacugaggauaga

SEQ ID NO: 1104267 - RNA, 19 nt, Homo sapiens
ugaagacauaugcaucauu

SEQ ID NO: 1104268 - RNA, 19 nt, Homo sapiens
aggaagcgcccaaggaaau

SEQ ID NO: 1104269 - RNA, 19 nt, Homo sapiens
uaggagcgcccaagcuuuc

SEQ ID NO: 1104270 - RNA, 19 nt, Homo sapiens
cagcugguuucucuggaau

SEQ ID NO: 1104271 - RNA, 19 nt, Homo sapiens
caugaugcuuugaagacau

SEQ ID NO: 1104272 - RNA, 19 nt, Homo sapiens
acagcugguuucucuggaa

SEQ ID NO: 1104273 - RNA, 19 nt, Homo sapiens
ggcgacauuuggaacaaca

SEQ ID NO: 1104274 - RNA, 19 nt, Homo sapiens
aggauagagaugucaauaa

SEQ ID NO: 1104275 - RNA, 19 nt, Homo sapiens
uugaagagacacuugagaa

SEQ ID NO: 1104276 - RNA, 19 nt, Homo sapiens
ugaaauuaauggcgauucc

SEQ ID NO: 1104277 - RNA, 19 nt, Homo sapiens
ggcauugcugaaagaguua

SEQ ID NO: 1104278 - RNA, 19 nt, Homo sapiens
gacuaagccauguggauuc

SEQ ID NO: 1104279 - RNA, 19 nt, Homo sapiens
gaaggguuuuaauccauug

SEQ ID NO: 1104280 - RNA, 19 nt, Homo sapiens
gcucacugauuggcauagu

SEQ ID NO: 1104281 - RNA, 19 nt, Homo sapiens
cuucaagguuaaacaugau

SEQ ID NO: 1104282 - RNA, 19 nt, Homo sapiens
cgcccaagcuuucgguucu

SEQ ID NO: 1104283 - RNA, 19 nt, Homo sapiens
uacaugaagaguaaccaaa

SEQ ID NO: 1104284 - RNA, 19 nt, Homo sapiens
ucuuucagauuauguuugg

SEQ ID NO: 1104285 - RNA, 19 nt, Homo sapiens
ggauucagguguggaugac

SEQ ID NO: 1104286 - RNA, 19 nt, Homo sapiens
uugaugcuuuguauucaga

SEQ ID NO: 1104287 - RNA, 19 nt, Homo sapiens
gcccaagguuuucaagaug

SEQ ID NO: 1104288 - RNA, 19 nt, Homo sapiens
ugcaguauuugaagagaca

SEQ ID NO: 1104289 - RNA, 19 nt, Homo sapiens
acuaagccauguggauuca

SEQ ID NO: 1104290 - RNA, 19 nt, Homo sapiens
ggaaauauccuaagagaaa

SEQ ID NO: 1104291 - RNA, 19 nt, Homo sapiens
ggaaacauccuaugauaaa

SEQ ID NO: 1104292 - RNA, 19 nt, Homo sapiens
ucaagaagccgaucacuaa

SEQ ID NO: 1104293 - RNA, 19 nt, Homo sapiens
ggacagaacacaaagcauu

SEQ ID NO: 1104294 - RNA, 19 nt, Homo sapiens
ccaaauaucaccuuacaaa

SEQ ID NO: 1104295 - RNA, 19 nt, Homo sapiens
ucaagaagccucugccuaa

SEQ ID NO: 1104296 - RNA, 19 nt, Homo sapiens
gcauuguguucucuuaauu

SEQ ID NO: 1104297 - RNA, 19 nt, Homo sapiens
uaauucaucucacagaguu

SEQ ID NO: 1104298 - RNA, 19 nt, Homo sapiens
uuagagagcuauggugaaa

SEQ ID NO: 1104299 - RNA, 19 nt, Homo sapiens
ucaagaagccguuuauuac

SEQ ID NO: 1104300 - RNA, 19 nt, Homo sapiens
agacuguucuuguggaauu

SEQ ID NO: 1104301 - RNA, 19 nt, Homo sapiens
ucacagaguuacagcuuuc

SEQ ID NO: 1104302 - RNA, 19 nt, Homo sapiens
ucacagaguuacagcuuuc

SEQ ID NO: 1104303 - RNA, 19 nt, Homo sapiens
cucaagaagccguuuauua

SEQ ID NO: 1104304 - RNA, 19 nt, Homo sapiens
agcgaaagcuuccgagaaa

SEQ ID NO: 1104305 - RNA, 19 nt, Homo sapiens
gacagaacacaaagcauuu

SEQ ID NO: 1104306 - RNA, 19 nt, Homo sapiens
ggauucauuucacagaguu

SEQ ID NO: 1104307 - RNA, 19 nt, Homo sapiens
gaaacugcuuuguguucug

SEQ ID NO: 1104308 - RNA, 19 nt, Homo sapiens
gaaacugcuuuguguucug

SEQ ID NO: 1104309 - RNA, 19 nt, Homo sapiens
gagaaacggcauuguguuc

SEQ ID NO: 1104310 - RNA, 19 nt, Homo sapiens
guuaauucaucucacagaa

SEQ ID NO: 1104311 - RNA, 19 nt, Homo sapiens
gaaacggcauuguguucuc

SEQ ID NO: 1104312 - RNA, 19 nt, Homo sapiens
ucacagaauuacagcuuuc

SEQ ID NO: 1104313 - RNA, 19 nt, Homo sapiens
gaauuugcaaggugauauu

SEQ ID NO: 1104314 - RNA, 19 nt, Homo sapiens
ggaaacugcuuuguguucu

SEQ ID NO: 1104315 - RNA, 19 nt, Homo sapiens
agagagggcuauggugaaa

SEQ ID NO: 1104316 - RNA, 19 nt, Homo sapiens
ucacggaauuguagcuuuc

SEQ ID NO: 1104317 - RNA, 19 nt, Homo sapiens
cugcgaaacugcuuugugu

SEQ ID NO: 1104318 - RNA, 19 nt, Homo sapiens
cugagaaccugcuuugugu

SEQ ID NO: 1104319 - RNA, 19 nt, Homo sapiens
ugaauggacagaacacaaa

SEQ ID NO: 1104320 - RNA, 19 nt, Homo sapiens
ggcauuguguucucuuaau

SEQ ID NO: 1104321 - RNA, 19 nt, Homo sapiens
agacuguuguuguggaauu

SEQ ID NO: 1104322 - RNA, 19 nt, Homo sapiens
cggcuguucuuguggaauu

SEQ ID NO: 1104323 - RNA, 19 nt, Homo sapiens
caaagcauucuuagcgaaa

SEQ ID NO: 1104324 - RNA, 19 nt, Homo sapiens
uaagacuguuguuguggaa

SEQ ID NO: 1104325 - RNA, 19 nt, Homo sapiens
gcgaaacugcuuuguguuc

SEQ ID NO: 1104326 - RNA, 19 nt, Homo sapiens
ugcaaaggcuguuucuugu

SEQ ID NO: 1104327 - RNA, 19 nt, Homo sapiens
gggaaacugcuuuguguuc

SEQ ID NO: 1104328 - RNA, 19 nt, Homo sapiens
caagaagccucugccuaag

SEQ ID NO: 1104329 - RNA, 19 nt, Homo sapiens
aauuacagcuuucccuuca

SEQ ID NO: 1104330 - RNA, 19 nt, Homo sapiens
caaauuccacaaagcauuc

SEQ ID NO: 1104331 - RNA, 19 nt, Homo sapiens
gcuuccaaauaucaccuua

SEQ ID NO: 1104332 - RNA, 19 nt, Homo sapiens
uugcaaaggcuguuucuug

SEQ ID NO: 1104333 - RNA, 19 nt, Homo sapiens
gccuaagacuguuguugug

SEQ ID NO: 1104334 - RNA, 19 nt, Homo sapiens
guuaaaaccuggaaagaag

SEQ ID NO: 1104335 - RNA, 19 nt, Homo sapiens
ucaagaagccuuuugcaaa

SEQ ID NO: 1104336 - RNA, 19 nt, Homo sapiens
cugggaaacugcuuugugu

SEQ ID NO: 1104337 - RNA, 19 nt, Homo sapiens
ggaauuugcaaggugauau

SEQ ID NO: 1104338 - RNA, 19 nt, Homo sapiens
gcaaaggcuguuucuugug

SEQ ID NO: 1104339 - RNA, 19 nt, Homo sapiens
uguguucucuuaauucauc

SEQ ID NO: 1104340 - RNA, 19 nt, Homo sapiens
uaaagcccuuagagagcua

SEQ ID NO: 1104341 - RNA, 19 nt, Homo sapiens
uauuacggcuguucuugug

SEQ ID NO: 1104342 - RNA, 19 nt, Homo sapiens
ucagaugaauggacagaac

SEQ ID NO: 1104343 - RNA, 19 nt, Homo sapiens
ccugcuuuguguucuguua

SEQ ID NO: 1104344 - RNA, 19 nt, Homo sapiens
uguguucuguggauucauu

SEQ ID NO: 1104345 - RNA, 19 nt, Homo sapiens
gacuguuguuguggaauuu

SEQ ID NO: 1104346 - RNA, 19 nt, Homo sapiens
cgaaacugcuuuguguucu

SEQ ID NO: 1104347 - RNA, 19 nt, Homo sapiens
cgagaaacggcauuguguu

SEQ ID NO: 1104348 - RNA, 19 nt, Homo sapiens
uagcgaaagcuuccgagaa

SEQ ID NO: 1104349 - RNA, 19 nt, Homo sapiens
acaaauuccacaaagcauu

SEQ ID NO: 1104350 - RNA, 19 nt, Homo sapiens
aaacugcuuuguguucugu

SEQ ID NO: 1104351 - RNA, 19 nt, Homo sapiens
aaacugcuuuguguucugu

SEQ ID NO: 1104352 - RNA, 19 nt, Homo sapiens
uuacagcuuucccuucaag

SEQ ID NO: 1104353 - RNA, 19 nt, Homo sapiens
gcuuuguguucuguuaauu

SEQ ID NO: 1104354 - RNA, 19 nt, Homo sapiens
gcuuuguguucuguuaauu

SEQ ID NO: 1104355 - RNA, 19 nt, Homo sapiens
uuacagcuuucuccucaag

SEQ ID NO: 1104356 - RNA, 19 nt, Homo sapiens
aacugaagauauucccuuu

SEQ ID NO: 1104357 - RNA, 19 nt, Homo sapiens
uuacaaauuccacaaagca

SEQ ID NO: 1104358 - RNA, 19 nt, Homo sapiens
uuccaaauaucaccuuaca

SEQ ID NO: 1104359 - RNA, 19 nt, Homo sapiens
gaauggacagaacacaaag

SEQ ID NO: 1104360 - RNA, 19 nt, Homo sapiens
cagagagggcuauggugaa

SEQ ID NO: 1104361 - RNA, 19 nt, Homo sapiens
ccgagaaacggcauugugu

SEQ ID NO: 1104362 - RNA, 19 nt, Homo sapiens
ucugagaaccugcuuugug

SEQ ID NO: 1104363 - RNA, 19 nt, Homo sapiens
gcuguuucuuguggcauuu

SEQ ID NO: 1104364 - RNA, 19 nt, Homo sapiens
ugccuugacuagagcugua

SEQ ID NO: 1104365 - RNA, 19 nt, Homo sapiens
ucuguuaauucaucucaca

SEQ ID NO: 1104366 - RNA, 19 nt, Homo sapiens
uguguucuguuaauucauc

SEQ ID NO: 1104367 - RNA, 19 nt, Homo sapiens
acugcuuuguguucuguua

SEQ ID NO: 1104368 - RNA, 19 nt, Homo sapiens
caagaagccguuuauuacg

SEQ ID NO: 1104369 - RNA, 19 nt, Homo sapiens
ucuguuaauucaucucaca

SEQ ID NO: 1104370 - RNA, 19 nt, Homo sapiens
uguguucuguuaauucauc

SEQ ID NO: 1104371 - RNA, 19 nt, Homo sapiens
agaagccgaucacuaagac

SEQ ID NO: 1104372 - RNA, 19 nt, Homo sapiens
gauguauagugccuugacu

SEQ ID NO: 1104373 - RNA, 19 nt, Homo sapiens
agaagccucugccuaagac

SEQ ID NO: 1104374 - RNA, 19 nt, Homo sapiens
ccuuacaaauuccacaaag

SEQ ID NO: 1104375 - RNA, 19 nt, Homo sapiens
ggcuguuucuuguggcauu

SEQ ID NO: 1104376 - RNA, 19 nt, Homo sapiens
gccgaucacuaagacuguu

SEQ ID NO: 1104377 - RNA, 19 nt, Homo sapiens
aagaagccgaucacuaaga

SEQ ID NO: 1104378 - RNA, 19 nt, Homo sapiens
acggcauuguguucucuua

SEQ ID NO: 1104379 - RNA, 19 nt, Homo sapiens
cacaaagcauuuucucaga

SEQ ID NO: 1104380 - RNA, 19 nt, Homo sapiens
caucaagggcuagggugaa

SEQ ID NO: 1104381 - RNA, 19 nt, Homo sapiens
ggucuauggugcaaaagga

SEQ ID NO: 1104382 - RNA, 19 nt, Homo sapiens
caagaagccgaucacuaag

SEQ ID NO: 1104383 - RNA, 19 nt, Homo sapiens
aagaagccucugccuaaga

SEQ ID NO: 1104384 - RNA, 19 nt, Homo sapiens
cucacagaauuacagcuuu

SEQ ID NO: 1104385 - RNA, 19 nt, Homo sapiens
cucaagaagccgaucacua

SEQ ID NO: 1104386 - RNA, 19 nt, Homo sapiens
gcauuugcaaagugguauu

SEQ ID NO: 1104387 - RNA, 19 nt, Homo sapiens
gauauuuggaagcccauag

SEQ ID NO: 1104388 - RNA, 19 nt, Homo sapiens
gaaaguaccucgcucuaga

SEQ ID NO: 1104389 - RNA, 19 nt, Homo sapiens
cuacaaggcugaacucuuu

SEQ ID NO: 1104390 - RNA, 19 nt, Homo sapiens
guaccucgcucuagaaauu

SEQ ID NO: 1104391 - RNA, 19 nt, Homo sapiens
ccaagaaccugaccauaga

SEQ ID NO: 1104392 - RNA, 19 nt, Homo sapiens
ggaaaggaguugccucuuc

SEQ ID NO: 1104393 - RNA, 19 nt, Homo sapiens
gaauuucucucuauugauc

SEQ ID NO: 1104394 - RNA, 19 nt, Homo sapiens
gaaaggaguugccucuucu

SEQ ID NO: 1104395 - RNA, 19 nt, Homo sapiens
ggacacacaugcuggacaa

SEQ ID NO: 1104396 - RNA, 19 nt, Homo sapiens
gacaauggcucugcgguuu

SEQ ID NO: 1104397 - RNA, 19 nt, Homo sapiens
gcucaugucuuuacaccuu

SEQ ID NO: 1104398 - RNA, 19 nt, Homo sapiens
caugauaccuucccagaug

SEQ ID NO: 1104399 - RNA, 19 nt, Homo sapiens
gcucugcgguuuccacaaa

SEQ ID NO: 1104400 - RNA, 19 nt, Homo sapiens
gugaauuucucucuauuga

SEQ ID NO: 1104401 - RNA, 19 nt, Homo sapiens
uaaccugccucaccaucua

SEQ ID NO: 1104402 - RNA, 19 nt, Homo sapiens
ggacugacucaacugguua

SEQ ID NO: 1104403 - RNA, 19 nt, Homo sapiens
ugagagagcugccagaaaa

SEQ ID NO: 1104404 - RNA, 19 nt, Homo sapiens
caacauucgucaucuacug

SEQ ID NO: 1104405 - RNA, 19 nt, Homo sapiens
ucagaaagguggccaggau

SEQ ID NO: 1104406 - RNA, 19 nt, Homo sapiens
gaugacagcagauggcauu

SEQ ID NO: 1104407 - RNA, 19 nt, Homo sapiens
cccgguggcugauuauuaa

SEQ ID NO: 1104408 - RNA, 19 nt, Homo sapiens
ugacucaacugguuauugg

SEQ ID NO: 1104409 - RNA, 19 nt, Homo sapiens
gggacugacucaacugguu

SEQ ID NO: 1104410 - RNA, 19 nt, Homo sapiens
ggccaugcccaaccaauaa

SEQ ID NO: 1104411 - RNA, 19 nt, Homo sapiens
ggcguuaucuccauugcuu

SEQ ID NO: 1104412 - RNA, 19 nt, Homo sapiens
gaaagguggccaggauaaa

SEQ ID NO: 1104413 - RNA, 19 nt, Homo sapiens
ccauagaggugcugauguc

SEQ ID NO: 1104414 - RNA, 19 nt, Homo sapiens
gcccgguggcugauuauua

SEQ ID NO: 1104415 - RNA, 19 nt, Homo sapiens
cgaggcagcucuguucaug

SEQ ID NO: 1104416 - RNA, 19 nt, Homo sapiens
aauggaaccugcugagaga

SEQ ID NO: 1104417 - RNA, 19 nt, Homo sapiens
gaucuuagcaccggccaaa

SEQ ID NO: 1104418 - RNA, 19 nt, Homo sapiens
cugccaggcucaugucuuu

SEQ ID NO: 1104419 - RNA, 19 nt, Homo sapiens
cuauugaucuccuacuaug

SEQ ID NO: 1104420 - RNA, 19 nt, Homo sapiens
gccaagaaccugaccauag

SEQ ID NO: 1104421 - RNA, 19 nt, Homo sapiens
caggauaaauggccacaag

SEQ ID NO: 1104422 - RNA, 19 nt, Homo sapiens
gguggugaauuucucucua

SEQ ID NO: 1104423 - RNA, 19 nt, Homo sapiens
ggauaaauggccacaagga

SEQ ID NO: 1104424 - RNA, 19 nt, Homo sapiens
guggugaauuucucucuau

SEQ ID NO: 1104425 - RNA, 19 nt, Homo sapiens
ccaugcugguggugaauuu

SEQ ID NO: 1104426 - RNA, 19 nt, Homo sapiens
cagcaucagugcccuucuu

SEQ ID NO: 1104427 - RNA, 19 nt, Homo sapiens
gccggcaucuuucugaguu

SEQ ID NO: 1104428 - RNA, 19 nt, Homo sapiens
agacuggguuccaaucuca

SEQ ID NO: 1104429 - RNA, 19 nt, Homo sapiens
ccacagcucacuccucuuc

SEQ ID NO: 1104430 - RNA, 19 nt, Homo sapiens
gucaaagacuccuggaaag

SEQ ID NO: 1104431 - RNA, 19 nt, Homo sapiens
gaaauugugccugcaugga

SEQ ID NO: 1104432 - RNA, 19 nt, Homo sapiens
aaagggauguuuugggaua

SEQ ID NO: 1104433 - RNA, 19 nt, Homo sapiens
gggcaaaccagaccaagca

SEQ ID NO: 1104434 - RNA, 19 nt, Homo sapiens
gaucagauuccccaccuua

SEQ ID NO: 1104435 - RNA, 19 nt, Homo sapiens
ggaaaguaccucgcucuag

SEQ ID NO: 1104436 - RNA, 19 nt, Homo sapiens
ggcaagaggccgucacugu

SEQ ID NO: 1104437 - RNA, 19 nt, Homo sapiens
agaaagguggccaggauaa

SEQ ID NO: 1104438 - RNA, 19 nt, Homo sapiens
ugaguucacugacacugau

SEQ ID NO: 1104439 - RNA, 19 nt, Homo sapiens
caaaccagaccaagcacuu

SEQ ID NO: 1104440 - RNA, 19 nt, Homo sapiens
ucuuagcaccggccaaaua

SEQ ID NO: 1104441 - RNA, 19 nt, Homo sapiens
gcgccaugcugguggugaa

SEQ ID NO: 1104442 - RNA, 19 nt, Homo sapiens
gggcagguaucagggugaa

SEQ ID NO: 1104443 - RNA, 19 nt, Homo sapiens
ucccugcccugaucagauu

SEQ ID NO: 1104444 - RNA, 19 nt, Homo sapiens
ggacuuccgcucccugaca

SEQ ID NO: 1104445 - RNA, 19 nt, Homo sapiens
cagaaagguggccaggaua

SEQ ID NO: 1104446 - RNA, 19 nt, Homo sapiens
gaccauagaggugcugaug

SEQ ID NO: 1104447 - RNA, 19 nt, Homo sapiens
uagcaccggccaaauaaau

SEQ ID NO: 1104448 - RNA, 19 nt, Homo sapiens
gaaggcagaaggucuuggu

SEQ ID NO: 1104449 - RNA, 19 nt, Homo sapiens
ggugaauuucucucuauug

SEQ ID NO: 1104450 - RNA, 19 nt, Homo sapiens
gcacuucaggagcucagaa

SEQ ID NO: 1104451 - RNA, 19 nt, Homo sapiens
cuuagcaccggccaaauaa

SEQ ID NO: 1104452 - RNA, 19 nt, Homo sapiens
ggccgucacuguggaaagu

SEQ ID NO: 1104453 - RNA, 19 nt, Homo sapiens
ccucuccucuauggcguua

SEQ ID NO: 1104454 - RNA, 19 nt, Homo sapiens
cuggugggcuccuuuaucu

SEQ ID NO: 1104455 - RNA, 19 nt, Homo sapiens
caccgaugcuggacacaca

SEQ ID NO: 1104456 - RNA, 19 nt, Homo sapiens
gcuggugccgcaagauuug

SEQ ID NO: 1104457 - RNA, 19 nt, Homo sapiens
acuaugggcuggucuucga

SEQ ID NO: 1104458 - RNA, 19 nt, Homo sapiens
cacaagauaaggaggaguu

SEQ ID NO: 1104459 - RNA, 19 nt, Homo sapiens
gcccucugguccacacuug

SEQ ID NO: 1104460 - RNA, 19 nt, Homo sapiens
uaaauggaaccugcugaga

SEQ ID NO: 1104461 - RNA, 19 nt, Homo sapiens
gcaccggccaaauaaaugg

SEQ ID NO: 1104462 - RNA, 19 nt, Homo sapiens
cacacaugcuggacaaugg

SEQ ID NO: 1104463 - RNA, 19 nt, Homo sapiens
cuaagccaguccaucuuca

SEQ ID NO: 1104464 - RNA, 19 nt, Homo sapiens
gcugagagagcugccagaa

SEQ ID NO: 1104465 - RNA, 19 nt, Homo sapiens
ggagagccagaaaucaaca

SEQ ID NO: 1104466 - RNA, 19 nt, Homo sapiens
ggccaagaaccugaccaua

SEQ ID NO: 1104467 - RNA, 19 nt, Homo sapiens
gccaguccaucuucauguc

SEQ ID NO: 1104468 - RNA, 19 nt, Homo sapiens
aaaguaccucgcucuagaa

SEQ ID NO: 1104469 - RNA, 19 nt, Homo sapiens
gccacaaggaggccaagaa

SEQ ID NO: 1104470 - RNA, 19 nt, Homo sapiens
aaagguggccaggauaaau

SEQ ID NO: 1104471 - RNA, 19 nt, Homo sapiens
gauccuggugggcuccuuu

SEQ ID NO: 1104472 - RNA, 19 nt, Homo sapiens
uggccaugcccaaccaaua

SEQ ID NO: 1104473 - RNA, 19 nt, Homo sapiens
gaggcgaguugggcgacuu

SEQ ID NO: 1104474 - RNA, 19 nt, Homo sapiens
ccacaaggaggccaagaac

SEQ ID NO: 1104475 - RNA, 19 nt, Homo sapiens
caucagugcccuucuuugc

SEQ ID NO: 1104476 - RNA, 19 nt, Homo sapiens
cgaguugggcgacuucaag

SEQ ID NO: 1104477 - RNA, 19 nt, Homo sapiens
uggugaauuucucucuauu

SEQ ID NO: 1104478 - RNA, 19 nt, Homo sapiens
guggacggcugggucuaug

SEQ ID NO: 1104479 - RNA, 19 nt, Homo sapiens
ugcaaucgguuccaaacag

SEQ ID NO: 1104480 - RNA, 19 nt, Homo sapiens
ugugaaaugagaaugauca

SEQ ID NO: 1104481 - RNA, 19 nt, Homo sapiens
gcauggagccccuuuaguc

SEQ ID NO: 1104482 - RNA, 19 nt, Homo sapiens
gcugccuccucuccucuau

SEQ ID NO: 1104483 - RNA, 19 nt, Homo sapiens
ccugggccgugacaucuuc

SEQ ID NO: 1104484 - RNA, 19 nt, Homo sapiens
caggaaggcagaaggucuu

SEQ ID NO: 1104485 - RNA, 19 nt, Homo sapiens
gcaucagugcccuucuuug

SEQ ID NO: 1104486 - RNA, 19 nt, Homo sapiens
ccuccucuccuaccgguuu

SEQ ID NO: 1104487 - RNA, 19 nt, Homo sapiens
gcagguaucagggugaacu

SEQ ID NO: 1104488 - RNA, 19 nt, Homo sapiens
ggagauaucccacauuuaa

SEQ ID NO: 1104489 - RNA, 19 nt, Homo sapiens
gcugggagcugacacaaua

SEQ ID NO: 1104490 - RNA, 19 nt, Homo sapiens
gcaagcaguuuguggaauu

SEQ ID NO: 1104491 - RNA, 19 nt, Homo sapiens
ggaauuggcaagugucuua

SEQ ID NO: 1104492 - RNA, 19 nt, Homo sapiens
gaaguccgcugguguuguu

SEQ ID NO: 1104493 - RNA, 19 nt, Homo sapiens
gcaagugucuuaaguacau

SEQ ID NO: 1104494 - RNA, 19 nt, Homo sapiens
gaucacagcugcccaaugc

SEQ ID NO: 1104495 - RNA, 19 nt, Homo sapiens
ggaaguauaccaagccuuu

SEQ ID NO: 1104496 - RNA, 19 nt, Homo sapiens
gaagacgcauucaguuuca

SEQ ID NO: 1104497 - RNA, 19 nt, Homo sapiens
gaucccaugugcuccuuua

SEQ ID NO: 1104498 - RNA, 19 nt, Homo sapiens
gaagggauauuugacuaug

SEQ ID NO: 1104499 - RNA, 19 nt, Homo sapiens
caacaaauccucaacuaca

SEQ ID NO: 1104500 - RNA, 19 nt, Homo sapiens
cagcauaugguccugauua

SEQ ID NO: 1104501 - RNA, 19 nt, Homo sapiens
gaacaggugacgugucuga

SEQ ID NO: 1104502 - RNA, 19 nt, Homo sapiens
ccagaucugugaaagugua

SEQ ID NO: 1104503 - RNA, 19 nt, Homo sapiens
ugagagcagucaccaguuu

SEQ ID NO: 1104504 - RNA, 19 nt, Homo sapiens
aaggagauaucccacauuu

SEQ ID NO: 1104505 - RNA, 19 nt, Homo sapiens
gaagacagcguguuuaugc

SEQ ID NO: 1104506 - RNA, 19 nt, Homo sapiens
ggaaaacacuauccucuga

SEQ ID NO: 1104507 - RNA, 19 nt, Homo sapiens
ccaguauggugcauucuuu

SEQ ID NO: 1104508 - RNA, 19 nt, Homo sapiens
ggagagaggguacugauca

SEQ ID NO: 1104509 - RNA, 19 nt, Homo sapiens
ggaguggugccuauaauga

SEQ ID NO: 1104510 - RNA, 19 nt, Homo sapiens
ugaagcauguggucuaguu

SEQ ID NO: 1104511 - RNA, 19 nt, Homo sapiens
uuaaguacauccuucaaug

SEQ ID NO: 1104512 - RNA, 19 nt, Homo sapiens
ccaaagcaguggucuuaca

SEQ ID NO: 1104513 - RNA, 19 nt, Homo sapiens
uagaauaugggcuagguua

SEQ ID NO: 1104514 - RNA, 19 nt, Homo sapiens
gaggaguggugccuauaau

SEQ ID NO: 1104515 - RNA, 19 nt, Homo sapiens
gaggauaguuaagccuaaa

SEQ ID NO: 1104516 - RNA, 19 nt, Homo sapiens
aagcagaugaggauaguua

SEQ ID NO: 1104517 - RNA, 19 nt, Homo sapiens
ggagaaguccgcugguguu

SEQ ID NO: 1104518 - RNA, 19 nt, Homo sapiens
gcuauaaccuugccaacac

SEQ ID NO: 1104519 - RNA, 19 nt, Homo sapiens
gaaguauaccaagccuuua

SEQ ID NO: 1104520 - RNA, 19 nt, Homo sapiens
gacggaaugugcaaaguag

SEQ ID NO: 1104521 - RNA, 19 nt, Homo sapiens
ccacugaagggauauuuga

SEQ ID NO: 1104522 - RNA, 19 nt, Homo sapiens
aauaugggcuagguuauga

SEQ ID NO: 1104523 - RNA, 19 nt, Homo sapiens
caagcaguuuguggaauuu

SEQ ID NO: 1104524 - RNA, 19 nt, Homo sapiens
uaaugaagacagcguguuu

SEQ ID NO: 1104525 - RNA, 19 nt, Homo sapiens
gaucagaagcuggaugaga

SEQ ID NO: 1104526 - RNA, 19 nt, Homo sapiens
gugaaaguguacuaaagga

SEQ ID NO: 1104527 - RNA, 19 nt, Homo sapiens
uaccagaucugugaaagug

SEQ ID NO: 1104528 - RNA, 19 nt, Homo sapiens
uagaagacgcauucaguuu

SEQ ID NO: 1104529 - RNA, 19 nt, Homo sapiens
guagaagacgcauucaguu

SEQ ID NO: 1104530 - RNA, 19 nt, Homo sapiens
gaauaugggcuagguuaug

SEQ ID NO: 1104531 - RNA, 19 nt, Homo sapiens
gagauaucccacauuuaaa

SEQ ID NO: 1104532 - RNA, 19 nt, Homo sapiens
aagggaaucugaagcaugu

SEQ ID NO: 1104533 - RNA, 19 nt, Homo sapiens
uauggugcauucuuugauu

SEQ ID NO: 1104534 - RNA, 19 nt, Homo sapiens
uccaacaaauccucaacua

SEQ ID NO: 1104535 - RNA, 19 nt, Homo sapiens
gccaagagggcgaugauga

SEQ ID NO: 1104536 - RNA, 19 nt, Homo sapiens
gcugaggaguggugccuau

SEQ ID NO: 1104537 - RNA, 19 nt, Homo sapiens
gacggaaauuugagcguau

SEQ ID NO: 1104538 - RNA, 19 nt, Homo sapiens
cugaagggauauuugacua

SEQ ID NO: 1104539 - RNA, 19 nt, Homo sapiens
gaaggagauaucccacauu

SEQ ID NO: 1104540 - RNA, 19 nt, Homo sapiens
aauauuaccagaucuguga

SEQ ID NO: 1104541 - RNA, 19 nt, Homo sapiens
ugacggaaugugcaaagua

SEQ ID NO: 1104542 - RNA, 19 nt, Homo sapiens
cauccggacuccauagaau

SEQ ID NO: 1104543 - RNA, 19 nt, Homo sapiens
ugaggauaguuaagccuaa

SEQ ID NO: 1104544 - RNA, 19 nt, Homo sapiens
aaacacacacacacaaaug

SEQ ID NO: 1104545 - RNA, 19 nt, Homo sapiens
caggugacgugucugaugu

SEQ ID NO: 1104546 - RNA, 19 nt, Homo sapiens
ugacuaugcagcagcuaua

SEQ ID NO: 1104547 - RNA, 19 nt, Homo sapiens
ucccaaagcaguggucuua

SEQ ID NO: 1104548 - RNA, 19 nt, Homo sapiens
gaagggacgguacuacagu

SEQ ID NO: 1104549 - RNA, 19 nt, Homo sapiens
ccgugucccugcacaaauu

SEQ ID NO: 1104550 - RNA, 19 nt, Homo sapiens
cagcugagaggcaggguuu

SEQ ID NO: 1104551 - RNA, 19 nt, Homo sapiens
cugauuaugugcuggaaau

SEQ ID NO: 1104552 - RNA, 19 nt, Homo sapiens
ggucccgguuuauaucuau

SEQ ID NO: 1104553 - RNA, 19 nt, Homo sapiens
uaucccacauuuaaaguuc

SEQ ID NO: 1104554 - RNA, 19 nt, Homo sapiens
agaaggagauaucccacau

SEQ ID NO: 1104555 - RNA, 19 nt, Homo sapiens
acagaaagagaucagguuu

SEQ ID NO: 1104556 - RNA, 19 nt, Homo sapiens
gcucgaugcuggacauacu

SEQ ID NO: 1104557 - RNA, 19 nt, Homo sapiens
caggauggcauacaagaug

SEQ ID NO: 1104558 - RNA, 19 nt, Homo sapiens
gcaaaguagcaauuaacug

SEQ ID NO: 1104559 - RNA, 19 nt, Homo sapiens
gggccaguauggugcauuc

SEQ ID NO: 1104560 - RNA, 19 nt, Homo sapiens
ccacacugaugcuuaucug

SEQ ID NO: 1104561 - RNA, 19 nt, Homo sapiens
uggaggagauggccaccuu

SEQ ID NO: 1104562 - RNA, 19 nt, Homo sapiens
uaucuauagucccgaguau

SEQ ID NO: 1104563 - RNA, 19 nt, Homo sapiens
gacagaaagagaucagguu

SEQ ID NO: 1104564 - RNA, 19 nt, Homo sapiens
caaagggaaucugaagcau

SEQ ID NO: 1104565 - RNA, 19 nt, Homo sapiens
gcaaugagccccaccgaau

SEQ ID NO: 1104566 - RNA, 19 nt, Homo sapiens
gaucugugaaaguguacua

SEQ ID NO: 1104567 - RNA, 19 nt, Homo sapiens
cagaucagaagcuggauga

SEQ ID NO: 1104568 - RNA, 19 nt, Homo sapiens
gaguggugccuauaaugaa

SEQ ID NO: 1104569 - RNA, 19 nt, Homo sapiens
ugugcaaaguagcaauuaa

SEQ ID NO: 1104570 - RNA, 19 nt, Homo sapiens
gagcagucaccaguuugua

SEQ ID NO: 1104571 - RNA, 19 nt, Homo sapiens
ugaggaguggugccuauaa

SEQ ID NO: 1104572 - RNA, 19 nt, Homo sapiens
cccaugugcuccuuuaaca

SEQ ID NO: 1104573 - RNA, 19 nt, Homo sapiens
gaaauuugagcguauucuc

SEQ ID NO: 1104574 - RNA, 19 nt, Homo sapiens
cgauugcgacggaaauuug

SEQ ID NO: 1104575 - RNA, 19 nt, Homo sapiens
cccagccacugaagggaua

SEQ ID NO: 1104576 - RNA, 19 nt, Homo sapiens
gagagaggguacugaucag

SEQ ID NO: 1104577 - RNA, 19 nt, Homo sapiens
gugacucccuggccaagau

SEQ ID NO: 1104578 - RNA, 19 nt, Homo sapiens
ucaaagggaaucugaagca

SEQ ID NO: 1104579 - RNA, 19 nt, Homo sapiens
ggugacgugucugauguug

SEQ ID NO: 1104580 - RNA, 19 nt, Homo sapiens
caaauccucaacuacauca

SEQ ID NO: 1104581 - RNA, 19 nt, Homo sapiens
uggcaagugucuuaaguac

SEQ ID NO: 1104582 - RNA, 19 nt, Homo sapiens
gaauuggcaagugucuuaa

SEQ ID NO: 1104583 - RNA, 19 nt, Homo sapiens
ggaagggacgguacuacag

SEQ ID NO: 1104584 - RNA, 19 nt, Homo sapiens
ccaagagggcgaugaugau

SEQ ID NO: 1104585 - RNA, 19 nt, Homo sapiens
ccaagccuuuaaucccaaa

SEQ ID NO: 1104586 - RNA, 19 nt, Homo sapiens
aaaguguacuaaaggaagu

SEQ ID NO: 1104587 - RNA, 19 nt, Homo sapiens
agaagacgcauucaguuuc

SEQ ID NO: 1104588 - RNA, 19 nt, Homo sapiens
gaaagaaacuguugaauca

SEQ ID NO: 1104589 - RNA, 19 nt, Homo sapiens
ggacugaacucacuuauga

SEQ ID NO: 1104590 - RNA, 19 nt, Homo sapiens
gagaaacaauggacaauua

SEQ ID NO: 1104591 - RNA, 19 nt, Homo sapiens
guaaagggauugauaaaga

SEQ ID NO: 1104592 - RNA, 19 nt, Homo sapiens
gcagacaccuuuacagauu

SEQ ID NO: 1104593 - RNA, 19 nt, Homo sapiens
gaacaugcauucagcaaga

SEQ ID NO: 1104594 - RNA, 19 nt, Homo sapiens
gaaauggucuguuaaugga

SEQ ID NO: 1104595 - RNA, 19 nt, Homo sapiens
gaaauuggguucuacuguu

SEQ ID NO: 1104596 - RNA, 19 nt, Homo sapiens
ggagagcgauauaagcaua

SEQ ID NO: 1104597 - RNA, 19 nt, Homo sapiens
ccaagugucuguaguauga

SEQ ID NO: 1104598 - RNA, 19 nt, Homo sapiens
caaaugaggucaccaguca

SEQ ID NO: 1104599 - RNA, 19 nt, Homo sapiens
gaaaagggaucuuaugaaa

SEQ ID NO: 1104600 - RNA, 19 nt, Homo sapiens
ccagagaccuuaaacagaa

SEQ ID NO: 1104601 - RNA, 19 nt, Homo sapiens
gaaagugacccucaaagaa

SEQ ID NO: 1104602 - RNA, 19 nt, Homo sapiens
caaagaacuuggagaacua

SEQ ID NO: 1104603 - RNA, 19 nt, Homo sapiens
gcacaccagugauaauauu

SEQ ID NO: 1104604 - RNA, 19 nt, Homo sapiens
uaaaucggcuucacagaaa

SEQ ID NO: 1104605 - RNA, 19 nt, Homo sapiens
ggagaugccucaacuggaa

SEQ ID NO: 1104606 - RNA, 19 nt, Homo sapiens
gcaagcagccaaugagaua

SEQ ID NO: 1104607 - RNA, 19 nt, Homo sapiens
gaggaaggccuaaaucuaa

SEQ ID NO: 1104608 - RNA, 19 nt, Homo sapiens
caagagaaguguaguggaa

SEQ ID NO: 1104609 - RNA, 19 nt, Homo sapiens
ugacagcccuggacucuuu

SEQ ID NO: 1104610 - RNA, 19 nt, Homo sapiens
ccaacuaucuuucgaauca

SEQ ID NO: 1104611 - RNA, 19 nt, Homo sapiens
gaaagaaccaguuuacuuc

SEQ ID NO: 1104612 - RNA, 19 nt, Homo sapiens
gaaagaagcuaggaauugg

SEQ ID NO: 1104613 - RNA, 19 nt, Homo sapiens
ggauggugauugacaguua

SEQ ID NO: 1104614 - RNA, 19 nt, Homo sapiens
caagcaagcuagaaucuga

SEQ ID NO: 1104615 - RNA, 19 nt, Homo sapiens
gcugaaagccuaaguacua

SEQ ID NO: 1104616 - RNA, 19 nt, Homo sapiens
gacaaacacugccaaguug

SEQ ID NO: 1104617 - RNA, 19 nt, Homo sapiens
gcacaggacacuucacuaa

SEQ ID NO: 1104618 - RNA, 19 nt, Homo sapiens
gaucuguccuggaaucuuu

SEQ ID NO: 1104619 - RNA, 19 nt, Homo sapiens
ggaaagaaccaguuuacuu

SEQ ID NO: 1104620 - RNA, 19 nt, Homo sapiens
gcacuucuccggacuuuaa

SEQ ID NO: 1104621 - RNA, 19 nt, Homo sapiens
gcaaggauuugaucaggaa

SEQ ID NO: 1104622 - RNA, 19 nt, Homo sapiens
gaaagcagaugauguugca

SEQ ID NO: 1104623 - RNA, 19 nt, Homo sapiens
gaacuaauaagucgccuaa

SEQ ID NO: 1104624 - RNA, 19 nt, Homo sapiens
gaucaugacuuccuuaaac

SEQ ID NO: 1104625 - RNA, 19 nt, Homo sapiens
cgacuguuaucucacauua

SEQ ID NO: 1104626 - RNA, 19 nt, Homo sapiens
gaagagcaagagaauaaua

SEQ ID NO: 1104627 - RNA, 19 nt, Homo sapiens
gacauaaacuugacaucuu

SEQ ID NO: 1104628 - RNA, 19 nt, Homo sapiens
gcaagaaaggaaccauuua

SEQ ID NO: 1104629 - RNA, 19 nt, Homo sapiens
acucagaaauggcagauua

SEQ ID NO: 1104630 - RNA, 19 nt, Homo sapiens
guaagaagccagaugauga

SEQ ID NO: 1104631 - RNA, 19 nt, Homo sapiens
ggucagagcccuguaagua

SEQ ID NO: 1104632 - RNA, 19 nt, Homo sapiens
ggaaagaagcuaggaauug

SEQ ID NO: 1104633 - RNA, 19 nt, Homo sapiens
guaaagcacaccagugaua

SEQ ID NO: 1104634 - RNA, 19 nt, Homo sapiens
gaacagagacgaggaagga

SEQ ID NO: 1104635 - RNA, 19 nt, Homo sapiens
cuacagaacuaaucgaaga

SEQ ID NO: 1104636 - RNA, 19 nt, Homo sapiens
uaagauuccuuggcaauaa

SEQ ID NO: 1104637 - RNA, 19 nt, Homo sapiens
cuacagcgguauucauuaa

SEQ ID NO: 1104638 - RNA, 19 nt, Homo sapiens
caagaaagcagaugauguu

SEQ ID NO: 1104639 - RNA, 19 nt, Homo sapiens
gcaccaaacccuaugcuuu

SEQ ID NO: 1104640 - RNA, 19 nt, Homo sapiens
cagauugacuguucagaaa

SEQ ID NO: 1104641 - RNA, 19 nt, Homo sapiens
ggaauuggaacagauaaua

SEQ ID NO: 1104642 - RNA, 19 nt, Homo sapiens
ccaguucagugccauauuu

SEQ ID NO: 1104643 - RNA, 19 nt, Homo sapiens
gagaagaggucgcaaacca

SEQ ID NO: 1104644 - RNA, 19 nt, Homo sapiens
gaauguaaagggauugaua

SEQ ID NO: 1104645 - RNA, 19 nt, Homo sapiens
ggaaguuugucucuccuuu

SEQ ID NO: 1104646 - RNA, 19 nt, Homo sapiens
gaaggacgacgauguuauu

SEQ ID NO: 1104647 - RNA, 19 nt, Homo sapiens
gguaucaucucuuauaaag

SEQ ID NO: 1104648 - RNA, 19 nt, Homo sapiens
aagcagggcuguauucuga

SEQ ID NO: 1104649 - RNA, 19 nt, Homo sapiens
guggaaagaugacggauga

SEQ ID NO: 1104650 - RNA, 19 nt, Homo sapiens
ccacaggcauugcgaagaa

SEQ ID NO: 1104651 - RNA, 19 nt, Homo sapiens
cgaaaggccuauuacaaug

SEQ ID NO: 1104652 - RNA, 19 nt, Homo sapiens
gauccucacugguuacuau

SEQ ID NO: 1104653 - RNA, 19 nt, Homo sapiens
gaagccaccuguacuguca

SEQ ID NO: 1104654 - RNA, 19 nt, Homo sapiens
gggaggugcuucugaugua

SEQ ID NO: 1104655 - RNA, 19 nt, Homo sapiens
ccagaugucccacuauaua

SEQ ID NO: 1104656 - RNA, 19 nt, Homo sapiens
ggaaacacaaucagcuaua

SEQ ID NO: 1104657 - RNA, 19 nt, Homo sapiens
gaacuuggagaacuaugua

SEQ ID NO: 1104658 - RNA, 19 nt, Homo sapiens
ccaagacaguucagguuaa

SEQ ID NO: 1104659 - RNA, 19 nt, Homo sapiens
guuaaagcaucauguauuc

SEQ ID NO: 1104660 - RNA, 19 nt, Homo sapiens
caaagaagaaguaucagaa

SEQ ID NO: 1104661 - RNA, 19 nt, Homo sapiens
gaaagugacaaccauagaa

SEQ ID NO: 1104662 - RNA, 19 nt, Homo sapiens
ggucauaguauaaguauug

SEQ ID NO: 1104663 - RNA, 19 nt, Homo sapiens
gcgaaggcguacuuuguuu

SEQ ID NO: 1104664 - RNA, 19 nt, Homo sapiens
gaagaggucgcaaaccaaa

SEQ ID NO: 1104665 - RNA, 19 nt, Homo sapiens
uggcaggucugaucaguaa

SEQ ID NO: 1104666 - RNA, 19 nt, Homo sapiens
gaugaugguuugacugaug

SEQ ID NO: 1104667 - RNA, 19 nt, Homo sapiens
caaacggaaucgagaaaga

SEQ ID NO: 1104668 - RNA, 19 nt, Homo sapiens
gagaagcuuuggaagaaug

SEQ ID NO: 1104669 - RNA, 19 nt, Homo sapiens
gaagaaguaucagaaagca

SEQ ID NO: 1104670 - RNA, 19 nt, Homo sapiens
gagcauguuucucugauuc

SEQ ID NO: 1104671 - RNA, 19 nt, Homo sapiens
gaaagaugaugguuugacu

SEQ ID NO: 1104672 - RNA, 19 nt, Homo sapiens
ggaaggaucaggcaggaaa

SEQ ID NO: 1104673 - RNA, 19 nt, Homo sapiens
aaagauuucucgccucauu

SEQ ID NO: 1104674 - RNA, 19 nt, Homo sapiens
aagagaagcuggaguauac

SEQ ID NO: 1104675 - RNA, 19 nt, Homo sapiens
aagaagagcaagagaauaa

SEQ ID NO: 1104676 - RNA, 19 nt, Homo sapiens
ggaagaagagcaagagaau

SEQ ID NO: 1104677 - RNA, 19 nt, Homo sapiens
gcaucucacuccuaucuga

SEQ ID NO: 1104678 - RNA, 19 nt, Homo sapiens
caucagagagcacaaauug

SEQ ID NO: 1104679 - RNA, 19 nt, Homo sapiens
agacaguucagguuaauua

SEQ ID NO: 1104680 - RNA, 19 nt, Homo sapiens
caagucagcacaccuguuu

SEQ ID NO: 1104681 - RNA, 19 nt, Homo sapiens
gaucuuaucaccauagaga

SEQ ID NO: 1104682 - RNA, 19 nt, Homo sapiens
ggaguucccucucgaaguc

SEQ ID NO: 1104683 - RNA, 19 nt, Homo sapiens
ucucuuagcugauagugaa

SEQ ID NO: 1104684 - RNA, 19 nt, Homo sapiens
aaagaugccauaaaccuua

SEQ ID NO: 1104685 - RNA, 19 nt, Homo sapiens
uaaagagucuggcaagaag

SEQ ID NO: 1104686 - RNA, 19 nt, Homo sapiens
uagccgggauccugauuua

SEQ ID NO: 1104687 - RNA, 19 nt, Homo sapiens
cuucaaaguuguacaagaa

SEQ ID NO: 1104688 - RNA, 19 nt, Homo sapiens
gaaauuggcuuuggaguuu

SEQ ID NO: 1104689 - RNA, 19 nt, Homo sapiens
gaagugcgcuggagaaauc

SEQ ID NO: 1104690 - RNA, 19 nt, Homo sapiens
gauagucucucuggaauaa

SEQ ID NO: 1104691 - RNA, 19 nt, Homo sapiens
acacaaagaucaagaguug

SEQ ID NO: 1104692 - RNA, 19 nt, Homo sapiens
gaacacaaccucaccuuga

SEQ ID NO: 1104693 - RNA, 19 nt, Homo sapiens
caacacuucugaacuauau

SEQ ID NO: 1104694 - RNA, 19 nt, Homo sapiens
agacaacacuucugaacua

SEQ ID NO: 1104695 - RNA, 19 nt, Homo sapiens
ccaagaagaucaaguuugu

SEQ ID NO: 1104696 - RNA, 19 nt, Homo sapiens
gaguugaucucucuaaugu

SEQ ID NO: 1104697 - RNA, 19 nt, Homo sapiens
guggagagcucuaugaaga

SEQ ID NO: 1104698 - RNA, 19 nt, Homo sapiens
gcagaaauuuagauaagga

SEQ ID NO: 1104699 - RNA, 19 nt, Homo sapiens
gacaacacguuuccaagaa

SEQ ID NO: 1104700 - RNA, 19 nt, Homo sapiens
ugacagagcaacauaguaa

SEQ ID NO: 1104701 - RNA, 19 nt, Homo sapiens
gauacaacuuucaacauug

SEQ ID NO: 1104702 - RNA, 19 nt, Homo sapiens
ggacaaaucuuagaaacac

SEQ ID NO: 1104703 - RNA, 19 nt, Homo sapiens
ggaauaaguuugcagaaaa

SEQ ID NO: 1104704 - RNA, 19 nt, Homo sapiens
gaagaguggcuggaacuua

SEQ ID NO: 1104705 - RNA, 19 nt, Homo sapiens
guugaucucucuaauguau

SEQ ID NO: 1104706 - RNA, 19 nt, Homo sapiens
ggacaacacguuuccaaga

SEQ ID NO: 1104707 - RNA, 19 nt, Homo sapiens
ucauaaggcugaagggauu

SEQ ID NO: 1104708 - RNA, 19 nt, Homo sapiens
gcuuuggaguuuacauaua

SEQ ID NO: 1104709 - RNA, 19 nt, Homo sapiens
acaaguaagugucaccauu

SEQ ID NO: 1104710 - RNA, 19 nt, Homo sapiens
caaguaagugucaccauuu

SEQ ID NO: 1104711 - RNA, 19 nt, Homo sapiens
caacacguuuccaagaaga

SEQ ID NO: 1104712 - RNA, 19 nt, Homo sapiens
ugcaguggcuucuauguuu

SEQ ID NO: 1104713 - RNA, 19 nt, Homo sapiens
gaauuagggagugauauuu

SEQ ID NO: 1104714 - RNA, 19 nt, Homo sapiens
gagaaauccuuagcuguca

SEQ ID NO: 1104715 - RNA, 19 nt, Homo sapiens
caagaucccagucacaauu

SEQ ID NO: 1104716 - RNA, 19 nt, Homo sapiens
ggauuguccugaauugguu

SEQ ID NO: 1104717 - RNA, 19 nt, Homo sapiens
gaacgacaauuagauccau

SEQ ID NO: 1104718 - RNA, 19 nt, Homo sapiens
cagaagaagauguaaagaa

SEQ ID NO: 1104719 - RNA, 19 nt, Homo sapiens
gaucaaguuuguacauaac

SEQ ID NO: 1104720 - RNA, 19 nt, Homo sapiens
uggaauaaguuugcagaaa

SEQ ID NO: 1104721 - RNA, 19 nt, Homo sapiens
gaagaucaaguuuguacau

SEQ ID NO: 1104722 - RNA, 19 nt, Homo sapiens
guuuauagcuacugugaca

SEQ ID NO: 1104723 - RNA, 19 nt, Homo sapiens
agacaaaucacaacaagug

SEQ ID NO: 1104724 - RNA, 19 nt, Homo sapiens
aaagacaaaucacaacaag

SEQ ID NO: 1104725 - RNA, 19 nt, Homo sapiens
ggggaaauuugauuacaua

SEQ ID NO: 1104726 - RNA, 19 nt, Homo sapiens
ccuuagagcuauugagaau

SEQ ID NO: 1104727 - RNA, 19 nt, Homo sapiens
gaaaugcaaaggaagaaca

SEQ ID NO: 1104728 - RNA, 19 nt, Homo sapiens
uaaauggacuaggacaaau

SEQ ID NO: 1104729 - RNA, 19 nt, Homo sapiens
gaucuucaugccuuugaua

SEQ ID NO: 1104730 - RNA, 19 nt, Homo sapiens
gaaaccugauggccuuauc

SEQ ID NO: 1104731 - RNA, 19 nt, Homo sapiens
uggcagaaauuuagauaag

SEQ ID NO: 1104732 - RNA, 19 nt, Homo sapiens
gcugauugcagagauauaa

SEQ ID NO: 1104733 - RNA, 19 nt, Homo sapiens
ugagagaacaaaucgauug

SEQ ID NO: 1104734 - RNA, 19 nt, Homo sapiens
caaagacaaaucacaacaa

SEQ ID NO: 1104735 - RNA, 19 nt, Homo sapiens
ugaauuagggagugauauu

SEQ ID NO: 1104736 - RNA, 19 nt, Homo sapiens
uuggguugaugcugaauua

SEQ ID NO: 1104737 - RNA, 19 nt, Homo sapiens
gacaacacuucugaacuau

SEQ ID NO: 1104738 - RNA, 19 nt, Homo sapiens
gaugauacaacuuucaaca

SEQ ID NO: 1104739 - RNA, 19 nt, Homo sapiens
ggacuaggacaaaucuuag

SEQ ID NO: 1104740 - RNA, 19 nt, Homo sapiens
aagaguggcuggaacuuag

SEQ ID NO: 1104741 - RNA, 19 nt, Homo sapiens
ucagcugauugcagagaua

SEQ ID NO: 1104742 - RNA, 19 nt, Homo sapiens
gcaaagcgaggaggaggaa

SEQ ID NO: 1104743 - RNA, 19 nt, Homo sapiens
ggaugacacugagagaaca

SEQ ID NO: 1104744 - RNA, 19 nt, Homo sapiens
ugagaaacaaggacaauca

SEQ ID NO: 1104745 - RNA, 19 nt, Homo sapiens
uggacuaggacaaaucuua

SEQ ID NO: 1104746 - RNA, 19 nt, Homo sapiens
gauuacauacuguuagaga

SEQ ID NO: 1104747 - RNA, 19 nt, Homo sapiens
gaguagcggucauuuuaaa

SEQ ID NO: 1104748 - RNA, 19 nt, Homo sapiens
ugaaauuggcuuuggaguu

SEQ ID NO: 1104749 - RNA, 19 nt, Homo sapiens
gcuggaaggaugacacuga

SEQ ID NO: 1104750 - RNA, 19 nt, Homo sapiens
gaaguaccaggaaaugcaa

SEQ ID NO: 1104751 - RNA, 19 nt, Homo sapiens
gaagcuacuaggcaaguug

SEQ ID NO: 1104752 - RNA, 19 nt, Homo sapiens
gaaggaugacacugagaga

SEQ ID NO: 1104753 - RNA, 19 nt, Homo sapiens
uaagaacgacaauuagauc

SEQ ID NO: 1104754 - RNA, 19 nt, Homo sapiens
gauugcagagauauaauga

SEQ ID NO: 1104755 - RNA, 19 nt, Homo sapiens
gaaaagaaugugagaaaca

SEQ ID NO: 1104756 - RNA, 19 nt, Homo sapiens
gaaacacaaagaucaagag

SEQ ID NO: 1104757 - RNA, 19 nt, Homo sapiens
aaauuggcuuuggaguuua

SEQ ID NO: 1104758 - RNA, 19 nt, Homo sapiens
ggccuuagagcuauugaga

SEQ ID NO: 1104759 - RNA, 19 nt, Homo sapiens
gggaaaagaaugugagaaa

SEQ ID NO: 1104760 - RNA, 19 nt, Homo sapiens
cauuugaaguaccaggaaa

SEQ ID NO: 1104761 - RNA, 19 nt, Homo sapiens
aagaguagcggucauuuua

SEQ ID NO: 1104762 - RNA, 19 nt, Homo sapiens
gcugaauuagggagugaua

SEQ ID NO: 1104763 - RNA, 19 nt, Homo sapiens
gaaaagcaguggacaacac

SEQ ID NO: 1104764 - RNA, 19 nt, Homo sapiens
caaccucaccuugaucaga

SEQ ID NO: 1104765 - RNA, 19 nt, Homo sapiens
gcaguggcuucuauguuuu

SEQ ID NO: 1104766 - RNA, 19 nt, Homo sapiens
gcaaaagaaggggaaauuu

SEQ ID NO: 1104767 - RNA, 19 nt, Homo sapiens
aauuaucaccggguauuua

SEQ ID NO: 1104768 - RNA, 19 nt, Homo sapiens
cuugaucagaguauuguua

SEQ ID NO: 1104769 - RNA, 19 nt, Homo sapiens
auaaauggacuaggacaaa

SEQ ID NO: 1104770 - RNA, 19 nt, Homo sapiens
aagaucccagucacaauua

SEQ ID NO: 1104771 - RNA, 19 nt, Homo sapiens
ucuuagaacuucagcugau

SEQ ID NO: 1104772 - RNA, 19 nt, Homo sapiens
caagaagaucaaguuugua

SEQ ID NO: 1104773 - RNA, 19 nt, Homo sapiens
ggaagugcgcuggagaaau

SEQ ID NO: 1104774 - RNA, 19 nt, Homo sapiens
caggaaaugcaaaggaaga

SEQ ID NO: 1104775 - RNA, 19 nt, Homo sapiens
uaggacaaaucuuagaaac

SEQ ID NO: 1104776 - RNA, 19 nt, Homo sapiens
guuagagaccacuggauug

SEQ ID NO: 1104777 - RNA, 19 nt, Homo sapiens
ucaaagacaaaucacaaca

SEQ ID NO: 1104778 - RNA, 19 nt, Homo sapiens
ugaaguaccaggaaaugca

SEQ ID NO: 1104779 - RNA, 19 nt, Homo sapiens
ggaauguuaccggcuguug

SEQ ID NO: 1104780 - RNA, 19 nt, Homo sapiens
cgacaauuagauccauaaa

SEQ ID NO: 1104781 - RNA, 19 nt, Homo sapiens
gccaagaucccagucacaa

SEQ ID NO: 1104782 - RNA, 19 nt, Homo sapiens
gacagagcaacauaguaaa

SEQ ID NO: 1104783 - RNA, 19 nt, Homo sapiens
accaggaaaugcaaaggaa

SEQ ID NO: 1104784 - RNA, 19 nt, Homo sapiens
gacaaaucuuagaaacaca

SEQ ID NO: 1104785 - RNA, 19 nt, Homo sapiens
aaaagaaggggaaauuuga

SEQ ID NO: 1104786 - RNA, 19 nt, Homo sapiens
gcaacauaguaaaagagua

SEQ ID NO: 1104787 - RNA, 19 nt, Homo sapiens
acaaucacauuugaaguac

SEQ ID NO: 1104788 - RNA, 19 nt, Homo sapiens
gaaacuagcuacauaagua

SEQ ID NO: 1104789 - RNA, 19 nt, Homo sapiens
gcuguaaacuguaacauua

SEQ ID NO: 1104790 - RNA, 19 nt, Homo sapiens
ggaaacagaugucuaguga

SEQ ID NO: 1104791 - RNA, 19 nt, Homo sapiens
gaaaguaauugaacucuuc

SEQ ID NO: 1104792 - RNA, 19 nt, Homo sapiens
gaccauaguuucuuguuaa

SEQ ID NO: 1104793 - RNA, 19 nt, Homo sapiens
uaaaguaucugcaccaaga

SEQ ID NO: 1104794 - RNA, 19 nt, Homo sapiens
guaaauguguaccuaauga

SEQ ID NO: 1104795 - RNA, 19 nt, Homo sapiens
gagaguggcuuucacaaug

SEQ ID NO: 1104796 - RNA, 19 nt, Homo sapiens
ggaccauaguuucuuguua

SEQ ID NO: 1104797 - RNA, 19 nt, Homo sapiens
aagaguagcuccuuggaua

SEQ ID NO: 1104798 - RNA, 19 nt, Homo sapiens
gacauaaagucuucaaaug

SEQ ID NO: 1104799 - RNA, 19 nt, Homo sapiens
ugacaaggcagacauauuu

SEQ ID NO: 1104800 - RNA, 19 nt, Homo sapiens
caagacaccaagcaaauua

SEQ ID NO: 1104801 - RNA, 19 nt, Homo sapiens
gaauauggcaagaggguua

SEQ ID NO: 1104802 - RNA, 19 nt, Homo sapiens
ccaagcaaauuaucagaaa

SEQ ID NO: 1104803 - RNA, 19 nt, Homo sapiens
ggaggagaaugguguuauu

SEQ ID NO: 1104804 - RNA, 19 nt, Homo sapiens
gcaagaggguuaaaguauc

SEQ ID NO: 1104805 - RNA, 19 nt, Homo sapiens
aaacagaugucuagugauc

SEQ ID NO: 1104806 - RNA, 19 nt, Homo sapiens
gaagggaucaguaauuuca

SEQ ID NO: 1104807 - RNA, 19 nt, Homo sapiens
gcuauaagcacuuggaauu

SEQ ID NO: 1104808 - RNA, 19 nt, Homo sapiens
uaauugaacucuucucugu

SEQ ID NO: 1104809 - RNA, 19 nt, Homo sapiens
ccaagagguuugucucauu

SEQ ID NO: 1104810 - RNA, 19 nt, Homo sapiens
caaaugaugaugaugauga

SEQ ID NO: 1104811 - RNA, 19 nt, Homo sapiens
guaaaacgcuguaaacugu

SEQ ID NO: 1104812 - RNA, 19 nt, Homo sapiens
cuacugacauuagcacuuu

SEQ ID NO: 1104813 - RNA, 19 nt, Homo sapiens
gcagacauauuugccuuug

SEQ ID NO: 1104814 - RNA, 19 nt, Homo sapiens
agaaugguguuauuacuga

SEQ ID NO: 1104815 - RNA, 19 nt, Homo sapiens
uggaagggaucaguaauuu

SEQ ID NO: 1104816 - RNA, 19 nt, Homo sapiens
caagagguuugucucauuc

SEQ ID NO: 1104817 - RNA, 19 nt, Homo sapiens
gaucaguaauuucaagaca

SEQ ID NO: 1104818 - RNA, 19 nt, Homo sapiens
gaggagaaugguguuauua

SEQ ID NO: 1104819 - RNA, 19 nt, Homo sapiens
uggaagaacuggaugaauc

SEQ ID NO: 1104820 - RNA, 19 nt, Homo sapiens
gggaaaugaugacuuuauc

SEQ ID NO: 1104821 - RNA, 19 nt, Homo sapiens
gcacuaaugaagacccuaa

SEQ ID NO: 1104822 - RNA, 19 nt, Homo sapiens
ggagaaugguguuauuacu

SEQ ID NO: 1104823 - RNA, 19 nt, Homo sapiens
gaaaagaaacugcuucaug

SEQ ID NO: 1104824 - RNA, 19 nt, Homo sapiens
caagaggguuaaaguaucu

SEQ ID NO: 1104825 - RNA, 19 nt, Homo sapiens
ggaagaacuggaugaauca

SEQ ID NO: 1104826 - RNA, 19 nt, Homo sapiens
gaucaucucagcugaagug

SEQ ID NO: 1104827 - RNA, 19 nt, Homo sapiens
ugugggaaaugaugacuuu

SEQ ID NO: 1104828 - RNA, 19 nt, Homo sapiens
gugagacucuggacugaga

SEQ ID NO: 1104829 - RNA, 19 nt, Homo sapiens
gcauuucccagcuguguaa

SEQ ID NO: 1104830 - RNA, 19 nt, Homo sapiens
uauaagcacuuggaauugu

SEQ ID NO: 1104831 - RNA, 19 nt, Homo sapiens
ggcaagaggguuaaaguau

SEQ ID NO: 1104832 - RNA, 19 nt, Homo sapiens
gguuacagauugucuugau

SEQ ID NO: 1104833 - RNA, 19 nt, Homo sapiens
guucaacuccaacuauaaa

SEQ ID NO: 1104834 - RNA, 19 nt, Homo sapiens
caauggaagggaucaguaa

SEQ ID NO: 1104835 - RNA, 19 nt, Homo sapiens
ggccuuacuuugugggaaa

SEQ ID NO: 1104836 - RNA, 19 nt, Homo sapiens
uaaaaucugugauguagga

SEQ ID NO: 1104837 - RNA, 19 nt, Homo sapiens
ggugaaaagucucuaaaug

SEQ ID NO: 1104838 - RNA, 19 nt, Homo sapiens
gacauuagcacuuuguaca

SEQ ID NO: 1104839 - RNA, 19 nt, Homo sapiens
uaaugaagacccuaaagau

SEQ ID NO: 1104840 - RNA, 19 nt, Homo sapiens
gaaucauaccagaaaguaa

SEQ ID NO: 1104841 - RNA, 19 nt, Homo sapiens
ggacugagaguggcuuuca

SEQ ID NO: 1104842 - RNA, 19 nt, Homo sapiens
ggcagucugugucuugcua

SEQ ID NO: 1104843 - RNA, 19 nt, Homo sapiens
uaaaggcgauuuugaaaca

SEQ ID NO: 1104844 - RNA, 19 nt, Homo sapiens
auaagcacuuggaauugua

SEQ ID NO: 1104845 - RNA, 19 nt, Homo sapiens
gccaggaggguucgaauug

SEQ ID NO: 1104846 - RNA, 19 nt, Homo sapiens
gaacucuucucuguaugca

SEQ ID NO: 1104847 - RNA, 19 nt, Homo sapiens
gguacuuggccacgacuua

SEQ ID NO: 1104848 - RNA, 19 nt, Homo sapiens
ugaaucauaccagaaagua

SEQ ID NO: 1104849 - RNA, 19 nt, Homo sapiens
aagaagcuguggaggagaa

SEQ ID NO: 1104850 - RNA, 19 nt, Homo sapiens
gauauaaagccagccaaga

SEQ ID NO: 1104851 - RNA, 19 nt, Homo sapiens
ucucuuggaucuccucaga

SEQ ID NO: 1104852 - RNA, 19 nt, Homo sapiens
ugaggaccauaguuucuug

SEQ ID NO: 1104853 - RNA, 19 nt, Homo sapiens
gagaaugguguuauuacug

SEQ ID NO: 1104854 - RNA, 19 nt, Homo sapiens
uauggaauauggaggugaa

SEQ ID NO: 1104855 - RNA, 19 nt, Homo sapiens
ggaugaagcuaagauuuug

SEQ ID NO: 1104856 - RNA, 19 nt, Homo sapiens
cuaaugaagacccuaaaga

SEQ ID NO: 1104857 - RNA, 19 nt, Homo sapiens
aaaagagacuaauggauga

SEQ ID NO: 1104858 - RNA, 19 nt, Homo sapiens
uuuaauggaucuacugaca

SEQ ID NO: 1104859 - RNA, 19 nt, Homo sapiens
ggccaccuauuaauaugga

SEQ ID NO: 1104860 - RNA, 19 nt, Homo sapiens
gauggcagucugugucuug

SEQ ID NO: 1104861 - RNA, 19 nt, Homo sapiens
uaucgaaguguguaucaaa

SEQ ID NO: 1104862 - RNA, 19 nt, Homo sapiens
auugaacucuucucuguau

SEQ ID NO: 1104863 - RNA, 19 nt, Homo sapiens
cuccucagaucuuugguuu

SEQ ID NO: 1104864 - RNA, 19 nt, Homo sapiens
guacuggguuuucuguaaa

SEQ ID NO: 1104865 - RNA, 19 nt, Homo sapiens
ccugaggcuuguuacauug

SEQ ID NO: 1104866 - RNA, 19 nt, Homo sapiens
cccugaggcuuguuacauu

SEQ ID NO: 1104867 - RNA, 19 nt, Homo sapiens
guuaaaguaucugcaccaa

SEQ ID NO: 1104868 - RNA, 19 nt, Homo sapiens
guacugggguaaaugugua

SEQ ID NO: 1104869 - RNA, 19 nt, Homo sapiens
cuagcuacauaaguacuuu

SEQ ID NO: 1104870 - RNA, 19 nt, Homo sapiens
ggaagggaucaguaauuuc

SEQ ID NO: 1104871 - RNA, 19 nt, Homo sapiens
gaaagugauuuugaugaug

SEQ ID NO: 1104872 - RNA, 19 nt, Homo sapiens
auauuugccuuuggccuua

SEQ ID NO: 1104873 - RNA, 19 nt, Homo sapiens
ucaagacaccaagcaaauu

SEQ ID NO: 1104874 - RNA, 19 nt, Homo sapiens
uauuugaggaccauaguuu

SEQ ID NO: 1104875 - RNA, 19 nt, Homo sapiens
gcacagagccauggaaacc

SEQ ID NO: 1104876 - RNA, 19 nt, Homo sapiens
gugaaaagucucuaaauga

SEQ ID NO: 1104877 - RNA, 19 nt, Homo sapiens
guagcuccuuggauacuuc

SEQ ID NO: 1104878 - RNA, 19 nt, Homo sapiens
guacuuggccacgacuuau

SEQ ID NO: 1104879 - RNA, 19 nt, Homo sapiens
ugaugaugaugaugaagau

SEQ ID NO: 1104880 - RNA, 19 nt, Homo sapiens
guauuauguucaacuccaa

SEQ ID NO: 1104881 - RNA, 19 nt, Homo sapiens
acagaugucuagugaucau

SEQ ID NO: 1104882 - RNA, 19 nt, Homo sapiens
uggcaagaggguuaaagua

SEQ ID NO: 1104883 - RNA, 19 nt, Homo sapiens
gaucauuaucgaagugugu

SEQ ID NO: 1104884 - RNA, 19 nt, Homo sapiens
aaagaucuccaagagguuu

SEQ ID NO: 1104885 - RNA, 19 nt, Homo sapiens
gacaaggcagacauauuug

SEQ ID NO: 1104886 - RNA, 19 nt, Homo sapiens
acuaauggaugaagcuaag

SEQ ID NO: 1104887 - RNA, 19 nt, Homo sapiens
acaauggaagggaucagua

SEQ ID NO: 1104888 - RNA, 19 nt, Homo sapiens
gagauuacccaaagaaaua

SEQ ID NO: 1104889 - RNA, 19 nt, Homo sapiens
gaggaaaucacaagaauug

SEQ ID NO: 1104890 - RNA, 19 nt, Homo sapiens
ccagaaacaugaaggagaa

SEQ ID NO: 1104891 - RNA, 19 nt, Homo sapiens
cagggaauaugauggcuua

SEQ ID NO: 1104892 - RNA, 19 nt, Homo sapiens
guccugagcuaucgaguaa

SEQ ID NO: 1104893 - RNA, 19 nt, Homo sapiens
ccaauacccuccucccaaa

SEQ ID NO: 1104894 - RNA, 19 nt, Homo sapiens
caaaucggguccugagcua

SEQ ID NO: 1104895 - RNA, 19 nt, Homo sapiens
auacauggacuucugauua

SEQ ID NO: 1104896 - RNA, 19 nt, Homo sapiens
uacauggacuucugauuaa

SEQ ID NO: 1104897 - RNA, 19 nt, Homo sapiens
uaucugagguccugauuuc

SEQ ID NO: 1104898 - RNA, 19 nt, Homo sapiens
gagaguugauagugagauu

SEQ ID NO: 1104899 - RNA, 19 nt, Homo sapiens
gaaaagaugugcuaaacuc

SEQ ID NO: 1104900 - RNA, 19 nt, Homo sapiens
uaaacucccucgcuaagug

SEQ ID NO: 1104901 - RNA, 19 nt, Homo sapiens
ugacagaggagaagagaaa

SEQ ID NO: 1104902 - RNA, 19 nt, Homo sapiens
cccauucgcuccauguuaa

SEQ ID NO: 1104903 - RNA, 19 nt, Homo sapiens
ggacaagugguuagaugaa

SEQ ID NO: 1104904 - RNA, 19 nt, Homo sapiens
ggauaugauugccguuaga

SEQ ID NO: 1104905 - RNA, 19 nt, Homo sapiens
caucucagcuauaaacaca

SEQ ID NO: 1104906 - RNA, 19 nt, Homo sapiens
acaaggagacgaugagaaa

SEQ ID NO: 1104907 - RNA, 19 nt, Homo sapiens
caagaauuguaguuaagga

SEQ ID NO: 1104908 - RNA, 19 nt, Homo sapiens
ggaauaugauggcuuagcu

SEQ ID NO: 1104909 - RNA, 19 nt, Homo sapiens
caaccauucuuugauguau

SEQ ID NO: 1104910 - RNA, 19 nt, Homo sapiens
gaaacaugaaggagaaguu

SEQ ID NO: 1104911 - RNA, 19 nt, Homo sapiens
aaagcgaccggcaauauaa

SEQ ID NO: 1104912 - RNA, 19 nt, Homo sapiens
ggaucuagagcaaagagua

SEQ ID NO: 1104913 - RNA, 19 nt, Homo sapiens
gaauuguaguuaaggagau

SEQ ID NO: 1104914 - RNA, 19 nt, Homo sapiens
cagcaguccuccugacaug

SEQ ID NO: 1104915 - RNA, 19 nt, Homo sapiens
gugguuagaugaacuggau

SEQ ID NO: 1104916 - RNA, 19 nt, Homo sapiens
ccagugggaccucuuuaaa

SEQ ID NO: 1104917 - RNA, 19 nt, Homo sapiens
gaggauuccagaaacauga

SEQ ID NO: 1104918 - RNA, 19 nt, Homo sapiens
cgaccggcaauauaaauuu

SEQ ID NO: 1104919 - RNA, 19 nt, Homo sapiens
gcagccaaccauucuuuga

SEQ ID NO: 1104920 - RNA, 19 nt, Homo sapiens
ugcuagagcugucugaaga

SEQ ID NO: 1104921 - RNA, 19 nt, Homo sapiens
agacaagccucuccuaagc

SEQ ID NO: 1104922 - RNA, 19 nt, Homo sapiens
gaaaagcgaccggcaauau

SEQ ID NO: 1104923 - RNA, 19 nt, Homo sapiens
guaucuggcuacccuugaa

SEQ ID NO: 1104924 - RNA, 19 nt, Homo sapiens
aaaucaagauaucggagaa

SEQ ID NO: 1104925 - RNA, 19 nt, Homo sapiens
guuagaagccuuguugaug

SEQ ID NO: 1104926 - RNA, 19 nt, Homo sapiens
ugucaucaguuaaggcuau

SEQ ID NO: 1104927 - RNA, 19 nt, Homo sapiens
cuccugacauggacuauga

SEQ ID NO: 1104928 - RNA, 19 nt, Homo sapiens
ugaaggaccaggugaaauc

SEQ ID NO: 1104929 - RNA, 19 nt, Homo sapiens
gaucuagagcaaagaguau

SEQ ID NO: 1104930 - RNA, 19 nt, Homo sapiens
ggcaggaucuagagcaaag

SEQ ID NO: 1104931 - RNA, 19 nt, Homo sapiens
gaagagaaaagaugugcua

SEQ ID NO: 1104932 - RNA, 19 nt, Homo sapiens
guucggaggauuccagaaa

SEQ ID NO: 1104933 - RNA, 19 nt, Homo sapiens
gaaacucuggagacgguaa

SEQ ID NO: 1104934 - RNA, 19 nt, Homo sapiens
gauagugagauuacccaaa

SEQ ID NO: 1104935 - RNA, 19 nt, Homo sapiens
gggauaugauugccguuag

SEQ ID NO: 1104936 - RNA, 19 nt, Homo sapiens
cuaccucugucucuuccua

SEQ ID NO: 1104937 - RNA, 19 nt, Homo sapiens
gagaaaagaugugcuaaac

SEQ ID NO: 1104938 - RNA, 19 nt, Homo sapiens
gaucaauuaauacgagaga

SEQ ID NO: 1104939 - RNA, 19 nt, Homo sapiens
auagugagauuacccaaag

SEQ ID NO: 1104940 - RNA, 19 nt, Homo sapiens
aaacugaaauuggcuucug

SEQ ID NO: 1104941 - RNA, 19 nt, Homo sapiens
ggcagguugugcauguuaa

SEQ ID NO: 1104942 - RNA, 19 nt, Homo sapiens
caaaagccauucuggacuu

SEQ ID NO: 1104943 - RNA, 19 nt, Homo sapiens
gggcuuccaccaucagaaa

SEQ ID NO: 1104944 - RNA, 19 nt, Homo sapiens
ggaaugucaucaguuaagg

SEQ ID NO: 1104945 - RNA, 19 nt, Homo sapiens
cagccuggauuucauacau

SEQ ID NO: 1104946 - RNA, 19 nt, Homo sapiens
gaacuacccuuuucauucc

SEQ ID NO: 1104947 - RNA, 19 nt, Homo sapiens
gcaauguucagcguauuug

SEQ ID NO: 1104948 - RNA, 19 nt, Homo sapiens
ggaacuacccuuuucauuc

SEQ ID NO: 1104949 - RNA, 19 nt, Homo sapiens
aaacaagcagccaaccauu

SEQ ID NO: 1104950 - RNA, 19 nt, Homo sapiens
uggaggacauggagagugu

SEQ ID NO: 1104951 - RNA, 19 nt, Homo sapiens
ucagggccaucucagcuau

SEQ ID NO: 1104952 - RNA, 19 nt, Homo sapiens
uaaaggaggaaacccugaa

SEQ ID NO: 1104953 - RNA, 19 nt, Homo sapiens
gaguuucaaauucuggaua

SEQ ID NO: 1104954 - RNA, 19 nt, Homo sapiens
uugaggaaaucacaagaau

SEQ ID NO: 1104955 - RNA, 19 nt, Homo sapiens
ccaaccauucuuugaugua

SEQ ID NO: 1104956 - RNA, 19 nt, Homo sapiens
ccacaagccucuggguuuu

SEQ ID NO: 1104957 - RNA, 19 nt, Homo sapiens
ccugagcuaucgaguaaag

SEQ ID NO: 1104958 - RNA, 19 nt, Homo sapiens
ugagauuacccaaagaaau

SEQ ID NO: 1104959 - RNA, 19 nt, Homo sapiens
gcgcaauguucagcguauu

SEQ ID NO: 1104960 - RNA, 19 nt, Homo sapiens
gggacaagugguuagauga

SEQ ID NO: 1104961 - RNA, 19 nt, Homo sapiens
uggcuucuguuucugaguu

SEQ ID NO: 1104962 - RNA, 19 nt, Homo sapiens
gauaugauugccguuagaa

SEQ ID NO: 1104963 - RNA, 19 nt, Homo sapiens
gcagguugugcauguuaaa

SEQ ID NO: 1104964 - RNA, 19 nt, Homo sapiens
ucacugccaucgccacuac

SEQ ID NO: 1104965 - RNA, 19 nt, Homo sapiens
ucugugcgcuguauguugu

SEQ ID NO: 1104966 - RNA, 19 nt, Homo sapiens
gcaguccuccugacaugga

SEQ ID NO: 1104967 - RNA, 19 nt, Homo sapiens
cugaagagcagcaguuugu

SEQ ID NO: 1104968 - RNA, 19 nt, Homo sapiens
gcuaaacucccucgcuaag

SEQ ID NO: 1104969 - RNA, 19 nt, Homo sapiens
ggaggauuccagaaacaug

SEQ ID NO: 1104970 - RNA, 19 nt, Homo sapiens
ggucacagggaauaugaug

SEQ ID NO: 1104971 - RNA, 19 nt, Homo sapiens
caaauucuggauaauguag

SEQ ID NO: 1104972 - RNA, 19 nt, Homo sapiens
gccaaccauucuuugaugu

SEQ ID NO: 1104973 - RNA, 19 nt, Homo sapiens
gguccugagcuaucgagua

SEQ ID NO: 1104974 - RNA, 19 nt, Homo sapiens
gaccggcaauauaaauuuu

SEQ ID NO: 1104975 - RNA, 19 nt, Homo sapiens
gaaaacaggaagcugaaga

SEQ ID NO: 1104976 - RNA, 19 nt, Homo sapiens
gaauaugauggcuuagcuu

SEQ ID NO: 1104977 - RNA, 19 nt, Homo sapiens
ucaaaaggcugaguuucaa

SEQ ID NO: 1104978 - RNA, 19 nt, Homo sapiens
uguauguuguugucucuau

SEQ ID NO: 1104979 - RNA, 19 nt, Homo sapiens
aaacaugaaggagaaguug

SEQ ID NO: 1104980 - RNA, 19 nt, Homo sapiens
caacaaggagacgaugaga

SEQ ID NO: 1104981 - RNA, 19 nt, Homo sapiens
uuucauacauggacuucug

SEQ ID NO: 1104982 - RNA, 19 nt, Homo sapiens
gggccuaccucugucucuu

SEQ ID NO: 1104983 - RNA, 19 nt, Homo sapiens
gguagaagcgcgugcaaaa

SEQ ID NO: 1104984 - RNA, 19 nt, Homo sapiens
gcgaccggcaauauaaauu

SEQ ID NO: 1104985 - RNA, 19 nt, Homo sapiens
gccguuagaagccuuguug

SEQ ID NO: 1104986 - RNA, 19 nt, Homo sapiens
aagcagccaaccauucuuu

SEQ ID NO: 1104987 - RNA, 19 nt, Homo sapiens
ggcgcaauguucagcguau

SEQ ID NO: 1104988 - RNA, 19 nt, Homo sapiens
gaacagaucucagaaauga

SEQ ID NO: 1104989 - RNA, 19 nt, Homo sapiens
gcaaggagguguauuucua

SEQ ID NO: 1104990 - RNA, 19 nt, Homo sapiens
cuacacagguuccuacaua

SEQ ID NO: 1104991 - RNA, 19 nt, Homo sapiens
gaaggacgauuacuagcaa

SEQ ID NO: 1104992 - RNA, 19 nt, Homo sapiens
gguguucgcuuuaaugguu

SEQ ID NO: 1104993 - RNA, 19 nt, Homo sapiens
caucagacuuggaaagauu

SEQ ID NO: 1104994 - RNA, 19 nt, Homo sapiens
acaauuggcuuaacuucaa

SEQ ID NO: 1104995 - RNA, 19 nt, Homo sapiens
gcgacugccuugccauuaa

SEQ ID NO: 1104996 - RNA, 19 nt, Homo sapiens
gguugaagacaucauauua

SEQ ID NO: 1104997 - RNA, 19 nt, Homo sapiens
uuggaaagauucacgcuua

SEQ ID NO: 1104998 - RNA, 19 nt, Homo sapiens
gaaauuccacuucgaguuc

SEQ ID NO: 1104999 - RNA, 19 nt, Homo sapiens
guagagagcuaugguuaca

SEQ ID NO: 1105000 - RNA, 19 nt, Homo sapiens
gaacuugacccuggacuau

SEQ ID NO: 1105001 - RNA, 19 nt, Homo sapiens
acuauuaccucuuggauau

SEQ ID NO: 1105002 - RNA, 19 nt, Homo sapiens
ggaccuugaugacaacaau

SEQ ID NO: 1105003 - RNA, 19 nt, Homo sapiens
gcugggaccuugaugacaa

SEQ ID NO: 1105004 - RNA, 19 nt, Homo sapiens
cgagaagggugugcaagaa

SEQ ID NO: 1105005 - RNA, 19 nt, Homo sapiens
gcuaugguguucgcuuuaa

SEQ ID NO: 1105006 - RNA, 19 nt, Homo sapiens
gagcaauucaagugugaua

SEQ ID NO: 1105007 - RNA, 19 nt, Homo sapiens
agagggaaguuaacagcua

SEQ ID NO: 1105008 - RNA, 19 nt, Homo sapiens
ucucagaaaugaauaugga

SEQ ID NO: 1105009 - RNA, 19 nt, Homo sapiens
caauucaagugugauacua

SEQ ID NO: 1105010 - RNA, 19 nt, Homo sapiens
gagaaagccugagcgaucu

SEQ ID NO: 1105011 - RNA, 19 nt, Homo sapiens
gcugugcuccuuucaguuu

SEQ ID NO: 1105012 - RNA, 19 nt, Homo sapiens
cagcuaugguguucgcuuu

SEQ ID NO: 1105013 - RNA, 19 nt, Homo sapiens
gcauugaacagaucucaga

SEQ ID NO: 1105014 - RNA, 19 nt, Homo sapiens
ucaccacuauuaccucuug

SEQ ID NO: 1105015 - RNA, 19 nt, Homo sapiens
caacauuuccuguaucaag

SEQ ID NO: 1105016 - RNA, 19 nt, Homo sapiens
ccagucccaucccgaaauu

SEQ ID NO: 1105017 - RNA, 19 nt, Homo sapiens
gauaagcuccccaacauuu

SEQ ID NO: 1105018 - RNA, 19 nt, Homo sapiens
cuacuguccucaccacuau

SEQ ID NO: 1105019 - RNA, 19 nt, Homo sapiens
caaggccauugauaucuau

SEQ ID NO: 1105020 - RNA, 19 nt, Homo sapiens
cccuggaucugcauaaauu

SEQ ID NO: 1105021 - RNA, 19 nt, Homo sapiens
ucccaaaggucgacaagug

SEQ ID NO: 1105022 - RNA, 19 nt, Homo sapiens
gaaagccucagcccacuca

SEQ ID NO: 1105023 - RNA, 19 nt, Homo sapiens
ggaaggacgauuacuagca

SEQ ID NO: 1105024 - RNA, 19 nt, Homo sapiens
gaaagauucacgcuuagca

SEQ ID NO: 1105025 - RNA, 19 nt, Homo sapiens
caugaagauuccaaugaga

SEQ ID NO: 1105026 - RNA, 19 nt, Homo sapiens
acucacaucugcgggauaa

SEQ ID NO: 1105027 - RNA, 19 nt, Homo sapiens
ccaugaagauuccaaugag

SEQ ID NO: 1105028 - RNA, 19 nt, Homo sapiens
uaacagcuaccuugugcaa

SEQ ID NO: 1105029 - RNA, 19 nt, Homo sapiens
ugacugaggagcugcauau

SEQ ID NO: 1105030 - RNA, 19 nt, Homo sapiens
gcagccagggugacaauug

SEQ ID NO: 1105031 - RNA, 19 nt, Homo sapiens
uugaacagaucucagaaau

SEQ ID NO: 1105032 - RNA, 19 nt, Homo sapiens
ucacgagcauugaacagau

SEQ ID NO: 1105033 - RNA, 19 nt, Homo sapiens
uacauacgccugauacuga

SEQ ID NO: 1105034 - RNA, 19 nt, Homo sapiens
gagaccacccugaacuuga

SEQ ID NO: 1105035 - RNA, 19 nt, Homo sapiens
gcgagaagggugugcaaga

SEQ ID NO: 1105036 - RNA, 19 nt, Homo sapiens
cuagcaaggagguguauuu

SEQ ID NO: 1105037 - RNA, 19 nt, Homo sapiens
uaaauucccuauggacaag

SEQ ID NO: 1105038 - RNA, 19 nt, Homo sapiens
caagugugauacuaacagu

SEQ ID NO: 1105039 - RNA, 19 nt, Homo sapiens
gcauaucccucaguucacu

SEQ ID NO: 1105040 - RNA, 19 nt, Homo sapiens
gcuacuuucugaacagcaa

SEQ ID NO: 1105041 - RNA, 19 nt, Homo sapiens
aauauggacuacacgauca

SEQ ID NO: 1105042 - RNA, 19 nt, Homo sapiens
gugcugugcuccuuucagu

SEQ ID NO: 1105043 - RNA, 19 nt, Homo sapiens
ccucuucccucuggccuuu

SEQ ID NO: 1105044 - RNA, 19 nt, Homo sapiens
gccaagagaaggacaguag

SEQ ID NO: 1105045 - RNA, 19 nt, Homo sapiens
uuaaggagcaauucaagug

SEQ ID NO: 1105046 - RNA, 19 nt, Homo sapiens
gagcgacugccuugccauu

SEQ ID NO: 1105047 - RNA, 19 nt, Homo sapiens
cggcacagcuaugguguuc

SEQ ID NO: 1105048 - RNA, 19 nt, Homo sapiens
gggaacgccauccacauga

SEQ ID NO: 1105049 - RNA, 19 nt, Homo sapiens
uguggagaaucgcguguuu

SEQ ID NO: 1105050 - RNA, 19 nt, Homo sapiens
cagaaaugaauauggacua

SEQ ID NO: 1105051 - RNA, 19 nt, Homo sapiens
cccaacauuuccuguauca

SEQ ID NO: 1105052 - RNA, 19 nt, Homo sapiens
gacaauuggcuuaacuuca

SEQ ID NO: 1105053 - RNA, 19 nt, Homo sapiens
caagucuacuggccuacug

SEQ ID NO: 1105054 - RNA, 19 nt, Homo sapiens
gaaccucuucaacugcaaa

SEQ ID NO: 1105055 - RNA, 19 nt, Homo sapiens
ccaggcugaugacaguauu

SEQ ID NO: 1105056 - RNA, 19 nt, Homo sapiens
ggugacaauuggcuuaacu

SEQ ID NO: 1105057 - RNA, 19 nt, Homo sapiens
ugguagagagcuaugguua

SEQ ID NO: 1105058 - RNA, 19 nt, Homo sapiens
ccugacugcuacuuucuga

SEQ ID NO: 1105059 - RNA, 19 nt, Homo sapiens
aagauucacgcuuagcaua

SEQ ID NO: 1105060 - RNA, 19 nt, Homo sapiens
ggacaguagcucagagucu

SEQ ID NO: 1105061 - RNA, 19 nt, Homo sapiens
cgacugccuugccauuaag

SEQ ID NO: 1105062 - RNA, 19 nt, Homo sapiens
uguccuugcuggaguaugu

SEQ ID NO: 1105063 - RNA, 19 nt, Homo sapiens
uuacacgguugaagacauc

SEQ ID NO: 1105064 - RNA, 19 nt, Homo sapiens
gaaaugaauauggacuaca

SEQ ID NO: 1105065 - RNA, 19 nt, Homo sapiens
acagaucucagaaaugaau

SEQ ID NO: 1105066 - RNA, 19 nt, Homo sapiens
acauacgccugauacugaa

SEQ ID NO: 1105067 - RNA, 19 nt, Homo sapiens
ggaacgccauccacaugac

SEQ ID NO: 1105068 - RNA, 19 nt, Homo sapiens
gcaauucaagugugauacu

SEQ ID NO: 1105069 - RNA, 19 nt, Homo sapiens
uaacuucaaugcucauccu

SEQ ID NO: 1105070 - RNA, 19 nt, Homo sapiens
gagaagggugugcaagaag

SEQ ID NO: 1105071 - RNA, 19 nt, Homo sapiens
cagggugacaauuggcuua

SEQ ID NO: 1105072 - RNA, 19 nt, Homo sapiens
cagccagggugacaauugg

SEQ ID NO: 1105073 - RNA, 19 nt, Homo sapiens
cugcauaucccucaguuca

SEQ ID NO: 1105074 - RNA, 19 nt, Homo sapiens
ccugcaaccuggugguaga

SEQ ID NO: 1105075 - RNA, 19 nt, Homo sapiens
aaaugaauauggacuacac

SEQ ID NO: 1105076 - RNA, 19 nt, Homo sapiens
ccauuaaggagcaauucaa

SEQ ID NO: 1105077 - RNA, 19 nt, Homo sapiens
ugaccaccaucgacucaca

SEQ ID NO: 1105078 - RNA, 19 nt, Homo sapiens
gcauccgacucaccacuac

SEQ ID NO: 1105079 - RNA, 19 nt, Homo sapiens
acuaucggaugcaugagaa

SEQ ID NO: 1105080 - RNA, 19 nt, Homo sapiens
cuccuucgaucucuuuaau

SEQ ID NO: 1105081 - RNA, 19 nt, Homo sapiens
aggagcaauucaaguguga

SEQ ID NO: 1105082 - RNA, 19 nt, Homo sapiens
gaugacaacaaugacaaga

SEQ ID NO: 1105083 - RNA, 19 nt, Homo sapiens
gauacugaaguuccagguu

SEQ ID NO: 1105084 - RNA, 19 nt, Homo sapiens
ggacgauuacuagcaagga

SEQ ID NO: 1105085 - RNA, 19 nt, Homo sapiens
guuacacgguugaagacau

SEQ ID NO: 1105086 - RNA, 19 nt, Homo sapiens
ugaugugacuguggagaau

SEQ ID NO: 1105087 - RNA, 19 nt, Homo sapiens
gaucucagaaaugaauaug

SEQ ID NO: 1105088 - RNA, 19 nt, Homo sapiens
caacagagccuuacguuaa

SEQ ID NO: 1105089 - RNA, 19 nt, Homo sapiens
ugaaagaguuccucacaua

SEQ ID NO: 1105090 - RNA, 19 nt, Homo sapiens
ggaaagcccuucgaaguuu

SEQ ID NO: 1105091 - RNA, 19 nt, Homo sapiens
ugagaaaguugaggaauuu

SEQ ID NO: 1105092 - RNA, 19 nt, Homo sapiens
aaagggaguugcuggaaua

SEQ ID NO: 1105093 - RNA, 19 nt, Homo sapiens
ggaggccaguguaacguua

SEQ ID NO: 1105094 - RNA, 19 nt, Homo sapiens
guaaagaauugguguaguc

SEQ ID NO: 1105095 - RNA, 19 nt, Homo sapiens
gcauguaguuaucuaauca

SEQ ID NO: 1105096 - RNA, 19 nt, Homo sapiens
gggaguugcuggaauaaug

SEQ ID NO: 1105097 - RNA, 19 nt, Homo sapiens
uuacaugacucguugagaa

SEQ ID NO: 1105098 - RNA, 19 nt, Homo sapiens
uaucaguggccauuuauua

SEQ ID NO: 1105099 - RNA, 19 nt, Homo sapiens
ccaccaagaugucgugaga

SEQ ID NO: 1105100 - RNA, 19 nt, Homo sapiens
caagacaccucauucaaac

SEQ ID NO: 1105101 - RNA, 19 nt, Homo sapiens
uaaacacgguaaacagauu

SEQ ID NO: 1105102 - RNA, 19 nt, Homo sapiens
gcaacagagccuuacguua

SEQ ID NO: 1105103 - RNA, 19 nt, Homo sapiens
caucuggucuugcauugaa

SEQ ID NO: 1105104 - RNA, 19 nt, Homo sapiens
ccaaacaucuggucuugca

SEQ ID NO: 1105105 - RNA, 19 nt, Homo sapiens
gguaaaucguccugucaaa

SEQ ID NO: 1105106 - RNA, 19 nt, Homo sapiens
gacagugacguccacauua

SEQ ID NO: 1105107 - RNA, 19 nt, Homo sapiens
gcaguguugucucuuguga

SEQ ID NO: 1105108 - RNA, 19 nt, Homo sapiens
ggagagaagucggucuuuc

SEQ ID NO: 1105109 - RNA, 19 nt, Homo sapiens
caugagguccuacacguua

SEQ ID NO: 1105110 - RNA, 19 nt, Homo sapiens
guaguuaucuaaucaagac

SEQ ID NO: 1105111 - RNA, 19 nt, Homo sapiens
gacuuuagcugauacucuu

SEQ ID NO: 1105112 - RNA, 19 nt, Homo sapiens
ucaagacaccucauucaaa

SEQ ID NO: 1105113 - RNA, 19 nt, Homo sapiens
gcacggcaacagagccuua

SEQ ID NO: 1105114 - RNA, 19 nt, Homo sapiens
caaagggaguugcuggaau

SEQ ID NO: 1105115 - RNA, 19 nt, Homo sapiens
cauuugguaugagguauua

SEQ ID NO: 1105116 - RNA, 19 nt, Homo sapiens
caugugaaagucagucuua

SEQ ID NO: 1105117 - RNA, 19 nt, Homo sapiens
gugaauagaauguagcaaa

SEQ ID NO: 1105118 - RNA, 19 nt, Homo sapiens
ggccaaacaucuggucuug

SEQ ID NO: 1105119 - RNA, 19 nt, Homo sapiens
uagcugauacucuuaugua

SEQ ID NO: 1105120 - RNA, 19 nt, Homo sapiens
gaauaaacacgguaaacag

SEQ ID NO: 1105121 - RNA, 19 nt, Homo sapiens
gaacucuuucugcuuguuu

SEQ ID NO: 1105122 - RNA, 19 nt, Homo sapiens
guacuagucauggaucuuu

SEQ ID NO: 1105123 - RNA, 19 nt, Homo sapiens
ucaaagcaguguugucucu

SEQ ID NO: 1105124 - RNA, 19 nt, Homo sapiens
gcuggacuguggucagauu

SEQ ID NO: 1105125 - RNA, 19 nt, Homo sapiens
uuaaucagcugguuucaac

SEQ ID NO: 1105126 - RNA, 19 nt, Homo sapiens
ccgcaugacuauucagaug

SEQ ID NO: 1105127 - RNA, 19 nt, Homo sapiens
cagaguugcuucgauguug

SEQ ID NO: 1105128 - RNA, 19 nt, Homo sapiens
aacagagccuuacguuaaa

SEQ ID NO: 1105129 - RNA, 19 nt, Homo sapiens
ggaauaaugggccaaacau

SEQ ID NO: 1105130 - RNA, 19 nt, Homo sapiens
cgaugucucuugccugguu

SEQ ID NO: 1105131 - RNA, 19 nt, Homo sapiens
uugagaaaguugaggaauu

SEQ ID NO: 1105132 - RNA, 19 nt, Homo sapiens
uagcauuucuuugggauug

SEQ ID NO: 1105133 - RNA, 19 nt, Homo sapiens
ccaagaaaaugaaagaguu

SEQ ID NO: 1105134 - RNA, 19 nt, Homo sapiens
ucugggaccugaauaaaca

SEQ ID NO: 1105135 - RNA, 19 nt, Homo sapiens
cuuaaucggugcuuuaugg

SEQ ID NO: 1105136 - RNA, 19 nt, Homo sapiens
aagaauugguguagucaug

SEQ ID NO: 1105137 - RNA, 19 nt, Homo sapiens
aguuaucaguggccauuua

SEQ ID NO: 1105138 - RNA, 19 nt, Homo sapiens
uaacaauggugugcaugug

SEQ ID NO: 1105139 - RNA, 19 nt, Homo sapiens
gaaagaguuccucacauac

SEQ ID NO: 1105140 - RNA, 19 nt, Homo sapiens
gcaucugggaccugaauaa

SEQ ID NO: 1105141 - RNA, 19 nt, Homo sapiens
cagcaaguguugaacucuu

SEQ ID NO: 1105142 - RNA, 19 nt, Homo sapiens
caucuugugcuucuuugua

SEQ ID NO: 1105143 - RNA, 19 nt, Homo sapiens
cuucgaaguuuccuaacaa

SEQ ID NO: 1105144 - RNA, 19 nt, Homo sapiens
gggcuuugcugcacauuuu

SEQ ID NO: 1105145 - RNA, 19 nt, Homo sapiens
aaagcaguguugucucuug

SEQ ID NO: 1105146 - RNA, 19 nt, Homo sapiens
gaagcuagagggccaucaa

SEQ ID NO: 1105147 - RNA, 19 nt, Homo sapiens
caacucuacugcgaaacaa

SEQ ID NO: 1105148 - RNA, 19 nt, Homo sapiens
ggauuaaucagcugguuuc

SEQ ID NO: 1105149 - RNA, 19 nt, Homo sapiens
gucaugacuuuagcugaua

SEQ ID NO: 1105150 - RNA, 19 nt, Homo sapiens
ccuaguaccuauccuugug

SEQ ID NO: 1105151 - RNA, 19 nt, Homo sapiens
gcgaaaggcugaggucacu

SEQ ID NO: 1105152 - RNA, 19 nt, Homo sapiens
aaaguacuguucuccuuca

SEQ ID NO: 1105153 - RNA, 19 nt, Homo sapiens
gaucugucucugcuguuua

SEQ ID NO: 1105154 - RNA, 19 nt, Homo sapiens
uaaaccgcaugacuauuca

SEQ ID NO: 1105155 - RNA, 19 nt, Homo sapiens
cggaaagcccuucgaaguu

SEQ ID NO: 1105156 - RNA, 19 nt, Homo sapiens
gaacugaaaacucccauug

SEQ ID NO: 1105157 - RNA, 19 nt, Homo sapiens
acagugacguccacauuag

SEQ ID NO: 1105158 - RNA, 19 nt, Homo sapiens
ugacagugacguccacauu

SEQ ID NO: 1105159 - RNA, 19 nt, Homo sapiens
caagaugucgugagagauc

SEQ ID NO: 1105160 - RNA, 19 nt, Homo sapiens
uuaaaccgcaugacuauuc

SEQ ID NO: 1105161 - RNA, 19 nt, Homo sapiens
gugcaggaaaugacaaauu

SEQ ID NO: 1105162 - RNA, 19 nt, Homo sapiens
uaagcaacaccacaucuug

SEQ ID NO: 1105163 - RNA, 19 nt, Homo sapiens
gauguuaagguacaacugu

SEQ ID NO: 1105164 - RNA, 19 nt, Homo sapiens
gauugugaauagaauguag

SEQ ID NO: 1105165 - RNA, 19 nt, Homo sapiens
ugucacggcuucuuacgau

SEQ ID NO: 1105166 - RNA, 19 nt, Homo sapiens
gaagucggucuuucuaugg

SEQ ID NO: 1105167 - RNA, 19 nt, Homo sapiens
cugauacucuuauguacga

SEQ ID NO: 1105168 - RNA, 19 nt, Homo sapiens
gccauuuauuagcaucaua

SEQ ID NO: 1105169 - RNA, 19 nt, Homo sapiens
aaacaucuggucuugcauu

SEQ ID NO: 1105170 - RNA, 19 nt, Homo sapiens
gagauggccacguccaguu

SEQ ID NO: 1105171 - RNA, 19 nt, Homo sapiens
gauguuggccaagugcuuu

SEQ ID NO: 1105172 - RNA, 19 nt, Homo sapiens
ggacuguggucagauuguc

SEQ ID NO: 1105173 - RNA, 19 nt, Homo sapiens
ggcauguaguuaucuaauc

SEQ ID NO: 1105174 - RNA, 19 nt, Homo sapiens
ucaguggcauguaguuauc

SEQ ID NO: 1105175 - RNA, 19 nt, Homo sapiens
uaaaaguacuguucuccuu

SEQ ID NO: 1105176 - RNA, 19 nt, Homo sapiens
gauggcuacugaguuauca

SEQ ID NO: 1105177 - RNA, 19 nt, Homo sapiens
gagcaguucaucccuaaag

SEQ ID NO: 1105178 - RNA, 19 nt, Homo sapiens
gaaaacucccauugcauuu

SEQ ID NO: 1105179 - RNA, 19 nt, Homo sapiens
gguaaacagauucaagugu

SEQ ID NO: 1105180 - RNA, 19 nt, Homo sapiens
gaacaguugcaaagauguc

SEQ ID NO: 1105181 - RNA, 19 nt, Homo sapiens
gaauaaugggccaaacauc

SEQ ID NO: 1105182 - RNA, 19 nt, Homo sapiens
aauaaacacgguaaacaga

SEQ ID NO: 1105183 - RNA, 19 nt, Homo sapiens
ugaauaaacacgguaaaca

SEQ ID NO: 1105184 - RNA, 19 nt, Homo sapiens
ugucucugcuguuuaacuu

SEQ ID NO: 1105185 - RNA, 19 nt, Homo sapiens
uugaacaguugcaaagaug

SEQ ID NO: 1105186 - RNA, 19 nt, Homo sapiens
ugaccgauccagacacuau

SEQ ID NO: 1105187 - RNA, 19 nt, Homo sapiens
guaccuauccuuguguuuc

SEQ ID NO: 1105188 - RNA, 19 nt, Homo sapiens
gaagaaagcucuagaaaga

SEQ ID NO: 1105189 - RNA, 19 nt, Homo sapiens
uaaaggcacuggacaaaua

SEQ ID NO: 1105190 - RNA, 19 nt, Homo sapiens
gcaagucuaucaacauuaa

SEQ ID NO: 1105191 - RNA, 19 nt, Homo sapiens
uaaaugagcuguaacuuuc

SEQ ID NO: 1105192 - RNA, 19 nt, Homo sapiens
gcaaaucucacuaaugaua

SEQ ID NO: 1105193 - RNA, 19 nt, Homo sapiens
aagcaaaucucacuaauga

SEQ ID NO: 1105194 - RNA, 19 nt, Homo sapiens
ucaccuggauuaaagauua

SEQ ID NO: 1105195 - RNA, 19 nt, Homo sapiens
gagaaauuauggagaauga

SEQ ID NO: 1105196 - RNA, 19 nt, Homo sapiens
cgaggaagguuuaaugaaa

SEQ ID NO: 1105197 - RNA, 19 nt, Homo sapiens
guacuaagcuaauugucuu

SEQ ID NO: 1105198 - RNA, 19 nt, Homo sapiens
gaaacaaagggauugauaa

SEQ ID NO: 1105199 - RNA, 19 nt, Homo sapiens
gcugagaacuagugauuau

SEQ ID NO: 1105200 - RNA, 19 nt, Homo sapiens
auaaauaucugcuggauuc

SEQ ID NO: 1105201 - RNA, 19 nt, Homo sapiens
ggacuacgaggaagguuua

SEQ ID NO: 1105202 - RNA, 19 nt, Homo sapiens
gaaaggacuugcauaacca

SEQ ID NO: 1105203 - RNA, 19 nt, Homo sapiens
gcccauaaauuguagcauu

SEQ ID NO: 1105204 - RNA, 19 nt, Homo sapiens
gaauaguguuucagcugua

SEQ ID NO: 1105205 - RNA, 19 nt, Homo sapiens
gaagagaaacaaagggauu

SEQ ID NO: 1105206 - RNA, 19 nt, Homo sapiens
gcuccacccuguacacuaa

SEQ ID NO: 1105207 - RNA, 19 nt, Homo sapiens
gcaggaugguuauauggaa

SEQ ID NO: 1105208 - RNA, 19 nt, Homo sapiens
uccaugaaaucgugaaaua

SEQ ID NO: 1105209 - RNA, 19 nt, Homo sapiens
aagcuaaucuuauccuuug

SEQ ID NO: 1105210 - RNA, 19 nt, Homo sapiens
caacauaaugcucauagaa

SEQ ID NO: 1105211 - RNA, 19 nt, Homo sapiens
agaauaacaugauccuuug

SEQ ID NO: 1105212 - RNA, 19 nt, Homo sapiens
caacagagugcugaguuua

SEQ ID NO: 1105213 - RNA, 19 nt, Homo sapiens
uccaaaugcuucaugguua

SEQ ID NO: 1105214 - RNA, 19 nt, Homo sapiens
uuauugaccugaaguacua

SEQ ID NO: 1105215 - RNA, 19 nt, Homo sapiens
caacucagaauacaucauu

SEQ ID NO: 1105216 - RNA, 19 nt, Homo sapiens
ccaacagagugcugaguuu

SEQ ID NO: 1105217 - RNA, 19 nt, Homo sapiens
gaaaaugguucugugaaaa

SEQ ID NO: 1105218 - RNA, 19 nt, Homo sapiens
aguacuaccuuacgugaua

SEQ ID NO: 1105219 - RNA, 19 nt, Homo sapiens
acacauagauaaagcaagu

SEQ ID NO: 1105220 - RNA, 19 nt, Homo sapiens
ggacaaauacuggcaugaa

SEQ ID NO: 1105221 - RNA, 19 nt, Homo sapiens
gaccugaaguacuaagcua

SEQ ID NO: 1105222 - RNA, 19 nt, Homo sapiens
uguuauaccugaauucuug

SEQ ID NO: 1105223 - RNA, 19 nt, Homo sapiens
aaacuugcuucuuugcuuu

SEQ ID NO: 1105224 - RNA, 19 nt, Homo sapiens
gcucuuuacuuacacaaug

SEQ ID NO: 1105225 - RNA, 19 nt, Homo sapiens
uaaagcaagucuaucaaca

SEQ ID NO: 1105226 - RNA, 19 nt, Homo sapiens
cacaggaaccuacugaaua

SEQ ID NO: 1105227 - RNA, 19 nt, Homo sapiens
ugacauccacuacuuauug

SEQ ID NO: 1105228 - RNA, 19 nt, Homo sapiens
aagcaagucuaucaacauu

SEQ ID NO: 1105229 - RNA, 19 nt, Homo sapiens
gaauacaaagcacuacauu

SEQ ID NO: 1105230 - RNA, 19 nt, Homo sapiens
gaggaagguuuaaugaaag

SEQ ID NO: 1105231 - RNA, 19 nt, Homo sapiens
ggaccgguaucuucuaaag

SEQ ID NO: 1105232 - RNA, 19 nt, Homo sapiens
gaaagcucccuuccuaaga

SEQ ID NO: 1105233 - RNA, 19 nt, Homo sapiens
uaccuuacgugauagcaua

SEQ ID NO: 1105234 - RNA, 19 nt, Homo sapiens
gagugugaaucuacugaaa

SEQ ID NO: 1105235 - RNA, 19 nt, Homo sapiens
gcccagaucucuccacaag

SEQ ID NO: 1105236 - RNA, 19 nt, Homo sapiens
gcaucuguauguagugaaa

SEQ ID NO: 1105237 - RNA, 19 nt, Homo sapiens
cccacaaacuugcuucuuu

SEQ ID NO: 1105238 - RNA, 19 nt, Homo sapiens
gugaaauaguacuaccuua

SEQ ID NO: 1105239 - RNA, 19 nt, Homo sapiens
gcaacauaaugcucauaga

SEQ ID NO: 1105240 - RNA, 19 nt, Homo sapiens
gcugaggguuucauaacuu

SEQ ID NO: 1105241 - RNA, 19 nt, Homo sapiens
uaugugaacuagugccuuu

SEQ ID NO: 1105242 - RNA, 19 nt, Homo sapiens
gcuguaacuuucuaguaaa

SEQ ID NO: 1105243 - RNA, 19 nt, Homo sapiens
caugucagcuuuguaauca

SEQ ID NO: 1105244 - RNA, 19 nt, Homo sapiens
agagaaaggacuugcauaa

SEQ ID NO: 1105245 - RNA, 19 nt, Homo sapiens
guagugagguuacuuuuga

SEQ ID NO: 1105246 - RNA, 19 nt, Homo sapiens
gaugguauuugaguaguga

SEQ ID NO: 1105247 - RNA, 19 nt, Homo sapiens
ggacugcaguugccuaaaa

SEQ ID NO: 1105248 - RNA, 19 nt, Homo sapiens
gaaccaggacggagagaga

SEQ ID NO: 1105249 - RNA, 19 nt, Homo sapiens
aauaucugcuggauucuuu

SEQ ID NO: 1105250 - RNA, 19 nt, Homo sapiens
ucacuuucaucuugcuuaa

SEQ ID NO: 1105251 - RNA, 19 nt, Homo sapiens
ugaccuguguuuguaauuu

SEQ ID NO: 1105252 - RNA, 19 nt, Homo sapiens
cgugauagcauacaaagaa

SEQ ID NO: 1105253 - RNA, 19 nt, Homo sapiens
ccacaauuaugagaugauu

SEQ ID NO: 1105254 - RNA, 19 nt, Homo sapiens
uuugugugcucuuuacuua

SEQ ID NO: 1105255 - RNA, 19 nt, Homo sapiens
ggacaccuguggcucagau

SEQ ID NO: 1105256 - RNA, 19 nt, Homo sapiens
gagcuguaacuuucuagua

SEQ ID NO: 1105257 - RNA, 19 nt, Homo sapiens
ggcaugagauguuuauuuu

SEQ ID NO: 1105258 - RNA, 19 nt, Homo sapiens
gguuaggagucuucaaguu

SEQ ID NO: 1105259 - RNA, 19 nt, Homo sapiens
gaaaagcaaaucucacuaa

SEQ ID NO: 1105260 - RNA, 19 nt, Homo sapiens
acaggaaccuacugaauag

SEQ ID NO: 1105261 - RNA, 19 nt, Homo sapiens
uuacucaccuggauuaaag

SEQ ID NO: 1105262 - RNA, 19 nt, Homo sapiens
cauugaagcuaugauggua

SEQ ID NO: 1105263 - RNA, 19 nt, Homo sapiens
gcacauugaagcuaugaug

SEQ ID NO: 1105264 - RNA, 19 nt, Homo sapiens
aaacugcgcugccuguagu

SEQ ID NO: 1105265 - RNA, 19 nt, Homo sapiens
gacaaauacuggcaugaag

SEQ ID NO: 1105266 - RNA, 19 nt, Homo sapiens
gcaugugaaucuggauauu

SEQ ID NO: 1105267 - RNA, 19 nt, Homo sapiens
agaaacaaagggauugaua

SEQ ID NO: 1105268 - RNA, 19 nt, Homo sapiens
cacaagagcugaggguuuc

SEQ ID NO: 1105269 - RNA, 19 nt, Homo sapiens
gaaggcaggaugguuauau

SEQ ID NO: 1105270 - RNA, 19 nt, Homo sapiens
ccacauguacauaagaauu

SEQ ID NO: 1105271 - RNA, 19 nt, Homo sapiens
acagagugcugaguuuaaa

SEQ ID NO: 1105272 - RNA, 19 nt, Homo sapiens
aaauuacucaccuggauua

SEQ ID NO: 1105273 - RNA, 19 nt, Homo sapiens
gauaaaaugcugagaacua

SEQ ID NO: 1105274 - RNA, 19 nt, Homo sapiens
ccacaagagcugaggguuu

SEQ ID NO: 1105275 - RNA, 19 nt, Homo sapiens
uaggaaggcaggaugguua

SEQ ID NO: 1105276 - RNA, 19 nt, Homo sapiens
cuaauugucuugacuacuc

SEQ ID NO: 1105277 - RNA, 19 nt, Homo sapiens
gaaguacuaagcuaauugu

SEQ ID NO: 1105278 - RNA, 19 nt, Homo sapiens
agacaagaauaguguuuca

SEQ ID NO: 1105279 - RNA, 19 nt, Homo sapiens
gaagagaaaggacuugcau

SEQ ID NO: 1105280 - RNA, 19 nt, Homo sapiens
ccaaaugcuucaugguuag

SEQ ID NO: 1105281 - RNA, 19 nt, Homo sapiens
gauagcauacaaagaagaa

SEQ ID NO: 1105282 - RNA, 19 nt, Homo sapiens
gaauagcguagauauagga

SEQ ID NO: 1105283 - RNA, 19 nt, Homo sapiens
ccaguguuauuugcauaua

SEQ ID NO: 1105284 - RNA, 19 nt, Homo sapiens
uuaaguaauugccaacuca

SEQ ID NO: 1105285 - RNA, 19 nt, Homo sapiens
gaaaagauuugagugugaa

SEQ ID NO: 1105286 - RNA, 19 nt, Homo sapiens
uaccauuuguguuccauuu

SEQ ID NO: 1105287 - RNA, 19 nt, Homo sapiens
cacuaaagcuaaucuuauc

SEQ ID NO: 1105288 - RNA, 19 nt, Homo sapiens
gaguuaagcugucuuuaua

SEQ ID NO: 1105289 - RNA, 19 nt, Homo sapiens
gagaaacccuauaaaugua

SEQ ID NO: 1105290 - RNA, 19 nt, Homo sapiens
ggagaaaccuuaugaaugc

SEQ ID NO: 1105291 - RNA, 19 nt, Homo sapiens
gggaagguauucaguuaua

SEQ ID NO: 1105292 - RNA, 19 nt, Homo sapiens
ggagaaacccuauaaaugu

SEQ ID NO: 1105293 - RNA, 19 nt, Homo sapiens
ggacagaaauccuaucgau

SEQ ID NO: 1105294 - RNA, 19 nt, Homo sapiens
gagaaacccuaugaauaua

SEQ ID NO: 1105295 - RNA, 19 nt, Homo sapiens
gaagggagcagacuagaaa

SEQ ID NO: 1105296 - RNA, 19 nt, Homo sapiens
ggagaagccuuaugagugu

SEQ ID NO: 1105297 - RNA, 19 nt, Homo sapiens
gcaacgaccuuugaguuaa

SEQ ID NO: 1105298 - RNA, 19 nt, Homo sapiens
ggaaauaacagaugaagau

SEQ ID NO: 1105299 - RNA, 19 nt, Homo sapiens
guacauaccaguuguuaaa

SEQ ID NO: 1105300 - RNA, 19 nt, Homo sapiens
agagaaaccuuaugaaugu

SEQ ID NO: 1105301 - RNA, 19 nt, Homo sapiens
ggacaaaccucagaugaag

SEQ ID NO: 1105302 - RNA, 19 nt, Homo sapiens
ggaaagccuucaaucagaa

SEQ ID NO: 1105303 - RNA, 19 nt, Homo sapiens
gcacagcucccaucucauu

SEQ ID NO: 1105304 - RNA, 19 nt, Homo sapiens
gggaaagccuucaaucaga

SEQ ID NO: 1105305 - RNA, 19 nt, Homo sapiens
guaacaagcuucucuuugg

SEQ ID NO: 1105306 - RNA, 19 nt, Homo sapiens
ucagaacucucaacucauu

SEQ ID NO: 1105307 - RNA, 19 nt, Homo sapiens
ggagaggcauucauucgaa

SEQ ID NO: 1105308 - RNA, 19 nt, Homo sapiens
ccugagaccugaacuauug

SEQ ID NO: 1105309 - RNA, 19 nt, Homo sapiens
ggagauguuugugaagaua

SEQ ID NO: 1105310 - RNA, 19 nt, Homo sapiens
gugggaagguauucaguua

SEQ ID NO: 1105311 - RNA, 19 nt, Homo sapiens
gagagaaaccuuaugaaug

SEQ ID NO: 1105312 - RNA, 19 nt, Homo sapiens
gcucacagcuuauuguaca

SEQ ID NO: 1105313 - RNA, 19 nt, Homo sapiens
ugagaaacccuaugaauau

SEQ ID NO: 1105314 - RNA, 19 nt, Homo sapiens
cuacacaugucauugaauu

SEQ ID NO: 1105315 - RNA, 19 nt, Homo sapiens
gcagcagucuccagaagaa

SEQ ID NO: 1105316 - RNA, 19 nt, Homo sapiens
gugagaaacccuaugaaua

SEQ ID NO: 1105317 - RNA, 19 nt, Homo sapiens
aaucagaacucucaacuca

SEQ ID NO: 1105318 - RNA, 19 nt, Homo sapiens
aguuauagcuccagccuua

SEQ ID NO: 1105319 - RNA, 19 nt, Homo sapiens
ucacuaaggugggagagua

SEQ ID NO: 1105320 - RNA, 19 nt, Homo sapiens
gaauguagcgaguguggua

SEQ ID NO: 1105321 - RNA, 19 nt, Homo sapiens
ggacuucgcucaauguacu

SEQ ID NO: 1105322 - RNA, 19 nt, Homo sapiens
ggacuacacaugucauuga

SEQ ID NO: 1105323 - RNA, 19 nt, Homo sapiens
ggagagaaaccuuaugaau

SEQ ID NO: 1105324 - RNA, 19 nt, Homo sapiens
ggaaaauccuucaaucaaa

SEQ ID NO: 1105325 - RNA, 19 nt, Homo sapiens
gggagaaacccuauaaaug

SEQ ID NO: 1105326 - RNA, 19 nt, Homo sapiens
aaucggaguucucaccuua

SEQ ID NO: 1105327 - RNA, 19 nt, Homo sapiens
gagaaacccuaugagugua

SEQ ID NO: 1105328 - RNA, 19 nt, Homo sapiens
gaaaucucauugaccauca

SEQ ID NO: 1105329 - RNA, 19 nt, Homo sapiens
gaacuauugaccaucauuu

SEQ ID NO: 1105330 - RNA, 19 nt, Homo sapiens
gauuugaccucagugcuuu

SEQ ID NO: 1105331 - RNA, 19 nt, Homo sapiens
cggaguaaaugucuuauuc

SEQ ID NO: 1105332 - RNA, 19 nt, Homo sapiens
ggucagguauguauuucuu

SEQ ID NO: 1105333 - RNA, 19 nt, Homo sapiens
gagcaacgaccuuugaguu

SEQ ID NO: 1105334 - RNA, 19 nt, Homo sapiens
aaucaaaacucacaccuua

SEQ ID NO: 1105335 - RNA, 19 nt, Homo sapiens
ucucaucacugaaauacuu

SEQ ID NO: 1105336 - RNA, 19 nt, Homo sapiens
gggagaaaccuuaugaaug

SEQ ID NO: 1105337 - RNA, 19 nt, Homo sapiens
gaaauccuaucgaugugau

SEQ ID NO: 1105338 - RNA, 19 nt, Homo sapiens
caacuucucuugauuugac

SEQ ID NO: 1105339 - RNA, 19 nt, Homo sapiens
gaguaaaugucuuauucga

SEQ ID NO: 1105340 - RNA, 19 nt, Homo sapiens
gugguuaauugccuuguaa

SEQ ID NO: 1105341 - RNA, 19 nt, Homo sapiens
gagaaaccuuaugaaugua

SEQ ID NO: 1105342 - RNA, 19 nt, Homo sapiens
ggucugaguaaaugucuua

SEQ ID NO: 1105343 - RNA, 19 nt, Homo sapiens
gguaaggcauuuggucuga

SEQ ID NO: 1105344 - RNA, 19 nt, Homo sapiens
caucagagccuccauacug

SEQ ID NO: 1105345 - RNA, 19 nt, Homo sapiens
gagaguaggaguaacuuau

SEQ ID NO: 1105346 - RNA, 19 nt, Homo sapiens
ggucuggcuuggucaguuu

SEQ ID NO: 1105347 - RNA, 19 nt, Homo sapiens
guacaucagagaacccaua

SEQ ID NO: 1105348 - RNA, 19 nt, Homo sapiens
gaacauccaccucugucuu

SEQ ID NO: 1105349 - RNA, 19 nt, Homo sapiens
gaagaagggagcagacuag

SEQ ID NO: 1105350 - RNA, 19 nt, Homo sapiens
ucaauguacuucuccaguu

SEQ ID NO: 1105351 - RNA, 19 nt, Homo sapiens
uaaucagacuccaugcuuu

SEQ ID NO: 1105352 - RNA, 19 nt, Homo sapiens
gaguaggaguaacuuauuc

SEQ ID NO: 1105353 - RNA, 19 nt, Homo sapiens
gcucauuguucaucucaga

SEQ ID NO: 1105354 - RNA, 19 nt, Homo sapiens
agacuacacucagaagaaa

SEQ ID NO: 1105355 - RNA, 19 nt, Homo sapiens
cugaguaaaugucuuauuc

SEQ ID NO: 1105356 - RNA, 19 nt, Homo sapiens
ggagagaaacccuaugagu

SEQ ID NO: 1105357 - RNA, 19 nt, Homo sapiens
uaagcugucuuuauaagca

SEQ ID NO: 1105358 - RNA, 19 nt, Homo sapiens
uugcgugucuguauacuuu

SEQ ID NO: 1105359 - RNA, 19 nt, Homo sapiens
caccagagacuccauaaug

SEQ ID NO: 1105360 - RNA, 19 nt, Homo sapiens
gcaaaccucccagcucauu

SEQ ID NO: 1105361 - RNA, 19 nt, Homo sapiens
uaaagggacagaaauccua

SEQ ID NO: 1105362 - RNA, 19 nt, Homo sapiens
caauguacuucuccaguuc

SEQ ID NO: 1105363 - RNA, 19 nt, Homo sapiens
ggagaguaggaguaacuua

SEQ ID NO: 1105364 - RNA, 19 nt, Homo sapiens
gaaaagcccuauaaaugca

SEQ ID NO: 1105365 - RNA, 19 nt, Homo sapiens
gacuggagauguuugugaa

SEQ ID NO: 1105366 - RNA, 19 nt, Homo sapiens
agagagcccugcaguggaa

SEQ ID NO: 1105367 - RNA, 19 nt, Homo sapiens
gaacucaggagaccaagca

SEQ ID NO: 1105368 - RNA, 19 nt, Homo sapiens
caacagcucuggguacaac

SEQ ID NO: 1105369 - RNA, 19 nt, Homo sapiens
ugaauucacuggugcuaca

SEQ ID NO: 1105370 - RNA, 19 nt, Homo sapiens
aaauccaucucaucacuga

SEQ ID NO: 1105371 - RNA, 19 nt, Homo sapiens
gucauugaauuguagguuu

SEQ ID NO: 1105372 - RNA, 19 nt, Homo sapiens
gguaaggacuacacauguc

SEQ ID NO: 1105373 - RNA, 19 nt, Homo sapiens
guuaagcugucuuuauaag

SEQ ID NO: 1105374 - RNA, 19 nt, Homo sapiens
gaccugaacuauugaccau

SEQ ID NO: 1105375 - RNA, 19 nt, Homo sapiens
acagaaauccuaucgaugu

SEQ ID NO: 1105376 - RNA, 19 nt, Homo sapiens
gacuacacaugucauugaa

SEQ ID NO: 1105377 - RNA, 19 nt, Homo sapiens
uuccaguucuuacccauua

SEQ ID NO: 1105378 - RNA, 19 nt, Homo sapiens
caacgaccuuugaguuaag

SEQ ID NO: 1105379 - RNA, 19 nt, Homo sapiens
gaacucacacuggagagaa

SEQ ID NO: 1105380 - RNA, 19 nt, Homo sapiens
agagcauucuguuccaaua

SEQ ID NO: 1105381 - RNA, 19 nt, Homo sapiens
gacaacagcucuggguaca

SEQ ID NO: 1105382 - RNA, 19 nt, Homo sapiens
gaaaccuuaugaaugcaau

SEQ ID NO: 1105383 - RNA, 19 nt, Homo sapiens
gcucccaucucauucaaca

SEQ ID NO: 1105384 - RNA, 19 nt, Homo sapiens
aggcacagcucccaucuca

SEQ ID NO: 1105385 - RNA, 19 nt, Homo sapiens
guauuucuuucccauauag

SEQ ID NO: 1105386 - RNA, 19 nt, Homo sapiens
ggaagguauucaguuauag

SEQ ID NO: 1105387 - RNA, 19 nt, Homo sapiens
caacaccagagacuccaua

SEQ ID NO: 1105388 - RNA, 19 nt, Homo sapiens
uaaaggagcugcaggagaa

SEQ ID NO: 1105389 - RNA, 19 nt, Homo sapiens
gauagaguguguuucauuu

SEQ ID NO: 1105390 - RNA, 19 nt, Homo sapiens
guacugacauuuagaguug

SEQ ID NO: 1105391 - RNA, 19 nt, Homo sapiens
ucuaagagcugaucaagaa

SEQ ID NO: 1105392 - RNA, 19 nt, Homo sapiens
gaaaggcucccaucauuga

SEQ ID NO: 1105393 - RNA, 19 nt, Homo sapiens
gacaacaucuggacaguga

SEQ ID NO: 1105394 - RNA, 19 nt, Homo sapiens
gagcugaucaagaaauuua

SEQ ID NO: 1105395 - RNA, 19 nt, Homo sapiens
gaagaagcgugacauacau

SEQ ID NO: 1105396 - RNA, 19 nt, Homo sapiens
gagcacuguuuauuacuuu

SEQ ID NO: 1105397 - RNA, 19 nt, Homo sapiens
acacaaagacccacuaauu

SEQ ID NO: 1105398 - RNA, 19 nt, Homo sapiens
ggaacaggcugccaugcuu

SEQ ID NO: 1105399 - RNA, 19 nt, Homo sapiens
gcucugggcucaugaagau

SEQ ID NO: 1105400 - RNA, 19 nt, Homo sapiens
gguggaggcucgaacauug

SEQ ID NO: 1105401 - RNA, 19 nt, Homo sapiens
agaagaaucucgacagaau

SEQ ID NO: 1105402 - RNA, 19 nt, Homo sapiens
gaagagcccugguauucca

SEQ ID NO: 1105403 - RNA, 19 nt, Homo sapiens
acagugagcucuucauuag

SEQ ID NO: 1105404 - RNA, 19 nt, Homo sapiens
gcaggaugguguuuaugaa

SEQ ID NO: 1105405 - RNA, 19 nt, Homo sapiens
gaacauugaaggaagagaa

SEQ ID NO: 1105406 - RNA, 19 nt, Homo sapiens
gaguucauguuaccuguuu

SEQ ID NO: 1105407 - RNA, 19 nt, Homo sapiens
gagaguccuucaccguaua

SEQ ID NO: 1105408 - RNA, 19 nt, Homo sapiens
gaagaaucucgacagaaua

SEQ ID NO: 1105409 - RNA, 19 nt, Homo sapiens
cacaaagacccacuaauuu

SEQ ID NO: 1105410 - RNA, 19 nt, Homo sapiens
gacaaucagucaacucaau

SEQ ID NO: 1105411 - RNA, 19 nt, Homo sapiens
uggaacagcuacaagauga

SEQ ID NO: 1105412 - RNA, 19 nt, Homo sapiens
gagcuuguccgaacucaaa

SEQ ID NO: 1105413 - RNA, 19 nt, Homo sapiens
gauuauuucugaggaauga

SEQ ID NO: 1105414 - RNA, 19 nt, Homo sapiens
gagccacucacauuuauuu

SEQ ID NO: 1105415 - RNA, 19 nt, Homo sapiens
aaagucagaguucauguua

SEQ ID NO: 1105416 - RNA, 19 nt, Homo sapiens
guaguucccuuaggauuug

SEQ ID NO: 1105417 - RNA, 19 nt, Homo sapiens
gcagcugucuccugucaug

SEQ ID NO: 1105418 - RNA, 19 nt, Homo sapiens
caaucaacauccucacauu

SEQ ID NO: 1105419 - RNA, 19 nt, Homo sapiens
gcucuucauuagcucaaua

SEQ ID NO: 1105420 - RNA, 19 nt, Homo sapiens
gaagugagccuggacaaca

SEQ ID NO: 1105421 - RNA, 19 nt, Homo sapiens
gagagacugugugaacaaa

SEQ ID NO: 1105422 - RNA, 19 nt, Homo sapiens
ggauagaguguguuucauu

SEQ ID NO: 1105423 - RNA, 19 nt, Homo sapiens
agaaggagauggaggacaa

SEQ ID NO: 1105424 - RNA, 19 nt, Homo sapiens
gaggagaggcuguggaaga

SEQ ID NO: 1105425 - RNA, 19 nt, Homo sapiens
agaaacaaguggaacauca

SEQ ID NO: 1105426 - RNA, 19 nt, Homo sapiens
ggaugggaguaauaacauu

SEQ ID NO: 1105427 - RNA, 19 nt, Homo sapiens
gaacaggcugccaugcuuu

SEQ ID NO: 1105428 - RNA, 19 nt, Homo sapiens
gaacagggagauaaacauc

SEQ ID NO: 1105429 - RNA, 19 nt, Homo sapiens
guaccaagaacuagcagua

SEQ ID NO: 1105430 - RNA, 19 nt, Homo sapiens
gcaggugugugcaggauag

SEQ ID NO: 1105431 - RNA, 19 nt, Homo sapiens
caaaggaagagcccuggua

SEQ ID NO: 1105432 - RNA, 19 nt, Homo sapiens
guucaucuccuacacaauu

SEQ ID NO: 1105433 - RNA, 19 nt, Homo sapiens
gaaauacacaaagcacaaa

SEQ ID NO: 1105434 - RNA, 19 nt, Homo sapiens
gcuaugacguuugaucgaa

SEQ ID NO: 1105435 - RNA, 19 nt, Homo sapiens
guaggugacuggagguguu

SEQ ID NO: 1105436 - RNA, 19 nt, Homo sapiens
ugaaacagcagaagaaaca

SEQ ID NO: 1105437 - RNA, 19 nt, Homo sapiens
guucugcuaugacguuuga

SEQ ID NO: 1105438 - RNA, 19 nt, Homo sapiens
cuagagccacucacauuua

SEQ ID NO: 1105439 - RNA, 19 nt, Homo sapiens
gcaguuguacccuuucuug

SEQ ID NO: 1105440 - RNA, 19 nt, Homo sapiens
ggagauaaacaucaucauc

SEQ ID NO: 1105441 - RNA, 19 nt, Homo sapiens
ggacggagcaguggagaga

SEQ ID NO: 1105442 - RNA, 19 nt, Homo sapiens
aaugagcgcuguacuaugg

SEQ ID NO: 1105443 - RNA, 19 nt, Homo sapiens
gaguauaugucccaguaca

SEQ ID NO: 1105444 - RNA, 19 nt, Homo sapiens
gguaguucccuuaggauuu

SEQ ID NO: 1105445 - RNA, 19 nt, Homo sapiens
gcuagagccacucacauuu

SEQ ID NO: 1105446 - RNA, 19 nt, Homo sapiens
gcuacaagaugaggccaaa

SEQ ID NO: 1105447 - RNA, 19 nt, Homo sapiens
gcuuagagcauuuauaucu

SEQ ID NO: 1105448 - RNA, 19 nt, Homo sapiens
guuguacccuuucuugaug

SEQ ID NO: 1105449 - RNA, 19 nt, Homo sapiens
ucaugaagauauugcauca

SEQ ID NO: 1105450 - RNA, 19 nt, Homo sapiens
caauugagcacuguuuauu

SEQ ID NO: 1105451 - RNA, 19 nt, Homo sapiens
gugcuuauguucugcuaug

SEQ ID NO: 1105452 - RNA, 19 nt, Homo sapiens
gaauucaaacacacaaaga

SEQ ID NO: 1105453 - RNA, 19 nt, Homo sapiens
uagagccacucacauuuau

SEQ ID NO: 1105454 - RNA, 19 nt, Homo sapiens
uggaaggucuggagggaaa

SEQ ID NO: 1105455 - RNA, 19 nt, Homo sapiens
gaugggaguaauaacauuu

SEQ ID NO: 1105456 - RNA, 19 nt, Homo sapiens
gacguuugaucgaauccua

SEQ ID NO: 1105457 - RNA, 19 nt, Homo sapiens
gagaggauguggaaaaugu

SEQ ID NO: 1105458 - RNA, 19 nt, Homo sapiens
gaauaucagcaaaggaaga

SEQ ID NO: 1105459 - RNA, 19 nt, Homo sapiens
gcagaagaaacaaguggaa

SEQ ID NO: 1105460 - RNA, 19 nt, Homo sapiens
gcccuuagguggugggaau

SEQ ID NO: 1105461 - RNA, 19 nt, Homo sapiens
ucgaggaucugaacaacga

SEQ ID NO: 1105462 - RNA, 19 nt, Homo sapiens
gagcagaggcuacgcaaac

SEQ ID NO: 1105463 - RNA, 19 nt, Homo sapiens
caaauggagcgguuagaga

SEQ ID NO: 1105464 - RNA, 19 nt, Homo sapiens
gcuggaagaagcaaagaaa

SEQ ID NO: 1105465 - RNA, 19 nt, Homo sapiens
ugaagauauugcaucauga

SEQ ID NO: 1105466 - RNA, 19 nt, Homo sapiens
uaugguaguucccuuagga

SEQ ID NO: 1105467 - RNA, 19 nt, Homo sapiens
ugagcaggaugguguuuau

SEQ ID NO: 1105468 - RNA, 19 nt, Homo sapiens
gcaguuggagcagcaagua

SEQ ID NO: 1105469 - RNA, 19 nt, Homo sapiens
ggagagacugugugaacaa

SEQ ID NO: 1105470 - RNA, 19 nt, Homo sapiens
uuagaagaaucucgacaga

SEQ ID NO: 1105471 - RNA, 19 nt, Homo sapiens
aagaaucucgacagaauaa

SEQ ID NO: 1105472 - RNA, 19 nt, Homo sapiens
uagaguguguuucauuugu

SEQ ID NO: 1105473 - RNA, 19 nt, Homo sapiens
cacagugagcucuucauua

SEQ ID NO: 1105474 - RNA, 19 nt, Homo sapiens
ggaugguguuuaugaagug

SEQ ID NO: 1105475 - RNA, 19 nt, Homo sapiens
ccagaacccugcugaugag

SEQ ID NO: 1105476 - RNA, 19 nt, Homo sapiens
aagaauaucagcaaaggaa

SEQ ID NO: 1105477 - RNA, 19 nt, Homo sapiens
gguuacagcagaccauaaa

SEQ ID NO: 1105478 - RNA, 19 nt, Homo sapiens
gaagaccacccuuuaccau

SEQ ID NO: 1105479 - RNA, 19 nt, Homo sapiens
gaacaucagcuggaagaag

SEQ ID NO: 1105480 - RNA, 19 nt, Homo sapiens
gaaugaaaggcucccauca

SEQ ID NO: 1105481 - RNA, 19 nt, Homo sapiens
cauaucgaguuugcccuua

SEQ ID NO: 1105482 - RNA, 19 nt, Homo sapiens
uaagggagaguuggucuuu

SEQ ID NO: 1105483 - RNA, 19 nt, Homo sapiens
gugcagcugucuccuguca

SEQ ID NO: 1105484 - RNA, 19 nt, Homo sapiens
ucacacagcagccuuguag

SEQ ID NO: 1105485 - RNA, 19 nt, Homo sapiens
gaagagaagaagcgugaca

SEQ ID NO: 1105486 - RNA, 19 nt, Homo sapiens
cuacacagcagcaggaaga

SEQ ID NO: 1105487 - RNA, 19 nt, Homo sapiens
gaagauauugcaucaugag

SEQ ID NO: 1105488 - RNA, 19 nt, Homo sapiens
gaacaagggugccuaauaa

SEQ ID NO: 1105489 - RNA, 19 nt, Homo sapiens
ggaacaagggugccuaaua

SEQ ID NO: 1105490 - RNA, 19 nt, Homo sapiens
cgaaggagcuuacgacauc

SEQ ID NO: 1105491 - RNA, 19 nt, Homo sapiens
caagggugccuaauaaaua

SEQ ID NO: 1105492 - RNA, 19 nt, Homo sapiens
guagaggucaucaucaaua

SEQ ID NO: 1105493 - RNA, 19 nt, Homo sapiens
ggaucgucauguauacuua

SEQ ID NO: 1105494 - RNA, 19 nt, Homo sapiens
ccacaaagccuuggugaug

SEQ ID NO: 1105495 - RNA, 19 nt, Homo sapiens
ggaucuugcuccucuguga

SEQ ID NO: 1105496 - RNA, 19 nt, Homo sapiens
ccacugagauggcccugau

SEQ ID NO: 1105497 - RNA, 19 nt, Homo sapiens
acucucaggucuuuagaaa

SEQ ID NO: 1105498 - RNA, 19 nt, Homo sapiens
gcuaugagaccauccugaa

SEQ ID NO: 1105499 - RNA, 19 nt, Homo sapiens
ucucggcgcuuccucuuug

SEQ ID NO: 1105500 - RNA, 19 nt, Homo sapiens
gggcagcgccuauguuucu

SEQ ID NO: 1105501 - RNA, 19 nt, Homo sapiens
gcaacaagcagcacaacag

SEQ ID NO: 1105502 - RNA, 19 nt, Homo sapiens
ccauaugggugguguggau

SEQ ID NO: 1105503 - RNA, 19 nt, Homo sapiens
gaagagugcccuggucaca

SEQ ID NO: 1105504 - RNA, 19 nt, Homo sapiens
ucuggcggcucacgucuuu

SEQ ID NO: 1105505 - RNA, 19 nt, Homo sapiens
gaggaacaagggugccuaa

SEQ ID NO: 1105506 - RNA, 19 nt, Homo sapiens
ccaccuccguugccauaug

SEQ ID NO: 1105507 - RNA, 19 nt, Homo sapiens
cacaaagccuuggugaugu

SEQ ID NO: 1105508 - RNA, 19 nt, Homo sapiens
ggucacagcacccuugaag

SEQ ID NO: 1105509 - RNA, 19 nt, Homo sapiens
gaaggagcuuacgacauca

SEQ ID NO: 1105510 - RNA, 19 nt, Homo sapiens
ccauacagcggguacaaug

SEQ ID NO: 1105511 - RNA, 19 nt, Homo sapiens
ugguagaggucaucaucaa

SEQ ID NO: 1105512 - RNA, 19 nt, Homo sapiens
caacaagcagcacaacagu

SEQ ID NO: 1105513 - RNA, 19 nt, Homo sapiens
acaaagccuuggugaugug

SEQ ID NO: 1105514 - RNA, 19 nt, Homo sapiens
caaaguuccguccgaagga

SEQ ID NO: 1105515 - RNA, 19 nt, Homo sapiens
uacaagcgcuggcguaagc

SEQ ID NO: 1105516 - RNA, 19 nt, Homo sapiens
gcuacaagcgcuggcguaa

SEQ ID NO: 1105517 - RNA, 19 nt, Homo sapiens
gaacucucaggucuuuaga

SEQ ID NO: 1105518 - RNA, 19 nt, Homo sapiens
gaaagacggcaagaacucu

SEQ ID NO: 1105519 - RNA, 19 nt, Homo sapiens
acaagggugccuaauaaau

SEQ ID NO: 1105520 - RNA, 19 nt, Homo sapiens
ugguguggaucgucaugua

SEQ ID NO: 1105521 - RNA, 19 nt, Homo sapiens
ccugcgggcugaagacaug

SEQ ID NO: 1105522 - RNA, 19 nt, Homo sapiens
guguggaucgucauguaua

SEQ ID NO: 1105523 - RNA, 19 nt, Homo sapiens
cgaaagacggcaagaacuc

SEQ ID NO: 1105524 - RNA, 19 nt, Homo sapiens
ucacagcacccuugaagac

SEQ ID NO: 1105525 - RNA, 19 nt, Homo sapiens
uagaggucaucaucaauac

SEQ ID NO: 1105526 - RNA, 19 nt, Homo sapiens
ccucuucugccucguguuu

SEQ ID NO: 1105527 - RNA, 19 nt, Homo sapiens
aagggugccuaauaaauac

SEQ ID NO: 1105528 - RNA, 19 nt, Homo sapiens
gggccuucguccucuucua

SEQ ID NO: 1105529 - RNA, 19 nt, Homo sapiens
gucacacuccagccaaaua

SEQ ID NO: 1105530 - RNA, 19 nt, Homo sapiens
ucucaggucuuuagaaacc

SEQ ID NO: 1105531 - RNA, 19 nt, Homo sapiens
agauggcccugaugcacaa

SEQ ID NO: 1105532 - RNA, 19 nt, Homo sapiens
ucgccaacauggacuuugu

SEQ ID NO: 1105533 - RNA, 19 nt, Homo sapiens
guaccagcccacugagaug

SEQ ID NO: 1105534 - RNA, 19 nt, Homo sapiens
uaugagaccauccugaaag

SEQ ID NO: 1105535 - RNA, 19 nt, Homo sapiens
ucauggcacucaucuacgu

SEQ ID NO: 1105536 - RNA, 19 nt, Homo sapiens
aauacagaguggcugauca

SEQ ID NO: 1105537 - RNA, 19 nt, Homo sapiens
ggacccagguauucuuccu

SEQ ID NO: 1105538 - RNA, 19 nt, Homo sapiens
augagaccauccugaaaga

SEQ ID NO: 1105539 - RNA, 19 nt, Homo sapiens
gggcauugucaccacguuu

SEQ ID NO: 1105540 - RNA, 19 nt, Homo sapiens
gacugccucucuuccuguu

SEQ ID NO: 1105541 - RNA, 19 nt, Homo sapiens
ccacguuugugcucaccau

SEQ ID NO: 1105542 - RNA, 19 nt, Homo sapiens
cgucuuugcccucaacuuc

SEQ ID NO: 1105543 - RNA, 19 nt, Homo sapiens
gccaucugcuucucuuguc

SEQ ID NO: 1105544 - RNA, 19 nt, Homo sapiens
ggcauugucaccacguuug

SEQ ID NO: 1105545 - RNA, 19 nt, Homo sapiens
gguagaggucaucaucaau

SEQ ID NO: 1105546 - RNA, 19 nt, Homo sapiens
gaggucaucaucaauacag

SEQ ID NO: 1105547 - RNA, 19 nt, Homo sapiens
ucacacuccagccaaauag

SEQ ID NO: 1105548 - RNA, 19 nt, Homo sapiens
gcccugaugcacaaaguuc

SEQ ID NO: 1105549 - RNA, 19 nt, Homo sapiens
ugucauggcacucaucuac

SEQ ID NO: 1105550 - RNA, 19 nt, Homo sapiens
gguguggaucgucauguau

SEQ ID NO: 1105551 - RNA, 19 nt, Homo sapiens
ucacgucuuugcccucaac

SEQ ID NO: 1105552 - RNA, 19 nt, Homo sapiens
gaacaagggugccuaauaa

SEQ ID NO: 1105553 - RNA, 19 nt, Homo sapiens
ggaacaagggugccuaaua

SEQ ID NO: 1105554 - RNA, 19 nt, Homo sapiens
cgaaggagcuuacgacauc

SEQ ID NO: 1105555 - RNA, 19 nt, Homo sapiens
caagggugccuaauaaaua

SEQ ID NO: 1105556 - RNA, 19 nt, Homo sapiens
guagaggucaucaucaaua

SEQ ID NO: 1105557 - RNA, 19 nt, Homo sapiens
ggaucgucauguauacuua

SEQ ID NO: 1105558 - RNA, 19 nt, Homo sapiens
ccacaaagccuuggugaug

SEQ ID NO: 1105559 - RNA, 19 nt, Homo sapiens
ggaucuugcuccucuguga

SEQ ID NO: 1105560 - RNA, 19 nt, Homo sapiens
ccacugagauggcccugau

SEQ ID NO: 1105561 - RNA, 19 nt, Homo sapiens
acucucaggucuuuagaaa

SEQ ID NO: 1105562 - RNA, 19 nt, Homo sapiens
gcuaugagaccauccugaa

SEQ ID NO: 1105563 - RNA, 19 nt, Homo sapiens
ucucggcgcuuccucuuug

SEQ ID NO: 1105564 - RNA, 19 nt, Homo sapiens
gggcagcgccuauguuucu

SEQ ID NO: 1105565 - RNA, 19 nt, Homo sapiens
gcaacaagcagcacaacag

SEQ ID NO: 1105566 - RNA, 19 nt, Homo sapiens
ccauaugggugguguggau

SEQ ID NO: 1105567 - RNA, 19 nt, Homo sapiens
ucuggcggcucacgucuuu

SEQ ID NO: 1105568 - RNA, 19 nt, Homo sapiens
gaggaacaagggugccuaa

SEQ ID NO: 1105569 - RNA, 19 nt, Homo sapiens
ccaccuccguugccauaug

SEQ ID NO: 1105570 - RNA, 19 nt, Homo sapiens
cacaaagccuuggugaugu

SEQ ID NO: 1105571 - RNA, 19 nt, Homo sapiens
gaaggagcuuacgacauca

SEQ ID NO: 1105572 - RNA, 19 nt, Homo sapiens
ccauacagcggguacaaug

SEQ ID NO: 1105573 - RNA, 19 nt, Homo sapiens
ugguagaggucaucaucaa

SEQ ID NO: 1105574 - RNA, 19 nt, Homo sapiens
caacaagcagcacaacagu

SEQ ID NO: 1105575 - RNA, 19 nt, Homo sapiens
acaaagccuuggugaugug

SEQ ID NO: 1105576 - RNA, 19 nt, Homo sapiens
caaaguuccguccgaagga

SEQ ID NO: 1105577 - RNA, 19 nt, Homo sapiens
uacaagcgcuggcguaagc

SEQ ID NO: 1105578 - RNA, 19 nt, Homo sapiens
gcuacaagcgcuggcguaa

SEQ ID NO: 1105579 - RNA, 19 nt, Homo sapiens
gaacucucaggucuuuaga

SEQ ID NO: 1105580 - RNA, 19 nt, Homo sapiens
gaaagacggcaagaacucu

SEQ ID NO: 1105581 - RNA, 19 nt, Homo sapiens
acaagggugccuaauaaau

SEQ ID NO: 1105582 - RNA, 19 nt, Homo sapiens
ugguguggaucgucaugua

SEQ ID NO: 1105583 - RNA, 19 nt, Homo sapiens
ccugcgggcugaagacaug

SEQ ID NO: 1105584 - RNA, 19 nt, Homo sapiens
guguggaucgucauguaua

SEQ ID NO: 1105585 - RNA, 19 nt, Homo sapiens
cgaaagacggcaagaacuc

SEQ ID NO: 1105586 - RNA, 19 nt, Homo sapiens
uagaggucaucaucaauac

SEQ ID NO: 1105587 - RNA, 19 nt, Homo sapiens
ccucuucugccucguguuu

SEQ ID NO: 1105588 - RNA, 19 nt, Homo sapiens
aagggugccuaauaaauac

SEQ ID NO: 1105589 - RNA, 19 nt, Homo sapiens
gggccuucguccucuucua

SEQ ID NO: 1105590 - RNA, 19 nt, Homo sapiens
gucacacuccagccaaaua

SEQ ID NO: 1105591 - RNA, 19 nt, Homo sapiens
ucucaggucuuuagaaacc

SEQ ID NO: 1105592 - RNA, 19 nt, Homo sapiens
agauggcccugaugcacaa

SEQ ID NO: 1105593 - RNA, 19 nt, Homo sapiens
ucgccaacauggacuuugu

SEQ ID NO: 1105594 - RNA, 19 nt, Homo sapiens
guaccagcccacugagaug

SEQ ID NO: 1105595 - RNA, 19 nt, Homo sapiens
uaugagaccauccugaaag

SEQ ID NO: 1105596 - RNA, 19 nt, Homo sapiens
ucauggcacucaucuacgu

SEQ ID NO: 1105597 - RNA, 19 nt, Homo sapiens
aauacagaguggcugauca

SEQ ID NO: 1105598 - RNA, 19 nt, Homo sapiens
ccacguuugugcucaccau

SEQ ID NO: 1105599 - RNA, 19 nt, Homo sapiens
gacugccucucuuccuguu

SEQ ID NO: 1105600 - RNA, 19 nt, Homo sapiens
ggacccagguauucuuccu

SEQ ID NO: 1105601 - RNA, 19 nt, Homo sapiens
augagaccauccugaaaga

SEQ ID NO: 1105602 - RNA, 19 nt, Homo sapiens
gggcauugucaccacguuu

SEQ ID NO: 1105603 - RNA, 19 nt, Homo sapiens
cgucuuugcccucaacuuc

SEQ ID NO: 1105604 - RNA, 19 nt, Homo sapiens
gccaucugcuucucuuguc

SEQ ID NO: 1105605 - RNA, 19 nt, Homo sapiens
gguagaggucaucaucaau

SEQ ID NO: 1105606 - RNA, 19 nt, Homo sapiens
ggcauugucaccacguuug

SEQ ID NO: 1105607 - RNA, 19 nt, Homo sapiens
gaggucaucaucaauacag

SEQ ID NO: 1105608 - RNA, 19 nt, Homo sapiens
ucacacuccagccaaauag

SEQ ID NO: 1105609 - RNA, 19 nt, Homo sapiens
gcccugaugcacaaaguuc

SEQ ID NO: 1105610 - RNA, 19 nt, Homo sapiens
ugucauggcacucaucuac

SEQ ID NO: 1105611 - RNA, 19 nt, Homo sapiens
gguguggaucgucauguau

SEQ ID NO: 1105612 - RNA, 19 nt, Homo sapiens
ucacgucuuugcccucaac

SEQ ID NO: 1105613 - RNA, 19 nt, Homo sapiens
ucaaggaacugcuggauua

SEQ ID NO: 1105614 - RNA, 19 nt, Homo sapiens
ggccauaaacaaugaguaa

SEQ ID NO: 1105615 - RNA, 19 nt, Homo sapiens
agaccugccucaucucuga

SEQ ID NO: 1105616 - RNA, 19 nt, Homo sapiens
ucucugagccuccuucauu

SEQ ID NO: 1105617 - RNA, 19 nt, Homo sapiens
ugaguaaacaguaaagugu

SEQ ID NO: 1105618 - RNA, 19 nt, Homo sapiens
aggaacugcuggauuaaug

SEQ ID NO: 1105619 - RNA, 19 nt, Homo sapiens
guuugagaaucacugaauu

SEQ ID NO: 1105620 - RNA, 19 nt, Homo sapiens
gcuuugagcugugucaucu

SEQ ID NO: 1105621 - RNA, 19 nt, Homo sapiens
gcgggugccugucauuaag

SEQ ID NO: 1105622 - RNA, 19 nt, Homo sapiens
gaucuuaccauacccucau

SEQ ID NO: 1105623 - RNA, 19 nt, Homo sapiens
uaccauacccucauaguac

SEQ ID NO: 1105624 - RNA, 19 nt, Homo sapiens
caaggaacugcuggauuaa

SEQ ID NO: 1105625 - RNA, 19 nt, Homo sapiens
ccucauaguaccaagaaug

SEQ ID NO: 1105626 - RNA, 19 nt, Homo sapiens
uuaccauacccucauagua

SEQ ID NO: 1105627 - RNA, 19 nt, Homo sapiens
gaacuguugcccacaugca

SEQ ID NO: 1105628 - RNA, 19 nt, Homo sapiens
gcccaaacccuacccuucu

SEQ ID NO: 1105629 - RNA, 19 nt, Homo sapiens
gaacugcuggauuaauggu

SEQ ID NO: 1105630 - RNA, 19 nt, Homo sapiens
cccaaacccuacccuucuu

SEQ ID NO: 1105631 - RNA, 19 nt, Homo sapiens
ccauaaacaaugaguaaac

SEQ ID NO: 1105632 - RNA, 19 nt, Homo sapiens
gcugguguaucaaggaacu

SEQ ID NO: 1105633 - RNA, 19 nt, Homo sapiens
aaguguggauccugcuuug

SEQ ID NO: 1105634 - RNA, 19 nt, Homo sapiens
ugagcugugucaucuagca

SEQ ID NO: 1105635 - RNA, 19 nt, Homo sapiens
ggaacugcuggauuaaugg

SEQ ID NO: 1105636 - RNA, 19 nt, Homo sapiens
gggugccugucauuaagau

SEQ ID NO: 1105637 - RNA, 19 nt, Homo sapiens
gccauaaacaaugaguaaa

SEQ ID NO: 1105638 - RNA, 19 nt, Homo sapiens
uuugagcugugucaucuag

SEQ ID NO: 1105639 - RNA, 19 nt, Homo sapiens
gaaugcaucuguugaauua

SEQ ID NO: 1105640 - RNA, 19 nt, Homo sapiens
gaacaggauuccauacaaa

SEQ ID NO: 1105641 - RNA, 19 nt, Homo sapiens
ggugaaggcugauggauuu

SEQ ID NO: 1105642 - RNA, 19 nt, Homo sapiens
caucacaacugcaauguuu

SEQ ID NO: 1105643 - RNA, 19 nt, Homo sapiens
gaacaaguugcacaaauaa

SEQ ID NO: 1105644 - RNA, 19 nt, Homo sapiens
agaacaaguugcacaaaua

SEQ ID NO: 1105645 - RNA, 19 nt, Homo sapiens
ggaaauucuuacacagaua

SEQ ID NO: 1105646 - RNA, 19 nt, Homo sapiens
caggagagcucaacaaaca

SEQ ID NO: 1105647 - RNA, 19 nt, Homo sapiens
ggacagagauuugcucaag

SEQ ID NO: 1105648 - RNA, 19 nt, Homo sapiens
uaaaggauuugcucagaaa

SEQ ID NO: 1105649 - RNA, 19 nt, Homo sapiens
cuacagagauaucuaguau

SEQ ID NO: 1105650 - RNA, 19 nt, Homo sapiens
ggaaaggcauuuacccaau

SEQ ID NO: 1105651 - RNA, 19 nt, Homo sapiens
uggaagagguggucacuaa

SEQ ID NO: 1105652 - RNA, 19 nt, Homo sapiens
uagcaaacaucucugguaa

SEQ ID NO: 1105653 - RNA, 19 nt, Homo sapiens
ggagaaagaccauuuaucu

SEQ ID NO: 1105654 - RNA, 19 nt, Homo sapiens
gauaaaggauuugcucaga

SEQ ID NO: 1105655 - RNA, 19 nt, Homo sapiens
uagaauugcccuucauuua

SEQ ID NO: 1105656 - RNA, 19 nt, Homo sapiens
aaagaacacucuaugucua

SEQ ID NO: 1105657 - RNA, 19 nt, Homo sapiens
gauaugacuuuaccauuag

SEQ ID NO: 1105658 - RNA, 19 nt, Homo sapiens
gcaaacaucucugguaagg

SEQ ID NO: 1105659 - RNA, 19 nt, Homo sapiens
gcccacaccuguaguagaa

SEQ ID NO: 1105660 - RNA, 19 nt, Homo sapiens
ggaaugugcuggccuccuu

SEQ ID NO: 1105661 - RNA, 19 nt, Homo sapiens
gaauugugcuauuucucua

SEQ ID NO: 1105662 - RNA, 19 nt, Homo sapiens
gaaagaacacucuaugucu

SEQ ID NO: 1105663 - RNA, 19 nt, Homo sapiens
aaagucaucucaaacgaaa

SEQ ID NO: 1105664 - RNA, 19 nt, Homo sapiens
aaauuuaggcgcugaauaa

SEQ ID NO: 1105665 - RNA, 19 nt, Homo sapiens
gauauugugcacacuguua

SEQ ID NO: 1105666 - RNA, 19 nt, Homo sapiens
ccagugacaucuuagagaa

SEQ ID NO: 1105667 - RNA, 19 nt, Homo sapiens
guagaaguguugccauuca

SEQ ID NO: 1105668 - RNA, 19 nt, Homo sapiens
cgagagaaaucagaaguau

SEQ ID NO: 1105669 - RNA, 19 nt, Homo sapiens
guuuaaagcucauaggaau

SEQ ID NO: 1105670 - RNA, 19 nt, Homo sapiens
uaaaucagccaguuaaugu

SEQ ID NO: 1105671 - RNA, 19 nt, Homo sapiens
gaacacucuaugucuaaua

SEQ ID NO: 1105672 - RNA, 19 nt, Homo sapiens
gaucauacuuugagugaac

SEQ ID NO: 1105673 - RNA, 19 nt, Homo sapiens
ugaauugugugauaaagga

SEQ ID NO: 1105674 - RNA, 19 nt, Homo sapiens
ccaagaguguguugcuauu

SEQ ID NO: 1105675 - RNA, 19 nt, Homo sapiens
gaauugcccuucauuuacu

SEQ ID NO: 1105676 - RNA, 19 nt, Homo sapiens
aaacugugcucugaaagaa

SEQ ID NO: 1105677 - RNA, 19 nt, Homo sapiens
gccaaacugugcucugaaa

SEQ ID NO: 1105678 - RNA, 19 nt, Homo sapiens
cacaggaacuuuaaaucuu

SEQ ID NO: 1105679 - RNA, 19 nt, Homo sapiens
gugcagaggaucauacuuu

SEQ ID NO: 1105680 - RNA, 19 nt, Homo sapiens
gagaaugcaucuguugaau

SEQ ID NO: 1105681 - RNA, 19 nt, Homo sapiens
gauggaagauuuugcuuuu

SEQ ID NO: 1105682 - RNA, 19 nt, Homo sapiens
gaagagguggucacuaaau

SEQ ID NO: 1105683 - RNA, 19 nt, Homo sapiens
cuugacaguuggaauguua

SEQ ID NO: 1105684 - RNA, 19 nt, Homo sapiens
ccauuuaucugcgaauuau

SEQ ID NO: 1105685 - RNA, 19 nt, Homo sapiens
gcacaugagaauacauaaa

SEQ ID NO: 1105686 - RNA, 19 nt, Homo sapiens
gagaagccauacaaaugug

SEQ ID NO: 1105687 - RNA, 19 nt, Homo sapiens
guugugaccugugggauuu

SEQ ID NO: 1105688 - RNA, 19 nt, Homo sapiens
cagaaacuauggaugugaa

SEQ ID NO: 1105689 - RNA, 19 nt, Homo sapiens
ugaacaggauuccauacaa

SEQ ID NO: 1105690 - RNA, 19 nt, Homo sapiens
gaagccagcaguuugagaa

SEQ ID NO: 1105691 - RNA, 19 nt, Homo sapiens
uaacacaugugggaaagug

SEQ ID NO: 1105692 - RNA, 19 nt, Homo sapiens
gaaaucagaaguaucuaca

SEQ ID NO: 1105693 - RNA, 19 nt, Homo sapiens
cuuuaaaucuugacaguug

SEQ ID NO: 1105694 - RNA, 19 nt, Homo sapiens
gaacaaugucuuucuugau

SEQ ID NO: 1105695 - RNA, 19 nt, Homo sapiens
uagagagacugaacaaaca

SEQ ID NO: 1105696 - RNA, 19 nt, Homo sapiens
uuuaggcgcugaauaagaa

SEQ ID NO: 1105697 - RNA, 19 nt, Homo sapiens
ccaaaggauuguguuaguu

SEQ ID NO: 1105698 - RNA, 19 nt, Homo sapiens
cuaguucucuuaucacuca

SEQ ID NO: 1105699 - RNA, 19 nt, Homo sapiens
uaucauguccguaggcaua

SEQ ID NO: 1105700 - RNA, 19 nt, Homo sapiens
gaguuuauauacacaggaa

SEQ ID NO: 1105701 - RNA, 19 nt, Homo sapiens
gaauauaggaaugcuaaga

SEQ ID NO: 1105702 - RNA, 19 nt, Homo sapiens
gugagaagccauacaaaug

SEQ ID NO: 1105703 - RNA, 19 nt, Homo sapiens
uagaacaaguugcacaaau

SEQ ID NO: 1105704 - RNA, 19 nt, Homo sapiens
acaggaacuuuaaaucuug

SEQ ID NO: 1105705 - RNA, 19 nt, Homo sapiens
ccagcacacugaccuauca

SEQ ID NO: 1105706 - RNA, 19 nt, Homo sapiens
gaaggcacaugagaauaca

SEQ ID NO: 1105707 - RNA, 19 nt, Homo sapiens
caaaggauuguguuaguug

SEQ ID NO: 1105708 - RNA, 19 nt, Homo sapiens
aaucagaaguaucuacaga

SEQ ID NO: 1105709 - RNA, 19 nt, Homo sapiens
uuccugcccucauaauuua

SEQ ID NO: 1105710 - RNA, 19 nt, Homo sapiens
gaaggcauuugcugucucu

SEQ ID NO: 1105711 - RNA, 19 nt, Homo sapiens
ggagagaagccauaugucu

SEQ ID NO: 1105712 - RNA, 19 nt, Homo sapiens
cagcuagucuuccauaguc

SEQ ID NO: 1105713 - RNA, 19 nt, Homo sapiens
gguggucacuaaaugcaaa

SEQ ID NO: 1105714 - RNA, 19 nt, Homo sapiens
caacugcaauguuuguuuu

SEQ ID NO: 1105715 - RNA, 19 nt, Homo sapiens
cugguaaggugcauauauu

SEQ ID NO: 1105716 - RNA, 19 nt, Homo sapiens
guagcaaacaucucuggua

SEQ ID NO: 1105717 - RNA, 19 nt, Homo sapiens
gagaaaagccuuauguaug

SEQ ID NO: 1105718 - RNA, 19 nt, Homo sapiens
cagccaaacugugcucuga

SEQ ID NO: 1105719 - RNA, 19 nt, Homo sapiens
caccgucacuuauugaugu

SEQ ID NO: 1105720 - RNA, 19 nt, Homo sapiens
caguuaaugugauucaguu

SEQ ID NO: 1105721 - RNA, 19 nt, Homo sapiens
gaagccauaugucugugau

SEQ ID NO: 1105722 - RNA, 19 nt, Homo sapiens
ucaggcaaauccuaaacaa

SEQ ID NO: 1105723 - RNA, 19 nt, Homo sapiens
gugcuggccuccuuuagug

SEQ ID NO: 1105724 - RNA, 19 nt, Homo sapiens
ggaagcagguuuucucugu

SEQ ID NO: 1105725 - RNA, 19 nt, Homo sapiens
gcucaagccagcacacuga

SEQ ID NO: 1105726 - RNA, 19 nt, Homo sapiens
gagaaggcacaugagaaua

SEQ ID NO: 1105727 - RNA, 19 nt, Homo sapiens
cuggaaacauugaauugaa

SEQ ID NO: 1105728 - RNA, 19 nt, Homo sapiens
aagaguguguugcuauuug

SEQ ID NO: 1105729 - RNA, 19 nt, Homo sapiens
gaccauuuaucugcgaauu

SEQ ID NO: 1105730 - RNA, 19 nt, Homo sapiens
caaacugugcucugaaaga

SEQ ID NO: 1105731 - RNA, 19 nt, Homo sapiens
gaacaaacagcgggaagca

SEQ ID NO: 1105732 - RNA, 19 nt, Homo sapiens
uacaucagauacauuguug

SEQ ID NO: 1105733 - RNA, 19 nt, Homo sapiens
uaucagaaacuauggaugu

SEQ ID NO: 1105734 - RNA, 19 nt, Homo sapiens
agaaaagccuuauguaugu

SEQ ID NO: 1105735 - RNA, 19 nt, Homo sapiens
gcacacugaccuaucaugu

SEQ ID NO: 1105736 - RNA, 19 nt, Homo sapiens
cuauaaaugugauguaugc

SEQ ID NO: 1105737 - RNA, 19 nt, Homo sapiens
ggaagagguggucacuaaa

SEQ ID NO: 1105738 - RNA, 19 nt, Homo sapiens
caguuggaauguuaaagaa

SEQ ID NO: 1105739 - RNA, 19 nt, Homo sapiens
ggaaauggaugagaugaug

SEQ ID NO: 1105740 - RNA, 19 nt, Homo sapiens
gcagaaaccgaaagagaaa

SEQ ID NO: 1105741 - RNA, 19 nt, Homo sapiens
gcacagggaguuugucuug

SEQ ID NO: 1105742 - RNA, 19 nt, Homo sapiens
ggaggaggauuucuacuac

SEQ ID NO: 1105743 - RNA, 19 nt, Homo sapiens
acacagaggugcagcugaa

SEQ ID NO: 1105744 - RNA, 19 nt, Homo sapiens
ccaaacugaucauggcuuu

SEQ ID NO: 1105745 - RNA, 19 nt, Homo sapiens
gaaggagaguggugacauc

SEQ ID NO: 1105746 - RNA, 19 nt, Homo sapiens
gaaagagaaagaacggaaa

SEQ ID NO: 1105747 - RNA, 19 nt, Homo sapiens
gcucagcgccuucacuuug

SEQ ID NO: 1105748 - RNA, 19 nt, Homo sapiens
gggaggaggauuucuacua

SEQ ID NO: 1105749 - RNA, 19 nt, Homo sapiens
gaaagaacucugugaaggu

SEQ ID NO: 1105750 - RNA, 19 nt, Homo sapiens
ugaaggugauguacaagug

SEQ ID NO: 1105751 - RNA, 19 nt, Homo sapiens
ccagaguggugccaggaaa

SEQ ID NO: 1105752 - RNA, 19 nt, Homo sapiens
cagcagaaaccgaaagaga

SEQ ID NO: 1105753 - RNA, 19 nt, Homo sapiens
caucaaacgacacgucaaa

SEQ ID NO: 1105754 - RNA, 19 nt, Homo sapiens
gaagucggacgcaguggaa

SEQ ID NO: 1105755 - RNA, 19 nt, Homo sapiens
gggacacaguggacucuga

SEQ ID NO: 1105756 - RNA, 19 nt, Homo sapiens
aaagaaagaacucugugaa

SEQ ID NO: 1105757 - RNA, 19 nt, Homo sapiens
gagcugugcugcagguucu

SEQ ID NO: 1105758 - RNA, 19 nt, Homo sapiens
caccugcgaugaaaucuca

SEQ ID NO: 1105759 - RNA, 19 nt, Homo sapiens
gcaaaguucugcgcuccau

SEQ ID NO: 1105760 - RNA, 19 nt, Homo sapiens
gaggccaacuucucugcuu

SEQ ID NO: 1105761 - RNA, 19 nt, Homo sapiens
aaacugaucauggcuuuga

SEQ ID NO: 1105762 - RNA, 19 nt, Homo sapiens
caccagcccucagcagaaa

SEQ ID NO: 1105763 - RNA, 19 nt, Homo sapiens
gccagcaccugcgaugaaa

SEQ ID NO: 1105764 - RNA, 19 nt, Homo sapiens
gggcagaagguuuaugugu

SEQ ID NO: 1105765 - RNA, 19 nt, Homo sapiens
gcagcagcauggcgagugu

SEQ ID NO: 1105766 - RNA, 19 nt, Homo sapiens
gggcaggcguucccaugau

SEQ ID NO: 1105767 - RNA, 19 nt, Homo sapiens
ucaggcagaucaugcauac

SEQ ID NO: 1105768 - RNA, 19 nt, Homo sapiens
gaggaggauuucuacuaca

SEQ ID NO: 1105769 - RNA, 19 nt, Homo sapiens
cgaaccagcuccacgaaaa

SEQ ID NO: 1105770 - RNA, 19 nt, Homo sapiens
agaccgauccugacccuuu

SEQ ID NO: 1105771 - RNA, 19 nt, Homo sapiens
acaagugccuguggccaaa

SEQ ID NO: 1105772 - RNA, 19 nt, Homo sapiens
acagggaguuugucuugug

SEQ ID NO: 1105773 - RNA, 19 nt, Homo sapiens
cgucaaagcccuccaucug

SEQ ID NO: 1105774 - RNA, 19 nt, Homo sapiens
gaccgauccugacccuuuc

SEQ ID NO: 1105775 - RNA, 19 nt, Homo sapiens
ucuguuggcuaagguguaa

SEQ ID NO: 1105776 - RNA, 19 nt, Homo sapiens
gggaguuugucuugugcaa

SEQ ID NO: 1105777 - RNA, 19 nt, Homo sapiens
ggcaggcguucccaugaug

SEQ ID NO: 1105778 - RNA, 19 nt, Homo sapiens
ggacucugaucaguucaag

SEQ ID NO: 1105779 - RNA, 19 nt, Homo sapiens
ggacacaguggacucugau

SEQ ID NO: 1105780 - RNA, 19 nt, Homo sapiens
uuugggcucuguuggcuaa

SEQ ID NO: 1105781 - RNA, 19 nt, Homo sapiens
aaaguucugcgcuccauug

SEQ ID NO: 1105782 - RNA, 19 nt, Homo sapiens
cugugaaggugauguacaa

SEQ ID NO: 1105783 - RNA, 19 nt, Homo sapiens
ugacucagagaccuaaaga

SEQ ID NO: 1105784 - RNA, 19 nt, Homo sapiens
ggaccgaggccaacuucuc

SEQ ID NO: 1105785 - RNA, 19 nt, Homo sapiens
caguggaaauggaugagau

SEQ ID NO: 1105786 - RNA, 19 nt, Homo sapiens
ggacgcaguggaaauggau

SEQ ID NO: 1105787 - RNA, 19 nt, Homo sapiens
gaaaccgaaagagaaagaa

SEQ ID NO: 1105788 - RNA, 19 nt, Homo sapiens
acaagaggccaguguguca

SEQ ID NO: 1105789 - RNA, 19 nt, Homo sapiens
ucaagcgggaggaggauuu

SEQ ID NO: 1105790 - RNA, 19 nt, Homo sapiens
gggcucagcgccuucacuu

SEQ ID NO: 1105791 - RNA, 19 nt, Homo sapiens
gcugcagguucuacucugu

SEQ ID NO: 1105792 - RNA, 19 nt, Homo sapiens
ggaaggagaguggugacau

SEQ ID NO: 1105793 - RNA, 19 nt, Homo sapiens
gaagugccgcaagguguau

SEQ ID NO: 1105794 - RNA, 19 nt, Homo sapiens
agaagugccgcaaggugua

SEQ ID NO: 1105795 - RNA, 19 nt, Homo sapiens
aguggacucugaucaguuc

SEQ ID NO: 1105796 - RNA, 19 nt, Homo sapiens
gacagcggcagcagcacua

SEQ ID NO: 1105797 - RNA, 19 nt, Homo sapiens
ucaccagcccucagcagaa

SEQ ID NO: 1105798 - RNA, 19 nt, Homo sapiens
gaaggccugccagcgcuuu

SEQ ID NO: 1105799 - RNA, 19 nt, Homo sapiens
acucagagaccuaaagaag

SEQ ID NO: 1105800 - RNA, 19 nt, Homo sapiens
agaaaccgaaagagaaaga

SEQ ID NO: 1105801 - RNA, 19 nt, Homo sapiens
ugacaagaggccagugugu

SEQ ID NO: 1105802 - RNA, 19 nt, Homo sapiens
ccucggagccacugcuaga

SEQ ID NO: 1105803 - RNA, 19 nt, Homo sapiens
gaccgaggccaacuucucu

SEQ ID NO: 1105804 - RNA, 19 nt, Homo sapiens
ugaaaucucaucugaucgu

SEQ ID NO: 1105805 - RNA, 19 nt, Homo sapiens
gcacauucaggcagaucau

SEQ ID NO: 1105806 - RNA, 19 nt, Homo sapiens
caccaccucugcacaaagc

SEQ ID NO: 1105807 - RNA, 19 nt, Homo sapiens
acaguggacucugaucagu

SEQ ID NO: 1105808 - RNA, 19 nt, Homo sapiens
gcaguggaaauggaugaga

SEQ ID NO: 1105809 - RNA, 19 nt, Homo sapiens
agccugggcagaagguuua

SEQ ID NO: 1105810 - RNA, 19 nt, Homo sapiens
agcagaaaccgaaagagaa

SEQ ID NO: 1105811 - RNA, 19 nt, Homo sapiens
cagcaccugcgaugaaauc

SEQ ID NO: 1105812 - RNA, 19 nt, Homo sapiens
cagaggugcagcugaagga

SEQ ID NO: 1105813 - RNA, 19 nt, Homo sapiens
ggaaaugccuucuuaaagu

SEQ ID NO: 1105814 - RNA, 19 nt, Homo sapiens
gaaaugccuucuuaaaguu

SEQ ID NO: 1105815 - RNA, 19 nt, Homo sapiens
guguggaaaugccuucuua

SEQ ID NO: 1105816 - RNA, 19 nt, Homo sapiens
gauccauuaucuucuguuu

SEQ ID NO: 1105817 - RNA, 19 nt, Homo sapiens
ggucauggaggaaucauaa

SEQ ID NO: 1105818 - RNA, 19 nt, Homo sapiens
cauaaugucaucacuguaa

SEQ ID NO: 1105819 - RNA, 19 nt, Homo sapiens
accauuggguuccuaauua

SEQ ID NO: 1105820 - RNA, 19 nt, Homo sapiens
ccauuggguuccuaauuaa

SEQ ID NO: 1105821 - RNA, 19 nt, Homo sapiens
gaggaaucauaaacacauu

SEQ ID NO: 1105822 - RNA, 19 nt, Homo sapiens
gugcucagcugccuuccaa

SEQ ID NO: 1105823 - RNA, 19 nt, Homo sapiens
gaggauccauuaucuucug

SEQ ID NO: 1105824 - RNA, 19 nt, Homo sapiens
cgaaaaugcugccgaagaa

SEQ ID NO: 1105825 - RNA, 19 nt, Homo sapiens
cagaaaacaugucauaaug

SEQ ID NO: 1105826 - RNA, 19 nt, Homo sapiens
ugacgagaguguuguaaag

SEQ ID NO: 1105827 - RNA, 19 nt, Homo sapiens
guggaaaugccuucuuaaa

SEQ ID NO: 1105828 - RNA, 19 nt, Homo sapiens
ggaggaaucauaaacacau

SEQ ID NO: 1105829 - RNA, 19 nt, Homo sapiens
gucauaaugucaucacugu

SEQ ID NO: 1105830 - RNA, 19 nt, Homo sapiens
cgagaguguuguaaagugu

SEQ ID NO: 1105831 - RNA, 19 nt, Homo sapiens
gagcucugccuuaccauug

SEQ ID NO: 1105832 - RNA, 19 nt, Homo sapiens
cagcuaugaggauccauua

SEQ ID NO: 1105833 - RNA, 19 nt, Homo sapiens
cauagggagcucugccuua

SEQ ID NO: 1105834 - RNA, 19 nt, Homo sapiens
guuguaaaguguggaaaug

SEQ ID NO: 1105835 - RNA, 19 nt, Homo sapiens
gcuaugaggauccauuauc

SEQ ID NO: 1105836 - RNA, 19 nt, Homo sapiens
ccugaaacaugacgagagu

SEQ ID NO: 1105837 - RNA, 19 nt, Homo sapiens
cuaugaggauccauuaucu

SEQ ID NO: 1105838 - RNA, 19 nt, Homo sapiens
gcagcuaugaggauccauu

SEQ ID NO: 1105839 - RNA, 19 nt, Homo sapiens
caucagaaaacaugucaua

SEQ ID NO: 1105840 - RNA, 19 nt, Homo sapiens
ggaaucauaaacacauuac

SEQ ID NO: 1105841 - RNA, 19 nt, Homo sapiens
uccauuaucuucuguuugc

SEQ ID NO: 1105842 - RNA, 19 nt, Homo sapiens
uuuauaaagugaccaagca

SEQ ID NO: 1105843 - RNA, 19 nt, Homo sapiens
ggagcucugccuuaccauu

SEQ ID NO: 1105844 - RNA, 19 nt, Homo sapiens
uggaaaugccuucuuaaag

SEQ ID NO: 1105845 - RNA, 19 nt, Homo sapiens
ugaaacaugacgagagugu

SEQ ID NO: 1105846 - RNA, 19 nt, Homo sapiens
acgagaguguuguaaagug

SEQ ID NO: 1105847 - RNA, 19 nt, Homo sapiens
guggcuggaaccuuuauaa

SEQ ID NO: 1105848 - RNA, 19 nt, Homo sapiens
gcucagcugccuuccaaag

SEQ ID NO: 1105849 - RNA, 19 nt, Homo sapiens
aggaacagaucggcaagug

SEQ ID NO: 1105850 - RNA, 19 nt, Homo sapiens
gcuuugcucuuccuguuuu

SEQ ID NO: 1105851 - RNA, 19 nt, Homo sapiens
uaccauuggguuccuaauu

SEQ ID NO: 1105852 - RNA, 19 nt, Homo sapiens
uugcuuugcucuuccuguu

SEQ ID NO: 1105853 - RNA, 19 nt, Homo sapiens
uggcuggaaccuuuauaaa

SEQ ID NO: 1105854 - RNA, 19 nt, Homo sapiens
gaguggguguguucugcau

SEQ ID NO: 1105855 - RNA, 19 nt, Homo sapiens
cauggaggaaucauaaaca

SEQ ID NO: 1105856 - RNA, 19 nt, Homo sapiens
gcuguggcuggaaccuuua

SEQ ID NO: 1105857 - RNA, 19 nt, Homo sapiens
ucacuguaauaugacaaga

SEQ ID NO: 1105858 - RNA, 19 nt, Homo sapiens
aaaugcugccgaagaaaga

SEQ ID NO: 1105859 - RNA, 19 nt, Homo sapiens
ugagugaguggguguguuc

SEQ ID NO: 1105860 - RNA, 19 nt, Homo sapiens
agcuguggcuggaaccuuu

SEQ ID NO: 1105861 - RNA, 19 nt, Homo sapiens
auagggagcucugccuuac

SEQ ID NO: 1105862 - RNA, 19 nt, Homo sapiens
ucuguuugcuuugcucuuc

SEQ ID NO: 1105863 - RNA, 19 nt, Homo sapiens
ccauagggcuagacacuuu

SEQ ID NO: 1105864 - RNA, 19 nt, Homo sapiens
aaacuguacuggugucaaa

SEQ ID NO: 1105865 - RNA, 19 nt, Homo sapiens
ggccagagccugaccaaga

SEQ ID NO: 1105866 - RNA, 19 nt, Homo sapiens
gccagagccugaccaagau

SEQ ID NO: 1105867 - RNA, 19 nt, Homo sapiens
gcgccuggcuauccgcuau

SEQ ID NO: 1105868 - RNA, 19 nt, Homo sapiens
gcgacgugcuggcucuguu

SEQ ID NO: 1105869 - RNA, 19 nt, Homo sapiens
ccucagcaccuucgaagug

SEQ ID NO: 1105870 - RNA, 19 nt, Homo sapiens
ccagugagcgggagaaacu

SEQ ID NO: 1105871 - RNA, 19 nt, Homo sapiens
cugaggagcccaagugaca

SEQ ID NO: 1105872 - RNA, 19 nt, Homo sapiens
ggacccauagggcuagaca

SEQ ID NO: 1105873 - RNA, 19 nt, Homo sapiens
gcaaugagcuguucaaaug

SEQ ID NO: 1105874 - RNA, 19 nt, Homo sapiens
gaaaguggcugugcaauga

SEQ ID NO: 1105875 - RNA, 19 nt, Homo sapiens
caaagaaggugccaucauu

SEQ ID NO: 1105876 - RNA, 19 nt, Homo sapiens
caaccaagauggagaguga

SEQ ID NO: 1105877 - RNA, 19 nt, Homo sapiens
gauagaaggcuacauguuu

SEQ ID NO: 1105878 - RNA, 19 nt, Homo sapiens
ggacaaagcaguggaauau

SEQ ID NO: 1105879 - RNA, 19 nt, Homo sapiens
gcuggaagauuacgacaaa

SEQ ID NO: 1105880 - RNA, 19 nt, Homo sapiens
ucagcaagcucuuugauga

SEQ ID NO: 1105881 - RNA, 19 nt, Homo sapiens
gcugaaggcuccacucuca

SEQ ID NO: 1105882 - RNA, 19 nt, Homo sapiens
ugaaggaccuauauaagug

SEQ ID NO: 1105883 - RNA, 19 nt, Homo sapiens
gcucaggccugcagaacuu

SEQ ID NO: 1105884 - RNA, 19 nt, Homo sapiens
ugaagguccucaucaguaa

SEQ ID NO: 1105885 - RNA, 19 nt, Homo sapiens
ggaugcggcugcucugaaa

SEQ ID NO: 1105886 - RNA, 19 nt, Homo sapiens
gcccugacccuccugauua

SEQ ID NO: 1105887 - RNA, 19 nt, Homo sapiens
ccucaucaguaaccucuua

SEQ ID NO: 1105888 - RNA, 19 nt, Homo sapiens
guucagcucuugcaacguu

SEQ ID NO: 1105889 - RNA, 19 nt, Homo sapiens
gaaggugcaucccaacaca

SEQ ID NO: 1105890 - RNA, 19 nt, Homo sapiens
gaagagaagggcacugaga

SEQ ID NO: 1105891 - RNA, 19 nt, Homo sapiens
uggcuuaccugaccuuuga

SEQ ID NO: 1105892 - RNA, 19 nt, Homo sapiens
gaacugcaccaacagcuau

SEQ ID NO: 1105893 - RNA, 19 nt, Homo sapiens
gagaauuuccacagacuuu

SEQ ID NO: 1105894 - RNA, 19 nt, Homo sapiens
gggagagacugaccucaug

SEQ ID NO: 1105895 - RNA, 19 nt, Homo sapiens
gcaguggaauaugggcuua

SEQ ID NO: 1105896 - RNA, 19 nt, Homo sapiens
gcuaagcagugucgaaagu

SEQ ID NO: 1105897 - RNA, 19 nt, Homo sapiens
ucaguaaccucuuagaucu

SEQ ID NO: 1105898 - RNA, 19 nt, Homo sapiens
ugguggagcuggccaagua

SEQ ID NO: 1105899 - RNA, 19 nt, Homo sapiens
gagggagaauuuccacaga

SEQ ID NO: 1105900 - RNA, 19 nt, Homo sapiens
guucaaauguggagacuac

SEQ ID NO: 1105901 - RNA, 19 nt, Homo sapiens
acaaagcaguggaauaugg

SEQ ID NO: 1105902 - RNA, 19 nt, Homo sapiens
cuucuuggcuuuaguggaa

SEQ ID NO: 1105903 - RNA, 19 nt, Homo sapiens
gcacccugauggagaguga

SEQ ID NO: 1105904 - RNA, 19 nt, Homo sapiens
ccacggagugcauguguaa

SEQ ID NO: 1105905 - RNA, 19 nt, Homo sapiens
ccucagcgcuggugaacug

SEQ ID NO: 1105906 - RNA, 19 nt, Homo sapiens
ugaagcugcuggugcugua

SEQ ID NO: 1105907 - RNA, 19 nt, Homo sapiens
auagaaggcuacauguuug

SEQ ID NO: 1105908 - RNA, 19 nt, Homo sapiens
gcaccaacagcuaugacua

SEQ ID NO: 1105909 - RNA, 19 nt, Homo sapiens
agagugagaugauggagau

SEQ ID NO: 1105910 - RNA, 19 nt, Homo sapiens
gagaaggugcgauacaugu

SEQ ID NO: 1105911 - RNA, 19 nt, Homo sapiens
gagccaagcccuagagaag

SEQ ID NO: 1105912 - RNA, 19 nt, Homo sapiens
gagaggcuccggcagaaga

SEQ ID NO: 1105913 - RNA, 19 nt, Homo sapiens
gauguccucuguucugagu

SEQ ID NO: 1105914 - RNA, 19 nt, Homo sapiens
accucaagcuggaagauua

SEQ ID NO: 1105915 - RNA, 19 nt, Homo sapiens
gcaaagaaggugccaucau

SEQ ID NO: 1105916 - RNA, 19 nt, Homo sapiens
ugauggagaucuugucagu

SEQ ID NO: 1105917 - RNA, 19 nt, Homo sapiens
ggagggcaaugagcuguuc

SEQ ID NO: 1105918 - RNA, 19 nt, Homo sapiens
gcucauggcccuaacaaac

SEQ ID NO: 1105919 - RNA, 19 nt, Homo sapiens
ggaccgaggcacugugguu

SEQ ID NO: 1105920 - RNA, 19 nt, Homo sapiens
gcccugugcugaccaguuc

SEQ ID NO: 1105921 - RNA, 19 nt, Homo sapiens
cgacgugaaggaagaguuu

SEQ ID NO: 1105922 - RNA, 19 nt, Homo sapiens
gaacuucgaggcgcucaug

SEQ ID NO: 1105923 - RNA, 19 nt, Homo sapiens
ggagaaggugcgauacaug

SEQ ID NO: 1105924 - RNA, 19 nt, Homo sapiens
gagcugaagguccucauca

SEQ ID NO: 1105925 - RNA, 19 nt, Homo sapiens
caggaggccuugcggaaca

SEQ ID NO: 1105926 - RNA, 19 nt, Homo sapiens
ggagaucuugucagugcua

SEQ ID NO: 1105927 - RNA, 19 nt, Homo sapiens
gauggagagugagaugaug

SEQ ID NO: 1105928 - RNA, 19 nt, Homo sapiens
cgaaaguggcugugcaaug

SEQ ID NO: 1105929 - RNA, 19 nt, Homo sapiens
ggaauaugggcuuauccaa

SEQ ID NO: 1105930 - RNA, 19 nt, Homo sapiens
ggaagaguuuguggaggau

SEQ ID NO: 1105931 - RNA, 19 nt, Homo sapiens
ccaaagccauugaaaagga

SEQ ID NO: 1105932 - RNA, 19 nt, Homo sapiens
ugaaggcuccacucucaaa

SEQ ID NO: 1105933 - RNA, 19 nt, Homo sapiens
agaaacagaggcauccaaa

SEQ ID NO: 1105934 - RNA, 19 nt, Homo sapiens
ggcaaccucuccgcgauga

SEQ ID NO: 1105935 - RNA, 19 nt, Homo sapiens
gaaggcugugcccaugaua

SEQ ID NO: 1105936 - RNA, 19 nt, Homo sapiens
guacgcugguuggcauuug

SEQ ID NO: 1105937 - RNA, 19 nt, Homo sapiens
cagaagagaagggcacuga

SEQ ID NO: 1105938 - RNA, 19 nt, Homo sapiens
gaugauggagaucuuguca

SEQ ID NO: 1105939 - RNA, 19 nt, Homo sapiens
gagaaggcugugcccauga

SEQ ID NO: 1105940 - RNA, 19 nt, Homo sapiens
ggaagauuacgacaaagca

SEQ ID NO: 1105941 - RNA, 19 nt, Homo sapiens
gcugugcaaugaccagauc

SEQ ID NO: 1105942 - RNA, 19 nt, Homo sapiens
gcugaaggaccuauauaag

SEQ ID NO: 1105943 - RNA, 19 nt, Homo sapiens
gggagaauuuccacagacu

SEQ ID NO: 1105944 - RNA, 19 nt, Homo sapiens
ccucuuagaucugcugaca

SEQ ID NO: 1105945 - RNA, 19 nt, Homo sapiens
ggagugcauguguaacuug

SEQ ID NO: 1105946 - RNA, 19 nt, Homo sapiens
gaauuuccacagacuuugu

SEQ ID NO: 1105947 - RNA, 19 nt, Homo sapiens
aaagaaggugccaucauug

SEQ ID NO: 1105948 - RNA, 19 nt, Homo sapiens
ccucaaggaaggugucaaa

SEQ ID NO: 1105949 - RNA, 19 nt, Homo sapiens
gcaaugaccgacugaagcu

SEQ ID NO: 1105950 - RNA, 19 nt, Homo sapiens
gcuguacaguggagaggau

SEQ ID NO: 1105951 - RNA, 19 nt, Homo sapiens
gaaacagaggcauccaaag

SEQ ID NO: 1105952 - RNA, 19 nt, Homo sapiens
aaacagaggcauccaaagc

SEQ ID NO: 1105953 - RNA, 19 nt, Homo sapiens
aaugagcuguucaaaugug

SEQ ID NO: 1105954 - RNA, 19 nt, Homo sapiens
ggcaaugagcuguucaaau

SEQ ID NO: 1105955 - RNA, 19 nt, Homo sapiens
gccacggagugcaugugua

SEQ ID NO: 1105956 - RNA, 19 nt, Homo sapiens
ccagggucuucuuggcuuu

SEQ ID NO: 1105957 - RNA, 19 nt, Homo sapiens
gagugugauugcucugugu

SEQ ID NO: 1105958 - RNA, 19 nt, Homo sapiens
ccucuauucuccucagcaa

SEQ ID NO: 1105959 - RNA, 19 nt, Homo sapiens
cgcaugagcgccucuauuc

SEQ ID NO: 1105960 - RNA, 19 nt, Homo sapiens
cccugacccuccugauuaa

SEQ ID NO: 1105961 - RNA, 19 nt, Homo sapiens
agagaagggcacugagaaa

SEQ ID NO: 1105962 - RNA, 19 nt, Homo sapiens
agaaggcugugcccaugau

SEQ ID NO: 1105963 - RNA, 19 nt, Homo sapiens
gagcccaagaacaaaguuu

SEQ ID NO: 1105964 - RNA, 19 nt, Homo sapiens
uggagcagcugcggaagga

SEQ ID NO: 1105965 - RNA, 19 nt, Homo sapiens
caguggagggccuggcuua

SEQ ID NO: 1105966 - RNA, 19 nt, Homo sapiens
cugaaggaccuauauaagu

SEQ ID NO: 1105967 - RNA, 19 nt, Homo sapiens
ggagccaagcccuagagaa

SEQ ID NO: 1105968 - RNA, 19 nt, Homo sapiens
gugucucgcugcugaagga

SEQ ID NO: 1105969 - RNA, 19 nt, Homo sapiens
gaccugcagagauguguga

SEQ ID NO: 1105970 - RNA, 19 nt, Homo sapiens
guggcuggcaugcccaaua

SEQ ID NO: 1105971 - RNA, 19 nt, Homo sapiens
gugcugugguggugcugaa

SEQ ID NO: 1105972 - RNA, 19 nt, Homo sapiens
ugauagaaggcuacauguu

SEQ ID NO: 1105973 - RNA, 19 nt, Homo sapiens
gaaauaaacuggagacaaa

SEQ ID NO: 1105974 - RNA, 19 nt, Homo sapiens
ggaaaggccuucauucaua

SEQ ID NO: 1105975 - RNA, 19 nt, Homo sapiens
caacaucacaguauucaua

SEQ ID NO: 1105976 - RNA, 19 nt, Homo sapiens
gcaguuaugcuauuuguaa

SEQ ID NO: 1105977 - RNA, 19 nt, Homo sapiens
gugcaucccuuauucuaua

SEQ ID NO: 1105978 - RNA, 19 nt, Homo sapiens
ggaauucacacaaauauga

SEQ ID NO: 1105979 - RNA, 19 nt, Homo sapiens
gagagaagccuuaugaaug

SEQ ID NO: 1105980 - RNA, 19 nt, Homo sapiens
gagagaaaccuuacaaaug

SEQ ID NO: 1105981 - RNA, 19 nt, Homo sapiens
gagaauaaaugguggaaag

SEQ ID NO: 1105982 - RNA, 19 nt, Homo sapiens
guaugaauguggaaacuuu

SEQ ID NO: 1105983 - RNA, 19 nt, Homo sapiens
gaagggaauucacacaaau

SEQ ID NO: 1105984 - RNA, 19 nt, Homo sapiens
agagaaaccuuacgaaugu

SEQ ID NO: 1105985 - RNA, 19 nt, Homo sapiens
gagagaagcccuaugaaug

SEQ ID NO: 1105986 - RNA, 19 nt, Homo sapiens
ggaaauugcagaauaaugu

SEQ ID NO: 1105987 - RNA, 19 nt, Homo sapiens
cauagauccucccuuauuu

SEQ ID NO: 1105988 - RNA, 19 nt, Homo sapiens
agcaaaggcucgaaucuua

SEQ ID NO: 1105989 - RNA, 19 nt, Homo sapiens
caacaucagaguauucaua

SEQ ID NO: 1105990 - RNA, 19 nt, Homo sapiens
gaaaggccuucauucauag

SEQ ID NO: 1105991 - RNA, 19 nt, Homo sapiens
guagagaaaucauaugaag

SEQ ID NO: 1105992 - RNA, 19 nt, Homo sapiens
ggacacugcccaucucuaa

SEQ ID NO: 1105993 - RNA, 19 nt, Homo sapiens
cagcuugaaucacugaaua

SEQ ID NO: 1105994 - RNA, 19 nt, Homo sapiens
gccaguaaauguuauaaug

SEQ ID NO: 1105995 - RNA, 19 nt, Homo sapiens
gaagagaagcaguguuuau

SEQ ID NO: 1105996 - RNA, 19 nt, Homo sapiens
gcuauagacuucucucaug

SEQ ID NO: 1105997 - RNA, 19 nt, Homo sapiens
ggagagcaaauaaacauaa

SEQ ID NO: 1105998 - RNA, 19 nt, Homo sapiens
gauccucccuuauuuaaca

SEQ ID NO: 1105999 - RNA, 19 nt, Homo sapiens
guacaucagagaauucaua

SEQ ID NO: 1106000 - RNA, 19 nt, Homo sapiens
gagagaaaccuuacgaaug

SEQ ID NO: 1106001 - RNA, 19 nt, Homo sapiens
gagagaaaccguaugaaug

SEQ ID NO: 1106002 - RNA, 19 nt, Homo sapiens
auucauagauccucccuua

SEQ ID NO: 1106003 - RNA, 19 nt, Homo sapiens
caucaaagaauucacagua

SEQ ID NO: 1106004 - RNA, 19 nt, Homo sapiens
gaagcaccuuucauucaaa

SEQ ID NO: 1106005 - RNA, 19 nt, Homo sapiens
acgguaaacuucauucaua

SEQ ID NO: 1106006 - RNA, 19 nt, Homo sapiens
gcucacaccuuacucaaca

SEQ ID NO: 1106007 - RNA, 19 nt, Homo sapiens
ggagagaaaccuuacaaau

SEQ ID NO: 1106008 - RNA, 19 nt, Homo sapiens
cauuggaaauugcagaaua

SEQ ID NO: 1106009 - RNA, 19 nt, Homo sapiens
gaaacccaauaguguggua

SEQ ID NO: 1106010 - RNA, 19 nt, Homo sapiens
gagagaaacccaauagugu

SEQ ID NO: 1106011 - RNA, 19 nt, Homo sapiens
agagaagccuuaugaaugu

SEQ ID NO: 1106012 - RNA, 19 nt, Homo sapiens
agagcaaccugaaggauuu

SEQ ID NO: 1106013 - RNA, 19 nt, Homo sapiens
ccaagugcaucccuuauuc

SEQ ID NO: 1106014 - RNA, 19 nt, Homo sapiens
ggagagaaacccaauagug

SEQ ID NO: 1106015 - RNA, 19 nt, Homo sapiens
guucaaaccuuacuguaca

SEQ ID NO: 1106016 - RNA, 19 nt, Homo sapiens
gaggagccaguaaauguua

SEQ ID NO: 1106017 - RNA, 19 nt, Homo sapiens
ggaaagacuauaggcaaua

SEQ ID NO: 1106018 - RNA, 19 nt, Homo sapiens
cagaagagaagcaguguuu

SEQ ID NO: 1106019 - RNA, 19 nt, Homo sapiens
caucaaagaguacauaaug

SEQ ID NO: 1106020 - RNA, 19 nt, Homo sapiens
ggagagaagccuuaugaau

SEQ ID NO: 1106021 - RNA, 19 nt, Homo sapiens
gagaaaccguaugaaugua

SEQ ID NO: 1106022 - RNA, 19 nt, Homo sapiens
ggagagaaaccguaugaau

SEQ ID NO: 1106023 - RNA, 19 nt, Homo sapiens
gaucauaugaaucccuaua

SEQ ID NO: 1106024 - RNA, 19 nt, Homo sapiens
ucaaagaauucacaguaug

SEQ ID NO: 1106025 - RNA, 19 nt, Homo sapiens
gcucaucacuuacuaacca

SEQ ID NO: 1106026 - RNA, 19 nt, Homo sapiens
agagaaaccuuacaaaugc

SEQ ID NO: 1106027 - RNA, 19 nt, Homo sapiens
gcaaaugugggaaagacua

SEQ ID NO: 1106028 - RNA, 19 nt, Homo sapiens
caaagaauucacaguauga

SEQ ID NO: 1106029 - RNA, 19 nt, Homo sapiens
gagaaaaguuguaugaaug

SEQ ID NO: 1106030 - RNA, 19 nt, Homo sapiens
uuuaguagcuucucauuuc

SEQ ID NO: 1106031 - RNA, 19 nt, Homo sapiens
gaaaccguaugaauguaug

SEQ ID NO: 1106032 - RNA, 19 nt, Homo sapiens
ggagagaagcccuaugaau

SEQ ID NO: 1106033 - RNA, 19 nt, Homo sapiens
cauaagaagaugaauggua

SEQ ID NO: 1106034 - RNA, 19 nt, Homo sapiens
ggaaauaaacuggagacaa

SEQ ID NO: 1106035 - RNA, 19 nt, Homo sapiens
ggagaaaaguuguaugaau

SEQ ID NO: 1106036 - RNA, 19 nt, Homo sapiens
ccaauagugugguaagugu

SEQ ID NO: 1106037 - RNA, 19 nt, Homo sapiens
gggaaagacuauaggcaau

SEQ ID NO: 1106038 - RNA, 19 nt, Homo sapiens
ccauauaaauguagugagu

SEQ ID NO: 1106039 - RNA, 19 nt, Homo sapiens
gagaaaagccauauaaaug

SEQ ID NO: 1106040 - RNA, 19 nt, Homo sapiens
ggagagaaaccuuacgaau

SEQ ID NO: 1106041 - RNA, 19 nt, Homo sapiens
guaacuaagccauauguga

SEQ ID NO: 1106042 - RNA, 19 nt, Homo sapiens
gagaauucauacuggagaa

SEQ ID NO: 1106043 - RNA, 19 nt, Homo sapiens
gaauaaaugguggaaagaa

SEQ ID NO: 1106044 - RNA, 19 nt, Homo sapiens
guaugaagguggugaacau

SEQ ID NO: 1106045 - RNA, 19 nt, Homo sapiens
agaagcaccuuucauucaa

SEQ ID NO: 1106046 - RNA, 19 nt, Homo sapiens
ggaauuaucaacaaagaag

SEQ ID NO: 1106047 - RNA, 19 nt, Homo sapiens
gggcaugugaagauauuua

SEQ ID NO: 1106048 - RNA, 19 nt, Homo sapiens
gcaguagcuugcaguuuca

SEQ ID NO: 1106049 - RNA, 19 nt, Homo sapiens
ucauagauccucccuuauu

SEQ ID NO: 1106050 - RNA, 19 nt, Homo sapiens
gagaaaccuuacgaaugua

SEQ ID NO: 1106051 - RNA, 19 nt, Homo sapiens
gagaaugugggaaagcuuu

SEQ ID NO: 1106052 - RNA, 19 nt, Homo sapiens
gagaagccuuaugaaugua

SEQ ID NO: 1106053 - RNA, 19 nt, Homo sapiens
cagcaucuaagaauucaua

SEQ ID NO: 1106054 - RNA, 19 nt, Homo sapiens
guggaaacuuuagaaauug

SEQ ID NO: 1106055 - RNA, 19 nt, Homo sapiens
caggugacauuuagugaug

SEQ ID NO: 1106056 - RNA, 19 nt, Homo sapiens
ugugagaaaucuuacagaa

SEQ ID NO: 1106057 - RNA, 19 nt, Homo sapiens
ugcuguagcucacaccuua

SEQ ID NO: 1106058 - RNA, 19 nt, Homo sapiens
cagaggagccaguaaaugu

SEQ ID NO: 1106059 - RNA, 19 nt, Homo sapiens
ggucgucccugcuucaaca

SEQ ID NO: 1106060 - RNA, 19 nt, Homo sapiens
cgacaucagauaagccaua

SEQ ID NO: 1106061 - RNA, 19 nt, Homo sapiens
cuauagacuucucucauga

SEQ ID NO: 1106062 - RNA, 19 nt, Homo sapiens
gagagaaaaucuauacaug

SEQ ID NO: 1106063 - RNA, 19 nt, Homo sapiens
uaacuaagccauaugugau

SEQ ID NO: 1106064 - RNA, 19 nt, Homo sapiens
gagagcaaauaaacauaag

SEQ ID NO: 1106065 - RNA, 19 nt, Homo sapiens
gccuuuagaucauaugaau

SEQ ID NO: 1106066 - RNA, 19 nt, Homo sapiens
gaauguggaaacuuuagaa

SEQ ID NO: 1106067 - RNA, 19 nt, Homo sapiens
gauugaaacccuacgaaug

SEQ ID NO: 1106068 - RNA, 19 nt, Homo sapiens
caggagagaagcccuauga

SEQ ID NO: 1106069 - RNA, 19 nt, Homo sapiens
guuuagaaaugcaggaaau

SEQ ID NO: 1106070 - RNA, 19 nt, Homo sapiens
gagugggcaugccuagauu

SEQ ID NO: 1106071 - RNA, 19 nt, Homo sapiens
gaaucuuacugcccaucaa

SEQ ID NO: 1106072 - RNA, 19 nt, Homo sapiens
uuagugauguggcuauaga

SEQ ID NO: 1106073 - RNA, 19 nt, Homo sapiens
gaaauaaacuggagacaaa

SEQ ID NO: 1106074 - RNA, 19 nt, Homo sapiens
ggaaaggccuucauucaua

SEQ ID NO: 1106075 - RNA, 19 nt, Homo sapiens
caacaucacaguauucaua

SEQ ID NO: 1106076 - RNA, 19 nt, Homo sapiens
gcaguuaugcuauuuguaa

SEQ ID NO: 1106077 - RNA, 19 nt, Homo sapiens
gugcaucccuuauucuaua

SEQ ID NO: 1106078 - RNA, 19 nt, Homo sapiens
ggaauucacacaaauauga

SEQ ID NO: 1106079 - RNA, 19 nt, Homo sapiens
gagagaagccuuaugaaug

SEQ ID NO: 1106080 - RNA, 19 nt, Homo sapiens
gagagaaaccuuacaaaug

SEQ ID NO: 1106081 - RNA, 19 nt, Homo sapiens
gagaauaaaugguggaaag

SEQ ID NO: 1106082 - RNA, 19 nt, Homo sapiens
guaugaauguggaaacuuu

SEQ ID NO: 1106083 - RNA, 19 nt, Homo sapiens
gaagggaauucacacaaau

SEQ ID NO: 1106084 - RNA, 19 nt, Homo sapiens
gugcuuugcuuucuugaua

SEQ ID NO: 1106085 - RNA, 19 nt, Homo sapiens
gagagaagcccuaugaaug

SEQ ID NO: 1106086 - RNA, 19 nt, Homo sapiens
ggaaauugcagaauaaugu

SEQ ID NO: 1106087 - RNA, 19 nt, Homo sapiens
cauagauccucccuuauuu

SEQ ID NO: 1106088 - RNA, 19 nt, Homo sapiens
agcaaaggcucgaaucuua

SEQ ID NO: 1106089 - RNA, 19 nt, Homo sapiens
caacaucagaguauucaua

SEQ ID NO: 1106090 - RNA, 19 nt, Homo sapiens
gaaaggccuucauucauag

SEQ ID NO: 1106091 - RNA, 19 nt, Homo sapiens
guagagaaaucauaugaag

SEQ ID NO: 1106092 - RNA, 19 nt, Homo sapiens
cagcuugaaucacugaaua

SEQ ID NO: 1106093 - RNA, 19 nt, Homo sapiens
ggacacugcccaucucuaa

SEQ ID NO: 1106094 - RNA, 19 nt, Homo sapiens
gccaguaaauguuauaaug

SEQ ID NO: 1106095 - RNA, 19 nt, Homo sapiens
gaagagaagcaguguuuau

SEQ ID NO: 1106096 - RNA, 19 nt, Homo sapiens
uggauucucugcucuauuu

SEQ ID NO: 1106097 - RNA, 19 nt, Homo sapiens
gcuauagacuucucucaug

SEQ ID NO: 1106098 - RNA, 19 nt, Homo sapiens
ggagagcaaauaaacauaa

SEQ ID NO: 1106099 - RNA, 19 nt, Homo sapiens
gauccucccuuauuuaaca

SEQ ID NO: 1106100 - RNA, 19 nt, Homo sapiens
guacaucagagaauucaua

SEQ ID NO: 1106101 - RNA, 19 nt, Homo sapiens
gagagaaaccguaugaaug

SEQ ID NO: 1106102 - RNA, 19 nt, Homo sapiens
auucauagauccucccuua

SEQ ID NO: 1106103 - RNA, 19 nt, Homo sapiens
caucaaagaauucacagua

SEQ ID NO: 1106104 - RNA, 19 nt, Homo sapiens
gaagcaccuuucauucaaa

SEQ ID NO: 1106105 - RNA, 19 nt, Homo sapiens
acgguaaacuucauucaua

SEQ ID NO: 1106106 - RNA, 19 nt, Homo sapiens
gcucacaccuuacucaaca

SEQ ID NO: 1106107 - RNA, 19 nt, Homo sapiens
ggagagaaaccuuacaaau

SEQ ID NO: 1106108 - RNA, 19 nt, Homo sapiens
cauuggaaauugcagaaua

SEQ ID NO: 1106109 - RNA, 19 nt, Homo sapiens
gaaacccaauaguguggua

SEQ ID NO: 1106110 - RNA, 19 nt, Homo sapiens
gagagaaacccaauagugu

SEQ ID NO: 1106111 - RNA, 19 nt, Homo sapiens
agagaagccuuaugaaugu

SEQ ID NO: 1106112 - RNA, 19 nt, Homo sapiens
agagcaaccugaaggauuu

SEQ ID NO: 1106113 - RNA, 19 nt, Homo sapiens
ccaagugcaucccuuauuc

SEQ ID NO: 1106114 - RNA, 19 nt, Homo sapiens
ggagagaaacccaauagug

SEQ ID NO: 1106115 - RNA, 19 nt, Homo sapiens
guucaaaccuuacuguaca

SEQ ID NO: 1106116 - RNA, 19 nt, Homo sapiens
gaggagccaguaaauguua

SEQ ID NO: 1106117 - RNA, 19 nt, Homo sapiens
ggaaagacuauaggcaaua

SEQ ID NO: 1106118 - RNA, 19 nt, Homo sapiens
cagaagagaagcaguguuu

SEQ ID NO: 1106119 - RNA, 19 nt, Homo sapiens
caucaaagaguacauaaug

SEQ ID NO: 1106120 - RNA, 19 nt, Homo sapiens
ggagagaagccuuaugaau

SEQ ID NO: 1106121 - RNA, 19 nt, Homo sapiens
gagaaaccguaugaaugua

SEQ ID NO: 1106122 - RNA, 19 nt, Homo sapiens
ggagagaaaccguaugaau

SEQ ID NO: 1106123 - RNA, 19 nt, Homo sapiens
gcagugcuuugcuuucuug

SEQ ID NO: 1106124 - RNA, 19 nt, Homo sapiens
gaucauaugaaucccuaua

SEQ ID NO: 1106125 - RNA, 19 nt, Homo sapiens
ucaaagaauucacaguaug

SEQ ID NO: 1106126 - RNA, 19 nt, Homo sapiens
gcucaucacuuacuaacca

SEQ ID NO: 1106127 - RNA, 19 nt, Homo sapiens
agagaaaccuuacaaaugc

SEQ ID NO: 1106128 - RNA, 19 nt, Homo sapiens
gcaaaugugggaaagacua

SEQ ID NO: 1106129 - RNA, 19 nt, Homo sapiens
caaagaauucacaguauga

SEQ ID NO: 1106130 - RNA, 19 nt, Homo sapiens
gucaaaagcuuacccauuu

SEQ ID NO: 1106131 - RNA, 19 nt, Homo sapiens
gagaaaaguuguaugaaug

SEQ ID NO: 1106132 - RNA, 19 nt, Homo sapiens
uuuaguagcuucucauuuc

SEQ ID NO: 1106133 - RNA, 19 nt, Homo sapiens
gaaaccguaugaauguaug

SEQ ID NO: 1106134 - RNA, 19 nt, Homo sapiens
ggagagaagcccuaugaau

SEQ ID NO: 1106135 - RNA, 19 nt, Homo sapiens
cauaagaagaugaauggua

SEQ ID NO: 1106136 - RNA, 19 nt, Homo sapiens
ggaaauaaacuggagacaa

SEQ ID NO: 1106137 - RNA, 19 nt, Homo sapiens
ggagaaaaguuguaugaau

SEQ ID NO: 1106138 - RNA, 19 nt, Homo sapiens
ccaauagugugguaagugu

SEQ ID NO: 1106139 - RNA, 19 nt, Homo sapiens
gggaaagacuauaggcaau

SEQ ID NO: 1106140 - RNA, 19 nt, Homo sapiens
ccauauaaauguagugagu

SEQ ID NO: 1106141 - RNA, 19 nt, Homo sapiens
gagaaaagccauauaaaug

SEQ ID NO: 1106142 - RNA, 19 nt, Homo sapiens
guaacuaagccauauguga

SEQ ID NO: 1106143 - RNA, 19 nt, Homo sapiens
gagaauucauacuggagaa

SEQ ID NO: 1106144 - RNA, 19 nt, Homo sapiens
acaaaugucucaaggucuu

SEQ ID NO: 1106145 - RNA, 19 nt, Homo sapiens
gaauaaaugguggaaagaa

SEQ ID NO: 1106146 - RNA, 19 nt, Homo sapiens
guaugaagguggugaacau

SEQ ID NO: 1106147 - RNA, 19 nt, Homo sapiens
agaagcaccuuucauucaa

SEQ ID NO: 1106148 - RNA, 19 nt, Homo sapiens
ggaauuaucaacaaagaag

SEQ ID NO: 1106149 - RNA, 19 nt, Homo sapiens
gggcaugugaagauauuua

SEQ ID NO: 1106150 - RNA, 19 nt, Homo sapiens
gcaguagcuugcaguuuca

SEQ ID NO: 1106151 - RNA, 19 nt, Homo sapiens
ucauagauccucccuuauu

SEQ ID NO: 1106152 - RNA, 19 nt, Homo sapiens
gagaaugugggaaagcuuu

SEQ ID NO: 1106153 - RNA, 19 nt, Homo sapiens
gagaagccuuaugaaugua

SEQ ID NO: 1106154 - RNA, 19 nt, Homo sapiens
cagcaucuaagaauucaua

SEQ ID NO: 1106155 - RNA, 19 nt, Homo sapiens
guggaaacuuuagaaauug

SEQ ID NO: 1106156 - RNA, 19 nt, Homo sapiens
ugugagaaaucuuacagaa

SEQ ID NO: 1106157 - RNA, 19 nt, Homo sapiens
ugcuguagcucacaccuua

SEQ ID NO: 1106158 - RNA, 19 nt, Homo sapiens
caggugacauuuagugaug

SEQ ID NO: 1106159 - RNA, 19 nt, Homo sapiens
gcuuugcuuucuugauaua

SEQ ID NO: 1106160 - RNA, 19 nt, Homo sapiens
cagaggagccaguaaaugu

SEQ ID NO: 1106161 - RNA, 19 nt, Homo sapiens
gugcaaccuugaacaaaug

SEQ ID NO: 1106162 - RNA, 19 nt, Homo sapiens
ggucgucccugcuucaaca

SEQ ID NO: 1106163 - RNA, 19 nt, Homo sapiens
cuauagacuucucucauga

SEQ ID NO: 1106164 - RNA, 19 nt, Homo sapiens
cgacaucagauaagccaua

SEQ ID NO: 1106165 - RNA, 19 nt, Homo sapiens
gagagaaaaucuauacaug

SEQ ID NO: 1106166 - RNA, 19 nt, Homo sapiens
uaacuaagccauaugugau

SEQ ID NO: 1106167 - RNA, 19 nt, Homo sapiens
gagagcaaauaaacauaag

SEQ ID NO: 1106168 - RNA, 19 nt, Homo sapiens
gccuuuagaucauaugaau

SEQ ID NO: 1106169 - RNA, 19 nt, Homo sapiens
gaauguggaaacuuuagaa

SEQ ID NO: 1106170 - RNA, 19 nt, Homo sapiens
gauugaaacccuacgaaug

SEQ ID NO: 1106171 - RNA, 19 nt, Homo sapiens
caggagagaagcccuauga

SEQ ID NO: 1106172 - RNA, 19 nt, Homo sapiens
guuuagaaaugcaggaaau

SEQ ID NO: 1106173 - RNA, 19 nt, Homo sapiens
ggaagaagcugcagcaaac

SEQ ID NO: 1106174 - RNA, 19 nt, Homo sapiens
ggagagaggaggacaauuu

SEQ ID NO: 1106175 - RNA, 19 nt, Homo sapiens
gcaaacaaguuccggauca

SEQ ID NO: 1106176 - RNA, 19 nt, Homo sapiens
gaagaggaccauucacuug

SEQ ID NO: 1106177 - RNA, 19 nt, Homo sapiens
ccaaguaccuccugaccaa

SEQ ID NO: 1106178 - RNA, 19 nt, Homo sapiens
ggacagcgaguuuccauga

SEQ ID NO: 1106179 - RNA, 19 nt, Homo sapiens
uggagaagcuggugaucua

SEQ ID NO: 1106180 - RNA, 19 nt, Homo sapiens
ugaaaccaauguugaaaga

SEQ ID NO: 1106181 - RNA, 19 nt, Homo sapiens
gaaugaaaccaauguugaa

SEQ ID NO: 1106182 - RNA, 19 nt, Homo sapiens
caaggaggcuggugacuac

SEQ ID NO: 1106183 - RNA, 19 nt, Homo sapiens
uggagaagcugaauaucuu

SEQ ID NO: 1106184 - RNA, 19 nt, Homo sapiens
gauacaaacuggugauggu

SEQ ID NO: 1106185 - RNA, 19 nt, Homo sapiens
ggaaauaagaaccagcaaa

SEQ ID NO: 1106186 - RNA, 19 nt, Homo sapiens
ccagggaacacuaaaguuu

SEQ ID NO: 1106187 - RNA, 19 nt, Homo sapiens
gaagaauaaguacugcuuu

SEQ ID NO: 1106188 - RNA, 19 nt, Homo sapiens
gaaauaagaaccagcaaaa

SEQ ID NO: 1106189 - RNA, 19 nt, Homo sapiens
gaaaggacaugaggagacu

SEQ ID NO: 1106190 - RNA, 19 nt, Homo sapiens
gcaggcagaggacagauuu

SEQ ID NO: 1106191 - RNA, 19 nt, Homo sapiens
ugacagacacugccauuga

SEQ ID NO: 1106192 - RNA, 19 nt, Homo sapiens
caaaguguaucacgugucu

SEQ ID NO: 1106193 - RNA, 19 nt, Homo sapiens
caacaccaaucagacugua

SEQ ID NO: 1106194 - RNA, 19 nt, Homo sapiens
gacggaaacuaccaaagug

SEQ ID NO: 1106195 - RNA, 19 nt, Homo sapiens
ggaagaggaccauucacuu

SEQ ID NO: 1106196 - RNA, 19 nt, Homo sapiens
gaggaugaaaccacaagua

SEQ ID NO: 1106197 - RNA, 19 nt, Homo sapiens
ccaacaacaucgugacugu

SEQ ID NO: 1106198 - RNA, 19 nt, Homo sapiens
gacaugaggagacuaaaga

SEQ ID NO: 1106199 - RNA, 19 nt, Homo sapiens
gauaaucccaccucuguuc

SEQ ID NO: 1106200 - RNA, 19 nt, Homo sapiens
ggaagaauaaguacugcuu

SEQ ID NO: 1106201 - RNA, 19 nt, Homo sapiens
gacagacacugccauugau

SEQ ID NO: 1106202 - RNA, 19 nt, Homo sapiens
uaaacccucucccuaaauc

SEQ ID NO: 1106203 - RNA, 19 nt, Homo sapiens
ccagugaaguccaacaaca

SEQ ID NO: 1106204 - RNA, 19 nt, Homo sapiens
ggaggagugugcugcuuuc

SEQ ID NO: 1106205 - RNA, 19 nt, Homo sapiens
aagaauaaguacugcuuug

SEQ ID NO: 1106206 - RNA, 19 nt, Homo sapiens
gaguuugccuucuaugaca

SEQ ID NO: 1106207 - RNA, 19 nt, Homo sapiens
cauuaaacccucucccuaa

SEQ ID NO: 1106208 - RNA, 19 nt, Homo sapiens
gacagaaugugaggaggaa

SEQ ID NO: 1106209 - RNA, 19 nt, Homo sapiens
ggaaacuaccaaaguguau

SEQ ID NO: 1106210 - RNA, 19 nt, Homo sapiens
ggaauggccugucuuucac

SEQ ID NO: 1106211 - RNA, 19 nt, Homo sapiens
gagagagccaggccaugua

SEQ ID NO: 1106212 - RNA, 19 nt, Homo sapiens
acaagagugucucaaggaa

SEQ ID NO: 1106213 - RNA, 19 nt, Homo sapiens
gaggagugcaugcuaauuc

SEQ ID NO: 1106214 - RNA, 19 nt, Homo sapiens
cacaaugacuccagaagca

SEQ ID NO: 1106215 - RNA, 19 nt, Homo sapiens
caaacaaguuccggaucaa

SEQ ID NO: 1106216 - RNA, 19 nt, Homo sapiens
agaaaggucugacggaaac

SEQ ID NO: 1106217 - RNA, 19 nt, Homo sapiens
gcaguuaaaggagaugaaa

SEQ ID NO: 1106218 - RNA, 19 nt, Homo sapiens
gguauauccuugugcuugu

SEQ ID NO: 1106219 - RNA, 19 nt, Homo sapiens
ucagagaaauacagaaacu

SEQ ID NO: 1106220 - RNA, 19 nt, Homo sapiens
gacuacugguucacaauga

SEQ ID NO: 1106221 - RNA, 19 nt, Homo sapiens
cugaauaucuucucuugag

SEQ ID NO: 1106222 - RNA, 19 nt, Homo sapiens
gguacucugugacuauguu

SEQ ID NO: 1106223 - RNA, 19 nt, Homo sapiens
ggucaaaugaagaggauga

SEQ ID NO: 1106224 - RNA, 19 nt, Homo sapiens
agaaugaaaccaauguuga

SEQ ID NO: 1106225 - RNA, 19 nt, Homo sapiens
gcaugcuaauucagagaaa

SEQ ID NO: 1106226 - RNA, 19 nt, Homo sapiens
gacuaaagaccugggauuu

SEQ ID NO: 1106227 - RNA, 19 nt, Homo sapiens
cacguugacuugaauagga

SEQ ID NO: 1106228 - RNA, 19 nt, Homo sapiens
caagugggccuauuuacca

SEQ ID NO: 1106229 - RNA, 19 nt, Homo sapiens
gacagcgaguuuccaugaa

SEQ ID NO: 1106230 - RNA, 19 nt, Homo sapiens
guccaacgcccagaagaua

SEQ ID NO: 1106231 - RNA, 19 nt, Homo sapiens
aaggaggagugcaugcuaa

SEQ ID NO: 1106232 - RNA, 19 nt, Homo sapiens
gcccagaaauuuggauaca

SEQ ID NO: 1106233 - RNA, 19 nt, Homo sapiens
gcaagaagaaauucaagac

SEQ ID NO: 1106234 - RNA, 19 nt, Homo sapiens
caaccacugugcccguuuc

SEQ ID NO: 1106235 - RNA, 19 nt, Homo sapiens
gccaggccauguagcacua

SEQ ID NO: 1106236 - RNA, 19 nt, Homo sapiens
aaaccaauguugaaagacu

SEQ ID NO: 1106237 - RNA, 19 nt, Homo sapiens
ccagcgcucccuuagauuu

SEQ ID NO: 1106238 - RNA, 19 nt, Homo sapiens
agagaaauacagaaacuug

SEQ ID NO: 1106239 - RNA, 19 nt, Homo sapiens
auuaaacccucucccuaaa

SEQ ID NO: 1106240 - RNA, 19 nt, Homo sapiens
ucaggccaguugugccaua

SEQ ID NO: 1106241 - RNA, 19 nt, Homo sapiens
cagaaugaaaccaauguug

SEQ ID NO: 1106242 - RNA, 19 nt, Homo sapiens
cuaaagaccugggauuuug

SEQ ID NO: 1106243 - RNA, 19 nt, Homo sapiens
ugacggaaacuaccaaagu

SEQ ID NO: 1106244 - RNA, 19 nt, Homo sapiens
agggaacacuaaaguuuga

SEQ ID NO: 1106245 - RNA, 19 nt, Homo sapiens
ccaaucagacuguaacuac

SEQ ID NO: 1106246 - RNA, 19 nt, Homo sapiens
gaauucacaaggaagaaau

SEQ ID NO: 1106247 - RNA, 19 nt, Homo sapiens
gaacccgugguccauuaaa

SEQ ID NO: 1106248 - RNA, 19 nt, Homo sapiens
ggaaagcccggaagaagcu

SEQ ID NO: 1106249 - RNA, 19 nt, Homo sapiens
ggacaugaggagacuaaag

SEQ ID NO: 1106250 - RNA, 19 nt, Homo sapiens
uggaauggccugucuuuca

SEQ ID NO: 1106251 - RNA, 19 nt, Homo sapiens
gguggaauggccugucuuu

SEQ ID NO: 1106252 - RNA, 19 nt, Homo sapiens
ggaucaccaggcaggauua

SEQ ID NO: 1106253 - RNA, 19 nt, Homo sapiens
caagaagaaauucaagaca

SEQ ID NO: 1106254 - RNA, 19 nt, Homo sapiens
gacuguaacuaccaaguac

SEQ ID NO: 1106255 - RNA, 19 nt, Homo sapiens
ggaggaaguaacacacaga

SEQ ID NO: 1106256 - RNA, 19 nt, Homo sapiens
gagaagcuggugaucuaga

SEQ ID NO: 1106257 - RNA, 19 nt, Homo sapiens
ucaaggaggcuggugacua

SEQ ID NO: 1106258 - RNA, 19 nt, Homo sapiens
caaaugaagaggaugaaac

SEQ ID NO: 1106259 - RNA, 19 nt, Homo sapiens
cggaagaagcugcagcaaa

SEQ ID NO: 1106260 - RNA, 19 nt, Homo sapiens
aagauaaucccaccucugu

SEQ ID NO: 1106261 - RNA, 19 nt, Homo sapiens
gacacaggcaucccucuga

SEQ ID NO: 1106262 - RNA, 19 nt, Homo sapiens
ucacugguauauccuugug

SEQ ID NO: 1106263 - RNA, 19 nt, Homo sapiens
caaucagaaugaaaccaau

SEQ ID NO: 1106264 - RNA, 19 nt, Homo sapiens
gcuggugacuacugguuca

SEQ ID NO: 1106265 - RNA, 19 nt, Homo sapiens
uuugagugcuucuauuuca

SEQ ID NO: 1106266 - RNA, 19 nt, Homo sapiens
agacuguaacuaccaagua

SEQ ID NO: 1106267 - RNA, 19 nt, Homo sapiens
ggaacccgugguccauuaa

SEQ ID NO: 1106268 - RNA, 19 nt, Homo sapiens
cggaaacuaccaaagugua

SEQ ID NO: 1106269 - RNA, 19 nt, Homo sapiens
gaugaaaccacaaguacac

SEQ ID NO: 1106270 - RNA, 19 nt, Homo sapiens
ggaugaaaccacaaguaca

SEQ ID NO: 1106271 - RNA, 19 nt, Homo sapiens
ccauggagccaguguagug

SEQ ID NO: 1106272 - RNA, 19 nt, Homo sapiens
gaggcaagaagaaauucaa

SEQ ID NO: 1106273 - RNA, 19 nt, Homo sapiens
ggagaaggguuucccagua

SEQ ID NO: 1106274 - RNA, 19 nt, Homo sapiens
gaacagaacccagcccaua

SEQ ID NO: 1106275 - RNA, 19 nt, Homo sapiens
gagaaggguuucccaguaa

SEQ ID NO: 1106276 - RNA, 19 nt, Homo sapiens
gaaguuuccuggauacuau

SEQ ID NO: 1106277 - RNA, 19 nt, Homo sapiens
gagacaaccuacuuuaaga

SEQ ID NO: 1106278 - RNA, 19 nt, Homo sapiens
gaacccagcccauaagaga

SEQ ID NO: 1106279 - RNA, 19 nt, Homo sapiens
uuaagaaguuuccuggaua

SEQ ID NO: 1106280 - RNA, 19 nt, Homo sapiens
gagaugagccugucaccaa

SEQ ID NO: 1106281 - RNA, 19 nt, Homo sapiens
gaauaaagccugugaucuc

SEQ ID NO: 1106282 - RNA, 19 nt, Homo sapiens
caaguuaaguguucaaagg

SEQ ID NO: 1106283 - RNA, 19 nt, Homo sapiens
gcaccuggcuugccuaaaa

SEQ ID NO: 1106284 - RNA, 19 nt, Homo sapiens
ccacaaccuucaaguaugu

SEQ ID NO: 1106285 - RNA, 19 nt, Homo sapiens
ucaagaagcagauuagaga

SEQ ID NO: 1106286 - RNA, 19 nt, Homo sapiens
ggaagauugcucagaauga

SEQ ID NO: 1106287 - RNA, 19 nt, Homo sapiens
ccacauauccggacgugaa

SEQ ID NO: 1106288 - RNA, 19 nt, Homo sapiens
gaucaucugcuucuuugaa

SEQ ID NO: 1106289 - RNA, 19 nt, Homo sapiens
ggaccaggauggcuauuac

SEQ ID NO: 1106290 - RNA, 19 nt, Homo sapiens
caacuuugaugugacuaaa

SEQ ID NO: 1106291 - RNA, 19 nt, Homo sapiens
uaugucagcucucuuagga

SEQ ID NO: 1106292 - RNA, 19 nt, Homo sapiens
gaacaugauccugaccuuu

SEQ ID NO: 1106293 - RNA, 19 nt, Homo sapiens
ccgaggagcucaagaagca

SEQ ID NO: 1106294 - RNA, 19 nt, Homo sapiens
gugaaugccucuacugcuu

SEQ ID NO: 1106295 - RNA, 19 nt, Homo sapiens
aauacaaggugaccaaguu

SEQ ID NO: 1106296 - RNA, 19 nt, Homo sapiens
ggagucagcacuuguggaa

SEQ ID NO: 1106297 - RNA, 19 nt, Homo sapiens
gaagauugcucagaaugac

SEQ ID NO: 1106298 - RNA, 19 nt, Homo sapiens
gaaugccucuacugcuuug

SEQ ID NO: 1106299 - RNA, 19 nt, Homo sapiens
guggacaccuucuggcaaa

SEQ ID NO: 1106300 - RNA, 19 nt, Homo sapiens
gcaugcacuugcccuuaaa

SEQ ID NO: 1106301 - RNA, 19 nt, Homo sapiens
gagcucaagaagcagauua

SEQ ID NO: 1106302 - RNA, 19 nt, Homo sapiens
gauuccagcugcagucuuc

SEQ ID NO: 1106303 - RNA, 19 nt, Homo sapiens
ccacucagaucacauacca

SEQ ID NO: 1106304 - RNA, 19 nt, Homo sapiens
gugaacggaucuuggauuc

SEQ ID NO: 1106305 - RNA, 19 nt, Homo sapiens
acaauguacuggaucgaaa

SEQ ID NO: 1106306 - RNA, 19 nt, Homo sapiens
gcagggaggcagcugugua

SEQ ID NO: 1106307 - RNA, 19 nt, Homo sapiens
aacaugauccugaccuuua

SEQ ID NO: 1106308 - RNA, 19 nt, Homo sapiens
gggaaaaucuucauugagu

SEQ ID NO: 1106309 - RNA, 19 nt, Homo sapiens
guuggaaggugaagcugaa

SEQ ID NO: 1106310 - RNA, 19 nt, Homo sapiens
gccacaaccuucaaguaug

SEQ ID NO: 1106311 - RNA, 19 nt, Homo sapiens
ggagaccacucagaucaca

SEQ ID NO: 1106312 - RNA, 19 nt, Homo sapiens
agagacagguggccacaug

SEQ ID NO: 1106313 - RNA, 19 nt, Homo sapiens
gaucacauaccaucagcuu

SEQ ID NO: 1106314 - RNA, 19 nt, Homo sapiens
guacaacuuugaugugacu

SEQ ID NO: 1106315 - RNA, 19 nt, Homo sapiens
aagguuaucugguguucaa

SEQ ID NO: 1106316 - RNA, 19 nt, Homo sapiens
ucagcaauguucuccgaaa

SEQ ID NO: 1106317 - RNA, 19 nt, Homo sapiens
ggaggcagcuguguaaucc

SEQ ID NO: 1106318 - RNA, 19 nt, Homo sapiens
uaagaaguuuccuggauac

SEQ ID NO: 1106319 - RNA, 19 nt, Homo sapiens
gcagaagugucaggagaag

SEQ ID NO: 1106320 - RNA, 19 nt, Homo sapiens
aauaaagccugugaucuca

SEQ ID NO: 1106321 - RNA, 19 nt, Homo sapiens
ugaaggaguaaauguguuu

SEQ ID NO: 1106322 - RNA, 19 nt, Homo sapiens
gaucaugcgcacagucuau

SEQ ID NO: 1106323 - RNA, 19 nt, Homo sapiens
gcuuugcacuccauugugu

SEQ ID NO: 1106324 - RNA, 19 nt, Homo sapiens
gaaaacagggcauucagaa

SEQ ID NO: 1106325 - RNA, 19 nt, Homo sapiens
caacuaccaacaucugcua

SEQ ID NO: 1106326 - RNA, 19 nt, Homo sapiens
gagacaacauccugugacu

SEQ ID NO: 1106327 - RNA, 19 nt, Homo sapiens
gggagacauugccaaggaa

SEQ ID NO: 1106328 - RNA, 19 nt, Homo sapiens
uuuccuggauacuauguua

SEQ ID NO: 1106329 - RNA, 19 nt, Homo sapiens
gagccugucaccaagcaua

SEQ ID NO: 1106330 - RNA, 19 nt, Homo sapiens
gcagucuucucaucacuac

SEQ ID NO: 1106331 - RNA, 19 nt, Homo sapiens
agacauugccaaggaauuu

SEQ ID NO: 1106332 - RNA, 19 nt, Homo sapiens
gaguaaauguguuuuguuc

SEQ ID NO: 1106333 - RNA, 19 nt, Homo sapiens
gaccauccagugaacauga

SEQ ID NO: 1106334 - RNA, 19 nt, Homo sapiens
cagcacuuguggaacauga

SEQ ID NO: 1106335 - RNA, 19 nt, Homo sapiens
gagguggagucagcacuug

SEQ ID NO: 1106336 - RNA, 19 nt, Homo sapiens
ggaauaaagccugugaucu

SEQ ID NO: 1106337 - RNA, 19 nt, Homo sapiens
ugaugugacuaaagggaaa

SEQ ID NO: 1106338 - RNA, 19 nt, Homo sapiens
ugucaucagucaccucuuc

SEQ ID NO: 1106339 - RNA, 19 nt, Homo sapiens
gggcauccuugcagguguu

SEQ ID NO: 1106340 - RNA, 19 nt, Homo sapiens
ugacuuccaugcagaggau

SEQ ID NO: 1106341 - RNA, 19 nt, Homo sapiens
gaucgaaauguccaugaga

SEQ ID NO: 1106342 - RNA, 19 nt, Homo sapiens
ucuaggaacuugacgugau

SEQ ID NO: 1106343 - RNA, 19 nt, Homo sapiens
ccaggaacaauuuacuauu

SEQ ID NO: 1106344 - RNA, 19 nt, Homo sapiens
cagggaggcagcuguguaa

SEQ ID NO: 1106345 - RNA, 19 nt, Homo sapiens
cuacccaaguuaaguguuc

SEQ ID NO: 1106346 - RNA, 19 nt, Homo sapiens
gaaaagauuggccccauug

SEQ ID NO: 1106347 - RNA, 19 nt, Homo sapiens
gaaggguuucccaguaaga

SEQ ID NO: 1106348 - RNA, 19 nt, Homo sapiens
cuaggaacuugacgugaug

SEQ ID NO: 1106349 - RNA, 19 nt, Homo sapiens
gcucaagcccugugguugu

SEQ ID NO: 1106350 - RNA, 19 nt, Homo sapiens
gugaguccaggaacaauuu

SEQ ID NO: 1106351 - RNA, 19 nt, Homo sapiens
aggcagcuguguaauccua

SEQ ID NO: 1106352 - RNA, 19 nt, Homo sapiens
gggaccaggauggcuauua

SEQ ID NO: 1106353 - RNA, 19 nt, Homo sapiens
uuuaagaaguuuccuggau

SEQ ID NO: 1106354 - RNA, 19 nt, Homo sapiens
aaggugaagcugaagguua

SEQ ID NO: 1106355 - RNA, 19 nt, Homo sapiens
accaacaucugcuacaaug

SEQ ID NO: 1106356 - RNA, 19 nt, Homo sapiens
gagcaacuaccaacaucug

SEQ ID NO: 1106357 - RNA, 19 nt, Homo sapiens
gcagcuguguaauccuaug

SEQ ID NO: 1106358 - RNA, 19 nt, Homo sapiens
cagacuacauccagaaugc

SEQ ID NO: 1106359 - RNA, 19 nt, Homo sapiens
agucagcacuuguggaaca

SEQ ID NO: 1106360 - RNA, 19 nt, Homo sapiens
ggaucgaaauguccaugag

SEQ ID NO: 1106361 - RNA, 19 nt, Homo sapiens
ugagacaaccuacuuuaag

SEQ ID NO: 1106362 - RNA, 19 nt, Homo sapiens
cacgaacgcuuugagacaa

SEQ ID NO: 1106363 - RNA, 19 nt, Homo sapiens
ccacgaacgcuuugagaca

SEQ ID NO: 1106364 - RNA, 19 nt, Homo sapiens
aggugaagcugaagguuau

SEQ ID NO: 1106365 - RNA, 19 nt, Homo sapiens
cgguacaacuuugauguga

SEQ ID NO: 1106366 - RNA, 19 nt, Homo sapiens
cagcugcagucuucucauc

SEQ ID NO: 1106367 - RNA, 19 nt, Homo sapiens
agaccacucagaucacaua

SEQ ID NO: 1106368 - RNA, 19 nt, Homo sapiens
guaggaauaaagccuguga

SEQ ID NO: 1106369 - RNA, 19 nt, Homo sapiens
gcuguguaauccuauguca

SEQ ID NO: 1106370 - RNA, 19 nt, Homo sapiens
cuggaucacuggcaggauu

SEQ ID NO: 1106371 - RNA, 19 nt, Homo sapiens
gggaaaagcuugugaaccu

SEQ ID NO: 1106372 - RNA, 19 nt, Homo sapiens
cuaccaacaucugcuacaa

SEQ ID NO: 1106373 - RNA, 19 nt, Homo sapiens
ggagaaggguuucccagua

SEQ ID NO: 1106374 - RNA, 19 nt, Homo sapiens
gaacagaacccagcccaua

SEQ ID NO: 1106375 - RNA, 19 nt, Homo sapiens
gagaaggguuucccaguaa

SEQ ID NO: 1106376 - RNA, 19 nt, Homo sapiens
gaaguuuccuggauacuau

SEQ ID NO: 1106377 - RNA, 19 nt, Homo sapiens
gagacaaccuacuuuaaga

SEQ ID NO: 1106378 - RNA, 19 nt, Homo sapiens
gaacccagcccauaagaga

SEQ ID NO: 1106379 - RNA, 19 nt, Homo sapiens
uuaagaaguuuccuggaua

SEQ ID NO: 1106380 - RNA, 19 nt, Homo sapiens
gagaugagccugucaccaa

SEQ ID NO: 1106381 - RNA, 19 nt, Homo sapiens
gaauaaagccugugaucuc

SEQ ID NO: 1106382 - RNA, 19 nt, Homo sapiens
caaguuaaguguucaaagg

SEQ ID NO: 1106383 - RNA, 19 nt, Homo sapiens
gcaccuggcuugccuaaaa

SEQ ID NO: 1106384 - RNA, 19 nt, Homo sapiens
ccacaaccuucaaguaugu

SEQ ID NO: 1106385 - RNA, 19 nt, Homo sapiens
ucaagaagcagauuagaga

SEQ ID NO: 1106386 - RNA, 19 nt, Homo sapiens
ggaagauugcucagaauga

SEQ ID NO: 1106387 - RNA, 19 nt, Homo sapiens
ccacauauccggacgugaa

SEQ ID NO: 1106388 - RNA, 19 nt, Homo sapiens
gaucaucugcuucuuugaa

SEQ ID NO: 1106389 - RNA, 19 nt, Homo sapiens
ggaccaggauggcuauuac

SEQ ID NO: 1106390 - RNA, 19 nt, Homo sapiens
caacuuugaugugacuaaa

SEQ ID NO: 1106391 - RNA, 19 nt, Homo sapiens
uaugucagcucucuuagga

SEQ ID NO: 1106392 - RNA, 19 nt, Homo sapiens
gaacaugauccugaccuuu

SEQ ID NO: 1106393 - RNA, 19 nt, Homo sapiens
ccgaggagcucaagaagca

SEQ ID NO: 1106394 - RNA, 19 nt, Homo sapiens
gugaaugccucuacugcuu

SEQ ID NO: 1106395 - RNA, 19 nt, Homo sapiens
aauacaaggugaccaaguu

SEQ ID NO: 1106396 - RNA, 19 nt, Homo sapiens
ggagucagcacuuguggaa

SEQ ID NO: 1106397 - RNA, 19 nt, Homo sapiens
gaagauugcucagaaugac

SEQ ID NO: 1106398 - RNA, 19 nt, Homo sapiens
gaaugccucuacugcuuug

SEQ ID NO: 1106399 - RNA, 19 nt, Homo sapiens
guggacaccuucuggcaaa

SEQ ID NO: 1106400 - RNA, 19 nt, Homo sapiens
gcaugcacuugcccuuaaa

SEQ ID NO: 1106401 - RNA, 19 nt, Homo sapiens
gagcucaagaagcagauua

SEQ ID NO: 1106402 - RNA, 19 nt, Homo sapiens
gauuccagcugcagucuuc

SEQ ID NO: 1106403 - RNA, 19 nt, Homo sapiens
ccacucagaucacauacca

SEQ ID NO: 1106404 - RNA, 19 nt, Homo sapiens
gugaacggaucuuggauuc

SEQ ID NO: 1106405 - RNA, 19 nt, Homo sapiens
acaauguacuggaucgaaa

SEQ ID NO: 1106406 - RNA, 19 nt, Homo sapiens
gcagggaggcagcugugua

SEQ ID NO: 1106407 - RNA, 19 nt, Homo sapiens
aacaugauccugaccuuua

SEQ ID NO: 1106408 - RNA, 19 nt, Homo sapiens
gggaaaaucuucauugagu

SEQ ID NO: 1106409 - RNA, 19 nt, Homo sapiens
cagccagucugugaaauga

SEQ ID NO: 1106410 - RNA, 19 nt, Homo sapiens
guuggaaggugaagcugaa

SEQ ID NO: 1106411 - RNA, 19 nt, Homo sapiens
gccacaaccuucaaguaug

SEQ ID NO: 1106412 - RNA, 19 nt, Homo sapiens
ggagaccacucagaucaca

SEQ ID NO: 1106413 - RNA, 19 nt, Homo sapiens
agagacagguggccacaug

SEQ ID NO: 1106414 - RNA, 19 nt, Homo sapiens
gaucacauaccaucagcuu

SEQ ID NO: 1106415 - RNA, 19 nt, Homo sapiens
guacaacuuugaugugacu

SEQ ID NO: 1106416 - RNA, 19 nt, Homo sapiens
aagguuaucugguguucaa

SEQ ID NO: 1106417 - RNA, 19 nt, Homo sapiens
ucagcaauguucuccgaaa

SEQ ID NO: 1106418 - RNA, 19 nt, Homo sapiens
ggaggcagcuguguaaucc

SEQ ID NO: 1106419 - RNA, 19 nt, Homo sapiens
uaagaaguuuccuggauac

SEQ ID NO: 1106420 - RNA, 19 nt, Homo sapiens
gcagaagugucaggagaag

SEQ ID NO: 1106421 - RNA, 19 nt, Homo sapiens
aauaaagccugugaucuca

SEQ ID NO: 1106422 - RNA, 19 nt, Homo sapiens
ugaaggaguaaauguguuu

SEQ ID NO: 1106423 - RNA, 19 nt, Homo sapiens
gaucaugcgcacagucuau

SEQ ID NO: 1106424 - RNA, 19 nt, Homo sapiens
gccagucugugaaaugaug

SEQ ID NO: 1106425 - RNA, 19 nt, Homo sapiens
gcuuugcacuccauugugu

SEQ ID NO: 1106426 - RNA, 19 nt, Homo sapiens
gaaaacagggcauucagaa

SEQ ID NO: 1106427 - RNA, 19 nt, Homo sapiens
caacuaccaacaucugcua

SEQ ID NO: 1106428 - RNA, 19 nt, Homo sapiens
gggagacauugccaaggaa

SEQ ID NO: 1106429 - RNA, 19 nt, Homo sapiens
gagacaacauccugugacu

SEQ ID NO: 1106430 - RNA, 19 nt, Homo sapiens
uuuccuggauacuauguua

SEQ ID NO: 1106431 - RNA, 19 nt, Homo sapiens
gagccugucaccaagcaua

SEQ ID NO: 1106432 - RNA, 19 nt, Homo sapiens
gcagucuucucaucacuac

SEQ ID NO: 1106433 - RNA, 19 nt, Homo sapiens
agacauugccaaggaauuu

SEQ ID NO: 1106434 - RNA, 19 nt, Homo sapiens
gaguaaauguguuuuguuc

SEQ ID NO: 1106435 - RNA, 19 nt, Homo sapiens
gaccauccagugaacauga

SEQ ID NO: 1106436 - RNA, 19 nt, Homo sapiens
cagcacuuguggaacauga

SEQ ID NO: 1106437 - RNA, 19 nt, Homo sapiens
gagguggagucagcacuug

SEQ ID NO: 1106438 - RNA, 19 nt, Homo sapiens
ggaauaaagccugugaucu

SEQ ID NO: 1106439 - RNA, 19 nt, Homo sapiens
ugaugugacuaaagggaaa

SEQ ID NO: 1106440 - RNA, 19 nt, Homo sapiens
ugucaucagucaccucuuc

SEQ ID NO: 1106441 - RNA, 19 nt, Homo sapiens
gggcauccuugcagguguu

SEQ ID NO: 1106442 - RNA, 19 nt, Homo sapiens
ugacuuccaugcagaggau

SEQ ID NO: 1106443 - RNA, 19 nt, Homo sapiens
gaucgaaauguccaugaga

SEQ ID NO: 1106444 - RNA, 19 nt, Homo sapiens
gaggugggcacuucuuugu

SEQ ID NO: 1106445 - RNA, 19 nt, Homo sapiens
ccaggaacaauuuacuauu

SEQ ID NO: 1106446 - RNA, 19 nt, Homo sapiens
cagggaggcagcuguguaa

SEQ ID NO: 1106447 - RNA, 19 nt, Homo sapiens
cuacccaaguuaaguguuc

SEQ ID NO: 1106448 - RNA, 19 nt, Homo sapiens
gaaaagauuggccccauug

SEQ ID NO: 1106449 - RNA, 19 nt, Homo sapiens
gaaggguuucccaguaaga

SEQ ID NO: 1106450 - RNA, 19 nt, Homo sapiens
gcacuucuuuguggugagu

SEQ ID NO: 1106451 - RNA, 19 nt, Homo sapiens
gcucaagcccugugguugu

SEQ ID NO: 1106452 - RNA, 19 nt, Homo sapiens
gugaguccaggaacaauuu

SEQ ID NO: 1106453 - RNA, 19 nt, Homo sapiens
aggcagcuguguaauccua

SEQ ID NO: 1106454 - RNA, 19 nt, Homo sapiens
gggaccaggauggcuauua

SEQ ID NO: 1106455 - RNA, 19 nt, Homo sapiens
uuuaagaaguuuccuggau

SEQ ID NO: 1106456 - RNA, 19 nt, Homo sapiens
aaggugaagcugaagguua

SEQ ID NO: 1106457 - RNA, 19 nt, Homo sapiens
accaacaucugcuacaaug

SEQ ID NO: 1106458 - RNA, 19 nt, Homo sapiens
gcagcuguguaauccuaug

SEQ ID NO: 1106459 - RNA, 19 nt, Homo sapiens
cgguacaacuuugauguga

SEQ ID NO: 1106460 - RNA, 19 nt, Homo sapiens
gagcaacuaccaacaucug

SEQ ID NO: 1106461 - RNA, 19 nt, Homo sapiens
cagacuacauccagaaugc

SEQ ID NO: 1106462 - RNA, 19 nt, Homo sapiens
agucagcacuuguggaaca

SEQ ID NO: 1106463 - RNA, 19 nt, Homo sapiens
ugagacaaccuacuuuaag

SEQ ID NO: 1106464 - RNA, 19 nt, Homo sapiens
cacgaacgcuuugagacaa

SEQ ID NO: 1106465 - RNA, 19 nt, Homo sapiens
ccacgaacgcuuugagaca

SEQ ID NO: 1106466 - RNA, 19 nt, Homo sapiens
aggugaagcugaagguuau

SEQ ID NO: 1106467 - RNA, 19 nt, Homo sapiens
cagcugcagucuucucauc

SEQ ID NO: 1106468 - RNA, 19 nt, Homo sapiens
agaccacucagaucacaua

SEQ ID NO: 1106469 - RNA, 19 nt, Homo sapiens
ggaucgaaauguccaugag

SEQ ID NO: 1106470 - RNA, 19 nt, Homo sapiens
guaggaauaaagccuguga

SEQ ID NO: 1106471 - RNA, 19 nt, Homo sapiens
gcuguguaauccuauguca

SEQ ID NO: 1106472 - RNA, 19 nt, Homo sapiens
cuggaucacuggcaggauu

SEQ ID NO: 1106473 - RNA, 19 nt, Homo sapiens
ggaguuaacuucucaguga

SEQ ID NO: 1106474 - RNA, 19 nt, Homo sapiens
gaaacaagcucuggaagaa

SEQ ID NO: 1106475 - RNA, 19 nt, Homo sapiens
gaaauaccaugcacuuuga

SEQ ID NO: 1106476 - RNA, 19 nt, Homo sapiens
aagaauagcucugagauua

SEQ ID NO: 1106477 - RNA, 19 nt, Homo sapiens
gcauaggacuccauaguaa

SEQ ID NO: 1106478 - RNA, 19 nt, Homo sapiens
ggaaauggcugcagguuca

SEQ ID NO: 1106479 - RNA, 19 nt, Homo sapiens
gaaugcaucuuagguauaa

SEQ ID NO: 1106480 - RNA, 19 nt, Homo sapiens
cuacacaacucaauucuuu

SEQ ID NO: 1106481 - RNA, 19 nt, Homo sapiens
caaugggacuccacaguua

SEQ ID NO: 1106482 - RNA, 19 nt, Homo sapiens
gaacugaaauuacuauugc

SEQ ID NO: 1106483 - RNA, 19 nt, Homo sapiens
caagaaagauccagaaguc

SEQ ID NO: 1106484 - RNA, 19 nt, Homo sapiens
caaagaagcacuugguuaa

SEQ ID NO: 1106485 - RNA, 19 nt, Homo sapiens
caacauacagucaguuuaa

SEQ ID NO: 1106486 - RNA, 19 nt, Homo sapiens
gaugaaacuuguagaaaug

SEQ ID NO: 1106487 - RNA, 19 nt, Homo sapiens
guaaagagcccugacagua

SEQ ID NO: 1106488 - RNA, 19 nt, Homo sapiens
cugcaaacuuucagaauua

SEQ ID NO: 1106489 - RNA, 19 nt, Homo sapiens
ggaaauaccaugcacuuug

SEQ ID NO: 1106490 - RNA, 19 nt, Homo sapiens
gaaaagaaccuacugaaaa

SEQ ID NO: 1106491 - RNA, 19 nt, Homo sapiens
cacaucagcucaagccuua

SEQ ID NO: 1106492 - RNA, 19 nt, Homo sapiens
ucagaaaccuccacaccua

SEQ ID NO: 1106493 - RNA, 19 nt, Homo sapiens
gaauacagagggaaguuua

SEQ ID NO: 1106494 - RNA, 19 nt, Homo sapiens
guagagagccauauacaaa

SEQ ID NO: 1106495 - RNA, 19 nt, Homo sapiens
ggagaaagaacaacacauu

SEQ ID NO: 1106496 - RNA, 19 nt, Homo sapiens
ggaagacccugauccugaa

SEQ ID NO: 1106497 - RNA, 19 nt, Homo sapiens
agaaaggccucuacgcaua

SEQ ID NO: 1106498 - RNA, 19 nt, Homo sapiens
gcacuagcagaaauaauua

SEQ ID NO: 1106499 - RNA, 19 nt, Homo sapiens
ucaagaguuuccaaaguua

SEQ ID NO: 1106500 - RNA, 19 nt, Homo sapiens
guacauaugacaagucuuu

SEQ ID NO: 1106501 - RNA, 19 nt, Homo sapiens
aaacagagcuccaacaaaa

SEQ ID NO: 1106502 - RNA, 19 nt, Homo sapiens
ggacauggcucauuuuguu

SEQ ID NO: 1106503 - RNA, 19 nt, Homo sapiens
gagcuuuacuucucaguga

SEQ ID NO: 1106504 - RNA, 19 nt, Homo sapiens
ccagugcucuuucguugua

SEQ ID NO: 1106505 - RNA, 19 nt, Homo sapiens
ucagugaacuuauggaaga

SEQ ID NO: 1106506 - RNA, 19 nt, Homo sapiens
gcuguucccuuccagauuu

SEQ ID NO: 1106507 - RNA, 19 nt, Homo sapiens
aaaggaagaugacaagaga

SEQ ID NO: 1106508 - RNA, 19 nt, Homo sapiens
gaugaaacuuccagugcua

SEQ ID NO: 1106509 - RNA, 19 nt, Homo sapiens
ggcaacuucuggaacauua

SEQ ID NO: 1106510 - RNA, 19 nt, Homo sapiens
gaacugggucugcaagaaa

SEQ ID NO: 1106511 - RNA, 19 nt, Homo sapiens
ccaaagggaacugaaauua

SEQ ID NO: 1106512 - RNA, 19 nt, Homo sapiens
gcacaaagaauagcucuga

SEQ ID NO: 1106513 - RNA, 19 nt, Homo sapiens
acagagaacuuuccacuca

SEQ ID NO: 1106514 - RNA, 19 nt, Homo sapiens
ucagugaacuccaacuuga

SEQ ID NO: 1106515 - RNA, 19 nt, Homo sapiens
gaaaggccucuacgcauaa

SEQ ID NO: 1106516 - RNA, 19 nt, Homo sapiens
gaagaugacaagagaagaa

SEQ ID NO: 1106517 - RNA, 19 nt, Homo sapiens
gaagagcccagaaacuaaa

SEQ ID NO: 1106518 - RNA, 19 nt, Homo sapiens
aagcauggauggaucgaua

SEQ ID NO: 1106519 - RNA, 19 nt, Homo sapiens
gcaggcaacuucuggaaca

SEQ ID NO: 1106520 - RNA, 19 nt, Homo sapiens
caacaccagcuacaguuua

SEQ ID NO: 1106521 - RNA, 19 nt, Homo sapiens
auacacagauugucaguga

SEQ ID NO: 1106522 - RNA, 19 nt, Homo sapiens
guaaugaaguagaaaugga

SEQ ID NO: 1106523 - RNA, 19 nt, Homo sapiens
ggaaguuuaugcugagaga

SEQ ID NO: 1106524 - RNA, 19 nt, Homo sapiens
cuacaggccucaucauuca

SEQ ID NO: 1106525 - RNA, 19 nt, Homo sapiens
gagggaggcacaaagaaua

SEQ ID NO: 1106526 - RNA, 19 nt, Homo sapiens
gagaaagaacaacacauuu

SEQ ID NO: 1106527 - RNA, 19 nt, Homo sapiens
gcacuugguuaaugaaugg

SEQ ID NO: 1106528 - RNA, 19 nt, Homo sapiens
gaacaagucagagaaagga

SEQ ID NO: 1106529 - RNA, 19 nt, Homo sapiens
gaagaaugaaccagaaguu

SEQ ID NO: 1106530 - RNA, 19 nt, Homo sapiens
gaaauaaagagacgcacuu

SEQ ID NO: 1106531 - RNA, 19 nt, Homo sapiens
caauagaaccagaaacuga

SEQ ID NO: 1106532 - RNA, 19 nt, Homo sapiens
gcagaucugaugcugauuu

SEQ ID NO: 1106533 - RNA, 19 nt, Homo sapiens
ggaacauuauuuacacaga

SEQ ID NO: 1106534 - RNA, 19 nt, Homo sapiens
ccagauacuucucaaaaua

SEQ ID NO: 1106535 - RNA, 19 nt, Homo sapiens
ggacuguuaaugacaauuu

SEQ ID NO: 1106536 - RNA, 19 nt, Homo sapiens
gaagagaacaagcuuugga

SEQ ID NO: 1106537 - RNA, 19 nt, Homo sapiens
agaaaggaguuaucagaga

SEQ ID NO: 1106538 - RNA, 19 nt, Homo sapiens
uacagauccugaaguguua

SEQ ID NO: 1106539 - RNA, 19 nt, Homo sapiens
auaaauguccuaccaagua

SEQ ID NO: 1106540 - RNA, 19 nt, Homo sapiens
gcucugagauuaggcaaug

SEQ ID NO: 1106541 - RNA, 19 nt, Homo sapiens
ggguucagcuccagagauu

SEQ ID NO: 1106542 - RNA, 19 nt, Homo sapiens
caucaaggaccuccacuuu

SEQ ID NO: 1106543 - RNA, 19 nt, Homo sapiens
gguagucuuucucaacaaa

SEQ ID NO: 1106544 - RNA, 19 nt, Homo sapiens
ccacuacuauuaaaugaca

SEQ ID NO: 1106545 - RNA, 19 nt, Homo sapiens
ggaaccauacaucuuuaua

SEQ ID NO: 1106546 - RNA, 19 nt, Homo sapiens
gaaguuaugguacugaugu

SEQ ID NO: 1106547 - RNA, 19 nt, Homo sapiens
ggacagauuccaauucaca

SEQ ID NO: 1106548 - RNA, 19 nt, Homo sapiens
ugagaagaaugaaccagaa

SEQ ID NO: 1106549 - RNA, 19 nt, Homo sapiens
acaaagaagcacuugguua

SEQ ID NO: 1106550 - RNA, 19 nt, Homo sapiens
gaggauggaaguuauggua

SEQ ID NO: 1106551 - RNA, 19 nt, Homo sapiens
gaaaguaguacaguauaug

SEQ ID NO: 1106552 - RNA, 19 nt, Homo sapiens
cuacacaucauaccacuuu

SEQ ID NO: 1106553 - RNA, 19 nt, Homo sapiens
ggucgcauauucauucuca

SEQ ID NO: 1106554 - RNA, 19 nt, Homo sapiens
gcaacacucuguagcacau

SEQ ID NO: 1106555 - RNA, 19 nt, Homo sapiens
gcaacauacagucaguuua

SEQ ID NO: 1106556 - RNA, 19 nt, Homo sapiens
uagauucgguuuacucaga

SEQ ID NO: 1106557 - RNA, 19 nt, Homo sapiens
gaaaagagagagaaaagaa

SEQ ID NO: 1106558 - RNA, 19 nt, Homo sapiens
gcagauugcagaaaggaaa

SEQ ID NO: 1106559 - RNA, 19 nt, Homo sapiens
ggacugugcaugccucaaa

SEQ ID NO: 1106560 - RNA, 19 nt, Homo sapiens
ggaacugaaauuacuauug

SEQ ID NO: 1106561 - RNA, 19 nt, Homo sapiens
gcaaaacugugugaucuuu

SEQ ID NO: 1106562 - RNA, 19 nt, Homo sapiens
agaagcacuugguuaauga

SEQ ID NO: 1106563 - RNA, 19 nt, Homo sapiens
guaaagauacacagauugu

SEQ ID NO: 1106564 - RNA, 19 nt, Homo sapiens
cuaggaauuuggauaaaga

SEQ ID NO: 1106565 - RNA, 19 nt, Homo sapiens
gaugauggauacaugaucu

SEQ ID NO: 1106566 - RNA, 19 nt, Homo sapiens
gaaguaggcauauuuacca

SEQ ID NO: 1106567 - RNA, 19 nt, Homo sapiens
ucacaucauucacacaguu

SEQ ID NO: 1106568 - RNA, 19 nt, Homo sapiens
gugaaugcaucuuagguau

SEQ ID NO: 1106569 - RNA, 19 nt, Homo sapiens
cagcagagacgucauacuu

SEQ ID NO: 1106570 - RNA, 19 nt, Homo sapiens
caacuggacucgacucacu

SEQ ID NO: 1106571 - RNA, 19 nt, Homo sapiens
aaagggaacugaaauuacu

SEQ ID NO: 1106572 - RNA, 19 nt, Homo sapiens
gagauuaggcaauggaaau

SEQ ID NO: 1106573 - RNA, 19 nt, Homo sapiens
gagcuuccauuacauauua

SEQ ID NO: 1106574 - RNA, 19 nt, Homo sapiens
gaaacuuacuuccuuguau

SEQ ID NO: 1106575 - RNA, 19 nt, Homo sapiens
gaagaacuuugaucaggaa

SEQ ID NO: 1106576 - RNA, 19 nt, Homo sapiens
gaaacuugcuuuaggaaca

SEQ ID NO: 1106577 - RNA, 19 nt, Homo sapiens
gcaagugucuccuuuccuu

SEQ ID NO: 1106578 - RNA, 19 nt, Homo sapiens
uuacagagcuuccauuaca

SEQ ID NO: 1106579 - RNA, 19 nt, Homo sapiens
gagagaagcuauaggaaac

SEQ ID NO: 1106580 - RNA, 19 nt, Homo sapiens
gaacuuugaucaggaagga

SEQ ID NO: 1106581 - RNA, 19 nt, Homo sapiens
gcuuagagguguacgagaa

SEQ ID NO: 1106582 - RNA, 19 nt, Homo sapiens
gcagagagaagcuauagga

SEQ ID NO: 1106583 - RNA, 19 nt, Homo sapiens
guggaacacugcaaauuau

SEQ ID NO: 1106584 - RNA, 19 nt, Homo sapiens
ggacugaugugaguguaug

SEQ ID NO: 1106585 - RNA, 19 nt, Homo sapiens
gaaagugagauuuguuaug

SEQ ID NO: 1106586 - RNA, 19 nt, Homo sapiens
cagaaagugagauuuguua

SEQ ID NO: 1106587 - RNA, 19 nt, Homo sapiens
ggaggagggucagcuaaga

SEQ ID NO: 1106588 - RNA, 19 nt, Homo sapiens
ugaagcaagugucuccuuu

SEQ ID NO: 1106589 - RNA, 19 nt, Homo sapiens
ggauuaugauguugaugaa

SEQ ID NO: 1106590 - RNA, 19 nt, Homo sapiens
gcacggauaccaaaucugu

SEQ ID NO: 1106591 - RNA, 19 nt, Homo sapiens
gcacuucuuguauuucuaa

SEQ ID NO: 1106592 - RNA, 19 nt, Homo sapiens
gaagaggacaugaugaauc

SEQ ID NO: 1106593 - RNA, 19 nt, Homo sapiens
ggagggaaaucuggcgaaa

SEQ ID NO: 1106594 - RNA, 19 nt, Homo sapiens
gagccugccuacauucuug

SEQ ID NO: 1106595 - RNA, 19 nt, Homo sapiens
ccgagaaacuuacuuccuu

SEQ ID NO: 1106596 - RNA, 19 nt, Homo sapiens
ccaaauaccagaauuacau

SEQ ID NO: 1106597 - RNA, 19 nt, Homo sapiens
aggauaagguauaaccaua

SEQ ID NO: 1106598 - RNA, 19 nt, Homo sapiens
ggucaugaauagcacaaug

SEQ ID NO: 1106599 - RNA, 19 nt, Homo sapiens
gggacagggucacuucuga

SEQ ID NO: 1106600 - RNA, 19 nt, Homo sapiens
uggaagaaguucacucaga

SEQ ID NO: 1106601 - RNA, 19 nt, Homo sapiens
cuaauaagaugacuuucca

SEQ ID NO: 1106602 - RNA, 19 nt, Homo sapiens
uguggaacacugcaaauua

SEQ ID NO: 1106603 - RNA, 19 nt, Homo sapiens
ugccauggcugccguaaga

SEQ ID NO: 1106604 - RNA, 19 nt, Homo sapiens
gcuggaaacuugcuuuagg

SEQ ID NO: 1106605 - RNA, 19 nt, Homo sapiens
caacagaccugaaaaugag

SEQ ID NO: 1106606 - RNA, 19 nt, Homo sapiens
uggaaguguuucuggguua

SEQ ID NO: 1106607 - RNA, 19 nt, Homo sapiens
acacagggcccacuggaaa

SEQ ID NO: 1106608 - RNA, 19 nt, Homo sapiens
acacugguuucgacaugua

SEQ ID NO: 1106609 - RNA, 19 nt, Homo sapiens
uagauuaaacugagcauug

SEQ ID NO: 1106610 - RNA, 19 nt, Homo sapiens
cccaaggugugcagacuuu

SEQ ID NO: 1106611 - RNA, 19 nt, Homo sapiens
ggaaaucuggcgaaaccuu

SEQ ID NO: 1106612 - RNA, 19 nt, Homo sapiens
ugacacugguuucgacaug

SEQ ID NO: 1106613 - RNA, 19 nt, Homo sapiens
ggacucagcggauacuagu

SEQ ID NO: 1106614 - RNA, 19 nt, Homo sapiens
ggaacacugcaaauuauuc

SEQ ID NO: 1106615 - RNA, 19 nt, Homo sapiens
guuccaaauaccagaauua

SEQ ID NO: 1106616 - RNA, 19 nt, Homo sapiens
gcaccgagaaacuuacuuc

SEQ ID NO: 1106617 - RNA, 19 nt, Homo sapiens
gaugucauaugucucugau

SEQ ID NO: 1106618 - RNA, 19 nt, Homo sapiens
ggaguucauauuucacaaa

SEQ ID NO: 1106619 - RNA, 19 nt, Homo sapiens
uaaaagcuguugcuggaaa

SEQ ID NO: 1106620 - RNA, 19 nt, Homo sapiens
ggucccacguggcuacuug

SEQ ID NO: 1106621 - RNA, 19 nt, Homo sapiens
caaaaggcauauggguuua

SEQ ID NO: 1106622 - RNA, 19 nt, Homo sapiens
gcacagcacaucgcaagau

SEQ ID NO: 1106623 - RNA, 19 nt, Homo sapiens
agagagaagcuauaggaaa

SEQ ID NO: 1106624 - RNA, 19 nt, Homo sapiens
ugcuaucugucucauguua

SEQ ID NO: 1106625 - RNA, 19 nt, Homo sapiens
gcagaguccgugcuugcua

SEQ ID NO: 1106626 - RNA, 19 nt, Homo sapiens
cuaugacuccuguaccuua

SEQ ID NO: 1106627 - RNA, 19 nt, Homo sapiens
cagaguccgugcuugcuau

SEQ ID NO: 1106628 - RNA, 19 nt, Homo sapiens
cagcggauacuaguucuuu

SEQ ID NO: 1106629 - RNA, 19 nt, Homo sapiens
uccaaaccguuacaccuuu

SEQ ID NO: 1106630 - RNA, 19 nt, Homo sapiens
uuuguuauguucuggcuuu

SEQ ID NO: 1106631 - RNA, 19 nt, Homo sapiens
aaagucuguuuauccguaa

SEQ ID NO: 1106632 - RNA, 19 nt, Homo sapiens
ggaaguguuucuggguuag

SEQ ID NO: 1106633 - RNA, 19 nt, Homo sapiens
gcccuucucuucccuuugg

SEQ ID NO: 1106634 - RNA, 19 nt, Homo sapiens
acagagcuuccauuacaua

SEQ ID NO: 1106635 - RNA, 19 nt, Homo sapiens
cacugcaaauuauuccaua

SEQ ID NO: 1106636 - RNA, 19 nt, Homo sapiens
agauuaaacugagcauugu

SEQ ID NO: 1106637 - RNA, 19 nt, Homo sapiens
cauguuuaccucuccauuu

SEQ ID NO: 1106638 - RNA, 19 nt, Homo sapiens
gaagcaagugucuccuuuc

SEQ ID NO: 1106639 - RNA, 19 nt, Homo sapiens
ccaaaccguuacaccuuuc

SEQ ID NO: 1106640 - RNA, 19 nt, Homo sapiens
cauuaaggaugcaucucuu

SEQ ID NO: 1106641 - RNA, 19 nt, Homo sapiens
gugugaaggccaccauuaa

SEQ ID NO: 1106642 - RNA, 19 nt, Homo sapiens
ccaaaaggcauauggguuu

SEQ ID NO: 1106643 - RNA, 19 nt, Homo sapiens
cagaugaauuagaagaaag

SEQ ID NO: 1106644 - RNA, 19 nt, Homo sapiens
aggaaggacuuguggaaca

SEQ ID NO: 1106645 - RNA, 19 nt, Homo sapiens
agugagauuuguuauguuc

SEQ ID NO: 1106646 - RNA, 19 nt, Homo sapiens
cuguuaaccuuguuuguca

SEQ ID NO: 1106647 - RNA, 19 nt, Homo sapiens
gaugaagaggacaugauga

SEQ ID NO: 1106648 - RNA, 19 nt, Homo sapiens
ccagaaagugagauuuguu

SEQ ID NO: 1106649 - RNA, 19 nt, Homo sapiens
ccuuggaguucauauuuca

SEQ ID NO: 1106650 - RNA, 19 nt, Homo sapiens
uagggaaguuaaagucugu

SEQ ID NO: 1106651 - RNA, 19 nt, Homo sapiens
guuauguucuggcuuuuaa

SEQ ID NO: 1106652 - RNA, 19 nt, Homo sapiens
gaaggccaccauuaaggau

SEQ ID NO: 1106653 - RNA, 19 nt, Homo sapiens
aaccuuggaguucauauuu

SEQ ID NO: 1106654 - RNA, 19 nt, Homo sapiens
gaauuagaagaaagagguu

SEQ ID NO: 1106655 - RNA, 19 nt, Homo sapiens
caggucagcccuucucuuc

SEQ ID NO: 1106656 - RNA, 19 nt, Homo sapiens
uguuacagagcuuccauua

SEQ ID NO: 1106657 - RNA, 19 nt, Homo sapiens
uagcacggauaccaaaucu

SEQ ID NO: 1106658 - RNA, 19 nt, Homo sapiens
ucaggaaggacuuguggaa

SEQ ID NO: 1106659 - RNA, 19 nt, Homo sapiens
guccugagaagaacuuuga

SEQ ID NO: 1106660 - RNA, 19 nt, Homo sapiens
ugagauuuguuauguucug

SEQ ID NO: 1106661 - RNA, 19 nt, Homo sapiens
gugcacuucuuguauuucu

SEQ ID NO: 1106662 - RNA, 19 nt, Homo sapiens
cuggaaacuugcuuuagga

SEQ ID NO: 1106663 - RNA, 19 nt, Homo sapiens
cuuuguagaugcagagaga

SEQ ID NO: 1106664 - RNA, 19 nt, Homo sapiens
gaaccucugauugaccaaa

SEQ ID NO: 1106665 - RNA, 19 nt, Homo sapiens
auaccagaauuacaucaug

SEQ ID NO: 1106666 - RNA, 19 nt, Homo sapiens
acaacgcggucauguuuac

SEQ ID NO: 1106667 - RNA, 19 nt, Homo sapiens
ugaaggccaccauuaagga

SEQ ID NO: 1106668 - RNA, 19 nt, Homo sapiens
ccauagcacggauaccaaa

SEQ ID NO: 1106669 - RNA, 19 nt, Homo sapiens
ggaaggacuuguggaacac

SEQ ID NO: 1106670 - RNA, 19 nt, Homo sapiens
cgagacaucguucauaagg

SEQ ID NO: 1106671 - RNA, 19 nt, Homo sapiens
gaaaaccugcuuuguagau

SEQ ID NO: 1106672 - RNA, 19 nt, Homo sapiens
gggaaguuaaagucuguuu

SEQ ID NO: 1106673 - RNA, 19 nt, Homo sapiens
gcaccuauaugcccucuuu

SEQ ID NO: 1106674 - RNA, 19 nt, Homo sapiens
gaagcaggaugaauaaaga

SEQ ID NO: 1106675 - RNA, 19 nt, Homo sapiens
caaggaggcugcaugauga

SEQ ID NO: 1106676 - RNA, 19 nt, Homo sapiens
uaaggucacucgaagauaa

SEQ ID NO: 1106677 - RNA, 19 nt, Homo sapiens
gaggagaggaguagauuua

SEQ ID NO: 1106678 - RNA, 19 nt, Homo sapiens
caugaagcuuugcuaauua

SEQ ID NO: 1106679 - RNA, 19 nt, Homo sapiens
gaaaucaugugcaaauugg

SEQ ID NO: 1106680 - RNA, 19 nt, Homo sapiens
gcucagauaugauucucua

SEQ ID NO: 1106681 - RNA, 19 nt, Homo sapiens
aaaggcaccugaaggaaua

SEQ ID NO: 1106682 - RNA, 19 nt, Homo sapiens
gguaaaggacccaguauuu

SEQ ID NO: 1106683 - RNA, 19 nt, Homo sapiens
ccacgaagucuccuauuua

SEQ ID NO: 1106684 - RNA, 19 nt, Homo sapiens
ggacaauagucuucauguu

SEQ ID NO: 1106685 - RNA, 19 nt, Homo sapiens
gcaaaaggcucagauauga

SEQ ID NO: 1106686 - RNA, 19 nt, Homo sapiens
ugacaucuguguuggcuuu

SEQ ID NO: 1106687 - RNA, 19 nt, Homo sapiens
gauccacgcugacaucaau

SEQ ID NO: 1106688 - RNA, 19 nt, Homo sapiens
gcauggcuguaauucuuua

SEQ ID NO: 1106689 - RNA, 19 nt, Homo sapiens
cacgaagucuccuauuuaa

SEQ ID NO: 1106690 - RNA, 19 nt, Homo sapiens
gccaaucacuuuacacaug

SEQ ID NO: 1106691 - RNA, 19 nt, Homo sapiens
ggagaggaguagauuuaga

SEQ ID NO: 1106692 - RNA, 19 nt, Homo sapiens
gacgugaaauugacaguga

SEQ ID NO: 1106693 - RNA, 19 nt, Homo sapiens
gacaauagucuucauguug

SEQ ID NO: 1106694 - RNA, 19 nt, Homo sapiens
gcacaugaagcuuugcuaa

SEQ ID NO: 1106695 - RNA, 19 nt, Homo sapiens
gagaagcuuuccuuggauu

SEQ ID NO: 1106696 - RNA, 19 nt, Homo sapiens
uagaagauuuccacaguga

SEQ ID NO: 1106697 - RNA, 19 nt, Homo sapiens
gaagucuccuauuuaaugu

SEQ ID NO: 1106698 - RNA, 19 nt, Homo sapiens
acaugaagcuuugcuaauu

SEQ ID NO: 1106699 - RNA, 19 nt, Homo sapiens
ggagauggaccuucugcua

SEQ ID NO: 1106700 - RNA, 19 nt, Homo sapiens
gaacaagacccugcagaug

SEQ ID NO: 1106701 - RNA, 19 nt, Homo sapiens
caagaaaucaugugcaaau

SEQ ID NO: 1106702 - RNA, 19 nt, Homo sapiens
ccaaucacuuuacacauga

SEQ ID NO: 1106703 - RNA, 19 nt, Homo sapiens
uaaacagugugucugauga

SEQ ID NO: 1106704 - RNA, 19 nt, Homo sapiens
gagagcacaugaagcuuug

SEQ ID NO: 1106705 - RNA, 19 nt, Homo sapiens
ggagagcacaugaagcuuu

SEQ ID NO: 1106706 - RNA, 19 nt, Homo sapiens
gaaaggcaccugaaggaau

SEQ ID NO: 1106707 - RNA, 19 nt, Homo sapiens
guaagaguguugugucugu

SEQ ID NO: 1106708 - RNA, 19 nt, Homo sapiens
ucccuuggcugguguauuu

SEQ ID NO: 1106709 - RNA, 19 nt, Homo sapiens
cgaagucuccuauuuaaug

SEQ ID NO: 1106710 - RNA, 19 nt, Homo sapiens
uuaaagagaucaggaacaa

SEQ ID NO: 1106711 - RNA, 19 nt, Homo sapiens
aggaguagauuuagauuug

SEQ ID NO: 1106712 - RNA, 19 nt, Homo sapiens
uaagaucaaugaaccuuuc

SEQ ID NO: 1106713 - RNA, 19 nt, Homo sapiens
ggaaaacacuaucaaacaa

SEQ ID NO: 1106714 - RNA, 19 nt, Homo sapiens
ggaaagcauuaaagagauc

SEQ ID NO: 1106715 - RNA, 19 nt, Homo sapiens
gcacuugagucagaggaaa

SEQ ID NO: 1106716 - RNA, 19 nt, Homo sapiens
ggaguagauuuagauuuga

SEQ ID NO: 1106717 - RNA, 19 nt, Homo sapiens
ggaggcccauaucuuguuu

SEQ ID NO: 1106718 - RNA, 19 nt, Homo sapiens
ggacuuuccuuccauucau

SEQ ID NO: 1106719 - RNA, 19 nt, Homo sapiens
gcacaugcucaaugguaua

SEQ ID NO: 1106720 - RNA, 19 nt, Homo sapiens
uggaguaaauucugaguau

SEQ ID NO: 1106721 - RNA, 19 nt, Homo sapiens
gaaggugggugggacuuuc

SEQ ID NO: 1106722 - RNA, 19 nt, Homo sapiens
guacuaggcugugugucuu

SEQ ID NO: 1106723 - RNA, 19 nt, Homo sapiens
ggagaagcuuuccuuggau

SEQ ID NO: 1106724 - RNA, 19 nt, Homo sapiens
gaagaagaggagaagcuuu

SEQ ID NO: 1106725 - RNA, 19 nt, Homo sapiens
ucaaacaaucugagaauga

SEQ ID NO: 1106726 - RNA, 19 nt, Homo sapiens
gaagaucaaggcucguuug

SEQ ID NO: 1106727 - RNA, 19 nt, Homo sapiens
gaaagggagagcacaugaa

SEQ ID NO: 1106728 - RNA, 19 nt, Homo sapiens
ggaagcaggaugaauaaag

SEQ ID NO: 1106729 - RNA, 19 nt, Homo sapiens
aaagagaucaggaacaaga

SEQ ID NO: 1106730 - RNA, 19 nt, Homo sapiens
gaaaguaagaguguugugu

SEQ ID NO: 1106731 - RNA, 19 nt, Homo sapiens
guguauguguucacuauau

SEQ ID NO: 1106732 - RNA, 19 nt, Homo sapiens
ucacuuugcuccuauuucu

SEQ ID NO: 1106733 - RNA, 19 nt, Homo sapiens
ucaccggaaugcaccuaua

SEQ ID NO: 1106734 - RNA, 19 nt, Homo sapiens
aggcauggcuguaauucuu

SEQ ID NO: 1106735 - RNA, 19 nt, Homo sapiens
guaaaggacccaguauuuc

SEQ ID NO: 1106736 - RNA, 19 nt, Homo sapiens
ggaacaagacccugcagau

SEQ ID NO: 1106737 - RNA, 19 nt, Homo sapiens
cccacgaagucuccuauuu

SEQ ID NO: 1106738 - RNA, 19 nt, Homo sapiens
gcaaauuggaaagcauuaa

SEQ ID NO: 1106739 - RNA, 19 nt, Homo sapiens
gaggcugcaugaugaguau

SEQ ID NO: 1106740 - RNA, 19 nt, Homo sapiens
gagaggaguagauuuagau

SEQ ID NO: 1106741 - RNA, 19 nt, Homo sapiens
gaggcucccugacuugugu

SEQ ID NO: 1106742 - RNA, 19 nt, Homo sapiens
acaagacccugcagaugga

SEQ ID NO: 1106743 - RNA, 19 nt, Homo sapiens
ggaaaggcaccugaaggaa

SEQ ID NO: 1106744 - RNA, 19 nt, Homo sapiens
guguguauguguucacuau

SEQ ID NO: 1106745 - RNA, 19 nt, Homo sapiens
gaggaguagauuuagauuu

SEQ ID NO: 1106746 - RNA, 19 nt, Homo sapiens
gcuguaauucuuuagcuuu

SEQ ID NO: 1106747 - RNA, 19 nt, Homo sapiens
caaacaaucugagaaugac

SEQ ID NO: 1106748 - RNA, 19 nt, Homo sapiens
ggaguaaauucugaguauc

SEQ ID NO: 1106749 - RNA, 19 nt, Homo sapiens
ccuacugccuaagucauua

SEQ ID NO: 1106750 - RNA, 19 nt, Homo sapiens
ugacuugugugaagaagag

SEQ ID NO: 1106751 - RNA, 19 nt, Homo sapiens
gcauuaaagagaucaggaa

SEQ ID NO: 1106752 - RNA, 19 nt, Homo sapiens
uaagaguguugugucugua

SEQ ID NO: 1106753 - RNA, 19 nt, Homo sapiens
gaguaaaugccaaucacuu

SEQ ID NO: 1106754 - RNA, 19 nt, Homo sapiens
ugaaaaguauggcagauga

SEQ ID NO: 1106755 - RNA, 19 nt, Homo sapiens
cauaucuuguuucagguaa

SEQ ID NO: 1106756 - RNA, 19 nt, Homo sapiens
gcagaggcucccugacuug

SEQ ID NO: 1106757 - RNA, 19 nt, Homo sapiens
ggaggcugcaugaugagua

SEQ ID NO: 1106758 - RNA, 19 nt, Homo sapiens
agaaugaccuaaacaagcu

SEQ ID NO: 1106759 - RNA, 19 nt, Homo sapiens
gguaaggucacucgaagau

SEQ ID NO: 1106760 - RNA, 19 nt, Homo sapiens
ugccuaaccuacugccuaa

SEQ ID NO: 1106761 - RNA, 19 nt, Homo sapiens
aguagaagauuuccacagu

SEQ ID NO: 1106762 - RNA, 19 nt, Homo sapiens
cgaaacggaagcaggauga

SEQ ID NO: 1106763 - RNA, 19 nt, Homo sapiens
acaaggaggcugcaugaug

SEQ ID NO: 1106764 - RNA, 19 nt, Homo sapiens
cuacaaggaggcugcauga

SEQ ID NO: 1106765 - RNA, 19 nt, Homo sapiens
guggcuacauugugucuau

SEQ ID NO: 1106766 - RNA, 19 nt, Homo sapiens
cagcuuuccuuuccaccaa

SEQ ID NO: 1106767 - RNA, 19 nt, Homo sapiens
ggaggagaggaguagauuu

SEQ ID NO: 1106768 - RNA, 19 nt, Homo sapiens
uaugaaggccugcuuguca

SEQ ID NO: 1106769 - RNA, 19 nt, Homo sapiens
aguauaagccacugaaaga

SEQ ID NO: 1106770 - RNA, 19 nt, Homo sapiens
uaucuacuguguauuggau

SEQ ID NO: 1106771 - RNA, 19 nt, Homo sapiens
ucauuggaguaaauucuga

SEQ ID NO: 1106772 - RNA, 19 nt, Homo sapiens
ucucguggcuacauugugu

SEQ ID NO: 1106773 - RNA, 19 nt, Homo sapiens
gaaaugaagugucugauga

SEQ ID NO: 1106774 - RNA, 19 nt, Homo sapiens
gaaaggaguucgugaagug

SEQ ID NO: 1106775 - RNA, 19 nt, Homo sapiens
ggaaagaaguggcauaucu

SEQ ID NO: 1106776 - RNA, 19 nt, Homo sapiens
agacugggauggagaauua

SEQ ID NO: 1106777 - RNA, 19 nt, Homo sapiens
gaccgaaccucugaauuua

SEQ ID NO: 1106778 - RNA, 19 nt, Homo sapiens
gagcacauuugccuacuaa

SEQ ID NO: 1106779 - RNA, 19 nt, Homo sapiens
gaauguggccaaacaauuu

SEQ ID NO: 1106780 - RNA, 19 nt, Homo sapiens
guaagaacaucaucaaagu

SEQ ID NO: 1106781 - RNA, 19 nt, Homo sapiens
gcaaagagaagcuuaagga

SEQ ID NO: 1106782 - RNA, 19 nt, Homo sapiens
gauauugauuggccuauug

SEQ ID NO: 1106783 - RNA, 19 nt, Homo sapiens
gaaagggccuguucaaagc

SEQ ID NO: 1106784 - RNA, 19 nt, Homo sapiens
gacagaccaugaugaaauu

SEQ ID NO: 1106785 - RNA, 19 nt, Homo sapiens
aagagaagcuuaaggaaau

SEQ ID NO: 1106786 - RNA, 19 nt, Homo sapiens
gaaaugcgagcugaacaua

SEQ ID NO: 1106787 - RNA, 19 nt, Homo sapiens
uggcauaucuuggaaauga

SEQ ID NO: 1106788 - RNA, 19 nt, Homo sapiens
gagcaaagaguauuaagau

SEQ ID NO: 1106789 - RNA, 19 nt, Homo sapiens
gaugaagagugcuugaaga

SEQ ID NO: 1106790 - RNA, 19 nt, Homo sapiens
gaaguggcauaucuuggaa

SEQ ID NO: 1106791 - RNA, 19 nt, Homo sapiens
gaacauaguguggauauag

SEQ ID NO: 1106792 - RNA, 19 nt, Homo sapiens
ccagaaggcuguuggauac

SEQ ID NO: 1106793 - RNA, 19 nt, Homo sapiens
ugaccgaaccucugaauuu

SEQ ID NO: 1106794 - RNA, 19 nt, Homo sapiens
gaagugaccgaaccucuga

SEQ ID NO: 1106795 - RNA, 19 nt, Homo sapiens
gcaccuggcagcccuaauu

SEQ ID NO: 1106796 - RNA, 19 nt, Homo sapiens
ccgaaccucugaauuuaaa

SEQ ID NO: 1106797 - RNA, 19 nt, Homo sapiens
gaaggcuguuggauacauu

SEQ ID NO: 1106798 - RNA, 19 nt, Homo sapiens
agaaaugauucgagaagaa

SEQ ID NO: 1106799 - RNA, 19 nt, Homo sapiens
uuucaaagauguugggauu

SEQ ID NO: 1106800 - RNA, 19 nt, Homo sapiens
gcuagcaguuguagaugaa

SEQ ID NO: 1106801 - RNA, 19 nt, Homo sapiens
agacagcucuaccucacua

SEQ ID NO: 1106802 - RNA, 19 nt, Homo sapiens
cgacagaccaugaugaaau

SEQ ID NO: 1106803 - RNA, 19 nt, Homo sapiens
gaagagagugggccuaagu

SEQ ID NO: 1106804 - RNA, 19 nt, Homo sapiens
ggaaaugaagugucugaug

SEQ ID NO: 1106805 - RNA, 19 nt, Homo sapiens
gcugaugccuguucuacug

SEQ ID NO: 1106806 - RNA, 19 nt, Homo sapiens
ugaagugucugaugaagag

SEQ ID NO: 1106807 - RNA, 19 nt, Homo sapiens
ggauggagaauuauaugaa

SEQ ID NO: 1106808 - RNA, 19 nt, Homo sapiens
aaagagaagcuuaaggaaa

SEQ ID NO: 1106809 - RNA, 19 nt, Homo sapiens
acaauuuggugcacaaguu

SEQ ID NO: 1106810 - RNA, 19 nt, Homo sapiens
gggacaguguguaugguaa

SEQ ID NO: 1106811 - RNA, 19 nt, Homo sapiens
gcacaaguucaucgaagaa

SEQ ID NO: 1106812 - RNA, 19 nt, Homo sapiens
uuacagagagugugauuug

SEQ ID NO: 1106813 - RNA, 19 nt, Homo sapiens
caaguaagaacaucaucaa

SEQ ID NO: 1106814 - RNA, 19 nt, Homo sapiens
cagagagugugauuugguu

SEQ ID NO: 1106815 - RNA, 19 nt, Homo sapiens
ggauauugauuggccuauu

SEQ ID NO: 1106816 - RNA, 19 nt, Homo sapiens
ugauagagauggguuacuu

SEQ ID NO: 1106817 - RNA, 19 nt, Homo sapiens
uaaacggccucgucgacaa

SEQ ID NO: 1106818 - RNA, 19 nt, Homo sapiens
caagcuacuucuccauguu

SEQ ID NO: 1106819 - RNA, 19 nt, Homo sapiens
gaaauauucaagcuacuuc

SEQ ID NO: 1106820 - RNA, 19 nt, Homo sapiens
gcaaguaagaacaucauca

SEQ ID NO: 1106821 - RNA, 19 nt, Homo sapiens
gcagagcaaagaguauuaa

SEQ ID NO: 1106822 - RNA, 19 nt, Homo sapiens
gagaagaaggauaugauuc

SEQ ID NO: 1106823 - RNA, 19 nt, Homo sapiens
caagcuagcaguuguagau

SEQ ID NO: 1106824 - RNA, 19 nt, Homo sapiens
gcagaaaugauucgagaag

SEQ ID NO: 1106825 - RNA, 19 nt, Homo sapiens
ggaaauauucaagcuacuu

SEQ ID NO: 1106826 - RNA, 19 nt, Homo sapiens
ucaaagauguugggauuuu

SEQ ID NO: 1106827 - RNA, 19 nt, Homo sapiens
caaagagaagcuuaaggaa

SEQ ID NO: 1106828 - RNA, 19 nt, Homo sapiens
cagaaaugauucgagaaga

SEQ ID NO: 1106829 - RNA, 19 nt, Homo sapiens
gaauuugcagagcacauuu

SEQ ID NO: 1106830 - RNA, 19 nt, Homo sapiens
gaaaugauucgagaagaag

SEQ ID NO: 1106831 - RNA, 19 nt, Homo sapiens
ggagaaggcgugggaggaa

SEQ ID NO: 1106832 - RNA, 19 nt, Homo sapiens
uacagucuuucucagauuu

SEQ ID NO: 1106833 - RNA, 19 nt, Homo sapiens
agaaagggccuguucaaag

SEQ ID NO: 1106834 - RNA, 19 nt, Homo sapiens
agagaagcuuaaggaaaua

SEQ ID NO: 1106835 - RNA, 19 nt, Homo sapiens
guguauggguuucgacaga

SEQ ID NO: 1106836 - RNA, 19 nt, Homo sapiens
guaaaugcaaguaagaaca

SEQ ID NO: 1106837 - RNA, 19 nt, Homo sapiens
gagaauguggccaaacaau

SEQ ID NO: 1106838 - RNA, 19 nt, Homo sapiens
cgagaagaaggauaugauu

SEQ ID NO: 1106839 - RNA, 19 nt, Homo sapiens
caaagauguugggauuuua

SEQ ID NO: 1106840 - RNA, 19 nt, Homo sapiens
uuacagucuuucucagauu

SEQ ID NO: 1106841 - RNA, 19 nt, Homo sapiens
caaguucaucgaagaaguu

SEQ ID NO: 1106842 - RNA, 19 nt, Homo sapiens
gauuacagucuuucucaga

SEQ ID NO: 1106843 - RNA, 19 nt, Homo sapiens
gaagucaguguaucagaca

SEQ ID NO: 1106844 - RNA, 19 nt, Homo sapiens
guauugaggugaggcuaau

SEQ ID NO: 1106845 - RNA, 19 nt, Homo sapiens
aaaagaugcuauugggaua

SEQ ID NO: 1106846 - RNA, 19 nt, Homo sapiens
gaaccucugaauuuaaauc

SEQ ID NO: 1106847 - RNA, 19 nt, Homo sapiens
gacauuguaggaaauauuc

SEQ ID NO: 1106848 - RNA, 19 nt, Homo sapiens
ugaacauaguguggauaua

SEQ ID NO: 1106849 - RNA, 19 nt, Homo sapiens
ucaagcuacuucuccaugu

SEQ ID NO: 1106850 - RNA, 19 nt, Homo sapiens
guaggaaauauucaagcua

SEQ ID NO: 1106851 - RNA, 19 nt, Homo sapiens
gacaguguguaugguaaga

SEQ ID NO: 1106852 - RNA, 19 nt, Homo sapiens
gugauuugguuugugauau

SEQ ID NO: 1106853 - RNA, 19 nt, Homo sapiens
cagaaagggccuguucaaa

SEQ ID NO: 1106854 - RNA, 19 nt, Homo sapiens
gagaagcuuaaggaaauaa

SEQ ID NO: 1106855 - RNA, 19 nt, Homo sapiens
aaugcgagcugaacauagu

SEQ ID NO: 1106856 - RNA, 19 nt, Homo sapiens
ucagaaaggaguucgugaa

SEQ ID NO: 1106857 - RNA, 19 nt, Homo sapiens
gagagugugauuugguuug

SEQ ID NO: 1106858 - RNA, 19 nt, Homo sapiens
cccagaaggcuguuggaua

SEQ ID NO: 1106859 - RNA, 19 nt, Homo sapiens
ggccugugcuggaaagaag

SEQ ID NO: 1106860 - RNA, 19 nt, Homo sapiens
aaaacuggauugcaaaaug

SEQ ID NO: 1106861 - RNA, 19 nt, Homo sapiens
gauagagauggguuacuug

SEQ ID NO: 1106862 - RNA, 19 nt, Homo sapiens
gggauggagaauuauauga

SEQ ID NO: 1106863 - RNA, 19 nt, Homo sapiens
ugugagacgccaucaguuu

SEQ ID NO: 1106864 - RNA, 19 nt, Homo sapiens
gaaggauaugauucuguuu

SEQ ID NO: 1106865 - RNA, 19 nt, Homo sapiens
ucagaaagggccuguucaa

SEQ ID NO: 1106866 - RNA, 19 nt, Homo sapiens
gguauugaggugaggcuaa

SEQ ID NO: 1106867 - RNA, 19 nt, Homo sapiens
ugauggaugucucaccaau

SEQ ID NO: 1106868 - RNA, 19 nt, Homo sapiens
caaaauggaagucagugua

SEQ ID NO: 1106869 - RNA, 19 nt, Homo sapiens
gacgcugucuucuuuaaaa

SEQ ID NO: 1106870 - RNA, 19 nt, Homo sapiens
gaaauucagaaaggaguuc

SEQ ID NO: 1106871 - RNA, 19 nt, Homo sapiens
gauucgagaagaaggauau

SEQ ID NO: 1106872 - RNA, 19 nt, Homo sapiens
agaauguggccaaacaauu

SEQ ID NO: 1106873 - RNA, 19 nt, Homo sapiens
gaacugaggaccaaucaug

SEQ ID NO: 1106874 - RNA, 19 nt, Homo sapiens
gggaggagcugccuguuca

SEQ ID NO: 1106875 - RNA, 19 nt, Homo sapiens
ggacaaaggcagaggaugu

SEQ ID NO: 1106876 - RNA, 19 nt, Homo sapiens
cagcuggacuugccaaaga

SEQ ID NO: 1106877 - RNA, 19 nt, Homo sapiens
gugaaggccucgcggguaa

SEQ ID NO: 1106878 - RNA, 19 nt, Homo sapiens
gcagagucguggcaucuca

SEQ ID NO: 1106879 - RNA, 19 nt, Homo sapiens
ccgagaauuugaggucuua

SEQ ID NO: 1106880 - RNA, 19 nt, Homo sapiens
ggauggaacugaggaccaa

SEQ ID NO: 1106881 - RNA, 19 nt, Homo sapiens
gaacagccugggucucuau

SEQ ID NO: 1106882 - RNA, 19 nt, Homo sapiens
ggaacagccugggucucua

SEQ ID NO: 1106883 - RNA, 19 nt, Homo sapiens
gguccucgccugucaugua

SEQ ID NO: 1106884 - RNA, 19 nt, Homo sapiens
gacaaaggcagaggaugua

SEQ ID NO: 1106885 - RNA, 19 nt, Homo sapiens
gagaauuugaggucuuaaa

SEQ ID NO: 1106886 - RNA, 19 nt, Homo sapiens
uugaggcuguuauaccuua

SEQ ID NO: 1106887 - RNA, 19 nt, Homo sapiens
ugaaguugaggcuguuaua

SEQ ID NO: 1106888 - RNA, 19 nt, Homo sapiens
aagcagagccacauccuau

SEQ ID NO: 1106889 - RNA, 19 nt, Homo sapiens
ccaaucaugcugcaaggaa

SEQ ID NO: 1106890 - RNA, 19 nt, Homo sapiens
ccuggcggcugcugaaguu

SEQ ID NO: 1106891 - RNA, 19 nt, Homo sapiens
uaaaggcucacgcugacaa

SEQ ID NO: 1106892 - RNA, 19 nt, Homo sapiens
ggagaccaccggugugaag

SEQ ID NO: 1106893 - RNA, 19 nt, Homo sapiens
gguggaggaaggacaugua

SEQ ID NO: 1106894 - RNA, 19 nt, Homo sapiens
gcagagccacauccuaugg

SEQ ID NO: 1106895 - RNA, 19 nt, Homo sapiens
ggaugcagcccaggaacuu

SEQ ID NO: 1106896 - RNA, 19 nt, Homo sapiens
gcacucgcacggcaagguu

SEQ ID NO: 1106897 - RNA, 19 nt, Homo sapiens
gaauuugaggucuuaaagg

SEQ ID NO: 1106898 - RNA, 19 nt, Homo sapiens
gaaguugaggcuguuauac

SEQ ID NO: 1106899 - RNA, 19 nt, Homo sapiens
caagcagagccacauccua

SEQ ID NO: 1106900 - RNA, 19 nt, Homo sapiens
uaccuuagacccucaguca

SEQ ID NO: 1106901 - RNA, 19 nt, Homo sapiens
gaaggccucgcggguaaau

SEQ ID NO: 1106902 - RNA, 19 nt, Homo sapiens
ccacagacacugggagaca

SEQ ID NO: 1106903 - RNA, 19 nt, Homo sapiens
ccuuagacccucagucaug

SEQ ID NO: 1106904 - RNA, 19 nt, Homo sapiens
ucucuauggccgcacaaua

SEQ ID NO: 1106905 - RNA, 19 nt, Homo sapiens
ucagauggaggaggauauu

SEQ ID NO: 1106906 - RNA, 19 nt, Homo sapiens
cuacacaccccucauuaaa

SEQ ID NO: 1106907 - RNA, 19 nt, Homo sapiens
gagggacggcugacaaagg

SEQ ID NO: 1106908 - RNA, 19 nt, Homo sapiens
ugacaaaggccaggaacag

SEQ ID NO: 1106909 - RNA, 19 nt, Homo sapiens
ugggagaguggauucauga

SEQ ID NO: 1106910 - RNA, 19 nt, Homo sapiens
ggcccugccuaccgagaau

SEQ ID NO: 1106911 - RNA, 19 nt, Homo sapiens
gauggaggaggauauucug

SEQ ID NO: 1106912 - RNA, 19 nt, Homo sapiens
caagccuguuggagacuca

SEQ ID NO: 1106913 - RNA, 19 nt, Homo sapiens
cggagggacggcugacaaa

SEQ ID NO: 1106914 - RNA, 19 nt, Homo sapiens
gaagauauccuuggacuua

SEQ ID NO: 1106915 - RNA, 19 nt, Homo sapiens
gagcucagguuguguacua

SEQ ID NO: 1106916 - RNA, 19 nt, Homo sapiens
caucaaaucuaccuccaaa

SEQ ID NO: 1106917 - RNA, 19 nt, Homo sapiens
gguaagcaguguagacaaa

SEQ ID NO: 1106918 - RNA, 19 nt, Homo sapiens
ucaaugaaacguccacaua

SEQ ID NO: 1106919 - RNA, 19 nt, Homo sapiens
gaacugucccacaagaauu

SEQ ID NO: 1106920 - RNA, 19 nt, Homo sapiens
gaaaugcacaagaucuuug

SEQ ID NO: 1106921 - RNA, 19 nt, Homo sapiens
gaacgaggccaaacucagu

SEQ ID NO: 1106922 - RNA, 19 nt, Homo sapiens
agaaagacaugaagaagag

SEQ ID NO: 1106923 - RNA, 19 nt, Homo sapiens
gggcuucguuggcuaaguu

SEQ ID NO: 1106924 - RNA, 19 nt, Homo sapiens
gaggacacacucucaguuu

SEQ ID NO: 1106925 - RNA, 19 nt, Homo sapiens
ggaaaugcacaagaucuuu

SEQ ID NO: 1106926 - RNA, 19 nt, Homo sapiens
gcggauggaugccuucaau

SEQ ID NO: 1106927 - RNA, 19 nt, Homo sapiens
gggcaagccuaggagagua

SEQ ID NO: 1106928 - RNA, 19 nt, Homo sapiens
cugaguaucuggaauuuua

SEQ ID NO: 1106929 - RNA, 19 nt, Homo sapiens
gaaacagauugugcccaaa

SEQ ID NO: 1106930 - RNA, 19 nt, Homo sapiens
ggaacugucccacaagaau

SEQ ID NO: 1106931 - RNA, 19 nt, Homo sapiens
ggauggaugccuucaauca

SEQ ID NO: 1106932 - RNA, 19 nt, Homo sapiens
aggccaagguggagaagua

SEQ ID NO: 1106933 - RNA, 19 nt, Homo sapiens
ggacacacucucaguuugu

SEQ ID NO: 1106934 - RNA, 19 nt, Homo sapiens
guauugugcuguaacuuag

SEQ ID NO: 1106935 - RNA, 19 nt, Homo sapiens
gaaacguccacauaguauu

SEQ ID NO: 1106936 - RNA, 19 nt, Homo sapiens
gaacaguggguuugugucu

SEQ ID NO: 1106937 - RNA, 19 nt, Homo sapiens
gcagccgccucgacuacuu

SEQ ID NO: 1106938 - RNA, 19 nt, Homo sapiens
cagaaagacaugaagaaga

SEQ ID NO: 1106939 - RNA, 19 nt, Homo sapiens
ggaggacacacucucaguu

SEQ ID NO: 1106940 - RNA, 19 nt, Homo sapiens
ugaguuggauuccuuuuaa

SEQ ID NO: 1106941 - RNA, 19 nt, Homo sapiens
aaacguccacauaguauug

SEQ ID NO: 1106942 - RNA, 19 nt, Homo sapiens
gacacacucucaguuuguu

SEQ ID NO: 1106943 - RNA, 19 nt, Homo sapiens
caaugaaacguccacauag

SEQ ID NO: 1106944 - RNA, 19 nt, Homo sapiens
gaccaggaccuucugaaca

SEQ ID NO: 1106945 - RNA, 19 nt, Homo sapiens
gcagaaagacaugaagaag

SEQ ID NO: 1106946 - RNA, 19 nt, Homo sapiens
aguauugugcuguaacuua

SEQ ID NO: 1106947 - RNA, 19 nt, Homo sapiens
agaauucacaggucucaaa

SEQ ID NO: 1106948 - RNA, 19 nt, Homo sapiens
ucagccagcuucccagcaa

SEQ ID NO: 1106949 - RNA, 19 nt, Homo sapiens
cauccgagcucagguugug

SEQ ID NO: 1106950 - RNA, 19 nt, Homo sapiens
ccaagguggagaaguauga

SEQ ID NO: 1106951 - RNA, 19 nt, Homo sapiens
ugaaacguccacauaguau

SEQ ID NO: 1106952 - RNA, 19 nt, Homo sapiens
aaugaaacguccacauagu

SEQ ID NO: 1106953 - RNA, 19 nt, Homo sapiens
cccggaggcugcagaaaga

SEQ ID NO: 1106954 - RNA, 19 nt, Homo sapiens
gcuagcugcuccucucaca

SEQ ID NO: 1106955 - RNA, 19 nt, Homo sapiens
uuggagaccugucccauca

SEQ ID NO: 1106956 - RNA, 19 nt, Homo sapiens
ccaaaacaguggagagaga

SEQ ID NO: 1106957 - RNA, 19 nt, Homo sapiens
acaguggguuugugucuca

SEQ ID NO: 1106958 - RNA, 19 nt, Homo sapiens
cauuguggccgaugacuga

SEQ ID NO: 1106959 - RNA, 19 nt, Homo sapiens
guggagagagacuuugaaa

SEQ ID NO: 1106960 - RNA, 19 nt, Homo sapiens
acucggaaaugcacaagau

SEQ ID NO: 1106961 - RNA, 19 nt, Homo sapiens
ggagaacgaggccaaacuc

SEQ ID NO: 1106962 - RNA, 19 nt, Homo sapiens
guugugggcaucaaaucua

SEQ ID NO: 1106963 - RNA, 19 nt, Homo sapiens
guggagaaguaugaggaaa

SEQ ID NO: 1106964 - RNA, 19 nt, Homo sapiens
ugaaccagauccagaagac

SEQ ID NO: 1106965 - RNA, 19 nt, Homo sapiens
acgcagaccuggccauguc

SEQ ID NO: 1106966 - RNA, 19 nt, Homo sapiens
gacaaacccuuggggcuuu

SEQ ID NO: 1106967 - RNA, 19 nt, Homo sapiens
gagaacgaggccaaacuca

SEQ ID NO: 1106968 - RNA, 19 nt, Homo sapiens
caccugaguaucuggaauu

SEQ ID NO: 1106969 - RNA, 19 nt, Homo sapiens
gaauucacaggucucaaag

SEQ ID NO: 1106970 - RNA, 19 nt, Homo sapiens
guuguguacuacucggaaa

SEQ ID NO: 1106971 - RNA, 19 nt, Homo sapiens
aggacacacucucaguuug

SEQ ID NO: 1106972 - RNA, 19 nt, Homo sapiens
augaaacguccacauagua

SEQ ID NO: 1106973 - RNA, 19 nt, Homo sapiens
auucacaggucucaaagca

SEQ ID NO: 1106974 - RNA, 19 nt, Homo sapiens
ggagaaguaugaggaaaag

SEQ ID NO: 1106975 - RNA, 19 nt, Homo sapiens
gcaggaacaguggguuugu

SEQ ID NO: 1106976 - RNA, 19 nt, Homo sapiens
guggucagccucauucauc

SEQ ID NO: 1106977 - RNA, 19 nt, Homo sapiens
accaggaccuucugaacau

SEQ ID NO: 1106978 - RNA, 19 nt, Homo sapiens
gcagguaagcaguguagac

SEQ ID NO: 1106979 - RNA, 19 nt, Homo sapiens
gcaagaccaggaccuucug

SEQ ID NO: 1106980 - RNA, 19 nt, Homo sapiens
caagaauucacaggucuca

SEQ ID NO: 1106981 - RNA, 19 nt, Homo sapiens
ggacuuugaagccaagaac

SEQ ID NO: 1106982 - RNA, 19 nt, Homo sapiens
aaaguucggcagugucuuc

SEQ ID NO: 1106983 - RNA, 19 nt, Homo sapiens
ccgugaagauauccuugga

SEQ ID NO: 1106984 - RNA, 19 nt, Homo sapiens
ucaccugaguaucuggaau

SEQ ID NO: 1106985 - RNA, 19 nt, Homo sapiens
caggaacaguggguuugug

SEQ ID NO: 1106986 - RNA, 19 nt, Homo sapiens
gcaucaaaucuaccuccaa

SEQ ID NO: 1106987 - RNA, 19 nt, Homo sapiens
ugaaagggaguauggaaaa

SEQ ID NO: 1106988 - RNA, 19 nt, Homo sapiens
cuacuuccagcccagcuuu

SEQ ID NO: 1106989 - RNA, 19 nt, Homo sapiens
ccaggaccuucugaacaug

SEQ ID NO: 1106990 - RNA, 19 nt, Homo sapiens
caagaccaggaccuucuga

SEQ ID NO: 1106991 - RNA, 19 nt, Homo sapiens
acauaguauugugcuguaa

SEQ ID NO: 1106992 - RNA, 19 nt, Homo sapiens
caagcugcagcccuucuga

SEQ ID NO: 1106993 - RNA, 19 nt, Homo sapiens
gucaaaaucugccgugaag

SEQ ID NO: 1106994 - RNA, 19 nt, Homo sapiens
cggaaaugcacaagaucuu

SEQ ID NO: 1106995 - RNA, 19 nt, Homo sapiens
accaugaguuggauuccuu

SEQ ID NO: 1106996 - RNA, 19 nt, Homo sapiens
cagcuucccagcaagacaa

SEQ ID NO: 1106997 - RNA, 19 nt, Homo sapiens
cagcagguaagcaguguag

SEQ ID NO: 1106998 - RNA, 19 nt, Homo sapiens
gacguggucagccucauuc

SEQ ID NO: 1106999 - RNA, 19 nt, Homo sapiens
ggaaagacagggaagauug

SEQ ID NO: 1107000 - RNA, 19 nt, Homo sapiens
gaaaggagaagagguggua

SEQ ID NO: 1107001 - RNA, 19 nt, Homo sapiens
gggaauaccgugaacuuaa

SEQ ID NO: 1107002 - RNA, 19 nt, Homo sapiens
gaacuuaaggagucugauu

SEQ ID NO: 1107003 - RNA, 19 nt, Homo sapiens
gaagaggccagggcaauuu

SEQ ID NO: 1107004 - RNA, 19 nt, Homo sapiens
ggaauaccgugaacuuaag

SEQ ID NO: 1107005 - RNA, 19 nt, Homo sapiens
ccagaaggcuugcuccaau

SEQ ID NO: 1107006 - RNA, 19 nt, Homo sapiens
aauaaagacugcaaggaaa

SEQ ID NO: 1107007 - RNA, 19 nt, Homo sapiens
cagaaagccuggaacaugu

SEQ ID NO: 1107008 - RNA, 19 nt, Homo sapiens
caauaaagacugcaaggaa

SEQ ID NO: 1107009 - RNA, 19 nt, Homo sapiens
gaagagaggcugagaagcu

SEQ ID NO: 1107010 - RNA, 19 nt, Homo sapiens
ccagagaaacugaggauga

SEQ ID NO: 1107011 - RNA, 19 nt, Homo sapiens
gagaaggccugugaaagca

SEQ ID NO: 1107012 - RNA, 19 nt, Homo sapiens
ggaagaagaggcuguugga

SEQ ID NO: 1107013 - RNA, 19 nt, Homo sapiens
ugacagaacauccagaaga

SEQ ID NO: 1107014 - RNA, 19 nt, Homo sapiens
ccgagagucugaacuauca

SEQ ID NO: 1107015 - RNA, 19 nt, Homo sapiens
gaagugaacagagaagaga

SEQ ID NO: 1107016 - RNA, 19 nt, Homo sapiens
ggagaugacagaagacaug

SEQ ID NO: 1107017 - RNA, 19 nt, Homo sapiens
caaggagacugagccagaa

SEQ ID NO: 1107018 - RNA, 19 nt, Homo sapiens
gacagaacauccagaagag

SEQ ID NO: 1107019 - RNA, 19 nt, Homo sapiens
gaaagacagggaagauugu

SEQ ID NO: 1107020 - RNA, 19 nt, Homo sapiens
gcaugcaggugggcaagaa

SEQ ID NO: 1107021 - RNA, 19 nt, Homo sapiens
ggagaaggccugugaaagc

SEQ ID NO: 1107022 - RNA, 19 nt, Homo sapiens
gcacugaaagaacagaaga

SEQ ID NO: 1107023 - RNA, 19 nt, Homo sapiens
ggaagaggccagggcaauu

SEQ ID NO: 1107024 - RNA, 19 nt, Homo sapiens
gagaagagaggcugagaag

SEQ ID NO: 1107025 - RNA, 19 nt, Homo sapiens
ggacgcuguuggaagaaga

SEQ ID NO: 1107026 - RNA, 19 nt, Homo sapiens
ggacauggagagaggaaau

SEQ ID NO: 1107027 - RNA, 19 nt, Homo sapiens
cagacagacucaauaugga

SEQ ID NO: 1107028 - RNA, 19 nt, Homo sapiens
cagaaggcuugcuccaaug

SEQ ID NO: 1107029 - RNA, 19 nt, Homo sapiens
ugacagaagacaugaagug

SEQ ID NO: 1107030 - RNA, 19 nt, Homo sapiens
gccuggagaugacagaaga

SEQ ID NO: 1107031 - RNA, 19 nt, Homo sapiens
ggcugggacucgaaagaaa

SEQ ID NO: 1107032 - RNA, 19 nt, Homo sapiens
gaccgagagucugaacuau

SEQ ID NO: 1107033 - RNA, 19 nt, Homo sapiens
guaaggaggcugagaugag

SEQ ID NO: 1107034 - RNA, 19 nt, Homo sapiens
gcaaggcugggacucgaaa

SEQ ID NO: 1107035 - RNA, 19 nt, Homo sapiens
ucagacagacucaauaugg

SEQ ID NO: 1107036 - RNA, 19 nt, Homo sapiens
gagagggccuggagaugac

SEQ ID NO: 1107037 - RNA, 19 nt, Homo sapiens
gugggaggaucgcuugaga

SEQ ID NO: 1107038 - RNA, 19 nt, Homo sapiens
ggagggcucagcagaggaa

SEQ ID NO: 1107039 - RNA, 19 nt, Homo sapiens
ugagagggccuggagauga

SEQ ID NO: 1107040 - RNA, 19 nt, Homo sapiens
ggcggaggcugacagaaca

SEQ ID NO: 1107041 - RNA, 19 nt, Homo sapiens
gggccucagugucuugaug

SEQ ID NO: 1107042 - RNA, 19 nt, Homo sapiens
ggaggaagccaggacaauc

SEQ ID NO: 1107043 - RNA, 19 nt, Homo sapiens
gcaggaagugaacagagaa

SEQ ID NO: 1107044 - RNA, 19 nt, Homo sapiens
gggaaagacagggaagauu

SEQ ID NO: 1107045 - RNA, 19 nt, Homo sapiens
cagagaaacugaggaugag

SEQ ID NO: 1107046 - RNA, 19 nt, Homo sapiens
gagaaaggacauggagaga

SEQ ID NO: 1107047 - RNA, 19 nt, Homo sapiens
gagcuuugagggccaggua

SEQ ID NO: 1107048 - RNA, 19 nt, Homo sapiens
gacucaauauggagcaguu

SEQ ID NO: 1107049 - RNA, 19 nt, Homo sapiens
aguggacgcuguuggaaga

SEQ ID NO: 1107050 - RNA, 19 nt, Homo sapiens
gcugacagaacauccagaa

SEQ ID NO: 1107051 - RNA, 19 nt, Homo sapiens
gacauggagagaggaaaua

SEQ ID NO: 1107052 - RNA, 19 nt, Homo sapiens
gaugacagaagacaugaag

SEQ ID NO: 1107053 - RNA, 19 nt, Homo sapiens
gaggaagccaggacaaucu

SEQ ID NO: 1107054 - RNA, 19 nt, Homo sapiens
gcacgagaaaggacaugga

SEQ ID NO: 1107055 - RNA, 19 nt, Homo sapiens
ggaccuggagggccuuaga

SEQ ID NO: 1107056 - RNA, 19 nt, Homo sapiens
ggagucccaugagcaggaa

SEQ ID NO: 1107057 - RNA, 19 nt, Homo sapiens
ucagcugucuggacugcaa

SEQ ID NO: 1107058 - RNA, 19 nt, Homo sapiens
ggaaugggguggccucaca

SEQ ID NO: 1107059 - RNA, 19 nt, Homo sapiens
gcagaggcagccaaguaga

SEQ ID NO: 1107060 - RNA, 19 nt, Homo sapiens
gcaggugggcaagaauuug

SEQ ID NO: 1107061 - RNA, 19 nt, Homo sapiens
gaagaggucagggcaagag

SEQ ID NO: 1107062 - RNA, 19 nt, Homo sapiens
ggaagugaacagagaagag

SEQ ID NO: 1107063 - RNA, 19 nt, Homo sapiens
gaaagccuggaacauguca

SEQ ID NO: 1107064 - RNA, 19 nt, Homo sapiens
gagaugacagaagacauga

SEQ ID NO: 1107065 - RNA, 19 nt, Homo sapiens
acacacagcgucaccaaag

SEQ ID NO: 1107066 - RNA, 19 nt, Homo sapiens
ggacaaccucaggcaaaga

SEQ ID NO: 1107067 - RNA, 19 nt, Homo sapiens
ccugggcacugaaagaaca

SEQ ID NO: 1107068 - RNA, 19 nt, Homo sapiens
gggaaaaccgcacgagaaa

SEQ ID NO: 1107069 - RNA, 19 nt, Homo sapiens
agacagggaagauuguaga

SEQ ID NO: 1107070 - RNA, 19 nt, Homo sapiens
ggugagcccuuuccccaaa

SEQ ID NO: 1107071 - RNA, 19 nt, Homo sapiens
guggagaaggccugugaaa

SEQ ID NO: 1107072 - RNA, 19 nt, Homo sapiens
gaagauuguagaggaggaa

SEQ ID NO: 1107073 - RNA, 19 nt, Homo sapiens
gaagaagaggcuguuggau

SEQ ID NO: 1107074 - RNA, 19 nt, Homo sapiens
gguagaggccgaggaaucu

SEQ ID NO: 1107075 - RNA, 19 nt, Homo sapiens
gacuagcuguggccuacug

SEQ ID NO: 1107076 - RNA, 19 nt, Homo sapiens
gggaagaggccagggcaau

SEQ ID NO: 1107077 - RNA, 19 nt, Homo sapiens
gcgugcaccucucgagaag

SEQ ID NO: 1107078 - RNA, 19 nt, Homo sapiens
ggguagaggccgaggaauc

SEQ ID NO: 1107079 - RNA, 19 nt, Homo sapiens
gacgaggccuggacaaccu

SEQ ID NO: 1107080 - RNA, 19 nt, Homo sapiens
ggggaaggcuggugcuguu

SEQ ID NO: 1107081 - RNA, 19 nt, Homo sapiens
gugcaccucucgagaagcu

SEQ ID NO: 1107082 - RNA, 19 nt, Homo sapiens
agcaggaagugaacagaga

SEQ ID NO: 1107083 - RNA, 19 nt, Homo sapiens
gcugagagggccuggagau

SEQ ID NO: 1107084 - RNA, 19 nt, Homo sapiens
gaaaaccgcacgagaaagg

SEQ ID NO: 1107085 - RNA, 19 nt, Homo sapiens
gccucagugucuugaugua

SEQ ID NO: 1107086 - RNA, 19 nt, Homo sapiens
aaagacagggaagauugua

SEQ ID NO: 1107087 - RNA, 19 nt, Homo sapiens
gguaaggaggcugagauga

SEQ ID NO: 1107088 - RNA, 19 nt, Homo sapiens
ccuagaggcuacuggaaaa

SEQ ID NO: 1107089 - RNA, 19 nt, Homo sapiens
ugggaauaccgugaacuua

SEQ ID NO: 1107090 - RNA, 19 nt, Homo sapiens
cuaagcaacccgaggaaag

SEQ ID NO: 1107091 - RNA, 19 nt, Homo sapiens
gguccugggcacugaaaga

SEQ ID NO: 1107092 - RNA, 19 nt, Homo sapiens
cgaaggggcugggaaagga

SEQ ID NO: 1107093 - RNA, 19 nt, Homo sapiens
ggaagaggucagggcaaga

SEQ ID NO: 1107094 - RNA, 19 nt, Homo sapiens
agagagaacagagggaaga

SEQ ID NO: 1107095 - RNA, 19 nt, Homo sapiens
ggcagaggcagccaaguag

SEQ ID NO: 1107096 - RNA, 19 nt, Homo sapiens
agaggccuaugccagagaa

SEQ ID NO: 1107097 - RNA, 19 nt, Homo sapiens
ccacuuggaggccagaaag

SEQ ID NO: 1107098 - RNA, 19 nt, Homo sapiens
gggacaaccgggagaugga

SEQ ID NO: 1107099 - RNA, 19 nt, Homo sapiens
ugaaacagcucacauauuu

SEQ ID NO: 1107100 - RNA, 19 nt, Homo sapiens
ggaaacagauucuuuauca

SEQ ID NO: 1107101 - RNA, 19 nt, Homo sapiens
gaacuuggauuuagcauau

SEQ ID NO: 1107102 - RNA, 19 nt, Homo sapiens
guucaaagcucaugauaaa

SEQ ID NO: 1107103 - RNA, 19 nt, Homo sapiens
cagaugagcuuaagaauau

SEQ ID NO: 1107104 - RNA, 19 nt, Homo sapiens
gaacaaguacuucgacaua

SEQ ID NO: 1107105 - RNA, 19 nt, Homo sapiens
ggaaacaaguauccuaauu

SEQ ID NO: 1107106 - RNA, 19 nt, Homo sapiens
gaauugcuguggagaguua

SEQ ID NO: 1107107 - RNA, 19 nt, Homo sapiens
gaagaccaauaacuguuua

SEQ ID NO: 1107108 - RNA, 19 nt, Homo sapiens
ggaaaugggugauaugcaa

SEQ ID NO: 1107109 - RNA, 19 nt, Homo sapiens
gcaacuaaguggauugaaa

SEQ ID NO: 1107110 - RNA, 19 nt, Homo sapiens
guguaaagguguucaaaua

SEQ ID NO: 1107111 - RNA, 19 nt, Homo sapiens
gcacagugauagagaauug

SEQ ID NO: 1107112 - RNA, 19 nt, Homo sapiens
ugaugacacucacaaauua

SEQ ID NO: 1107113 - RNA, 19 nt, Homo sapiens
uuacaaagcuacagcaauu

SEQ ID NO: 1107114 - RNA, 19 nt, Homo sapiens
gggaagaacuccuccaaug

SEQ ID NO: 1107115 - RNA, 19 nt, Homo sapiens
gaauuuacccuuuagcuuu

SEQ ID NO: 1107116 - RNA, 19 nt, Homo sapiens
caagagauuugaaguguug

SEQ ID NO: 1107117 - RNA, 19 nt, Homo sapiens
gugaagaccucagaaagua

SEQ ID NO: 1107118 - RNA, 19 nt, Homo sapiens
gaaagaauguuggcucaau

SEQ ID NO: 1107119 - RNA, 19 nt, Homo sapiens
gaagacagcaagauuuauu

SEQ ID NO: 1107120 - RNA, 19 nt, Homo sapiens
ucacuacucuugauuauuc

SEQ ID NO: 1107121 - RNA, 19 nt, Homo sapiens
ggaaggaaaucaugucaag

SEQ ID NO: 1107122 - RNA, 19 nt, Homo sapiens
gaaagccucugagaacuug

SEQ ID NO: 1107123 - RNA, 19 nt, Homo sapiens
ggagacuguugaauucaua

SEQ ID NO: 1107124 - RNA, 19 nt, Homo sapiens
uaaaggagacuguugaauu

SEQ ID NO: 1107125 - RNA, 19 nt, Homo sapiens
cagcauagaugguccaaau

SEQ ID NO: 1107126 - RNA, 19 nt, Homo sapiens
ugugaaaucucauagcaua

SEQ ID NO: 1107127 - RNA, 19 nt, Homo sapiens
gauccaaagugacugauga

SEQ ID NO: 1107128 - RNA, 19 nt, Homo sapiens
gaacucaaauauugcacuu

SEQ ID NO: 1107129 - RNA, 19 nt, Homo sapiens
ugaguaacauguaauggua

SEQ ID NO: 1107130 - RNA, 19 nt, Homo sapiens
caaaguugaugaaagagaa

SEQ ID NO: 1107131 - RNA, 19 nt, Homo sapiens
uagaagaacuggauuguag

SEQ ID NO: 1107132 - RNA, 19 nt, Homo sapiens
gaaggaauuucaacaugug

SEQ ID NO: 1107133 - RNA, 19 nt, Homo sapiens
gggaagacagcaagauuua

SEQ ID NO: 1107134 - RNA, 19 nt, Homo sapiens
gcuaauggcuacaguuuua

SEQ ID NO: 1107135 - RNA, 19 nt, Homo sapiens
gcucgacccucuauuaaug

SEQ ID NO: 1107136 - RNA, 19 nt, Homo sapiens
caagcucccugauggauuu

SEQ ID NO: 1107137 - RNA, 19 nt, Homo sapiens
gaucaaccauugcagguau

SEQ ID NO: 1107138 - RNA, 19 nt, Homo sapiens
ucugagaacuugaagcaua

SEQ ID NO: 1107139 - RNA, 19 nt, Homo sapiens
gcacgaacauacagcauag

SEQ ID NO: 1107140 - RNA, 19 nt, Homo sapiens
ugacuuagguauuuccaaa

SEQ ID NO: 1107141 - RNA, 19 nt, Homo sapiens
gaaaccacaugaagaucaa

SEQ ID NO: 1107142 - RNA, 19 nt, Homo sapiens
ggaagaacuccuccaauga

SEQ ID NO: 1107143 - RNA, 19 nt, Homo sapiens
ugaggaaucugaagaacuu

SEQ ID NO: 1107144 - RNA, 19 nt, Homo sapiens
aagcaaaguugaugaaaga

SEQ ID NO: 1107145 - RNA, 19 nt, Homo sapiens
gauuugaaguguuggcuuu

SEQ ID NO: 1107146 - RNA, 19 nt, Homo sapiens
aaaggagacuguugaauuc

SEQ ID NO: 1107147 - RNA, 19 nt, Homo sapiens
caaacaaaauccccaaaua

SEQ ID NO: 1107148 - RNA, 19 nt, Homo sapiens
uaacuaauauggagauugg

SEQ ID NO: 1107149 - RNA, 19 nt, Homo sapiens
ugacccagcuggaaagauu

SEQ ID NO: 1107150 - RNA, 19 nt, Homo sapiens
gcacagaaaaucaaaguua

SEQ ID NO: 1107151 - RNA, 19 nt, Homo sapiens
gagaugcgaccaccauuaa

SEQ ID NO: 1107152 - RNA, 19 nt, Homo sapiens
ggagaugcgaccaccauua

SEQ ID NO: 1107153 - RNA, 19 nt, Homo sapiens
ggacugaggauguuauguu

SEQ ID NO: 1107154 - RNA, 19 nt, Homo sapiens
cuauguggcucucagauaa

SEQ ID NO: 1107155 - RNA, 19 nt, Homo sapiens
ccaauaaacuugagacacu

SEQ ID NO: 1107156 - RNA, 19 nt, Homo sapiens
ugaaaugguugaagaagga

SEQ ID NO: 1107157 - RNA, 19 nt, Homo sapiens
gaagaacuccuccaaugau

SEQ ID NO: 1107158 - RNA, 19 nt, Homo sapiens
ugauuguucuguugacuua

SEQ ID NO: 1107159 - RNA, 19 nt, Homo sapiens
aaagauauccaacaccaua

SEQ ID NO: 1107160 - RNA, 19 nt, Homo sapiens
gcuaauagacugacuuuua

SEQ ID NO: 1107161 - RNA, 19 nt, Homo sapiens
ugacaaacagcuucuuuaa

SEQ ID NO: 1107162 - RNA, 19 nt, Homo sapiens
uacgagaaguuuccucaua

SEQ ID NO: 1107163 - RNA, 19 nt, Homo sapiens
cacaauagcaaucagaaua

SEQ ID NO: 1107164 - RNA, 19 nt, Homo sapiens
ugaaugugaugaagacaaa

SEQ ID NO: 1107165 - RNA, 19 nt, Homo sapiens
aauguuggcucaauuaaga

SEQ ID NO: 1107166 - RNA, 19 nt, Homo sapiens
uaaaggguuucuaugugua

SEQ ID NO: 1107167 - RNA, 19 nt, Homo sapiens
gcaagagauuugaaguguu

SEQ ID NO: 1107168 - RNA, 19 nt, Homo sapiens
cauaagcacuguggacaaa

SEQ ID NO: 1107169 - RNA, 19 nt, Homo sapiens
gcuaaacauucugccaaua

SEQ ID NO: 1107170 - RNA, 19 nt, Homo sapiens
cgaagagccaaauauaaua

SEQ ID NO: 1107171 - RNA, 19 nt, Homo sapiens
gacugaggauguuauguuu

SEQ ID NO: 1107172 - RNA, 19 nt, Homo sapiens
gaacuugaagcauauuguu

SEQ ID NO: 1107173 - RNA, 19 nt, Homo sapiens
ccagaugagcuuaagaaua

SEQ ID NO: 1107174 - RNA, 19 nt, Homo sapiens
cuacagcaauugacagcua

SEQ ID NO: 1107175 - RNA, 19 nt, Homo sapiens
cagauuaacuaaacuccaa

SEQ ID NO: 1107176 - RNA, 19 nt, Homo sapiens
ccaacugccuuucuuuguu

SEQ ID NO: 1107177 - RNA, 19 nt, Homo sapiens
cgaccaccauuaauugaaa

SEQ ID NO: 1107178 - RNA, 19 nt, Homo sapiens
ggauauaguagaagaaaug

SEQ ID NO: 1107179 - RNA, 19 nt, Homo sapiens
caacugccuuucuuuguuc

SEQ ID NO: 1107180 - RNA, 19 nt, Homo sapiens
acaaguacuucgacauauu

SEQ ID NO: 1107181 - RNA, 19 nt, Homo sapiens
guucugagcauucuuuauu

SEQ ID NO: 1107182 - RNA, 19 nt, Homo sapiens
gaaauaccagagagaacua

SEQ ID NO: 1107183 - RNA, 19 nt, Homo sapiens
gaagaucucuccccucaga

SEQ ID NO: 1107184 - RNA, 19 nt, Homo sapiens
gaagaaggaauuucaacau

SEQ ID NO: 1107185 - RNA, 19 nt, Homo sapiens
ggacucacuuuccauucuu

SEQ ID NO: 1107186 - RNA, 19 nt, Homo sapiens
gccauugacuauacauuug

SEQ ID NO: 1107187 - RNA, 19 nt, Homo sapiens
ggcaagagauuugaagugu

SEQ ID NO: 1107188 - RNA, 19 nt, Homo sapiens
ggauaaaggagacuguuga

SEQ ID NO: 1107189 - RNA, 19 nt, Homo sapiens
cagaugaaguuacacacaa

SEQ ID NO: 1107190 - RNA, 19 nt, Homo sapiens
gauuaguccugggaguuua

SEQ ID NO: 1107191 - RNA, 19 nt, Homo sapiens
ggaaacagcgggcucaagu

SEQ ID NO: 1107192 - RNA, 19 nt, Homo sapiens
uagaagaaaugugcuguau

SEQ ID NO: 1107193 - RNA, 19 nt, Homo sapiens
acgagaaguuuccucauaa

SEQ ID NO: 1107194 - RNA, 19 nt, Homo sapiens
caaguauccuaauuuggaa

SEQ ID NO: 1107195 - RNA, 19 nt, Homo sapiens
gaaccugaagcugagauua

SEQ ID NO: 1107196 - RNA, 19 nt, Homo sapiens
guucaaaccauuguacaua

SEQ ID NO: 1107197 - RNA, 19 nt, Homo sapiens
guauguguguuguaaucua

SEQ ID NO: 1107198 - RNA, 19 nt, Homo sapiens
gauugaaacccuuuaacaa

SEQ ID NO: 1107199 - RNA, 19 nt, Homo sapiens
guugacaccuuccuacuua

SEQ ID NO: 1107200 - RNA, 19 nt, Homo sapiens
cuaccgagcuugcaaguuu

SEQ ID NO: 1107201 - RNA, 19 nt, Homo sapiens
guacuagcccuuauuuaua

SEQ ID NO: 1107202 - RNA, 19 nt, Homo sapiens
gaauuacccaucaucauua

SEQ ID NO: 1107203 - RNA, 19 nt, Homo sapiens
ggaauuacccaucaucauu

SEQ ID NO: 1107204 - RNA, 19 nt, Homo sapiens
gggaagaucauucauaauu

SEQ ID NO: 1107205 - RNA, 19 nt, Homo sapiens
gcagaguggugucuagauu

SEQ ID NO: 1107206 - RNA, 19 nt, Homo sapiens
uagccuaccuucauuaauu

SEQ ID NO: 1107207 - RNA, 19 nt, Homo sapiens
gauggguuauugcagauua

SEQ ID NO: 1107208 - RNA, 19 nt, Homo sapiens
gggaacagguggugucuau

SEQ ID NO: 1107209 - RNA, 19 nt, Homo sapiens
gaagucaguuuaagauaag

SEQ ID NO: 1107210 - RNA, 19 nt, Homo sapiens
gaaugucaguuuaggagaa

SEQ ID NO: 1107211 - RNA, 19 nt, Homo sapiens
gauaaguguuugaaucaga

SEQ ID NO: 1107212 - RNA, 19 nt, Homo sapiens
ccagguauauguuacuaaa

SEQ ID NO: 1107213 - RNA, 19 nt, Homo sapiens
gguagucaaugcuauuauu

SEQ ID NO: 1107214 - RNA, 19 nt, Homo sapiens
ccaacaacauuaugguauu

SEQ ID NO: 1107215 - RNA, 19 nt, Homo sapiens
gaaacccaguauugauuau

SEQ ID NO: 1107216 - RNA, 19 nt, Homo sapiens
cauguuagauugaugacuu

SEQ ID NO: 1107217 - RNA, 19 nt, Homo sapiens
guucuaaccaacaacauua

SEQ ID NO: 1107218 - RNA, 19 nt, Homo sapiens
ggacagaggauugacagaa

SEQ ID NO: 1107219 - RNA, 19 nt, Homo sapiens
aaacgggacuuacuucaca

SEQ ID NO: 1107220 - RNA, 19 nt, Homo sapiens
guaaauacaguuccagaug

SEQ ID NO: 1107221 - RNA, 19 nt, Homo sapiens
gguguaagcuguuuuaaau

SEQ ID NO: 1107222 - RNA, 19 nt, Homo sapiens
uaacagcacccucaucaau

SEQ ID NO: 1107223 - RNA, 19 nt, Homo sapiens
ccagagacaucacgguuuc

SEQ ID NO: 1107224 - RNA, 19 nt, Homo sapiens
acgggaagaucauucauaa

SEQ ID NO: 1107225 - RNA, 19 nt, Homo sapiens
gaccaugcaugaauguaug

SEQ ID NO: 1107226 - RNA, 19 nt, Homo sapiens
cauuugaacuugacucuuc

SEQ ID NO: 1107227 - RNA, 19 nt, Homo sapiens
gaaauggugaaacccagua

SEQ ID NO: 1107228 - RNA, 19 nt, Homo sapiens
ucaugucccugcaauuaaa

SEQ ID NO: 1107229 - RNA, 19 nt, Homo sapiens
acacucaacuggacucaug

SEQ ID NO: 1107230 - RNA, 19 nt, Homo sapiens
gaacagguggugucuaucu

SEQ ID NO: 1107231 - RNA, 19 nt, Homo sapiens
gaggagaaguacuugaaag

SEQ ID NO: 1107232 - RNA, 19 nt, Homo sapiens
cugaugagcugcuuuaugg

SEQ ID NO: 1107233 - RNA, 19 nt, Homo sapiens
ggagaaacgggacuuacuu

SEQ ID NO: 1107234 - RNA, 19 nt, Homo sapiens
guuccgugguucugcauua

SEQ ID NO: 1107235 - RNA, 19 nt, Homo sapiens
ugaaacccaguauugauua

SEQ ID NO: 1107236 - RNA, 19 nt, Homo sapiens
gguggugucuaucuuguau

SEQ ID NO: 1107237 - RNA, 19 nt, Homo sapiens
gaagccauccaucaacauu

SEQ ID NO: 1107238 - RNA, 19 nt, Homo sapiens
gaauaaaggaggagauuuu

SEQ ID NO: 1107239 - RNA, 19 nt, Homo sapiens
gcacccucaucaauauaaa

SEQ ID NO: 1107240 - RNA, 19 nt, Homo sapiens
cguacaaggucuuuaagga

SEQ ID NO: 1107241 - RNA, 19 nt, Homo sapiens
uuaaagagguagucaaugc

SEQ ID NO: 1107242 - RNA, 19 nt, Homo sapiens
gacagaggauugacagaag

SEQ ID NO: 1107243 - RNA, 19 nt, Homo sapiens
uaagacggauccagaccaa

SEQ ID NO: 1107244 - RNA, 19 nt, Homo sapiens
gagcugaccaugcaugaau

SEQ ID NO: 1107245 - RNA, 19 nt, Homo sapiens
ucacgcaggauaagaagua

SEQ ID NO: 1107246 - RNA, 19 nt, Homo sapiens
gaaagaggccauggagugu

SEQ ID NO: 1107247 - RNA, 19 nt, Homo sapiens
ggaauaaaggaggagauuu

SEQ ID NO: 1107248 - RNA, 19 nt, Homo sapiens
gugucuaucuuguauauca

SEQ ID NO: 1107249 - RNA, 19 nt, Homo sapiens
uggcuggaauuuacuauau

SEQ ID NO: 1107250 - RNA, 19 nt, Homo sapiens
caugacugcucugcuuaua

SEQ ID NO: 1107251 - RNA, 19 nt, Homo sapiens
acagcacccucaucaauau

SEQ ID NO: 1107252 - RNA, 19 nt, Homo sapiens
gcuggaauuuacuauaugu

SEQ ID NO: 1107253 - RNA, 19 nt, Homo sapiens
uggcauggcuggaauuuac

SEQ ID NO: 1107254 - RNA, 19 nt, Homo sapiens
gagguagucaaugcuauua

SEQ ID NO: 1107255 - RNA, 19 nt, Homo sapiens
aaagaacacuucggaaucu

SEQ ID NO: 1107256 - RNA, 19 nt, Homo sapiens
gaggugcuguuccgugguu

SEQ ID NO: 1107257 - RNA, 19 nt, Homo sapiens
ugagucagcuauuaaagag

SEQ ID NO: 1107258 - RNA, 19 nt, Homo sapiens
gcuaaggcuugugucauga

SEQ ID NO: 1107259 - RNA, 19 nt, Homo sapiens
aggcauggcuggcgcuauu

SEQ ID NO: 1107260 - RNA, 19 nt, Homo sapiens
cagaguggugucuagauua

SEQ ID NO: 1107261 - RNA, 19 nt, Homo sapiens
ggaggagaaguacuugaaa

SEQ ID NO: 1107262 - RNA, 19 nt, Homo sapiens
gaacacuucggaaucugaa

SEQ ID NO: 1107263 - RNA, 19 nt, Homo sapiens
gacagaagucaguuuaaga

SEQ ID NO: 1107264 - RNA, 19 nt, Homo sapiens
acauucagcuucuaaacga

SEQ ID NO: 1107265 - RNA, 19 nt, Homo sapiens
cuagguacuucucgucuug

SEQ ID NO: 1107266 - RNA, 19 nt, Homo sapiens
gacgggaagaucauucaua

SEQ ID NO: 1107267 - RNA, 19 nt, Homo sapiens
ggcuggcgcuauucacuuu

SEQ ID NO: 1107268 - RNA, 19 nt, Homo sapiens
gcggaagggcuacgggaua

SEQ ID NO: 1107269 - RNA, 19 nt, Homo sapiens
gugaaacccaguauugauu

SEQ ID NO: 1107270 - RNA, 19 nt, Homo sapiens
acacugagggaaagauuaa

SEQ ID NO: 1107271 - RNA, 19 nt, Homo sapiens
uguccaaucucauccaaau

SEQ ID NO: 1107272 - RNA, 19 nt, Homo sapiens
aaaguacuagcccuuauuu

SEQ ID NO: 1107273 - RNA, 19 nt, Homo sapiens
acucaugucccugcaauua

SEQ ID NO: 1107274 - RNA, 19 nt, Homo sapiens
caucacgguuuccagcauu

SEQ ID NO: 1107275 - RNA, 19 nt, Homo sapiens
ugacagaaauggugaaacc

SEQ ID NO: 1107276 - RNA, 19 nt, Homo sapiens
guucuguggugaugaccua

SEQ ID NO: 1107277 - RNA, 19 nt, Homo sapiens
ugacugcucugcuuauacu

SEQ ID NO: 1107278 - RNA, 19 nt, Homo sapiens
gugugugagucagcuauua

SEQ ID NO: 1107279 - RNA, 19 nt, Homo sapiens
gaaggaaagaauuugaagu

SEQ ID NO: 1107280 - RNA, 19 nt, Homo sapiens
ccaccuggguugacaccuu

SEQ ID NO: 1107281 - RNA, 19 nt, Homo sapiens
gaugacuucugugaauaga

SEQ ID NO: 1107282 - RNA, 19 nt, Homo sapiens
ggguuagccuaccuucauu

SEQ ID NO: 1107283 - RNA, 19 nt, Homo sapiens
gcccuuauuuauagauaug

SEQ ID NO: 1107284 - RNA, 19 nt, Homo sapiens
uacuagcccuuauuuauag

SEQ ID NO: 1107285 - RNA, 19 nt, Homo sapiens
gaccgaagccauccaucaa

SEQ ID NO: 1107286 - RNA, 19 nt, Homo sapiens
ggacaggcauagcccuuuu

SEQ ID NO: 1107287 - RNA, 19 nt, Homo sapiens
cagaagucaguuuaagaua

SEQ ID NO: 1107288 - RNA, 19 nt, Homo sapiens
gagaaacgggacuuacuuc

SEQ ID NO: 1107289 - RNA, 19 nt, Homo sapiens
uccaaucucauccaaauaa

SEQ ID NO: 1107290 - RNA, 19 nt, Homo sapiens
uuagauugaugacuucugu

SEQ ID NO: 1107291 - RNA, 19 nt, Homo sapiens
ccaccucaguuuaucaaca

SEQ ID NO: 1107292 - RNA, 19 nt, Homo sapiens
gcauguuucuugguguuug

SEQ ID NO: 1107293 - RNA, 19 nt, Homo sapiens
guaccugaacacagagaua

SEQ ID NO: 1107294 - RNA, 19 nt, Homo sapiens
cuacuuauccacuagaugu

SEQ ID NO: 1107295 - RNA, 19 nt, Homo sapiens
caucacagcacucaguaga

SEQ ID NO: 1107296 - RNA, 19 nt, Homo sapiens
uaaggcuugugucaugaaa

SEQ ID NO: 1107297 - RNA, 19 nt, Homo sapiens
gcgagaccaugucaaagag

SEQ ID NO: 1107298 - RNA, 19 nt, Homo sapiens
ggcgagaccaugucaaaga

SEQ ID NO: 1107299 - RNA, 19 nt, Homo sapiens
gaagaacaaugguaacuaa

SEQ ID NO: 1107300 - RNA, 19 nt, Homo sapiens
gcaaauagaucuguuucaa

SEQ ID NO: 1107301 - RNA, 19 nt, Homo sapiens
gaauagggaaugagaaaua

SEQ ID NO: 1107302 - RNA, 19 nt, Homo sapiens
gcccaaaguuucuuaugua

SEQ ID NO: 1107303 - RNA, 19 nt, Homo sapiens
gaagcuggcuggcugagaa

SEQ ID NO: 1107304 - RNA, 19 nt, Homo sapiens
caagauuggucuaguaguu

SEQ ID NO: 1107305 - RNA, 19 nt, Homo sapiens
gaacccagccuauugcaaa

SEQ ID NO: 1107306 - RNA, 19 nt, Homo sapiens
gcaacucagucccaaacua

SEQ ID NO: 1107307 - RNA, 19 nt, Homo sapiens
gaaaagagccagauaaaga

SEQ ID NO: 1107308 - RNA, 19 nt, Homo sapiens
ggaauugcauauagagaug

SEQ ID NO: 1107309 - RNA, 19 nt, Homo sapiens
uaacuacucugacauacug

SEQ ID NO: 1107310 - RNA, 19 nt, Homo sapiens
caugagaguuggagucaaa

SEQ ID NO: 1107311 - RNA, 19 nt, Homo sapiens
gauuuguucuuccauauga

SEQ ID NO: 1107312 - RNA, 19 nt, Homo sapiens
gagaauagggaaugagaaa

SEQ ID NO: 1107313 - RNA, 19 nt, Homo sapiens
guucaugauuguuguguuu

SEQ ID NO: 1107314 - RNA, 19 nt, Homo sapiens
gcauauaacuagcaauaac

SEQ ID NO: 1107315 - RNA, 19 nt, Homo sapiens
ggagucaaagccauuguua

SEQ ID NO: 1107316 - RNA, 19 nt, Homo sapiens
uuacuucaccucauacuua

SEQ ID NO: 1107317 - RNA, 19 nt, Homo sapiens
guacuaacauacucacugu

SEQ ID NO: 1107318 - RNA, 19 nt, Homo sapiens
cacaugaucuugguacuaa

SEQ ID NO: 1107319 - RNA, 19 nt, Homo sapiens
gauuguagaagcacuauaa

SEQ ID NO: 1107320 - RNA, 19 nt, Homo sapiens
cauaugacauugagcaaau

SEQ ID NO: 1107321 - RNA, 19 nt, Homo sapiens
uaaggaggguggccaaaug

SEQ ID NO: 1107322 - RNA, 19 nt, Homo sapiens
gguaaugaaugguaguaga

SEQ ID NO: 1107323 - RNA, 19 nt, Homo sapiens
uauaaggacuagacuguau

SEQ ID NO: 1107324 - RNA, 19 nt, Homo sapiens
cauagugagcuuauucuua

SEQ ID NO: 1107325 - RNA, 19 nt, Homo sapiens
gguaaacuauugguacuug

SEQ ID NO: 1107326 - RNA, 19 nt, Homo sapiens
ggaaugagaaauagaaauc

SEQ ID NO: 1107327 - RNA, 19 nt, Homo sapiens
gcugaggaguuugucaaua

SEQ ID NO: 1107328 - RNA, 19 nt, Homo sapiens
gaauagcaaaucuucauga

SEQ ID NO: 1107329 - RNA, 19 nt, Homo sapiens
ucaaagccauuguuaucuu

SEQ ID NO: 1107330 - RNA, 19 nt, Homo sapiens
gcaauaaaccuaaccuuuu

SEQ ID NO: 1107331 - RNA, 19 nt, Homo sapiens
uuacauaacuacucugaca

SEQ ID NO: 1107332 - RNA, 19 nt, Homo sapiens
gccaaaugguaaacuauug

SEQ ID NO: 1107333 - RNA, 19 nt, Homo sapiens
caaacaacauuucuucaac

SEQ ID NO: 1107334 - RNA, 19 nt, Homo sapiens
caaaauauguucccgcuau

SEQ ID NO: 1107335 - RNA, 19 nt, Homo sapiens
cuccaggucuauacauuua

SEQ ID NO: 1107336 - RNA, 19 nt, Homo sapiens
agagaaggauaccaaagaa

SEQ ID NO: 1107337 - RNA, 19 nt, Homo sapiens
gaacuaauagcuuuaacag

SEQ ID NO: 1107338 - RNA, 19 nt, Homo sapiens
gaaggauaccaaagaagaa

SEQ ID NO: 1107339 - RNA, 19 nt, Homo sapiens
gcaaaacguucucaguuga

SEQ ID NO: 1107340 - RNA, 19 nt, Homo sapiens
uguggaagauugcaaguga

SEQ ID NO: 1107341 - RNA, 19 nt, Homo sapiens
ccacgucucuggauuuuaa

SEQ ID NO: 1107342 - RNA, 19 nt, Homo sapiens
aaaccaugcuuucuuguag

SEQ ID NO: 1107343 - RNA, 19 nt, Homo sapiens
gagaauagcaaaucuucau

SEQ ID NO: 1107344 - RNA, 19 nt, Homo sapiens
cugaggaguuugucaauau

SEQ ID NO: 1107345 - RNA, 19 nt, Homo sapiens
cagagaagaacaaugguaa

SEQ ID NO: 1107346 - RNA, 19 nt, Homo sapiens
uuaacagggucuaacauga

SEQ ID NO: 1107347 - RNA, 19 nt, Homo sapiens
caagugaucaugaguguca

SEQ ID NO: 1107348 - RNA, 19 nt, Homo sapiens
gauggaaacaaacaacauu

SEQ ID NO: 1107349 - RNA, 19 nt, Homo sapiens
acacauugccuucuaguga

SEQ ID NO: 1107350 - RNA, 19 nt, Homo sapiens
guaaugaaugguaguagaa

SEQ ID NO: 1107351 - RNA, 19 nt, Homo sapiens
ggaugucagcacaauauaa

SEQ ID NO: 1107352 - RNA, 19 nt, Homo sapiens
gaacaaugguaacuaaaag

SEQ ID NO: 1107353 - RNA, 19 nt, Homo sapiens
ggcccaaaguuucuuaugu

SEQ ID NO: 1107354 - RNA, 19 nt, Homo sapiens
gaggguggccaaaugguaa

SEQ ID NO: 1107355 - RNA, 19 nt, Homo sapiens
guagaagcacuauaauaug

SEQ ID NO: 1107356 - RNA, 19 nt, Homo sapiens
uccaaacucuguauaacuu

SEQ ID NO: 1107357 - RNA, 19 nt, Homo sapiens
caaucagaauguccaaaug

SEQ ID NO: 1107358 - RNA, 19 nt, Homo sapiens
ucuagcagcugccaguuug

SEQ ID NO: 1107359 - RNA, 19 nt, Homo sapiens
ccaaagaagaaguaacuau

SEQ ID NO: 1107360 - RNA, 19 nt, Homo sapiens
ggaacuacucguauaagga

SEQ ID NO: 1107361 - RNA, 19 nt, Homo sapiens
uaaaccaugcuuucuugua

SEQ ID NO: 1107362 - RNA, 19 nt, Homo sapiens
cagcuuuguuucuacauug

SEQ ID NO: 1107363 - RNA, 19 nt, Homo sapiens
cagagaaggauaccaaaga

SEQ ID NO: 1107364 - RNA, 19 nt, Homo sapiens
gcacuaaccaggcuguauc

SEQ ID NO: 1107365 - RNA, 19 nt, Homo sapiens
ggcuggaacuacucguaua

SEQ ID NO: 1107366 - RNA, 19 nt, Homo sapiens
uuaaauggcuggaacuacu

SEQ ID NO: 1107367 - RNA, 19 nt, Homo sapiens
ggauaccaaagaagaagua

SEQ ID NO: 1107368 - RNA, 19 nt, Homo sapiens
ggaggguggccaaauggua

SEQ ID NO: 1107369 - RNA, 19 nt, Homo sapiens
ugaggaguuugucaauauu

SEQ ID NO: 1107370 - RNA, 19 nt, Homo sapiens
gccaagugaucaugagugu

SEQ ID NO: 1107371 - RNA, 19 nt, Homo sapiens
guugauaucugaguauugg

SEQ ID NO: 1107372 - RNA, 19 nt, Homo sapiens
guacagauuuagguuuaca

SEQ ID NO: 1107373 - RNA, 19 nt, Homo sapiens
uuucaagauuggucuagua

SEQ ID NO: 1107374 - RNA, 19 nt, Homo sapiens
uuuaaaccaugcuuucuug

SEQ ID NO: 1107375 - RNA, 19 nt, Homo sapiens
ccagauaaagagaaagauu

SEQ ID NO: 1107376 - RNA, 19 nt, Homo sapiens
auacuggaauugcauauag

SEQ ID NO: 1107377 - RNA, 19 nt, Homo sapiens
cugcauauaacuagcaaua

SEQ ID NO: 1107378 - RNA, 19 nt, Homo sapiens
gagaaaagagccagauaaa

SEQ ID NO: 1107379 - RNA, 19 nt, Homo sapiens
uccauuaguuccagcaauu

SEQ ID NO: 1107380 - RNA, 19 nt, Homo sapiens
gcaaaaguccauucucauu

SEQ ID NO: 1107381 - RNA, 19 nt, Homo sapiens
gugauuuguucuuccauau

SEQ ID NO: 1107382 - RNA, 19 nt, Homo sapiens
agauuggucuaguaguuaa

SEQ ID NO: 1107383 - RNA, 19 nt, Homo sapiens
gcuggaacuacucguauaa

SEQ ID NO: 1107384 - RNA, 19 nt, Homo sapiens
agaaggauaccaaagaaga

SEQ ID NO: 1107385 - RNA, 19 nt, Homo sapiens
gcagcaacaaucagaaugu

SEQ ID NO: 1107386 - RNA, 19 nt, Homo sapiens
gagcaaauagaucuguuuc

SEQ ID NO: 1107387 - RNA, 19 nt, Homo sapiens
ggucuauacauuuagguaa

SEQ ID NO: 1107388 - RNA, 19 nt, Homo sapiens
gggugcauuugguggcuua

SEQ ID NO: 1107389 - RNA, 19 nt, Homo sapiens
gaacacacugcuacaaggu

SEQ ID NO: 1107390 - RNA, 19 nt, Homo sapiens
ccaacaauacuguguggaa

SEQ ID NO: 1107391 - RNA, 19 nt, Homo sapiens
uauguuagauugccaacca

SEQ ID NO: 1107392 - RNA, 19 nt, Homo sapiens
gaggaguuugucaauauuu

SEQ ID NO: 1107393 - RNA, 19 nt, Homo sapiens
uaaggacuagacuguauuu

SEQ ID NO: 1107394 - RNA, 19 nt, Homo sapiens
gugcauuguucaugauugu

SEQ ID NO: 1107395 - RNA, 19 nt, Homo sapiens
uuacagagaagaacaaugg

SEQ ID NO: 1107396 - RNA, 19 nt, Homo sapiens
uaacagcaauaaaccuaac

SEQ ID NO: 1107397 - RNA, 19 nt, Homo sapiens
gcuccaggucuauacauuu

SEQ ID NO: 1107398 - RNA, 19 nt, Homo sapiens
acauaacuacucugacaua

SEQ ID NO: 1107399 - RNA, 19 nt, Homo sapiens
gcucaugccuguaaucuua

SEQ ID NO: 1107400 - RNA, 19 nt, Homo sapiens
gaacugcacauuaagauua

SEQ ID NO: 1107401 - RNA, 19 nt, Homo sapiens
ggaaaucaguguauaauca

SEQ ID NO: 1107402 - RNA, 19 nt, Homo sapiens
aaacucaacuggucauaua

SEQ ID NO: 1107403 - RNA, 19 nt, Homo sapiens
gaaaucacaucuccauuca

SEQ ID NO: 1107404 - RNA, 19 nt, Homo sapiens
ggaaagcauuggacacauu

SEQ ID NO: 1107405 - RNA, 19 nt, Homo sapiens
gaacuagaaucacucaaca

SEQ ID NO: 1107406 - RNA, 19 nt, Homo sapiens
uaaagaagauagugaagga

SEQ ID NO: 1107407 - RNA, 19 nt, Homo sapiens
agaagaagcucucuaguca

SEQ ID NO: 1107408 - RNA, 19 nt, Homo sapiens
acacagagauacuuucauu

SEQ ID NO: 1107409 - RNA, 19 nt, Homo sapiens
guaaggaacuucugauucu

SEQ ID NO: 1107410 - RNA, 19 nt, Homo sapiens
gcacaaacccacucucuau

SEQ ID NO: 1107411 - RNA, 19 nt, Homo sapiens
ccuguaaucuuaucacuuu

SEQ ID NO: 1107412 - RNA, 19 nt, Homo sapiens
gcugaaaccaucuguauaa

SEQ ID NO: 1107413 - RNA, 19 nt, Homo sapiens
gaaaggcaccucaaagaug

SEQ ID NO: 1107414 - RNA, 19 nt, Homo sapiens
gagaagagccgggugagua

SEQ ID NO: 1107415 - RNA, 19 nt, Homo sapiens
gagagaggcugacucaaca

SEQ ID NO: 1107416 - RNA, 19 nt, Homo sapiens
gaacuccugacacuauuua

SEQ ID NO: 1107417 - RNA, 19 nt, Homo sapiens
ugaguaaacuggaagaaga

SEQ ID NO: 1107418 - RNA, 19 nt, Homo sapiens
gauaaaggcaaauacauga

SEQ ID NO: 1107419 - RNA, 19 nt, Homo sapiens
gcccugaccuccugcuaua

SEQ ID NO: 1107420 - RNA, 19 nt, Homo sapiens
aaucacaucuccauucaaa

SEQ ID NO: 1107421 - RNA, 19 nt, Homo sapiens
ccaagcagcuggcccgaaa

SEQ ID NO: 1107422 - RNA, 19 nt, Homo sapiens
caaauaagacuauccacaa

SEQ ID NO: 1107423 - RNA, 19 nt, Homo sapiens
caaguagaacugcacauua

SEQ ID NO: 1107424 - RNA, 19 nt, Homo sapiens
ggucagaauuauacaaguu

SEQ ID NO: 1107425 - RNA, 19 nt, Homo sapiens
gaaugggaauccuucuaaa

SEQ ID NO: 1107426 - RNA, 19 nt, Homo sapiens
aaguagaacugcacauuaa

SEQ ID NO: 1107427 - RNA, 19 nt, Homo sapiens
gcauaaaggacaaguagaa

SEQ ID NO: 1107428 - RNA, 19 nt, Homo sapiens
gcaagucuaugcggacaaa

SEQ ID NO: 1107429 - RNA, 19 nt, Homo sapiens
aaacaggccucucacacaa

SEQ ID NO: 1107430 - RNA, 19 nt, Homo sapiens
gaacuucugauucugauug

SEQ ID NO: 1107431 - RNA, 19 nt, Homo sapiens
acacagugguuauaugauu

SEQ ID NO: 1107432 - RNA, 19 nt, Homo sapiens
uagaaucacucaacacuca

SEQ ID NO: 1107433 - RNA, 19 nt, Homo sapiens
ccaauacuguuguagcaaa

SEQ ID NO: 1107434 - RNA, 19 nt, Homo sapiens
uggcaagguucauagaaua

SEQ ID NO: 1107435 - RNA, 19 nt, Homo sapiens
gccuagaucuucaguauca

SEQ ID NO: 1107436 - RNA, 19 nt, Homo sapiens
gauccucugugaauucuga

SEQ ID NO: 1107437 - RNA, 19 nt, Homo sapiens
gagaagcaguuaucagagu

SEQ ID NO: 1107438 - RNA, 19 nt, Homo sapiens
gcaagaaagccaccaacaa

SEQ ID NO: 1107439 - RNA, 19 nt, Homo sapiens
gaaagcauuggacacauuu

SEQ ID NO: 1107440 - RNA, 19 nt, Homo sapiens
ugguaaggauguugaguua

SEQ ID NO: 1107441 - RNA, 19 nt, Homo sapiens
gaaacaggccucucacaca

SEQ ID NO: 1107442 - RNA, 19 nt, Homo sapiens
ccaugcagcucgccacaaa

SEQ ID NO: 1107443 - RNA, 19 nt, Homo sapiens
gggaacaacugagagcaaa

SEQ ID NO: 1107444 - RNA, 19 nt, Homo sapiens
gagcugagccugaaauugg

SEQ ID NO: 1107445 - RNA, 19 nt, Homo sapiens
caacaaggcagccgaggaa

SEQ ID NO: 1107446 - RNA, 19 nt, Homo sapiens
gaacagaagaagcucucua

SEQ ID NO: 1107447 - RNA, 19 nt, Homo sapiens
acacacacuuaaacacaua

SEQ ID NO: 1107448 - RNA, 19 nt, Homo sapiens
ccugguaucuguaucugua

SEQ ID NO: 1107449 - RNA, 19 nt, Homo sapiens
gaagagaaccggaccaaaa

SEQ ID NO: 1107450 - RNA, 19 nt, Homo sapiens
ggauacggcugaaggagau

SEQ ID NO: 1107451 - RNA, 19 nt, Homo sapiens
ccaguuuccugcauaaguu

SEQ ID NO: 1107452 - RNA, 19 nt, Homo sapiens
acaggaaggugaggaaauu

SEQ ID NO: 1107453 - RNA, 19 nt, Homo sapiens
aaaagugccugaaauauga

SEQ ID NO: 1107454 - RNA, 19 nt, Homo sapiens
gugauuugcuaucuauuug

SEQ ID NO: 1107455 - RNA, 19 nt, Homo sapiens
caagaaagccaccaacaag

SEQ ID NO: 1107456 - RNA, 19 nt, Homo sapiens
gauggaaaucaguguauaa

SEQ ID NO: 1107457 - RNA, 19 nt, Homo sapiens
aaaaugagauccucuguga

SEQ ID NO: 1107458 - RNA, 19 nt, Homo sapiens
aaaggcaccucaaagaugu

SEQ ID NO: 1107459 - RNA, 19 nt, Homo sapiens
caacauagccaagaugaca

SEQ ID NO: 1107460 - RNA, 19 nt, Homo sapiens
aacccacucucuauucuua

SEQ ID NO: 1107461 - RNA, 19 nt, Homo sapiens
gcaagguucauagaauaua

SEQ ID NO: 1107462 - RNA, 19 nt, Homo sapiens
caguacagcuggcaagguu

SEQ ID NO: 1107463 - RNA, 19 nt, Homo sapiens
aaaccaggauuaccaguuc

SEQ ID NO: 1107464 - RNA, 19 nt, Homo sapiens
caaaugaagccuagaucuu

SEQ ID NO: 1107465 - RNA, 19 nt, Homo sapiens
gcuguuacuugaauaggaa

SEQ ID NO: 1107466 - RNA, 19 nt, Homo sapiens
cagaaaggcaccucaaaga

SEQ ID NO: 1107467 - RNA, 19 nt, Homo sapiens
cuaaugagcaauugaagaa

SEQ ID NO: 1107468 - RNA, 19 nt, Homo sapiens
ucaccuacaugcuagagaa

SEQ ID NO: 1107469 - RNA, 19 nt, Homo sapiens
gaagaacgcuauggaaaau

SEQ ID NO: 1107470 - RNA, 19 nt, Homo sapiens
gaaacccuccugagcacua

SEQ ID NO: 1107471 - RNA, 19 nt, Homo sapiens
uuauagagcccuugagaaa

SEQ ID NO: 1107472 - RNA, 19 nt, Homo sapiens
uaucaggcuuucaagauga

SEQ ID NO: 1107473 - RNA, 19 nt, Homo sapiens
aaaggcaggugauggaaau

SEQ ID NO: 1107474 - RNA, 19 nt, Homo sapiens
gaccuccugcuauaauuua

SEQ ID NO: 1107475 - RNA, 19 nt, Homo sapiens
aagccuagaucuucaguau

SEQ ID NO: 1107476 - RNA, 19 nt, Homo sapiens
aauaggaaaugguuacuca

SEQ ID NO: 1107477 - RNA, 19 nt, Homo sapiens
gcaauugaagaaaccagua

SEQ ID NO: 1107478 - RNA, 19 nt, Homo sapiens
gaaagaagaaauggaaagu

SEQ ID NO: 1107479 - RNA, 19 nt, Homo sapiens
gguuacucauucuguauaa

SEQ ID NO: 1107480 - RNA, 19 nt, Homo sapiens
ggugauuugcuaucuauuu

SEQ ID NO: 1107481 - RNA, 19 nt, Homo sapiens
cccaacagcucucccuuug

SEQ ID NO: 1107482 - RNA, 19 nt, Homo sapiens
cagauucacuagccaacaa

SEQ ID NO: 1107483 - RNA, 19 nt, Homo sapiens
gguacucacuaagcguuua

SEQ ID NO: 1107484 - RNA, 19 nt, Homo sapiens
acagagauacuuucauuga

SEQ ID NO: 1107485 - RNA, 19 nt, Homo sapiens
uaucagaguuugacaucga

SEQ ID NO: 1107486 - RNA, 19 nt, Homo sapiens
ucucaagcaucuacuguug

SEQ ID NO: 1107487 - RNA, 19 nt, Homo sapiens
ccagucaucguaccaagua

SEQ ID NO: 1107488 - RNA, 19 nt, Homo sapiens
ggagcaacauagccaagau

SEQ ID NO: 1107489 - RNA, 19 nt, Homo sapiens
ccaaaacccugaaagaaga

SEQ ID NO: 1107490 - RNA, 19 nt, Homo sapiens
cuccacagcuuauaguuug

SEQ ID NO: 1107491 - RNA, 19 nt, Homo sapiens
ggagaggccuuggugucuu

SEQ ID NO: 1107492 - RNA, 19 nt, Homo sapiens
cacagugguuauaugauuu

SEQ ID NO: 1107493 - RNA, 19 nt, Homo sapiens
guugcaaccucuuucauuc

SEQ ID NO: 1107494 - RNA, 19 nt, Homo sapiens
caacacagagauacuuuca

SEQ ID NO: 1107495 - RNA, 19 nt, Homo sapiens
uagagaagcaguuaucaga

SEQ ID NO: 1107496 - RNA, 19 nt, Homo sapiens
caagcuuuguguucugaaa

SEQ ID NO: 1107497 - RNA, 19 nt, Homo sapiens
gaauuaugcagaagugguu

SEQ ID NO: 1107498 - RNA, 19 nt, Homo sapiens
gagaggccuuggugucuuc

SEQ ID NO: 1107499 - RNA, 19 nt, Homo sapiens
gaaaggagcuguugaagau

SEQ ID NO: 1107500 - RNA, 19 nt, Homo sapiens
cuagagagcugacuaauga

SEQ ID NO: 1107501 - RNA, 19 nt, Homo sapiens
gaaguuagaugccaaaaua

SEQ ID NO: 1107502 - RNA, 19 nt, Homo sapiens
guaaaugccuaaugaggua

SEQ ID NO: 1107503 - RNA, 19 nt, Homo sapiens
ccaaauggcugaagguauu

SEQ ID NO: 1107504 - RNA, 19 nt, Homo sapiens
caagauacccuguugauaa

SEQ ID NO: 1107505 - RNA, 19 nt, Homo sapiens
gcagaaacguauugaaguu

SEQ ID NO: 1107506 - RNA, 19 nt, Homo sapiens
caagagacaucuaccaaga

SEQ ID NO: 1107507 - RNA, 19 nt, Homo sapiens
gaacgacacagcucaguuu

SEQ ID NO: 1107508 - RNA, 19 nt, Homo sapiens
uauaaaggcucuguaguuu

SEQ ID NO: 1107509 - RNA, 19 nt, Homo sapiens
ggagaugccuucauaugau

SEQ ID NO: 1107510 - RNA, 19 nt, Homo sapiens
uaagaugucucaccuuguu

SEQ ID NO: 1107511 - RNA, 19 nt, Homo sapiens
gaacagaucaucagaaacu

SEQ ID NO: 1107512 - RNA, 19 nt, Homo sapiens
gaagaaaggagcuguugaa

SEQ ID NO: 1107513 - RNA, 19 nt, Homo sapiens
gcaagccgguuccaaauuc

SEQ ID NO: 1107514 - RNA, 19 nt, Homo sapiens
aaaggaagcuugaacuguu

SEQ ID NO: 1107515 - RNA, 19 nt, Homo sapiens
cagcaacucuccauuauag

SEQ ID NO: 1107516 - RNA, 19 nt, Homo sapiens
agacaaauccugaguauau

SEQ ID NO: 1107517 - RNA, 19 nt, Homo sapiens
gaaggaagaccuacuagau

SEQ ID NO: 1107518 - RNA, 19 nt, Homo sapiens
gaaugacaguugaguaugu

SEQ ID NO: 1107519 - RNA, 19 nt, Homo sapiens
uaacaauucugccucauuc

SEQ ID NO: 1107520 - RNA, 19 nt, Homo sapiens
acagcaaucugcaacaaua

SEQ ID NO: 1107521 - RNA, 19 nt, Homo sapiens
gacaaauccugaguauaua

SEQ ID NO: 1107522 - RNA, 19 nt, Homo sapiens
uaagacaaauccugaguau

SEQ ID NO: 1107523 - RNA, 19 nt, Homo sapiens
gccaaacacuggaccaauu

SEQ ID NO: 1107524 - RNA, 19 nt, Homo sapiens
ggaauucucaguauuguga

SEQ ID NO: 1107525 - RNA, 19 nt, Homo sapiens
gaagaugugauuucaagaa

SEQ ID NO: 1107526 - RNA, 19 nt, Homo sapiens
cuccaaaggugaccaauaa

SEQ ID NO: 1107527 - RNA, 19 nt, Homo sapiens
caagcaaauugagaucuua

SEQ ID NO: 1107528 - RNA, 19 nt, Homo sapiens
caacaccuuugaucuuuga

SEQ ID NO: 1107529 - RNA, 19 nt, Homo sapiens
gagccaaaguugaucagaa

SEQ ID NO: 1107530 - RNA, 19 nt, Homo sapiens
gcuuauuucuggaauguaa

SEQ ID NO: 1107531 - RNA, 19 nt, Homo sapiens
ucacagcaacucuccauua

SEQ ID NO: 1107532 - RNA, 19 nt, Homo sapiens
aaacuuugguucaaucuga

SEQ ID NO: 1107533 - RNA, 19 nt, Homo sapiens
gaagugauuuacuguaucu

SEQ ID NO: 1107534 - RNA, 19 nt, Homo sapiens
gcacagcaaucugcaacaa

SEQ ID NO: 1107535 - RNA, 19 nt, Homo sapiens
ccaaaggugaccaauaaua

SEQ ID NO: 1107536 - RNA, 19 nt, Homo sapiens
uaacagccaacauguauuu

SEQ ID NO: 1107537 - RNA, 19 nt, Homo sapiens
gaaguauggucuuaagagu

SEQ ID NO: 1107538 - RNA, 19 nt, Homo sapiens
aaagaauucuguccacuug

SEQ ID NO: 1107539 - RNA, 19 nt, Homo sapiens
uaaggacccugauuccauu

SEQ ID NO: 1107540 - RNA, 19 nt, Homo sapiens
gcagagagacucacagcaa

SEQ ID NO: 1107541 - RNA, 19 nt, Homo sapiens
agagagcaguugaaaguuu

SEQ ID NO: 1107542 - RNA, 19 nt, Homo sapiens
cagaugauauugugcaguu

SEQ ID NO: 1107543 - RNA, 19 nt, Homo sapiens
caagagagauauugaacag

SEQ ID NO: 1107544 - RNA, 19 nt, Homo sapiens
aauaugagaugaugccaaa

SEQ ID NO: 1107545 - RNA, 19 nt, Homo sapiens
ugucucaccuuguucauuu

SEQ ID NO: 1107546 - RNA, 19 nt, Homo sapiens
gcccagaaguauggucuua

SEQ ID NO: 1107547 - RNA, 19 nt, Homo sapiens
gaagccaguuauagaaugu

SEQ ID NO: 1107548 - RNA, 19 nt, Homo sapiens
caacugucauuaacaacuu

SEQ ID NO: 1107549 - RNA, 19 nt, Homo sapiens
cagcaacugucauuaacaa

SEQ ID NO: 1107550 - RNA, 19 nt, Homo sapiens
gcaaaugaugcaauuggua

SEQ ID NO: 1107551 - RNA, 19 nt, Homo sapiens
cacaacaccuuugaucuuu

SEQ ID NO: 1107552 - RNA, 19 nt, Homo sapiens
gcaagaacacauauccaaa

SEQ ID NO: 1107553 - RNA, 19 nt, Homo sapiens
agaauucuguccacuugua

SEQ ID NO: 1107554 - RNA, 19 nt, Homo sapiens
aguauggucuuaagaguaa

SEQ ID NO: 1107555 - RNA, 19 nt, Homo sapiens
cggcggaaauucaagcaua

SEQ ID NO: 1107556 - RNA, 19 nt, Homo sapiens
gaugggaauucucaguauu

SEQ ID NO: 1107557 - RNA, 19 nt, Homo sapiens
aagauacccuguugauaaa

SEQ ID NO: 1107558 - RNA, 19 nt, Homo sapiens
gauauuggaaccuaaagaa

SEQ ID NO: 1107559 - RNA, 19 nt, Homo sapiens
gcaaauugagaucuuacua

SEQ ID NO: 1107560 - RNA, 19 nt, Homo sapiens
ggaagcaaauacaucagau

SEQ ID NO: 1107561 - RNA, 19 nt, Homo sapiens
gaaacguauugaaguuaga

SEQ ID NO: 1107562 - RNA, 19 nt, Homo sapiens
gaaaggaagcuugaacugu

SEQ ID NO: 1107563 - RNA, 19 nt, Homo sapiens
gaacggaagcaaauacauc

SEQ ID NO: 1107564 - RNA, 19 nt, Homo sapiens
cugcuuagcugaagguuau

SEQ ID NO: 1107565 - RNA, 19 nt, Homo sapiens
uuuacaagaucacugcuua

SEQ ID NO: 1107566 - RNA, 19 nt, Homo sapiens
gggagaugccuucauauga

SEQ ID NO: 1107567 - RNA, 19 nt, Homo sapiens
gauagagaccacaaucaaa

SEQ ID NO: 1107568 - RNA, 19 nt, Homo sapiens
ggugcuagaugauuucuca

SEQ ID NO: 1107569 - RNA, 19 nt, Homo sapiens
guacauguccuuaccaaca

SEQ ID NO: 1107570 - RNA, 19 nt, Homo sapiens
ccacacagauuugacuuuc

SEQ ID NO: 1107571 - RNA, 19 nt, Homo sapiens
caauugguauccuuaacaa

SEQ ID NO: 1107572 - RNA, 19 nt, Homo sapiens
gaaaugacuucuggaucug

SEQ ID NO: 1107573 - RNA, 19 nt, Homo sapiens
ggaagugauuuacuguauc

SEQ ID NO: 1107574 - RNA, 19 nt, Homo sapiens
ggaaauucaagcauacauu

SEQ ID NO: 1107575 - RNA, 19 nt, Homo sapiens
gaaucagccauuucucuaa

SEQ ID NO: 1107576 - RNA, 19 nt, Homo sapiens
uaacuucuaccaugugauu

SEQ ID NO: 1107577 - RNA, 19 nt, Homo sapiens
uugaacagaucaucagaaa

SEQ ID NO: 1107578 - RNA, 19 nt, Homo sapiens
cacagcaacucuccauuau

SEQ ID NO: 1107579 - RNA, 19 nt, Homo sapiens
caguaagagucuauucaaa

SEQ ID NO: 1107580 - RNA, 19 nt, Homo sapiens
caagaacacauauccaaau

SEQ ID NO: 1107581 - RNA, 19 nt, Homo sapiens
ugacaagcaagaacacaua

SEQ ID NO: 1107582 - RNA, 19 nt, Homo sapiens
agagagauauugaacagau

SEQ ID NO: 1107583 - RNA, 19 nt, Homo sapiens
ucuagagagugaaguaauu

SEQ ID NO: 1107584 - RNA, 19 nt, Homo sapiens
cgacacagcucaguuuaac

SEQ ID NO: 1107585 - RNA, 19 nt, Homo sapiens
agagguaaaugaacaaaca

SEQ ID NO: 1107586 - RNA, 19 nt, Homo sapiens
caaaagagguaaaugaaca

SEQ ID NO: 1107587 - RNA, 19 nt, Homo sapiens
gaaaugauagagaccacaa

SEQ ID NO: 1107588 - RNA, 19 nt, Homo sapiens
aaagaaaugcuacauguuc

SEQ ID NO: 1107589 - RNA, 19 nt, Homo sapiens
caaaggugaccaauaauag

SEQ ID NO: 1107590 - RNA, 19 nt, Homo sapiens
caaagugauucuagagagu

SEQ ID NO: 1107591 - RNA, 19 nt, Homo sapiens
caaaugaugcaauugguau

SEQ ID NO: 1107592 - RNA, 19 nt, Homo sapiens
gagaagcaguauuuuauug

SEQ ID NO: 1107593 - RNA, 19 nt, Homo sapiens
aagccaacuuuguaacaua

SEQ ID NO: 1107594 - RNA, 19 nt, Homo sapiens
ugagagagcaguugaaagu

SEQ ID NO: 1107595 - RNA, 19 nt, Homo sapiens
ccaaacacuggaccaauuu

SEQ ID NO: 1107596 - RNA, 19 nt, Homo sapiens
cuaccaagauuauacucaa

SEQ ID NO: 1107597 - RNA, 19 nt, Homo sapiens
guguaugcuuccugaauaa

SEQ ID NO: 1107598 - RNA, 19 nt, Homo sapiens
gcugagagagcacuacuug

SEQ ID NO: 1107599 - RNA, 19 nt, Homo sapiens
ggaggugggugauggcuua

SEQ ID NO: 1107600 - RNA, 19 nt, Homo sapiens
gaaccgaacccgacaaaug

SEQ ID NO: 1107601 - RNA, 19 nt, Homo sapiens
gcacucacccucaggauuu

SEQ ID NO: 1107602 - RNA, 19 nt, Homo sapiens
aagaguagcuggagaguga

SEQ ID NO: 1107603 - RNA, 19 nt, Homo sapiens
caagggcucuggucauuuc

SEQ ID NO: 1107604 - RNA, 19 nt, Homo sapiens
ccucaggauuugauauuaa

SEQ ID NO: 1107605 - RNA, 19 nt, Homo sapiens
aaagagcccuggagcauca

SEQ ID NO: 1107606 - RNA, 19 nt, Homo sapiens
ggacacagccacaucaaag

SEQ ID NO: 1107607 - RNA, 19 nt, Homo sapiens
gaucagaugaacugcauga

SEQ ID NO: 1107608 - RNA, 19 nt, Homo sapiens
ccaaagaccuccguugaac

SEQ ID NO: 1107609 - RNA, 19 nt, Homo sapiens
ugacagcaaacaucuuuaa

SEQ ID NO: 1107610 - RNA, 19 nt, Homo sapiens
gcucacagaaggucaagaa

SEQ ID NO: 1107611 - RNA, 19 nt, Homo sapiens
ugaacauucuguauggaaa

SEQ ID NO: 1107612 - RNA, 19 nt, Homo sapiens
ggaaauggacugcuaucuc

SEQ ID NO: 1107613 - RNA, 19 nt, Homo sapiens
gaaaaucccucugacaucu

SEQ ID NO: 1107614 - RNA, 19 nt, Homo sapiens
cagaggaggagaucagaaa

SEQ ID NO: 1107615 - RNA, 19 nt, Homo sapiens
caaaugggcgcaugacgau

SEQ ID NO: 1107616 - RNA, 19 nt, Homo sapiens
ucgacagccucugguguua

SEQ ID NO: 1107617 - RNA, 19 nt, Homo sapiens
uccaagggcucuggucauu

SEQ ID NO: 1107618 - RNA, 19 nt, Homo sapiens
aaaguugacugagccugaa

SEQ ID NO: 1107619 - RNA, 19 nt, Homo sapiens
ccugacagcaaacaucuuu

SEQ ID NO: 1107620 - RNA, 19 nt, Homo sapiens
aacaggagcugauguccau

SEQ ID NO: 1107621 - RNA, 19 nt, Homo sapiens
gguggaggagguaagagua

SEQ ID NO: 1107622 - RNA, 19 nt, Homo sapiens
gucaagaagcggagccuuu

SEQ ID NO: 1107623 - RNA, 19 nt, Homo sapiens
uggaacagcuggagaucuc

SEQ ID NO: 1107624 - RNA, 19 nt, Homo sapiens
gaaaagagcccuggagcau

SEQ ID NO: 1107625 - RNA, 19 nt, Homo sapiens
gagacagaaaguugacuga

SEQ ID NO: 1107626 - RNA, 19 nt, Homo sapiens
gugaccggcugcugaagga

SEQ ID NO: 1107627 - RNA, 19 nt, Homo sapiens
agaccuccguugaacauuc

SEQ ID NO: 1107628 - RNA, 19 nt, Homo sapiens
gagcugugcgugugugugu

SEQ ID NO: 1107629 - RNA, 19 nt, Homo sapiens
ucagaugaacugcaugaug

SEQ ID NO: 1107630 - RNA, 19 nt, Homo sapiens
gcagaggaggagaucagaa

SEQ ID NO: 1107631 - RNA, 19 nt, Homo sapiens
cccucaggauuugauauua

SEQ ID NO: 1107632 - RNA, 19 nt, Homo sapiens
cguugaacauucuguaugg

SEQ ID NO: 1107633 - RNA, 19 nt, Homo sapiens
cauaggagugucuguggaa

SEQ ID NO: 1107634 - RNA, 19 nt, Homo sapiens
gacagccucugguguuagg

SEQ ID NO: 1107635 - RNA, 19 nt, Homo sapiens
gaccuccguugaacauucu

SEQ ID NO: 1107636 - RNA, 19 nt, Homo sapiens
caaagaccuccguugaaca

SEQ ID NO: 1107637 - RNA, 19 nt, Homo sapiens
ucaagaagcggagccuuuc

SEQ ID NO: 1107638 - RNA, 19 nt, Homo sapiens
gcaucagguuccccagaua

SEQ ID NO: 1107639 - RNA, 19 nt, Homo sapiens
guugggagaggcugucuug

SEQ ID NO: 1107640 - RNA, 19 nt, Homo sapiens
gcuuacaggaucagaugaa

SEQ ID NO: 1107641 - RNA, 19 nt, Homo sapiens
gggcaauuggcuagacuug

SEQ ID NO: 1107642 - RNA, 19 nt, Homo sapiens
gcagacagcacuggaacag

SEQ ID NO: 1107643 - RNA, 19 nt, Homo sapiens
gaacauucuguauggaaaa

SEQ ID NO: 1107644 - RNA, 19 nt, Homo sapiens
aaagaccuccguugaacau

SEQ ID NO: 1107645 - RNA, 19 nt, Homo sapiens
cccaaagaccuccguugaa

SEQ ID NO: 1107646 - RNA, 19 nt, Homo sapiens
cgguauggcucucgaaagc

SEQ ID NO: 1107647 - RNA, 19 nt, Homo sapiens
ccuagagacagaaaguuga

SEQ ID NO: 1107648 - RNA, 19 nt, Homo sapiens
cgaaagcccaacuccaagu

SEQ ID NO: 1107649 - RNA, 19 nt, Homo sapiens
ccaagggcucuggucauuu

SEQ ID NO: 1107650 - RNA, 19 nt, Homo sapiens
ucaaacaggagcugauguc

SEQ ID NO: 1107651 - RNA, 19 nt, Homo sapiens
ccaggacacagccacauca

SEQ ID NO: 1107652 - RNA, 19 nt, Homo sapiens
caggagcugauguccauga

SEQ ID NO: 1107653 - RNA, 19 nt, Homo sapiens
ccaaguuuccaucccauag

SEQ ID NO: 1107654 - RNA, 19 nt, Homo sapiens
ggaccuccacguugauguc

SEQ ID NO: 1107655 - RNA, 19 nt, Homo sapiens
ggcagcagcaccaaguuuc

SEQ ID NO: 1107656 - RNA, 19 nt, Homo sapiens
cuaucuccgucgccucaaa

SEQ ID NO: 1107657 - RNA, 19 nt, Homo sapiens
aggaucagaugaacugcau

SEQ ID NO: 1107658 - RNA, 19 nt, Homo sapiens
gcagaccuggugggcaauu

SEQ ID NO: 1107659 - RNA, 19 nt, Homo sapiens
uggcagcagcaccaaguuu

SEQ ID NO: 1107660 - RNA, 19 nt, Homo sapiens
aaauagagcugcugaguug

SEQ ID NO: 1107661 - RNA, 19 nt, Homo sapiens
ggacuaaggcagaaacuga

SEQ ID NO: 1107662 - RNA, 19 nt, Homo sapiens
gagcugagcccgacaccua

SEQ ID NO: 1107663 - RNA, 19 nt, Homo sapiens
gcacagaccuuaagauacc

SEQ ID NO: 1107664 - RNA, 19 nt, Homo sapiens
gagcaggaguaccagcuuu

SEQ ID NO: 1107665 - RNA, 19 nt, Homo sapiens
gcaagaaggacauuaucaa

SEQ ID NO: 1107666 - RNA, 19 nt, Homo sapiens
ccaaggacaccaucauuga

SEQ ID NO: 1107667 - RNA, 19 nt, Homo sapiens
aaacugaccaccucuuuga

SEQ ID NO: 1107668 - RNA, 19 nt, Homo sapiens
gcucuacucugacaagaag

SEQ ID NO: 1107669 - RNA, 19 nt, Homo sapiens
gugcuaagcuugccaacgu

SEQ ID NO: 1107670 - RNA, 19 nt, Homo sapiens
ggaccacccuucuccucuu

SEQ ID NO: 1107671 - RNA, 19 nt, Homo sapiens
gaagaaggagcgggagaaa

SEQ ID NO: 1107672 - RNA, 19 nt, Homo sapiens
gaaacugaccaccucuuug

SEQ ID NO: 1107673 - RNA, 19 nt, Homo sapiens
gaagaucaaggcccuggaa

SEQ ID NO: 1107674 - RNA, 19 nt, Homo sapiens
caagaaguccucugagaca

SEQ ID NO: 1107675 - RNA, 19 nt, Homo sapiens
ucaaggcccuggaacagau

SEQ ID NO: 1107676 - RNA, 19 nt, Homo sapiens
ggacggagcaauguucuuc

SEQ ID NO: 1107677 - RNA, 19 nt, Homo sapiens
ggaaguggaugccauucac

SEQ ID NO: 1107678 - RNA, 19 nt, Homo sapiens
aaaagaagcuaccccagaa

SEQ ID NO: 1107679 - RNA, 19 nt, Homo sapiens
uaaauagagcugcugaguu

SEQ ID NO: 1107680 - RNA, 19 nt, Homo sapiens
ggaagaaggagcgggagaa

SEQ ID NO: 1107681 - RNA, 19 nt, Homo sapiens
aggcacagaccuuaagaua

SEQ ID NO: 1107682 - RNA, 19 nt, Homo sapiens
gguaugaccaccagcaguu

SEQ ID NO: 1107683 - RNA, 19 nt, Homo sapiens
guacagugaaggccaaguu

SEQ ID NO: 1107684 - RNA, 19 nt, Homo sapiens
cggaggagcuggugcacau

SEQ ID NO: 1107685 - RNA, 19 nt, Homo sapiens
gaugaugcuuggacuaagg

SEQ ID NO: 1107686 - RNA, 19 nt, Homo sapiens
ccucugagacacugacuuu

SEQ ID NO: 1107687 - RNA, 19 nt, Homo sapiens
uaucaacccggacaagaaa

SEQ ID NO: 1107688 - RNA, 19 nt, Homo sapiens
gaccacccuucuccucuug

SEQ ID NO: 1107689 - RNA, 19 nt, Homo sapiens
gcaaggacggagcaauguu

SEQ ID NO: 1107690 - RNA, 19 nt, Homo sapiens
uccaagaaguccucugaga

SEQ ID NO: 1107691 - RNA, 19 nt, Homo sapiens
guaaauagagcugcugagu

SEQ ID NO: 1107692 - RNA, 19 nt, Homo sapiens
uacaggagcugcgcaagau

SEQ ID NO: 1107693 - RNA, 19 nt, Homo sapiens
agaaacugaccaccucuuu

SEQ ID NO: 1107694 - RNA, 19 nt, Homo sapiens
gaccugcguuuuguuguua

SEQ ID NO: 1107695 - RNA, 19 nt, Homo sapiens
caaggacggagcaauguuc

SEQ ID NO: 1107696 - RNA, 19 nt, Homo sapiens
cugagacacugacuuucaa

SEQ ID NO: 1107697 - RNA, 19 nt, Homo sapiens
gaucaaggcccuggaacag

SEQ ID NO: 1107698 - RNA, 19 nt, Homo sapiens
caagaaggacauuaucaac

SEQ ID NO: 1107699 - RNA, 19 nt, Homo sapiens
gcaggaguaccagcuuuau

SEQ ID NO: 1107700 - RNA, 19 nt, Homo sapiens
uggugcacauguucaauga

SEQ ID NO: 1107701 - RNA, 19 nt, Homo sapiens
ucagcaagaaggacauuau

SEQ ID NO: 1107702 - RNA, 19 nt, Homo sapiens
gggauaccguacagugaag

SEQ ID NO: 1107703 - RNA, 19 nt, Homo sapiens
ggugugggcgacgcuguua

SEQ ID NO: 1107704 - RNA, 19 nt, Homo sapiens
aguaugagcugcagaugcu

SEQ ID NO: 1107705 - RNA, 19 nt, Homo sapiens
cuacaggagcugcgcaaga

SEQ ID NO: 1107706 - RNA, 19 nt, Homo sapiens
agcuuuaucuccacgauga

SEQ ID NO: 1107707 - RNA, 19 nt, Homo sapiens
caggagcugcgcaagauug

SEQ ID NO: 1107708 - RNA, 19 nt, Homo sapiens
gcaugcaccgggaagucua

SEQ ID NO: 1107709 - RNA, 19 nt, Homo sapiens
ccgcuuaggucuggauugg

SEQ ID NO: 1107710 - RNA, 19 nt, Homo sapiens
cugcggagccaacggauga

SEQ ID NO: 1107711 - RNA, 19 nt, Homo sapiens
ccgcaaggacggagcaaug

SEQ ID NO: 1107712 - RNA, 19 nt, Homo sapiens
gagacacugacuuucaaga

SEQ ID NO: 1107713 - RNA, 19 nt, Homo sapiens
gacugcaggcaucaaguuu

SEQ ID NO: 1107714 - RNA, 19 nt, Homo sapiens
guacgggacauucuagaac

SEQ ID NO: 1107715 - RNA, 19 nt, Homo sapiens
gaacagcuugagcgucucu

SEQ ID NO: 1107716 - RNA, 19 nt, Homo sapiens
gaagcguucuguggaagac

SEQ ID NO: 1107717 - RNA, 19 nt, Homo sapiens
gaggagcuggugcacaugu

SEQ ID NO: 1107718 - RNA, 19 nt, Homo sapiens
aauccaagaaguccucuga

SEQ ID NO: 1107719 - RNA, 19 nt, Homo sapiens
cggaggagggcaaggacua

SEQ ID NO: 1107720 - RNA, 19 nt, Homo sapiens
caacucgccuccgcuuagg

SEQ ID NO: 1107721 - RNA, 19 nt, Homo sapiens
uagagcugcugaguuggaa

SEQ ID NO: 1107722 - RNA, 19 nt, Homo sapiens
ggcaucaaguuuccagacu

SEQ ID NO: 1107723 - RNA, 19 nt, Homo sapiens
ucaacucgccuccgcuuag

SEQ ID NO: 1107724 - RNA, 19 nt, Homo sapiens
uuugccagguucaauaaga

SEQ ID NO: 1107725 - RNA, 19 nt, Homo sapiens
ggccagggauaccguacag

SEQ ID NO: 1107726 - RNA, 19 nt, Homo sapiens
cccaaggacaccaucauug

SEQ ID NO: 1107727 - RNA, 19 nt, Homo sapiens
ucugagacacugacuuuca

SEQ ID NO: 1107728 - RNA, 19 nt, Homo sapiens
cagggauaccguacaguga

SEQ ID NO: 1107729 - RNA, 19 nt, Homo sapiens
uuaucaacccggacaagaa

SEQ ID NO: 1107730 - RNA, 19 nt, Homo sapiens
gcgaguaugagcugcagau

SEQ ID NO: 1107731 - RNA, 19 nt, Homo sapiens
agacugcaggcaucaaguu

SEQ ID NO: 1107732 - RNA, 19 nt, Homo sapiens
cagcaagaaggacauuauc

SEQ ID NO: 1107733 - RNA, 19 nt, Homo sapiens
ggagcaggaguaccagcuu

SEQ ID NO: 1107734 - RNA, 19 nt, Homo sapiens
gagcuggugcacauguuca

SEQ ID NO: 1107735 - RNA, 19 nt, Homo sapiens
gcugagaagccggcuguuc

SEQ ID NO: 1107736 - RNA, 19 nt, Homo sapiens
agaaggagcgggagaaacg

SEQ ID NO: 1107737 - RNA, 19 nt, Homo sapiens
uguuauccaugaccgguau

SEQ ID NO: 1107738 - RNA, 19 nt, Homo sapiens
ggaccaucagcaagaagga

SEQ ID NO: 1107739 - RNA, 19 nt, Homo sapiens
ggagcuggugcacauguuc

SEQ ID NO: 1107740 - RNA, 19 nt, Homo sapiens
augccuugcucuacucuga

SEQ ID NO: 1107741 - RNA, 19 nt, Homo sapiens
gaacggagcuggauuauuc

SEQ ID NO: 1107742 - RNA, 19 nt, Homo sapiens
gaacagcuuugaacaauuu

SEQ ID NO: 1107743 - RNA, 19 nt, Homo sapiens
gaaguuacccuuugaauuu

SEQ ID NO: 1107744 - RNA, 19 nt, Homo sapiens
gaagauagauguggagaaa

SEQ ID NO: 1107745 - RNA, 19 nt, Homo sapiens
ggacauacaucgaguucua

SEQ ID NO: 1107746 - RNA, 19 nt, Homo sapiens
gcacuuugcugauaaggua

SEQ ID NO: 1107747 - RNA, 19 nt, Homo sapiens
gauaagaacuugcagaaca

SEQ ID NO: 1107748 - RNA, 19 nt, Homo sapiens
gcacagcagucggaauuua

SEQ ID NO: 1107749 - RNA, 19 nt, Homo sapiens
ccaaauaucucuuucaagu

SEQ ID NO: 1107750 - RNA, 19 nt, Homo sapiens
ccaagcagcucuuugauga

SEQ ID NO: 1107751 - RNA, 19 nt, Homo sapiens
agagaagacugaagaguua

SEQ ID NO: 1107752 - RNA, 19 nt, Homo sapiens
gaagaauggcuuaaagaua

SEQ ID NO: 1107753 - RNA, 19 nt, Homo sapiens
gaagaagaauuagacauga

SEQ ID NO: 1107754 - RNA, 19 nt, Homo sapiens
uggaagaucuggaacauuu

SEQ ID NO: 1107755 - RNA, 19 nt, Homo sapiens
gaaagaugcuggaggaaca

SEQ ID NO: 1107756 - RNA, 19 nt, Homo sapiens
aaucuuaccugccaacaua

SEQ ID NO: 1107757 - RNA, 19 nt, Homo sapiens
ggaugaagaauguuuguua

SEQ ID NO: 1107758 - RNA, 19 nt, Homo sapiens
aaagugaagucaaguguaa

SEQ ID NO: 1107759 - RNA, 19 nt, Homo sapiens
gcaagcaggucaagacaau

SEQ ID NO: 1107760 - RNA, 19 nt, Homo sapiens
cagcugugauucuauaaua

SEQ ID NO: 1107761 - RNA, 19 nt, Homo sapiens
aggagaagcugauugauaa

SEQ ID NO: 1107762 - RNA, 19 nt, Homo sapiens
ucaauugccugaagcagua

SEQ ID NO: 1107763 - RNA, 19 nt, Homo sapiens
gaugagaaguuacccuuug

SEQ ID NO: 1107764 - RNA, 19 nt, Homo sapiens
ugacagcugugauucuaua

SEQ ID NO: 1107765 - RNA, 19 nt, Homo sapiens
gcagaguuguguuauggua

SEQ ID NO: 1107766 - RNA, 19 nt, Homo sapiens
gccaacauauucaccauaa

SEQ ID NO: 1107767 - RNA, 19 nt, Homo sapiens
uuaaagcucucaaggauga

SEQ ID NO: 1107768 - RNA, 19 nt, Homo sapiens
agaagcagauucagucuuu

SEQ ID NO: 1107769 - RNA, 19 nt, Homo sapiens
gagcuuuccuucagcgaua

SEQ ID NO: 1107770 - RNA, 19 nt, Homo sapiens
gcacagagcuacccuucca

SEQ ID NO: 1107771 - RNA, 19 nt, Homo sapiens
gagccaacaugagcacuua

SEQ ID NO: 1107772 - RNA, 19 nt, Homo sapiens
gaaccucauucuugacuug

SEQ ID NO: 1107773 - RNA, 19 nt, Homo sapiens
cgaaagcuaugacauugaa

SEQ ID NO: 1107774 - RNA, 19 nt, Homo sapiens
cacaguggcuuccaaguuu

SEQ ID NO: 1107775 - RNA, 19 nt, Homo sapiens
ugacaaugcugcuccugua

SEQ ID NO: 1107776 - RNA, 19 nt, Homo sapiens
gaucuaugcucaccuguuc

SEQ ID NO: 1107777 - RNA, 19 nt, Homo sapiens
cagcaacgcucacguggaa

SEQ ID NO: 1107778 - RNA, 19 nt, Homo sapiens
ccaaacaacuucucgaaag

SEQ ID NO: 1107779 - RNA, 19 nt, Homo sapiens
caggacaaguggcuuauuu

SEQ ID NO: 1107780 - RNA, 19 nt, Homo sapiens
gaagcugauugauaagauu

SEQ ID NO: 1107781 - RNA, 19 nt, Homo sapiens
gaacuuugguuugcuuaug

SEQ ID NO: 1107782 - RNA, 19 nt, Homo sapiens
gaacaagaagaauacauga

SEQ ID NO: 1107783 - RNA, 19 nt, Homo sapiens
guacaggcucuccuaaaua

SEQ ID NO: 1107784 - RNA, 19 nt, Homo sapiens
gaagaauugucuaaucagu

SEQ ID NO: 1107785 - RNA, 19 nt, Homo sapiens
ggagaaacaugugcaguca

SEQ ID NO: 1107786 - RNA, 19 nt, Homo sapiens
cugauaagguagaguauaa

SEQ ID NO: 1107787 - RNA, 19 nt, Homo sapiens
ugaucgagcugaaauggua

SEQ ID NO: 1107788 - RNA, 19 nt, Homo sapiens
acaagcaguugccaauaua

SEQ ID NO: 1107789 - RNA, 19 nt, Homo sapiens
ugauguggcuauacgaaua

SEQ ID NO: 1107790 - RNA, 19 nt, Homo sapiens
ucagaaggauugcuaugaa

SEQ ID NO: 1107791 - RNA, 19 nt, Homo sapiens
gaagaucuggaacauuuaa

SEQ ID NO: 1107792 - RNA, 19 nt, Homo sapiens
gccaaaugaugagaaguua

SEQ ID NO: 1107793 - RNA, 19 nt, Homo sapiens
ugaacgaaauuaccacauu

SEQ ID NO: 1107794 - RNA, 19 nt, Homo sapiens
ccuaaaaccucauuugaua

SEQ ID NO: 1107795 - RNA, 19 nt, Homo sapiens
gaacuugcagaacagcuua

SEQ ID NO: 1107796 - RNA, 19 nt, Homo sapiens
cagaucaggugcaauauca

SEQ ID NO: 1107797 - RNA, 19 nt, Homo sapiens
acagacagauucucaguga

SEQ ID NO: 1107798 - RNA, 19 nt, Homo sapiens
gcucauauccuguucaugu

SEQ ID NO: 1107799 - RNA, 19 nt, Homo sapiens
agacgcagauuccagagua

SEQ ID NO: 1107800 - RNA, 19 nt, Homo sapiens
caacagaaaccaguccaua

SEQ ID NO: 1107801 - RNA, 19 nt, Homo sapiens
ggugacagcugugauucua

SEQ ID NO: 1107802 - RNA, 19 nt, Homo sapiens
gaaugugauuuaaggaaga

SEQ ID NO: 1107803 - RNA, 19 nt, Homo sapiens
gaucaagucaagacacuaa

SEQ ID NO: 1107804 - RNA, 19 nt, Homo sapiens
gaaagugaagucaagugua

SEQ ID NO: 1107805 - RNA, 19 nt, Homo sapiens
gcaagcaaguuucaucucu

SEQ ID NO: 1107806 - RNA, 19 nt, Homo sapiens
guauaaaugugaagguuuc

SEQ ID NO: 1107807 - RNA, 19 nt, Homo sapiens
gaugaaaacuggccucaaa

SEQ ID NO: 1107808 - RNA, 19 nt, Homo sapiens
gaagcgcuccucuagcaua

SEQ ID NO: 1107809 - RNA, 19 nt, Homo sapiens
gaauaagaauugcuugaac

SEQ ID NO: 1107810 - RNA, 19 nt, Homo sapiens
gaaagcauccgucaugaag

SEQ ID NO: 1107811 - RNA, 19 nt, Homo sapiens
gaagagaaauuggcaaagc

SEQ ID NO: 1107812 - RNA, 19 nt, Homo sapiens
gaggagguaucgaaagaug

SEQ ID NO: 1107813 - RNA, 19 nt, Homo sapiens
aagaauacaugaaggaaga

SEQ ID NO: 1107814 - RNA, 19 nt, Homo sapiens
gaaauacacagaaaucagu

SEQ ID NO: 1107815 - RNA, 19 nt, Homo sapiens
ugagggauguguuuuauua

SEQ ID NO: 1107816 - RNA, 19 nt, Homo sapiens
uuggaagucugcugaaaua

SEQ ID NO: 1107817 - RNA, 19 nt, Homo sapiens
gcuggaagaucagaacaaa

SEQ ID NO: 1107818 - RNA, 19 nt, Homo sapiens
gcaaggaggagguaucgaa

SEQ ID NO: 1107819 - RNA, 19 nt, Homo sapiens
gaaauccagaguugucuuu

SEQ ID NO: 1107820 - RNA, 19 nt, Homo sapiens
agaaaccaguccauaauug

SEQ ID NO: 1107821 - RNA, 19 nt, Homo sapiens
caaugcugcuccuguaauu

SEQ ID NO: 1107822 - RNA, 19 nt, Homo sapiens
ucaagcaggugguuaagga

SEQ ID NO: 1107823 - RNA, 19 nt, Homo sapiens
gaaguuauucagagaagaa

SEQ ID NO: 1107824 - RNA, 19 nt, Homo sapiens
ugucagagaucaccaaaca

SEQ ID NO: 1107825 - RNA, 19 nt, Homo sapiens
acaaguggcuuauuuagag

SEQ ID NO: 1107826 - RNA, 19 nt, Homo sapiens
acaagcagauggccagaaa

SEQ ID NO: 1107827 - RNA, 19 nt, Homo sapiens
caagucacauuuccuuuua

SEQ ID NO: 1107828 - RNA, 19 nt, Homo sapiens
cagaaggauugcuaugaaa

SEQ ID NO: 1107829 - RNA, 19 nt, Homo sapiens
ggagaacuuugguuugcuu

SEQ ID NO: 1107830 - RNA, 19 nt, Homo sapiens
gaaaagaugucagagauca

SEQ ID NO: 1107831 - RNA, 19 nt, Homo sapiens
gagaaacuucgauuggaua

SEQ ID NO: 1107832 - RNA, 19 nt, Homo sapiens
ggaacaagaagaauacaug

SEQ ID NO: 1107833 - RNA, 19 nt, Homo sapiens
gugaacagcuuugaacaau

SEQ ID NO: 1107834 - RNA, 19 nt, Homo sapiens
gacaugugcuccugcagaa

SEQ ID NO: 1107835 - RNA, 19 nt, Homo sapiens
cgggaaugcuggaguauga

SEQ ID NO: 1107836 - RNA, 19 nt, Homo sapiens
ggaaggaacacaaagaaag

SEQ ID NO: 1107837 - RNA, 19 nt, Homo sapiens
gcagcucuuugaugaugua

SEQ ID NO: 1107838 - RNA, 19 nt, Homo sapiens
gaagaucagaacaaagaaa

SEQ ID NO: 1107839 - RNA, 19 nt, Homo sapiens
gagcaggacaaguggcuua

SEQ ID NO: 1107840 - RNA, 19 nt, Homo sapiens
acacacaccagcuguauuu

SEQ ID NO: 1107841 - RNA, 19 nt, Homo sapiens
ccugugagcuguccaauaa

SEQ ID NO: 1107842 - RNA, 19 nt, Homo sapiens
uaacugaccuguaacuuca

SEQ ID NO: 1107843 - RNA, 19 nt, Homo sapiens
uccaauaacugaccuguaa

SEQ ID NO: 1107844 - RNA, 19 nt, Homo sapiens
gaagauguuccaccaaauu

SEQ ID NO: 1107845 - RNA, 19 nt, Homo sapiens
gagcacagaucucagaacu

SEQ ID NO: 1107846 - RNA, 19 nt, Homo sapiens
gcccugacaugaagacuga

SEQ ID NO: 1107847 - RNA, 19 nt, Homo sapiens
ggacuccaaagccuucuua

SEQ ID NO: 1107848 - RNA, 19 nt, Homo sapiens
gaagggagcacagaucuca

SEQ ID NO: 1107849 - RNA, 19 nt, Homo sapiens
uccaaagccuucuuauuga

SEQ ID NO: 1107850 - RNA, 19 nt, Homo sapiens
cuccaaagccuucuuauug

SEQ ID NO: 1107851 - RNA, 19 nt, Homo sapiens
uacaaucgcucaccacauc

SEQ ID NO: 1107852 - RNA, 19 nt, Homo sapiens
cugaagauguuccaccaaa

SEQ ID NO: 1107853 - RNA, 19 nt, Homo sapiens
aaugggagcugaguuguug

SEQ ID NO: 1107854 - RNA, 19 nt, Homo sapiens
ggaaucaagaggccuguga

SEQ ID NO: 1107855 - RNA, 19 nt, Homo sapiens
caugaaagaugggcucugu

SEQ ID NO: 1107856 - RNA, 19 nt, Homo sapiens
gcucugcucuacuucuaug

SEQ ID NO: 1107857 - RNA, 19 nt, Homo sapiens
cagcucugcucuacuucua

SEQ ID NO: 1107858 - RNA, 19 nt, Homo sapiens
cuacuucuaugguauuauc

SEQ ID NO: 1107859 - RNA, 19 nt, Homo sapiens
ccacucaagauaauaaaga

SEQ ID NO: 1107860 - RNA, 19 nt, Homo sapiens
ggaucuaccaccugacuga

SEQ ID NO: 1107861 - RNA, 19 nt, Homo sapiens
gaccuguaacuucaucuaa

SEQ ID NO: 1107862 - RNA, 19 nt, Homo sapiens
ugaagauguuccaccaaau

SEQ ID NO: 1107863 - RNA, 19 nt, Homo sapiens
gguggaaucaugcugaaug

SEQ ID NO: 1107864 - RNA, 19 nt, Homo sapiens
ugaaagaugggcucugugu

SEQ ID NO: 1107865 - RNA, 19 nt, Homo sapiens
ccagcucccacucaagaua

SEQ ID NO: 1107866 - RNA, 19 nt, Homo sapiens
ccuccugccugaagauguu

SEQ ID NO: 1107867 - RNA, 19 nt, Homo sapiens
cuuauugacuccuaggaau

SEQ ID NO: 1107868 - RNA, 19 nt, Homo sapiens
ccaaagccuucuuauugac

SEQ ID NO: 1107869 - RNA, 19 nt, Homo sapiens
aaaaguguguggaggaauu

SEQ ID NO: 1107870 - RNA, 19 nt, Homo sapiens
guauuauccuuaacuccau

SEQ ID NO: 1107871 - RNA, 19 nt, Homo sapiens
cagguggaaucaugcugaa

SEQ ID NO: 1107872 - RNA, 19 nt, Homo sapiens
cagcucccacucaagauaa

SEQ ID NO: 1107873 - RNA, 19 nt, Homo sapiens
aagauguuccaccaaauuu

SEQ ID NO: 1107874 - RNA, 19 nt, Homo sapiens
cugcucuacuucuauggua

SEQ ID NO: 1107875 - RNA, 19 nt, Homo sapiens
gcucuacuucuaugguauu

SEQ ID NO: 1107876 - RNA, 19 nt, Homo sapiens
guacaaugggagcugaguu

SEQ ID NO: 1107877 - RNA, 19 nt, Homo sapiens
caaugggagcugaguuguu

SEQ ID NO: 1107878 - RNA, 19 nt, Homo sapiens
cagcuccaccuucgugcua

SEQ ID NO: 1107879 - RNA, 19 nt, Homo sapiens
uacaaugggagcugaguug

SEQ ID NO: 1107880 - RNA, 19 nt, Homo sapiens
gugcuaccauccgcaugaa

SEQ ID NO: 1107881 - RNA, 19 nt, Homo sapiens
ugagcuguccaauaacuga

SEQ ID NO: 1107882 - RNA, 19 nt, Homo sapiens
gcucccuccugccugaaga

SEQ ID NO: 1107883 - RNA, 19 nt, Homo sapiens
ggccagugguacuuuaucg

SEQ ID NO: 1107884 - RNA, 19 nt, Homo sapiens
gaucuaccaccugacugaa

SEQ ID NO: 1107885 - RNA, 19 nt, Homo sapiens
gcuaccauccgcaugaaag

SEQ ID NO: 1107886 - RNA, 19 nt, Homo sapiens
ugugagcuguccaauaacu

SEQ ID NO: 1107887 - RNA, 19 nt, Homo sapiens
cgaaaaguguguggaggaa

SEQ ID NO: 1107888 - RNA, 19 nt, Homo sapiens
ugaccuguaacuucaucua

SEQ ID NO: 1107889 - RNA, 19 nt, Homo sapiens
auaacugaccuguaacuuc

SEQ ID NO: 1107890 - RNA, 19 nt, Homo sapiens
gccugugagcuguccaaua

SEQ ID NO: 1107891 - RNA, 19 nt, Homo sapiens
ggagaaaacuuccaaaugu

SEQ ID NO: 1107892 - RNA, 19 nt, Homo sapiens
ucaaauagcugggacuaca

SEQ ID NO: 1107893 - RNA, 19 nt, Homo sapiens
caccucagccucucaaaua

SEQ ID NO: 1107894 - RNA, 19 nt, Homo sapiens
ccaagaaggucugguacga

SEQ ID NO: 1107895 - RNA, 19 nt, Homo sapiens
gagaaaacuuccaaauguu

SEQ ID NO: 1107896 - RNA, 19 nt, Homo sapiens
caucagaaccacugucuuc

SEQ ID NO: 1107897 - RNA, 19 nt, Homo sapiens
ugcaggaaguuucuacuga

SEQ ID NO: 1107898 - RNA, 19 nt, Homo sapiens
ggacacggccacaccaagu

SEQ ID NO: 1107899 - RNA, 19 nt, Homo sapiens
gaaggucugguacgacaug

SEQ ID NO: 1107900 - RNA, 19 nt, Homo sapiens
ggaguguaguggcgcaauc

SEQ ID NO: 1107901 - RNA, 19 nt, Homo sapiens
caggaaguuucuacugaca

SEQ ID NO: 1107902 - RNA, 19 nt, Homo sapiens
gacaggccagugcgacuuu

SEQ ID NO: 1107903 - RNA, 19 nt, Homo sapiens
ggucugguacgacauguuc

SEQ ID NO: 1107904 - RNA, 19 nt, Homo sapiens
uuucucaucagucacaaua

SEQ ID NO: 1107905 - RNA, 19 nt, Homo sapiens
uacgacauguuccgagaug

SEQ ID NO: 1107906 - RNA, 19 nt, Homo sapiens
ucucaucagucacaauagg

SEQ ID NO: 1107907 - RNA, 19 nt, Homo sapiens
gggagaaaacuuccaaaug

SEQ ID NO: 1107908 - RNA, 19 nt, Homo sapiens
ucacuuuucucaucaguca

SEQ ID NO: 1107909 - RNA, 19 nt, Homo sapiens
ccaaguagcagggcugaac

SEQ ID NO: 1107910 - RNA, 19 nt, Homo sapiens
ccaccucagccucucaaau

SEQ ID NO: 1107911 - RNA, 19 nt, Homo sapiens
ccacgaagcucaucuuuga

SEQ ID NO: 1107912 - RNA, 19 nt, Homo sapiens
gaggagggcucagagguaa

SEQ ID NO: 1107913 - RNA, 19 nt, Homo sapiens
caaaccauguucccuguga

SEQ ID NO: 1107914 - RNA, 19 nt, Homo sapiens
gaaccagcuucguuacuca

SEQ ID NO: 1107915 - RNA, 19 nt, Homo sapiens
gcaagagucgugaugugua

SEQ ID NO: 1107916 - RNA, 19 nt, Homo sapiens
ccaacuggaugcugucuug

SEQ ID NO: 1107917 - RNA, 19 nt, Homo sapiens
ccucagacacccacaauaa

SEQ ID NO: 1107918 - RNA, 19 nt, Homo sapiens
ggaaccagcuucguuacuc

SEQ ID NO: 1107919 - RNA, 19 nt, Homo sapiens
gcucagagguaaccaacag

SEQ ID NO: 1107920 - RNA, 19 nt, Homo sapiens
gcagcgauccaacacauau

SEQ ID NO: 1107921 - RNA, 19 nt, Homo sapiens
gaaaucagagcuggagaug

SEQ ID NO: 1107922 - RNA, 19 nt, Homo sapiens
cagcuucguuacucagaaa

SEQ ID NO: 1107923 - RNA, 19 nt, Homo sapiens
cagcaagagucgugaugug

SEQ ID NO: 1107924 - RNA, 19 nt, Homo sapiens
caacaugcagcgcuggaaa

SEQ ID NO: 1107925 - RNA, 19 nt, Homo sapiens
gauguacgaacgacaguga

SEQ ID NO: 1107926 - RNA, 19 nt, Homo sapiens
gaagauccuacgagagaug

SEQ ID NO: 1107927 - RNA, 19 nt, Homo sapiens
caagagucgugauguguac

SEQ ID NO: 1107928 - RNA, 19 nt, Homo sapiens
gcgagaacacgccacugua

SEQ ID NO: 1107929 - RNA, 19 nt, Homo sapiens
cauaugugaucaagcuguu

SEQ ID NO: 1107930 - RNA, 19 nt, Homo sapiens
ggacagggagcgucuggau

SEQ ID NO: 1107931 - RNA, 19 nt, Homo sapiens
acagggagcgucuggauga

SEQ ID NO: 1107932 - RNA, 19 nt, Homo sapiens
acacucaucuaucgcaaca

SEQ ID NO: 1107933 - RNA, 19 nt, Homo sapiens
gaaggugaaaguggagaaa

SEQ ID NO: 1107934 - RNA, 19 nt, Homo sapiens
gagguaaccaacagcaaga

SEQ ID NO: 1107935 - RNA, 19 nt, Homo sapiens
acucaucuaucgcaacaug

SEQ ID NO: 1107936 - RNA, 19 nt, Homo sapiens
ggaagaagaggagggagau

SEQ ID NO: 1107937 - RNA, 19 nt, Homo sapiens
ugacccagcuagccagauc

SEQ ID NO: 1107938 - RNA, 19 nt, Homo sapiens
caucggaaccagcuucguu

SEQ ID NO: 1107939 - RNA, 19 nt, Homo sapiens
aagcucaucuuugaacugu

SEQ ID NO: 1107940 - RNA, 19 nt, Homo sapiens
ggccaaagcccggaaccaa

SEQ ID NO: 1107941 - RNA, 19 nt, Homo sapiens
ugaaaguggagaaaucaga

SEQ ID NO: 1107942 - RNA, 19 nt, Homo sapiens
ccgcagcgauccaacacau

SEQ ID NO: 1107943 - RNA, 19 nt, Homo sapiens
ggaugaggaagcugggaaa

SEQ ID NO: 1107944 - RNA, 19 nt, Homo sapiens
acacgccacuguacccaau

SEQ ID NO: 1107945 - RNA, 19 nt, Homo sapiens
ggugaaaguggagaaauca

SEQ ID NO: 1107946 - RNA, 19 nt, Homo sapiens
gaagcucaucuuugaacug

SEQ ID NO: 1107947 - RNA, 19 nt, Homo sapiens
augaagauccuacgagaga

SEQ ID NO: 1107948 - RNA, 19 nt, Homo sapiens
ccagcuucguuacucagaa

SEQ ID NO: 1107949 - RNA, 19 nt, Homo sapiens
gcguggacuuggcccaguu

SEQ ID NO: 1107950 - RNA, 19 nt, Homo sapiens
gguggaaggaggccucuca

SEQ ID NO: 1107951 - RNA, 19 nt, Homo sapiens
aaaccauguucccugugaa

SEQ ID NO: 1107952 - RNA, 19 nt, Homo sapiens
guacgaacgacagugaugu

SEQ ID NO: 1107953 - RNA, 19 nt, Homo sapiens
gaagaggagggagauggau

SEQ ID NO: 1107954 - RNA, 19 nt, Homo sapiens
gaagaagaggagggagaug

SEQ ID NO: 1107955 - RNA, 19 nt, Homo sapiens
ugaggaagcugggaaaaca

SEQ ID NO: 1107956 - RNA, 19 nt, Homo sapiens
cagaaagcaugaagauccu

SEQ ID NO: 1107957 - RNA, 19 nt, Homo sapiens
ccuccacacucaucuaucg

SEQ ID NO: 1107958 - RNA, 19 nt, Homo sapiens
cgagaacacgccacuguac

SEQ ID NO: 1107959 - RNA, 19 nt, Homo sapiens
gcccacgaagcucaucuuu

SEQ ID NO: 1107960 - RNA, 19 nt, Homo sapiens
ccaaagcccggaaccaacu

SEQ ID NO: 1107961 - RNA, 19 nt, Homo sapiens
gcaacaugcagcgcuggaa

SEQ ID NO: 1107962 - RNA, 19 nt, Homo sapiens
agaggagggagauggauga

SEQ ID NO: 1107963 - RNA, 19 nt, Homo sapiens
ucagacacccacaauaagg

SEQ ID NO: 1107964 - RNA, 19 nt, Homo sapiens
caccagcggaggaagaaga

SEQ ID NO: 1107965 - RNA, 19 nt, Homo sapiens
cagacacccacaauaagga

SEQ ID NO: 1107966 - RNA, 19 nt, Homo sapiens
gaacaaagcuauaggguuu

SEQ ID NO: 1107967 - RNA, 19 nt, Homo sapiens
gaacuuuccugcuuuauug

SEQ ID NO: 1107968 - RNA, 19 nt, Homo sapiens
cacaggaucucaucaauua

SEQ ID NO: 1107969 - RNA, 19 nt, Homo sapiens
gaagaacuuuccugcuuua

SEQ ID NO: 1107970 - RNA, 19 nt, Homo sapiens
gaacaacuuucuccuuauu

SEQ ID NO: 1107971 - RNA, 19 nt, Homo sapiens
gcuaacaccuacaaucuua

SEQ ID NO: 1107972 - RNA, 19 nt, Homo sapiens
ggauuaugcugcaaaguua

SEQ ID NO: 1107973 - RNA, 19 nt, Homo sapiens
gaugaaaucuucccuguuc

SEQ ID NO: 1107974 - RNA, 19 nt, Homo sapiens
gaaagguugccaaguauua

SEQ ID NO: 1107975 - RNA, 19 nt, Homo sapiens
ggaggccgcucuaaacuaa

SEQ ID NO: 1107976 - RNA, 19 nt, Homo sapiens
cgucaugggugaucuaaua

SEQ ID NO: 1107977 - RNA, 19 nt, Homo sapiens
ugucaugucugucaacuua

SEQ ID NO: 1107978 - RNA, 19 nt, Homo sapiens
ggaauucucuguaaugagu

SEQ ID NO: 1107979 - RNA, 19 nt, Homo sapiens
caacgaugcugaaauuguu

SEQ ID NO: 1107980 - RNA, 19 nt, Homo sapiens
gaauaaucguuguauggua

SEQ ID NO: 1107981 - RNA, 19 nt, Homo sapiens
gacaguagauuucaugaga

SEQ ID NO: 1107982 - RNA, 19 nt, Homo sapiens
gaacaagguuggucugaag

SEQ ID NO: 1107983 - RNA, 19 nt, Homo sapiens
gaaauucaguaccagagaa

SEQ ID NO: 1107984 - RNA, 19 nt, Homo sapiens
gaacaagugauuaugauga

SEQ ID NO: 1107985 - RNA, 19 nt, Homo sapiens
gcuaacaaaugcauucuga

SEQ ID NO: 1107986 - RNA, 19 nt, Homo sapiens
gacaauaccugcgugaauu

SEQ ID NO: 1107987 - RNA, 19 nt, Homo sapiens
gagauaagcucuaugucau

SEQ ID NO: 1107988 - RNA, 19 nt, Homo sapiens
gaacugccauucgaucuga

SEQ ID NO: 1107989 - RNA, 19 nt, Homo sapiens
ccagaaauaugacccagaa

SEQ ID NO: 1107990 - RNA, 19 nt, Homo sapiens
uauggaggcuuaauguaua

SEQ ID NO: 1107991 - RNA, 19 nt, Homo sapiens
gaaagaacaagauuugaug

SEQ ID NO: 1107992 - RNA, 19 nt, Homo sapiens
gauaagggcuacagcauac

SEQ ID NO: 1107993 - RNA, 19 nt, Homo sapiens
gaaauuguccagaaauaug

SEQ ID NO: 1107994 - RNA, 19 nt, Homo sapiens
gauaagcucuaugucauug

SEQ ID NO: 1107995 - RNA, 19 nt, Homo sapiens
caaagcagccguuucuauu

SEQ ID NO: 1107996 - RNA, 19 nt, Homo sapiens
gguagaaauuguccagaaa

SEQ ID NO: 1107997 - RNA, 19 nt, Homo sapiens
caaagaagccagcuacaga

SEQ ID NO: 1107998 - RNA, 19 nt, Homo sapiens
ucaggagucucuuuggaua

SEQ ID NO: 1107999 - RNA, 19 nt, Homo sapiens
gcaaauggaguuacaggaa

SEQ ID NO: 1108000 - RNA, 19 nt, Homo sapiens
guagaugacugugguaaau

SEQ ID NO: 1108001 - RNA, 19 nt, Homo sapiens
ggaacaacuuucuccuuau

SEQ ID NO: 1108002 - RNA, 19 nt, Homo sapiens
ggagauaagcucuauguca

SEQ ID NO: 1108003 - RNA, 19 nt, Homo sapiens
gguugucaguaaagaauua

SEQ ID NO: 1108004 - RNA, 19 nt, Homo sapiens
ggauaacuguguugagguu

SEQ ID NO: 1108005 - RNA, 19 nt, Homo sapiens
auacaugcaugcacacaua

SEQ ID NO: 1108006 - RNA, 19 nt, Homo sapiens
ggcaaucacuucagaggaa

SEQ ID NO: 1108007 - RNA, 19 nt, Homo sapiens
acagauaaauggaugcaaa

SEQ ID NO: 1108008 - RNA, 19 nt, Homo sapiens
gaauuacccaugacacuuu

SEQ ID NO: 1108009 - RNA, 19 nt, Homo sapiens
ugaagaacuuuccugcuuu

SEQ ID NO: 1108010 - RNA, 19 nt, Homo sapiens
aacgaaagguugccaagua

SEQ ID NO: 1108011 - RNA, 19 nt, Homo sapiens
caaguuauaggaucucuuu

SEQ ID NO: 1108012 - RNA, 19 nt, Homo sapiens
gcaagcaggagauaacauu

SEQ ID NO: 1108013 - RNA, 19 nt, Homo sapiens
gauccucgguauaauaaau

SEQ ID NO: 1108014 - RNA, 19 nt, Homo sapiens
gaauaauugucuaccugaa

SEQ ID NO: 1108015 - RNA, 19 nt, Homo sapiens
caaauggaguuacaggaau

SEQ ID NO: 1108016 - RNA, 19 nt, Homo sapiens
gaagcuagcaauuaccaaa

SEQ ID NO: 1108017 - RNA, 19 nt, Homo sapiens
guaccgaacuugaacucuu

SEQ ID NO: 1108018 - RNA, 19 nt, Homo sapiens
gaaccuuacugcccauaca

SEQ ID NO: 1108019 - RNA, 19 nt, Homo sapiens
ccauuaugcuucaaaguug

SEQ ID NO: 1108020 - RNA, 19 nt, Homo sapiens
ggucagaguaauuaugaua

SEQ ID NO: 1108021 - RNA, 19 nt, Homo sapiens
aauauucgauuuccacuga

SEQ ID NO: 1108022 - RNA, 19 nt, Homo sapiens
ggaaugaaagaacaagauu

SEQ ID NO: 1108023 - RNA, 19 nt, Homo sapiens
gaagauugucagcauguaa

SEQ ID NO: 1108024 - RNA, 19 nt, Homo sapiens
ggaagauugucagcaugua

SEQ ID NO: 1108025 - RNA, 19 nt, Homo sapiens
ugacugccuucccuugaua

SEQ ID NO: 1108026 - RNA, 19 nt, Homo sapiens
aacaguauauggaggcuua

SEQ ID NO: 1108027 - RNA, 19 nt, Homo sapiens
gauuugauccucgguauaa

SEQ ID NO: 1108028 - RNA, 19 nt, Homo sapiens
caagauuugaugugcauua

SEQ ID NO: 1108029 - RNA, 19 nt, Homo sapiens
gagugauucugaagaggua

SEQ ID NO: 1108030 - RNA, 19 nt, Homo sapiens
ucaugugacuaaaccguua

SEQ ID NO: 1108031 - RNA, 19 nt, Homo sapiens
ccacucacuugguuacauu

SEQ ID NO: 1108032 - RNA, 19 nt, Homo sapiens
gaacuugaacucuuuaagg

SEQ ID NO: 1108033 - RNA, 19 nt, Homo sapiens
cauuugugcuuuccaguaa

SEQ ID NO: 1108034 - RNA, 19 nt, Homo sapiens
gcauguaaaucaggaacaa

SEQ ID NO: 1108035 - RNA, 19 nt, Homo sapiens
ggaacacuauggucuuaca

SEQ ID NO: 1108036 - RNA, 19 nt, Homo sapiens
ucagaugaagcuuacauua

SEQ ID NO: 1108037 - RNA, 19 nt, Homo sapiens
gcaaggcuuugaucagcuu

SEQ ID NO: 1108038 - RNA, 19 nt, Homo sapiens
gaagcuuacauuacuguuu

SEQ ID NO: 1108039 - RNA, 19 nt, Homo sapiens
caaccaaauuugucaugug

SEQ ID NO: 1108040 - RNA, 19 nt, Homo sapiens
cuaaaucgacaaccaaauu

SEQ ID NO: 1108041 - RNA, 19 nt, Homo sapiens
ggaguugccgucuuugaaa

SEQ ID NO: 1108042 - RNA, 19 nt, Homo sapiens
gaggaacaagugauuauga

SEQ ID NO: 1108043 - RNA, 19 nt, Homo sapiens
caggaggaauuacccauga

SEQ ID NO: 1108044 - RNA, 19 nt, Homo sapiens
ggacaccucguuaccugua

SEQ ID NO: 1108045 - RNA, 19 nt, Homo sapiens
gcuagcaauuaccaaauga

SEQ ID NO: 1108046 - RNA, 19 nt, Homo sapiens
guaaaucaggaacaacuuu

SEQ ID NO: 1108047 - RNA, 19 nt, Homo sapiens
gauauaaagguaacugaug

SEQ ID NO: 1108048 - RNA, 19 nt, Homo sapiens
aaagaugaguggcauaaag

SEQ ID NO: 1108049 - RNA, 19 nt, Homo sapiens
ggacauuuguaugcaguug

SEQ ID NO: 1108050 - RNA, 19 nt, Homo sapiens
gcagcugguugucaguaaa

SEQ ID NO: 1108051 - RNA, 19 nt, Homo sapiens
gcuaugaucugagcaagca

SEQ ID NO: 1108052 - RNA, 19 nt, Homo sapiens
ucaaguggcuaacaaaugc

SEQ ID NO: 1108053 - RNA, 19 nt, Homo sapiens
gaugaaagggcacaagaau

SEQ ID NO: 1108054 - RNA, 19 nt, Homo sapiens
aagcggaacugcugaagga

SEQ ID NO: 1108055 - RNA, 19 nt, Homo sapiens
ucaauuacgugcagacagu

SEQ ID NO: 1108056 - RNA, 19 nt, Homo sapiens
gcugcaaaguuaaugaaga

SEQ ID NO: 1108057 - RNA, 19 nt, Homo sapiens
ggaagacccucggauggau

SEQ ID NO: 1108058 - RNA, 19 nt, Homo sapiens
cgacuugcauuugugcuuu

SEQ ID NO: 1108059 - RNA, 19 nt, Homo sapiens
cugaagaacuuuccugcuu

SEQ ID NO: 1108060 - RNA, 19 nt, Homo sapiens
caccuacaaucuuauagaa

SEQ ID NO: 1108061 - RNA, 19 nt, Homo sapiens
uagaaggauugcuuuguga

SEQ ID NO: 1108062 - RNA, 19 nt, Homo sapiens
gcacauuugaguacauuug

SEQ ID NO: 1108063 - RNA, 19 nt, Homo sapiens
gggcuaggccgguauucua

SEQ ID NO: 1108064 - RNA, 19 nt, Homo sapiens
caggaauucucuguaauga

SEQ ID NO: 1108065 - RNA, 19 nt, Homo sapiens
aaagguaucccuauugguu

SEQ ID NO: 1108066 - RNA, 19 nt, Homo sapiens
gagagucccuuguaaguuu

SEQ ID NO: 1108067 - RNA, 19 nt, Homo sapiens
gcccagagguuauacauuu

SEQ ID NO: 1108068 - RNA, 19 nt, Homo sapiens
ggacaacccuccuguaagu

SEQ ID NO: 1108069 - RNA, 19 nt, Homo sapiens
ggacacaacuugcucaaag

SEQ ID NO: 1108070 - RNA, 19 nt, Homo sapiens
ggagaagucugaauucaag

SEQ ID NO: 1108071 - RNA, 19 nt, Homo sapiens
ggaguugacuuucuucugu

SEQ ID NO: 1108072 - RNA, 19 nt, Homo sapiens
ugaaagaacucaucaagag

SEQ ID NO: 1108073 - RNA, 19 nt, Homo sapiens
agacuucucucccuucuaa

SEQ ID NO: 1108074 - RNA, 19 nt, Homo sapiens
gagaccaaaucaacaauga

SEQ ID NO: 1108075 - RNA, 19 nt, Homo sapiens
cgucauacauuuaggcuuu

SEQ ID NO: 1108076 - RNA, 19 nt, Homo sapiens
gaaaggaauaggaaagaaa

SEQ ID NO: 1108077 - RNA, 19 nt, Homo sapiens
gaaggaauuugaugaggau

SEQ ID NO: 1108078 - RNA, 19 nt, Homo sapiens
gaacaucaucccugucauu

SEQ ID NO: 1108079 - RNA, 19 nt, Homo sapiens
ggaauuugaugaggauuug

SEQ ID NO: 1108080 - RNA, 19 nt, Homo sapiens
guacagcccuacugcauca

SEQ ID NO: 1108081 - RNA, 19 nt, Homo sapiens
ggaauaggaaagaaaguuu

SEQ ID NO: 1108082 - RNA, 19 nt, Homo sapiens
acaaacagauugccagaga

SEQ ID NO: 1108083 - RNA, 19 nt, Homo sapiens
ugacaucucucacuuccuu

SEQ ID NO: 1108084 - RNA, 19 nt, Homo sapiens
gguuauacauuucaacaga

SEQ ID NO: 1108085 - RNA, 19 nt, Homo sapiens
gaagcccuguauuuauuaa

SEQ ID NO: 1108086 - RNA, 19 nt, Homo sapiens
gguggucacuguaggcuaa

SEQ ID NO: 1108087 - RNA, 19 nt, Homo sapiens
ccaguugcauccuccauuu

SEQ ID NO: 1108088 - RNA, 19 nt, Homo sapiens
ucaacacgcucuucaaauc

SEQ ID NO: 1108089 - RNA, 19 nt, Homo sapiens
uagacugccuuucacauaa

SEQ ID NO: 1108090 - RNA, 19 nt, Homo sapiens
ucacucaggugcuaggaaa

SEQ ID NO: 1108091 - RNA, 19 nt, Homo sapiens
cacaauauguacacgcuaa

SEQ ID NO: 1108092 - RNA, 19 nt, Homo sapiens
cgagagagccugugugugu

SEQ ID NO: 1108093 - RNA, 19 nt, Homo sapiens
gaggagaagucugaauuca

SEQ ID NO: 1108094 - RNA, 19 nt, Homo sapiens
gaccaaaucaacaaugaaa

SEQ ID NO: 1108095 - RNA, 19 nt, Homo sapiens
gagcagaugcgcaagaaga

SEQ ID NO: 1108096 - RNA, 19 nt, Homo sapiens
gagggugggucacuacaga

SEQ ID NO: 1108097 - RNA, 19 nt, Homo sapiens
cugaagcccuguauuuauu

SEQ ID NO: 1108098 - RNA, 19 nt, Homo sapiens
ccaagcggcucaaugacaa

SEQ ID NO: 1108099 - RNA, 19 nt, Homo sapiens
gacaaggaguaccaaguga

SEQ ID NO: 1108100 - RNA, 19 nt, Homo sapiens
gggagcccauugagaagua

SEQ ID NO: 1108101 - RNA, 19 nt, Homo sapiens
gaggaaagccacgacagua

SEQ ID NO: 1108102 - RNA, 19 nt, Homo sapiens
ucaaggaagugacacacaa

SEQ ID NO: 1108103 - RNA, 19 nt, Homo sapiens
caacaucgccaggaagaaa

SEQ ID NO: 1108104 - RNA, 19 nt, Homo sapiens
ucagaugcaugaauguuug

SEQ ID NO: 1108105 - RNA, 19 nt, Homo sapiens
uccauuaucugucuccuuu

SEQ ID NO: 1108106 - RNA, 19 nt, Homo sapiens
ucaaugagcaguacgagaa

SEQ ID NO: 1108107 - RNA, 19 nt, Homo sapiens
ccagaaacccacaauaugu

SEQ ID NO: 1108108 - RNA, 19 nt, Homo sapiens
ggaaacacagugaguuaug

SEQ ID NO: 1108109 - RNA, 19 nt, Homo sapiens
gcaagaagaccaugaagac

SEQ ID NO: 1108110 - RNA, 19 nt, Homo sapiens
cagaaacccacaauaugua

SEQ ID NO: 1108111 - RNA, 19 nt, Homo sapiens
cacacaacauccacuauga

SEQ ID NO: 1108112 - RNA, 19 nt, Homo sapiens
ggaaggcggugucaaaaug

SEQ ID NO: 1108113 - RNA, 19 nt, Homo sapiens
gcaugaauguuugcgaaug

SEQ ID NO: 1108114 - RNA, 19 nt, Homo sapiens
gaaaucugggucaaagaaa

SEQ ID NO: 1108115 - RNA, 19 nt, Homo sapiens
ccacuucucugugucauca

SEQ ID NO: 1108116 - RNA, 19 nt, Homo sapiens
gaugaggauuuggaggaua

SEQ ID NO: 1108117 - RNA, 19 nt, Homo sapiens
ggucaacacgcucuucaaa

SEQ ID NO: 1108118 - RNA, 19 nt, Homo sapiens
gaaaggcugaguaggaaug

SEQ ID NO: 1108119 - RNA, 19 nt, Homo sapiens
aagcaucagugccuacaaa

SEQ ID NO: 1108120 - RNA, 19 nt, Homo sapiens
ccacgacaguaacccauga

SEQ ID NO: 1108121 - RNA, 19 nt, Homo sapiens
gggccaagcggcucaauga

SEQ ID NO: 1108122 - RNA, 19 nt, Homo sapiens
ucaaagaaaggaauaggaa

SEQ ID NO: 1108123 - RNA, 19 nt, Homo sapiens
ggacaguacaaacagauug

SEQ ID NO: 1108124 - RNA, 19 nt, Homo sapiens
acacacacaucccaaauac

SEQ ID NO: 1108125 - RNA, 19 nt, Homo sapiens
gaucuugaguucaugaaac

SEQ ID NO: 1108126 - RNA, 19 nt, Homo sapiens
cucaaaggcuggugacuug

SEQ ID NO: 1108127 - RNA, 19 nt, Homo sapiens
ccauuccucucagcuguua

SEQ ID NO: 1108128 - RNA, 19 nt, Homo sapiens
caaacagauugccagagaa

SEQ ID NO: 1108129 - RNA, 19 nt, Homo sapiens
ccaagacaguggagaucaa

SEQ ID NO: 1108130 - RNA, 19 nt, Homo sapiens
gaaacacagugaguuaugc

SEQ ID NO: 1108131 - RNA, 19 nt, Homo sapiens
aaacuaaacacacacacaa

SEQ ID NO: 1108132 - RNA, 19 nt, Homo sapiens
caaagaaaggaauaggaaa

SEQ ID NO: 1108133 - RNA, 19 nt, Homo sapiens
ggaagugacacacaacauc

SEQ ID NO: 1108134 - RNA, 19 nt, Homo sapiens
caguggagaucaaagcuau

SEQ ID NO: 1108135 - RNA, 19 nt, Homo sapiens
gcaaaucaacgcuggucaa

SEQ ID NO: 1108136 - RNA, 19 nt, Homo sapiens
uaacgcagccacugaggaa

SEQ ID NO: 1108137 - RNA, 19 nt, Homo sapiens
cuuacuagauucauugaga

SEQ ID NO: 1108138 - RNA, 19 nt, Homo sapiens
uggaaaggcugaguaggaa

SEQ ID NO: 1108139 - RNA, 19 nt, Homo sapiens
aaacagauugccagagaaa

SEQ ID NO: 1108140 - RNA, 19 nt, Homo sapiens
agacugccuuucacauaaa

SEQ ID NO: 1108141 - RNA, 19 nt, Homo sapiens
gacgaccacuucucugugu

SEQ ID NO: 1108142 - RNA, 19 nt, Homo sapiens
cuaaagaaguaucagaaac

SEQ ID NO: 1108143 - RNA, 19 nt, Homo sapiens
gcuccacccuucagucugu

SEQ ID NO: 1108144 - RNA, 19 nt, Homo sapiens
agacaaaggaggauucaug

SEQ ID NO: 1108145 - RNA, 19 nt, Homo sapiens
acucuuggcuuccuuaaag

SEQ ID NO: 1108146 - RNA, 19 nt, Homo sapiens
uagaagcaguccuguaugg

SEQ ID NO: 1108147 - RNA, 19 nt, Homo sapiens
caacagaacagggauccuu

SEQ ID NO: 1108148 - RNA, 19 nt, Homo sapiens
gcacuuauaaucccagucu

SEQ ID NO: 1108149 - RNA, 19 nt, Homo sapiens
ucacaggcagccaauguaa

SEQ ID NO: 1108150 - RNA, 19 nt, Homo sapiens
caucacacauacccacuuc

SEQ ID NO: 1108151 - RNA, 19 nt, Homo sapiens
ccaugacccuggaggagaa

SEQ ID NO: 1108152 - RNA, 19 nt, Homo sapiens
gcaagguugugaacaucau

SEQ ID NO: 1108153 - RNA, 19 nt, Homo sapiens
caugaauguuugcgaaugu

SEQ ID NO: 1108154 - RNA, 19 nt, Homo sapiens
gcacccuucuguccacuca

SEQ ID NO: 1108155 - RNA, 19 nt, Homo sapiens
cauccuccauuuauccaaa

SEQ ID NO: 1108156 - RNA, 19 nt, Homo sapiens
guaaagagggaaacacagu

SEQ ID NO: 1108157 - RNA, 19 nt, Homo sapiens
agaaaggaauaggaaagaa

SEQ ID NO: 1108158 - RNA, 19 nt, Homo sapiens
agagaaaucugggucaaag

SEQ ID NO: 1108159 - RNA, 19 nt, Homo sapiens
ggagagucccuuguaaguu

SEQ ID NO: 1108160 - RNA, 19 nt, Homo sapiens
gaaggaggaggucaacauc

SEQ ID NO: 1108161 - RNA, 19 nt, Homo sapiens
caagggcuaggaucacuuu

SEQ ID NO: 1108162 - RNA, 19 nt, Homo sapiens
gcauugcucccuacccauu

SEQ ID NO: 1108163 - RNA, 19 nt, Homo sapiens
cuaugaaucccagcacuua

SEQ ID NO: 1108164 - RNA, 19 nt, Homo sapiens
ugaagcccuguauuuauua

SEQ ID NO: 1108165 - RNA, 19 nt, Homo sapiens
gugcugaagcuaaucauau

SEQ ID NO: 1108166 - RNA, 19 nt, Homo sapiens
ggacacaacuugcucaaag

SEQ ID NO: 1108167 - RNA, 19 nt, Homo sapiens
ggagaagucugaauucaag

SEQ ID NO: 1108168 - RNA, 19 nt, Homo sapiens
ggaguugacuuucuucugu

SEQ ID NO: 1108169 - RNA, 19 nt, Homo sapiens
ugaaagaacucaucaagag

SEQ ID NO: 1108170 - RNA, 19 nt, Homo sapiens
gagaccaaaucaacaauga

SEQ ID NO: 1108171 - RNA, 19 nt, Homo sapiens
gaaggaauuugaugaggau

SEQ ID NO: 1108172 - RNA, 19 nt, Homo sapiens
gaacaucaucccugucauu

SEQ ID NO: 1108173 - RNA, 19 nt, Homo sapiens
ggaauuugaugaggauuug

SEQ ID NO: 1108174 - RNA, 19 nt, Homo sapiens
guacagcccuacugcauca

SEQ ID NO: 1108175 - RNA, 19 nt, Homo sapiens
gguggucacuguaggcuaa

SEQ ID NO: 1108176 - RNA, 19 nt, Homo sapiens
ccaguugcauccuccauuu

SEQ ID NO: 1108177 - RNA, 19 nt, Homo sapiens
ucaacacgcucuucaaauc

SEQ ID NO: 1108178 - RNA, 19 nt, Homo sapiens
cacaauauguacacgcuaa

SEQ ID NO: 1108179 - RNA, 19 nt, Homo sapiens
gaggagaagucugaauuca

SEQ ID NO: 1108180 - RNA, 19 nt, Homo sapiens
gaccaaaucaacaaugaaa

SEQ ID NO: 1108181 - RNA, 19 nt, Homo sapiens
gagcagaugcgcaagaaga

SEQ ID NO: 1108182 - RNA, 19 nt, Homo sapiens
gagggugggucacuacaga

SEQ ID NO: 1108183 - RNA, 19 nt, Homo sapiens
ccaagcggcucaaugacaa

SEQ ID NO: 1108184 - RNA, 19 nt, Homo sapiens
gacaaggaguaccaaguga

SEQ ID NO: 1108185 - RNA, 19 nt, Homo sapiens
gggagcccauugagaagua

SEQ ID NO: 1108186 - RNA, 19 nt, Homo sapiens
ucaaggaagugacacacaa

SEQ ID NO: 1108187 - RNA, 19 nt, Homo sapiens
caacaucgccaggaagaaa

SEQ ID NO: 1108188 - RNA, 19 nt, Homo sapiens
ucagaugcaugaauguuug

SEQ ID NO: 1108189 - RNA, 19 nt, Homo sapiens
ucaaugagcaguacgagaa

SEQ ID NO: 1108190 - RNA, 19 nt, Homo sapiens
ccagaaacccacaauaugu

SEQ ID NO: 1108191 - RNA, 19 nt, Homo sapiens
gcaagaagaccaugaagac

SEQ ID NO: 1108192 - RNA, 19 nt, Homo sapiens
cagaaacccacaauaugua

SEQ ID NO: 1108193 - RNA, 19 nt, Homo sapiens
cacacaacauccacuauga

SEQ ID NO: 1108194 - RNA, 19 nt, Homo sapiens
ggaaggcggugucaaaaug

SEQ ID NO: 1108195 - RNA, 19 nt, Homo sapiens
gcaugaauguuugcgaaug

SEQ ID NO: 1108196 - RNA, 19 nt, Homo sapiens
gaugaggauuuggaggaua

SEQ ID NO: 1108197 - RNA, 19 nt, Homo sapiens
ggucaacacgcucuucaaa

SEQ ID NO: 1108198 - RNA, 19 nt, Homo sapiens
gggccaagcggcucaauga

SEQ ID NO: 1108199 - RNA, 19 nt, Homo sapiens
gaucuugaguucaugaaac

SEQ ID NO: 1108200 - RNA, 19 nt, Homo sapiens
cucaaaggcuggugacuug

SEQ ID NO: 1108201 - RNA, 19 nt, Homo sapiens
ccauuccucucagcuguua

SEQ ID NO: 1108202 - RNA, 19 nt, Homo sapiens
ccaagacaguggagaucaa

SEQ ID NO: 1108203 - RNA, 19 nt, Homo sapiens
aaacuaaacacacacacaa

SEQ ID NO: 1108204 - RNA, 19 nt, Homo sapiens
ggaagugacacacaacauc

SEQ ID NO: 1108205 - RNA, 19 nt, Homo sapiens
caguggagaucaaagcuau

SEQ ID NO: 1108206 - RNA, 19 nt, Homo sapiens
gcaaaucaacgcuggucaa

SEQ ID NO: 1108207 - RNA, 19 nt, Homo sapiens
uaacgcagccacugaggaa

SEQ ID NO: 1108208 - RNA, 19 nt, Homo sapiens
cuuacuagauucauugaga

SEQ ID NO: 1108209 - RNA, 19 nt, Homo sapiens
agacaaaggaggauucaug

SEQ ID NO: 1108210 - RNA, 19 nt, Homo sapiens
acucuuggcuuccuuaaag

SEQ ID NO: 1108211 - RNA, 19 nt, Homo sapiens
ccaugacccuggaggagaa

SEQ ID NO: 1108212 - RNA, 19 nt, Homo sapiens
gcaagguugugaacaucau

SEQ ID NO: 1108213 - RNA, 19 nt, Homo sapiens
caugaauguuugcgaaugu

SEQ ID NO: 1108214 - RNA, 19 nt, Homo sapiens
gcacccuucuguccacuca

SEQ ID NO: 1108215 - RNA, 19 nt, Homo sapiens
cauccuccauuuauccaaa

SEQ ID NO: 1108216 - RNA, 19 nt, Homo sapiens
gaaggaggaggucaacauc

SEQ ID NO: 1108217 - RNA, 19 nt, Homo sapiens
caagggcuaggaucacuuu

SEQ ID NO: 1108218 - RNA, 19 nt, Homo sapiens
gcauugcucccuacccauu

SEQ ID NO: 1108219 - RNA, 19 nt, Homo sapiens
aggauaagacggagaauga

SEQ ID NO: 1108220 - RNA, 19 nt, Homo sapiens
ggaggagaagucugaauuc

SEQ ID NO: 1108221 - RNA, 19 nt, Homo sapiens
ucagcaagguugugaacau

SEQ ID NO: 1108222 - RNA, 19 nt, Homo sapiens
gacaaaggaggauucaugu

SEQ ID NO: 1108223 - RNA, 19 nt, Homo sapiens
gaggaacggagacaaagga

SEQ ID NO: 1108224 - RNA, 19 nt, Homo sapiens
ucaaagcuaucgggcaugu

SEQ ID NO: 1108225 - RNA, 19 nt, Homo sapiens
gaggauucauguccaaagg

SEQ ID NO: 1108226 - RNA, 19 nt, Homo sapiens
ugacaaggaguaccaagug

SEQ ID NO: 1108227 - RNA, 19 nt, Homo sapiens
caucaucccugucauugcu

SEQ ID NO: 1108228 - RNA, 19 nt, Homo sapiens
agaggaaggcggugucaaa

SEQ ID NO: 1108229 - RNA, 19 nt, Homo sapiens
ggagcaagggcuaggauca

SEQ ID NO: 1108230 - RNA, 19 nt, Homo sapiens
gugaaagaacucaucaaga

SEQ ID NO: 1108231 - RNA, 19 nt, Homo sapiens
gaagugacaaggaguacca

SEQ ID NO: 1108232 - RNA, 19 nt, Homo sapiens
gguuucgacuucaacauca

SEQ ID NO: 1108233 - RNA, 19 nt, Homo sapiens
gcucaaaggcuggugacuu

SEQ ID NO: 1108234 - RNA, 19 nt, Homo sapiens
gaauguuugcgaauguuga

SEQ ID NO: 1108235 - RNA, 19 nt, Homo sapiens
agaagacauugcuggaguu

SEQ ID NO: 1108236 - RNA, 19 nt, Homo sapiens
ggugaaagaacucaucaag

SEQ ID NO: 1108237 - RNA, 19 nt, Homo sapiens
caacauccacuaugagacu

SEQ ID NO: 1108238 - RNA, 19 nt, Homo sapiens
gauaagacggagaaugaca

SEQ ID NO: 1108239 - RNA, 19 nt, Homo sapiens
aaucaacgcuggucaacac

SEQ ID NO: 1108240 - RNA, 19 nt, Homo sapiens
uuucuucuguccaaacaaa

SEQ ID NO: 1108241 - RNA, 19 nt, Homo sapiens
gaagacauugcuggaguug

SEQ ID NO: 1108242 - RNA, 19 nt, Homo sapiens
ggugucuccuucauuacuu

SEQ ID NO: 1108243 - RNA, 19 nt, Homo sapiens
ucauugagaucagcugugu

SEQ ID NO: 1108244 - RNA, 19 nt, Homo sapiens
ugacacacaacauccacua

SEQ ID NO: 1108245 - RNA, 19 nt, Homo sapiens
caaggaguaccaagugaau

SEQ ID NO: 1108246 - RNA, 19 nt, Homo sapiens
ggagaccaaaucaacaaug

SEQ ID NO: 1108247 - RNA, 19 nt, Homo sapiens
agacauugcuggaguugac

SEQ ID NO: 1108248 - RNA, 19 nt, Homo sapiens
gugucuccuucauuacuua

SEQ ID NO: 1108249 - RNA, 19 nt, Homo sapiens
augaggauuuggaggauaa

SEQ ID NO: 1108250 - RNA, 19 nt, Homo sapiens
aaagcuaucgggcauguga

SEQ ID NO: 1108251 - RNA, 19 nt, Homo sapiens
cacugugucuuuauagaau

SEQ ID NO: 1108252 - RNA, 19 nt, Homo sapiens
gugggucacuacagauguu

SEQ ID NO: 1108253 - RNA, 19 nt, Homo sapiens
ccacugcugccuuuacuuc

SEQ ID NO: 1108254 - RNA, 19 nt, Homo sapiens
ucuguccacucagcaauaa

SEQ ID NO: 1108255 - RNA, 19 nt, Homo sapiens
ggggccagcugccucuuua

SEQ ID NO: 1108256 - RNA, 19 nt, Homo sapiens
cagcaagguugugaacauc

SEQ ID NO: 1108257 - RNA, 19 nt, Homo sapiens
caagacaguggagaucaaa

SEQ ID NO: 1108258 - RNA, 19 nt, Homo sapiens
gacacaacuugcucaaagg

SEQ ID NO: 1108259 - RNA, 19 nt, Homo sapiens
ccaugagcaucaacuccaa

SEQ ID NO: 1108260 - RNA, 19 nt, Homo sapiens
gaagagugguuuuccuaag

SEQ ID NO: 1108261 - RNA, 19 nt, Homo sapiens
ccucucagcuguuauugcu

SEQ ID NO: 1108262 - RNA, 19 nt, Homo sapiens
uaagacggagaaugacaaa

SEQ ID NO: 1108263 - RNA, 19 nt, Homo sapiens
gugaacaucaucccuguca

SEQ ID NO: 1108264 - RNA, 19 nt, Homo sapiens
cguguccacugcugccuuu

SEQ ID NO: 1108265 - RNA, 19 nt, Homo sapiens
gcuggaaccgggaggagaa

SEQ ID NO: 1108266 - RNA, 19 nt, Homo sapiens
ggacacaacuugcucaaag

SEQ ID NO: 1108267 - RNA, 19 nt, Homo sapiens
ggaguugacuuucuucugu

SEQ ID NO: 1108268 - RNA, 19 nt, Homo sapiens
ugaaagaacucaucaagag

SEQ ID NO: 1108269 - RNA, 19 nt, Homo sapiens
gaaggaauuugaugaggau

SEQ ID NO: 1108270 - RNA, 19 nt, Homo sapiens
ggaauuugaugaggauuug

SEQ ID NO: 1108271 - RNA, 19 nt, Homo sapiens
guacagcccuacugcauca

SEQ ID NO: 1108272 - RNA, 19 nt, Homo sapiens
gguggucacuguaggcuaa

SEQ ID NO: 1108273 - RNA, 19 nt, Homo sapiens
ccaguugcauccuccauuu

SEQ ID NO: 1108274 - RNA, 19 nt, Homo sapiens
cacaauauguacacgcuaa

SEQ ID NO: 1108275 - RNA, 19 nt, Homo sapiens
gagcagaugcgcaagaaga

SEQ ID NO: 1108276 - RNA, 19 nt, Homo sapiens
gagggugggucacuacaga

SEQ ID NO: 1108277 - RNA, 19 nt, Homo sapiens
ccaagcggcucaaugacaa

SEQ ID NO: 1108278 - RNA, 19 nt, Homo sapiens
gacaaggaguaccaaguga

SEQ ID NO: 1108279 - RNA, 19 nt, Homo sapiens
gggagcccauugagaagua

SEQ ID NO: 1108280 - RNA, 19 nt, Homo sapiens
ucaaggaagugacacacaa

SEQ ID NO: 1108281 - RNA, 19 nt, Homo sapiens
caacaucgccaggaagaaa

SEQ ID NO: 1108282 - RNA, 19 nt, Homo sapiens
ucagaugcaugaauguuug

SEQ ID NO: 1108283 - RNA, 19 nt, Homo sapiens
ugaaacaccucagcaagga

SEQ ID NO: 1108284 - RNA, 19 nt, Homo sapiens
ucaaugagcaguacgagaa

SEQ ID NO: 1108285 - RNA, 19 nt, Homo sapiens
ccagaaacccacaauaugu

SEQ ID NO: 1108286 - RNA, 19 nt, Homo sapiens
gcaagaagaccaugaagac

SEQ ID NO: 1108287 - RNA, 19 nt, Homo sapiens
cagaaacccacaauaugua

SEQ ID NO: 1108288 - RNA, 19 nt, Homo sapiens
cacacaacauccacuauga

SEQ ID NO: 1108289 - RNA, 19 nt, Homo sapiens
gcaugaauguuugcgaaug

SEQ ID NO: 1108290 - RNA, 19 nt, Homo sapiens
gaugaggauuuggaggaua

SEQ ID NO: 1108291 - RNA, 19 nt, Homo sapiens
gggccaagcggcucaauga

SEQ ID NO: 1108292 - RNA, 19 nt, Homo sapiens
gaucuugaguucaugaaac

SEQ ID NO: 1108293 - RNA, 19 nt, Homo sapiens
cucaaaggcuggugacuug

SEQ ID NO: 1108294 - RNA, 19 nt, Homo sapiens
ccauuccucucagcuguua

SEQ ID NO: 1108295 - RNA, 19 nt, Homo sapiens
aaacuaaacacacacacaa

SEQ ID NO: 1108296 - RNA, 19 nt, Homo sapiens
ggaagugacacacaacauc

SEQ ID NO: 1108297 - RNA, 19 nt, Homo sapiens
uaacgcagccacugaggaa

SEQ ID NO: 1108298 - RNA, 19 nt, Homo sapiens
cuuacuagauucauugaga

SEQ ID NO: 1108299 - RNA, 19 nt, Homo sapiens
agacaaaggaggauucaug

SEQ ID NO: 1108300 - RNA, 19 nt, Homo sapiens
acucuuggcuuccuuaaag

SEQ ID NO: 1108301 - RNA, 19 nt, Homo sapiens
caugaauguuugcgaaugu

SEQ ID NO: 1108302 - RNA, 19 nt, Homo sapiens
gcacccuucuguccacuca

SEQ ID NO: 1108303 - RNA, 19 nt, Homo sapiens
cauccuccauuuauccaaa

SEQ ID NO: 1108304 - RNA, 19 nt, Homo sapiens
gaaggaggaggucaacauc

SEQ ID NO: 1108305 - RNA, 19 nt, Homo sapiens
caagggcuaggaucacuuu

SEQ ID NO: 1108306 - RNA, 19 nt, Homo sapiens
gcauugcucccuacccauu

SEQ ID NO: 1108307 - RNA, 19 nt, Homo sapiens
aggauaagacggagaauga

SEQ ID NO: 1108308 - RNA, 19 nt, Homo sapiens
gacaaaggaggauucaugu

SEQ ID NO: 1108309 - RNA, 19 nt, Homo sapiens
gaggaacggagacaaagga

SEQ ID NO: 1108310 - RNA, 19 nt, Homo sapiens
ugacaaggaguaccaagug

SEQ ID NO: 1108311 - RNA, 19 nt, Homo sapiens
gaggauucauguccaaagg

SEQ ID NO: 1108312 - RNA, 19 nt, Homo sapiens
ggagcaagggcuaggauca

SEQ ID NO: 1108313 - RNA, 19 nt, Homo sapiens
gugaaagaacucaucaaga

SEQ ID NO: 1108314 - RNA, 19 nt, Homo sapiens
gaagugacaaggaguacca

SEQ ID NO: 1108315 - RNA, 19 nt, Homo sapiens
gguuucgacuucaacauca

SEQ ID NO: 1108316 - RNA, 19 nt, Homo sapiens
gcucaaaggcuggugacuu

SEQ ID NO: 1108317 - RNA, 19 nt, Homo sapiens
gaauguuugcgaauguuga

SEQ ID NO: 1108318 - RNA, 19 nt, Homo sapiens
agaagacauugcuggaguu

SEQ ID NO: 1108319 - RNA, 19 nt, Homo sapiens
ggugaaagaacucaucaag

SEQ ID NO: 1108320 - RNA, 19 nt, Homo sapiens
caacauccacuaugagacu

SEQ ID NO: 1108321 - RNA, 19 nt, Homo sapiens
gauaagacggagaaugaca

SEQ ID NO: 1108322 - RNA, 19 nt, Homo sapiens
uuucuucuguccaaacaaa

SEQ ID NO: 1108323 - RNA, 19 nt, Homo sapiens
gaagacauugcuggaguug

SEQ ID NO: 1108324 - RNA, 19 nt, Homo sapiens
ggugucuccuucauuacuu

SEQ ID NO: 1108325 - RNA, 19 nt, Homo sapiens
ucauugagaucagcugugu

SEQ ID NO: 1108326 - RNA, 19 nt, Homo sapiens
ugacacacaacauccacua

SEQ ID NO: 1108327 - RNA, 19 nt, Homo sapiens
caaggaguaccaagugaau

SEQ ID NO: 1108328 - RNA, 19 nt, Homo sapiens
agacauugcuggaguugac

SEQ ID NO: 1108329 - RNA, 19 nt, Homo sapiens
gugucuccuucauuacuua

SEQ ID NO: 1108330 - RNA, 19 nt, Homo sapiens
augaggauuuggaggauaa

SEQ ID NO: 1108331 - RNA, 19 nt, Homo sapiens
cacugugucuuuauagaau

SEQ ID NO: 1108332 - RNA, 19 nt, Homo sapiens
gugggucacuacagauguu

SEQ ID NO: 1108333 - RNA, 19 nt, Homo sapiens
ccacugcugccuuuacuuc

SEQ ID NO: 1108334 - RNA, 19 nt, Homo sapiens
ucuguccacucagcaauaa

SEQ ID NO: 1108335 - RNA, 19 nt, Homo sapiens
ggggccagcugccucuuua

SEQ ID NO: 1108336 - RNA, 19 nt, Homo sapiens
gacacaacuugcucaaagg

SEQ ID NO: 1108337 - RNA, 19 nt, Homo sapiens
ccaugagcaucaacuccaa

SEQ ID NO: 1108338 - RNA, 19 nt, Homo sapiens
gaagagugguuuuccuaag

SEQ ID NO: 1108339 - RNA, 19 nt, Homo sapiens
ccucucagcuguuauugcu

SEQ ID NO: 1108340 - RNA, 19 nt, Homo sapiens
uaagacggagaaugacaaa

SEQ ID NO: 1108341 - RNA, 19 nt, Homo sapiens
cguguccacugcugccuuu

SEQ ID NO: 1108342 - RNA, 19 nt, Homo sapiens
uaaagggucaagaaagcaa

SEQ ID NO: 1108343 - RNA, 19 nt, Homo sapiens
cuuaaagggucaagaaagc

SEQ ID NO: 1108344 - RNA, 19 nt, Homo sapiens
cacaacauccacuaugaga

SEQ ID NO: 1108345 - RNA, 19 nt, Homo sapiens
acacacaacauccacuaug

SEQ ID NO: 1108346 - RNA, 19 nt, Homo sapiens
ucgagcagaugcgcaagaa

SEQ ID NO: 1108347 - RNA, 19 nt, Homo sapiens
cccagaaacccacaauaug

SEQ ID NO: 1108348 - RNA, 19 nt, Homo sapiens
uccaggaccucaaggaagu

SEQ ID NO: 1108349 - RNA, 19 nt, Homo sapiens
gaggauaagacggagaaug

SEQ ID NO: 1108350 - RNA, 19 nt, Homo sapiens
ugaaggaggaggucaacau

SEQ ID NO: 1108351 - RNA, 19 nt, Homo sapiens
ccaccuacccuaccuacuc

SEQ ID NO: 1108352 - RNA, 19 nt, Homo sapiens
guccaaacaaacaaacaaa

SEQ ID NO: 1108353 - RNA, 19 nt, Homo sapiens
ggagacaaaggaggauuca

SEQ ID NO: 1108354 - RNA, 19 nt, Homo sapiens
acaaccaaguccugaugga

SEQ ID NO: 1108355 - RNA, 19 nt, Homo sapiens
caaaggcuggugacuugug

SEQ ID NO: 1108356 - RNA, 19 nt, Homo sapiens
ucaugagggugggucacua

SEQ ID NO: 1108357 - RNA, 19 nt, Homo sapiens
gccaagcggcucaaugaca

SEQ ID NO: 1108358 - RNA, 19 nt, Homo sapiens
caguugcauccuccauuua

SEQ ID NO: 1108359 - RNA, 19 nt, Homo sapiens
gcggcucaaugacaaugga

SEQ ID NO: 1108360 - RNA, 19 nt, Homo sapiens
cuucgagacuuugucauca

SEQ ID NO: 1108361 - RNA, 19 nt, Homo sapiens
ggaucuugaguucaugaaa

SEQ ID NO: 1108362 - RNA, 19 nt, Homo sapiens
cuacaaccaaguccugaug

SEQ ID NO: 1108363 - RNA, 19 nt, Homo sapiens
gacggacgcagccauguca

SEQ ID NO: 1108364 - RNA, 19 nt, Homo sapiens
gcuacucuuggcuuccuua

SEQ ID NO: 1108365 - RNA, 19 nt, Homo sapiens
aagaaacgcaucccugaca

SEQ ID NO: 1108366 - RNA, 19 nt, Homo sapiens
gcagagaaaucuuacagaa

SEQ ID NO: 1108367 - RNA, 19 nt, Homo sapiens
ggucauagcugcucucauc

SEQ ID NO: 1108368 - RNA, 19 nt, Homo sapiens
ccaugacgcugcagacuaa

SEQ ID NO: 1108369 - RNA, 19 nt, Homo sapiens
gcaccuaccacuucuguuu

SEQ ID NO: 1108370 - RNA, 19 nt, Homo sapiens
gaaagaagaaaggaaagaa

SEQ ID NO: 1108371 - RNA, 19 nt, Homo sapiens
ucugagaaaugguuugaaa

SEQ ID NO: 1108372 - RNA, 19 nt, Homo sapiens
gagaaaugguuugaaaucu

SEQ ID NO: 1108373 - RNA, 19 nt, Homo sapiens
gagucgcuauuucugguua

SEQ ID NO: 1108374 - RNA, 19 nt, Homo sapiens
gaagaaaggaaagaaagga

SEQ ID NO: 1108375 - RNA, 19 nt, Homo sapiens
gaacagaaagaagaaagga

SEQ ID NO: 1108376 - RNA, 19 nt, Homo sapiens
gccagaaccucacggacuu

SEQ ID NO: 1108377 - RNA, 19 nt, Homo sapiens
cggaagccaugccuggaua

SEQ ID NO: 1108378 - RNA, 19 nt, Homo sapiens
aaacacacacacacacuuu

SEQ ID NO: 1108379 - RNA, 19 nt, Homo sapiens
gaaccugugccaauaauac

SEQ ID NO: 1108380 - RNA, 19 nt, Homo sapiens
caucagaucaucaccauca

SEQ ID NO: 1108381 - RNA, 19 nt, Homo sapiens
gcucuaggccaaaucuauu

SEQ ID NO: 1108382 - RNA, 19 nt, Homo sapiens
ccacagagacugaguucau

SEQ ID NO: 1108383 - RNA, 19 nt, Homo sapiens
gaaaccgacccuccucuuc

SEQ ID NO: 1108384 - RNA, 19 nt, Homo sapiens
cagagaaaucuuacagaaa

SEQ ID NO: 1108385 - RNA, 19 nt, Homo sapiens
acagaaagaagaaaggaaa

SEQ ID NO: 1108386 - RNA, 19 nt, Homo sapiens
gcucucaucacaacucuug

SEQ ID NO: 1108387 - RNA, 19 nt, Homo sapiens
cuacaaacacggaagacaa

SEQ ID NO: 1108388 - RNA, 19 nt, Homo sapiens
gccauguacugacccgaaa

SEQ ID NO: 1108389 - RNA, 19 nt, Homo sapiens
agacaaaaccuaaaacuga

SEQ ID NO: 1108390 - RNA, 19 nt, Homo sapiens
ugagaaaugguuugaaauc

SEQ ID NO: 1108391 - RNA, 19 nt, Homo sapiens
ggauacugauagccauguu

SEQ ID NO: 1108392 - RNA, 19 nt, Homo sapiens
agaaaugguuugaaaucuc

SEQ ID NO: 1108393 - RNA, 19 nt, Homo sapiens
ggaaaccgacccuccucuu

SEQ ID NO: 1108394 - RNA, 19 nt, Homo sapiens
agccaugccuggauacuga

SEQ ID NO: 1108395 - RNA, 19 nt, Homo sapiens
cuuaguaugagcagaauaa

SEQ ID NO: 1108396 - RNA, 19 nt, Homo sapiens
ggaaccagaggcagagaga

SEQ ID NO: 1108397 - RNA, 19 nt, Homo sapiens
gaaacgugaccauguggau

SEQ ID NO: 1108398 - RNA, 19 nt, Homo sapiens
cagcgaaucacgcagagaa

SEQ ID NO: 1108399 - RNA, 19 nt, Homo sapiens
gaggauacccagcgaaagg

SEQ ID NO: 1108400 - RNA, 19 nt, Homo sapiens
gagaacagaaagaagaaag

SEQ ID NO: 1108401 - RNA, 19 nt, Homo sapiens
cauagcugcucucaucaca

SEQ ID NO: 1108402 - RNA, 19 nt, Homo sapiens
gggaguacaaauccacauu

SEQ ID NO: 1108403 - RNA, 19 nt, Homo sapiens
ggacauauucacggccuau

SEQ ID NO: 1108404 - RNA, 19 nt, Homo sapiens
caaacacacacacacacuu

SEQ ID NO: 1108405 - RNA, 19 nt, Homo sapiens
ggaggaagcauccgaaacc

SEQ ID NO: 1108406 - RNA, 19 nt, Homo sapiens
gauacugauagccauguuu

SEQ ID NO: 1108407 - RNA, 19 nt, Homo sapiens
uagcugcucucaucacaac

SEQ ID NO: 1108408 - RNA, 19 nt, Homo sapiens
gagcagaauaaaccagugu

SEQ ID NO: 1108409 - RNA, 19 nt, Homo sapiens
ggagaacagaaagaagaaa

SEQ ID NO: 1108410 - RNA, 19 nt, Homo sapiens
gaauuguguuauagguuac

SEQ ID NO: 1108411 - RNA, 19 nt, Homo sapiens
acgagacccugcaguguuc

SEQ ID NO: 1108412 - RNA, 19 nt, Homo sapiens
aaacacggaagacaacugu

SEQ ID NO: 1108413 - RNA, 19 nt, Homo sapiens
uaacgagacccugcagugu

SEQ ID NO: 1108414 - RNA, 19 nt, Homo sapiens
acauauucacggccuauaa

SEQ ID NO: 1108415 - RNA, 19 nt, Homo sapiens
gcgaaucacgcagagaaau

SEQ ID NO: 1108416 - RNA, 19 nt, Homo sapiens
gaaucacgcagagaaaucu

SEQ ID NO: 1108417 - RNA, 19 nt, Homo sapiens
cgaaucacgcagagaaauc

SEQ ID NO: 1108418 - RNA, 19 nt, Homo sapiens
cacagagacugaguucauc

SEQ ID NO: 1108419 - RNA, 19 nt, Homo sapiens
agaaagaagaaaggaaaga

SEQ ID NO: 1108420 - RNA, 19 nt, Homo sapiens
cauguggauucaacagcuu

SEQ ID NO: 1108421 - RNA, 19 nt, Homo sapiens
cccgaaacgugaccaugug

SEQ ID NO: 1108422 - RNA, 19 nt, Homo sapiens
gggacggucucagcagcuu

SEQ ID NO: 1108423 - RNA, 19 nt, Homo sapiens
cugaaccugugccaauaau

SEQ ID NO: 1108424 - RNA, 19 nt, Homo sapiens
aagaagaaaggaaagaaag

SEQ ID NO: 1108425 - RNA, 19 nt, Homo sapiens
aagaaaggaaagaaaggaa

SEQ ID NO: 1108426 - RNA, 19 nt, Homo sapiens
aaacgugaccauguggauu

SEQ ID NO: 1108427 - RNA, 19 nt, Homo sapiens
cgacccuccucuucugauc

SEQ ID NO: 1108428 - RNA, 19 nt, Homo sapiens
caccgucucccucaucaug

SEQ ID NO: 1108429 - RNA, 19 nt, Homo sapiens
caacagcuuuuaggacuca

SEQ ID NO: 1108430 - RNA, 19 nt, Homo sapiens
cuucgugucugagaaaugg

SEQ ID NO: 1108431 - RNA, 19 nt, Homo sapiens
aaaccgacccuccucuucu

SEQ ID NO: 1108432 - RNA, 19 nt, Homo sapiens
gacauauucacggccuaua

SEQ ID NO: 1108433 - RNA, 19 nt, Homo sapiens
cagcagccuggacauauuc

SEQ ID NO: 1108434 - RNA, 19 nt, Homo sapiens
gcgaaagggacgggaggaa

SEQ ID NO: 1108435 - RNA, 19 nt, Homo sapiens
uuggagaacagaaagaaga

SEQ ID NO: 1108436 - RNA, 19 nt, Homo sapiens
ggccuucgugucugagaaa

SEQ ID NO: 1108437 - RNA, 19 nt, Homo sapiens
ucugaucggcaucuuauuc

SEQ ID NO: 1108438 - RNA, 19 nt, Homo sapiens
cuucugaucggcaucuuau

SEQ ID NO: 1108439 - RNA, 19 nt, Homo sapiens
gaagaacaguugaaacaug

SEQ ID NO: 1108440 - RNA, 19 nt, Homo sapiens
ggaaacaaauacuaugaag

SEQ ID NO: 1108441 - RNA, 19 nt, Homo sapiens
ggacgaaccauaaauucaa

SEQ ID NO: 1108442 - RNA, 19 nt, Homo sapiens
gaagacaaauauggaaaca

SEQ ID NO: 1108443 - RNA, 19 nt, Homo sapiens
gaagguugguacauuagug

SEQ ID NO: 1108444 - RNA, 19 nt, Homo sapiens
caaauacuaugaagacaac

SEQ ID NO: 1108445 - RNA, 19 nt, Homo sapiens
guaaagacaaugaagaaca

SEQ ID NO: 1108446 - RNA, 19 nt, Homo sapiens
ggacaaaugaugcgaaggu

SEQ ID NO: 1108447 - RNA, 19 nt, Homo sapiens
gaggcaagauggaguuagu

SEQ ID NO: 1108448 - RNA, 19 nt, Homo sapiens
cuucaacaccuuacaagua

SEQ ID NO: 1108449 - RNA, 19 nt, Homo sapiens
uaaagacaaugaagaacag

SEQ ID NO: 1108450 - RNA, 19 nt, Homo sapiens
caaguaaagacaaugaaga

SEQ ID NO: 1108451 - RNA, 19 nt, Homo sapiens
ugcgaagguugguacauua

SEQ ID NO: 1108452 - RNA, 19 nt, Homo sapiens
gacaaaugaugcgaagguu

SEQ ID NO: 1108453 - RNA, 19 nt, Homo sapiens
cagaacaauauguaccuua

SEQ ID NO: 1108454 - RNA, 19 nt, Homo sapiens
gaagacaacaagcaauuuu

SEQ ID NO: 1108455 - RNA, 19 nt, Homo sapiens
ucauuuggacgaaccauaa

SEQ ID NO: 1108456 - RNA, 19 nt, Homo sapiens
cauggugccuccugaaugg

SEQ ID NO: 1108457 - RNA, 19 nt, Homo sapiens
gggaagacaaauauggaaa

SEQ ID NO: 1108458 - RNA, 19 nt, Homo sapiens
caaugaagaacaguugaaa

SEQ ID NO: 1108459 - RNA, 19 nt, Homo sapiens
guaccuuauucuaccacua

SEQ ID NO: 1108460 - RNA, 19 nt, Homo sapiens
gguuguauauacuacugaa

SEQ ID NO: 1108461 - RNA, 19 nt, Homo sapiens
gaacaguugaaacaugcaa

SEQ ID NO: 1108462 - RNA, 19 nt, Homo sapiens
gaugauccuccaacaacaa

SEQ ID NO: 1108463 - RNA, 19 nt, Homo sapiens
gcauggugccuccugaaug

SEQ ID NO: 1108464 - RNA, 19 nt, Homo sapiens
caucguuggcuucacagua

SEQ ID NO: 1108465 - RNA, 19 nt, Homo sapiens
ucaccgauggguuguauau

SEQ ID NO: 1108466 - RNA, 19 nt, Homo sapiens
ugaagacaacaagcaauuu

SEQ ID NO: 1108467 - RNA, 19 nt, Homo sapiens
auauggagcuuuucaugua

SEQ ID NO: 1108468 - RNA, 19 nt, Homo sapiens
agacaaugaagaacaguug

SEQ ID NO: 1108469 - RNA, 19 nt, Homo sapiens
ccacuagaaagaagauuca

SEQ ID NO: 1108470 - RNA, 19 nt, Homo sapiens
gacuacggcugcgagaaga

SEQ ID NO: 1108471 - RNA, 19 nt, Homo sapiens
ggaagacaaauauggaaac

SEQ ID NO: 1108472 - RNA, 19 nt, Homo sapiens
ccagaacaauauguaccuu

SEQ ID NO: 1108473 - RNA, 19 nt, Homo sapiens
cgucaccgauggguuguau

SEQ ID NO: 1108474 - RNA, 19 nt, Homo sapiens
gacgaaccauaaauucaac

SEQ ID NO: 1108475 - RNA, 19 nt, Homo sapiens
gacaaugaagaacaguuga

SEQ ID NO: 1108476 - RNA, 19 nt, Homo sapiens
gguuaccauucacuauaau

SEQ ID NO: 1108477 - RNA, 19 nt, Homo sapiens
uggcaucguuggcuucaca

SEQ ID NO: 1108478 - RNA, 19 nt, Homo sapiens
augcgaagguugguacauu

SEQ ID NO: 1108479 - RNA, 19 nt, Homo sapiens
cgacuacggcugcgagaag

SEQ ID NO: 1108480 - RNA, 19 nt, Homo sapiens
gauggguuguauauacuac

SEQ ID NO: 1108481 - RNA, 19 nt, Homo sapiens
ugaugauccuccaacaaca

SEQ ID NO: 1108482 - RNA, 19 nt, Homo sapiens
ccuccugaauggcaucguu

SEQ ID NO: 1108483 - RNA, 19 nt, Homo sapiens
acaaugaagaacaguugaa

SEQ ID NO: 1108484 - RNA, 19 nt, Homo sapiens
gcgaggcaagauggaguua

SEQ ID NO: 1108485 - RNA, 19 nt, Homo sapiens
accgauggguuguauauac

SEQ ID NO: 1108486 - RNA, 19 nt, Homo sapiens
augaagaacaguugaaaca

SEQ ID NO: 1108487 - RNA, 19 nt, Homo sapiens
gacugaugauccuccaaca

SEQ ID NO: 1108488 - RNA, 19 nt, Homo sapiens
aucguuggcuucacaguau

SEQ ID NO: 1108489 - RNA, 19 nt, Homo sapiens
gcgaagguugguacauuag

SEQ ID NO: 1108490 - RNA, 19 nt, Homo sapiens
gcugcgagaagacgacaga

SEQ ID NO: 1108491 - RNA, 19 nt, Homo sapiens
ccgauggguuguauauacu

SEQ ID NO: 1108492 - RNA, 19 nt, Homo sapiens
caacaacgcaaauuuauga

SEQ ID NO: 1108493 - RNA, 19 nt, Homo sapiens
cacaaagucuuacugauuu

SEQ ID NO: 1108494 - RNA, 19 nt, Homo sapiens
uuagaagccuccauugaaa

SEQ ID NO: 1108495 - RNA, 19 nt, Homo sapiens
gagugacccuuugcugaua

SEQ ID NO: 1108496 - RNA, 19 nt, Homo sapiens
acacaaagucuuacugauu

SEQ ID NO: 1108497 - RNA, 19 nt, Homo sapiens
ggaauaccaacuucagaaa

SEQ ID NO: 1108498 - RNA, 19 nt, Homo sapiens
gauuagaagccuccauuga

SEQ ID NO: 1108499 - RNA, 19 nt, Homo sapiens
agauuuaccuucagcuuau

SEQ ID NO: 1108500 - RNA, 19 nt, Homo sapiens
gcggauucauuccacuuaa

SEQ ID NO: 1108501 - RNA, 19 nt, Homo sapiens
gcaagcaccaacaauauag

SEQ ID NO: 1108502 - RNA, 19 nt, Homo sapiens
guucucagcuuggaauaau

SEQ ID NO: 1108503 - RNA, 19 nt, Homo sapiens
gugcagcaguuaagauuag

SEQ ID NO: 1108504 - RNA, 19 nt, Homo sapiens
ccacacaaagucuuacuga

SEQ ID NO: 1108505 - RNA, 19 nt, Homo sapiens
uaaccacugcuaauaacua

SEQ ID NO: 1108506 - RNA, 19 nt, Homo sapiens
gguaaccacugcuaauaac

SEQ ID NO: 1108507 - RNA, 19 nt, Homo sapiens
cagcaagcaccaacaauau

SEQ ID NO: 1108508 - RNA, 19 nt, Homo sapiens
acagcaagcaccaacaaua

SEQ ID NO: 1108509 - RNA, 19 nt, Homo sapiens
gaggagaggucggaauguc

SEQ ID NO: 1108510 - RNA, 19 nt, Homo sapiens
ggagugacccuuugcugau

SEQ ID NO: 1108511 - RNA, 19 nt, Homo sapiens
caaguuguccuuucuccuu

SEQ ID NO: 1108512 - RNA, 19 nt, Homo sapiens
aaccacugcuaauaacuaa

SEQ ID NO: 1108513 - RNA, 19 nt, Homo sapiens
cggauucauuccacuuaaa

SEQ ID NO: 1108514 - RNA, 19 nt, Homo sapiens
gcuccuugaagaagauuua

SEQ ID NO: 1108515 - RNA, 19 nt, Homo sapiens
aaacauuggaccacacaaa

SEQ ID NO: 1108516 - RNA, 19 nt, Homo sapiens
aagauuuaccuucagcuua

SEQ ID NO: 1108517 - RNA, 19 nt, Homo sapiens
gcagcuccuugaagaagau

SEQ ID NO: 1108518 - RNA, 19 nt, Homo sapiens
ucccaacaacgcaaauuua

SEQ ID NO: 1108519 - RNA, 19 nt, Homo sapiens
aaguuguccuuucuccuua

SEQ ID NO: 1108520 - RNA, 19 nt, Homo sapiens
ugauaggaauaccaacuuc

SEQ ID NO: 1108521 - RNA, 19 nt, Homo sapiens
aaacagcaagcaccaacaa

SEQ ID NO: 1108522 - RNA, 19 nt, Homo sapiens
gauuuaccuucagcuuauu

SEQ ID NO: 1108523 - RNA, 19 nt, Homo sapiens
aauugaagauguccagcaa

SEQ ID NO: 1108524 - RNA, 19 nt, Homo sapiens
ccucgccucuucccaacaa

SEQ ID NO: 1108525 - RNA, 19 nt, Homo sapiens
ccaacaacgcaaauuuaug

SEQ ID NO: 1108526 - RNA, 19 nt, Homo sapiens
gauaggaauaccaacuuca

SEQ ID NO: 1108527 - RNA, 19 nt, Homo sapiens
gaagauguccagcaaaaca

SEQ ID NO: 1108528 - RNA, 19 nt, Homo sapiens
auuagaagccuccauugaa

SEQ ID NO: 1108529 - RNA, 19 nt, Homo sapiens
aagauuagaagccuccauu

SEQ ID NO: 1108530 - RNA, 19 nt, Homo sapiens
ggcggauucauuccacuua

SEQ ID NO: 1108531 - RNA, 19 nt, Homo sapiens
cccaacaacgcaaauuuau

SEQ ID NO: 1108532 - RNA, 19 nt, Homo sapiens
acaaagucuuacugauuuc

SEQ ID NO: 1108533 - RNA, 19 nt, Homo sapiens
guuguccuuucuccuuaaa

SEQ ID NO: 1108534 - RNA, 19 nt, Homo sapiens
ggcaucagcggaccucaug

SEQ ID NO: 1108535 - RNA, 19 nt, Homo sapiens
agcaagcaccaacaauaua

SEQ ID NO: 1108536 - RNA, 19 nt, Homo sapiens
gaauaccaacuucagaaaa

SEQ ID NO: 1108537 - RNA, 19 nt, Homo sapiens
aagccuccauugaaagaau

SEQ ID NO: 1108538 - RNA, 19 nt, Homo sapiens
agaagccuccauugaaaga

SEQ ID NO: 1108539 - RNA, 19 nt, Homo sapiens
cacacaaagucuuacugau

SEQ ID NO: 1108540 - RNA, 19 nt, Homo sapiens
caucuuauaguggaauaga

SEQ ID NO: 1108541 - RNA, 19 nt, Homo sapiens
aggaauaccaacuucagaa

SEQ ID NO: 1108542 - RNA, 19 nt, Homo sapiens
ugccaggagugacccuuug

SEQ ID NO: 1108543 - RNA, 19 nt, Homo sapiens
uuggaauaauggacucuga

SEQ ID NO: 1108544 - RNA, 19 nt, Homo sapiens
auaguggaauagagaaaca

SEQ ID NO: 1108545 - RNA, 19 nt, Homo sapiens
uugaagauguccagcaaaa

SEQ ID NO: 1108546 - RNA, 19 nt, Homo sapiens
ccacugcuaauaacuaaaa

SEQ ID NO: 1108547 - RNA, 19 nt, Homo sapiens
aaacagcuccucgccucuu

SEQ ID NO: 1108548 - RNA, 19 nt, Homo sapiens
caaagucuuacugauuuca

SEQ ID NO: 1108549 - RNA, 19 nt, Homo sapiens
gaaacgcacucaaauauga

SEQ ID NO: 1108550 - RNA, 19 nt, Homo sapiens
gaagauaucacguaaguuu

SEQ ID NO: 1108551 - RNA, 19 nt, Homo sapiens
gaacuugacgugaaauaua

SEQ ID NO: 1108552 - RNA, 19 nt, Homo sapiens
acaaagagauuauccauga

SEQ ID NO: 1108553 - RNA, 19 nt, Homo sapiens
gaagcaaugugguuaggaa

SEQ ID NO: 1108554 - RNA, 19 nt, Homo sapiens
gauagaacuugacgugaaa

SEQ ID NO: 1108555 - RNA, 19 nt, Homo sapiens
guaguuggguugacaaguu

SEQ ID NO: 1108556 - RNA, 19 nt, Homo sapiens
ggacugaacaugaugaaga

SEQ ID NO: 1108557 - RNA, 19 nt, Homo sapiens
caacugaacugggacaugu

SEQ ID NO: 1108558 - RNA, 19 nt, Homo sapiens
caacgagagucuugaugaa

SEQ ID NO: 1108559 - RNA, 19 nt, Homo sapiens
gcaaaccacauacauuauu

SEQ ID NO: 1108560 - RNA, 19 nt, Homo sapiens
agagugaaauccagaaauu

SEQ ID NO: 1108561 - RNA, 19 nt, Homo sapiens
caacgggacugaacaugau

SEQ ID NO: 1108562 - RNA, 19 nt, Homo sapiens
gcaaugugguuaggaaaga

SEQ ID NO: 1108563 - RNA, 19 nt, Homo sapiens
agaagaagauagaacuuga

SEQ ID NO: 1108564 - RNA, 19 nt, Homo sapiens
ugaagaagaucagaaggaa

SEQ ID NO: 1108565 - RNA, 19 nt, Homo sapiens
ucuaaaugcucaccaaaga

SEQ ID NO: 1108566 - RNA, 19 nt, Homo sapiens
gagagaagcaaugugguua

SEQ ID NO: 1108567 - RNA, 19 nt, Homo sapiens
caucuuagcaugcaaauca

SEQ ID NO: 1108568 - RNA, 19 nt, Homo sapiens
gaaauucauugcagauggu

SEQ ID NO: 1108569 - RNA, 19 nt, Homo sapiens
cacaaaggguaaauaauuc

SEQ ID NO: 1108570 - RNA, 19 nt, Homo sapiens
ugacaaguuucugccuuua

SEQ ID NO: 1108571 - RNA, 19 nt, Homo sapiens
ucauagagauuucaaguac

SEQ ID NO: 1108572 - RNA, 19 nt, Homo sapiens
uaggaucgccagaauguua

SEQ ID NO: 1108573 - RNA, 19 nt, Homo sapiens
aagaagauaucacguaagu

SEQ ID NO: 1108574 - RNA, 19 nt, Homo sapiens
gacugaacaugaugaagaa

SEQ ID NO: 1108575 - RNA, 19 nt, Homo sapiens
gcaacgggacugaacauga

SEQ ID NO: 1108576 - RNA, 19 nt, Homo sapiens
uauaugaacgcaacucuaa

SEQ ID NO: 1108577 - RNA, 19 nt, Homo sapiens
cuaaagaagauaucacgua

SEQ ID NO: 1108578 - RNA, 19 nt, Homo sapiens
gaccagcucagccauuuaa

SEQ ID NO: 1108579 - RNA, 19 nt, Homo sapiens
gcauauaccagucccuuga

SEQ ID NO: 1108580 - RNA, 19 nt, Homo sapiens
cugcagaacuacugaauuc

SEQ ID NO: 1108581 - RNA, 19 nt, Homo sapiens
agaaagcgcccaagaaugu

SEQ ID NO: 1108582 - RNA, 19 nt, Homo sapiens
cuuaauaacagccagaaua

SEQ ID NO: 1108583 - RNA, 19 nt, Homo sapiens
acacgaaguugcuggaaga

SEQ ID NO: 1108584 - RNA, 19 nt, Homo sapiens
uugcaaaccacauacauua

SEQ ID NO: 1108585 - RNA, 19 nt, Homo sapiens
agauagaacuugacgugaa

SEQ ID NO: 1108586 - RNA, 19 nt, Homo sapiens
aaaucaugcuucucuguuu

SEQ ID NO: 1108587 - RNA, 19 nt, Homo sapiens
caaagaaauugaguaugug

SEQ ID NO: 1108588 - RNA, 19 nt, Homo sapiens
aaagaaagcgcccaagaau

SEQ ID NO: 1108589 - RNA, 19 nt, Homo sapiens
ccacauacauuauuaucac

SEQ ID NO: 1108590 - RNA, 19 nt, Homo sapiens
ugaagaagcagaaagugaa

SEQ ID NO: 1108591 - RNA, 19 nt, Homo sapiens
caaacagaacacaagaaua

SEQ ID NO: 1108592 - RNA, 19 nt, Homo sapiens
gcucgaguuuccucuaaga

SEQ ID NO: 1108593 - RNA, 19 nt, Homo sapiens
ccgaaacgcacucaaauau

SEQ ID NO: 1108594 - RNA, 19 nt, Homo sapiens
caagcugaguugaagaaga

SEQ ID NO: 1108595 - RNA, 19 nt, Homo sapiens
gagaagaagauagaacuug

SEQ ID NO: 1108596 - RNA, 19 nt, Homo sapiens
gggcugcgaaauuuaauaa

SEQ ID NO: 1108597 - RNA, 19 nt, Homo sapiens
ccucacaacuucuuggaau

SEQ ID NO: 1108598 - RNA, 19 nt, Homo sapiens
uaauuaggaucgccagaau

SEQ ID NO: 1108599 - RNA, 19 nt, Homo sapiens
uuccgaagaucccaguuua

SEQ ID NO: 1108600 - RNA, 19 nt, Homo sapiens
gaacacaaagaaauugagu

SEQ ID NO: 1108601 - RNA, 19 nt, Homo sapiens
guuucugccuuuaagauaa

SEQ ID NO: 1108602 - RNA, 19 nt, Homo sapiens
gaagaagaucagaaggaaa

SEQ ID NO: 1108603 - RNA, 19 nt, Homo sapiens
gaaaucccaagcugaguug

SEQ ID NO: 1108604 - RNA, 19 nt, Homo sapiens
caucaaagugccagagaaa

SEQ ID NO: 1108605 - RNA, 19 nt, Homo sapiens
gaaauccagaaauucauug

SEQ ID NO: 1108606 - RNA, 19 nt, Homo sapiens
gccgaaacgcacucaaaua

SEQ ID NO: 1108607 - RNA, 19 nt, Homo sapiens
ccaaacagaacacaagaau

SEQ ID NO: 1108608 - RNA, 19 nt, Homo sapiens
uaaaugcucaccaaagaug

SEQ ID NO: 1108609 - RNA, 19 nt, Homo sapiens
gcacucaaauaugaacaca

SEQ ID NO: 1108610 - RNA, 19 nt, Homo sapiens
aagcugaguugaagaagau

SEQ ID NO: 1108611 - RNA, 19 nt, Homo sapiens
caaaucaugcuucucuguu

SEQ ID NO: 1108612 - RNA, 19 nt, Homo sapiens
ggaagaaaaugagacagaa

SEQ ID NO: 1108613 - RNA, 19 nt, Homo sapiens
cgaaguugcuggaagaaaa

SEQ ID NO: 1108614 - RNA, 19 nt, Homo sapiens
agaaagcuguaaacgcuau

SEQ ID NO: 1108615 - RNA, 19 nt, Homo sapiens
ucacguaaguuugcaucuu

SEQ ID NO: 1108616 - RNA, 19 nt, Homo sapiens
gcaaaucaugcuucucugu

SEQ ID NO: 1108617 - RNA, 19 nt, Homo sapiens
aaggauggcuggcucuaug

SEQ ID NO: 1108618 - RNA, 19 nt, Homo sapiens
cagaacuacugaauuccaa

SEQ ID NO: 1108619 - RNA, 19 nt, Homo sapiens
aagaggcgcuucugcuuuc

SEQ ID NO: 1108620 - RNA, 19 nt, Homo sapiens
gacauguccucauagagau

SEQ ID NO: 1108621 - RNA, 19 nt, Homo sapiens
gacacaagcucgaguuucc

SEQ ID NO: 1108622 - RNA, 19 nt, Homo sapiens
cuuacagucugcagaacua

SEQ ID NO: 1108623 - RNA, 19 nt, Homo sapiens
guaauuaggaucgccagaa

SEQ ID NO: 1108624 - RNA, 19 nt, Homo sapiens
gaaaagaaagcgcccaaga

SEQ ID NO: 1108625 - RNA, 19 nt, Homo sapiens
cagaauaagggauagucua

SEQ ID NO: 1108626 - RNA, 19 nt, Homo sapiens
uaguuggguugacaaguuu

SEQ ID NO: 1108627 - RNA, 19 nt, Homo sapiens
aagcucgaguuuccucuaa

SEQ ID NO: 1108628 - RNA, 19 nt, Homo sapiens
ccucaggcuucacccauga

SEQ ID NO: 1108629 - RNA, 19 nt, Homo sapiens
ccaucaaagugccagagaa

SEQ ID NO: 1108630 - RNA, 19 nt, Homo sapiens
ggagaagaagauagaacuu

SEQ ID NO: 1108631 - RNA, 19 nt, Homo sapiens
gacaaguuucugccuuuaa

SEQ ID NO: 1108632 - RNA, 19 nt, Homo sapiens
gagaagcaaugugguuagg

SEQ ID NO: 1108633 - RNA, 19 nt, Homo sapiens
acaaguuucugccuuuaag

SEQ ID NO: 1108634 - RNA, 19 nt, Homo sapiens
ucacguaguuggguugaca

SEQ ID NO: 1108635 - RNA, 19 nt, Homo sapiens
accagucccuugaucgaua

SEQ ID NO: 1108636 - RNA, 19 nt, Homo sapiens
cgagagaagcaaugugguu

SEQ ID NO: 1108637 - RNA, 19 nt, Homo sapiens
gggugaaacuccccuguaa

SEQ ID NO: 1108638 - RNA, 19 nt, Homo sapiens
cgaaacgcacucaaauaug

SEQ ID NO: 1108639 - RNA, 19 nt, Homo sapiens
uuacgacacccuuucuaaa

SEQ ID NO: 1108640 - RNA, 19 nt, Homo sapiens
ucacuuacagucugcagaa

SEQ ID NO: 1108641 - RNA, 19 nt, Homo sapiens
uuacaacuagugcacuuaa

SEQ ID NO: 1108642 - RNA, 19 nt, Homo sapiens
gaaggauggcuggcucuau

SEQ ID NO: 1108643 - RNA, 19 nt, Homo sapiens
gaagaagcagaaagugaag

SEQ ID NO: 1108644 - RNA, 19 nt, Homo sapiens
cgacacccuuucuaaaugc

SEQ ID NO: 1108645 - RNA, 19 nt, Homo sapiens
acgacacccuuucuaaaug

SEQ ID NO: 1108646 - RNA, 19 nt, Homo sapiens
uagagucuuuggagaaauc

SEQ ID NO: 1108647 - RNA, 19 nt, Homo sapiens
aaagauaccaaacagaaca

SEQ ID NO: 1108648 - RNA, 19 nt, Homo sapiens
ccacaaagagauuauccau

SEQ ID NO: 1108649 - RNA, 19 nt, Homo sapiens
gcaacaaacuaugguauaa

SEQ ID NO: 1108650 - RNA, 19 nt, Homo sapiens
gacaagagauuaucaaagu

SEQ ID NO: 1108651 - RNA, 19 nt, Homo sapiens
gaaccaagaugcaguccaa

SEQ ID NO: 1108652 - RNA, 19 nt, Homo sapiens
guaauggacucauggauca

SEQ ID NO: 1108653 - RNA, 19 nt, Homo sapiens
caaccuggauuauaaugaa

SEQ ID NO: 1108654 - RNA, 19 nt, Homo sapiens
agacacaacuuuggacaua

SEQ ID NO: 1108655 - RNA, 19 nt, Homo sapiens
uaccugcuaugaucaauua

SEQ ID NO: 1108656 - RNA, 19 nt, Homo sapiens
gagccaacauuuaugauca

SEQ ID NO: 1108657 - RNA, 19 nt, Homo sapiens
ccaagaagauggagacucu

SEQ ID NO: 1108658 - RNA, 19 nt, Homo sapiens
gcaauguacugguauaacu

SEQ ID NO: 1108659 - RNA, 19 nt, Homo sapiens
gauggagacucuuaagcaa

SEQ ID NO: 1108660 - RNA, 19 nt, Homo sapiens
ugacaccucuucaacaaau

SEQ ID NO: 1108661 - RNA, 19 nt, Homo sapiens
guacugguauaacuaugaa

SEQ ID NO: 1108662 - RNA, 19 nt, Homo sapiens
gaaaucugguuuauaugag

SEQ ID NO: 1108663 - RNA, 19 nt, Homo sapiens
uuaaagaagugguuaugug

SEQ ID NO: 1108664 - RNA, 19 nt, Homo sapiens
uaaagaagugguuauguga

SEQ ID NO: 1108665 - RNA, 19 nt, Homo sapiens
gggcugggcuccuacuguu

SEQ ID NO: 1108666 - RNA, 19 nt, Homo sapiens
ugugauaagucaacuagaa

SEQ ID NO: 1108667 - RNA, 19 nt, Homo sapiens
gcauagaguugaagaacag

SEQ ID NO: 1108668 - RNA, 19 nt, Homo sapiens
uaagugcucuucugagauc

SEQ ID NO: 1108669 - RNA, 19 nt, Homo sapiens
gaaaccugcauaccaauug

SEQ ID NO: 1108670 - RNA, 19 nt, Homo sapiens
caacuuggaacaacacuau

SEQ ID NO: 1108671 - RNA, 19 nt, Homo sapiens
aaugaaaccugcauaccaa

SEQ ID NO: 1108672 - RNA, 19 nt, Homo sapiens
caagagauuaucaaaguga

SEQ ID NO: 1108673 - RNA, 19 nt, Homo sapiens
gaaggcagcaauacuagug

SEQ ID NO: 1108674 - RNA, 19 nt, Homo sapiens
ucucagcaauguacuggua

SEQ ID NO: 1108675 - RNA, 19 nt, Homo sapiens
gaacugcaucgauuuguca

SEQ ID NO: 1108676 - RNA, 19 nt, Homo sapiens
ggaauuguagccagauuug

SEQ ID NO: 1108677 - RNA, 19 nt, Homo sapiens
ggcauuaaaucucuaugga

SEQ ID NO: 1108678 - RNA, 19 nt, Homo sapiens
gauaagucaacuagaauug

SEQ ID NO: 1108679 - RNA, 19 nt, Homo sapiens
ucaauuaagugcucuucug

SEQ ID NO: 1108680 - RNA, 19 nt, Homo sapiens
acucauggaucaucuaugu

SEQ ID NO: 1108681 - RNA, 19 nt, Homo sapiens
caacuuuggacauaugaaa

SEQ ID NO: 1108682 - RNA, 19 nt, Homo sapiens
gguauaagaagccaggaaa

SEQ ID NO: 1108683 - RNA, 19 nt, Homo sapiens
ggcaacaaacuaugguaua

SEQ ID NO: 1108684 - RNA, 19 nt, Homo sapiens
aaauauggauccugagaca

SEQ ID NO: 1108685 - RNA, 19 nt, Homo sapiens
acacaacuuuggacauaug

SEQ ID NO: 1108686 - RNA, 19 nt, Homo sapiens
gaagugguuaugugagaaa

SEQ ID NO: 1108687 - RNA, 19 nt, Homo sapiens
ucagcaauguacugguaua

SEQ ID NO: 1108688 - RNA, 19 nt, Homo sapiens
ggaacugcaucgauuuguc

SEQ ID NO: 1108689 - RNA, 19 nt, Homo sapiens
gaaguuuucuuacguggaa

SEQ ID NO: 1108690 - RNA, 19 nt, Homo sapiens
auaagaagccaggaaauuu

SEQ ID NO: 1108691 - RNA, 19 nt, Homo sapiens
ggacaagagauuaucaaag

SEQ ID NO: 1108692 - RNA, 19 nt, Homo sapiens
uguugcaacuuuaccauuu

SEQ ID NO: 1108693 - RNA, 19 nt, Homo sapiens
aagaagugguuaugugaga

SEQ ID NO: 1108694 - RNA, 19 nt, Homo sapiens
cugccacaguuauuuauuu

SEQ ID NO: 1108695 - RNA, 19 nt, Homo sapiens
uaagaagccaggaaauuuc

SEQ ID NO: 1108696 - RNA, 19 nt, Homo sapiens
uauaagaagccaggaaauu

SEQ ID NO: 1108697 - RNA, 19 nt, Homo sapiens
gaauugauuagaaccaaga

SEQ ID NO: 1108698 - RNA, 19 nt, Homo sapiens
acaacacuaugcccaagaa

SEQ ID NO: 1108699 - RNA, 19 nt, Homo sapiens
ccaagaugcaguccaagaa

SEQ ID NO: 1108700 - RNA, 19 nt, Homo sapiens
caauuaagugcucuucuga

SEQ ID NO: 1108701 - RNA, 19 nt, Homo sapiens
caaagugacaccucuucaa

SEQ ID NO: 1108702 - RNA, 19 nt, Homo sapiens
acaaaugcuugccucaugu

SEQ ID NO: 1108703 - RNA, 19 nt, Homo sapiens
aacaaaugcuugccucaug

SEQ ID NO: 1108704 - RNA, 19 nt, Homo sapiens
gcuccugcuugugccauua

SEQ ID NO: 1108705 - RNA, 19 nt, Homo sapiens
guaccuuucucagcaaugu

SEQ ID NO: 1108706 - RNA, 19 nt, Homo sapiens
gauguaccuuucucagcaa

SEQ ID NO: 1108707 - RNA, 19 nt, Homo sapiens
gggaacauuggaugcauuu

SEQ ID NO: 1108708 - RNA, 19 nt, Homo sapiens
gaagagggaggcaacaaac

SEQ ID NO: 1108709 - RNA, 19 nt, Homo sapiens
caaaugcuugccucaugua

SEQ ID NO: 1108710 - RNA, 19 nt, Homo sapiens
caacuuuaccauuugaugu

SEQ ID NO: 1108711 - RNA, 19 nt, Homo sapiens
ggacucauggaucaucuau

SEQ ID NO: 1108712 - RNA, 19 nt, Homo sapiens
caguacauaugaauuugga

SEQ ID NO: 1108713 - RNA, 19 nt, Homo sapiens
uaaaauugcuccugcuugu

SEQ ID NO: 1108714 - RNA, 19 nt, Homo sapiens
gaagaacagacucaaacca

SEQ ID NO: 1108715 - RNA, 19 nt, Homo sapiens
caauguacugguauaacua

SEQ ID NO: 1108716 - RNA, 19 nt, Homo sapiens
ucuuagagauguaccuuuc

SEQ ID NO: 1108717 - RNA, 19 nt, Homo sapiens
agugacaccucuucaacaa

SEQ ID NO: 1108718 - RNA, 19 nt, Homo sapiens
ugugagaaaucugguuuau

SEQ ID NO: 1108719 - RNA, 19 nt, Homo sapiens
gagggaggcaacaaacuau

SEQ ID NO: 1108720 - RNA, 19 nt, Homo sapiens
gggacaagagauuaucaaa

SEQ ID NO: 1108721 - RNA, 19 nt, Homo sapiens
gaugcugguucaacuugga

SEQ ID NO: 1108722 - RNA, 19 nt, Homo sapiens
gcauaugucaaccuggauu

SEQ ID NO: 1108723 - RNA, 19 nt, Homo sapiens
gacacaacuuuggacauau

SEQ ID NO: 1108724 - RNA, 19 nt, Homo sapiens
guugcaacuuuaccauuug

SEQ ID NO: 1108725 - RNA, 19 nt, Homo sapiens
auuaagugcucuucugaga

SEQ ID NO: 1108726 - RNA, 19 nt, Homo sapiens
ugaagagggaggcaacaaa

SEQ ID NO: 1108727 - RNA, 19 nt, Homo sapiens
augucaaccuggauuauaa

SEQ ID NO: 1108728 - RNA, 19 nt, Homo sapiens
cauaugucaaccuggauua

SEQ ID NO: 1108729 - RNA, 19 nt, Homo sapiens
gcaacuuuaccauuugaug

SEQ ID NO: 1108730 - RNA, 19 nt, Homo sapiens
caaacuaugguauaagaag

SEQ ID NO: 1108731 - RNA, 19 nt, Homo sapiens
ccaaugauuuaugucuuuc

SEQ ID NO: 1108732 - RNA, 19 nt, Homo sapiens
uggagacucuuaagcaaag

SEQ ID NO: 1108733 - RNA, 19 nt, Homo sapiens
gugagaaaucugguuuaua

SEQ ID NO: 1108734 - RNA, 19 nt, Homo sapiens
agccagauuuggugcagua

SEQ ID NO: 1108735 - RNA, 19 nt, Homo sapiens
agagggaggcaacaaacua

SEQ ID NO: 1108736 - RNA, 19 nt, Homo sapiens
aggccuaauuccucgcuua

SEQ ID NO: 1108737 - RNA, 19 nt, Homo sapiens
uaugucaaccuggauuaua

SEQ ID NO: 1108738 - RNA, 19 nt, Homo sapiens
uaugagccaacauuuauga

SEQ ID NO: 1108739 - RNA, 19 nt, Homo sapiens
gugcucuucugagaucuaa

SEQ ID NO: 1108740 - RNA, 19 nt, Homo sapiens
ucucuccaaugauuuaugu

SEQ ID NO: 1108741 - RNA, 19 nt, Homo sapiens
acaagagauuaucaaagug

SEQ ID NO: 1108742 - RNA, 19 nt, Homo sapiens
ggcauugucugguucuuuu

SEQ ID NO: 1108743 - RNA, 19 nt, Homo sapiens
cuacuguucuuagagaugu

SEQ ID NO: 1108744 - RNA, 19 nt, Homo sapiens
cagauuuggugcaguaacu

SEQ ID NO: 1108745 - RNA, 19 nt, Homo sapiens
aaaccugcauaccaauugu

SEQ ID NO: 1108746 - RNA, 19 nt, Homo sapiens
gagcauagaguugaagaac

SEQ ID NO: 1108747 - RNA, 19 nt, Homo sapiens
ggccuaauuccucgcuuaa

SEQ ID NO: 1108748 - RNA, 19 nt, Homo sapiens
gaugguuggauuucccuuu

SEQ ID NO: 1108749 - RNA, 19 nt, Homo sapiens
acacauagguuguauugua

SEQ ID NO: 1108750 - RNA, 19 nt, Homo sapiens
gaaagaauaugaucaacuc

SEQ ID NO: 1108751 - RNA, 19 nt, Homo sapiens
gaaagaacacucugaacuu

SEQ ID NO: 1108752 - RNA, 19 nt, Homo sapiens
gguauaugguggcuguuua

SEQ ID NO: 1108753 - RNA, 19 nt, Homo sapiens
cagcagaccugaugccuau

SEQ ID NO: 1108754 - RNA, 19 nt, Homo sapiens
ugagagaaguaaggaaaua

SEQ ID NO: 1108755 - RNA, 19 nt, Homo sapiens
ccucagagauggcagaaga

SEQ ID NO: 1108756 - RNA, 19 nt, Homo sapiens
ucagauauauugcaaaguc

SEQ ID NO: 1108757 - RNA, 19 nt, Homo sapiens
cacauagguuguauuguaa

SEQ ID NO: 1108758 - RNA, 19 nt, Homo sapiens
aaaugaagaugcagucaga

SEQ ID NO: 1108759 - RNA, 19 nt, Homo sapiens
gaaaagccaugguaaagau

SEQ ID NO: 1108760 - RNA, 19 nt, Homo sapiens
agaaagaggcaacaagaaa

SEQ ID NO: 1108761 - RNA, 19 nt, Homo sapiens
aaagaacacucugaacuuc

SEQ ID NO: 1108762 - RNA, 19 nt, Homo sapiens
ccacacauagguuguauug

SEQ ID NO: 1108763 - RNA, 19 nt, Homo sapiens
gaagaugcagucagagaga

SEQ ID NO: 1108764 - RNA, 19 nt, Homo sapiens
caaacaaagguguacuuaa

SEQ ID NO: 1108765 - RNA, 19 nt, Homo sapiens
ugguaaagaugaagaaugu

SEQ ID NO: 1108766 - RNA, 19 nt, Homo sapiens
aaagaacguucaaacaaag

SEQ ID NO: 1108767 - RNA, 19 nt, Homo sapiens
gaaauauuccucaguucau

SEQ ID NO: 1108768 - RNA, 19 nt, Homo sapiens
uaugaccgguucguaauuu

SEQ ID NO: 1108769 - RNA, 19 nt, Homo sapiens
ucaaacaaagguguacuua

SEQ ID NO: 1108770 - RNA, 19 nt, Homo sapiens
uuaaucuucugccuacuuu

SEQ ID NO: 1108771 - RNA, 19 nt, Homo sapiens
gcaguggcaaccuuucuuu

SEQ ID NO: 1108772 - RNA, 19 nt, Homo sapiens
uauuccagcucuuaagaaa

SEQ ID NO: 1108773 - RNA, 19 nt, Homo sapiens
aaagacacuugcaauauac

SEQ ID NO: 1108774 - RNA, 19 nt, Homo sapiens
gaucaacuccugaaagaac

SEQ ID NO: 1108775 - RNA, 19 nt, Homo sapiens
guggcaaccuuucuuuaug

SEQ ID NO: 1108776 - RNA, 19 nt, Homo sapiens
gguggcuguuuaccaauaa

SEQ ID NO: 1108777 - RNA, 19 nt, Homo sapiens
guaaagaugaagaaugugu

SEQ ID NO: 1108778 - RNA, 19 nt, Homo sapiens
caaaagaacguucaaacaa

SEQ ID NO: 1108779 - RNA, 19 nt, Homo sapiens
acacacagaugaaacuuuu

SEQ ID NO: 1108780 - RNA, 19 nt, Homo sapiens
gagaaguaaggaaauauuc

SEQ ID NO: 1108781 - RNA, 19 nt, Homo sapiens
gaaagaggcaacaagaaaa

SEQ ID NO: 1108782 - RNA, 19 nt, Homo sapiens
gaacacacacagaugaaac

SEQ ID NO: 1108783 - RNA, 19 nt, Homo sapiens
gcagaccugaugccuauga

SEQ ID NO: 1108784 - RNA, 19 nt, Homo sapiens
gggguaaaauugcaacuuu

SEQ ID NO: 1108785 - RNA, 19 nt, Homo sapiens
gcacuaugaccgguucgua

SEQ ID NO: 1108786 - RNA, 19 nt, Homo sapiens
cuucagaugcccuuucuaa

SEQ ID NO: 1108787 - RNA, 19 nt, Homo sapiens
gcaauauacugugucaaaa

SEQ ID NO: 1108788 - RNA, 19 nt, Homo sapiens
ucaggaucguuuagaaaga

SEQ ID NO: 1108789 - RNA, 19 nt, Homo sapiens
guguugagacgucugguua

SEQ ID NO: 1108790 - RNA, 19 nt, Homo sapiens
gaacuucaggaucguuuag

SEQ ID NO: 1108791 - RNA, 19 nt, Homo sapiens
gaagaccaggagaaacuga

SEQ ID NO: 1108792 - RNA, 19 nt, Homo sapiens
cauagguuguauuguaaug

SEQ ID NO: 1108793 - RNA, 19 nt, Homo sapiens
ugaagaauguguuuuggaa

SEQ ID NO: 1108794 - RNA, 19 nt, Homo sapiens
augaucaacuccugaaaga

SEQ ID NO: 1108795 - RNA, 19 nt, Homo sapiens
ugguuacgcuuauuacuca

SEQ ID NO: 1108796 - RNA, 19 nt, Homo sapiens
uuagaaagaggcaacaaga

SEQ ID NO: 1108797 - RNA, 19 nt, Homo sapiens
ugaaagaacacucugaacu

SEQ ID NO: 1108798 - RNA, 19 nt, Homo sapiens
gggcugcaguggcaaccuu

SEQ ID NO: 1108799 - RNA, 19 nt, Homo sapiens
gagagaaguaaggaaauau

SEQ ID NO: 1108800 - RNA, 19 nt, Homo sapiens
ugcaauauacugugucaaa

SEQ ID NO: 1108801 - RNA, 19 nt, Homo sapiens
uaugaacacacacagauga

SEQ ID NO: 1108802 - RNA, 19 nt, Homo sapiens
guucauaccauugagaaga

SEQ ID NO: 1108803 - RNA, 19 nt, Homo sapiens
gcaaaagaacguucaaaca

SEQ ID NO: 1108804 - RNA, 19 nt, Homo sapiens
cgucugguuacgcuuauua

SEQ ID NO: 1108805 - RNA, 19 nt, Homo sapiens
agacgucugguuacgcuua

SEQ ID NO: 1108806 - RNA, 19 nt, Homo sapiens
gaccugaugccuaugaaca

SEQ ID NO: 1108807 - RNA, 19 nt, Homo sapiens
uagaaagaggcaacaagaa

SEQ ID NO: 1108808 - RNA, 19 nt, Homo sapiens
gaugugauggaaaugaaga

SEQ ID NO: 1108809 - RNA, 19 nt, Homo sapiens
ugauggaaaugaagaugca

SEQ ID NO: 1108810 - RNA, 19 nt, Homo sapiens
aggcuuuccuuaccauuau

SEQ ID NO: 1108811 - RNA, 19 nt, Homo sapiens
uuacucaacuggcaaaaga

SEQ ID NO: 1108812 - RNA, 19 nt, Homo sapiens
guuagccucuagaaaauuu

SEQ ID NO: 1108813 - RNA, 19 nt, Homo sapiens
ggaaaugaagaugcaguca

SEQ ID NO: 1108814 - RNA, 19 nt, Homo sapiens
aggagaaacugaaaacuga

SEQ ID NO: 1108815 - RNA, 19 nt, Homo sapiens
uagaagaccaggagaaacu

SEQ ID NO: 1108816 - RNA, 19 nt, Homo sapiens
cagagauggcagaagauuu

SEQ ID NO: 1108817 - RNA, 19 nt, Homo sapiens
caguggcaaccuuucuuua

SEQ ID NO: 1108818 - RNA, 19 nt, Homo sapiens
gacuucagaugcccuuucu

SEQ ID NO: 1108819 - RNA, 19 nt, Homo sapiens
ugugagagaaguaaggaaa

SEQ ID NO: 1108820 - RNA, 19 nt, Homo sapiens
ucuagaugcugugagagaa

SEQ ID NO: 1108821 - RNA, 19 nt, Homo sapiens
uauguuagccucuagaaaa

SEQ ID NO: 1108822 - RNA, 19 nt, Homo sapiens
uucaauacuuucuggauuc

SEQ ID NO: 1108823 - RNA, 19 nt, Homo sapiens
cgaaagaauaugaucaacu

SEQ ID NO: 1108824 - RNA, 19 nt, Homo sapiens
ucagagauggcagaagauu

SEQ ID NO: 1108825 - RNA, 19 nt, Homo sapiens
ccucaguucauaccauuga

SEQ ID NO: 1108826 - RNA, 19 nt, Homo sapiens
guauuccagcucuuaagaa

SEQ ID NO: 1108827 - RNA, 19 nt, Homo sapiens
gauauauugcaaagucugu

SEQ ID NO: 1108828 - RNA, 19 nt, Homo sapiens
cacuaugaccgguucguaa

SEQ ID NO: 1108829 - RNA, 19 nt, Homo sapiens
ccugaaagaacacucugaa

SEQ ID NO: 1108830 - RNA, 19 nt, Homo sapiens
gacgucugguuacgcuuau

SEQ ID NO: 1108831 - RNA, 19 nt, Homo sapiens
caggaucguuuagaaagag

SEQ ID NO: 1108832 - RNA, 19 nt, Homo sapiens
uuucuggauucucguuauu

SEQ ID NO: 1108833 - RNA, 19 nt, Homo sapiens
accauuaucauccuauuga

SEQ ID NO: 1108834 - RNA, 19 nt, Homo sapiens
ccuaugaacacacacagau

SEQ ID NO: 1108835 - RNA, 19 nt, Homo sapiens
agagauggcagaagauuuu

SEQ ID NO: 1108836 - RNA, 19 nt, Homo sapiens
uggcaaccuuucuuuaugc

SEQ ID NO: 1108837 - RNA, 19 nt, Homo sapiens
cagaccugaugccuaugaa

SEQ ID NO: 1108838 - RNA, 19 nt, Homo sapiens
cagauauauugcaaagucu

SEQ ID NO: 1108839 - RNA, 19 nt, Homo sapiens
ggacucauuuuaaucuucu

SEQ ID NO: 1108840 - RNA, 19 nt, Homo sapiens
ucaauacuuucuggauucu

SEQ ID NO: 1108841 - RNA, 19 nt, Homo sapiens
aguagaagaccaggagaaa

SEQ ID NO: 1108842 - RNA, 19 nt, Homo sapiens
ugaacacacacagaugaaa

SEQ ID NO: 1108843 - RNA, 19 nt, Homo sapiens
cuucaggaucguuuagaaa

SEQ ID NO: 1108844 - RNA, 19 nt, Homo sapiens
augaugugauggaaaugaa

SEQ ID NO: 1108845 - RNA, 19 nt, Homo sapiens
aaacugaauuaaggaagac

SEQ ID NO: 1108846 - RNA, 19 nt, Homo sapiens
aaagccaugguaaagauga

SEQ ID NO: 1108847 - RNA, 19 nt, Homo sapiens
gagaugacuuugaggauaa

SEQ ID NO: 1108848 - RNA, 19 nt, Homo sapiens
gagcugagaucgugccauu

SEQ ID NO: 1108849 - RNA, 19 nt, Homo sapiens
ggugcaaucuuuagaauau

SEQ ID NO: 1108850 - RNA, 19 nt, Homo sapiens
gaacaagagaugacuuuga

SEQ ID NO: 1108851 - RNA, 19 nt, Homo sapiens
caaagagaccuccuuguuu

SEQ ID NO: 1108852 - RNA, 19 nt, Homo sapiens
aaagagaccuccuuguuuc

SEQ ID NO: 1108853 - RNA, 19 nt, Homo sapiens
cuaaggugauucaaacuaa

SEQ ID NO: 1108854 - RNA, 19 nt, Homo sapiens
ccaaagagaccuccuuguu

SEQ ID NO: 1108855 - RNA, 19 nt, Homo sapiens
caaacuaaaucaacccaau

SEQ ID NO: 1108856 - RNA, 19 nt, Homo sapiens
ggaaucgucaccagcuuua

SEQ ID NO: 1108857 - RNA, 19 nt, Homo sapiens
agagaugacuuugaggaua

SEQ ID NO: 1108858 - RNA, 19 nt, Homo sapiens
uggcauaucugcauuacug

SEQ ID NO: 1108859 - RNA, 19 nt, Homo sapiens
ugacuuggcuaaggugauu

SEQ ID NO: 1108860 - RNA, 19 nt, Homo sapiens
gggaacaagagaugacuuu

SEQ ID NO: 1108861 - RNA, 19 nt, Homo sapiens
gcuaaggugauucaaacua

SEQ ID NO: 1108862 - RNA, 19 nt, Homo sapiens
uuucuggacucgcucauuu

SEQ ID NO: 1108863 - RNA, 19 nt, Homo sapiens
acucagagaucccuauauc

SEQ ID NO: 1108864 - RNA, 19 nt, Homo sapiens
gcaggagaauugcuugaac

SEQ ID NO: 1108865 - RNA, 19 nt, Homo sapiens
gaaaccccaucucuacuaa

SEQ ID NO: 1108866 - RNA, 19 nt, Homo sapiens
agaccaaccugacuaacau

SEQ ID NO: 1108867 - RNA, 19 nt, Homo sapiens
gauaaaaggaccaaagaaa

SEQ ID NO: 1108868 - RNA, 19 nt, Homo sapiens
gaaccaaagagaccuccuu

SEQ ID NO: 1108869 - RNA, 19 nt, Homo sapiens
gaacuacuggcuccugcaa

SEQ ID NO: 1108870 - RNA, 19 nt, Homo sapiens
ccuaggagaugaaaucacu

SEQ ID NO: 1108871 - RNA, 19 nt, Homo sapiens
gcugagaucgugccauugu

SEQ ID NO: 1108872 - RNA, 19 nt, Homo sapiens
gugccaaccugaaccaaag

SEQ ID NO: 1108873 - RNA, 19 nt, Homo sapiens
uuuauccgcuucuggcuuu

SEQ ID NO: 1108874 - RNA, 19 nt, Homo sapiens
aacaagagaugacuuugag

SEQ ID NO: 1108875 - RNA, 19 nt, Homo sapiens
uaucaugguguccaacuuu

SEQ ID NO: 1108876 - RNA, 19 nt, Homo sapiens
ucagagaucccuauaucau

SEQ ID NO: 1108877 - RNA, 19 nt, Homo sapiens
ucaagaccaaccugacuaa

SEQ ID NO: 1108878 - RNA, 19 nt, Homo sapiens
cgacucagagaucccuaua

SEQ ID NO: 1108879 - RNA, 19 nt, Homo sapiens
aaccugggcuggcugaguu

SEQ ID NO: 1108880 - RNA, 19 nt, Homo sapiens
ccacggaagucaacaaccu

SEQ ID NO: 1108881 - RNA, 19 nt, Homo sapiens
gaucgugccauugugauau

SEQ ID NO: 1108882 - RNA, 19 nt, Homo sapiens
ugacuaacauggugaaacc

SEQ ID NO: 1108883 - RNA, 19 nt, Homo sapiens
gucaggaguucaagaccaa

SEQ ID NO: 1108884 - RNA, 19 nt, Homo sapiens
uggcuaaggugauucaaac

SEQ ID NO: 1108885 - RNA, 19 nt, Homo sapiens
gaagcguguugugcuccua

SEQ ID NO: 1108886 - RNA, 19 nt, Homo sapiens
ucagauuccugcccuuucu

SEQ ID NO: 1108887 - RNA, 19 nt, Homo sapiens
gcaguggguugugggaaca

SEQ ID NO: 1108888 - RNA, 19 nt, Homo sapiens
cccuguauaucuuggcaua

SEQ ID NO: 1108889 - RNA, 19 nt, Homo sapiens
cuucagacccuguauaucu

SEQ ID NO: 1108890 - RNA, 19 nt, Homo sapiens
uaggagaugaaaucacuuu

SEQ ID NO: 1108891 - RNA, 19 nt, Homo sapiens
gagcaugcguggucuucac

SEQ ID NO: 1108892 - RNA, 19 nt, Homo sapiens
ggaacaagagaugacuuug

SEQ ID NO: 1108893 - RNA, 19 nt, Homo sapiens
aaacuaaaucaacccaaug

SEQ ID NO: 1108894 - RNA, 19 nt, Homo sapiens
gcgcuucagacccuguaua

SEQ ID NO: 1108895 - RNA, 19 nt, Homo sapiens
ccuguaaucccagcacuuu

SEQ ID NO: 1108896 - RNA, 19 nt, Homo sapiens
ugcagugucuucaccauca

SEQ ID NO: 1108897 - RNA, 19 nt, Homo sapiens
ccuggguuauggcuacuuu

SEQ ID NO: 1108898 - RNA, 19 nt, Homo sapiens
ugagaucgugccauuguga

SEQ ID NO: 1108899 - RNA, 19 nt, Homo sapiens
gggugcaaucuuuagaaua

SEQ ID NO: 1108900 - RNA, 19 nt, Homo sapiens
gggccuaggagaugaaauc

SEQ ID NO: 1108901 - RNA, 19 nt, Homo sapiens
ucucaccacuggcugacuu

SEQ ID NO: 1108902 - RNA, 19 nt, Homo sapiens
gagacgggauccucaucgu

SEQ ID NO: 1108903 - RNA, 19 nt, Homo sapiens
cagagaucccuauaucaug

SEQ ID NO: 1108904 - RNA, 19 nt, Homo sapiens
cuaaaucaacccaaugucu

SEQ ID NO: 1108905 - RNA, 19 nt, Homo sapiens
gagcaagacaggaacuacu

SEQ ID NO: 1108906 - RNA, 19 nt, Homo sapiens
ggguccuucuccuggguua

SEQ ID NO: 1108907 - RNA, 19 nt, Homo sapiens
ggcugaggcaggagaauug

SEQ ID NO: 1108908 - RNA, 19 nt, Homo sapiens
caggaaucgucaccagcuu

SEQ ID NO: 1108909 - RNA, 19 nt, Homo sapiens
gugcaaucuuuagaauaug

SEQ ID NO: 1108910 - RNA, 19 nt, Homo sapiens
ccuauaucaugguguccaa

SEQ ID NO: 1108911 - RNA, 19 nt, Homo sapiens
gugccauugugauaugaau

SEQ ID NO: 1108912 - RNA, 19 nt, Homo sapiens
caacccaaugucucuccua

SEQ ID NO: 1108913 - RNA, 19 nt, Homo sapiens
gaguguggacaacgucaga

SEQ ID NO: 1108914 - RNA, 19 nt, Homo sapiens
ggcaggagaauugcuugaa

SEQ ID NO: 1108915 - RNA, 19 nt, Homo sapiens
ccuguaaucccagauacuu

SEQ ID NO: 1108916 - RNA, 19 nt, Homo sapiens
uaucuuggcauaucugcau

SEQ ID NO: 1108917 - RNA, 19 nt, Homo sapiens
gaacauaucuagcaagaaa

SEQ ID NO: 1108918 - RNA, 19 nt, Homo sapiens
gaaaugagguuccuauaaa

SEQ ID NO: 1108919 - RNA, 19 nt, Homo sapiens
ggaagaagcuaaauuguug

SEQ ID NO: 1108920 - RNA, 19 nt, Homo sapiens
gcaguuggcucuauaguuu

SEQ ID NO: 1108921 - RNA, 19 nt, Homo sapiens
aaacucagcucuguauuua

SEQ ID NO: 1108922 - RNA, 19 nt, Homo sapiens
gaaauacgaugaaccuaau

SEQ ID NO: 1108923 - RNA, 19 nt, Homo sapiens
aaagucagguuuccucuua

SEQ ID NO: 1108924 - RNA, 19 nt, Homo sapiens
gagcagaggaucagguuua

SEQ ID NO: 1108925 - RNA, 19 nt, Homo sapiens
caauaucaguguugacuuu

SEQ ID NO: 1108926 - RNA, 19 nt, Homo sapiens
cgaauggacugcuauaaug

SEQ ID NO: 1108927 - RNA, 19 nt, Homo sapiens
gauuauagcuggacagaca

SEQ ID NO: 1108928 - RNA, 19 nt, Homo sapiens
gaaacucagcucuguauuu

SEQ ID NO: 1108929 - RNA, 19 nt, Homo sapiens
cagaagugcuauacgguua

SEQ ID NO: 1108930 - RNA, 19 nt, Homo sapiens
gaagaaagaaacaugacua

SEQ ID NO: 1108931 - RNA, 19 nt, Homo sapiens
caacuaacaugcuugaauc

SEQ ID NO: 1108932 - RNA, 19 nt, Homo sapiens
gcucagggauuuauacuca

SEQ ID NO: 1108933 - RNA, 19 nt, Homo sapiens
gagaagagcagcaagaaga

SEQ ID NO: 1108934 - RNA, 19 nt, Homo sapiens
acaguuugcuugucuauuu

SEQ ID NO: 1108935 - RNA, 19 nt, Homo sapiens
uggacaauguggaauauua

SEQ ID NO: 1108936 - RNA, 19 nt, Homo sapiens
ggaaugagguaccaucuac

SEQ ID NO: 1108937 - RNA, 19 nt, Homo sapiens
gcagucaggugguugaaau

SEQ ID NO: 1108938 - RNA, 19 nt, Homo sapiens
gcacaagaccuagaagaaa

SEQ ID NO: 1108939 - RNA, 19 nt, Homo sapiens
uaacacaucuucucaacca

SEQ ID NO: 1108940 - RNA, 19 nt, Homo sapiens
gaagaagaccgagaagaaa

SEQ ID NO: 1108941 - RNA, 19 nt, Homo sapiens
uaaccuaguugucucuaaa

SEQ ID NO: 1108942 - RNA, 19 nt, Homo sapiens
gguacaagcugaaccacuu

SEQ ID NO: 1108943 - RNA, 19 nt, Homo sapiens
gaaagcaacugcagaugac

SEQ ID NO: 1108944 - RNA, 19 nt, Homo sapiens
uagcacccaucauuaauuu

SEQ ID NO: 1108945 - RNA, 19 nt, Homo sapiens
caaggcauauacacacuuu

SEQ ID NO: 1108946 - RNA, 19 nt, Homo sapiens
aagauuggcucaucaguga

SEQ ID NO: 1108947 - RNA, 19 nt, Homo sapiens
gaagaaucaugggcuggua

SEQ ID NO: 1108948 - RNA, 19 nt, Homo sapiens
ggacugcuauaauguagug

SEQ ID NO: 1108949 - RNA, 19 nt, Homo sapiens
ccaauggccuaaucuaugu

SEQ ID NO: 1108950 - RNA, 19 nt, Homo sapiens
gcaagaagaagaccgagaa

SEQ ID NO: 1108951 - RNA, 19 nt, Homo sapiens
gauugaaccugugaagaaa

SEQ ID NO: 1108952 - RNA, 19 nt, Homo sapiens
gcuagaauuuccgugaaua

SEQ ID NO: 1108953 - RNA, 19 nt, Homo sapiens
ccacccagcuguaguugaa

SEQ ID NO: 1108954 - RNA, 19 nt, Homo sapiens
uuaacgagaucaugaauuc

SEQ ID NO: 1108955 - RNA, 19 nt, Homo sapiens
caacuccucaugaaauaua

SEQ ID NO: 1108956 - RNA, 19 nt, Homo sapiens
ggaccgagaagaacuugua

SEQ ID NO: 1108957 - RNA, 19 nt, Homo sapiens
gaaaagcacugguaguugu

SEQ ID NO: 1108958 - RNA, 19 nt, Homo sapiens
gaaacaugacuaccgcaua

SEQ ID NO: 1108959 - RNA, 19 nt, Homo sapiens
gaauuuccgugaauagcaa

SEQ ID NO: 1108960 - RNA, 19 nt, Homo sapiens
ggacgcagcccaguuggua

SEQ ID NO: 1108961 - RNA, 19 nt, Homo sapiens
gcuauaauguagugaagga

SEQ ID NO: 1108962 - RNA, 19 nt, Homo sapiens
aaacaugacuaccgcauag

SEQ ID NO: 1108963 - RNA, 19 nt, Homo sapiens
ccuaaucgccagccauuua

SEQ ID NO: 1108964 - RNA, 19 nt, Homo sapiens
gaacuucuuuaacgagauc

SEQ ID NO: 1108965 - RNA, 19 nt, Homo sapiens
ugaaaugagguuccuauaa

SEQ ID NO: 1108966 - RNA, 19 nt, Homo sapiens
gaagagacccuugaaacau

SEQ ID NO: 1108967 - RNA, 19 nt, Homo sapiens
caaauugucuugguauaag

SEQ ID NO: 1108968 - RNA, 19 nt, Homo sapiens
acucagcucuguauuuauu

SEQ ID NO: 1108969 - RNA, 19 nt, Homo sapiens
caaagaugcugaaccugau

SEQ ID NO: 1108970 - RNA, 19 nt, Homo sapiens
gaaguagaacucaaagaug

SEQ ID NO: 1108971 - RNA, 19 nt, Homo sapiens
cagagugagucaaggcaua

SEQ ID NO: 1108972 - RNA, 19 nt, Homo sapiens
gggaagaagcuaaauuguu

SEQ ID NO: 1108973 - RNA, 19 nt, Homo sapiens
cggaaacagugauuuaaau

SEQ ID NO: 1108974 - RNA, 19 nt, Homo sapiens
ccaagaacauaucuagcaa

SEQ ID NO: 1108975 - RNA, 19 nt, Homo sapiens
guaggaaacucagcucugu

SEQ ID NO: 1108976 - RNA, 19 nt, Homo sapiens
guagauggcacaagaccua

SEQ ID NO: 1108977 - RNA, 19 nt, Homo sapiens
ugaaauacgaugaaccuaa

SEQ ID NO: 1108978 - RNA, 19 nt, Homo sapiens
cagaggaucagguuuauga

SEQ ID NO: 1108979 - RNA, 19 nt, Homo sapiens
aguccucacuguuaaauaa

SEQ ID NO: 1108980 - RNA, 19 nt, Homo sapiens
gcacccaucauuaauuuau

SEQ ID NO: 1108981 - RNA, 19 nt, Homo sapiens
ucacaaaacuuccuaaaca

SEQ ID NO: 1108982 - RNA, 19 nt, Homo sapiens
ggaaggguguaacagugaa

SEQ ID NO: 1108983 - RNA, 19 nt, Homo sapiens
gaauuugcuuauacugcua

SEQ ID NO: 1108984 - RNA, 19 nt, Homo sapiens
gaacaacugguggaauuug

SEQ ID NO: 1108985 - RNA, 19 nt, Homo sapiens
uaaagcgaauggacugcua

SEQ ID NO: 1108986 - RNA, 19 nt, Homo sapiens
ccacagucuuguagauauu

SEQ ID NO: 1108987 - RNA, 19 nt, Homo sapiens
cagcuuagucucacaguuu

SEQ ID NO: 1108988 - RNA, 19 nt, Homo sapiens
ucaggguguuggucgauua

SEQ ID NO: 1108989 - RNA, 19 nt, Homo sapiens
aaggauagcugguauucga

SEQ ID NO: 1108990 - RNA, 19 nt, Homo sapiens
caaccacagucuuguagau

SEQ ID NO: 1108991 - RNA, 19 nt, Homo sapiens
agaagaagaccgagaagaa

SEQ ID NO: 1108992 - RNA, 19 nt, Homo sapiens
gguuuccucuuauaucaaa

SEQ ID NO: 1108993 - RNA, 19 nt, Homo sapiens
gcuuagcacccaucauuaa

SEQ ID NO: 1108994 - RNA, 19 nt, Homo sapiens
cuaaauuguuggcggguuu

SEQ ID NO: 1108995 - RNA, 19 nt, Homo sapiens
caguuugcuugucuauuua

SEQ ID NO: 1108996 - RNA, 19 nt, Homo sapiens
aagaacauaucuagcaaga

SEQ ID NO: 1108997 - RNA, 19 nt, Homo sapiens
uugaacaacugguggaauu

SEQ ID NO: 1108998 - RNA, 19 nt, Homo sapiens
aaagauaccugcucaucgu

SEQ ID NO: 1108999 - RNA, 19 nt, Homo sapiens
caaaugaagagacccuuga

SEQ ID NO: 1109000 - RNA, 19 nt, Homo sapiens
guucacaacuaacaugcuu

SEQ ID NO: 1109001 - RNA, 19 nt, Homo sapiens
ugaauaacaugcggaaaca

SEQ ID NO: 1109002 - RNA, 19 nt, Homo sapiens
gucaagaacuaagaaauag

SEQ ID NO: 1109003 - RNA, 19 nt, Homo sapiens
acugaaagcuggcacacaa

SEQ ID NO: 1109004 - RNA, 19 nt, Homo sapiens
gcgaauggacugcuauaau

SEQ ID NO: 1109005 - RNA, 19 nt, Homo sapiens
guacaagcugaaccacuua

SEQ ID NO: 1109006 - RNA, 19 nt, Homo sapiens
ugaaagcaacugcagauga

SEQ ID NO: 1109007 - RNA, 19 nt, Homo sapiens
gcagaaggcaaaauuuaua

SEQ ID NO: 1109008 - RNA, 19 nt, Homo sapiens
gcggaaacagugauuuaaa

SEQ ID NO: 1109009 - RNA, 19 nt, Homo sapiens
cacaagaccuagaagaaag

SEQ ID NO: 1109010 - RNA, 19 nt, Homo sapiens
cagguuuccucuuauauca

SEQ ID NO: 1109011 - RNA, 19 nt, Homo sapiens
uccaacuccucaugaaaua

SEQ ID NO: 1109012 - RNA, 19 nt, Homo sapiens
auacacacuuucucacaaa

SEQ ID NO: 1109013 - RNA, 19 nt, Homo sapiens
gcauauacacacuuucuca

SEQ ID NO: 1109014 - RNA, 19 nt, Homo sapiens
aagagacccuugaaacaug

SEQ ID NO: 1109015 - RNA, 19 nt, Homo sapiens
agucagguuuccucuuaua

SEQ ID NO: 1109016 - RNA, 19 nt, Homo sapiens
gcagcgaaccaauaucaga

SEQ ID NO: 1109017 - RNA, 19 nt, Homo sapiens
ggaaacagcuaucaaagag

SEQ ID NO: 1109018 - RNA, 19 nt, Homo sapiens
guaaagacaccuucaaaug

SEQ ID NO: 1109019 - RNA, 19 nt, Homo sapiens
ggaaacugaucuucaaugc

SEQ ID NO: 1109020 - RNA, 19 nt, Homo sapiens
gagaggaagucaccaaggu

SEQ ID NO: 1109021 - RNA, 19 nt, Homo sapiens
gaacauccacaucuucugu

SEQ ID NO: 1109022 - RNA, 19 nt, Homo sapiens
ucaccaagguugccacuca

SEQ ID NO: 1109023 - RNA, 19 nt, Homo sapiens
uaacggcgguagagaggaa

SEQ ID NO: 1109024 - RNA, 19 nt, Homo sapiens
gaguaaagacaccuucaaa

SEQ ID NO: 1109025 - RNA, 19 nt, Homo sapiens
aaagacaccuucaaaugca

SEQ ID NO: 1109026 - RNA, 19 nt, Homo sapiens
ggacuugggcaucgccuuu

SEQ ID NO: 1109027 - RNA, 19 nt, Homo sapiens
gggaaacagcuaucaaaga

SEQ ID NO: 1109028 - RNA, 19 nt, Homo sapiens
gaagggaacauccacaucu

SEQ ID NO: 1109029 - RNA, 19 nt, Homo sapiens
caagauaccaucccguuuc

SEQ ID NO: 1109030 - RNA, 19 nt, Homo sapiens
cugaagcacugggugaaua

SEQ ID NO: 1109031 - RNA, 19 nt, Homo sapiens
gaccagaggcgcagugaau

SEQ ID NO: 1109032 - RNA, 19 nt, Homo sapiens
caugucaggcuucuguuua

SEQ ID NO: 1109033 - RNA, 19 nt, Homo sapiens
gggcaucgccuuuaauuuu

SEQ ID NO: 1109034 - RNA, 19 nt, Homo sapiens
ccuggaaacugaucuucaa

SEQ ID NO: 1109035 - RNA, 19 nt, Homo sapiens
uaaagacaccuucaaaugc

SEQ ID NO: 1109036 - RNA, 19 nt, Homo sapiens
gaucaucaauuugggaaac

SEQ ID NO: 1109037 - RNA, 19 nt, Homo sapiens
ggaguaaagacaccuucaa

SEQ ID NO: 1109038 - RNA, 19 nt, Homo sapiens
gcauuacagaucaucaauu

SEQ ID NO: 1109039 - RNA, 19 nt, Homo sapiens
gaaacagcuaucaaagaga

SEQ ID NO: 1109040 - RNA, 19 nt, Homo sapiens
uuacagaucaucaauuugg

SEQ ID NO: 1109041 - RNA, 19 nt, Homo sapiens
gcugugacccgaaagacuu

SEQ ID NO: 1109042 - RNA, 19 nt, Homo sapiens
guagagaggaagucaccaa

SEQ ID NO: 1109043 - RNA, 19 nt, Homo sapiens
gacugcagaacucaagaua

SEQ ID NO: 1109044 - RNA, 19 nt, Homo sapiens
ugaccgcugugacccgaaa

SEQ ID NO: 1109045 - RNA, 19 nt, Homo sapiens
uacggucaguuuggcauua

SEQ ID NO: 1109046 - RNA, 19 nt, Homo sapiens
gaaacauaacggcgguaga

SEQ ID NO: 1109047 - RNA, 19 nt, Homo sapiens
ggaagggaacauccacauc

SEQ ID NO: 1109048 - RNA, 19 nt, Homo sapiens
gaaacugaucuucaaugca

SEQ ID NO: 1109049 - RNA, 19 nt, Homo sapiens
gcagaacucaagauaccau

SEQ ID NO: 1109050 - RNA, 19 nt, Homo sapiens
aagggaacauccacaucuu

SEQ ID NO: 1109051 - RNA, 19 nt, Homo sapiens
ucaaagagagaaacauaac

SEQ ID NO: 1109052 - RNA, 19 nt, Homo sapiens
ucaagauaccaucccguuu

SEQ ID NO: 1109053 - RNA, 19 nt, Homo sapiens
aaacauaacggcgguagag

SEQ ID NO: 1109054 - RNA, 19 nt, Homo sapiens
gaagggaagggaacaucca

SEQ ID NO: 1109055 - RNA, 19 nt, Homo sapiens
ggacugcagaacucaagau

SEQ ID NO: 1109056 - RNA, 19 nt, Homo sapiens
guacucguccauucugugu

SEQ ID NO: 1109057 - RNA, 19 nt, Homo sapiens
gaagcacugggugaauauu

SEQ ID NO: 1109058 - RNA, 19 nt, Homo sapiens
aagcacugggugaauauuu

SEQ ID NO: 1109059 - RNA, 19 nt, Homo sapiens
ucagaagcaccgacaguca

SEQ ID NO: 1109060 - RNA, 19 nt, Homo sapiens
cuucuguacucguccauuc

SEQ ID NO: 1109061 - RNA, 19 nt, Homo sapiens
gcucagggacugcagaacu

SEQ ID NO: 1109062 - RNA, 19 nt, Homo sapiens
ugaagcacugggugaauau

SEQ ID NO: 1109063 - RNA, 19 nt, Homo sapiens
gacuugggcaucgccuuua

SEQ ID NO: 1109064 - RNA, 19 nt, Homo sapiens
gggaacauccacaucuucu

SEQ ID NO: 1109065 - RNA, 19 nt, Homo sapiens
ccaugucaggcuucuguuu

SEQ ID NO: 1109066 - RNA, 19 nt, Homo sapiens
aagauaccaucccguuucu

SEQ ID NO: 1109067 - RNA, 19 nt, Homo sapiens
cugcagaacucaagauacc

SEQ ID NO: 1109068 - RNA, 19 nt, Homo sapiens
ccaagguugccacucagaa

SEQ ID NO: 1109069 - RNA, 19 nt, Homo sapiens
caagguugccacucagaag

SEQ ID NO: 1109070 - RNA, 19 nt, Homo sapiens
gggaagggaacauccacau

SEQ ID NO: 1109071 - RNA, 19 nt, Homo sapiens
cuucaaugcacuaagagaa

SEQ ID NO: 1109072 - RNA, 19 nt, Homo sapiens
aguaaagacaccuucaaau

SEQ ID NO: 1109073 - RNA, 19 nt, Homo sapiens
caccaugucaggcuucugu

SEQ ID NO: 1109074 - RNA, 19 nt, Homo sapiens
acuugggcaucgccuuuaa

SEQ ID NO: 1109075 - RNA, 19 nt, Homo sapiens
gcuaucaaagagagaaaca

SEQ ID NO: 1109076 - RNA, 19 nt, Homo sapiens
caauuugggaaacagcuau

SEQ ID NO: 1109077 - RNA, 19 nt, Homo sapiens
gcacuaagagaaggagacu

SEQ ID NO: 1109078 - RNA, 19 nt, Homo sapiens
gaagaucacugaaagaaau

SEQ ID NO: 1109079 - RNA, 19 nt, Homo sapiens
gaaaugacauagugaagau

SEQ ID NO: 1109080 - RNA, 19 nt, Homo sapiens
gaaauaaugccguauaugu

SEQ ID NO: 1109081 - RNA, 19 nt, Homo sapiens
ggaccagucugccuaugua

SEQ ID NO: 1109082 - RNA, 19 nt, Homo sapiens
ggacauagccaccugaaga

SEQ ID NO: 1109083 - RNA, 19 nt, Homo sapiens
ugaaggaugucaguuauaa

SEQ ID NO: 1109084 - RNA, 19 nt, Homo sapiens
gauauaauccugaaucgaa

SEQ ID NO: 1109085 - RNA, 19 nt, Homo sapiens
gacaaggcauggcuaauga

SEQ ID NO: 1109086 - RNA, 19 nt, Homo sapiens
gcaaguacuucaaggauag

SEQ ID NO: 1109087 - RNA, 19 nt, Homo sapiens
gaagagcuauggcuagaag

SEQ ID NO: 1109088 - RNA, 19 nt, Homo sapiens
ggaugucaguuauaagauu

SEQ ID NO: 1109089 - RNA, 19 nt, Homo sapiens
ucacuaugcuccagacuga

SEQ ID NO: 1109090 - RNA, 19 nt, Homo sapiens
aaggauagcaggaauauaa

SEQ ID NO: 1109091 - RNA, 19 nt, Homo sapiens
ucccugagcuguugucuuu

SEQ ID NO: 1109092 - RNA, 19 nt, Homo sapiens
acaggaagcuagugaaaug

SEQ ID NO: 1109093 - RNA, 19 nt, Homo sapiens
ggagucauuuccaggguaa

SEQ ID NO: 1109094 - RNA, 19 nt, Homo sapiens
gacaauaaguggaacuaca

SEQ ID NO: 1109095 - RNA, 19 nt, Homo sapiens
cacaauuccuuaugggaua

SEQ ID NO: 1109096 - RNA, 19 nt, Homo sapiens
gaagaaaggugggagucau

SEQ ID NO: 1109097 - RNA, 19 nt, Homo sapiens
gaccaagaagccaaaguua

SEQ ID NO: 1109098 - RNA, 19 nt, Homo sapiens
ggucaggucuucacuaugc

SEQ ID NO: 1109099 - RNA, 19 nt, Homo sapiens
gaacaaacgguacaauguc

SEQ ID NO: 1109100 - RNA, 19 nt, Homo sapiens
aagaggaacugucauuaug

SEQ ID NO: 1109101 - RNA, 19 nt, Homo sapiens
ccacaaggaccgccaacua

SEQ ID NO: 1109102 - RNA, 19 nt, Homo sapiens
gaugagggauguccacaag

SEQ ID NO: 1109103 - RNA, 19 nt, Homo sapiens
acagugacguuacauguug

SEQ ID NO: 1109104 - RNA, 19 nt, Homo sapiens
aaacuagaguggucucaga

SEQ ID NO: 1109105 - RNA, 19 nt, Homo sapiens
gaaauuucccugagcuguu

SEQ ID NO: 1109106 - RNA, 19 nt, Homo sapiens
gaucaaauccauauuacca

SEQ ID NO: 1109107 - RNA, 19 nt, Homo sapiens
caacaggaagcuagugaaa

SEQ ID NO: 1109108 - RNA, 19 nt, Homo sapiens
ugacagcucugagacaaug

SEQ ID NO: 1109109 - RNA, 19 nt, Homo sapiens
ccuacucugugaagaauaa

SEQ ID NO: 1109110 - RNA, 19 nt, Homo sapiens
gaucugagacccuaaagca

SEQ ID NO: 1109111 - RNA, 19 nt, Homo sapiens
agagaaggcucccaaaguc

SEQ ID NO: 1109112 - RNA, 19 nt, Homo sapiens
cuagugaaaugacauagug

SEQ ID NO: 1109113 - RNA, 19 nt, Homo sapiens
caagaggaacugucauuau

SEQ ID NO: 1109114 - RNA, 19 nt, Homo sapiens
gcuguugucuuugaacuug

SEQ ID NO: 1109115 - RNA, 19 nt, Homo sapiens
aggcauggcuaaugaauuc

SEQ ID NO: 1109116 - RNA, 19 nt, Homo sapiens
gcauggagaugagggaugu

SEQ ID NO: 1109117 - RNA, 19 nt, Homo sapiens
guggaggccuucaagcaaa

SEQ ID NO: 1109118 - RNA, 19 nt, Homo sapiens
ggauggccuuucugacauu

SEQ ID NO: 1109119 - RNA, 19 nt, Homo sapiens
caacuaagacacacuccuu

SEQ ID NO: 1109120 - RNA, 19 nt, Homo sapiens
cauugaaggaugucaguua

SEQ ID NO: 1109121 - RNA, 19 nt, Homo sapiens
ugaauucaauccagagcaa

SEQ ID NO: 1109122 - RNA, 19 nt, Homo sapiens
cauauuaccauuuggagaa

SEQ ID NO: 1109123 - RNA, 19 nt, Homo sapiens
ugagggauguccacaagga

SEQ ID NO: 1109124 - RNA, 19 nt, Homo sapiens
gauggaagcauggagauga

SEQ ID NO: 1109125 - RNA, 19 nt, Homo sapiens
guucugaucuugccuucau

SEQ ID NO: 1109126 - RNA, 19 nt, Homo sapiens
gauggccuuucugacauua

SEQ ID NO: 1109127 - RNA, 19 nt, Homo sapiens
cacaaggaccgccaacuaa

SEQ ID NO: 1109128 - RNA, 19 nt, Homo sapiens
gccgugacauugauauaau

SEQ ID NO: 1109129 - RNA, 19 nt, Homo sapiens
ccaguuguucuguguauuu

SEQ ID NO: 1109130 - RNA, 19 nt, Homo sapiens
ugcaaguacuucaaggaua

SEQ ID NO: 1109131 - RNA, 19 nt, Homo sapiens
ccugagcuguugucuuuga

SEQ ID NO: 1109132 - RNA, 19 nt, Homo sapiens
gugaagaucaaauccauau

SEQ ID NO: 1109133 - RNA, 19 nt, Homo sapiens
cauaauaaacagugacguu

SEQ ID NO: 1109134 - RNA, 19 nt, Homo sapiens
cugagacccuaaagcauuu

SEQ ID NO: 1109135 - RNA, 19 nt, Homo sapiens
ugcuaaagcugaccaugaa

SEQ ID NO: 1109136 - RNA, 19 nt, Homo sapiens
ggaagcuagugaaaugaca

SEQ ID NO: 1109137 - RNA, 19 nt, Homo sapiens
gaacaugguggguaugaac

SEQ ID NO: 1109138 - RNA, 19 nt, Homo sapiens
ccaagaagccaaaguuaac

SEQ ID NO: 1109139 - RNA, 19 nt, Homo sapiens
gacccugaaucucuccaaa

SEQ ID NO: 1109140 - RNA, 19 nt, Homo sapiens
ugaacaaacgguacaaugu

SEQ ID NO: 1109141 - RNA, 19 nt, Homo sapiens
gagagacagcaacaacaaa

SEQ ID NO: 1109142 - RNA, 19 nt, Homo sapiens
uagaaaaccuccagagaga

SEQ ID NO: 1109143 - RNA, 19 nt, Homo sapiens
aauaaacagugacguuaca

SEQ ID NO: 1109144 - RNA, 19 nt, Homo sapiens
aaugauaagcuguuucuga

SEQ ID NO: 1109145 - RNA, 19 nt, Homo sapiens
caugaaugauaagcuguuu

SEQ ID NO: 1109146 - RNA, 19 nt, Homo sapiens
ugacaaggcauggcuaaug

SEQ ID NO: 1109147 - RNA, 19 nt, Homo sapiens
caacaaaaguauacucuac

SEQ ID NO: 1109148 - RNA, 19 nt, Homo sapiens
caaggaccgccaacuaaga

SEQ ID NO: 1109149 - RNA, 19 nt, Homo sapiens
aaacagugacguuacaugu

SEQ ID NO: 1109150 - RNA, 19 nt, Homo sapiens
ccuaagaccacucuaagga

SEQ ID NO: 1109151 - RNA, 19 nt, Homo sapiens
acaagaggaacugucauua

SEQ ID NO: 1109152 - RNA, 19 nt, Homo sapiens
aaauuucccugagcuguug

SEQ ID NO: 1109153 - RNA, 19 nt, Homo sapiens
aagacacacuccuuauaga

SEQ ID NO: 1109154 - RNA, 19 nt, Homo sapiens
ugaccaagaagccaaaguu

SEQ ID NO: 1109155 - RNA, 19 nt, Homo sapiens
uaaguggaacuacauuaga

SEQ ID NO: 1109156 - RNA, 19 nt, Homo sapiens
gcauuuaguccugcaauuc

SEQ ID NO: 1109157 - RNA, 19 nt, Homo sapiens
aaugaaacccugcaaggaa

SEQ ID NO: 1109158 - RNA, 19 nt, Homo sapiens
ucgaagagcuauggcuaga

SEQ ID NO: 1109159 - RNA, 19 nt, Homo sapiens
cagagaaggcucccaaagu

SEQ ID NO: 1109160 - RNA, 19 nt, Homo sapiens
gaugggccgugacauugau

SEQ ID NO: 1109161 - RNA, 19 nt, Homo sapiens
aaauggagaugcuaaagcu

SEQ ID NO: 1109162 - RNA, 19 nt, Homo sapiens
gaaaaccuccagagagaaa

SEQ ID NO: 1109163 - RNA, 19 nt, Homo sapiens
acacacuccuuauagaauc

SEQ ID NO: 1109164 - RNA, 19 nt, Homo sapiens
cuucucauccucuuuguuu

SEQ ID NO: 1109165 - RNA, 19 nt, Homo sapiens
ucaagcaaauccccuaaaa

SEQ ID NO: 1109166 - RNA, 19 nt, Homo sapiens
gugcauugccugaaacuca

SEQ ID NO: 1109167 - RNA, 19 nt, Homo sapiens
aggaaauggugcaggcuuu

SEQ ID NO: 1109168 - RNA, 19 nt, Homo sapiens
augaaacccugcaaggaaa

SEQ ID NO: 1109169 - RNA, 19 nt, Homo sapiens
gagaaggcucccaaaguca

SEQ ID NO: 1109170 - RNA, 19 nt, Homo sapiens
aggccuggcugaccaagaa

SEQ ID NO: 1109171 - RNA, 19 nt, Homo sapiens
cagagguggugguguuugu

SEQ ID NO: 1109172 - RNA, 19 nt, Homo sapiens
ucugagacccuaaagcauu

SEQ ID NO: 1109173 - RNA, 19 nt, Homo sapiens
ggaagaaaggugggaguca

SEQ ID NO: 1109174 - RNA, 19 nt, Homo sapiens
gcccuacucugugaagaau

SEQ ID NO: 1109175 - RNA, 19 nt, Homo sapiens
gcggaacacacaagaugaa

SEQ ID NO: 1109176 - RNA, 19 nt, Homo sapiens
ugaaaugacauagugaaga

SEQ ID NO: 1109177 - RNA, 19 nt, Homo sapiens
gcaacaggaagcuagugaa

SEQ ID NO: 1109178 - RNA, 19 nt, Homo sapiens
gaagaucacugaaagaaau

SEQ ID NO: 1109179 - RNA, 19 nt, Homo sapiens
gaaaugacauagugaagau

SEQ ID NO: 1109180 - RNA, 19 nt, Homo sapiens
gaaauaaugccguauaugu

SEQ ID NO: 1109181 - RNA, 19 nt, Homo sapiens
ggaccagucugccuaugua

SEQ ID NO: 1109182 - RNA, 19 nt, Homo sapiens
ggacauagccaccugaaga

SEQ ID NO: 1109183 - RNA, 19 nt, Homo sapiens
ugaaggaugucaguuauaa

SEQ ID NO: 1109184 - RNA, 19 nt, Homo sapiens
gauauaauccugaaucgaa

SEQ ID NO: 1109185 - RNA, 19 nt, Homo sapiens
gacaaggcauggcuaauga

SEQ ID NO: 1109186 - RNA, 19 nt, Homo sapiens
gcaaguacuucaaggauag

SEQ ID NO: 1109187 - RNA, 19 nt, Homo sapiens
gaagagcuauggcuagaag

SEQ ID NO: 1109188 - RNA, 19 nt, Homo sapiens
ggaugucaguuauaagauu

SEQ ID NO: 1109189 - RNA, 19 nt, Homo sapiens
ucacuaugcuccagacuga

SEQ ID NO: 1109190 - RNA, 19 nt, Homo sapiens
aaggauagcaggaauauaa

SEQ ID NO: 1109191 - RNA, 19 nt, Homo sapiens
ucccugagcuguugucuuu

SEQ ID NO: 1109192 - RNA, 19 nt, Homo sapiens
acaggaagcuagugaaaug

SEQ ID NO: 1109193 - RNA, 19 nt, Homo sapiens
ggagucauuuccaggguaa

SEQ ID NO: 1109194 - RNA, 19 nt, Homo sapiens
gacaauaaguggaacuaca

SEQ ID NO: 1109195 - RNA, 19 nt, Homo sapiens
cacaauuccuuaugggaua

SEQ ID NO: 1109196 - RNA, 19 nt, Homo sapiens
gaagaaaggugggagucau

SEQ ID NO: 1109197 - RNA, 19 nt, Homo sapiens
gaccaagaagccaaaguua

SEQ ID NO: 1109198 - RNA, 19 nt, Homo sapiens
ggucaggucuucacuaugc

SEQ ID NO: 1109199 - RNA, 19 nt, Homo sapiens
gaacaaacgguacaauguc

SEQ ID NO: 1109200 - RNA, 19 nt, Homo sapiens
aagaggaacugucauuaug

SEQ ID NO: 1109201 - RNA, 19 nt, Homo sapiens
ccacaaggaccgccaacua

SEQ ID NO: 1109202 - RNA, 19 nt, Homo sapiens
gaugagggauguccacaag

SEQ ID NO: 1109203 - RNA, 19 nt, Homo sapiens
acagugacguuacauguug

SEQ ID NO: 1109204 - RNA, 19 nt, Homo sapiens
aaacuagaguggucucaga

SEQ ID NO: 1109205 - RNA, 19 nt, Homo sapiens
gaaauuucccugagcuguu

SEQ ID NO: 1109206 - RNA, 19 nt, Homo sapiens
gaucaaauccauauuacca

SEQ ID NO: 1109207 - RNA, 19 nt, Homo sapiens
caacaggaagcuagugaaa

SEQ ID NO: 1109208 - RNA, 19 nt, Homo sapiens
ugacagcucugagacaaug

SEQ ID NO: 1109209 - RNA, 19 nt, Homo sapiens
ccuacucugugaagaauaa

SEQ ID NO: 1109210 - RNA, 19 nt, Homo sapiens
gaucugagacccuaaagca

SEQ ID NO: 1109211 - RNA, 19 nt, Homo sapiens
agagaaggcucccaaaguc

SEQ ID NO: 1109212 - RNA, 19 nt, Homo sapiens
cuagugaaaugacauagug

SEQ ID NO: 1109213 - RNA, 19 nt, Homo sapiens
caagaggaacugucauuau

SEQ ID NO: 1109214 - RNA, 19 nt, Homo sapiens
ccagagagccagaguggaa

SEQ ID NO: 1109215 - RNA, 19 nt, Homo sapiens
gcuguugucuuugaacuug

SEQ ID NO: 1109216 - RNA, 19 nt, Homo sapiens
aggcauggcuaaugaauuc

SEQ ID NO: 1109217 - RNA, 19 nt, Homo sapiens
gcauggagaugagggaugu

SEQ ID NO: 1109218 - RNA, 19 nt, Homo sapiens
guggaggccuucaagcaaa

SEQ ID NO: 1109219 - RNA, 19 nt, Homo sapiens
ggauggccuuucugacauu

SEQ ID NO: 1109220 - RNA, 19 nt, Homo sapiens
caacuaagacacacuccuu

SEQ ID NO: 1109221 - RNA, 19 nt, Homo sapiens
cauugaaggaugucaguua

SEQ ID NO: 1109222 - RNA, 19 nt, Homo sapiens
ugaauucaauccagagcaa

SEQ ID NO: 1109223 - RNA, 19 nt, Homo sapiens
cauauuaccauuuggagaa

SEQ ID NO: 1109224 - RNA, 19 nt, Homo sapiens
ugagggauguccacaagga

SEQ ID NO: 1109225 - RNA, 19 nt, Homo sapiens
gauggaagcauggagauga

SEQ ID NO: 1109226 - RNA, 19 nt, Homo sapiens
guucugaucuugccuucau

SEQ ID NO: 1109227 - RNA, 19 nt, Homo sapiens
gauggccuuucugacauua

SEQ ID NO: 1109228 - RNA, 19 nt, Homo sapiens
cacaaggaccgccaacuaa

SEQ ID NO: 1109229 - RNA, 19 nt, Homo sapiens
gccgugacauugauauaau

SEQ ID NO: 1109230 - RNA, 19 nt, Homo sapiens
ccaguuguucuguguauuu

SEQ ID NO: 1109231 - RNA, 19 nt, Homo sapiens
ugcaaguacuucaaggaua

SEQ ID NO: 1109232 - RNA, 19 nt, Homo sapiens
ccugagcuguugucuuuga

SEQ ID NO: 1109233 - RNA, 19 nt, Homo sapiens
gugaagaucaaauccauau

SEQ ID NO: 1109234 - RNA, 19 nt, Homo sapiens
cauaauaaacagugacguu

SEQ ID NO: 1109235 - RNA, 19 nt, Homo sapiens
cugagacccuaaagcauuu

SEQ ID NO: 1109236 - RNA, 19 nt, Homo sapiens
ugcuaaagcugaccaugaa

SEQ ID NO: 1109237 - RNA, 19 nt, Homo sapiens
ggaagcuagugaaaugaca

SEQ ID NO: 1109238 - RNA, 19 nt, Homo sapiens
gaacaugguggguaugaac

SEQ ID NO: 1109239 - RNA, 19 nt, Homo sapiens
ccaagaagccaaaguuaac

SEQ ID NO: 1109240 - RNA, 19 nt, Homo sapiens
gacccugaaucucuccaaa

SEQ ID NO: 1109241 - RNA, 19 nt, Homo sapiens
ugaacaaacgguacaaugu

SEQ ID NO: 1109242 - RNA, 19 nt, Homo sapiens
gagagacagcaacaacaaa

SEQ ID NO: 1109243 - RNA, 19 nt, Homo sapiens
uagaaaaccuccagagaga

SEQ ID NO: 1109244 - RNA, 19 nt, Homo sapiens
aauaaacagugacguuaca

SEQ ID NO: 1109245 - RNA, 19 nt, Homo sapiens
aaugauaagcuguuucuga

SEQ ID NO: 1109246 - RNA, 19 nt, Homo sapiens
caugaaugauaagcuguuu

SEQ ID NO: 1109247 - RNA, 19 nt, Homo sapiens
ugacaaggcauggcuaaug

SEQ ID NO: 1109248 - RNA, 19 nt, Homo sapiens
caacaaaaguauacucuac

SEQ ID NO: 1109249 - RNA, 19 nt, Homo sapiens
caaggaccgccaacuaaga

SEQ ID NO: 1109250 - RNA, 19 nt, Homo sapiens
aaacagugacguuacaugu

SEQ ID NO: 1109251 - RNA, 19 nt, Homo sapiens
ccuaagaccacucuaagga

SEQ ID NO: 1109252 - RNA, 19 nt, Homo sapiens
aaauuucccugagcuguug

SEQ ID NO: 1109253 - RNA, 19 nt, Homo sapiens
acaagaggaacugucauua

SEQ ID NO: 1109254 - RNA, 19 nt, Homo sapiens
aagacacacuccuuauaga

SEQ ID NO: 1109255 - RNA, 19 nt, Homo sapiens
ugaccaagaagccaaaguu

SEQ ID NO: 1109256 - RNA, 19 nt, Homo sapiens
uaaguggaacuacauuaga

SEQ ID NO: 1109257 - RNA, 19 nt, Homo sapiens
gcauuuaguccugcaauuc

SEQ ID NO: 1109258 - RNA, 19 nt, Homo sapiens
aaugaaacccugcaaggaa

SEQ ID NO: 1109259 - RNA, 19 nt, Homo sapiens
ucgaagagcuauggcuaga

SEQ ID NO: 1109260 - RNA, 19 nt, Homo sapiens
cagagaaggcucccaaagu

SEQ ID NO: 1109261 - RNA, 19 nt, Homo sapiens
gaugggccgugacauugau

SEQ ID NO: 1109262 - RNA, 19 nt, Homo sapiens
aaauggagaugcuaaagcu

SEQ ID NO: 1109263 - RNA, 19 nt, Homo sapiens
gaaaaccuccagagagaaa

SEQ ID NO: 1109264 - RNA, 19 nt, Homo sapiens
acacacuccuuauagaauc

SEQ ID NO: 1109265 - RNA, 19 nt, Homo sapiens
cuucucauccucuuuguuu

SEQ ID NO: 1109266 - RNA, 19 nt, Homo sapiens
ucaagcaaauccccuaaaa

SEQ ID NO: 1109267 - RNA, 19 nt, Homo sapiens
gugcauugccugaaacuca

SEQ ID NO: 1109268 - RNA, 19 nt, Homo sapiens
aggaaauggugcaggcuuu

SEQ ID NO: 1109269 - RNA, 19 nt, Homo sapiens
augaaacccugcaaggaaa

SEQ ID NO: 1109270 - RNA, 19 nt, Homo sapiens
gagaaggcucccaaaguca

SEQ ID NO: 1109271 - RNA, 19 nt, Homo sapiens
aggccuggcugaccaagaa

SEQ ID NO: 1109272 - RNA, 19 nt, Homo sapiens
ggaagaaaggugggaguca

SEQ ID NO: 1109273 - RNA, 19 nt, Homo sapiens
ucugagacccuaaagcauu

SEQ ID NO: 1109274 - RNA, 19 nt, Homo sapiens
gcccuacucugugaagaau

SEQ ID NO: 1109275 - RNA, 19 nt, Homo sapiens
gcggaacacacaagaugaa

SEQ ID NO: 1109276 - RNA, 19 nt, Homo sapiens
ugaaaugacauagugaaga

SEQ ID NO: 1109277 - RNA, 19 nt, Homo sapiens
gcaacaggaagcuagugaa

SEQ ID NO: 1109278 - RNA, 19 nt, Homo sapiens
gaagaucacugaaagaaau

SEQ ID NO: 1109279 - RNA, 19 nt, Homo sapiens
gaaaugacauagugaagau

SEQ ID NO: 1109280 - RNA, 19 nt, Homo sapiens
gaaauaaugccguauaugu

SEQ ID NO: 1109281 - RNA, 19 nt, Homo sapiens
ggaccagucugccuaugua

SEQ ID NO: 1109282 - RNA, 19 nt, Homo sapiens
ggacauagccaccugaaga

SEQ ID NO: 1109283 - RNA, 19 nt, Homo sapiens
ugaaggaugucaguuauaa

SEQ ID NO: 1109284 - RNA, 19 nt, Homo sapiens
gauauaauccugaaucgaa

SEQ ID NO: 1109285 - RNA, 19 nt, Homo sapiens
gacaaggcauggcuaauga

SEQ ID NO: 1109286 - RNA, 19 nt, Homo sapiens
gcaaguacuucaaggauag

SEQ ID NO: 1109287 - RNA, 19 nt, Homo sapiens
gaagagcuauggcuagaag

SEQ ID NO: 1109288 - RNA, 19 nt, Homo sapiens
ggaugucaguuauaagauu

SEQ ID NO: 1109289 - RNA, 19 nt, Homo sapiens
ucacuaugcuccagacuga

SEQ ID NO: 1109290 - RNA, 19 nt, Homo sapiens
aaggauagcaggaauauaa

SEQ ID NO: 1109291 - RNA, 19 nt, Homo sapiens
acaggaagcuagugaaaug

SEQ ID NO: 1109292 - RNA, 19 nt, Homo sapiens
ggagucauuuccaggguaa

SEQ ID NO: 1109293 - RNA, 19 nt, Homo sapiens
gacaauaaguggaacuaca

SEQ ID NO: 1109294 - RNA, 19 nt, Homo sapiens
cacaauuccuuaugggaua

SEQ ID NO: 1109295 - RNA, 19 nt, Homo sapiens
gaagaaaggugggagucau

SEQ ID NO: 1109296 - RNA, 19 nt, Homo sapiens
gaccaagaagccaaaguua

SEQ ID NO: 1109297 - RNA, 19 nt, Homo sapiens
ggucaggucuucacuaugc

SEQ ID NO: 1109298 - RNA, 19 nt, Homo sapiens
gaacaaacgguacaauguc

SEQ ID NO: 1109299 - RNA, 19 nt, Homo sapiens
aagaggaacugucauuaug

SEQ ID NO: 1109300 - RNA, 19 nt, Homo sapiens
ccacaaggaccgccaacua

SEQ ID NO: 1109301 - RNA, 19 nt, Homo sapiens
gaugagggauguccacaag

SEQ ID NO: 1109302 - RNA, 19 nt, Homo sapiens
acagugacguuacauguug

SEQ ID NO: 1109303 - RNA, 19 nt, Homo sapiens
aaacuagaguggucucaga

SEQ ID NO: 1109304 - RNA, 19 nt, Homo sapiens
gaucaaauccauauuacca

SEQ ID NO: 1109305 - RNA, 19 nt, Homo sapiens
caacaggaagcuagugaaa

SEQ ID NO: 1109306 - RNA, 19 nt, Homo sapiens
ugacagcucugagacaaug

SEQ ID NO: 1109307 - RNA, 19 nt, Homo sapiens
gagagaaggcucccaaagu

SEQ ID NO: 1109308 - RNA, 19 nt, Homo sapiens
ccuacucugugaagaauaa

SEQ ID NO: 1109309 - RNA, 19 nt, Homo sapiens
gaucugagacccuaaagca

SEQ ID NO: 1109310 - RNA, 19 nt, Homo sapiens
agagaaggcucccaaaguc

SEQ ID NO: 1109311 - RNA, 19 nt, Homo sapiens
cuagugaaaugacauagug

SEQ ID NO: 1109312 - RNA, 19 nt, Homo sapiens
caagaggaacugucauuau

SEQ ID NO: 1109313 - RNA, 19 nt, Homo sapiens
ccagagagccagaguggaa

SEQ ID NO: 1109314 - RNA, 19 nt, Homo sapiens
gaaauuucccugagagaag

SEQ ID NO: 1109315 - RNA, 19 nt, Homo sapiens
aggcauggcuaaugaauuc

SEQ ID NO: 1109316 - RNA, 19 nt, Homo sapiens
gcauggagaugagggaugu

SEQ ID NO: 1109317 - RNA, 19 nt, Homo sapiens
guggaggccuucaagcaaa

SEQ ID NO: 1109318 - RNA, 19 nt, Homo sapiens
caacuaagacacacuccuu

SEQ ID NO: 1109319 - RNA, 19 nt, Homo sapiens
cauugaaggaugucaguua

SEQ ID NO: 1109320 - RNA, 19 nt, Homo sapiens
ugaauucaauccagagcaa

SEQ ID NO: 1109321 - RNA, 19 nt, Homo sapiens
cauauuaccauuuggagaa

SEQ ID NO: 1109322 - RNA, 19 nt, Homo sapiens
ugagggauguccacaagga

SEQ ID NO: 1109323 - RNA, 19 nt, Homo sapiens
gauggaagcauggagauga

SEQ ID NO: 1109324 - RNA, 19 nt, Homo sapiens
guucugaucuugccuucau

SEQ ID NO: 1109325 - RNA, 19 nt, Homo sapiens
cacaaggaccgccaacuaa

SEQ ID NO: 1109326 - RNA, 19 nt, Homo sapiens
gccgugacauugauauaau

SEQ ID NO: 1109327 - RNA, 19 nt, Homo sapiens
ccaguuguucuguguauuu

SEQ ID NO: 1109328 - RNA, 19 nt, Homo sapiens
ugcaaguacuucaaggaua

SEQ ID NO: 1109329 - RNA, 19 nt, Homo sapiens
gugaagaucaaauccauau

SEQ ID NO: 1109330 - RNA, 19 nt, Homo sapiens
cauaauaaacagugacguu

SEQ ID NO: 1109331 - RNA, 19 nt, Homo sapiens
cugagacccuaaagcauuu

SEQ ID NO: 1109332 - RNA, 19 nt, Homo sapiens
ugcuaaagcugaccaugaa

SEQ ID NO: 1109333 - RNA, 19 nt, Homo sapiens
ggaagcuagugaaaugaca

SEQ ID NO: 1109334 - RNA, 19 nt, Homo sapiens
gaacaugguggguaugaac

SEQ ID NO: 1109335 - RNA, 19 nt, Homo sapiens
ccaagaagccaaaguuaac

SEQ ID NO: 1109336 - RNA, 19 nt, Homo sapiens
gacccugaaucucuccaaa

SEQ ID NO: 1109337 - RNA, 19 nt, Homo sapiens
ugaacaaacgguacaaugu

SEQ ID NO: 1109338 - RNA, 19 nt, Homo sapiens
gagagacagcaacaacaaa

SEQ ID NO: 1109339 - RNA, 19 nt, Homo sapiens
uagaaaaccuccagagaga

SEQ ID NO: 1109340 - RNA, 19 nt, Homo sapiens
aauaaacagugacguuaca

SEQ ID NO: 1109341 - RNA, 19 nt, Homo sapiens
aaugauaagcuguuucuga

SEQ ID NO: 1109342 - RNA, 19 nt, Homo sapiens
caugaaugauaagcuguuu

SEQ ID NO: 1109343 - RNA, 19 nt, Homo sapiens
caacaaaaguauacucuac

SEQ ID NO: 1109344 - RNA, 19 nt, Homo sapiens
ugacaaggcauggcuaaug

SEQ ID NO: 1109345 - RNA, 19 nt, Homo sapiens
caaggaccgccaacuaaga

SEQ ID NO: 1109346 - RNA, 19 nt, Homo sapiens
aaacagugacguuacaugu

SEQ ID NO: 1109347 - RNA, 19 nt, Homo sapiens
ccuaagaccacucuaagga

SEQ ID NO: 1109348 - RNA, 19 nt, Homo sapiens
acaagaggaacugucauua

SEQ ID NO: 1109349 - RNA, 19 nt, Homo sapiens
aagacacacuccuuauaga

SEQ ID NO: 1109350 - RNA, 19 nt, Homo sapiens
ugaccaagaagccaaaguu

SEQ ID NO: 1109351 - RNA, 19 nt, Homo sapiens
uaaguggaacuacauuaga

SEQ ID NO: 1109352 - RNA, 19 nt, Homo sapiens
gcauuuaguccugcaauuc

SEQ ID NO: 1109353 - RNA, 19 nt, Homo sapiens
aaugaaacccugcaaggaa

SEQ ID NO: 1109354 - RNA, 19 nt, Homo sapiens
ucgaagagcuauggcuaga

SEQ ID NO: 1109355 - RNA, 19 nt, Homo sapiens
gaugggccgugacauugau

SEQ ID NO: 1109356 - RNA, 19 nt, Homo sapiens
aaauggagaugcuaaagcu

SEQ ID NO: 1109357 - RNA, 19 nt, Homo sapiens
gaaaaccuccagagagaaa

SEQ ID NO: 1109358 - RNA, 19 nt, Homo sapiens
acacacuccuuauagaauc

SEQ ID NO: 1109359 - RNA, 19 nt, Homo sapiens
cuucucauccucuuuguuu

SEQ ID NO: 1109360 - RNA, 19 nt, Homo sapiens
ucaagcaaauccccuaaaa

SEQ ID NO: 1109361 - RNA, 19 nt, Homo sapiens
gugcauugccugaaacuca

SEQ ID NO: 1109362 - RNA, 19 nt, Homo sapiens
aggaaauggugcaggcuuu

SEQ ID NO: 1109363 - RNA, 19 nt, Homo sapiens
augaaacccugcaaggaaa

SEQ ID NO: 1109364 - RNA, 19 nt, Homo sapiens
gagaaggcucccaaaguca

SEQ ID NO: 1109365 - RNA, 19 nt, Homo sapiens
aggccuggcugaccaagaa

SEQ ID NO: 1109366 - RNA, 19 nt, Homo sapiens
ucugagacccuaaagcauu

SEQ ID NO: 1109367 - RNA, 19 nt, Homo sapiens
ggaagaaaggugggaguca

SEQ ID NO: 1109368 - RNA, 19 nt, Homo sapiens
gcccuacucugugaagaau

SEQ ID NO: 1109369 - RNA, 19 nt, Homo sapiens
gcggaacacacaagaugaa

SEQ ID NO: 1109370 - RNA, 19 nt, Homo sapiens
ugaaaugacauagugaaga

SEQ ID NO: 1109371 - RNA, 19 nt, Homo sapiens
gcaacaggaagcuagugaa

SEQ ID NO: 1109372 - RNA, 19 nt, Homo sapiens
agacacacuccuuauagaa

SEQ ID NO: 1109373 - RNA, 19 nt, Homo sapiens
ccacucaugaucaccguuu

SEQ ID NO: 1109374 - RNA, 19 nt, Homo sapiens
gaagagccaguuguucugu

SEQ ID NO: 1109375 - RNA, 19 nt, Homo sapiens
caaugaaacccugcaagga

SEQ ID NO: 1109376 - RNA, 19 nt, Homo sapiens
gacauugacagcucugaga

SEQ ID NO: 1109377 - RNA, 19 nt, Homo sapiens
ccuggacggccgagaguua

SEQ ID NO: 1109378 - RNA, 19 nt, Homo sapiens
gaagaucacugaaagaaau

SEQ ID NO: 1109379 - RNA, 19 nt, Homo sapiens
gaaaugacauagugaagau

SEQ ID NO: 1109380 - RNA, 19 nt, Homo sapiens
gaaauaaugccguauaugu

SEQ ID NO: 1109381 - RNA, 19 nt, Homo sapiens
ggaccagucugccuaugua

SEQ ID NO: 1109382 - RNA, 19 nt, Homo sapiens
ggacauagccaccugaaga

SEQ ID NO: 1109383 - RNA, 19 nt, Homo sapiens
gauauaauccugaaucgaa

SEQ ID NO: 1109384 - RNA, 19 nt, Homo sapiens
gcaaguacuucaaggauag

SEQ ID NO: 1109385 - RNA, 19 nt, Homo sapiens
gaagagcuauggcuagaag

SEQ ID NO: 1109386 - RNA, 19 nt, Homo sapiens
ucacuaugcuccagacuga

SEQ ID NO: 1109387 - RNA, 19 nt, Homo sapiens
aaggauagcaggaauauaa

SEQ ID NO: 1109388 - RNA, 19 nt, Homo sapiens
ucccugagcuguugucuuu

SEQ ID NO: 1109389 - RNA, 19 nt, Homo sapiens
acaggaagcuagugaaaug

SEQ ID NO: 1109390 - RNA, 19 nt, Homo sapiens
ggagucauuuccaggguaa

SEQ ID NO: 1109391 - RNA, 19 nt, Homo sapiens
gacaauaaguggaacuaca

SEQ ID NO: 1109392 - RNA, 19 nt, Homo sapiens
gaagaaaggugggagucau

SEQ ID NO: 1109393 - RNA, 19 nt, Homo sapiens
gaccaagaagccaaaguua

SEQ ID NO: 1109394 - RNA, 19 nt, Homo sapiens
ggucaggucuucacuaugc

SEQ ID NO: 1109395 - RNA, 19 nt, Homo sapiens
gaacaaacgguacaauguc

SEQ ID NO: 1109396 - RNA, 19 nt, Homo sapiens
aagaggaacugucauuaug

SEQ ID NO: 1109397 - RNA, 19 nt, Homo sapiens
ccacaaggaccgccaacua

SEQ ID NO: 1109398 - RNA, 19 nt, Homo sapiens
gaugagggauguccacaag

SEQ ID NO: 1109399 - RNA, 19 nt, Homo sapiens
acagugacguuacauguug

SEQ ID NO: 1109400 - RNA, 19 nt, Homo sapiens
aaacuagaguggucucaga

SEQ ID NO: 1109401 - RNA, 19 nt, Homo sapiens
gaaauuucccugagcuguu

SEQ ID NO: 1109402 - RNA, 19 nt, Homo sapiens
gaucaaauccauauuacca

SEQ ID NO: 1109403 - RNA, 19 nt, Homo sapiens
caacaggaagcuagugaaa

SEQ ID NO: 1109404 - RNA, 19 nt, Homo sapiens
ugacagcucugagacaaug

SEQ ID NO: 1109405 - RNA, 19 nt, Homo sapiens
ccuacucugugaagaauaa

SEQ ID NO: 1109406 - RNA, 19 nt, Homo sapiens
gaucugagacccuaaagca

SEQ ID NO: 1109407 - RNA, 19 nt, Homo sapiens
agagaaggcucccaaaguc

SEQ ID NO: 1109408 - RNA, 19 nt, Homo sapiens
cuagugaaaugacauagug

SEQ ID NO: 1109409 - RNA, 19 nt, Homo sapiens
caagaggaacugucauuau

SEQ ID NO: 1109410 - RNA, 19 nt, Homo sapiens
ccagagagccagaguggaa

SEQ ID NO: 1109411 - RNA, 19 nt, Homo sapiens
gcuguugucuuugaacuug

SEQ ID NO: 1109412 - RNA, 19 nt, Homo sapiens
gcauggagaugagggaugu

SEQ ID NO: 1109413 - RNA, 19 nt, Homo sapiens
guggaggccuucaagcaaa

SEQ ID NO: 1109414 - RNA, 19 nt, Homo sapiens
ggauggccuuucugacauu

SEQ ID NO: 1109415 - RNA, 19 nt, Homo sapiens
caacuaagacacacuccuu

SEQ ID NO: 1109416 - RNA, 19 nt, Homo sapiens
cauauuaccauuuggagaa

SEQ ID NO: 1109417 - RNA, 19 nt, Homo sapiens
ugagggauguccacaagga

SEQ ID NO: 1109418 - RNA, 19 nt, Homo sapiens
gauggaagcauggagauga

SEQ ID NO: 1109419 - RNA, 19 nt, Homo sapiens
guucugaucuugccuucau

SEQ ID NO: 1109420 - RNA, 19 nt, Homo sapiens
caaggucacaauauguaua

SEQ ID NO: 1109421 - RNA, 19 nt, Homo sapiens
gauggccuuucugacauua

SEQ ID NO: 1109422 - RNA, 19 nt, Homo sapiens
cacaaggaccgccaacuaa

SEQ ID NO: 1109423 - RNA, 19 nt, Homo sapiens
gccgugacauugauauaau

SEQ ID NO: 1109424 - RNA, 19 nt, Homo sapiens
gguucaaggucacaauaug

SEQ ID NO: 1109425 - RNA, 19 nt, Homo sapiens
ccaguuguucuguguauuu

SEQ ID NO: 1109426 - RNA, 19 nt, Homo sapiens
ugcaaguacuucaaggaua

SEQ ID NO: 1109427 - RNA, 19 nt, Homo sapiens
ccugagcuguugucuuuga

SEQ ID NO: 1109428 - RNA, 19 nt, Homo sapiens
gugaagaucaaauccauau

SEQ ID NO: 1109429 - RNA, 19 nt, Homo sapiens
cauaauaaacagugacguu

SEQ ID NO: 1109430 - RNA, 19 nt, Homo sapiens
cugagacccuaaagcauuu

SEQ ID NO: 1109431 - RNA, 19 nt, Homo sapiens
ugcuaaagcugaccaugaa

SEQ ID NO: 1109432 - RNA, 19 nt, Homo sapiens
ggaagcuagugaaaugaca

SEQ ID NO: 1109433 - RNA, 19 nt, Homo sapiens
gaacaugguggguaugaac

SEQ ID NO: 1109434 - RNA, 19 nt, Homo sapiens
ccaagaagccaaaguuaac

SEQ ID NO: 1109435 - RNA, 19 nt, Homo sapiens
gagagacagcaacaacaaa

SEQ ID NO: 1109436 - RNA, 19 nt, Homo sapiens
gacccugaaucucuccaaa

SEQ ID NO: 1109437 - RNA, 19 nt, Homo sapiens
ugaacaaacgguacaaugu

SEQ ID NO: 1109438 - RNA, 19 nt, Homo sapiens
uagaaaaccuccagagaga

SEQ ID NO: 1109439 - RNA, 19 nt, Homo sapiens
aauaaacagugacguuaca

SEQ ID NO: 1109440 - RNA, 19 nt, Homo sapiens
aaugauaagcuguuucuga

SEQ ID NO: 1109441 - RNA, 19 nt, Homo sapiens
caugaaugauaagcuguuu

SEQ ID NO: 1109442 - RNA, 19 nt, Homo sapiens
caacaaaaguauacucuac

SEQ ID NO: 1109443 - RNA, 19 nt, Homo sapiens
caaggaccgccaacuaaga

SEQ ID NO: 1109444 - RNA, 19 nt, Homo sapiens
aaacagugacguuacaugu

SEQ ID NO: 1109445 - RNA, 19 nt, Homo sapiens
ccuaagaccacucuaagga

SEQ ID NO: 1109446 - RNA, 19 nt, Homo sapiens
aaauuucccugagcuguug

SEQ ID NO: 1109447 - RNA, 19 nt, Homo sapiens
acaagaggaacugucauua

SEQ ID NO: 1109448 - RNA, 19 nt, Homo sapiens
aagacacacuccuuauaga

SEQ ID NO: 1109449 - RNA, 19 nt, Homo sapiens
ugaccaagaagccaaaguu

SEQ ID NO: 1109450 - RNA, 19 nt, Homo sapiens
uaaguggaacuacauuaga

SEQ ID NO: 1109451 - RNA, 19 nt, Homo sapiens
gcauuuaguccugcaauuc

SEQ ID NO: 1109452 - RNA, 19 nt, Homo sapiens
aaugaaacccugcaaggaa

SEQ ID NO: 1109453 - RNA, 19 nt, Homo sapiens
ucgaagagcuauggcuaga

SEQ ID NO: 1109454 - RNA, 19 nt, Homo sapiens
cagagaaggcucccaaagu

SEQ ID NO: 1109455 - RNA, 19 nt, Homo sapiens
gaugggccgugacauugau

SEQ ID NO: 1109456 - RNA, 19 nt, Homo sapiens
aaauggagaugcuaaagcu

SEQ ID NO: 1109457 - RNA, 19 nt, Homo sapiens
gaaaaccuccagagagaaa

SEQ ID NO: 1109458 - RNA, 19 nt, Homo sapiens
acacacuccuuauagaauc

SEQ ID NO: 1109459 - RNA, 19 nt, Homo sapiens
cuucucauccucuuuguuu

SEQ ID NO: 1109460 - RNA, 19 nt, Homo sapiens
ucaagcaaauccccuaaaa

SEQ ID NO: 1109461 - RNA, 19 nt, Homo sapiens
gugcauugccugaaacuca

SEQ ID NO: 1109462 - RNA, 19 nt, Homo sapiens
aggaaauggugcaggcuuu

SEQ ID NO: 1109463 - RNA, 19 nt, Homo sapiens
augaaacccugcaaggaaa

SEQ ID NO: 1109464 - RNA, 19 nt, Homo sapiens
gagaaggcucccaaaguca

SEQ ID NO: 1109465 - RNA, 19 nt, Homo sapiens
aggccuggcugaccaagaa

SEQ ID NO: 1109466 - RNA, 19 nt, Homo sapiens
ucugagacccuaaagcauu

SEQ ID NO: 1109467 - RNA, 19 nt, Homo sapiens
ggaagaaaggugggaguca

SEQ ID NO: 1109468 - RNA, 19 nt, Homo sapiens
gcccuacucugugaagaau

SEQ ID NO: 1109469 - RNA, 19 nt, Homo sapiens
gcggaacacacaagaugaa

SEQ ID NO: 1109470 - RNA, 19 nt, Homo sapiens
ugaaaugacauagugaaga

SEQ ID NO: 1109471 - RNA, 19 nt, Homo sapiens
gcaacaggaagcuagugaa

SEQ ID NO: 1109472 - RNA, 19 nt, Homo sapiens
agacacacuccuuauagaa

SEQ ID NO: 1109473 - RNA, 19 nt, Homo sapiens
ccacucaugaucaccguuu

SEQ ID NO: 1109474 - RNA, 19 nt, Homo sapiens
gaagagccaguuguucugu

SEQ ID NO: 1109475 - RNA, 19 nt, Homo sapiens
ugagagacagcaacaacaa

SEQ ID NO: 1109476 - RNA, 19 nt, Homo sapiens
caaugaaacccugcaagga

SEQ ID NO: 1109477 - RNA, 19 nt, Homo sapiens
gacauugacagcucugaga

SEQ ID NO: 1109478 - RNA, 19 nt, Homo sapiens
gaagaucacugaaagaaau

SEQ ID NO: 1109479 - RNA, 19 nt, Homo sapiens
gaaaugacauagugaagau

SEQ ID NO: 1109480 - RNA, 19 nt, Homo sapiens
gaaauaaugccguauaugu

SEQ ID NO: 1109481 - RNA, 19 nt, Homo sapiens
ggaccagucugccuaugua

SEQ ID NO: 1109482 - RNA, 19 nt, Homo sapiens
ggacauagccaccugaaga

SEQ ID NO: 1109483 - RNA, 19 nt, Homo sapiens
gauauaauccugaaucgaa

SEQ ID NO: 1109484 - RNA, 19 nt, Homo sapiens
gcaaguacuucaaggauag

SEQ ID NO: 1109485 - RNA, 19 nt, Homo sapiens
gaagagcuauggcuagaag

SEQ ID NO: 1109486 - RNA, 19 nt, Homo sapiens
ucacuaugcuccagacuga

SEQ ID NO: 1109487 - RNA, 19 nt, Homo sapiens
caaggaagguggugguguu

SEQ ID NO: 1109488 - RNA, 19 nt, Homo sapiens
aaggauagcaggaauauaa

SEQ ID NO: 1109489 - RNA, 19 nt, Homo sapiens
ucccugagcuguugucuuu

SEQ ID NO: 1109490 - RNA, 19 nt, Homo sapiens
acaggaagcuagugaaaug

SEQ ID NO: 1109491 - RNA, 19 nt, Homo sapiens
ggagucauuuccaggguaa

SEQ ID NO: 1109492 - RNA, 19 nt, Homo sapiens
ggaagguggugguguuugu

SEQ ID NO: 1109493 - RNA, 19 nt, Homo sapiens
gacaauaaguggaacuaca

SEQ ID NO: 1109494 - RNA, 19 nt, Homo sapiens
gaagaaaggugggagucau

SEQ ID NO: 1109495 - RNA, 19 nt, Homo sapiens
gaccaagaagccaaaguua

SEQ ID NO: 1109496 - RNA, 19 nt, Homo sapiens
ggucaggucuucacuaugc

SEQ ID NO: 1109497 - RNA, 19 nt, Homo sapiens
gaacaaacgguacaauguc

SEQ ID NO: 1109498 - RNA, 19 nt, Homo sapiens
aagaggaacugucauuaug

SEQ ID NO: 1109499 - RNA, 19 nt, Homo sapiens
ccacaaggaccgccaacua

SEQ ID NO: 1109500 - RNA, 19 nt, Homo sapiens
gaugagggauguccacaag

SEQ ID NO: 1109501 - RNA, 19 nt, Homo sapiens
acagugacguuacauguug

SEQ ID NO: 1109502 - RNA, 19 nt, Homo sapiens
aaacuagaguggucucaga

SEQ ID NO: 1109503 - RNA, 19 nt, Homo sapiens
gaaauuucccugagcuguu

SEQ ID NO: 1109504 - RNA, 19 nt, Homo sapiens
gaucaaauccauauuacca

SEQ ID NO: 1109505 - RNA, 19 nt, Homo sapiens
caacaggaagcuagugaaa

SEQ ID NO: 1109506 - RNA, 19 nt, Homo sapiens
ugacagcucugagacaaug

SEQ ID NO: 1109507 - RNA, 19 nt, Homo sapiens
ccuacucugugaagaauaa

SEQ ID NO: 1109508 - RNA, 19 nt, Homo sapiens
gaucugagacccuaaagca

SEQ ID NO: 1109509 - RNA, 19 nt, Homo sapiens
agagaaggcucccaaaguc

SEQ ID NO: 1109510 - RNA, 19 nt, Homo sapiens
cuagugaaaugacauagug

SEQ ID NO: 1109511 - RNA, 19 nt, Homo sapiens
caagaggaacugucauuau

SEQ ID NO: 1109512 - RNA, 19 nt, Homo sapiens
gcuguugucuuugaacuug

SEQ ID NO: 1109513 - RNA, 19 nt, Homo sapiens
gcauggagaugagggaugu

SEQ ID NO: 1109514 - RNA, 19 nt, Homo sapiens
guggaggccuucaagcaaa

SEQ ID NO: 1109515 - RNA, 19 nt, Homo sapiens
ggauggccuuucugacauu

SEQ ID NO: 1109516 - RNA, 19 nt, Homo sapiens
caacuaagacacacuccuu

SEQ ID NO: 1109517 - RNA, 19 nt, Homo sapiens
cauauuaccauuuggagaa

SEQ ID NO: 1109518 - RNA, 19 nt, Homo sapiens
ugagggauguccacaagga

SEQ ID NO: 1109519 - RNA, 19 nt, Homo sapiens
gauggaagcauggagauga

SEQ ID NO: 1109520 - RNA, 19 nt, Homo sapiens
guucugaucuugccuucau

SEQ ID NO: 1109521 - RNA, 19 nt, Homo sapiens
caacggaguguucaaggaa

SEQ ID NO: 1109522 - RNA, 19 nt, Homo sapiens
caaggucacaauauguaua

SEQ ID NO: 1109523 - RNA, 19 nt, Homo sapiens
gauggccuuucugacauua

SEQ ID NO: 1109524 - RNA, 19 nt, Homo sapiens
cacaaggaccgccaacuaa

SEQ ID NO: 1109525 - RNA, 19 nt, Homo sapiens
gccgugacauugauauaau

SEQ ID NO: 1109526 - RNA, 19 nt, Homo sapiens
gguucaaggucacaauaug

SEQ ID NO: 1109527 - RNA, 19 nt, Homo sapiens
ccaguuguucuguguauuu

SEQ ID NO: 1109528 - RNA, 19 nt, Homo sapiens
ugcaaguacuucaaggaua

SEQ ID NO: 1109529 - RNA, 19 nt, Homo sapiens
ccugagcuguugucuuuga

SEQ ID NO: 1109530 - RNA, 19 nt, Homo sapiens
gugaagaucaaauccauau

SEQ ID NO: 1109531 - RNA, 19 nt, Homo sapiens
cauaauaaacagugacguu

SEQ ID NO: 1109532 - RNA, 19 nt, Homo sapiens
cugagacccuaaagcauuu

SEQ ID NO: 1109533 - RNA, 19 nt, Homo sapiens
ugcuaaagcugaccaugaa

SEQ ID NO: 1109534 - RNA, 19 nt, Homo sapiens
ggaagcuagugaaaugaca

SEQ ID NO: 1109535 - RNA, 19 nt, Homo sapiens
gcaccugagcgcuuccuuu

SEQ ID NO: 1109536 - RNA, 19 nt, Homo sapiens
gaacaugguggguaugaac

SEQ ID NO: 1109537 - RNA, 19 nt, Homo sapiens
ccaagaagccaaaguuaac

SEQ ID NO: 1109538 - RNA, 19 nt, Homo sapiens
gagagacagcaacaacaaa

SEQ ID NO: 1109539 - RNA, 19 nt, Homo sapiens
gacccugaaucucuccaaa

SEQ ID NO: 1109540 - RNA, 19 nt, Homo sapiens
ugaacaaacgguacaaugu

SEQ ID NO: 1109541 - RNA, 19 nt, Homo sapiens
uagaaaaccuccagagaga

SEQ ID NO: 1109542 - RNA, 19 nt, Homo sapiens
aauaaacagugacguuaca

SEQ ID NO: 1109543 - RNA, 19 nt, Homo sapiens
caacaaaaguauacucuac

SEQ ID NO: 1109544 - RNA, 19 nt, Homo sapiens
aaugauaagcuguuucuga

SEQ ID NO: 1109545 - RNA, 19 nt, Homo sapiens
caugaaugauaagcuguuu

SEQ ID NO: 1109546 - RNA, 19 nt, Homo sapiens
caaggaccgccaacuaaga

SEQ ID NO: 1109547 - RNA, 19 nt, Homo sapiens
aaacagugacguuacaugu

SEQ ID NO: 1109548 - RNA, 19 nt, Homo sapiens
acaagaggaacugucauua

SEQ ID NO: 1109549 - RNA, 19 nt, Homo sapiens
ccuaagaccacucuaagga

SEQ ID NO: 1109550 - RNA, 19 nt, Homo sapiens
ucaacggaguguucaagga

SEQ ID NO: 1109551 - RNA, 19 nt, Homo sapiens
aaauuucccugagcuguug

SEQ ID NO: 1109552 - RNA, 19 nt, Homo sapiens
aagacacacuccuuauaga

SEQ ID NO: 1109553 - RNA, 19 nt, Homo sapiens
ugaccaagaagccaaaguu

SEQ ID NO: 1109554 - RNA, 19 nt, Homo sapiens
uaaguggaacuacauuaga

SEQ ID NO: 1109555 - RNA, 19 nt, Homo sapiens
gcauuuaguccugcaauuc

SEQ ID NO: 1109556 - RNA, 19 nt, Homo sapiens
aaugaaacccugcaaggaa

SEQ ID NO: 1109557 - RNA, 19 nt, Homo sapiens
ucgaagagcuauggcuaga

SEQ ID NO: 1109558 - RNA, 19 nt, Homo sapiens
cagagaaggcucccaaagu

SEQ ID NO: 1109559 - RNA, 19 nt, Homo sapiens
gaugggccgugacauugau

SEQ ID NO: 1109560 - RNA, 19 nt, Homo sapiens
aaauggagaugcuaaagcu

SEQ ID NO: 1109561 - RNA, 19 nt, Homo sapiens
gaaaaccuccagagagaaa

SEQ ID NO: 1109562 - RNA, 19 nt, Homo sapiens
acacacuccuuauagaauc

SEQ ID NO: 1109563 - RNA, 19 nt, Homo sapiens
cuucucauccucuuuguuu

SEQ ID NO: 1109564 - RNA, 19 nt, Homo sapiens
ucaagcaaauccccuaaaa

SEQ ID NO: 1109565 - RNA, 19 nt, Homo sapiens
gugcauugccugaaacuca

SEQ ID NO: 1109566 - RNA, 19 nt, Homo sapiens
aggaaauggugcaggcuuu

SEQ ID NO: 1109567 - RNA, 19 nt, Homo sapiens
augaaacccugcaaggaaa

SEQ ID NO: 1109568 - RNA, 19 nt, Homo sapiens
gagaaggcucccaaaguca

SEQ ID NO: 1109569 - RNA, 19 nt, Homo sapiens
aggccuggcugaccaagaa

SEQ ID NO: 1109570 - RNA, 19 nt, Homo sapiens
ggaagaaaggugggaguca

SEQ ID NO: 1109571 - RNA, 19 nt, Homo sapiens
ucugagacccuaaagcauu

SEQ ID NO: 1109572 - RNA, 19 nt, Homo sapiens
gcccuacucugugaagaau

SEQ ID NO: 1109573 - RNA, 19 nt, Homo sapiens
gcggaacacacaagaugaa

SEQ ID NO: 1109574 - RNA, 19 nt, Homo sapiens
ugaaaugacauagugaaga

SEQ ID NO: 1109575 - RNA, 19 nt, Homo sapiens
gcaacaggaagcuagugaa

SEQ ID NO: 1109576 - RNA, 19 nt, Homo sapiens
agacacacuccuuauagaa

SEQ ID NO: 1109577 - RNA, 19 nt, Homo sapiens
ccacucaugaucaccguuu

SEQ ID NO: 1109578 - RNA, 19 nt, Homo sapiens
gaacauaccuacagugaug

SEQ ID NO: 1109579 - RNA, 19 nt, Homo sapiens
caaaggagauuuagcagua

SEQ ID NO: 1109580 - RNA, 19 nt, Homo sapiens
agaaguggcugcugaauuu

SEQ ID NO: 1109581 - RNA, 19 nt, Homo sapiens
caagagagcccuauaagga

SEQ ID NO: 1109582 - RNA, 19 nt, Homo sapiens
aaaguauggugucuuguua

SEQ ID NO: 1109583 - RNA, 19 nt, Homo sapiens
cgucagagcuccucauguu

SEQ ID NO: 1109584 - RNA, 19 nt, Homo sapiens
ccaggaagcucuugauauc

SEQ ID NO: 1109585 - RNA, 19 nt, Homo sapiens
gaaugucaguggcaagauu

SEQ ID NO: 1109586 - RNA, 19 nt, Homo sapiens
gcaagauguugggauauuu

SEQ ID NO: 1109587 - RNA, 19 nt, Homo sapiens
agauaaagcuggccaugaa

SEQ ID NO: 1109588 - RNA, 19 nt, Homo sapiens
aaggauagcaggaauauaa

SEQ ID NO: 1109589 - RNA, 19 nt, Homo sapiens
gagaacauaccuacaguga

SEQ ID NO: 1109590 - RNA, 19 nt, Homo sapiens
uuagggagcugguucaaga

SEQ ID NO: 1109591 - RNA, 19 nt, Homo sapiens
caaagaagagcaagauguu

SEQ ID NO: 1109592 - RNA, 19 nt, Homo sapiens
ccacacagauucuccucaa

SEQ ID NO: 1109593 - RNA, 19 nt, Homo sapiens
caagauguugggauauuua

SEQ ID NO: 1109594 - RNA, 19 nt, Homo sapiens
gaaccgugauacuaagaug

SEQ ID NO: 1109595 - RNA, 19 nt, Homo sapiens
gaagagaacauaccuacag

SEQ ID NO: 1109596 - RNA, 19 nt, Homo sapiens
ugucaacccugcuggcaua

SEQ ID NO: 1109597 - RNA, 19 nt, Homo sapiens
caguugaguuucacuauga

SEQ ID NO: 1109598 - RNA, 19 nt, Homo sapiens
agagcaagauguugggaua

SEQ ID NO: 1109599 - RNA, 19 nt, Homo sapiens
aauaaaguauggugucuug

SEQ ID NO: 1109600 - RNA, 19 nt, Homo sapiens
caagaucacaguucccuuu

SEQ ID NO: 1109601 - RNA, 19 nt, Homo sapiens
ccuaugcacugaagaaugu

SEQ ID NO: 1109602 - RNA, 19 nt, Homo sapiens
gcagcaagauggagaugca

SEQ ID NO: 1109603 - RNA, 19 nt, Homo sapiens
ggacaaguggaaagggaua

SEQ ID NO: 1109604 - RNA, 19 nt, Homo sapiens
gagaaguggcugcugaauu

SEQ ID NO: 1109605 - RNA, 19 nt, Homo sapiens
gauacacucccuauacuau

SEQ ID NO: 1109606 - RNA, 19 nt, Homo sapiens
ggacguccaugaagagaac

SEQ ID NO: 1109607 - RNA, 19 nt, Homo sapiens
ucacagggcugacucucau

SEQ ID NO: 1109608 - RNA, 19 nt, Homo sapiens
gcaaguucuucaaggauag

SEQ ID NO: 1109609 - RNA, 19 nt, Homo sapiens
ggauaccuccagcaacaua

SEQ ID NO: 1109610 - RNA, 19 nt, Homo sapiens
uaagauacacucccuauac

SEQ ID NO: 1109611 - RNA, 19 nt, Homo sapiens
gaucgacagggucuccuua

SEQ ID NO: 1109612 - RNA, 19 nt, Homo sapiens
acaguucccuuuggcauaa

SEQ ID NO: 1109613 - RNA, 19 nt, Homo sapiens
gaucaaguuguucaaagaa

SEQ ID NO: 1109614 - RNA, 19 nt, Homo sapiens
ucacacugaucaaguuguu

SEQ ID NO: 1109615 - RNA, 19 nt, Homo sapiens
uaaaguauggugucuuguu

SEQ ID NO: 1109616 - RNA, 19 nt, Homo sapiens
aagggaagcuucuuuggau

SEQ ID NO: 1109617 - RNA, 19 nt, Homo sapiens
uacacucccuauacuauuu

SEQ ID NO: 1109618 - RNA, 19 nt, Homo sapiens
cagaaugaaugcaguguac

SEQ ID NO: 1109619 - RNA, 19 nt, Homo sapiens
guaagauacacucccuaua

SEQ ID NO: 1109620 - RNA, 19 nt, Homo sapiens
ucaaguuguucaaagaaga

SEQ ID NO: 1109621 - RNA, 19 nt, Homo sapiens
ugaucaaguuguucaaaga

SEQ ID NO: 1109622 - RNA, 19 nt, Homo sapiens
gcacgaccuucucggauac

SEQ ID NO: 1109623 - RNA, 19 nt, Homo sapiens
ggauagagccaggagagaa

SEQ ID NO: 1109624 - RNA, 19 nt, Homo sapiens
cggaauggaugcucugcuu

SEQ ID NO: 1109625 - RNA, 19 nt, Homo sapiens
ugcaaguucuucaaggaua

SEQ ID NO: 1109626 - RNA, 19 nt, Homo sapiens
ccaguugaguuucacuaug

SEQ ID NO: 1109627 - RNA, 19 nt, Homo sapiens
caagaccaaacccacguua

SEQ ID NO: 1109628 - RNA, 19 nt, Homo sapiens
agauggagaugcagcaaug

SEQ ID NO: 1109629 - RNA, 19 nt, Homo sapiens
ccuauaaggacauugguaa

SEQ ID NO: 1109630 - RNA, 19 nt, Homo sapiens
agaaaaugcugccuucgua

SEQ ID NO: 1109631 - RNA, 19 nt, Homo sapiens
agagcaacuuuauguggua

SEQ ID NO: 1109632 - RNA, 19 nt, Homo sapiens
ggaauggaugcucugcuuu

SEQ ID NO: 1109633 - RNA, 19 nt, Homo sapiens
gggucacacugaucaaguu

SEQ ID NO: 1109634 - RNA, 19 nt, Homo sapiens
ucaaagaagagcaagaugu

SEQ ID NO: 1109635 - RNA, 19 nt, Homo sapiens
ucggauaccuccagcaaca

SEQ ID NO: 1109636 - RNA, 19 nt, Homo sapiens
ucugagauguugaagaauc

SEQ ID NO: 1109637 - RNA, 19 nt, Homo sapiens
ugcacgaccuucucggaua

SEQ ID NO: 1109638 - RNA, 19 nt, Homo sapiens
gcacagggagcugaaguca

SEQ ID NO: 1109639 - RNA, 19 nt, Homo sapiens
uugcauggcccaagaugua

SEQ ID NO: 1109640 - RNA, 19 nt, Homo sapiens
cgacagggucuccuuagug

SEQ ID NO: 1109641 - RNA, 19 nt, Homo sapiens
agaaucugguccugcaauu

SEQ ID NO: 1109642 - RNA, 19 nt, Homo sapiens
gauuugggaugaggauaau

SEQ ID NO: 1109643 - RNA, 19 nt, Homo sapiens
guacugaagcccacaagag

SEQ ID NO: 1109644 - RNA, 19 nt, Homo sapiens
ggagauggacaaguggaaa

SEQ ID NO: 1109645 - RNA, 19 nt, Homo sapiens
ccucaagagagcccuauaa

SEQ ID NO: 1109646 - RNA, 19 nt, Homo sapiens
gaaccaacagugugauguc

SEQ ID NO: 1109647 - RNA, 19 nt, Homo sapiens
aaacccacguuaacaugga

SEQ ID NO: 1109648 - RNA, 19 nt, Homo sapiens
acccggaccuucauugcua

SEQ ID NO: 1109649 - RNA, 19 nt, Homo sapiens
ggaaguggaaggacagucu

SEQ ID NO: 1109650 - RNA, 19 nt, Homo sapiens
gaagcuucuuuggaucuga

SEQ ID NO: 1109651 - RNA, 19 nt, Homo sapiens
uaagggaagcuucuuugga

SEQ ID NO: 1109652 - RNA, 19 nt, Homo sapiens
caucgaauccuagaaagug

SEQ ID NO: 1109653 - RNA, 19 nt, Homo sapiens
gaaaagguggagcagauaa

SEQ ID NO: 1109654 - RNA, 19 nt, Homo sapiens
guggcaagauuugggauga

SEQ ID NO: 1109655 - RNA, 19 nt, Homo sapiens
acacagauucuccucaaga

SEQ ID NO: 1109656 - RNA, 19 nt, Homo sapiens
guauuucccugugacugaa

SEQ ID NO: 1109657 - RNA, 19 nt, Homo sapiens
guaacaaccagugugacua

SEQ ID NO: 1109658 - RNA, 19 nt, Homo sapiens
ggacccagagugccuuguu

SEQ ID NO: 1109659 - RNA, 19 nt, Homo sapiens
caaauuauuaugccuggau

SEQ ID NO: 1109660 - RNA, 19 nt, Homo sapiens
ggugaaccgugauacuaag

SEQ ID NO: 1109661 - RNA, 19 nt, Homo sapiens
gggagcugguucaagauca

SEQ ID NO: 1109662 - RNA, 19 nt, Homo sapiens
gacccagagugccuuguuc

SEQ ID NO: 1109663 - RNA, 19 nt, Homo sapiens
gcacacaaaacuugauauu

SEQ ID NO: 1109664 - RNA, 19 nt, Homo sapiens
ccaaacccacguuaacaug

SEQ ID NO: 1109665 - RNA, 19 nt, Homo sapiens
gaccaaacccacguuaaca

SEQ ID NO: 1109666 - RNA, 19 nt, Homo sapiens
ggcagcaguuccagucugu

SEQ ID NO: 1109667 - RNA, 19 nt, Homo sapiens
uaacauggagagagagcaa

SEQ ID NO: 1109668 - RNA, 19 nt, Homo sapiens
ggucugaaccugucaaucc

SEQ ID NO: 1109669 - RNA, 19 nt, Homo sapiens
ucaaggauagcaggaauau

SEQ ID NO: 1109670 - RNA, 19 nt, Homo sapiens
cagaaaagguggagcagau

SEQ ID NO: 1109671 - RNA, 19 nt, Homo sapiens
gaaaaugcugccuucguaa

SEQ ID NO: 1109672 - RNA, 19 nt, Homo sapiens
ggaagcuucuuuggaucug

SEQ ID NO: 1109673 - RNA, 19 nt, Homo sapiens
ugacucucauccuuccaaa

SEQ ID NO: 1109674 - RNA, 19 nt, Homo sapiens
uaacaaccagugugacuac

SEQ ID NO: 1109675 - RNA, 19 nt, Homo sapiens
gaauggaugcucugcuuuu

SEQ ID NO: 1109676 - RNA, 19 nt, Homo sapiens
gcaacuuuaugugguacug

SEQ ID NO: 1109677 - RNA, 19 nt, Homo sapiens
gauagagccaggagagaag

SEQ ID NO: 1109678 - RNA, 19 nt, Homo sapiens
aaagagaacugcauucgua

SEQ ID NO: 1109679 - RNA, 19 nt, Homo sapiens
gcagaggccuucaagcaaa

SEQ ID NO: 1109680 - RNA, 19 nt, Homo sapiens
gaggauagcaggaauauga

SEQ ID NO: 1109681 - RNA, 19 nt, Homo sapiens
gaagacgaaauccguauua

SEQ ID NO: 1109682 - RNA, 19 nt, Homo sapiens
gacauuuccucaaucuuua

SEQ ID NO: 1109683 - RNA, 19 nt, Homo sapiens
ugaaggaugucaguuauaa

SEQ ID NO: 1109684 - RNA, 19 nt, Homo sapiens
gauauaauccugaaucgaa

SEQ ID NO: 1109685 - RNA, 19 nt, Homo sapiens
gacaaggcauggcuaauga

SEQ ID NO: 1109686 - RNA, 19 nt, Homo sapiens
gaacugcauucguagcauu

SEQ ID NO: 1109687 - RNA, 19 nt, Homo sapiens
gcaaguacuuugaggauag

SEQ ID NO: 1109688 - RNA, 19 nt, Homo sapiens
gaagagcuauggcuagaag

SEQ ID NO: 1109689 - RNA, 19 nt, Homo sapiens
ggaugucaguuauaagauu

SEQ ID NO: 1109690 - RNA, 19 nt, Homo sapiens
uccagaagaucacgaauaa

SEQ ID NO: 1109691 - RNA, 19 nt, Homo sapiens
aagaggagcugucauuaug

SEQ ID NO: 1109692 - RNA, 19 nt, Homo sapiens
ucccugagcuguugucuuu

SEQ ID NO: 1109693 - RNA, 19 nt, Homo sapiens
ccacaaggaccaacaacua

SEQ ID NO: 1109694 - RNA, 19 nt, Homo sapiens
ggagauaccagucagcauu

SEQ ID NO: 1109695 - RNA, 19 nt, Homo sapiens
guucacauccucuuuguuu

SEQ ID NO: 1109696 - RNA, 19 nt, Homo sapiens
gaagaucacgaauaagaga

SEQ ID NO: 1109697 - RNA, 19 nt, Homo sapiens
cagaagaucacgaauaaga

SEQ ID NO: 1109698 - RNA, 19 nt, Homo sapiens
aaacacagcaucucuucua

SEQ ID NO: 1109699 - RNA, 19 nt, Homo sapiens
ugacauaaccacccaaaga

SEQ ID NO: 1109700 - RNA, 19 nt, Homo sapiens
gaacaaacgguacaauguc

SEQ ID NO: 1109701 - RNA, 19 nt, Homo sapiens
agaaugaaauggcauagug

SEQ ID NO: 1109702 - RNA, 19 nt, Homo sapiens
ugacauuuccucaaucuuu

SEQ ID NO: 1109703 - RNA, 19 nt, Homo sapiens
ggaaguuucucaaucugau

SEQ ID NO: 1109704 - RNA, 19 nt, Homo sapiens
ggcccuaacugaggaauuu

SEQ ID NO: 1109705 - RNA, 19 nt, Homo sapiens
cacaauuccuuacgggaua

SEQ ID NO: 1109706 - RNA, 19 nt, Homo sapiens
acaaggaacugguuuaagg

SEQ ID NO: 1109707 - RNA, 19 nt, Homo sapiens
gaugagggauguccacaag

SEQ ID NO: 1109708 - RNA, 19 nt, Homo sapiens
gcucuacucuaaagaagug

SEQ ID NO: 1109709 - RNA, 19 nt, Homo sapiens
cuaggcagcuugaguugaa

SEQ ID NO: 1109710 - RNA, 19 nt, Homo sapiens
gaaauuucccugagcuguu

SEQ ID NO: 1109711 - RNA, 19 nt, Homo sapiens
gaaauggcauagugaagac

SEQ ID NO: 1109712 - RNA, 19 nt, Homo sapiens
ugacagcucugagacaaug

SEQ ID NO: 1109713 - RNA, 19 nt, Homo sapiens
ccuacucugugaagaauaa

SEQ ID NO: 1109714 - RNA, 19 nt, Homo sapiens
ggaguucuuuccgggauaa

SEQ ID NO: 1109715 - RNA, 19 nt, Homo sapiens
ggacaaagcaacaacaaaa

SEQ ID NO: 1109716 - RNA, 19 nt, Homo sapiens
gaucugagacccuaaagca

SEQ ID NO: 1109717 - RNA, 19 nt, Homo sapiens
agagaaggcucccaaaguc

SEQ ID NO: 1109718 - RNA, 19 nt, Homo sapiens
cagaucaccugaauuugug

SEQ ID NO: 1109719 - RNA, 19 nt, Homo sapiens
gcccuccgaugucuucuuu

SEQ ID NO: 1109720 - RNA, 19 nt, Homo sapiens
aaacuggaguggucucaga

SEQ ID NO: 1109721 - RNA, 19 nt, Homo sapiens
gcuguugucuuugaacuug

SEQ ID NO: 1109722 - RNA, 19 nt, Homo sapiens
aggcauggcuaaugaauuc

SEQ ID NO: 1109723 - RNA, 19 nt, Homo sapiens
aaaaugugcucuacucuaa

SEQ ID NO: 1109724 - RNA, 19 nt, Homo sapiens
gcuggaaguuucucaaucu

SEQ ID NO: 1109725 - RNA, 19 nt, Homo sapiens
caagaaagagaacugcauu

SEQ ID NO: 1109726 - RNA, 19 nt, Homo sapiens
ggauggccuuucugacauu

SEQ ID NO: 1109727 - RNA, 19 nt, Homo sapiens
gaacacacaggauggauac

SEQ ID NO: 1109728 - RNA, 19 nt, Homo sapiens
caacuaagacacacuccuu

SEQ ID NO: 1109729 - RNA, 19 nt, Homo sapiens
caagaggagcugucauuau

SEQ ID NO: 1109730 - RNA, 19 nt, Homo sapiens
gagauaccagucagcauuu

SEQ ID NO: 1109731 - RNA, 19 nt, Homo sapiens
gagacuaugcugaguguga

SEQ ID NO: 1109732 - RNA, 19 nt, Homo sapiens
ggaagccaacguuaacuug

SEQ ID NO: 1109733 - RNA, 19 nt, Homo sapiens
cauugaaggaugucaguua

SEQ ID NO: 1109734 - RNA, 19 nt, Homo sapiens
gaaugaaauggcauaguga

SEQ ID NO: 1109735 - RNA, 19 nt, Homo sapiens
ugagggauguccacaagga

SEQ ID NO: 1109736 - RNA, 19 nt, Homo sapiens
uaaagaagugugggacaua

SEQ ID NO: 1109737 - RNA, 19 nt, Homo sapiens
ccaccaaggcccuaacuga

SEQ ID NO: 1109738 - RNA, 19 nt, Homo sapiens
gaaagaaaggugggaguuc

SEQ ID NO: 1109739 - RNA, 19 nt, Homo sapiens
ccacagcccugacacuuuu

SEQ ID NO: 1109740 - RNA, 19 nt, Homo sapiens
ccaggacgcuucauugcau

SEQ ID NO: 1109741 - RNA, 19 nt, Homo sapiens
gaacaucaccaagaaagag

SEQ ID NO: 1109742 - RNA, 19 nt, Homo sapiens
gaccaggaagccaacguua

SEQ ID NO: 1109743 - RNA, 19 nt, Homo sapiens
gacaaugaguggaacuaca

SEQ ID NO: 1109744 - RNA, 19 nt, Homo sapiens
gauggccuuucugacauua

SEQ ID NO: 1109745 - RNA, 19 nt, Homo sapiens
gauggaagcguggagauga

SEQ ID NO: 1109746 - RNA, 19 nt, Homo sapiens
gccgugacauugauauaau

SEQ ID NO: 1109747 - RNA, 19 nt, Homo sapiens
caggauggauacacaagga

SEQ ID NO: 1109748 - RNA, 19 nt, Homo sapiens
gaaaaccuccggagagaaa

SEQ ID NO: 1109749 - RNA, 19 nt, Homo sapiens
cggaaaggaugcucugcuu

SEQ ID NO: 1109750 - RNA, 19 nt, Homo sapiens
ccugagcuguugucuuuga

SEQ ID NO: 1109751 - RNA, 19 nt, Homo sapiens
ggacauacagaacugaagu

SEQ ID NO: 1109752 - RNA, 19 nt, Homo sapiens
ccaaguucguucugugaga

SEQ ID NO: 1109753 - RNA, 19 nt, Homo sapiens
ccacucaugaucaccauuu

SEQ ID NO: 1109754 - RNA, 19 nt, Homo sapiens
cugagacccuaaagcauuu

SEQ ID NO: 1109755 - RNA, 19 nt, Homo sapiens
ugcuaaagcugaccaugaa

SEQ ID NO: 1109756 - RNA, 19 nt, Homo sapiens
cacaaggaccaacaacuaa

SEQ ID NO: 1109757 - RNA, 19 nt, Homo sapiens
cagcuugaguugaaguaga

SEQ ID NO: 1109758 - RNA, 19 nt, Homo sapiens
gaccaguccgccuauguaa

SEQ ID NO: 1109759 - RNA, 19 nt, Homo sapiens
gacccugaaucucuccaaa

SEQ ID NO: 1109760 - RNA, 19 nt, Homo sapiens
ucaccugaauuuguggaua

SEQ ID NO: 1109761 - RNA, 19 nt, Homo sapiens
ugaacaaacgguacaaugu

SEQ ID NO: 1109762 - RNA, 19 nt, Homo sapiens
ugaaauggcauagugaaga

SEQ ID NO: 1109763 - RNA, 19 nt, Homo sapiens
caaaaccacuggacuagau

SEQ ID NO: 1109764 - RNA, 19 nt, Homo sapiens
aauaaagagugacguuaca

SEQ ID NO: 1109765 - RNA, 19 nt, Homo sapiens
ucaagcaaaucuccuaaaa

SEQ ID NO: 1109766 - RNA, 19 nt, Homo sapiens
ugacaaggcauggcuaaug

SEQ ID NO: 1109767 - RNA, 19 nt, Homo sapiens
gaacugguuuaaggucaca

SEQ ID NO: 1109768 - RNA, 19 nt, Homo sapiens
gacgaaauccguauuacca

SEQ ID NO: 1109769 - RNA, 19 nt, Homo sapiens
gcugacauuuccucaaucu

SEQ ID NO: 1109770 - RNA, 19 nt, Homo sapiens
uggcagaacugggcuggaa

SEQ ID NO: 1109771 - RNA, 19 nt, Homo sapiens
uccagaacaucaccaagaa

SEQ ID NO: 1109772 - RNA, 19 nt, Homo sapiens
aaauuucccugagcuguug

SEQ ID NO: 1109773 - RNA, 19 nt, Homo sapiens
gggaguucuuuccgggaua

SEQ ID NO: 1109774 - RNA, 19 nt, Homo sapiens
ggaggccucauucucauug

SEQ ID NO: 1109775 - RNA, 19 nt, Homo sapiens
gaacugcugaggcgcacaa

SEQ ID NO: 1109776 - RNA, 19 nt, Homo sapiens
gcauuuaguccugcaauuc

SEQ ID NO: 1109777 - RNA, 19 nt, Homo sapiens
aaugaaacccugcaaggaa

SEQ ID NO: 1109778 - RNA, 19 nt, Homo sapiens
gcagaggccuucaagcaaa

SEQ ID NO: 1109779 - RNA, 19 nt, Homo sapiens
gaggauagcaggaauauga

SEQ ID NO: 1109780 - RNA, 19 nt, Homo sapiens
gaagacgaaauccguauua

SEQ ID NO: 1109781 - RNA, 19 nt, Homo sapiens
gacauuuccucaaucuuua

SEQ ID NO: 1109782 - RNA, 19 nt, Homo sapiens
ugaaggaugucaguuauaa

SEQ ID NO: 1109783 - RNA, 19 nt, Homo sapiens
gauauaauccugaaucgaa

SEQ ID NO: 1109784 - RNA, 19 nt, Homo sapiens
gacaaggcauggcuaauga

SEQ ID NO: 1109785 - RNA, 19 nt, Homo sapiens
gcaaguacuuugaggauag

SEQ ID NO: 1109786 - RNA, 19 nt, Homo sapiens
gaagagcuauggcuagaag

SEQ ID NO: 1109787 - RNA, 19 nt, Homo sapiens
ggaugucaguuauaagauu

SEQ ID NO: 1109788 - RNA, 19 nt, Homo sapiens
aagaggagcugucauuaug

SEQ ID NO: 1109789 - RNA, 19 nt, Homo sapiens
ucccugagcuguugucuuu

SEQ ID NO: 1109790 - RNA, 19 nt, Homo sapiens
ccacaaggaccaacaacua

SEQ ID NO: 1109791 - RNA, 19 nt, Homo sapiens
ggagauaccagucagcauu

SEQ ID NO: 1109792 - RNA, 19 nt, Homo sapiens
ccaagucuucuuccaauua

SEQ ID NO: 1109793 - RNA, 19 nt, Homo sapiens
guucacauccucuuuguuu

SEQ ID NO: 1109794 - RNA, 19 nt, Homo sapiens
ugacauaaccacccaaaga

SEQ ID NO: 1109795 - RNA, 19 nt, Homo sapiens
gaacaaacgguacaauguc

SEQ ID NO: 1109796 - RNA, 19 nt, Homo sapiens
agaaugaaauggcauagug

SEQ ID NO: 1109797 - RNA, 19 nt, Homo sapiens
ugacauuuccucaaucuuu

SEQ ID NO: 1109798 - RNA, 19 nt, Homo sapiens
cacaauuccuuacgggaua

SEQ ID NO: 1109799 - RNA, 19 nt, Homo sapiens
acaaggaacugguuuaagg

SEQ ID NO: 1109800 - RNA, 19 nt, Homo sapiens
gaugagggauguccacaag

SEQ ID NO: 1109801 - RNA, 19 nt, Homo sapiens
gcucuacucuaaagaagug

SEQ ID NO: 1109802 - RNA, 19 nt, Homo sapiens
gaaauuucccugagcuguu

SEQ ID NO: 1109803 - RNA, 19 nt, Homo sapiens
gaaauggcauagugaagac

SEQ ID NO: 1109804 - RNA, 19 nt, Homo sapiens
ugacagcucugagacaaug

SEQ ID NO: 1109805 - RNA, 19 nt, Homo sapiens
ccuacucugugaagaauaa

SEQ ID NO: 1109806 - RNA, 19 nt, Homo sapiens
ggaguucuuuccgggauaa

SEQ ID NO: 1109807 - RNA, 19 nt, Homo sapiens
ggacaaagcaacaacaaaa

SEQ ID NO: 1109808 - RNA, 19 nt, Homo sapiens
gaucugagacccuaaagca

SEQ ID NO: 1109809 - RNA, 19 nt, Homo sapiens
agagaaggcucccaaaguc

SEQ ID NO: 1109810 - RNA, 19 nt, Homo sapiens
gcccuccgaugucuucuuu

SEQ ID NO: 1109811 - RNA, 19 nt, Homo sapiens
aaacuggaguggucucaga

SEQ ID NO: 1109812 - RNA, 19 nt, Homo sapiens
gcuguugucuuugaacuug

SEQ ID NO: 1109813 - RNA, 19 nt, Homo sapiens
aggcauggcuaaugaauuc

SEQ ID NO: 1109814 - RNA, 19 nt, Homo sapiens
aaaaugugcucuacucuaa

SEQ ID NO: 1109815 - RNA, 19 nt, Homo sapiens
ggauggccuuucugacauu

SEQ ID NO: 1109816 - RNA, 19 nt, Homo sapiens
gaacacacaggauggauac

SEQ ID NO: 1109817 - RNA, 19 nt, Homo sapiens
caacuaagacacacuccuu

SEQ ID NO: 1109818 - RNA, 19 nt, Homo sapiens
caagaggagcugucauuau

SEQ ID NO: 1109819 - RNA, 19 nt, Homo sapiens
gagauaccagucagcauuu

SEQ ID NO: 1109820 - RNA, 19 nt, Homo sapiens
ggaagccaacguuaacuug

SEQ ID NO: 1109821 - RNA, 19 nt, Homo sapiens
cauugaaggaugucaguua

SEQ ID NO: 1109822 - RNA, 19 nt, Homo sapiens
gaaugaaauggcauaguga

SEQ ID NO: 1109823 - RNA, 19 nt, Homo sapiens
ugagggauguccacaagga

SEQ ID NO: 1109824 - RNA, 19 nt, Homo sapiens
uaaagaagugugggacaua

SEQ ID NO: 1109825 - RNA, 19 nt, Homo sapiens
ccaggacgcuucauugcau

SEQ ID NO: 1109826 - RNA, 19 nt, Homo sapiens
gaaagaaaggugggaguuc

SEQ ID NO: 1109827 - RNA, 19 nt, Homo sapiens
ccacagcccugacacuuuu

SEQ ID NO: 1109828 - RNA, 19 nt, Homo sapiens
gaccaggaagccaacguua

SEQ ID NO: 1109829 - RNA, 19 nt, Homo sapiens
caagucuucuuccaauuag

SEQ ID NO: 1109830 - RNA, 19 nt, Homo sapiens
gacaaugaguggaacuaca

SEQ ID NO: 1109831 - RNA, 19 nt, Homo sapiens
gauggccuuucugacauua

SEQ ID NO: 1109832 - RNA, 19 nt, Homo sapiens
gauggaagcguggagauga

SEQ ID NO: 1109833 - RNA, 19 nt, Homo sapiens
gccgugacauugauauaau

SEQ ID NO: 1109834 - RNA, 19 nt, Homo sapiens
caggauggauacacaagga

SEQ ID NO: 1109835 - RNA, 19 nt, Homo sapiens
gaaaaccuccggagagaaa

SEQ ID NO: 1109836 - RNA, 19 nt, Homo sapiens
cggaaaggaugcucugcuu

SEQ ID NO: 1109837 - RNA, 19 nt, Homo sapiens
ccugagcuguugucuuuga

SEQ ID NO: 1109838 - RNA, 19 nt, Homo sapiens
ggacauacagaacugaagu

SEQ ID NO: 1109839 - RNA, 19 nt, Homo sapiens
ccaaguucguucugugaga

SEQ ID NO: 1109840 - RNA, 19 nt, Homo sapiens
ccacucaugaucaccauuu

SEQ ID NO: 1109841 - RNA, 19 nt, Homo sapiens
cugagacccuaaagcauuu

SEQ ID NO: 1109842 - RNA, 19 nt, Homo sapiens
ugcuaaagcugaccaugaa

SEQ ID NO: 1109843 - RNA, 19 nt, Homo sapiens
cacaaggaccaacaacuaa

SEQ ID NO: 1109844 - RNA, 19 nt, Homo sapiens
gaccaguccgccuauguaa

SEQ ID NO: 1109845 - RNA, 19 nt, Homo sapiens
gacccugaaucucuccaaa

SEQ ID NO: 1109846 - RNA, 19 nt, Homo sapiens
ugaacaaacgguacaaugu

SEQ ID NO: 1109847 - RNA, 19 nt, Homo sapiens
ugaaauggcauagugaaga

SEQ ID NO: 1109848 - RNA, 19 nt, Homo sapiens
aauaaagagugacguuaca

SEQ ID NO: 1109849 - RNA, 19 nt, Homo sapiens
ucaagcaaaucuccuaaaa

SEQ ID NO: 1109850 - RNA, 19 nt, Homo sapiens
ugacaaggcauggcuaaug

SEQ ID NO: 1109851 - RNA, 19 nt, Homo sapiens
gaacugguuuaaggucaca

SEQ ID NO: 1109852 - RNA, 19 nt, Homo sapiens
gacgaaauccguauuacca

SEQ ID NO: 1109853 - RNA, 19 nt, Homo sapiens
gcugacauuuccucaaucu

SEQ ID NO: 1109854 - RNA, 19 nt, Homo sapiens
aaauuucccugagcuguug

SEQ ID NO: 1109855 - RNA, 19 nt, Homo sapiens
gggaguucuuuccgggaua

SEQ ID NO: 1109856 - RNA, 19 nt, Homo sapiens
gaacugcugaggcgcacaa

SEQ ID NO: 1109857 - RNA, 19 nt, Homo sapiens
gcauuuaguccugcaauuc

SEQ ID NO: 1109858 - RNA, 19 nt, Homo sapiens
aaugaaacccugcaaggaa

SEQ ID NO: 1109859 - RNA, 19 nt, Homo sapiens
ucgaagagcuauggcuaga

SEQ ID NO: 1109860 - RNA, 19 nt, Homo sapiens
cagagaaggcucccaaagu

SEQ ID NO: 1109861 - RNA, 19 nt, Homo sapiens
gaugggccgugacauugau

SEQ ID NO: 1109862 - RNA, 19 nt, Homo sapiens
aaauggagaugcuaaagcu

SEQ ID NO: 1109863 - RNA, 19 nt, Homo sapiens
guucuuuccgggauaauuu

SEQ ID NO: 1109864 - RNA, 19 nt, Homo sapiens
ccacguggagaaauagaaa

SEQ ID NO: 1109865 - RNA, 19 nt, Homo sapiens
caaggaccaacaacuaaga

SEQ ID NO: 1109866 - RNA, 19 nt, Homo sapiens
acaagaggagcugucauua

SEQ ID NO: 1109867 - RNA, 19 nt, Homo sapiens
aggaaauggugcaggcuuu

SEQ ID NO: 1109868 - RNA, 19 nt, Homo sapiens
acccggaccuucauugcua

SEQ ID NO: 1109869 - RNA, 19 nt, Homo sapiens
ggaaguggaaggacagucu

SEQ ID NO: 1109870 - RNA, 19 nt, Homo sapiens
ggauagcaggaauaugaaa

SEQ ID NO: 1109871 - RNA, 19 nt, Homo sapiens
ggucuucauuucuccuuag

SEQ ID NO: 1109872 - RNA, 19 nt, Homo sapiens
augaaacccugcaaggaaa

SEQ ID NO: 1109873 - RNA, 19 nt, Homo sapiens
gagaaggcucccaaaguca

SEQ ID NO: 1109874 - RNA, 19 nt, Homo sapiens
cuacugcgcccuacucugu

SEQ ID NO: 1109875 - RNA, 19 nt, Homo sapiens
gaaguguagcucccagguu

SEQ ID NO: 1109876 - RNA, 19 nt, Homo sapiens
acacaaggaacugguuuaa

SEQ ID NO: 1109877 - RNA, 19 nt, Homo sapiens
cauaauaaagagugacguu

SEQ ID NO: 1109878 - RNA, 19 nt, Homo sapiens
uaucgcagcuucaugauug

SEQ ID NO: 1109879 - RNA, 19 nt, Homo sapiens
aagaagaacucaauuccaa

SEQ ID NO: 1109880 - RNA, 19 nt, Homo sapiens
ccaacgagcgagcagcuua

SEQ ID NO: 1109881 - RNA, 19 nt, Homo sapiens
ggaaggacacagacccaaa

SEQ ID NO: 1109882 - RNA, 19 nt, Homo sapiens
cgccaaggaugcagagaaa

SEQ ID NO: 1109883 - RNA, 19 nt, Homo sapiens
cgggcgagcugcugaaguu

SEQ ID NO: 1109884 - RNA, 19 nt, Homo sapiens
gaucuugaaugcggacaau

SEQ ID NO: 1109885 - RNA, 19 nt, Homo sapiens
cgagcgagcagcuuacuga

SEQ ID NO: 1109886 - RNA, 19 nt, Homo sapiens
ccacaacggccugagauug

SEQ ID NO: 1109887 - RNA, 19 nt, Homo sapiens
gagaagcagaaguaccuuu

SEQ ID NO: 1109888 - RNA, 19 nt, Homo sapiens
gaagacgugguaccagaau

SEQ ID NO: 1109889 - RNA, 19 nt, Homo sapiens
ggcggaagcuacagucucu

SEQ ID NO: 1109890 - RNA, 19 nt, Homo sapiens
uugcgaagacggugacuuu

SEQ ID NO: 1109891 - RNA, 19 nt, Homo sapiens
gcgcgcuucugggcucuaa

SEQ ID NO: 1109892 - RNA, 19 nt, Homo sapiens
aaacgaggaaggacacaga

SEQ ID NO: 1109893 - RNA, 19 nt, Homo sapiens
gaaggacacagacccaaaa

SEQ ID NO: 1109894 - RNA, 19 nt, Homo sapiens
gccuaucgcagcuucauga

SEQ ID NO: 1109895 - RNA, 19 nt, Homo sapiens
gaggaugaaguggaagaaa

SEQ ID NO: 1109896 - RNA, 19 nt, Homo sapiens
gcugaugggccuggagaaa

SEQ ID NO: 1109897 - RNA, 19 nt, Homo sapiens
gcgccaaggaugcagagaa

SEQ ID NO: 1109898 - RNA, 19 nt, Homo sapiens
caagaagaacucaauucca

SEQ ID NO: 1109899 - RNA, 19 nt, Homo sapiens
ggacagaauagaucuugcu

SEQ ID NO: 1109900 - RNA, 19 nt, Homo sapiens
uaccagaaucggaggauga

SEQ ID NO: 1109901 - RNA, 19 nt, Homo sapiens
uggagaaacgcuucgagaa

SEQ ID NO: 1109902 - RNA, 19 nt, Homo sapiens
gaggacugagggcgguaua

SEQ ID NO: 1109903 - RNA, 19 nt, Homo sapiens
ggaggaugaaguggaagaa

SEQ ID NO: 1109904 - RNA, 19 nt, Homo sapiens
cagaaucggaggaugaagu

SEQ ID NO: 1109905 - RNA, 19 nt, Homo sapiens
ccaagaagaacucaauucc

SEQ ID NO: 1109906 - RNA, 19 nt, Homo sapiens
gcccaagaagaacucaauu

SEQ ID NO: 1109907 - RNA, 19 nt, Homo sapiens
ugaagacgugguaccagaa

SEQ ID NO: 1109908 - RNA, 19 nt, Homo sapiens
gcccuuccgcguccaagaa

SEQ ID NO: 1109909 - RNA, 19 nt, Homo sapiens
ugagccaguugcaggugaa

SEQ ID NO: 1109910 - RNA, 19 nt, Homo sapiens
aagcagaaguaccuuucca

SEQ ID NO: 1109911 - RNA, 19 nt, Homo sapiens
ucuugaaugcggacaauug

SEQ ID NO: 1109912 - RNA, 19 nt, Homo sapiens
ggcccaagaagaacucaau

SEQ ID NO: 1109913 - RNA, 19 nt, Homo sapiens
agaagcagaaguaccuuuc

SEQ ID NO: 1109914 - RNA, 19 nt, Homo sapiens
gaacacauccuauuuauug

SEQ ID NO: 1109915 - RNA, 19 nt, Homo sapiens
gaagagaacuacauucaug

SEQ ID NO: 1109916 - RNA, 19 nt, Homo sapiens
gaauagaauugguaaguug

SEQ ID NO: 1109917 - RNA, 19 nt, Homo sapiens
ggauacaacuuacguuuga

SEQ ID NO: 1109918 - RNA, 19 nt, Homo sapiens
uuaaauagaucaccagcua

SEQ ID NO: 1109919 - RNA, 19 nt, Homo sapiens
gaacuaaagagaaccgaua

SEQ ID NO: 1109920 - RNA, 19 nt, Homo sapiens
ggaacuauguugcuaugaa

SEQ ID NO: 1109921 - RNA, 19 nt, Homo sapiens
uggaagaccuuauucgaua

SEQ ID NO: 1109922 - RNA, 19 nt, Homo sapiens
gaacuacauucaugguuug

SEQ ID NO: 1109923 - RNA, 19 nt, Homo sapiens
caacuuacguuugaugaaa

SEQ ID NO: 1109924 - RNA, 19 nt, Homo sapiens
ccagcuaguuucagaguua

SEQ ID NO: 1109925 - RNA, 19 nt, Homo sapiens
gaggagacaucaaacagaa

SEQ ID NO: 1109926 - RNA, 19 nt, Homo sapiens
cauuauaacuguuggcuuu

SEQ ID NO: 1109927 - RNA, 19 nt, Homo sapiens
ggaauagaauugguaaguu

SEQ ID NO: 1109928 - RNA, 19 nt, Homo sapiens
ggccuuaucuucacuuuau

SEQ ID NO: 1109929 - RNA, 19 nt, Homo sapiens
gaacuauguugcuaugaau

SEQ ID NO: 1109930 - RNA, 19 nt, Homo sapiens
ccacuggaccugcuuaaua

SEQ ID NO: 1109931 - RNA, 19 nt, Homo sapiens
gaaaguagacauucagauc

SEQ ID NO: 1109932 - RNA, 19 nt, Homo sapiens
uaacagaggagguaagauu

SEQ ID NO: 1109933 - RNA, 19 nt, Homo sapiens
gggagucgcugcuuccaaa

SEQ ID NO: 1109934 - RNA, 19 nt, Homo sapiens
ucacauauguaaaccagaa

SEQ ID NO: 1109935 - RNA, 19 nt, Homo sapiens
caagguuuccucauacuua

SEQ ID NO: 1109936 - RNA, 19 nt, Homo sapiens
cagcaugagagaauuauua

SEQ ID NO: 1109937 - RNA, 19 nt, Homo sapiens
cagaggagguaagauuaua

SEQ ID NO: 1109938 - RNA, 19 nt, Homo sapiens
gaauccaaccugaguagua

SEQ ID NO: 1109939 - RNA, 19 nt, Homo sapiens
cacuggaccugcuuaauaa

SEQ ID NO: 1109940 - RNA, 19 nt, Homo sapiens
ugaaagaggagacaucaaa

SEQ ID NO: 1109941 - RNA, 19 nt, Homo sapiens
ggaagaccuuauucgauau

SEQ ID NO: 1109942 - RNA, 19 nt, Homo sapiens
guaugucucuuaaccaguu

SEQ ID NO: 1109943 - RNA, 19 nt, Homo sapiens
acagaaguaugucucuuaa

SEQ ID NO: 1109944 - RNA, 19 nt, Homo sapiens
agaacuacauucaugguuu

SEQ ID NO: 1109945 - RNA, 19 nt, Homo sapiens
aaagagaaccgauaccauu

SEQ ID NO: 1109946 - RNA, 19 nt, Homo sapiens
gaggaacaaagaugauaua

SEQ ID NO: 1109947 - RNA, 19 nt, Homo sapiens
cuagcuggguucuguauuu

SEQ ID NO: 1109948 - RNA, 19 nt, Homo sapiens
gggaagaacuaaagagaac

SEQ ID NO: 1109949 - RNA, 19 nt, Homo sapiens
gaagaugacauaugcaagu

SEQ ID NO: 1109950 - RNA, 19 nt, Homo sapiens
gaaacuacccugcgauucu

SEQ ID NO: 1109951 - RNA, 19 nt, Homo sapiens
gauuuacagugcauucuga

SEQ ID NO: 1109952 - RNA, 19 nt, Homo sapiens
gcagugcaguggcugauuc

SEQ ID NO: 1109953 - RNA, 19 nt, Homo sapiens
gaacagaacggaguacaag

SEQ ID NO: 1109954 - RNA, 19 nt, Homo sapiens
ggagacaucaaacagaauu

SEQ ID NO: 1109955 - RNA, 19 nt, Homo sapiens
ccucguaacuucucagugu

SEQ ID NO: 1109956 - RNA, 19 nt, Homo sapiens
caaccugaguaguaaauuc

SEQ ID NO: 1109957 - RNA, 19 nt, Homo sapiens
gggauuauguggaaacuac

SEQ ID NO: 1109958 - RNA, 19 nt, Homo sapiens
ugcguuaucuccauccuua

SEQ ID NO: 1109959 - RNA, 19 nt, Homo sapiens
cuuggcagcuuccugauaa

SEQ ID NO: 1109960 - RNA, 19 nt, Homo sapiens
ucuauuggcagcuuuguua

SEQ ID NO: 1109961 - RNA, 19 nt, Homo sapiens
caaacagaauuaggaguug

SEQ ID NO: 1109962 - RNA, 19 nt, Homo sapiens
gauggcaguuggacuuaga

SEQ ID NO: 1109963 - RNA, 19 nt, Homo sapiens
gcaguuggacuuagaagau

SEQ ID NO: 1109964 - RNA, 19 nt, Homo sapiens
guuauguggugacuauuug

SEQ ID NO: 1109965 - RNA, 19 nt, Homo sapiens
aaacauaaagcaccuugaa

SEQ ID NO: 1109966 - RNA, 19 nt, Homo sapiens
uagguuauguggugacuau

SEQ ID NO: 1109967 - RNA, 19 nt, Homo sapiens
uuaaccaguucacuuauug

SEQ ID NO: 1109968 - RNA, 19 nt, Homo sapiens
gauaggacagacuggauuu

SEQ ID NO: 1109969 - RNA, 19 nt, Homo sapiens
ccuuucaucuucaggauuu

SEQ ID NO: 1109970 - RNA, 19 nt, Homo sapiens
gcaguggcugauucuauua

SEQ ID NO: 1109971 - RNA, 19 nt, Homo sapiens
gcuauaacugccuuuagua

SEQ ID NO: 1109972 - RNA, 19 nt, Homo sapiens
ugaaagauuugggcuugaa

SEQ ID NO: 1109973 - RNA, 19 nt, Homo sapiens
ccucauacuuauccaagaa

SEQ ID NO: 1109974 - RNA, 19 nt, Homo sapiens
uacaagauccucagcauga

SEQ ID NO: 1109975 - RNA, 19 nt, Homo sapiens
aauccaaccugaguaguaa

SEQ ID NO: 1109976 - RNA, 19 nt, Homo sapiens
gagauaaaccugaaaagaa

SEQ ID NO: 1109977 - RNA, 19 nt, Homo sapiens
gagaaaaggucuucaaucg

SEQ ID NO: 1109978 - RNA, 19 nt, Homo sapiens
gaucugaaccuucuaacag

SEQ ID NO: 1109979 - RNA, 19 nt, Homo sapiens
ggacucaggcggaauccaa

SEQ ID NO: 1109980 - RNA, 19 nt, Homo sapiens
uggaagagauaaaccugaa

SEQ ID NO: 1109981 - RNA, 19 nt, Homo sapiens
cuacauucaugguuuggaa

SEQ ID NO: 1109982 - RNA, 19 nt, Homo sapiens
gguaaugucaguacaggaa

SEQ ID NO: 1109983 - RNA, 19 nt, Homo sapiens
gaguuaccauguacguauu

SEQ ID NO: 1109984 - RNA, 19 nt, Homo sapiens
gcaaugaaugucaaugugu

SEQ ID NO: 1109985 - RNA, 19 nt, Homo sapiens
ggaacacauccuauuuauu

SEQ ID NO: 1109986 - RNA, 19 nt, Homo sapiens
gaagaagagaacuacauuc

SEQ ID NO: 1109987 - RNA, 19 nt, Homo sapiens
ucaaacagaauuaggaguu

SEQ ID NO: 1109988 - RNA, 19 nt, Homo sapiens
gcucaggauuuguuuaaac

SEQ ID NO: 1109989 - RNA, 19 nt, Homo sapiens
guacagaaguaugucucuu

SEQ ID NO: 1109990 - RNA, 19 nt, Homo sapiens
ggugcuagaguuagauuaa

SEQ ID NO: 1109991 - RNA, 19 nt, Homo sapiens
aaagaagaguggccuuauc

SEQ ID NO: 1109992 - RNA, 19 nt, Homo sapiens
gaaaagaagaguggccuua

SEQ ID NO: 1109993 - RNA, 19 nt, Homo sapiens
gcuaugaauuaaacuugug

SEQ ID NO: 1109994 - RNA, 19 nt, Homo sapiens
gcagcuuuguuauugauca

SEQ ID NO: 1109995 - RNA, 19 nt, Homo sapiens
gaccuuauucgauaucuug

SEQ ID NO: 1109996 - RNA, 19 nt, Homo sapiens
ccacagcucaggauuuguu

SEQ ID NO: 1109997 - RNA, 19 nt, Homo sapiens
ggagauuaguagcaguaga

SEQ ID NO: 1109998 - RNA, 19 nt, Homo sapiens
cagcucaggauuuguuuaa

SEQ ID NO: 1109999 - RNA, 19 nt, Homo sapiens
ggccuaaaaucguauaaaa

SEQ ID NO: 1110000 - RNA, 19 nt, Homo sapiens
ccauguacguauuccacua

SEQ ID NO: 1110001 - RNA, 19 nt, Homo sapiens
aagaugacauaugcaagua

SEQ ID NO: 1110002 - RNA, 19 nt, Homo sapiens
uaauaucgugccuagguua

SEQ ID NO: 1110003 - RNA, 19 nt, Homo sapiens
uacagaaguaugucucuua

SEQ ID NO: 1110004 - RNA, 19 nt, Homo sapiens
uaucuuccauuccuguuau

SEQ ID NO: 1110005 - RNA, 19 nt, Homo sapiens
uaucauaucuuccauuccu

SEQ ID NO: 1110006 - RNA, 19 nt, Homo sapiens
uggaugggauuauguggaa

SEQ ID NO: 1110007 - RNA, 19 nt, Homo sapiens
gagauggcaguuggacuua

SEQ ID NO: 1110008 - RNA, 19 nt, Homo sapiens
uuagggcgcuggugugguu

SEQ ID NO: 1110009 - RNA, 19 nt, Homo sapiens
gcgggcaacccuugaguuu

SEQ ID NO: 1110010 - RNA, 19 nt, Homo sapiens
guauggugcuagaguuaga

SEQ ID NO: 1110011 - RNA, 19 nt, Homo sapiens
ggucuucaaucguggaaag

SEQ ID NO: 1110012 - RNA, 19 nt, Homo sapiens
ugcaguggcugauucuauu

SEQ ID NO: 1110013 - RNA, 19 nt, Homo sapiens
uaacuucucaguguccaua

SEQ ID NO: 1110014 - RNA, 19 nt, Homo sapiens
gagaagaccuggcggauaa

SEQ ID NO: 1110015 - RNA, 19 nt, Homo sapiens
gaagcaagcucgucauuga

SEQ ID NO: 1110016 - RNA, 19 nt, Homo sapiens
gauagccgaugucuuauua

SEQ ID NO: 1110017 - RNA, 19 nt, Homo sapiens
uuagauagccgaugucuua

SEQ ID NO: 1110018 - RNA, 19 nt, Homo sapiens
gcggauaacuggcacauca

SEQ ID NO: 1110019 - RNA, 19 nt, Homo sapiens
ugacagaacuucagagucu

SEQ ID NO: 1110020 - RNA, 19 nt, Homo sapiens
gccagaagcugaaaugaca

SEQ ID NO: 1110021 - RNA, 19 nt, Homo sapiens
gaacaacagaauucagauu

SEQ ID NO: 1110022 - RNA, 19 nt, Homo sapiens
gaugagcucuugcagaaca

SEQ ID NO: 1110023 - RNA, 19 nt, Homo sapiens
gcccgcaucuuucuuuaaa

SEQ ID NO: 1110024 - RNA, 19 nt, Homo sapiens
gaacaacugacucuugaug

SEQ ID NO: 1110025 - RNA, 19 nt, Homo sapiens
gaaccuguguguuaccaau

SEQ ID NO: 1110026 - RNA, 19 nt, Homo sapiens
caccugaaccuguguguua

SEQ ID NO: 1110027 - RNA, 19 nt, Homo sapiens
uacaugagcuggugaaaca

SEQ ID NO: 1110028 - RNA, 19 nt, Homo sapiens
ggacagaggacgaagacuu

SEQ ID NO: 1110029 - RNA, 19 nt, Homo sapiens
gcagugggcuuggcuuugu

SEQ ID NO: 1110030 - RNA, 19 nt, Homo sapiens
caacagaauucagauugug

SEQ ID NO: 1110031 - RNA, 19 nt, Homo sapiens
gcacccacacgcuuagaua

SEQ ID NO: 1110032 - RNA, 19 nt, Homo sapiens
ggacugugcucccuuuggu

SEQ ID NO: 1110033 - RNA, 19 nt, Homo sapiens
ugaaaugacagcaguggua

SEQ ID NO: 1110034 - RNA, 19 nt, Homo sapiens
guacggagucaaaguugua

SEQ ID NO: 1110035 - RNA, 19 nt, Homo sapiens
gcguauuacuguucuguga

SEQ ID NO: 1110036 - RNA, 19 nt, Homo sapiens
gacacaaccuuccuucucu

SEQ ID NO: 1110037 - RNA, 19 nt, Homo sapiens
augaugagcucuugcagaa

SEQ ID NO: 1110038 - RNA, 19 nt, Homo sapiens
ggagccaggugccuauauc

SEQ ID NO: 1110039 - RNA, 19 nt, Homo sapiens
ggacacaaccuuccuucuc

SEQ ID NO: 1110040 - RNA, 19 nt, Homo sapiens
uauccgcuuucccauauaa

SEQ ID NO: 1110041 - RNA, 19 nt, Homo sapiens
uugaacaacugacucuuga

SEQ ID NO: 1110042 - RNA, 19 nt, Homo sapiens
uagccgaugucuuauuaga

SEQ ID NO: 1110043 - RNA, 19 nt, Homo sapiens
uuucaugucugauuuaugg

SEQ ID NO: 1110044 - RNA, 19 nt, Homo sapiens
ugaaggugguggacauguu

SEQ ID NO: 1110045 - RNA, 19 nt, Homo sapiens
gccaggugccuauaucuuu

SEQ ID NO: 1110046 - RNA, 19 nt, Homo sapiens
cuaaaccaguuccggaaga

SEQ ID NO: 1110047 - RNA, 19 nt, Homo sapiens
gaaaauggccuggucuuug

SEQ ID NO: 1110048 - RNA, 19 nt, Homo sapiens
ggugaaacaugaagaaaau

SEQ ID NO: 1110049 - RNA, 19 nt, Homo sapiens
cagaacaacagaauucaga

SEQ ID NO: 1110050 - RNA, 19 nt, Homo sapiens
uaaaccaguuccggaagaa

SEQ ID NO: 1110051 - RNA, 19 nt, Homo sapiens
ggccuaugagggaguauua

SEQ ID NO: 1110052 - RNA, 19 nt, Homo sapiens
cgacaagcccgcaucuuuc

SEQ ID NO: 1110053 - RNA, 19 nt, Homo sapiens
ccaaugcuaugcgagaaga

SEQ ID NO: 1110054 - RNA, 19 nt, Homo sapiens
aaaauggccuggucuuuga

SEQ ID NO: 1110055 - RNA, 19 nt, Homo sapiens
ccuaugagggaguauuaua

SEQ ID NO: 1110056 - RNA, 19 nt, Homo sapiens
ggaagcaagcucgucauug

SEQ ID NO: 1110057 - RNA, 19 nt, Homo sapiens
ccaggugccuauaucuuuc

SEQ ID NO: 1110058 - RNA, 19 nt, Homo sapiens
ggaaauuaacauucuccaa

SEQ ID NO: 1110059 - RNA, 19 nt, Homo sapiens
gaaggugguggacauguuc

SEQ ID NO: 1110060 - RNA, 19 nt, Homo sapiens
acaacugacucuugaugga

SEQ ID NO: 1110061 - RNA, 19 nt, Homo sapiens
caagcccgcaucuuucuuu

SEQ ID NO: 1110062 - RNA, 19 nt, Homo sapiens
uuuauccgcuuucccauau

SEQ ID NO: 1110063 - RNA, 19 nt, Homo sapiens
cgagaagaccuggcggaua

SEQ ID NO: 1110064 - RNA, 19 nt, Homo sapiens
gcacaaagaaaaugcuauu

SEQ ID NO: 1110065 - RNA, 19 nt, Homo sapiens
cgggcaagcuaaaccaguu

SEQ ID NO: 1110066 - RNA, 19 nt, Homo sapiens
ccaugaaggugguggacau

SEQ ID NO: 1110067 - RNA, 19 nt, Homo sapiens
gccuggaccugcccaugaa

SEQ ID NO: 1110068 - RNA, 19 nt, Homo sapiens
gcucagcugcagaugcuuu

SEQ ID NO: 1110069 - RNA, 19 nt, Homo sapiens
cagcaccggcucuucauga

SEQ ID NO: 1110070 - RNA, 19 nt, Homo sapiens
acgacaagcccgcaucuuu

SEQ ID NO: 1110071 - RNA, 19 nt, Homo sapiens
gcauugcugucugcugguu

SEQ ID NO: 1110072 - RNA, 19 nt, Homo sapiens
uuugauuccugucuugaaa

SEQ ID NO: 1110073 - RNA, 19 nt, Homo sapiens
ucucucgucugugugauaa

SEQ ID NO: 1110074 - RNA, 19 nt, Homo sapiens
ccaguacggagucaaaguu

SEQ ID NO: 1110075 - RNA, 19 nt, Homo sapiens
uaacauucuccaaacauuc

SEQ ID NO: 1110076 - RNA, 19 nt, Homo sapiens
ccaagugguacgagaaguu

SEQ ID NO: 1110077 - RNA, 19 nt, Homo sapiens
guuugugguuccugauuug

SEQ ID NO: 1110078 - RNA, 19 nt, Homo sapiens
aagcccgcaucuuucuuua

SEQ ID NO: 1110079 - RNA, 19 nt, Homo sapiens
ucagggcugugaccgucua

SEQ ID NO: 1110080 - RNA, 19 nt, Homo sapiens
cuauguacuugcuguggaa

SEQ ID NO: 1110081 - RNA, 19 nt, Homo sapiens
acgcuuagauagccgaugu

SEQ ID NO: 1110082 - RNA, 19 nt, Homo sapiens
ccaggucugccuagcauug

SEQ ID NO: 1110083 - RNA, 19 nt, Homo sapiens
cauacuugauacacacguu

SEQ ID NO: 1110084 - RNA, 19 nt, Homo sapiens
guauuacuguucugugacu

SEQ ID NO: 1110085 - RNA, 19 nt, Homo sapiens
caucaugggucuggugcau

SEQ ID NO: 1110086 - RNA, 19 nt, Homo sapiens
aacaacagaauucagauug

SEQ ID NO: 1110087 - RNA, 19 nt, Homo sapiens
gcuagcguauuacuguucu

SEQ ID NO: 1110088 - RNA, 19 nt, Homo sapiens
acugugcucccuuugguua

SEQ ID NO: 1110089 - RNA, 19 nt, Homo sapiens
gcuggugaaacaugaagaa

SEQ ID NO: 1110090 - RNA, 19 nt, Homo sapiens
gacagaacuucagagucuu

SEQ ID NO: 1110091 - RNA, 19 nt, Homo sapiens
gacaagcccgcaucuuucu

SEQ ID NO: 1110092 - RNA, 19 nt, Homo sapiens
gguuggccuugauuucuuc

SEQ ID NO: 1110093 - RNA, 19 nt, Homo sapiens
cagcuccgaugggaugaga

SEQ ID NO: 1110094 - RNA, 19 nt, Homo sapiens
gauccugcgggcaagcuaa

SEQ ID NO: 1110095 - RNA, 19 nt, Homo sapiens
gagcuggacagaggacgaa

SEQ ID NO: 1110096 - RNA, 19 nt, Homo sapiens
gaaccugaggacccaguca

SEQ ID NO: 1110097 - RNA, 19 nt, Homo sapiens
uaccaaugcuaugcgagaa

SEQ ID NO: 1110098 - RNA, 19 nt, Homo sapiens
cuuccucucuucuucuguu

SEQ ID NO: 1110099 - RNA, 19 nt, Homo sapiens
aaugacagcagugguacua

SEQ ID NO: 1110100 - RNA, 19 nt, Homo sapiens
cuucaaguguuuacaugag

SEQ ID NO: 1110101 - RNA, 19 nt, Homo sapiens
gagggagccaggugccuau

SEQ ID NO: 1110102 - RNA, 19 nt, Homo sapiens
aguuugugguuccugauuu

SEQ ID NO: 1110103 - RNA, 19 nt, Homo sapiens
ugucugauuuauggugauu

SEQ ID NO: 1110104 - RNA, 19 nt, Homo sapiens
uugcagaacaacagaauuc

SEQ ID NO: 1110105 - RNA, 19 nt, Homo sapiens
caagugguacgagaaguuc

SEQ ID NO: 1110106 - RNA, 19 nt, Homo sapiens
cuuauuagagggcaguuug

SEQ ID NO: 1110107 - RNA, 19 nt, Homo sapiens
ccucucuucuucuguucuu

SEQ ID NO: 1110108 - RNA, 19 nt, Homo sapiens
gaaacgcuuccucucuucu

SEQ ID NO: 1110109 - RNA, 19 nt, Homo sapiens
guucgugggcugccuuugu

SEQ ID NO: 1110110 - RNA, 19 nt, Homo sapiens
gcagaacaacagaauucag

SEQ ID NO: 1110111 - RNA, 19 nt, Homo sapiens
ccaguccaaugaaaguuuu

SEQ ID NO: 1110112 - RNA, 19 nt, Homo sapiens
cugcagaacuccucauccu

SEQ ID NO: 1110113 - RNA, 19 nt, Homo sapiens
ccugcuagcguauuacugu

SEQ ID NO: 1110114 - RNA, 19 nt, Homo sapiens
gaacugcucuguugcaaga

SEQ ID NO: 1110115 - RNA, 19 nt, Homo sapiens
ggacacagcuggauucauc

SEQ ID NO: 1110116 - RNA, 19 nt, Homo sapiens
gcucaaaccuuaucaaaca

SEQ ID NO: 1110117 - RNA, 19 nt, Homo sapiens
gcaaaggcacggacuauaa

SEQ ID NO: 1110118 - RNA, 19 nt, Homo sapiens
cagagaagaugcaauggua

SEQ ID NO: 1110119 - RNA, 19 nt, Homo sapiens
caacauuggugcucauuug

SEQ ID NO: 1110120 - RNA, 19 nt, Homo sapiens
ggcaagaacugcucuguug

SEQ ID NO: 1110121 - RNA, 19 nt, Homo sapiens
ggaagaagucauuugauaa

SEQ ID NO: 1110122 - RNA, 19 nt, Homo sapiens
uggaagaagucauuugaua

SEQ ID NO: 1110123 - RNA, 19 nt, Homo sapiens
agucacagcucaaaccuua

SEQ ID NO: 1110124 - RNA, 19 nt, Homo sapiens
ugaguuaucuucuacauuc

SEQ ID NO: 1110125 - RNA, 19 nt, Homo sapiens
gagaagccauguagggaaa

SEQ ID NO: 1110126 - RNA, 19 nt, Homo sapiens
gagggcagguuacaaagaa

SEQ ID NO: 1110127 - RNA, 19 nt, Homo sapiens
agaauccucugaagauaua

SEQ ID NO: 1110128 - RNA, 19 nt, Homo sapiens
ggaagacauugcccagauu

SEQ ID NO: 1110129 - RNA, 19 nt, Homo sapiens
gaaagugauuggaagaagu

SEQ ID NO: 1110130 - RNA, 19 nt, Homo sapiens
uaaauggccuucuggacuu

SEQ ID NO: 1110131 - RNA, 19 nt, Homo sapiens
gguaaggucuucagucaca

SEQ ID NO: 1110132 - RNA, 19 nt, Homo sapiens
ucaagaagcuuccagaaaa

SEQ ID NO: 1110133 - RNA, 19 nt, Homo sapiens
acucaagggucucaaagua

SEQ ID NO: 1110134 - RNA, 19 nt, Homo sapiens
gaggauucauggugauaaa

SEQ ID NO: 1110135 - RNA, 19 nt, Homo sapiens
gaagaagucauuugauaag

SEQ ID NO: 1110136 - RNA, 19 nt, Homo sapiens
ugagaaacccuaugaaugu

SEQ ID NO: 1110137 - RNA, 19 nt, Homo sapiens
gcucugcccuugucauuca

SEQ ID NO: 1110138 - RNA, 19 nt, Homo sapiens
gaaacccuaugaaugugaa

SEQ ID NO: 1110139 - RNA, 19 nt, Homo sapiens
ggaguaggcgacauuauug

SEQ ID NO: 1110140 - RNA, 19 nt, Homo sapiens
gggaguaggcgacauuauu

SEQ ID NO: 1110141 - RNA, 19 nt, Homo sapiens
gggaagacauugcccagau

SEQ ID NO: 1110142 - RNA, 19 nt, Homo sapiens
cuucuggacuuguuaauug

SEQ ID NO: 1110143 - RNA, 19 nt, Homo sapiens
ggagaguggucuggaaguu

SEQ ID NO: 1110144 - RNA, 19 nt, Homo sapiens
gaagucuuauugaacauca

SEQ ID NO: 1110145 - RNA, 19 nt, Homo sapiens
ggagaagcccuaugagugu

SEQ ID NO: 1110146 - RNA, 19 nt, Homo sapiens
cuggagcccuuaaugguua

SEQ ID NO: 1110147 - RNA, 19 nt, Homo sapiens
cgauagaguucuccagguu

SEQ ID NO: 1110148 - RNA, 19 nt, Homo sapiens
guggugaaauacagacuaa

SEQ ID NO: 1110149 - RNA, 19 nt, Homo sapiens
gugguaaggucuucaguca

SEQ ID NO: 1110150 - RNA, 19 nt, Homo sapiens
gagaaacccuaugaaugug

SEQ ID NO: 1110151 - RNA, 19 nt, Homo sapiens
ggagggugcugcagagaag

SEQ ID NO: 1110152 - RNA, 19 nt, Homo sapiens
ggucgcaacuagagugaga

SEQ ID NO: 1110153 - RNA, 19 nt, Homo sapiens
ugagaaacccuaucagugu

SEQ ID NO: 1110154 - RNA, 19 nt, Homo sapiens
gaaagccagugggaaaaua

SEQ ID NO: 1110155 - RNA, 19 nt, Homo sapiens
caagauggcacuauugaca

SEQ ID NO: 1110156 - RNA, 19 nt, Homo sapiens
caucaucggguauuagaaa

SEQ ID NO: 1110157 - RNA, 19 nt, Homo sapiens
aaaggagcaugggaagaua

SEQ ID NO: 1110158 - RNA, 19 nt, Homo sapiens
ucccagcccuuacacgaua

SEQ ID NO: 1110159 - RNA, 19 nt, Homo sapiens
gaugaguuaucuucuacau

SEQ ID NO: 1110160 - RNA, 19 nt, Homo sapiens
gugagaaacccuaugaaug

SEQ ID NO: 1110161 - RNA, 19 nt, Homo sapiens
ggugaaauacagacuaaga

SEQ ID NO: 1110162 - RNA, 19 nt, Homo sapiens
guucucacccaguguauuu

SEQ ID NO: 1110163 - RNA, 19 nt, Homo sapiens
gaccagggcuuuauuuacc

SEQ ID NO: 1110164 - RNA, 19 nt, Homo sapiens
acacggaauagaagucuua

SEQ ID NO: 1110165 - RNA, 19 nt, Homo sapiens
cgagaacucugcggacaau

SEQ ID NO: 1110166 - RNA, 19 nt, Homo sapiens
gcccucagccagcacuuua

SEQ ID NO: 1110167 - RNA, 19 nt, Homo sapiens
gcacggacuauaagagaga

SEQ ID NO: 1110168 - RNA, 19 nt, Homo sapiens
cgacauuauugccaugaau

SEQ ID NO: 1110169 - RNA, 19 nt, Homo sapiens
guugcaagauggcacuauu

SEQ ID NO: 1110170 - RNA, 19 nt, Homo sapiens
guauuuaaauggccuucug

SEQ ID NO: 1110171 - RNA, 19 nt, Homo sapiens
aauccacacuggugagaaa

SEQ ID NO: 1110172 - RNA, 19 nt, Homo sapiens
gaagccauaugagugugaa

SEQ ID NO: 1110173 - RNA, 19 nt, Homo sapiens
aauccacacuggugagaaa

SEQ ID NO: 1110174 - RNA, 19 nt, Homo sapiens
gagcucugcccuugucauu

SEQ ID NO: 1110175 - RNA, 19 nt, Homo sapiens
ggugagaaacccuaugaau

SEQ ID NO: 1110176 - RNA, 19 nt, Homo sapiens
gaagacauugcccagauuc

SEQ ID NO: 1110177 - RNA, 19 nt, Homo sapiens
caucagagaagccauguag

SEQ ID NO: 1110178 - RNA, 19 nt, Homo sapiens
caggagggcagguuacaaa

SEQ ID NO: 1110179 - RNA, 19 nt, Homo sapiens
gggcuuuauuuaccacuau

SEQ ID NO: 1110180 - RNA, 19 nt, Homo sapiens
ucccgugucuuauaaaugu

SEQ ID NO: 1110181 - RNA, 19 nt, Homo sapiens
ccaugaauguggaaagagu

SEQ ID NO: 1110182 - RNA, 19 nt, Homo sapiens
gucaagaagcuuccagaaa

SEQ ID NO: 1110183 - RNA, 19 nt, Homo sapiens
ggaccagggcuuuauuuac

SEQ ID NO: 1110184 - RNA, 19 nt, Homo sapiens
gaggcucccgugucuuaua

SEQ ID NO: 1110185 - RNA, 19 nt, Homo sapiens
cagcucaaaccuuaucaaa

SEQ ID NO: 1110186 - RNA, 19 nt, Homo sapiens
cuaugaaugugaagacugu

SEQ ID NO: 1110187 - RNA, 19 nt, Homo sapiens
ggagggcagguuacaaaga

SEQ ID NO: 1110188 - RNA, 19 nt, Homo sapiens
gauacuuacugugggauuc

SEQ ID NO: 1110189 - RNA, 19 nt, Homo sapiens
cauuggugcucauuuguca

SEQ ID NO: 1110190 - RNA, 19 nt, Homo sapiens
gcucccgugucuuauaaau

SEQ ID NO: 1110191 - RNA, 19 nt, Homo sapiens
gcagccuccuugaacauca

SEQ ID NO: 1110192 - RNA, 19 nt, Homo sapiens
ugugaagacuguggaaaga

SEQ ID NO: 1110193 - RNA, 19 nt, Homo sapiens
agaaguuucacacggaaua

SEQ ID NO: 1110194 - RNA, 19 nt, Homo sapiens
cugaggcucccgugucuua

SEQ ID NO: 1110195 - RNA, 19 nt, Homo sapiens
caaaggcacggacuauaag

SEQ ID NO: 1110196 - RNA, 19 nt, Homo sapiens
gaacaggagggcagguuac

SEQ ID NO: 1110197 - RNA, 19 nt, Homo sapiens
gacauugcccagauuccua

SEQ ID NO: 1110198 - RNA, 19 nt, Homo sapiens
caaacucaagggucucaaa

SEQ ID NO: 1110199 - RNA, 19 nt, Homo sapiens
agaguggucuggaaguugu

SEQ ID NO: 1110200 - RNA, 19 nt, Homo sapiens
ggucagaauggcuagagaa

SEQ ID NO: 1110201 - RNA, 19 nt, Homo sapiens
guaaugagugugagagaag

SEQ ID NO: 1110202 - RNA, 19 nt, Homo sapiens
gagcugcagccuccuugaa

SEQ ID NO: 1110203 - RNA, 19 nt, Homo sapiens
ugaacaggagggcagguua

SEQ ID NO: 1110204 - RNA, 19 nt, Homo sapiens
gcagagaagaugcaauggu

SEQ ID NO: 1110205 - RNA, 19 nt, Homo sapiens
gugauuggaagaagucauu

SEQ ID NO: 1110206 - RNA, 19 nt, Homo sapiens
ggcuuuauuuaccacuaua

SEQ ID NO: 1110207 - RNA, 19 nt, Homo sapiens
aggcucccgugucuuauaa

SEQ ID NO: 1110208 - RNA, 19 nt, Homo sapiens
cauaugagugugaagaaug

SEQ ID NO: 1110209 - RNA, 19 nt, Homo sapiens
guacugccuugggucagaa

SEQ ID NO: 1110210 - RNA, 19 nt, Homo sapiens
ggugcucauuugucacuga

SEQ ID NO: 1110211 - RNA, 19 nt, Homo sapiens
ggugagaaacccuaucagu

SEQ ID NO: 1110212 - RNA, 19 nt, Homo sapiens
ccgugaagguggagaagga

SEQ ID NO: 1110213 - RNA, 19 nt, Homo sapiens
gggaccacuugcaguucua

SEQ ID NO: 1110214 - RNA, 19 nt, Homo sapiens
ggaauacucuuaagugugu

SEQ ID NO: 1110215 - RNA, 19 nt, Homo sapiens
ggaauaagaccaagcauga

SEQ ID NO: 1110216 - RNA, 19 nt, Homo sapiens
gaguagaucugccaauuau

SEQ ID NO: 1110217 - RNA, 19 nt, Homo sapiens
gcagggagcugguggacuu

SEQ ID NO: 1110218 - RNA, 19 nt, Homo sapiens
gagaguagaucugccaauu

SEQ ID NO: 1110219 - RNA, 19 nt, Homo sapiens
gaacauguuguguggaaua

SEQ ID NO: 1110220 - RNA, 19 nt, Homo sapiens
cagaagauccacucgauua

SEQ ID NO: 1110221 - RNA, 19 nt, Homo sapiens
gaggugauguggugacuga

SEQ ID NO: 1110222 - RNA, 19 nt, Homo sapiens
gcagucagcuucauaccau

SEQ ID NO: 1110223 - RNA, 19 nt, Homo sapiens
ugauguacuuucaccauua

SEQ ID NO: 1110224 - RNA, 19 nt, Homo sapiens
acaggaaaguguuggauaa

SEQ ID NO: 1110225 - RNA, 19 nt, Homo sapiens
caauaaaucuggaggaaaa

SEQ ID NO: 1110226 - RNA, 19 nt, Homo sapiens
ggaaaguguuggauaaagg

SEQ ID NO: 1110227 - RNA, 19 nt, Homo sapiens
ugcagaaagucauguauaa

SEQ ID NO: 1110228 - RNA, 19 nt, Homo sapiens
gagacucaccuuuaaacua

SEQ ID NO: 1110229 - RNA, 19 nt, Homo sapiens
cuaaagagcggacugagaa

SEQ ID NO: 1110230 - RNA, 19 nt, Homo sapiens
agacucaccuuuaaacuag

SEQ ID NO: 1110231 - RNA, 19 nt, Homo sapiens
gcagaaacaacacaggaaa

SEQ ID NO: 1110232 - RNA, 19 nt, Homo sapiens
cgaaggacaugaagacuac

SEQ ID NO: 1110233 - RNA, 19 nt, Homo sapiens
ccacggaagccucuuacua

SEQ ID NO: 1110234 - RNA, 19 nt, Homo sapiens
guaaacacacccaaagaug

SEQ ID NO: 1110235 - RNA, 19 nt, Homo sapiens
guagaucugccaauuaugu

SEQ ID NO: 1110236 - RNA, 19 nt, Homo sapiens
gaaaguguuggauaaagga

SEQ ID NO: 1110237 - RNA, 19 nt, Homo sapiens
auagaaaccuccaccuguu

SEQ ID NO: 1110238 - RNA, 19 nt, Homo sapiens
ccgaacauguuguguggaa

SEQ ID NO: 1110239 - RNA, 19 nt, Homo sapiens
guacuggguuccaacucaa

SEQ ID NO: 1110240 - RNA, 19 nt, Homo sapiens
gauguacuuucaccauuag

SEQ ID NO: 1110241 - RNA, 19 nt, Homo sapiens
caugauggcguuucaguug

SEQ ID NO: 1110242 - RNA, 19 nt, Homo sapiens
gcaguaaacacacccaaag

SEQ ID NO: 1110243 - RNA, 19 nt, Homo sapiens
gaccaagcaugacgugaag

SEQ ID NO: 1110244 - RNA, 19 nt, Homo sapiens
uuaaguguguuugagagua

SEQ ID NO: 1110245 - RNA, 19 nt, Homo sapiens
guggaauacucuuaagugu

SEQ ID NO: 1110246 - RNA, 19 nt, Homo sapiens
cagaggugauguacuuuca

SEQ ID NO: 1110247 - RNA, 19 nt, Homo sapiens
ggagacugacccaaaguga

SEQ ID NO: 1110248 - RNA, 19 nt, Homo sapiens
gcacuaaagagcggacuga

SEQ ID NO: 1110249 - RNA, 19 nt, Homo sapiens
uguccggcauguacaauaa

SEQ ID NO: 1110250 - RNA, 19 nt, Homo sapiens
agaguagaucugccaauua

SEQ ID NO: 1110251 - RNA, 19 nt, Homo sapiens
ccaggagacugacccaaag

SEQ ID NO: 1110252 - RNA, 19 nt, Homo sapiens
uacaauaaaucuggaggaa

SEQ ID NO: 1110253 - RNA, 19 nt, Homo sapiens
ucagccagcucgccucuuc

SEQ ID NO: 1110254 - RNA, 19 nt, Homo sapiens
agccagaggugauguacuu

SEQ ID NO: 1110255 - RNA, 19 nt, Homo sapiens
ccuuuaaacuagaacaaga

SEQ ID NO: 1110256 - RNA, 19 nt, Homo sapiens
gaucugccaauuauguuga

SEQ ID NO: 1110257 - RNA, 19 nt, Homo sapiens
uaaguguguuugagaguag

SEQ ID NO: 1110258 - RNA, 19 nt, Homo sapiens
cagugaaccuaucgaagga

SEQ ID NO: 1110259 - RNA, 19 nt, Homo sapiens
aggcgggucuccauagaaa

SEQ ID NO: 1110260 - RNA, 19 nt, Homo sapiens
gaagauccacucgauuaca

SEQ ID NO: 1110261 - RNA, 19 nt, Homo sapiens
ccgagacuguggcuacuga

SEQ ID NO: 1110262 - RNA, 19 nt, Homo sapiens
auauguggaugcaaucaaa

SEQ ID NO: 1110263 - RNA, 19 nt, Homo sapiens
gaaccuaucgaaggacaug

SEQ ID NO: 1110264 - RNA, 19 nt, Homo sapiens
caagaccagcuguggauug

SEQ ID NO: 1110265 - RNA, 19 nt, Homo sapiens
caugugggauggaauagca

SEQ ID NO: 1110266 - RNA, 19 nt, Homo sapiens
gaaacaacacaggaaagug

SEQ ID NO: 1110267 - RNA, 19 nt, Homo sapiens
ccgaagagaacaagaagga

SEQ ID NO: 1110268 - RNA, 19 nt, Homo sapiens
gagacugacccaaagugaa

SEQ ID NO: 1110269 - RNA, 19 nt, Homo sapiens
gcuguggauuggcacuaaa

SEQ ID NO: 1110270 - RNA, 19 nt, Homo sapiens
agagcggacugagaaauug

SEQ ID NO: 1110271 - RNA, 19 nt, Homo sapiens
aacagaagauccacucgau

SEQ ID NO: 1110272 - RNA, 19 nt, Homo sapiens
gacccaaagugaaggacau

SEQ ID NO: 1110273 - RNA, 19 nt, Homo sapiens
ccaagcaugacgugaaguu

SEQ ID NO: 1110274 - RNA, 19 nt, Homo sapiens
gggagcugguggacuugaa

SEQ ID NO: 1110275 - RNA, 19 nt, Homo sapiens
ugaagacuaccacaugaug

SEQ ID NO: 1110276 - RNA, 19 nt, Homo sapiens
cacaggaaaguguuggaua

SEQ ID NO: 1110277 - RNA, 19 nt, Homo sapiens
cagaaagucauguauaagg

SEQ ID NO: 1110278 - RNA, 19 nt, Homo sapiens
gcagaaagucauguauaag

SEQ ID NO: 1110279 - RNA, 19 nt, Homo sapiens
gguuccaacucaauaugug

SEQ ID NO: 1110280 - RNA, 19 nt, Homo sapiens
cucaauauguggaugcaau

SEQ ID NO: 1110281 - RNA, 19 nt, Homo sapiens
ggucagugaaccuaucgaa

SEQ ID NO: 1110282 - RNA, 19 nt, Homo sapiens
acacggaggccgagacugu

SEQ ID NO: 1110283 - RNA, 19 nt, Homo sapiens
aaaauuaccaguucccuuu

SEQ ID NO: 1110284 - RNA, 19 nt, Homo sapiens
uaaagagcggacugagaaa

SEQ ID NO: 1110285 - RNA, 19 nt, Homo sapiens
uguacuggguuccaacuca

SEQ ID NO: 1110286 - RNA, 19 nt, Homo sapiens
ucgaaggacaugaagacua

SEQ ID NO: 1110287 - RNA, 19 nt, Homo sapiens
cugguggacuugaagauca

SEQ ID NO: 1110288 - RNA, 19 nt, Homo sapiens
agaccaagcaugacgugaa

SEQ ID NO: 1110289 - RNA, 19 nt, Homo sapiens
gaauuccgaacauguugug

SEQ ID NO: 1110290 - RNA, 19 nt, Homo sapiens
guacuuucaccauuagcuu

SEQ ID NO: 1110291 - RNA, 19 nt, Homo sapiens
aagagcggacugagaaauu

SEQ ID NO: 1110292 - RNA, 19 nt, Homo sapiens
gggcagaggccagagaaag

SEQ ID NO: 1110293 - RNA, 19 nt, Homo sapiens
gcaaaggccgaagagaaca

SEQ ID NO: 1110294 - RNA, 19 nt, Homo sapiens
ugacaagggaaugaucaaa

SEQ ID NO: 1110295 - RNA, 19 nt, Homo sapiens
cauguuguguggaauacuc

SEQ ID NO: 1110296 - RNA, 19 nt, Homo sapiens
caggaaaguguuggauaaa

SEQ ID NO: 1110297 - RNA, 19 nt, Homo sapiens
ggcagaaacaacacaggaa

SEQ ID NO: 1110298 - RNA, 19 nt, Homo sapiens
caguaaacacacccaaaga

SEQ ID NO: 1110299 - RNA, 19 nt, Homo sapiens
ugacaccaccggaaaggau

SEQ ID NO: 1110300 - RNA, 19 nt, Homo sapiens
aaucugaauuccgaacaug

SEQ ID NO: 1110301 - RNA, 19 nt, Homo sapiens
cacggaagccucuuacuac

SEQ ID NO: 1110302 - RNA, 19 nt, Homo sapiens
caaaggccgaagagaacaa

SEQ ID NO: 1110303 - RNA, 19 nt, Homo sapiens
gaggcgggucuccauagaa

SEQ ID NO: 1110304 - RNA, 19 nt, Homo sapiens
agacugacccaaagugaag

SEQ ID NO: 1110305 - RNA, 19 nt, Homo sapiens
ccaccggaaaggauucauu

SEQ ID NO: 1110306 - RNA, 19 nt, Homo sapiens
uauucaaucugaggugaug

SEQ ID NO: 1110307 - RNA, 19 nt, Homo sapiens
guaccgcuguccggcaugu

SEQ ID NO: 1110308 - RNA, 19 nt, Homo sapiens
caaugauguuuuagcagua

SEQ ID NO: 1110309 - RNA, 19 nt, Homo sapiens
augcagaaagucauguaua

SEQ ID NO: 1110310 - RNA, 19 nt, Homo sapiens
gacaagggaaugaucaaaa

SEQ ID NO: 1110311 - RNA, 19 nt, Homo sapiens
guuguguggaauacucuua

SEQ ID NO: 1110312 - RNA, 19 nt, Homo sapiens
cccaggagacugacccaaa

SEQ ID NO: 1110313 - RNA, 19 nt, Homo sapiens
augcaaaggccgaagagaa

SEQ ID NO: 1110314 - RNA, 19 nt, Homo sapiens
caaagaagcuugugagaaa

SEQ ID NO: 1110315 - RNA, 19 nt, Homo sapiens
gaagagcaguuccauguua

SEQ ID NO: 1110316 - RNA, 19 nt, Homo sapiens
ggauggagcuaucuaaaua

SEQ ID NO: 1110317 - RNA, 19 nt, Homo sapiens
gaaagaagauaccauugaa

SEQ ID NO: 1110318 - RNA, 19 nt, Homo sapiens
ccaaagagcuaaacaauuc

SEQ ID NO: 1110319 - RNA, 19 nt, Homo sapiens
gaagauaucacaugaacua

SEQ ID NO: 1110320 - RNA, 19 nt, Homo sapiens
gaaagaguuugaugugaaa

SEQ ID NO: 1110321 - RNA, 19 nt, Homo sapiens
gauaugagccaucagaaua

SEQ ID NO: 1110322 - RNA, 19 nt, Homo sapiens
gaacguaaguuguacaaag

SEQ ID NO: 1110323 - RNA, 19 nt, Homo sapiens
ugaaaucaguguagaagua

SEQ ID NO: 1110324 - RNA, 19 nt, Homo sapiens
gaaagaagaacguaaguug

SEQ ID NO: 1110325 - RNA, 19 nt, Homo sapiens
gaacacaguugagucauau

SEQ ID NO: 1110326 - RNA, 19 nt, Homo sapiens
cuucauagcugcauuuaaa

SEQ ID NO: 1110327 - RNA, 19 nt, Homo sapiens
gaugauggcugaugacaau

SEQ ID NO: 1110328 - RNA, 19 nt, Homo sapiens
ggaauuacguagccaguau

SEQ ID NO: 1110329 - RNA, 19 nt, Homo sapiens
caauguugcuucuugauuu

SEQ ID NO: 1110330 - RNA, 19 nt, Homo sapiens
gaaagguacuacuacuauu

SEQ ID NO: 1110331 - RNA, 19 nt, Homo sapiens
gcagcaacauaaucugaua

SEQ ID NO: 1110332 - RNA, 19 nt, Homo sapiens
cacaugaacuaccuaauuu

SEQ ID NO: 1110333 - RNA, 19 nt, Homo sapiens
uguaagggcucacacauuu

SEQ ID NO: 1110334 - RNA, 19 nt, Homo sapiens
ucaaauaucucaccacagu

SEQ ID NO: 1110335 - RNA, 19 nt, Homo sapiens
caauaagccuggucaauuc

SEQ ID NO: 1110336 - RNA, 19 nt, Homo sapiens
gagcacacauauaaauuug

SEQ ID NO: 1110337 - RNA, 19 nt, Homo sapiens
ccagggcacucaaacauaa

SEQ ID NO: 1110338 - RNA, 19 nt, Homo sapiens
caaauaauaucccaaagag

SEQ ID NO: 1110339 - RNA, 19 nt, Homo sapiens
gaagauaccauugaaaguu

SEQ ID NO: 1110340 - RNA, 19 nt, Homo sapiens
gaagauccaugaugcaaag

SEQ ID NO: 1110341 - RNA, 19 nt, Homo sapiens
ugacagcucuuaccaacaa

SEQ ID NO: 1110342 - RNA, 19 nt, Homo sapiens
ggacaaagggagaaagaaa

SEQ ID NO: 1110343 - RNA, 19 nt, Homo sapiens
ggacauacuuauuugaaca

SEQ ID NO: 1110344 - RNA, 19 nt, Homo sapiens
ugaauacaguggaauguuu

SEQ ID NO: 1110345 - RNA, 19 nt, Homo sapiens
cacauacaauggauucuua

SEQ ID NO: 1110346 - RNA, 19 nt, Homo sapiens
gcacacaaauacacuaugg

SEQ ID NO: 1110347 - RNA, 19 nt, Homo sapiens
gauacuaagucccaaccua

SEQ ID NO: 1110348 - RNA, 19 nt, Homo sapiens
gaagauagagacauagaga

SEQ ID NO: 1110349 - RNA, 19 nt, Homo sapiens
agagagagcuauagauuuc

SEQ ID NO: 1110350 - RNA, 19 nt, Homo sapiens
gauggaagcuaugaaguau

SEQ ID NO: 1110351 - RNA, 19 nt, Homo sapiens
gagaaacgcgcacaagauu

SEQ ID NO: 1110352 - RNA, 19 nt, Homo sapiens
caaauggaaugaaacuaga

SEQ ID NO: 1110353 - RNA, 19 nt, Homo sapiens
ggagcuaucuaaauacugu

SEQ ID NO: 1110354 - RNA, 19 nt, Homo sapiens
gaacguggcacacaaauac

SEQ ID NO: 1110355 - RNA, 19 nt, Homo sapiens
caaaugcacuaaauuccuu

SEQ ID NO: 1110356 - RNA, 19 nt, Homo sapiens
gcacaagauuuggagauga

SEQ ID NO: 1110357 - RNA, 19 nt, Homo sapiens
gaaacgcgcacaagauuug

SEQ ID NO: 1110358 - RNA, 19 nt, Homo sapiens
gaaagacaauguugcuucu

SEQ ID NO: 1110359 - RNA, 19 nt, Homo sapiens
gaaguagaguuaccuaaac

SEQ ID NO: 1110360 - RNA, 19 nt, Homo sapiens
caaauguccucaacuguca

SEQ ID NO: 1110361 - RNA, 19 nt, Homo sapiens
ugaauacucucuucucaau

SEQ ID NO: 1110362 - RNA, 19 nt, Homo sapiens
gaccucagcuucagagugu

SEQ ID NO: 1110363 - RNA, 19 nt, Homo sapiens
uuucgcagcugauaauaua

SEQ ID NO: 1110364 - RNA, 19 nt, Homo sapiens
uaaauuccuuggugcagua

SEQ ID NO: 1110365 - RNA, 19 nt, Homo sapiens
gagaacuacuugaaagaga

SEQ ID NO: 1110366 - RNA, 19 nt, Homo sapiens
agagagccguucagaauuu

SEQ ID NO: 1110367 - RNA, 19 nt, Homo sapiens
gagcagauaugagccauca

SEQ ID NO: 1110368 - RNA, 19 nt, Homo sapiens
ggaaagugaaaguugaaua

SEQ ID NO: 1110369 - RNA, 19 nt, Homo sapiens
agaaagaguuugaugugaa

SEQ ID NO: 1110370 - RNA, 19 nt, Homo sapiens
aauaauggcucuuugacaa

SEQ ID NO: 1110371 - RNA, 19 nt, Homo sapiens
gccauugucucuaauucua

SEQ ID NO: 1110372 - RNA, 19 nt, Homo sapiens
uggaagagcuggugcaugu

SEQ ID NO: 1110373 - RNA, 19 nt, Homo sapiens
acagagaaaugaauggaaa

SEQ ID NO: 1110374 - RNA, 19 nt, Homo sapiens
gaaagagaaacaacuaugu

SEQ ID NO: 1110375 - RNA, 19 nt, Homo sapiens
caaaugaagauacuccuaa

SEQ ID NO: 1110376 - RNA, 19 nt, Homo sapiens
ugaacacaguugagucaua

SEQ ID NO: 1110377 - RNA, 19 nt, Homo sapiens
gauggcugaugacaauaua

SEQ ID NO: 1110378 - RNA, 19 nt, Homo sapiens
ugaagauacuccuaaauca

SEQ ID NO: 1110379 - RNA, 19 nt, Homo sapiens
gggccucacuuguauagaa

SEQ ID NO: 1110380 - RNA, 19 nt, Homo sapiens
gcacacauauaaauuuggu

SEQ ID NO: 1110381 - RNA, 19 nt, Homo sapiens
ugacggacauacuuauuug

SEQ ID NO: 1110382 - RNA, 19 nt, Homo sapiens
gcaacauaaucugauagua

SEQ ID NO: 1110383 - RNA, 19 nt, Homo sapiens
ggagaaagaaauacauguu

SEQ ID NO: 1110384 - RNA, 19 nt, Homo sapiens
gcaaagcccucggacaaag

SEQ ID NO: 1110385 - RNA, 19 nt, Homo sapiens
cuaaaucaguuccagagaa

SEQ ID NO: 1110386 - RNA, 19 nt, Homo sapiens
ucacaugaacuaccuaauu

SEQ ID NO: 1110387 - RNA, 19 nt, Homo sapiens
caugugaugcuauguguua

SEQ ID NO: 1110388 - RNA, 19 nt, Homo sapiens
uaguguggcuuuagaauau

SEQ ID NO: 1110389 - RNA, 19 nt, Homo sapiens
gcuaaacaauuccuuacau

SEQ ID NO: 1110390 - RNA, 19 nt, Homo sapiens
aaacauaacugugcuuguc

SEQ ID NO: 1110391 - RNA, 19 nt, Homo sapiens
uggcauagcuggacuugau

SEQ ID NO: 1110392 - RNA, 19 nt, Homo sapiens
aaagagagagcuauagauu

SEQ ID NO: 1110393 - RNA, 19 nt, Homo sapiens
ucaauaagccuggucaauu

SEQ ID NO: 1110394 - RNA, 19 nt, Homo sapiens
gcaguuccauguuauaaac

SEQ ID NO: 1110395 - RNA, 19 nt, Homo sapiens
acacaaauguccucaacug

SEQ ID NO: 1110396 - RNA, 19 nt, Homo sapiens
gcacuaaauucagauccuu

SEQ ID NO: 1110397 - RNA, 19 nt, Homo sapiens
uguguuaccuugggacuua

SEQ ID NO: 1110398 - RNA, 19 nt, Homo sapiens
cagccuagcuugccaaucu

SEQ ID NO: 1110399 - RNA, 19 nt, Homo sapiens
gccaguaugucaacuccua

SEQ ID NO: 1110400 - RNA, 19 nt, Homo sapiens
gcugcaauguuuacuaaug

SEQ ID NO: 1110401 - RNA, 19 nt, Homo sapiens
ggacagaaacggacugaag

SEQ ID NO: 1110402 - RNA, 19 nt, Homo sapiens
gaaagugaaaguugaauac

SEQ ID NO: 1110403 - RNA, 19 nt, Homo sapiens
gcaagaaagaguuugaugu

SEQ ID NO: 1110404 - RNA, 19 nt, Homo sapiens
ggcaugaugugcagaauag

SEQ ID NO: 1110405 - RNA, 19 nt, Homo sapiens
gagaaacaacuaugugaug

SEQ ID NO: 1110406 - RNA, 19 nt, Homo sapiens
ucagagagccguucagaau

SEQ ID NO: 1110407 - RNA, 19 nt, Homo sapiens
caagaaagaguuugaugug

SEQ ID NO: 1110408 - RNA, 19 nt, Homo sapiens
acaaagggagaaagaaaua

SEQ ID NO: 1110409 - RNA, 19 nt, Homo sapiens
ugaaagaagauaccauuga

SEQ ID NO: 1110410 - RNA, 19 nt, Homo sapiens
gcucacacauuuacuguac

SEQ ID NO: 1110411 - RNA, 19 nt, Homo sapiens
gcagauaugagccaucaga

SEQ ID NO: 1110412 - RNA, 19 nt, Homo sapiens
caacgaggugcuaccaaua

SEQ ID NO: 1110413 - RNA, 19 nt, Homo sapiens
aagaagaacguaaguugua

SEQ ID NO: 1110414 - RNA, 19 nt, Homo sapiens
caaagaagcuugugagaaa

SEQ ID NO: 1110415 - RNA, 19 nt, Homo sapiens
gaagagcaguuccauguua

SEQ ID NO: 1110416 - RNA, 19 nt, Homo sapiens
ggauggagcuaucuaaaua

SEQ ID NO: 1110417 - RNA, 19 nt, Homo sapiens
gaaagaagauaccauugaa

SEQ ID NO: 1110418 - RNA, 19 nt, Homo sapiens
gaaagaguuugaugugaaa

SEQ ID NO: 1110419 - RNA, 19 nt, Homo sapiens
gaacacaguugagucauau

SEQ ID NO: 1110420 - RNA, 19 nt, Homo sapiens
gaugauggcugaugacaau

SEQ ID NO: 1110421 - RNA, 19 nt, Homo sapiens
ggaauuacguagccaguau

SEQ ID NO: 1110422 - RNA, 19 nt, Homo sapiens
gaaagguacuacuacuauu

SEQ ID NO: 1110423 - RNA, 19 nt, Homo sapiens
gcagcaacauaaucugaua

SEQ ID NO: 1110424 - RNA, 19 nt, Homo sapiens
gaagauaccauugaaaguu

SEQ ID NO: 1110425 - RNA, 19 nt, Homo sapiens
ggaaagagagcaugcaaga

SEQ ID NO: 1110426 - RNA, 19 nt, Homo sapiens
gaagauccaugaugcaaag

SEQ ID NO: 1110427 - RNA, 19 nt, Homo sapiens
ggacauacuuauuugaaca

SEQ ID NO: 1110428 - RNA, 19 nt, Homo sapiens
ugaauacaguggaauguuu

SEQ ID NO: 1110429 - RNA, 19 nt, Homo sapiens
cacauacaauggauucuua

SEQ ID NO: 1110430 - RNA, 19 nt, Homo sapiens
gcacacaaauacacuaugg

SEQ ID NO: 1110431 - RNA, 19 nt, Homo sapiens
gauggaagcuaugaaguau

SEQ ID NO: 1110432 - RNA, 19 nt, Homo sapiens
gagaaacgcgcacaagauu

SEQ ID NO: 1110433 - RNA, 19 nt, Homo sapiens
ggagcuaucuaaauacugu

SEQ ID NO: 1110434 - RNA, 19 nt, Homo sapiens
gaacguggcacacaaauac

SEQ ID NO: 1110435 - RNA, 19 nt, Homo sapiens
caaaugcacuaaauuccuu

SEQ ID NO: 1110436 - RNA, 19 nt, Homo sapiens
gcacaagauuuggagauga

SEQ ID NO: 1110437 - RNA, 19 nt, Homo sapiens
gaaacgcgcacaagauuug

SEQ ID NO: 1110438 - RNA, 19 nt, Homo sapiens
uaaauuccuuggugcagua

SEQ ID NO: 1110439 - RNA, 19 nt, Homo sapiens
gagaacuacuugaaagaga

SEQ ID NO: 1110440 - RNA, 19 nt, Homo sapiens
agagagccguucagaauuu

SEQ ID NO: 1110441 - RNA, 19 nt, Homo sapiens
agaaagaguuugaugugaa

SEQ ID NO: 1110442 - RNA, 19 nt, Homo sapiens
acagagaaaugaauggaaa

SEQ ID NO: 1110443 - RNA, 19 nt, Homo sapiens
gaaagagaaacaacuaugu

SEQ ID NO: 1110444 - RNA, 19 nt, Homo sapiens
caaaugaagauacuccuaa

SEQ ID NO: 1110445 - RNA, 19 nt, Homo sapiens
ugaacacaguugagucaua

SEQ ID NO: 1110446 - RNA, 19 nt, Homo sapiens
gauggcugaugacaauaua

SEQ ID NO: 1110447 - RNA, 19 nt, Homo sapiens
ugaagauacuccuaaauca

SEQ ID NO: 1110448 - RNA, 19 nt, Homo sapiens
agaaaugaauggaaagaga

SEQ ID NO: 1110449 - RNA, 19 nt, Homo sapiens
ugacggacauacuuauuug

SEQ ID NO: 1110450 - RNA, 19 nt, Homo sapiens
gcaacauaaucugauagua

SEQ ID NO: 1110451 - RNA, 19 nt, Homo sapiens
gcaaagcccucggacaaag

SEQ ID NO: 1110452 - RNA, 19 nt, Homo sapiens
cuaaaucaguuccagagaa

SEQ ID NO: 1110453 - RNA, 19 nt, Homo sapiens
gcaguuccauguuauaaac

SEQ ID NO: 1110454 - RNA, 19 nt, Homo sapiens
gcacuaaauucagauccuu

SEQ ID NO: 1110455 - RNA, 19 nt, Homo sapiens
gccaguaugucaacuccua

SEQ ID NO: 1110456 - RNA, 19 nt, Homo sapiens
gcugcaauguuuacuaaug

SEQ ID NO: 1110457 - RNA, 19 nt, Homo sapiens
ggacagaaacggacugaag

SEQ ID NO: 1110458 - RNA, 19 nt, Homo sapiens
ggcaugaugugcagaauag

SEQ ID NO: 1110459 - RNA, 19 nt, Homo sapiens
gagaaacaacuaugugaug

SEQ ID NO: 1110460 - RNA, 19 nt, Homo sapiens
gcaagaaagaguuugaugu

SEQ ID NO: 1110461 - RNA, 19 nt, Homo sapiens
ucagagagccguucagaau

SEQ ID NO: 1110462 - RNA, 19 nt, Homo sapiens
ugaaagaagauaccauuga

SEQ ID NO: 1110463 - RNA, 19 nt, Homo sapiens
caagaaagaguuugaugug

SEQ ID NO: 1110464 - RNA, 19 nt, Homo sapiens
aaacuucugugcagugaug

SEQ ID NO: 1110465 - RNA, 19 nt, Homo sapiens
gcuuccagcuaaugaaauu

SEQ ID NO: 1110466 - RNA, 19 nt, Homo sapiens
acaacuaugugaugugcua

SEQ ID NO: 1110467 - RNA, 19 nt, Homo sapiens
uaaaucaguuccagagaag

SEQ ID NO: 1110468 - RNA, 19 nt, Homo sapiens
caacauaaucugauaguac

SEQ ID NO: 1110469 - RNA, 19 nt, Homo sapiens
ccacacagaagcugaaaga

SEQ ID NO: 1110470 - RNA, 19 nt, Homo sapiens
agagaaggcuuuugucuuu

SEQ ID NO: 1110471 - RNA, 19 nt, Homo sapiens
gcuaugaaagguacuacua

SEQ ID NO: 1110472 - RNA, 19 nt, Homo sapiens
acacuucauugagguaaua

SEQ ID NO: 1110473 - RNA, 19 nt, Homo sapiens
ggaaggaguagauccaaau

SEQ ID NO: 1110474 - RNA, 19 nt, Homo sapiens
gcgcagugucugauuauuu

SEQ ID NO: 1110475 - RNA, 19 nt, Homo sapiens
gcccauagguugguucuca

SEQ ID NO: 1110476 - RNA, 19 nt, Homo sapiens
gauaacaaaggcuccguuu

SEQ ID NO: 1110477 - RNA, 19 nt, Homo sapiens
gcaaaugaagauacuccua

SEQ ID NO: 1110478 - RNA, 19 nt, Homo sapiens
gagcaguuccauguuauaa

SEQ ID NO: 1110479 - RNA, 19 nt, Homo sapiens
gucagugucuggcaagaaa

SEQ ID NO: 1110480 - RNA, 19 nt, Homo sapiens
ggcaaaaucuggacuguga

SEQ ID NO: 1110481 - RNA, 19 nt, Homo sapiens
ugaaagguacuacuacuau

SEQ ID NO: 1110482 - RNA, 19 nt, Homo sapiens
uggaagcuaugaaguauca

SEQ ID NO: 1110483 - RNA, 19 nt, Homo sapiens
gggaggaagagacgguuua

SEQ ID NO: 1110484 - RNA, 19 nt, Homo sapiens
gaacuacuugaaagagaaa

SEQ ID NO: 1110485 - RNA, 19 nt, Homo sapiens
gaaacggacugaagaaaag

SEQ ID NO: 1110486 - RNA, 19 nt, Homo sapiens
cuacgugguuggaggauau

SEQ ID NO: 1110487 - RNA, 19 nt, Homo sapiens
ggacaaagccuagaaaauc

SEQ ID NO: 1110488 - RNA, 19 nt, Homo sapiens
gugcagugaugacauuaau

SEQ ID NO: 1110489 - RNA, 19 nt, Homo sapiens
gaacacuucauugagguaa

SEQ ID NO: 1110490 - RNA, 19 nt, Homo sapiens
gcccaaggcuguacagaac

SEQ ID NO: 1110491 - RNA, 19 nt, Homo sapiens
gaugugaaacagauccuaa

SEQ ID NO: 1110492 - RNA, 19 nt, Homo sapiens
gcuuagggauucgaucauu

SEQ ID NO: 1110493 - RNA, 19 nt, Homo sapiens
acaacacucugaagacaug

SEQ ID NO: 1110494 - RNA, 19 nt, Homo sapiens
acacagaagcugaaagaga

SEQ ID NO: 1110495 - RNA, 19 nt, Homo sapiens
gaaagagagcaugcaagaa

SEQ ID NO: 1110496 - RNA, 19 nt, Homo sapiens
aaccauugcuccaggcuuu

SEQ ID NO: 1110497 - RNA, 19 nt, Homo sapiens
ggaguugccacauacaaug

SEQ ID NO: 1110498 - RNA, 19 nt, Homo sapiens
ggagucgcaguuauugaua

SEQ ID NO: 1110499 - RNA, 19 nt, Homo sapiens
ggccguaggcuucaauuug

SEQ ID NO: 1110500 - RNA, 19 nt, Homo sapiens
gauccaaaugcacuaaauu

SEQ ID NO: 1110501 - RNA, 19 nt, Homo sapiens
cugcaauguuuacuaauga

SEQ ID NO: 1110502 - RNA, 19 nt, Homo sapiens
gacagaaacggacugaaga

SEQ ID NO: 1110503 - RNA, 19 nt, Homo sapiens
ugauggaagcuaugaagua

SEQ ID NO: 1110504 - RNA, 19 nt, Homo sapiens
ccaaggcuguacagaacuu

SEQ ID NO: 1110505 - RNA, 19 nt, Homo sapiens
ggaccaauguaugcuguag

SEQ ID NO: 1110506 - RNA, 19 nt, Homo sapiens
ggaggaagagacgguuuaa

SEQ ID NO: 1110507 - RNA, 19 nt, Homo sapiens
gagaagauccaugaugcaa

SEQ ID NO: 1110508 - RNA, 19 nt, Homo sapiens
ucaaacugcuuagggauuc

SEQ ID NO: 1110509 - RNA, 19 nt, Homo sapiens
agaaacaacuaugugaugu

SEQ ID NO: 1110510 - RNA, 19 nt, Homo sapiens
agaacuacuugaaagagaa

SEQ ID NO: 1110511 - RNA, 19 nt, Homo sapiens
aagaaagaguuugauguga

SEQ ID NO: 1110512 - RNA, 19 nt, Homo sapiens
gcacagagaaaugaaugga

SEQ ID NO: 1110513 - RNA, 19 nt, Homo sapiens
gaguuugugugcuccaaug

SEQ ID NO: 1110514 - RNA, 19 nt, Homo sapiens
gaaguuaggagaucauuua

SEQ ID NO: 1110515 - RNA, 19 nt, Homo sapiens
ggaagaaacuggaaauuag

SEQ ID NO: 1110516 - RNA, 19 nt, Homo sapiens
gcuuagagcuggauaauau

SEQ ID NO: 1110517 - RNA, 19 nt, Homo sapiens
guggaucccuucucuauua

SEQ ID NO: 1110518 - RNA, 19 nt, Homo sapiens
gcuaucaucuucacacuga

SEQ ID NO: 1110519 - RNA, 19 nt, Homo sapiens
gagaagauauugguggaaa

SEQ ID NO: 1110520 - RNA, 19 nt, Homo sapiens
gaacugcuuccucauuuaa

SEQ ID NO: 1110521 - RNA, 19 nt, Homo sapiens
aguaguagcugucaauaaa

SEQ ID NO: 1110522 - RNA, 19 nt, Homo sapiens
guuaggagaucauuuacuu

SEQ ID NO: 1110523 - RNA, 19 nt, Homo sapiens
gaagaagggacaggauaua

SEQ ID NO: 1110524 - RNA, 19 nt, Homo sapiens
ggagaucauuuacuuucaa

SEQ ID NO: 1110525 - RNA, 19 nt, Homo sapiens
ccugaagucuuaucgcuuu

SEQ ID NO: 1110526 - RNA, 19 nt, Homo sapiens
gaugaggcccugugaagaa

SEQ ID NO: 1110527 - RNA, 19 nt, Homo sapiens
gcccaaggcugccaguuuc

SEQ ID NO: 1110528 - RNA, 19 nt, Homo sapiens
gaacauggcagaggagaca

SEQ ID NO: 1110529 - RNA, 19 nt, Homo sapiens
caaccuaugucacugucaa

SEQ ID NO: 1110530 - RNA, 19 nt, Homo sapiens
gaaggaagaaacuggaaau

SEQ ID NO: 1110531 - RNA, 19 nt, Homo sapiens
gcacaccuggcgaguagua

SEQ ID NO: 1110532 - RNA, 19 nt, Homo sapiens
cagcacaccuggcgaguag

SEQ ID NO: 1110533 - RNA, 19 nt, Homo sapiens
caugcucacuggcucauuu

SEQ ID NO: 1110534 - RNA, 19 nt, Homo sapiens
caagggcuccucugucuga

SEQ ID NO: 1110535 - RNA, 19 nt, Homo sapiens
aggaagaaacuggaaauua

SEQ ID NO: 1110536 - RNA, 19 nt, Homo sapiens
gaauggagccgugaguaug

SEQ ID NO: 1110537 - RNA, 19 nt, Homo sapiens
ggaaggaagaaacuggaaa

SEQ ID NO: 1110538 - RNA, 19 nt, Homo sapiens
uaugaugagugccggcuuu

SEQ ID NO: 1110539 - RNA, 19 nt, Homo sapiens
gaguaguagcugucaauaa

SEQ ID NO: 1110540 - RNA, 19 nt, Homo sapiens
guaacucucuggcuaucau

SEQ ID NO: 1110541 - RNA, 19 nt, Homo sapiens
gaaccgagggaagaaggua

SEQ ID NO: 1110542 - RNA, 19 nt, Homo sapiens
gugaagaagggacaggaua

SEQ ID NO: 1110543 - RNA, 19 nt, Homo sapiens
gaagagcccucagcauucc

SEQ ID NO: 1110544 - RNA, 19 nt, Homo sapiens
caccgucugucuucacaaa

SEQ ID NO: 1110545 - RNA, 19 nt, Homo sapiens
gguggaaggccauacagaa

SEQ ID NO: 1110546 - RNA, 19 nt, Homo sapiens
ggagagggcuggguuaccu

SEQ ID NO: 1110547 - RNA, 19 nt, Homo sapiens
gggcagcuggagacaguua

SEQ ID NO: 1110548 - RNA, 19 nt, Homo sapiens
uccaacagcuuaccugauc

SEQ ID NO: 1110549 - RNA, 19 nt, Homo sapiens
gguaggaaguuaggagauc

SEQ ID NO: 1110550 - RNA, 19 nt, Homo sapiens
gaagaaacuggaaauuagg

SEQ ID NO: 1110551 - RNA, 19 nt, Homo sapiens
ggaauuucacucugcauca

SEQ ID NO: 1110552 - RNA, 19 nt, Homo sapiens
ggaaguuaggagaucauuu

SEQ ID NO: 1110553 - RNA, 19 nt, Homo sapiens
ggagacaguuaugaugagu

SEQ ID NO: 1110554 - RNA, 19 nt, Homo sapiens
guaggaaguuaggagauca

SEQ ID NO: 1110555 - RNA, 19 nt, Homo sapiens
ugaagagcccucagcauuc

SEQ ID NO: 1110556 - RNA, 19 nt, Homo sapiens
cgucugucuucacaaagua

SEQ ID NO: 1110557 - RNA, 19 nt, Homo sapiens
gaugagugccggcuuugug

SEQ ID NO: 1110558 - RNA, 19 nt, Homo sapiens
gaagggacaggauauacag

SEQ ID NO: 1110559 - RNA, 19 nt, Homo sapiens
ugaagaagggacaggauau

SEQ ID NO: 1110560 - RNA, 19 nt, Homo sapiens
ggcccaaggcugccaguuu

SEQ ID NO: 1110561 - RNA, 19 nt, Homo sapiens
uaguagcugucaauaaauc

SEQ ID NO: 1110562 - RNA, 19 nt, Homo sapiens
ucaaagggcagcugagaag

SEQ ID NO: 1110563 - RNA, 19 nt, Homo sapiens
guggggagcuugcuucuug

SEQ ID NO: 1110564 - RNA, 19 nt, Homo sapiens
cucacuggcucauuucuug

SEQ ID NO: 1110565 - RNA, 19 nt, Homo sapiens
gauccaagggcuccucugu

SEQ ID NO: 1110566 - RNA, 19 nt, Homo sapiens
uaggagaucauuuacuuuc

SEQ ID NO: 1110567 - RNA, 19 nt, Homo sapiens
agggccagcugcagacuuu

SEQ ID NO: 1110568 - RNA, 19 nt, Homo sapiens
gcuggccauucuuaccuuu

SEQ ID NO: 1110569 - RNA, 19 nt, Homo sapiens
gcccuggaccuucaugcua

SEQ ID NO: 1110570 - RNA, 19 nt, Homo sapiens
ccaccagccugacuuaucc

SEQ ID NO: 1110571 - RNA, 19 nt, Homo sapiens
ugauugcuggccauucuua

SEQ ID NO: 1110572 - RNA, 19 nt, Homo sapiens
cagcagggaccaaccuaug

SEQ ID NO: 1110573 - RNA, 19 nt, Homo sapiens
uggcugugcccaucuguaa

SEQ ID NO: 1110574 - RNA, 19 nt, Homo sapiens
uccaagggcuccucugucu

SEQ ID NO: 1110575 - RNA, 19 nt, Homo sapiens
gcgaguaguagcugucaau

SEQ ID NO: 1110576 - RNA, 19 nt, Homo sapiens
ccugauugcuggccauucu

SEQ ID NO: 1110577 - RNA, 19 nt, Homo sapiens
cagaauggagccgugagua

SEQ ID NO: 1110578 - RNA, 19 nt, Homo sapiens
gaauuucacucugcaucac

SEQ ID NO: 1110579 - RNA, 19 nt, Homo sapiens
gagcuggauaauauaaguu

SEQ ID NO: 1110580 - RNA, 19 nt, Homo sapiens
agagcuggauaauauaagu

SEQ ID NO: 1110581 - RNA, 19 nt, Homo sapiens
guguggaucccuucucuau

SEQ ID NO: 1110582 - RNA, 19 nt, Homo sapiens
auacuccuauaacuccuaa

SEQ ID NO: 1110583 - RNA, 19 nt, Homo sapiens
cugagugucuucaucaucu

SEQ ID NO: 1110584 - RNA, 19 nt, Homo sapiens
guggaaggccauacagaau

SEQ ID NO: 1110585 - RNA, 19 nt, Homo sapiens
ggagguggaaggccauaca

SEQ ID NO: 1110586 - RNA, 19 nt, Homo sapiens
ugacuuauccagggacaga

SEQ ID NO: 1110587 - RNA, 19 nt, Homo sapiens
gcuggagacaguuaugaug

SEQ ID NO: 1110588 - RNA, 19 nt, Homo sapiens
uccuauaacuccuaaagag

SEQ ID NO: 1110589 - RNA, 19 nt, Homo sapiens
ucacaagggaggagaacug

SEQ ID NO: 1110590 - RNA, 19 nt, Homo sapiens
auucuuaccuuuccuacuc

SEQ ID NO: 1110591 - RNA, 19 nt, Homo sapiens
gcuggggucuggcauagaa

SEQ ID NO: 1110592 - RNA, 19 nt, Homo sapiens
cugaagucuuaucgcuuua

SEQ ID NO: 1110593 - RNA, 19 nt, Homo sapiens
agaauggagccgugaguau

SEQ ID NO: 1110594 - RNA, 19 nt, Homo sapiens
guagcugucaauaaaucua

SEQ ID NO: 1110595 - RNA, 19 nt, Homo sapiens
guaguagcugucaauaaau

SEQ ID NO: 1110596 - RNA, 19 nt, Homo sapiens
cgaguaguagcugucaaua

SEQ ID NO: 1110597 - RNA, 19 nt, Homo sapiens
gggcuuagagcuggauaau

SEQ ID NO: 1110598 - RNA, 19 nt, Homo sapiens
acuccucgaugcccaguga

SEQ ID NO: 1110599 - RNA, 19 nt, Homo sapiens
aauucggucugguuccuuu

SEQ ID NO: 1110600 - RNA, 19 nt, Homo sapiens
gcagggaccaaccuauguc

SEQ ID NO: 1110601 - RNA, 19 nt, Homo sapiens
gugaugaggcccugugaag

SEQ ID NO: 1110602 - RNA, 19 nt, Homo sapiens
gugccggcuuugugucuga

SEQ ID NO: 1110603 - RNA, 19 nt, Homo sapiens
ggagaagauauugguggaa

SEQ ID NO: 1110604 - RNA, 19 nt, Homo sapiens
agugagaggugggccuuug

SEQ ID NO: 1110605 - RNA, 19 nt, Homo sapiens
ggauggcaaggaagugaga

SEQ ID NO: 1110606 - RNA, 19 nt, Homo sapiens
uuccugauccaacagcuua

SEQ ID NO: 1110607 - RNA, 19 nt, Homo sapiens
ggccagcugcagacuuuga

SEQ ID NO: 1110608 - RNA, 19 nt, Homo sapiens
caguguggaucccuucucu

SEQ ID NO: 1110609 - RNA, 19 nt, Homo sapiens
uggaaggccauacagaaug

SEQ ID NO: 1110610 - RNA, 19 nt, Homo sapiens
agacuuugagccagaaaug

SEQ ID NO: 1110611 - RNA, 19 nt, Homo sapiens
gcucacuggcucauuucuu

SEQ ID NO: 1110612 - RNA, 19 nt, Homo sapiens
cuggagacaguuaugauga

SEQ ID NO: 1110613 - RNA, 19 nt, Homo sapiens
gcagcuggagacaguuaug

SEQ ID NO: 1110614 - RNA, 19 nt, Homo sapiens
ggacaaagcuugacacauc

SEQ ID NO: 1110615 - RNA, 19 nt, Homo sapiens
guucagaccuuacccuuua

SEQ ID NO: 1110616 - RNA, 19 nt, Homo sapiens
guacugacuucuccuauaa

SEQ ID NO: 1110617 - RNA, 19 nt, Homo sapiens
gcaagaaggagaagaagua

SEQ ID NO: 1110618 - RNA, 19 nt, Homo sapiens
ggauuaaacuggcauuuca

SEQ ID NO: 1110619 - RNA, 19 nt, Homo sapiens
gaccugccauuucagauua

SEQ ID NO: 1110620 - RNA, 19 nt, Homo sapiens
ugacaacucuccuagcuuu

SEQ ID NO: 1110621 - RNA, 19 nt, Homo sapiens
uaacaggaccaauggauua

SEQ ID NO: 1110622 - RNA, 19 nt, Homo sapiens
caagaucaaugcucaaguu

SEQ ID NO: 1110623 - RNA, 19 nt, Homo sapiens
gcuaauccguguagaggua

SEQ ID NO: 1110624 - RNA, 19 nt, Homo sapiens
ggagucacguuucuaugaa

SEQ ID NO: 1110625 - RNA, 19 nt, Homo sapiens
ggaccacccuuaucucugu

SEQ ID NO: 1110626 - RNA, 19 nt, Homo sapiens
gaagugagccuugauaucu

SEQ ID NO: 1110627 - RNA, 19 nt, Homo sapiens
gaagcucgaagcagguuua

SEQ ID NO: 1110628 - RNA, 19 nt, Homo sapiens
gaucaaugcucaaguuuug

SEQ ID NO: 1110629 - RNA, 19 nt, Homo sapiens
uagaauagccaguagugua

SEQ ID NO: 1110630 - RNA, 19 nt, Homo sapiens
uuacacugcuuacauccua

SEQ ID NO: 1110631 - RNA, 19 nt, Homo sapiens
gggaccaaaugaacagaaa

SEQ ID NO: 1110632 - RNA, 19 nt, Homo sapiens
gcucgaagcagguuuagga

SEQ ID NO: 1110633 - RNA, 19 nt, Homo sapiens
gcaauggcaacaagaagaa

SEQ ID NO: 1110634 - RNA, 19 nt, Homo sapiens
ggacucagguagaaauggu

SEQ ID NO: 1110635 - RNA, 19 nt, Homo sapiens
cguacugacuucuccuaua

SEQ ID NO: 1110636 - RNA, 19 nt, Homo sapiens
gacaaagcuugacacauca

SEQ ID NO: 1110637 - RNA, 19 nt, Homo sapiens
cagcugaacuccuccaucu

SEQ ID NO: 1110638 - RNA, 19 nt, Homo sapiens
gacaacauccuccagauuc

SEQ ID NO: 1110639 - RNA, 19 nt, Homo sapiens
gacaucagcuggugcuuac

SEQ ID NO: 1110640 - RNA, 19 nt, Homo sapiens
gccauagccugguuaaagu

SEQ ID NO: 1110641 - RNA, 19 nt, Homo sapiens
agaaacaagugcccaguca

SEQ ID NO: 1110642 - RNA, 19 nt, Homo sapiens
gaagaagucgggcaagaag

SEQ ID NO: 1110643 - RNA, 19 nt, Homo sapiens
gaggccacaucccacuaua

SEQ ID NO: 1110644 - RNA, 19 nt, Homo sapiens
caacuagacuauucuuuug

SEQ ID NO: 1110645 - RNA, 19 nt, Homo sapiens
gaaagucucagcccaggau

SEQ ID NO: 1110646 - RNA, 19 nt, Homo sapiens
ggaggaggcucuguauguc

SEQ ID NO: 1110647 - RNA, 19 nt, Homo sapiens
gaccgggacucagguagaa

SEQ ID NO: 1110648 - RNA, 19 nt, Homo sapiens
ggaccagucuucuguuuug

SEQ ID NO: 1110649 - RNA, 19 nt, Homo sapiens
gaggauggacggaucuuug

SEQ ID NO: 1110650 - RNA, 19 nt, Homo sapiens
ccacagugcugcugguucu

SEQ ID NO: 1110651 - RNA, 19 nt, Homo sapiens
ccaucaggcucaacauuuc

SEQ ID NO: 1110652 - RNA, 19 nt, Homo sapiens
ugacuucacuuuucuaaga

SEQ ID NO: 1110653 - RNA, 19 nt, Homo sapiens
cagcguaccuuugacuaug

SEQ ID NO: 1110654 - RNA, 19 nt, Homo sapiens
ccacuucucucugaaugug

SEQ ID NO: 1110655 - RNA, 19 nt, Homo sapiens
caagugcugugcauguugu

SEQ ID NO: 1110656 - RNA, 19 nt, Homo sapiens
ggacccuucccacuacaua

SEQ ID NO: 1110657 - RNA, 19 nt, Homo sapiens
cuacaagccuccuaguucu

SEQ ID NO: 1110658 - RNA, 19 nt, Homo sapiens
gaacuccuccaucuuccaa

SEQ ID NO: 1110659 - RNA, 19 nt, Homo sapiens
gcaccaauacugugagcuu

SEQ ID NO: 1110660 - RNA, 19 nt, Homo sapiens
guguugaaguaccaaguaa

SEQ ID NO: 1110661 - RNA, 19 nt, Homo sapiens
gggccuuacuggaggauga

SEQ ID NO: 1110662 - RNA, 19 nt, Homo sapiens
ggagggccacugugugauu

SEQ ID NO: 1110663 - RNA, 19 nt, Homo sapiens
gaccugcccuuacaguagu

SEQ ID NO: 1110664 - RNA, 19 nt, Homo sapiens
ugaaguaccaaguaaccua

SEQ ID NO: 1110665 - RNA, 19 nt, Homo sapiens
gcugaacuccuccaucuuc

SEQ ID NO: 1110666 - RNA, 19 nt, Homo sapiens
gcacccaggccucagaguu

SEQ ID NO: 1110667 - RNA, 19 nt, Homo sapiens
caagaaggagaagaaguaa

SEQ ID NO: 1110668 - RNA, 19 nt, Homo sapiens
gcuuuacacugcuuacauc

SEQ ID NO: 1110669 - RNA, 19 nt, Homo sapiens
ggugaagugagccuugaua

SEQ ID NO: 1110670 - RNA, 19 nt, Homo sapiens
ccuauaagcgcuucucuuc

SEQ ID NO: 1110671 - RNA, 19 nt, Homo sapiens
ggccauagccugguuaaag

SEQ ID NO: 1110672 - RNA, 19 nt, Homo sapiens
ggcaagugcugugcauguu

SEQ ID NO: 1110673 - RNA, 19 nt, Homo sapiens
ggagaagaaguaacaugga

SEQ ID NO: 1110674 - RNA, 19 nt, Homo sapiens
gaauguugcucaggaucug

SEQ ID NO: 1110675 - RNA, 19 nt, Homo sapiens
cuagucaccuucaccuuuc

SEQ ID NO: 1110676 - RNA, 19 nt, Homo sapiens
ugaggacccugaggaaaug

SEQ ID NO: 1110677 - RNA, 19 nt, Homo sapiens
gcacuguggcugccucaga

SEQ ID NO: 1110678 - RNA, 19 nt, Homo sapiens
acaaacaucucaccaucag

SEQ ID NO: 1110679 - RNA, 19 nt, Homo sapiens
ccaauacugugagcuuuua

SEQ ID NO: 1110680 - RNA, 19 nt, Homo sapiens
guagugcggugugcuuuua

SEQ ID NO: 1110681 - RNA, 19 nt, Homo sapiens
caacaaccaguuugacaca

SEQ ID NO: 1110682 - RNA, 19 nt, Homo sapiens
ccagugacuuccucauaca

SEQ ID NO: 1110683 - RNA, 19 nt, Homo sapiens
gcccaaauccagugacuuc

SEQ ID NO: 1110684 - RNA, 19 nt, Homo sapiens
guagugggguuguuuaaug

SEQ ID NO: 1110685 - RNA, 19 nt, Homo sapiens
gaaccucuuuggccuagac

SEQ ID NO: 1110686 - RNA, 19 nt, Homo sapiens
gggcauggacaaagcuuga

SEQ ID NO: 1110687 - RNA, 19 nt, Homo sapiens
gcaagugcugugcauguug

SEQ ID NO: 1110688 - RNA, 19 nt, Homo sapiens
caccaauacugugagcuuu

SEQ ID NO: 1110689 - RNA, 19 nt, Homo sapiens
gagcuaacaggaccaaugg

SEQ ID NO: 1110690 - RNA, 19 nt, Homo sapiens
gccauaaaccaauaacuag

SEQ ID NO: 1110691 - RNA, 19 nt, Homo sapiens
ugacaacauccuccagauu

SEQ ID NO: 1110692 - RNA, 19 nt, Homo sapiens
ugucugggcagcuucguua

SEQ ID NO: 1110693 - RNA, 19 nt, Homo sapiens
gguguugaaguaccaagua

SEQ ID NO: 1110694 - RNA, 19 nt, Homo sapiens
agaaggagaagaaguaaca

SEQ ID NO: 1110695 - RNA, 19 nt, Homo sapiens
aagaagaagucgggcaaga

SEQ ID NO: 1110696 - RNA, 19 nt, Homo sapiens
gcaccuggcccaacaacca

SEQ ID NO: 1110697 - RNA, 19 nt, Homo sapiens
ggaugaggacccugaggaa

SEQ ID NO: 1110698 - RNA, 19 nt, Homo sapiens
gcagccgucuguccuugau

SEQ ID NO: 1110699 - RNA, 19 nt, Homo sapiens
gcuggacccuucccacuac

SEQ ID NO: 1110700 - RNA, 19 nt, Homo sapiens
acaagagacuccacugcau

SEQ ID NO: 1110701 - RNA, 19 nt, Homo sapiens
guuccucuuucccgaguaa

SEQ ID NO: 1110702 - RNA, 19 nt, Homo sapiens
acaaccaguuugacacaga

SEQ ID NO: 1110703 - RNA, 19 nt, Homo sapiens
ccuagucaccuucaccuuu

SEQ ID NO: 1110704 - RNA, 19 nt, Homo sapiens
gaugaggacccugaggaaa

SEQ ID NO: 1110705 - RNA, 19 nt, Homo sapiens
gaaccacuacucgcugcua

SEQ ID NO: 1110706 - RNA, 19 nt, Homo sapiens
gcgcuucucuucgcauagu

SEQ ID NO: 1110707 - RNA, 19 nt, Homo sapiens
gcuuugggcugagcuaaca

SEQ ID NO: 1110708 - RNA, 19 nt, Homo sapiens
ccuacaagccuccuaguuc

SEQ ID NO: 1110709 - RNA, 19 nt, Homo sapiens
guagacaccaagaaccauu

SEQ ID NO: 1110710 - RNA, 19 nt, Homo sapiens
ggacggcacgcucaaguac

SEQ ID NO: 1110711 - RNA, 19 nt, Homo sapiens
cugaggaaaugcccaaauc

SEQ ID NO: 1110712 - RNA, 19 nt, Homo sapiens
gcacaccagugggcacagu

SEQ ID NO: 1110713 - RNA, 19 nt, Homo sapiens
agacaucagcuggugcuua

SEQ ID NO: 1110714 - RNA, 19 nt, Homo sapiens
guucagaccuuacccuuua

SEQ ID NO: 1110715 - RNA, 19 nt, Homo sapiens
gaccugccauuucagauua

SEQ ID NO: 1110716 - RNA, 19 nt, Homo sapiens
ugacaacucuccuagcuuu

SEQ ID NO: 1110717 - RNA, 19 nt, Homo sapiens
gcuaauccguguagaggua

SEQ ID NO: 1110718 - RNA, 19 nt, Homo sapiens
ggagucacguuucuaugaa

SEQ ID NO: 1110719 - RNA, 19 nt, Homo sapiens
ggaccacccuuaucucugu

SEQ ID NO: 1110720 - RNA, 19 nt, Homo sapiens
aaaccagaguggccgauua

SEQ ID NO: 1110721 - RNA, 19 nt, Homo sapiens
gaagugagccuugauaucu

SEQ ID NO: 1110722 - RNA, 19 nt, Homo sapiens
uuacacugcuuacauccua

SEQ ID NO: 1110723 - RNA, 19 nt, Homo sapiens
ggacucagguagaaauggu

SEQ ID NO: 1110724 - RNA, 19 nt, Homo sapiens
gacaucagcuggugcuuac

SEQ ID NO: 1110725 - RNA, 19 nt, Homo sapiens
gaggccacaucccacuaua

SEQ ID NO: 1110726 - RNA, 19 nt, Homo sapiens
caacuagacuauucuuuug

SEQ ID NO: 1110727 - RNA, 19 nt, Homo sapiens
gaccgggacucagguagaa

SEQ ID NO: 1110728 - RNA, 19 nt, Homo sapiens
gaggauggacggaucuuug

SEQ ID NO: 1110729 - RNA, 19 nt, Homo sapiens
ccacagugcugcugguucu

SEQ ID NO: 1110730 - RNA, 19 nt, Homo sapiens
ccaucaggcucaacauuuc

SEQ ID NO: 1110731 - RNA, 19 nt, Homo sapiens
caagugcugugcauguugu

SEQ ID NO: 1110732 - RNA, 19 nt, Homo sapiens
ugacuucacuuuucuaaga

SEQ ID NO: 1110733 - RNA, 19 nt, Homo sapiens
cagcguaccuuugacuaug

SEQ ID NO: 1110734 - RNA, 19 nt, Homo sapiens
ccacuucucucugaaugug

SEQ ID NO: 1110735 - RNA, 19 nt, Homo sapiens
gcaccaauacugugagcuu

SEQ ID NO: 1110736 - RNA, 19 nt, Homo sapiens
gggccuuacuggaggauga

SEQ ID NO: 1110737 - RNA, 19 nt, Homo sapiens
ggagggccacugugugauu

SEQ ID NO: 1110738 - RNA, 19 nt, Homo sapiens
gcuuuacacugcuuacauc

SEQ ID NO: 1110739 - RNA, 19 nt, Homo sapiens
ggugaagugagccuugaua

SEQ ID NO: 1110740 - RNA, 19 nt, Homo sapiens
cuagucaccuucaccuuuc

SEQ ID NO: 1110741 - RNA, 19 nt, Homo sapiens
ugaggacccugaggaaaug

SEQ ID NO: 1110742 - RNA, 19 nt, Homo sapiens
gcacuguggcugccucaga

SEQ ID NO: 1110743 - RNA, 19 nt, Homo sapiens
gaauguugcucaggaucug

SEQ ID NO: 1110744 - RNA, 19 nt, Homo sapiens
acaaacaucucaccaucag

SEQ ID NO: 1110745 - RNA, 19 nt, Homo sapiens
ggcaagugcugugcauguu

SEQ ID NO: 1110746 - RNA, 19 nt, Homo sapiens
ccaauacugugagcuuuua

SEQ ID NO: 1110747 - RNA, 19 nt, Homo sapiens
ccagugacuuccucauaca

SEQ ID NO: 1110748 - RNA, 19 nt, Homo sapiens
gcccaaauccagugacuuc

SEQ ID NO: 1110749 - RNA, 19 nt, Homo sapiens
guagugggguuguuuaaug

SEQ ID NO: 1110750 - RNA, 19 nt, Homo sapiens
gaaccucuuuggccuagac

SEQ ID NO: 1110751 - RNA, 19 nt, Homo sapiens
gcaagugcugugcauguug

SEQ ID NO: 1110752 - RNA, 19 nt, Homo sapiens
caccaauacugugagcuuu

SEQ ID NO: 1110753 - RNA, 19 nt, Homo sapiens
ggaugaggacccugaggaa

SEQ ID NO: 1110754 - RNA, 19 nt, Homo sapiens
ugucugggcagcuucguua

SEQ ID NO: 1110755 - RNA, 19 nt, Homo sapiens
ccuagucaccuucaccuuu

SEQ ID NO: 1110756 - RNA, 19 nt, Homo sapiens
gaugaggacccugaggaaa

SEQ ID NO: 1110757 - RNA, 19 nt, Homo sapiens
gaaccacuacucgcugcua

SEQ ID NO: 1110758 - RNA, 19 nt, Homo sapiens
ggacggcacgcucaaguac

SEQ ID NO: 1110759 - RNA, 19 nt, Homo sapiens
cugaggaaaugcccaaauc

SEQ ID NO: 1110760 - RNA, 19 nt, Homo sapiens
gcacaccagugggcacagu

SEQ ID NO: 1110761 - RNA, 19 nt, Homo sapiens
agacaucagcuggugcuua

SEQ ID NO: 1110762 - RNA, 19 nt, Homo sapiens
gcuucaaccagcagcuuua

SEQ ID NO: 1110763 - RNA, 19 nt, Homo sapiens
caccuucccuacacaaaca

SEQ ID NO: 1110764 - RNA, 19 nt, Homo sapiens
gaugugggcaccaauacug

SEQ ID NO: 1110765 - RNA, 19 nt, Homo sapiens
gaaaccagaguggccgauu

SEQ ID NO: 1110766 - RNA, 19 nt, Homo sapiens
gagggccacugugugauuc

SEQ ID NO: 1110767 - RNA, 19 nt, Homo sapiens
ggaucucaaugacaacucu

SEQ ID NO: 1110768 - RNA, 19 nt, Homo sapiens
cgggaucauuggaccguuu

SEQ ID NO: 1110769 - RNA, 19 nt, Homo sapiens
ggaggccacaucccacuau

SEQ ID NO: 1110770 - RNA, 19 nt, Homo sapiens
ccacaucccacuauaucau

SEQ ID NO: 1110771 - RNA, 19 nt, Homo sapiens
ggccacaucccacuauauc

SEQ ID NO: 1110772 - RNA, 19 nt, Homo sapiens
aacagccacuucucucuga

SEQ ID NO: 1110773 - RNA, 19 nt, Homo sapiens
gaggagaaugggcgcuauu

SEQ ID NO: 1110774 - RNA, 19 nt, Homo sapiens
ggacuguuccucgugucua

SEQ ID NO: 1110775 - RNA, 19 nt, Homo sapiens
ccaacuagacuauucuuuu

SEQ ID NO: 1110776 - RNA, 19 nt, Homo sapiens
gaggaaaugcccaaaucca

SEQ ID NO: 1110777 - RNA, 19 nt, Homo sapiens
cgccucaccuacuccauug

SEQ ID NO: 1110778 - RNA, 19 nt, Homo sapiens
cucaggaucugggcuuaaa

SEQ ID NO: 1110779 - RNA, 19 nt, Homo sapiens
ugaggagucacguuucuau

SEQ ID NO: 1110780 - RNA, 19 nt, Homo sapiens
gaccgucagucucuuaucc

SEQ ID NO: 1110781 - RNA, 19 nt, Homo sapiens
uaccuuugacuaugaauug

SEQ ID NO: 1110782 - RNA, 19 nt, Homo sapiens
ggaauguugcucaggaucu

SEQ ID NO: 1110783 - RNA, 19 nt, Homo sapiens
gcucuccuacucacuguug

SEQ ID NO: 1110784 - RNA, 19 nt, Homo sapiens
aaccacuacucgcugcuaa

SEQ ID NO: 1110785 - RNA, 19 nt, Homo sapiens
agguagaaauggugaagug

SEQ ID NO: 1110786 - RNA, 19 nt, Homo sapiens
gcagugcggaaccucuuug

SEQ ID NO: 1110787 - RNA, 19 nt, Homo sapiens
gcuccaaccuuccaauccu

SEQ ID NO: 1110788 - RNA, 19 nt, Homo sapiens
aaugacaacucuccuagcu

SEQ ID NO: 1110789 - RNA, 19 nt, Homo sapiens
aaccagaguggccgauuaa

SEQ ID NO: 1110790 - RNA, 19 nt, Homo sapiens
caccuucaccuuucuguca

SEQ ID NO: 1110791 - RNA, 19 nt, Homo sapiens
gcauguguuuguccuagac

SEQ ID NO: 1110792 - RNA, 19 nt, Homo sapiens
gcguaccuuugacuaugaa

SEQ ID NO: 1110793 - RNA, 19 nt, Homo sapiens
ccucaccuacuccauugua

SEQ ID NO: 1110794 - RNA, 19 nt, Homo sapiens
caggaucugggcuuaaaga

SEQ ID NO: 1110795 - RNA, 19 nt, Homo sapiens
guccuagacgagaaugaua

SEQ ID NO: 1110796 - RNA, 19 nt, Homo sapiens
gugaagugagccuugauau

SEQ ID NO: 1110797 - RNA, 19 nt, Homo sapiens
aggagucacguuucuauga

SEQ ID NO: 1110798 - RNA, 19 nt, Homo sapiens
guaccuuugacuaugaauu

SEQ ID NO: 1110799 - RNA, 19 nt, Homo sapiens
ugaagugagccuugauauc

SEQ ID NO: 1110800 - RNA, 19 nt, Homo sapiens
cuuccaauccucaguucua

SEQ ID NO: 1110801 - RNA, 19 nt, Homo sapiens
gugaagacccuaaaagaug

SEQ ID NO: 1110802 - RNA, 19 nt, Homo sapiens
gguagaaauggugaaguga

SEQ ID NO: 1110803 - RNA, 19 nt, Homo sapiens
ugaaugugaagacccuaaa

SEQ ID NO: 1110804 - RNA, 19 nt, Homo sapiens
ugaccgagaaagccuaugu

SEQ ID NO: 1110805 - RNA, 19 nt, Homo sapiens
caaggugacagccguggau

SEQ ID NO: 1110806 - RNA, 19 nt, Homo sapiens
caccaucaggcucaacauu

SEQ ID NO: 1110807 - RNA, 19 nt, Homo sapiens
gcucaggaucugggcuuaa

SEQ ID NO: 1110808 - RNA, 19 nt, Homo sapiens
ggagaaugggcgcuauuuu

SEQ ID NO: 1110809 - RNA, 19 nt, Homo sapiens
gccacugugugauucaagu

SEQ ID NO: 1110810 - RNA, 19 nt, Homo sapiens
gaggagucacguuucuaug

SEQ ID NO: 1110811 - RNA, 19 nt, Homo sapiens
uccagugacuuccucauac

SEQ ID NO: 1110812 - RNA, 19 nt, Homo sapiens
acuaugaauugcugcagau

SEQ ID NO: 1110813 - RNA, 19 nt, Homo sapiens
ccuccuccuuuguguaugu

SEQ ID NO: 1110814 - RNA, 19 nt, Homo sapiens
ggacaaagcuugacacauc

SEQ ID NO: 1110815 - RNA, 19 nt, Homo sapiens
guacugacuucuccuauaa

SEQ ID NO: 1110816 - RNA, 19 nt, Homo sapiens
gaaugucgcucaagauuuc

SEQ ID NO: 1110817 - RNA, 19 nt, Homo sapiens
gcaagaaggagaagaagua

SEQ ID NO: 1110818 - RNA, 19 nt, Homo sapiens
ggaagacacucauccaguu

SEQ ID NO: 1110819 - RNA, 19 nt, Homo sapiens
gugagaagcuggacagaaa

SEQ ID NO: 1110820 - RNA, 19 nt, Homo sapiens
ggauuaaacuggcauuuca

SEQ ID NO: 1110821 - RNA, 19 nt, Homo sapiens
uaacaggaccaauggauua

SEQ ID NO: 1110822 - RNA, 19 nt, Homo sapiens
caagaucaaugcucaaguu

SEQ ID NO: 1110823 - RNA, 19 nt, Homo sapiens
ugaaugcgcuuaucuccua

SEQ ID NO: 1110824 - RNA, 19 nt, Homo sapiens
uguaacaguucgucuauuu

SEQ ID NO: 1110825 - RNA, 19 nt, Homo sapiens
gagcuccaaugaacacuuu

SEQ ID NO: 1110826 - RNA, 19 nt, Homo sapiens
ggacuuggauucagguuac

SEQ ID NO: 1110827 - RNA, 19 nt, Homo sapiens
cacagaagcuggucauugu

SEQ ID NO: 1110828 - RNA, 19 nt, Homo sapiens
gcacugugguggcacuuau

SEQ ID NO: 1110829 - RNA, 19 nt, Homo sapiens
gaucguagaugugaaugau

SEQ ID NO: 1110830 - RNA, 19 nt, Homo sapiens
gaagcucgaagcagguuua

SEQ ID NO: 1110831 - RNA, 19 nt, Homo sapiens
gaucaaugcucaaguuuug

SEQ ID NO: 1110832 - RNA, 19 nt, Homo sapiens
uagaauagccaguagugua

SEQ ID NO: 1110833 - RNA, 19 nt, Homo sapiens
gcccaggaaucgagaugua

SEQ ID NO: 1110834 - RNA, 19 nt, Homo sapiens
gaugugagccuccgcauuc

SEQ ID NO: 1110835 - RNA, 19 nt, Homo sapiens
caagauuuccugcuggaua

SEQ ID NO: 1110836 - RNA, 19 nt, Homo sapiens
cagaugacccuaucaaguu

SEQ ID NO: 1110837 - RNA, 19 nt, Homo sapiens
gagagaagcaaucggacua

SEQ ID NO: 1110838 - RNA, 19 nt, Homo sapiens
ccucugaucuucucuaugg

SEQ ID NO: 1110839 - RNA, 19 nt, Homo sapiens
cagcuggacuuggaaauug

SEQ ID NO: 1110840 - RNA, 19 nt, Homo sapiens
ggaaugucgcucaagauuu

SEQ ID NO: 1110841 - RNA, 19 nt, Homo sapiens
gggaccaaaugaacagaaa

SEQ ID NO: 1110842 - RNA, 19 nt, Homo sapiens
gcucgaagcagguuuagga

SEQ ID NO: 1110843 - RNA, 19 nt, Homo sapiens
gcaauggcaacaagaagaa

SEQ ID NO: 1110844 - RNA, 19 nt, Homo sapiens
cguacugacuucuccuaua

SEQ ID NO: 1110845 - RNA, 19 nt, Homo sapiens
gacaaagcuugacacauca

SEQ ID NO: 1110846 - RNA, 19 nt, Homo sapiens
cagcugaacuccuccaucu

SEQ ID NO: 1110847 - RNA, 19 nt, Homo sapiens
ccaaugggauccuccgaau

SEQ ID NO: 1110848 - RNA, 19 nt, Homo sapiens
gaggucacaugagguguuu

SEQ ID NO: 1110849 - RNA, 19 nt, Homo sapiens
gagugagaauuacuaugaa

SEQ ID NO: 1110850 - RNA, 19 nt, Homo sapiens
ggagaagccuuuggaucga

SEQ ID NO: 1110851 - RNA, 19 nt, Homo sapiens
gacaacauccuccagauuc

SEQ ID NO: 1110852 - RNA, 19 nt, Homo sapiens
guagagaucguagauguga

SEQ ID NO: 1110853 - RNA, 19 nt, Homo sapiens
gagcagagguagagaucgu

SEQ ID NO: 1110854 - RNA, 19 nt, Homo sapiens
gggaaugucgcucaagauu

SEQ ID NO: 1110855 - RNA, 19 nt, Homo sapiens
gccauagccugguuaaagu

SEQ ID NO: 1110856 - RNA, 19 nt, Homo sapiens
agaaacaagugcccaguca

SEQ ID NO: 1110857 - RNA, 19 nt, Homo sapiens
gaagaagucgggcaagaag

SEQ ID NO: 1110858 - RNA, 19 nt, Homo sapiens
gcuauaggcugagcuccaa

SEQ ID NO: 1110859 - RNA, 19 nt, Homo sapiens
gaaagucucagcccaggau

SEQ ID NO: 1110860 - RNA, 19 nt, Homo sapiens
ggaggaggcucuguauguc

SEQ ID NO: 1110861 - RNA, 19 nt, Homo sapiens
agagugagaauuacuauga

SEQ ID NO: 1110862 - RNA, 19 nt, Homo sapiens
ccaccuggguuacguuugu

SEQ ID NO: 1110863 - RNA, 19 nt, Homo sapiens
ggaccagucuucuguuuug

SEQ ID NO: 1110864 - RNA, 19 nt, Homo sapiens
gaagacacucauccaguug

SEQ ID NO: 1110865 - RNA, 19 nt, Homo sapiens
uguaucagcuuccucuuuc

SEQ ID NO: 1110866 - RNA, 19 nt, Homo sapiens
gguaaaggauagugguagu

SEQ ID NO: 1110867 - RNA, 19 nt, Homo sapiens
ccgcauuccugaccacuug

SEQ ID NO: 1110868 - RNA, 19 nt, Homo sapiens
ggacccuucccacuacaua

SEQ ID NO: 1110869 - RNA, 19 nt, Homo sapiens
cuacaagccuccuaguucu

SEQ ID NO: 1110870 - RNA, 19 nt, Homo sapiens
gaacuccuccaucuuccaa

SEQ ID NO: 1110871 - RNA, 19 nt, Homo sapiens
agaugacccuaucaaguuu

SEQ ID NO: 1110872 - RNA, 19 nt, Homo sapiens
gaauccagcuagggucaga

SEQ ID NO: 1110873 - RNA, 19 nt, Homo sapiens
ccacagaagcuggucauug

SEQ ID NO: 1110874 - RNA, 19 nt, Homo sapiens
guguugaaguaccaaguaa

SEQ ID NO: 1110875 - RNA, 19 nt, Homo sapiens
cuacaggauuaguguguug

SEQ ID NO: 1110876 - RNA, 19 nt, Homo sapiens
gaagcuggucauuguggua

SEQ ID NO: 1110877 - RNA, 19 nt, Homo sapiens
cccagacacugcaguuuga

SEQ ID NO: 1110878 - RNA, 19 nt, Homo sapiens
gaccugcccuuacaguagu

SEQ ID NO: 1110879 - RNA, 19 nt, Homo sapiens
uagggaaugucgcucaaga

SEQ ID NO: 1110880 - RNA, 19 nt, Homo sapiens
ugaaguaccaaguaaccua

SEQ ID NO: 1110881 - RNA, 19 nt, Homo sapiens
gcugaacuccuccaucuuc

SEQ ID NO: 1110882 - RNA, 19 nt, Homo sapiens
gcacccaggccucagaguu

SEQ ID NO: 1110883 - RNA, 19 nt, Homo sapiens
caagaaggagaagaaguaa

SEQ ID NO: 1110884 - RNA, 19 nt, Homo sapiens
uaacaguucgucuauuugu

SEQ ID NO: 1110885 - RNA, 19 nt, Homo sapiens
ccugaccacuugccauuug

SEQ ID NO: 1110886 - RNA, 19 nt, Homo sapiens
ccuauaagcgcuucucuuc

SEQ ID NO: 1110887 - RNA, 19 nt, Homo sapiens
ggccauagccugguuaaag

SEQ ID NO: 1110888 - RNA, 19 nt, Homo sapiens
ggagaagaaguaacaugga

SEQ ID NO: 1110889 - RNA, 19 nt, Homo sapiens
gcagcuggacuuggaaauu

SEQ ID NO: 1110890 - RNA, 19 nt, Homo sapiens
guagugcggugugcuuuua

SEQ ID NO: 1110891 - RNA, 19 nt, Homo sapiens
caacaaccaguuugacaca

SEQ ID NO: 1110892 - RNA, 19 nt, Homo sapiens
gcggacggcuguuccuauc

SEQ ID NO: 1110893 - RNA, 19 nt, Homo sapiens
ugacugcuguggacuugga

SEQ ID NO: 1110894 - RNA, 19 nt, Homo sapiens
uaauccacccucuuucuuu

SEQ ID NO: 1110895 - RNA, 19 nt, Homo sapiens
gauaauccacccucuuucu

SEQ ID NO: 1110896 - RNA, 19 nt, Homo sapiens
gugguaacgucaccuuuua

SEQ ID NO: 1110897 - RNA, 19 nt, Homo sapiens
gggcauggacaaagcuuga

SEQ ID NO: 1110898 - RNA, 19 nt, Homo sapiens
ggauucagguuacaaugcu

SEQ ID NO: 1110899 - RNA, 19 nt, Homo sapiens
gcugacugcugucgaugga

SEQ ID NO: 1110900 - RNA, 19 nt, Homo sapiens
gagcuaacaggaccaaugg

SEQ ID NO: 1110901 - RNA, 19 nt, Homo sapiens
gccauaaaccaauaacuag

SEQ ID NO: 1110902 - RNA, 19 nt, Homo sapiens
ugacaacauccuccagauu

SEQ ID NO: 1110903 - RNA, 19 nt, Homo sapiens
gguguugaaguaccaagua

SEQ ID NO: 1110904 - RNA, 19 nt, Homo sapiens
agaaggagaagaaguaaca

SEQ ID NO: 1110905 - RNA, 19 nt, Homo sapiens
aagaagaagucgggcaaga

SEQ ID NO: 1110906 - RNA, 19 nt, Homo sapiens
gcaccuggcccaacaacca

SEQ ID NO: 1110907 - RNA, 19 nt, Homo sapiens
ggagugauagcuucaugau

SEQ ID NO: 1110908 - RNA, 19 nt, Homo sapiens
ggugacugcuguggacuug

SEQ ID NO: 1110909 - RNA, 19 nt, Homo sapiens
ggccaaaucuagcuaugac

SEQ ID NO: 1110910 - RNA, 19 nt, Homo sapiens
acuuugagagugagaauua

SEQ ID NO: 1110911 - RNA, 19 nt, Homo sapiens
gcagccgucuguccuugau

SEQ ID NO: 1110912 - RNA, 19 nt, Homo sapiens
gcuggacccuucccacuac

SEQ ID NO: 1110913 - RNA, 19 nt, Homo sapiens
acaagagacuccacugcau

SEQ ID NO: 1110914 - RNA, 19 nt, Homo sapiens
gaaugucgcucaagauuuc

SEQ ID NO: 1110915 - RNA, 19 nt, Homo sapiens
ggaagacacucauccaguu

SEQ ID NO: 1110916 - RNA, 19 nt, Homo sapiens
guaacuguuucgugaauua

SEQ ID NO: 1110917 - RNA, 19 nt, Homo sapiens
gugagaagcuggacagaaa

SEQ ID NO: 1110918 - RNA, 19 nt, Homo sapiens
ugaaugcgcuuaucuccua

SEQ ID NO: 1110919 - RNA, 19 nt, Homo sapiens
uguaacaguucgucuauuu

SEQ ID NO: 1110920 - RNA, 19 nt, Homo sapiens
gagcuccaaugaacacuuu

SEQ ID NO: 1110921 - RNA, 19 nt, Homo sapiens
aacaaaugcuugaggguua

SEQ ID NO: 1110922 - RNA, 19 nt, Homo sapiens
ggacuuggauucagguuac

SEQ ID NO: 1110923 - RNA, 19 nt, Homo sapiens
cacagaagcuggucauugu

SEQ ID NO: 1110924 - RNA, 19 nt, Homo sapiens
gcacugugguggcacuuau

SEQ ID NO: 1110925 - RNA, 19 nt, Homo sapiens
gaucguagaugugaaugau

SEQ ID NO: 1110926 - RNA, 19 nt, Homo sapiens
gcccaggaaucgagaugua

SEQ ID NO: 1110927 - RNA, 19 nt, Homo sapiens
gaugugagccuccgcauuc

SEQ ID NO: 1110928 - RNA, 19 nt, Homo sapiens
caagauuuccugcuggaua

SEQ ID NO: 1110929 - RNA, 19 nt, Homo sapiens
cagaugacccuaucaaguu

SEQ ID NO: 1110930 - RNA, 19 nt, Homo sapiens
gagagaagcaaucggacua

SEQ ID NO: 1110931 - RNA, 19 nt, Homo sapiens
ccucugaucuucucuaugg

SEQ ID NO: 1110932 - RNA, 19 nt, Homo sapiens
cagcuggacuuggaaauug

SEQ ID NO: 1110933 - RNA, 19 nt, Homo sapiens
ggaaugucgcucaagauuu

SEQ ID NO: 1110934 - RNA, 19 nt, Homo sapiens
gguagacgcugugcuuugu

SEQ ID NO: 1110935 - RNA, 19 nt, Homo sapiens
ccaaugggauccuccgaau

SEQ ID NO: 1110936 - RNA, 19 nt, Homo sapiens
gaggucacaugagguguuu

SEQ ID NO: 1110937 - RNA, 19 nt, Homo sapiens
gagugagaauuacuaugaa

SEQ ID NO: 1110938 - RNA, 19 nt, Homo sapiens
ggagaagccuuuggaucga

SEQ ID NO: 1110939 - RNA, 19 nt, Homo sapiens
guagagaucguagauguga

SEQ ID NO: 1110940 - RNA, 19 nt, Homo sapiens
gagcagagguagagaucgu

SEQ ID NO: 1110941 - RNA, 19 nt, Homo sapiens
gggaaugucgcucaagauu

SEQ ID NO: 1110942 - RNA, 19 nt, Homo sapiens
gcuauaggcugagcuccaa

SEQ ID NO: 1110943 - RNA, 19 nt, Homo sapiens
agagugagaauuacuauga

SEQ ID NO: 1110944 - RNA, 19 nt, Homo sapiens
gaagacacucauccaguug

SEQ ID NO: 1110945 - RNA, 19 nt, Homo sapiens
ccaccuggguuacguuugu

SEQ ID NO: 1110946 - RNA, 19 nt, Homo sapiens
uguaagagguaacuaugug

SEQ ID NO: 1110947 - RNA, 19 nt, Homo sapiens
uguaucagcuuccucuuuc

SEQ ID NO: 1110948 - RNA, 19 nt, Homo sapiens
uagacgcugugcuuuguaa

SEQ ID NO: 1110949 - RNA, 19 nt, Homo sapiens
gguaaaggauagugguagu

SEQ ID NO: 1110950 - RNA, 19 nt, Homo sapiens
ccgcauuccugaccacuug

SEQ ID NO: 1110951 - RNA, 19 nt, Homo sapiens
agaugacccuaucaaguuu

SEQ ID NO: 1110952 - RNA, 19 nt, Homo sapiens
gaauccagcuagggucaga

SEQ ID NO: 1110953 - RNA, 19 nt, Homo sapiens
ccacagaagcuggucauug

SEQ ID NO: 1110954 - RNA, 19 nt, Homo sapiens
cuacaggauuaguguguug

SEQ ID NO: 1110955 - RNA, 19 nt, Homo sapiens
gaagcuggucauuguggua

SEQ ID NO: 1110956 - RNA, 19 nt, Homo sapiens
cccagacacugcaguuuga

SEQ ID NO: 1110957 - RNA, 19 nt, Homo sapiens
guaagugcccauagugaug

SEQ ID NO: 1110958 - RNA, 19 nt, Homo sapiens
uaacaguucgucuauuugu

SEQ ID NO: 1110959 - RNA, 19 nt, Homo sapiens
ccugaccacuugccauuug

SEQ ID NO: 1110960 - RNA, 19 nt, Homo sapiens
uagggaaugucgcucaaga

SEQ ID NO: 1110961 - RNA, 19 nt, Homo sapiens
gcagcuggacuuggaaauu

SEQ ID NO: 1110962 - RNA, 19 nt, Homo sapiens
gcggacggcuguuccuauc

SEQ ID NO: 1110963 - RNA, 19 nt, Homo sapiens
ugacugcuguggacuugga

SEQ ID NO: 1110964 - RNA, 19 nt, Homo sapiens
uaauccacccucuuucuuu

SEQ ID NO: 1110965 - RNA, 19 nt, Homo sapiens
gauaauccacccucuuucu

SEQ ID NO: 1110966 - RNA, 19 nt, Homo sapiens
gugguaacgucaccuuuua

SEQ ID NO: 1110967 - RNA, 19 nt, Homo sapiens
ggauucagguuacaaugcu

SEQ ID NO: 1110968 - RNA, 19 nt, Homo sapiens
gcugacugcugucgaugga

SEQ ID NO: 1110969 - RNA, 19 nt, Homo sapiens
ggagugauagcuucaugau

SEQ ID NO: 1110970 - RNA, 19 nt, Homo sapiens
ggugacugcuguggacuug

SEQ ID NO: 1110971 - RNA, 19 nt, Homo sapiens
ggccaaaucuagcuaugac

SEQ ID NO: 1110972 - RNA, 19 nt, Homo sapiens
acuuugagagugagaauua

SEQ ID NO: 1110973 - RNA, 19 nt, Homo sapiens
ggccauguccuagagagua

SEQ ID NO: 1110974 - RNA, 19 nt, Homo sapiens
gcugggaacccuccucuca

SEQ ID NO: 1110975 - RNA, 19 nt, Homo sapiens
aaaucuagcuaugacauca

SEQ ID NO: 1110976 - RNA, 19 nt, Homo sapiens
gaucgagaggccaaaucua

SEQ ID NO: 1110977 - RNA, 19 nt, Homo sapiens
uauccgugcuggacguaaa

SEQ ID NO: 1110978 - RNA, 19 nt, Homo sapiens
ggaaaaggcucaggaugca

SEQ ID NO: 1110979 - RNA, 19 nt, Homo sapiens
caauuugcuuugucuccuu

SEQ ID NO: 1110980 - RNA, 19 nt, Homo sapiens
gaggccaaaucuagcuaug

SEQ ID NO: 1110981 - RNA, 19 nt, Homo sapiens
gggagcaauucgauuagca

SEQ ID NO: 1110982 - RNA, 19 nt, Homo sapiens
ucguagaugugaaugauca

SEQ ID NO: 1110983 - RNA, 19 nt, Homo sapiens
ggaccucaaugacaaugcu

SEQ ID NO: 1110984 - RNA, 19 nt, Homo sapiens
aggcugagcuccaaugaac

SEQ ID NO: 1110985 - RNA, 19 nt, Homo sapiens
gacccuaucaaguuuguug

SEQ ID NO: 1110986 - RNA, 19 nt, Homo sapiens
ucagaugacccuaucaagu

SEQ ID NO: 1110987 - RNA, 19 nt, Homo sapiens
guaacaguucgucuauuug

SEQ ID NO: 1110988 - RNA, 19 nt, Homo sapiens
gcuacaggauuaguguguu

SEQ ID NO: 1110989 - RNA, 19 nt, Homo sapiens
agguagagaucguagaugu

SEQ ID NO: 1110990 - RNA, 19 nt, Homo sapiens
ccagaucccagccuguuug

SEQ ID NO: 1110991 - RNA, 19 nt, Homo sapiens
gcuacucgauccuuugacu

SEQ ID NO: 1110992 - RNA, 19 nt, Homo sapiens
ucacaugagguguuuguuc

SEQ ID NO: 1110993 - RNA, 19 nt, Homo sapiens
uaaaugacaaugccccuua

SEQ ID NO: 1110994 - RNA, 19 nt, Homo sapiens
cuggagaggugaaccaaag

SEQ ID NO: 1110995 - RNA, 19 nt, Homo sapiens
gcugugcuuuguaacuguu

SEQ ID NO: 1110996 - RNA, 19 nt, Homo sapiens
cauggucacugcuucugau

SEQ ID NO: 1110997 - RNA, 19 nt, Homo sapiens
gauccagacucagggucaa

SEQ ID NO: 1110998 - RNA, 19 nt, Homo sapiens
ugucccagaucuucgagaa

SEQ ID NO: 1110999 - RNA, 19 nt, Homo sapiens
augcuuggguuuccuauca

SEQ ID NO: 1111000 - RNA, 19 nt, Homo sapiens
gagaagcuggacagaaauc

SEQ ID NO: 1111001 - RNA, 19 nt, Homo sapiens
ucaagucugccuucaggaa

SEQ ID NO: 1111002 - RNA, 19 nt, Homo sapiens
gcuugaggguuauucugau

SEQ ID NO: 1111003 - RNA, 19 nt, Homo sapiens
acaaaugcuugaggguuau

SEQ ID NO: 1111004 - RNA, 19 nt, Homo sapiens
gugccugucucaccagauc

SEQ ID NO: 1111005 - RNA, 19 nt, Homo sapiens
ucaugcuacucgauccuuu

SEQ ID NO: 1111006 - RNA, 19 nt, Homo sapiens
aauccacccucuuucuuuc

SEQ ID NO: 1111007 - RNA, 19 nt, Homo sapiens
ggucacugcuucugaugcu

SEQ ID NO: 1111008 - RNA, 19 nt, Homo sapiens
ggugcugacugcugucgau

SEQ ID NO: 1111009 - RNA, 19 nt, Homo sapiens
ucccagaucuucgagaauc

SEQ ID NO: 1111010 - RNA, 19 nt, Homo sapiens
ggucacaugagguguuugu

SEQ ID NO: 1111011 - RNA, 19 nt, Homo sapiens
cucaauauuucagauguga

SEQ ID NO: 1111012 - RNA, 19 nt, Homo sapiens
uggaucugcuggacguaaa

SEQ ID NO: 1111013 - RNA, 19 nt, Homo sapiens
ggugagaagcuggacagaa

SEQ ID NO: 1111014 - RNA, 19 nt, Homo sapiens
ggacaaagcuugacacauc

SEQ ID NO: 1111015 - RNA, 19 nt, Homo sapiens
gaagucagguguagcuuaa

SEQ ID NO: 1111016 - RNA, 19 nt, Homo sapiens
gcagagcgcucaccacuug

SEQ ID NO: 1111017 - RNA, 19 nt, Homo sapiens
uggcaaauauccagaauua

SEQ ID NO: 1111018 - RNA, 19 nt, Homo sapiens
guacugacuucuccuauaa

SEQ ID NO: 1111019 - RNA, 19 nt, Homo sapiens
gagcaaauaugcaaagaga

SEQ ID NO: 1111020 - RNA, 19 nt, Homo sapiens
ugaauucgcugagcaaaua

SEQ ID NO: 1111021 - RNA, 19 nt, Homo sapiens
gcaagaaggagaagaagua

SEQ ID NO: 1111022 - RNA, 19 nt, Homo sapiens
guagagguguuccauuuaa

SEQ ID NO: 1111023 - RNA, 19 nt, Homo sapiens
ggauuaaacuggcauuuca

SEQ ID NO: 1111024 - RNA, 19 nt, Homo sapiens
uaacaggaccaauggauua

SEQ ID NO: 1111025 - RNA, 19 nt, Homo sapiens
gcacauuacugacgucaau

SEQ ID NO: 1111026 - RNA, 19 nt, Homo sapiens
caagaucaaugcucaaguu

SEQ ID NO: 1111027 - RNA, 19 nt, Homo sapiens
uaacgaguauuucucauug

SEQ ID NO: 1111028 - RNA, 19 nt, Homo sapiens
gaauuaguauugcagaaga

SEQ ID NO: 1111029 - RNA, 19 nt, Homo sapiens
aagauaaccucaacaaaga

SEQ ID NO: 1111030 - RNA, 19 nt, Homo sapiens
ucacaucuguugaucauug

SEQ ID NO: 1111031 - RNA, 19 nt, Homo sapiens
gacaacagcccagaaauaa

SEQ ID NO: 1111032 - RNA, 19 nt, Homo sapiens
gaucacuuauuccuucuuu

SEQ ID NO: 1111033 - RNA, 19 nt, Homo sapiens
gauaagaauccugguaaua

SEQ ID NO: 1111034 - RNA, 19 nt, Homo sapiens
gcaaauauccagaauuagu

SEQ ID NO: 1111035 - RNA, 19 nt, Homo sapiens
cgacaacagcccagaaaua

SEQ ID NO: 1111036 - RNA, 19 nt, Homo sapiens
gaaccucgcuaaggaucua

SEQ ID NO: 1111037 - RNA, 19 nt, Homo sapiens
gcaaauaugcaaagagaga

SEQ ID NO: 1111038 - RNA, 19 nt, Homo sapiens
uaagaauccugguaauaga

SEQ ID NO: 1111039 - RNA, 19 nt, Homo sapiens
gaaagacaauccugauggu

SEQ ID NO: 1111040 - RNA, 19 nt, Homo sapiens
gcagaagauccugauauua

SEQ ID NO: 1111041 - RNA, 19 nt, Homo sapiens
acucagagaucacuuauuc

SEQ ID NO: 1111042 - RNA, 19 nt, Homo sapiens
gcuagucgcuguaagagau

SEQ ID NO: 1111043 - RNA, 19 nt, Homo sapiens
gaagaugugaguugcaauu

SEQ ID NO: 1111044 - RNA, 19 nt, Homo sapiens
caagauaaccucaacaaag

SEQ ID NO: 1111045 - RNA, 19 nt, Homo sapiens
ggaagucagguguagcuua

SEQ ID NO: 1111046 - RNA, 19 nt, Homo sapiens
gagcaaauaccaacuaagu

SEQ ID NO: 1111047 - RNA, 19 nt, Homo sapiens
gaauagaccgugagcaaau

SEQ ID NO: 1111048 - RNA, 19 nt, Homo sapiens
aaguagagguguuccauuu

SEQ ID NO: 1111049 - RNA, 19 nt, Homo sapiens
caggaaacauucuaacuca

SEQ ID NO: 1111050 - RNA, 19 nt, Homo sapiens
gagaagaagaugugaguug

SEQ ID NO: 1111051 - RNA, 19 nt, Homo sapiens
gaugugaguugcaauugga

SEQ ID NO: 1111052 - RNA, 19 nt, Homo sapiens
gaagcucgaagcagguuua

SEQ ID NO: 1111053 - RNA, 19 nt, Homo sapiens
gaucaaugcucaaguuuug

SEQ ID NO: 1111054 - RNA, 19 nt, Homo sapiens
ucacgucacucucugauca

SEQ ID NO: 1111055 - RNA, 19 nt, Homo sapiens
gguaauagaugccaaugac

SEQ ID NO: 1111056 - RNA, 19 nt, Homo sapiens
gaagauccugauauuagua

SEQ ID NO: 1111057 - RNA, 19 nt, Homo sapiens
uagaauagccaguagugua

SEQ ID NO: 1111058 - RNA, 19 nt, Homo sapiens
gauaaccucaacaaagaua

SEQ ID NO: 1111059 - RNA, 19 nt, Homo sapiens
cagaagauccugauauuag

SEQ ID NO: 1111060 - RNA, 19 nt, Homo sapiens
caacagcccagaaauaauc

SEQ ID NO: 1111061 - RNA, 19 nt, Homo sapiens
gauucuagcuauugcucua

SEQ ID NO: 1111062 - RNA, 19 nt, Homo sapiens
cgauaaacauagaagcaaa

SEQ ID NO: 1111063 - RNA, 19 nt, Homo sapiens
gggaccaaaugaacagaaa

SEQ ID NO: 1111064 - RNA, 19 nt, Homo sapiens
gcucgaagcagguuuagga

SEQ ID NO: 1111065 - RNA, 19 nt, Homo sapiens
gcaauggcaacaagaagaa

SEQ ID NO: 1111066 - RNA, 19 nt, Homo sapiens
cguacugacuucuccuaua

SEQ ID NO: 1111067 - RNA, 19 nt, Homo sapiens
gacaaagcuugacacauca

SEQ ID NO: 1111068 - RNA, 19 nt, Homo sapiens
cagcugaacuccuccaucu

SEQ ID NO: 1111069 - RNA, 19 nt, Homo sapiens
ccggaaagaugaaauaaac

SEQ ID NO: 1111070 - RNA, 19 nt, Homo sapiens
gacaacauccuccagauuc

SEQ ID NO: 1111071 - RNA, 19 nt, Homo sapiens
gguguuccauuuaagauuc

SEQ ID NO: 1111072 - RNA, 19 nt, Homo sapiens
cagauaagaauccugguaa

SEQ ID NO: 1111073 - RNA, 19 nt, Homo sapiens
guacugaccgccuuagaug

SEQ ID NO: 1111074 - RNA, 19 nt, Homo sapiens
ugcagaagauccugauauu

SEQ ID NO: 1111075 - RNA, 19 nt, Homo sapiens
gccauagccugguuaaagu

SEQ ID NO: 1111076 - RNA, 19 nt, Homo sapiens
agaaacaagugcccaguca

SEQ ID NO: 1111077 - RNA, 19 nt, Homo sapiens
gaagaagucgggcaagaag

SEQ ID NO: 1111078 - RNA, 19 nt, Homo sapiens
gcaaagagagaagaagaug

SEQ ID NO: 1111079 - RNA, 19 nt, Homo sapiens
gaaagucucagcccaggau

SEQ ID NO: 1111080 - RNA, 19 nt, Homo sapiens
ggaggaggcucuguauguc

SEQ ID NO: 1111081 - RNA, 19 nt, Homo sapiens
ugaagcagauaagaagauu

SEQ ID NO: 1111082 - RNA, 19 nt, Homo sapiens
aagcgguacugcucagaua

SEQ ID NO: 1111083 - RNA, 19 nt, Homo sapiens
ggaccagucuucuguuuug

SEQ ID NO: 1111084 - RNA, 19 nt, Homo sapiens
uguagaaguuguagacgaa

SEQ ID NO: 1111085 - RNA, 19 nt, Homo sapiens
gguguaaaguaauuguaga

SEQ ID NO: 1111086 - RNA, 19 nt, Homo sapiens
ccgaggaucucucucaaca

SEQ ID NO: 1111087 - RNA, 19 nt, Homo sapiens
aauagaccgugagcaaaua

SEQ ID NO: 1111088 - RNA, 19 nt, Homo sapiens
ggagaaagacaauccugau

SEQ ID NO: 1111089 - RNA, 19 nt, Homo sapiens
gaucaaaugaauccagaau

SEQ ID NO: 1111090 - RNA, 19 nt, Homo sapiens
ccauaacccugcacauuac

SEQ ID NO: 1111091 - RNA, 19 nt, Homo sapiens
gaaguagaaagauauacga

SEQ ID NO: 1111092 - RNA, 19 nt, Homo sapiens
ggacccuucccacuacaua

SEQ ID NO: 1111093 - RNA, 19 nt, Homo sapiens
cuacaagccuccuaguucu

SEQ ID NO: 1111094 - RNA, 19 nt, Homo sapiens
gaacuccuccaucuuccaa

SEQ ID NO: 1111095 - RNA, 19 nt, Homo sapiens
aagagguacugccggauuu

SEQ ID NO: 1111096 - RNA, 19 nt, Homo sapiens
gcaccuccauccugagagu

SEQ ID NO: 1111097 - RNA, 19 nt, Homo sapiens
guacugcucagauaagaau

SEQ ID NO: 1111098 - RNA, 19 nt, Homo sapiens
gagaaagacaauccugaug

SEQ ID NO: 1111099 - RNA, 19 nt, Homo sapiens
ugauugaggauguuaauga

SEQ ID NO: 1111100 - RNA, 19 nt, Homo sapiens
gagagaagaagaugugagu

SEQ ID NO: 1111101 - RNA, 19 nt, Homo sapiens
guguugaaguaccaaguaa

SEQ ID NO: 1111102 - RNA, 19 nt, Homo sapiens
accauaacccugcacauua

SEQ ID NO: 1111103 - RNA, 19 nt, Homo sapiens
gaccgaggaucucucucaa

SEQ ID NO: 1111104 - RNA, 19 nt, Homo sapiens
ggacgagggcaucaacuca

SEQ ID NO: 1111105 - RNA, 19 nt, Homo sapiens
uaacucagcagccuuugga

SEQ ID NO: 1111106 - RNA, 19 nt, Homo sapiens
gggacuuacuugugaagga

SEQ ID NO: 1111107 - RNA, 19 nt, Homo sapiens
gggaacaauucuugagucu

SEQ ID NO: 1111108 - RNA, 19 nt, Homo sapiens
gaccugcccuuacaguagu

SEQ ID NO: 1111109 - RNA, 19 nt, Homo sapiens
ugaaguaccaaguaaccua

SEQ ID NO: 1111110 - RNA, 19 nt, Homo sapiens
gcugaacuccuccaucuuc

SEQ ID NO: 1111111 - RNA, 19 nt, Homo sapiens
gcacccaggccucagaguu

SEQ ID NO: 1111112 - RNA, 19 nt, Homo sapiens
caagaaggagaagaaguaa

SEQ ID NO: 1111113 - RNA, 19 nt, Homo sapiens
ucaguucucugcuccaagu

SEQ ID NO: 1111114 - RNA, 19 nt, Homo sapiens
gaagucagguguagcuuaa

SEQ ID NO: 1111115 - RNA, 19 nt, Homo sapiens
gcagagcgcucaccacuug

SEQ ID NO: 1111116 - RNA, 19 nt, Homo sapiens
uggcaaauauccagaauua

SEQ ID NO: 1111117 - RNA, 19 nt, Homo sapiens
gagcaaauaugcaaagaga

SEQ ID NO: 1111118 - RNA, 19 nt, Homo sapiens
ugaauucgcugagcaaaua

SEQ ID NO: 1111119 - RNA, 19 nt, Homo sapiens
guagagguguuccauuuaa

SEQ ID NO: 1111120 - RNA, 19 nt, Homo sapiens
gcacauuacugacgucaau

SEQ ID NO: 1111121 - RNA, 19 nt, Homo sapiens
uaacgaguauuucucauug

SEQ ID NO: 1111122 - RNA, 19 nt, Homo sapiens
cuagauaacuucuucauag

SEQ ID NO: 1111123 - RNA, 19 nt, Homo sapiens
gaauuaguauugcagaaga

SEQ ID NO: 1111124 - RNA, 19 nt, Homo sapiens
aagauaaccucaacaaaga

SEQ ID NO: 1111125 - RNA, 19 nt, Homo sapiens
ucacaucuguugaucauug

SEQ ID NO: 1111126 - RNA, 19 nt, Homo sapiens
gacaacagcccagaaauaa

SEQ ID NO: 1111127 - RNA, 19 nt, Homo sapiens
gaucacuuauuccuucuuu

SEQ ID NO: 1111128 - RNA, 19 nt, Homo sapiens
gauaagaauccugguaaua

SEQ ID NO: 1111129 - RNA, 19 nt, Homo sapiens
gcaaauauccagaauuagu

SEQ ID NO: 1111130 - RNA, 19 nt, Homo sapiens
cgacaacagcccagaaaua

SEQ ID NO: 1111131 - RNA, 19 nt, Homo sapiens
gaaccucgcuaaggaucua

SEQ ID NO: 1111132 - RNA, 19 nt, Homo sapiens
gcaaauaugcaaagagaga

SEQ ID NO: 1111133 - RNA, 19 nt, Homo sapiens
uaagaauccugguaauaga

SEQ ID NO: 1111134 - RNA, 19 nt, Homo sapiens
gaaagacaauccugauggu

SEQ ID NO: 1111135 - RNA, 19 nt, Homo sapiens
gcagaagauccugauauua

SEQ ID NO: 1111136 - RNA, 19 nt, Homo sapiens
acucagagaucacuuauuc

SEQ ID NO: 1111137 - RNA, 19 nt, Homo sapiens
gcuagucgcuguaagagau

SEQ ID NO: 1111138 - RNA, 19 nt, Homo sapiens
gaagaugugaguugcaauu

SEQ ID NO: 1111139 - RNA, 19 nt, Homo sapiens
caagauaaccucaacaaag

SEQ ID NO: 1111140 - RNA, 19 nt, Homo sapiens
ggaagucagguguagcuua

SEQ ID NO: 1111141 - RNA, 19 nt, Homo sapiens
gagcaaauaccaacuaagu

SEQ ID NO: 1111142 - RNA, 19 nt, Homo sapiens
gaauagaccgugagcaaau

SEQ ID NO: 1111143 - RNA, 19 nt, Homo sapiens
aaguagagguguuccauuu

SEQ ID NO: 1111144 - RNA, 19 nt, Homo sapiens
caggaaacauucuaacuca

SEQ ID NO: 1111145 - RNA, 19 nt, Homo sapiens
gagaagaagaugugaguug

SEQ ID NO: 1111146 - RNA, 19 nt, Homo sapiens
gaugugaguugcaauugga

SEQ ID NO: 1111147 - RNA, 19 nt, Homo sapiens
ucacgucacucucugauca

SEQ ID NO: 1111148 - RNA, 19 nt, Homo sapiens
gguaauagaugccaaugac

SEQ ID NO: 1111149 - RNA, 19 nt, Homo sapiens
gaagauccugauauuagua

SEQ ID NO: 1111150 - RNA, 19 nt, Homo sapiens
gauaaccucaacaaagaua

SEQ ID NO: 1111151 - RNA, 19 nt, Homo sapiens
cagaagauccugauauuag

SEQ ID NO: 1111152 - RNA, 19 nt, Homo sapiens
gauaacuucuucauagagu

SEQ ID NO: 1111153 - RNA, 19 nt, Homo sapiens
caacagcccagaaauaauc

SEQ ID NO: 1111154 - RNA, 19 nt, Homo sapiens
gauucuagcuauugcucua

SEQ ID NO: 1111155 - RNA, 19 nt, Homo sapiens
cgauaaacauagaagcaaa

SEQ ID NO: 1111156 - RNA, 19 nt, Homo sapiens
ccggaaagaugaaauaaac

SEQ ID NO: 1111157 - RNA, 19 nt, Homo sapiens
ucauagaguucgcaaaaua

SEQ ID NO: 1111158 - RNA, 19 nt, Homo sapiens
gauucuagauaacuucuuc

SEQ ID NO: 1111159 - RNA, 19 nt, Homo sapiens
gguguuccauuuaagauuc

SEQ ID NO: 1111160 - RNA, 19 nt, Homo sapiens
cagauaagaauccugguaa

SEQ ID NO: 1111161 - RNA, 19 nt, Homo sapiens
guacugaccgccuuagaug

SEQ ID NO: 1111162 - RNA, 19 nt, Homo sapiens
ugcagaagauccugauauu

SEQ ID NO: 1111163 - RNA, 19 nt, Homo sapiens
gcaaagagagaagaagaug

SEQ ID NO: 1111164 - RNA, 19 nt, Homo sapiens
ugaagcagauaagaagauu

SEQ ID NO: 1111165 - RNA, 19 nt, Homo sapiens
aagcgguacugcucagaua

SEQ ID NO: 1111166 - RNA, 19 nt, Homo sapiens
uguagaaguuguagacgaa

SEQ ID NO: 1111167 - RNA, 19 nt, Homo sapiens
gguguaaaguaauuguaga

SEQ ID NO: 1111168 - RNA, 19 nt, Homo sapiens
ccgaggaucucucucaaca

SEQ ID NO: 1111169 - RNA, 19 nt, Homo sapiens
aauagaccgugagcaaaua

SEQ ID NO: 1111170 - RNA, 19 nt, Homo sapiens
ggagaaagacaauccugau

SEQ ID NO: 1111171 - RNA, 19 nt, Homo sapiens
gaucaaaugaauccagaau

SEQ ID NO: 1111172 - RNA, 19 nt, Homo sapiens
ccauaacccugcacauuac

SEQ ID NO: 1111173 - RNA, 19 nt, Homo sapiens
gaaguagaaagauauacga

SEQ ID NO: 1111174 - RNA, 19 nt, Homo sapiens
aagagguacugccggauuu

SEQ ID NO: 1111175 - RNA, 19 nt, Homo sapiens
gcaccuccauccugagagu

SEQ ID NO: 1111176 - RNA, 19 nt, Homo sapiens
guacugcucagauaagaau

SEQ ID NO: 1111177 - RNA, 19 nt, Homo sapiens
gagaaagacaauccugaug

SEQ ID NO: 1111178 - RNA, 19 nt, Homo sapiens
ugauugaggauguuaauga

SEQ ID NO: 1111179 - RNA, 19 nt, Homo sapiens
gagagaagaagaugugagu

SEQ ID NO: 1111180 - RNA, 19 nt, Homo sapiens
accauaacccugcacauua

SEQ ID NO: 1111181 - RNA, 19 nt, Homo sapiens
gaccgaggaucucucucaa

SEQ ID NO: 1111182 - RNA, 19 nt, Homo sapiens
ggacgagggcaucaacuca

SEQ ID NO: 1111183 - RNA, 19 nt, Homo sapiens
uaacucagcagccuuugga

SEQ ID NO: 1111184 - RNA, 19 nt, Homo sapiens
gggacuuacuugugaagga

SEQ ID NO: 1111185 - RNA, 19 nt, Homo sapiens
gggaacaauucuugagucu

SEQ ID NO: 1111186 - RNA, 19 nt, Homo sapiens
ggcagguacuauuuccuuu

SEQ ID NO: 1111187 - RNA, 19 nt, Homo sapiens
ucaguucucugcuccaagu

SEQ ID NO: 1111188 - RNA, 19 nt, Homo sapiens
caagagguacugccggauu

SEQ ID NO: 1111189 - RNA, 19 nt, Homo sapiens
cagaauuaguauugcagaa

SEQ ID NO: 1111190 - RNA, 19 nt, Homo sapiens
ucaacucagagaucacuua

SEQ ID NO: 1111191 - RNA, 19 nt, Homo sapiens
caggacguguacaggguua

SEQ ID NO: 1111192 - RNA, 19 nt, Homo sapiens
uaauagaugccaaugacaa

SEQ ID NO: 1111193 - RNA, 19 nt, Homo sapiens
gggaugggaacaauucuug

SEQ ID NO: 1111194 - RNA, 19 nt, Homo sapiens
aaagagagaagaagaugug

SEQ ID NO: 1111195 - RNA, 19 nt, Homo sapiens
aggcugagaugcaguuuua

SEQ ID NO: 1111196 - RNA, 19 nt, Homo sapiens
ggauuacacuacaggaaac

SEQ ID NO: 1111197 - RNA, 19 nt, Homo sapiens
agaagauccugauauuagu

SEQ ID NO: 1111198 - RNA, 19 nt, Homo sapiens
ggucaaauuuaugguuauc

SEQ ID NO: 1111199 - RNA, 19 nt, Homo sapiens
gcagguacuauuuccuuug

SEQ ID NO: 1111200 - RNA, 19 nt, Homo sapiens
ggcaucaacucagagauca

SEQ ID NO: 1111201 - RNA, 19 nt, Homo sapiens
uaaguccuaacgaguauuu

SEQ ID NO: 1111202 - RNA, 19 nt, Homo sapiens
uagcuuaaguagagguguu

SEQ ID NO: 1111203 - RNA, 19 nt, Homo sapiens
caacucagagaucacuuau

SEQ ID NO: 1111204 - RNA, 19 nt, Homo sapiens
ucagauaagaauccuggua

SEQ ID NO: 1111205 - RNA, 19 nt, Homo sapiens
gcugagcaaauaccaacua

SEQ ID NO: 1111206 - RNA, 19 nt, Homo sapiens
ccgaauagaccgugagcaa

SEQ ID NO: 1111207 - RNA, 19 nt, Homo sapiens
cugagcaaauaccaacuaa

SEQ ID NO: 1111208 - RNA, 19 nt, Homo sapiens
gauccugauauuaguauga

SEQ ID NO: 1111209 - RNA, 19 nt, Homo sapiens
aagaagaugugaguugcaa

SEQ ID NO: 1111210 - RNA, 19 nt, Homo sapiens
gguggaaaauccuuuaaau

SEQ ID NO: 1111211 - RNA, 19 nt, Homo sapiens
gcucuacgccugcgacagu

SEQ ID NO: 1111212 - RNA, 19 nt, Homo sapiens
guucgcagauagcuugcaa

SEQ ID NO: 1111213 - RNA, 19 nt, Homo sapiens
cgaauagaccgugagcaaa

SEQ ID NO: 1111214 - RNA, 19 nt, Homo sapiens
ggacaaagcuugacacauc

SEQ ID NO: 1111215 - RNA, 19 nt, Homo sapiens
ggacuuugccuuauucuua

SEQ ID NO: 1111216 - RNA, 19 nt, Homo sapiens
gaacagagaucucauagcu

SEQ ID NO: 1111217 - RNA, 19 nt, Homo sapiens
gaagucagguguaauauag

SEQ ID NO: 1111218 - RNA, 19 nt, Homo sapiens
guacugacuucuccuauaa

SEQ ID NO: 1111219 - RNA, 19 nt, Homo sapiens
gagcaaauaugcaaagaga

SEQ ID NO: 1111220 - RNA, 19 nt, Homo sapiens
ucucauagcuugauauuga

SEQ ID NO: 1111221 - RNA, 19 nt, Homo sapiens
gcagacaacuugcaagaga

SEQ ID NO: 1111222 - RNA, 19 nt, Homo sapiens
gcaagaaggagaagaagua

SEQ ID NO: 1111223 - RNA, 19 nt, Homo sapiens
ggagaagucagguguaaua

SEQ ID NO: 1111224 - RNA, 19 nt, Homo sapiens
ggauuaaacuggcauuuca

SEQ ID NO: 1111225 - RNA, 19 nt, Homo sapiens
uaacaggaccaauggauua

SEQ ID NO: 1111226 - RNA, 19 nt, Homo sapiens
caagaucaaugcucaaguu

SEQ ID NO: 1111227 - RNA, 19 nt, Homo sapiens
gaagaacagagaucucaua

SEQ ID NO: 1111228 - RNA, 19 nt, Homo sapiens
guagaagcaucaccuugua

SEQ ID NO: 1111229 - RNA, 19 nt, Homo sapiens
gacauuccauucaagauuu

SEQ ID NO: 1111230 - RNA, 19 nt, Homo sapiens
aaacagacauuccauucaa

SEQ ID NO: 1111231 - RNA, 19 nt, Homo sapiens
ccacaucuccuacucuaua

SEQ ID NO: 1111232 - RNA, 19 nt, Homo sapiens
gacaacagcccagaaauaa

SEQ ID NO: 1111233 - RNA, 19 nt, Homo sapiens
ggacggagguggucucucu

SEQ ID NO: 1111234 - RNA, 19 nt, Homo sapiens
cgacaacagcccagaaaua

SEQ ID NO: 1111235 - RNA, 19 nt, Homo sapiens
gaaccucgcuaaggaucua

SEQ ID NO: 1111236 - RNA, 19 nt, Homo sapiens
ccacggauccugauauaaa

SEQ ID NO: 1111237 - RNA, 19 nt, Homo sapiens
gcaaauaugcaaagagaga

SEQ ID NO: 1111238 - RNA, 19 nt, Homo sapiens
gcaaauacccagaguuauc

SEQ ID NO: 1111239 - RNA, 19 nt, Homo sapiens
ucaaggauaccaaugauaa

SEQ ID NO: 1111240 - RNA, 19 nt, Homo sapiens
gaagaugugaguugcaauu

SEQ ID NO: 1111241 - RNA, 19 nt, Homo sapiens
ucacuucucucucugauca

SEQ ID NO: 1111242 - RNA, 19 nt, Homo sapiens
gaauagaccgugagcaaau

SEQ ID NO: 1111243 - RNA, 19 nt, Homo sapiens
gagaagaagaugugaguug

SEQ ID NO: 1111244 - RNA, 19 nt, Homo sapiens
gaaauaaucaucacuucuc

SEQ ID NO: 1111245 - RNA, 19 nt, Homo sapiens
guacacgacuaucgcuuga

SEQ ID NO: 1111246 - RNA, 19 nt, Homo sapiens
gaugugaguugcaauugga

SEQ ID NO: 1111247 - RNA, 19 nt, Homo sapiens
gaagcucgaagcagguuua

SEQ ID NO: 1111248 - RNA, 19 nt, Homo sapiens
gaucaaugcucaaguuuug

SEQ ID NO: 1111249 - RNA, 19 nt, Homo sapiens
uagaauagccaguagugua

SEQ ID NO: 1111250 - RNA, 19 nt, Homo sapiens
gacaugguuugcaguguuu

SEQ ID NO: 1111251 - RNA, 19 nt, Homo sapiens
gagagcagacaccagaaua

SEQ ID NO: 1111252 - RNA, 19 nt, Homo sapiens
caacagcccagaaauaauc

SEQ ID NO: 1111253 - RNA, 19 nt, Homo sapiens
cagcagagacgaauauaga

SEQ ID NO: 1111254 - RNA, 19 nt, Homo sapiens
uggcaaauacccagaguua

SEQ ID NO: 1111255 - RNA, 19 nt, Homo sapiens
ggccacaucuccuacucua

SEQ ID NO: 1111256 - RNA, 19 nt, Homo sapiens
gcaagccgccucuuucuuc

SEQ ID NO: 1111257 - RNA, 19 nt, Homo sapiens
gaaacagacauuccauuca

SEQ ID NO: 1111258 - RNA, 19 nt, Homo sapiens
gguguaauauagaaacaga

SEQ ID NO: 1111259 - RNA, 19 nt, Homo sapiens
gagaaaacagguaugauua

SEQ ID NO: 1111260 - RNA, 19 nt, Homo sapiens
ugucaagucuggaccugua

SEQ ID NO: 1111261 - RNA, 19 nt, Homo sapiens
gggaccaaaugaacagaaa

SEQ ID NO: 1111262 - RNA, 19 nt, Homo sapiens
gcucgaagcagguuuagga

SEQ ID NO: 1111263 - RNA, 19 nt, Homo sapiens
gcaauggcaacaagaagaa

SEQ ID NO: 1111264 - RNA, 19 nt, Homo sapiens
gcagacaccagaauacaau

SEQ ID NO: 1111265 - RNA, 19 nt, Homo sapiens
cguacugacuucuccuaua

SEQ ID NO: 1111266 - RNA, 19 nt, Homo sapiens
gacaaagcuugacacauca

SEQ ID NO: 1111267 - RNA, 19 nt, Homo sapiens
cagcugaacuccuccaucu

SEQ ID NO: 1111268 - RNA, 19 nt, Homo sapiens
gggacuuacuugugaagaa

SEQ ID NO: 1111269 - RNA, 19 nt, Homo sapiens
agaauaaccagucauuuga

SEQ ID NO: 1111270 - RNA, 19 nt, Homo sapiens
gagaucucauagcuugaua

SEQ ID NO: 1111271 - RNA, 19 nt, Homo sapiens
gacaacauccuccagauuc

SEQ ID NO: 1111272 - RNA, 19 nt, Homo sapiens
cagaaauaaucaucacuuc

SEQ ID NO: 1111273 - RNA, 19 nt, Homo sapiens
gaaauuucugucaaggaua

SEQ ID NO: 1111274 - RNA, 19 nt, Homo sapiens
gccauagccugguuaaagu

SEQ ID NO: 1111275 - RNA, 19 nt, Homo sapiens
agaaacaagugcccaguca

SEQ ID NO: 1111276 - RNA, 19 nt, Homo sapiens
gaagaagucgggcaagaag

SEQ ID NO: 1111277 - RNA, 19 nt, Homo sapiens
gcaaagagagaagaagaug

SEQ ID NO: 1111278 - RNA, 19 nt, Homo sapiens
gaaagucucagcccaggau

SEQ ID NO: 1111279 - RNA, 19 nt, Homo sapiens
ggaggaggcucuguauguc

SEQ ID NO: 1111280 - RNA, 19 nt, Homo sapiens
gacuuugccuuauucuuau

SEQ ID NO: 1111281 - RNA, 19 nt, Homo sapiens
gauuaagaauaaccaguca

SEQ ID NO: 1111282 - RNA, 19 nt, Homo sapiens
ugagauaaacuacuacuuc

SEQ ID NO: 1111283 - RNA, 19 nt, Homo sapiens
aauagaccgugagcaaaua

SEQ ID NO: 1111284 - RNA, 19 nt, Homo sapiens
ggaccagucuucuguuuug

SEQ ID NO: 1111285 - RNA, 19 nt, Homo sapiens
ggcaggugcuauuuccuuu

SEQ ID NO: 1111286 - RNA, 19 nt, Homo sapiens
uugaagauguagaaaggua

SEQ ID NO: 1111287 - RNA, 19 nt, Homo sapiens
aagaauaaccagucauuug

SEQ ID NO: 1111288 - RNA, 19 nt, Homo sapiens
gaucucauagcuugauauu

SEQ ID NO: 1111289 - RNA, 19 nt, Homo sapiens
agacaugguuugcaguguu

SEQ ID NO: 1111290 - RNA, 19 nt, Homo sapiens
ggucaaugcugagauaaac

SEQ ID NO: 1111291 - RNA, 19 nt, Homo sapiens
gggaggauuugacuucaca

SEQ ID NO: 1111292 - RNA, 19 nt, Homo sapiens
aaacacgggaucuggauuu

SEQ ID NO: 1111293 - RNA, 19 nt, Homo sapiens
aaucaucacuucucucucu

SEQ ID NO: 1111294 - RNA, 19 nt, Homo sapiens
ggauccugauauaaacaua

SEQ ID NO: 1111295 - RNA, 19 nt, Homo sapiens
ggacccuucccacuacaua

SEQ ID NO: 1111296 - RNA, 19 nt, Homo sapiens
cuacaagccuccuaguucu

SEQ ID NO: 1111297 - RNA, 19 nt, Homo sapiens
gaacuccuccaucuuccaa

SEQ ID NO: 1111298 - RNA, 19 nt, Homo sapiens
gagagaagaagaugugagu

SEQ ID NO: 1111299 - RNA, 19 nt, Homo sapiens
gcagagacgaauauagaau

SEQ ID NO: 1111300 - RNA, 19 nt, Homo sapiens
gaaucugcauccgcuggua

SEQ ID NO: 1111301 - RNA, 19 nt, Homo sapiens
ugauugaggauguuaauga

SEQ ID NO: 1111302 - RNA, 19 nt, Homo sapiens
ggacuuacuugugaagaac

SEQ ID NO: 1111303 - RNA, 19 nt, Homo sapiens
guguugaaguaccaaguaa

SEQ ID NO: 1111304 - RNA, 19 nt, Homo sapiens
ugccacggauccugauaua

SEQ ID NO: 1111305 - RNA, 19 nt, Homo sapiens
gcuccgcguucuucgauau

SEQ ID NO: 1111306 - RNA, 19 nt, Homo sapiens
ugccaccgcucacauagaa

SEQ ID NO: 1111307 - RNA, 19 nt, Homo sapiens
gaccugcccuuacaguagu

SEQ ID NO: 1111308 - RNA, 19 nt, Homo sapiens
ugaaguaccaaguaaccua

SEQ ID NO: 1111309 - RNA, 19 nt, Homo sapiens
gcugaacuccuccaucuuc

SEQ ID NO: 1111310 - RNA, 19 nt, Homo sapiens
gcacccaggccucagaguu

SEQ ID NO: 1111311 - RNA, 19 nt, Homo sapiens
caagaaggagaagaaguaa

SEQ ID NO: 1111312 - RNA, 19 nt, Homo sapiens
augcugagauaaacuacua

SEQ ID NO: 1111313 - RNA, 19 nt, Homo sapiens
cagagacgaauauagaauu

SEQ ID NO: 1111314 - RNA, 19 nt, Homo sapiens
ggacuuugccuuauucuua

SEQ ID NO: 1111315 - RNA, 19 nt, Homo sapiens
gaacagagaucucauagcu

SEQ ID NO: 1111316 - RNA, 19 nt, Homo sapiens
gaagucagguguaauauag

SEQ ID NO: 1111317 - RNA, 19 nt, Homo sapiens
gagcaaauaugcaaagaga

SEQ ID NO: 1111318 - RNA, 19 nt, Homo sapiens
ucucauagcuugauauuga

SEQ ID NO: 1111319 - RNA, 19 nt, Homo sapiens
gcagacaacuugcaagaga

SEQ ID NO: 1111320 - RNA, 19 nt, Homo sapiens
ggagaagucagguguaaua

SEQ ID NO: 1111321 - RNA, 19 nt, Homo sapiens
gaagaacagagaucucaua

SEQ ID NO: 1111322 - RNA, 19 nt, Homo sapiens
guagaagcaucaccuugua

SEQ ID NO: 1111323 - RNA, 19 nt, Homo sapiens
gacauuccauucaagauuu

SEQ ID NO: 1111324 - RNA, 19 nt, Homo sapiens
aaacagacauuccauucaa

SEQ ID NO: 1111325 - RNA, 19 nt, Homo sapiens
ccacaucuccuacucuaua

SEQ ID NO: 1111326 - RNA, 19 nt, Homo sapiens
gacaacagcccagaaauaa

SEQ ID NO: 1111327 - RNA, 19 nt, Homo sapiens
ggacggagguggucucucu

SEQ ID NO: 1111328 - RNA, 19 nt, Homo sapiens
cgacaacagcccagaaaua

SEQ ID NO: 1111329 - RNA, 19 nt, Homo sapiens
gaaccucgcuaaggaucua

SEQ ID NO: 1111330 - RNA, 19 nt, Homo sapiens
ccacggauccugauauaaa

SEQ ID NO: 1111331 - RNA, 19 nt, Homo sapiens
gcaaauaugcaaagagaga

SEQ ID NO: 1111332 - RNA, 19 nt, Homo sapiens
gcaaauacccagaguuauc

SEQ ID NO: 1111333 - RNA, 19 nt, Homo sapiens
ucaaggauaccaaugauaa

SEQ ID NO: 1111334 - RNA, 19 nt, Homo sapiens
gaagaugugaguugcaauu

SEQ ID NO: 1111335 - RNA, 19 nt, Homo sapiens
ucacuucucucucugauca

SEQ ID NO: 1111336 - RNA, 19 nt, Homo sapiens
gaauagaccgugagcaaau

SEQ ID NO: 1111337 - RNA, 19 nt, Homo sapiens
gagaagaagaugugaguug

SEQ ID NO: 1111338 - RNA, 19 nt, Homo sapiens
gaaauaaucaucacuucuc

SEQ ID NO: 1111339 - RNA, 19 nt, Homo sapiens
guacacgacuaucgcuuga

SEQ ID NO: 1111340 - RNA, 19 nt, Homo sapiens
gaugugaguugcaauugga

SEQ ID NO: 1111341 - RNA, 19 nt, Homo sapiens
gacaugguuugcaguguuu

SEQ ID NO: 1111342 - RNA, 19 nt, Homo sapiens
gagagcagacaccagaaua

SEQ ID NO: 1111343 - RNA, 19 nt, Homo sapiens
caacagcccagaaauaauc

SEQ ID NO: 1111344 - RNA, 19 nt, Homo sapiens
cagcagagacgaauauaga

SEQ ID NO: 1111345 - RNA, 19 nt, Homo sapiens
uggcaaauacccagaguua

SEQ ID NO: 1111346 - RNA, 19 nt, Homo sapiens
ggccacaucuccuacucua

SEQ ID NO: 1111347 - RNA, 19 nt, Homo sapiens
gcaagccgccucuuucuuc

SEQ ID NO: 1111348 - RNA, 19 nt, Homo sapiens
gaaacagacauuccauuca

SEQ ID NO: 1111349 - RNA, 19 nt, Homo sapiens
gguguaauauagaaacaga

SEQ ID NO: 1111350 - RNA, 19 nt, Homo sapiens
gagaaaacagguaugauua

SEQ ID NO: 1111351 - RNA, 19 nt, Homo sapiens
ugucaagucuggaccugua

SEQ ID NO: 1111352 - RNA, 19 nt, Homo sapiens
gcagacaccagaauacaau

SEQ ID NO: 1111353 - RNA, 19 nt, Homo sapiens
agaauaaccagucauuuga

SEQ ID NO: 1111354 - RNA, 19 nt, Homo sapiens
gagaucucauagcuugaua

SEQ ID NO: 1111355 - RNA, 19 nt, Homo sapiens
gggacuuacuugugaagaa

SEQ ID NO: 1111356 - RNA, 19 nt, Homo sapiens
cagaaauaaucaucacuuc

SEQ ID NO: 1111357 - RNA, 19 nt, Homo sapiens
gaaauuucugucaaggaua

SEQ ID NO: 1111358 - RNA, 19 nt, Homo sapiens
gcaaagagagaagaagaug

SEQ ID NO: 1111359 - RNA, 19 nt, Homo sapiens
gacuuugccuuauucuuau

SEQ ID NO: 1111360 - RNA, 19 nt, Homo sapiens
gauuaagaauaaccaguca

SEQ ID NO: 1111361 - RNA, 19 nt, Homo sapiens
ugagauaaacuacuacuuc

SEQ ID NO: 1111362 - RNA, 19 nt, Homo sapiens
uugaagauguagaaaggua

SEQ ID NO: 1111363 - RNA, 19 nt, Homo sapiens
aagaauaaccagucauuug

SEQ ID NO: 1111364 - RNA, 19 nt, Homo sapiens
gaucucauagcuugauauu

SEQ ID NO: 1111365 - RNA, 19 nt, Homo sapiens
ggcaggugcuauuuccuuu

SEQ ID NO: 1111366 - RNA, 19 nt, Homo sapiens
aauagaccgugagcaaaua

SEQ ID NO: 1111367 - RNA, 19 nt, Homo sapiens
agacaugguuugcaguguu

SEQ ID NO: 1111368 - RNA, 19 nt, Homo sapiens
ggucaaugcugagauaaac

SEQ ID NO: 1111369 - RNA, 19 nt, Homo sapiens
gggaggauuugacuucaca

SEQ ID NO: 1111370 - RNA, 19 nt, Homo sapiens
aaacacgggaucuggauuu

SEQ ID NO: 1111371 - RNA, 19 nt, Homo sapiens
aaucaucacuucucucucu

SEQ ID NO: 1111372 - RNA, 19 nt, Homo sapiens
ggauccugauauaaacaua

SEQ ID NO: 1111373 - RNA, 19 nt, Homo sapiens
gcagagacgaauauagaau

SEQ ID NO: 1111374 - RNA, 19 nt, Homo sapiens
gaaucugcauccgcuggua

SEQ ID NO: 1111375 - RNA, 19 nt, Homo sapiens
ugauugaggauguuaauga

SEQ ID NO: 1111376 - RNA, 19 nt, Homo sapiens
gagagaagaagaugugagu

SEQ ID NO: 1111377 - RNA, 19 nt, Homo sapiens
ugccacggauccugauaua

SEQ ID NO: 1111378 - RNA, 19 nt, Homo sapiens
ggacuuacuugugaagaac

SEQ ID NO: 1111379 - RNA, 19 nt, Homo sapiens
gcuccgcguucuucgauau

SEQ ID NO: 1111380 - RNA, 19 nt, Homo sapiens
ugccaccgcucacauagaa

SEQ ID NO: 1111381 - RNA, 19 nt, Homo sapiens
augcugagauaaacuacua

SEQ ID NO: 1111382 - RNA, 19 nt, Homo sapiens
cagagacgaauauagaauu

SEQ ID NO: 1111383 - RNA, 19 nt, Homo sapiens
uaauuccgaugguggcaaa

SEQ ID NO: 1111384 - RNA, 19 nt, Homo sapiens
ccaaugaagacaugguuug

SEQ ID NO: 1111385 - RNA, 19 nt, Homo sapiens
agaagucagguguaauaua

SEQ ID NO: 1111386 - RNA, 19 nt, Homo sapiens
gaucagauuuuggagaauu

SEQ ID NO: 1111387 - RNA, 19 nt, Homo sapiens
gcacugcccagagcacaaa

SEQ ID NO: 1111388 - RNA, 19 nt, Homo sapiens
aaagagagaagaagaugug

SEQ ID NO: 1111389 - RNA, 19 nt, Homo sapiens
acuacaaacuggugacaga

SEQ ID NO: 1111390 - RNA, 19 nt, Homo sapiens
ccagaaauaaucaucacuu

SEQ ID NO: 1111391 - RNA, 19 nt, Homo sapiens
gaauaaccagucauuugau

SEQ ID NO: 1111392 - RNA, 19 nt, Homo sapiens
gaaaacagguaugauuaag

SEQ ID NO: 1111393 - RNA, 19 nt, Homo sapiens
gcccagagcacaaaacaua

SEQ ID NO: 1111394 - RNA, 19 nt, Homo sapiens
ucaaugcugagauaaacua

SEQ ID NO: 1111395 - RNA, 19 nt, Homo sapiens
agucagguguaauauagaa

SEQ ID NO: 1111396 - RNA, 19 nt, Homo sapiens
gaucuggauuucggaggaa

SEQ ID NO: 1111397 - RNA, 19 nt, Homo sapiens
gagaauucaccuccaggaa

SEQ ID NO: 1111398 - RNA, 19 nt, Homo sapiens
gggaagaacagagaucuca

SEQ ID NO: 1111399 - RNA, 19 nt, Homo sapiens
agacaacuugcaagagaua

SEQ ID NO: 1111400 - RNA, 19 nt, Homo sapiens
cggaggaaauggagaaguc

SEQ ID NO: 1111401 - RNA, 19 nt, Homo sapiens
gagcagacaccagaauaca

SEQ ID NO: 1111402 - RNA, 19 nt, Homo sapiens
aagaagaugugaguugcaa

SEQ ID NO: 1111403 - RNA, 19 nt, Homo sapiens
caauaacuacuacaaacug

SEQ ID NO: 1111404 - RNA, 19 nt, Homo sapiens
agacauuccauucaagauu

SEQ ID NO: 1111405 - RNA, 19 nt, Homo sapiens
agaaacagacauuccauuc

SEQ ID NO: 1111406 - RNA, 19 nt, Homo sapiens
ccgaauagaccgugagcaa

SEQ ID NO: 1111407 - RNA, 19 nt, Homo sapiens
cauagaaauccuugaugaa

SEQ ID NO: 1111408 - RNA, 19 nt, Homo sapiens
cgaccgcccuguacucucu

SEQ ID NO: 1111409 - RNA, 19 nt, Homo sapiens
ucaauggccacaucuccua

SEQ ID NO: 1111410 - RNA, 19 nt, Homo sapiens
gaagcaucaccuuguaugu

SEQ ID NO: 1111411 - RNA, 19 nt, Homo sapiens
gacagccacugaccaggau

SEQ ID NO: 1111412 - RNA, 19 nt, Homo sapiens
gguggaaaauccuuuaaau

SEQ ID NO: 1111413 - RNA, 19 nt, Homo sapiens
gagccuccauugcgcaagu

SEQ ID NO: 1111414 - RNA, 19 nt, Homo sapiens
ggacaaagcuugacacauc

SEQ ID NO: 1111415 - RNA, 19 nt, Homo sapiens
gggcaaaucuuuagucuga

SEQ ID NO: 1111416 - RNA, 19 nt, Homo sapiens
gaaagacggaguuuaauuu

SEQ ID NO: 1111417 - RNA, 19 nt, Homo sapiens
guacugacuucuccuauaa

SEQ ID NO: 1111418 - RNA, 19 nt, Homo sapiens
gaaacaggaugguaguaaa

SEQ ID NO: 1111419 - RNA, 19 nt, Homo sapiens
gacaauagcccagaaguua

SEQ ID NO: 1111420 - RNA, 19 nt, Homo sapiens
gcaagaaggagaagaagua

SEQ ID NO: 1111421 - RNA, 19 nt, Homo sapiens
ucaaagagcggagaaauua

SEQ ID NO: 1111422 - RNA, 19 nt, Homo sapiens
uaaacucucugcagaagua

SEQ ID NO: 1111423 - RNA, 19 nt, Homo sapiens
uaacccaaguuucucauua

SEQ ID NO: 1111424 - RNA, 19 nt, Homo sapiens
ggauuaaacuggcauuuca

SEQ ID NO: 1111425 - RNA, 19 nt, Homo sapiens
uaacaggaccaauggauua

SEQ ID NO: 1111426 - RNA, 19 nt, Homo sapiens
caagaucaaugcucaaguu

SEQ ID NO: 1111427 - RNA, 19 nt, Homo sapiens
ucagagacgucaacgauaa

SEQ ID NO: 1111428 - RNA, 19 nt, Homo sapiens
ggcaucaacucagaaauua

SEQ ID NO: 1111429 - RNA, 19 nt, Homo sapiens
caaggaauauucaaugguu

SEQ ID NO: 1111430 - RNA, 19 nt, Homo sapiens
caacagaguuaccaucguu

SEQ ID NO: 1111431 - RNA, 19 nt, Homo sapiens
gcucugcgcucuucgauau

SEQ ID NO: 1111432 - RNA, 19 nt, Homo sapiens
gcacaagauuuauacuaga

SEQ ID NO: 1111433 - RNA, 19 nt, Homo sapiens
gauuaucucuucauccaaa

SEQ ID NO: 1111434 - RNA, 19 nt, Homo sapiens
ggaaagacggaguuuaauu

SEQ ID NO: 1111435 - RNA, 19 nt, Homo sapiens
gcaauugaguucaggacaa

SEQ ID NO: 1111436 - RNA, 19 nt, Homo sapiens
ggacuuugccuuauuccua

SEQ ID NO: 1111437 - RNA, 19 nt, Homo sapiens
gaaguuacauuccauucuc

SEQ ID NO: 1111438 - RNA, 19 nt, Homo sapiens
gcaaaucuuuagucugaau

SEQ ID NO: 1111439 - RNA, 19 nt, Homo sapiens
gaacacuaauugcuuugau

SEQ ID NO: 1111440 - RNA, 19 nt, Homo sapiens
caggaaagacggaguuuaa

SEQ ID NO: 1111441 - RNA, 19 nt, Homo sapiens
gcggagaaauuaccacuca

SEQ ID NO: 1111442 - RNA, 19 nt, Homo sapiens
gaagcucgaagcagguuua

SEQ ID NO: 1111443 - RNA, 19 nt, Homo sapiens
gaucaaugcucaaguuuug

SEQ ID NO: 1111444 - RNA, 19 nt, Homo sapiens
gaagagaccaaggaauauu

SEQ ID NO: 1111445 - RNA, 19 nt, Homo sapiens
uagaauagccaguagugua

SEQ ID NO: 1111446 - RNA, 19 nt, Homo sapiens
gaaauuaccacucaaaaga

SEQ ID NO: 1111447 - RNA, 19 nt, Homo sapiens
ccaccaggcguccuacuua

SEQ ID NO: 1111448 - RNA, 19 nt, Homo sapiens
caaaauacaugaccaagau

SEQ ID NO: 1111449 - RNA, 19 nt, Homo sapiens
ggagaaauuaccacucaaa

SEQ ID NO: 1111450 - RNA, 19 nt, Homo sapiens
gggcaucaacucagaaauu

SEQ ID NO: 1111451 - RNA, 19 nt, Homo sapiens
ggccaagucuccuacucua

SEQ ID NO: 1111452 - RNA, 19 nt, Homo sapiens
cguauaaguugguaacaga

SEQ ID NO: 1111453 - RNA, 19 nt, Homo sapiens
gaagucccuuuuaagauua

SEQ ID NO: 1111454 - RNA, 19 nt, Homo sapiens
uaaccgacgccaaugauaa

SEQ ID NO: 1111455 - RNA, 19 nt, Homo sapiens
gcagaaguauaaacucucu

SEQ ID NO: 1111456 - RNA, 19 nt, Homo sapiens
ggcacaagauuuauacuag

SEQ ID NO: 1111457 - RNA, 19 nt, Homo sapiens
gaggagauaugcgggaaga

SEQ ID NO: 1111458 - RNA, 19 nt, Homo sapiens
gggaccaaaugaacagaaa

SEQ ID NO: 1111459 - RNA, 19 nt, Homo sapiens
gcucgaagcagguuuagga

SEQ ID NO: 1111460 - RNA, 19 nt, Homo sapiens
gcaauggcaacaagaagaa

SEQ ID NO: 1111461 - RNA, 19 nt, Homo sapiens
cguacugacuucuccuaua

SEQ ID NO: 1111462 - RNA, 19 nt, Homo sapiens
gacaaagcuugacacauca

SEQ ID NO: 1111463 - RNA, 19 nt, Homo sapiens
cagcugaacuccuccaucu

SEQ ID NO: 1111464 - RNA, 19 nt, Homo sapiens
gacaacauccuccagauuc

SEQ ID NO: 1111465 - RNA, 19 nt, Homo sapiens
uugaagagaccaaggaaua

SEQ ID NO: 1111466 - RNA, 19 nt, Homo sapiens
cagccuggcacaagauuua

SEQ ID NO: 1111467 - RNA, 19 nt, Homo sapiens
ggagaucgaggacauuaau

SEQ ID NO: 1111468 - RNA, 19 nt, Homo sapiens
gccauagccugguuaaagu

SEQ ID NO: 1111469 - RNA, 19 nt, Homo sapiens
agaaacaagugcccaguca

SEQ ID NO: 1111470 - RNA, 19 nt, Homo sapiens
gaagaagucgggcaagaag

SEQ ID NO: 1111471 - RNA, 19 nt, Homo sapiens
gaaagucucagcccaggau

SEQ ID NO: 1111472 - RNA, 19 nt, Homo sapiens
ggaggaggcucuguauguc

SEQ ID NO: 1111473 - RNA, 19 nt, Homo sapiens
cagcauaagcgucauccua

SEQ ID NO: 1111474 - RNA, 19 nt, Homo sapiens
cgaagucccuuuuaagauu

SEQ ID NO: 1111475 - RNA, 19 nt, Homo sapiens
ggaccagucuucuguuuug

SEQ ID NO: 1111476 - RNA, 19 nt, Homo sapiens
aggcugagcugcaguuuua

SEQ ID NO: 1111477 - RNA, 19 nt, Homo sapiens
gcaccacuguguugcaagu

SEQ ID NO: 1111478 - RNA, 19 nt, Homo sapiens
agaugcagauauuggcuua

SEQ ID NO: 1111479 - RNA, 19 nt, Homo sapiens
guagugagcaauugaguuc

SEQ ID NO: 1111480 - RNA, 19 nt, Homo sapiens
gaaccgggcaaaucuuuag

SEQ ID NO: 1111481 - RNA, 19 nt, Homo sapiens
gcauaagcgucauccuaca

SEQ ID NO: 1111482 - RNA, 19 nt, Homo sapiens
gaccaaggaauauucaaug

SEQ ID NO: 1111483 - RNA, 19 nt, Homo sapiens
ggacccuucccacuacaua

SEQ ID NO: 1111484 - RNA, 19 nt, Homo sapiens
cuacaagccuccuaguucu

SEQ ID NO: 1111485 - RNA, 19 nt, Homo sapiens
gaacuccuccaucuuccaa

SEQ ID NO: 1111486 - RNA, 19 nt, Homo sapiens
ggacugguugcacaaugua

SEQ ID NO: 1111487 - RNA, 19 nt, Homo sapiens
aacccaaguuucucauuaa

SEQ ID NO: 1111488 - RNA, 19 nt, Homo sapiens
agcagaagaugcagauauu

SEQ ID NO: 1111489 - RNA, 19 nt, Homo sapiens
guguugaaguaccaaguaa

SEQ ID NO: 1111490 - RNA, 19 nt, Homo sapiens
gaguucaggacaagacaua

SEQ ID NO: 1111491 - RNA, 19 nt, Homo sapiens
ggauggugguggacugguu

SEQ ID NO: 1111492 - RNA, 19 nt, Homo sapiens
gaaacuggauuuugaagag

SEQ ID NO: 1111493 - RNA, 19 nt, Homo sapiens
ggccuuauuuccacuuugu

SEQ ID NO: 1111494 - RNA, 19 nt, Homo sapiens
caagucuccuacucuauca

SEQ ID NO: 1111495 - RNA, 19 nt, Homo sapiens
ggaacuggcacuggagaaa

SEQ ID NO: 1111496 - RNA, 19 nt, Homo sapiens
gaccugcccuuacaguagu

SEQ ID NO: 1111497 - RNA, 19 nt, Homo sapiens
ugaaguaccaaguaaccua

SEQ ID NO: 1111498 - RNA, 19 nt, Homo sapiens
gcugaacuccuccaucuuc

SEQ ID NO: 1111499 - RNA, 19 nt, Homo sapiens
gcacccaggccucagaguu

SEQ ID NO: 1111500 - RNA, 19 nt, Homo sapiens
caagaaggagaagaaguaa

SEQ ID NO: 1111501 - RNA, 19 nt, Homo sapiens
gaacuuuuaucacgugaau

SEQ ID NO: 1111502 - RNA, 19 nt, Homo sapiens
ccuauaagcgcuucucuuc

SEQ ID NO: 1111503 - RNA, 19 nt, Homo sapiens
ggccauagccugguuaaag

SEQ ID NO: 1111504 - RNA, 19 nt, Homo sapiens
ggagaagaaguaacaugga

SEQ ID NO: 1111505 - RNA, 19 nt, Homo sapiens
agacauacuuuguggugau

SEQ ID NO: 1111506 - RNA, 19 nt, Homo sapiens
cuggaacacuaauugcuuu

SEQ ID NO: 1111507 - RNA, 19 nt, Homo sapiens
guaaccgacgccaaugaua

SEQ ID NO: 1111508 - RNA, 19 nt, Homo sapiens
ccacugagcuccggaucca

SEQ ID NO: 1111509 - RNA, 19 nt, Homo sapiens
uauaaacucucucuuaacc

SEQ ID NO: 1111510 - RNA, 19 nt, Homo sapiens
guagugcggugugcuuuua

SEQ ID NO: 1111511 - RNA, 19 nt, Homo sapiens
cuugugcucuggaauuuga

SEQ ID NO: 1111512 - RNA, 19 nt, Homo sapiens
caacaaccaguuugacaca

SEQ ID NO: 1111513 - RNA, 19 nt, Homo sapiens
gacauacuuuguggugauu

SEQ ID NO: 1111514 - RNA, 19 nt, Homo sapiens
gggcaaaucuuuagucuga

SEQ ID NO: 1111515 - RNA, 19 nt, Homo sapiens
gaaagacggaguuuaauuu

SEQ ID NO: 1111516 - RNA, 19 nt, Homo sapiens
gaaacaggaugguaguaaa

SEQ ID NO: 1111517 - RNA, 19 nt, Homo sapiens
gacaauagcccagaaguua

SEQ ID NO: 1111518 - RNA, 19 nt, Homo sapiens
ucaaagagcggagaaauua

SEQ ID NO: 1111519 - RNA, 19 nt, Homo sapiens
uaaacucucugcagaagua

SEQ ID NO: 1111520 - RNA, 19 nt, Homo sapiens
uaacccaaguuucucauua

SEQ ID NO: 1111521 - RNA, 19 nt, Homo sapiens
ucagagacgucaacgauaa

SEQ ID NO: 1111522 - RNA, 19 nt, Homo sapiens
ggcaucaacucagaaauua

SEQ ID NO: 1111523 - RNA, 19 nt, Homo sapiens
caaggaauauucaaugguu

SEQ ID NO: 1111524 - RNA, 19 nt, Homo sapiens
caacagaguuaccaucguu

SEQ ID NO: 1111525 - RNA, 19 nt, Homo sapiens
gcucugcgcucuucgauau

SEQ ID NO: 1111526 - RNA, 19 nt, Homo sapiens
gcacaagauuuauacuaga

SEQ ID NO: 1111527 - RNA, 19 nt, Homo sapiens
gauuaucucuucauccaaa

SEQ ID NO: 1111528 - RNA, 19 nt, Homo sapiens
ggaaagacggaguuuaauu

SEQ ID NO: 1111529 - RNA, 19 nt, Homo sapiens
gcaauugaguucaggacaa

SEQ ID NO: 1111530 - RNA, 19 nt, Homo sapiens
ggacuuugccuuauuccua

SEQ ID NO: 1111531 - RNA, 19 nt, Homo sapiens
gaaguuacauuccauucuc

SEQ ID NO: 1111532 - RNA, 19 nt, Homo sapiens
gcaaaucuuuagucugaau

SEQ ID NO: 1111533 - RNA, 19 nt, Homo sapiens
gaacacuaauugcuuugau

SEQ ID NO: 1111534 - RNA, 19 nt, Homo sapiens
caggaaagacggaguuuaa

SEQ ID NO: 1111535 - RNA, 19 nt, Homo sapiens
gcggagaaauuaccacuca

SEQ ID NO: 1111536 - RNA, 19 nt, Homo sapiens
gaagagaccaaggaauauu

SEQ ID NO: 1111537 - RNA, 19 nt, Homo sapiens
gaaauuaccacucaaaaga

SEQ ID NO: 1111538 - RNA, 19 nt, Homo sapiens
ccaccaggcguccuacuua

SEQ ID NO: 1111539 - RNA, 19 nt, Homo sapiens
caaaauacaugaccaagau

SEQ ID NO: 1111540 - RNA, 19 nt, Homo sapiens
ggagaaauuaccacucaaa

SEQ ID NO: 1111541 - RNA, 19 nt, Homo sapiens
gggcaucaacucagaaauu

SEQ ID NO: 1111542 - RNA, 19 nt, Homo sapiens
ggccaagucuccuacucua

SEQ ID NO: 1111543 - RNA, 19 nt, Homo sapiens
cguauaaguugguaacaga

SEQ ID NO: 1111544 - RNA, 19 nt, Homo sapiens
gaagucccuuuuaagauua

SEQ ID NO: 1111545 - RNA, 19 nt, Homo sapiens
uaaccgacgccaaugauaa

SEQ ID NO: 1111546 - RNA, 19 nt, Homo sapiens
gcagaaguauaaacucucu

SEQ ID NO: 1111547 - RNA, 19 nt, Homo sapiens
ggcacaagauuuauacuag

SEQ ID NO: 1111548 - RNA, 19 nt, Homo sapiens
gaggagauaugcgggaaga

SEQ ID NO: 1111549 - RNA, 19 nt, Homo sapiens
uugaagagaccaaggaaua

SEQ ID NO: 1111550 - RNA, 19 nt, Homo sapiens
cagccuggcacaagauuua

SEQ ID NO: 1111551 - RNA, 19 nt, Homo sapiens
ggagaucgaggacauuaau

SEQ ID NO: 1111552 - RNA, 19 nt, Homo sapiens
cagcauaagcgucauccua

SEQ ID NO: 1111553 - RNA, 19 nt, Homo sapiens
cgaagucccuuuuaagauu

SEQ ID NO: 1111554 - RNA, 19 nt, Homo sapiens
aggcugagcugcaguuuua

SEQ ID NO: 1111555 - RNA, 19 nt, Homo sapiens
gcaccacuguguugcaagu

SEQ ID NO: 1111556 - RNA, 19 nt, Homo sapiens
agaugcagauauuggcuua

SEQ ID NO: 1111557 - RNA, 19 nt, Homo sapiens
guagugagcaauugaguuc

SEQ ID NO: 1111558 - RNA, 19 nt, Homo sapiens
gaaccgggcaaaucuuuag

SEQ ID NO: 1111559 - RNA, 19 nt, Homo sapiens
gcauaagcgucauccuaca

SEQ ID NO: 1111560 - RNA, 19 nt, Homo sapiens
gaccaaggaauauucaaug

SEQ ID NO: 1111561 - RNA, 19 nt, Homo sapiens
guuggugaguuucauuuau

SEQ ID NO: 1111562 - RNA, 19 nt, Homo sapiens
ggacugguugcacaaugua

SEQ ID NO: 1111563 - RNA, 19 nt, Homo sapiens
aacccaaguuucucauuaa

SEQ ID NO: 1111564 - RNA, 19 nt, Homo sapiens
agcagaagaugcagauauu

SEQ ID NO: 1111565 - RNA, 19 nt, Homo sapiens
gaguucaggacaagacaua

SEQ ID NO: 1111566 - RNA, 19 nt, Homo sapiens
ggauggugguggacugguu

SEQ ID NO: 1111567 - RNA, 19 nt, Homo sapiens
gaaacuggauuuugaagag

SEQ ID NO: 1111568 - RNA, 19 nt, Homo sapiens
ggccuuauuuccacuuugu

SEQ ID NO: 1111569 - RNA, 19 nt, Homo sapiens
caagucuccuacucuauca

SEQ ID NO: 1111570 - RNA, 19 nt, Homo sapiens
ggaacuggcacuggagaaa

SEQ ID NO: 1111571 - RNA, 19 nt, Homo sapiens
gaacuuuuaucacgugaau

SEQ ID NO: 1111572 - RNA, 19 nt, Homo sapiens
agacauacuuuguggugau

SEQ ID NO: 1111573 - RNA, 19 nt, Homo sapiens
cuggaacacuaauugcuuu

SEQ ID NO: 1111574 - RNA, 19 nt, Homo sapiens
guaaccgacgccaaugaua

SEQ ID NO: 1111575 - RNA, 19 nt, Homo sapiens
ccacugagcuccggaucca

SEQ ID NO: 1111576 - RNA, 19 nt, Homo sapiens
uauaaacucucucuuaacc

SEQ ID NO: 1111577 - RNA, 19 nt, Homo sapiens
gacauacuuuguggugauu

SEQ ID NO: 1111578 - RNA, 19 nt, Homo sapiens
uaucagagacgucaacgau

SEQ ID NO: 1111579 - RNA, 19 nt, Homo sapiens
ucaguucggagaagccuua

SEQ ID NO: 1111580 - RNA, 19 nt, Homo sapiens
cuugugcucuggaauuuga

SEQ ID NO: 1111581 - RNA, 19 nt, Homo sapiens
uaucauggccagcgaccua

SEQ ID NO: 1111582 - RNA, 19 nt, Homo sapiens
gcccagaaguuacauucca

SEQ ID NO: 1111583 - RNA, 19 nt, Homo sapiens
cagaaccgggcaaaucuuu

SEQ ID NO: 1111584 - RNA, 19 nt, Homo sapiens
gaguuaccaucguuuaguc

SEQ ID NO: 1111585 - RNA, 19 nt, Homo sapiens
gcacaauguacaguugaaa

SEQ ID NO: 1111586 - RNA, 19 nt, Homo sapiens
guucagcguccaggaguua

SEQ ID NO: 1111587 - RNA, 19 nt, Homo sapiens
caaccgagacguguacaga

SEQ ID NO: 1111588 - RNA, 19 nt, Homo sapiens
agaaacaggaugguaguaa

SEQ ID NO: 1111589 - RNA, 19 nt, Homo sapiens
gagaaacaggaugguagua

SEQ ID NO: 1111590 - RNA, 19 nt, Homo sapiens
gcagauauuggcuuaaacu

SEQ ID NO: 1111591 - RNA, 19 nt, Homo sapiens
uagcagaagaugcagauau

SEQ ID NO: 1111592 - RNA, 19 nt, Homo sapiens
uacauuccauucucuacuu

SEQ ID NO: 1111593 - RNA, 19 nt, Homo sapiens
ggaauauucaaugguugua

SEQ ID NO: 1111594 - RNA, 19 nt, Homo sapiens
cuacagaaccgggcaaauc

SEQ ID NO: 1111595 - RNA, 19 nt, Homo sapiens
ggagaaacaggaugguagu

SEQ ID NO: 1111596 - RNA, 19 nt, Homo sapiens
gcagaagaugcagauauug

SEQ ID NO: 1111597 - RNA, 19 nt, Homo sapiens
cgacuucccauccugaguu

SEQ ID NO: 1111598 - RNA, 19 nt, Homo sapiens
uaagcgucauccuacauau

SEQ ID NO: 1111599 - RNA, 19 nt, Homo sapiens
guggagaucgaggacauua

SEQ ID NO: 1111600 - RNA, 19 nt, Homo sapiens
caauugaguucaggacaag

SEQ ID NO: 1111601 - RNA, 19 nt, Homo sapiens
uuaaugaccacacgccaaa

SEQ ID NO: 1111602 - RNA, 19 nt, Homo sapiens
uaacagauggaacccuaga

SEQ ID NO: 1111603 - RNA, 19 nt, Homo sapiens
ugacaauagcccagaaguu

SEQ ID NO: 1111604 - RNA, 19 nt, Homo sapiens
ggagauaugcgggaagaag

SEQ ID NO: 1111605 - RNA, 19 nt, Homo sapiens
acagaguuaccaucguuua

SEQ ID NO: 1111606 - RNA, 19 nt, Homo sapiens
gaguuggugaguuucauuu

SEQ ID NO: 1111607 - RNA, 19 nt, Homo sapiens
gacggaguuuaauuuccua

SEQ ID NO: 1111608 - RNA, 19 nt, Homo sapiens
ccaagucuccuacucuauc

SEQ ID NO: 1111609 - RNA, 19 nt, Homo sapiens
guugcacaauguacaguug

SEQ ID NO: 1111610 - RNA, 19 nt, Homo sapiens
agagucagccuucgggaaa

SEQ ID NO: 1111611 - RNA, 19 nt, Homo sapiens
ccagguaaccgacgccaau

SEQ ID NO: 1111612 - RNA, 19 nt, Homo sapiens
gagcuccggauccagguaa

SEQ ID NO: 1111613 - RNA, 19 nt, Homo sapiens
aaacaggaugguaguaaau

SEQ ID NO: 1111614 - RNA, 19 nt, Homo sapiens
ggacaaagcuugacacauc

SEQ ID NO: 1111615 - RNA, 19 nt, Homo sapiens
gcagauagcuugcaagaga

SEQ ID NO: 1111616 - RNA, 19 nt, Homo sapiens
gaaauccuaugccaacuaa

SEQ ID NO: 1111617 - RNA, 19 nt, Homo sapiens
guacugacuucuccuauaa

SEQ ID NO: 1111618 - RNA, 19 nt, Homo sapiens
ggaaauagcuccggaugga

SEQ ID NO: 1111619 - RNA, 19 nt, Homo sapiens
gaucacagcuaccgacaaa

SEQ ID NO: 1111620 - RNA, 19 nt, Homo sapiens
gcaagaaggagaagaagua

SEQ ID NO: 1111621 - RNA, 19 nt, Homo sapiens
agagauagcuacacaauug

SEQ ID NO: 1111622 - RNA, 19 nt, Homo sapiens
gaacuggacuuugaagaga

SEQ ID NO: 1111623 - RNA, 19 nt, Homo sapiens
ggauuaaacuggcauuuca

SEQ ID NO: 1111624 - RNA, 19 nt, Homo sapiens
uaacaggaccaauggauua

SEQ ID NO: 1111625 - RNA, 19 nt, Homo sapiens
caagaucaaugcucaaguu

SEQ ID NO: 1111626 - RNA, 19 nt, Homo sapiens
gcucugcgcucuucgauau

SEQ ID NO: 1111627 - RNA, 19 nt, Homo sapiens
gaugaagccucuugguuug

SEQ ID NO: 1111628 - RNA, 19 nt, Homo sapiens
gaucuagauucuggauuua

SEQ ID NO: 1111629 - RNA, 19 nt, Homo sapiens
gauccgcacuucucuuuga

SEQ ID NO: 1111630 - RNA, 19 nt, Homo sapiens
gcauguagcugagaacaau

SEQ ID NO: 1111631 - RNA, 19 nt, Homo sapiens
ggacuuugccuuauuccua

SEQ ID NO: 1111632 - RNA, 19 nt, Homo sapiens
ccaccgaccuuuagccaaa

SEQ ID NO: 1111633 - RNA, 19 nt, Homo sapiens
gaaaucaucuaugccuuca

SEQ ID NO: 1111634 - RNA, 19 nt, Homo sapiens
ugaucuagauucuggauuu

SEQ ID NO: 1111635 - RNA, 19 nt, Homo sapiens
cgacguguguucuggaauu

SEQ ID NO: 1111636 - RNA, 19 nt, Homo sapiens
cuaauggccuugucuccua

SEQ ID NO: 1111637 - RNA, 19 nt, Homo sapiens
gcaagauccugauguaggu

SEQ ID NO: 1111638 - RNA, 19 nt, Homo sapiens
aaugggaacuuacuuguga

SEQ ID NO: 1111639 - RNA, 19 nt, Homo sapiens
gaagcucgaagcagguuua

SEQ ID NO: 1111640 - RNA, 19 nt, Homo sapiens
gaucaaugcucaaguuuug

SEQ ID NO: 1111641 - RNA, 19 nt, Homo sapiens
uagaauagccaguagugua

SEQ ID NO: 1111642 - RNA, 19 nt, Homo sapiens
ccucuugguuugaaaguaa

SEQ ID NO: 1111643 - RNA, 19 nt, Homo sapiens
ggacaucacacugcauauu

SEQ ID NO: 1111644 - RNA, 19 nt, Homo sapiens
gaagugagacaacuguuca

SEQ ID NO: 1111645 - RNA, 19 nt, Homo sapiens
gggaagagcagccacauca

SEQ ID NO: 1111646 - RNA, 19 nt, Homo sapiens
gcaagaagucgacgugugu

SEQ ID NO: 1111647 - RNA, 19 nt, Homo sapiens
uaaugacaauccagaaaug

SEQ ID NO: 1111648 - RNA, 19 nt, Homo sapiens
gcuacaguuucaccuagua

SEQ ID NO: 1111649 - RNA, 19 nt, Homo sapiens
gggaccaaaugaacagaaa

SEQ ID NO: 1111650 - RNA, 19 nt, Homo sapiens
gcucgaagcagguuuagga

SEQ ID NO: 1111651 - RNA, 19 nt, Homo sapiens
gcaauggcaacaagaagaa

SEQ ID NO: 1111652 - RNA, 19 nt, Homo sapiens
gcagaucccagaauacaau

SEQ ID NO: 1111653 - RNA, 19 nt, Homo sapiens
cguacugacuucuccuaua

SEQ ID NO: 1111654 - RNA, 19 nt, Homo sapiens
gacaaagcuugacacauca

SEQ ID NO: 1111655 - RNA, 19 nt, Homo sapiens
cagcugaacuccuccaucu

SEQ ID NO: 1111656 - RNA, 19 nt, Homo sapiens
gaaaugccuucuaauucag

SEQ ID NO: 1111657 - RNA, 19 nt, Homo sapiens
ugaugaagccucuugguuu

SEQ ID NO: 1111658 - RNA, 19 nt, Homo sapiens
gggcagaggcgaaugcuau

SEQ ID NO: 1111659 - RNA, 19 nt, Homo sapiens
agauaacccuggcuucuga

SEQ ID NO: 1111660 - RNA, 19 nt, Homo sapiens
gacaacauccuccagauuc

SEQ ID NO: 1111661 - RNA, 19 nt, Homo sapiens
uuggagaacuggacuuuga

SEQ ID NO: 1111662 - RNA, 19 nt, Homo sapiens
gccauagccugguuaaagu

SEQ ID NO: 1111663 - RNA, 19 nt, Homo sapiens
agaaacaagugcccaguca

SEQ ID NO: 1111664 - RNA, 19 nt, Homo sapiens
gaagaagucgggcaagaag

SEQ ID NO: 1111665 - RNA, 19 nt, Homo sapiens
uguucaagcuggacaguaa

SEQ ID NO: 1111666 - RNA, 19 nt, Homo sapiens
gaaagucucagcccaggau

SEQ ID NO: 1111667 - RNA, 19 nt, Homo sapiens
ggaggaggcucuguauguc

SEQ ID NO: 1111668 - RNA, 19 nt, Homo sapiens
gagauacaaccugaccuua

SEQ ID NO: 1111669 - RNA, 19 nt, Homo sapiens
gaagagagagauagcuaca

SEQ ID NO: 1111670 - RNA, 19 nt, Homo sapiens
ggagauuuguggcaagaag

SEQ ID NO: 1111671 - RNA, 19 nt, Homo sapiens
gaggagauuuguggcaaga

SEQ ID NO: 1111672 - RNA, 19 nt, Homo sapiens
ggaccagucuucuguuuug

SEQ ID NO: 1111673 - RNA, 19 nt, Homo sapiens
gauacaaccugaccuuagc

SEQ ID NO: 1111674 - RNA, 19 nt, Homo sapiens
gagcagaucccagaauaca

SEQ ID NO: 1111675 - RNA, 19 nt, Homo sapiens
caacauauacaagaagaug

SEQ ID NO: 1111676 - RNA, 19 nt, Homo sapiens
gacaucacacugcauauug

SEQ ID NO: 1111677 - RNA, 19 nt, Homo sapiens
gcaaggaagugagacaacu

SEQ ID NO: 1111678 - RNA, 19 nt, Homo sapiens
guaaugacaauccagaaau

SEQ ID NO: 1111679 - RNA, 19 nt, Homo sapiens
uagggaaccucgccaagga

SEQ ID NO: 1111680 - RNA, 19 nt, Homo sapiens
caaaacacaugaucuagau

SEQ ID NO: 1111681 - RNA, 19 nt, Homo sapiens
agagagagauagcuacaca

SEQ ID NO: 1111682 - RNA, 19 nt, Homo sapiens
gcacuucucuuugauucag

SEQ ID NO: 1111683 - RNA, 19 nt, Homo sapiens
gaccaucacucugcacauc

SEQ ID NO: 1111684 - RNA, 19 nt, Homo sapiens
ggacccuucccacuacaua

SEQ ID NO: 1111685 - RNA, 19 nt, Homo sapiens
cuacaagccuccuaguucu

SEQ ID NO: 1111686 - RNA, 19 nt, Homo sapiens
gaacuccuccaucuuccaa

SEQ ID NO: 1111687 - RNA, 19 nt, Homo sapiens
ggacugccguugcccugau

SEQ ID NO: 1111688 - RNA, 19 nt, Homo sapiens
gcuucugaaucccaacaua

SEQ ID NO: 1111689 - RNA, 19 nt, Homo sapiens
uaaaagugauggccauuga

SEQ ID NO: 1111690 - RNA, 19 nt, Homo sapiens
aaauaucacugagcuggaa

SEQ ID NO: 1111691 - RNA, 19 nt, Homo sapiens
guguugaaguaccaaguaa

SEQ ID NO: 1111692 - RNA, 19 nt, Homo sapiens
cacugcauauuguaaagua

SEQ ID NO: 1111693 - RNA, 19 nt, Homo sapiens
ugagacaacuguucaagcu

SEQ ID NO: 1111694 - RNA, 19 nt, Homo sapiens
gacaacccaccgaccuuua

SEQ ID NO: 1111695 - RNA, 19 nt, Homo sapiens
ccacugagggcuacuuuca

SEQ ID NO: 1111696 - RNA, 19 nt, Homo sapiens
ggaagugagacaacuguuc

SEQ ID NO: 1111697 - RNA, 19 nt, Homo sapiens
gaccugcccuuacaguagu

SEQ ID NO: 1111698 - RNA, 19 nt, Homo sapiens
ugaaguaccaaguaaccua

SEQ ID NO: 1111699 - RNA, 19 nt, Homo sapiens
gcugaacuccuccaucuuc

SEQ ID NO: 1111700 - RNA, 19 nt, Homo sapiens
gcacccaggccucagaguu

SEQ ID NO: 1111701 - RNA, 19 nt, Homo sapiens
caagaaggagaagaaguaa

SEQ ID NO: 1111702 - RNA, 19 nt, Homo sapiens
caagaucuucuaugugaug

SEQ ID NO: 1111703 - RNA, 19 nt, Homo sapiens
gagccuccauugcgcaugu

SEQ ID NO: 1111704 - RNA, 19 nt, Homo sapiens
gagagauagcuacacaauu

SEQ ID NO: 1111705 - RNA, 19 nt, Homo sapiens
ccuauaagcgcuucucuuc

SEQ ID NO: 1111706 - RNA, 19 nt, Homo sapiens
ggccauagccugguuaaag

SEQ ID NO: 1111707 - RNA, 19 nt, Homo sapiens
ggagaagaaguaacaugga

SEQ ID NO: 1111708 - RNA, 19 nt, Homo sapiens
gaaaaugggaacuuacuug

SEQ ID NO: 1111709 - RNA, 19 nt, Homo sapiens
guagugcggugugcuuuua

SEQ ID NO: 1111710 - RNA, 19 nt, Homo sapiens
caacaaccaguuugacaca

SEQ ID NO: 1111711 - RNA, 19 nt, Homo sapiens
gaagccucuugguuugaaa

SEQ ID NO: 1111712 - RNA, 19 nt, Homo sapiens
ggagcuacaguuucaccua

SEQ ID NO: 1111713 - RNA, 19 nt, Homo sapiens
aggcggagcuacaguuuca

SEQ ID NO: 1111714 - RNA, 19 nt, Homo sapiens
gcagauagcuugcaagaga

SEQ ID NO: 1111715 - RNA, 19 nt, Homo sapiens
gaaauccuaugccaacuaa

SEQ ID NO: 1111716 - RNA, 19 nt, Homo sapiens
ggaaauagcuccggaugga

SEQ ID NO: 1111717 - RNA, 19 nt, Homo sapiens
gaucacagcuaccgacaaa

SEQ ID NO: 1111718 - RNA, 19 nt, Homo sapiens
agagauagcuacacaauug

SEQ ID NO: 1111719 - RNA, 19 nt, Homo sapiens
gaacuggacuuugaagaga

SEQ ID NO: 1111720 - RNA, 19 nt, Homo sapiens
gcucugcgcucuucgauau

SEQ ID NO: 1111721 - RNA, 19 nt, Homo sapiens
gaugaagccucuugguuug

SEQ ID NO: 1111722 - RNA, 19 nt, Homo sapiens
gaucuagauucuggauuua

SEQ ID NO: 1111723 - RNA, 19 nt, Homo sapiens
gauccgcacuucucuuuga

SEQ ID NO: 1111724 - RNA, 19 nt, Homo sapiens
gcauguagcugagaacaau

SEQ ID NO: 1111725 - RNA, 19 nt, Homo sapiens
ggacuuugccuuauuccua

SEQ ID NO: 1111726 - RNA, 19 nt, Homo sapiens
ccaccgaccuuuagccaaa

SEQ ID NO: 1111727 - RNA, 19 nt, Homo sapiens
gaaaucaucuaugccuuca

SEQ ID NO: 1111728 - RNA, 19 nt, Homo sapiens
ugaucuagauucuggauuu

SEQ ID NO: 1111729 - RNA, 19 nt, Homo sapiens
cgacguguguucuggaauu

SEQ ID NO: 1111730 - RNA, 19 nt, Homo sapiens
cuaauggccuugucuccua

SEQ ID NO: 1111731 - RNA, 19 nt, Homo sapiens
gcaagauccugauguaggu

SEQ ID NO: 1111732 - RNA, 19 nt, Homo sapiens
aaugggaacuuacuuguga

SEQ ID NO: 1111733 - RNA, 19 nt, Homo sapiens
aaaggugaguuucuucaaa

SEQ ID NO: 1111734 - RNA, 19 nt, Homo sapiens
ccucuugguuugaaaguaa

SEQ ID NO: 1111735 - RNA, 19 nt, Homo sapiens
ggacaucacacugcauauu

SEQ ID NO: 1111736 - RNA, 19 nt, Homo sapiens
gaagugagacaacuguuca

SEQ ID NO: 1111737 - RNA, 19 nt, Homo sapiens
gggaagagcagccacauca

SEQ ID NO: 1111738 - RNA, 19 nt, Homo sapiens
gcaagaagucgacgugugu

SEQ ID NO: 1111739 - RNA, 19 nt, Homo sapiens
ucaaaccuuuccuuccaua

SEQ ID NO: 1111740 - RNA, 19 nt, Homo sapiens
uaaugacaauccagaaaug

SEQ ID NO: 1111741 - RNA, 19 nt, Homo sapiens
gcuacaguuucaccuagua

SEQ ID NO: 1111742 - RNA, 19 nt, Homo sapiens
gcagaucccagaauacaau

SEQ ID NO: 1111743 - RNA, 19 nt, Homo sapiens
gaaaugccuucuaauucag

SEQ ID NO: 1111744 - RNA, 19 nt, Homo sapiens
ugaugaagccucuugguuu

SEQ ID NO: 1111745 - RNA, 19 nt, Homo sapiens
agauaacccuggcuucuga

SEQ ID NO: 1111746 - RNA, 19 nt, Homo sapiens
gggcagaggcgaaugcuau

SEQ ID NO: 1111747 - RNA, 19 nt, Homo sapiens
uuggagaacuggacuuuga

SEQ ID NO: 1111748 - RNA, 19 nt, Homo sapiens
uguucaagcuggacaguaa

SEQ ID NO: 1111749 - RNA, 19 nt, Homo sapiens
gagauacaaccugaccuua

SEQ ID NO: 1111750 - RNA, 19 nt, Homo sapiens
gaagagagagauagcuaca

SEQ ID NO: 1111751 - RNA, 19 nt, Homo sapiens
ggagauuuguggcaagaag

SEQ ID NO: 1111752 - RNA, 19 nt, Homo sapiens
gaggagauuuguggcaaga

SEQ ID NO: 1111753 - RNA, 19 nt, Homo sapiens
gauacaaccugaccuuagc

SEQ ID NO: 1111754 - RNA, 19 nt, Homo sapiens
gagcagaucccagaauaca

SEQ ID NO: 1111755 - RNA, 19 nt, Homo sapiens
caacauauacaagaagaug

SEQ ID NO: 1111756 - RNA, 19 nt, Homo sapiens
gacaucacacugcauauug

SEQ ID NO: 1111757 - RNA, 19 nt, Homo sapiens
gcaaggaagugagacaacu

SEQ ID NO: 1111758 - RNA, 19 nt, Homo sapiens
guaaugacaauccagaaau

SEQ ID NO: 1111759 - RNA, 19 nt, Homo sapiens
caaaacacaugaucuagau

SEQ ID NO: 1111760 - RNA, 19 nt, Homo sapiens
agagagagauagcuacaca

SEQ ID NO: 1111761 - RNA, 19 nt, Homo sapiens
uagggaaccucgccaagga

SEQ ID NO: 1111762 - RNA, 19 nt, Homo sapiens
gcacuucucuuugauucag

SEQ ID NO: 1111763 - RNA, 19 nt, Homo sapiens
gaccaucacucugcacauc

SEQ ID NO: 1111764 - RNA, 19 nt, Homo sapiens
ggacugccguugcccugau

SEQ ID NO: 1111765 - RNA, 19 nt, Homo sapiens
gcuucugaaucccaacaua

SEQ ID NO: 1111766 - RNA, 19 nt, Homo sapiens
uaaaagugauggccauuga

SEQ ID NO: 1111767 - RNA, 19 nt, Homo sapiens
aaauaucacugagcuggaa

SEQ ID NO: 1111768 - RNA, 19 nt, Homo sapiens
cacugcauauuguaaagua

SEQ ID NO: 1111769 - RNA, 19 nt, Homo sapiens
ugagacaacuguucaagcu

SEQ ID NO: 1111770 - RNA, 19 nt, Homo sapiens
gacaacccaccgaccuuua

SEQ ID NO: 1111771 - RNA, 19 nt, Homo sapiens
ccacugagggcuacuuuca

SEQ ID NO: 1111772 - RNA, 19 nt, Homo sapiens
ggaagugagacaacuguuc

SEQ ID NO: 1111773 - RNA, 19 nt, Homo sapiens
caagaucuucuaugugaug

SEQ ID NO: 1111774 - RNA, 19 nt, Homo sapiens
gagccuccauugcgcaugu

SEQ ID NO: 1111775 - RNA, 19 nt, Homo sapiens
gagagauagcuacacaauu

SEQ ID NO: 1111776 - RNA, 19 nt, Homo sapiens
gaaaaugggaacuuacuug

SEQ ID NO: 1111777 - RNA, 19 nt, Homo sapiens
gaagccucuugguuugaaa

SEQ ID NO: 1111778 - RNA, 19 nt, Homo sapiens
ggagcuacaguuucaccua

SEQ ID NO: 1111779 - RNA, 19 nt, Homo sapiens
aggcggagcuacaguuuca

SEQ ID NO: 1111780 - RNA, 19 nt, Homo sapiens
aaacacaugaucuagauuc

SEQ ID NO: 1111781 - RNA, 19 nt, Homo sapiens
caucaauauuggcaaggaa

SEQ ID NO: 1111782 - RNA, 19 nt, Homo sapiens
ucuaugccuucaucaauau

SEQ ID NO: 1111783 - RNA, 19 nt, Homo sapiens
aaucaucuaugccuucauc

SEQ ID NO: 1111784 - RNA, 19 nt, Homo sapiens
ucgcagaugcaaaugauaa

SEQ ID NO: 1111785 - RNA, 19 nt, Homo sapiens
ugaagccucuugguuugaa

SEQ ID NO: 1111786 - RNA, 19 nt, Homo sapiens
acaccgaguuuaaauuucu

SEQ ID NO: 1111787 - RNA, 19 nt, Homo sapiens
ccuggugucugcuucaaga

SEQ ID NO: 1111788 - RNA, 19 nt, Homo sapiens
caucaaugccgaaaucauc

SEQ ID NO: 1111789 - RNA, 19 nt, Homo sapiens
cguguguucuggaauuuga

SEQ ID NO: 1111790 - RNA, 19 nt, Homo sapiens
gacguguguucuggaauuu

SEQ ID NO: 1111791 - RNA, 19 nt, Homo sapiens
gcagaggcgaaugcuauuu

SEQ ID NO: 1111792 - RNA, 19 nt, Homo sapiens
gaauacaaugugacgauca

SEQ ID NO: 1111793 - RNA, 19 nt, Homo sapiens
cuucaaaccuuuccuucca

SEQ ID NO: 1111794 - RNA, 19 nt, Homo sapiens
cauacagguuggugacaga

SEQ ID NO: 1111795 - RNA, 19 nt, Homo sapiens
ggagauaacccuggcuucu

SEQ ID NO: 1111796 - RNA, 19 nt, Homo sapiens
ggaacucaccacuauugga

SEQ ID NO: 1111797 - RNA, 19 nt, Homo sapiens
caucuaugccuucaucaau

SEQ ID NO: 1111798 - RNA, 19 nt, Homo sapiens
acccagagcuaguacugaa

SEQ ID NO: 1111799 - RNA, 19 nt, Homo sapiens
ggccuugucuccuacuaca

SEQ ID NO: 1111800 - RNA, 19 nt, Homo sapiens
ucacacugcauauuguaaa

SEQ ID NO: 1111801 - RNA, 19 nt, Homo sapiens
guggacaucacacugcaua

SEQ ID NO: 1111802 - RNA, 19 nt, Homo sapiens
gggucaauguugcagagaa

SEQ ID NO: 1111803 - RNA, 19 nt, Homo sapiens
ucucuuugauucagaagga

SEQ ID NO: 1111804 - RNA, 19 nt, Homo sapiens
ccgcacuucucuuugauuc

SEQ ID NO: 1111805 - RNA, 19 nt, Homo sapiens
caucacacugcauauugua

SEQ ID NO: 1111806 - RNA, 19 nt, Homo sapiens
ugauguaggugucaauucg

SEQ ID NO: 1111807 - RNA, 19 nt, Homo sapiens
ucauguaacugugcugauc

SEQ ID NO: 1111808 - RNA, 19 nt, Homo sapiens
cgacaacccaccgaccuuu

SEQ ID NO: 1111809 - RNA, 19 nt, Homo sapiens
gugaugaagccucuugguu

SEQ ID NO: 1111810 - RNA, 19 nt, Homo sapiens
accacaagaucuucuaugu

SEQ ID NO: 1111811 - RNA, 19 nt, Homo sapiens
guaguggcguuggccuuga

SEQ ID NO: 1111812 - RNA, 19 nt, Homo sapiens
cccaacauauacaagaaga

SEQ ID NO: 1111813 - RNA, 19 nt, Homo sapiens
ugaaaguaaugacaaucca

SEQ ID NO: 1111814 - RNA, 19 nt, Homo sapiens
ggacaaagcuugacacauc

SEQ ID NO: 1111815 - RNA, 19 nt, Homo sapiens
gaaggaauauuucacagua

SEQ ID NO: 1111816 - RNA, 19 nt, Homo sapiens
guacugacuucuccuauaa

SEQ ID NO: 1111817 - RNA, 19 nt, Homo sapiens
cuacaaagauaccaccuua

SEQ ID NO: 1111818 - RNA, 19 nt, Homo sapiens
gcaagaaggagaagaagua

SEQ ID NO: 1111819 - RNA, 19 nt, Homo sapiens
gcaaguaguuacacucuga

SEQ ID NO: 1111820 - RNA, 19 nt, Homo sapiens
ggauuaaacuggcauuuca

SEQ ID NO: 1111821 - RNA, 19 nt, Homo sapiens
uaacaggaccaauggauua

SEQ ID NO: 1111822 - RNA, 19 nt, Homo sapiens
caagaucaaugcucaaguu

SEQ ID NO: 1111823 - RNA, 19 nt, Homo sapiens
gguccuaacucacuacaaa

SEQ ID NO: 1111824 - RNA, 19 nt, Homo sapiens
gaacagugaucgccuugau

SEQ ID NO: 1111825 - RNA, 19 nt, Homo sapiens
gagcacaguuuacaucaau

SEQ ID NO: 1111826 - RNA, 19 nt, Homo sapiens
gaaguuuacugccaagugu

SEQ ID NO: 1111827 - RNA, 19 nt, Homo sapiens
guaaauauccugaguugau

SEQ ID NO: 1111828 - RNA, 19 nt, Homo sapiens
aaagauaccaccuuaauga

SEQ ID NO: 1111829 - RNA, 19 nt, Homo sapiens
caggagaaaucacgacaaa

SEQ ID NO: 1111830 - RNA, 19 nt, Homo sapiens
guacaacauuuccacuuga

SEQ ID NO: 1111831 - RNA, 19 nt, Homo sapiens
guacauugcccuauuccua

SEQ ID NO: 1111832 - RNA, 19 nt, Homo sapiens
gaaacagacuccagauggu

SEQ ID NO: 1111833 - RNA, 19 nt, Homo sapiens
gguacaacauuuccacuug

SEQ ID NO: 1111834 - RNA, 19 nt, Homo sapiens
ggaagcagccucugugugu

SEQ ID NO: 1111835 - RNA, 19 nt, Homo sapiens
gcgcggagaaggaauauuu

SEQ ID NO: 1111836 - RNA, 19 nt, Homo sapiens
cgcaagaucucgucuguga

SEQ ID NO: 1111837 - RNA, 19 nt, Homo sapiens
gauaccaccuuaaugacaa

SEQ ID NO: 1111838 - RNA, 19 nt, Homo sapiens
cuaacucacuacaaagaua

SEQ ID NO: 1111839 - RNA, 19 nt, Homo sapiens
gagacuuacuugugaguga

SEQ ID NO: 1111840 - RNA, 19 nt, Homo sapiens
cgaccgggaugaaggcaua

SEQ ID NO: 1111841 - RNA, 19 nt, Homo sapiens
gaagcucgaagcagguuua

SEQ ID NO: 1111842 - RNA, 19 nt, Homo sapiens
gaucaaugcucaaguuuug

SEQ ID NO: 1111843 - RNA, 19 nt, Homo sapiens
uagaauagccaguagugua

SEQ ID NO: 1111844 - RNA, 19 nt, Homo sapiens
gaacauaaccccggaauug

SEQ ID NO: 1111845 - RNA, 19 nt, Homo sapiens
gaagagcacaguuuacauc

SEQ ID NO: 1111846 - RNA, 19 nt, Homo sapiens
cagagaagagcacaguuua

SEQ ID NO: 1111847 - RNA, 19 nt, Homo sapiens
uaggaaaccucgccaagga

SEQ ID NO: 1111848 - RNA, 19 nt, Homo sapiens
ccaacagacuuccuacaug

SEQ ID NO: 1111849 - RNA, 19 nt, Homo sapiens
uaagccagguacaacauuu

SEQ ID NO: 1111850 - RNA, 19 nt, Homo sapiens
gagaucaccuacuccuuuc

SEQ ID NO: 1111851 - RNA, 19 nt, Homo sapiens
cagauccgcuauucaauuc

SEQ ID NO: 1111852 - RNA, 19 nt, Homo sapiens
caccuaaucuucgcggaua

SEQ ID NO: 1111853 - RNA, 19 nt, Homo sapiens
ggagaaaucacgacaaagg

SEQ ID NO: 1111854 - RNA, 19 nt, Homo sapiens
cgauaacccuccaguguuc

SEQ ID NO: 1111855 - RNA, 19 nt, Homo sapiens
ucacggaugccaacgauaa

SEQ ID NO: 1111856 - RNA, 19 nt, Homo sapiens
caaaguggcacgacccaaa

SEQ ID NO: 1111857 - RNA, 19 nt, Homo sapiens
cuacauagcaguaauugug

SEQ ID NO: 1111858 - RNA, 19 nt, Homo sapiens
gggaccaaaugaacagaaa

SEQ ID NO: 1111859 - RNA, 19 nt, Homo sapiens
gcucgaagcagguuuagga

SEQ ID NO: 1111860 - RNA, 19 nt, Homo sapiens
gcaauggcaacaagaagaa

SEQ ID NO: 1111861 - RNA, 19 nt, Homo sapiens
ccaagacagaguucaauuu

SEQ ID NO: 1111862 - RNA, 19 nt, Homo sapiens
ggagaucccagaauacaau

SEQ ID NO: 1111863 - RNA, 19 nt, Homo sapiens
cguacugacuucuccuaua

SEQ ID NO: 1111864 - RNA, 19 nt, Homo sapiens
gacaaagcuugacacauca

SEQ ID NO: 1111865 - RNA, 19 nt, Homo sapiens
cagcugaacuccuccaucu

SEQ ID NO: 1111866 - RNA, 19 nt, Homo sapiens
ccacugcaguauccaaguu

SEQ ID NO: 1111867 - RNA, 19 nt, Homo sapiens
uauccugaguugauucuaa

SEQ ID NO: 1111868 - RNA, 19 nt, Homo sapiens
gacaacauccuccagauuc

SEQ ID NO: 1111869 - RNA, 19 nt, Homo sapiens
gcuccgcccucuucgauau

SEQ ID NO: 1111870 - RNA, 19 nt, Homo sapiens
gagaagagcacaguuuaca

SEQ ID NO: 1111871 - RNA, 19 nt, Homo sapiens
gcaguaauugugcaggaua

SEQ ID NO: 1111872 - RNA, 19 nt, Homo sapiens
gccauagccugguuaaagu

SEQ ID NO: 1111873 - RNA, 19 nt, Homo sapiens
agaaacaagugcccaguca

SEQ ID NO: 1111874 - RNA, 19 nt, Homo sapiens
gaagaagucgggcaagaag

SEQ ID NO: 1111875 - RNA, 19 nt, Homo sapiens
ggagaaggaauauuucaca

SEQ ID NO: 1111876 - RNA, 19 nt, Homo sapiens
gaaagucucagcccaggau

SEQ ID NO: 1111877 - RNA, 19 nt, Homo sapiens
ggaggaggcucuguauguc

SEQ ID NO: 1111878 - RNA, 19 nt, Homo sapiens
gcacaguuuacaucaauug

SEQ ID NO: 1111879 - RNA, 19 nt, Homo sapiens
gaaagcggagacuuacuug

SEQ ID NO: 1111880 - RNA, 19 nt, Homo sapiens
ggaccagucuucuguuuug

SEQ ID NO: 1111881 - RNA, 19 nt, Homo sapiens
gaucucgucugugacaaug

SEQ ID NO: 1111882 - RNA, 19 nt, Homo sapiens
gcacaucuccgacgucaac

SEQ ID NO: 1111883 - RNA, 19 nt, Homo sapiens
gaagcagccucuguguguu

SEQ ID NO: 1111884 - RNA, 19 nt, Homo sapiens
gaauacaaucucaccauca

SEQ ID NO: 1111885 - RNA, 19 nt, Homo sapiens
ccucaaagaacuauuacaa

SEQ ID NO: 1111886 - RNA, 19 nt, Homo sapiens
acagugaucgccuugauaa

SEQ ID NO: 1111887 - RNA, 19 nt, Homo sapiens
caacgauugugcaccugaa

SEQ ID NO: 1111888 - RNA, 19 nt, Homo sapiens
ggucguaaauauccugagu

SEQ ID NO: 1111889 - RNA, 19 nt, Homo sapiens
caaagauaccaccuuaaug

SEQ ID NO: 1111890 - RNA, 19 nt, Homo sapiens
acaaagauaccaccuuaau

SEQ ID NO: 1111891 - RNA, 19 nt, Homo sapiens
ccagauccgcuauucaauu

SEQ ID NO: 1111892 - RNA, 19 nt, Homo sapiens
guaauugugcaggauauaa

SEQ ID NO: 1111893 - RNA, 19 nt, Homo sapiens
gaauagaccgagaacagau

SEQ ID NO: 1111894 - RNA, 19 nt, Homo sapiens
ggacccuucccacuacaua

SEQ ID NO: 1111895 - RNA, 19 nt, Homo sapiens
cuacaagccuccuaguucu

SEQ ID NO: 1111896 - RNA, 19 nt, Homo sapiens
gaacuccuccaucuuccaa

SEQ ID NO: 1111897 - RNA, 19 nt, Homo sapiens
ucuccgacgucaacgauaa

SEQ ID NO: 1111898 - RNA, 19 nt, Homo sapiens
gcaccugaaguuauuguga

SEQ ID NO: 1111899 - RNA, 19 nt, Homo sapiens
agagaucaccuacuccuuu

SEQ ID NO: 1111900 - RNA, 19 nt, Homo sapiens
guguugaaguaccaaguaa

SEQ ID NO: 1111901 - RNA, 19 nt, Homo sapiens
ucguaaauauccugaguug

SEQ ID NO: 1111902 - RNA, 19 nt, Homo sapiens
ggacagagaagagcacagu

SEQ ID NO: 1111903 - RNA, 19 nt, Homo sapiens
gaccugcccuuacaguagu

SEQ ID NO: 1111904 - RNA, 19 nt, Homo sapiens
ugaaguaccaaguaaccua

SEQ ID NO: 1111905 - RNA, 19 nt, Homo sapiens
gcugaacuccuccaucuuc

SEQ ID NO: 1111906 - RNA, 19 nt, Homo sapiens
gcacccaggccucagaguu

SEQ ID NO: 1111907 - RNA, 19 nt, Homo sapiens
caagaaggagaagaaguaa

SEQ ID NO: 1111908 - RNA, 19 nt, Homo sapiens
gagaaaucacgacaaagga

SEQ ID NO: 1111909 - RNA, 19 nt, Homo sapiens
ccuauaagcgcuucucuuc

SEQ ID NO: 1111910 - RNA, 19 nt, Homo sapiens
ggccauagccugguuaaag

SEQ ID NO: 1111911 - RNA, 19 nt, Homo sapiens
ggagaagaaguaacaugga

SEQ ID NO: 1111912 - RNA, 19 nt, Homo sapiens
ucaccuacuccuuucauaa

SEQ ID NO: 1111913 - RNA, 19 nt, Homo sapiens
acagagaagagcacaguuu

SEQ ID NO: 1111914 - RNA, 19 nt, Homo sapiens
gaaggaauauuucacagua

SEQ ID NO: 1111915 - RNA, 19 nt, Homo sapiens
cuacaaagauaccaccuua

SEQ ID NO: 1111916 - RNA, 19 nt, Homo sapiens
gcaaguaguuacacucuga

SEQ ID NO: 1111917 - RNA, 19 nt, Homo sapiens
gaaggugagcuuuaauuaa

SEQ ID NO: 1111918 - RNA, 19 nt, Homo sapiens
gguccuaacucacuacaaa

SEQ ID NO: 1111919 - RNA, 19 nt, Homo sapiens
gaacagugaucgccuugau

SEQ ID NO: 1111920 - RNA, 19 nt, Homo sapiens
gagcacaguuuacaucaau

SEQ ID NO: 1111921 - RNA, 19 nt, Homo sapiens
gaaguuuacugccaagugu

SEQ ID NO: 1111922 - RNA, 19 nt, Homo sapiens
guaaauauccugaguugau

SEQ ID NO: 1111923 - RNA, 19 nt, Homo sapiens
aaagauaccaccuuaauga

SEQ ID NO: 1111924 - RNA, 19 nt, Homo sapiens
caggagaaaucacgacaaa

SEQ ID NO: 1111925 - RNA, 19 nt, Homo sapiens
guacaacauuuccacuuga

SEQ ID NO: 1111926 - RNA, 19 nt, Homo sapiens
guacauugcccuauuccua

SEQ ID NO: 1111927 - RNA, 19 nt, Homo sapiens
gaaacagacuccagauggu

SEQ ID NO: 1111928 - RNA, 19 nt, Homo sapiens
gguacaacauuuccacuug

SEQ ID NO: 1111929 - RNA, 19 nt, Homo sapiens
ggaagcagccucugugugu

SEQ ID NO: 1111930 - RNA, 19 nt, Homo sapiens
gcgcggagaaggaauauuu

SEQ ID NO: 1111931 - RNA, 19 nt, Homo sapiens
cgcaagaucucgucuguga

SEQ ID NO: 1111932 - RNA, 19 nt, Homo sapiens
gauaccaccuuaaugacaa

SEQ ID NO: 1111933 - RNA, 19 nt, Homo sapiens
cuaacucacuacaaagaua

SEQ ID NO: 1111934 - RNA, 19 nt, Homo sapiens
gagacuuacuugugaguga

SEQ ID NO: 1111935 - RNA, 19 nt, Homo sapiens
cgaccgggaugaaggcaua

SEQ ID NO: 1111936 - RNA, 19 nt, Homo sapiens
ugaaggugagcuuuaauua

SEQ ID NO: 1111937 - RNA, 19 nt, Homo sapiens
gaacauaaccccggaauug

SEQ ID NO: 1111938 - RNA, 19 nt, Homo sapiens
gaagagcacaguuuacauc

SEQ ID NO: 1111939 - RNA, 19 nt, Homo sapiens
cagagaagagcacaguuua

SEQ ID NO: 1111940 - RNA, 19 nt, Homo sapiens
uaggaaaccucgccaagga

SEQ ID NO: 1111941 - RNA, 19 nt, Homo sapiens
ccaacagacuuccuacaug

SEQ ID NO: 1111942 - RNA, 19 nt, Homo sapiens
uaagccagguacaacauuu

SEQ ID NO: 1111943 - RNA, 19 nt, Homo sapiens
gagaucaccuacuccuuuc

SEQ ID NO: 1111944 - RNA, 19 nt, Homo sapiens
cagauccgcuauucaauuc

SEQ ID NO: 1111945 - RNA, 19 nt, Homo sapiens
caccuaaucuucgcggaua

SEQ ID NO: 1111946 - RNA, 19 nt, Homo sapiens
ggagaaaucacgacaaagg

SEQ ID NO: 1111947 - RNA, 19 nt, Homo sapiens
cgauaacccuccaguguuc

SEQ ID NO: 1111948 - RNA, 19 nt, Homo sapiens
ucacggaugccaacgauaa

SEQ ID NO: 1111949 - RNA, 19 nt, Homo sapiens
caaaguggcacgacccaaa

SEQ ID NO: 1111950 - RNA, 19 nt, Homo sapiens
cuacauagcaguaauugug

SEQ ID NO: 1111951 - RNA, 19 nt, Homo sapiens
ccaagacagaguucaauuu

SEQ ID NO: 1111952 - RNA, 19 nt, Homo sapiens
ggagaucccagaauacaau

SEQ ID NO: 1111953 - RNA, 19 nt, Homo sapiens
ccacugcaguauccaaguu

SEQ ID NO: 1111954 - RNA, 19 nt, Homo sapiens
uauccugaguugauucuaa

SEQ ID NO: 1111955 - RNA, 19 nt, Homo sapiens
gcuccgcccucuucgauau

SEQ ID NO: 1111956 - RNA, 19 nt, Homo sapiens
gagaagagcacaguuuaca

SEQ ID NO: 1111957 - RNA, 19 nt, Homo sapiens
gcaguaauugugcaggaua

SEQ ID NO: 1111958 - RNA, 19 nt, Homo sapiens
ggagaaggaauauuucaca

SEQ ID NO: 1111959 - RNA, 19 nt, Homo sapiens
gcacaguuuacaucaauug

SEQ ID NO: 1111960 - RNA, 19 nt, Homo sapiens
gaucucgucugugacaaug

SEQ ID NO: 1111961 - RNA, 19 nt, Homo sapiens
gcacaucuccgacgucaac

SEQ ID NO: 1111962 - RNA, 19 nt, Homo sapiens
gaagcagccucuguguguu

SEQ ID NO: 1111963 - RNA, 19 nt, Homo sapiens
gaaagcggagacuuacuug

SEQ ID NO: 1111964 - RNA, 19 nt, Homo sapiens
gaauacaaucucaccauca

SEQ ID NO: 1111965 - RNA, 19 nt, Homo sapiens
ccucaaagaacuauuacaa

SEQ ID NO: 1111966 - RNA, 19 nt, Homo sapiens
acagugaucgccuugauaa

SEQ ID NO: 1111967 - RNA, 19 nt, Homo sapiens
caacgauugugcaccugaa

SEQ ID NO: 1111968 - RNA, 19 nt, Homo sapiens
ccagauccgcuauucaauu

SEQ ID NO: 1111969 - RNA, 19 nt, Homo sapiens
ggucguaaauauccugagu

SEQ ID NO: 1111970 - RNA, 19 nt, Homo sapiens
caaagauaccaccuuaaug

SEQ ID NO: 1111971 - RNA, 19 nt, Homo sapiens
acaaagauaccaccuuaau

SEQ ID NO: 1111972 - RNA, 19 nt, Homo sapiens
guaauugugcaggauauaa

SEQ ID NO: 1111973 - RNA, 19 nt, Homo sapiens
gaauagaccgagaacagau

SEQ ID NO: 1111974 - RNA, 19 nt, Homo sapiens
ucuccgacgucaacgauaa

SEQ ID NO: 1111975 - RNA, 19 nt, Homo sapiens
gcaccugaaguuauuguga

SEQ ID NO: 1111976 - RNA, 19 nt, Homo sapiens
agagaucaccuacuccuuu

SEQ ID NO: 1111977 - RNA, 19 nt, Homo sapiens
ucguaaauauccugaguug

SEQ ID NO: 1111978 - RNA, 19 nt, Homo sapiens
ggacagagaagagcacagu

SEQ ID NO: 1111979 - RNA, 19 nt, Homo sapiens
gagaaaucacgacaaagga

SEQ ID NO: 1111980 - RNA, 19 nt, Homo sapiens
ucaccuacuccuuucauaa

SEQ ID NO: 1111981 - RNA, 19 nt, Homo sapiens
acagagaagagcacaguuu

SEQ ID NO: 1111982 - RNA, 19 nt, Homo sapiens
gagaaacagacuccagaug

SEQ ID NO: 1111983 - RNA, 19 nt, Homo sapiens
caagaucucgucugugaca

SEQ ID NO: 1111984 - RNA, 19 nt, Homo sapiens
gaggagaucccagaauaca

SEQ ID NO: 1111985 - RNA, 19 nt, Homo sapiens
ucacgacaaaggaugauuu

SEQ ID NO: 1111986 - RNA, 19 nt, Homo sapiens
caaauccgaaucaaaguca

SEQ ID NO: 1111987 - RNA, 19 nt, Homo sapiens
cccagaaagcggagacuua

SEQ ID NO: 1111988 - RNA, 19 nt, Homo sapiens
gugcaggauauaaaugaua

SEQ ID NO: 1111989 - RNA, 19 nt, Homo sapiens
gagaaaauggagaaguuua

SEQ ID NO: 1111990 - RNA, 19 nt, Homo sapiens
caagacagaguucaauuuu

SEQ ID NO: 1111991 - RNA, 19 nt, Homo sapiens
gggaaaugccaaguuuauu

SEQ ID NO: 1111992 - RNA, 19 nt, Homo sapiens
gauugugcaccugaaguua

SEQ ID NO: 1111993 - RNA, 19 nt, Homo sapiens
gcugaaaauccacuaaaua

SEQ ID NO: 1111994 - RNA, 19 nt, Homo sapiens
cagaauagaccgagaacag

SEQ ID NO: 1111995 - RNA, 19 nt, Homo sapiens
gcgccucuaucgcucaaau

SEQ ID NO: 1111996 - RNA, 19 nt, Homo sapiens
ggagacccaccucaaagug

SEQ ID NO: 1111997 - RNA, 19 nt, Homo sapiens
guccagauccgcuauucaa

SEQ ID NO: 1111998 - RNA, 19 nt, Homo sapiens
uauugugacuucaguaucu

SEQ ID NO: 1111999 - RNA, 19 nt, Homo sapiens
acgcagagaucaccuacuc

SEQ ID NO: 1112000 - RNA, 19 nt, Homo sapiens
gacaacgaguacuuugauc

SEQ ID NO: 1112001 - RNA, 19 nt, Homo sapiens
gaucucagugcucuucuuc

SEQ ID NO: 1112002 - RNA, 19 nt, Homo sapiens
ugacagaauagaccgagaa

SEQ ID NO: 1112003 - RNA, 19 nt, Homo sapiens
agaaagcggagacuuacuu

SEQ ID NO: 1112004 - RNA, 19 nt, Homo sapiens
ugacaacgaguacuuugau

SEQ ID NO: 1112005 - RNA, 19 nt, Homo sapiens
caaugccucuugggaacaa

SEQ ID NO: 1112006 - RNA, 19 nt, Homo sapiens
gccaagacagaguucaauu

SEQ ID NO: 1112007 - RNA, 19 nt, Homo sapiens
ggauagccugcaagaggua

SEQ ID NO: 1112008 - RNA, 19 nt, Homo sapiens
gacccaaauccgaaucaaa

SEQ ID NO: 1112009 - RNA, 19 nt, Homo sapiens
uccagauggucguaaauau

SEQ ID NO: 1112010 - RNA, 19 nt, Homo sapiens
caguaauugugcaggauau

SEQ ID NO: 1112011 - RNA, 19 nt, Homo sapiens
gauccgcuauucaauucca

SEQ ID NO: 1112012 - RNA, 19 nt, Homo sapiens
uaauguggacgaacaagug

SEQ ID NO: 1112013 - RNA, 19 nt, Homo sapiens
ccagauggucguaaauauc

SEQ ID NO: 1112014 - RNA, 19 nt, Homo sapiens
ggacaaagcuugacacauc

SEQ ID NO: 1112015 - RNA, 19 nt, Homo sapiens
guacugacuucuccuauaa

SEQ ID NO: 1112016 - RNA, 19 nt, Homo sapiens
gcaagaaggagaagaagua

SEQ ID NO: 1112017 - RNA, 19 nt, Homo sapiens
ggauuaaacuggcauuuca

SEQ ID NO: 1112018 - RNA, 19 nt, Homo sapiens
ucagagcucucaucgcuua

SEQ ID NO: 1112019 - RNA, 19 nt, Homo sapiens
uaacaggaccaauggauua

SEQ ID NO: 1112020 - RNA, 19 nt, Homo sapiens
caagaucaaugcucaaguu

SEQ ID NO: 1112021 - RNA, 19 nt, Homo sapiens
ggaaguaaauauccgguau

SEQ ID NO: 1112022 - RNA, 19 nt, Homo sapiens
gcaaagacagaguuuaauu

SEQ ID NO: 1112023 - RNA, 19 nt, Homo sapiens
guagauauguguugagugu

SEQ ID NO: 1112024 - RNA, 19 nt, Homo sapiens
gaauccaccucgaagaauu

SEQ ID NO: 1112025 - RNA, 19 nt, Homo sapiens
ggaaaguccugauggaagu

SEQ ID NO: 1112026 - RNA, 19 nt, Homo sapiens
ggcauugacuuagaaauuu

SEQ ID NO: 1112027 - RNA, 19 nt, Homo sapiens
gaaguuccuuucaaauuag

SEQ ID NO: 1112028 - RNA, 19 nt, Homo sapiens
gaggauuauuucaacguua

SEQ ID NO: 1112029 - RNA, 19 nt, Homo sapiens
gaagagacaaguagauaug

SEQ ID NO: 1112030 - RNA, 19 nt, Homo sapiens
ggacuuugcccuauuccua

SEQ ID NO: 1112031 - RNA, 19 nt, Homo sapiens
ccaccucgaagaauuauua

SEQ ID NO: 1112032 - RNA, 19 nt, Homo sapiens
ugauaaugcucccguguuu

SEQ ID NO: 1112033 - RNA, 19 nt, Homo sapiens
gaagcucgaagcagguuua

SEQ ID NO: 1112034 - RNA, 19 nt, Homo sapiens
gaucaaugcucaaguuuug

SEQ ID NO: 1112035 - RNA, 19 nt, Homo sapiens
gcauugacuuagaaauuug

SEQ ID NO: 1112036 - RNA, 19 nt, Homo sapiens
uagaauagccaguagugua

SEQ ID NO: 1112037 - RNA, 19 nt, Homo sapiens
cagagaagccgaaaugaug

SEQ ID NO: 1112038 - RNA, 19 nt, Homo sapiens
caacgacaaugcaccuguu

SEQ ID NO: 1112039 - RNA, 19 nt, Homo sapiens
gagaagauuugcggaagga

SEQ ID NO: 1112040 - RNA, 19 nt, Homo sapiens
gaagaaguuccuuucaaau

SEQ ID NO: 1112041 - RNA, 19 nt, Homo sapiens
guaccagccucuucaaucu

SEQ ID NO: 1112042 - RNA, 19 nt, Homo sapiens
ccacgugguuguuguaauc

SEQ ID NO: 1112043 - RNA, 19 nt, Homo sapiens
caccuaaucuucgcggaua

SEQ ID NO: 1112044 - RNA, 19 nt, Homo sapiens
caggagguauacaggguua

SEQ ID NO: 1112045 - RNA, 19 nt, Homo sapiens
gggaccaaaugaacagaaa

SEQ ID NO: 1112046 - RNA, 19 nt, Homo sapiens
gcucgaagcagguuuagga

SEQ ID NO: 1112047 - RNA, 19 nt, Homo sapiens
gcaauggcaacaagaagaa

SEQ ID NO: 1112048 - RNA, 19 nt, Homo sapiens
cguacugacuucuccuaua

SEQ ID NO: 1112049 - RNA, 19 nt, Homo sapiens
gacaaagcuugacacauca

SEQ ID NO: 1112050 - RNA, 19 nt, Homo sapiens
cagcugaacuccuccaucu

SEQ ID NO: 1112051 - RNA, 19 nt, Homo sapiens
acugagggcugcuuucaaa

SEQ ID NO: 1112052 - RNA, 19 nt, Homo sapiens
gaacaucagagcucucauc

SEQ ID NO: 1112053 - RNA, 19 nt, Homo sapiens
gaagauuugcggaaggaaa

SEQ ID NO: 1112054 - RNA, 19 nt, Homo sapiens
gacaacauccuccagauuc

SEQ ID NO: 1112055 - RNA, 19 nt, Homo sapiens
caaagacagaguuuaauuc

SEQ ID NO: 1112056 - RNA, 19 nt, Homo sapiens
gcuccgcccucuucgauau

SEQ ID NO: 1112057 - RNA, 19 nt, Homo sapiens
gcacaucuccgacaucaac

SEQ ID NO: 1112058 - RNA, 19 nt, Homo sapiens
uaggauagaucgagagaag

SEQ ID NO: 1112059 - RNA, 19 nt, Homo sapiens
gccauagccugguuaaagu

SEQ ID NO: 1112060 - RNA, 19 nt, Homo sapiens
agaaacaagugcccaguca

SEQ ID NO: 1112061 - RNA, 19 nt, Homo sapiens
gaagaagucgggcaagaag

SEQ ID NO: 1112062 - RNA, 19 nt, Homo sapiens
gaaagucucagcccaggau

SEQ ID NO: 1112063 - RNA, 19 nt, Homo sapiens
ggaggaggcucuguauguc

SEQ ID NO: 1112064 - RNA, 19 nt, Homo sapiens
uuacggaugccaaugauaa

SEQ ID NO: 1112065 - RNA, 19 nt, Homo sapiens
ggaccagucuucuguuuug

SEQ ID NO: 1112066 - RNA, 19 nt, Homo sapiens
acaaguagauauguguuga

SEQ ID NO: 1112067 - RNA, 19 nt, Homo sapiens
caaaaggcauugacuuaga

SEQ ID NO: 1112068 - RNA, 19 nt, Homo sapiens
cuacaacgucacaaucaua

SEQ ID NO: 1112069 - RNA, 19 nt, Homo sapiens
gauaaugcucccguguuua

SEQ ID NO: 1112070 - RNA, 19 nt, Homo sapiens
aaucaauacuucucucugu

SEQ ID NO: 1112071 - RNA, 19 nt, Homo sapiens
guaaaauucucucuggauu

SEQ ID NO: 1112072 - RNA, 19 nt, Homo sapiens
ggacccuucccacuacaua

SEQ ID NO: 1112073 - RNA, 19 nt, Homo sapiens
cuacaagccuccuaguucu

SEQ ID NO: 1112074 - RNA, 19 nt, Homo sapiens
gaacuccuccaucuuccaa

SEQ ID NO: 1112075 - RNA, 19 nt, Homo sapiens
cgcgggagcuguuguccua

SEQ ID NO: 1112076 - RNA, 19 nt, Homo sapiens
gacaugcuauacucaggaa

SEQ ID NO: 1112077 - RNA, 19 nt, Homo sapiens
uagaaauuguugacgagaa

SEQ ID NO: 1112078 - RNA, 19 nt, Homo sapiens
guguugaaguaccaaguaa

SEQ ID NO: 1112079 - RNA, 19 nt, Homo sapiens
cugcaaagacagaguuuaa

SEQ ID NO: 1112080 - RNA, 19 nt, Homo sapiens
agaaauuguugacgagaau

SEQ ID NO: 1112081 - RNA, 19 nt, Homo sapiens
ggauagaucgagagaagau

SEQ ID NO: 1112082 - RNA, 19 nt, Homo sapiens
ggagagcggggauuuguua

SEQ ID NO: 1112083 - RNA, 19 nt, Homo sapiens
cucaggaucugcuguguga

SEQ ID NO: 1112084 - RNA, 19 nt, Homo sapiens
gcagauccgauacacgauu

SEQ ID NO: 1112085 - RNA, 19 nt, Homo sapiens
gcagacagcagacuacaac

SEQ ID NO: 1112086 - RNA, 19 nt, Homo sapiens
gaccugcccuuacaguagu

SEQ ID NO: 1112087 - RNA, 19 nt, Homo sapiens
ugaaguaccaaguaaccua

SEQ ID NO: 1112088 - RNA, 19 nt, Homo sapiens
gcugaacuccuccaucuuc

SEQ ID NO: 1112089 - RNA, 19 nt, Homo sapiens
gcacccaggccucagaguu

SEQ ID NO: 1112090 - RNA, 19 nt, Homo sapiens
caagaaggagaagaaguaa

SEQ ID NO: 1112091 - RNA, 19 nt, Homo sapiens
uguaauagcccucauaaaa

SEQ ID NO: 1112092 - RNA, 19 nt, Homo sapiens
guccuucucuaaccagauu

SEQ ID NO: 1112093 - RNA, 19 nt, Homo sapiens
ccuauaagcgcuucucuuc

SEQ ID NO: 1112094 - RNA, 19 nt, Homo sapiens
ggccauagccugguuaaag

SEQ ID NO: 1112095 - RNA, 19 nt, Homo sapiens
ggagaagaaguaacaugga

SEQ ID NO: 1112096 - RNA, 19 nt, Homo sapiens
gaaguuauacaccaucaac

SEQ ID NO: 1112097 - RNA, 19 nt, Homo sapiens
guagugcggugugcuuuua

SEQ ID NO: 1112098 - RNA, 19 nt, Homo sapiens
caacaaccaguuugacaca

SEQ ID NO: 1112099 - RNA, 19 nt, Homo sapiens
gugcagaggauuauuucaa

SEQ ID NO: 1112100 - RNA, 19 nt, Homo sapiens
gggcauggacaaagcuuga

SEQ ID NO: 1112101 - RNA, 19 nt, Homo sapiens
gaaaguccugauggaagua

SEQ ID NO: 1112102 - RNA, 19 nt, Homo sapiens
gagcuaacaggaccaaugg

SEQ ID NO: 1112103 - RNA, 19 nt, Homo sapiens
gccauaaaccaauaacuag

SEQ ID NO: 1112104 - RNA, 19 nt, Homo sapiens
ugacaacauccuccagauu

SEQ ID NO: 1112105 - RNA, 19 nt, Homo sapiens
gguguugaaguaccaagua

SEQ ID NO: 1112106 - RNA, 19 nt, Homo sapiens
agaaggagaagaaguaaca

SEQ ID NO: 1112107 - RNA, 19 nt, Homo sapiens
aagaagaagucgggcaaga

SEQ ID NO: 1112108 - RNA, 19 nt, Homo sapiens
gcaccuggcccaacaacca

SEQ ID NO: 1112109 - RNA, 19 nt, Homo sapiens
ccuccagccucgacacuga

SEQ ID NO: 1112110 - RNA, 19 nt, Homo sapiens
ccucgaagaauuauuacaa

SEQ ID NO: 1112111 - RNA, 19 nt, Homo sapiens
uagaauccaccucgaagaa

SEQ ID NO: 1112112 - RNA, 19 nt, Homo sapiens
gaguuacggaugccaauga

SEQ ID NO: 1112113 - RNA, 19 nt, Homo sapiens
gagcucucaucgcuuaauc

SEQ ID NO: 1112114 - RNA, 19 nt, Homo sapiens
ucagagcucucaucgcuua

SEQ ID NO: 1112115 - RNA, 19 nt, Homo sapiens
ggaaguaaauauccgguau

SEQ ID NO: 1112116 - RNA, 19 nt, Homo sapiens
gcaaagacagaguuuaauu

SEQ ID NO: 1112117 - RNA, 19 nt, Homo sapiens
guagauauguguugagugu

SEQ ID NO: 1112118 - RNA, 19 nt, Homo sapiens
gcacgugaguuucugcaaa

SEQ ID NO: 1112119 - RNA, 19 nt, Homo sapiens
gaauccaccucgaagaauu

SEQ ID NO: 1112120 - RNA, 19 nt, Homo sapiens
ggaaaguccugauggaagu

SEQ ID NO: 1112121 - RNA, 19 nt, Homo sapiens
ggcauugacuuagaaauuu

SEQ ID NO: 1112122 - RNA, 19 nt, Homo sapiens
gaaguuccuuucaaauuag

SEQ ID NO: 1112123 - RNA, 19 nt, Homo sapiens
gaggauuauuucaacguua

SEQ ID NO: 1112124 - RNA, 19 nt, Homo sapiens
gaagagacaaguagauaug

SEQ ID NO: 1112125 - RNA, 19 nt, Homo sapiens
ggacuuugcccuauuccua

SEQ ID NO: 1112126 - RNA, 19 nt, Homo sapiens
ccaccucgaagaauuauua

SEQ ID NO: 1112127 - RNA, 19 nt, Homo sapiens
ugauaaugcucccguguuu

SEQ ID NO: 1112128 - RNA, 19 nt, Homo sapiens
gcauugacuuagaaauuug

SEQ ID NO: 1112129 - RNA, 19 nt, Homo sapiens
caacgacaaugcaccuguu

SEQ ID NO: 1112130 - RNA, 19 nt, Homo sapiens
cagagaagccgaaaugaug

SEQ ID NO: 1112131 - RNA, 19 nt, Homo sapiens
gagaagauuugcggaagga

SEQ ID NO: 1112132 - RNA, 19 nt, Homo sapiens
gaagaaguuccuuucaaau

SEQ ID NO: 1112133 - RNA, 19 nt, Homo sapiens
guaccagccucuucaaucu

SEQ ID NO: 1112134 - RNA, 19 nt, Homo sapiens
ccacgugguuguuguaauc

SEQ ID NO: 1112135 - RNA, 19 nt, Homo sapiens
caccuaaucuucgcggaua

SEQ ID NO: 1112136 - RNA, 19 nt, Homo sapiens
caggagguauacaggguua

SEQ ID NO: 1112137 - RNA, 19 nt, Homo sapiens
acugagggcugcuuucaaa

SEQ ID NO: 1112138 - RNA, 19 nt, Homo sapiens
gaacaucagagcucucauc

SEQ ID NO: 1112139 - RNA, 19 nt, Homo sapiens
gaagauuugcggaaggaaa

SEQ ID NO: 1112140 - RNA, 19 nt, Homo sapiens
caaagacagaguuuaauuc

SEQ ID NO: 1112141 - RNA, 19 nt, Homo sapiens
gcuccgcccucuucgauau

SEQ ID NO: 1112142 - RNA, 19 nt, Homo sapiens
gcacaucuccgacaucaac

SEQ ID NO: 1112143 - RNA, 19 nt, Homo sapiens
uaggauagaucgagagaag

SEQ ID NO: 1112144 - RNA, 19 nt, Homo sapiens
gugaguuucugcaaaucua

SEQ ID NO: 1112145 - RNA, 19 nt, Homo sapiens
uuacggaugccaaugauaa

SEQ ID NO: 1112146 - RNA, 19 nt, Homo sapiens
acaaguagauauguguuga

SEQ ID NO: 1112147 - RNA, 19 nt, Homo sapiens
caaaaggcauugacuuaga

SEQ ID NO: 1112148 - RNA, 19 nt, Homo sapiens
cuacaacgucacaaucaua

SEQ ID NO: 1112149 - RNA, 19 nt, Homo sapiens
gauaaugcucccguguuua

SEQ ID NO: 1112150 - RNA, 19 nt, Homo sapiens
aaucaauacuucucucugu

SEQ ID NO: 1112151 - RNA, 19 nt, Homo sapiens
guaaaauucucucuggauu

SEQ ID NO: 1112152 - RNA, 19 nt, Homo sapiens
cgcgggagcuguuguccua

SEQ ID NO: 1112153 - RNA, 19 nt, Homo sapiens
gacaugcuauacucaggaa

SEQ ID NO: 1112154 - RNA, 19 nt, Homo sapiens
uagaaauuguugacgagaa

SEQ ID NO: 1112155 - RNA, 19 nt, Homo sapiens
cugcaaagacagaguuuaa

SEQ ID NO: 1112156 - RNA, 19 nt, Homo sapiens
agaaauuguugacgagaau

SEQ ID NO: 1112157 - RNA, 19 nt, Homo sapiens
ggauagaucgagagaagau

SEQ ID NO: 1112158 - RNA, 19 nt, Homo sapiens
ggagagcggggauuuguua

SEQ ID NO: 1112159 - RNA, 19 nt, Homo sapiens
cucaggaucugcuguguga

SEQ ID NO: 1112160 - RNA, 19 nt, Homo sapiens
gcagacagcagacuacaac

SEQ ID NO: 1112161 - RNA, 19 nt, Homo sapiens
gcagauccgauacacgauu

SEQ ID NO: 1112162 - RNA, 19 nt, Homo sapiens
uguaauagcccucauaaaa

SEQ ID NO: 1112163 - RNA, 19 nt, Homo sapiens
guccuucucuaaccagauu

SEQ ID NO: 1112164 - RNA, 19 nt, Homo sapiens
gaaguuauacaccaucaac

SEQ ID NO: 1112165 - RNA, 19 nt, Homo sapiens
gugcagaggauuauuucaa

SEQ ID NO: 1112166 - RNA, 19 nt, Homo sapiens
gaaaguccugauggaagua

SEQ ID NO: 1112167 - RNA, 19 nt, Homo sapiens
ccuccagccucgacacuga

SEQ ID NO: 1112168 - RNA, 19 nt, Homo sapiens
ccucgaagaauuauuacaa

SEQ ID NO: 1112169 - RNA, 19 nt, Homo sapiens
uagaauccaccucgaagaa

SEQ ID NO: 1112170 - RNA, 19 nt, Homo sapiens
gaguuacggaugccaauga

SEQ ID NO: 1112171 - RNA, 19 nt, Homo sapiens
gagcucucaucgcuuaauc

SEQ ID NO: 1112172 - RNA, 19 nt, Homo sapiens
gcaccacguuucguugcaa

SEQ ID NO: 1112173 - RNA, 19 nt, Homo sapiens
cacgugaguuucugcaaau

SEQ ID NO: 1112174 - RNA, 19 nt, Homo sapiens
gguuguaugugccaguaau

SEQ ID NO: 1112175 - RNA, 19 nt, Homo sapiens
gacaaggauucugggcaaa

SEQ ID NO: 1112176 - RNA, 19 nt, Homo sapiens
gaaaagucagguacuguuu

SEQ ID NO: 1112177 - RNA, 19 nt, Homo sapiens
guuagugaacgguaggaua

SEQ ID NO: 1112178 - RNA, 19 nt, Homo sapiens
ccagagaagccgaaaugau

SEQ ID NO: 1112179 - RNA, 19 nt, Homo sapiens
ugucuucgcacgugaguuu

SEQ ID NO: 1112180 - RNA, 19 nt, Homo sapiens
ugaugauccuucuaugguu

SEQ ID NO: 1112181 - RNA, 19 nt, Homo sapiens
gaacuguaauagcccucau

SEQ ID NO: 1112182 - RNA, 19 nt, Homo sapiens
gagacaaguagauaugugu

SEQ ID NO: 1112183 - RNA, 19 nt, Homo sapiens
caauacuucucucugucaa

SEQ ID NO: 1112184 - RNA, 19 nt, Homo sapiens
ggauucugcucaagaugca

SEQ ID NO: 1112185 - RNA, 19 nt, Homo sapiens
cuuagaaauuugugaguca

SEQ ID NO: 1112186 - RNA, 19 nt, Homo sapiens
cagauccgauacacgauuc

SEQ ID NO: 1112187 - RNA, 19 nt, Homo sapiens
ccuaugccuuccucaauuc

SEQ ID NO: 1112188 - RNA, 19 nt, Homo sapiens
aggguuagccuccaagaaa

SEQ ID NO: 1112189 - RNA, 19 nt, Homo sapiens
gcuuaugacccuucuuugu

SEQ ID NO: 1112190 - RNA, 19 nt, Homo sapiens
ugaagagacaaguagauau

SEQ ID NO: 1112191 - RNA, 19 nt, Homo sapiens
ucuucaaucucaauccaaa

SEQ ID NO: 1112192 - RNA, 19 nt, Homo sapiens
gagaagccgaaaugaugaa

SEQ ID NO: 1112193 - RNA, 19 nt, Homo sapiens
ggauagccugcaagaggua

SEQ ID NO: 1112194 - RNA, 19 nt, Homo sapiens
ccacgugucugagaacaac

SEQ ID NO: 1112195 - RNA, 19 nt, Homo sapiens
gacuacaacgucacaauca

SEQ ID NO: 1112196 - RNA, 19 nt, Homo sapiens
uaauagcccucauaaaagu

SEQ ID NO: 1112197 - RNA, 19 nt, Homo sapiens
ggauggaggaguacacaca

SEQ ID NO: 1112198 - RNA, 19 nt, Homo sapiens
ucaagaugcagauguggaa

SEQ ID NO: 1112199 - RNA, 19 nt, Homo sapiens
agaggauuauuucaacguu

SEQ ID NO: 1112200 - RNA, 19 nt, Homo sapiens
acucuauucuggccaguga

SEQ ID NO: 1112201 - RNA, 19 nt, Homo sapiens
aaucauagccaccgacaag

SEQ ID NO: 1112202 - RNA, 19 nt, Homo sapiens
gacaaguagauauguguug

SEQ ID NO: 1112203 - RNA, 19 nt, Homo sapiens
agagacaaguagauaugug

SEQ ID NO: 1112204 - RNA, 19 nt, Homo sapiens
cauaucuggauccgaguua

SEQ ID NO: 1112205 - RNA, 19 nt, Homo sapiens
cuaagcggcaccacccaua

SEQ ID NO: 1112206 - RNA, 19 nt, Homo sapiens
guggaaggcaauucacuga

SEQ ID NO: 1112207 - RNA, 19 nt, Homo sapiens
aggcauugacuuagaaauu

SEQ ID NO: 1112208 - RNA, 19 nt, Homo sapiens
guuguuguaauccaagaua

SEQ ID NO: 1112209 - RNA, 19 nt, Homo sapiens
uguauugccucucauucug

SEQ ID NO: 1112210 - RNA, 19 nt, Homo sapiens
gggagcagacagcagacua

SEQ ID NO: 1112211 - RNA, 19 nt, Homo sapiens
aauccaccucgaagaauua

SEQ ID NO: 1112212 - RNA, 19 nt, Homo sapiens
uaaccagauuccagaggau

SEQ ID NO: 1112213 - RNA, 19 nt, Homo sapiens
augcagagaucaccuaugc

SEQ ID NO: 1112214 - RNA, 19 nt, Homo sapiens
gaagacaccuugaagauuu

SEQ ID NO: 1112215 - RNA, 19 nt, Homo sapiens
ggacaaagcuugacacauc

SEQ ID NO: 1112216 - RNA, 19 nt, Homo sapiens
ugauaacgcuccagaaaua

SEQ ID NO: 1112217 - RNA, 19 nt, Homo sapiens
guacugacuucuccuauaa

SEQ ID NO: 1112218 - RNA, 19 nt, Homo sapiens
guccagagcuacaauauaa

SEQ ID NO: 1112219 - RNA, 19 nt, Homo sapiens
gcaagaaggagaagaagua

SEQ ID NO: 1112220 - RNA, 19 nt, Homo sapiens
ggauuaaacuggcauuuca

SEQ ID NO: 1112221 - RNA, 19 nt, Homo sapiens
agaaugcccuggucacuua

SEQ ID NO: 1112222 - RNA, 19 nt, Homo sapiens
uaacaggaccaauggauua

SEQ ID NO: 1112223 - RNA, 19 nt, Homo sapiens
gcagaagagucaccugauu

SEQ ID NO: 1112224 - RNA, 19 nt, Homo sapiens
caagaucaaugcucaaguu

SEQ ID NO: 1112225 - RNA, 19 nt, Homo sapiens
acuaucaccucuucuauua

SEQ ID NO: 1112226 - RNA, 19 nt, Homo sapiens
gauauucggugccagaaga

SEQ ID NO: 1112227 - RNA, 19 nt, Homo sapiens
ggucaagucuccuguuuua

SEQ ID NO: 1112228 - RNA, 19 nt, Homo sapiens
ccucagaccucucgcugua

SEQ ID NO: 1112229 - RNA, 19 nt, Homo sapiens
gccuaggacuucauagaua

SEQ ID NO: 1112230 - RNA, 19 nt, Homo sapiens
ccaccugccuuuuaaauua

SEQ ID NO: 1112231 - RNA, 19 nt, Homo sapiens
cagcucagcccuaauaauu

SEQ ID NO: 1112232 - RNA, 19 nt, Homo sapiens
ccucacagcuuuagaugga

SEQ ID NO: 1112233 - RNA, 19 nt, Homo sapiens
gaguggagguggaaauaau

SEQ ID NO: 1112234 - RNA, 19 nt, Homo sapiens
gaagcucgaagcagguuua

SEQ ID NO: 1112235 - RNA, 19 nt, Homo sapiens
gaucaaugcucaaguuuug

SEQ ID NO: 1112236 - RNA, 19 nt, Homo sapiens
cuugauagcugaagacuca

SEQ ID NO: 1112237 - RNA, 19 nt, Homo sapiens
uagaauagccaguagugua

SEQ ID NO: 1112238 - RNA, 19 nt, Homo sapiens
gaaggcggguuggcaggua

SEQ ID NO: 1112239 - RNA, 19 nt, Homo sapiens
ccaauuggauucacaaacu

SEQ ID NO: 1112240 - RNA, 19 nt, Homo sapiens
ggaagacaccuugaagauu

SEQ ID NO: 1112241 - RNA, 19 nt, Homo sapiens
ccuccuaugucucuauuaa

SEQ ID NO: 1112242 - RNA, 19 nt, Homo sapiens
ucuaugagauggaaauuca

SEQ ID NO: 1112243 - RNA, 19 nt, Homo sapiens
caaggcuucugaaauauuc

SEQ ID NO: 1112244 - RNA, 19 nt, Homo sapiens
ggacuucauagauacauaa

SEQ ID NO: 1112245 - RNA, 19 nt, Homo sapiens
gaucacggcaggcaggaua

SEQ ID NO: 1112246 - RNA, 19 nt, Homo sapiens
agacucagcuaucauuuua

SEQ ID NO: 1112247 - RNA, 19 nt, Homo sapiens
gaaauucaaggccaagaug

SEQ ID NO: 1112248 - RNA, 19 nt, Homo sapiens
gaacucgggugcugauggu

SEQ ID NO: 1112249 - RNA, 19 nt, Homo sapiens
ugauugcucuucuaaaugu

SEQ ID NO: 1112250 - RNA, 19 nt, Homo sapiens
gcaaggcuucugaaauauu

SEQ ID NO: 1112251 - RNA, 19 nt, Homo sapiens
gggaccaaaugaacagaaa

SEQ ID NO: 1112252 - RNA, 19 nt, Homo sapiens
gcucgaagcagguuuagga

SEQ ID NO: 1112253 - RNA, 19 nt, Homo sapiens
gcaauggcaacaagaagaa

SEQ ID NO: 1112254 - RNA, 19 nt, Homo sapiens
gcgauuugcucuuccuaau

SEQ ID NO: 1112255 - RNA, 19 nt, Homo sapiens
cguacugacuucuccuaua

SEQ ID NO: 1112256 - RNA, 19 nt, Homo sapiens
gacaaagcuugacacauca

SEQ ID NO: 1112257 - RNA, 19 nt, Homo sapiens
cagcugaacuccuccaucu

SEQ ID NO: 1112258 - RNA, 19 nt, Homo sapiens
gaugguggaggucucuuua

SEQ ID NO: 1112259 - RNA, 19 nt, Homo sapiens
ggccaagaauccagagcua

SEQ ID NO: 1112260 - RNA, 19 nt, Homo sapiens
gacaacauccuccagauuc

SEQ ID NO: 1112261 - RNA, 19 nt, Homo sapiens
cagaagagucaccugauuu

SEQ ID NO: 1112262 - RNA, 19 nt, Homo sapiens
cacgaggucucucucauug

SEQ ID NO: 1112263 - RNA, 19 nt, Homo sapiens
gggcacugcuggacagaga

SEQ ID NO: 1112264 - RNA, 19 nt, Homo sapiens
gcuaccagcucagcccuaa

SEQ ID NO: 1112265 - RNA, 19 nt, Homo sapiens
ugaacucccuccagagcua

SEQ ID NO: 1112266 - RNA, 19 nt, Homo sapiens
gagguggaaauaauagaua

SEQ ID NO: 1112267 - RNA, 19 nt, Homo sapiens
gccauagccugguuaaagu

SEQ ID NO: 1112268 - RNA, 19 nt, Homo sapiens
agaaacaagugcccaguca

SEQ ID NO: 1112269 - RNA, 19 nt, Homo sapiens
gaagaagucgggcaagaag

SEQ ID NO: 1112270 - RNA, 19 nt, Homo sapiens
aaauaacuaucaccucuuc

SEQ ID NO: 1112271 - RNA, 19 nt, Homo sapiens
gaaagucucagcccaggau

SEQ ID NO: 1112272 - RNA, 19 nt, Homo sapiens
ggaggaggcucuguauguc

SEQ ID NO: 1112273 - RNA, 19 nt, Homo sapiens
gaagacucagcuaucauuu

SEQ ID NO: 1112274 - RNA, 19 nt, Homo sapiens
ugagcaguuucgagacuua

SEQ ID NO: 1112275 - RNA, 19 nt, Homo sapiens
guacagugauugcucuucu

SEQ ID NO: 1112276 - RNA, 19 nt, Homo sapiens
uaaaugaucacaucccaau

SEQ ID NO: 1112277 - RNA, 19 nt, Homo sapiens
ggaccagucuucuguuuug

SEQ ID NO: 1112278 - RNA, 19 nt, Homo sapiens
uacaauccuucgacuauga

SEQ ID NO: 1112279 - RNA, 19 nt, Homo sapiens
gggaguugguccagagcua

SEQ ID NO: 1112280 - RNA, 19 nt, Homo sapiens
acacaaagcggaaugagau

SEQ ID NO: 1112281 - RNA, 19 nt, Homo sapiens
gaaauaacuaucaccucuu

SEQ ID NO: 1112282 - RNA, 19 nt, Homo sapiens
gauuugcucuuccuaaugc

SEQ ID NO: 1112283 - RNA, 19 nt, Homo sapiens
ggacagagacgcgcucaag

SEQ ID NO: 1112284 - RNA, 19 nt, Homo sapiens
guugaucacuguuguggau

SEQ ID NO: 1112285 - RNA, 19 nt, Homo sapiens
aagacaccuugaagauuua

SEQ ID NO: 1112286 - RNA, 19 nt, Homo sapiens
ccaggcagauccgauauuc

SEQ ID NO: 1112287 - RNA, 19 nt, Homo sapiens
ggacccuucccacuacaua

SEQ ID NO: 1112288 - RNA, 19 nt, Homo sapiens
cuacaagccuccuaguucu

SEQ ID NO: 1112289 - RNA, 19 nt, Homo sapiens
gaacuccuccaucuuccaa

SEQ ID NO: 1112290 - RNA, 19 nt, Homo sapiens
aaaugugacccgacaagua

SEQ ID NO: 1112291 - RNA, 19 nt, Homo sapiens
caaccaaccagcucgagaa

SEQ ID NO: 1112292 - RNA, 19 nt, Homo sapiens
guguugaaguaccaaguaa

SEQ ID NO: 1112293 - RNA, 19 nt, Homo sapiens
aaugugacccgacaaguaa

SEQ ID NO: 1112294 - RNA, 19 nt, Homo sapiens
ugaagacucagcuaucauu

SEQ ID NO: 1112295 - RNA, 19 nt, Homo sapiens
acucaugucuggcugaaug

SEQ ID NO: 1112296 - RNA, 19 nt, Homo sapiens
agugauugcucuucuaaau

SEQ ID NO: 1112297 - RNA, 19 nt, Homo sapiens
gguccucgauguaaaugau

SEQ ID NO: 1112298 - RNA, 19 nt, Homo sapiens
ggaggacgaaguggagaua

SEQ ID NO: 1112299 - RNA, 19 nt, Homo sapiens
gaaaagcgagccacucuug

SEQ ID NO: 1112300 - RNA, 19 nt, Homo sapiens
gguccagagcuacaauaua

SEQ ID NO: 1112301 - RNA, 19 nt, Homo sapiens
gauaacgcuccagaaauaa

SEQ ID NO: 1112302 - RNA, 19 nt, Homo sapiens
guauaucgcgugaguguuc

SEQ ID NO: 1112303 - RNA, 19 nt, Homo sapiens
uaccagcucagcccuaaua

SEQ ID NO: 1112304 - RNA, 19 nt, Homo sapiens
gaccugcccuuacaguagu

SEQ ID NO: 1112305 - RNA, 19 nt, Homo sapiens
ugaaguaccaaguaaccua

SEQ ID NO: 1112306 - RNA, 19 nt, Homo sapiens
gcugaacuccuccaucuuc

SEQ ID NO: 1112307 - RNA, 19 nt, Homo sapiens
gcacccaggccucagaguu

SEQ ID NO: 1112308 - RNA, 19 nt, Homo sapiens
caagaaggagaagaaguaa

SEQ ID NO: 1112309 - RNA, 19 nt, Homo sapiens
ggaguggagguggaaauaa

SEQ ID NO: 1112310 - RNA, 19 nt, Homo sapiens
ccuauaagcgcuucucuuc

SEQ ID NO: 1112311 - RNA, 19 nt, Homo sapiens
ggccauagccugguuaaag

SEQ ID NO: 1112312 - RNA, 19 nt, Homo sapiens
ggagaagaaguaacaugga

SEQ ID NO: 1112313 - RNA, 19 nt, Homo sapiens
cgacgauguugaucacugu

SEQ ID NO: 1112314 - RNA, 19 nt, Homo sapiens
gaagacaccuugaagauuu

SEQ ID NO: 1112315 - RNA, 19 nt, Homo sapiens
ugauaacgcuccagaaaua

SEQ ID NO: 1112316 - RNA, 19 nt, Homo sapiens
guccagagcuacaauauaa

SEQ ID NO: 1112317 - RNA, 19 nt, Homo sapiens
agaaugcccuggucacuua

SEQ ID NO: 1112318 - RNA, 19 nt, Homo sapiens
gcagaagagucaccugauu

SEQ ID NO: 1112319 - RNA, 19 nt, Homo sapiens
caacuaugcugguuugguu

SEQ ID NO: 1112320 - RNA, 19 nt, Homo sapiens
acuaucaccucuucuauua

SEQ ID NO: 1112321 - RNA, 19 nt, Homo sapiens
guaguuauauuccaccauu

SEQ ID NO: 1112322 - RNA, 19 nt, Homo sapiens
gauauucggugccagaaga

SEQ ID NO: 1112323 - RNA, 19 nt, Homo sapiens
ggucaagucuccuguuuua

SEQ ID NO: 1112324 - RNA, 19 nt, Homo sapiens
ccucagaccucucgcugua

SEQ ID NO: 1112325 - RNA, 19 nt, Homo sapiens
gccuaggacuucauagaua

SEQ ID NO: 1112326 - RNA, 19 nt, Homo sapiens
ccaccugccuuuuaaauua

SEQ ID NO: 1112327 - RNA, 19 nt, Homo sapiens
cagcucagcccuaauaauu

SEQ ID NO: 1112328 - RNA, 19 nt, Homo sapiens
ccucacagcuuuagaugga

SEQ ID NO: 1112329 - RNA, 19 nt, Homo sapiens
gaguggagguggaaauaau

SEQ ID NO: 1112330 - RNA, 19 nt, Homo sapiens
gagcaauacaugugaguuu

SEQ ID NO: 1112331 - RNA, 19 nt, Homo sapiens
cuugauagcugaagacuca

SEQ ID NO: 1112332 - RNA, 19 nt, Homo sapiens
gaaggcggguuggcaggua

SEQ ID NO: 1112333 - RNA, 19 nt, Homo sapiens
ccaauuggauucacaaacu

SEQ ID NO: 1112334 - RNA, 19 nt, Homo sapiens
ggaagacaccuugaagauu

SEQ ID NO: 1112335 - RNA, 19 nt, Homo sapiens
ccuccuaugucucuauuaa

SEQ ID NO: 1112336 - RNA, 19 nt, Homo sapiens
ucuaugagauggaaauuca

SEQ ID NO: 1112337 - RNA, 19 nt, Homo sapiens
caaggcuucugaaauauuc

SEQ ID NO: 1112338 - RNA, 19 nt, Homo sapiens
ggacuucauagauacauaa

SEQ ID NO: 1112339 - RNA, 19 nt, Homo sapiens
gaucacggcaggcaggaua

SEQ ID NO: 1112340 - RNA, 19 nt, Homo sapiens
gauaaucuuucagaacguu

SEQ ID NO: 1112341 - RNA, 19 nt, Homo sapiens
agacucagcuaucauuuua

SEQ ID NO: 1112342 - RNA, 19 nt, Homo sapiens
gaaauucaaggccaagaug

SEQ ID NO: 1112343 - RNA, 19 nt, Homo sapiens
gaacucgggugcugauggu

SEQ ID NO: 1112344 - RNA, 19 nt, Homo sapiens
ugauugcucuucuaaaugu

SEQ ID NO: 1112345 - RNA, 19 nt, Homo sapiens
gcaaggcuucugaaauauu

SEQ ID NO: 1112346 - RNA, 19 nt, Homo sapiens
gcgauuugcucuuccuaau

SEQ ID NO: 1112347 - RNA, 19 nt, Homo sapiens
gaugguggaggucucuuua

SEQ ID NO: 1112348 - RNA, 19 nt, Homo sapiens
ggccaagaauccagagcua

SEQ ID NO: 1112349 - RNA, 19 nt, Homo sapiens
cagaagagucaccugauuu

SEQ ID NO: 1112350 - RNA, 19 nt, Homo sapiens
cacgaggucucucucauug

SEQ ID NO: 1112351 - RNA, 19 nt, Homo sapiens
gggcacugcuggacagaga

SEQ ID NO: 1112352 - RNA, 19 nt, Homo sapiens
gcuaccagcucagcccuaa

SEQ ID NO: 1112353 - RNA, 19 nt, Homo sapiens
ugaacucccuccagagcua

SEQ ID NO: 1112354 - RNA, 19 nt, Homo sapiens
gagguggaaauaauagaua

SEQ ID NO: 1112355 - RNA, 19 nt, Homo sapiens
aaauaacuaucaccucuuc

SEQ ID NO: 1112356 - RNA, 19 nt, Homo sapiens
gcugugccuucacugauuu

SEQ ID NO: 1112357 - RNA, 19 nt, Homo sapiens
gaagacucagcuaucauuu

SEQ ID NO: 1112358 - RNA, 19 nt, Homo sapiens
ugagcaguuucgagacuua

SEQ ID NO: 1112359 - RNA, 19 nt, Homo sapiens
guacagugauugcucuucu

SEQ ID NO: 1112360 - RNA, 19 nt, Homo sapiens
uaaaugaucacaucccaau

SEQ ID NO: 1112361 - RNA, 19 nt, Homo sapiens
uacaauccuucgacuauga

SEQ ID NO: 1112362 - RNA, 19 nt, Homo sapiens
gggaguugguccagagcua

SEQ ID NO: 1112363 - RNA, 19 nt, Homo sapiens
cggcauauauuuaguucau

SEQ ID NO: 1112364 - RNA, 19 nt, Homo sapiens
gaaauaacuaucaccucuu

SEQ ID NO: 1112365 - RNA, 19 nt, Homo sapiens
acacaaagcggaaugagau

SEQ ID NO: 1112366 - RNA, 19 nt, Homo sapiens
gauuugcucuuccuaaugc

SEQ ID NO: 1112367 - RNA, 19 nt, Homo sapiens
ggacagagacgcgcucaag

SEQ ID NO: 1112368 - RNA, 19 nt, Homo sapiens
guugaucacuguuguggau

SEQ ID NO: 1112369 - RNA, 19 nt, Homo sapiens
aagacaccuugaagauuua

SEQ ID NO: 1112370 - RNA, 19 nt, Homo sapiens
ccaggcagauccgauauuc

SEQ ID NO: 1112371 - RNA, 19 nt, Homo sapiens
uuauuucucugccuccuaa

SEQ ID NO: 1112372 - RNA, 19 nt, Homo sapiens
aaaugugacccgacaagua

SEQ ID NO: 1112373 - RNA, 19 nt, Homo sapiens
caaccaaccagcucgagaa

SEQ ID NO: 1112374 - RNA, 19 nt, Homo sapiens
ccuaauuguuggugucuug

SEQ ID NO: 1112375 - RNA, 19 nt, Homo sapiens
aaugugacccgacaaguaa

SEQ ID NO: 1112376 - RNA, 19 nt, Homo sapiens
ugaagacucagcuaucauu

SEQ ID NO: 1112377 - RNA, 19 nt, Homo sapiens
acucaugucuggcugaaug

SEQ ID NO: 1112378 - RNA, 19 nt, Homo sapiens
agugauugcucuucuaaau

SEQ ID NO: 1112379 - RNA, 19 nt, Homo sapiens
gguccucgauguaaaugau

SEQ ID NO: 1112380 - RNA, 19 nt, Homo sapiens
ggaggacgaaguggagaua

SEQ ID NO: 1112381 - RNA, 19 nt, Homo sapiens
gaaaagcgagccacucuug

SEQ ID NO: 1112382 - RNA, 19 nt, Homo sapiens
gguccagagcuacaauaua

SEQ ID NO: 1112383 - RNA, 19 nt, Homo sapiens
gauaacgcuccagaaauaa

SEQ ID NO: 1112384 - RNA, 19 nt, Homo sapiens
guauaucgcgugaguguuc

SEQ ID NO: 1112385 - RNA, 19 nt, Homo sapiens
uaccagcucagcccuaaua

SEQ ID NO: 1112386 - RNA, 19 nt, Homo sapiens
ggaguggagguggaaauaa

SEQ ID NO: 1112387 - RNA, 19 nt, Homo sapiens
cuucacugauuuguaguua

SEQ ID NO: 1112388 - RNA, 19 nt, Homo sapiens
cgacgauguugaucacugu

SEQ ID NO: 1112389 - RNA, 19 nt, Homo sapiens
caagaauccagagcuagua

SEQ ID NO: 1112390 - RNA, 19 nt, Homo sapiens
ccacgaggucucucucauu

SEQ ID NO: 1112391 - RNA, 19 nt, Homo sapiens
ggcugaauguggcagauga

SEQ ID NO: 1112392 - RNA, 19 nt, Homo sapiens
uacauaagccgauucacaa

SEQ ID NO: 1112393 - RNA, 19 nt, Homo sapiens
aaugauaacgcuccagaaa

SEQ ID NO: 1112394 - RNA, 19 nt, Homo sapiens
ucugaaauauuccaauugg

SEQ ID NO: 1112395 - RNA, 19 nt, Homo sapiens
gaggcgaucccauccgaaa

SEQ ID NO: 1112396 - RNA, 19 nt, Homo sapiens
caggagagcugugagaaaa

SEQ ID NO: 1112397 - RNA, 19 nt, Homo sapiens
gguaugcccacgucacauu

SEQ ID NO: 1112398 - RNA, 19 nt, Homo sapiens
ggauguagucggccuagga

SEQ ID NO: 1112399 - RNA, 19 nt, Homo sapiens
uuccuucgcuuucugauau

SEQ ID NO: 1112400 - RNA, 19 nt, Homo sapiens
gcaaaugugacccgacaag

SEQ ID NO: 1112401 - RNA, 19 nt, Homo sapiens
gcaucuuccuggucuuugu

SEQ ID NO: 1112402 - RNA, 19 nt, Homo sapiens
uggcagaugacaacgauaa

SEQ ID NO: 1112403 - RNA, 19 nt, Homo sapiens
uaacuaucaccucuucuau

SEQ ID NO: 1112404 - RNA, 19 nt, Homo sapiens
uccugacacuggagacuua

SEQ ID NO: 1112405 - RNA, 19 nt, Homo sapiens
ggaaauucaaggccaagau

SEQ ID NO: 1112406 - RNA, 19 nt, Homo sapiens
gagacgguguccuccuguu

SEQ ID NO: 1112407 - RNA, 19 nt, Homo sapiens
gcaauacaugugaguuuua

SEQ ID NO: 1112408 - RNA, 19 nt, Homo sapiens
gacaaguaaucaggugaga

SEQ ID NO: 1112409 - RNA, 19 nt, Homo sapiens
gggccaggcagauccgaua

SEQ ID NO: 1112410 - RNA, 19 nt, Homo sapiens
uaaaugugcaagaucaaga

SEQ ID NO: 1112411 - RNA, 19 nt, Homo sapiens
ccuacaauccuucgacuau

SEQ ID NO: 1112412 - RNA, 19 nt, Homo sapiens
cuuacucucugacggauga

SEQ ID NO: 1112413 - RNA, 19 nt, Homo sapiens
gaauguggcagaugacaac

SEQ ID NO: 1112414 - RNA, 19 nt, Homo sapiens
gaagacaccuugaagauuu

SEQ ID NO: 1112415 - RNA, 19 nt, Homo sapiens
ggacaaagcuugacacauc

SEQ ID NO: 1112416 - RNA, 19 nt, Homo sapiens
ugauaacgcuccagaaaua

SEQ ID NO: 1112417 - RNA, 19 nt, Homo sapiens
guacugacuucuccuauaa

SEQ ID NO: 1112418 - RNA, 19 nt, Homo sapiens
guccagagcuacaauauaa

SEQ ID NO: 1112419 - RNA, 19 nt, Homo sapiens
gcaagaaggagaagaagua

SEQ ID NO: 1112420 - RNA, 19 nt, Homo sapiens
ggauuaaacuggcauuuca

SEQ ID NO: 1112421 - RNA, 19 nt, Homo sapiens
agaaugcccuggucacuua

SEQ ID NO: 1112422 - RNA, 19 nt, Homo sapiens
uaacaggaccaauggauua

SEQ ID NO: 1112423 - RNA, 19 nt, Homo sapiens
caagaucaaugcucaaguu

SEQ ID NO: 1112424 - RNA, 19 nt, Homo sapiens
acuaucaccucuucuauua

SEQ ID NO: 1112425 - RNA, 19 nt, Homo sapiens
gauauucggugccagaaga

SEQ ID NO: 1112426 - RNA, 19 nt, Homo sapiens
ggucaagucuccuguuuua

SEQ ID NO: 1112427 - RNA, 19 nt, Homo sapiens
gccuaggacuucauagaua

SEQ ID NO: 1112428 - RNA, 19 nt, Homo sapiens
ccaccugccuuuuaaauua

SEQ ID NO: 1112429 - RNA, 19 nt, Homo sapiens
cagcucagcccuaauaauu

SEQ ID NO: 1112430 - RNA, 19 nt, Homo sapiens
ccucacagcuuuagaugga

SEQ ID NO: 1112431 - RNA, 19 nt, Homo sapiens
gaguggagguggaaauaau

SEQ ID NO: 1112432 - RNA, 19 nt, Homo sapiens
gaagcucgaagcagguuua

SEQ ID NO: 1112433 - RNA, 19 nt, Homo sapiens
gaucaaugcucaaguuuug

SEQ ID NO: 1112434 - RNA, 19 nt, Homo sapiens
uagaauagccaguagugua

SEQ ID NO: 1112435 - RNA, 19 nt, Homo sapiens
ccaauuggauucacaaacu

SEQ ID NO: 1112436 - RNA, 19 nt, Homo sapiens
ggaagacaccuugaagauu

SEQ ID NO: 1112437 - RNA, 19 nt, Homo sapiens
ccuccuaugucucuauuaa

SEQ ID NO: 1112438 - RNA, 19 nt, Homo sapiens
ucuaugagauggaaauuca

SEQ ID NO: 1112439 - RNA, 19 nt, Homo sapiens
caaggcuucugaaauauuc

SEQ ID NO: 1112440 - RNA, 19 nt, Homo sapiens
ggacuucauagauacauaa

SEQ ID NO: 1112441 - RNA, 19 nt, Homo sapiens
gaucacggcaggcaggaua

SEQ ID NO: 1112442 - RNA, 19 nt, Homo sapiens
gaaauucaaggccaagaug

SEQ ID NO: 1112443 - RNA, 19 nt, Homo sapiens
gaacucgggugcugauggu

SEQ ID NO: 1112444 - RNA, 19 nt, Homo sapiens
ugauugcucuucuaaaugu

SEQ ID NO: 1112445 - RNA, 19 nt, Homo sapiens
gcaaggcuucugaaauauu

SEQ ID NO: 1112446 - RNA, 19 nt, Homo sapiens
gggaccaaaugaacagaaa

SEQ ID NO: 1112447 - RNA, 19 nt, Homo sapiens
gcucgaagcagguuuagga

SEQ ID NO: 1112448 - RNA, 19 nt, Homo sapiens
gcaauggcaacaagaagaa

SEQ ID NO: 1112449 - RNA, 19 nt, Homo sapiens
gcgauuugcucuuccuaau

SEQ ID NO: 1112450 - RNA, 19 nt, Homo sapiens
cguacugacuucuccuaua

SEQ ID NO: 1112451 - RNA, 19 nt, Homo sapiens
gacaaagcuugacacauca

SEQ ID NO: 1112452 - RNA, 19 nt, Homo sapiens
cagcugaacuccuccaucu

SEQ ID NO: 1112453 - RNA, 19 nt, Homo sapiens
gaugguggaggucucuuua

SEQ ID NO: 1112454 - RNA, 19 nt, Homo sapiens
ggccaagaauccagagcua

SEQ ID NO: 1112455 - RNA, 19 nt, Homo sapiens
gacaacauccuccagauuc

SEQ ID NO: 1112456 - RNA, 19 nt, Homo sapiens
gcuaccagcucagcccuaa

SEQ ID NO: 1112457 - RNA, 19 nt, Homo sapiens
ugaacucccuccagagcua

SEQ ID NO: 1112458 - RNA, 19 nt, Homo sapiens
gagguggaaauaauagaua

SEQ ID NO: 1112459 - RNA, 19 nt, Homo sapiens
gccauagccugguuaaagu

SEQ ID NO: 1112460 - RNA, 19 nt, Homo sapiens
agaaacaagugcccaguca

SEQ ID NO: 1112461 - RNA, 19 nt, Homo sapiens
gaagaagucgggcaagaag

SEQ ID NO: 1112462 - RNA, 19 nt, Homo sapiens
aaauaacuaucaccucuuc

SEQ ID NO: 1112463 - RNA, 19 nt, Homo sapiens
gaaagucucagcccaggau

SEQ ID NO: 1112464 - RNA, 19 nt, Homo sapiens
ggaggaggcucuguauguc

SEQ ID NO: 1112465 - RNA, 19 nt, Homo sapiens
ugagcaguuucgagacuua

SEQ ID NO: 1112466 - RNA, 19 nt, Homo sapiens
guacagugauugcucuucu

SEQ ID NO: 1112467 - RNA, 19 nt, Homo sapiens
uaaaugaucacaucccaau

SEQ ID NO: 1112468 - RNA, 19 nt, Homo sapiens
ggaccagucuucuguuuug

SEQ ID NO: 1112469 - RNA, 19 nt, Homo sapiens
uacaauccuucgacuauga

SEQ ID NO: 1112470 - RNA, 19 nt, Homo sapiens
gggaguugguccagagcua

SEQ ID NO: 1112471 - RNA, 19 nt, Homo sapiens
acacaaagcggaaugagau

SEQ ID NO: 1112472 - RNA, 19 nt, Homo sapiens
gaaauaacuaucaccucuu

SEQ ID NO: 1112473 - RNA, 19 nt, Homo sapiens
gauuugcucuuccuaaugc

SEQ ID NO: 1112474 - RNA, 19 nt, Homo sapiens
guugaucacuguuguggau

SEQ ID NO: 1112475 - RNA, 19 nt, Homo sapiens
aagacaccuugaagauuua

SEQ ID NO: 1112476 - RNA, 19 nt, Homo sapiens
ccaggcagauccgauauuc

SEQ ID NO: 1112477 - RNA, 19 nt, Homo sapiens
ggacccuucccacuacaua

SEQ ID NO: 1112478 - RNA, 19 nt, Homo sapiens
cuacaagccuccuaguucu

SEQ ID NO: 1112479 - RNA, 19 nt, Homo sapiens
gaacuccuccaucuuccaa

SEQ ID NO: 1112480 - RNA, 19 nt, Homo sapiens
caaccaaccagcucgagaa

SEQ ID NO: 1112481 - RNA, 19 nt, Homo sapiens
guguugaaguaccaaguaa

SEQ ID NO: 1112482 - RNA, 19 nt, Homo sapiens
acucaugucuggcugaaug

SEQ ID NO: 1112483 - RNA, 19 nt, Homo sapiens
agugauugcucuucuaaau

SEQ ID NO: 1112484 - RNA, 19 nt, Homo sapiens
gguccucgauguaaaugau

SEQ ID NO: 1112485 - RNA, 19 nt, Homo sapiens
ggaggacgaaguggagaua

SEQ ID NO: 1112486 - RNA, 19 nt, Homo sapiens
gguccagagcuacaauaua

SEQ ID NO: 1112487 - RNA, 19 nt, Homo sapiens
gauaacgcuccagaaauaa

SEQ ID NO: 1112488 - RNA, 19 nt, Homo sapiens
guauaucgcgugaguguuc

SEQ ID NO: 1112489 - RNA, 19 nt, Homo sapiens
uaccagcucagcccuaaua

SEQ ID NO: 1112490 - RNA, 19 nt, Homo sapiens
gaccugcccuuacaguagu

SEQ ID NO: 1112491 - RNA, 19 nt, Homo sapiens
ugaaguaccaaguaaccua

SEQ ID NO: 1112492 - RNA, 19 nt, Homo sapiens
gcugaacuccuccaucuuc

SEQ ID NO: 1112493 - RNA, 19 nt, Homo sapiens
gcacccaggccucagaguu

SEQ ID NO: 1112494 - RNA, 19 nt, Homo sapiens
caagaaggagaagaaguaa

SEQ ID NO: 1112495 - RNA, 19 nt, Homo sapiens
ggaguggagguggaaauaa

SEQ ID NO: 1112496 - RNA, 19 nt, Homo sapiens
ccuauaagcgcuucucuuc

SEQ ID NO: 1112497 - RNA, 19 nt, Homo sapiens
ggccauagccugguuaaag

SEQ ID NO: 1112498 - RNA, 19 nt, Homo sapiens
ggagaagaaguaacaugga

SEQ ID NO: 1112499 - RNA, 19 nt, Homo sapiens
cgacgauguugaucacugu

SEQ ID NO: 1112500 - RNA, 19 nt, Homo sapiens
caagaauccagagcuagua

SEQ ID NO: 1112501 - RNA, 19 nt, Homo sapiens
guagugcggugugcuuuua

SEQ ID NO: 1112502 - RNA, 19 nt, Homo sapiens
uacauaagccgauucacaa

SEQ ID NO: 1112503 - RNA, 19 nt, Homo sapiens
caacaaccaguuugacaca

SEQ ID NO: 1112504 - RNA, 19 nt, Homo sapiens
ggcugaauguggcagauga

SEQ ID NO: 1112505 - RNA, 19 nt, Homo sapiens
aaugauaacgcuccagaaa

SEQ ID NO: 1112506 - RNA, 19 nt, Homo sapiens
ucugaaauauuccaauugg

SEQ ID NO: 1112507 - RNA, 19 nt, Homo sapiens
gaggcgaucccauccgaaa

SEQ ID NO: 1112508 - RNA, 19 nt, Homo sapiens
gggcauggacaaagcuuga

SEQ ID NO: 1112509 - RNA, 19 nt, Homo sapiens
ggauguagucggccuagga

SEQ ID NO: 1112510 - RNA, 19 nt, Homo sapiens
uuccuucgcuuucugauau

SEQ ID NO: 1112511 - RNA, 19 nt, Homo sapiens
gagcuaacaggaccaaugg

SEQ ID NO: 1112512 - RNA, 19 nt, Homo sapiens
gccauaaaccaauaacuag

SEQ ID NO: 1112513 - RNA, 19 nt, Homo sapiens
ugacaacauccuccagauu

SEQ ID NO: 1112514 - RNA, 19 nt, Homo sapiens
ggacaaagcuugacacauc

SEQ ID NO: 1112515 - RNA, 19 nt, Homo sapiens
guacugacuucuccuauaa

SEQ ID NO: 1112516 - RNA, 19 nt, Homo sapiens
gggaacagguauccucuua

SEQ ID NO: 1112517 - RNA, 19 nt, Homo sapiens
gcaagaaggagaagaagua

SEQ ID NO: 1112518 - RNA, 19 nt, Homo sapiens
gaacagguauccucuuaca

SEQ ID NO: 1112519 - RNA, 19 nt, Homo sapiens
ggauuaaacuggcauuuca

SEQ ID NO: 1112520 - RNA, 19 nt, Homo sapiens
ggacgaaggugccaaugga

SEQ ID NO: 1112521 - RNA, 19 nt, Homo sapiens
uaacaggaccaauggauua

SEQ ID NO: 1112522 - RNA, 19 nt, Homo sapiens
gaagacagggugaaacuuu

SEQ ID NO: 1112523 - RNA, 19 nt, Homo sapiens
caagaucaaugcucaaguu

SEQ ID NO: 1112524 - RNA, 19 nt, Homo sapiens
gagaaugcccagauuauuu

SEQ ID NO: 1112525 - RNA, 19 nt, Homo sapiens
caaagagaaugcccagauu

SEQ ID NO: 1112526 - RNA, 19 nt, Homo sapiens
gcagaucuccuacucaauu

SEQ ID NO: 1112527 - RNA, 19 nt, Homo sapiens
aauaagcacuucucccuaa

SEQ ID NO: 1112528 - RNA, 19 nt, Homo sapiens
gaccaucacgucucuauuu

SEQ ID NO: 1112529 - RNA, 19 nt, Homo sapiens
gcacuucucccuaagaguu

SEQ ID NO: 1112530 - RNA, 19 nt, Homo sapiens
gggaaguccuccucuauca

SEQ ID NO: 1112531 - RNA, 19 nt, Homo sapiens
ugacaguuauuacagauug

SEQ ID NO: 1112532 - RNA, 19 nt, Homo sapiens
uggcguaucuaccauuuaa

SEQ ID NO: 1112533 - RNA, 19 nt, Homo sapiens
gcaaagagaaugcccagau

SEQ ID NO: 1112534 - RNA, 19 nt, Homo sapiens
caacggaagcucacuuuau

SEQ ID NO: 1112535 - RNA, 19 nt, Homo sapiens
cagguauccucuuacaaua

SEQ ID NO: 1112536 - RNA, 19 nt, Homo sapiens
gaagcucgaagcagguuua

SEQ ID NO: 1112537 - RNA, 19 nt, Homo sapiens
gaucaaugcucaaguuuug

SEQ ID NO: 1112538 - RNA, 19 nt, Homo sapiens
uagaauagccaguagugua

SEQ ID NO: 1112539 - RNA, 19 nt, Homo sapiens
ggguaccucuguccucaua

SEQ ID NO: 1112540 - RNA, 19 nt, Homo sapiens
agaaugcccagauuauuua

SEQ ID NO: 1112541 - RNA, 19 nt, Homo sapiens
ucagauccuucgacuauga

SEQ ID NO: 1112542 - RNA, 19 nt, Homo sapiens
gagacgcgcucaagcaaag

SEQ ID NO: 1112543 - RNA, 19 nt, Homo sapiens
aaagagaaugcccagauua

SEQ ID NO: 1112544 - RNA, 19 nt, Homo sapiens
ccaccuaccuucucucaag

SEQ ID NO: 1112545 - RNA, 19 nt, Homo sapiens
aaaaguccauugacaguua

SEQ ID NO: 1112546 - RNA, 19 nt, Homo sapiens
gggaccaaaugaacagaaa

SEQ ID NO: 1112547 - RNA, 19 nt, Homo sapiens
gcucgaagcagguuuagga

SEQ ID NO: 1112548 - RNA, 19 nt, Homo sapiens
gcaauggcaacaagaagaa

SEQ ID NO: 1112549 - RNA, 19 nt, Homo sapiens
cguacugacuucuccuaua

SEQ ID NO: 1112550 - RNA, 19 nt, Homo sapiens
gacaaagcuugacacauca

SEQ ID NO: 1112551 - RNA, 19 nt, Homo sapiens
cagcugaacuccuccaucu

SEQ ID NO: 1112552 - RNA, 19 nt, Homo sapiens
gauucgaaguuuccuauag

SEQ ID NO: 1112553 - RNA, 19 nt, Homo sapiens
gguauccucuuacaauauc

SEQ ID NO: 1112554 - RNA, 19 nt, Homo sapiens
gagaagugacauauucauu

SEQ ID NO: 1112555 - RNA, 19 nt, Homo sapiens
gacaacauccuccagauuc

SEQ ID NO: 1112556 - RNA, 19 nt, Homo sapiens
gcgaaagagucaccugauc

SEQ ID NO: 1112557 - RNA, 19 nt, Homo sapiens
cggcagaucuccuacucaa

SEQ ID NO: 1112558 - RNA, 19 nt, Homo sapiens
gagcagaauggacagguaa

SEQ ID NO: 1112559 - RNA, 19 nt, Homo sapiens
gaagugacauauucauucc

SEQ ID NO: 1112560 - RNA, 19 nt, Homo sapiens
ugaacucccugcagagcua

SEQ ID NO: 1112561 - RNA, 19 nt, Homo sapiens
gccauagccugguuaaagu

SEQ ID NO: 1112562 - RNA, 19 nt, Homo sapiens
agaaacaagugcccaguca

SEQ ID NO: 1112563 - RNA, 19 nt, Homo sapiens
gaagaagucgggcaagaag

SEQ ID NO: 1112564 - RNA, 19 nt, Homo sapiens
gggcuuuccugcagaccua

SEQ ID NO: 1112565 - RNA, 19 nt, Homo sapiens
ucaaaggaaucgcucaaag

SEQ ID NO: 1112566 - RNA, 19 nt, Homo sapiens
caucacgucucuauuuagu

SEQ ID NO: 1112567 - RNA, 19 nt, Homo sapiens
gaaagucucagcccaggau

SEQ ID NO: 1112568 - RNA, 19 nt, Homo sapiens
ggaggaggcucuguauguc

SEQ ID NO: 1112569 - RNA, 19 nt, Homo sapiens
uggcagauaucaaugacaa

SEQ ID NO: 1112570 - RNA, 19 nt, Homo sapiens
ggaccagucuucuguuuug

SEQ ID NO: 1112571 - RNA, 19 nt, Homo sapiens
guuagaugauucgaaguuu

SEQ ID NO: 1112572 - RNA, 19 nt, Homo sapiens
aacggaagcucacuuuaug

SEQ ID NO: 1112573 - RNA, 19 nt, Homo sapiens
cgcauagucuccagaggua

SEQ ID NO: 1112574 - RNA, 19 nt, Homo sapiens
ggaggagcauaucuugcaa

SEQ ID NO: 1112575 - RNA, 19 nt, Homo sapiens
ugacaaugcuccaaaauuc

SEQ ID NO: 1112576 - RNA, 19 nt, Homo sapiens
uuaauauccuuguggaaga

SEQ ID NO: 1112577 - RNA, 19 nt, Homo sapiens
ggacgcagcuuuucucucu

SEQ ID NO: 1112578 - RNA, 19 nt, Homo sapiens
ggacagagacgcgcucaag

SEQ ID NO: 1112579 - RNA, 19 nt, Homo sapiens
acacgcaauuguugaaguu

SEQ ID NO: 1112580 - RNA, 19 nt, Homo sapiens
aggaaucgcucaaaggaau

SEQ ID NO: 1112581 - RNA, 19 nt, Homo sapiens
ugaguguuccugagaauuu

SEQ ID NO: 1112582 - RNA, 19 nt, Homo sapiens
gcucaaaggaaucaaagga

SEQ ID NO: 1112583 - RNA, 19 nt, Homo sapiens
ggauagaaauagaaguaac

SEQ ID NO: 1112584 - RNA, 19 nt, Homo sapiens
ggacccuucccacuacaua

SEQ ID NO: 1112585 - RNA, 19 nt, Homo sapiens
cuacaagccuccuaguucu

SEQ ID NO: 1112586 - RNA, 19 nt, Homo sapiens
gaacuccuccaucuuccaa

SEQ ID NO: 1112587 - RNA, 19 nt, Homo sapiens
ccucauacauauccaucaa

SEQ ID NO: 1112588 - RNA, 19 nt, Homo sapiens
uuaccuauaucccagagaa

SEQ ID NO: 1112589 - RNA, 19 nt, Homo sapiens
guguugaaguaccaaguaa

SEQ ID NO: 1112590 - RNA, 19 nt, Homo sapiens
accaucacgucucuauuua

SEQ ID NO: 1112591 - RNA, 19 nt, Homo sapiens
gaaauacaagcagaagaug

SEQ ID NO: 1112592 - RNA, 19 nt, Homo sapiens
gagugaguguuccugagaa

SEQ ID NO: 1112593 - RNA, 19 nt, Homo sapiens
cagaaaaucuagacguaaa

SEQ ID NO: 1112594 - RNA, 19 nt, Homo sapiens
gaaguaacugauaucaaug

SEQ ID NO: 1112595 - RNA, 19 nt, Homo sapiens
ccucuguccucauacauau

SEQ ID NO: 1112596 - RNA, 19 nt, Homo sapiens
gaccugcccuuacaguagu

SEQ ID NO: 1112597 - RNA, 19 nt, Homo sapiens
ugaaguaccaaguaaccua

SEQ ID NO: 1112598 - RNA, 19 nt, Homo sapiens
gcugaacuccuccaucuuc

SEQ ID NO: 1112599 - RNA, 19 nt, Homo sapiens
gcacccaggccucagaguu

SEQ ID NO: 1112600 - RNA, 19 nt, Homo sapiens
caagaaggagaagaaguaa

SEQ ID NO: 1112601 - RNA, 19 nt, Homo sapiens
aaacgauccuuugucuuug

SEQ ID NO: 1112602 - RNA, 19 nt, Homo sapiens
ugagcagaauggacaggua

SEQ ID NO: 1112603 - RNA, 19 nt, Homo sapiens
gauggaggagcauaucuug

SEQ ID NO: 1112604 - RNA, 19 nt, Homo sapiens
ccuauaagcgcuucucuuc

SEQ ID NO: 1112605 - RNA, 19 nt, Homo sapiens
ggccauagccugguuaaag

SEQ ID NO: 1112606 - RNA, 19 nt, Homo sapiens
ggagaagaaguaacaugga

SEQ ID NO: 1112607 - RNA, 19 nt, Homo sapiens
gagcccugcuggacagaga

SEQ ID NO: 1112608 - RNA, 19 nt, Homo sapiens
acucagauccuucgacuau

SEQ ID NO: 1112609 - RNA, 19 nt, Homo sapiens
guaccucuguccucauaca

SEQ ID NO: 1112610 - RNA, 19 nt, Homo sapiens
aaaggaaucgcucaaagga

SEQ ID NO: 1112611 - RNA, 19 nt, Homo sapiens
gaacagucguagcccuuuu

SEQ ID NO: 1112612 - RNA, 19 nt, Homo sapiens
caguagaagauguaaauga

SEQ ID NO: 1112613 - RNA, 19 nt, Homo sapiens
gaauaccgagugaguguuc

SEQ ID NO: 1112614 - RNA, 19 nt, Homo sapiens
gggaacagguauccucuua

SEQ ID NO: 1112615 - RNA, 19 nt, Homo sapiens
gaacagguauccucuuaca

SEQ ID NO: 1112616 - RNA, 19 nt, Homo sapiens
ggacgaaggugccaaugga

SEQ ID NO: 1112617 - RNA, 19 nt, Homo sapiens
gaagacagggugaaacuuu

SEQ ID NO: 1112618 - RNA, 19 nt, Homo sapiens
gagaaugcccagauuauuu

SEQ ID NO: 1112619 - RNA, 19 nt, Homo sapiens
caaagagaaugcccagauu

SEQ ID NO: 1112620 - RNA, 19 nt, Homo sapiens
gcagaucuccuacucaauu

SEQ ID NO: 1112621 - RNA, 19 nt, Homo sapiens
aauaagcacuucucccuaa

SEQ ID NO: 1112622 - RNA, 19 nt, Homo sapiens
gaccaucacgucucuauuu

SEQ ID NO: 1112623 - RNA, 19 nt, Homo sapiens
gcacuucucccuaagaguu

SEQ ID NO: 1112624 - RNA, 19 nt, Homo sapiens
gggaaguccuccucuauca

SEQ ID NO: 1112625 - RNA, 19 nt, Homo sapiens
ugacaguuauuacagauug

SEQ ID NO: 1112626 - RNA, 19 nt, Homo sapiens
uggcguaucuaccauuuaa

SEQ ID NO: 1112627 - RNA, 19 nt, Homo sapiens
gcaaagagaaugcccagau

SEQ ID NO: 1112628 - RNA, 19 nt, Homo sapiens
caacggaagcucacuuuau

SEQ ID NO: 1112629 - RNA, 19 nt, Homo sapiens
cagguauccucuuacaaua

SEQ ID NO: 1112630 - RNA, 19 nt, Homo sapiens
ggguaccucuguccucaua

SEQ ID NO: 1112631 - RNA, 19 nt, Homo sapiens
agaaugcccagauuauuua

SEQ ID NO: 1112632 - RNA, 19 nt, Homo sapiens
ucagauccuucgacuauga

SEQ ID NO: 1112633 - RNA, 19 nt, Homo sapiens
gagacgcgcucaagcaaag

SEQ ID NO: 1112634 - RNA, 19 nt, Homo sapiens
aaagagaaugcccagauua

SEQ ID NO: 1112635 - RNA, 19 nt, Homo sapiens
ccaccuaccuucucucaag

SEQ ID NO: 1112636 - RNA, 19 nt, Homo sapiens
aaaaguccauugacaguua

SEQ ID NO: 1112637 - RNA, 19 nt, Homo sapiens
acacugaugaguagaauuu

SEQ ID NO: 1112638 - RNA, 19 nt, Homo sapiens
gauucgaaguuuccuauag

SEQ ID NO: 1112639 - RNA, 19 nt, Homo sapiens
gguauccucuuacaauauc

SEQ ID NO: 1112640 - RNA, 19 nt, Homo sapiens
gagaagugacauauucauu

SEQ ID NO: 1112641 - RNA, 19 nt, Homo sapiens
gcgaaagagucaccugauc

SEQ ID NO: 1112642 - RNA, 19 nt, Homo sapiens
gagcagaauggacagguaa

SEQ ID NO: 1112643 - RNA, 19 nt, Homo sapiens
cggcagaucuccuacucaa

SEQ ID NO: 1112644 - RNA, 19 nt, Homo sapiens
gaagugacauauucauucc

SEQ ID NO: 1112645 - RNA, 19 nt, Homo sapiens
ugaacucccugcagagcua

SEQ ID NO: 1112646 - RNA, 19 nt, Homo sapiens
gggcuuuccugcagaccua

SEQ ID NO: 1112647 - RNA, 19 nt, Homo sapiens
caucacgucucuauuuagu

SEQ ID NO: 1112648 - RNA, 19 nt, Homo sapiens
ucaaaggaaucgcucaaag

SEQ ID NO: 1112649 - RNA, 19 nt, Homo sapiens
uggcagauaucaaugacaa

SEQ ID NO: 1112650 - RNA, 19 nt, Homo sapiens
gcaugaugguggaaagugu

SEQ ID NO: 1112651 - RNA, 19 nt, Homo sapiens
guuagaugauucgaaguuu

SEQ ID NO: 1112652 - RNA, 19 nt, Homo sapiens
aacggaagcucacuuuaug

SEQ ID NO: 1112653 - RNA, 19 nt, Homo sapiens
ggaggagcauaucuugcaa

SEQ ID NO: 1112654 - RNA, 19 nt, Homo sapiens
ugacaaugcuccaaaauuc

SEQ ID NO: 1112655 - RNA, 19 nt, Homo sapiens
uuaauauccuuguggaaga

SEQ ID NO: 1112656 - RNA, 19 nt, Homo sapiens
cgcauagucuccagaggua

SEQ ID NO: 1112657 - RNA, 19 nt, Homo sapiens
uggaaaguguaaaugcuaa

SEQ ID NO: 1112658 - RNA, 19 nt, Homo sapiens
ggacagagacgcgcucaag

SEQ ID NO: 1112659 - RNA, 19 nt, Homo sapiens
gcucaaaggaaucaaagga

SEQ ID NO: 1112660 - RNA, 19 nt, Homo sapiens
acacgcaauuguugaaguu

SEQ ID NO: 1112661 - RNA, 19 nt, Homo sapiens
aggaaucgcucaaaggaau

SEQ ID NO: 1112662 - RNA, 19 nt, Homo sapiens
ugaguguuccugagaauuu

SEQ ID NO: 1112663 - RNA, 19 nt, Homo sapiens
ggauagaaauagaaguaac

SEQ ID NO: 1112664 - RNA, 19 nt, Homo sapiens
ggacgcagcuuuucucucu

SEQ ID NO: 1112665 - RNA, 19 nt, Homo sapiens
ccucauacauauccaucaa

SEQ ID NO: 1112666 - RNA, 19 nt, Homo sapiens
uuaccuauaucccagagaa

SEQ ID NO: 1112667 - RNA, 19 nt, Homo sapiens
accaucacgucucuauuua

SEQ ID NO: 1112668 - RNA, 19 nt, Homo sapiens
gaaauacaagcagaagaug

SEQ ID NO: 1112669 - RNA, 19 nt, Homo sapiens
gagugaguguuccugagaa

SEQ ID NO: 1112670 - RNA, 19 nt, Homo sapiens
cagaaaaucuagacguaaa

SEQ ID NO: 1112671 - RNA, 19 nt, Homo sapiens
gaaguaacugauaucaaug

SEQ ID NO: 1112672 - RNA, 19 nt, Homo sapiens
ccucuguccucauacauau

SEQ ID NO: 1112673 - RNA, 19 nt, Homo sapiens
ugagcagaauggacaggua

SEQ ID NO: 1112674 - RNA, 19 nt, Homo sapiens
gauggaggagcauaucuug

SEQ ID NO: 1112675 - RNA, 19 nt, Homo sapiens
gagcccugcuggacagaga

SEQ ID NO: 1112676 - RNA, 19 nt, Homo sapiens
acucagauccuucgacuau

SEQ ID NO: 1112677 - RNA, 19 nt, Homo sapiens
guaccucuguccucauaca

SEQ ID NO: 1112678 - RNA, 19 nt, Homo sapiens
aaaggaaucgcucaaagga

SEQ ID NO: 1112679 - RNA, 19 nt, Homo sapiens
gaacagucguagcccuuuu

SEQ ID NO: 1112680 - RNA, 19 nt, Homo sapiens
caguagaagauguaaauga

SEQ ID NO: 1112681 - RNA, 19 nt, Homo sapiens
gaauaccgagugaguguuc

SEQ ID NO: 1112682 - RNA, 19 nt, Homo sapiens
guucagagccgugccaaug

SEQ ID NO: 1112683 - RNA, 19 nt, Homo sapiens
acauauccaucaacucaga

SEQ ID NO: 1112684 - RNA, 19 nt, Homo sapiens
auacauauccaucaacuca

SEQ ID NO: 1112685 - RNA, 19 nt, Homo sapiens
ucuccuacuuuaccuauau

SEQ ID NO: 1112686 - RNA, 19 nt, Homo sapiens
caacccaccuaccuucucu

SEQ ID NO: 1112687 - RNA, 19 nt, Homo sapiens
gcuaaaacacugaugagua

SEQ ID NO: 1112688 - RNA, 19 nt, Homo sapiens
caggagagcugugagaaaa

SEQ ID NO: 1112689 - RNA, 19 nt, Homo sapiens
acagguauccucuuacaau

SEQ ID NO: 1112690 - RNA, 19 nt, Homo sapiens
gaagauggaggagcauauc

SEQ ID NO: 1112691 - RNA, 19 nt, Homo sapiens
ugacauauucauuccgaaa

SEQ ID NO: 1112692 - RNA, 19 nt, Homo sapiens
ggaaaguguaaaugcuaaa

SEQ ID NO: 1112693 - RNA, 19 nt, Homo sapiens
cauugacaguuauuacaga

SEQ ID NO: 1112694 - RNA, 19 nt, Homo sapiens
gcaaaaguguugauuacag

SEQ ID NO: 1112695 - RNA, 19 nt, Homo sapiens
agaaauacaagcagaagau

SEQ ID NO: 1112696 - RNA, 19 nt, Homo sapiens
ugggauagaaauagaagua

SEQ ID NO: 1112697 - RNA, 19 nt, Homo sapiens
ccaauggagaagugacaua

SEQ ID NO: 1112698 - RNA, 19 nt, Homo sapiens
ucaaugacaaugcuccaaa

SEQ ID NO: 1112699 - RNA, 19 nt, Homo sapiens
aaacacugaugaguagaau

SEQ ID NO: 1112700 - RNA, 19 nt, Homo sapiens
cuaaaacacugaugaguag

SEQ ID NO: 1112701 - RNA, 19 nt, Homo sapiens
acaaguggcagauaucaau

SEQ ID NO: 1112702 - RNA, 19 nt, Homo sapiens
ggaagcucacuuuaugcua

SEQ ID NO: 1112703 - RNA, 19 nt, Homo sapiens
gaguguuccugagaauuug

SEQ ID NO: 1112704 - RNA, 19 nt, Homo sapiens
gaaguccuccucuaucaac

SEQ ID NO: 1112705 - RNA, 19 nt, Homo sapiens
ggaaguccuccucuaucaa

SEQ ID NO: 1112706 - RNA, 19 nt, Homo sapiens
caaaggaaucgcucaaagg

SEQ ID NO: 1112707 - RNA, 19 nt, Homo sapiens
auggagaagugacauauuc

SEQ ID NO: 1112708 - RNA, 19 nt, Homo sapiens
aaaugucgcugcgggaaug

SEQ ID NO: 1112709 - RNA, 19 nt, Homo sapiens
guggaaaguguaaaugcua

SEQ ID NO: 1112710 - RNA, 19 nt, Homo sapiens
ccagugaguuuuauuuuca

SEQ ID NO: 1112711 - RNA, 19 nt, Homo sapiens
gcguaucuaccauuuaaau

SEQ ID NO: 1112712 - RNA, 19 nt, Homo sapiens
ggaacagucguagcccuuu

SEQ ID NO: 1112713 - RNA, 19 nt, Homo sapiens
agaagugacauauucauuc

SEQ ID NO: 1112714 - RNA, 19 nt, Homo sapiens
ggacaaagcuugacacauc

SEQ ID NO: 1112715 - RNA, 19 nt, Homo sapiens
guacugacuucuccuauaa

SEQ ID NO: 1112716 - RNA, 19 nt, Homo sapiens
gcaagaaggagaagaagua

SEQ ID NO: 1112717 - RNA, 19 nt, Homo sapiens
caacggauuuaccgaguua

SEQ ID NO: 1112718 - RNA, 19 nt, Homo sapiens
gcaagugacugacaucaau

SEQ ID NO: 1112719 - RNA, 19 nt, Homo sapiens
ggauuaaacuggcauuuca

SEQ ID NO: 1112720 - RNA, 19 nt, Homo sapiens
uaacaggaccaauggauua

SEQ ID NO: 1112721 - RNA, 19 nt, Homo sapiens
caagaucaaugcucaaguu

SEQ ID NO: 1112722 - RNA, 19 nt, Homo sapiens
ccaccuaugucucuauuaa

SEQ ID NO: 1112723 - RNA, 19 nt, Homo sapiens
gaagaauggucaaguuguc

SEQ ID NO: 1112724 - RNA, 19 nt, Homo sapiens
ggaaauacaagcugaagau

SEQ ID NO: 1112725 - RNA, 19 nt, Homo sapiens
gaagauuaguccugcuaug

SEQ ID NO: 1112726 - RNA, 19 nt, Homo sapiens
gaaacuguacggaauagaa

SEQ ID NO: 1112727 - RNA, 19 nt, Homo sapiens
ccucagaccuuacccucua

SEQ ID NO: 1112728 - RNA, 19 nt, Homo sapiens
ggacaaaagugcucauuuc

SEQ ID NO: 1112729 - RNA, 19 nt, Homo sapiens
gaguuaaaguccuugagaa

SEQ ID NO: 1112730 - RNA, 19 nt, Homo sapiens
ccgaaagucuggaaguaaa

SEQ ID NO: 1112731 - RNA, 19 nt, Homo sapiens
gaagcucgaagcagguuua

SEQ ID NO: 1112732 - RNA, 19 nt, Homo sapiens
gaucaaugcucaaguuuug

SEQ ID NO: 1112733 - RNA, 19 nt, Homo sapiens
uagaauagccaguagugua

SEQ ID NO: 1112734 - RNA, 19 nt, Homo sapiens
gcaaugagaauucuagagu

SEQ ID NO: 1112735 - RNA, 19 nt, Homo sapiens
ugacaguguuggauacaaa

SEQ ID NO: 1112736 - RNA, 19 nt, Homo sapiens
gagugaaacuguacggaau

SEQ ID NO: 1112737 - RNA, 19 nt, Homo sapiens
gacaauagaccugaaguga

SEQ ID NO: 1112738 - RNA, 19 nt, Homo sapiens
ccacuuagcagcaaugugu

SEQ ID NO: 1112739 - RNA, 19 nt, Homo sapiens
caaugagaauucuagaguu

SEQ ID NO: 1112740 - RNA, 19 nt, Homo sapiens
ggaacaguaauucuucuuu

SEQ ID NO: 1112741 - RNA, 19 nt, Homo sapiens
gagcuuuccuacagaccua

SEQ ID NO: 1112742 - RNA, 19 nt, Homo sapiens
uaugagcaguuuagagauu

SEQ ID NO: 1112743 - RNA, 19 nt, Homo sapiens
gggaccaaaugaacagaaa

SEQ ID NO: 1112744 - RNA, 19 nt, Homo sapiens
gcucgaagcagguuuagga

SEQ ID NO: 1112745 - RNA, 19 nt, Homo sapiens
gcaauggcaacaagaagaa

SEQ ID NO: 1112746 - RNA, 19 nt, Homo sapiens
ucauugagacuguuuguuu

SEQ ID NO: 1112747 - RNA, 19 nt, Homo sapiens
ggccgaaagucuggaagua

SEQ ID NO: 1112748 - RNA, 19 nt, Homo sapiens
cggaauagaaauagaagua

SEQ ID NO: 1112749 - RNA, 19 nt, Homo sapiens
cguacugacuucuccuaua

SEQ ID NO: 1112750 - RNA, 19 nt, Homo sapiens
gacaaagcuugacacauca

SEQ ID NO: 1112751 - RNA, 19 nt, Homo sapiens
cagcugaacuccuccaucu

SEQ ID NO: 1112752 - RNA, 19 nt, Homo sapiens
ggucuccucucuccaccua

SEQ ID NO: 1112753 - RNA, 19 nt, Homo sapiens
gaaaacaacgccagaggua

SEQ ID NO: 1112754 - RNA, 19 nt, Homo sapiens
ucucugcuauuccagcuua

SEQ ID NO: 1112755 - RNA, 19 nt, Homo sapiens
uuaaaguccugguugaaga

SEQ ID NO: 1112756 - RNA, 19 nt, Homo sapiens
gacaacauccuccagauuc

SEQ ID NO: 1112757 - RNA, 19 nt, Homo sapiens
caaguugucuguucuaucc

SEQ ID NO: 1112758 - RNA, 19 nt, Homo sapiens
accauuacaucucuguuua

SEQ ID NO: 1112759 - RNA, 19 nt, Homo sapiens
ugaacucccuccagagcua

SEQ ID NO: 1112760 - RNA, 19 nt, Homo sapiens
gccauagccugguuaaagu

SEQ ID NO: 1112761 - RNA, 19 nt, Homo sapiens
agaaacaagugcccaguca

SEQ ID NO: 1112762 - RNA, 19 nt, Homo sapiens
gaagaagucgggcaagaag

SEQ ID NO: 1112763 - RNA, 19 nt, Homo sapiens
gaccugaagugaccauuac

SEQ ID NO: 1112764 - RNA, 19 nt, Homo sapiens
gaaagucucagcccaggau

SEQ ID NO: 1112765 - RNA, 19 nt, Homo sapiens
ggaggaggcucuguauguc

SEQ ID NO: 1112766 - RNA, 19 nt, Homo sapiens
gaccauuacaucucuguuu

SEQ ID NO: 1112767 - RNA, 19 nt, Homo sapiens
guacggaauagaaauagaa

SEQ ID NO: 1112768 - RNA, 19 nt, Homo sapiens
ggaccagucuucuguuuug

SEQ ID NO: 1112769 - RNA, 19 nt, Homo sapiens
agauagagaugcgcucaaa

SEQ ID NO: 1112770 - RNA, 19 nt, Homo sapiens
ggaaauaucaacagcaaaa

SEQ ID NO: 1112771 - RNA, 19 nt, Homo sapiens
ggugucuggugaacuuuaa

SEQ ID NO: 1112772 - RNA, 19 nt, Homo sapiens
ggaagaauggucaaguugu

SEQ ID NO: 1112773 - RNA, 19 nt, Homo sapiens
gcauacaaauucuggaaaa

SEQ ID NO: 1112774 - RNA, 19 nt, Homo sapiens
gcagucgucuccugugucu

SEQ ID NO: 1112775 - RNA, 19 nt, Homo sapiens
ccacagaaauucacaucac

SEQ ID NO: 1112776 - RNA, 19 nt, Homo sapiens
gaagugaccauuacaucuc

SEQ ID NO: 1112777 - RNA, 19 nt, Homo sapiens
gaaaaguggcauacaaauu

SEQ ID NO: 1112778 - RNA, 19 nt, Homo sapiens
ggacgcagcuuuucucucu

SEQ ID NO: 1112779 - RNA, 19 nt, Homo sapiens
ggacccuucccacuacaua

SEQ ID NO: 1112780 - RNA, 19 nt, Homo sapiens
cuacaagccuccuaguucu

SEQ ID NO: 1112781 - RNA, 19 nt, Homo sapiens
gaacuccuccaucuuccaa

SEQ ID NO: 1112782 - RNA, 19 nt, Homo sapiens
cagagguacuuccaucuuc

SEQ ID NO: 1112783 - RNA, 19 nt, Homo sapiens
gcaccucagggaacaguaa

SEQ ID NO: 1112784 - RNA, 19 nt, Homo sapiens
guguugaaguaccaaguaa

SEQ ID NO: 1112785 - RNA, 19 nt, Homo sapiens
cgggaagaauggucaaguu

SEQ ID NO: 1112786 - RNA, 19 nt, Homo sapiens
gaaauacaagcugaagaug

SEQ ID NO: 1112787 - RNA, 19 nt, Homo sapiens
ugaaaauacuggggaaaua

SEQ ID NO: 1112788 - RNA, 19 nt, Homo sapiens
ccaaguuuccuauagaaga

SEQ ID NO: 1112789 - RNA, 19 nt, Homo sapiens
gguggaagauguaaaugac

SEQ ID NO: 1112790 - RNA, 19 nt, Homo sapiens
gaccugcccuuacaguagu

SEQ ID NO: 1112791 - RNA, 19 nt, Homo sapiens
ugaaguaccaaguaaccua

SEQ ID NO: 1112792 - RNA, 19 nt, Homo sapiens
gcugaacuccuccaucuuc

SEQ ID NO: 1112793 - RNA, 19 nt, Homo sapiens
gcacccaggccucagaguu

SEQ ID NO: 1112794 - RNA, 19 nt, Homo sapiens
caagaaggagaagaaguaa

SEQ ID NO: 1112795 - RNA, 19 nt, Homo sapiens
gauuccaaguuuccuauag

SEQ ID NO: 1112796 - RNA, 19 nt, Homo sapiens
gggaagaauggucaaguug

SEQ ID NO: 1112797 - RNA, 19 nt, Homo sapiens
uggaagauguaaaugacaa

SEQ ID NO: 1112798 - RNA, 19 nt, Homo sapiens
aauacaagcugaagauggu

SEQ ID NO: 1112799 - RNA, 19 nt, Homo sapiens
ccuauaagcgcuucucuuc

SEQ ID NO: 1112800 - RNA, 19 nt, Homo sapiens
ggccauagccugguuaaag

SEQ ID NO: 1112801 - RNA, 19 nt, Homo sapiens
ggagaagaaguaacaugga

SEQ ID NO: 1112802 - RNA, 19 nt, Homo sapiens
guagugcggugugcuuuua

SEQ ID NO: 1112803 - RNA, 19 nt, Homo sapiens
caacaaccaguuugacaca

SEQ ID NO: 1112804 - RNA, 19 nt, Homo sapiens
gcccaacuaugcagacaca

SEQ ID NO: 1112805 - RNA, 19 nt, Homo sapiens
gaccgagacuccgggaaga

SEQ ID NO: 1112806 - RNA, 19 nt, Homo sapiens
ucauuucgguggaagaugu

SEQ ID NO: 1112807 - RNA, 19 nt, Homo sapiens
ggagcacguuauccacuuc

SEQ ID NO: 1112808 - RNA, 19 nt, Homo sapiens
gggcauggacaaagcuuga

SEQ ID NO: 1112809 - RNA, 19 nt, Homo sapiens
aaacuguacggaauagaaa

SEQ ID NO: 1112810 - RNA, 19 nt, Homo sapiens
gcucugugcuccuuugacu

SEQ ID NO: 1112811 - RNA, 19 nt, Homo sapiens
gagcuaacaggaccaaugg

SEQ ID NO: 1112812 - RNA, 19 nt, Homo sapiens
gccauaaaccaauaacuag

SEQ ID NO: 1112813 - RNA, 19 nt, Homo sapiens
ugacaacauccuccagauu

SEQ ID NO: 1112814 - RNA, 19 nt, Homo sapiens
caacggauuuaccgaguua

SEQ ID NO: 1112815 - RNA, 19 nt, Homo sapiens
gcaagugacugacaucaau

SEQ ID NO: 1112816 - RNA, 19 nt, Homo sapiens
ccaccuaugucucuauuaa

SEQ ID NO: 1112817 - RNA, 19 nt, Homo sapiens
gaagaauggucaaguuguc

SEQ ID NO: 1112818 - RNA, 19 nt, Homo sapiens
ggaaauacaagcugaagau

SEQ ID NO: 1112819 - RNA, 19 nt, Homo sapiens
gaaacuguacggaauagaa

SEQ ID NO: 1112820 - RNA, 19 nt, Homo sapiens
gaagauuaguccugcuaug

SEQ ID NO: 1112821 - RNA, 19 nt, Homo sapiens
ccucagaccuuacccucua

SEQ ID NO: 1112822 - RNA, 19 nt, Homo sapiens
ggacaaaagugcucauuuc

SEQ ID NO: 1112823 - RNA, 19 nt, Homo sapiens
gaguuaaaguccuugagaa

SEQ ID NO: 1112824 - RNA, 19 nt, Homo sapiens
ccgaaagucuggaaguaaa

SEQ ID NO: 1112825 - RNA, 19 nt, Homo sapiens
gcaaugagaauucuagagu

SEQ ID NO: 1112826 - RNA, 19 nt, Homo sapiens
ugacaguguuggauacaaa

SEQ ID NO: 1112827 - RNA, 19 nt, Homo sapiens
gagugaaacuguacggaau

SEQ ID NO: 1112828 - RNA, 19 nt, Homo sapiens
gacaauagaccugaaguga

SEQ ID NO: 1112829 - RNA, 19 nt, Homo sapiens
ccacuuagcagcaaugugu

SEQ ID NO: 1112830 - RNA, 19 nt, Homo sapiens
caaugagaauucuagaguu

SEQ ID NO: 1112831 - RNA, 19 nt, Homo sapiens
ggaacaguaauucuucuuu

SEQ ID NO: 1112832 - RNA, 19 nt, Homo sapiens
gagcuuuccuacagaccua

SEQ ID NO: 1112833 - RNA, 19 nt, Homo sapiens
uaugagcaguuuagagauu

SEQ ID NO: 1112834 - RNA, 19 nt, Homo sapiens
ucauugagacuguuuguuu

SEQ ID NO: 1112835 - RNA, 19 nt, Homo sapiens
ggccgaaagucuggaagua

SEQ ID NO: 1112836 - RNA, 19 nt, Homo sapiens
cggaauagaaauagaagua

SEQ ID NO: 1112837 - RNA, 19 nt, Homo sapiens
ggucuccucucuccaccua

SEQ ID NO: 1112838 - RNA, 19 nt, Homo sapiens
gaaaacaacgccagaggua

SEQ ID NO: 1112839 - RNA, 19 nt, Homo sapiens
ucucugcuauuccagcuua

SEQ ID NO: 1112840 - RNA, 19 nt, Homo sapiens
uuaaaguccugguugaaga

SEQ ID NO: 1112841 - RNA, 19 nt, Homo sapiens
caaguugucuguucuaucc

SEQ ID NO: 1112842 - RNA, 19 nt, Homo sapiens
accauuacaucucuguuua

SEQ ID NO: 1112843 - RNA, 19 nt, Homo sapiens
ugaacucccuccagagcua

SEQ ID NO: 1112844 - RNA, 19 nt, Homo sapiens
gaccugaagugaccauuac

SEQ ID NO: 1112845 - RNA, 19 nt, Homo sapiens
gaccauuacaucucuguuu

SEQ ID NO: 1112846 - RNA, 19 nt, Homo sapiens
guacggaauagaaauagaa

SEQ ID NO: 1112847 - RNA, 19 nt, Homo sapiens
agauagagaugcgcucaaa

SEQ ID NO: 1112848 - RNA, 19 nt, Homo sapiens
ggaaauaucaacagcaaaa

SEQ ID NO: 1112849 - RNA, 19 nt, Homo sapiens
ggugucuggugaacuuuaa

SEQ ID NO: 1112850 - RNA, 19 nt, Homo sapiens
ggaagaauggucaaguugu

SEQ ID NO: 1112851 - RNA, 19 nt, Homo sapiens
gcauacaaauucuggaaaa

SEQ ID NO: 1112852 - RNA, 19 nt, Homo sapiens
gcagucgucuccugugucu

SEQ ID NO: 1112853 - RNA, 19 nt, Homo sapiens
ccacagaaauucacaucac

SEQ ID NO: 1112854 - RNA, 19 nt, Homo sapiens
gaagugaccauuacaucuc

SEQ ID NO: 1112855 - RNA, 19 nt, Homo sapiens
gaaaaguggcauacaaauu

SEQ ID NO: 1112856 - RNA, 19 nt, Homo sapiens
ggacgcagcuuuucucucu

SEQ ID NO: 1112857 - RNA, 19 nt, Homo sapiens
cagagguacuuccaucuuc

SEQ ID NO: 1112858 - RNA, 19 nt, Homo sapiens
gcaccucagggaacaguaa

SEQ ID NO: 1112859 - RNA, 19 nt, Homo sapiens
cgggaagaauggucaaguu

SEQ ID NO: 1112860 - RNA, 19 nt, Homo sapiens
gaaauacaagcugaagaug

SEQ ID NO: 1112861 - RNA, 19 nt, Homo sapiens
ugaaaauacuggggaaaua

SEQ ID NO: 1112862 - RNA, 19 nt, Homo sapiens
ccaaguuuccuauagaaga

SEQ ID NO: 1112863 - RNA, 19 nt, Homo sapiens
gguggaagauguaaaugac

SEQ ID NO: 1112864 - RNA, 19 nt, Homo sapiens
gauuccaaguuuccuauag

SEQ ID NO: 1112865 - RNA, 19 nt, Homo sapiens
gggaagaauggucaaguug

SEQ ID NO: 1112866 - RNA, 19 nt, Homo sapiens
uggaagauguaaaugacaa

SEQ ID NO: 1112867 - RNA, 19 nt, Homo sapiens
aauacaagcugaagauggu

SEQ ID NO: 1112868 - RNA, 19 nt, Homo sapiens
gcccaacuaugcagacaca

SEQ ID NO: 1112869 - RNA, 19 nt, Homo sapiens
gaccgagacuccgggaaga

SEQ ID NO: 1112870 - RNA, 19 nt, Homo sapiens
ucauuucgguggaagaugu

SEQ ID NO: 1112871 - RNA, 19 nt, Homo sapiens
ggagcacguuauccacuuc

SEQ ID NO: 1112872 - RNA, 19 nt, Homo sapiens
gcucugugcuccuuugacu

SEQ ID NO: 1112873 - RNA, 19 nt, Homo sapiens
aaacuguacggaauagaaa

SEQ ID NO: 1112874 - RNA, 19 nt, Homo sapiens
gaccugggcagucuucaga

SEQ ID NO: 1112875 - RNA, 19 nt, Homo sapiens
cgcaucgucucuagaggua

SEQ ID NO: 1112876 - RNA, 19 nt, Homo sapiens
gugcccaccucacacuuug

SEQ ID NO: 1112877 - RNA, 19 nt, Homo sapiens
ccagcuccgcggaagauua

SEQ ID NO: 1112878 - RNA, 19 nt, Homo sapiens
gaccuauucucaggaguuc

SEQ ID NO: 1112879 - RNA, 19 nt, Homo sapiens
cuggaggccucagaccuua

SEQ ID NO: 1112880 - RNA, 19 nt, Homo sapiens
cuaugucucuauuaacuca

SEQ ID NO: 1112881 - RNA, 19 nt, Homo sapiens
gcauccaugugacaguguu

SEQ ID NO: 1112882 - RNA, 19 nt, Homo sapiens
gguucgagcuuuccuacag

SEQ ID NO: 1112883 - RNA, 19 nt, Homo sapiens
gaaaauacuggggaaauau

SEQ ID NO: 1112884 - RNA, 19 nt, Homo sapiens
cgaguuaaaguccuugaga

SEQ ID NO: 1112885 - RNA, 19 nt, Homo sapiens
caugugacaguguuggaua

SEQ ID NO: 1112886 - RNA, 19 nt, Homo sapiens
gguugaagacagagugaaa

SEQ ID NO: 1112887 - RNA, 19 nt, Homo sapiens
caaguuuccuauagaagac

SEQ ID NO: 1112888 - RNA, 19 nt, Homo sapiens
guucgagcuuuccuacaga

SEQ ID NO: 1112889 - RNA, 19 nt, Homo sapiens
acuaugagcaguuuagaga

SEQ ID NO: 1112890 - RNA, 19 nt, Homo sapiens
uuaaaguccuugagaacgu

SEQ ID NO: 1112891 - RNA, 19 nt, Homo sapiens
gccgaaagucuggaaguaa

SEQ ID NO: 1112892 - RNA, 19 nt, Homo sapiens
agaccugaagugaccauua

SEQ ID NO: 1112893 - RNA, 19 nt, Homo sapiens
aaaacaaucucugcuauuc

SEQ ID NO: 1112894 - RNA, 19 nt, Homo sapiens
ucaacggauuuaccgaguu

SEQ ID NO: 1112895 - RNA, 19 nt, Homo sapiens
gaaugacaaugccccagaa

SEQ ID NO: 1112896 - RNA, 19 nt, Homo sapiens
ucuccgugauugccuauga

SEQ ID NO: 1112897 - RNA, 19 nt, Homo sapiens
ucacaucacccugcaagug

SEQ ID NO: 1112898 - RNA, 19 nt, Homo sapiens
ucagggaacaguaauucuu

SEQ ID NO: 1112899 - RNA, 19 nt, Homo sapiens
gugaaacuguacggaauag

SEQ ID NO: 1112900 - RNA, 19 nt, Homo sapiens
gcuauuccagcuuaaugaa

SEQ ID NO: 1112901 - RNA, 19 nt, Homo sapiens
ggaagauuaguccugcuau

SEQ ID NO: 1112902 - RNA, 19 nt, Homo sapiens
acagugcgcauccauguga

SEQ ID NO: 1112903 - RNA, 19 nt, Homo sapiens
caaggaagagucaccugau

SEQ ID NO: 1112904 - RNA, 19 nt, Homo sapiens
uaauccaccugcuuucucu

SEQ ID NO: 1112905 - RNA, 19 nt, Homo sapiens
uccaggagaaucuaucuuu

SEQ ID NO: 1112906 - RNA, 19 nt, Homo sapiens
ggucaaguugucuguucua

SEQ ID NO: 1112907 - RNA, 19 nt, Homo sapiens
caggagaaucuaucuuuua

SEQ ID NO: 1112908 - RNA, 19 nt, Homo sapiens
ccaggagaaucuaucuuuu

SEQ ID NO: 1112909 - RNA, 19 nt, Homo sapiens
agagguaggacgcagcuuu

SEQ ID NO: 1112910 - RNA, 19 nt, Homo sapiens
ggauugaaaggguggacaa

SEQ ID NO: 1112911 - RNA, 19 nt, Homo sapiens
ggggaaauaucaacagcaa

SEQ ID NO: 1112912 - RNA, 19 nt, Homo sapiens
ccagagguacuuccaucuu

SEQ ID NO: 1112913 - RNA, 19 nt, Homo sapiens
aaaguggcauacaaauucu

SEQ ID NO: 1112914 - RNA, 19 nt, Homo sapiens
ggacaaagcuugacacauc

SEQ ID NO: 1112915 - RNA, 19 nt, Homo sapiens
gaaacacucucuuuguaua

SEQ ID NO: 1112916 - RNA, 19 nt, Homo sapiens
gaaacugccuucuaugaaa

SEQ ID NO: 1112917 - RNA, 19 nt, Homo sapiens
guacugacuucuccuauaa

SEQ ID NO: 1112918 - RNA, 19 nt, Homo sapiens
ggagaaauaucaacuuuag

SEQ ID NO: 1112919 - RNA, 19 nt, Homo sapiens
gggaaacacucucuuugua

SEQ ID NO: 1112920 - RNA, 19 nt, Homo sapiens
gcaagaaggagaagaagua

SEQ ID NO: 1112921 - RNA, 19 nt, Homo sapiens
ggacagagaugcccucaag

SEQ ID NO: 1112922 - RNA, 19 nt, Homo sapiens
ggauuaaacuggcauuuca

SEQ ID NO: 1112923 - RNA, 19 nt, Homo sapiens
uaacaggaccaauggauua

SEQ ID NO: 1112924 - RNA, 19 nt, Homo sapiens
caagaucaaugcucaaguu

SEQ ID NO: 1112925 - RNA, 19 nt, Homo sapiens
gaacuacaacuaagaguga

SEQ ID NO: 1112926 - RNA, 19 nt, Homo sapiens
ugucauaccuccugcuuaa

SEQ ID NO: 1112927 - RNA, 19 nt, Homo sapiens
cagggaaacucacauauuc

SEQ ID NO: 1112928 - RNA, 19 nt, Homo sapiens
caggagaaauaucaacuuu

SEQ ID NO: 1112929 - RNA, 19 nt, Homo sapiens
acuaugacgucuuuaagua

SEQ ID NO: 1112930 - RNA, 19 nt, Homo sapiens
ggaaacacucucuuuguau

SEQ ID NO: 1112931 - RNA, 19 nt, Homo sapiens
ugacaacguuccaagauuc

SEQ ID NO: 1112932 - RNA, 19 nt, Homo sapiens
gaagcucgaagcagguuua

SEQ ID NO: 1112933 - RNA, 19 nt, Homo sapiens
gaucaaugcucaaguuuug

SEQ ID NO: 1112934 - RNA, 19 nt, Homo sapiens
acuaugaccucacguugua

SEQ ID NO: 1112935 - RNA, 19 nt, Homo sapiens
uagaauagccaguagugua

SEQ ID NO: 1112936 - RNA, 19 nt, Homo sapiens
cgacgguccuuacaacuau

SEQ ID NO: 1112937 - RNA, 19 nt, Homo sapiens
gaucacaguuuuagaugua

SEQ ID NO: 1112938 - RNA, 19 nt, Homo sapiens
gggaccaaaugaacagaaa

SEQ ID NO: 1112939 - RNA, 19 nt, Homo sapiens
gcucgaagcagguuuagga

SEQ ID NO: 1112940 - RNA, 19 nt, Homo sapiens
gcaauggcaacaagaagaa

SEQ ID NO: 1112941 - RNA, 19 nt, Homo sapiens
cguacugacuucuccuaua

SEQ ID NO: 1112942 - RNA, 19 nt, Homo sapiens
gacaaagcuugacacauca

SEQ ID NO: 1112943 - RNA, 19 nt, Homo sapiens
cagcugaacuccuccaucu

SEQ ID NO: 1112944 - RNA, 19 nt, Homo sapiens
gacaacauccuccagauuc

SEQ ID NO: 1112945 - RNA, 19 nt, Homo sapiens
gaacucgcuuacaggagaa

SEQ ID NO: 1112946 - RNA, 19 nt, Homo sapiens
gccauagccugguuaaagu

SEQ ID NO: 1112947 - RNA, 19 nt, Homo sapiens
agaaacaagugcccaguca

SEQ ID NO: 1112948 - RNA, 19 nt, Homo sapiens
gaagaagucgggcaagaag

SEQ ID NO: 1112949 - RNA, 19 nt, Homo sapiens
ugauaaugcuccagaagug

SEQ ID NO: 1112950 - RNA, 19 nt, Homo sapiens
caucugaacucgcuuacag

SEQ ID NO: 1112951 - RNA, 19 nt, Homo sapiens
gaaagucucagcccaggau

SEQ ID NO: 1112952 - RNA, 19 nt, Homo sapiens
ggaggaggcucuguauguc

SEQ ID NO: 1112953 - RNA, 19 nt, Homo sapiens
ugagagaacuacaacuaag

SEQ ID NO: 1112954 - RNA, 19 nt, Homo sapiens
gaagugacauauucuuuuc

SEQ ID NO: 1112955 - RNA, 19 nt, Homo sapiens
cuauagacguggaaauaau

SEQ ID NO: 1112956 - RNA, 19 nt, Homo sapiens
ggaccagucuucuguuuug

SEQ ID NO: 1112957 - RNA, 19 nt, Homo sapiens
gggaagugacauauucuuu

SEQ ID NO: 1112958 - RNA, 19 nt, Homo sapiens
ugacagugguggaugugaa

SEQ ID NO: 1112959 - RNA, 19 nt, Homo sapiens
cgcaucaucuccagaggua

SEQ ID NO: 1112960 - RNA, 19 nt, Homo sapiens
gagagaacuacaacuaaga

SEQ ID NO: 1112961 - RNA, 19 nt, Homo sapiens
gauaaugcccagaucacuu

SEQ ID NO: 1112962 - RNA, 19 nt, Homo sapiens
ccagggaaacucacauauu

SEQ ID NO: 1112963 - RNA, 19 nt, Homo sapiens
aaacugccuucuaugaaau

SEQ ID NO: 1112964 - RNA, 19 nt, Homo sapiens
ccacacgccugucuucucu

SEQ ID NO: 1112965 - RNA, 19 nt, Homo sapiens
aaagaaaaccugccaagua

SEQ ID NO: 1112966 - RNA, 19 nt, Homo sapiens
uaagagugacugcacauga

SEQ ID NO: 1112967 - RNA, 19 nt, Homo sapiens
ggacagucauugcucuuuu

SEQ ID NO: 1112968 - RNA, 19 nt, Homo sapiens
ggacccuucccacuacaua

SEQ ID NO: 1112969 - RNA, 19 nt, Homo sapiens
cuacaagccuccuaguucu

SEQ ID NO: 1112970 - RNA, 19 nt, Homo sapiens
gaacuccuccaucuuccaa

SEQ ID NO: 1112971 - RNA, 19 nt, Homo sapiens
auaaugcccagaucacuua

SEQ ID NO: 1112972 - RNA, 19 nt, Homo sapiens
guguugaaguaccaaguaa

SEQ ID NO: 1112973 - RNA, 19 nt, Homo sapiens
uggcagacaccaacgauaa

SEQ ID NO: 1112974 - RNA, 19 nt, Homo sapiens
uguauaacaucacacugaa

SEQ ID NO: 1112975 - RNA, 19 nt, Homo sapiens
caagacugcucacgguaca

SEQ ID NO: 1112976 - RNA, 19 nt, Homo sapiens
guagcucaaucccugaaga

SEQ ID NO: 1112977 - RNA, 19 nt, Homo sapiens
ggacuacagaggauucuuc

SEQ ID NO: 1112978 - RNA, 19 nt, Homo sapiens
gacggaagaaauaaaugua

SEQ ID NO: 1112979 - RNA, 19 nt, Homo sapiens
gaccugcccuuacaguagu

SEQ ID NO: 1112980 - RNA, 19 nt, Homo sapiens
ugaaguaccaaguaaccua

SEQ ID NO: 1112981 - RNA, 19 nt, Homo sapiens
gcugaacuccuccaucuuc

SEQ ID NO: 1112982 - RNA, 19 nt, Homo sapiens
gcacccaggccucagaguu

SEQ ID NO: 1112983 - RNA, 19 nt, Homo sapiens
caagaaggagaagaaguaa

SEQ ID NO: 1112984 - RNA, 19 nt, Homo sapiens
ggauagaccgggaagagau

SEQ ID NO: 1112985 - RNA, 19 nt, Homo sapiens
cuacaucgcugagaacaac

SEQ ID NO: 1112986 - RNA, 19 nt, Homo sapiens
ccuauaagcgcuucucuuc

SEQ ID NO: 1112987 - RNA, 19 nt, Homo sapiens
ggccauagccugguuaaag

SEQ ID NO: 1112988 - RNA, 19 nt, Homo sapiens
ggagaagaaguaacaugga

SEQ ID NO: 1112989 - RNA, 19 nt, Homo sapiens
aagaaaaccugccaaguau

SEQ ID NO: 1112990 - RNA, 19 nt, Homo sapiens
gcuaacauccguagauuuu

SEQ ID NO: 1112991 - RNA, 19 nt, Homo sapiens
gcagaccuauucccaugag

SEQ ID NO: 1112992 - RNA, 19 nt, Homo sapiens
gacguggaaauaauagaua

SEQ ID NO: 1112993 - RNA, 19 nt, Homo sapiens
guagugcggugugcuuuua

SEQ ID NO: 1112994 - RNA, 19 nt, Homo sapiens
caacaaccaguuugacaca

SEQ ID NO: 1112995 - RNA, 19 nt, Homo sapiens
cuccuaaacuuccaaagau

SEQ ID NO: 1112996 - RNA, 19 nt, Homo sapiens
gggcaggacguauucucua

SEQ ID NO: 1112997 - RNA, 19 nt, Homo sapiens
gggcauggacaaagcuuga

SEQ ID NO: 1112998 - RNA, 19 nt, Homo sapiens
caggagagcugugagaaaa

SEQ ID NO: 1112999 - RNA, 19 nt, Homo sapiens
ggaagugacauauucuuuu

SEQ ID NO: 1113000 - RNA, 19 nt, Homo sapiens
gagcuaacaggaccaaugg

SEQ ID NO: 1113001 - RNA, 19 nt, Homo sapiens
gccauaaaccaauaacuag

SEQ ID NO: 1113002 - RNA, 19 nt, Homo sapiens
ugacaacauccuccagauu

SEQ ID NO: 1113003 - RNA, 19 nt, Homo sapiens
gguguugaaguaccaagua

SEQ ID NO: 1113004 - RNA, 19 nt, Homo sapiens
agaaggagaagaaguaaca

SEQ ID NO: 1113005 - RNA, 19 nt, Homo sapiens
aagaagaagucgggcaaga

SEQ ID NO: 1113006 - RNA, 19 nt, Homo sapiens
gcaccuggcccaacaacca

SEQ ID NO: 1113007 - RNA, 19 nt, Homo sapiens
gggcuccaguguccuccua

SEQ ID NO: 1113008 - RNA, 19 nt, Homo sapiens
gauaaugcuccagaaguga

SEQ ID NO: 1113009 - RNA, 19 nt, Homo sapiens
gcagccgucuguccuugau

SEQ ID NO: 1113010 - RNA, 19 nt, Homo sapiens
gcuggacccuucccacuac

SEQ ID NO: 1113011 - RNA, 19 nt, Homo sapiens
acaagagacuccacugcau

SEQ ID NO: 1113012 - RNA, 19 nt, Homo sapiens
guuccucuuucccgaguaa

SEQ ID NO: 1113013 - RNA, 19 nt, Homo sapiens
acaaccaguuugacacaga

SEQ ID NO: 1113014 - RNA, 19 nt, Homo sapiens
gaaacacucucuuuguaua

SEQ ID NO: 1113015 - RNA, 19 nt, Homo sapiens
gaaacugccuucuaugaaa

SEQ ID NO: 1113016 - RNA, 19 nt, Homo sapiens
gaacacauaggauauagua

SEQ ID NO: 1113017 - RNA, 19 nt, Homo sapiens
ggagaaauaucaacuuuag

SEQ ID NO: 1113018 - RNA, 19 nt, Homo sapiens
gggaaacacucucuuugua

SEQ ID NO: 1113019 - RNA, 19 nt, Homo sapiens
ggacagagaugcccucaag

SEQ ID NO: 1113020 - RNA, 19 nt, Homo sapiens
gaacuacaacuaagaguga

SEQ ID NO: 1113021 - RNA, 19 nt, Homo sapiens
guuccaaccuacuuucuua

SEQ ID NO: 1113022 - RNA, 19 nt, Homo sapiens
ugucauaccuccugcuuaa

SEQ ID NO: 1113023 - RNA, 19 nt, Homo sapiens
gaaagccuauggacaagau

SEQ ID NO: 1113024 - RNA, 19 nt, Homo sapiens
cagggaaacucacauauuc

SEQ ID NO: 1113025 - RNA, 19 nt, Homo sapiens
caggagaaauaucaacuuu

SEQ ID NO: 1113026 - RNA, 19 nt, Homo sapiens
gcccagcccuuccuuuauu

SEQ ID NO: 1113027 - RNA, 19 nt, Homo sapiens
gagcccagcccuuccuuua

SEQ ID NO: 1113028 - RNA, 19 nt, Homo sapiens
acuaugacgucuuuaagua

SEQ ID NO: 1113029 - RNA, 19 nt, Homo sapiens
ggaaacacucucuuuguau

SEQ ID NO: 1113030 - RNA, 19 nt, Homo sapiens
ugacaacguuccaagauuc

SEQ ID NO: 1113031 - RNA, 19 nt, Homo sapiens
acuaugaccucacguugua

SEQ ID NO: 1113032 - RNA, 19 nt, Homo sapiens
cgacgguccuuacaacuau

SEQ ID NO: 1113033 - RNA, 19 nt, Homo sapiens
gaucacaguuuuagaugua

SEQ ID NO: 1113034 - RNA, 19 nt, Homo sapiens
caaucuauguuccaaccua

SEQ ID NO: 1113035 - RNA, 19 nt, Homo sapiens
ggacaagauuaugaauaug

SEQ ID NO: 1113036 - RNA, 19 nt, Homo sapiens
ccuacuuucuuaacucaua

SEQ ID NO: 1113037 - RNA, 19 nt, Homo sapiens
ccaccuacuuuccaaucua

SEQ ID NO: 1113038 - RNA, 19 nt, Homo sapiens
ggugacacuuuaauauaga

SEQ ID NO: 1113039 - RNA, 19 nt, Homo sapiens
gaacucgcuuacaggagaa

SEQ ID NO: 1113040 - RNA, 19 nt, Homo sapiens
guggugacacuuuaauaua

SEQ ID NO: 1113041 - RNA, 19 nt, Homo sapiens
ugauaaugcuccagaagug

SEQ ID NO: 1113042 - RNA, 19 nt, Homo sapiens
caucugaacucgcuuacag

SEQ ID NO: 1113043 - RNA, 19 nt, Homo sapiens
ugagagaacuacaacuaag

SEQ ID NO: 1113044 - RNA, 19 nt, Homo sapiens
gaagugacauauucuuuuc

SEQ ID NO: 1113045 - RNA, 19 nt, Homo sapiens
cuauagacguggaaauaau

SEQ ID NO: 1113046 - RNA, 19 nt, Homo sapiens
gggaagugacauauucuuu

SEQ ID NO: 1113047 - RNA, 19 nt, Homo sapiens
ugacagugguggaugugaa

SEQ ID NO: 1113048 - RNA, 19 nt, Homo sapiens
caaccuacuuucuuaacuc

SEQ ID NO: 1113049 - RNA, 19 nt, Homo sapiens
cgcaucaucuccagaggua

SEQ ID NO: 1113050 - RNA, 19 nt, Homo sapiens
gagagaacuacaacuaaga

SEQ ID NO: 1113051 - RNA, 19 nt, Homo sapiens
gauaaugcccagaucacuu

SEQ ID NO: 1113052 - RNA, 19 nt, Homo sapiens
ccagggaaacucacauauu

SEQ ID NO: 1113053 - RNA, 19 nt, Homo sapiens
aaacugccuucuaugaaau

SEQ ID NO: 1113054 - RNA, 19 nt, Homo sapiens
ccacacgccugucuucucu

SEQ ID NO: 1113055 - RNA, 19 nt, Homo sapiens
augaauauguggacuauca

SEQ ID NO: 1113056 - RNA, 19 nt, Homo sapiens
aaagaaaaccugccaagua

SEQ ID NO: 1113057 - RNA, 19 nt, Homo sapiens
uaagagugacugcacauga

SEQ ID NO: 1113058 - RNA, 19 nt, Homo sapiens
ggacagucauugcucuuuu

SEQ ID NO: 1113059 - RNA, 19 nt, Homo sapiens
auaaugcccagaucacuua

SEQ ID NO: 1113060 - RNA, 19 nt, Homo sapiens
uggcagacaccaacgauaa

SEQ ID NO: 1113061 - RNA, 19 nt, Homo sapiens
uguauaacaucacacugaa

SEQ ID NO: 1113062 - RNA, 19 nt, Homo sapiens
caagacugcucacgguaca

SEQ ID NO: 1113063 - RNA, 19 nt, Homo sapiens
ggacuacagaggauucuuc

SEQ ID NO: 1113064 - RNA, 19 nt, Homo sapiens
guagcucaaucccugaaga

SEQ ID NO: 1113065 - RNA, 19 nt, Homo sapiens
gacggaagaaauaaaugua

SEQ ID NO: 1113066 - RNA, 19 nt, Homo sapiens
ggauagaccgggaagagau

SEQ ID NO: 1113067 - RNA, 19 nt, Homo sapiens
cuacaucgcugagaacaac

SEQ ID NO: 1113068 - RNA, 19 nt, Homo sapiens
aagaaaaccugccaaguau

SEQ ID NO: 1113069 - RNA, 19 nt, Homo sapiens
gcuaacauccguagauuuu

SEQ ID NO: 1113070 - RNA, 19 nt, Homo sapiens
gcagaccuauucccaugag

SEQ ID NO: 1113071 - RNA, 19 nt, Homo sapiens
gacguggaaauaauagaua

SEQ ID NO: 1113072 - RNA, 19 nt, Homo sapiens
caugaggaauuuauuugca

SEQ ID NO: 1113073 - RNA, 19 nt, Homo sapiens
cuccuaaacuuccaaagau

SEQ ID NO: 1113074 - RNA, 19 nt, Homo sapiens
gggcaggacguauucucua

SEQ ID NO: 1113075 - RNA, 19 nt, Homo sapiens
caggagagcugugagaaaa

SEQ ID NO: 1113076 - RNA, 19 nt, Homo sapiens
ggaagugacauauucuuuu

SEQ ID NO: 1113077 - RNA, 19 nt, Homo sapiens
gggcuccaguguccuccua

SEQ ID NO: 1113078 - RNA, 19 nt, Homo sapiens
gauaaugcuccagaaguga

SEQ ID NO: 1113079 - RNA, 19 nt, Homo sapiens
gaaaaccugccaaguauuc

SEQ ID NO: 1113080 - RNA, 19 nt, Homo sapiens
ccacgacagugaggauaau

SEQ ID NO: 1113081 - RNA, 19 nt, Homo sapiens
caccuacuuuccaaucuau

SEQ ID NO: 1113082 - RNA, 19 nt, Homo sapiens
uggugacacuuuaauauag

SEQ ID NO: 1113083 - RNA, 19 nt, Homo sapiens
cagcgagccaggacucuuu

SEQ ID NO: 1113084 - RNA, 19 nt, Homo sapiens
ugggagacaucgccaagga

SEQ ID NO: 1113085 - RNA, 19 nt, Homo sapiens
uagaacacauaggauauag

SEQ ID NO: 1113086 - RNA, 19 nt, Homo sapiens
aaacucacauauucaugca

SEQ ID NO: 1113087 - RNA, 19 nt, Homo sapiens
gcuuacaggagaaauauca

SEQ ID NO: 1113088 - RNA, 19 nt, Homo sapiens
gaggauaaugcccagauca

SEQ ID NO: 1113089 - RNA, 19 nt, Homo sapiens
ggaaacucacauauucaug

SEQ ID NO: 1113090 - RNA, 19 nt, Homo sapiens
aagugacuaugacgucuuu

SEQ ID NO: 1113091 - RNA, 19 nt, Homo sapiens
ccuauagacguggaaauaa

SEQ ID NO: 1113092 - RNA, 19 nt, Homo sapiens
agugaaagccuauggacaa

SEQ ID NO: 1113093 - RNA, 19 nt, Homo sapiens
ccaggagagcugugagaaa

SEQ ID NO: 1113094 - RNA, 19 nt, Homo sapiens
ugacggaagaaauaaaugu

SEQ ID NO: 1113095 - RNA, 19 nt, Homo sapiens
gugacuaugacgucuuuaa

SEQ ID NO: 1113096 - RNA, 19 nt, Homo sapiens
gaagugacuaugacgucuu

SEQ ID NO: 1113097 - RNA, 19 nt, Homo sapiens
gcucaagaugguccuggua

SEQ ID NO: 1113098 - RNA, 19 nt, Homo sapiens
uaacauccguagauuuuca

SEQ ID NO: 1113099 - RNA, 19 nt, Homo sapiens
ccaguguccuccuaugucu

SEQ ID NO: 1113100 - RNA, 19 nt, Homo sapiens
gggaaacucacauauucau

SEQ ID NO: 1113101 - RNA, 19 nt, Homo sapiens
ccuauggacaagauuauga

SEQ ID NO: 1113102 - RNA, 19 nt, Homo sapiens
uguacgcgcugcaauccuu

SEQ ID NO: 1113103 - RNA, 19 nt, Homo sapiens
cacaggaccacgacaguga

SEQ ID NO: 1113104 - RNA, 19 nt, Homo sapiens
gaccugcaccauuccagaa

SEQ ID NO: 1113105 - RNA, 19 nt, Homo sapiens
aaaugauaaugcuccagaa

SEQ ID NO: 1113106 - RNA, 19 nt, Homo sapiens
agagguaggacgcagcuuu

SEQ ID NO: 1113107 - RNA, 19 nt, Homo sapiens
cccuauagacguggaaaua

SEQ ID NO: 1113108 - RNA, 19 nt, Homo sapiens
gcuccaguguccuccuaug

SEQ ID NO: 1113109 - RNA, 19 nt, Homo sapiens
ggcaggacguauucucuac

SEQ ID NO: 1113110 - RNA, 19 nt, Homo sapiens
gcuccagaagugacuauga

SEQ ID NO: 1113111 - RNA, 19 nt, Homo sapiens
gaggaauuuauuugcauga

SEQ ID NO: 1113112 - RNA, 19 nt, Homo sapiens
cagucuacaucgcugagaa

SEQ ID NO: 1113113 - RNA, 19 nt, Homo sapiens
uauaacaucacacugaaag

SEQ ID NO: 1113114 - RNA, 19 nt, Homo sapiens
ggacaaagcuugacacauc

SEQ ID NO: 1113115 - RNA, 19 nt, Homo sapiens
gcgaaagucuuaauaacua

SEQ ID NO: 1113116 - RNA, 19 nt, Homo sapiens
guacugacuucuccuauaa

SEQ ID NO: 1113117 - RNA, 19 nt, Homo sapiens
gaaacaaucaucucucuaa

SEQ ID NO: 1113118 - RNA, 19 nt, Homo sapiens
gcaagaaggagaagaagua

SEQ ID NO: 1113119 - RNA, 19 nt, Homo sapiens
ggauuaaacuggcauuuca

SEQ ID NO: 1113120 - RNA, 19 nt, Homo sapiens
uaacaggaccaauggauua

SEQ ID NO: 1113121 - RNA, 19 nt, Homo sapiens
caagaucaaugcucaaguu

SEQ ID NO: 1113122 - RNA, 19 nt, Homo sapiens
gaggauaaacugaaucuuu

SEQ ID NO: 1113123 - RNA, 19 nt, Homo sapiens
gauuuaagcucagugguaa

SEQ ID NO: 1113124 - RNA, 19 nt, Homo sapiens
ggaugucaaugauaaugua

SEQ ID NO: 1113125 - RNA, 19 nt, Homo sapiens
acaaucaucucucuaaaug

SEQ ID NO: 1113126 - RNA, 19 nt, Homo sapiens
ggacauuaaugacaauaca

SEQ ID NO: 1113127 - RNA, 19 nt, Homo sapiens
cugcaaaucuagacuauga

SEQ ID NO: 1113128 - RNA, 19 nt, Homo sapiens
ggaaauaguggacauuaau

SEQ ID NO: 1113129 - RNA, 19 nt, Homo sapiens
ggauuuacuugaaacgaaa

SEQ ID NO: 1113130 - RNA, 19 nt, Homo sapiens
gcagaacaauugcugaaag

SEQ ID NO: 1113131 - RNA, 19 nt, Homo sapiens
aagcgagccucuucugaua

SEQ ID NO: 1113132 - RNA, 19 nt, Homo sapiens
gaagcucgaagcagguuua

SEQ ID NO: 1113133 - RNA, 19 nt, Homo sapiens
gaucaaugcucaaguuuug

SEQ ID NO: 1113134 - RNA, 19 nt, Homo sapiens
gagcgaaagucuuaauaac

SEQ ID NO: 1113135 - RNA, 19 nt, Homo sapiens
uagaauagccaguagugua

SEQ ID NO: 1113136 - RNA, 19 nt, Homo sapiens
gaaagugcaccuccaggaa

SEQ ID NO: 1113137 - RNA, 19 nt, Homo sapiens
ggauuuaagcucaguggua

SEQ ID NO: 1113138 - RNA, 19 nt, Homo sapiens
ggaagaauuggaagugaaa

SEQ ID NO: 1113139 - RNA, 19 nt, Homo sapiens
uaacaguucuagaugugaa

SEQ ID NO: 1113140 - RNA, 19 nt, Homo sapiens
gguaacaguucuagaugug

SEQ ID NO: 1113141 - RNA, 19 nt, Homo sapiens
gaaauaguggacauuaaug

SEQ ID NO: 1113142 - RNA, 19 nt, Homo sapiens
gaacaccaccucugucuac

SEQ ID NO: 1113143 - RNA, 19 nt, Homo sapiens
gcgcagauccgcuacucua

SEQ ID NO: 1113144 - RNA, 19 nt, Homo sapiens
aaucaucucucuaaaugug

SEQ ID NO: 1113145 - RNA, 19 nt, Homo sapiens
gaacaguaaucgcccuuuu

SEQ ID NO: 1113146 - RNA, 19 nt, Homo sapiens
gggaccaaaugaacagaaa

SEQ ID NO: 1113147 - RNA, 19 nt, Homo sapiens
gcucgaagcagguuuagga

SEQ ID NO: 1113148 - RNA, 19 nt, Homo sapiens
gcaauggcaacaagaagaa

SEQ ID NO: 1113149 - RNA, 19 nt, Homo sapiens
cguacugacuucuccuaua

SEQ ID NO: 1113150 - RNA, 19 nt, Homo sapiens
gacaaagcuugacacauca

SEQ ID NO: 1113151 - RNA, 19 nt, Homo sapiens
cagcugaacuccuccaucu

SEQ ID NO: 1113152 - RNA, 19 nt, Homo sapiens
gcguaagagucaucugauu

SEQ ID NO: 1113153 - RNA, 19 nt, Homo sapiens
cagauccgcuacucuauuc

SEQ ID NO: 1113154 - RNA, 19 nt, Homo sapiens
gcagauccgcuacucuauu

SEQ ID NO: 1113155 - RNA, 19 nt, Homo sapiens
gacaacauccuccagauuc

SEQ ID NO: 1113156 - RNA, 19 nt, Homo sapiens
gcucaagcgucgcccaaau

SEQ ID NO: 1113157 - RNA, 19 nt, Homo sapiens
gccauagccugguuaaagu

SEQ ID NO: 1113158 - RNA, 19 nt, Homo sapiens
agaaacaagugcccaguca

SEQ ID NO: 1113159 - RNA, 19 nt, Homo sapiens
gaagaagucgggcaagaag

SEQ ID NO: 1113160 - RNA, 19 nt, Homo sapiens
gggcuuuccugcagaccua

SEQ ID NO: 1113161 - RNA, 19 nt, Homo sapiens
gagguauucuuguacaaca

SEQ ID NO: 1113162 - RNA, 19 nt, Homo sapiens
gaaagucucagcccaggau

SEQ ID NO: 1113163 - RNA, 19 nt, Homo sapiens
ggaggaggcucuguauguc

SEQ ID NO: 1113164 - RNA, 19 nt, Homo sapiens
uggaaauaguggacauuaa

SEQ ID NO: 1113165 - RNA, 19 nt, Homo sapiens
ccgaggagcuggagaaagg

SEQ ID NO: 1113166 - RNA, 19 nt, Homo sapiens
ggaccagucuucuguuuug

SEQ ID NO: 1113167 - RNA, 19 nt, Homo sapiens
ggagaacccaggcaacuuc

SEQ ID NO: 1113168 - RNA, 19 nt, Homo sapiens
uaacucaggauuuacuuga

SEQ ID NO: 1113169 - RNA, 19 nt, Homo sapiens
cagaaacaaucaucucucu

SEQ ID NO: 1113170 - RNA, 19 nt, Homo sapiens
cagaaaagaucucacaaau

SEQ ID NO: 1113171 - RNA, 19 nt, Homo sapiens
cagccugucuaccguguaa

SEQ ID NO: 1113172 - RNA, 19 nt, Homo sapiens
ggaaggagaagccguuuac

SEQ ID NO: 1113173 - RNA, 19 nt, Homo sapiens
cagaacaauugcugaaagu

SEQ ID NO: 1113174 - RNA, 19 nt, Homo sapiens
cagaagugguuguuacauc

SEQ ID NO: 1113175 - RNA, 19 nt, Homo sapiens
gcagcuccauccucucguu

SEQ ID NO: 1113176 - RNA, 19 nt, Homo sapiens
cguaagagucaucugauuu

SEQ ID NO: 1113177 - RNA, 19 nt, Homo sapiens
ggacagagacgcgcucaag

SEQ ID NO: 1113178 - RNA, 19 nt, Homo sapiens
ucuuggaugucaaugauaa

SEQ ID NO: 1113179 - RNA, 19 nt, Homo sapiens
uaucuuggaugucaaugau

SEQ ID NO: 1113180 - RNA, 19 nt, Homo sapiens
guaacuuauuccuuuguga

SEQ ID NO: 1113181 - RNA, 19 nt, Homo sapiens
ggacccuucccacuacaua

SEQ ID NO: 1113182 - RNA, 19 nt, Homo sapiens
cuacaagccuccuaguucu

SEQ ID NO: 1113183 - RNA, 19 nt, Homo sapiens
gaacuccuccaucuuccaa

SEQ ID NO: 1113184 - RNA, 19 nt, Homo sapiens
gcaccuccaggaacaguaa

SEQ ID NO: 1113185 - RNA, 19 nt, Homo sapiens
guguugaaguaccaaguaa

SEQ ID NO: 1113186 - RNA, 19 nt, Homo sapiens
caaugauaauguaccagaa

SEQ ID NO: 1113187 - RNA, 19 nt, Homo sapiens
gaaucuuuaucccguggaa

SEQ ID NO: 1113188 - RNA, 19 nt, Homo sapiens
gaagucucccauuugaauu

SEQ ID NO: 1113189 - RNA, 19 nt, Homo sapiens
cuggagaaauuucaacuuc

SEQ ID NO: 1113190 - RNA, 19 nt, Homo sapiens
caaauucugguaacaguuc

SEQ ID NO: 1113191 - RNA, 19 nt, Homo sapiens
caauacaccccgauucuua

SEQ ID NO: 1113192 - RNA, 19 nt, Homo sapiens
gaccugcccuuacaguagu

SEQ ID NO: 1113193 - RNA, 19 nt, Homo sapiens
ugaaguaccaaguaaccua

SEQ ID NO: 1113194 - RNA, 19 nt, Homo sapiens
gcugaacuccuccaucuuc

SEQ ID NO: 1113195 - RNA, 19 nt, Homo sapiens
gcacccaggccucagaguu

SEQ ID NO: 1113196 - RNA, 19 nt, Homo sapiens
caagaaggagaagaaguaa

SEQ ID NO: 1113197 - RNA, 19 nt, Homo sapiens
gaaauuucaacuucugcaa

SEQ ID NO: 1113198 - RNA, 19 nt, Homo sapiens
ccuauaagcgcuucucuuc

SEQ ID NO: 1113199 - RNA, 19 nt, Homo sapiens
ggccauagccugguuaaag

SEQ ID NO: 1113200 - RNA, 19 nt, Homo sapiens
ggagaagaaguaacaugga

SEQ ID NO: 1113201 - RNA, 19 nt, Homo sapiens
guggaaauaguggacauua

SEQ ID NO: 1113202 - RNA, 19 nt, Homo sapiens
guagugcggugugcuuuua

SEQ ID NO: 1113203 - RNA, 19 nt, Homo sapiens
caacaaccaguuugacaca

SEQ ID NO: 1113204 - RNA, 19 nt, Homo sapiens
acucaggauuuacuugaaa

SEQ ID NO: 1113205 - RNA, 19 nt, Homo sapiens
uuuaugagcuggguguuga

SEQ ID NO: 1113206 - RNA, 19 nt, Homo sapiens
gggcauggacaaagcuuga

SEQ ID NO: 1113207 - RNA, 19 nt, Homo sapiens
auucggaccucacucugua

SEQ ID NO: 1113208 - RNA, 19 nt, Homo sapiens
guaauagucacuucucagu

SEQ ID NO: 1113209 - RNA, 19 nt, Homo sapiens
cgcggugucuggugaguuu

SEQ ID NO: 1113210 - RNA, 19 nt, Homo sapiens
gagcuaacaggaccaaugg

SEQ ID NO: 1113211 - RNA, 19 nt, Homo sapiens
gccauaaaccaauaacuag

SEQ ID NO: 1113212 - RNA, 19 nt, Homo sapiens
ugacaacauccuccagauu

SEQ ID NO: 1113213 - RNA, 19 nt, Homo sapiens
gguguugaaguaccaagua

SEQ ID NO: 1113214 - RNA, 19 nt, Homo sapiens
gcgaaagucuuaauaacua

SEQ ID NO: 1113215 - RNA, 19 nt, Homo sapiens
gaaacaaucaucucucuaa

SEQ ID NO: 1113216 - RNA, 19 nt, Homo sapiens
gaggauaaacugaaucuuu

SEQ ID NO: 1113217 - RNA, 19 nt, Homo sapiens
gauuuaagcucagugguaa

SEQ ID NO: 1113218 - RNA, 19 nt, Homo sapiens
ggaugucaaugauaaugua

SEQ ID NO: 1113219 - RNA, 19 nt, Homo sapiens
acaaucaucucucuaaaug

SEQ ID NO: 1113220 - RNA, 19 nt, Homo sapiens
ggacauuaaugacaauaca

SEQ ID NO: 1113221 - RNA, 19 nt, Homo sapiens
cugcaaaucuagacuauga

SEQ ID NO: 1113222 - RNA, 19 nt, Homo sapiens
ggaaauaguggacauuaau

SEQ ID NO: 1113223 - RNA, 19 nt, Homo sapiens
ggauuuacuugaaacgaaa

SEQ ID NO: 1113224 - RNA, 19 nt, Homo sapiens
gcagaacaauugcugaaag

SEQ ID NO: 1113225 - RNA, 19 nt, Homo sapiens
aagcgagccucuucugaua

SEQ ID NO: 1113226 - RNA, 19 nt, Homo sapiens
gagcgaaagucuuaauaac

SEQ ID NO: 1113227 - RNA, 19 nt, Homo sapiens
gaaagugcaccuccaggaa

SEQ ID NO: 1113228 - RNA, 19 nt, Homo sapiens
ggauuuaagcucaguggua

SEQ ID NO: 1113229 - RNA, 19 nt, Homo sapiens
ggaagaauuggaagugaaa

SEQ ID NO: 1113230 - RNA, 19 nt, Homo sapiens
uaacaguucuagaugugaa

SEQ ID NO: 1113231 - RNA, 19 nt, Homo sapiens
gguaacaguucuagaugug

SEQ ID NO: 1113232 - RNA, 19 nt, Homo sapiens
gaaauaguggacauuaaug

SEQ ID NO: 1113233 - RNA, 19 nt, Homo sapiens
gaacaccaccucugucuac

SEQ ID NO: 1113234 - RNA, 19 nt, Homo sapiens
aaucaucucucuaaaugug

SEQ ID NO: 1113235 - RNA, 19 nt, Homo sapiens
gaacaguaaucgcccuuuu

SEQ ID NO: 1113236 - RNA, 19 nt, Homo sapiens
gcgcagauccgcuacucua

SEQ ID NO: 1113237 - RNA, 19 nt, Homo sapiens
gcguaagagucaucugauu

SEQ ID NO: 1113238 - RNA, 19 nt, Homo sapiens
cagauccgcuacucuauuc

SEQ ID NO: 1113239 - RNA, 19 nt, Homo sapiens
gcucaagcgucgcccaaau

SEQ ID NO: 1113240 - RNA, 19 nt, Homo sapiens
gcagauccgcuacucuauu

SEQ ID NO: 1113241 - RNA, 19 nt, Homo sapiens
gggcuuuccugcagaccua

SEQ ID NO: 1113242 - RNA, 19 nt, Homo sapiens
gagguauucuuguacaaca

SEQ ID NO: 1113243 - RNA, 19 nt, Homo sapiens
ccgaggagcuggagaaagg

SEQ ID NO: 1113244 - RNA, 19 nt, Homo sapiens
uggaaauaguggacauuaa

SEQ ID NO: 1113245 - RNA, 19 nt, Homo sapiens
ggagaacccaggcaacuuc

SEQ ID NO: 1113246 - RNA, 19 nt, Homo sapiens
uaacucaggauuuacuuga

SEQ ID NO: 1113247 - RNA, 19 nt, Homo sapiens
cagaaacaaucaucucucu

SEQ ID NO: 1113248 - RNA, 19 nt, Homo sapiens
cagaaaagaucucacaaau

SEQ ID NO: 1113249 - RNA, 19 nt, Homo sapiens
cagccugucuaccguguaa

SEQ ID NO: 1113250 - RNA, 19 nt, Homo sapiens
ggaaggagaagccguuuac

SEQ ID NO: 1113251 - RNA, 19 nt, Homo sapiens
cagaacaauugcugaaagu

SEQ ID NO: 1113252 - RNA, 19 nt, Homo sapiens
cagaagugguuguuacauc

SEQ ID NO: 1113253 - RNA, 19 nt, Homo sapiens
gcagcuccauccucucguu

SEQ ID NO: 1113254 - RNA, 19 nt, Homo sapiens
cguaagagucaucugauuu

SEQ ID NO: 1113255 - RNA, 19 nt, Homo sapiens
ggacagagacgcgcucaag

SEQ ID NO: 1113256 - RNA, 19 nt, Homo sapiens
ucuuggaugucaaugauaa

SEQ ID NO: 1113257 - RNA, 19 nt, Homo sapiens
uaucuuggaugucaaugau

SEQ ID NO: 1113258 - RNA, 19 nt, Homo sapiens
guaacuuauuccuuuguga

SEQ ID NO: 1113259 - RNA, 19 nt, Homo sapiens
gcaccuccaggaacaguaa

SEQ ID NO: 1113260 - RNA, 19 nt, Homo sapiens
caaugauaauguaccagaa

SEQ ID NO: 1113261 - RNA, 19 nt, Homo sapiens
gaagucucccauuugaauu

SEQ ID NO: 1113262 - RNA, 19 nt, Homo sapiens
cuggagaaauuucaacuuc

SEQ ID NO: 1113263 - RNA, 19 nt, Homo sapiens
caaauucugguaacaguuc

SEQ ID NO: 1113264 - RNA, 19 nt, Homo sapiens
caauacaccccgauucuua

SEQ ID NO: 1113265 - RNA, 19 nt, Homo sapiens
gaaucuuuaucccguggaa

SEQ ID NO: 1113266 - RNA, 19 nt, Homo sapiens
gaaauuucaacuucugcaa

SEQ ID NO: 1113267 - RNA, 19 nt, Homo sapiens
guggaaauaguggacauua

SEQ ID NO: 1113268 - RNA, 19 nt, Homo sapiens
acucaggauuuacuugaaa

SEQ ID NO: 1113269 - RNA, 19 nt, Homo sapiens
uuuaugagcuggguguuga

SEQ ID NO: 1113270 - RNA, 19 nt, Homo sapiens
auucggaccucacucugua

SEQ ID NO: 1113271 - RNA, 19 nt, Homo sapiens
guaauagucacuucucagu

SEQ ID NO: 1113272 - RNA, 19 nt, Homo sapiens
cgcggugucuggugaguuu

SEQ ID NO: 1113273 - RNA, 19 nt, Homo sapiens
acacuccaauguuuacuca

SEQ ID NO: 1113274 - RNA, 19 nt, Homo sapiens
gagguaggaugcagcuuuu

SEQ ID NO: 1113275 - RNA, 19 nt, Homo sapiens
ccuacucacuggcagaaga

SEQ ID NO: 1113276 - RNA, 19 nt, Homo sapiens
agaagucucccauuugaau

SEQ ID NO: 1113277 - RNA, 19 nt, Homo sapiens
agaagugguuguuacaucu

SEQ ID NO: 1113278 - RNA, 19 nt, Homo sapiens
auaacuaucuuggauguca

SEQ ID NO: 1113279 - RNA, 19 nt, Homo sapiens
agagcgaaagucuuaauaa

SEQ ID NO: 1113280 - RNA, 19 nt, Homo sapiens
cagagcgaaagucuuaaua

SEQ ID NO: 1113281 - RNA, 19 nt, Homo sapiens
gcaacaucgucaaggaucu

SEQ ID NO: 1113282 - RNA, 19 nt, Homo sapiens
gggaaggagaagccguuua

SEQ ID NO: 1113283 - RNA, 19 nt, Homo sapiens
cgccuaagcgggaagagua

SEQ ID NO: 1113284 - RNA, 19 nt, Homo sapiens
ccaggagagcuaugagaaa

SEQ ID NO: 1113285 - RNA, 19 nt, Homo sapiens
cugcagcgcuggcacaagu

SEQ ID NO: 1113286 - RNA, 19 nt, Homo sapiens
ggaacaccaccucugucua

SEQ ID NO: 1113287 - RNA, 19 nt, Homo sapiens
gaccagaacgcccaagucu

SEQ ID NO: 1113288 - RNA, 19 nt, Homo sapiens
ugacaaaugcagcucuaga

SEQ ID NO: 1113289 - RNA, 19 nt, Homo sapiens
ucgagacucuggccugaau

SEQ ID NO: 1113290 - RNA, 19 nt, Homo sapiens
caacuucugcaaaucuaga

SEQ ID NO: 1113291 - RNA, 19 nt, Homo sapiens
gaaugacaacacuccaaug

SEQ ID NO: 1113292 - RNA, 19 nt, Homo sapiens
aggauuuacuugaaacgaa

SEQ ID NO: 1113293 - RNA, 19 nt, Homo sapiens
guaagagucaucugauuuu

SEQ ID NO: 1113294 - RNA, 19 nt, Homo sapiens
cgcaucgucuccagaggua

SEQ ID NO: 1113295 - RNA, 19 nt, Homo sapiens
uaagcucagugguaauagu

SEQ ID NO: 1113296 - RNA, 19 nt, Homo sapiens
uaguggacauuaaugacaa

SEQ ID NO: 1113297 - RNA, 19 nt, Homo sapiens
aggaagaauuggaagugaa

SEQ ID NO: 1113298 - RNA, 19 nt, Homo sapiens
gcgagccucuucugauaac

SEQ ID NO: 1113299 - RNA, 19 nt, Homo sapiens
agagguaggaugcagcuuu

SEQ ID NO: 1113300 - RNA, 19 nt, Homo sapiens
gaagugaaaauucucgaaa

SEQ ID NO: 1113301 - RNA, 19 nt, Homo sapiens
aaggaagaauuggaaguga

SEQ ID NO: 1113302 - RNA, 19 nt, Homo sapiens
caggagagcuaugagaaaa

SEQ ID NO: 1113303 - RNA, 19 nt, Homo sapiens
ugucgaggauaaacugaau

SEQ ID NO: 1113304 - RNA, 19 nt, Homo sapiens
uaacuaucuuggaugucaa

SEQ ID NO: 1113305 - RNA, 19 nt, Homo sapiens
acuaugaggacucgaguuu

SEQ ID NO: 1113306 - RNA, 19 nt, Homo sapiens
uaggcaacaucgucaagga

SEQ ID NO: 1113307 - RNA, 19 nt, Homo sapiens
ugaguuucuuuccgccuaa

SEQ ID NO: 1113308 - RNA, 19 nt, Homo sapiens
acuaugagcaguugagaga

SEQ ID NO: 1113309 - RNA, 19 nt, Homo sapiens
caacuccgacacugggauu

SEQ ID NO: 1113310 - RNA, 19 nt, Homo sapiens
caucuucucugugaaugca

SEQ ID NO: 1113311 - RNA, 19 nt, Homo sapiens
gccuccaucuucucuguga

SEQ ID NO: 1113312 - RNA, 19 nt, Homo sapiens
aaaggaacaccaccucugu

SEQ ID NO: 1113313 - RNA, 19 nt, Homo sapiens
ggaugcagcuuuucucucu

SEQ ID NO: 1113314 - RNA, 19 nt, Homo sapiens
ggacaaagcuugacacauc

SEQ ID NO: 1113315 - RNA, 19 nt, Homo sapiens
guacugacuucuccuauaa

SEQ ID NO: 1113316 - RNA, 19 nt, Homo sapiens
uaagguagaugcaaacaaa

SEQ ID NO: 1113317 - RNA, 19 nt, Homo sapiens
gcaagaaggagaagaagua

SEQ ID NO: 1113318 - RNA, 19 nt, Homo sapiens
gaaaguagcagacguuaau

SEQ ID NO: 1113319 - RNA, 19 nt, Homo sapiens
ggauuaaacuggcauuuca

SEQ ID NO: 1113320 - RNA, 19 nt, Homo sapiens
ggaauaaacgggaaauuga

SEQ ID NO: 1113321 - RNA, 19 nt, Homo sapiens
uaacaggaccaauggauua

SEQ ID NO: 1113322 - RNA, 19 nt, Homo sapiens
caagaucaaugcucaaguu

SEQ ID NO: 1113323 - RNA, 19 nt, Homo sapiens
ggaaauugaccuacucuuu

SEQ ID NO: 1113324 - RNA, 19 nt, Homo sapiens
gaagagagcugugagaaaa

SEQ ID NO: 1113325 - RNA, 19 nt, Homo sapiens
gagauugcaugcucuauuc

SEQ ID NO: 1113326 - RNA, 19 nt, Homo sapiens
gaagucaguugauaauuac

SEQ ID NO: 1113327 - RNA, 19 nt, Homo sapiens
uacaaucacuggacuauga

SEQ ID NO: 1113328 - RNA, 19 nt, Homo sapiens
cagacacgcuccuuaguga

SEQ ID NO: 1113329 - RNA, 19 nt, Homo sapiens
gaacuguaaucgcgcuguu

SEQ ID NO: 1113330 - RNA, 19 nt, Homo sapiens
gaagcucgaagcagguuua

SEQ ID NO: 1113331 - RNA, 19 nt, Homo sapiens
gaucaaugcucaaguuuug

SEQ ID NO: 1113332 - RNA, 19 nt, Homo sapiens
ucugaugucugauaaggua

SEQ ID NO: 1113333 - RNA, 19 nt, Homo sapiens
uagaauagccaguagugua

SEQ ID NO: 1113334 - RNA, 19 nt, Homo sapiens
ccaguucgaucucugaaga

SEQ ID NO: 1113335 - RNA, 19 nt, Homo sapiens
aaucucaacucuacaauca

SEQ ID NO: 1113336 - RNA, 19 nt, Homo sapiens
ggaaaucucaacucuacaa

SEQ ID NO: 1113337 - RNA, 19 nt, Homo sapiens
gcacuucucucuggaugug

SEQ ID NO: 1113338 - RNA, 19 nt, Homo sapiens
ugagauccuucgacuauga

SEQ ID NO: 1113339 - RNA, 19 nt, Homo sapiens
uagcagacguuaaugacaa

SEQ ID NO: 1113340 - RNA, 19 nt, Homo sapiens
gaaauugaccuacucuuuu

SEQ ID NO: 1113341 - RNA, 19 nt, Homo sapiens
ggagaagucaguugauaau

SEQ ID NO: 1113342 - RNA, 19 nt, Homo sapiens
ggauccagaugagggaaua

SEQ ID NO: 1113343 - RNA, 19 nt, Homo sapiens
gggaauaaacgggaaauug

SEQ ID NO: 1113344 - RNA, 19 nt, Homo sapiens
uggaguagaaguagaaaua

SEQ ID NO: 1113345 - RNA, 19 nt, Homo sapiens
gggaccaaaugaacagaaa

SEQ ID NO: 1113346 - RNA, 19 nt, Homo sapiens
gcucgaagcagguuuagga

SEQ ID NO: 1113347 - RNA, 19 nt, Homo sapiens
gcaauggcaacaagaagaa

SEQ ID NO: 1113348 - RNA, 19 nt, Homo sapiens
ugagagaccuacaguugug

SEQ ID NO: 1113349 - RNA, 19 nt, Homo sapiens
cuagggaccuggacagaga

SEQ ID NO: 1113350 - RNA, 19 nt, Homo sapiens
cguacugacuucuccuaua

SEQ ID NO: 1113351 - RNA, 19 nt, Homo sapiens
gacaaagcuugacacauca

SEQ ID NO: 1113352 - RNA, 19 nt, Homo sapiens
cagcugaacuccuccaucu

SEQ ID NO: 1113353 - RNA, 19 nt, Homo sapiens
gacaacauccuccagauuc

SEQ ID NO: 1113354 - RNA, 19 nt, Homo sapiens
gaggaagagucaccugauc

SEQ ID NO: 1113355 - RNA, 19 nt, Homo sapiens
ggaguagaaguagaaauaa

SEQ ID NO: 1113356 - RNA, 19 nt, Homo sapiens
gccauagccugguuaaagu

SEQ ID NO: 1113357 - RNA, 19 nt, Homo sapiens
agaaacaagugcccaguca

SEQ ID NO: 1113358 - RNA, 19 nt, Homo sapiens
gaagaagucgggcaagaag

SEQ ID NO: 1113359 - RNA, 19 nt, Homo sapiens
gggcuuuccugcagaccua

SEQ ID NO: 1113360 - RNA, 19 nt, Homo sapiens
gaaagucucagcccaggau

SEQ ID NO: 1113361 - RNA, 19 nt, Homo sapiens
guggugaacuuuaacaucu

SEQ ID NO: 1113362 - RNA, 19 nt, Homo sapiens
ggaggaggcucuguauguc

SEQ ID NO: 1113363 - RNA, 19 nt, Homo sapiens
gcacaagucacgccugcuu

SEQ ID NO: 1113364 - RNA, 19 nt, Homo sapiens
guugagagaccuacaguug

SEQ ID NO: 1113365 - RNA, 19 nt, Homo sapiens
cggaggagcuggacaaagg

SEQ ID NO: 1113366 - RNA, 19 nt, Homo sapiens
ggaccagucuucuguuuug

SEQ ID NO: 1113367 - RNA, 19 nt, Homo sapiens
aagcggaacugauggacaa

SEQ ID NO: 1113368 - RNA, 19 nt, Homo sapiens
gaacuuuaacaucuugguu

SEQ ID NO: 1113369 - RNA, 19 nt, Homo sapiens
ggugaacuuuaacaucuug

SEQ ID NO: 1113370 - RNA, 19 nt, Homo sapiens
ccuccuauguauccauuaa

SEQ ID NO: 1113371 - RNA, 19 nt, Homo sapiens
ucaccucucugaccaguuc

SEQ ID NO: 1113372 - RNA, 19 nt, Homo sapiens
gauggaggcgcucuuguug

SEQ ID NO: 1113373 - RNA, 19 nt, Homo sapiens
gauucuaccucauggaagu

SEQ ID NO: 1113374 - RNA, 19 nt, Homo sapiens
gcagacacgcuccuuagug

SEQ ID NO: 1113375 - RNA, 19 nt, Homo sapiens
ggacagagacgcgcucaag

SEQ ID NO: 1113376 - RNA, 19 nt, Homo sapiens
ggauggaggcgcucuuguu

SEQ ID NO: 1113377 - RNA, 19 nt, Homo sapiens
gcacucggcugcucaugcu

SEQ ID NO: 1113378 - RNA, 19 nt, Homo sapiens
uuuccgggaugaagaguua

SEQ ID NO: 1113379 - RNA, 19 nt, Homo sapiens
ggacccuucccacuacaua

SEQ ID NO: 1113380 - RNA, 19 nt, Homo sapiens
cuacaagccuccuaguucu

SEQ ID NO: 1113381 - RNA, 19 nt, Homo sapiens
gaacuccuccaucuuccaa

SEQ ID NO: 1113382 - RNA, 19 nt, Homo sapiens
caucuugguugagaacaaa

SEQ ID NO: 1113383 - RNA, 19 nt, Homo sapiens
gaacugauggacaaaagua

SEQ ID NO: 1113384 - RNA, 19 nt, Homo sapiens
guguugaaguaccaaguaa

SEQ ID NO: 1113385 - RNA, 19 nt, Homo sapiens
gaccuaggcaguaucaaga

SEQ ID NO: 1113386 - RNA, 19 nt, Homo sapiens
guacaggacgugaaugaca

SEQ ID NO: 1113387 - RNA, 19 nt, Homo sapiens
cugauaagguagaugcaaa

SEQ ID NO: 1113388 - RNA, 19 nt, Homo sapiens
gaccugcccuuacaguagu

SEQ ID NO: 1113389 - RNA, 19 nt, Homo sapiens
ugaaguaccaaguaaccua

SEQ ID NO: 1113390 - RNA, 19 nt, Homo sapiens
gcugaacuccuccaucuuc

SEQ ID NO: 1113391 - RNA, 19 nt, Homo sapiens
gcacccaggccucagaguu

SEQ ID NO: 1113392 - RNA, 19 nt, Homo sapiens
caagaaggagaagaaguaa

SEQ ID NO: 1113393 - RNA, 19 nt, Homo sapiens
gcccuuguccuccuaugua

SEQ ID NO: 1113394 - RNA, 19 nt, Homo sapiens
ccuauaagcgcuucucuuc

SEQ ID NO: 1113395 - RNA, 19 nt, Homo sapiens
ggccauagccugguuaaag

SEQ ID NO: 1113396 - RNA, 19 nt, Homo sapiens
ggagaagaaguaacaugga

SEQ ID NO: 1113397 - RNA, 19 nt, Homo sapiens
caaagaagaacggcgaguu

SEQ ID NO: 1113398 - RNA, 19 nt, Homo sapiens
ggaugaagaguuaaaagua

SEQ ID NO: 1113399 - RNA, 19 nt, Homo sapiens
aagcgagccucuucugaug

SEQ ID NO: 1113400 - RNA, 19 nt, Homo sapiens
gagcccugcuggacagaga

SEQ ID NO: 1113401 - RNA, 19 nt, Homo sapiens
gaguacagcgugaguguuc

SEQ ID NO: 1113402 - RNA, 19 nt, Homo sapiens
guagugcggugugcuuuua

SEQ ID NO: 1113403 - RNA, 19 nt, Homo sapiens
caacaaccaguuugacaca

SEQ ID NO: 1113404 - RNA, 19 nt, Homo sapiens
gcuccaaucugcacuucuc

SEQ ID NO: 1113405 - RNA, 19 nt, Homo sapiens
ugaagagagcugugagaaa

SEQ ID NO: 1113406 - RNA, 19 nt, Homo sapiens
gggcauggacaaagcuuga

SEQ ID NO: 1113407 - RNA, 19 nt, Homo sapiens
gaccucacacucuaucuug

SEQ ID NO: 1113408 - RNA, 19 nt, Homo sapiens
ucugagauccuucgacuau

SEQ ID NO: 1113409 - RNA, 19 nt, Homo sapiens
ugacaacccacccaauuuc

SEQ ID NO: 1113410 - RNA, 19 nt, Homo sapiens
uguguguggugaacuuuaa

SEQ ID NO: 1113411 - RNA, 19 nt, Homo sapiens
uuggagaagucaguugaua

SEQ ID NO: 1113412 - RNA, 19 nt, Homo sapiens
ucggagacuuuccaacuug

SEQ ID NO: 1113413 - RNA, 19 nt, Homo sapiens
gagcuaacaggaccaaugg

SEQ ID NO: 1113414 - RNA, 19 nt, Homo sapiens
uaagguagaugcaaacaaa

SEQ ID NO: 1113415 - RNA, 19 nt, Homo sapiens
gaaaguagcagacguuaau

SEQ ID NO: 1113416 - RNA, 19 nt, Homo sapiens
ggaauaaacgggaaauuga

SEQ ID NO: 1113417 - RNA, 19 nt, Homo sapiens
ggaaauugaccuacucuuu

SEQ ID NO: 1113418 - RNA, 19 nt, Homo sapiens
gaagagagcugugagaaaa

SEQ ID NO: 1113419 - RNA, 19 nt, Homo sapiens
gagauugcaugcucuauuc

SEQ ID NO: 1113420 - RNA, 19 nt, Homo sapiens
gaagucaguugauaauuac

SEQ ID NO: 1113421 - RNA, 19 nt, Homo sapiens
uacaaucacuggacuauga

SEQ ID NO: 1113422 - RNA, 19 nt, Homo sapiens
cagacacgcuccuuaguga

SEQ ID NO: 1113423 - RNA, 19 nt, Homo sapiens
gaacuguaaucgcgcuguu

SEQ ID NO: 1113424 - RNA, 19 nt, Homo sapiens
ucugaugucugauaaggua

SEQ ID NO: 1113425 - RNA, 19 nt, Homo sapiens
ccaguucgaucucugaaga

SEQ ID NO: 1113426 - RNA, 19 nt, Homo sapiens
aaucucaacucuacaauca

SEQ ID NO: 1113427 - RNA, 19 nt, Homo sapiens
ggaaaucucaacucuacaa

SEQ ID NO: 1113428 - RNA, 19 nt, Homo sapiens
gcacuucucucuggaugug

SEQ ID NO: 1113429 - RNA, 19 nt, Homo sapiens
ugagauccuucgacuauga

SEQ ID NO: 1113430 - RNA, 19 nt, Homo sapiens
uagcagacguuaaugacaa

SEQ ID NO: 1113431 - RNA, 19 nt, Homo sapiens
gaaauugaccuacucuuuu

SEQ ID NO: 1113432 - RNA, 19 nt, Homo sapiens
ggagaagucaguugauaau

SEQ ID NO: 1113433 - RNA, 19 nt, Homo sapiens
ggauccagaugagggaaua

SEQ ID NO: 1113434 - RNA, 19 nt, Homo sapiens
gggaauaaacgggaaauug

SEQ ID NO: 1113435 - RNA, 19 nt, Homo sapiens
uggaguagaaguagaaaua

SEQ ID NO: 1113436 - RNA, 19 nt, Homo sapiens
ugagagaccuacaguugug

SEQ ID NO: 1113437 - RNA, 19 nt, Homo sapiens
cuagggaccuggacagaga

SEQ ID NO: 1113438 - RNA, 19 nt, Homo sapiens
gaggaagagucaccugauc

SEQ ID NO: 1113439 - RNA, 19 nt, Homo sapiens
ggaguagaaguagaaauaa

SEQ ID NO: 1113440 - RNA, 19 nt, Homo sapiens
gggcuuuccugcagaccua

SEQ ID NO: 1113441 - RNA, 19 nt, Homo sapiens
gcacaagucacgccugcuu

SEQ ID NO: 1113442 - RNA, 19 nt, Homo sapiens
guugagagaccuacaguug

SEQ ID NO: 1113443 - RNA, 19 nt, Homo sapiens
cggaggagcuggacaaagg

SEQ ID NO: 1113444 - RNA, 19 nt, Homo sapiens
guggugaacuuuaacaucu

SEQ ID NO: 1113445 - RNA, 19 nt, Homo sapiens
aagcggaacugauggacaa

SEQ ID NO: 1113446 - RNA, 19 nt, Homo sapiens
ccuccuauguauccauuaa

SEQ ID NO: 1113447 - RNA, 19 nt, Homo sapiens
ucaccucucugaccaguuc

SEQ ID NO: 1113448 - RNA, 19 nt, Homo sapiens
gauggaggcgcucuuguug

SEQ ID NO: 1113449 - RNA, 19 nt, Homo sapiens
ggugaacuuuaacaucuug

SEQ ID NO: 1113450 - RNA, 19 nt, Homo sapiens
gauucuaccucauggaagu

SEQ ID NO: 1113451 - RNA, 19 nt, Homo sapiens
gaacuuuaacaucuugguu

SEQ ID NO: 1113452 - RNA, 19 nt, Homo sapiens
gcagacacgcuccuuagug

SEQ ID NO: 1113453 - RNA, 19 nt, Homo sapiens
ggacagagacgcgcucaag

SEQ ID NO: 1113454 - RNA, 19 nt, Homo sapiens
ggauggaggcgcucuuguu

SEQ ID NO: 1113455 - RNA, 19 nt, Homo sapiens
gcacucggcugcucaugcu

SEQ ID NO: 1113456 - RNA, 19 nt, Homo sapiens
uuuccgggaugaagaguua

SEQ ID NO: 1113457 - RNA, 19 nt, Homo sapiens
gaacugauggacaaaagua

SEQ ID NO: 1113458 - RNA, 19 nt, Homo sapiens
caucuugguugagaacaaa

SEQ ID NO: 1113459 - RNA, 19 nt, Homo sapiens
gaccuaggcaguaucaaga

SEQ ID NO: 1113460 - RNA, 19 nt, Homo sapiens
guacaggacgugaaugaca

SEQ ID NO: 1113461 - RNA, 19 nt, Homo sapiens
cugauaagguagaugcaaa

SEQ ID NO: 1113462 - RNA, 19 nt, Homo sapiens
gcccuuguccuccuaugua

SEQ ID NO: 1113463 - RNA, 19 nt, Homo sapiens
caaagaagaacggcgaguu

SEQ ID NO: 1113464 - RNA, 19 nt, Homo sapiens
aagcgagccucuucugaug

SEQ ID NO: 1113465 - RNA, 19 nt, Homo sapiens
gagcccugcuggacagaga

SEQ ID NO: 1113466 - RNA, 19 nt, Homo sapiens
gaguacagcgugaguguuc

SEQ ID NO: 1113467 - RNA, 19 nt, Homo sapiens
ggaugaagaguuaaaagua

SEQ ID NO: 1113468 - RNA, 19 nt, Homo sapiens
ugaagagagcugugagaaa

SEQ ID NO: 1113469 - RNA, 19 nt, Homo sapiens
gcuccaaucugcacuucuc

SEQ ID NO: 1113470 - RNA, 19 nt, Homo sapiens
uguguguggugaacuuuaa

SEQ ID NO: 1113471 - RNA, 19 nt, Homo sapiens
gaccucacacucuaucuug

SEQ ID NO: 1113472 - RNA, 19 nt, Homo sapiens
ucugagauccuucgacuau

SEQ ID NO: 1113473 - RNA, 19 nt, Homo sapiens
ugacaacccacccaauuuc

SEQ ID NO: 1113474 - RNA, 19 nt, Homo sapiens
uuggagaagucaguugaua

SEQ ID NO: 1113475 - RNA, 19 nt, Homo sapiens
ucggagacuuuccaacuug

SEQ ID NO: 1113476 - RNA, 19 nt, Homo sapiens
gaucuggaccucacacucu

SEQ ID NO: 1113477 - RNA, 19 nt, Homo sapiens
ccuaggaauuugccuuuua

SEQ ID NO: 1113478 - RNA, 19 nt, Homo sapiens
ucacuggacuaugaagaau

SEQ ID NO: 1113479 - RNA, 19 nt, Homo sapiens
gagaagucaguugauaauu

SEQ ID NO: 1113480 - RNA, 19 nt, Homo sapiens
gguagaugcaaacaaagaa

SEQ ID NO: 1113481 - RNA, 19 nt, Homo sapiens
ggaccucacacucuaucuu

SEQ ID NO: 1113482 - RNA, 19 nt, Homo sapiens
cagcgagccaggacucuuu

SEQ ID NO: 1113483 - RNA, 19 nt, Homo sapiens
gucucuaucuucucuguga

SEQ ID NO: 1113484 - RNA, 19 nt, Homo sapiens
uacaggacgugaaugacaa

SEQ ID NO: 1113485 - RNA, 19 nt, Homo sapiens
uuuaacaucuugguugaga

SEQ ID NO: 1113486 - RNA, 19 nt, Homo sapiens
ggugguagcgguggacaaa

SEQ ID NO: 1113487 - RNA, 19 nt, Homo sapiens
uagcguacaugauggugau

SEQ ID NO: 1113488 - RNA, 19 nt, Homo sapiens
uuacgguccucgacgcaaa

SEQ ID NO: 1113489 - RNA, 19 nt, Homo sapiens
gcgagccucuucugauguc

SEQ ID NO: 1113490 - RNA, 19 nt, Homo sapiens
ugguagcgguggacaaaga

SEQ ID NO: 1113491 - RNA, 19 nt, Homo sapiens
ccuacucccuggcugaaga

SEQ ID NO: 1113492 - RNA, 19 nt, Homo sapiens
aaugacaacccacccaauu

SEQ ID NO: 1113493 - RNA, 19 nt, Homo sapiens
cgcaucgucuccagaggua

SEQ ID NO: 1113494 - RNA, 19 nt, Homo sapiens
ugagauugcaugcucuauu

SEQ ID NO: 1113495 - RNA, 19 nt, Homo sapiens
gaaaucucaacucuacaau

SEQ ID NO: 1113496 - RNA, 19 nt, Homo sapiens
ggggaaaucucaacucuac

SEQ ID NO: 1113497 - RNA, 19 nt, Homo sapiens
gaauaaacgggaaauugac

SEQ ID NO: 1113498 - RNA, 19 nt, Homo sapiens
gugguaagcggaacugaug

SEQ ID NO: 1113499 - RNA, 19 nt, Homo sapiens
uaaggugguggucacagua

SEQ ID NO: 1113500 - RNA, 19 nt, Homo sapiens
gagacuuuccaacuugauu

SEQ ID NO: 1113501 - RNA, 19 nt, Homo sapiens
gcgugaguguuccagagaa

SEQ ID NO: 1113502 - RNA, 19 nt, Homo sapiens
ggaugugggugugaacucu

SEQ ID NO: 1113503 - RNA, 19 nt, Homo sapiens
uggagaagucaguugauaa

SEQ ID NO: 1113504 - RNA, 19 nt, Homo sapiens
acuaugagcaguugagaga

SEQ ID NO: 1113505 - RNA, 19 nt, Homo sapiens
acuguaaucgcgcuguuua

SEQ ID NO: 1113506 - RNA, 19 nt, Homo sapiens
caguacaggacgugaauga

SEQ ID NO: 1113507 - RNA, 19 nt, Homo sapiens
cagauucuaccucauggaa

SEQ ID NO: 1113508 - RNA, 19 nt, Homo sapiens
ccucuucugaugucugaua

SEQ ID NO: 1113509 - RNA, 19 nt, Homo sapiens
agagguaggacgcagcuuu

SEQ ID NO: 1113510 - RNA, 19 nt, Homo sapiens
cuaggaauuugccuuuuaa

SEQ ID NO: 1113511 - RNA, 19 nt, Homo sapiens
ggaagugguagcucaggau

SEQ ID NO: 1113512 - RNA, 19 nt, Homo sapiens
cggagacuuuccaacuuga

SEQ ID NO: 1113513 - RNA, 19 nt, Homo sapiens
gagaaaagcgagccucuuc

SEQ ID NO: 1113514 - RNA, 19 nt, Homo sapiens
ggacaaagcuugacacauc

SEQ ID NO: 1113515 - RNA, 19 nt, Homo sapiens
gaagaagucucagaauaua

SEQ ID NO: 1113516 - RNA, 19 nt, Homo sapiens
gggaagaagucucagaaua

SEQ ID NO: 1113517 - RNA, 19 nt, Homo sapiens
guacugacuucuccuauaa

SEQ ID NO: 1113518 - RNA, 19 nt, Homo sapiens
gaagauacagugaagauuu

SEQ ID NO: 1113519 - RNA, 19 nt, Homo sapiens
gcaagaaggagaagaagua

SEQ ID NO: 1113520 - RNA, 19 nt, Homo sapiens
gaaauggccuagucacaug

SEQ ID NO: 1113521 - RNA, 19 nt, Homo sapiens
ggauuaaacuggcauuuca

SEQ ID NO: 1113522 - RNA, 19 nt, Homo sapiens
uaacaggaccaauggauua

SEQ ID NO: 1113523 - RNA, 19 nt, Homo sapiens
ggaagaagucucagaauau

SEQ ID NO: 1113524 - RNA, 19 nt, Homo sapiens
caagaucaaugcucaaguu

SEQ ID NO: 1113525 - RNA, 19 nt, Homo sapiens
gaaaagaccuauggaaauu

SEQ ID NO: 1113526 - RNA, 19 nt, Homo sapiens
ugacaaaccuggagauucu

SEQ ID NO: 1113527 - RNA, 19 nt, Homo sapiens
uaucacagcuauuucaguu

SEQ ID NO: 1113528 - RNA, 19 nt, Homo sapiens
ucacagcuauuucaguuga

SEQ ID NO: 1113529 - RNA, 19 nt, Homo sapiens
caacucaaacgguuacuuu

SEQ ID NO: 1113530 - RNA, 19 nt, Homo sapiens
guuaccagcucaacucaaa

SEQ ID NO: 1113531 - RNA, 19 nt, Homo sapiens
aagcgagccucuucugaua

SEQ ID NO: 1113532 - RNA, 19 nt, Homo sapiens
cauguucuauuccagauaa

SEQ ID NO: 1113533 - RNA, 19 nt, Homo sapiens
ggguagagguggaaauaau

SEQ ID NO: 1113534 - RNA, 19 nt, Homo sapiens
gaagcucgaagcagguuua

SEQ ID NO: 1113535 - RNA, 19 nt, Homo sapiens
gaucaaugcucaaguuuug

SEQ ID NO: 1113536 - RNA, 19 nt, Homo sapiens
uagaauagccaguagugua

SEQ ID NO: 1113537 - RNA, 19 nt, Homo sapiens
gcaccagaagucacaguua

SEQ ID NO: 1113538 - RNA, 19 nt, Homo sapiens
ugaggacucuggauucuau

SEQ ID NO: 1113539 - RNA, 19 nt, Homo sapiens
gagccuccaucuuaucuau

SEQ ID NO: 1113540 - RNA, 19 nt, Homo sapiens
ggacagggaagaagucuca

SEQ ID NO: 1113541 - RNA, 19 nt, Homo sapiens
ggacagaacagagggaaau

SEQ ID NO: 1113542 - RNA, 19 nt, Homo sapiens
gggaccaaaugaacagaaa

SEQ ID NO: 1113543 - RNA, 19 nt, Homo sapiens
gcucgaagcagguuuagga

SEQ ID NO: 1113544 - RNA, 19 nt, Homo sapiens
gcaauggcaacaagaagaa

SEQ ID NO: 1113545 - RNA, 19 nt, Homo sapiens
cguacugacuucuccuaua

SEQ ID NO: 1113546 - RNA, 19 nt, Homo sapiens
gacaaagcuugacacauca

SEQ ID NO: 1113547 - RNA, 19 nt, Homo sapiens
cagcugaacuccuccaucu

SEQ ID NO: 1113548 - RNA, 19 nt, Homo sapiens
gacaacauccuccagauuc

SEQ ID NO: 1113549 - RNA, 19 nt, Homo sapiens
cgauaaugcucccguguuc

SEQ ID NO: 1113550 - RNA, 19 nt, Homo sapiens
gccauagccugguuaaagu

SEQ ID NO: 1113551 - RNA, 19 nt, Homo sapiens
agaaacaagugcccaguca

SEQ ID NO: 1113552 - RNA, 19 nt, Homo sapiens
gaagaagucgggcaagaag

SEQ ID NO: 1113553 - RNA, 19 nt, Homo sapiens
gggcuuuccugcagaccua

SEQ ID NO: 1113554 - RNA, 19 nt, Homo sapiens
gaaagucucagcccaggau

SEQ ID NO: 1113555 - RNA, 19 nt, Homo sapiens
ggaggaggcucuguauguc

SEQ ID NO: 1113556 - RNA, 19 nt, Homo sapiens
gcacaagucacgccugcuu

SEQ ID NO: 1113557 - RNA, 19 nt, Homo sapiens
gugcaccucuguccuccua

SEQ ID NO: 1113558 - RNA, 19 nt, Homo sapiens
cuagucacauguucuauuc

SEQ ID NO: 1113559 - RNA, 19 nt, Homo sapiens
ggaaauggccuagucacau

SEQ ID NO: 1113560 - RNA, 19 nt, Homo sapiens
ugccaggauucucauaaua

SEQ ID NO: 1113561 - RNA, 19 nt, Homo sapiens
ggaccagucuucuguuuug

SEQ ID NO: 1113562 - RNA, 19 nt, Homo sapiens
uaacucaggauuuacuuga

SEQ ID NO: 1113563 - RNA, 19 nt, Homo sapiens
gcaccucuguccuccuaug

SEQ ID NO: 1113564 - RNA, 19 nt, Homo sapiens
cagaacagagggaaauaaa

SEQ ID NO: 1113565 - RNA, 19 nt, Homo sapiens
gauccuauaugcucuuugc

SEQ ID NO: 1113566 - RNA, 19 nt, Homo sapiens
ggaaauuauuaucgguugu

SEQ ID NO: 1113567 - RNA, 19 nt, Homo sapiens
ggacagagacgcgcucaag

SEQ ID NO: 1113568 - RNA, 19 nt, Homo sapiens
gacagagacucaggucaga

SEQ ID NO: 1113569 - RNA, 19 nt, Homo sapiens
gacagugacucaggaggaa

SEQ ID NO: 1113570 - RNA, 19 nt, Homo sapiens
gaaaucagggccgaacaga

SEQ ID NO: 1113571 - RNA, 19 nt, Homo sapiens
ggacccuucccacuacaua

SEQ ID NO: 1113572 - RNA, 19 nt, Homo sapiens
cuacaagccuccuaguucu

SEQ ID NO: 1113573 - RNA, 19 nt, Homo sapiens
gaacuccuccaucuuccaa

SEQ ID NO: 1113574 - RNA, 19 nt, Homo sapiens
gacaaaauaucacagcuau

SEQ ID NO: 1113575 - RNA, 19 nt, Homo sapiens
guguugaaguaccaaguaa

SEQ ID NO: 1113576 - RNA, 19 nt, Homo sapiens
acaaugcccgaaucacuua

SEQ ID NO: 1113577 - RNA, 19 nt, Homo sapiens
gacaaugcccgaaucacuu

SEQ ID NO: 1113578 - RNA, 19 nt, Homo sapiens
cagcgagccgggacuauuu

SEQ ID NO: 1113579 - RNA, 19 nt, Homo sapiens
gccuccaucuuaucuauga

SEQ ID NO: 1113580 - RNA, 19 nt, Homo sapiens
aaucugccauucacacuug

SEQ ID NO: 1113581 - RNA, 19 nt, Homo sapiens
guggaaauaaucgauguua

SEQ ID NO: 1113582 - RNA, 19 nt, Homo sapiens
gcggguagagguggaaaua

SEQ ID NO: 1113583 - RNA, 19 nt, Homo sapiens
gaccugcccuuacaguagu

SEQ ID NO: 1113584 - RNA, 19 nt, Homo sapiens
ugaaguaccaaguaaccua

SEQ ID NO: 1113585 - RNA, 19 nt, Homo sapiens
gcugaacuccuccaucuuc

SEQ ID NO: 1113586 - RNA, 19 nt, Homo sapiens
gcacccaggccucagaguu

SEQ ID NO: 1113587 - RNA, 19 nt, Homo sapiens
caagaaggagaagaaguaa

SEQ ID NO: 1113588 - RNA, 19 nt, Homo sapiens
ccacucagcagcaaugugu

SEQ ID NO: 1113589 - RNA, 19 nt, Homo sapiens
auacagggauccuauaugc

SEQ ID NO: 1113590 - RNA, 19 nt, Homo sapiens
ccaauacagggauccuaua

SEQ ID NO: 1113591 - RNA, 19 nt, Homo sapiens
cagaauauaacaucacugu

SEQ ID NO: 1113592 - RNA, 19 nt, Homo sapiens
ccuauaagcgcuucucuuc

SEQ ID NO: 1113593 - RNA, 19 nt, Homo sapiens
ggccauagccugguuaaag

SEQ ID NO: 1113594 - RNA, 19 nt, Homo sapiens
ggagaagaaguaacaugga

SEQ ID NO: 1113595 - RNA, 19 nt, Homo sapiens
ccgaacagauucucuacuc

SEQ ID NO: 1113596 - RNA, 19 nt, Homo sapiens
caauacagggauccuauau

SEQ ID NO: 1113597 - RNA, 19 nt, Homo sapiens
guacaguaauugcacuuuu

SEQ ID NO: 1113598 - RNA, 19 nt, Homo sapiens
gaacagagggaaauaaaag

SEQ ID NO: 1113599 - RNA, 19 nt, Homo sapiens
guagugcggugugcuuuua

SEQ ID NO: 1113600 - RNA, 19 nt, Homo sapiens
caacaaccaguuugacaca

SEQ ID NO: 1113601 - RNA, 19 nt, Homo sapiens
acucaggauuuacuugaaa

SEQ ID NO: 1113602 - RNA, 19 nt, Homo sapiens
gcggaagagucaccugauc

SEQ ID NO: 1113603 - RNA, 19 nt, Homo sapiens
gggccgaugggauuaagua

SEQ ID NO: 1113604 - RNA, 19 nt, Homo sapiens
gggcauggacaaagcuuga

SEQ ID NO: 1113605 - RNA, 19 nt, Homo sapiens
caacccagcuaugcagaca

SEQ ID NO: 1113606 - RNA, 19 nt, Homo sapiens
gaugacagccagugacagu

SEQ ID NO: 1113607 - RNA, 19 nt, Homo sapiens
ugacaacgcaccagaaguc

SEQ ID NO: 1113608 - RNA, 19 nt, Homo sapiens
ugacaguucuggaugaaaa

SEQ ID NO: 1113609 - RNA, 19 nt, Homo sapiens
ggugacaguucuggaugaa

SEQ ID NO: 1113610 - RNA, 19 nt, Homo sapiens
gagcuaacaggaccaaugg

SEQ ID NO: 1113611 - RNA, 19 nt, Homo sapiens
gccauaaaccaauaacuag

SEQ ID NO: 1113612 - RNA, 19 nt, Homo sapiens
ugacaacauccuccagauu

SEQ ID NO: 1113613 - RNA, 19 nt, Homo sapiens
aaugauaacccacccaguu

SEQ ID NO: 1113614 - RNA, 19 nt, Homo sapiens
gaagaagucucagaauaua

SEQ ID NO: 1113615 - RNA, 19 nt, Homo sapiens
gggaagaagucucagaaua

SEQ ID NO: 1113616 - RNA, 19 nt, Homo sapiens
gaagauacagugaagauuu

SEQ ID NO: 1113617 - RNA, 19 nt, Homo sapiens
gaaauggccuagucacaug

SEQ ID NO: 1113618 - RNA, 19 nt, Homo sapiens
ggaagaagucucagaauau

SEQ ID NO: 1113619 - RNA, 19 nt, Homo sapiens
gaaaagaccuauggaaauu

SEQ ID NO: 1113620 - RNA, 19 nt, Homo sapiens
ugacaaaccuggagauucu

SEQ ID NO: 1113621 - RNA, 19 nt, Homo sapiens
uaucacagcuauuucaguu

SEQ ID NO: 1113622 - RNA, 19 nt, Homo sapiens
gaucauaccacacugaaau

SEQ ID NO: 1113623 - RNA, 19 nt, Homo sapiens
ucacagcuauuucaguuga

SEQ ID NO: 1113624 - RNA, 19 nt, Homo sapiens
caacucaaacgguuacuuu

SEQ ID NO: 1113625 - RNA, 19 nt, Homo sapiens
guuaccagcucaacucaaa

SEQ ID NO: 1113626 - RNA, 19 nt, Homo sapiens
aagcgagccucuucugaua

SEQ ID NO: 1113627 - RNA, 19 nt, Homo sapiens
cauguucuauuccagauaa

SEQ ID NO: 1113628 - RNA, 19 nt, Homo sapiens
ggguagagguggaaauaau

SEQ ID NO: 1113629 - RNA, 19 nt, Homo sapiens
gcaccagaagucacaguua

SEQ ID NO: 1113630 - RNA, 19 nt, Homo sapiens
ugaggacucuggauucuau

SEQ ID NO: 1113631 - RNA, 19 nt, Homo sapiens
gagccuccaucuuaucuau

SEQ ID NO: 1113632 - RNA, 19 nt, Homo sapiens
ggacagggaagaagucuca

SEQ ID NO: 1113633 - RNA, 19 nt, Homo sapiens
ggacagaacagagggaaau

SEQ ID NO: 1113634 - RNA, 19 nt, Homo sapiens
cgauaaugcucccguguuc

SEQ ID NO: 1113635 - RNA, 19 nt, Homo sapiens
gggcuuuccugcagaccua

SEQ ID NO: 1113636 - RNA, 19 nt, Homo sapiens
gcacaagucacgccugcuu

SEQ ID NO: 1113637 - RNA, 19 nt, Homo sapiens
gugcaccucuguccuccua

SEQ ID NO: 1113638 - RNA, 19 nt, Homo sapiens
cuagucacauguucuauuc

SEQ ID NO: 1113639 - RNA, 19 nt, Homo sapiens
ggaaauggccuagucacau

SEQ ID NO: 1113640 - RNA, 19 nt, Homo sapiens
ugccaggauucucauaaua

SEQ ID NO: 1113641 - RNA, 19 nt, Homo sapiens
uaacucaggauuuacuuga

SEQ ID NO: 1113642 - RNA, 19 nt, Homo sapiens
gcaccucuguccuccuaug

SEQ ID NO: 1113643 - RNA, 19 nt, Homo sapiens
cagaacagagggaaauaaa

SEQ ID NO: 1113644 - RNA, 19 nt, Homo sapiens
gauccuauaugcucuuugc

SEQ ID NO: 1113645 - RNA, 19 nt, Homo sapiens
ggaaauuauuaucgguugu

SEQ ID NO: 1113646 - RNA, 19 nt, Homo sapiens
ggacagagacgcgcucaag

SEQ ID NO: 1113647 - RNA, 19 nt, Homo sapiens
gacagagacucaggucaga

SEQ ID NO: 1113648 - RNA, 19 nt, Homo sapiens
gacagugacucaggaggaa

SEQ ID NO: 1113649 - RNA, 19 nt, Homo sapiens
auaccacacugaaauauag

SEQ ID NO: 1113650 - RNA, 19 nt, Homo sapiens
gaaaucagggccgaacaga

SEQ ID NO: 1113651 - RNA, 19 nt, Homo sapiens
gacaaaauaucacagcuau

SEQ ID NO: 1113652 - RNA, 19 nt, Homo sapiens
acaaugcccgaaucacuua

SEQ ID NO: 1113653 - RNA, 19 nt, Homo sapiens
gacaaugcccgaaucacuu

SEQ ID NO: 1113654 - RNA, 19 nt, Homo sapiens
ucaggugagucaaucuuau

SEQ ID NO: 1113655 - RNA, 19 nt, Homo sapiens
cagcgagccgggacuauuu

SEQ ID NO: 1113656 - RNA, 19 nt, Homo sapiens
gccuccaucuuaucuauga

SEQ ID NO: 1113657 - RNA, 19 nt, Homo sapiens
aaucugccauucacacuug

SEQ ID NO: 1113658 - RNA, 19 nt, Homo sapiens
guggaaauaaucgauguua

SEQ ID NO: 1113659 - RNA, 19 nt, Homo sapiens
gcggguagagguggaaaua

SEQ ID NO: 1113660 - RNA, 19 nt, Homo sapiens
cauaccacacugaaauaua

SEQ ID NO: 1113661 - RNA, 19 nt, Homo sapiens
ccacucagcagcaaugugu

SEQ ID NO: 1113662 - RNA, 19 nt, Homo sapiens
auacagggauccuauaugc

SEQ ID NO: 1113663 - RNA, 19 nt, Homo sapiens
ccaauacagggauccuaua

SEQ ID NO: 1113664 - RNA, 19 nt, Homo sapiens
cagaauauaacaucacugu

SEQ ID NO: 1113665 - RNA, 19 nt, Homo sapiens
caggugagucaaucuuaua

SEQ ID NO: 1113666 - RNA, 19 nt, Homo sapiens
caauacagggauccuauau

SEQ ID NO: 1113667 - RNA, 19 nt, Homo sapiens
ccgaacagauucucuacuc

SEQ ID NO: 1113668 - RNA, 19 nt, Homo sapiens
guacaguaauugcacuuuu

SEQ ID NO: 1113669 - RNA, 19 nt, Homo sapiens
gaacagagggaaauaaaag

SEQ ID NO: 1113670 - RNA, 19 nt, Homo sapiens
caaagaguuguguaaaugu

SEQ ID NO: 1113671 - RNA, 19 nt, Homo sapiens
acucaggauuuacuugaaa

SEQ ID NO: 1113672 - RNA, 19 nt, Homo sapiens
gcggaagagucaccugauc

SEQ ID NO: 1113673 - RNA, 19 nt, Homo sapiens
gggccgaugggauuaagua

SEQ ID NO: 1113674 - RNA, 19 nt, Homo sapiens
caacccagcuaugcagaca

SEQ ID NO: 1113675 - RNA, 19 nt, Homo sapiens
gaugacagccagugacagu

SEQ ID NO: 1113676 - RNA, 19 nt, Homo sapiens
ugacaacgcaccagaaguc

SEQ ID NO: 1113677 - RNA, 19 nt, Homo sapiens
ugacaguucuggaugaaaa

SEQ ID NO: 1113678 - RNA, 19 nt, Homo sapiens
ggugacaguucuggaugaa

SEQ ID NO: 1113679 - RNA, 19 nt, Homo sapiens
aaaggagacccuaaucuuc

SEQ ID NO: 1113680 - RNA, 19 nt, Homo sapiens
gaacuccuccacugucuac

SEQ ID NO: 1113681 - RNA, 19 nt, Homo sapiens
aaugauaacccacccaguu

SEQ ID NO: 1113682 - RNA, 19 nt, Homo sapiens
caccagaagucacaguuac

SEQ ID NO: 1113683 - RNA, 19 nt, Homo sapiens
ucauaauacuuguggauac

SEQ ID NO: 1113684 - RNA, 19 nt, Homo sapiens
caacgcaccagaagucaca

SEQ ID NO: 1113685 - RNA, 19 nt, Homo sapiens
ucuagaagauacagugaag

SEQ ID NO: 1113686 - RNA, 19 nt, Homo sapiens
gacagaacagagggaaaua

SEQ ID NO: 1113687 - RNA, 19 nt, Homo sapiens
cagauguccuggcugacuu

SEQ ID NO: 1113688 - RNA, 19 nt, Homo sapiens
uauaugcucuuugcuccuu

SEQ ID NO: 1113689 - RNA, 19 nt, Homo sapiens
gggauccuauaugcucuuu

SEQ ID NO: 1113690 - RNA, 19 nt, Homo sapiens
gaguggggauauaacaaua

SEQ ID NO: 1113691 - RNA, 19 nt, Homo sapiens
aaagaguuguguaaauguc

SEQ ID NO: 1113692 - RNA, 19 nt, Homo sapiens
ccgggagaguugugagaaa

SEQ ID NO: 1113693 - RNA, 19 nt, Homo sapiens
cgcaucgucuccagaggua

SEQ ID NO: 1113694 - RNA, 19 nt, Homo sapiens
acuaugagcaguuuagaga

SEQ ID NO: 1113695 - RNA, 19 nt, Homo sapiens
ggaaauaaaaguugcugaa

SEQ ID NO: 1113696 - RNA, 19 nt, Homo sapiens
gcgagccucuucugauaac

SEQ ID NO: 1113697 - RNA, 19 nt, Homo sapiens
uuccuacucugcuuacauu

SEQ ID NO: 1113698 - RNA, 19 nt, Homo sapiens
ggaggaaauggccuaguca

SEQ ID NO: 1113699 - RNA, 19 nt, Homo sapiens
uagaagauacagugaagau

SEQ ID NO: 1113700 - RNA, 19 nt, Homo sapiens
ccaggauucucauaauacu

SEQ ID NO: 1113701 - RNA, 19 nt, Homo sapiens
gggaacuccuccacugucu

SEQ ID NO: 1113702 - RNA, 19 nt, Homo sapiens
cugagacgcuggcacaagu

SEQ ID NO: 1113703 - RNA, 19 nt, Homo sapiens
ccuccuaugucuccaucaa

SEQ ID NO: 1113704 - RNA, 19 nt, Homo sapiens
ccacccacuuucccucaug

SEQ ID NO: 1113705 - RNA, 19 nt, Homo sapiens
caaacugugugacaaaccu

SEQ ID NO: 1113706 - RNA, 19 nt, Homo sapiens
agagguaggacgcagcuuu

SEQ ID NO: 1113707 - RNA, 19 nt, Homo sapiens
uaauagaucauaccacacu

SEQ ID NO: 1113708 - RNA, 19 nt, Homo sapiens
aaggagacccuaaucuuca

SEQ ID NO: 1113709 - RNA, 19 nt, Homo sapiens
ugacaacccacccacuuuc

SEQ ID NO: 1113710 - RNA, 19 nt, Homo sapiens
cagggaagaagucucagaa

SEQ ID NO: 1113711 - RNA, 19 nt, Homo sapiens
gaacacuggacagggaaga

SEQ ID NO: 1113712 - RNA, 19 nt, Homo sapiens
gggccgaacagauucucua

SEQ ID NO: 1113713 - RNA, 19 nt, Homo sapiens
gagaaaagcgagccucuuc

SEQ ID NO: 1113714 - RNA, 19 nt, Homo sapiens
gaaaggagauuccaaccua

SEQ ID NO: 1113715 - RNA, 19 nt, Homo sapiens
ggacaaagcuugacacauc

SEQ ID NO: 1113716 - RNA, 19 nt, Homo sapiens
guacugacuucuccuauaa

SEQ ID NO: 1113717 - RNA, 19 nt, Homo sapiens
ugacaaugcuccagaaauu

SEQ ID NO: 1113718 - RNA, 19 nt, Homo sapiens
gcaagaaggagaagaagua

SEQ ID NO: 1113719 - RNA, 19 nt, Homo sapiens
ggauuaaacuggcauuuca

SEQ ID NO: 1113720 - RNA, 19 nt, Homo sapiens
uaacaggaccaauggauua

SEQ ID NO: 1113721 - RNA, 19 nt, Homo sapiens
gcgaacaaauaucagaaua

SEQ ID NO: 1113722 - RNA, 19 nt, Homo sapiens
caagaucaaugcucaaguu

SEQ ID NO: 1113723 - RNA, 19 nt, Homo sapiens
gcucaagugucuuauauuc

SEQ ID NO: 1113724 - RNA, 19 nt, Homo sapiens
gaacccgauuuccaauuaa

SEQ ID NO: 1113725 - RNA, 19 nt, Homo sapiens
cugcagaacuacaagcuua

SEQ ID NO: 1113726 - RNA, 19 nt, Homo sapiens
gaaugacaaugcuccagaa

SEQ ID NO: 1113727 - RNA, 19 nt, Homo sapiens
gaaacaggauccggucaga

SEQ ID NO: 1113728 - RNA, 19 nt, Homo sapiens
cagaggaauuggaaauaaa

SEQ ID NO: 1113729 - RNA, 19 nt, Homo sapiens
aagcgagccucuucugaua

SEQ ID NO: 1113730 - RNA, 19 nt, Homo sapiens
gaagcucgaagcagguuua

SEQ ID NO: 1113731 - RNA, 19 nt, Homo sapiens
gaucaaugcucaaguuuug

SEQ ID NO: 1113732 - RNA, 19 nt, Homo sapiens
cgagcaauuuagagacuua

SEQ ID NO: 1113733 - RNA, 19 nt, Homo sapiens
uagaauagccaguagugua

SEQ ID NO: 1113734 - RNA, 19 nt, Homo sapiens
acagaggaauuggaaauaa

SEQ ID NO: 1113735 - RNA, 19 nt, Homo sapiens
cggaagagccaccugauuu

SEQ ID NO: 1113736 - RNA, 19 nt, Homo sapiens
ccacccaccuucccucauu

SEQ ID NO: 1113737 - RNA, 19 nt, Homo sapiens
gccauguucuaugaaauua

SEQ ID NO: 1113738 - RNA, 19 nt, Homo sapiens
gaguggagaaguaucaaua

SEQ ID NO: 1113739 - RNA, 19 nt, Homo sapiens
gaugccauguucuaugaaa

SEQ ID NO: 1113740 - RNA, 19 nt, Homo sapiens
guggagaaguaucaauauu

SEQ ID NO: 1113741 - RNA, 19 nt, Homo sapiens
ugacaacccaccaauguuu

SEQ ID NO: 1113742 - RNA, 19 nt, Homo sapiens
caacagaggaauuggaaau

SEQ ID NO: 1113743 - RNA, 19 nt, Homo sapiens
ugauaaugcuccuaauuuc

SEQ ID NO: 1113744 - RNA, 19 nt, Homo sapiens
gggaccaaaugaacagaaa

SEQ ID NO: 1113745 - RNA, 19 nt, Homo sapiens
gcucgaagcagguuuagga

SEQ ID NO: 1113746 - RNA, 19 nt, Homo sapiens
gcaauggcaacaagaagaa

SEQ ID NO: 1113747 - RNA, 19 nt, Homo sapiens
gacaaugcuccagaaauua

SEQ ID NO: 1113748 - RNA, 19 nt, Homo sapiens
gggauucaaugcucaagug

SEQ ID NO: 1113749 - RNA, 19 nt, Homo sapiens
cguacugacuucuccuaua

SEQ ID NO: 1113750 - RNA, 19 nt, Homo sapiens
gacaaagcuugacacauca

SEQ ID NO: 1113751 - RNA, 19 nt, Homo sapiens
cagcugaacuccuccaucu

SEQ ID NO: 1113752 - RNA, 19 nt, Homo sapiens
agaucaauauuaccgcuua

SEQ ID NO: 1113753 - RNA, 19 nt, Homo sapiens
gaagagggcaccguuggaa

SEQ ID NO: 1113754 - RNA, 19 nt, Homo sapiens
ucaaugcucaagugucuua

SEQ ID NO: 1113755 - RNA, 19 nt, Homo sapiens
uuaacucccugcagaacua

SEQ ID NO: 1113756 - RNA, 19 nt, Homo sapiens
gacaacauccuccagauuc

SEQ ID NO: 1113757 - RNA, 19 nt, Homo sapiens
gccauagccugguuaaagu

SEQ ID NO: 1113758 - RNA, 19 nt, Homo sapiens
agaaacaagugcccaguca

SEQ ID NO: 1113759 - RNA, 19 nt, Homo sapiens
gaagaagucgggcaagaag

SEQ ID NO: 1113760 - RNA, 19 nt, Homo sapiens
gggcuuuccugcagaccua

SEQ ID NO: 1113761 - RNA, 19 nt, Homo sapiens
gacaacccaccaauguuua

SEQ ID NO: 1113762 - RNA, 19 nt, Homo sapiens
gguugaggauaaauugaaa

SEQ ID NO: 1113763 - RNA, 19 nt, Homo sapiens
gaaagucucagcccaggau

SEQ ID NO: 1113764 - RNA, 19 nt, Homo sapiens
ggaggaggcucuguauguc

SEQ ID NO: 1113765 - RNA, 19 nt, Homo sapiens
ggaccagucuucuguuuug

SEQ ID NO: 1113766 - RNA, 19 nt, Homo sapiens
uaacucaggauuuacuuga

SEQ ID NO: 1113767 - RNA, 19 nt, Homo sapiens
caauauuaccgcuuaguga

SEQ ID NO: 1113768 - RNA, 19 nt, Homo sapiens
ugacccagauguaggcauu

SEQ ID NO: 1113769 - RNA, 19 nt, Homo sapiens
ggaccgcgaacaaauauca

SEQ ID NO: 1113770 - RNA, 19 nt, Homo sapiens
ggacagagacgcgcucaag

SEQ ID NO: 1113771 - RNA, 19 nt, Homo sapiens
gggcaccguuggaagagaa

SEQ ID NO: 1113772 - RNA, 19 nt, Homo sapiens
ggacgcagcuuuucucucu

SEQ ID NO: 1113773 - RNA, 19 nt, Homo sapiens
gcaaaugacaacccaccaa

SEQ ID NO: 1113774 - RNA, 19 nt, Homo sapiens
ggacccuucccacuacaua

SEQ ID NO: 1113775 - RNA, 19 nt, Homo sapiens
cuacaagccuccuaguucu

SEQ ID NO: 1113776 - RNA, 19 nt, Homo sapiens
gaacuccuccaucuuccaa

SEQ ID NO: 1113777 - RNA, 19 nt, Homo sapiens
guguugaaguaccaaguaa

SEQ ID NO: 1113778 - RNA, 19 nt, Homo sapiens
caagcucagucccagaaga

SEQ ID NO: 1113779 - RNA, 19 nt, Homo sapiens
gaccugcccuuacaguagu

SEQ ID NO: 1113780 - RNA, 19 nt, Homo sapiens
ugaaguaccaaguaaccua

SEQ ID NO: 1113781 - RNA, 19 nt, Homo sapiens
gcugaacuccuccaucuuc

SEQ ID NO: 1113782 - RNA, 19 nt, Homo sapiens
gcacccaggccucagaguu

SEQ ID NO: 1113783 - RNA, 19 nt, Homo sapiens
caagaaggagaagaaguaa

SEQ ID NO: 1113784 - RNA, 19 nt, Homo sapiens
gcugagauccuucgacuac

SEQ ID NO: 1113785 - RNA, 19 nt, Homo sapiens
aggaugccauguucuauga

SEQ ID NO: 1113786 - RNA, 19 nt, Homo sapiens
ugauaguccuggaugcaaa

SEQ ID NO: 1113787 - RNA, 19 nt, Homo sapiens
ccuauaagcgcuucucuuc

SEQ ID NO: 1113788 - RNA, 19 nt, Homo sapiens
ggccauagccugguuaaag

SEQ ID NO: 1113789 - RNA, 19 nt, Homo sapiens
ggagaagaaguaacaugga

SEQ ID NO: 1113790 - RNA, 19 nt, Homo sapiens
gagcccugcuggacagaga

SEQ ID NO: 1113791 - RNA, 19 nt, Homo sapiens
cgacuacgagcaauuuaga

SEQ ID NO: 1113792 - RNA, 19 nt, Homo sapiens
guagugcggugugcuuuua

SEQ ID NO: 1113793 - RNA, 19 nt, Homo sapiens
caacaaccaguuugacaca

SEQ ID NO: 1113794 - RNA, 19 nt, Homo sapiens
acucaggauuuacuugaaa

SEQ ID NO: 1113795 - RNA, 19 nt, Homo sapiens
ggacccagauagcaacaac

SEQ ID NO: 1113796 - RNA, 19 nt, Homo sapiens
gaaugggcagguugaaguu

SEQ ID NO: 1113797 - RNA, 19 nt, Homo sapiens
cgacgugcaugaccgagau

SEQ ID NO: 1113798 - RNA, 19 nt, Homo sapiens
acaaucacgucucucacaa

SEQ ID NO: 1113799 - RNA, 19 nt, Homo sapiens
gggcauggacaaagcuuga

SEQ ID NO: 1113800 - RNA, 19 nt, Homo sapiens
ugucugaggagcuagauaa

SEQ ID NO: 1113801 - RNA, 19 nt, Homo sapiens
caggagagcugugagaaaa

SEQ ID NO: 1113802 - RNA, 19 nt, Homo sapiens
auucggaccucacucugua

SEQ ID NO: 1113803 - RNA, 19 nt, Homo sapiens
caaaugacaacccaccaau

SEQ ID NO: 1113804 - RNA, 19 nt, Homo sapiens
gagcuaacaggaccaaugg

SEQ ID NO: 1113805 - RNA, 19 nt, Homo sapiens
gccauaaaccaauaacuag

SEQ ID NO: 1113806 - RNA, 19 nt, Homo sapiens
ugacaacauccuccagauu

SEQ ID NO: 1113807 - RNA, 19 nt, Homo sapiens
gguguugaaguaccaagua

SEQ ID NO: 1113808 - RNA, 19 nt, Homo sapiens
agaaggagaagaaguaaca

SEQ ID NO: 1113809 - RNA, 19 nt, Homo sapiens
aagaagaagucgggcaaga

SEQ ID NO: 1113810 - RNA, 19 nt, Homo sapiens
gcaccuggcccaacaacca

SEQ ID NO: 1113811 - RNA, 19 nt, Homo sapiens
gagccuccaucuucucagu

SEQ ID NO: 1113812 - RNA, 19 nt, Homo sapiens
gcagccgucuguccuugau

SEQ ID NO: 1113813 - RNA, 19 nt, Homo sapiens
gcuggacccuucccacuac

SEQ ID NO: 1113814 - RNA, 19 nt, Homo sapiens
gaaaggagauuccaaccua

SEQ ID NO: 1113815 - RNA, 19 nt, Homo sapiens
gaacaaauaugagaaugug

SEQ ID NO: 1113816 - RNA, 19 nt, Homo sapiens
ugacaaugcuccagaaauu

SEQ ID NO: 1113817 - RNA, 19 nt, Homo sapiens
gcgaacaaauaucagaaua

SEQ ID NO: 1113818 - RNA, 19 nt, Homo sapiens
gcucaagugucuuauauuc

SEQ ID NO: 1113819 - RNA, 19 nt, Homo sapiens
gaacccgauuuccaauuaa

SEQ ID NO: 1113820 - RNA, 19 nt, Homo sapiens
cugcagaacuacaagcuua

SEQ ID NO: 1113821 - RNA, 19 nt, Homo sapiens
gaaugacaaugcuccagaa

SEQ ID NO: 1113822 - RNA, 19 nt, Homo sapiens
gaaacaggauccggucaga

SEQ ID NO: 1113823 - RNA, 19 nt, Homo sapiens
cagaggaauuggaaauaaa

SEQ ID NO: 1113824 - RNA, 19 nt, Homo sapiens
aagcgagccucuucugaua

SEQ ID NO: 1113825 - RNA, 19 nt, Homo sapiens
cgagcaauuuagagacuua

SEQ ID NO: 1113826 - RNA, 19 nt, Homo sapiens
acagaggaauuggaaauaa

SEQ ID NO: 1113827 - RNA, 19 nt, Homo sapiens
cggaagagccaccugauuu

SEQ ID NO: 1113828 - RNA, 19 nt, Homo sapiens
ccacccaccuucccucauu

SEQ ID NO: 1113829 - RNA, 19 nt, Homo sapiens
gccauguucuaugaaauua

SEQ ID NO: 1113830 - RNA, 19 nt, Homo sapiens
gaguggagaaguaucaaua

SEQ ID NO: 1113831 - RNA, 19 nt, Homo sapiens
gaugccauguucuaugaaa

SEQ ID NO: 1113832 - RNA, 19 nt, Homo sapiens
guggagaaguaucaauauu

SEQ ID NO: 1113833 - RNA, 19 nt, Homo sapiens
ugacaacccaccaauguuu

SEQ ID NO: 1113834 - RNA, 19 nt, Homo sapiens
caacagaggaauuggaaau

SEQ ID NO: 1113835 - RNA, 19 nt, Homo sapiens
ugauaaugcuccuaauuuc

SEQ ID NO: 1113836 - RNA, 19 nt, Homo sapiens
gacaaugcuccagaaauua

SEQ ID NO: 1113837 - RNA, 19 nt, Homo sapiens
gggauucaaugcucaagug

SEQ ID NO: 1113838 - RNA, 19 nt, Homo sapiens
agaucaauauuaccgcuua

SEQ ID NO: 1113839 - RNA, 19 nt, Homo sapiens
gaagagggcaccguuggaa

SEQ ID NO: 1113840 - RNA, 19 nt, Homo sapiens
ucaaugcucaagugucuua

SEQ ID NO: 1113841 - RNA, 19 nt, Homo sapiens
uuaacucccugcagaacua

SEQ ID NO: 1113842 - RNA, 19 nt, Homo sapiens
gggcuuuccugcagaccua

SEQ ID NO: 1113843 - RNA, 19 nt, Homo sapiens
gacaacccaccaauguuua

SEQ ID NO: 1113844 - RNA, 19 nt, Homo sapiens
gguugaggauaaauugaaa

SEQ ID NO: 1113845 - RNA, 19 nt, Homo sapiens
uaacucaggauuuacuuga

SEQ ID NO: 1113846 - RNA, 19 nt, Homo sapiens
caauauuaccgcuuaguga

SEQ ID NO: 1113847 - RNA, 19 nt, Homo sapiens
ugacccagauguaggcauu

SEQ ID NO: 1113848 - RNA, 19 nt, Homo sapiens
ggaccgcgaacaaauauca

SEQ ID NO: 1113849 - RNA, 19 nt, Homo sapiens
ggacagagacgcgcucaag

SEQ ID NO: 1113850 - RNA, 19 nt, Homo sapiens
gggcaccguuggaagagaa

SEQ ID NO: 1113851 - RNA, 19 nt, Homo sapiens
gcaaaugacaacccaccaa

SEQ ID NO: 1113852 - RNA, 19 nt, Homo sapiens
ggacgcagcuuuucucucu

SEQ ID NO: 1113853 - RNA, 19 nt, Homo sapiens
caagcucagucccagaaga

SEQ ID NO: 1113854 - RNA, 19 nt, Homo sapiens
gcugagauccuucgacuac

SEQ ID NO: 1113855 - RNA, 19 nt, Homo sapiens
aggaugccauguucuauga

SEQ ID NO: 1113856 - RNA, 19 nt, Homo sapiens
ugauaguccuggaugcaaa

SEQ ID NO: 1113857 - RNA, 19 nt, Homo sapiens
gagcccugcuggacagaga

SEQ ID NO: 1113858 - RNA, 19 nt, Homo sapiens
cgacuacgagcaauuuaga

SEQ ID NO: 1113859 - RNA, 19 nt, Homo sapiens
acucaggauuuacuugaaa

SEQ ID NO: 1113860 - RNA, 19 nt, Homo sapiens
ggacccagauagcaacaac

SEQ ID NO: 1113861 - RNA, 19 nt, Homo sapiens
gaaugggcagguugaaguu

SEQ ID NO: 1113862 - RNA, 19 nt, Homo sapiens
cgacgugcaugaccgagau

SEQ ID NO: 1113863 - RNA, 19 nt, Homo sapiens
acaaucacgucucucacaa

SEQ ID NO: 1113864 - RNA, 19 nt, Homo sapiens
cuucaggugaguuuauuua

SEQ ID NO: 1113865 - RNA, 19 nt, Homo sapiens
caggagagcugugagaaaa

SEQ ID NO: 1113866 - RNA, 19 nt, Homo sapiens
auucggaccucacucugua

SEQ ID NO: 1113867 - RNA, 19 nt, Homo sapiens
ugucugaggagcuagauaa

SEQ ID NO: 1113868 - RNA, 19 nt, Homo sapiens
caaaugacaacccaccaau

SEQ ID NO: 1113869 - RNA, 19 nt, Homo sapiens
gagccuccaucuucucagu

SEQ ID NO: 1113870 - RNA, 19 nt, Homo sapiens
gaggaugccauguucuaug

SEQ ID NO: 1113871 - RNA, 19 nt, Homo sapiens
cugaggagcuagauaaagg

SEQ ID NO: 1113872 - RNA, 19 nt, Homo sapiens
uaaaaugccugggaaaauc

SEQ ID NO: 1113873 - RNA, 19 nt, Homo sapiens
ggaagagccaccugauuuu

SEQ ID NO: 1113874 - RNA, 19 nt, Homo sapiens
uguccacucuggcaacuug

SEQ ID NO: 1113875 - RNA, 19 nt, Homo sapiens
gcauuaacucccugcagaa

SEQ ID NO: 1113876 - RNA, 19 nt, Homo sapiens
cgcaucgucuccagaggua

SEQ ID NO: 1113877 - RNA, 19 nt, Homo sapiens
gcggaagagccaccugauu

SEQ ID NO: 1113878 - RNA, 19 nt, Homo sapiens
ugagauccuucgacuacga

SEQ ID NO: 1113879 - RNA, 19 nt, Homo sapiens
cuccaacacuggcguccua

SEQ ID NO: 1113880 - RNA, 19 nt, Homo sapiens
gaucaauauuaccgcuuag

SEQ ID NO: 1113881 - RNA, 19 nt, Homo sapiens
caaauaugagaaugugguu

SEQ ID NO: 1113882 - RNA, 19 nt, Homo sapiens
gcgagccucuucugauaac

SEQ ID NO: 1113883 - RNA, 19 nt, Homo sapiens
ccaggagagcugugagaaa

SEQ ID NO: 1113884 - RNA, 19 nt, Homo sapiens
caacacuggcguccuauac

SEQ ID NO: 1113885 - RNA, 19 nt, Homo sapiens
ggucaccgcggagaggaua

SEQ ID NO: 1113886 - RNA, 19 nt, Homo sapiens
ggagauuccaaccuacuuc

SEQ ID NO: 1113887 - RNA, 19 nt, Homo sapiens
gaaaugaaaggagauucca

SEQ ID NO: 1113888 - RNA, 19 nt, Homo sapiens
acauucugguugaggauaa

SEQ ID NO: 1113889 - RNA, 19 nt, Homo sapiens
aaucugccauuuaaguuag

SEQ ID NO: 1113890 - RNA, 19 nt, Homo sapiens
uuaugaggaugccauguuc

SEQ ID NO: 1113891 - RNA, 19 nt, Homo sapiens
augcucaagugucuuauau

SEQ ID NO: 1113892 - RNA, 19 nt, Homo sapiens
gccuccaucuucucaguga

SEQ ID NO: 1113893 - RNA, 19 nt, Homo sapiens
ccuggaccgcgaacaaaua

SEQ ID NO: 1113894 - RNA, 19 nt, Homo sapiens
gagaaauugcucuuaucga

SEQ ID NO: 1113895 - RNA, 19 nt, Homo sapiens
caagugucuuauauucuag

SEQ ID NO: 1113896 - RNA, 19 nt, Homo sapiens
aaugacaacccaccaaugu

SEQ ID NO: 1113897 - RNA, 19 nt, Homo sapiens
agagguaggacgcagcuuu

SEQ ID NO: 1113898 - RNA, 19 nt, Homo sapiens
aaauuacaaucacgucucu

SEQ ID NO: 1113899 - RNA, 19 nt, Homo sapiens
ggaugugaaugacaaugcu

SEQ ID NO: 1113900 - RNA, 19 nt, Homo sapiens
gcacauccaagugauaguc

SEQ ID NO: 1113901 - RNA, 19 nt, Homo sapiens
gagaaaagcgagccucuuc

SEQ ID NO: 1113902 - RNA, 19 nt, Homo sapiens
gauaaaaugccugggaaaa

SEQ ID NO: 1113903 - RNA, 19 nt, Homo sapiens
aacccgauuuccaauuaaa

SEQ ID NO: 1113904 - RNA, 19 nt, Homo sapiens
gagauuccaaccuacuuca

SEQ ID NO: 1113905 - RNA, 19 nt, Homo sapiens
gauaacucaggauuuacuu

SEQ ID NO: 1113906 - RNA, 19 nt, Homo sapiens
uauacgcgcugagauccuu

SEQ ID NO: 1113907 - RNA, 19 nt, Homo sapiens
caccuucccucauuuaucc

SEQ ID NO: 1113908 - RNA, 19 nt, Homo sapiens
cagccugaguaccguguga

SEQ ID NO: 1113909 - RNA, 19 nt, Homo sapiens
aaagcgagccucuucugau

SEQ ID NO: 1113910 - RNA, 19 nt, Homo sapiens
gcuccuaauuucccaacag

SEQ ID NO: 1113911 - RNA, 19 nt, Homo sapiens
cacccaccuucccucauuu

SEQ ID NO: 1113912 - RNA, 19 nt, Homo sapiens
gaggagcuagauaaagguu

SEQ ID NO: 1113913 - RNA, 19 nt, Homo sapiens
gaguaccgugugaguguuu

SEQ ID NO: 1113914 - RNA, 19 nt, Homo sapiens
ggacaaagcuugacacauc

SEQ ID NO: 1113915 - RNA, 19 nt, Homo sapiens
gcacugcgcuccuuugauu

SEQ ID NO: 1113916 - RNA, 19 nt, Homo sapiens
guacugacuucuccuauaa

SEQ ID NO: 1113917 - RNA, 19 nt, Homo sapiens
gcaagaaggagaagaagua

SEQ ID NO: 1113918 - RNA, 19 nt, Homo sapiens
ccaaagaaauucagucgaa

SEQ ID NO: 1113919 - RNA, 19 nt, Homo sapiens
ggauuaaacuggcauuuca

SEQ ID NO: 1113920 - RNA, 19 nt, Homo sapiens
uaacaggaccaauggauua

SEQ ID NO: 1113921 - RNA, 19 nt, Homo sapiens
caacgacaaugcucaugua

SEQ ID NO: 1113922 - RNA, 19 nt, Homo sapiens
caagaucaaugcucaaguu

SEQ ID NO: 1113923 - RNA, 19 nt, Homo sapiens
cuacuacgcucaaguggua

SEQ ID NO: 1113924 - RNA, 19 nt, Homo sapiens
cgacagaggcuccuucgua

SEQ ID NO: 1113925 - RNA, 19 nt, Homo sapiens
gaugcuacauuccaugaaa

SEQ ID NO: 1113926 - RNA, 19 nt, Homo sapiens
ggagaacugacaaucauaa

SEQ ID NO: 1113927 - RNA, 19 nt, Homo sapiens
uagaggaacuggagcuaaa

SEQ ID NO: 1113928 - RNA, 19 nt, Homo sapiens
cgacaaugcucauguaacu

SEQ ID NO: 1113929 - RNA, 19 nt, Homo sapiens
gcauaagcauuccggagaa

SEQ ID NO: 1113930 - RNA, 19 nt, Homo sapiens
gaacaaguacccagaacug

SEQ ID NO: 1113931 - RNA, 19 nt, Homo sapiens
gagcugaugggaacaagua

SEQ ID NO: 1113932 - RNA, 19 nt, Homo sapiens
gagcuuaagucaacaucug

SEQ ID NO: 1113933 - RNA, 19 nt, Homo sapiens
ggaaauggcggcucugcaa

SEQ ID NO: 1113934 - RNA, 19 nt, Homo sapiens
gaagcucgaagcagguuua

SEQ ID NO: 1113935 - RNA, 19 nt, Homo sapiens
gaucaaugcucaaguuuug

SEQ ID NO: 1113936 - RNA, 19 nt, Homo sapiens
acaaugcucauguaacuua

SEQ ID NO: 1113937 - RNA, 19 nt, Homo sapiens
ucagagguauuugagcuua

SEQ ID NO: 1113938 - RNA, 19 nt, Homo sapiens
cacccugucuguugaauuu

SEQ ID NO: 1113939 - RNA, 19 nt, Homo sapiens
uagaauagccaguagugua

SEQ ID NO: 1113940 - RNA, 19 nt, Homo sapiens
agaaagagaagaaacguuu

SEQ ID NO: 1113941 - RNA, 19 nt, Homo sapiens
cggaagagccaccugauuu

SEQ ID NO: 1113942 - RNA, 19 nt, Homo sapiens
gaacgacaaugcgccuguu

SEQ ID NO: 1113943 - RNA, 19 nt, Homo sapiens
caacccaaaugaccacuuc

SEQ ID NO: 1113944 - RNA, 19 nt, Homo sapiens
gggaccaaaugaacagaaa

SEQ ID NO: 1113945 - RNA, 19 nt, Homo sapiens
gcucgaagcagguuuagga

SEQ ID NO: 1113946 - RNA, 19 nt, Homo sapiens
gcaauggcaacaagaagaa

SEQ ID NO: 1113947 - RNA, 19 nt, Homo sapiens
gaagaagaaagagaagaaa

SEQ ID NO: 1113948 - RNA, 19 nt, Homo sapiens
gggcacccuuauccucuua

SEQ ID NO: 1113949 - RNA, 19 nt, Homo sapiens
cguacugacuucuccuaua

SEQ ID NO: 1113950 - RNA, 19 nt, Homo sapiens
gacaaagcuugacacauca

SEQ ID NO: 1113951 - RNA, 19 nt, Homo sapiens
cagcugaacuccuccaucu

SEQ ID NO: 1113952 - RNA, 19 nt, Homo sapiens
gacaacauccuccagauuc

SEQ ID NO: 1113953 - RNA, 19 nt, Homo sapiens
gagcgcacccugucuguug

SEQ ID NO: 1113954 - RNA, 19 nt, Homo sapiens
gccauagccugguuaaagu

SEQ ID NO: 1113955 - RNA, 19 nt, Homo sapiens
agaaacaagugcccaguca

SEQ ID NO: 1113956 - RNA, 19 nt, Homo sapiens
gaagaagucgggcaagaag

SEQ ID NO: 1113957 - RNA, 19 nt, Homo sapiens
cgaagaagaaagagaagaa

SEQ ID NO: 1113958 - RNA, 19 nt, Homo sapiens
gggcuuuccugcagaccua

SEQ ID NO: 1113959 - RNA, 19 nt, Homo sapiens
acgcucaagugguauauuu

SEQ ID NO: 1113960 - RNA, 19 nt, Homo sapiens
gaaauggcggcucugcaaa

SEQ ID NO: 1113961 - RNA, 19 nt, Homo sapiens
gaaagucucagcccaggau

SEQ ID NO: 1113962 - RNA, 19 nt, Homo sapiens
ggaggaggcucuguauguc

SEQ ID NO: 1113963 - RNA, 19 nt, Homo sapiens
augcagagcucgcacuuug

SEQ ID NO: 1113964 - RNA, 19 nt, Homo sapiens
ggaccagucuucuguuuug

SEQ ID NO: 1113965 - RNA, 19 nt, Homo sapiens
ggauuccggauuccucuua

SEQ ID NO: 1113966 - RNA, 19 nt, Homo sapiens
gagguggaaauaacagaua

SEQ ID NO: 1113967 - RNA, 19 nt, Homo sapiens
gaaguugacucggagaaaa

SEQ ID NO: 1113968 - RNA, 19 nt, Homo sapiens
ccucuuacaucucuaucaa

SEQ ID NO: 1113969 - RNA, 19 nt, Homo sapiens
ggacagagacgcgcucaag

SEQ ID NO: 1113970 - RNA, 19 nt, Homo sapiens
ggacccuucccacuacaua

SEQ ID NO: 1113971 - RNA, 19 nt, Homo sapiens
cuacaagccuccuaguucu

SEQ ID NO: 1113972 - RNA, 19 nt, Homo sapiens
gaacuccuccaucuuccaa

SEQ ID NO: 1113973 - RNA, 19 nt, Homo sapiens
ggaucuuccuuuuaaguua

SEQ ID NO: 1113974 - RNA, 19 nt, Homo sapiens
guguugaaguaccaaguaa

SEQ ID NO: 1113975 - RNA, 19 nt, Homo sapiens
gucaacaucuggagaacug

SEQ ID NO: 1113976 - RNA, 19 nt, Homo sapiens
gaaugcugguuaucucaca

SEQ ID NO: 1113977 - RNA, 19 nt, Homo sapiens
gcacauccuacuccaccua

SEQ ID NO: 1113978 - RNA, 19 nt, Homo sapiens
uggcagacaucaacgacaa

SEQ ID NO: 1113979 - RNA, 19 nt, Homo sapiens
gagaaaagcccuggagaaa

SEQ ID NO: 1113980 - RNA, 19 nt, Homo sapiens
gaccugcccuuacaguagu

SEQ ID NO: 1113981 - RNA, 19 nt, Homo sapiens
ggaaguugacucggagaaa

SEQ ID NO: 1113982 - RNA, 19 nt, Homo sapiens
ugaaguaccaaguaaccua

SEQ ID NO: 1113983 - RNA, 19 nt, Homo sapiens
gcugaacuccuccaucuuc

SEQ ID NO: 1113984 - RNA, 19 nt, Homo sapiens
gcacccaggccucagaguu

SEQ ID NO: 1113985 - RNA, 19 nt, Homo sapiens
caagaaggagaagaaguaa

SEQ ID NO: 1113986 - RNA, 19 nt, Homo sapiens
gcagagcucgcacuuugug

SEQ ID NO: 1113987 - RNA, 19 nt, Homo sapiens
guccacggaugcucacauu

SEQ ID NO: 1113988 - RNA, 19 nt, Homo sapiens
gagaacugacaaucauaaa

SEQ ID NO: 1113989 - RNA, 19 nt, Homo sapiens
ggugagaacgcccuucaga

SEQ ID NO: 1113990 - RNA, 19 nt, Homo sapiens
gauuccggauuccucuuaa

SEQ ID NO: 1113991 - RNA, 19 nt, Homo sapiens
ccuauaagcgcuucucuuc

SEQ ID NO: 1113992 - RNA, 19 nt, Homo sapiens
ggccauagccugguuaaag

SEQ ID NO: 1113993 - RNA, 19 nt, Homo sapiens
ggagaagaaguaacaugga

SEQ ID NO: 1113994 - RNA, 19 nt, Homo sapiens
gagcccugcuggacagaga

SEQ ID NO: 1113995 - RNA, 19 nt, Homo sapiens
uacaugacaucugcuacua

SEQ ID NO: 1113996 - RNA, 19 nt, Homo sapiens
ucaggacaccaaagaaauu

SEQ ID NO: 1113997 - RNA, 19 nt, Homo sapiens
guagugcggugugcuuuua

SEQ ID NO: 1113998 - RNA, 19 nt, Homo sapiens
caacaaccaguuugacaca

SEQ ID NO: 1113999 - RNA, 19 nt, Homo sapiens
gcaacgacaaugcucaugu

SEQ ID NO: 1114000 - RNA, 19 nt, Homo sapiens
cuacauuccaugaaauuga

SEQ ID NO: 1114001 - RNA, 19 nt, Homo sapiens
caguagagguggaaauaac

SEQ ID NO: 1114002 - RNA, 19 nt, Homo sapiens
acauucugcuggaggauaa

SEQ ID NO: 1114003 - RNA, 19 nt, Homo sapiens
gggcauggacaaagcuuga

SEQ ID NO: 1114004 - RNA, 19 nt, Homo sapiens
caggagagcugugagaaaa

SEQ ID NO: 1114005 - RNA, 19 nt, Homo sapiens
auucggaccucacucugua

SEQ ID NO: 1114006 - RNA, 19 nt, Homo sapiens
uaagucaacaucuggagaa

SEQ ID NO: 1114007 - RNA, 19 nt, Homo sapiens
gaaaagcccuggagaaacc

SEQ ID NO: 1114008 - RNA, 19 nt, Homo sapiens
gagcuaacaggaccaaugg

SEQ ID NO: 1114009 - RNA, 19 nt, Homo sapiens
gccauaaaccaauaacuag

SEQ ID NO: 1114010 - RNA, 19 nt, Homo sapiens
ugacaacauccuccagauu

SEQ ID NO: 1114011 - RNA, 19 nt, Homo sapiens
gguguugaaguaccaagua

SEQ ID NO: 1114012 - RNA, 19 nt, Homo sapiens
agaaggagaagaaguaaca

SEQ ID NO: 1114013 - RNA, 19 nt, Homo sapiens
aagaagaagucgggcaaga

SEQ ID NO: 1114014 - RNA, 19 nt, Homo sapiens
gcacugcgcuccuuugauu

SEQ ID NO: 1114015 - RNA, 19 nt, Homo sapiens
ccaaagaaauucagucgaa

SEQ ID NO: 1114016 - RNA, 19 nt, Homo sapiens
caacgacaaugcucaugua

SEQ ID NO: 1114017 - RNA, 19 nt, Homo sapiens
cuacuacgcucaaguggua

SEQ ID NO: 1114018 - RNA, 19 nt, Homo sapiens
cgacagaggcuccuucgua

SEQ ID NO: 1114019 - RNA, 19 nt, Homo sapiens
gaugcuacauuccaugaaa

SEQ ID NO: 1114020 - RNA, 19 nt, Homo sapiens
ggagaacugacaaucauaa

SEQ ID NO: 1114021 - RNA, 19 nt, Homo sapiens
uagaggaacuggagcuaaa

SEQ ID NO: 1114022 - RNA, 19 nt, Homo sapiens
cgacaaugcucauguaacu

SEQ ID NO: 1114023 - RNA, 19 nt, Homo sapiens
gcauaagcauuccggagaa

SEQ ID NO: 1114024 - RNA, 19 nt, Homo sapiens
gaacaaguacccagaacug

SEQ ID NO: 1114025 - RNA, 19 nt, Homo sapiens
gagcugaugggaacaagua

SEQ ID NO: 1114026 - RNA, 19 nt, Homo sapiens
gagcuuaagucaacaucug

SEQ ID NO: 1114027 - RNA, 19 nt, Homo sapiens
ggaaauggcggcucugcaa

SEQ ID NO: 1114028 - RNA, 19 nt, Homo sapiens
acaaugcucauguaacuua

SEQ ID NO: 1114029 - RNA, 19 nt, Homo sapiens
ucagagguauuugagcuua

SEQ ID NO: 1114030 - RNA, 19 nt, Homo sapiens
cacccugucuguugaauuu

SEQ ID NO: 1114031 - RNA, 19 nt, Homo sapiens
agaaagagaagaaacguuu

SEQ ID NO: 1114032 - RNA, 19 nt, Homo sapiens
cggaagagccaccugauuu

SEQ ID NO: 1114033 - RNA, 19 nt, Homo sapiens
gaacgacaaugcgccuguu

SEQ ID NO: 1114034 - RNA, 19 nt, Homo sapiens
caacccaaaugaccacuuc

SEQ ID NO: 1114035 - RNA, 19 nt, Homo sapiens
uagcuaguuugcugaagua

SEQ ID NO: 1114036 - RNA, 19 nt, Homo sapiens
gaagaagaaagagaagaaa

SEQ ID NO: 1114037 - RNA, 19 nt, Homo sapiens
gggcacccuuauccucuua

SEQ ID NO: 1114038 - RNA, 19 nt, Homo sapiens
gagcgcacccugucuguug

SEQ ID NO: 1114039 - RNA, 19 nt, Homo sapiens
cgaagaagaaagagaagaa

SEQ ID NO: 1114040 - RNA, 19 nt, Homo sapiens
gggcuuuccugcagaccua

SEQ ID NO: 1114041 - RNA, 19 nt, Homo sapiens
acgcucaagugguauauuu

SEQ ID NO: 1114042 - RNA, 19 nt, Homo sapiens
gaaauggcggcucugcaaa

SEQ ID NO: 1114043 - RNA, 19 nt, Homo sapiens
augcagagcucgcacuuug

SEQ ID NO: 1114044 - RNA, 19 nt, Homo sapiens
ggauuccggauuccucuua

SEQ ID NO: 1114045 - RNA, 19 nt, Homo sapiens
gagguggaaauaacagaua

SEQ ID NO: 1114046 - RNA, 19 nt, Homo sapiens
gaaguugacucggagaaaa

SEQ ID NO: 1114047 - RNA, 19 nt, Homo sapiens
ccucuuacaucucuaucaa

SEQ ID NO: 1114048 - RNA, 19 nt, Homo sapiens
ggacagagacgcgcucaag

SEQ ID NO: 1114049 - RNA, 19 nt, Homo sapiens
ggaucuuccuuuuaaguua

SEQ ID NO: 1114050 - RNA, 19 nt, Homo sapiens
gucaacaucuggagaacug

SEQ ID NO: 1114051 - RNA, 19 nt, Homo sapiens
gcacauccuacuccaccua

SEQ ID NO: 1114052 - RNA, 19 nt, Homo sapiens
uggcagacaucaacgacaa

SEQ ID NO: 1114053 - RNA, 19 nt, Homo sapiens
gaaugcugguuaucucaca

SEQ ID NO: 1114054 - RNA, 19 nt, Homo sapiens
gagaaaagcccuggagaaa

SEQ ID NO: 1114055 - RNA, 19 nt, Homo sapiens
gcagagcucgcacuuugug

SEQ ID NO: 1114056 - RNA, 19 nt, Homo sapiens
guccacggaugcucacauu

SEQ ID NO: 1114057 - RNA, 19 nt, Homo sapiens
gagaacugacaaucauaaa

SEQ ID NO: 1114058 - RNA, 19 nt, Homo sapiens
ggugagaacgcccuucaga

SEQ ID NO: 1114059 - RNA, 19 nt, Homo sapiens
gauuccggauuccucuuaa

SEQ ID NO: 1114060 - RNA, 19 nt, Homo sapiens
ggaaguugacucggagaaa

SEQ ID NO: 1114061 - RNA, 19 nt, Homo sapiens
gagcccugcuggacagaga

SEQ ID NO: 1114062 - RNA, 19 nt, Homo sapiens
uacaugacaucugcuacua

SEQ ID NO: 1114063 - RNA, 19 nt, Homo sapiens
ucaggacaccaaagaaauu

SEQ ID NO: 1114064 - RNA, 19 nt, Homo sapiens
gcaacgacaaugcucaugu

SEQ ID NO: 1114065 - RNA, 19 nt, Homo sapiens
cuacauuccaugaaauuga

SEQ ID NO: 1114066 - RNA, 19 nt, Homo sapiens
caguagagguggaaauaac

SEQ ID NO: 1114067 - RNA, 19 nt, Homo sapiens
acauucugcuggaggauaa

SEQ ID NO: 1114068 - RNA, 19 nt, Homo sapiens
caggagagcugugagaaaa

SEQ ID NO: 1114069 - RNA, 19 nt, Homo sapiens
auucggaccucacucugua

SEQ ID NO: 1114070 - RNA, 19 nt, Homo sapiens
uaagucaacaucuggagaa

SEQ ID NO: 1114071 - RNA, 19 nt, Homo sapiens
gaaaagcccuggagaaacc

SEQ ID NO: 1114072 - RNA, 19 nt, Homo sapiens
gagccucugucuucucagu

SEQ ID NO: 1114073 - RNA, 19 nt, Homo sapiens
ugacaaugccccagaauuu

SEQ ID NO: 1114074 - RNA, 19 nt, Homo sapiens
cagagguauuugagcuuaa

SEQ ID NO: 1114075 - RNA, 19 nt, Homo sapiens
gccucaaucucuacucgaa

SEQ ID NO: 1114076 - RNA, 19 nt, Homo sapiens
gcuauucugugcgggaaga

SEQ ID NO: 1114077 - RNA, 19 nt, Homo sapiens
gaagaaagagaagaaacgu

SEQ ID NO: 1114078 - RNA, 19 nt, Homo sapiens
uaucagcgccucaaucucu

SEQ ID NO: 1114079 - RNA, 19 nt, Homo sapiens
ggaagagccaccugauuuu

SEQ ID NO: 1114080 - RNA, 19 nt, Homo sapiens
ucuaaccgcuaaagaugga

SEQ ID NO: 1114081 - RNA, 19 nt, Homo sapiens
gaacaguuuuccuuuuaca

SEQ ID NO: 1114082 - RNA, 19 nt, Homo sapiens
gaacugacaaucauaaaag

SEQ ID NO: 1114083 - RNA, 19 nt, Homo sapiens
guccugcugugcuuccuuu

SEQ ID NO: 1114084 - RNA, 19 nt, Homo sapiens
cagaacgccuggcugucuu

SEQ ID NO: 1114085 - RNA, 19 nt, Homo sapiens
uuaugaggaugcuacauuc

SEQ ID NO: 1114086 - RNA, 19 nt, Homo sapiens
guagaggaacuggagcuaa

SEQ ID NO: 1114087 - RNA, 19 nt, Homo sapiens
gcggaagagccaccugauu

SEQ ID NO: 1114088 - RNA, 19 nt, Homo sapiens
ccacucaguagcaauguau

SEQ ID NO: 1114089 - RNA, 19 nt, Homo sapiens
cgcaucgucuccagaggua

SEQ ID NO: 1114090 - RNA, 19 nt, Homo sapiens
ucucagguaaucuaucuuu

SEQ ID NO: 1114091 - RNA, 19 nt, Homo sapiens
ccaggagagcugugagaaa

SEQ ID NO: 1114092 - RNA, 19 nt, Homo sapiens
gguggagguuuggcccuaa

SEQ ID NO: 1114093 - RNA, 19 nt, Homo sapiens
ccaccuacauucccgaaaa

SEQ ID NO: 1114094 - RNA, 19 nt, Homo sapiens
agaucuagauuaugaggau

SEQ ID NO: 1114095 - RNA, 19 nt, Homo sapiens
cuggagaacugacaaucau

SEQ ID NO: 1114096 - RNA, 19 nt, Homo sapiens
gaccgccacugacgcagau

SEQ ID NO: 1114097 - RNA, 19 nt, Homo sapiens
gaguaccgcauaagcauuc

SEQ ID NO: 1114098 - RNA, 19 nt, Homo sapiens
gguaaucuaucuuuucaca

SEQ ID NO: 1114099 - RNA, 19 nt, Homo sapiens
gaaugacaaugccccagaa

SEQ ID NO: 1114100 - RNA, 19 nt, Homo sapiens
gccucugucuucucaguga

SEQ ID NO: 1114101 - RNA, 19 nt, Homo sapiens
gggaacaaguacccagaac

SEQ ID NO: 1114102 - RNA, 19 nt, Homo sapiens
gugagaacgcccuucagaa

SEQ ID NO: 1114103 - RNA, 19 nt, Homo sapiens
ucccagcucuuugcucuga

SEQ ID NO: 1114104 - RNA, 19 nt, Homo sapiens
cuagcuaguuugcugaagu

SEQ ID NO: 1114105 - RNA, 19 nt, Homo sapiens
uuucacaacauacguacua

SEQ ID NO: 1114106 - RNA, 19 nt, Homo sapiens
cucaaucucuacucgaaga

SEQ ID NO: 1114107 - RNA, 19 nt, Homo sapiens
cgggaacccuccacucagu

SEQ ID NO: 1114108 - RNA, 19 nt, Homo sapiens
gcacccuuauccucuuaca

SEQ ID NO: 1114109 - RNA, 19 nt, Homo sapiens
caauuacuaccgacugguu

SEQ ID NO: 1114110 - RNA, 19 nt, Homo sapiens
guggagguuuggcccuaaa

SEQ ID NO: 1114111 - RNA, 19 nt, Homo sapiens
ggucacugcgaacaggaua

SEQ ID NO: 1114112 - RNA, 19 nt, Homo sapiens
aaucucuacucgaagaaga

SEQ ID NO: 1114113 - RNA, 19 nt, Homo sapiens
ccacggaugcucacauuuu

SEQ ID NO: 1114114 - RNA, 19 nt, Homo sapiens
ggacaaagcuugacacauc

SEQ ID NO: 1114115 - RNA, 19 nt, Homo sapiens
guacugacuucuccuauaa

SEQ ID NO: 1114116 - RNA, 19 nt, Homo sapiens
gcaagaaggagaagaagua

SEQ ID NO: 1114117 - RNA, 19 nt, Homo sapiens
ggauuaaacuggcauuuca

SEQ ID NO: 1114118 - RNA, 19 nt, Homo sapiens
uaacaggaccaauggauua

SEQ ID NO: 1114119 - RNA, 19 nt, Homo sapiens
caagaucaaugcucaaguu

SEQ ID NO: 1114120 - RNA, 19 nt, Homo sapiens
gaaauaacgacuccaggua

SEQ ID NO: 1114121 - RNA, 19 nt, Homo sapiens
gaacuuaucucuggguaca

SEQ ID NO: 1114122 - RNA, 19 nt, Homo sapiens
ugacaauccuccagcauuu

SEQ ID NO: 1114123 - RNA, 19 nt, Homo sapiens
ccaaggaacuccagcucua

SEQ ID NO: 1114124 - RNA, 19 nt, Homo sapiens
ugacagauaucaaugacaa

SEQ ID NO: 1114125 - RNA, 19 nt, Homo sapiens
cagaguggcccaaauauuu

SEQ ID NO: 1114126 - RNA, 19 nt, Homo sapiens
aaagaacacuggacagaga

SEQ ID NO: 1114127 - RNA, 19 nt, Homo sapiens
gcaaugagaaugcacaaau

SEQ ID NO: 1114128 - RNA, 19 nt, Homo sapiens
gcacaauaccauauaaaug

SEQ ID NO: 1114129 - RNA, 19 nt, Homo sapiens
gcacaagucacgucugcua

SEQ ID NO: 1114130 - RNA, 19 nt, Homo sapiens
gcucauggcuaaaguuaag

SEQ ID NO: 1114131 - RNA, 19 nt, Homo sapiens
gcccaaauauuucguuuag

SEQ ID NO: 1114132 - RNA, 19 nt, Homo sapiens
guacucagcugcucauggu

SEQ ID NO: 1114133 - RNA, 19 nt, Homo sapiens
gaagcucgaagcagguuua

SEQ ID NO: 1114134 - RNA, 19 nt, Homo sapiens
gaucaaugcucaaguuuug

SEQ ID NO: 1114135 - RNA, 19 nt, Homo sapiens
caaaucacuuacucccuaa

SEQ ID NO: 1114136 - RNA, 19 nt, Homo sapiens
uagaauagccaguagugua

SEQ ID NO: 1114137 - RNA, 19 nt, Homo sapiens
uaaagaaccacuagauuuc

SEQ ID NO: 1114138 - RNA, 19 nt, Homo sapiens
cggaagagccaccugauuu

SEQ ID NO: 1114139 - RNA, 19 nt, Homo sapiens
guacuccuuucacaaugua

SEQ ID NO: 1114140 - RNA, 19 nt, Homo sapiens
uaauugcucuuaucagugu

SEQ ID NO: 1114141 - RNA, 19 nt, Homo sapiens
gaagagacagacaaagguu

SEQ ID NO: 1114142 - RNA, 19 nt, Homo sapiens
ccuggaaauuuacccuuua

SEQ ID NO: 1114143 - RNA, 19 nt, Homo sapiens
gcuaccaacucagcucuaa

SEQ ID NO: 1114144 - RNA, 19 nt, Homo sapiens
ugaacucacuccagagcua

SEQ ID NO: 1114145 - RNA, 19 nt, Homo sapiens
gggaccaaaugaacagaaa

SEQ ID NO: 1114146 - RNA, 19 nt, Homo sapiens
gcucgaagcagguuuagga

SEQ ID NO: 1114147 - RNA, 19 nt, Homo sapiens
gcaauggcaacaagaagaa

SEQ ID NO: 1114148 - RNA, 19 nt, Homo sapiens
cacuagauuucgaagaaua

SEQ ID NO: 1114149 - RNA, 19 nt, Homo sapiens
cguacugacuucuccuaua

SEQ ID NO: 1114150 - RNA, 19 nt, Homo sapiens
gacaaagcuugacacauca

SEQ ID NO: 1114151 - RNA, 19 nt, Homo sapiens
cagcugaacuccuccaucu

SEQ ID NO: 1114152 - RNA, 19 nt, Homo sapiens
ggguacaacaucacaauaa

SEQ ID NO: 1114153 - RNA, 19 nt, Homo sapiens
gacaauggcuacaccacau

SEQ ID NO: 1114154 - RNA, 19 nt, Homo sapiens
gacaacauccuccagauuc

SEQ ID NO: 1114155 - RNA, 19 nt, Homo sapiens
caaugagaaugcacaaauc

SEQ ID NO: 1114156 - RNA, 19 nt, Homo sapiens
gccauagccugguuaaagu

SEQ ID NO: 1114157 - RNA, 19 nt, Homo sapiens
agaaacaagugcccaguca

SEQ ID NO: 1114158 - RNA, 19 nt, Homo sapiens
caacaucgccaaggaccua

SEQ ID NO: 1114159 - RNA, 19 nt, Homo sapiens
gaagaagucgggcaagaag

SEQ ID NO: 1114160 - RNA, 19 nt, Homo sapiens
gggcuuuccugcagaccua

SEQ ID NO: 1114161 - RNA, 19 nt, Homo sapiens
ggacagcaaugagaaugca

SEQ ID NO: 1114162 - RNA, 19 nt, Homo sapiens
gggcucauggcuaaaguua

SEQ ID NO: 1114163 - RNA, 19 nt, Homo sapiens
gaaagucucagcccaggau

SEQ ID NO: 1114164 - RNA, 19 nt, Homo sapiens
ggaggaggcucuguauguc

SEQ ID NO: 1114165 - RNA, 19 nt, Homo sapiens
agaaugcacaaaucacuua

SEQ ID NO: 1114166 - RNA, 19 nt, Homo sapiens
gcagagucccuuagacaga

SEQ ID NO: 1114167 - RNA, 19 nt, Homo sapiens
ggaccagucuucuguuuug

SEQ ID NO: 1114168 - RNA, 19 nt, Homo sapiens
ccagcucuaucuacugaaa

SEQ ID NO: 1114169 - RNA, 19 nt, Homo sapiens
ggacagagacgcgcucaag

SEQ ID NO: 1114170 - RNA, 19 nt, Homo sapiens
ggacccuucccacuacaua

SEQ ID NO: 1114171 - RNA, 19 nt, Homo sapiens
cuacaagccuccuaguucu

SEQ ID NO: 1114172 - RNA, 19 nt, Homo sapiens
gaacuccuccaucuuccaa

SEQ ID NO: 1114173 - RNA, 19 nt, Homo sapiens
gagccuccaucuucucugu

SEQ ID NO: 1114174 - RNA, 19 nt, Homo sapiens
ggaagagacagacaaaggu

SEQ ID NO: 1114175 - RNA, 19 nt, Homo sapiens
guguugaaguaccaaguaa

SEQ ID NO: 1114176 - RNA, 19 nt, Homo sapiens
guaacguacuccuuucaca

SEQ ID NO: 1114177 - RNA, 19 nt, Homo sapiens
caggcacaauaccauauaa

SEQ ID NO: 1114178 - RNA, 19 nt, Homo sapiens
ugacaacacuccccaauuc

SEQ ID NO: 1114179 - RNA, 19 nt, Homo sapiens
gacaugcaacugaaaguga

SEQ ID NO: 1114180 - RNA, 19 nt, Homo sapiens
gacaauccuccagcauuua

SEQ ID NO: 1114181 - RNA, 19 nt, Homo sapiens
gaccugcccuuacaguagu

SEQ ID NO: 1114182 - RNA, 19 nt, Homo sapiens
ugaaguaccaaguaaccua

SEQ ID NO: 1114183 - RNA, 19 nt, Homo sapiens
gcugaacuccuccaucuuc

SEQ ID NO: 1114184 - RNA, 19 nt, Homo sapiens
gcacccaggccucagaguu

SEQ ID NO: 1114185 - RNA, 19 nt, Homo sapiens
caagaaggagaagaaguaa

SEQ ID NO: 1114186 - RNA, 19 nt, Homo sapiens
gaccaggacucaggagaca

SEQ ID NO: 1114187 - RNA, 19 nt, Homo sapiens
uuaagguacugaucaaagu

SEQ ID NO: 1114188 - RNA, 19 nt, Homo sapiens
ugccgugucucgugaguuu

SEQ ID NO: 1114189 - RNA, 19 nt, Homo sapiens
ccuauaagcgcuucucuuc

SEQ ID NO: 1114190 - RNA, 19 nt, Homo sapiens
ggccauagccugguuaaag

SEQ ID NO: 1114191 - RNA, 19 nt, Homo sapiens
ggagaagaaguaacaugga

SEQ ID NO: 1114192 - RNA, 19 nt, Homo sapiens
gagcccugcuggacagaga

SEQ ID NO: 1114193 - RNA, 19 nt, Homo sapiens
gguacaacaucacaauaac

SEQ ID NO: 1114194 - RNA, 19 nt, Homo sapiens
uuacacaggagaaauauca

SEQ ID NO: 1114195 - RNA, 19 nt, Homo sapiens
cuccagagcuaccaacuca

SEQ ID NO: 1114196 - RNA, 19 nt, Homo sapiens
guagugcggugugcuuuua

SEQ ID NO: 1114197 - RNA, 19 nt, Homo sapiens
caacaaccaguuugacaca

SEQ ID NO: 1114198 - RNA, 19 nt, Homo sapiens
gaacuccagcucuaucuac

SEQ ID NO: 1114199 - RNA, 19 nt, Homo sapiens
ugaaagaacacuggacaga

SEQ ID NO: 1114200 - RNA, 19 nt, Homo sapiens
cuggaaauuuacccuuuaa

SEQ ID NO: 1114201 - RNA, 19 nt, Homo sapiens
gggcauggacaaagcuuga

SEQ ID NO: 1114202 - RNA, 19 nt, Homo sapiens
caggagagcugugagaaaa

SEQ ID NO: 1114203 - RNA, 19 nt, Homo sapiens
auucggaccucacucugua

SEQ ID NO: 1114204 - RNA, 19 nt, Homo sapiens
gagaaugcacaaaucacuu

SEQ ID NO: 1114205 - RNA, 19 nt, Homo sapiens
acacuggacagagaacuua

SEQ ID NO: 1114206 - RNA, 19 nt, Homo sapiens
caaauaaagaaccacuaga

SEQ ID NO: 1114207 - RNA, 19 nt, Homo sapiens
uaacguacuccuuucacaa

SEQ ID NO: 1114208 - RNA, 19 nt, Homo sapiens
gagcuaacaggaccaaugg

SEQ ID NO: 1114209 - RNA, 19 nt, Homo sapiens
gccauaaaccaauaacuag

SEQ ID NO: 1114210 - RNA, 19 nt, Homo sapiens
ugacaacauccuccagauu

SEQ ID NO: 1114211 - RNA, 19 nt, Homo sapiens
gggcugggaauauucacua

SEQ ID NO: 1114212 - RNA, 19 nt, Homo sapiens
gguguugaaguaccaagua

SEQ ID NO: 1114213 - RNA, 19 nt, Homo sapiens
agaaggagaagaaguaaca

SEQ ID NO: 1114214 - RNA, 19 nt, Homo sapiens
gaaauaacgacuccaggua

SEQ ID NO: 1114215 - RNA, 19 nt, Homo sapiens
gaacuuaucucuggguaca

SEQ ID NO: 1114216 - RNA, 19 nt, Homo sapiens
ugacaauccuccagcauuu

SEQ ID NO: 1114217 - RNA, 19 nt, Homo sapiens
ccaaggaacuccagcucua

SEQ ID NO: 1114218 - RNA, 19 nt, Homo sapiens
ugacagauaucaaugacaa

SEQ ID NO: 1114219 - RNA, 19 nt, Homo sapiens
cagaguggcccaaauauuu

SEQ ID NO: 1114220 - RNA, 19 nt, Homo sapiens
aaagaacacuggacagaga

SEQ ID NO: 1114221 - RNA, 19 nt, Homo sapiens
gcaaugagaaugcacaaau

SEQ ID NO: 1114222 - RNA, 19 nt, Homo sapiens
gcacaauaccauauaaaug

SEQ ID NO: 1114223 - RNA, 19 nt, Homo sapiens
uaucagcuaucuagagaaa

SEQ ID NO: 1114224 - RNA, 19 nt, Homo sapiens
gcacaagucacgucugcua

SEQ ID NO: 1114225 - RNA, 19 nt, Homo sapiens
gcucauggcuaaaguuaag

SEQ ID NO: 1114226 - RNA, 19 nt, Homo sapiens
gcccaaauauuucguuuag

SEQ ID NO: 1114227 - RNA, 19 nt, Homo sapiens
guacucagcugcucauggu

SEQ ID NO: 1114228 - RNA, 19 nt, Homo sapiens
caaaucacuuacucccuaa

SEQ ID NO: 1114229 - RNA, 19 nt, Homo sapiens
uaaagaaccacuagauuuc

SEQ ID NO: 1114230 - RNA, 19 nt, Homo sapiens
gaauguaucagcuaucuag

SEQ ID NO: 1114231 - RNA, 19 nt, Homo sapiens
cggaagagccaccugauuu

SEQ ID NO: 1114232 - RNA, 19 nt, Homo sapiens
guacuccuuucacaaugua

SEQ ID NO: 1114233 - RNA, 19 nt, Homo sapiens
uaauugcucuuaucagugu

SEQ ID NO: 1114234 - RNA, 19 nt, Homo sapiens
gaagagacagacaaagguu

SEQ ID NO: 1114235 - RNA, 19 nt, Homo sapiens
ccuggaaauuuacccuuua

SEQ ID NO: 1114236 - RNA, 19 nt, Homo sapiens
gcuaccaacucagcucuaa

SEQ ID NO: 1114237 - RNA, 19 nt, Homo sapiens
ugaacucacuccagagcua

SEQ ID NO: 1114238 - RNA, 19 nt, Homo sapiens
cacuagauuucgaagaaua

SEQ ID NO: 1114239 - RNA, 19 nt, Homo sapiens
ggguacaacaucacaauaa

SEQ ID NO: 1114240 - RNA, 19 nt, Homo sapiens
gacaauggcuacaccacau

SEQ ID NO: 1114241 - RNA, 19 nt, Homo sapiens
caaugagaaugcacaaauc

SEQ ID NO: 1114242 - RNA, 19 nt, Homo sapiens
gggcuuuccugcagaccua

SEQ ID NO: 1114243 - RNA, 19 nt, Homo sapiens
ggacagcaaugagaaugca

SEQ ID NO: 1114244 - RNA, 19 nt, Homo sapiens
gggcucauggcuaaaguua

SEQ ID NO: 1114245 - RNA, 19 nt, Homo sapiens
caacaucgccaaggaccua

SEQ ID NO: 1114246 - RNA, 19 nt, Homo sapiens
agaaugcacaaaucacuua

SEQ ID NO: 1114247 - RNA, 19 nt, Homo sapiens
gcagagucccuuagacaga

SEQ ID NO: 1114248 - RNA, 19 nt, Homo sapiens
uguaucagcuaucuagaga

SEQ ID NO: 1114249 - RNA, 19 nt, Homo sapiens
ccagcucuaucuacugaaa

SEQ ID NO: 1114250 - RNA, 19 nt, Homo sapiens
ggacagagacgcgcucaag

SEQ ID NO: 1114251 - RNA, 19 nt, Homo sapiens
gagccuccaucuucucugu

SEQ ID NO: 1114252 - RNA, 19 nt, Homo sapiens
ggaagagacagacaaaggu

SEQ ID NO: 1114253 - RNA, 19 nt, Homo sapiens
guaacguacuccuuucaca

SEQ ID NO: 1114254 - RNA, 19 nt, Homo sapiens
caggcacaauaccauauaa

SEQ ID NO: 1114255 - RNA, 19 nt, Homo sapiens
ugacaacacuccccaauuc

SEQ ID NO: 1114256 - RNA, 19 nt, Homo sapiens
gacaugcaacugaaaguga

SEQ ID NO: 1114257 - RNA, 19 nt, Homo sapiens
gacaauccuccagcauuua

SEQ ID NO: 1114258 - RNA, 19 nt, Homo sapiens
gaccaggacucaggagaca

SEQ ID NO: 1114259 - RNA, 19 nt, Homo sapiens
uuaagguacugaucaaagu

SEQ ID NO: 1114260 - RNA, 19 nt, Homo sapiens
ugccgugucucgugaguuu

SEQ ID NO: 1114261 - RNA, 19 nt, Homo sapiens
gagcccugcuggacagaga

SEQ ID NO: 1114262 - RNA, 19 nt, Homo sapiens
gguacaacaucacaauaac

SEQ ID NO: 1114263 - RNA, 19 nt, Homo sapiens
uuacacaggagaaauauca

SEQ ID NO: 1114264 - RNA, 19 nt, Homo sapiens
cuccagagcuaccaacuca

SEQ ID NO: 1114265 - RNA, 19 nt, Homo sapiens
gaacuccagcucuaucuac

SEQ ID NO: 1114266 - RNA, 19 nt, Homo sapiens
ugaaagaacacuggacaga

SEQ ID NO: 1114267 - RNA, 19 nt, Homo sapiens
cuggaaauuuacccuuuaa

SEQ ID NO: 1114268 - RNA, 19 nt, Homo sapiens
caggagagcugugagaaaa

SEQ ID NO: 1114269 - RNA, 19 nt, Homo sapiens
auucggaccucacucugua

SEQ ID NO: 1114270 - RNA, 19 nt, Homo sapiens
gagaaugcacaaaucacuu

SEQ ID NO: 1114271 - RNA, 19 nt, Homo sapiens
acacuggacagagaacuua

SEQ ID NO: 1114272 - RNA, 19 nt, Homo sapiens
caaauaaagaaccacuaga

SEQ ID NO: 1114273 - RNA, 19 nt, Homo sapiens
uaacguacuccuuucacaa

SEQ ID NO: 1114274 - RNA, 19 nt, Homo sapiens
gggcugggaauauucacua

SEQ ID NO: 1114275 - RNA, 19 nt, Homo sapiens
ggaauauucacuacucagu

SEQ ID NO: 1114276 - RNA, 19 nt, Homo sapiens
cuacaccacauguuucauu

SEQ ID NO: 1114277 - RNA, 19 nt, Homo sapiens
ggacaugcaacugaaagug

SEQ ID NO: 1114278 - RNA, 19 nt, Homo sapiens
gcugcgauccuucgacuau

SEQ ID NO: 1114279 - RNA, 19 nt, Homo sapiens
ucacuuacucccuaauaga

SEQ ID NO: 1114280 - RNA, 19 nt, Homo sapiens
ggaacuccagcucuaucua

SEQ ID NO: 1114281 - RNA, 19 nt, Homo sapiens
guacaacaucacaauaaca

SEQ ID NO: 1114282 - RNA, 19 nt, Homo sapiens
accacuagauuucgaagaa

SEQ ID NO: 1114283 - RNA, 19 nt, Homo sapiens
ggaaccauuuucucaggua

SEQ ID NO: 1114284 - RNA, 19 nt, Homo sapiens
ggaagagccaccugauuuu

SEQ ID NO: 1114285 - RNA, 19 nt, Homo sapiens
ucaaauaaagaaccacuag

SEQ ID NO: 1114286 - RNA, 19 nt, Homo sapiens
cagguaaacuuuugugaug

SEQ ID NO: 1114287 - RNA, 19 nt, Homo sapiens
gcucugaauccuagaagug

SEQ ID NO: 1114288 - RNA, 19 nt, Homo sapiens
ccacuagauuucgaagaau

SEQ ID NO: 1114289 - RNA, 19 nt, Homo sapiens
gagguaggaugccgcuuuu

SEQ ID NO: 1114290 - RNA, 19 nt, Homo sapiens
ggcacaauaccauauaaau

SEQ ID NO: 1114291 - RNA, 19 nt, Homo sapiens
ucaggcacaauaccauaua

SEQ ID NO: 1114292 - RNA, 19 nt, Homo sapiens
gcggaagagccaccugauu

SEQ ID NO: 1114293 - RNA, 19 nt, Homo sapiens
cuccuacucugccuacauu

SEQ ID NO: 1114294 - RNA, 19 nt, Homo sapiens
aaacucacauuucacuacu

SEQ ID NO: 1114295 - RNA, 19 nt, Homo sapiens
cuccagcucuaucuacuga

SEQ ID NO: 1114296 - RNA, 19 nt, Homo sapiens
cgcaucgucuccagaggua

SEQ ID NO: 1114297 - RNA, 19 nt, Homo sapiens
aaaguuaagguacugauca

SEQ ID NO: 1114298 - RNA, 19 nt, Homo sapiens
agaaguggcagcuugauca

SEQ ID NO: 1114299 - RNA, 19 nt, Homo sapiens
cauuuacucaggcacaaua

SEQ ID NO: 1114300 - RNA, 19 nt, Homo sapiens
gcucuaacccucauuucuc

SEQ ID NO: 1114301 - RNA, 19 nt, Homo sapiens
ccaggagagcugugagaaa

SEQ ID NO: 1114302 - RNA, 19 nt, Homo sapiens
caucacaauaacagcaaua

SEQ ID NO: 1114303 - RNA, 19 nt, Homo sapiens
ccacugcaguuccagaaaa

SEQ ID NO: 1114304 - RNA, 19 nt, Homo sapiens
ucguuuagauucuuacaca

SEQ ID NO: 1114305 - RNA, 19 nt, Homo sapiens
gaaccauuuucucagguaa

SEQ ID NO: 1114306 - RNA, 19 nt, Homo sapiens
aaucacuuacucccuaaua

SEQ ID NO: 1114307 - RNA, 19 nt, Homo sapiens
uuuagugacugaaagaaca

SEQ ID NO: 1114308 - RNA, 19 nt, Homo sapiens
uguauucaauggaaguuca

SEQ ID NO: 1114309 - RNA, 19 nt, Homo sapiens
gguaaacuuuugugaugaa

SEQ ID NO: 1114310 - RNA, 19 nt, Homo sapiens
gccuccaucuucucuguga

SEQ ID NO: 1114311 - RNA, 19 nt, Homo sapiens
ugugagggcccacgacuug

SEQ ID NO: 1114312 - RNA, 19 nt, Homo sapiens
agagguaggaugccgcuuu

SEQ ID NO: 1114313 - RNA, 19 nt, Homo sapiens
uaggcaacaucgccaagga

SEQ ID NO: 1114314 - RNA, 19 nt, Homo sapiens
gagcucagauuaaccuuga

SEQ ID NO: 1114315 - RNA, 19 nt, Homo sapiens
guagguaucuguagcuuuc

SEQ ID NO: 1114316 - RNA, 19 nt, Homo sapiens
ggaacuaaguauuucauca

SEQ ID NO: 1114317 - RNA, 19 nt, Homo sapiens
ggaaguauuucgagcugaa

SEQ ID NO: 1114318 - RNA, 19 nt, Homo sapiens
caaauggagagauaucaua

SEQ ID NO: 1114319 - RNA, 19 nt, Homo sapiens
ugacagacauaaacgauca

SEQ ID NO: 1114320 - RNA, 19 nt, Homo sapiens
gaaguggcccuguuuagga

SEQ ID NO: 1114321 - RNA, 19 nt, Homo sapiens
aaagagaaaugacccugaa

SEQ ID NO: 1114322 - RNA, 19 nt, Homo sapiens
ggacaacggccaccuguuc

SEQ ID NO: 1114323 - RNA, 19 nt, Homo sapiens
gcucugaaaguaaugauuu

SEQ ID NO: 1114324 - RNA, 19 nt, Homo sapiens
ccugaagggugauaugaaa

SEQ ID NO: 1114325 - RNA, 19 nt, Homo sapiens
gaagggugauaugaaaguu

SEQ ID NO: 1114326 - RNA, 19 nt, Homo sapiens
uauaaugcauuuccaagug

SEQ ID NO: 1114327 - RNA, 19 nt, Homo sapiens
gggaggcucugaaaguaau

SEQ ID NO: 1114328 - RNA, 19 nt, Homo sapiens
gauaucauacucccuuuau

SEQ ID NO: 1114329 - RNA, 19 nt, Homo sapiens
gcaggccgagcucagauua

SEQ ID NO: 1114330 - RNA, 19 nt, Homo sapiens
ggacuguguuuccucugaa

SEQ ID NO: 1114331 - RNA, 19 nt, Homo sapiens
ggcaguugauauuaaauga

SEQ ID NO: 1114332 - RNA, 19 nt, Homo sapiens
gagauaucauacucccuuu

SEQ ID NO: 1114333 - RNA, 19 nt, Homo sapiens
ugggacaaauggagagaua

SEQ ID NO: 1114334 - RNA, 19 nt, Homo sapiens
ggucucugcuagggauuua

SEQ ID NO: 1114335 - RNA, 19 nt, Homo sapiens
caauauuucucccaauucu

SEQ ID NO: 1114336 - RNA, 19 nt, Homo sapiens
ucacuuaccagcccuauuc

SEQ ID NO: 1114337 - RNA, 19 nt, Homo sapiens
gggacuguguuuccucuga

SEQ ID NO: 1114338 - RNA, 19 nt, Homo sapiens
agagagagguucuuuugua

SEQ ID NO: 1114339 - RNA, 19 nt, Homo sapiens
ggacaaauggagagauauc

SEQ ID NO: 1114340 - RNA, 19 nt, Homo sapiens
gggcagcaauaauguucaa

SEQ ID NO: 1114341 - RNA, 19 nt, Homo sapiens
caaccuggccaaugaccua

SEQ ID NO: 1114342 - RNA, 19 nt, Homo sapiens
aaacagagagagguucuuu

SEQ ID NO: 1114343 - RNA, 19 nt, Homo sapiens
guuaaggugcuggauguua

SEQ ID NO: 1114344 - RNA, 19 nt, Homo sapiens
agggugauaugaaaguuaa

SEQ ID NO: 1114345 - RNA, 19 nt, Homo sapiens
acuguugucuuuaguaaug

SEQ ID NO: 1114346 - RNA, 19 nt, Homo sapiens
ggagauagacaaaccuuuu

SEQ ID NO: 1114347 - RNA, 19 nt, Homo sapiens
ggacgugggcagcaauaau

SEQ ID NO: 1114348 - RNA, 19 nt, Homo sapiens
cgaucauucuccugaguuu

SEQ ID NO: 1114349 - RNA, 19 nt, Homo sapiens
ucuacaggcugguaacaga

SEQ ID NO: 1114350 - RNA, 19 nt, Homo sapiens
ccaauucucauuuccaugu

SEQ ID NO: 1114351 - RNA, 19 nt, Homo sapiens
ccagagaacagcccaguag

SEQ ID NO: 1114352 - RNA, 19 nt, Homo sapiens
cuacugagcccuguauaau

SEQ ID NO: 1114353 - RNA, 19 nt, Homo sapiens
gaccgggcaguugauauua

SEQ ID NO: 1114354 - RNA, 19 nt, Homo sapiens
gcagaccgggcaguugaua

SEQ ID NO: 1114355 - RNA, 19 nt, Homo sapiens
ccgacucgcuuaccgucua

SEQ ID NO: 1114356 - RNA, 19 nt, Homo sapiens
gaacuaaguauuucaucac

SEQ ID NO: 1114357 - RNA, 19 nt, Homo sapiens
ccgggcaguugauauuaaa

SEQ ID NO: 1114358 - RNA, 19 nt, Homo sapiens
gcuaaaaccuucuguugag

SEQ ID NO: 1114359 - RNA, 19 nt, Homo sapiens
guggcccuguuuaggauua

SEQ ID NO: 1114360 - RNA, 19 nt, Homo sapiens
ggagcgcuuucccgaacaa

SEQ ID NO: 1114361 - RNA, 19 nt, Homo sapiens
gacgugggcagcaauaaug

SEQ ID NO: 1114362 - RNA, 19 nt, Homo sapiens
agacauaaacgaucauucu

SEQ ID NO: 1114363 - RNA, 19 nt, Homo sapiens
ucauuuccuuugucugauu

SEQ ID NO: 1114364 - RNA, 19 nt, Homo sapiens
acgggaggcucugaaagua

SEQ ID NO: 1114365 - RNA, 19 nt, Homo sapiens
ugucuucgcucuuccucuu

SEQ ID NO: 1114366 - RNA, 19 nt, Homo sapiens
caaaggcaaguccugauuc

SEQ ID NO: 1114367 - RNA, 19 nt, Homo sapiens
caggagaaauucgacuaau

SEQ ID NO: 1114368 - RNA, 19 nt, Homo sapiens
gcuuuccgaccgucuguua

SEQ ID NO: 1114369 - RNA, 19 nt, Homo sapiens
ugaagccuauauucccaaa

SEQ ID NO: 1114370 - RNA, 19 nt, Homo sapiens
gaguacaacaucaccauca

SEQ ID NO: 1114371 - RNA, 19 nt, Homo sapiens
gagcuaagcagccuuucag

SEQ ID NO: 1114372 - RNA, 19 nt, Homo sapiens
cauacucccuuuauuacag

SEQ ID NO: 1114373 - RNA, 19 nt, Homo sapiens
gaauaauguagguaucugu

SEQ ID NO: 1114374 - RNA, 19 nt, Homo sapiens
gaaaugacccugaaaaucc

SEQ ID NO: 1114375 - RNA, 19 nt, Homo sapiens
ccugcaggcuuucgaguuc

SEQ ID NO: 1114376 - RNA, 19 nt, Homo sapiens
acgaggcccugcaggcuuu

SEQ ID NO: 1114377 - RNA, 19 nt, Homo sapiens
ggugcuggauguuaacgau

SEQ ID NO: 1114378 - RNA, 19 nt, Homo sapiens
gaggaaacagagagagguu

SEQ ID NO: 1114379 - RNA, 19 nt, Homo sapiens
ccaggacucuaggaggaaa

SEQ ID NO: 1114380 - RNA, 19 nt, Homo sapiens
gacgggaggcucugaaagu

SEQ ID NO: 1114381 - RNA, 19 nt, Homo sapiens
gaccagagccgaguacaac

SEQ ID NO: 1114382 - RNA, 19 nt, Homo sapiens
ugcuggauguuaacgauaa

SEQ ID NO: 1114383 - RNA, 19 nt, Homo sapiens
gggcaguugauauuaaaug

SEQ ID NO: 1114384 - RNA, 19 nt, Homo sapiens
ucaggagaaauucgacuaa

SEQ ID NO: 1114385 - RNA, 19 nt, Homo sapiens
aagcagccuuucaggagaa

SEQ ID NO: 1114386 - RNA, 19 nt, Homo sapiens
aaaggcaaguccugauucu

SEQ ID NO: 1114387 - RNA, 19 nt, Homo sapiens
gaauuucuacaggcuggua

SEQ ID NO: 1114388 - RNA, 19 nt, Homo sapiens
gcucaauucaggaugaugu

SEQ ID NO: 1114389 - RNA, 19 nt, Homo sapiens
caauucucauuuccauguu

SEQ ID NO: 1114390 - RNA, 19 nt, Homo sapiens
acaaaggcaaguccugauu

SEQ ID NO: 1114391 - RNA, 19 nt, Homo sapiens
auuucgagcugaacuacua

SEQ ID NO: 1114392 - RNA, 19 nt, Homo sapiens
uaaugcauuuccaaguguu

SEQ ID NO: 1114393 - RNA, 19 nt, Homo sapiens
ggaaacagagagagguucu

SEQ ID NO: 1114394 - RNA, 19 nt, Homo sapiens
gauguuccuuuuaagcuaa

SEQ ID NO: 1114395 - RNA, 19 nt, Homo sapiens
gagagagguucuuuuguag

SEQ ID NO: 1114396 - RNA, 19 nt, Homo sapiens
aaaaugcucugucucuguu

SEQ ID NO: 1114397 - RNA, 19 nt, Homo sapiens
cuacaauauuucucccaau

SEQ ID NO: 1114398 - RNA, 19 nt, Homo sapiens
gcauuggccucggugucuu

SEQ ID NO: 1114399 - RNA, 19 nt, Homo sapiens
ucccuggucuccauuaaca

SEQ ID NO: 1114400 - RNA, 19 nt, Homo sapiens
agaccgggcaguugauauu

SEQ ID NO: 1114401 - RNA, 19 nt, Homo sapiens
guccugauucuccuucuuu

SEQ ID NO: 1114402 - RNA, 19 nt, Homo sapiens
gaaaguuaaccccaccuaa

SEQ ID NO: 1114403 - RNA, 19 nt, Homo sapiens
gagagaccagagccgagua

SEQ ID NO: 1114404 - RNA, 19 nt, Homo sapiens
ccuacugagcccuguauaa

SEQ ID NO: 1114405 - RNA, 19 nt, Homo sapiens
gaagcuguguggcccuacu

SEQ ID NO: 1114406 - RNA, 19 nt, Homo sapiens
gaaaaugcucugucucugu

SEQ ID NO: 1114407 - RNA, 19 nt, Homo sapiens
guauaaugcauuuccaagu

SEQ ID NO: 1114408 - RNA, 19 nt, Homo sapiens
auaaugcauuuccaagugu

SEQ ID NO: 1114409 - RNA, 19 nt, Homo sapiens
cuagaauaauguagguauc

SEQ ID NO: 1114410 - RNA, 19 nt, Homo sapiens
aaugcucugucucuguuaa

SEQ ID NO: 1114411 - RNA, 19 nt, Homo sapiens
acucauuuccuuugucuga

SEQ ID NO: 1114412 - RNA, 19 nt, Homo sapiens
guucuugaagccuauauuc

SEQ ID NO: 1114413 - RNA, 19 nt, Homo sapiens
uaguggugcuggucaagga

SEQ ID NO: 1114414 - RNA, 19 nt, Homo sapiens
cgaaauagcuuuggacuua

SEQ ID NO: 1114415 - RNA, 19 nt, Homo sapiens
gaacucagauuaacacuca

SEQ ID NO: 1114416 - RNA, 19 nt, Homo sapiens
ggagagugcucaagauuug

SEQ ID NO: 1114417 - RNA, 19 nt, Homo sapiens
guaguugcaugcaugauua

SEQ ID NO: 1114418 - RNA, 19 nt, Homo sapiens
ggacaaaugaguucaaauu

SEQ ID NO: 1114419 - RNA, 19 nt, Homo sapiens
aaacagaaauuggcucuuu

SEQ ID NO: 1114420 - RNA, 19 nt, Homo sapiens
ggaaauguaaucuguguuu

SEQ ID NO: 1114421 - RNA, 19 nt, Homo sapiens
gaaauagcuuuggacuuaa

SEQ ID NO: 1114422 - RNA, 19 nt, Homo sapiens
gguccuagauagagcuuua

SEQ ID NO: 1114423 - RNA, 19 nt, Homo sapiens
caaagagaauuccagagaa

SEQ ID NO: 1114424 - RNA, 19 nt, Homo sapiens
ggagcuaccuuucuaaugg

SEQ ID NO: 1114425 - RNA, 19 nt, Homo sapiens
guaauacaguccuacacua

SEQ ID NO: 1114426 - RNA, 19 nt, Homo sapiens
ggacaauggccaccuguuu

SEQ ID NO: 1114427 - RNA, 19 nt, Homo sapiens
gguagugucugaugauaau

SEQ ID NO: 1114428 - RNA, 19 nt, Homo sapiens
gcaagaccauauucucaau

SEQ ID NO: 1114429 - RNA, 19 nt, Homo sapiens
ccaagacucuggagacaau

SEQ ID NO: 1114430 - RNA, 19 nt, Homo sapiens
auaaugacguggaaaugua

SEQ ID NO: 1114431 - RNA, 19 nt, Homo sapiens
uaaccgugcugcucucuga

SEQ ID NO: 1114432 - RNA, 19 nt, Homo sapiens
caacuuugguucucaucaa

SEQ ID NO: 1114433 - RNA, 19 nt, Homo sapiens
auacaguccuacacuauaa

SEQ ID NO: 1114434 - RNA, 19 nt, Homo sapiens
gaggaugauuugcucuauu

SEQ ID NO: 1114435 - RNA, 19 nt, Homo sapiens
gacaaugggaggaugauuu

SEQ ID NO: 1114436 - RNA, 19 nt, Homo sapiens
aaaugcacccuucuaguua

SEQ ID NO: 1114437 - RNA, 19 nt, Homo sapiens
gcaacagucuccaaaacua

SEQ ID NO: 1114438 - RNA, 19 nt, Homo sapiens
ggaagcaacagucuccaaa

SEQ ID NO: 1114439 - RNA, 19 nt, Homo sapiens
gcuccuaaaugagaaacua

SEQ ID NO: 1114440 - RNA, 19 nt, Homo sapiens
ggaaguuaauuugagauca

SEQ ID NO: 1114441 - RNA, 19 nt, Homo sapiens
caucagaagauauucguaa

SEQ ID NO: 1114442 - RNA, 19 nt, Homo sapiens
gaaaaccgaguacaacaua

SEQ ID NO: 1114443 - RNA, 19 nt, Homo sapiens
ggaggaugauuugcucuau

SEQ ID NO: 1114444 - RNA, 19 nt, Homo sapiens
cuagauagagcuuuagauu

SEQ ID NO: 1114445 - RNA, 19 nt, Homo sapiens
gcuuuggacuuaacauuca

SEQ ID NO: 1114446 - RNA, 19 nt, Homo sapiens
gaaguuaauuugagaucac

SEQ ID NO: 1114447 - RNA, 19 nt, Homo sapiens
guagugacagaaagauaua

SEQ ID NO: 1114448 - RNA, 19 nt, Homo sapiens
ggauaugcaaacuaaagua

SEQ ID NO: 1114449 - RNA, 19 nt, Homo sapiens
ucaggucgcuggacuacga

SEQ ID NO: 1114450 - RNA, 19 nt, Homo sapiens
gauuugcucuauucaagau

SEQ ID NO: 1114451 - RNA, 19 nt, Homo sapiens
acaaagagaauuccagaga

SEQ ID NO: 1114452 - RNA, 19 nt, Homo sapiens
ggacaacuuugguucucau

SEQ ID NO: 1114453 - RNA, 19 nt, Homo sapiens
guacugaaucugcacacua

SEQ ID NO: 1114454 - RNA, 19 nt, Homo sapiens
gagcuaccuuucuaaugga

SEQ ID NO: 1114455 - RNA, 19 nt, Homo sapiens
cuacauuucuagacaagga

SEQ ID NO: 1114456 - RNA, 19 nt, Homo sapiens
gacaauggccaccuguuug

SEQ ID NO: 1114457 - RNA, 19 nt, Homo sapiens
gaucaccccuggauuuuga

SEQ ID NO: 1114458 - RNA, 19 nt, Homo sapiens
uagacaccaucaaagcaua

SEQ ID NO: 1114459 - RNA, 19 nt, Homo sapiens
aaaccgaccuucaagaacu

SEQ ID NO: 1114460 - RNA, 19 nt, Homo sapiens
caccagaagugaccauauc

SEQ ID NO: 1114461 - RNA, 19 nt, Homo sapiens
gauagagcuuuagauuaug

SEQ ID NO: 1114462 - RNA, 19 nt, Homo sapiens
guggaaauguaaucugugu

SEQ ID NO: 1114463 - RNA, 19 nt, Homo sapiens
gaacuuucgaaauagcuuu

SEQ ID NO: 1114464 - RNA, 19 nt, Homo sapiens
gaccaagacucuggagaca

SEQ ID NO: 1114465 - RNA, 19 nt, Homo sapiens
gcagaggaaacagaaauug

SEQ ID NO: 1114466 - RNA, 19 nt, Homo sapiens
gaacaggaagcugaacuca

SEQ ID NO: 1114467 - RNA, 19 nt, Homo sapiens
cuccaaaacuacacaauua

SEQ ID NO: 1114468 - RNA, 19 nt, Homo sapiens
gaaguaauacaguccuaca

SEQ ID NO: 1114469 - RNA, 19 nt, Homo sapiens
cgacaguagugacagaaag

SEQ ID NO: 1114470 - RNA, 19 nt, Homo sapiens
cgacaacccaccagaagug

SEQ ID NO: 1114471 - RNA, 19 nt, Homo sapiens
cuagacaaggaaauacuua

SEQ ID NO: 1114472 - RNA, 19 nt, Homo sapiens
uacugaaucugcacacuau

SEQ ID NO: 1114473 - RNA, 19 nt, Homo sapiens
gauucuugguuguacugua

SEQ ID NO: 1114474 - RNA, 19 nt, Homo sapiens
aaggcaaguucuaauauuc

SEQ ID NO: 1114475 - RNA, 19 nt, Homo sapiens
ggagacaaugggaggauga

SEQ ID NO: 1114476 - RNA, 19 nt, Homo sapiens
uaauacaguccuacacuau

SEQ ID NO: 1114477 - RNA, 19 nt, Homo sapiens
gcugcucucugacgucaau

SEQ ID NO: 1114478 - RNA, 19 nt, Homo sapiens
gagagagccaagccgagua

SEQ ID NO: 1114479 - RNA, 19 nt, Homo sapiens
gcacccuucuaguuaaagu

SEQ ID NO: 1114480 - RNA, 19 nt, Homo sapiens
aaugcacccuucuaguuaa

SEQ ID NO: 1114481 - RNA, 19 nt, Homo sapiens
uguuggagcuaccuuucua

SEQ ID NO: 1114482 - RNA, 19 nt, Homo sapiens
aggaugauuugcucuauuc

SEQ ID NO: 1114483 - RNA, 19 nt, Homo sapiens
uaaauauucaggcaacaga

SEQ ID NO: 1114484 - RNA, 19 nt, Homo sapiens
gcuauaaugacguggaaau

SEQ ID NO: 1114485 - RNA, 19 nt, Homo sapiens
gcaagcugaugguacuuuu

SEQ ID NO: 1114486 - RNA, 19 nt, Homo sapiens
gagguuccgggacaaauga

SEQ ID NO: 1114487 - RNA, 19 nt, Homo sapiens
gaguacaacaucacgauca

SEQ ID NO: 1114488 - RNA, 19 nt, Homo sapiens
uaaugacguggaaauguaa

SEQ ID NO: 1114489 - RNA, 19 nt, Homo sapiens
ucaugacacugguaggaau

SEQ ID NO: 1114490 - RNA, 19 nt, Homo sapiens
ggagguuccgggacaaaug

SEQ ID NO: 1114491 - RNA, 19 nt, Homo sapiens
guauuugcaccuugauuug

SEQ ID NO: 1114492 - RNA, 19 nt, Homo sapiens
uaauggagagugcucaaga

SEQ ID NO: 1114493 - RNA, 19 nt, Homo sapiens
guacuguaguugcaugcau

SEQ ID NO: 1114494 - RNA, 19 nt, Homo sapiens
cgggacaaaugaguucaaa

SEQ ID NO: 1114495 - RNA, 19 nt, Homo sapiens
ugucgucgcucuuccucuu

SEQ ID NO: 1114496 - RNA, 19 nt, Homo sapiens
gaucaccgucacagacuug

SEQ ID NO: 1114497 - RNA, 19 nt, Homo sapiens
gaaaccgaccuucaagaac

SEQ ID NO: 1114498 - RNA, 19 nt, Homo sapiens
acaaugggaggaugauuug

SEQ ID NO: 1114499 - RNA, 19 nt, Homo sapiens
aauacaguccuacacuaua

SEQ ID NO: 1114500 - RNA, 19 nt, Homo sapiens
gacaguagugacagaaaga

SEQ ID NO: 1114501 - RNA, 19 nt, Homo sapiens
ccaauucucacuucuacau

SEQ ID NO: 1114502 - RNA, 19 nt, Homo sapiens
ccaacgcccaggucaacua

SEQ ID NO: 1114503 - RNA, 19 nt, Homo sapiens
aaacgacaacccaccagaa

SEQ ID NO: 1114504 - RNA, 19 nt, Homo sapiens
ucaagguguuggacaucaa

SEQ ID NO: 1114505 - RNA, 19 nt, Homo sapiens
cggguagugucugaugaua

SEQ ID NO: 1114506 - RNA, 19 nt, Homo sapiens
caagaccauauucucaauu

SEQ ID NO: 1114507 - RNA, 19 nt, Homo sapiens
cuacaggaguucgaguuuc

SEQ ID NO: 1114508 - RNA, 19 nt, Homo sapiens
gaugauuugcucuauucaa

SEQ ID NO: 1114509 - RNA, 19 nt, Homo sapiens
gggaggaugauuugcucua

SEQ ID NO: 1114510 - RNA, 19 nt, Homo sapiens
ccaugcaucagaagauauu

SEQ ID NO: 1114511 - RNA, 19 nt, Homo sapiens
ggaucuggaugcaggaaac

SEQ ID NO: 1114512 - RNA, 19 nt, Homo sapiens
aaaaguauuugcaccuuga

SEQ ID NO: 1114513 - RNA, 19 nt, Homo sapiens
caugacacugguaggaaua

SEQ ID NO: 1114514 - RNA, 19 nt, Homo sapiens
ugagguaucuguagaauaa

SEQ ID NO: 1114515 - RNA, 19 nt, Homo sapiens
ggaaagaaauacaaggaaa

SEQ ID NO: 1114516 - RNA, 19 nt, Homo sapiens
ucacaaagcucuagugcaa

SEQ ID NO: 1114517 - RNA, 19 nt, Homo sapiens
gaacuucacccacuauuau

SEQ ID NO: 1114518 - RNA, 19 nt, Homo sapiens
cagauggucuuaauuugua

SEQ ID NO: 1114519 - RNA, 19 nt, Homo sapiens
cgaccacucuccaguauuu

SEQ ID NO: 1114520 - RNA, 19 nt, Homo sapiens
gaaacacacaagcuuaaua

SEQ ID NO: 1114521 - RNA, 19 nt, Homo sapiens
cacacaagcuuaauagaaa

SEQ ID NO: 1114522 - RNA, 19 nt, Homo sapiens
gagauuuccuauucacuuu

SEQ ID NO: 1114523 - RNA, 19 nt, Homo sapiens
ggugacaauucauucuuua

SEQ ID NO: 1114524 - RNA, 19 nt, Homo sapiens
gagcucagguuaacacuca

SEQ ID NO: 1114525 - RNA, 19 nt, Homo sapiens
uaacacagcucaauaugac

SEQ ID NO: 1114526 - RNA, 19 nt, Homo sapiens
aaauuggaguuguguguua

SEQ ID NO: 1114527 - RNA, 19 nt, Homo sapiens
gauacaacucuaaguguua

SEQ ID NO: 1114528 - RNA, 19 nt, Homo sapiens
gaauacaacaucacuauca

SEQ ID NO: 1114529 - RNA, 19 nt, Homo sapiens
gagggcagcuccuuuguca

SEQ ID NO: 1114530 - RNA, 19 nt, Homo sapiens
gcaggcacauuaauauugu

SEQ ID NO: 1114531 - RNA, 19 nt, Homo sapiens
caggagaaauugaacuaaa

SEQ ID NO: 1114532 - RNA, 19 nt, Homo sapiens
ggacuacguuuccucugaa

SEQ ID NO: 1114533 - RNA, 19 nt, Homo sapiens
gcagaugccugugcccaaa

SEQ ID NO: 1114534 - RNA, 19 nt, Homo sapiens
uaauuugccucccuaaaga

SEQ ID NO: 1114535 - RNA, 19 nt, Homo sapiens
ugacuccuauucagacaua

SEQ ID NO: 1114536 - RNA, 19 nt, Homo sapiens
ggagagaccacuagacaga

SEQ ID NO: 1114537 - RNA, 19 nt, Homo sapiens
gaaaaccuauauccuauga

SEQ ID NO: 1114538 - RNA, 19 nt, Homo sapiens
ggacaacggccaccuguuc

SEQ ID NO: 1114539 - RNA, 19 nt, Homo sapiens
ggaguuguguguuaaugug

SEQ ID NO: 1114540 - RNA, 19 nt, Homo sapiens
gaaauuggaccgugaggau

SEQ ID NO: 1114541 - RNA, 19 nt, Homo sapiens
gggacuacguuuccucuga

SEQ ID NO: 1114542 - RNA, 19 nt, Homo sapiens
uaacccagauggucuuaau

SEQ ID NO: 1114543 - RNA, 19 nt, Homo sapiens
ccacggagcucggucuguu

SEQ ID NO: 1114544 - RNA, 19 nt, Homo sapiens
aaagagcaauaccaaauca

SEQ ID NO: 1114545 - RNA, 19 nt, Homo sapiens
gcagugauggcaggaaaua

SEQ ID NO: 1114546 - RNA, 19 nt, Homo sapiens
ggagaccgcggauuuguug

SEQ ID NO: 1114547 - RNA, 19 nt, Homo sapiens
gaaaauuaguugcuccauu

SEQ ID NO: 1114548 - RNA, 19 nt, Homo sapiens
ggagaaaaugggaaaauua

SEQ ID NO: 1114549 - RNA, 19 nt, Homo sapiens
acggagagauuuccuauuc

SEQ ID NO: 1114550 - RNA, 19 nt, Homo sapiens
gcuccuuugucaccaauuu

SEQ ID NO: 1114551 - RNA, 19 nt, Homo sapiens
uuacugcaaccaauaguua

SEQ ID NO: 1114552 - RNA, 19 nt, Homo sapiens
ugauacaacucuaaguguu

SEQ ID NO: 1114553 - RNA, 19 nt, Homo sapiens
ggaccaaugaguucaaguu

SEQ ID NO: 1114554 - RNA, 19 nt, Homo sapiens
cagcauuucuucauuugau

SEQ ID NO: 1114555 - RNA, 19 nt, Homo sapiens
cgucagcgcuacagacaga

SEQ ID NO: 1114556 - RNA, 19 nt, Homo sapiens
gaucuugauucaggagaaa

SEQ ID NO: 1114557 - RNA, 19 nt, Homo sapiens
aagagaugcuggaaccuuu

SEQ ID NO: 1114558 - RNA, 19 nt, Homo sapiens
acuacucacuggcauauuu

SEQ ID NO: 1114559 - RNA, 19 nt, Homo sapiens
cuaaagagcaauaccaaau

SEQ ID NO: 1114560 - RNA, 19 nt, Homo sapiens
gaaguuaccaugucugcau

SEQ ID NO: 1114561 - RNA, 19 nt, Homo sapiens
gcaccguucugauucaagu

SEQ ID NO: 1114562 - RNA, 19 nt, Homo sapiens
gagcagccuuucuauagag

SEQ ID NO: 1114563 - RNA, 19 nt, Homo sapiens
gagaaagcagagcggaaua

SEQ ID NO: 1114564 - RNA, 19 nt, Homo sapiens
gaagcucauuugcagacaa

SEQ ID NO: 1114565 - RNA, 19 nt, Homo sapiens
acacacaagcuuaauagaa

SEQ ID NO: 1114566 - RNA, 19 nt, Homo sapiens
acaaagcucuagugcaauc

SEQ ID NO: 1114567 - RNA, 19 nt, Homo sapiens
ucacaucccuggucuccau

SEQ ID NO: 1114568 - RNA, 19 nt, Homo sapiens
gaaauccgcggaaaacuuu

SEQ ID NO: 1114569 - RNA, 19 nt, Homo sapiens
gacaggagaaauugaacua

SEQ ID NO: 1114570 - RNA, 19 nt, Homo sapiens
gauaacacagcucaauaug

SEQ ID NO: 1114571 - RNA, 19 nt, Homo sapiens
guuaccaugucugcauuua

SEQ ID NO: 1114572 - RNA, 19 nt, Homo sapiens
ggcaaaaccuuuaagauca

SEQ ID NO: 1114573 - RNA, 19 nt, Homo sapiens
guauauacaccagaaacua

SEQ ID NO: 1114574 - RNA, 19 nt, Homo sapiens
gcauauuucugagguaucu

SEQ ID NO: 1114575 - RNA, 19 nt, Homo sapiens
guacggauuuacucuugau

SEQ ID NO: 1114576 - RNA, 19 nt, Homo sapiens
caacggagagauuuccuau

SEQ ID NO: 1114577 - RNA, 19 nt, Homo sapiens
ggagucaacggagagauuu

SEQ ID NO: 1114578 - RNA, 19 nt, Homo sapiens
gaaauaaaugcuugugaac

SEQ ID NO: 1114579 - RNA, 19 nt, Homo sapiens
cugggaauaugaagcuaua

SEQ ID NO: 1114580 - RNA, 19 nt, Homo sapiens
ugagcagccuuucuauaga

SEQ ID NO: 1114581 - RNA, 19 nt, Homo sapiens
uuaguauccuuuccucauu

SEQ ID NO: 1114582 - RNA, 19 nt, Homo sapiens
gaaacugugguugcacuuu

SEQ ID NO: 1114583 - RNA, 19 nt, Homo sapiens
gaacgaccaugccccagaa

SEQ ID NO: 1114584 - RNA, 19 nt, Homo sapiens
ggagagauuuccuauucac

SEQ ID NO: 1114585 - RNA, 19 nt, Homo sapiens
gagggaacaaacuacauuu

SEQ ID NO: 1114586 - RNA, 19 nt, Homo sapiens
aaacacacaagcuuaauag

SEQ ID NO: 1114587 - RNA, 19 nt, Homo sapiens
ggacuacucacuggcauau

SEQ ID NO: 1114588 - RNA, 19 nt, Homo sapiens
ucaggucucuggacuacga

SEQ ID NO: 1114589 - RNA, 19 nt, Homo sapiens
aaacgaccacucuccagua

SEQ ID NO: 1114590 - RNA, 19 nt, Homo sapiens
uagcauaaauuggaguugu

SEQ ID NO: 1114591 - RNA, 19 nt, Homo sapiens
gcauuuaccagcccaauac

SEQ ID NO: 1114592 - RNA, 19 nt, Homo sapiens
gcaaaaccuuuaagaucaa

SEQ ID NO: 1114593 - RNA, 19 nt, Homo sapiens
gcaaguaauagacauaaac

SEQ ID NO: 1114594 - RNA, 19 nt, Homo sapiens
guugcuaaaugagaaauug

SEQ ID NO: 1114595 - RNA, 19 nt, Homo sapiens
cagaaaaccuauauccuau

SEQ ID NO: 1114596 - RNA, 19 nt, Homo sapiens
gaauaaccacagccucaga

SEQ ID NO: 1114597 - RNA, 19 nt, Homo sapiens
ggcggaaccuagaagcuau

SEQ ID NO: 1114598 - RNA, 19 nt, Homo sapiens
gggaaagaaauacaaggaa

SEQ ID NO: 1114599 - RNA, 19 nt, Homo sapiens
ugauaacacagcucaauau

SEQ ID NO: 1114600 - RNA, 19 nt, Homo sapiens
aaaauuaguugcuccauuc

SEQ ID NO: 1114601 - RNA, 19 nt, Homo sapiens
gcacugcucaggucuacau

SEQ ID NO: 1114602 - RNA, 19 nt, Homo sapiens
gcaaccaauaguuaagauu

SEQ ID NO: 1114603 - RNA, 19 nt, Homo sapiens
ugccuguacuaucauauaa

SEQ ID NO: 1114604 - RNA, 19 nt, Homo sapiens
ccagauggucuuaauuugu

SEQ ID NO: 1114605 - RNA, 19 nt, Homo sapiens
gaacauuuaccuuuauucc

SEQ ID NO: 1114606 - RNA, 19 nt, Homo sapiens
ucccagagcuaccaguaug

SEQ ID NO: 1114607 - RNA, 19 nt, Homo sapiens
caguauuucuggacaaaca

SEQ ID NO: 1114608 - RNA, 19 nt, Homo sapiens
gugcuacguuuccaagugu

SEQ ID NO: 1114609 - RNA, 19 nt, Homo sapiens
ccgcggauuuguugcuaaa

SEQ ID NO: 1114610 - RNA, 19 nt, Homo sapiens
agaugccugugcccaaaua

SEQ ID NO: 1114611 - RNA, 19 nt, Homo sapiens
ccagaaaaccuauauccua

SEQ ID NO: 1114612 - RNA, 19 nt, Homo sapiens
gaaagcagagcggaauaca

SEQ ID NO: 1114613 - RNA, 19 nt, Homo sapiens
gggaauaugaagcuauaau

SEQ ID NO: 1114614 - RNA, 19 nt, Homo sapiens
gauaucaccuggcaaguuu

SEQ ID NO: 1114615 - RNA, 19 nt, Homo sapiens
gaaauacccugaguuaguu

SEQ ID NO: 1114616 - RNA, 19 nt, Homo sapiens
cgacaacgcuccugaaauc

SEQ ID NO: 1114617 - RNA, 19 nt, Homo sapiens
acaaggcgcuggauuauga

SEQ ID NO: 1114618 - RNA, 19 nt, Homo sapiens
ggacaacggccaccuguuu

SEQ ID NO: 1114619 - RNA, 19 nt, Homo sapiens
uaacagcaccuuuggauuu

SEQ ID NO: 1114620 - RNA, 19 nt, Homo sapiens
gaaagaugguuuguucuau

SEQ ID NO: 1114621 - RNA, 19 nt, Homo sapiens
aagcauagauuguagugua

SEQ ID NO: 1114622 - RNA, 19 nt, Homo sapiens
ggaaauacccugaguuagu

SEQ ID NO: 1114623 - RNA, 19 nt, Homo sapiens
gaguauaccuacccuaguu

SEQ ID NO: 1114624 - RNA, 19 nt, Homo sapiens
gaaaugugcauguguaaug

SEQ ID NO: 1114625 - RNA, 19 nt, Homo sapiens
ggaaagaugguuuguucua

SEQ ID NO: 1114626 - RNA, 19 nt, Homo sapiens
gcucugaucugcccaaauc

SEQ ID NO: 1114627 - RNA, 19 nt, Homo sapiens
gaauucaggugauggaugu

SEQ ID NO: 1114628 - RNA, 19 nt, Homo sapiens
ggauauaaaugaucacucu

SEQ ID NO: 1114629 - RNA, 19 nt, Homo sapiens
gcccaaaucuuaaguaaaa

SEQ ID NO: 1114630 - RNA, 19 nt, Homo sapiens
uuagaaugcuguucgagua

SEQ ID NO: 1114631 - RNA, 19 nt, Homo sapiens
gugcauguguaaugguuua

SEQ ID NO: 1114632 - RNA, 19 nt, Homo sapiens
caggaaaugugcaugugua

SEQ ID NO: 1114633 - RNA, 19 nt, Homo sapiens
ggacaucccauucgugcua

SEQ ID NO: 1114634 - RNA, 19 nt, Homo sapiens
gaaaugcucuuagaaaucc

SEQ ID NO: 1114635 - RNA, 19 nt, Homo sapiens
uaagguccacuaacuaaua

SEQ ID NO: 1114636 - RNA, 19 nt, Homo sapiens
gaacaaacagugaacuauc

SEQ ID NO: 1114637 - RNA, 19 nt, Homo sapiens
caagaacacuucacaaagc

SEQ ID NO: 1114638 - RNA, 19 nt, Homo sapiens
ggauacagauuuaguacca

SEQ ID NO: 1114639 - RNA, 19 nt, Homo sapiens
caauaaauccgaacucuca

SEQ ID NO: 1114640 - RNA, 19 nt, Homo sapiens
aaacugagcauccauccua

SEQ ID NO: 1114641 - RNA, 19 nt, Homo sapiens
uaggaaauacccugaguua

SEQ ID NO: 1114642 - RNA, 19 nt, Homo sapiens
gaacucucauuuccacguu

SEQ ID NO: 1114643 - RNA, 19 nt, Homo sapiens
gggcucgggugguuucuaa

SEQ ID NO: 1114644 - RNA, 19 nt, Homo sapiens
ugaaaucacugugucauca

SEQ ID NO: 1114645 - RNA, 19 nt, Homo sapiens
gcaaaggauuuagauguag

SEQ ID NO: 1114646 - RNA, 19 nt, Homo sapiens
gggauuugcuccugagaga

SEQ ID NO: 1114647 - RNA, 19 nt, Homo sapiens
ucacuaagguccacuaacu

SEQ ID NO: 1114648 - RNA, 19 nt, Homo sapiens
gagcacagguagugaaguc

SEQ ID NO: 1114649 - RNA, 19 nt, Homo sapiens
gagcauccauccuagaucu

SEQ ID NO: 1114650 - RNA, 19 nt, Homo sapiens
ugaacuauccuauaccuuu

SEQ ID NO: 1114651 - RNA, 19 nt, Homo sapiens
ggacaaggcgcuggauuau

SEQ ID NO: 1114652 - RNA, 19 nt, Homo sapiens
ugcaaaggauuuagaugua

SEQ ID NO: 1114653 - RNA, 19 nt, Homo sapiens
ggucuuagagauucaguaa

SEQ ID NO: 1114654 - RNA, 19 nt, Homo sapiens
gauauucgcaagacauuug

SEQ ID NO: 1114655 - RNA, 19 nt, Homo sapiens
ggucagggauauaaaugau

SEQ ID NO: 1114656 - RNA, 19 nt, Homo sapiens
uugaagcaauugagucaua

SEQ ID NO: 1114657 - RNA, 19 nt, Homo sapiens
gcuguguucuugcuugaaa

SEQ ID NO: 1114658 - RNA, 19 nt, Homo sapiens
gaacuauccuauaccuuuu

SEQ ID NO: 1114659 - RNA, 19 nt, Homo sapiens
gguggugguuguagauauu

SEQ ID NO: 1114660 - RNA, 19 nt, Homo sapiens
guaagucuuguuugagaua

SEQ ID NO: 1114661 - RNA, 19 nt, Homo sapiens
ucaaaagucuggugacauu

SEQ ID NO: 1114662 - RNA, 19 nt, Homo sapiens
gaagauauucgcaagacau

SEQ ID NO: 1114663 - RNA, 19 nt, Homo sapiens
ugaggugccuguaaaguag

SEQ ID NO: 1114664 - RNA, 19 nt, Homo sapiens
ucaggucgcuggacuacga

SEQ ID NO: 1114665 - RNA, 19 nt, Homo sapiens
gcuaaaaucuucgguaaau

SEQ ID NO: 1114666 - RNA, 19 nt, Homo sapiens
ggaacaaacagugaacuau

SEQ ID NO: 1114667 - RNA, 19 nt, Homo sapiens
ucagggauauaaaugauca

SEQ ID NO: 1114668 - RNA, 19 nt, Homo sapiens
gugaggugccuguaaagua

SEQ ID NO: 1114669 - RNA, 19 nt, Homo sapiens
agagaccgcuggacagaga

SEQ ID NO: 1114670 - RNA, 19 nt, Homo sapiens
acagugaacuauccuauac

SEQ ID NO: 1114671 - RNA, 19 nt, Homo sapiens
ggauuuagacucuggaaca

SEQ ID NO: 1114672 - RNA, 19 nt, Homo sapiens
ucaguaaguucacuaaggu

SEQ ID NO: 1114673 - RNA, 19 nt, Homo sapiens
acggaaagaugguuuguuc

SEQ ID NO: 1114674 - RNA, 19 nt, Homo sapiens
gcagagcgggagcuuugua

SEQ ID NO: 1114675 - RNA, 19 nt, Homo sapiens
aaagaugguuuguucuauc

SEQ ID NO: 1114676 - RNA, 19 nt, Homo sapiens
gauuuagacucuggaacaa

SEQ ID NO: 1114677 - RNA, 19 nt, Homo sapiens
ggauaucaccuggcaaguu

SEQ ID NO: 1114678 - RNA, 19 nt, Homo sapiens
aagguccacuaacuaauaa

SEQ ID NO: 1114679 - RNA, 19 nt, Homo sapiens
agaaugcuguucgaguaua

SEQ ID NO: 1114680 - RNA, 19 nt, Homo sapiens
guagugaagucgaagaaaa

SEQ ID NO: 1114681 - RNA, 19 nt, Homo sapiens
cgucucagccugggauuua

SEQ ID NO: 1114682 - RNA, 19 nt, Homo sapiens
ugaaagugcaaaggauuua

SEQ ID NO: 1114683 - RNA, 19 nt, Homo sapiens
gauuugcuccugagagaaa

SEQ ID NO: 1114684 - RNA, 19 nt, Homo sapiens
gugcaaaggauuuagaugu

SEQ ID NO: 1114685 - RNA, 19 nt, Homo sapiens
uaagugguaagucuuguuu

SEQ ID NO: 1114686 - RNA, 19 nt, Homo sapiens
gagcagagccgaguacaac

SEQ ID NO: 1114687 - RNA, 19 nt, Homo sapiens
ucccaugccucagaagaua

SEQ ID NO: 1114688 - RNA, 19 nt, Homo sapiens
ucagaagcauagauuguag

SEQ ID NO: 1114689 - RNA, 19 nt, Homo sapiens
uuacuacacuuuggaaaca

SEQ ID NO: 1114690 - RNA, 19 nt, Homo sapiens
gaaaucacugugucaucaa

SEQ ID NO: 1114691 - RNA, 19 nt, Homo sapiens
ggagcuuuguaggaaauuu

SEQ ID NO: 1114692 - RNA, 19 nt, Homo sapiens
uggacaaggcgcuggauua

SEQ ID NO: 1114693 - RNA, 19 nt, Homo sapiens
cgggugguuucuaaugaua

SEQ ID NO: 1114694 - RNA, 19 nt, Homo sapiens
guaggaaucaaugcuguaa

SEQ ID NO: 1114695 - RNA, 19 nt, Homo sapiens
agugguaagucuuguuuga

SEQ ID NO: 1114696 - RNA, 19 nt, Homo sapiens
ccaagaacacuucacaaag

SEQ ID NO: 1114697 - RNA, 19 nt, Homo sapiens
caucagcgccacagacaga

SEQ ID NO: 1114698 - RNA, 19 nt, Homo sapiens
ugguaagucuuguuugaga

SEQ ID NO: 1114699 - RNA, 19 nt, Homo sapiens
ucccagagcuaccacuaug

SEQ ID NO: 1114700 - RNA, 19 nt, Homo sapiens
ccgacucgcucacugucua

SEQ ID NO: 1114701 - RNA, 19 nt, Homo sapiens
ucagaagaaacauauguga

SEQ ID NO: 1114702 - RNA, 19 nt, Homo sapiens
gaaugcuguucgaguauac

SEQ ID NO: 1114703 - RNA, 19 nt, Homo sapiens
ucuauuaagugguaagucu

SEQ ID NO: 1114704 - RNA, 19 nt, Homo sapiens
cauguguaaugguuuaugu

SEQ ID NO: 1114705 - RNA, 19 nt, Homo sapiens
gaauaauuuggguuucuga

SEQ ID NO: 1114706 - RNA, 19 nt, Homo sapiens
gcuugaaagugcaaaggau

SEQ ID NO: 1114707 - RNA, 19 nt, Homo sapiens
ucuuagaaaucccagagaa

SEQ ID NO: 1114708 - RNA, 19 nt, Homo sapiens
cugcccaaaucuuaaguaa

SEQ ID NO: 1114709 - RNA, 19 nt, Homo sapiens
gagcgggagcuuuguagga

SEQ ID NO: 1114710 - RNA, 19 nt, Homo sapiens
agaagaaacauaugugaca

SEQ ID NO: 1114711 - RNA, 19 nt, Homo sapiens
agccuugugugcuguauuu

SEQ ID NO: 1114712 - RNA, 19 nt, Homo sapiens
gguaagucuuguuugagau

SEQ ID NO: 1114713 - RNA, 19 nt, Homo sapiens
guaccaagaacacuucaca

SEQ ID NO: 1114714 - RNA, 19 nt, Homo sapiens
gaacaaauggugaaauaug

SEQ ID NO: 1114715 - RNA, 19 nt, Homo sapiens
acaaggcgcuggauuauga

SEQ ID NO: 1114716 - RNA, 19 nt, Homo sapiens
gggauuugcucuuaaguga

SEQ ID NO: 1114717 - RNA, 19 nt, Homo sapiens
uggaacaaauggugaaaua

SEQ ID NO: 1114718 - RNA, 19 nt, Homo sapiens
gauuugcucuuaagugaaa

SEQ ID NO: 1114719 - RNA, 19 nt, Homo sapiens
ggauauaaaugaucacucu

SEQ ID NO: 1114720 - RNA, 19 nt, Homo sapiens
ugacaaugcuccugaaauc

SEQ ID NO: 1114721 - RNA, 19 nt, Homo sapiens
aaacaaaugcuccuagaaa

SEQ ID NO: 1114722 - RNA, 19 nt, Homo sapiens
uugaaacgauugagucaua

SEQ ID NO: 1114723 - RNA, 19 nt, Homo sapiens
ugucucagcuugggauuua

SEQ ID NO: 1114724 - RNA, 19 nt, Homo sapiens
gcacagccgaguacaauau

SEQ ID NO: 1114725 - RNA, 19 nt, Homo sapiens
agucauaauucacgugaua

SEQ ID NO: 1114726 - RNA, 19 nt, Homo sapiens
ugaaaucacugugucauca

SEQ ID NO: 1114727 - RNA, 19 nt, Homo sapiens
ucaaaagucuggagaaauu

SEQ ID NO: 1114728 - RNA, 19 nt, Homo sapiens
cggguggucucuaaugaua

SEQ ID NO: 1114729 - RNA, 19 nt, Homo sapiens
acagguaguuaauccauuu

SEQ ID NO: 1114730 - RNA, 19 nt, Homo sapiens
cuucugagcucaagagaug

SEQ ID NO: 1114731 - RNA, 19 nt, Homo sapiens
ggacaaggcgcuggauuau

SEQ ID NO: 1114732 - RNA, 19 nt, Homo sapiens
gggcucggguggucucuaa

SEQ ID NO: 1114733 - RNA, 19 nt, Homo sapiens
ccgaguagcuggcauuaca

SEQ ID NO: 1114734 - RNA, 19 nt, Homo sapiens
gauauucgcaagacauuug

SEQ ID NO: 1114735 - RNA, 19 nt, Homo sapiens
ggucagggauauaaaugau

SEQ ID NO: 1114736 - RNA, 19 nt, Homo sapiens
caucgagccuugcgugcua

SEQ ID NO: 1114737 - RNA, 19 nt, Homo sapiens
gguaguuaauccauuucua

SEQ ID NO: 1114738 - RNA, 19 nt, Homo sapiens
ggagugcaauggugugauc

SEQ ID NO: 1114739 - RNA, 19 nt, Homo sapiens
guuugcagcuggacauaaa

SEQ ID NO: 1114740 - RNA, 19 nt, Homo sapiens
cgagacaaaugaauucaag

SEQ ID NO: 1114741 - RNA, 19 nt, Homo sapiens
gacacgcacucagcagaua

SEQ ID NO: 1114742 - RNA, 19 nt, Homo sapiens
gagagucauuccagacaau

SEQ ID NO: 1114743 - RNA, 19 nt, Homo sapiens
gaagauauucgcaagacau

SEQ ID NO: 1114744 - RNA, 19 nt, Homo sapiens
ccaaagugcugggauuaca

SEQ ID NO: 1114745 - RNA, 19 nt, Homo sapiens
ucaggucgcuggacuacga

SEQ ID NO: 1114746 - RNA, 19 nt, Homo sapiens
gagcacagccgaguacaau

SEQ ID NO: 1114747 - RNA, 19 nt, Homo sapiens
ucagggauauaaaugauca

SEQ ID NO: 1114748 - RNA, 19 nt, Homo sapiens
ccaccacgcucggcuaaau

SEQ ID NO: 1114749 - RNA, 19 nt, Homo sapiens
uaaaaccgguuaucccuaa

SEQ ID NO: 1114750 - RNA, 19 nt, Homo sapiens
gcaaguccugcuucucuuu

SEQ ID NO: 1114751 - RNA, 19 nt, Homo sapiens
ggauuuagacucuggaaca

SEQ ID NO: 1114752 - RNA, 19 nt, Homo sapiens
gagcaccucuggauuuuga

SEQ ID NO: 1114753 - RNA, 19 nt, Homo sapiens
uagaaagugcgaaggauuu

SEQ ID NO: 1114754 - RNA, 19 nt, Homo sapiens
ggucucuaaugauaagaaa

SEQ ID NO: 1114755 - RNA, 19 nt, Homo sapiens
uggaaaaucuacagucaua

SEQ ID NO: 1114756 - RNA, 19 nt, Homo sapiens
gauuuagacucuggaacaa

SEQ ID NO: 1114757 - RNA, 19 nt, Homo sapiens
ugcgaaggauuuagaugua

SEQ ID NO: 1114758 - RNA, 19 nt, Homo sapiens
gacgggagguuccgagaca

SEQ ID NO: 1114759 - RNA, 19 nt, Homo sapiens
gaagaauuguuuguuccau

SEQ ID NO: 1114760 - RNA, 19 nt, Homo sapiens
uaauucacgugauagaugu

SEQ ID NO: 1114761 - RNA, 19 nt, Homo sapiens
aacaaaugcuccuagaaau

SEQ ID NO: 1114762 - RNA, 19 nt, Homo sapiens
ccggcuacuucuuguauuu

SEQ ID NO: 1114763 - RNA, 19 nt, Homo sapiens
uaggcaaucuggcaaagga

SEQ ID NO: 1114764 - RNA, 19 nt, Homo sapiens
ggagaaauuacuuuaagag

SEQ ID NO: 1114765 - RNA, 19 nt, Homo sapiens
ucccaugccucagaagaua

SEQ ID NO: 1114766 - RNA, 19 nt, Homo sapiens
ggugaaauaugcuauaccu

SEQ ID NO: 1114767 - RNA, 19 nt, Homo sapiens
gcaucagccucccgaguag

SEQ ID NO: 1114768 - RNA, 19 nt, Homo sapiens
aagcaauucuccugcauca

SEQ ID NO: 1114769 - RNA, 19 nt, Homo sapiens
agagaccacuggacagaga

SEQ ID NO: 1114770 - RNA, 19 nt, Homo sapiens
gaaaucacugugucaucaa

SEQ ID NO: 1114771 - RNA, 19 nt, Homo sapiens
uggacaaggcgcuggauua

SEQ ID NO: 1114772 - RNA, 19 nt, Homo sapiens
gagcuucaggucagggaua

SEQ ID NO: 1114773 - RNA, 19 nt, Homo sapiens
gaucgucaccauauuucuu

SEQ ID NO: 1114774 - RNA, 19 nt, Homo sapiens
cuaguuacguuauuaugca

SEQ ID NO: 1114775 - RNA, 19 nt, Homo sapiens
caaaugaauucaaguuccu

SEQ ID NO: 1114776 - RNA, 19 nt, Homo sapiens
guuggucucugacgucaau

SEQ ID NO: 1114777 - RNA, 19 nt, Homo sapiens
gcuaaaaucuucaguugag

SEQ ID NO: 1114778 - RNA, 19 nt, Homo sapiens
ugacaacuccccugaauuu

SEQ ID NO: 1114779 - RNA, 19 nt, Homo sapiens
guaggaaucaaugcuguaa

SEQ ID NO: 1114780 - RNA, 19 nt, Homo sapiens
ggaagaauagugaagaaaa

SEQ ID NO: 1114781 - RNA, 19 nt, Homo sapiens
ggaaauaccccgaguuagu

SEQ ID NO: 1114782 - RNA, 19 nt, Homo sapiens
gagguuccgagacaaauga

SEQ ID NO: 1114783 - RNA, 19 nt, Homo sapiens
cgugauagauguaaaugac

SEQ ID NO: 1114784 - RNA, 19 nt, Homo sapiens
caaauggugaaauaugcua

SEQ ID NO: 1114785 - RNA, 19 nt, Homo sapiens
ggaacaaauggugaaauau

SEQ ID NO: 1114786 - RNA, 19 nt, Homo sapiens
gguggucucuaaugauaag

SEQ ID NO: 1114787 - RNA, 19 nt, Homo sapiens
caacggaagaauuguuugu

SEQ ID NO: 1114788 - RNA, 19 nt, Homo sapiens
gcgaaggauuuagauguag

SEQ ID NO: 1114789 - RNA, 19 nt, Homo sapiens
cguuggugcuguguucuua

SEQ ID NO: 1114790 - RNA, 19 nt, Homo sapiens
gacaaaugaauucaaguuc

SEQ ID NO: 1114791 - RNA, 19 nt, Homo sapiens
ugucuucgcucuuccucuu

SEQ ID NO: 1114792 - RNA, 19 nt, Homo sapiens
gagagagcacagccgagua

SEQ ID NO: 1114793 - RNA, 19 nt, Homo sapiens
cggaagaccucccauucgu

SEQ ID NO: 1114794 - RNA, 19 nt, Homo sapiens
auccuuggcucgcugauuu

SEQ ID NO: 1114795 - RNA, 19 nt, Homo sapiens
agaaagugcgaaggauuua

SEQ ID NO: 1114796 - RNA, 19 nt, Homo sapiens
ccgacucgcucaccgucua

SEQ ID NO: 1114797 - RNA, 19 nt, Homo sapiens
cagaagauauucgcaagac

SEQ ID NO: 1114798 - RNA, 19 nt, Homo sapiens
uuuagacucuggaacaaau

SEQ ID NO: 1114799 - RNA, 19 nt, Homo sapiens
gaaauaccccgaguuaguu

SEQ ID NO: 1114800 - RNA, 19 nt, Homo sapiens
ccaccuccgccuccaagua

SEQ ID NO: 1114801 - RNA, 19 nt, Homo sapiens
aacuccaccuuucgaaaua

SEQ ID NO: 1114802 - RNA, 19 nt, Homo sapiens
aaacuccaccuuucgaaau

SEQ ID NO: 1114803 - RNA, 19 nt, Homo sapiens
gaagaauagugaagaaaac

SEQ ID NO: 1114804 - RNA, 19 nt, Homo sapiens
ucccuaauauccaggcaaa

SEQ ID NO: 1114805 - RNA, 19 nt, Homo sapiens
gaagcugcucggugccuaa

SEQ ID NO: 1114806 - RNA, 19 nt, Homo sapiens
agacaacggccaccuguuc

SEQ ID NO: 1114807 - RNA, 19 nt, Homo sapiens
gugcuaaaaucuucaguug

SEQ ID NO: 1114808 - RNA, 19 nt, Homo sapiens
cuggagaaauuacuuuaag

SEQ ID NO: 1114809 - RNA, 19 nt, Homo sapiens
aaugaucacucucccaucu

SEQ ID NO: 1114810 - RNA, 19 nt, Homo sapiens
gagccuugcgugcuacauu

SEQ ID NO: 1114811 - RNA, 19 nt, Homo sapiens
gucuuaaacuaguuacguu

SEQ ID NO: 1114812 - RNA, 19 nt, Homo sapiens
ugggaagaauagugaagaa

SEQ ID NO: 1114813 - RNA, 19 nt, Homo sapiens
guuccgagacaaaugaauu

SEQ ID NO: 1114814 - RNA, 19 nt, Homo sapiens
gagaauugcuugauuauga

SEQ ID NO: 1114815 - RNA, 19 nt, Homo sapiens
ggaaguauccuauucauuu

SEQ ID NO: 1114816 - RNA, 19 nt, Homo sapiens
gaugaucccuuucagauuu

SEQ ID NO: 1114817 - RNA, 19 nt, Homo sapiens
ucagagaauugcuugauua

SEQ ID NO: 1114818 - RNA, 19 nt, Homo sapiens
gaacaaccuuucaaaucaa

SEQ ID NO: 1114819 - RNA, 19 nt, Homo sapiens
cgaacaaccuuucaaauca

SEQ ID NO: 1114820 - RNA, 19 nt, Homo sapiens
gaaggcauaucuacauuuc

SEQ ID NO: 1114821 - RNA, 19 nt, Homo sapiens
ggacuuaacgguauccaaa

SEQ ID NO: 1114822 - RNA, 19 nt, Homo sapiens
gacuaugccuuauaauuga

SEQ ID NO: 1114823 - RNA, 19 nt, Homo sapiens
gagcaauacugaacaucaa

SEQ ID NO: 1114824 - RNA, 19 nt, Homo sapiens
cuacuaugcucaugacaaa

SEQ ID NO: 1114825 - RNA, 19 nt, Homo sapiens
aaagaugguuugcuacauu

SEQ ID NO: 1114826 - RNA, 19 nt, Homo sapiens
caugauauauccagagcua

SEQ ID NO: 1114827 - RNA, 19 nt, Homo sapiens
caaagcauauugugagcaa

SEQ ID NO: 1114828 - RNA, 19 nt, Homo sapiens
ucuaaucacuucugucuau

SEQ ID NO: 1114829 - RNA, 19 nt, Homo sapiens
ggacaacggccaccuguuc

SEQ ID NO: 1114830 - RNA, 19 nt, Homo sapiens
gcaauacugaacaucaaua

SEQ ID NO: 1114831 - RNA, 19 nt, Homo sapiens
gaagcuguguggcccuaaa

SEQ ID NO: 1114832 - RNA, 19 nt, Homo sapiens
aaacagacuaugccuuaua

SEQ ID NO: 1114833 - RNA, 19 nt, Homo sapiens
ccaaacucauucuaacauu

SEQ ID NO: 1114834 - RNA, 19 nt, Homo sapiens
gaaagaugguuugcuacau

SEQ ID NO: 1114835 - RNA, 19 nt, Homo sapiens
cccaaggaauuaauuacua

SEQ ID NO: 1114836 - RNA, 19 nt, Homo sapiens
gguaugggcagaagaugua

SEQ ID NO: 1114837 - RNA, 19 nt, Homo sapiens
agacuaugccuuauaauug

SEQ ID NO: 1114838 - RNA, 19 nt, Homo sapiens
caaacucauucuaacauuc

SEQ ID NO: 1114839 - RNA, 19 nt, Homo sapiens
ccagugaguucaaguucuu

SEQ ID NO: 1114840 - RNA, 19 nt, Homo sapiens
aaucugccauuccuacuaa

SEQ ID NO: 1114841 - RNA, 19 nt, Homo sapiens
ggacagcauuuagacuaga

SEQ ID NO: 1114842 - RNA, 19 nt, Homo sapiens
aacagacuaugccuuauaa

SEQ ID NO: 1114843 - RNA, 19 nt, Homo sapiens
uaaaacagacuaugccuua

SEQ ID NO: 1114844 - RNA, 19 nt, Homo sapiens
gaugaaggcaugauauauc

SEQ ID NO: 1114845 - RNA, 19 nt, Homo sapiens
uaguguacuugcucuauuu

SEQ ID NO: 1114846 - RNA, 19 nt, Homo sapiens
ggaaagaugguuugcuaca

SEQ ID NO: 1114847 - RNA, 19 nt, Homo sapiens
ggcagaagauguagacucu

SEQ ID NO: 1114848 - RNA, 19 nt, Homo sapiens
gcaacuucaagcauuauuu

SEQ ID NO: 1114849 - RNA, 19 nt, Homo sapiens
ucaggucgcuggacuacga

SEQ ID NO: 1114850 - RNA, 19 nt, Homo sapiens
gaaaaccgagcacaacaua

SEQ ID NO: 1114851 - RNA, 19 nt, Homo sapiens
ucagggauauaaaugauca

SEQ ID NO: 1114852 - RNA, 19 nt, Homo sapiens
cagacuaugccuuauaauu

SEQ ID NO: 1114853 - RNA, 19 nt, Homo sapiens
guacuugcucuauuuaaga

SEQ ID NO: 1114854 - RNA, 19 nt, Homo sapiens
uaagaaggcauaucuacau

SEQ ID NO: 1114855 - RNA, 19 nt, Homo sapiens
ccaguuauuucggauauuc

SEQ ID NO: 1114856 - RNA, 19 nt, Homo sapiens
gugaugaaggcaugauaua

SEQ ID NO: 1114857 - RNA, 19 nt, Homo sapiens
gguuuccgaugauaacaaa

SEQ ID NO: 1114858 - RNA, 19 nt, Homo sapiens
ccagggugguuuccgauga

SEQ ID NO: 1114859 - RNA, 19 nt, Homo sapiens
ggcaaaggaucugggacua

SEQ ID NO: 1114860 - RNA, 19 nt, Homo sapiens
guucuggguuuggacguua

SEQ ID NO: 1114861 - RNA, 19 nt, Homo sapiens
aagaaggcauaucuacauu

SEQ ID NO: 1114862 - RNA, 19 nt, Homo sapiens
gaucagagccgaguacaac

SEQ ID NO: 1114863 - RNA, 19 nt, Homo sapiens
gaaacuggaccgagagaag

SEQ ID NO: 1114864 - RNA, 19 nt, Homo sapiens
ccgaugauaacaaacaaua

SEQ ID NO: 1114865 - RNA, 19 nt, Homo sapiens
aauuccaccuuccgaaaua

SEQ ID NO: 1114866 - RNA, 19 nt, Homo sapiens
gaggaagggugaagaaaau

SEQ ID NO: 1114867 - RNA, 19 nt, Homo sapiens
gaguacaacaucacuauca

SEQ ID NO: 1114868 - RNA, 19 nt, Homo sapiens
gacagcauuuagacuagaa

SEQ ID NO: 1114869 - RNA, 19 nt, Homo sapiens
ccaacugcccaaggaauua

SEQ ID NO: 1114870 - RNA, 19 nt, Homo sapiens
gaaaauggaaagaugguuu

SEQ ID NO: 1114871 - RNA, 19 nt, Homo sapiens
auggaaagaugguuugcua

SEQ ID NO: 1114872 - RNA, 19 nt, Homo sapiens
gcauaucuacauuuccaaa

SEQ ID NO: 1114873 - RNA, 19 nt, Homo sapiens
ggaguguccuuggcagguu

SEQ ID NO: 1114874 - RNA, 19 nt, Homo sapiens
ucugcaagauguaggguuu

SEQ ID NO: 1114875 - RNA, 19 nt, Homo sapiens
gagagucagggauauaaau

SEQ ID NO: 1114876 - RNA, 19 nt, Homo sapiens
aggcaaguccuguuucuuu

SEQ ID NO: 1114877 - RNA, 19 nt, Homo sapiens
cuaaucacuucugucuaua

SEQ ID NO: 1114878 - RNA, 19 nt, Homo sapiens
gggacagcauuuagacuag

SEQ ID NO: 1114879 - RNA, 19 nt, Homo sapiens
gccaguauuucaggacaaa

SEQ ID NO: 1114880 - RNA, 19 nt, Homo sapiens
acaaaggcaaguccuguuu

SEQ ID NO: 1114881 - RNA, 19 nt, Homo sapiens
caacugcccaaggaauuaa

SEQ ID NO: 1114882 - RNA, 19 nt, Homo sapiens
ggaccagugaguucaaguu

SEQ ID NO: 1114883 - RNA, 19 nt, Homo sapiens
ucccagagcuaccaguaug

SEQ ID NO: 1114884 - RNA, 19 nt, Homo sapiens
cuacauuuccaaacucauu

SEQ ID NO: 1114885 - RNA, 19 nt, Homo sapiens
gcggaaguauccuauucau

SEQ ID NO: 1114886 - RNA, 19 nt, Homo sapiens
ucuuuaagcaugcuacuuu

SEQ ID NO: 1114887 - RNA, 19 nt, Homo sapiens
ccauuggguuccuuauugu

SEQ ID NO: 1114888 - RNA, 19 nt, Homo sapiens
gagcuaguguuggacaaag

SEQ ID NO: 1114889 - RNA, 19 nt, Homo sapiens
gaagggacagcauuuagac

SEQ ID NO: 1114890 - RNA, 19 nt, Homo sapiens
gauccuuuguggucaaucu

SEQ ID NO: 1114891 - RNA, 19 nt, Homo sapiens
gcuugcaucucaugauucu

SEQ ID NO: 1114892 - RNA, 19 nt, Homo sapiens
ccuuucaaaucaauccuuu

SEQ ID NO: 1114893 - RNA, 19 nt, Homo sapiens
ucgaacaaccuuucaaauc

SEQ ID NO: 1114894 - RNA, 19 nt, Homo sapiens
gcuugauuaugaguuagua

SEQ ID NO: 1114895 - RNA, 19 nt, Homo sapiens
gcauuuagacuagaaagag

SEQ ID NO: 1114896 - RNA, 19 nt, Homo sapiens
ugaagggacagcauuuaga

SEQ ID NO: 1114897 - RNA, 19 nt, Homo sapiens
gacaaaggcaaguccuguu

SEQ ID NO: 1114898 - RNA, 19 nt, Homo sapiens
ucacauaccgggaauuugc

SEQ ID NO: 1114899 - RNA, 19 nt, Homo sapiens
uugcaucucaugauucuaa

SEQ ID NO: 1114900 - RNA, 19 nt, Homo sapiens
ccugcaggcuuucgaguuc

SEQ ID NO: 1114901 - RNA, 19 nt, Homo sapiens
acgaggcccugcaggcuuu

SEQ ID NO: 1114902 - RNA, 19 nt, Homo sapiens
gguggaggccuuucugcaa

SEQ ID NO: 1114903 - RNA, 19 nt, Homo sapiens
gagucagggauauaaauga

SEQ ID NO: 1114904 - RNA, 19 nt, Homo sapiens
gacguuauucggugacuga

SEQ ID NO: 1114905 - RNA, 19 nt, Homo sapiens
guauaccccugugguuuua

SEQ ID NO: 1114906 - RNA, 19 nt, Homo sapiens
aaaggcaaguccuguuucu

SEQ ID NO: 1114907 - RNA, 19 nt, Homo sapiens
ggagucaacgcggaaguau

SEQ ID NO: 1114908 - RNA, 19 nt, Homo sapiens
ugaucacgcgccaguauuu

SEQ ID NO: 1114909 - RNA, 19 nt, Homo sapiens
cuuggcagguucuggguuu

SEQ ID NO: 1114910 - RNA, 19 nt, Homo sapiens
ggaggaagggugaagaaaa

SEQ ID NO: 1114911 - RNA, 19 nt, Homo sapiens
caacgcggaaguauccuau

SEQ ID NO: 1114912 - RNA, 19 nt, Homo sapiens
ggugaugaaggcaugauau

SEQ ID NO: 1114913 - RNA, 19 nt, Homo sapiens
aaccaguuauuucggauau

SEQ ID NO: 1114914 - RNA, 19 nt, Homo sapiens
gaaaggaacccacuuaaua

SEQ ID NO: 1114915 - RNA, 19 nt, Homo sapiens
gagaauugcuugauuauga

SEQ ID NO: 1114916 - RNA, 19 nt, Homo sapiens
caacagcaaucacaaagua

SEQ ID NO: 1114917 - RNA, 19 nt, Homo sapiens
gaugaucccuuucagauuu

SEQ ID NO: 1114918 - RNA, 19 nt, Homo sapiens
ucagagaauugcuugauua

SEQ ID NO: 1114919 - RNA, 19 nt, Homo sapiens
gagcuucuuucuagauaua

SEQ ID NO: 1114920 - RNA, 19 nt, Homo sapiens
gaugaggcauuucuuacua

SEQ ID NO: 1114921 - RNA, 19 nt, Homo sapiens
gaaagacaauuugcuaugu

SEQ ID NO: 1114922 - RNA, 19 nt, Homo sapiens
ggaacccacuuaauaaaga

SEQ ID NO: 1114923 - RNA, 19 nt, Homo sapiens
gagcaaaacuccaucaaaa

SEQ ID NO: 1114924 - RNA, 19 nt, Homo sapiens
ggacuacaguugcauguca

SEQ ID NO: 1114925 - RNA, 19 nt, Homo sapiens
gaaaccgucuguugacaau

SEQ ID NO: 1114926 - RNA, 19 nt, Homo sapiens
gaaaguaaggaaacagaaa

SEQ ID NO: 1114927 - RNA, 19 nt, Homo sapiens
ugagguuccuguuaaauuu

SEQ ID NO: 1114928 - RNA, 19 nt, Homo sapiens
gagcaaagcugaguacaac

SEQ ID NO: 1114929 - RNA, 19 nt, Homo sapiens
gagccgagauugcaccauu

SEQ ID NO: 1114930 - RNA, 19 nt, Homo sapiens
ugaaaccgguguucuuauu

SEQ ID NO: 1114931 - RNA, 19 nt, Homo sapiens
ggacaauggccaccuguuu

SEQ ID NO: 1114932 - RNA, 19 nt, Homo sapiens
ccacucagccucccaaauu

SEQ ID NO: 1114933 - RNA, 19 nt, Homo sapiens
caugauauauccagagcua

SEQ ID NO: 1114934 - RNA, 19 nt, Homo sapiens
ggaaagaaauagaggaaaa

SEQ ID NO: 1114935 - RNA, 19 nt, Homo sapiens
cgacauuccuugacuuaau

SEQ ID NO: 1114936 - RNA, 19 nt, Homo sapiens
aaaggaacccacuuaauaa

SEQ ID NO: 1114937 - RNA, 19 nt, Homo sapiens
gcaaaacuccaucaaaaua

SEQ ID NO: 1114938 - RNA, 19 nt, Homo sapiens
uaaagugucugcaggagau

SEQ ID NO: 1114939 - RNA, 19 nt, Homo sapiens
caaagacaagugaaaguaa

SEQ ID NO: 1114940 - RNA, 19 nt, Homo sapiens
ccacaaagaagguacuauu

SEQ ID NO: 1114941 - RNA, 19 nt, Homo sapiens
ggaaagacaauuugcuaug

SEQ ID NO: 1114942 - RNA, 19 nt, Homo sapiens
gcagaaguauccuauucau

SEQ ID NO: 1114943 - RNA, 19 nt, Homo sapiens
gccucuacauuauucauua

SEQ ID NO: 1114944 - RNA, 19 nt, Homo sapiens
gaagcuguguggcccuaaa

SEQ ID NO: 1114945 - RNA, 19 nt, Homo sapiens
gcacccagccuacaauaau

SEQ ID NO: 1114946 - RNA, 19 nt, Homo sapiens
ucuauaggaucaugugaaa

SEQ ID NO: 1114947 - RNA, 19 nt, Homo sapiens
gggauaguauuggcuguuu

SEQ ID NO: 1114948 - RNA, 19 nt, Homo sapiens
ggacagcauuuagacuaga

SEQ ID NO: 1114949 - RNA, 19 nt, Homo sapiens
gacagagacuccggagaaa

SEQ ID NO: 1114950 - RNA, 19 nt, Homo sapiens
ugaaaacucuccugggaua

SEQ ID NO: 1114951 - RNA, 19 nt, Homo sapiens
ugauucaucuucaacuuug

SEQ ID NO: 1114952 - RNA, 19 nt, Homo sapiens
ucugcaagauguacaguuu

SEQ ID NO: 1114953 - RNA, 19 nt, Homo sapiens
gaugaaggcaugauauauc

SEQ ID NO: 1114954 - RNA, 19 nt, Homo sapiens
cuuguuggcuaacuaaauu

SEQ ID NO: 1114955 - RNA, 19 nt, Homo sapiens
uaucaucacuuuccaacuc

SEQ ID NO: 1114956 - RNA, 19 nt, Homo sapiens
ucaggucgcuggacuacga

SEQ ID NO: 1114957 - RNA, 19 nt, Homo sapiens
agacagagacuccggagaa

SEQ ID NO: 1114958 - RNA, 19 nt, Homo sapiens
ugacaauccuccugaacug

SEQ ID NO: 1114959 - RNA, 19 nt, Homo sapiens
gaaaccgguguucuuauug

SEQ ID NO: 1114960 - RNA, 19 nt, Homo sapiens
aaccgucuguugacaauuu

SEQ ID NO: 1114961 - RNA, 19 nt, Homo sapiens
gacauuccuugacuuaauc

SEQ ID NO: 1114962 - RNA, 19 nt, Homo sapiens
gacaauggccaccuguuug

SEQ ID NO: 1114963 - RNA, 19 nt, Homo sapiens
ggcaaaggaucugggacua

SEQ ID NO: 1114964 - RNA, 19 nt, Homo sapiens
gcauuguggucuuggaugu

SEQ ID NO: 1114965 - RNA, 19 nt, Homo sapiens
gugaugaaggcaugauaua

SEQ ID NO: 1114966 - RNA, 19 nt, Homo sapiens
gguuuccgaugauaacaaa

SEQ ID NO: 1114967 - RNA, 19 nt, Homo sapiens
ccagggugguuuccgauga

SEQ ID NO: 1114968 - RNA, 19 nt, Homo sapiens
aaacaacagcaaucacaaa

SEQ ID NO: 1114969 - RNA, 19 nt, Homo sapiens
uagaaucccauaagugaaa

SEQ ID NO: 1114970 - RNA, 19 nt, Homo sapiens
aaacucuccugggauagua

SEQ ID NO: 1114971 - RNA, 19 nt, Homo sapiens
guucuggguuuggacguua

SEQ ID NO: 1114972 - RNA, 19 nt, Homo sapiens
gaaacuggaccgagagaag

SEQ ID NO: 1114973 - RNA, 19 nt, Homo sapiens
ccgaugauaacaaacaaua

SEQ ID NO: 1114974 - RNA, 19 nt, Homo sapiens
acaaagacaagugaaagua

SEQ ID NO: 1114975 - RNA, 19 nt, Homo sapiens
ccagugccauccaguugaa

SEQ ID NO: 1114976 - RNA, 19 nt, Homo sapiens
cacaaagaagguacuauuu

SEQ ID NO: 1114977 - RNA, 19 nt, Homo sapiens
gcaggucuccgacgucaau

SEQ ID NO: 1114978 - RNA, 19 nt, Homo sapiens
aggagucaaugcagaagua

SEQ ID NO: 1114979 - RNA, 19 nt, Homo sapiens
gacagcauuuagacuagaa

SEQ ID NO: 1114980 - RNA, 19 nt, Homo sapiens
auucauugccucuacauua

SEQ ID NO: 1114981 - RNA, 19 nt, Homo sapiens
cuaacuaaauuguguaugc

SEQ ID NO: 1114982 - RNA, 19 nt, Homo sapiens
aaagacaagugaaaguaag

SEQ ID NO: 1114983 - RNA, 19 nt, Homo sapiens
gcaggagaaucgcuugaac

SEQ ID NO: 1114984 - RNA, 19 nt, Homo sapiens
cuagauauaaggucuuuga

SEQ ID NO: 1114985 - RNA, 19 nt, Homo sapiens
gcuuuagucuggaaaccaa

SEQ ID NO: 1114986 - RNA, 19 nt, Homo sapiens
uuacuagaaucccauaagu

SEQ ID NO: 1114987 - RNA, 19 nt, Homo sapiens
ucuucaacuuugcguauua

SEQ ID NO: 1114988 - RNA, 19 nt, Homo sapiens
gcaaagcugaguacaacau

SEQ ID NO: 1114989 - RNA, 19 nt, Homo sapiens
caaugacaauccuccugaa

SEQ ID NO: 1114990 - RNA, 19 nt, Homo sapiens
cacccagccuacaauaauu

SEQ ID NO: 1114991 - RNA, 19 nt, Homo sapiens
agagacggguuucaucaug

SEQ ID NO: 1114992 - RNA, 19 nt, Homo sapiens
guagagacggguuucauca

SEQ ID NO: 1114993 - RNA, 19 nt, Homo sapiens
ggaguguccuuggcagguu

SEQ ID NO: 1114994 - RNA, 19 nt, Homo sapiens
uaaauucauugccucuaca

SEQ ID NO: 1114995 - RNA, 19 nt, Homo sapiens
gaucauaucaucacuuucc

SEQ ID NO: 1114996 - RNA, 19 nt, Homo sapiens
gaccuccacuauacgcauu

SEQ ID NO: 1114997 - RNA, 19 nt, Homo sapiens
aggcaaguccuguuucuuu

SEQ ID NO: 1114998 - RNA, 19 nt, Homo sapiens
ggagguggaaguugcuuug

SEQ ID NO: 1114999 - RNA, 19 nt, Homo sapiens
gcuauuagaguguuauugg

SEQ ID NO: 1115000 - RNA, 19 nt, Homo sapiens
acuagaaucccauaaguga

SEQ ID NO: 1115001 - RNA, 19 nt, Homo sapiens
ccacgacauuccuugacuu

SEQ ID NO: 1115002 - RNA, 19 nt, Homo sapiens
gaaaaccgagcacagcaua

SEQ ID NO: 1115003 - RNA, 19 nt, Homo sapiens
gggacagcauuuagacuag

SEQ ID NO: 1115004 - RNA, 19 nt, Homo sapiens
uuccugagguuccuguuaa

SEQ ID NO: 1115005 - RNA, 19 nt, Homo sapiens
uugccauccuuguucauua

SEQ ID NO: 1115006 - RNA, 19 nt, Homo sapiens
ccgguguucuuauugguuu

SEQ ID NO: 1115007 - RNA, 19 nt, Homo sapiens
gaacccacuuaauaaagac

SEQ ID NO: 1115008 - RNA, 19 nt, Homo sapiens
acaaaggcaaguccuguuu

SEQ ID NO: 1115009 - RNA, 19 nt, Homo sapiens
ugaaaggaacccacuuaau

SEQ ID NO: 1115010 - RNA, 19 nt, Homo sapiens
ggacagagagagcaaagcu

SEQ ID NO: 1115011 - RNA, 19 nt, Homo sapiens
ccugaugaggcauuucuua

SEQ ID NO: 1115012 - RNA, 19 nt, Homo sapiens
guucagcuuuccaagacaa

SEQ ID NO: 1115013 - RNA, 19 nt, Homo sapiens
ucaccacguucggcuaauu

SEQ ID NO: 1115014 - RNA, 19 nt, Homo sapiens
gaaaauaaguugcuccauu

SEQ ID NO: 1115015 - RNA, 19 nt, Homo sapiens
cgaccacucuccaguauuu

SEQ ID NO: 1115016 - RNA, 19 nt, Homo sapiens
gagagaugcuggaggcuuu

SEQ ID NO: 1115017 - RNA, 19 nt, Homo sapiens
gagauuuccuauucacuuu

SEQ ID NO: 1115018 - RNA, 19 nt, Homo sapiens
gagcucagguuaacacuca

SEQ ID NO: 1115019 - RNA, 19 nt, Homo sapiens
ggagaaauucgacuaaaga

SEQ ID NO: 1115020 - RNA, 19 nt, Homo sapiens
gagggcagcuccuuuguca

SEQ ID NO: 1115021 - RNA, 19 nt, Homo sapiens
caacacaucucaauaugac

SEQ ID NO: 1115022 - RNA, 19 nt, Homo sapiens
gacaacacaucucaauaug

SEQ ID NO: 1115023 - RNA, 19 nt, Homo sapiens
ggacugcguuuccucugaa

SEQ ID NO: 1115024 - RNA, 19 nt, Homo sapiens
gaaauucgacuaaagaaac

SEQ ID NO: 1115025 - RNA, 19 nt, Homo sapiens
gaaauuggaccgugaggau

SEQ ID NO: 1115026 - RNA, 19 nt, Homo sapiens
ugacaacacaucucaauau

SEQ ID NO: 1115027 - RNA, 19 nt, Homo sapiens
uaaggucgauuucuugaca

SEQ ID NO: 1115028 - RNA, 19 nt, Homo sapiens
gcagugauggcaggaaaua

SEQ ID NO: 1115029 - RNA, 19 nt, Homo sapiens
ggagaccgcggauuuguug

SEQ ID NO: 1115030 - RNA, 19 nt, Homo sapiens
ugaaaccaguauuaccuaa

SEQ ID NO: 1115031 - RNA, 19 nt, Homo sapiens
acggagagauuuccuauuc

SEQ ID NO: 1115032 - RNA, 19 nt, Homo sapiens
gcuccuuugucaccaauuu

SEQ ID NO: 1115033 - RNA, 19 nt, Homo sapiens
uaacagagacaccacuaga

SEQ ID NO: 1115034 - RNA, 19 nt, Homo sapiens
gagccugucucagaacuau

SEQ ID NO: 1115035 - RNA, 19 nt, Homo sapiens
acuacucacuggcauauuu

SEQ ID NO: 1115036 - RNA, 19 nt, Homo sapiens
gaaguuaccaugucugcau

SEQ ID NO: 1115037 - RNA, 19 nt, Homo sapiens
gcaccguucugauucaagu

SEQ ID NO: 1115038 - RNA, 19 nt, Homo sapiens
ucaggucgcuggacuacga

SEQ ID NO: 1115039 - RNA, 19 nt, Homo sapiens
gaagcucauuugcagacaa

SEQ ID NO: 1115040 - RNA, 19 nt, Homo sapiens
gaauucagcaagaacaaug

SEQ ID NO: 1115041 - RNA, 19 nt, Homo sapiens
caggagaaauucgacuaaa

SEQ ID NO: 1115042 - RNA, 19 nt, Homo sapiens
gauauaggccaaaacaaua

SEQ ID NO: 1115043 - RNA, 19 nt, Homo sapiens
guuaccaugucugcauuua

SEQ ID NO: 1115044 - RNA, 19 nt, Homo sapiens
gagaaauucgacuaaagaa

SEQ ID NO: 1115045 - RNA, 19 nt, Homo sapiens
gguuucagccuucaguuaa

SEQ ID NO: 1115046 - RNA, 19 nt, Homo sapiens
gcauauuucugagguaucu

SEQ ID NO: 1115047 - RNA, 19 nt, Homo sapiens
caacggagagauuuccuau

SEQ ID NO: 1115048 - RNA, 19 nt, Homo sapiens
ggagucaacggagagauuu

SEQ ID NO: 1115049 - RNA, 19 nt, Homo sapiens
gggacugcguuuccucuga

SEQ ID NO: 1115050 - RNA, 19 nt, Homo sapiens
ggaacaaaacucuaacuuu

SEQ ID NO: 1115051 - RNA, 19 nt, Homo sapiens
ggagaaaaugggaaaauaa

SEQ ID NO: 1115052 - RNA, 19 nt, Homo sapiens
gaaacugugguugcacuuu

SEQ ID NO: 1115053 - RNA, 19 nt, Homo sapiens
gaacgaccaugccccagaa

SEQ ID NO: 1115054 - RNA, 19 nt, Homo sapiens
ggagagauuuccuauucac

SEQ ID NO: 1115055 - RNA, 19 nt, Homo sapiens
gagggaacaaacuacauuu

SEQ ID NO: 1115056 - RNA, 19 nt, Homo sapiens
gaguacaacgucacuauca

SEQ ID NO: 1115057 - RNA, 19 nt, Homo sapiens
agacaccacuagacagaga

SEQ ID NO: 1115058 - RNA, 19 nt, Homo sapiens
aaacgaccacucuccagua

SEQ ID NO: 1115059 - RNA, 19 nt, Homo sapiens
ggacuacucacuggcauau

SEQ ID NO: 1115060 - RNA, 19 nt, Homo sapiens
gcauuuaccagcccaauac

SEQ ID NO: 1115061 - RNA, 19 nt, Homo sapiens
gcaaguaauagacauaaac

SEQ ID NO: 1115062 - RNA, 19 nt, Homo sapiens
guugcuaaaugagaaauug

SEQ ID NO: 1115063 - RNA, 19 nt, Homo sapiens
ggccagaaauggaacaaaa

SEQ ID NO: 1115064 - RNA, 19 nt, Homo sapiens
agaaugcgccugaaacugu

SEQ ID NO: 1115065 - RNA, 19 nt, Homo sapiens
ccuaugaagucaauaucga

SEQ ID NO: 1115066 - RNA, 19 nt, Homo sapiens
cgacuaaagaaacaacuug

SEQ ID NO: 1115067 - RNA, 19 nt, Homo sapiens
aggaauggcuuugguuuca

SEQ ID NO: 1115068 - RNA, 19 nt, Homo sapiens
gagaaagcagagccgagua

SEQ ID NO: 1115069 - RNA, 19 nt, Homo sapiens
aaaauaaguugcuccauuc

SEQ ID NO: 1115070 - RNA, 19 nt, Homo sapiens
gcacugcucaggucuacau

SEQ ID NO: 1115071 - RNA, 19 nt, Homo sapiens
ggcggaaccuagaagcuau

SEQ ID NO: 1115072 - RNA, 19 nt, Homo sapiens
gacaggagaaauucgacua

SEQ ID NO: 1115073 - RNA, 19 nt, Homo sapiens
caguauuucuggacaaaca

SEQ ID NO: 1115074 - RNA, 19 nt, Homo sapiens
gugcuacguuuccaagugu

SEQ ID NO: 1115075 - RNA, 19 nt, Homo sapiens
ccgcggauuuguugcuaaa

SEQ ID NO: 1115076 - RNA, 19 nt, Homo sapiens
gaccuugauucaggagaaa

SEQ ID NO: 1115077 - RNA, 19 nt, Homo sapiens
caauaagcuuccugguugu

SEQ ID NO: 1115078 - RNA, 19 nt, Homo sapiens
guuucagccuucaguuaaa

SEQ ID NO: 1115079 - RNA, 19 nt, Homo sapiens
ugucuucgcucuuccucuu

SEQ ID NO: 1115080 - RNA, 19 nt, Homo sapiens
ugauucaagugauagaugu

SEQ ID NO: 1115081 - RNA, 19 nt, Homo sapiens
ccaagcuucagaugagaua

SEQ ID NO: 1115082 - RNA, 19 nt, Homo sapiens
caaauguuggugaaaguau

SEQ ID NO: 1115083 - RNA, 19 nt, Homo sapiens
gaccgcggauuuguugcua

SEQ ID NO: 1115084 - RNA, 19 nt, Homo sapiens
ucaccaauuuagcaaagga

SEQ ID NO: 1115085 - RNA, 19 nt, Homo sapiens
agagagucccuucgaguuu

SEQ ID NO: 1115086 - RNA, 19 nt, Homo sapiens
agacaacggccaccuguuc

SEQ ID NO: 1115087 - RNA, 19 nt, Homo sapiens
gcugacaacacaucucaau

SEQ ID NO: 1115088 - RNA, 19 nt, Homo sapiens
uaagcuuccugguugugaa

SEQ ID NO: 1115089 - RNA, 19 nt, Homo sapiens
gcagcuccuuugucaccaa

SEQ ID NO: 1115090 - RNA, 19 nt, Homo sapiens
agaccuugauucaggagaa

SEQ ID NO: 1115091 - RNA, 19 nt, Homo sapiens
gagagucccuucgaguuuu

SEQ ID NO: 1115092 - RNA, 19 nt, Homo sapiens
ccgggagccugucucagaa

SEQ ID NO: 1115093 - RNA, 19 nt, Homo sapiens
gcuggaggcuuuucuggaa

SEQ ID NO: 1115094 - RNA, 19 nt, Homo sapiens
ucaguccuaugaagucaau

SEQ ID NO: 1115095 - RNA, 19 nt, Homo sapiens
agacauaaacgaccacucu

SEQ ID NO: 1115096 - RNA, 19 nt, Homo sapiens
cacccaggcugacaacaca

SEQ ID NO: 1115097 - RNA, 19 nt, Homo sapiens
gacuaaagaaacaacuuga

SEQ ID NO: 1115098 - RNA, 19 nt, Homo sapiens
uagagagucccuucgaguu

SEQ ID NO: 1115099 - RNA, 19 nt, Homo sapiens
ccgacucucucaccgucua

SEQ ID NO: 1115100 - RNA, 19 nt, Homo sapiens
aaacugugguugcacuuuu

SEQ ID NO: 1115101 - RNA, 19 nt, Homo sapiens
ucugagguaucuguagaaa

SEQ ID NO: 1115102 - RNA, 19 nt, Homo sapiens
cggagagauuuccuauuca

SEQ ID NO: 1115103 - RNA, 19 nt, Homo sapiens
gcugcaaguaauagacaua

SEQ ID NO: 1115104 - RNA, 19 nt, Homo sapiens
agagggaacaaacuacauu

SEQ ID NO: 1115105 - RNA, 19 nt, Homo sapiens
ugucucagaacuaucagua

SEQ ID NO: 1115106 - RNA, 19 nt, Homo sapiens
cgucagcgccacagacaga

SEQ ID NO: 1115107 - RNA, 19 nt, Homo sapiens
uuucugagguaucuguaga

SEQ ID NO: 1115108 - RNA, 19 nt, Homo sapiens
gaaagcagagccgaguaca

SEQ ID NO: 1115109 - RNA, 19 nt, Homo sapiens
uggcauauuucugagguau

SEQ ID NO: 1115110 - RNA, 19 nt, Homo sapiens
gagcugcaaguaauagaca

SEQ ID NO: 1115111 - RNA, 19 nt, Homo sapiens
acaacacaucucaauauga

SEQ ID NO: 1115112 - RNA, 19 nt, Homo sapiens
gaccaugccccagaaguua

SEQ ID NO: 1115113 - RNA, 19 nt, Homo sapiens
aggagaaauucgacuaaag

SEQ ID NO: 1115114 - RNA, 19 nt, Homo sapiens
gcaaguuucugccuaauua

SEQ ID NO: 1115115 - RNA, 19 nt, Homo sapiens
gugaauacguuucugauua

SEQ ID NO: 1115116 - RNA, 19 nt, Homo sapiens
gaacuagaauuguuucaga

SEQ ID NO: 1115117 - RNA, 19 nt, Homo sapiens
gauaucaccuggcaaguuu

SEQ ID NO: 1115118 - RNA, 19 nt, Homo sapiens
gaauaucuaucccgaauug

SEQ ID NO: 1115119 - RNA, 19 nt, Homo sapiens
ccacaaacauugcuauuau

SEQ ID NO: 1115120 - RNA, 19 nt, Homo sapiens
acaaauagauggucuuaga

SEQ ID NO: 1115121 - RNA, 19 nt, Homo sapiens
gaacaaauagauggucuua

SEQ ID NO: 1115122 - RNA, 19 nt, Homo sapiens
ggagaagucuuuuaucaua

SEQ ID NO: 1115123 - RNA, 19 nt, Homo sapiens
ucacaaagcaugaaaugua

SEQ ID NO: 1115124 - RNA, 19 nt, Homo sapiens
gaccagaacaugcaaauuu

SEQ ID NO: 1115125 - RNA, 19 nt, Homo sapiens
gagagaggcaccuuucuua

SEQ ID NO: 1115126 - RNA, 19 nt, Homo sapiens
ggacaacggccaccuguuu

SEQ ID NO: 1115127 - RNA, 19 nt, Homo sapiens
ggacaaaugaguucaaguu

SEQ ID NO: 1115128 - RNA, 19 nt, Homo sapiens
caaaugaguucaaguuucu

SEQ ID NO: 1115129 - RNA, 19 nt, Homo sapiens
gggaagagauaccagaguu

SEQ ID NO: 1115130 - RNA, 19 nt, Homo sapiens
gaaauuggaccgagaggaa

SEQ ID NO: 1115131 - RNA, 19 nt, Homo sapiens
acagagagauuuccuugaa

SEQ ID NO: 1115132 - RNA, 19 nt, Homo sapiens
ucaguaaguucacuaaguu

SEQ ID NO: 1115133 - RNA, 19 nt, Homo sapiens
gaaccaacagccugaguaa

SEQ ID NO: 1115134 - RNA, 19 nt, Homo sapiens
aggcaagucuuauuucuuu

SEQ ID NO: 1115135 - RNA, 19 nt, Homo sapiens
gaaagacugauccaaagaa

SEQ ID NO: 1115136 - RNA, 19 nt, Homo sapiens
gcacaggauucagauguug

SEQ ID NO: 1115137 - RNA, 19 nt, Homo sapiens
ugaucacgcuccaguauuu

SEQ ID NO: 1115138 - RNA, 19 nt, Homo sapiens
gcaccuuucuuaccaacuu

SEQ ID NO: 1115139 - RNA, 19 nt, Homo sapiens
gcucugaucuguccaaacu

SEQ ID NO: 1115140 - RNA, 19 nt, Homo sapiens
aaacuucuauacucuggua

SEQ ID NO: 1115141 - RNA, 19 nt, Homo sapiens
gaaauucucggaaguuaag

SEQ ID NO: 1115142 - RNA, 19 nt, Homo sapiens
aagcauagacuguagagua

SEQ ID NO: 1115143 - RNA, 19 nt, Homo sapiens
caagaacccuucacaaagc

SEQ ID NO: 1115144 - RNA, 19 nt, Homo sapiens
ucaaagagaaucauagaug

SEQ ID NO: 1115145 - RNA, 19 nt, Homo sapiens
ccaacucgcucaccgucua

SEQ ID NO: 1115146 - RNA, 19 nt, Homo sapiens
gaaaaggcaagucuuauuu

SEQ ID NO: 1115147 - RNA, 19 nt, Homo sapiens
ggauuccgcugcugccauu

SEQ ID NO: 1115148 - RNA, 19 nt, Homo sapiens
cacaaagcaugaaauguau

SEQ ID NO: 1115149 - RNA, 19 nt, Homo sapiens
gauaccagaguucaguuua

SEQ ID NO: 1115150 - RNA, 19 nt, Homo sapiens
ggaaacagugguaauagga

SEQ ID NO: 1115151 - RNA, 19 nt, Homo sapiens
ggucuuagagauucaguaa

SEQ ID NO: 1115152 - RNA, 19 nt, Homo sapiens
gaaaggaaacagugguaau

SEQ ID NO: 1115153 - RNA, 19 nt, Homo sapiens
gagcauccaucccagaucu

SEQ ID NO: 1115154 - RNA, 19 nt, Homo sapiens
ggagugucuuuacaucauu

SEQ ID NO: 1115155 - RNA, 19 nt, Homo sapiens
ugaauacguuucugauuag

SEQ ID NO: 1115156 - RNA, 19 nt, Homo sapiens
aaaggaaacagugguaaua

SEQ ID NO: 1115157 - RNA, 19 nt, Homo sapiens
ucaaaucaauccaacaucu

SEQ ID NO: 1115158 - RNA, 19 nt, Homo sapiens
gaaaauagccccguugguu

SEQ ID NO: 1115159 - RNA, 19 nt, Homo sapiens
gugaucuacuucuaaauga

SEQ ID NO: 1115160 - RNA, 19 nt, Homo sapiens
acaaaugaguucaaguuuc

SEQ ID NO: 1115161 - RNA, 19 nt, Homo sapiens
gagagaggaacacugagua

SEQ ID NO: 1115162 - RNA, 19 nt, Homo sapiens
ccaacagccugaguaacua

SEQ ID NO: 1115163 - RNA, 19 nt, Homo sapiens
ggaaccaacagccugagua

SEQ ID NO: 1115164 - RNA, 19 nt, Homo sapiens
auacugcuguccaaucuuu

SEQ ID NO: 1115165 - RNA, 19 nt, Homo sapiens
gacaaaugaguucaaguuu

SEQ ID NO: 1115166 - RNA, 19 nt, Homo sapiens
uuacgccacugaaagaauu

SEQ ID NO: 1115167 - RNA, 19 nt, Homo sapiens
gaagagauaccagaguuca

SEQ ID NO: 1115168 - RNA, 19 nt, Homo sapiens
cccaaugccuauuuccaua

SEQ ID NO: 1115169 - RNA, 19 nt, Homo sapiens
gcagaaaaggcaagucuua

SEQ ID NO: 1115170 - RNA, 19 nt, Homo sapiens
cuucagaacauaugacuuu

SEQ ID NO: 1115171 - RNA, 19 nt, Homo sapiens
guaagucuuguuugagaua

SEQ ID NO: 1115172 - RNA, 19 nt, Homo sapiens
gcccauuucagaauaauuu

SEQ ID NO: 1115173 - RNA, 19 nt, Homo sapiens
gcagggaaguggaagaaaa

SEQ ID NO: 1115174 - RNA, 19 nt, Homo sapiens
guuuaacccucaccgcuuu

SEQ ID NO: 1115175 - RNA, 19 nt, Homo sapiens
caaugccuauuuccauauu

SEQ ID NO: 1115176 - RNA, 19 nt, Homo sapiens
auaggauccugauuuagua

SEQ ID NO: 1115177 - RNA, 19 nt, Homo sapiens
gggagugucuuuacaucau

SEQ ID NO: 1115178 - RNA, 19 nt, Homo sapiens
gaaaaccgagcacaacaua

SEQ ID NO: 1115179 - RNA, 19 nt, Homo sapiens
gaaacagugguaauaggaa

SEQ ID NO: 1115180 - RNA, 19 nt, Homo sapiens
gauuaaugguccugaguag

SEQ ID NO: 1115181 - RNA, 19 nt, Homo sapiens
gaaagacagugugcuccau

SEQ ID NO: 1115182 - RNA, 19 nt, Homo sapiens
ccgaauuggugcugaauca

SEQ ID NO: 1115183 - RNA, 19 nt, Homo sapiens
ggaaaggaaacagugguaa

SEQ ID NO: 1115184 - RNA, 19 nt, Homo sapiens
ggagcgugcugugcagaaa

SEQ ID NO: 1115185 - RNA, 19 nt, Homo sapiens
agacugauccaaagaagaa

SEQ ID NO: 1115186 - RNA, 19 nt, Homo sapiens
cauaugaggcaugguauuu

SEQ ID NO: 1115187 - RNA, 19 nt, Homo sapiens
gcuauuauucagcucauuu

SEQ ID NO: 1115188 - RNA, 19 nt, Homo sapiens
augaggcaauucaaacuua

SEQ ID NO: 1115189 - RNA, 19 nt, Homo sapiens
gagugucuuuacaucauuu

SEQ ID NO: 1115190 - RNA, 19 nt, Homo sapiens
aaucgcccauuucagaaua

SEQ ID NO: 1115191 - RNA, 19 nt, Homo sapiens
uaacagagaaaccuuugga

SEQ ID NO: 1115192 - RNA, 19 nt, Homo sapiens
ggugaucuacuucuaaaug

SEQ ID NO: 1115193 - RNA, 19 nt, Homo sapiens
gagacuuccugaguugauu

SEQ ID NO: 1115194 - RNA, 19 nt, Homo sapiens
aaacagugguaauaggaau

SEQ ID NO: 1115195 - RNA, 19 nt, Homo sapiens
ugacuuucauuucccagaa

SEQ ID NO: 1115196 - RNA, 19 nt, Homo sapiens
gaguguaccuacccuaguc

SEQ ID NO: 1115197 - RNA, 19 nt, Homo sapiens
ucaagaacccuucacaaag

SEQ ID NO: 1115198 - RNA, 19 nt, Homo sapiens
uuagauaccggaaguaaug

SEQ ID NO: 1115199 - RNA, 19 nt, Homo sapiens
cgugucagccagagauuua

SEQ ID NO: 1115200 - RNA, 19 nt, Homo sapiens
auaccagaguucaguuuaa

SEQ ID NO: 1115201 - RNA, 19 nt, Homo sapiens
ggaccgagaggaacugugu

SEQ ID NO: 1115202 - RNA, 19 nt, Homo sapiens
gaacacugaguacaacauc

SEQ ID NO: 1115203 - RNA, 19 nt, Homo sapiens
cagcucauuucaaaggauu

SEQ ID NO: 1115204 - RNA, 19 nt, Homo sapiens
gaucuacuucuaaaugaga

SEQ ID NO: 1115205 - RNA, 19 nt, Homo sapiens
ucacccauacuuaacauuu

SEQ ID NO: 1115206 - RNA, 19 nt, Homo sapiens
uagauggucuuagagauuc

SEQ ID NO: 1115207 - RNA, 19 nt, Homo sapiens
uaugaggcaugguauuuua

SEQ ID NO: 1115208 - RNA, 19 nt, Homo sapiens
auacguuucugauuaggaa

SEQ ID NO: 1115209 - RNA, 19 nt, Homo sapiens
gaggaacacugaguacaac

SEQ ID NO: 1115210 - RNA, 19 nt, Homo sapiens
cugcuccugucuucacuua

SEQ ID NO: 1115211 - RNA, 19 nt, Homo sapiens
uaacuauucaggccaaaga

SEQ ID NO: 1115212 - RNA, 19 nt, Homo sapiens
aagcgcaauuggacuauga

SEQ ID NO: 1115213 - RNA, 19 nt, Homo sapiens
gaacuaugggucagagaca

SEQ ID NO: 1115214 - RNA, 19 nt, Homo sapiens
gcaaguggcuuucuucauu

SEQ ID NO: 1115215 - RNA, 19 nt, Homo sapiens
ggagaucucuuuuaacuua

SEQ ID NO: 1115216 - RNA, 19 nt, Homo sapiens
caaccaacccuucgaaaua

SEQ ID NO: 1115217 - RNA, 19 nt, Homo sapiens
gguaagaguuguuucacua

SEQ ID NO: 1115218 - RNA, 19 nt, Homo sapiens
ggaauucccugccagagaa

SEQ ID NO: 1115219 - RNA, 19 nt, Homo sapiens
gcaacggccuucagaggua

SEQ ID NO: 1115220 - RNA, 19 nt, Homo sapiens
ggacaacggccaccuguuu

SEQ ID NO: 1115221 - RNA, 19 nt, Homo sapiens
aaaguuacauggucuguuu

SEQ ID NO: 1115222 - RNA, 19 nt, Homo sapiens
gaccuuccguggagaauuu

SEQ ID NO: 1115223 - RNA, 19 nt, Homo sapiens
gacagaaaguggcacguuu

SEQ ID NO: 1115224 - RNA, 19 nt, Homo sapiens
ucaguuaagugugggauua

SEQ ID NO: 1115225 - RNA, 19 nt, Homo sapiens
aaugauggcuaaacacuaa

SEQ ID NO: 1115226 - RNA, 19 nt, Homo sapiens
caaguggcuuucuucauuu

SEQ ID NO: 1115227 - RNA, 19 nt, Homo sapiens
uugaggaaauucagucuua

SEQ ID NO: 1115228 - RNA, 19 nt, Homo sapiens
gacaacauuugcaguuuga

SEQ ID NO: 1115229 - RNA, 19 nt, Homo sapiens
ccagagaaaugcuccugaa

SEQ ID NO: 1115230 - RNA, 19 nt, Homo sapiens
gaaauucggcugagaaagg

SEQ ID NO: 1115231 - RNA, 19 nt, Homo sapiens
gaaauuacuaugccaggaa

SEQ ID NO: 1115232 - RNA, 19 nt, Homo sapiens
gaaaugcuccugaaaauau

SEQ ID NO: 1115233 - RNA, 19 nt, Homo sapiens
guucaugcuuaguaguuua

SEQ ID NO: 1115234 - RNA, 19 nt, Homo sapiens
cauggucuguuucuuguuu

SEQ ID NO: 1115235 - RNA, 19 nt, Homo sapiens
gaggguacuugacaauaug

SEQ ID NO: 1115236 - RNA, 19 nt, Homo sapiens
ccacggagcucggucuguu

SEQ ID NO: 1115237 - RNA, 19 nt, Homo sapiens
ugaggguacuugacaauau

SEQ ID NO: 1115238 - RNA, 19 nt, Homo sapiens
gagaaaugcuccugaaaau

SEQ ID NO: 1115239 - RNA, 19 nt, Homo sapiens
gcacguuuguggccaacuu

SEQ ID NO: 1115240 - RNA, 19 nt, Homo sapiens
ggagaaauucggcugagaa

SEQ ID NO: 1115241 - RNA, 19 nt, Homo sapiens
aaccaacccuucgaaauaa

SEQ ID NO: 1115242 - RNA, 19 nt, Homo sapiens
cgaaauaaacgcaaucaca

SEQ ID NO: 1115243 - RNA, 19 nt, Homo sapiens
cuucagagguacacaauca

SEQ ID NO: 1115244 - RNA, 19 nt, Homo sapiens
gauucaguauuccguauug

SEQ ID NO: 1115245 - RNA, 19 nt, Homo sapiens
ccagaaaacuuaccagaga

SEQ ID NO: 1115246 - RNA, 19 nt, Homo sapiens
gagaaauucggcugagaaa

SEQ ID NO: 1115247 - RNA, 19 nt, Homo sapiens
cagacaacauuugcaguuu

SEQ ID NO: 1115248 - RNA, 19 nt, Homo sapiens
ucaggucgcuggacuacga

SEQ ID NO: 1115249 - RNA, 19 nt, Homo sapiens
agacaacauuugcaguuug

SEQ ID NO: 1115250 - RNA, 19 nt, Homo sapiens
aaagggaacagacaacauu

SEQ ID NO: 1115251 - RNA, 19 nt, Homo sapiens
acacuaaaguagccauuca

SEQ ID NO: 1115252 - RNA, 19 nt, Homo sapiens
gcacugagagagaaaugga

SEQ ID NO: 1115253 - RNA, 19 nt, Homo sapiens
caaaugaguucaaguuccu

SEQ ID NO: 1115254 - RNA, 19 nt, Homo sapiens
ggagcucuaugaagcacaa

SEQ ID NO: 1115255 - RNA, 19 nt, Homo sapiens
gaauuucuacacccuggua

SEQ ID NO: 1115256 - RNA, 19 nt, Homo sapiens
gcacaagucccugagaaca

SEQ ID NO: 1115257 - RNA, 19 nt, Homo sapiens
gcaggucuccgacgucaau

SEQ ID NO: 1115258 - RNA, 19 nt, Homo sapiens
gaguacaacaucacuauca

SEQ ID NO: 1115259 - RNA, 19 nt, Homo sapiens
gacccaugauuuacugcua

SEQ ID NO: 1115260 - RNA, 19 nt, Homo sapiens
gacuauagacuuuacugaa

SEQ ID NO: 1115261 - RNA, 19 nt, Homo sapiens
ccauaauagucaauccaaa

SEQ ID NO: 1115262 - RNA, 19 nt, Homo sapiens
ccucuauucuuuagguuga

SEQ ID NO: 1115263 - RNA, 19 nt, Homo sapiens
gacagagacucaggcauca

SEQ ID NO: 1115264 - RNA, 19 nt, Homo sapiens
gguggguucugaaucgauu

SEQ ID NO: 1115265 - RNA, 19 nt, Homo sapiens
aaagucgugccaauuauaa

SEQ ID NO: 1115266 - RNA, 19 nt, Homo sapiens
aagaguuguuucacuauug

SEQ ID NO: 1115267 - RNA, 19 nt, Homo sapiens
acgaggcccugcagucuuu

SEQ ID NO: 1115268 - RNA, 19 nt, Homo sapiens
gagcagagccgaguacaac

SEQ ID NO: 1115269 - RNA, 19 nt, Homo sapiens
gagauucagauccagguuu

SEQ ID NO: 1115270 - RNA, 19 nt, Homo sapiens
aaauuacuaugccaggaaa

SEQ ID NO: 1115271 - RNA, 19 nt, Homo sapiens
gaugcaaacuaaaguacag

SEQ ID NO: 1115272 - RNA, 19 nt, Homo sapiens
gaacuaaugauggcuaaac

SEQ ID NO: 1115273 - RNA, 19 nt, Homo sapiens
gcaguaacuccuacagugu

SEQ ID NO: 1115274 - RNA, 19 nt, Homo sapiens
agagagaaauggaagaaac

SEQ ID NO: 1115275 - RNA, 19 nt, Homo sapiens
aagcacaagucccugagaa

SEQ ID NO: 1115276 - RNA, 19 nt, Homo sapiens
ucagggaccuccgagauuc

SEQ ID NO: 1115277 - RNA, 19 nt, Homo sapiens
guggaggccuaucaggaaa

SEQ ID NO: 1115278 - RNA, 19 nt, Homo sapiens
gguggaggccuaucaggaa

SEQ ID NO: 1115279 - RNA, 19 nt, Homo sapiens
cuuaugacguggauguuga

SEQ ID NO: 1115280 - RNA, 19 nt, Homo sapiens
ucaagucgaugacgucaac

SEQ ID NO: 1115281 - RNA, 19 nt, Homo sapiens
uuacauggucuguuucuug

SEQ ID NO: 1115282 - RNA, 19 nt, Homo sapiens
cuaaaguacagaacaagaa

SEQ ID NO: 1115283 - RNA, 19 nt, Homo sapiens
guuaagugugggauuauuu

SEQ ID NO: 1115284 - RNA, 19 nt, Homo sapiens
gcaaucacaggagaaauuc

SEQ ID NO: 1115285 - RNA, 19 nt, Homo sapiens
uauuuccuguucaugcuua

SEQ ID NO: 1115286 - RNA, 19 nt, Homo sapiens
gaggaaauucagucuuaug

SEQ ID NO: 1115287 - RNA, 19 nt, Homo sapiens
caaacuaaaguacagaaca

SEQ ID NO: 1115288 - RNA, 19 nt, Homo sapiens
ggagagguggguucugaau

SEQ ID NO: 1115289 - RNA, 19 nt, Homo sapiens
ccucggcucucugguuauu

SEQ ID NO: 1115290 - RNA, 19 nt, Homo sapiens
aagaacuaaugauggcuaa

SEQ ID NO: 1115291 - RNA, 19 nt, Homo sapiens
guaagaguuguuucacuau

SEQ ID NO: 1115292 - RNA, 19 nt, Homo sapiens
uacauggucuguuucuugu

SEQ ID NO: 1115293 - RNA, 19 nt, Homo sapiens
uuacuuauguuuggagauc

SEQ ID NO: 1115294 - RNA, 19 nt, Homo sapiens
agaaacaaaugaguucaag

SEQ ID NO: 1115295 - RNA, 19 nt, Homo sapiens
ucccggagcuggugcuaga

SEQ ID NO: 1115296 - RNA, 19 nt, Homo sapiens
acuauagacuuuacugaag

SEQ ID NO: 1115297 - RNA, 19 nt, Homo sapiens
guauuucuagcuauuggua

SEQ ID NO: 1115298 - RNA, 19 nt, Homo sapiens
guuuggagaucucuuuuaa

SEQ ID NO: 1115299 - RNA, 19 nt, Homo sapiens
gacgggaggcucagaaaca

SEQ ID NO: 1115300 - RNA, 19 nt, Homo sapiens
acaaaggaccugggacuga

SEQ ID NO: 1115301 - RNA, 19 nt, Homo sapiens
guaggacuguuuaaaaugu

SEQ ID NO: 1115302 - RNA, 19 nt, Homo sapiens
guacuugacaauaugaaca

SEQ ID NO: 1115303 - RNA, 19 nt, Homo sapiens
ugucgucgcucuuccucuu

SEQ ID NO: 1115304 - RNA, 19 nt, Homo sapiens
gacaacggccaccuguuug

SEQ ID NO: 1115305 - RNA, 19 nt, Homo sapiens
cgcaaucacaggagaaauu

SEQ ID NO: 1115306 - RNA, 19 nt, Homo sapiens
ugugcuaccuuuccaagug

SEQ ID NO: 1115307 - RNA, 19 nt, Homo sapiens
guuucacuauugcuaugua

SEQ ID NO: 1115308 - RNA, 19 nt, Homo sapiens
uagcuucccguucaguuaa

SEQ ID NO: 1115309 - RNA, 19 nt, Homo sapiens
ucuacacccugguaacaga

SEQ ID NO: 1115310 - RNA, 19 nt, Homo sapiens
gagaucacaguggcaguuu

SEQ ID NO: 1115311 - RNA, 19 nt, Homo sapiens
ugaggaaauucagucuuau

SEQ ID NO: 1115312 - RNA, 19 nt, Homo sapiens
gcgagucagagauauaaau

SEQ ID NO: 1115313 - RNA, 19 nt, Homo sapiens
acuaaaguagccauucaua

SEQ ID NO: 1115314 - RNA, 19 nt, Homo sapiens
ggucuuagcuagagauaua

SEQ ID NO: 1115315 - RNA, 19 nt, Homo sapiens
gcacuucacuacauuggua

SEQ ID NO: 1115316 - RNA, 19 nt, Homo sapiens
ggacauaaaugaucacucu

SEQ ID NO: 1115317 - RNA, 19 nt, Homo sapiens
gcacuugcaugaaauaaau

SEQ ID NO: 1115318 - RNA, 19 nt, Homo sapiens
ugacaaugcuccugaguuu

SEQ ID NO: 1115319 - RNA, 19 nt, Homo sapiens
guacauuacuuugcagaua

SEQ ID NO: 1115320 - RNA, 19 nt, Homo sapiens
gaagagcucugugguccua

SEQ ID NO: 1115321 - RNA, 19 nt, Homo sapiens
gguauucaguuaaguauug

SEQ ID NO: 1115322 - RNA, 19 nt, Homo sapiens
gaaagaugauuugcucuau

SEQ ID NO: 1115323 - RNA, 19 nt, Homo sapiens
ccacaugucuagugauuau

SEQ ID NO: 1115324 - RNA, 19 nt, Homo sapiens
ccauguaacuuaauguuug

SEQ ID NO: 1115325 - RNA, 19 nt, Homo sapiens
guucagaaauagcuuggua

SEQ ID NO: 1115326 - RNA, 19 nt, Homo sapiens
caucauaggucuccuugug

SEQ ID NO: 1115327 - RNA, 19 nt, Homo sapiens
cuacuuaccuagcacauug

SEQ ID NO: 1115328 - RNA, 19 nt, Homo sapiens
gaguguuucuuauggcuua

SEQ ID NO: 1115329 - RNA, 19 nt, Homo sapiens
ggccugauaucaucuuaaa

SEQ ID NO: 1115330 - RNA, 19 nt, Homo sapiens
ccacugcaaugccuuuauu

SEQ ID NO: 1115331 - RNA, 19 nt, Homo sapiens
ggaaagaugauuugcucua

SEQ ID NO: 1115332 - RNA, 19 nt, Homo sapiens
ccagaguguuugaaaguuu

SEQ ID NO: 1115333 - RNA, 19 nt, Homo sapiens
caccuuggcuauucuguuu

SEQ ID NO: 1115334 - RNA, 19 nt, Homo sapiens
cuacucaugucccugauaa

SEQ ID NO: 1115335 - RNA, 19 nt, Homo sapiens
aaugaucacucuccaauau

SEQ ID NO: 1115336 - RNA, 19 nt, Homo sapiens
ggcaagaaauacccagauu

SEQ ID NO: 1115337 - RNA, 19 nt, Homo sapiens
ggaggaggccuuucuggaa

SEQ ID NO: 1115338 - RNA, 19 nt, Homo sapiens
ugaagucacgggagaaaua

SEQ ID NO: 1115339 - RNA, 19 nt, Homo sapiens
gagaggagcagccugaguu

SEQ ID NO: 1115340 - RNA, 19 nt, Homo sapiens
agauagagauuccggagaa

SEQ ID NO: 1115341 - RNA, 19 nt, Homo sapiens
ggacaucaaugacaaugcu

SEQ ID NO: 1115342 - RNA, 19 nt, Homo sapiens
aaagggaagugcucuugaa

SEQ ID NO: 1115343 - RNA, 19 nt, Homo sapiens
auaauuaccuuguccuuuc

SEQ ID NO: 1115344 - RNA, 19 nt, Homo sapiens
ucauagaggugguggaugu

SEQ ID NO: 1115345 - RNA, 19 nt, Homo sapiens
aaaaggcacuguagucaua

SEQ ID NO: 1115346 - RNA, 19 nt, Homo sapiens
gaucugggccugggaauug

SEQ ID NO: 1115347 - RNA, 19 nt, Homo sapiens
gaagugcucuugaaaauac

SEQ ID NO: 1115348 - RNA, 19 nt, Homo sapiens
caccacaugucuagugauu

SEQ ID NO: 1115349 - RNA, 19 nt, Homo sapiens
cuacauugguaauacacua

SEQ ID NO: 1115350 - RNA, 19 nt, Homo sapiens
ggauauugaguauggauuu

SEQ ID NO: 1115351 - RNA, 19 nt, Homo sapiens
ggagggaaguuaaggaaaa

SEQ ID NO: 1115352 - RNA, 19 nt, Homo sapiens
uauagaugcuggaaacuuc

SEQ ID NO: 1115353 - RNA, 19 nt, Homo sapiens
gaaagggaagugcucuuga

SEQ ID NO: 1115354 - RNA, 19 nt, Homo sapiens
gaaauugaggccacagaug

SEQ ID NO: 1115355 - RNA, 19 nt, Homo sapiens
gcagauauggacagccuuu

SEQ ID NO: 1115356 - RNA, 19 nt, Homo sapiens
ccuagacucuccaauuguu

SEQ ID NO: 1115357 - RNA, 19 nt, Homo sapiens
gggcagcaauggucuucaa

SEQ ID NO: 1115358 - RNA, 19 nt, Homo sapiens
guacugcauuuccaagugu

SEQ ID NO: 1115359 - RNA, 19 nt, Homo sapiens
aagcuaaauuugucccuuu

SEQ ID NO: 1115360 - RNA, 19 nt, Homo sapiens
gaacuuaucauaucuucac

SEQ ID NO: 1115361 - RNA, 19 nt, Homo sapiens
gcucugugguccuauugaa

SEQ ID NO: 1115362 - RNA, 19 nt, Homo sapiens
ggacuggugaguucaaguu

SEQ ID NO: 1115363 - RNA, 19 nt, Homo sapiens
ucaggucgcuggacuacga

SEQ ID NO: 1115364 - RNA, 19 nt, Homo sapiens
aagaugauuugcucuauuc

SEQ ID NO: 1115365 - RNA, 19 nt, Homo sapiens
uaaaugaucacucuccaau

SEQ ID NO: 1115366 - RNA, 19 nt, Homo sapiens
gcuauucuguuuaaaucug

SEQ ID NO: 1115367 - RNA, 19 nt, Homo sapiens
gauagagauuccggagaaa

SEQ ID NO: 1115368 - RNA, 19 nt, Homo sapiens
ggagaaauacuguugaaaa

SEQ ID NO: 1115369 - RNA, 19 nt, Homo sapiens
cugcaaugccuuuauuuaa

SEQ ID NO: 1115370 - RNA, 19 nt, Homo sapiens
ugaagccaauauuuccuaa

SEQ ID NO: 1115371 - RNA, 19 nt, Homo sapiens
gcacggucaugguucgaau

SEQ ID NO: 1115372 - RNA, 19 nt, Homo sapiens
gcaggucuccgacgucaau

SEQ ID NO: 1115373 - RNA, 19 nt, Homo sapiens
auagugagggcaagaaaua

SEQ ID NO: 1115374 - RNA, 19 nt, Homo sapiens
uuaauagccaugaguguaa

SEQ ID NO: 1115375 - RNA, 19 nt, Homo sapiens
gggaagugcucuugaaaau

SEQ ID NO: 1115376 - RNA, 19 nt, Homo sapiens
ucuccaauauucccugaaa

SEQ ID NO: 1115377 - RNA, 19 nt, Homo sapiens
ugaucacucuccaauauuc

SEQ ID NO: 1115378 - RNA, 19 nt, Homo sapiens
gaaauuucuucugcaccuu

SEQ ID NO: 1115379 - RNA, 19 nt, Homo sapiens
gcaaguguuggccuuuauu

SEQ ID NO: 1115380 - RNA, 19 nt, Homo sapiens
ccagccggguacucuauuu

SEQ ID NO: 1115381 - RNA, 19 nt, Homo sapiens
ucucaauuaugccaaaguu

SEQ ID NO: 1115382 - RNA, 19 nt, Homo sapiens
aauguuccaugaaugcuaa

SEQ ID NO: 1115383 - RNA, 19 nt, Homo sapiens
uaauagccaugaguguaaa

SEQ ID NO: 1115384 - RNA, 19 nt, Homo sapiens
gaguauggauuuucucuau

SEQ ID NO: 1115385 - RNA, 19 nt, Homo sapiens
caaguguuggccuuuauuu

SEQ ID NO: 1115386 - RNA, 19 nt, Homo sapiens
gaccagcgcugaguacaac

SEQ ID NO: 1115387 - RNA, 19 nt, Homo sapiens
ggacaaaccacuggaucga

SEQ ID NO: 1115388 - RNA, 19 nt, Homo sapiens
gaaacuagaccgggaagag

SEQ ID NO: 1115389 - RNA, 19 nt, Homo sapiens
uaccacaauuucaaaccua

SEQ ID NO: 1115390 - RNA, 19 nt, Homo sapiens
gccucgagccuauucguua

SEQ ID NO: 1115391 - RNA, 19 nt, Homo sapiens
aagccaauauuuccuaauc

SEQ ID NO: 1115392 - RNA, 19 nt, Homo sapiens
ucaaguuccugaagccaau

SEQ ID NO: 1115393 - RNA, 19 nt, Homo sapiens
cagaacuuaucauaucuuc

SEQ ID NO: 1115394 - RNA, 19 nt, Homo sapiens
cgggagaaauacuguugaa

SEQ ID NO: 1115395 - RNA, 19 nt, Homo sapiens
ggcaaguguuggccuuuau

SEQ ID NO: 1115396 - RNA, 19 nt, Homo sapiens
agauauagaugcuggaaac

SEQ ID NO: 1115397 - RNA, 19 nt, Homo sapiens
ucacuacauugguaauaca

SEQ ID NO: 1115398 - RNA, 19 nt, Homo sapiens
gugccugucuuuaccaugu

SEQ ID NO: 1115399 - RNA, 19 nt, Homo sapiens
gauuugcucuauuccagau

SEQ ID NO: 1115400 - RNA, 19 nt, Homo sapiens
cgaauucgagauagagauu

SEQ ID NO: 1115401 - RNA, 19 nt, Homo sapiens
ccuuggcuauucuguuuaa

SEQ ID NO: 1115402 - RNA, 19 nt, Homo sapiens
gagagaccagcgcugagua

SEQ ID NO: 1115403 - RNA, 19 nt, Homo sapiens
gauauggacagccuuuaca

SEQ ID NO: 1115404 - RNA, 19 nt, Homo sapiens
uggcuauucuguuuaaauc

SEQ ID NO: 1115405 - RNA, 19 nt, Homo sapiens
gccagaguguuugaaaguu

SEQ ID NO: 1115406 - RNA, 19 nt, Homo sapiens
gcaaggccagaguguuuga

SEQ ID NO: 1115407 - RNA, 19 nt, Homo sapiens
uagggagaauucauccaaa

SEQ ID NO: 1115408 - RNA, 19 nt, Homo sapiens
gccaauauuuccuaaucuc

SEQ ID NO: 1115409 - RNA, 19 nt, Homo sapiens
gcagcuggaucgucagacu

SEQ ID NO: 1115410 - RNA, 19 nt, Homo sapiens
gaagaagcuagggagaauu

SEQ ID NO: 1115411 - RNA, 19 nt, Homo sapiens
cagauuuggugcaggacaa

SEQ ID NO: 1115412 - RNA, 19 nt, Homo sapiens
aaucugaaauaagcccuaa

SEQ ID NO: 1115413 - RNA, 19 nt, Homo sapiens
ccugauaaagcuaaauuug

SEQ ID NO: 1115414 - RNA, 19 nt, Homo sapiens
ggacacaaauauagacuaa

SEQ ID NO: 1115415 - RNA, 19 nt, Homo sapiens
guaauuacccuuugguuua

SEQ ID NO: 1115416 - RNA, 19 nt, Homo sapiens
gaaaccaucuguagagaau

SEQ ID NO: 1115417 - RNA, 19 nt, Homo sapiens
ggacaacggccaccuguuu

SEQ ID NO: 1115418 - RNA, 19 nt, Homo sapiens
ggacaaaugaguucaaguu

SEQ ID NO: 1115419 - RNA, 19 nt, Homo sapiens
gaaguacccggaacuagua

SEQ ID NO: 1115420 - RNA, 19 nt, Homo sapiens
gcagcuuugucuauaguua

SEQ ID NO: 1115421 - RNA, 19 nt, Homo sapiens
ggaggagagcgauuucuua

SEQ ID NO: 1115422 - RNA, 19 nt, Homo sapiens
cggaaagucuacagucaua

SEQ ID NO: 1115423 - RNA, 19 nt, Homo sapiens
gugauuugcuccugaauga

SEQ ID NO: 1115424 - RNA, 19 nt, Homo sapiens
ggauauaguacucaaauga

SEQ ID NO: 1115425 - RNA, 19 nt, Homo sapiens
gaagagcuuugaauucagu

SEQ ID NO: 1115426 - RNA, 19 nt, Homo sapiens
cgacaaugcaccagaauuu

SEQ ID NO: 1115427 - RNA, 19 nt, Homo sapiens
ugucucggcuucugacuua

SEQ ID NO: 1115428 - RNA, 19 nt, Homo sapiens
ggaagaaacagccuccaaa

SEQ ID NO: 1115429 - RNA, 19 nt, Homo sapiens
ggacuuggaugugggaaga

SEQ ID NO: 1115430 - RNA, 19 nt, Homo sapiens
ggagagcgauuucuuagac

SEQ ID NO: 1115431 - RNA, 19 nt, Homo sapiens
gaaacagccuccaaaacua

SEQ ID NO: 1115432 - RNA, 19 nt, Homo sapiens
gaaccaugcauacuacauu

SEQ ID NO: 1115433 - RNA, 19 nt, Homo sapiens
ggagacaacggaagaguga

SEQ ID NO: 1115434 - RNA, 19 nt, Homo sapiens
guguugacauuugcaauua

SEQ ID NO: 1115435 - RNA, 19 nt, Homo sapiens
gggaaaugcugaggacuug

SEQ ID NO: 1115436 - RNA, 19 nt, Homo sapiens
auaugcaacuggucaaaua

SEQ ID NO: 1115437 - RNA, 19 nt, Homo sapiens
gauaaacauccaggucuua

SEQ ID NO: 1115438 - RNA, 19 nt, Homo sapiens
gcaaguagcaagaauagag

SEQ ID NO: 1115439 - RNA, 19 nt, Homo sapiens
cgagaauccuuagucgaua

SEQ ID NO: 1115440 - RNA, 19 nt, Homo sapiens
agagugauguguuccauug

SEQ ID NO: 1115441 - RNA, 19 nt, Homo sapiens
aaacgacaaugcaccagaa

SEQ ID NO: 1115442 - RNA, 19 nt, Homo sapiens
gaccuugucuucaguaaac

SEQ ID NO: 1115443 - RNA, 19 nt, Homo sapiens
caaaggaucugggacuaag

SEQ ID NO: 1115444 - RNA, 19 nt, Homo sapiens
aggaagagcuuugaauuca

SEQ ID NO: 1115445 - RNA, 19 nt, Homo sapiens
ggaaguacccggaacuagu

SEQ ID NO: 1115446 - RNA, 19 nt, Homo sapiens
caaacgagcuccguaucau

SEQ ID NO: 1115447 - RNA, 19 nt, Homo sapiens
ggacagcccagauaaacau

SEQ ID NO: 1115448 - RNA, 19 nt, Homo sapiens
gcaaaggaucugggacuaa

SEQ ID NO: 1115449 - RNA, 19 nt, Homo sapiens
auaaagcaauguagagaga

SEQ ID NO: 1115450 - RNA, 19 nt, Homo sapiens
gagaauccuuagucgauag

SEQ ID NO: 1115451 - RNA, 19 nt, Homo sapiens
gaucuagacucuggagaca

SEQ ID NO: 1115452 - RNA, 19 nt, Homo sapiens
ucaggucgcuggacuacga

SEQ ID NO: 1115453 - RNA, 19 nt, Homo sapiens
aaccaucuguagagaauuu

SEQ ID NO: 1115454 - RNA, 19 nt, Homo sapiens
gaaagcacucugccaggaa

SEQ ID NO: 1115455 - RNA, 19 nt, Homo sapiens
cuuagucgauagaacauuu

SEQ ID NO: 1115456 - RNA, 19 nt, Homo sapiens
gaagagugauguguuccau

SEQ ID NO: 1115457 - RNA, 19 nt, Homo sapiens
gaacuaguacuggauaaag

SEQ ID NO: 1115458 - RNA, 19 nt, Homo sapiens
caaaugaguucaaguuccu

SEQ ID NO: 1115459 - RNA, 19 nt, Homo sapiens
gauagacaagaauguguuu

SEQ ID NO: 1115460 - RNA, 19 nt, Homo sapiens
guaguuaauccuugcauau

SEQ ID NO: 1115461 - RNA, 19 nt, Homo sapiens
guaguuguguggcucugaa

SEQ ID NO: 1115462 - RNA, 19 nt, Homo sapiens
gcaagaauagagcaaaaua

SEQ ID NO: 1115463 - RNA, 19 nt, Homo sapiens
gagcuuugaauucaguuaa

SEQ ID NO: 1115464 - RNA, 19 nt, Homo sapiens
gaaaaccaaguacaacaua

SEQ ID NO: 1115465 - RNA, 19 nt, Homo sapiens
gaaaaugaaaugcaucuga

SEQ ID NO: 1115466 - RNA, 19 nt, Homo sapiens
caaggcaaguagcaagaau

SEQ ID NO: 1115467 - RNA, 19 nt, Homo sapiens
ucaggaagagcuuugaauu

SEQ ID NO: 1115468 - RNA, 19 nt, Homo sapiens
gaaagucuacagucauagu

SEQ ID NO: 1115469 - RNA, 19 nt, Homo sapiens
gaaaugcugaggacuugga

SEQ ID NO: 1115470 - RNA, 19 nt, Homo sapiens
gcuccugaaugagaaauug

SEQ ID NO: 1115471 - RNA, 19 nt, Homo sapiens
uaucuaaaguguguucaug

SEQ ID NO: 1115472 - RNA, 19 nt, Homo sapiens
gccaaaauauggacacaaa

SEQ ID NO: 1115473 - RNA, 19 nt, Homo sapiens
gaggagagcgauuucuuag

SEQ ID NO: 1115474 - RNA, 19 nt, Homo sapiens
ugcaacuggucaaauauuu

SEQ ID NO: 1115475 - RNA, 19 nt, Homo sapiens
gggauauaguacucaaaug

SEQ ID NO: 1115476 - RNA, 19 nt, Homo sapiens
ucaguaaacagcccuauuc

SEQ ID NO: 1115477 - RNA, 19 nt, Homo sapiens
gaauucccacuuccacgua

SEQ ID NO: 1115478 - RNA, 19 nt, Homo sapiens
aaacgagcuccguaucaua

SEQ ID NO: 1115479 - RNA, 19 nt, Homo sapiens
aaccaugcauacuacauuu

SEQ ID NO: 1115480 - RNA, 19 nt, Homo sapiens
ggauagacaagaauguguu

SEQ ID NO: 1115481 - RNA, 19 nt, Homo sapiens
gaagaaacagccuccaaaa

SEQ ID NO: 1115482 - RNA, 19 nt, Homo sapiens
cacagaaccaugcauacua

SEQ ID NO: 1115483 - RNA, 19 nt, Homo sapiens
ggaagagcuuugaauucag

SEQ ID NO: 1115484 - RNA, 19 nt, Homo sapiens
ucaaguuccugaagccaau

SEQ ID NO: 1115485 - RNA, 19 nt, Homo sapiens
uagccaaccuagcaaagga

SEQ ID NO: 1115486 - RNA, 19 nt, Homo sapiens
ggaacuaguacuggauaaa

SEQ ID NO: 1115487 - RNA, 19 nt, Homo sapiens
guuaauaaggaucuacuga

SEQ ID NO: 1115488 - RNA, 19 nt, Homo sapiens
ccugagaacucgggagaga

SEQ ID NO: 1115489 - RNA, 19 nt, Homo sapiens
uugcacagccgcucuauga

SEQ ID NO: 1115490 - RNA, 19 nt, Homo sapiens
guacucacucgcagucgua

SEQ ID NO: 1115491 - RNA, 19 nt, Homo sapiens
uguaguuaauccuugcaua

SEQ ID NO: 1115492 - RNA, 19 nt, Homo sapiens
gaguacaacauuaccauca

SEQ ID NO: 1115493 - RNA, 19 nt, Homo sapiens
gaagaaauucgcaaaacuu

SEQ ID NO: 1115494 - RNA, 19 nt, Homo sapiens
cauccaggucuuagauaua

SEQ ID NO: 1115495 - RNA, 19 nt, Homo sapiens
gauuugcuccugaaugaga

SEQ ID NO: 1115496 - RNA, 19 nt, Homo sapiens
uggcuuagguuucauuaac

SEQ ID NO: 1115497 - RNA, 19 nt, Homo sapiens
cgaggcaaaucccaguuuc

SEQ ID NO: 1115498 - RNA, 19 nt, Homo sapiens
auccaggucuuagauauaa

SEQ ID NO: 1115499 - RNA, 19 nt, Homo sapiens
ucuaaaguguguucaugau

SEQ ID NO: 1115500 - RNA, 19 nt, Homo sapiens
guuaauccuugcauauucu

SEQ ID NO: 1115501 - RNA, 19 nt, Homo sapiens
ugucuucgcucuuccucuu

SEQ ID NO: 1115502 - RNA, 19 nt, Homo sapiens
gagagcgauuucuuagaca

SEQ ID NO: 1115503 - RNA, 19 nt, Homo sapiens
gaacucgggagagacugua

SEQ ID NO: 1115504 - RNA, 19 nt, Homo sapiens
caccggaacugaccuuguc

SEQ ID NO: 1115505 - RNA, 19 nt, Homo sapiens
ugccaacgcagucuuaauu

SEQ ID NO: 1115506 - RNA, 19 nt, Homo sapiens
caggaagagcuuugaauuc

SEQ ID NO: 1115507 - RNA, 19 nt, Homo sapiens
guacaacauuaccaucacu

SEQ ID NO: 1115508 - RNA, 19 nt, Homo sapiens
gcagccggaacucagcuua

SEQ ID NO: 1115509 - RNA, 19 nt, Homo sapiens
acagaaccaugcauacuac

SEQ ID NO: 1115510 - RNA, 19 nt, Homo sapiens
ccagggauggcuuagguuu

SEQ ID NO: 1115511 - RNA, 19 nt, Homo sapiens
gcgaggcaaaucccaguuu

SEQ ID NO: 1115512 - RNA, 19 nt, Homo sapiens
gacaaaugaguucaaguuc

SEQ ID NO: 1115513 - RNA, 19 nt, Homo sapiens
gacaaugcaccagaauuug

SEQ ID NO: 1115514 - RNA, 19 nt, Homo sapiens
gaaaguaaccaucuuauuc

SEQ ID NO: 1115515 - RNA, 19 nt, Homo sapiens
gaacuugugugguauuugu

SEQ ID NO: 1115516 - RNA, 19 nt, Homo sapiens
ccaagcaucugaagacauu

SEQ ID NO: 1115517 - RNA, 19 nt, Homo sapiens
gaaaguaucacuccuggaa

SEQ ID NO: 1115518 - RNA, 19 nt, Homo sapiens
cuaacuaugucgacacuua

SEQ ID NO: 1115519 - RNA, 19 nt, Homo sapiens
uugcaaagcugcucuauga

SEQ ID NO: 1115520 - RNA, 19 nt, Homo sapiens
ggaacuacuuucuuaauag

SEQ ID NO: 1115521 - RNA, 19 nt, Homo sapiens
ggacaaaugaguucaaguu

SEQ ID NO: 1115522 - RNA, 19 nt, Homo sapiens
ggagaaauaucuuaugcau

SEQ ID NO: 1115523 - RNA, 19 nt, Homo sapiens
guccugauauucuuuguuu

SEQ ID NO: 1115524 - RNA, 19 nt, Homo sapiens
gcauguuacugguauuuau

SEQ ID NO: 1115525 - RNA, 19 nt, Homo sapiens
ccaacagucuccaaaauua

SEQ ID NO: 1115526 - RNA, 19 nt, Homo sapiens
guaaccaucuuauuccaau

SEQ ID NO: 1115527 - RNA, 19 nt, Homo sapiens
ggacaacggccaccuguuc

SEQ ID NO: 1115528 - RNA, 19 nt, Homo sapiens
ucgaauccauccagacaua

SEQ ID NO: 1115529 - RNA, 19 nt, Homo sapiens
gaagagcuuugaauucacu

SEQ ID NO: 1115530 - RNA, 19 nt, Homo sapiens
gaauacaacaucaccauca

SEQ ID NO: 1115531 - RNA, 19 nt, Homo sapiens
aggcuagucucguuuaauu

SEQ ID NO: 1115532 - RNA, 19 nt, Homo sapiens
aaaggcaaguccugauauu

SEQ ID NO: 1115533 - RNA, 19 nt, Homo sapiens
aggaagagcuuugaauuca

SEQ ID NO: 1115534 - RNA, 19 nt, Homo sapiens
ugucgacacuuaucaauca

SEQ ID NO: 1115535 - RNA, 19 nt, Homo sapiens
gaacuaauggagaaauauc

SEQ ID NO: 1115536 - RNA, 19 nt, Homo sapiens
cagucucgauggcauaaua

SEQ ID NO: 1115537 - RNA, 19 nt, Homo sapiens
ugacaauccuccggaacua

SEQ ID NO: 1115538 - RNA, 19 nt, Homo sapiens
gggccuaucuggaacuugu

SEQ ID NO: 1115539 - RNA, 19 nt, Homo sapiens
ugacaacgucccagaguuu

SEQ ID NO: 1115540 - RNA, 19 nt, Homo sapiens
uaagacagaaacuggauuu

SEQ ID NO: 1115541 - RNA, 19 nt, Homo sapiens
gcuccuuuguggccaauuu

SEQ ID NO: 1115542 - RNA, 19 nt, Homo sapiens
gcuagucucguuuaauuug

SEQ ID NO: 1115543 - RNA, 19 nt, Homo sapiens
gaaaaccgagcacaacaua

SEQ ID NO: 1115544 - RNA, 19 nt, Homo sapiens
uggaacuaauggagaaaua

SEQ ID NO: 1115545 - RNA, 19 nt, Homo sapiens
ggauugaaguuguggacau

SEQ ID NO: 1115546 - RNA, 19 nt, Homo sapiens
gagcacguuuggugagaga

SEQ ID NO: 1115547 - RNA, 19 nt, Homo sapiens
caaaugaguucaaguuccu

SEQ ID NO: 1115548 - RNA, 19 nt, Homo sapiens
gaaggagcgcguuccgaaa

SEQ ID NO: 1115549 - RNA, 19 nt, Homo sapiens
gaacugcuuuuaagacaga

SEQ ID NO: 1115550 - RNA, 19 nt, Homo sapiens
ugccagggauuuagacauu

SEQ ID NO: 1115551 - RNA, 19 nt, Homo sapiens
gagcuuugaauucacuuaa

SEQ ID NO: 1115552 - RNA, 19 nt, Homo sapiens
cacaaucagucccaauuuc

SEQ ID NO: 1115553 - RNA, 19 nt, Homo sapiens
ccaauucuaugcauguuac

SEQ ID NO: 1115554 - RNA, 19 nt, Homo sapiens
ucaggaagagcuuugaauu

SEQ ID NO: 1115555 - RNA, 19 nt, Homo sapiens
ggaaccaacagucuccaaa

SEQ ID NO: 1115556 - RNA, 19 nt, Homo sapiens
ggcaaguccugauauucuu

SEQ ID NO: 1115557 - RNA, 19 nt, Homo sapiens
gagauagaguuagcgacaa

SEQ ID NO: 1115558 - RNA, 19 nt, Homo sapiens
gaccagauccgaauacaac

SEQ ID NO: 1115559 - RNA, 19 nt, Homo sapiens
uccuggaacuacuuucuua

SEQ ID NO: 1115560 - RNA, 19 nt, Homo sapiens
gcaaguccugauauucuuu

SEQ ID NO: 1115561 - RNA, 19 nt, Homo sapiens
acaaaggcaaguccugaua

SEQ ID NO: 1115562 - RNA, 19 nt, Homo sapiens
caaaggcaaguccugauau

SEQ ID NO: 1115563 - RNA, 19 nt, Homo sapiens
gcuuugaauucacuuaagu

SEQ ID NO: 1115564 - RNA, 19 nt, Homo sapiens
ucaaguuccugaagccaau

SEQ ID NO: 1115565 - RNA, 19 nt, Homo sapiens
ucaaucagaucccagaaaa

SEQ ID NO: 1115566 - RNA, 19 nt, Homo sapiens
guuaauaaggaucuacuga

SEQ ID NO: 1115567 - RNA, 19 nt, Homo sapiens
gaccggggauuuguuguua

SEQ ID NO: 1115568 - RNA, 19 nt, Homo sapiens
ggaacuaauggagaaauau

SEQ ID NO: 1115569 - RNA, 19 nt, Homo sapiens
gcccaggacuuggauguag

SEQ ID NO: 1115570 - RNA, 19 nt, Homo sapiens
cgaggcaaaucccaguuuc

SEQ ID NO: 1115571 - RNA, 19 nt, Homo sapiens
cgacacuuaucaaucagau

SEQ ID NO: 1115572 - RNA, 19 nt, Homo sapiens
ucucgauggcauaauauua

SEQ ID NO: 1115573 - RNA, 19 nt, Homo sapiens
ugucuucgcucuuccucuu

SEQ ID NO: 1115574 - RNA, 19 nt, Homo sapiens
gagaccagauccgaauaca

SEQ ID NO: 1115575 - RNA, 19 nt, Homo sapiens
gaaguuguggacaucaaug

SEQ ID NO: 1115576 - RNA, 19 nt, Homo sapiens
acacaaucagucccaauuu

SEQ ID NO: 1115577 - RNA, 19 nt, Homo sapiens
gggccagggucguuuccaa

SEQ ID NO: 1115578 - RNA, 19 nt, Homo sapiens
caggaagagcuuugaauuc

SEQ ID NO: 1115579 - RNA, 19 nt, Homo sapiens
gcgaggagcagccugagau

SEQ ID NO: 1115580 - RNA, 19 nt, Homo sapiens
cagggucguuuccaaagga

SEQ ID NO: 1115581 - RNA, 19 nt, Homo sapiens
ggagauaggagaacuugcu

SEQ ID NO: 1115582 - RNA, 19 nt, Homo sapiens
ugaggcuagucucguuuaa

SEQ ID NO: 1115583 - RNA, 19 nt, Homo sapiens
gcgaggcaaaucccaguuu

SEQ ID NO: 1115584 - RNA, 19 nt, Homo sapiens
gacaaaugaguucaaguuc

SEQ ID NO: 1115585 - RNA, 19 nt, Homo sapiens
ugagagaccagaaagcaau

SEQ ID NO: 1115586 - RNA, 19 nt, Homo sapiens
ugauggauuugaaugacaa

SEQ ID NO: 1115587 - RNA, 19 nt, Homo sapiens
caagugauggauuugaaug

SEQ ID NO: 1115588 - RNA, 19 nt, Homo sapiens
uaaauauucaggcgacaga

SEQ ID NO: 1115589 - RNA, 19 nt, Homo sapiens
ccagacauacacaguaaau

SEQ ID NO: 1115590 - RNA, 19 nt, Homo sapiens
gagaacugcuuuuaagaca

SEQ ID NO: 1115591 - RNA, 19 nt, Homo sapiens
cgcaaaacguuucgauuaa

SEQ ID NO: 1115592 - RNA, 19 nt, Homo sapiens
gauugaaguuguggacauc

SEQ ID NO: 1115593 - RNA, 19 nt, Homo sapiens
ggaagagcuuugaauucac

SEQ ID NO: 1115594 - RNA, 19 nt, Homo sapiens
cuugaaaccuucuguugag

SEQ ID NO: 1115595 - RNA, 19 nt, Homo sapiens
gauccugacuccggagaca

SEQ ID NO: 1115596 - RNA, 19 nt, Homo sapiens
cauccagacauacacagua

SEQ ID NO: 1115597 - RNA, 19 nt, Homo sapiens
ucgcaaaacguuucgauua

SEQ ID NO: 1115598 - RNA, 19 nt, Homo sapiens
ggagcgcguuccgaaacaa

SEQ ID NO: 1115599 - RNA, 19 nt, Homo sapiens
ggacacccucauugcugua

SEQ ID NO: 1115600 - RNA, 19 nt, Homo sapiens
auccagacauacacaguaa

SEQ ID NO: 1115601 - RNA, 19 nt, Homo sapiens
gaaccaacagucuccaaaa

SEQ ID NO: 1115602 - RNA, 19 nt, Homo sapiens
caaaucccaguuucaggaa

SEQ ID NO: 1115603 - RNA, 19 nt, Homo sapiens
guauucagcguuucagauc

SEQ ID NO: 1115604 - RNA, 19 nt, Homo sapiens
uaacuaugucgacacuuau

SEQ ID NO: 1115605 - RNA, 19 nt, Homo sapiens
gacaauccuccggaacuaa

SEQ ID NO: 1115606 - RNA, 19 nt, Homo sapiens
gugauggauuugaaugaca

SEQ ID NO: 1115607 - RNA, 19 nt, Homo sapiens
gauuuagacauuggaacua

SEQ ID NO: 1115608 - RNA, 19 nt, Homo sapiens
uuccagguguuacuagaaa

SEQ ID NO: 1115609 - RNA, 19 nt, Homo sapiens
cuaugcauguuacugguau

SEQ ID NO: 1115610 - RNA, 19 nt, Homo sapiens
gggagaccagauccgaaua

SEQ ID NO: 1115611 - RNA, 19 nt, Homo sapiens
cuuuguggccaauuuguua

SEQ ID NO: 1115612 - RNA, 19 nt, Homo sapiens
gcaaaacguuucgauuaag

SEQ ID NO: 1115613 - RNA, 19 nt, Homo sapiens
ggauuuagacauuggaacu

SEQ ID NO: 1115614 - RNA, 19 nt, Homo sapiens
gcaaaucucucccauguag

SEQ ID NO: 1115615 - RNA, 19 nt, Homo sapiens
guaggagucuguuauuuaa

SEQ ID NO: 1115616 - RNA, 19 nt, Homo sapiens
aaucacagcuuuacucuuu

SEQ ID NO: 1115617 - RNA, 19 nt, Homo sapiens
caacacaugugaaccauug

SEQ ID NO: 1115618 - RNA, 19 nt, Homo sapiens
gaucauugcugcuacagaa

SEQ ID NO: 1115619 - RNA, 19 nt, Homo sapiens
aagcagaucugauguguuu

SEQ ID NO: 1115620 - RNA, 19 nt, Homo sapiens
gauguuaccugaaaucaau

SEQ ID NO: 1115621 - RNA, 19 nt, Homo sapiens
cgacaacucuccugccuuu

SEQ ID NO: 1115622 - RNA, 19 nt, Homo sapiens
cuacagaagugcuuuaaga

SEQ ID NO: 1115623 - RNA, 19 nt, Homo sapiens
gaucugauguguuuccuau

SEQ ID NO: 1115624 - RNA, 19 nt, Homo sapiens
ggaccagacuuucuaaauc

SEQ ID NO: 1115625 - RNA, 19 nt, Homo sapiens
gguaggagucuguuauuua

SEQ ID NO: 1115626 - RNA, 19 nt, Homo sapiens
gaacgcauuuaacagguuu

SEQ ID NO: 1115627 - RNA, 19 nt, Homo sapiens
agagugaacuuuaagcuuu

SEQ ID NO: 1115628 - RNA, 19 nt, Homo sapiens
gagugaacuuuaagcuuua

SEQ ID NO: 1115629 - RNA, 19 nt, Homo sapiens
ugaaaucaaucucccauau

SEQ ID NO: 1115630 - RNA, 19 nt, Homo sapiens
acaauuaugugcacuuuga

SEQ ID NO: 1115631 - RNA, 19 nt, Homo sapiens
cagaagugcuuuaagagaa

SEQ ID NO: 1115632 - RNA, 19 nt, Homo sapiens
uuaccaaucugaccucuuu

SEQ ID NO: 1115633 - RNA, 19 nt, Homo sapiens
caauauugaugccaggaua

SEQ ID NO: 1115634 - RNA, 19 nt, Homo sapiens
ggauaaagcuguuuuguuc

SEQ ID NO: 1115635 - RNA, 19 nt, Homo sapiens
gaaccugauuauucucaaa

SEQ ID NO: 1115636 - RNA, 19 nt, Homo sapiens
ugacaacagugaccaguga

SEQ ID NO: 1115637 - RNA, 19 nt, Homo sapiens
ggagcgcgcuuucacauag

SEQ ID NO: 1115638 - RNA, 19 nt, Homo sapiens
cuaagacuccugaaauaua

SEQ ID NO: 1115639 - RNA, 19 nt, Homo sapiens
cagcggaaguuaucaguau

SEQ ID NO: 1115640 - RNA, 19 nt, Homo sapiens
ugagaucucugacaucaau

SEQ ID NO: 1115641 - RNA, 19 nt, Homo sapiens
ccuaugauguuaccugaaa

SEQ ID NO: 1115642 - RNA, 19 nt, Homo sapiens
acucugaaauuacccuuua

SEQ ID NO: 1115643 - RNA, 19 nt, Homo sapiens
gaccagacuuucuaaaucu

SEQ ID NO: 1115644 - RNA, 19 nt, Homo sapiens
agcaacagcuggaccuuua

SEQ ID NO: 1115645 - RNA, 19 nt, Homo sapiens
ccacugagcagcacuguga

SEQ ID NO: 1115646 - RNA, 19 nt, Homo sapiens
gagaaucgggcuaauuuau

SEQ ID NO: 1115647 - RNA, 19 nt, Homo sapiens
ugaaauaucagcucauaga

SEQ ID NO: 1115648 - RNA, 19 nt, Homo sapiens
gcacacaauguuuaugaaa

SEQ ID NO: 1115649 - RNA, 19 nt, Homo sapiens
guacaaggaaggcaagaaa

SEQ ID NO: 1115650 - RNA, 19 nt, Homo sapiens
ggacaucaacgacaacuca

SEQ ID NO: 1115651 - RNA, 19 nt, Homo sapiens
ggagaaucgggcuaauuua

SEQ ID NO: 1115652 - RNA, 19 nt, Homo sapiens
gcucauagaaaguaacaaa

SEQ ID NO: 1115653 - RNA, 19 nt, Homo sapiens
gcaauucccugcuccuuuu

SEQ ID NO: 1115654 - RNA, 19 nt, Homo sapiens
aaacaagccaacaacaaua

SEQ ID NO: 1115655 - RNA, 19 nt, Homo sapiens
ccaggaagaugggagauga

SEQ ID NO: 1115656 - RNA, 19 nt, Homo sapiens
gagcucagguacuccuuga

SEQ ID NO: 1115657 - RNA, 19 nt, Homo sapiens
gguauuuccucuguuauug

SEQ ID NO: 1115658 - RNA, 19 nt, Homo sapiens
uggcaaaucucucccaugu

SEQ ID NO: 1115659 - RNA, 19 nt, Homo sapiens
caaacaagccaacaacaau

SEQ ID NO: 1115660 - RNA, 19 nt, Homo sapiens
cugcagaacuguacaaaca

SEQ ID NO: 1115661 - RNA, 19 nt, Homo sapiens
ggagaacaguaaagugcuu

SEQ ID NO: 1115662 - RNA, 19 nt, Homo sapiens
aaaauuugcugucaccuua

SEQ ID NO: 1115663 - RNA, 19 nt, Homo sapiens
gaaauaucagcucauagaa

SEQ ID NO: 1115664 - RNA, 19 nt, Homo sapiens
ggaaugaauacugacaaua

SEQ ID NO: 1115665 - RNA, 19 nt, Homo sapiens
gggaauggauaaagcuguu

SEQ ID NO: 1115666 - RNA, 19 nt, Homo sapiens
aaaucaaucucccauaugu

SEQ ID NO: 1115667 - RNA, 19 nt, Homo sapiens
gaaaucaaucucccauaug

SEQ ID NO: 1115668 - RNA, 19 nt, Homo sapiens
aagagaaagucuauagcua

SEQ ID NO: 1115669 - RNA, 19 nt, Homo sapiens
gaaaguucccugugucugu

SEQ ID NO: 1115670 - RNA, 19 nt, Homo sapiens
ggacauacucugaaauuac

SEQ ID NO: 1115671 - RNA, 19 nt, Homo sapiens
gcaaggugcugguggacau

SEQ ID NO: 1115672 - RNA, 19 nt, Homo sapiens
gcccauguaucugaccuua

SEQ ID NO: 1115673 - RNA, 19 nt, Homo sapiens
caaauaaacagcggaaguu

SEQ ID NO: 1115674 - RNA, 19 nt, Homo sapiens
agaggaggcuggcauucua

SEQ ID NO: 1115675 - RNA, 19 nt, Homo sapiens
gcaagggaauggauaaagc

SEQ ID NO: 1115676 - RNA, 19 nt, Homo sapiens
ccucuugcauguauuacua

SEQ ID NO: 1115677 - RNA, 19 nt, Homo sapiens
gccugaaacaucuguauua

SEQ ID NO: 1115678 - RNA, 19 nt, Homo sapiens
gagaauugccugaaacauc

SEQ ID NO: 1115679 - RNA, 19 nt, Homo sapiens
uuaagagaauugccugaaa

SEQ ID NO: 1115680 - RNA, 19 nt, Homo sapiens
uaaagucuguuggcuguga

SEQ ID NO: 1115681 - RNA, 19 nt, Homo sapiens
gcagaacuguacaaacaag

SEQ ID NO: 1115682 - RNA, 19 nt, Homo sapiens
ccuccuaugucuccauuaa

SEQ ID NO: 1115683 - RNA, 19 nt, Homo sapiens
gcacauugguggugaagcu

SEQ ID NO: 1115684 - RNA, 19 nt, Homo sapiens
gcacaaauuuuaccaaucu

SEQ ID NO: 1115685 - RNA, 19 nt, Homo sapiens
gaagugcuuuaagagaauu

SEQ ID NO: 1115686 - RNA, 19 nt, Homo sapiens
uaacaagacccaggagaaa

SEQ ID NO: 1115687 - RNA, 19 nt, Homo sapiens
gcugggaaccugauuauuc

SEQ ID NO: 1115688 - RNA, 19 nt, Homo sapiens
aaacugucuugucuacuuu

SEQ ID NO: 1115689 - RNA, 19 nt, Homo sapiens
aauaucagcucauagaaag

SEQ ID NO: 1115690 - RNA, 19 nt, Homo sapiens
ucaagauacuggugauuca

SEQ ID NO: 1115691 - RNA, 19 nt, Homo sapiens
gauacacaaccuucucuaa

SEQ ID NO: 1115692 - RNA, 19 nt, Homo sapiens
ucaccaaagucauagcuau

SEQ ID NO: 1115693 - RNA, 19 nt, Homo sapiens
uaccuagagugaacuuuaa

SEQ ID NO: 1115694 - RNA, 19 nt, Homo sapiens
uaagacuccugaaauauac

SEQ ID NO: 1115695 - RNA, 19 nt, Homo sapiens
ugcuaagacuccugaaaua

SEQ ID NO: 1115696 - RNA, 19 nt, Homo sapiens
guaacaagacccaggagaa

SEQ ID NO: 1115697 - RNA, 19 nt, Homo sapiens
ggacuccuauuccaucuac

SEQ ID NO: 1115698 - RNA, 19 nt, Homo sapiens
guugagaucucugacauca

SEQ ID NO: 1115699 - RNA, 19 nt, Homo sapiens
cuucagcucugcaggauug

SEQ ID NO: 1115700 - RNA, 19 nt, Homo sapiens
aaucugaccucuuugaagu

SEQ ID NO: 1115701 - RNA, 19 nt, Homo sapiens
gaagaugggagaugagagu

SEQ ID NO: 1115702 - RNA, 19 nt, Homo sapiens
gcuucauucucccauauuu

SEQ ID NO: 1115703 - RNA, 19 nt, Homo sapiens
gguaugcgagugccagaua

SEQ ID NO: 1115704 - RNA, 19 nt, Homo sapiens
ggaggcuucuguggaguaa

SEQ ID NO: 1115705 - RNA, 19 nt, Homo sapiens
cggacauacucugaaauua

SEQ ID NO: 1115706 - RNA, 19 nt, Homo sapiens
ccagguguguugcucugua

SEQ ID NO: 1115707 - RNA, 19 nt, Homo sapiens
gaagugcuuuccaauccau

SEQ ID NO: 1115708 - RNA, 19 nt, Homo sapiens
agaauugccugaaacaucu

SEQ ID NO: 1115709 - RNA, 19 nt, Homo sapiens
guccugugcucacuuuauu

SEQ ID NO: 1115710 - RNA, 19 nt, Homo sapiens
gagagcggguggcugucua

SEQ ID NO: 1115711 - RNA, 19 nt, Homo sapiens
gcgaagugcuuuccaaucc

SEQ ID NO: 1115712 - RNA, 19 nt, Homo sapiens
ccguugagguggaaauauu

SEQ ID NO: 1115713 - RNA, 19 nt, Homo sapiens
caacuauuaccuagaguga

SEQ ID NO: 1115714 - RNA, 19 nt, Homo sapiens
cgacaacucuccugccuuu

SEQ ID NO: 1115715 - RNA, 19 nt, Homo sapiens
caauauugaugccaggaua

SEQ ID NO: 1115716 - RNA, 19 nt, Homo sapiens
gaaccugauuauucucaaa

SEQ ID NO: 1115717 - RNA, 19 nt, Homo sapiens
ucuacaaacucaugcauuu

SEQ ID NO: 1115718 - RNA, 19 nt, Homo sapiens
ggagcgcgcuuucacauag

SEQ ID NO: 1115719 - RNA, 19 nt, Homo sapiens
ugagaucucugacaucaau

SEQ ID NO: 1115720 - RNA, 19 nt, Homo sapiens
acucugaaauuacccuuua

SEQ ID NO: 1115721 - RNA, 19 nt, Homo sapiens
ccacugagcagcacuguga

SEQ ID NO: 1115722 - RNA, 19 nt, Homo sapiens
ggacaucaacgacaacuca

SEQ ID NO: 1115723 - RNA, 19 nt, Homo sapiens
aaacaagccaacaacaaua

SEQ ID NO: 1115724 - RNA, 19 nt, Homo sapiens
ccaggaagaugggagauga

SEQ ID NO: 1115725 - RNA, 19 nt, Homo sapiens
gagcucagguacuccuuga

SEQ ID NO: 1115726 - RNA, 19 nt, Homo sapiens
caaacaagccaacaacaau

SEQ ID NO: 1115727 - RNA, 19 nt, Homo sapiens
cugcagaacuguacaaaca

SEQ ID NO: 1115728 - RNA, 19 nt, Homo sapiens
ggagaacaguaaagugcuu

SEQ ID NO: 1115729 - RNA, 19 nt, Homo sapiens
ggacauacucugaaauuac

SEQ ID NO: 1115730 - RNA, 19 nt, Homo sapiens
gcaaggugcugguggacau

SEQ ID NO: 1115731 - RNA, 19 nt, Homo sapiens
gcagaacuguacaaacaag

SEQ ID NO: 1115732 - RNA, 19 nt, Homo sapiens
ccuccuaugucuccauuaa

SEQ ID NO: 1115733 - RNA, 19 nt, Homo sapiens
gcacauugguggugaagcu

SEQ ID NO: 1115734 - RNA, 19 nt, Homo sapiens
gcugggaaccugauuauuc

SEQ ID NO: 1115735 - RNA, 19 nt, Homo sapiens
ucaccaaagucauagcuau

SEQ ID NO: 1115736 - RNA, 19 nt, Homo sapiens
ggacuccuauuccaucuac

SEQ ID NO: 1115737 - RNA, 19 nt, Homo sapiens
guugagaucucugacauca

SEQ ID NO: 1115738 - RNA, 19 nt, Homo sapiens
ugauuuggcuuuauugagu

SEQ ID NO: 1115739 - RNA, 19 nt, Homo sapiens
gaagaugggagaugagagu

SEQ ID NO: 1115740 - RNA, 19 nt, Homo sapiens
ggaggcuucuguggaguaa

SEQ ID NO: 1115741 - RNA, 19 nt, Homo sapiens
cggacauacucugaaauua

SEQ ID NO: 1115742 - RNA, 19 nt, Homo sapiens
ccagguguguugcucugua

SEQ ID NO: 1115743 - RNA, 19 nt, Homo sapiens
gagagcggguggcugucua

SEQ ID NO: 1115744 - RNA, 19 nt, Homo sapiens
cccaauauccugugauuug

SEQ ID NO: 1115745 - RNA, 19 nt, Homo sapiens
ccguugagguggaaauauu

SEQ ID NO: 1115746 - RNA, 19 nt, Homo sapiens
gauaccgcauggccucaaa

SEQ ID NO: 1115747 - RNA, 19 nt, Homo sapiens
ccucggacauacucugaaa

SEQ ID NO: 1115748 - RNA, 19 nt, Homo sapiens
ggacaucguggacgugaau

SEQ ID NO: 1115749 - RNA, 19 nt, Homo sapiens
ggagagccaucacuaucag

SEQ ID NO: 1115750 - RNA, 19 nt, Homo sapiens
ccagucaccuccuaugucu

SEQ ID NO: 1115751 - RNA, 19 nt, Homo sapiens
ucaccaagaccuacugcua

SEQ ID NO: 1115752 - RNA, 19 nt, Homo sapiens
gcacacaggagaaauuagg

SEQ ID NO: 1115753 - RNA, 19 nt, Homo sapiens
guggagcgcucuucgucaa

SEQ ID NO: 1115754 - RNA, 19 nt, Homo sapiens
guggaaauauuggacauca

SEQ ID NO: 1115755 - RNA, 19 nt, Homo sapiens
ccugugauuuggcuuuauu

SEQ ID NO: 1115756 - RNA, 19 nt, Homo sapiens
ggaaauauuggacaucaac

SEQ ID NO: 1115757 - RNA, 19 nt, Homo sapiens
acauacaggagaacaauuu

SEQ ID NO: 1115758 - RNA, 19 nt, Homo sapiens
ggaaccugauuauucucaa

SEQ ID NO: 1115759 - RNA, 19 nt, Homo sapiens
uaagagcccucggacauac

SEQ ID NO: 1115760 - RNA, 19 nt, Homo sapiens
guuaagagcccucggacau

SEQ ID NO: 1115761 - RNA, 19 nt, Homo sapiens
ugacaucaaugacaaucca

SEQ ID NO: 1115762 - RNA, 19 nt, Homo sapiens
ucucugacaucaaugacaa

SEQ ID NO: 1115763 - RNA, 19 nt, Homo sapiens
gaauaccgcagcucacauc

SEQ ID NO: 1115764 - RNA, 19 nt, Homo sapiens
ccaacucaguacagaccua

SEQ ID NO: 1115765 - RNA, 19 nt, Homo sapiens
gcggguggcugucuacaac

SEQ ID NO: 1115766 - RNA, 19 nt, Homo sapiens
acacugccuuuccgacuga

SEQ ID NO: 1115767 - RNA, 19 nt, Homo sapiens
gagcgcgcuuucacauaga

SEQ ID NO: 1115768 - RNA, 19 nt, Homo sapiens
caagccaacaacaauauug

SEQ ID NO: 1115769 - RNA, 19 nt, Homo sapiens
acaaacaagccaacaacaa

SEQ ID NO: 1115770 - RNA, 19 nt, Homo sapiens
aggcagcucuucagcauag

SEQ ID NO: 1115771 - RNA, 19 nt, Homo sapiens
gacacucagaggcauguua

SEQ ID NO: 1115772 - RNA, 19 nt, Homo sapiens
cacugugacugccaacgua

SEQ ID NO: 1115773 - RNA, 19 nt, Homo sapiens
ccuuugaccaguccacuua

SEQ ID NO: 1115774 - RNA, 19 nt, Homo sapiens
guacaaacaagccaacaac

SEQ ID NO: 1115775 - RNA, 19 nt, Homo sapiens
ggaaagguccccugcagaa

SEQ ID NO: 1115776 - RNA, 19 nt, Homo sapiens
caauuugccagguguguug

SEQ ID NO: 1115777 - RNA, 19 nt, Homo sapiens
ccaauggugagcucaggua

SEQ ID NO: 1115778 - RNA, 19 nt, Homo sapiens
gacauacucugaaauuacc

SEQ ID NO: 1115779 - RNA, 19 nt, Homo sapiens
acacucagaggcauguuaa

SEQ ID NO: 1115780 - RNA, 19 nt, Homo sapiens
caggagaaauuaggacuac

SEQ ID NO: 1115781 - RNA, 19 nt, Homo sapiens
ccuauuccaucuacauaca

SEQ ID NO: 1115782 - RNA, 19 nt, Homo sapiens
gagcugcacacaggagaaa

SEQ ID NO: 1115783 - RNA, 19 nt, Homo sapiens
gaaguuucgggaguucuuu

SEQ ID NO: 1115784 - RNA, 19 nt, Homo sapiens
acuucgagcuggaccuuaa

SEQ ID NO: 1115785 - RNA, 19 nt, Homo sapiens
gcaggagaacaguaaagug

SEQ ID NO: 1115786 - RNA, 19 nt, Homo sapiens
uuaagagcccucggacaua

SEQ ID NO: 1115787 - RNA, 19 nt, Homo sapiens
ggauaggguuuccaaaauc

SEQ ID NO: 1115788 - RNA, 19 nt, Homo sapiens
ccacagacccagaugaaaa

SEQ ID NO: 1115789 - RNA, 19 nt, Homo sapiens
gcacagugucuuuuauauu

SEQ ID NO: 1115790 - RNA, 19 nt, Homo sapiens
ggagaaauuaggacuacca

SEQ ID NO: 1115791 - RNA, 19 nt, Homo sapiens
ccaucuacauacaggagaa

SEQ ID NO: 1115792 - RNA, 19 nt, Homo sapiens
ucacaucccugcguacacu

SEQ ID NO: 1115793 - RNA, 19 nt, Homo sapiens
acaacucuccugccuuuga

SEQ ID NO: 1115794 - RNA, 19 nt, Homo sapiens
ggccaaaguggucagaaug

SEQ ID NO: 1115795 - RNA, 19 nt, Homo sapiens
ggaauggcucccucaccaa

SEQ ID NO: 1115796 - RNA, 19 nt, Homo sapiens
cauugaaguucgagggaau

SEQ ID NO: 1115797 - RNA, 19 nt, Homo sapiens
cuucugaccuggaccucuu

SEQ ID NO: 1115798 - RNA, 19 nt, Homo sapiens
uuucgggaguucuuuguga

SEQ ID NO: 1115799 - RNA, 19 nt, Homo sapiens
caacuccuuugacuaugag

SEQ ID NO: 1115800 - RNA, 19 nt, Homo sapiens
uauuggacaucaacgacaa

SEQ ID NO: 1115801 - RNA, 19 nt, Homo sapiens
cugaauggcuuuggaaacu

SEQ ID NO: 1115802 - RNA, 19 nt, Homo sapiens
cgacugaauggcuuuggaa

SEQ ID NO: 1115803 - RNA, 19 nt, Homo sapiens
cugggaaccugauuauucu

SEQ ID NO: 1115804 - RNA, 19 nt, Homo sapiens
gaaucucacaggccaaagu

SEQ ID NO: 1115805 - RNA, 19 nt, Homo sapiens
gccaacaacaauauugaug

SEQ ID NO: 1115806 - RNA, 19 nt, Homo sapiens
gcauuaagcacagugucuu

SEQ ID NO: 1115807 - RNA, 19 nt, Homo sapiens
ucggacauacucugaaauu

SEQ ID NO: 1115808 - RNA, 19 nt, Homo sapiens
caguagcugugguggauag

SEQ ID NO: 1115809 - RNA, 19 nt, Homo sapiens
aaauuaggacuaccaggaa

SEQ ID NO: 1115810 - RNA, 19 nt, Homo sapiens
gcugcacacaggagaaauu

SEQ ID NO: 1115811 - RNA, 19 nt, Homo sapiens
gaccuggaccucuuuaagg

SEQ ID NO: 1115812 - RNA, 19 nt, Homo sapiens
uggcuuuauugagucauua

SEQ ID NO: 1115813 - RNA, 19 nt, Homo sapiens
gagauggugccucgaacug

SEQ ID NO: 1115814 - RNA, 19 nt, Homo sapiens
gaaguaagaugguuucaaa

SEQ ID NO: 1115815 - RNA, 19 nt, Homo sapiens
gcaaguagcugcuucacua

SEQ ID NO: 1115816 - RNA, 19 nt, Homo sapiens
gcaaaucucucccauguag

SEQ ID NO: 1115817 - RNA, 19 nt, Homo sapiens
ggacugaauuugccaauau

SEQ ID NO: 1115818 - RNA, 19 nt, Homo sapiens
ggacuugguucugauaaua

SEQ ID NO: 1115819 - RNA, 19 nt, Homo sapiens
guaggagucuguuauuuaa

SEQ ID NO: 1115820 - RNA, 19 nt, Homo sapiens
aaucacagcuuuacucuuu

SEQ ID NO: 1115821 - RNA, 19 nt, Homo sapiens
caacacaugugaaccauug

SEQ ID NO: 1115822 - RNA, 19 nt, Homo sapiens
gaucauugcugcuacagaa

SEQ ID NO: 1115823 - RNA, 19 nt, Homo sapiens
aagcagaucugauguguuu

SEQ ID NO: 1115824 - RNA, 19 nt, Homo sapiens
agaauggccuugucucuua

SEQ ID NO: 1115825 - RNA, 19 nt, Homo sapiens
gauguuaccugaaaucaau

SEQ ID NO: 1115826 - RNA, 19 nt, Homo sapiens
gcaaugggauacuaagcua

SEQ ID NO: 1115827 - RNA, 19 nt, Homo sapiens
cuacagaagugcuuuaaga

SEQ ID NO: 1115828 - RNA, 19 nt, Homo sapiens
gaucugagguauggaagua

SEQ ID NO: 1115829 - RNA, 19 nt, Homo sapiens
gaucugauguguuuccuau

SEQ ID NO: 1115830 - RNA, 19 nt, Homo sapiens
ggaccagacuuucuaaauc

SEQ ID NO: 1115831 - RNA, 19 nt, Homo sapiens
gguaggagucuguuauuua

SEQ ID NO: 1115832 - RNA, 19 nt, Homo sapiens
gaacgcauuuaacagguuu

SEQ ID NO: 1115833 - RNA, 19 nt, Homo sapiens
agagugaacuuuaagcuuu

SEQ ID NO: 1115834 - RNA, 19 nt, Homo sapiens
gcccagaacuuguauuuag

SEQ ID NO: 1115835 - RNA, 19 nt, Homo sapiens
gagugaacuuuaagcuuua

SEQ ID NO: 1115836 - RNA, 19 nt, Homo sapiens
guaauugccuuggcuugua

SEQ ID NO: 1115837 - RNA, 19 nt, Homo sapiens
ggacgaaggugucuuuggu

SEQ ID NO: 1115838 - RNA, 19 nt, Homo sapiens
ugaaaucaaucucccauau

SEQ ID NO: 1115839 - RNA, 19 nt, Homo sapiens
acaauuaugugcacuuuga

SEQ ID NO: 1115840 - RNA, 19 nt, Homo sapiens
cagaagugcuuuaagagaa

SEQ ID NO: 1115841 - RNA, 19 nt, Homo sapiens
ugacaacgcgccuguauuu

SEQ ID NO: 1115842 - RNA, 19 nt, Homo sapiens
gcacaagucaccaucauug

SEQ ID NO: 1115843 - RNA, 19 nt, Homo sapiens
gcaauuugguggucagaga

SEQ ID NO: 1115844 - RNA, 19 nt, Homo sapiens
uuaccaaucugaccucuuu

SEQ ID NO: 1115845 - RNA, 19 nt, Homo sapiens
gcagaucagugaauaccaa

SEQ ID NO: 1115846 - RNA, 19 nt, Homo sapiens
ggacaccaaugacaacuca

SEQ ID NO: 1115847 - RNA, 19 nt, Homo sapiens
ggauaaagcuguuuuguuc

SEQ ID NO: 1115848 - RNA, 19 nt, Homo sapiens
gaaggugucuuugguuuag

SEQ ID NO: 1115849 - RNA, 19 nt, Homo sapiens
auacuaagcuacagccuaa

SEQ ID NO: 1115850 - RNA, 19 nt, Homo sapiens
ugacaacagugaccaguga

SEQ ID NO: 1115851 - RNA, 19 nt, Homo sapiens
gggagcagaucagugaaua

SEQ ID NO: 1115852 - RNA, 19 nt, Homo sapiens
augaagaccucgauucuaa

SEQ ID NO: 1115853 - RNA, 19 nt, Homo sapiens
cuaagacuccugaaauaua

SEQ ID NO: 1115854 - RNA, 19 nt, Homo sapiens
cagcggaaguuaucaguau

SEQ ID NO: 1115855 - RNA, 19 nt, Homo sapiens
gugcaacagugacuauaaa

SEQ ID NO: 1115856 - RNA, 19 nt, Homo sapiens
gcacagugauugcucucuu

SEQ ID NO: 1115857 - RNA, 19 nt, Homo sapiens
ccuaugauguuaccugaaa

SEQ ID NO: 1115858 - RNA, 19 nt, Homo sapiens
ucaguuacuuccagacuuu

SEQ ID NO: 1115859 - RNA, 19 nt, Homo sapiens
gaccagacuuucuaaaucu

SEQ ID NO: 1115860 - RNA, 19 nt, Homo sapiens
agcaacagcuggaccuuua

SEQ ID NO: 1115861 - RNA, 19 nt, Homo sapiens
gagaaucgggcuaauuuau

SEQ ID NO: 1115862 - RNA, 19 nt, Homo sapiens
ugaaauaucagcucauaga

SEQ ID NO: 1115863 - RNA, 19 nt, Homo sapiens
gcacacaauguuuaugaaa

SEQ ID NO: 1115864 - RNA, 19 nt, Homo sapiens
guacaaggaaggcaagaaa

SEQ ID NO: 1115865 - RNA, 19 nt, Homo sapiens
gaaguccaguacucccuaa

SEQ ID NO: 1115866 - RNA, 19 nt, Homo sapiens
ggagaaucgggcuaauuua

SEQ ID NO: 1115867 - RNA, 19 nt, Homo sapiens
gcucauagaaaguaacaaa

SEQ ID NO: 1115868 - RNA, 19 nt, Homo sapiens
gcaauucccugcuccuuuu

SEQ ID NO: 1115869 - RNA, 19 nt, Homo sapiens
caacagugacuauaaacuu

SEQ ID NO: 1115870 - RNA, 19 nt, Homo sapiens
aaacuuccuuugacuuuga

SEQ ID NO: 1115871 - RNA, 19 nt, Homo sapiens
ugacugacgugaacgauca

SEQ ID NO: 1115872 - RNA, 19 nt, Homo sapiens
gguauuuccucuguuauug

SEQ ID NO: 1115873 - RNA, 19 nt, Homo sapiens
uggcaaaucucucccaugu

SEQ ID NO: 1115874 - RNA, 19 nt, Homo sapiens
cuuaugagcuguuggaugu

SEQ ID NO: 1115875 - RNA, 19 nt, Homo sapiens
gggaagcaaugggauacua

SEQ ID NO: 1115876 - RNA, 19 nt, Homo sapiens
aaaauuugcugucaccuua

SEQ ID NO: 1115877 - RNA, 19 nt, Homo sapiens
gaaauaucagcucauagaa

SEQ ID NO: 1115878 - RNA, 19 nt, Homo sapiens
ggaaugaauacugacaaua

SEQ ID NO: 1115879 - RNA, 19 nt, Homo sapiens
gggaauggauaaagcuguu

SEQ ID NO: 1115880 - RNA, 19 nt, Homo sapiens
aaaucaaucucccauaugu

SEQ ID NO: 1115881 - RNA, 19 nt, Homo sapiens
gaaaucaaucucccauaug

SEQ ID NO: 1115882 - RNA, 19 nt, Homo sapiens
aagagaaagucuauagcua

SEQ ID NO: 1115883 - RNA, 19 nt, Homo sapiens
gaaaguucccugugucugu

SEQ ID NO: 1115884 - RNA, 19 nt, Homo sapiens
ugacaacucaccucucuuu

SEQ ID NO: 1115885 - RNA, 19 nt, Homo sapiens
gcccauguaucugaccuua

SEQ ID NO: 1115886 - RNA, 19 nt, Homo sapiens
caaauaaacagcggaaguu

SEQ ID NO: 1115887 - RNA, 19 nt, Homo sapiens
agaggaggcuggcauucua

SEQ ID NO: 1115888 - RNA, 19 nt, Homo sapiens
uaugagcuguuggauguua

SEQ ID NO: 1115889 - RNA, 19 nt, Homo sapiens
gcaagggaauggauaaagc

SEQ ID NO: 1115890 - RNA, 19 nt, Homo sapiens
ccucuugcauguauuacua

SEQ ID NO: 1115891 - RNA, 19 nt, Homo sapiens
gccugaaacaucuguauua

SEQ ID NO: 1115892 - RNA, 19 nt, Homo sapiens
gagaauugccugaaacauc

SEQ ID NO: 1115893 - RNA, 19 nt, Homo sapiens
uuaagagaauugccugaaa

SEQ ID NO: 1115894 - RNA, 19 nt, Homo sapiens
uaaagucuguuggcuguga

SEQ ID NO: 1115895 - RNA, 19 nt, Homo sapiens
gcuccguacugcucgcuua

SEQ ID NO: 1115896 - RNA, 19 nt, Homo sapiens
ccaaugggacuguguuauu

SEQ ID NO: 1115897 - RNA, 19 nt, Homo sapiens
gcacaaauuuuaccaaucu

SEQ ID NO: 1115898 - RNA, 19 nt, Homo sapiens
gaagugcuuuaagagaauu

SEQ ID NO: 1115899 - RNA, 19 nt, Homo sapiens
uaacaagacccaggagaaa

SEQ ID NO: 1115900 - RNA, 19 nt, Homo sapiens
ccacuuagcacccgaagga

SEQ ID NO: 1115901 - RNA, 19 nt, Homo sapiens
aaacugucuugucuacuuu

SEQ ID NO: 1115902 - RNA, 19 nt, Homo sapiens
aauaucagcucauagaaag

SEQ ID NO: 1115903 - RNA, 19 nt, Homo sapiens
ucaagauacuggugauuca

SEQ ID NO: 1115904 - RNA, 19 nt, Homo sapiens
gauacacaaccuucucuaa

SEQ ID NO: 1115905 - RNA, 19 nt, Homo sapiens
ggaucacgcuaaugucaau

SEQ ID NO: 1115906 - RNA, 19 nt, Homo sapiens
gaaccaggagggcagcuuu

SEQ ID NO: 1115907 - RNA, 19 nt, Homo sapiens
gaagaccucgauucuaaug

SEQ ID NO: 1115908 - RNA, 19 nt, Homo sapiens
caaugggacuguguuauuc

SEQ ID NO: 1115909 - RNA, 19 nt, Homo sapiens
ggaagcaaugggauacuaa

SEQ ID NO: 1115910 - RNA, 19 nt, Homo sapiens
uaccuagagugaacuuuaa

SEQ ID NO: 1115911 - RNA, 19 nt, Homo sapiens
uaagacuccugaaauauac

SEQ ID NO: 1115912 - RNA, 19 nt, Homo sapiens
ugcuaagacuccugaaaua

SEQ ID NO: 1115913 - RNA, 19 nt, Homo sapiens
guaacaagacccaggagaa

SEQ ID NO: 1115914 - RNA, 19 nt, Homo sapiens
gaaguaagaugguuucaaa

SEQ ID NO: 1115915 - RNA, 19 nt, Homo sapiens
gcaaguagcugcuucacua

SEQ ID NO: 1115916 - RNA, 19 nt, Homo sapiens
caagaaaucuggaaguaua

SEQ ID NO: 1115917 - RNA, 19 nt, Homo sapiens
guaaggcacucuaauauuu

SEQ ID NO: 1115918 - RNA, 19 nt, Homo sapiens
guaagagucugcuuuauau

SEQ ID NO: 1115919 - RNA, 19 nt, Homo sapiens
ggacugaauuugccaauau

SEQ ID NO: 1115920 - RNA, 19 nt, Homo sapiens
ucaagggacuuauaguuua

SEQ ID NO: 1115921 - RNA, 19 nt, Homo sapiens
ggacuugguucugauaaua

SEQ ID NO: 1115922 - RNA, 19 nt, Homo sapiens
agaauggccuugucucuua

SEQ ID NO: 1115923 - RNA, 19 nt, Homo sapiens
gcaaugggauacuaagcua

SEQ ID NO: 1115924 - RNA, 19 nt, Homo sapiens
gaucugagguauggaagua

SEQ ID NO: 1115925 - RNA, 19 nt, Homo sapiens
uauggaaggugaaacauuu

SEQ ID NO: 1115926 - RNA, 19 nt, Homo sapiens
gcccagaacuuguauuuag

SEQ ID NO: 1115927 - RNA, 19 nt, Homo sapiens
gaacuaaacacuccuucuu

SEQ ID NO: 1115928 - RNA, 19 nt, Homo sapiens
guaauugccuuggcuugua

SEQ ID NO: 1115929 - RNA, 19 nt, Homo sapiens
ggacgaaggugucuuuggu

SEQ ID NO: 1115930 - RNA, 19 nt, Homo sapiens
ugacaacgcgccuguauuu

SEQ ID NO: 1115931 - RNA, 19 nt, Homo sapiens
gcacaagucaccaucauug

SEQ ID NO: 1115932 - RNA, 19 nt, Homo sapiens
gcaauuugguggucagaga

SEQ ID NO: 1115933 - RNA, 19 nt, Homo sapiens
gcagaucagugaauaccaa

SEQ ID NO: 1115934 - RNA, 19 nt, Homo sapiens
ggacaccaaugacaacuca

SEQ ID NO: 1115935 - RNA, 19 nt, Homo sapiens
gccaagaaaucuggaagua

SEQ ID NO: 1115936 - RNA, 19 nt, Homo sapiens
gaaggugucuuugguuuag

SEQ ID NO: 1115937 - RNA, 19 nt, Homo sapiens
auacuaagcuacagccuaa

SEQ ID NO: 1115938 - RNA, 19 nt, Homo sapiens
gggagcagaucagugaaua

SEQ ID NO: 1115939 - RNA, 19 nt, Homo sapiens
augaagaccucgauucuaa

SEQ ID NO: 1115940 - RNA, 19 nt, Homo sapiens
gugcaacagugacuauaaa

SEQ ID NO: 1115941 - RNA, 19 nt, Homo sapiens
gcacagugauugcucucuu

SEQ ID NO: 1115942 - RNA, 19 nt, Homo sapiens
ucaguuacuuccagacuuu

SEQ ID NO: 1115943 - RNA, 19 nt, Homo sapiens
gaaguccaguacucccuaa

SEQ ID NO: 1115944 - RNA, 19 nt, Homo sapiens
caagggacuuauaguuuau

SEQ ID NO: 1115945 - RNA, 19 nt, Homo sapiens
caacagugacuauaaacuu

SEQ ID NO: 1115946 - RNA, 19 nt, Homo sapiens
aaacuuccuuugacuuuga

SEQ ID NO: 1115947 - RNA, 19 nt, Homo sapiens
ugacugacgugaacgauca

SEQ ID NO: 1115948 - RNA, 19 nt, Homo sapiens
cacaacauuucaucaauug

SEQ ID NO: 1115949 - RNA, 19 nt, Homo sapiens
agacaagccuuucacaaca

SEQ ID NO: 1115950 - RNA, 19 nt, Homo sapiens
cuuaugagcuguuggaugu

SEQ ID NO: 1115951 - RNA, 19 nt, Homo sapiens
gggaagcaaugggauacua

SEQ ID NO: 1115952 - RNA, 19 nt, Homo sapiens
uaaugucaaugccauggua

SEQ ID NO: 1115953 - RNA, 19 nt, Homo sapiens
ugacaacucaccucucuuu

SEQ ID NO: 1115954 - RNA, 19 nt, Homo sapiens
uguaagagucugcuuuaua

SEQ ID NO: 1115955 - RNA, 19 nt, Homo sapiens
uaugagcuguuggauguua

SEQ ID NO: 1115956 - RNA, 19 nt, Homo sapiens
gcuccguacugcucgcuua

SEQ ID NO: 1115957 - RNA, 19 nt, Homo sapiens
ccaaugggacuguguuauu

SEQ ID NO: 1115958 - RNA, 19 nt, Homo sapiens
ccacuuagcacccgaagga

SEQ ID NO: 1115959 - RNA, 19 nt, Homo sapiens
ggaucacgcuaaugucaau

SEQ ID NO: 1115960 - RNA, 19 nt, Homo sapiens
gaaccaggagggcagcuuu

SEQ ID NO: 1115961 - RNA, 19 nt, Homo sapiens
gaagaccucgauucuaaug

SEQ ID NO: 1115962 - RNA, 19 nt, Homo sapiens
caaugggacuguguuauuc

SEQ ID NO: 1115963 - RNA, 19 nt, Homo sapiens
ggaagcaaugggauacuaa

SEQ ID NO: 1115964 - RNA, 19 nt, Homo sapiens
gaaggugaaacauuuacuu

SEQ ID NO: 1115965 - RNA, 19 nt, Homo sapiens
caccauagaugucacuaca

SEQ ID NO: 1115966 - RNA, 19 nt, Homo sapiens
ccacuuuccuccucuguca

SEQ ID NO: 1115967 - RNA, 19 nt, Homo sapiens
gaauggccuugucucuuau

SEQ ID NO: 1115968 - RNA, 19 nt, Homo sapiens
ggaggugacugacgugaac

SEQ ID NO: 1115969 - RNA, 19 nt, Homo sapiens
gcuuaguucuucccacuga

SEQ ID NO: 1115970 - RNA, 19 nt, Homo sapiens
ugacaauacaccaaacuuu

SEQ ID NO: 1115971 - RNA, 19 nt, Homo sapiens
uauguaagagucugcuuua

SEQ ID NO: 1115972 - RNA, 19 nt, Homo sapiens
ccauagaugucacuacagu

SEQ ID NO: 1115973 - RNA, 19 nt, Homo sapiens
gacaauacaccaaacuuuc

SEQ ID NO: 1115974 - RNA, 19 nt, Homo sapiens
gaagugcaacagugacuau

SEQ ID NO: 1115975 - RNA, 19 nt, Homo sapiens
gaagggccaucagccucua

SEQ ID NO: 1115976 - RNA, 19 nt, Homo sapiens
gaaaggggaucacgcuaau

SEQ ID NO: 1115977 - RNA, 19 nt, Homo sapiens
ucaaugccaugguaagcaa

SEQ ID NO: 1115978 - RNA, 19 nt, Homo sapiens
ccagaacuuguauuuagua

SEQ ID NO: 1115979 - RNA, 19 nt, Homo sapiens
acaauuauccgguuaucuu

SEQ ID NO: 1115980 - RNA, 19 nt, Homo sapiens
gaucacggccucagauagu

SEQ ID NO: 1115981 - RNA, 19 nt, Homo sapiens
gaccucgauucuaauggua

SEQ ID NO: 1115982 - RNA, 19 nt, Homo sapiens
gcuguuggauguuaucucu

SEQ ID NO: 1115983 - RNA, 19 nt, Homo sapiens
gggcguagccguaggcaau

SEQ ID NO: 1115984 - RNA, 19 nt, Homo sapiens
gaagaauggccuugucucu

SEQ ID NO: 1115985 - RNA, 19 nt, Homo sapiens
gaugaagaccucgauucua

SEQ ID NO: 1115986 - RNA, 19 nt, Homo sapiens
ugauugcucucuuuagugu

SEQ ID NO: 1115987 - RNA, 19 nt, Homo sapiens
cgaaggugucuuugguuua

SEQ ID NO: 1115988 - RNA, 19 nt, Homo sapiens
caacgcgccuguauuugag

SEQ ID NO: 1115989 - RNA, 19 nt, Homo sapiens
gaaaucuggaaguauagaa

SEQ ID NO: 1115990 - RNA, 19 nt, Homo sapiens
guaagaugguuucaaaucc

SEQ ID NO: 1115991 - RNA, 19 nt, Homo sapiens
caaagcugccugcgucuug

SEQ ID NO: 1115992 - RNA, 19 nt, Homo sapiens
gagggacgaaggugucuuu

SEQ ID NO: 1115993 - RNA, 19 nt, Homo sapiens
cacagugauugcucucuuu

SEQ ID NO: 1115994 - RNA, 19 nt, Homo sapiens
acgaaggugucuuugguuu

SEQ ID NO: 1115995 - RNA, 19 nt, Homo sapiens
agagucugcuuuauaugaa

SEQ ID NO: 1115996 - RNA, 19 nt, Homo sapiens
uguguaaggcacucuaaua

SEQ ID NO: 1115997 - RNA, 19 nt, Homo sapiens
gacaagccuuucacaacau

SEQ ID NO: 1115998 - RNA, 19 nt, Homo sapiens
guagauaggaaugacaauu

SEQ ID NO: 1115999 - RNA, 19 nt, Homo sapiens
caacucaccucucuuuccu

SEQ ID NO: 1116000 - RNA, 19 nt, Homo sapiens
aaugacaauuauccgguua

SEQ ID NO: 1116001 - RNA, 19 nt, Homo sapiens
ugaaugacaauacaccaaa

SEQ ID NO: 1116002 - RNA, 19 nt, Homo sapiens
gcucuuggaggcauacauu

SEQ ID NO: 1116003 - RNA, 19 nt, Homo sapiens
acaacgcgccuguauuuga

SEQ ID NO: 1116004 - RNA, 19 nt, Homo sapiens
caugacaucagccaccaua

SEQ ID NO: 1116005 - RNA, 19 nt, Homo sapiens
cauggagacccaccacuuu

SEQ ID NO: 1116006 - RNA, 19 nt, Homo sapiens
aacagugacuauaaacuug

SEQ ID NO: 1116007 - RNA, 19 nt, Homo sapiens
acaccaaacuuuccucaac

SEQ ID NO: 1116008 - RNA, 19 nt, Homo sapiens
gaaugacaauacaccaaac

SEQ ID NO: 1116009 - RNA, 19 nt, Homo sapiens
ggaugaagaccucgauucu

SEQ ID NO: 1116010 - RNA, 19 nt, Homo sapiens
gcuuucacgugcacccuaa

SEQ ID NO: 1116011 - RNA, 19 nt, Homo sapiens
gcgaauacccggaguuggu

SEQ ID NO: 1116012 - RNA, 19 nt, Homo sapiens
guguaaggcacucuaauau

SEQ ID NO: 1116013 - RNA, 19 nt, Homo sapiens
uaauugccuuggcuuguau

SEQ ID NO: 1116014 - RNA, 19 nt, Homo sapiens
caaacuagauuucgaagaa

SEQ ID NO: 1116015 - RNA, 19 nt, Homo sapiens
gcaaaucucucccauguag

SEQ ID NO: 1116016 - RNA, 19 nt, Homo sapiens
guaggagucuguuauuuaa

SEQ ID NO: 1116017 - RNA, 19 nt, Homo sapiens
aaucacagcuuuacucuuu

SEQ ID NO: 1116018 - RNA, 19 nt, Homo sapiens
caacacaugugaaccauug

SEQ ID NO: 1116019 - RNA, 19 nt, Homo sapiens
gaucauugcugcuacagaa

SEQ ID NO: 1116020 - RNA, 19 nt, Homo sapiens
aagcagaucugauguguuu

SEQ ID NO: 1116021 - RNA, 19 nt, Homo sapiens
gauguuaccugaaaucaau

SEQ ID NO: 1116022 - RNA, 19 nt, Homo sapiens
caagaacuacuacucauua

SEQ ID NO: 1116023 - RNA, 19 nt, Homo sapiens
cuacagaagugcuuuaaga

SEQ ID NO: 1116024 - RNA, 19 nt, Homo sapiens
gaucugauguguuuccuau

SEQ ID NO: 1116025 - RNA, 19 nt, Homo sapiens
ggaccagacuuucuaaauc

SEQ ID NO: 1116026 - RNA, 19 nt, Homo sapiens
gguaggagucuguuauuua

SEQ ID NO: 1116027 - RNA, 19 nt, Homo sapiens
gaacgcauuuaacagguuu

SEQ ID NO: 1116028 - RNA, 19 nt, Homo sapiens
agagugaacuuuaagcuuu

SEQ ID NO: 1116029 - RNA, 19 nt, Homo sapiens
gagaacgccuucaauggaa

SEQ ID NO: 1116030 - RNA, 19 nt, Homo sapiens
gagugaacuuuaagcuuua

SEQ ID NO: 1116031 - RNA, 19 nt, Homo sapiens
gaaagcaagaaacgaauaa

SEQ ID NO: 1116032 - RNA, 19 nt, Homo sapiens
ugaaaucaaucucccauau

SEQ ID NO: 1116033 - RNA, 19 nt, Homo sapiens
acaauuaugugcacuuuga

SEQ ID NO: 1116034 - RNA, 19 nt, Homo sapiens
cagaagugcuuuaagagaa

SEQ ID NO: 1116035 - RNA, 19 nt, Homo sapiens
uuaccaaucugaccucuuu

SEQ ID NO: 1116036 - RNA, 19 nt, Homo sapiens
gcagugguauaugcauuua

SEQ ID NO: 1116037 - RNA, 19 nt, Homo sapiens
ggauaaagcuguuuuguuc

SEQ ID NO: 1116038 - RNA, 19 nt, Homo sapiens
ggacaggccucugcagguu

SEQ ID NO: 1116039 - RNA, 19 nt, Homo sapiens
ggaugucaauguuuacuug

SEQ ID NO: 1116040 - RNA, 19 nt, Homo sapiens
gagaggaaauucaggaaca

SEQ ID NO: 1116041 - RNA, 19 nt, Homo sapiens
ugacaacagugaccaguga

SEQ ID NO: 1116042 - RNA, 19 nt, Homo sapiens
cuaagacuccugaaauaua

SEQ ID NO: 1116043 - RNA, 19 nt, Homo sapiens
cagcggaaguuaucaguau

SEQ ID NO: 1116044 - RNA, 19 nt, Homo sapiens
ggacucagaaugcuugaaa

SEQ ID NO: 1116045 - RNA, 19 nt, Homo sapiens
gaacauuagugaucaagcu

SEQ ID NO: 1116046 - RNA, 19 nt, Homo sapiens
cuacugcucuggcuucuga

SEQ ID NO: 1116047 - RNA, 19 nt, Homo sapiens
ccuaugauguuaccugaaa

SEQ ID NO: 1116048 - RNA, 19 nt, Homo sapiens
ggaggcaguugacaaagga

SEQ ID NO: 1116049 - RNA, 19 nt, Homo sapiens
ggaaaacacuggacagaga

SEQ ID NO: 1116050 - RNA, 19 nt, Homo sapiens
caacgauuauuucacuuug

SEQ ID NO: 1116051 - RNA, 19 nt, Homo sapiens
gaccagacuuucuaaaucu

SEQ ID NO: 1116052 - RNA, 19 nt, Homo sapiens
agcaacagcuggaccuuua

SEQ ID NO: 1116053 - RNA, 19 nt, Homo sapiens
gagaaucgggcuaauuuau

SEQ ID NO: 1116054 - RNA, 19 nt, Homo sapiens
ugaaauaucagcucauaga

SEQ ID NO: 1116055 - RNA, 19 nt, Homo sapiens
gcacacaauguuuaugaaa

SEQ ID NO: 1116056 - RNA, 19 nt, Homo sapiens
guacaaggaaggcaagaaa

SEQ ID NO: 1116057 - RNA, 19 nt, Homo sapiens
gacuggaucccaacgauua

SEQ ID NO: 1116058 - RNA, 19 nt, Homo sapiens
gaauaaucauugcagaauc

SEQ ID NO: 1116059 - RNA, 19 nt, Homo sapiens
ggagaaucgggcuaauuua

SEQ ID NO: 1116060 - RNA, 19 nt, Homo sapiens
gcucauagaaaguaacaaa

SEQ ID NO: 1116061 - RNA, 19 nt, Homo sapiens
gcaauucccugcuccuuuu

SEQ ID NO: 1116062 - RNA, 19 nt, Homo sapiens
ggagguaaaucugcagaau

SEQ ID NO: 1116063 - RNA, 19 nt, Homo sapiens
gguauuuccucuguuauug

SEQ ID NO: 1116064 - RNA, 19 nt, Homo sapiens
uggcaaaucucucccaugu

SEQ ID NO: 1116065 - RNA, 19 nt, Homo sapiens
gaaauucaggaacauaguu

SEQ ID NO: 1116066 - RNA, 19 nt, Homo sapiens
aaaauuugcugucaccuua

SEQ ID NO: 1116067 - RNA, 19 nt, Homo sapiens
gaaauaucagcucauagaa

SEQ ID NO: 1116068 - RNA, 19 nt, Homo sapiens
ggaaugaauacugacaaua

SEQ ID NO: 1116069 - RNA, 19 nt, Homo sapiens
gggaauggauaaagcuguu

SEQ ID NO: 1116070 - RNA, 19 nt, Homo sapiens
aaaucaaucucccauaugu

SEQ ID NO: 1116071 - RNA, 19 nt, Homo sapiens
gaaaucaaucucccauaug

SEQ ID NO: 1116072 - RNA, 19 nt, Homo sapiens
aagagaaagucuauagcua

SEQ ID NO: 1116073 - RNA, 19 nt, Homo sapiens
gaaaguucccugugucugu

SEQ ID NO: 1116074 - RNA, 19 nt, Homo sapiens
gcccauguaucugaccuua

SEQ ID NO: 1116075 - RNA, 19 nt, Homo sapiens
caaauaaacagcggaaguu

SEQ ID NO: 1116076 - RNA, 19 nt, Homo sapiens
agaggaggcuggcauucua

SEQ ID NO: 1116077 - RNA, 19 nt, Homo sapiens
ggaaguacuagauguaaau

SEQ ID NO: 1116078 - RNA, 19 nt, Homo sapiens
gcaagggaauggauaaagc

SEQ ID NO: 1116079 - RNA, 19 nt, Homo sapiens
ccucuugcauguauuacua

SEQ ID NO: 1116080 - RNA, 19 nt, Homo sapiens
gccugaaacaucuguauua

SEQ ID NO: 1116081 - RNA, 19 nt, Homo sapiens
gagaauugccugaaacauc

SEQ ID NO: 1116082 - RNA, 19 nt, Homo sapiens
uuaagagaauugccugaaa

SEQ ID NO: 1116083 - RNA, 19 nt, Homo sapiens
uaaagucuguuggcuguga

SEQ ID NO: 1116084 - RNA, 19 nt, Homo sapiens
gagcguaucagccuaugaa

SEQ ID NO: 1116085 - RNA, 19 nt, Homo sapiens
gcacaaauuuuaccaaucu

SEQ ID NO: 1116086 - RNA, 19 nt, Homo sapiens
gaagugcuuuaagagaauu

SEQ ID NO: 1116087 - RNA, 19 nt, Homo sapiens
uaacaagacccaggagaaa

SEQ ID NO: 1116088 - RNA, 19 nt, Homo sapiens
ucacguugcugcuguauac

SEQ ID NO: 1116089 - RNA, 19 nt, Homo sapiens
gcugguggaugucaauguu

SEQ ID NO: 1116090 - RNA, 19 nt, Homo sapiens
uaccaucacuucuuuguca

SEQ ID NO: 1116091 - RNA, 19 nt, Homo sapiens
aaacugucuugucuacuuu

SEQ ID NO: 1116092 - RNA, 19 nt, Homo sapiens
aauaucagcucauagaaag

SEQ ID NO: 1116093 - RNA, 19 nt, Homo sapiens
ucaagauacuggugauuca

SEQ ID NO: 1116094 - RNA, 19 nt, Homo sapiens
gauacacaaccuucucuaa

SEQ ID NO: 1116095 - RNA, 19 nt, Homo sapiens
ccaauccguuuauaaagug

SEQ ID NO: 1116096 - RNA, 19 nt, Homo sapiens
gaaucuagaccuccggaaa

SEQ ID NO: 1116097 - RNA, 19 nt, Homo sapiens
uaccuagagugaacuuuaa

SEQ ID NO: 1116098 - RNA, 19 nt, Homo sapiens
uaagacuccugaaauauac

SEQ ID NO: 1116099 - RNA, 19 nt, Homo sapiens
ugcuaagacuccugaaaua

SEQ ID NO: 1116100 - RNA, 19 nt, Homo sapiens
guaacaagacccaggagaa

SEQ ID NO: 1116101 - RNA, 19 nt, Homo sapiens
agaacgcgcuggucuccua

SEQ ID NO: 1116102 - RNA, 19 nt, Homo sapiens
gcaguugacaaaggaaaua

SEQ ID NO: 1116103 - RNA, 19 nt, Homo sapiens
ggaacauaguuuauuacug

SEQ ID NO: 1116104 - RNA, 19 nt, Homo sapiens
cgaugcagauauuggagua

SEQ ID NO: 1116105 - RNA, 19 nt, Homo sapiens
cuucagcucugcaggauug

SEQ ID NO: 1116106 - RNA, 19 nt, Homo sapiens
aaucugaccucuuugaagu

SEQ ID NO: 1116107 - RNA, 19 nt, Homo sapiens
uguauggccugcaguggua

SEQ ID NO: 1116108 - RNA, 19 nt, Homo sapiens
gcuucauucucccauauuu

SEQ ID NO: 1116109 - RNA, 19 nt, Homo sapiens
gguaugcgagugccagaua

SEQ ID NO: 1116110 - RNA, 19 nt, Homo sapiens
cagccuagcgccauuauug

SEQ ID NO: 1116111 - RNA, 19 nt, Homo sapiens
caagcuaaaugccacagau

SEQ ID NO: 1116112 - RNA, 19 nt, Homo sapiens
gaagugcuuuccaauccau

SEQ ID NO: 1116113 - RNA, 19 nt, Homo sapiens
ugagggacauuaacgacaa

SEQ ID NO: 1116114 - RNA, 19 nt, Homo sapiens
caaacuagauuucgaagaa

SEQ ID NO: 1116115 - RNA, 19 nt, Homo sapiens
caagaacuacuacucauua

SEQ ID NO: 1116116 - RNA, 19 nt, Homo sapiens
ugaaagagguaagcuuaua

SEQ ID NO: 1116117 - RNA, 19 nt, Homo sapiens
gagaacgccuucaauggaa

SEQ ID NO: 1116118 - RNA, 19 nt, Homo sapiens
gaaagcaagaaacgaauaa

SEQ ID NO: 1116119 - RNA, 19 nt, Homo sapiens
gcagugguauaugcauuua

SEQ ID NO: 1116120 - RNA, 19 nt, Homo sapiens
ggacaggccucugcagguu

SEQ ID NO: 1116121 - RNA, 19 nt, Homo sapiens
ggaugucaauguuuacuug

SEQ ID NO: 1116122 - RNA, 19 nt, Homo sapiens
gagaggaaauucaggaaca

SEQ ID NO: 1116123 - RNA, 19 nt, Homo sapiens
ggacucagaaugcuugaaa

SEQ ID NO: 1116124 - RNA, 19 nt, Homo sapiens
gaacauuagugaucaagcu

SEQ ID NO: 1116125 - RNA, 19 nt, Homo sapiens
ggaggcaguugacaaagga

SEQ ID NO: 1116126 - RNA, 19 nt, Homo sapiens
ggaaaacacuggacagaga

SEQ ID NO: 1116127 - RNA, 19 nt, Homo sapiens
caacgauuauuucacuuug

SEQ ID NO: 1116128 - RNA, 19 nt, Homo sapiens
cuacugcucuggcuucuga

SEQ ID NO: 1116129 - RNA, 19 nt, Homo sapiens
gaaagagguaagcuuauau

SEQ ID NO: 1116130 - RNA, 19 nt, Homo sapiens
gacuggaucccaacgauua

SEQ ID NO: 1116131 - RNA, 19 nt, Homo sapiens
gaauaaucauugcagaauc

SEQ ID NO: 1116132 - RNA, 19 nt, Homo sapiens
ggagguaaaucugcagaau

SEQ ID NO: 1116133 - RNA, 19 nt, Homo sapiens
gaaauucaggaacauaguu

SEQ ID NO: 1116134 - RNA, 19 nt, Homo sapiens
ggaaguacuagauguaaau

SEQ ID NO: 1116135 - RNA, 19 nt, Homo sapiens
gagcguaucagccuaugaa

SEQ ID NO: 1116136 - RNA, 19 nt, Homo sapiens
ucacguugcugcuguauac

SEQ ID NO: 1116137 - RNA, 19 nt, Homo sapiens
gcugguggaugucaauguu

SEQ ID NO: 1116138 - RNA, 19 nt, Homo sapiens
uaccaucacuucuuuguca

SEQ ID NO: 1116139 - RNA, 19 nt, Homo sapiens
ccaauccguuuauaaagug

SEQ ID NO: 1116140 - RNA, 19 nt, Homo sapiens
gaaucuagaccuccggaaa

SEQ ID NO: 1116141 - RNA, 19 nt, Homo sapiens
agaacgcgcuggucuccua

SEQ ID NO: 1116142 - RNA, 19 nt, Homo sapiens
gcaguugacaaaggaaaua

SEQ ID NO: 1116143 - RNA, 19 nt, Homo sapiens
ggaacauaguuuauuacug

SEQ ID NO: 1116144 - RNA, 19 nt, Homo sapiens
cgaugcagauauuggagua

SEQ ID NO: 1116145 - RNA, 19 nt, Homo sapiens
uguauggccugcaguggua

SEQ ID NO: 1116146 - RNA, 19 nt, Homo sapiens
cagccuagcgccauuauug

SEQ ID NO: 1116147 - RNA, 19 nt, Homo sapiens
caagcuaaaugccacagau

SEQ ID NO: 1116148 - RNA, 19 nt, Homo sapiens
augcguggcuuucguauga

SEQ ID NO: 1116149 - RNA, 19 nt, Homo sapiens
ugagggacauuaacgacaa

SEQ ID NO: 1116150 - RNA, 19 nt, Homo sapiens
ggacagagaggaaauucag

SEQ ID NO: 1116151 - RNA, 19 nt, Homo sapiens
ugguggaugucaauguuua

SEQ ID NO: 1116152 - RNA, 19 nt, Homo sapiens
ugguacaaauggagauaua

SEQ ID NO: 1116153 - RNA, 19 nt, Homo sapiens
gcaagaaacgaauaaucau

SEQ ID NO: 1116154 - RNA, 19 nt, Homo sapiens
ugaaagcaagaaacgaaua

SEQ ID NO: 1116155 - RNA, 19 nt, Homo sapiens
gaacaauggagaaauuagg

SEQ ID NO: 1116156 - RNA, 19 nt, Homo sapiens
cuugaaagagguaagcuua

SEQ ID NO: 1116157 - RNA, 19 nt, Homo sapiens
gcuguacacuggcgagauc

SEQ ID NO: 1116158 - RNA, 19 nt, Homo sapiens
gcauaagacggaccucaug

SEQ ID NO: 1116159 - RNA, 19 nt, Homo sapiens
gaucgugacucuggcucaa

SEQ ID NO: 1116160 - RNA, 19 nt, Homo sapiens
gaggaaauucaggaacaua

SEQ ID NO: 1116161 - RNA, 19 nt, Homo sapiens
gcagggaguuggucguacu

SEQ ID NO: 1116162 - RNA, 19 nt, Homo sapiens
ccaccuacaagaacuacua

SEQ ID NO: 1116163 - RNA, 19 nt, Homo sapiens
gagguuaccaucacuucuu

SEQ ID NO: 1116164 - RNA, 19 nt, Homo sapiens
ccaacgauuauuucacuuu

SEQ ID NO: 1116165 - RNA, 19 nt, Homo sapiens
gguggaaguacuagaugua

SEQ ID NO: 1116166 - RNA, 19 nt, Homo sapiens
cgaauaaucauugcagaau

SEQ ID NO: 1116167 - RNA, 19 nt, Homo sapiens
cuacaagaacuacuacuca

SEQ ID NO: 1116168 - RNA, 19 nt, Homo sapiens
uccgaacaauggagaaauu

SEQ ID NO: 1116169 - RNA, 19 nt, Homo sapiens
ggagauauaguuuacucau

SEQ ID NO: 1116170 - RNA, 19 nt, Homo sapiens
guacaaauggagauauagu

SEQ ID NO: 1116171 - RNA, 19 nt, Homo sapiens
gggaggaggacucagaaug

SEQ ID NO: 1116172 - RNA, 19 nt, Homo sapiens
uaccauaaauccgaacaau

SEQ ID NO: 1116173 - RNA, 19 nt, Homo sapiens
gagguaaaucugcagaaug

SEQ ID NO: 1116174 - RNA, 19 nt, Homo sapiens
agagaacgccuucaaugga

SEQ ID NO: 1116175 - RNA, 19 nt, Homo sapiens
ggaggaggacucagaaugc

SEQ ID NO: 1116176 - RNA, 19 nt, Homo sapiens
uggaaguacuagauguaaa

SEQ ID NO: 1116177 - RNA, 19 nt, Homo sapiens
agguaaaucugcagaaugg

SEQ ID NO: 1116178 - RNA, 19 nt, Homo sapiens
gcaaacuagauuucgaaga

SEQ ID NO: 1116179 - RNA, 19 nt, Homo sapiens
aaacagucuugagcaaaug

SEQ ID NO: 1116180 - RNA, 19 nt, Homo sapiens
gaaguacuagauguaaaug

SEQ ID NO: 1116181 - RNA, 19 nt, Homo sapiens
uuagagaacgccuucaaug

SEQ ID NO: 1116182 - RNA, 19 nt, Homo sapiens
ggaaauucaggaacauagu

SEQ ID NO: 1116183 - RNA, 19 nt, Homo sapiens
ugaaggugagggacauuaa

SEQ ID NO: 1116184 - RNA, 19 nt, Homo sapiens
gaugguacaaauggagaua

SEQ ID NO: 1116185 - RNA, 19 nt, Homo sapiens
ccugaaagcaagaaacgaa

SEQ ID NO: 1116186 - RNA, 19 nt, Homo sapiens
uaaacucggcauugaccua

SEQ ID NO: 1116187 - RNA, 19 nt, Homo sapiens
uacaagaacuacuacucau

SEQ ID NO: 1116188 - RNA, 19 nt, Homo sapiens
cguaucagccuaugaacug

SEQ ID NO: 1116189 - RNA, 19 nt, Homo sapiens
gugaaggugagggacauua

SEQ ID NO: 1116190 - RNA, 19 nt, Homo sapiens
ccgaacaauggagaaauua

SEQ ID NO: 1116191 - RNA, 19 nt, Homo sapiens
ccgcccauauucccugaaa

SEQ ID NO: 1116192 - RNA, 19 nt, Homo sapiens
uuuauaaagugacgguguu

SEQ ID NO: 1116193 - RNA, 19 nt, Homo sapiens
aaacucgauuuccacuaga

SEQ ID NO: 1116194 - RNA, 19 nt, Homo sapiens
acaagaacuacuacucauu

SEQ ID NO: 1116195 - RNA, 19 nt, Homo sapiens
ucauuuagaaggccuguau

SEQ ID NO: 1116196 - RNA, 19 nt, Homo sapiens
gagggaggaggacucagaa

SEQ ID NO: 1116197 - RNA, 19 nt, Homo sapiens
guugacaaaggaaauauuc

SEQ ID NO: 1116198 - RNA, 19 nt, Homo sapiens
aaagugacgguguuagaga

SEQ ID NO: 1116199 - RNA, 19 nt, Homo sapiens
gaggaggacucagaaugcu

SEQ ID NO: 1116200 - RNA, 19 nt, Homo sapiens
ggaccgcgagagcguauca

SEQ ID NO: 1116201 - RNA, 19 nt, Homo sapiens
guggaaguacuagauguaa

SEQ ID NO: 1116202 - RNA, 19 nt, Homo sapiens
ggacaaaaggcaaacuaga

SEQ ID NO: 1116203 - RNA, 19 nt, Homo sapiens
acgauuauuucacuuugga

SEQ ID NO: 1116204 - RNA, 19 nt, Homo sapiens
gaucccaacgauuauuuca

SEQ ID NO: 1116205 - RNA, 19 nt, Homo sapiens
aagugacgguguuagagaa

SEQ ID NO: 1116206 - RNA, 19 nt, Homo sapiens
accaauccguuuauaaagu

SEQ ID NO: 1116207 - RNA, 19 nt, Homo sapiens
agcaagaaacgaauaauca

SEQ ID NO: 1116208 - RNA, 19 nt, Homo sapiens
acaaugcguggcuuucgua

SEQ ID NO: 1116209 - RNA, 19 nt, Homo sapiens
gagagcguaucagccuaug

SEQ ID NO: 1116210 - RNA, 19 nt, Homo sapiens
augcagauauuggaguaaa

SEQ ID NO: 1116211 - RNA, 19 nt, Homo sapiens
gcaccuugacgccgcaugu

SEQ ID NO: 1116212 - RNA, 19 nt, Homo sapiens
ggccugcagugguauaugc

SEQ ID NO: 1116213 - RNA, 19 nt, Homo sapiens
ugccacagauccugaugau

SEQ ID NO: 1116214 - RNA, 19 nt, Homo sapiens
gcaaaucucucccauguag

SEQ ID NO: 1116215 - RNA, 19 nt, Homo sapiens
guaggagucuguuauuuaa

SEQ ID NO: 1116216 - RNA, 19 nt, Homo sapiens
aaucacagcuuuacucuuu

SEQ ID NO: 1116217 - RNA, 19 nt, Homo sapiens
caacacaugugaaccauug

SEQ ID NO: 1116218 - RNA, 19 nt, Homo sapiens
gaucauugcugcuacagaa

SEQ ID NO: 1116219 - RNA, 19 nt, Homo sapiens
aagcagaucugauguguuu

SEQ ID NO: 1116220 - RNA, 19 nt, Homo sapiens
gauguuaccugaaaucaau

SEQ ID NO: 1116221 - RNA, 19 nt, Homo sapiens
cuacagaagugcuuuaaga

SEQ ID NO: 1116222 - RNA, 19 nt, Homo sapiens
gaucugauguguuuccuau

SEQ ID NO: 1116223 - RNA, 19 nt, Homo sapiens
ggaccagacuuucuaaauc

SEQ ID NO: 1116224 - RNA, 19 nt, Homo sapiens
gguaggagucuguuauuua

SEQ ID NO: 1116225 - RNA, 19 nt, Homo sapiens
gaacgcauuuaacagguuu

SEQ ID NO: 1116226 - RNA, 19 nt, Homo sapiens
agagugaacuuuaagcuuu

SEQ ID NO: 1116227 - RNA, 19 nt, Homo sapiens
gagugaacuuuaagcuuua

SEQ ID NO: 1116228 - RNA, 19 nt, Homo sapiens
gguaaucgauggcgguaaa

SEQ ID NO: 1116229 - RNA, 19 nt, Homo sapiens
ugaaaucaaucucccauau

SEQ ID NO: 1116230 - RNA, 19 nt, Homo sapiens
acaauuaugugcacuuuga

SEQ ID NO: 1116231 - RNA, 19 nt, Homo sapiens
cagaagugcuuuaagagaa

SEQ ID NO: 1116232 - RNA, 19 nt, Homo sapiens
uuaccaaucugaccucuuu

SEQ ID NO: 1116233 - RNA, 19 nt, Homo sapiens
ggauaaagcuguuuuguuc

SEQ ID NO: 1116234 - RNA, 19 nt, Homo sapiens
caagagugauccaacuaaa

SEQ ID NO: 1116235 - RNA, 19 nt, Homo sapiens
caaugucccugaaguaaug

SEQ ID NO: 1116236 - RNA, 19 nt, Homo sapiens
agacacaggugaaauuaga

SEQ ID NO: 1116237 - RNA, 19 nt, Homo sapiens
ugacaacagugaccaguga

SEQ ID NO: 1116238 - RNA, 19 nt, Homo sapiens
aaagguaccuguuucugaa

SEQ ID NO: 1116239 - RNA, 19 nt, Homo sapiens
cuaagacuccugaaauaua

SEQ ID NO: 1116240 - RNA, 19 nt, Homo sapiens
cagcggaaguuaucaguau

SEQ ID NO: 1116241 - RNA, 19 nt, Homo sapiens
ccuaugauguuaccugaaa

SEQ ID NO: 1116242 - RNA, 19 nt, Homo sapiens
gaccagacuuucuaaaucu

SEQ ID NO: 1116243 - RNA, 19 nt, Homo sapiens
agcaacagcuggaccuuua

SEQ ID NO: 1116244 - RNA, 19 nt, Homo sapiens
gagaaucgggcuaauuuau

SEQ ID NO: 1116245 - RNA, 19 nt, Homo sapiens
ugaaauaucagcucauaga

SEQ ID NO: 1116246 - RNA, 19 nt, Homo sapiens
gcacacaauguuuaugaaa

SEQ ID NO: 1116247 - RNA, 19 nt, Homo sapiens
guacaaggaaggcaagaaa

SEQ ID NO: 1116248 - RNA, 19 nt, Homo sapiens
gagaauaaugccuaugaaa

SEQ ID NO: 1116249 - RNA, 19 nt, Homo sapiens
gaaauuuccuaugggauca

SEQ ID NO: 1116250 - RNA, 19 nt, Homo sapiens
ggacuuaauggagaaauuu

SEQ ID NO: 1116251 - RNA, 19 nt, Homo sapiens
aaaguaguguugucugaaa

SEQ ID NO: 1116252 - RNA, 19 nt, Homo sapiens
ugaaggacauuaacgacaa

SEQ ID NO: 1116253 - RNA, 19 nt, Homo sapiens
ggagaaucgggcuaauuua

SEQ ID NO: 1116254 - RNA, 19 nt, Homo sapiens
gcucauagaaaguaacaaa

SEQ ID NO: 1116255 - RNA, 19 nt, Homo sapiens
gcaauucccugcuccuuuu

SEQ ID NO: 1116256 - RNA, 19 nt, Homo sapiens
ggagguaaaucugcagaau

SEQ ID NO: 1116257 - RNA, 19 nt, Homo sapiens
gguauuuccucuguuauug

SEQ ID NO: 1116258 - RNA, 19 nt, Homo sapiens
uggcaaaucucucccaugu

SEQ ID NO: 1116259 - RNA, 19 nt, Homo sapiens
aaaauuugcugucaccuua

SEQ ID NO: 1116260 - RNA, 19 nt, Homo sapiens
gaaauaucagcucauagaa

SEQ ID NO: 1116261 - RNA, 19 nt, Homo sapiens
ggaaugaauacugacaaua

SEQ ID NO: 1116262 - RNA, 19 nt, Homo sapiens
gggaauggauaaagcuguu

SEQ ID NO: 1116263 - RNA, 19 nt, Homo sapiens
aaaucaaucucccauaugu

SEQ ID NO: 1116264 - RNA, 19 nt, Homo sapiens
gaaaucaaucucccauaug

SEQ ID NO: 1116265 - RNA, 19 nt, Homo sapiens
aagagaaagucuauagcua

SEQ ID NO: 1116266 - RNA, 19 nt, Homo sapiens
gaaaguucccugugucugu

SEQ ID NO: 1116267 - RNA, 19 nt, Homo sapiens
gcccauguaucugaccuua

SEQ ID NO: 1116268 - RNA, 19 nt, Homo sapiens
caaauaaacagcggaaguu

SEQ ID NO: 1116269 - RNA, 19 nt, Homo sapiens
agaggaggcuggcauucua

SEQ ID NO: 1116270 - RNA, 19 nt, Homo sapiens
gcaagggaauggauaaagc

SEQ ID NO: 1116271 - RNA, 19 nt, Homo sapiens
ccucuugcauguauuacua

SEQ ID NO: 1116272 - RNA, 19 nt, Homo sapiens
gccugaaacaucuguauua

SEQ ID NO: 1116273 - RNA, 19 nt, Homo sapiens
gagaauugccugaaacauc

SEQ ID NO: 1116274 - RNA, 19 nt, Homo sapiens
uuaagagaauugccugaaa

SEQ ID NO: 1116275 - RNA, 19 nt, Homo sapiens
uaaagucuguuggcuguga

SEQ ID NO: 1116276 - RNA, 19 nt, Homo sapiens
caggucaucugcucacuga

SEQ ID NO: 1116277 - RNA, 19 nt, Homo sapiens
ggaaguuauuggacagaga

SEQ ID NO: 1116278 - RNA, 19 nt, Homo sapiens
gcacaaauuuuaccaaucu

SEQ ID NO: 1116279 - RNA, 19 nt, Homo sapiens
gaagugcuuuaagagaauu

SEQ ID NO: 1116280 - RNA, 19 nt, Homo sapiens
uaacaagacccaggagaaa

SEQ ID NO: 1116281 - RNA, 19 nt, Homo sapiens
aaacugucuugucuacuuu

SEQ ID NO: 1116282 - RNA, 19 nt, Homo sapiens
aauaucagcucauagaaag

SEQ ID NO: 1116283 - RNA, 19 nt, Homo sapiens
ucaagauacuggugauuca

SEQ ID NO: 1116284 - RNA, 19 nt, Homo sapiens
gauacacaaccuucucuaa

SEQ ID NO: 1116285 - RNA, 19 nt, Homo sapiens
cagguuaacgccauugaua

SEQ ID NO: 1116286 - RNA, 19 nt, Homo sapiens
ucaaauaaccguccuggau

SEQ ID NO: 1116287 - RNA, 19 nt, Homo sapiens
uaccuagagugaacuuuaa

SEQ ID NO: 1116288 - RNA, 19 nt, Homo sapiens
uaagacuccugaaauauac

SEQ ID NO: 1116289 - RNA, 19 nt, Homo sapiens
ugcuaagacuccugaaaua

SEQ ID NO: 1116290 - RNA, 19 nt, Homo sapiens
guaacaagacccaggagaa

SEQ ID NO: 1116291 - RNA, 19 nt, Homo sapiens
agaacgcgcugguguccua

SEQ ID NO: 1116292 - RNA, 19 nt, Homo sapiens
cgaaggacuuaauggagaa

SEQ ID NO: 1116293 - RNA, 19 nt, Homo sapiens
gauaagcccagcuauaaag

SEQ ID NO: 1116294 - RNA, 19 nt, Homo sapiens
cuucagcucugcaggauug

SEQ ID NO: 1116295 - RNA, 19 nt, Homo sapiens
aaucugaccucuuugaagu

SEQ ID NO: 1116296 - RNA, 19 nt, Homo sapiens
ggugacugcucauaaaaua

SEQ ID NO: 1116297 - RNA, 19 nt, Homo sapiens
gcuucauucucccauauuu

SEQ ID NO: 1116298 - RNA, 19 nt, Homo sapiens
gguaugcgagugccagaua

SEQ ID NO: 1116299 - RNA, 19 nt, Homo sapiens
gaagugcuuuccaauccau

SEQ ID NO: 1116300 - RNA, 19 nt, Homo sapiens
agaauugccugaaacaucu

SEQ ID NO: 1116301 - RNA, 19 nt, Homo sapiens
guccugugcucacuuuauu

SEQ ID NO: 1116302 - RNA, 19 nt, Homo sapiens
ccagacacaggugaaauua

SEQ ID NO: 1116303 - RNA, 19 nt, Homo sapiens
gcgaagugcuuuccaaucc

SEQ ID NO: 1116304 - RNA, 19 nt, Homo sapiens
caacuauuaccuagaguga

SEQ ID NO: 1116305 - RNA, 19 nt, Homo sapiens
uaagagaauugccugaaac

SEQ ID NO: 1116306 - RNA, 19 nt, Homo sapiens
uuaccuagagugaacuuua

SEQ ID NO: 1116307 - RNA, 19 nt, Homo sapiens
auaacacucugaauugcua

SEQ ID NO: 1116308 - RNA, 19 nt, Homo sapiens
gaucagcaguggccaacag

SEQ ID NO: 1116309 - RNA, 19 nt, Homo sapiens
gguuaacgccauugauaaa

SEQ ID NO: 1116310 - RNA, 19 nt, Homo sapiens
gaauuggugcuauugguau

SEQ ID NO: 1116311 - RNA, 19 nt, Homo sapiens
uauguaugcuguaugcuau

SEQ ID NO: 1116312 - RNA, 19 nt, Homo sapiens
ccugaaacaucuguauuau

SEQ ID NO: 1116313 - RNA, 19 nt, Homo sapiens
aagggugacugcucauaaa

SEQ ID NO: 1116314 - RNA, 19 nt, Homo sapiens
ccagugaaguaaguuauua

SEQ ID NO: 1116315 - RNA, 19 nt, Homo sapiens
gguaaucgauggcgguaaa

SEQ ID NO: 1116316 - RNA, 19 nt, Homo sapiens
caagagugauccaacuaaa

SEQ ID NO: 1116317 - RNA, 19 nt, Homo sapiens
caaugucccugaaguaaug

SEQ ID NO: 1116318 - RNA, 19 nt, Homo sapiens
agacacaggugaaauuaga

SEQ ID NO: 1116319 - RNA, 19 nt, Homo sapiens
aaagguaccuguuucugaa

SEQ ID NO: 1116320 - RNA, 19 nt, Homo sapiens
gagaauaaugccuaugaaa

SEQ ID NO: 1116321 - RNA, 19 nt, Homo sapiens
gaaauuuccuaugggauca

SEQ ID NO: 1116322 - RNA, 19 nt, Homo sapiens
ggacuuaauggagaaauuu

SEQ ID NO: 1116323 - RNA, 19 nt, Homo sapiens
aaaguaguguugucugaaa

SEQ ID NO: 1116324 - RNA, 19 nt, Homo sapiens
ugaaggacauuaacgacaa

SEQ ID NO: 1116325 - RNA, 19 nt, Homo sapiens
ggagguaaaucugcagaau

SEQ ID NO: 1116326 - RNA, 19 nt, Homo sapiens
caggucaucugcucacuga

SEQ ID NO: 1116327 - RNA, 19 nt, Homo sapiens
ggaaguuauuggacagaga

SEQ ID NO: 1116328 - RNA, 19 nt, Homo sapiens
cagguuaacgccauugaua

SEQ ID NO: 1116329 - RNA, 19 nt, Homo sapiens
ucaaauaaccguccuggau

SEQ ID NO: 1116330 - RNA, 19 nt, Homo sapiens
agaacgcgcugguguccua

SEQ ID NO: 1116331 - RNA, 19 nt, Homo sapiens
cgaaggacuuaauggagaa

SEQ ID NO: 1116332 - RNA, 19 nt, Homo sapiens
gauaagcccagcuauaaag

SEQ ID NO: 1116333 - RNA, 19 nt, Homo sapiens
ggugacugcucauaaaaua

SEQ ID NO: 1116334 - RNA, 19 nt, Homo sapiens
ccagacacaggugaaauua

SEQ ID NO: 1116335 - RNA, 19 nt, Homo sapiens
gguuaacgccauugauaaa

SEQ ID NO: 1116336 - RNA, 19 nt, Homo sapiens
guuuaaauccucccaguga

SEQ ID NO: 1116337 - RNA, 19 nt, Homo sapiens
ugaagagaauaaugccuau

SEQ ID NO: 1116338 - RNA, 19 nt, Homo sapiens
aagggugacugcucauaaa

SEQ ID NO: 1116339 - RNA, 19 nt, Homo sapiens
auaaaguaguguugucuga

SEQ ID NO: 1116340 - RNA, 19 nt, Homo sapiens
gcuauaaaguaguguuguc

SEQ ID NO: 1116341 - RNA, 19 nt, Homo sapiens
aagcggcucugguggauau

SEQ ID NO: 1116342 - RNA, 19 nt, Homo sapiens
ccaccuacaagaauuacua

SEQ ID NO: 1116343 - RNA, 19 nt, Homo sapiens
ugacaaugguccggcguuu

SEQ ID NO: 1116344 - RNA, 19 nt, Homo sapiens
gcuguacacuggcgagauc

SEQ ID NO: 1116345 - RNA, 19 nt, Homo sapiens
ucagguggguaccgucauu

SEQ ID NO: 1116346 - RNA, 19 nt, Homo sapiens
ggcaagcgaucccuuaaaa

SEQ ID NO: 1116347 - RNA, 19 nt, Homo sapiens
uugauaagcccagcuauaa

SEQ ID NO: 1116348 - RNA, 19 nt, Homo sapiens
gcccagcuauaaaguagug

SEQ ID NO: 1116349 - RNA, 19 nt, Homo sapiens
aaauaaccguccuggaugu

SEQ ID NO: 1116350 - RNA, 19 nt, Homo sapiens
cgccaaaacucaauuuauu

SEQ ID NO: 1116351 - RNA, 19 nt, Homo sapiens
uaaacucucuuuugaccua

SEQ ID NO: 1116352 - RNA, 19 nt, Homo sapiens
ucacugacaccucauguuc

SEQ ID NO: 1116353 - RNA, 19 nt, Homo sapiens
agagaauaaugccuaugaa

SEQ ID NO: 1116354 - RNA, 19 nt, Homo sapiens
uaaccguccuggaugugaa

SEQ ID NO: 1116355 - RNA, 19 nt, Homo sapiens
agagugauccaacuaaaug

SEQ ID NO: 1116356 - RNA, 19 nt, Homo sapiens
acaaugguccggcguuuga

SEQ ID NO: 1116357 - RNA, 19 nt, Homo sapiens
ggaugugaaugacaauggu

SEQ ID NO: 1116358 - RNA, 19 nt, Homo sapiens
cguuaagucuaaaugagaa

SEQ ID NO: 1116359 - RNA, 19 nt, Homo sapiens
ggauaucggcguaaacucu

SEQ ID NO: 1116360 - RNA, 19 nt, Homo sapiens
ucagcugucucgagaagau

SEQ ID NO: 1116361 - RNA, 19 nt, Homo sapiens
cggcucugguggauauuaa

SEQ ID NO: 1116362 - RNA, 19 nt, Homo sapiens
aaagggugacugcucauaa

SEQ ID NO: 1116363 - RNA, 19 nt, Homo sapiens
aagagaauaaugccuauga

SEQ ID NO: 1116364 - RNA, 19 nt, Homo sapiens
gaaggacauuaacgacaac

SEQ ID NO: 1116365 - RNA, 19 nt, Homo sapiens
gagguaaaucugcagaaug

SEQ ID NO: 1116366 - RNA, 19 nt, Homo sapiens
uagaauuuauggugaacug

SEQ ID NO: 1116367 - RNA, 19 nt, Homo sapiens
gagugagaaauguauguuu

SEQ ID NO: 1116368 - RNA, 19 nt, Homo sapiens
guauauugccugaauuagu

SEQ ID NO: 1116369 - RNA, 19 nt, Homo sapiens
ucaggcaagcgaucccuua

SEQ ID NO: 1116370 - RNA, 19 nt, Homo sapiens
gcaugguccugguggaagu

SEQ ID NO: 1116371 - RNA, 19 nt, Homo sapiens
acagagagcaaacgccaaa

SEQ ID NO: 1116372 - RNA, 19 nt, Homo sapiens
ggcguaaacucucuuuuga

SEQ ID NO: 1116373 - RNA, 19 nt, Homo sapiens
agguaaaucugcagaaugg

SEQ ID NO: 1116374 - RNA, 19 nt, Homo sapiens
gauccagacgaaggacuua

SEQ ID NO: 1116375 - RNA, 19 nt, Homo sapiens
acaagagugauccaacuaa

SEQ ID NO: 1116376 - RNA, 19 nt, Homo sapiens
acacaagagugauccaacu

SEQ ID NO: 1116377 - RNA, 19 nt, Homo sapiens
cgauggcgguaaaccagaa

SEQ ID NO: 1116378 - RNA, 19 nt, Homo sapiens
uaacguguaccucaucauc

SEQ ID NO: 1116379 - RNA, 19 nt, Homo sapiens
gacgcugacuccggcuaua

SEQ ID NO: 1116380 - RNA, 19 nt, Homo sapiens
ccagugagugagaaaugua

SEQ ID NO: 1116381 - RNA, 19 nt, Homo sapiens
ugguggauauuaacgugua

SEQ ID NO: 1116382 - RNA, 19 nt, Homo sapiens
cgaagcggcucugguggau

SEQ ID NO: 1116383 - RNA, 19 nt, Homo sapiens
acgcuuggcuguccuacga

SEQ ID NO: 1116384 - RNA, 19 nt, Homo sapiens
gaacuggauuuugaagaga

SEQ ID NO: 1116385 - RNA, 19 nt, Homo sapiens
aagcccagcuauaaaguag

SEQ ID NO: 1116386 - RNA, 19 nt, Homo sapiens
uaagcccagcuauaaagua

SEQ ID NO: 1116387 - RNA, 19 nt, Homo sapiens
ugauaagcccagcuauaaa

SEQ ID NO: 1116388 - RNA, 19 nt, Homo sapiens
gcguuaagucuaaaugaga

SEQ ID NO: 1116389 - RNA, 19 nt, Homo sapiens
uggaaguucuggacgugaa

SEQ ID NO: 1116390 - RNA, 19 nt, Homo sapiens
gccagugagugagaaaugu

SEQ ID NO: 1116391 - RNA, 19 nt, Homo sapiens
gaccuaugcguuaagucua

SEQ ID NO: 1116392 - RNA, 19 nt, Homo sapiens
cuagagggcgcuucugaug

SEQ ID NO: 1116393 - RNA, 19 nt, Homo sapiens
uuucugcaauggugauuau

SEQ ID NO: 1116394 - RNA, 19 nt, Homo sapiens
agacgaaggacuuaaugga

SEQ ID NO: 1116395 - RNA, 19 nt, Homo sapiens
gacaggccgcugcagguuu

SEQ ID NO: 1116396 - RNA, 19 nt, Homo sapiens
cacaagagugauccaacua

SEQ ID NO: 1116397 - RNA, 19 nt, Homo sapiens
caccucauguucccuucaa

SEQ ID NO: 1116398 - RNA, 19 nt, Homo sapiens
uucaauaaauccagacaca

SEQ ID NO: 1116399 - RNA, 19 nt, Homo sapiens
uaaaguaguguugucugaa

SEQ ID NO: 1116400 - RNA, 19 nt, Homo sapiens
gagcaaacgccaaaacuca

SEQ ID NO: 1116401 - RNA, 19 nt, Homo sapiens
uggugucgcugguggagaa

SEQ ID NO: 1116402 - RNA, 19 nt, Homo sapiens
uuuaaauccucccagugaa

SEQ ID NO: 1116403 - RNA, 19 nt, Homo sapiens
ggacgcugacuccggcuau

SEQ ID NO: 1116404 - RNA, 19 nt, Homo sapiens
gaagagaauaaugccuaug

SEQ ID NO: 1116405 - RNA, 19 nt, Homo sapiens
auggagaaauuuccuaugg

SEQ ID NO: 1116406 - RNA, 19 nt, Homo sapiens
uuugauaagcccagcuaua

SEQ ID NO: 1116407 - RNA, 19 nt, Homo sapiens
gcccaagacggaccucaug

SEQ ID NO: 1116408 - RNA, 19 nt, Homo sapiens
gcauuuuguuugugaauuc

SEQ ID NO: 1116409 - RNA, 19 nt, Homo sapiens
uaccgucauugcccugauu

SEQ ID NO: 1116410 - RNA, 19 nt, Homo sapiens
cgccauugauaaagggauu

SEQ ID NO: 1116411 - RNA, 19 nt, Homo sapiens
caaaacgacacaagaguga

SEQ ID NO: 1116412 - RNA, 19 nt, Homo sapiens
gugauuaucggaccaagag

SEQ ID NO: 1116413 - RNA, 19 nt, Homo sapiens
ggcgguaaaccagaacuaa

SEQ ID NO: 1116414 - RNA, 19 nt, Homo sapiens
gaacuuaauuugcugcuaa

SEQ ID NO: 1116415 - RNA, 19 nt, Homo sapiens
gagaauagaucauguggaa

SEQ ID NO: 1116416 - RNA, 19 nt, Homo sapiens
gcaaaucucucccauguag

SEQ ID NO: 1116417 - RNA, 19 nt, Homo sapiens
guaggagucuguuauuuaa

SEQ ID NO: 1116418 - RNA, 19 nt, Homo sapiens
gaaauucuguggugguaaa

SEQ ID NO: 1116419 - RNA, 19 nt, Homo sapiens
aaucacagcuuuacucuuu

SEQ ID NO: 1116420 - RNA, 19 nt, Homo sapiens
caacacaugugaaccauug

SEQ ID NO: 1116421 - RNA, 19 nt, Homo sapiens
gaucauugcugcuacagaa

SEQ ID NO: 1116422 - RNA, 19 nt, Homo sapiens
aagcagaucugauguguuu

SEQ ID NO: 1116423 - RNA, 19 nt, Homo sapiens
ugaagaaucugguacugua

SEQ ID NO: 1116424 - RNA, 19 nt, Homo sapiens
gauguuaccugaaaucaau

SEQ ID NO: 1116425 - RNA, 19 nt, Homo sapiens
caaaggaacuccaucauac

SEQ ID NO: 1116426 - RNA, 19 nt, Homo sapiens
cgacaaugauccagaguuu

SEQ ID NO: 1116427 - RNA, 19 nt, Homo sapiens
cuacagaagugcuuuaaga

SEQ ID NO: 1116428 - RNA, 19 nt, Homo sapiens
uuaaagaagucucuggaua

SEQ ID NO: 1116429 - RNA, 19 nt, Homo sapiens
gaucugauguguuuccuau

SEQ ID NO: 1116430 - RNA, 19 nt, Homo sapiens
ggaccagacuuucuaaauc

SEQ ID NO: 1116431 - RNA, 19 nt, Homo sapiens
gguaggagucuguuauuua

SEQ ID NO: 1116432 - RNA, 19 nt, Homo sapiens
gaacgcauuuaacagguuu

SEQ ID NO: 1116433 - RNA, 19 nt, Homo sapiens
gagggucaauggaacuuua

SEQ ID NO: 1116434 - RNA, 19 nt, Homo sapiens
caagggagacugaaaguaa

SEQ ID NO: 1116435 - RNA, 19 nt, Homo sapiens
agagugaacuuuaagcuuu

SEQ ID NO: 1116436 - RNA, 19 nt, Homo sapiens
ccacagagaugagaauaga

SEQ ID NO: 1116437 - RNA, 19 nt, Homo sapiens
gagugaacuuuaagcuuua

SEQ ID NO: 1116438 - RNA, 19 nt, Homo sapiens
ggaaaaugcugcuaaagaa

SEQ ID NO: 1116439 - RNA, 19 nt, Homo sapiens
gguggaaaguucauuuaaa

SEQ ID NO: 1116440 - RNA, 19 nt, Homo sapiens
ugaaaucaaucucccauau

SEQ ID NO: 1116441 - RNA, 19 nt, Homo sapiens
acaauuaugugcacuuuga

SEQ ID NO: 1116442 - RNA, 19 nt, Homo sapiens
cagaagugcuuuaagagaa

SEQ ID NO: 1116443 - RNA, 19 nt, Homo sapiens
uaaauaagcacguuggaaa

SEQ ID NO: 1116444 - RNA, 19 nt, Homo sapiens
uuaccaaucugaccucuuu

SEQ ID NO: 1116445 - RNA, 19 nt, Homo sapiens
ggauaaagcuguuuuguuc

SEQ ID NO: 1116446 - RNA, 19 nt, Homo sapiens
gaacauaaacacuaaagag

SEQ ID NO: 1116447 - RNA, 19 nt, Homo sapiens
gagguaacauacuccuuaa

SEQ ID NO: 1116448 - RNA, 19 nt, Homo sapiens
ugacaacagugaccaguga

SEQ ID NO: 1116449 - RNA, 19 nt, Homo sapiens
gaaguacaggcuacagaua

SEQ ID NO: 1116450 - RNA, 19 nt, Homo sapiens
gaagugagggucaauggaa

SEQ ID NO: 1116451 - RNA, 19 nt, Homo sapiens
ggaagacacuuauuuacac

SEQ ID NO: 1116452 - RNA, 19 nt, Homo sapiens
cuaccaaguuugagaauau

SEQ ID NO: 1116453 - RNA, 19 nt, Homo sapiens
cuaagacuccugaaauaua

SEQ ID NO: 1116454 - RNA, 19 nt, Homo sapiens
cagcggaaguuaucaguau

SEQ ID NO: 1116455 - RNA, 19 nt, Homo sapiens
ccuaugauguuaccugaaa

SEQ ID NO: 1116456 - RNA, 19 nt, Homo sapiens
gaccagacuuucuaaaucu

SEQ ID NO: 1116457 - RNA, 19 nt, Homo sapiens
agcaacagcuggaccuuua

SEQ ID NO: 1116458 - RNA, 19 nt, Homo sapiens
gaggagggcccaccuaaga

SEQ ID NO: 1116459 - RNA, 19 nt, Homo sapiens
gaauagaucauguggaaca

SEQ ID NO: 1116460 - RNA, 19 nt, Homo sapiens
gagaaucgggcuaauuuau

SEQ ID NO: 1116461 - RNA, 19 nt, Homo sapiens
ugaaauaucagcucauaga

SEQ ID NO: 1116462 - RNA, 19 nt, Homo sapiens
gcacacaauguuuaugaaa

SEQ ID NO: 1116463 - RNA, 19 nt, Homo sapiens
guacaaggaaggcaagaaa

SEQ ID NO: 1116464 - RNA, 19 nt, Homo sapiens
acgcguggcuuucauauga

SEQ ID NO: 1116465 - RNA, 19 nt, Homo sapiens
ugaaggacauuaacgacaa

SEQ ID NO: 1116466 - RNA, 19 nt, Homo sapiens
ggagaaucgggcuaauuua

SEQ ID NO: 1116467 - RNA, 19 nt, Homo sapiens
gcucauagaaaguaacaaa

SEQ ID NO: 1116468 - RNA, 19 nt, Homo sapiens
gcaauucccugcuccuuuu

SEQ ID NO: 1116469 - RNA, 19 nt, Homo sapiens
caaaugguaagcagauuaa

SEQ ID NO: 1116470 - RNA, 19 nt, Homo sapiens
gaacaaaagcugcugauug

SEQ ID NO: 1116471 - RNA, 19 nt, Homo sapiens
ggagguaaaucugcagaau

SEQ ID NO: 1116472 - RNA, 19 nt, Homo sapiens
gguauuuccucuguuauug

SEQ ID NO: 1116473 - RNA, 19 nt, Homo sapiens
uggcaaaucucucccaugu

SEQ ID NO: 1116474 - RNA, 19 nt, Homo sapiens
cguaugcgauguuugguuu

SEQ ID NO: 1116475 - RNA, 19 nt, Homo sapiens
guggaaaguucauuuaaag

SEQ ID NO: 1116476 - RNA, 19 nt, Homo sapiens
gcacaguacucacaguuuu

SEQ ID NO: 1116477 - RNA, 19 nt, Homo sapiens
aaaauuugcugucaccuua

SEQ ID NO: 1116478 - RNA, 19 nt, Homo sapiens
gaaauaucagcucauagaa

SEQ ID NO: 1116479 - RNA, 19 nt, Homo sapiens
ggaaugaauacugacaaua

SEQ ID NO: 1116480 - RNA, 19 nt, Homo sapiens
gggaauggauaaagcuguu

SEQ ID NO: 1116481 - RNA, 19 nt, Homo sapiens
ggaacaacacuuucaggaa

SEQ ID NO: 1116482 - RNA, 19 nt, Homo sapiens
aaaucaaucucccauaugu

SEQ ID NO: 1116483 - RNA, 19 nt, Homo sapiens
gaaaucaaucucccauaug

SEQ ID NO: 1116484 - RNA, 19 nt, Homo sapiens
aagagaaagucuauagcua

SEQ ID NO: 1116485 - RNA, 19 nt, Homo sapiens
gaaaguucccugugucugu

SEQ ID NO: 1116486 - RNA, 19 nt, Homo sapiens
caauggaagacacuuauuu

SEQ ID NO: 1116487 - RNA, 19 nt, Homo sapiens
gcccauguaucugaccuua

SEQ ID NO: 1116488 - RNA, 19 nt, Homo sapiens
caaauaaacagcggaaguu

SEQ ID NO: 1116489 - RNA, 19 nt, Homo sapiens
agaggaggcuggcauucua

SEQ ID NO: 1116490 - RNA, 19 nt, Homo sapiens
acaaaggaacuccaucaua

SEQ ID NO: 1116491 - RNA, 19 nt, Homo sapiens
gcaagggaauggauaaagc

SEQ ID NO: 1116492 - RNA, 19 nt, Homo sapiens
ccucuugcauguauuacua

SEQ ID NO: 1116493 - RNA, 19 nt, Homo sapiens
gccugaaacaucuguauua

SEQ ID NO: 1116494 - RNA, 19 nt, Homo sapiens
gagaauugccugaaacauc

SEQ ID NO: 1116495 - RNA, 19 nt, Homo sapiens
uuaagagaauugccugaaa

SEQ ID NO: 1116496 - RNA, 19 nt, Homo sapiens
uaaagucuguuggcuguga

SEQ ID NO: 1116497 - RNA, 19 nt, Homo sapiens
gguaacauacuccuuaaug

SEQ ID NO: 1116498 - RNA, 19 nt, Homo sapiens
aaagaagucucuggauaga

SEQ ID NO: 1116499 - RNA, 19 nt, Homo sapiens
agaaugcucuauugaccua

SEQ ID NO: 1116500 - RNA, 19 nt, Homo sapiens
gcacaaauuuuaccaaucu

SEQ ID NO: 1116501 - RNA, 19 nt, Homo sapiens
gaagugcuuuaagagaauu

SEQ ID NO: 1116502 - RNA, 19 nt, Homo sapiens
uaacaagacccaggagaaa

SEQ ID NO: 1116503 - RNA, 19 nt, Homo sapiens
uaagcacguuggaaauauu

SEQ ID NO: 1116504 - RNA, 19 nt, Homo sapiens
aaacugucuugucuacuuu

SEQ ID NO: 1116505 - RNA, 19 nt, Homo sapiens
aauaucagcucauagaaag

SEQ ID NO: 1116506 - RNA, 19 nt, Homo sapiens
ucaagauacuggugauuca

SEQ ID NO: 1116507 - RNA, 19 nt, Homo sapiens
gauacacaaccuucucuaa

SEQ ID NO: 1116508 - RNA, 19 nt, Homo sapiens
agagguaacauacuccuua

SEQ ID NO: 1116509 - RNA, 19 nt, Homo sapiens
gcacucccauacaaaggaa

SEQ ID NO: 1116510 - RNA, 19 nt, Homo sapiens
uaccuagagugaacuuuaa

SEQ ID NO: 1116511 - RNA, 19 nt, Homo sapiens
uaagacuccugaaauauac

SEQ ID NO: 1116512 - RNA, 19 nt, Homo sapiens
ugcuaagacuccugaaaua

SEQ ID NO: 1116513 - RNA, 19 nt, Homo sapiens
guaacaagacccaggagaa

SEQ ID NO: 1116514 - RNA, 19 nt, Homo sapiens
gaacuuaauuugcugcuaa

SEQ ID NO: 1116515 - RNA, 19 nt, Homo sapiens
gagaauagaucauguggaa

SEQ ID NO: 1116516 - RNA, 19 nt, Homo sapiens
gaaauucuguggugguaaa

SEQ ID NO: 1116517 - RNA, 19 nt, Homo sapiens
ugaagaaucugguacugua

SEQ ID NO: 1116518 - RNA, 19 nt, Homo sapiens
caaaggaacuccaucauac

SEQ ID NO: 1116519 - RNA, 19 nt, Homo sapiens
cgacaaugauccagaguuu

SEQ ID NO: 1116520 - RNA, 19 nt, Homo sapiens
uuaaagaagucucuggaua

SEQ ID NO: 1116521 - RNA, 19 nt, Homo sapiens
gagggucaauggaacuuua

SEQ ID NO: 1116522 - RNA, 19 nt, Homo sapiens
caagggagacugaaaguaa

SEQ ID NO: 1116523 - RNA, 19 nt, Homo sapiens
ccacagagaugagaauaga

SEQ ID NO: 1116524 - RNA, 19 nt, Homo sapiens
ggaaaaugcugcuaaagaa

SEQ ID NO: 1116525 - RNA, 19 nt, Homo sapiens
gguggaaaguucauuuaaa

SEQ ID NO: 1116526 - RNA, 19 nt, Homo sapiens
uaaauaagcacguuggaaa

SEQ ID NO: 1116527 - RNA, 19 nt, Homo sapiens
gaacauaaacacuaaagag

SEQ ID NO: 1116528 - RNA, 19 nt, Homo sapiens
gagguaacauacuccuuaa

SEQ ID NO: 1116529 - RNA, 19 nt, Homo sapiens
gaaguacaggcuacagaua

SEQ ID NO: 1116530 - RNA, 19 nt, Homo sapiens
gaagugagggucaauggaa

SEQ ID NO: 1116531 - RNA, 19 nt, Homo sapiens
ggaagacacuuauuuacac

SEQ ID NO: 1116532 - RNA, 19 nt, Homo sapiens
cuaccaaguuugagaauau

SEQ ID NO: 1116533 - RNA, 19 nt, Homo sapiens
gaggagggcccaccuaaga

SEQ ID NO: 1116534 - RNA, 19 nt, Homo sapiens
gaauagaucauguggaaca

SEQ ID NO: 1116535 - RNA, 19 nt, Homo sapiens
acgcguggcuuucauauga

SEQ ID NO: 1116536 - RNA, 19 nt, Homo sapiens
ugaaggacauuaacgacaa

SEQ ID NO: 1116537 - RNA, 19 nt, Homo sapiens
caaaugguaagcagauuaa

SEQ ID NO: 1116538 - RNA, 19 nt, Homo sapiens
gaacaaaagcugcugauug

SEQ ID NO: 1116539 - RNA, 19 nt, Homo sapiens
ggagguaaaucugcagaau

SEQ ID NO: 1116540 - RNA, 19 nt, Homo sapiens
cguaugcgauguuugguuu

SEQ ID NO: 1116541 - RNA, 19 nt, Homo sapiens
guggaaaguucauuuaaag

SEQ ID NO: 1116542 - RNA, 19 nt, Homo sapiens
gcacaguacucacaguuuu

SEQ ID NO: 1116543 - RNA, 19 nt, Homo sapiens
caauggaagacacuuauuu

SEQ ID NO: 1116544 - RNA, 19 nt, Homo sapiens
ggaacaacacuuucaggaa

SEQ ID NO: 1116545 - RNA, 19 nt, Homo sapiens
acaaaggaacuccaucaua

SEQ ID NO: 1116546 - RNA, 19 nt, Homo sapiens
gguaacauacuccuuaaug

SEQ ID NO: 1116547 - RNA, 19 nt, Homo sapiens
aaagaagucucuggauaga

SEQ ID NO: 1116548 - RNA, 19 nt, Homo sapiens
agaaugcucuauugaccua

SEQ ID NO: 1116549 - RNA, 19 nt, Homo sapiens
uaagcacguuggaaauauu

SEQ ID NO: 1116550 - RNA, 19 nt, Homo sapiens
agagguaacauacuccuua

SEQ ID NO: 1116551 - RNA, 19 nt, Homo sapiens
gcacucccauacaaaggaa

SEQ ID NO: 1116552 - RNA, 19 nt, Homo sapiens
agaacgcgcugguguccua

SEQ ID NO: 1116553 - RNA, 19 nt, Homo sapiens
uaaagaagucucuggauag

SEQ ID NO: 1116554 - RNA, 19 nt, Homo sapiens
caacaaaugguaagcagau

SEQ ID NO: 1116555 - RNA, 19 nt, Homo sapiens
ggaagccaauuucguaugc

SEQ ID NO: 1116556 - RNA, 19 nt, Homo sapiens
gaagaaucugguacuguaa

SEQ ID NO: 1116557 - RNA, 19 nt, Homo sapiens
cgauaacucuccugaaguc

SEQ ID NO: 1116558 - RNA, 19 nt, Homo sapiens
gaagacacuuauuuacacu

SEQ ID NO: 1116559 - RNA, 19 nt, Homo sapiens
gugaggcacucccauacaa

SEQ ID NO: 1116560 - RNA, 19 nt, Homo sapiens
cgcaaggugucgcucuuua

SEQ ID NO: 1116561 - RNA, 19 nt, Homo sapiens
caacugaauucucuuucuc

SEQ ID NO: 1116562 - RNA, 19 nt, Homo sapiens
gaacgugugggccuaugaa

SEQ ID NO: 1116563 - RNA, 19 nt, Homo sapiens
cuauugaccuacaggcuaa

SEQ ID NO: 1116564 - RNA, 19 nt, Homo sapiens
gaaacugaagaaucuggua

SEQ ID NO: 1116565 - RNA, 19 nt, Homo sapiens
ggaaaguucauuuaaaggu

SEQ ID NO: 1116566 - RNA, 19 nt, Homo sapiens
gugaaauucugugguggua

SEQ ID NO: 1116567 - RNA, 19 nt, Homo sapiens
ggaaauguuuaacccuagu

SEQ ID NO: 1116568 - RNA, 19 nt, Homo sapiens
uguccaccuucaagaauua

SEQ ID NO: 1116569 - RNA, 19 nt, Homo sapiens
gauccagaguuugauaaau

SEQ ID NO: 1116570 - RNA, 19 nt, Homo sapiens
acaaugauccagaguuuga

SEQ ID NO: 1116571 - RNA, 19 nt, Homo sapiens
ucaauuaagcccaauggaa

SEQ ID NO: 1116572 - RNA, 19 nt, Homo sapiens
acaaaugguaagcagauua

SEQ ID NO: 1116573 - RNA, 19 nt, Homo sapiens
caguaaagaaugagaacua

SEQ ID NO: 1116574 - RNA, 19 nt, Homo sapiens
uguggaacauaaacacuaa

SEQ ID NO: 1116575 - RNA, 19 nt, Homo sapiens
ccaccaggcugccacaucu

SEQ ID NO: 1116576 - RNA, 19 nt, Homo sapiens
ggaacuuaauuugcugcua

SEQ ID NO: 1116577 - RNA, 19 nt, Homo sapiens
ucaauggagagguaacaua

SEQ ID NO: 1116578 - RNA, 19 nt, Homo sapiens
gaggccaccuuaacaacug

SEQ ID NO: 1116579 - RNA, 19 nt, Homo sapiens
ccaccuaucaggaagugua

SEQ ID NO: 1116580 - RNA, 19 nt, Homo sapiens
cuacagauuccaccuauca

SEQ ID NO: 1116581 - RNA, 19 nt, Homo sapiens
aauaagcacguuggaaaua

SEQ ID NO: 1116582 - RNA, 19 nt, Homo sapiens
cuuaacaacugaauucucu

SEQ ID NO: 1116583 - RNA, 19 nt, Homo sapiens
aagggagacugaaaguaaa

SEQ ID NO: 1116584 - RNA, 19 nt, Homo sapiens
guaacaagggagacugaaa

SEQ ID NO: 1116585 - RNA, 19 nt, Homo sapiens
gcucuuuacuugguggaaa

SEQ ID NO: 1116586 - RNA, 19 nt, Homo sapiens
ucacgcugcugcuguauac

SEQ ID NO: 1116587 - RNA, 19 nt, Homo sapiens
gcuguacacgggcgagaua

SEQ ID NO: 1116588 - RNA, 19 nt, Homo sapiens
aaacuccggaacuuaauuu

SEQ ID NO: 1116589 - RNA, 19 nt, Homo sapiens
gacaggagccagggucaaa

SEQ ID NO: 1116590 - RNA, 19 nt, Homo sapiens
gcaguuaacaagcuaguac

SEQ ID NO: 1116591 - RNA, 19 nt, Homo sapiens
ugaccuacaggcuaaguaa

SEQ ID NO: 1116592 - RNA, 19 nt, Homo sapiens
uaacaagggagacugaaag

SEQ ID NO: 1116593 - RNA, 19 nt, Homo sapiens
ggacaccaacgauaacucu

SEQ ID NO: 1116594 - RNA, 19 nt, Homo sapiens
gaaggacauuaacgacaac

SEQ ID NO: 1116595 - RNA, 19 nt, Homo sapiens
gagguaaaucugcagaaug

SEQ ID NO: 1116596 - RNA, 19 nt, Homo sapiens
agucaaacauagacacaau

SEQ ID NO: 1116597 - RNA, 19 nt, Homo sapiens
ccaccgacuucuaguacug

SEQ ID NO: 1116598 - RNA, 19 nt, Homo sapiens
ugccacaucuucacagugu

SEQ ID NO: 1116599 - RNA, 19 nt, Homo sapiens
aacgauaacucuccugaag

SEQ ID NO: 1116600 - RNA, 19 nt, Homo sapiens
gaaaaugcugcuaaagaaa

SEQ ID NO: 1116601 - RNA, 19 nt, Homo sapiens
ggaacauaaacacuaaaga

SEQ ID NO: 1116602 - RNA, 19 nt, Homo sapiens
guacuguaaguguaaagaa

SEQ ID NO: 1116603 - RNA, 19 nt, Homo sapiens
gcacggucauugcccugau

SEQ ID NO: 1116604 - RNA, 19 nt, Homo sapiens
gucaauggaacuuuagauu

SEQ ID NO: 1116605 - RNA, 19 nt, Homo sapiens
aggagucaauggagaggua

SEQ ID NO: 1116606 - RNA, 19 nt, Homo sapiens
agagggagcuucugaugcu

SEQ ID NO: 1116607 - RNA, 19 nt, Homo sapiens
agguaaaucugcagaaugg

SEQ ID NO: 1116608 - RNA, 19 nt, Homo sapiens
auaagcacguuggaaauau

SEQ ID NO: 1116609 - RNA, 19 nt, Homo sapiens
gaaauguuuaacccuaguu

SEQ ID NO: 1116610 - RNA, 19 nt, Homo sapiens
gaauucucuuucucucuca

SEQ ID NO: 1116611 - RNA, 19 nt, Homo sapiens
agacacuuauuuacacuag

SEQ ID NO: 1116612 - RNA, 19 nt, Homo sapiens
cuuaagaauucaacgagau

SEQ ID NO: 1116613 - RNA, 19 nt, Homo sapiens
gcagugcacaguacucaca

SEQ ID NO: 1116614 - RNA, 19 nt, Homo sapiens
gaaagaagaugcucaagug

SEQ ID NO: 1116615 - RNA, 19 nt, Homo sapiens
gcaaaucucucccauguag

SEQ ID NO: 1116616 - RNA, 19 nt, Homo sapiens
guaggagucuguuauuuaa

SEQ ID NO: 1116617 - RNA, 19 nt, Homo sapiens
aaucacagcuuuacucuuu

SEQ ID NO: 1116618 - RNA, 19 nt, Homo sapiens
ggagagaacgcauugcuua

SEQ ID NO: 1116619 - RNA, 19 nt, Homo sapiens
caacacaugugaaccauug

SEQ ID NO: 1116620 - RNA, 19 nt, Homo sapiens
gaucauugcugcuacagaa

SEQ ID NO: 1116621 - RNA, 19 nt, Homo sapiens
aagcagaucugauguguuu

SEQ ID NO: 1116622 - RNA, 19 nt, Homo sapiens
gauguuaccugaaaucaau

SEQ ID NO: 1116623 - RNA, 19 nt, Homo sapiens
cuacagaagugcuuuaaga

SEQ ID NO: 1116624 - RNA, 19 nt, Homo sapiens
gaucugauguguuuccuau

SEQ ID NO: 1116625 - RNA, 19 nt, Homo sapiens
ggaccagacuuucuaaauc

SEQ ID NO: 1116626 - RNA, 19 nt, Homo sapiens
gaauuuaccggaucuguuu

SEQ ID NO: 1116627 - RNA, 19 nt, Homo sapiens
gguaggagucuguuauuua

SEQ ID NO: 1116628 - RNA, 19 nt, Homo sapiens
gaacgcauuuaacagguuu

SEQ ID NO: 1116629 - RNA, 19 nt, Homo sapiens
agagugaacuuuaagcuuu

SEQ ID NO: 1116630 - RNA, 19 nt, Homo sapiens
gaaaggacgggagaaauaa

SEQ ID NO: 1116631 - RNA, 19 nt, Homo sapiens
cgaaaggacgggagaaaua

SEQ ID NO: 1116632 - RNA, 19 nt, Homo sapiens
gagugaacuuuaagcuuua

SEQ ID NO: 1116633 - RNA, 19 nt, Homo sapiens
ugaaaucaaucucccauau

SEQ ID NO: 1116634 - RNA, 19 nt, Homo sapiens
acaauuaugugcacuuuga

SEQ ID NO: 1116635 - RNA, 19 nt, Homo sapiens
cagaagugcuuuaagagaa

SEQ ID NO: 1116636 - RNA, 19 nt, Homo sapiens
uuaccaaucugaccucuuu

SEQ ID NO: 1116637 - RNA, 19 nt, Homo sapiens
acaaggaaaugauguauuc

SEQ ID NO: 1116638 - RNA, 19 nt, Homo sapiens
ggauaaagcuguuuuguuc

SEQ ID NO: 1116639 - RNA, 19 nt, Homo sapiens
ugacaacagugaccaguga

SEQ ID NO: 1116640 - RNA, 19 nt, Homo sapiens
ggaauaaacaaggaaauga

SEQ ID NO: 1116641 - RNA, 19 nt, Homo sapiens
ucaagugaaccaaacauua

SEQ ID NO: 1116642 - RNA, 19 nt, Homo sapiens
cagcuaaaguuguuguuga

SEQ ID NO: 1116643 - RNA, 19 nt, Homo sapiens
cuaagacuccugaaauaua

SEQ ID NO: 1116644 - RNA, 19 nt, Homo sapiens
cagcggaaguuaucaguau

SEQ ID NO: 1116645 - RNA, 19 nt, Homo sapiens
ccuaugauguuaccugaaa

SEQ ID NO: 1116646 - RNA, 19 nt, Homo sapiens
cuacaagaauuacuacuca

SEQ ID NO: 1116647 - RNA, 19 nt, Homo sapiens
gagaacgcauugcuuacuu

SEQ ID NO: 1116648 - RNA, 19 nt, Homo sapiens
gaccagacuuucuaaaucu

SEQ ID NO: 1116649 - RNA, 19 nt, Homo sapiens
agcaacagcuggaccuuua

SEQ ID NO: 1116650 - RNA, 19 nt, Homo sapiens
gacaguaacacuuaugaaa

SEQ ID NO: 1116651 - RNA, 19 nt, Homo sapiens
gagaaucgggcuaauuuau

SEQ ID NO: 1116652 - RNA, 19 nt, Homo sapiens
ugaaauaucagcucauaga

SEQ ID NO: 1116653 - RNA, 19 nt, Homo sapiens
gcacacaauguuuaugaaa

SEQ ID NO: 1116654 - RNA, 19 nt, Homo sapiens
guacaaggaaggcaagaaa

SEQ ID NO: 1116655 - RNA, 19 nt, Homo sapiens
gcucaacgcuucugauucg

SEQ ID NO: 1116656 - RNA, 19 nt, Homo sapiens
ugaaggacauuaacgacaa

SEQ ID NO: 1116657 - RNA, 19 nt, Homo sapiens
ggagaaucgggcuaauuua

SEQ ID NO: 1116658 - RNA, 19 nt, Homo sapiens
gcucauagaaaguaacaaa

SEQ ID NO: 1116659 - RNA, 19 nt, Homo sapiens
gcaauucccugcuccuuuu

SEQ ID NO: 1116660 - RNA, 19 nt, Homo sapiens
ggagguaaaucugcagaau

SEQ ID NO: 1116661 - RNA, 19 nt, Homo sapiens
gguauuuccucuguuauug

SEQ ID NO: 1116662 - RNA, 19 nt, Homo sapiens
uggcaaaucucucccaugu

SEQ ID NO: 1116663 - RNA, 19 nt, Homo sapiens
aaaauuugcugucaccuua

SEQ ID NO: 1116664 - RNA, 19 nt, Homo sapiens
gaaauaucagcucauagaa

SEQ ID NO: 1116665 - RNA, 19 nt, Homo sapiens
ggaaugaauacugacaaua

SEQ ID NO: 1116666 - RNA, 19 nt, Homo sapiens
gggaauggauaaagcuguu

SEQ ID NO: 1116667 - RNA, 19 nt, Homo sapiens
aaaucaaucucccauaugu

SEQ ID NO: 1116668 - RNA, 19 nt, Homo sapiens
gaaaucaaucucccauaug

SEQ ID NO: 1116669 - RNA, 19 nt, Homo sapiens
aagagaaagucuauagcua

SEQ ID NO: 1116670 - RNA, 19 nt, Homo sapiens
gaaaguucccugugucugu

SEQ ID NO: 1116671 - RNA, 19 nt, Homo sapiens
gguguuagaugccaaugau

SEQ ID NO: 1116672 - RNA, 19 nt, Homo sapiens
ggaggcaaaccugaauuua

SEQ ID NO: 1116673 - RNA, 19 nt, Homo sapiens
gcccauguaucugaccuua

SEQ ID NO: 1116674 - RNA, 19 nt, Homo sapiens
caaauaaacagcggaaguu

SEQ ID NO: 1116675 - RNA, 19 nt, Homo sapiens
agaggaggcuggcauucua

SEQ ID NO: 1116676 - RNA, 19 nt, Homo sapiens
gcaagggaauggauaaagc

SEQ ID NO: 1116677 - RNA, 19 nt, Homo sapiens
ccucuugcauguauuacua

SEQ ID NO: 1116678 - RNA, 19 nt, Homo sapiens
gccugaaacaucuguauua

SEQ ID NO: 1116679 - RNA, 19 nt, Homo sapiens
gagaauugccugaaacauc

SEQ ID NO: 1116680 - RNA, 19 nt, Homo sapiens
uuaagagaauugccugaaa

SEQ ID NO: 1116681 - RNA, 19 nt, Homo sapiens
uaaagucuguuggcuguga

SEQ ID NO: 1116682 - RNA, 19 nt, Homo sapiens
ugacagaccgguuuaugaa

SEQ ID NO: 1116683 - RNA, 19 nt, Homo sapiens
agaacgcauugcuuacuua

SEQ ID NO: 1116684 - RNA, 19 nt, Homo sapiens
gcacaaauuuuaccaaucu

SEQ ID NO: 1116685 - RNA, 19 nt, Homo sapiens
gaagugcuuuaagagaauu

SEQ ID NO: 1116686 - RNA, 19 nt, Homo sapiens
uaacaagacccaggagaaa

SEQ ID NO: 1116687 - RNA, 19 nt, Homo sapiens
acgcguggcugucguauga

SEQ ID NO: 1116688 - RNA, 19 nt, Homo sapiens
gaaggaauaaacaaggaaa

SEQ ID NO: 1116689 - RNA, 19 nt, Homo sapiens
aaacugucuugucuacuuu

SEQ ID NO: 1116690 - RNA, 19 nt, Homo sapiens
aauaucagcucauagaaag

SEQ ID NO: 1116691 - RNA, 19 nt, Homo sapiens
ucaagauacuggugauuca

SEQ ID NO: 1116692 - RNA, 19 nt, Homo sapiens
gauacacaaccuucucuaa

SEQ ID NO: 1116693 - RNA, 19 nt, Homo sapiens
uaccuagagugaacuuuaa

SEQ ID NO: 1116694 - RNA, 19 nt, Homo sapiens
uaagacuccugaaauauac

SEQ ID NO: 1116695 - RNA, 19 nt, Homo sapiens
ugcuaagacuccugaaaua

SEQ ID NO: 1116696 - RNA, 19 nt, Homo sapiens
guaacaagacccaggagaa

SEQ ID NO: 1116697 - RNA, 19 nt, Homo sapiens
cuucagcucugcaggauug

SEQ ID NO: 1116698 - RNA, 19 nt, Homo sapiens
aaucugaccucuuugaagu

SEQ ID NO: 1116699 - RNA, 19 nt, Homo sapiens
gaacaaaagcucucaauac

SEQ ID NO: 1116700 - RNA, 19 nt, Homo sapiens
caagugaaccaaacauuag

SEQ ID NO: 1116701 - RNA, 19 nt, Homo sapiens
gcuucauucucccauauuu

SEQ ID NO: 1116702 - RNA, 19 nt, Homo sapiens
gguaugcgagugccagaua

SEQ ID NO: 1116703 - RNA, 19 nt, Homo sapiens
caagaauuacuacucauug

SEQ ID NO: 1116704 - RNA, 19 nt, Homo sapiens
gaagugcuuuccaauccau

SEQ ID NO: 1116705 - RNA, 19 nt, Homo sapiens
agaauugccugaaacaucu

SEQ ID NO: 1116706 - RNA, 19 nt, Homo sapiens
guccugugcucacuuuauu

SEQ ID NO: 1116707 - RNA, 19 nt, Homo sapiens
gcugcuggaucgugaagaa

SEQ ID NO: 1116708 - RNA, 19 nt, Homo sapiens
gcgaagugcuuuccaaucc

SEQ ID NO: 1116709 - RNA, 19 nt, Homo sapiens
caacuauuaccuagaguga

SEQ ID NO: 1116710 - RNA, 19 nt, Homo sapiens
uaagagaauugccugaaac

SEQ ID NO: 1116711 - RNA, 19 nt, Homo sapiens
acgcauugcuuacuuacaa

SEQ ID NO: 1116712 - RNA, 19 nt, Homo sapiens
uuaccuagagugaacuuua

SEQ ID NO: 1116713 - RNA, 19 nt, Homo sapiens
auaacacucugaauugcua

SEQ ID NO: 1116714 - RNA, 19 nt, Homo sapiens
gaaagaagaugcucaagug

SEQ ID NO: 1116715 - RNA, 19 nt, Homo sapiens
gaagguggguuauuacguu

SEQ ID NO: 1116716 - RNA, 19 nt, Homo sapiens
ggagagaacgcauugcuua

SEQ ID NO: 1116717 - RNA, 19 nt, Homo sapiens
cuaggaagguggguuauua

SEQ ID NO: 1116718 - RNA, 19 nt, Homo sapiens
gaauuuaccggaucuguuu

SEQ ID NO: 1116719 - RNA, 19 nt, Homo sapiens
gaaaggacgggagaaauaa

SEQ ID NO: 1116720 - RNA, 19 nt, Homo sapiens
cgaaaggacgggagaaaua

SEQ ID NO: 1116721 - RNA, 19 nt, Homo sapiens
acaaggaaaugauguauuc

SEQ ID NO: 1116722 - RNA, 19 nt, Homo sapiens
ggaauaaacaaggaaauga

SEQ ID NO: 1116723 - RNA, 19 nt, Homo sapiens
ucaagugaaccaaacauua

SEQ ID NO: 1116724 - RNA, 19 nt, Homo sapiens
cagcuaaaguuguuguuga

SEQ ID NO: 1116725 - RNA, 19 nt, Homo sapiens
gcuugaauauuucuaguga

SEQ ID NO: 1116726 - RNA, 19 nt, Homo sapiens
cuacaagaauuacuacuca

SEQ ID NO: 1116727 - RNA, 19 nt, Homo sapiens
gagaacgcauugcuuacuu

SEQ ID NO: 1116728 - RNA, 19 nt, Homo sapiens
gacaguaacacuuaugaaa

SEQ ID NO: 1116729 - RNA, 19 nt, Homo sapiens
gcucaacgcuucugauucg

SEQ ID NO: 1116730 - RNA, 19 nt, Homo sapiens
ugaaggacauuaacgacaa

SEQ ID NO: 1116731 - RNA, 19 nt, Homo sapiens
ggagguaaaucugcagaau

SEQ ID NO: 1116732 - RNA, 19 nt, Homo sapiens
gguguuagaugccaaugau

SEQ ID NO: 1116733 - RNA, 19 nt, Homo sapiens
ggaggcaaaccugaauuua

SEQ ID NO: 1116734 - RNA, 19 nt, Homo sapiens
ugacagaccgguuuaugaa

SEQ ID NO: 1116735 - RNA, 19 nt, Homo sapiens
agaacgcauugcuuacuua

SEQ ID NO: 1116736 - RNA, 19 nt, Homo sapiens
acgcguggcugucguauga

SEQ ID NO: 1116737 - RNA, 19 nt, Homo sapiens
gaaggaauaaacaaggaaa

SEQ ID NO: 1116738 - RNA, 19 nt, Homo sapiens
caagugaaccaaacauuag

SEQ ID NO: 1116739 - RNA, 19 nt, Homo sapiens
gaacaaaagcucucaauac

SEQ ID NO: 1116740 - RNA, 19 nt, Homo sapiens
caagaauuacuacucauug

SEQ ID NO: 1116741 - RNA, 19 nt, Homo sapiens
gcugcuggaucgugaagaa

SEQ ID NO: 1116742 - RNA, 19 nt, Homo sapiens
acgcauugcuuacuuacaa

SEQ ID NO: 1116743 - RNA, 19 nt, Homo sapiens
gauugucacuucucugucu

SEQ ID NO: 1116744 - RNA, 19 nt, Homo sapiens
gaagaaaauccucagcuaa

SEQ ID NO: 1116745 - RNA, 19 nt, Homo sapiens
gggaagaucagucuauugg

SEQ ID NO: 1116746 - RNA, 19 nt, Homo sapiens
ccaccuacaagaauuacua

SEQ ID NO: 1116747 - RNA, 19 nt, Homo sapiens
gauaagggaaacccaccua

SEQ ID NO: 1116748 - RNA, 19 nt, Homo sapiens
ggacaguaacacuuaugaa

SEQ ID NO: 1116749 - RNA, 19 nt, Homo sapiens
agaacgcccugguguccua

SEQ ID NO: 1116750 - RNA, 19 nt, Homo sapiens
gaaaaucaagugaaccaaa

SEQ ID NO: 1116751 - RNA, 19 nt, Homo sapiens
ugaagaaaauccucagcua

SEQ ID NO: 1116752 - RNA, 19 nt, Homo sapiens
gagguaaaucugcagaaug

SEQ ID NO: 1116753 - RNA, 19 nt, Homo sapiens
gaaggacauuaacgacaac

SEQ ID NO: 1116754 - RNA, 19 nt, Homo sapiens
gaggcaaaccugaauuuac

SEQ ID NO: 1116755 - RNA, 19 nt, Homo sapiens
cugcuugacucucgauuuc

SEQ ID NO: 1116756 - RNA, 19 nt, Homo sapiens
agguaaaucugcagaaugg

SEQ ID NO: 1116757 - RNA, 19 nt, Homo sapiens
ccgcccagguucuccguaa

SEQ ID NO: 1116758 - RNA, 19 nt, Homo sapiens
gcaccgucauugcccuaau

SEQ ID NO: 1116759 - RNA, 19 nt, Homo sapiens
caagugggcaccgucauug

SEQ ID NO: 1116760 - RNA, 19 nt, Homo sapiens
ugaaagaagaugcucaagu

SEQ ID NO: 1116761 - RNA, 19 nt, Homo sapiens
gcacgguccuaguggaacu

SEQ ID NO: 1116762 - RNA, 19 nt, Homo sapiens
gugaaccaaacauuaguaa

SEQ ID NO: 1116763 - RNA, 19 nt, Homo sapiens
cagaccgguuuaugaaguu

SEQ ID NO: 1116764 - RNA, 19 nt, Homo sapiens
acagaccgguuuaugaagu

SEQ ID NO: 1116765 - RNA, 19 nt, Homo sapiens
uguuagaugccaaugauaa

SEQ ID NO: 1116766 - RNA, 19 nt, Homo sapiens
caaauucccagugcuuguu

SEQ ID NO: 1116767 - RNA, 19 nt, Homo sapiens
gaauauuucuagugauacc

SEQ ID NO: 1116768 - RNA, 19 nt, Homo sapiens
cagcguuucugaccaugau

SEQ ID NO: 1116769 - RNA, 19 nt, Homo sapiens
uaagggaaacccaccuaug

SEQ ID NO: 1116770 - RNA, 19 nt, Homo sapiens
ugaggacaguaacacuuau

SEQ ID NO: 1116771 - RNA, 19 nt, Homo sapiens
uugaggacaguaacacuua

SEQ ID NO: 1116772 - RNA, 19 nt, Homo sapiens
ucaagugggcaccgucauu

SEQ ID NO: 1116773 - RNA, 19 nt, Homo sapiens
guauucauuuagcucuuug

SEQ ID NO: 1116774 - RNA, 19 nt, Homo sapiens
uacaaacucaguccaaaug

SEQ ID NO: 1116775 - RNA, 19 nt, Homo sapiens
cugcugcucucgcuucuuc

SEQ ID NO: 1116776 - RNA, 19 nt, Homo sapiens
gagagggugucggccuaug

SEQ ID NO: 1116777 - RNA, 19 nt, Homo sapiens
gauggaggcaaaccugaau

SEQ ID NO: 1116778 - RNA, 19 nt, Homo sapiens
cuuacaaacucaguccaaa

SEQ ID NO: 1116779 - RNA, 19 nt, Homo sapiens
ugucuacauuccauuuaug

SEQ ID NO: 1116780 - RNA, 19 nt, Homo sapiens
guuugugaauucucggauu

SEQ ID NO: 1116781 - RNA, 19 nt, Homo sapiens
augaugcuauugacuuuga

SEQ ID NO: 1116782 - RNA, 19 nt, Homo sapiens
ggaugaaggaauaaacaag

SEQ ID NO: 1116783 - RNA, 19 nt, Homo sapiens
agaccgguuuaugaaguua

SEQ ID NO: 1116784 - RNA, 19 nt, Homo sapiens
gacaggccgcugcagguuu

SEQ ID NO: 1116785 - RNA, 19 nt, Homo sapiens
ggaagaucagucuauugga

SEQ ID NO: 1116786 - RNA, 19 nt, Homo sapiens
cgggucacgugguggcuaa

SEQ ID NO: 1116787 - RNA, 19 nt, Homo sapiens
aagaauuacuacucauugg

SEQ ID NO: 1116788 - RNA, 19 nt, Homo sapiens
ggaagugaaggacauuaac

SEQ ID NO: 1116789 - RNA, 19 nt, Homo sapiens
agacaaauucccagugcuu

SEQ ID NO: 1116790 - RNA, 19 nt, Homo sapiens
gaacgcauugcuuacuuac

SEQ ID NO: 1116791 - RNA, 19 nt, Homo sapiens
gacucucgauuuccacuag

SEQ ID NO: 1116792 - RNA, 19 nt, Homo sapiens
aagguggguuauuacguuu

SEQ ID NO: 1116793 - RNA, 19 nt, Homo sapiens
gcguggcugucguaugaau

SEQ ID NO: 1116794 - RNA, 19 nt, Homo sapiens
gaagugaaggacauuaacg

SEQ ID NO: 1116795 - RNA, 19 nt, Homo sapiens
ugaauuuaccggaucuguu

SEQ ID NO: 1116796 - RNA, 19 nt, Homo sapiens
ugguggaugucaacgugua

SEQ ID NO: 1116797 - RNA, 19 nt, Homo sapiens
uggaagugaaggacauuaa

SEQ ID NO: 1116798 - RNA, 19 nt, Homo sapiens
aaaggacgggagaaauaaa

SEQ ID NO: 1116799 - RNA, 19 nt, Homo sapiens
cuagugauaccuuuguaau

SEQ ID NO: 1116800 - RNA, 19 nt, Homo sapiens
cuacauuccauuuaugcuu

SEQ ID NO: 1116801 - RNA, 19 nt, Homo sapiens
uuugugaauucucggauug

SEQ ID NO: 1116802 - RNA, 19 nt, Homo sapiens
gcauuuuguuugugaauuc

SEQ ID NO: 1116803 - RNA, 19 nt, Homo sapiens
ccucugggcagcaacuuga

SEQ ID NO: 1116804 - RNA, 19 nt, Homo sapiens
gaggacaguaacacuuaug

SEQ ID NO: 1116805 - RNA, 19 nt, Homo sapiens
cggcucaacgcuucugauu

SEQ ID NO: 1116806 - RNA, 19 nt, Homo sapiens
uggaggcaaaccugaauuu

SEQ ID NO: 1116807 - RNA, 19 nt, Homo sapiens
gagagaacgcauugcuuac

SEQ ID NO: 1116808 - RNA, 19 nt, Homo sapiens
ggaagguggguuauuacgu

SEQ ID NO: 1116809 - RNA, 19 nt, Homo sapiens
acucuaggaagguggguua

SEQ ID NO: 1116810 - RNA, 19 nt, Homo sapiens
caacguguaccugaucauc

SEQ ID NO: 1116811 - RNA, 19 nt, Homo sapiens
guguccaccuacaagaauu

SEQ ID NO: 1116812 - RNA, 19 nt, Homo sapiens
aggcaaaccugaauuuacc

SEQ ID NO: 1116813 - RNA, 19 nt, Homo sapiens
gcuugacucucgauuucca

SEQ ID NO: 1116814 - RNA, 19 nt, Homo sapiens
gaaagaagaugcucaagug

SEQ ID NO: 1116815 - RNA, 19 nt, Homo sapiens
gcaaaucucucccauguag

SEQ ID NO: 1116816 - RNA, 19 nt, Homo sapiens
guaggagucuguuauuuaa

SEQ ID NO: 1116817 - RNA, 19 nt, Homo sapiens
aaucacagcuuuacucuuu

SEQ ID NO: 1116818 - RNA, 19 nt, Homo sapiens
ggagagaacgcauugcuua

SEQ ID NO: 1116819 - RNA, 19 nt, Homo sapiens
caacacaugugaaccauug

SEQ ID NO: 1116820 - RNA, 19 nt, Homo sapiens
gaucauugcugcuacagaa

SEQ ID NO: 1116821 - RNA, 19 nt, Homo sapiens
aagcagaucugauguguuu

SEQ ID NO: 1116822 - RNA, 19 nt, Homo sapiens
gauguuaccugaaaucaau

SEQ ID NO: 1116823 - RNA, 19 nt, Homo sapiens
cuacagaagugcuuuaaga

SEQ ID NO: 1116824 - RNA, 19 nt, Homo sapiens
gaucugauguguuuccuau

SEQ ID NO: 1116825 - RNA, 19 nt, Homo sapiens
ggaccagacuuucuaaauc

SEQ ID NO: 1116826 - RNA, 19 nt, Homo sapiens
gaauuuaccggaucuguuu

SEQ ID NO: 1116827 - RNA, 19 nt, Homo sapiens
gguaggagucuguuauuua

SEQ ID NO: 1116828 - RNA, 19 nt, Homo sapiens
gaacgcauuuaacagguuu

SEQ ID NO: 1116829 - RNA, 19 nt, Homo sapiens
agagugaacuuuaagcuuu

SEQ ID NO: 1116830 - RNA, 19 nt, Homo sapiens
gaaaggacgggagaaauaa

SEQ ID NO: 1116831 - RNA, 19 nt, Homo sapiens
cgaaaggacgggagaaaua

SEQ ID NO: 1116832 - RNA, 19 nt, Homo sapiens
gagugaacuuuaagcuuua

SEQ ID NO: 1116833 - RNA, 19 nt, Homo sapiens
ugaaaucaaucucccauau

SEQ ID NO: 1116834 - RNA, 19 nt, Homo sapiens
acaauuaugugcacuuuga

SEQ ID NO: 1116835 - RNA, 19 nt, Homo sapiens
cagaagugcuuuaagagaa

SEQ ID NO: 1116836 - RNA, 19 nt, Homo sapiens
uuaccaaucugaccucuuu

SEQ ID NO: 1116837 - RNA, 19 nt, Homo sapiens
acaaggaaaugauguauuc

SEQ ID NO: 1116838 - RNA, 19 nt, Homo sapiens
ggauaaagcuguuuuguuc

SEQ ID NO: 1116839 - RNA, 19 nt, Homo sapiens
ugacaacagugaccaguga

SEQ ID NO: 1116840 - RNA, 19 nt, Homo sapiens
ggaauaaacaaggaaauga

SEQ ID NO: 1116841 - RNA, 19 nt, Homo sapiens
ucaagugaaccaaacauua

SEQ ID NO: 1116842 - RNA, 19 nt, Homo sapiens
cagcuaaaguuguuguuga

SEQ ID NO: 1116843 - RNA, 19 nt, Homo sapiens
cuaagacuccugaaauaua

SEQ ID NO: 1116844 - RNA, 19 nt, Homo sapiens
cagcggaaguuaucaguau

SEQ ID NO: 1116845 - RNA, 19 nt, Homo sapiens
ccuaugauguuaccugaaa

SEQ ID NO: 1116846 - RNA, 19 nt, Homo sapiens
cuacaagaauuacuacuca

SEQ ID NO: 1116847 - RNA, 19 nt, Homo sapiens
gagaacgcauugcuuacuu

SEQ ID NO: 1116848 - RNA, 19 nt, Homo sapiens
gaccagacuuucuaaaucu

SEQ ID NO: 1116849 - RNA, 19 nt, Homo sapiens
agcaacagcuggaccuuua

SEQ ID NO: 1116850 - RNA, 19 nt, Homo sapiens
gacaguaacacuuaugaaa

SEQ ID NO: 1116851 - RNA, 19 nt, Homo sapiens
gagaaucgggcuaauuuau

SEQ ID NO: 1116852 - RNA, 19 nt, Homo sapiens
ugaaauaucagcucauaga

SEQ ID NO: 1116853 - RNA, 19 nt, Homo sapiens
gcacacaauguuuaugaaa

SEQ ID NO: 1116854 - RNA, 19 nt, Homo sapiens
guacaaggaaggcaagaaa

SEQ ID NO: 1116855 - RNA, 19 nt, Homo sapiens
gcucaacgcuucugauucg

SEQ ID NO: 1116856 - RNA, 19 nt, Homo sapiens
ugaaggacauuaacgacaa

SEQ ID NO: 1116857 - RNA, 19 nt, Homo sapiens
ggagaaucgggcuaauuua

SEQ ID NO: 1116858 - RNA, 19 nt, Homo sapiens
gcucauagaaaguaacaaa

SEQ ID NO: 1116859 - RNA, 19 nt, Homo sapiens
gcaauucccugcuccuuuu

SEQ ID NO: 1116860 - RNA, 19 nt, Homo sapiens
ggagguaaaucugcagaau

SEQ ID NO: 1116861 - RNA, 19 nt, Homo sapiens
gguauuuccucuguuauug

SEQ ID NO: 1116862 - RNA, 19 nt, Homo sapiens
uggcaaaucucucccaugu

SEQ ID NO: 1116863 - RNA, 19 nt, Homo sapiens
aaaauuugcugucaccuua

SEQ ID NO: 1116864 - RNA, 19 nt, Homo sapiens
gaaauaucagcucauagaa

SEQ ID NO: 1116865 - RNA, 19 nt, Homo sapiens
ggaaugaauacugacaaua

SEQ ID NO: 1116866 - RNA, 19 nt, Homo sapiens
gggaauggauaaagcuguu

SEQ ID NO: 1116867 - RNA, 19 nt, Homo sapiens
aaaucaaucucccauaugu

SEQ ID NO: 1116868 - RNA, 19 nt, Homo sapiens
gaaaucaaucucccauaug

SEQ ID NO: 1116869 - RNA, 19 nt, Homo sapiens
aagagaaagucuauagcua

SEQ ID NO: 1116870 - RNA, 19 nt, Homo sapiens
gaaaguucccugugucugu

SEQ ID NO: 1116871 - RNA, 19 nt, Homo sapiens
gguguuagaugccaaugau

SEQ ID NO: 1116872 - RNA, 19 nt, Homo sapiens
ggaggcaaaccugaauuua

SEQ ID NO: 1116873 - RNA, 19 nt, Homo sapiens
gcccauguaucugaccuua

SEQ ID NO: 1116874 - RNA, 19 nt, Homo sapiens
caaauaaacagcggaaguu

SEQ ID NO: 1116875 - RNA, 19 nt, Homo sapiens
agaggaggcuggcauucua

SEQ ID NO: 1116876 - RNA, 19 nt, Homo sapiens
gcaagggaauggauaaagc

SEQ ID NO: 1116877 - RNA, 19 nt, Homo sapiens
ccucuugcauguauuacua

SEQ ID NO: 1116878 - RNA, 19 nt, Homo sapiens
gccugaaacaucuguauua

SEQ ID NO: 1116879 - RNA, 19 nt, Homo sapiens
gagaauugccugaaacauc

SEQ ID NO: 1116880 - RNA, 19 nt, Homo sapiens
uuaagagaauugccugaaa

SEQ ID NO: 1116881 - RNA, 19 nt, Homo sapiens
uaaagucuguuggcuguga

SEQ ID NO: 1116882 - RNA, 19 nt, Homo sapiens
ugacagaccgguuuaugaa

SEQ ID NO: 1116883 - RNA, 19 nt, Homo sapiens
agaacgcauugcuuacuua

SEQ ID NO: 1116884 - RNA, 19 nt, Homo sapiens
gcacaaauuuuaccaaucu

SEQ ID NO: 1116885 - RNA, 19 nt, Homo sapiens
gaagugcuuuaagagaauu

SEQ ID NO: 1116886 - RNA, 19 nt, Homo sapiens
uaacaagacccaggagaaa

SEQ ID NO: 1116887 - RNA, 19 nt, Homo sapiens
gaaggaauaaacaaggaaa

SEQ ID NO: 1116888 - RNA, 19 nt, Homo sapiens
aaacugucuugucuacuuu

SEQ ID NO: 1116889 - RNA, 19 nt, Homo sapiens
aauaucagcucauagaaag

SEQ ID NO: 1116890 - RNA, 19 nt, Homo sapiens
ucaagauacuggugauuca

SEQ ID NO: 1116891 - RNA, 19 nt, Homo sapiens
gauacacaaccuucucuaa

SEQ ID NO: 1116892 - RNA, 19 nt, Homo sapiens
uaccuagagugaacuuuaa

SEQ ID NO: 1116893 - RNA, 19 nt, Homo sapiens
uaagacuccugaaauauac

SEQ ID NO: 1116894 - RNA, 19 nt, Homo sapiens
ugcuaagacuccugaaaua

SEQ ID NO: 1116895 - RNA, 19 nt, Homo sapiens
guaacaagacccaggagaa

SEQ ID NO: 1116896 - RNA, 19 nt, Homo sapiens
cuucagcucugcaggauug

SEQ ID NO: 1116897 - RNA, 19 nt, Homo sapiens
gaacaaaagcucucaauac

SEQ ID NO: 1116898 - RNA, 19 nt, Homo sapiens
aaucugaccucuuugaagu

SEQ ID NO: 1116899 - RNA, 19 nt, Homo sapiens
caagugaaccaaacauuag

SEQ ID NO: 1116900 - RNA, 19 nt, Homo sapiens
gcuucauucucccauauuu

SEQ ID NO: 1116901 - RNA, 19 nt, Homo sapiens
gguaugcgagugccagaua

SEQ ID NO: 1116902 - RNA, 19 nt, Homo sapiens
caagaauuacuacucauug

SEQ ID NO: 1116903 - RNA, 19 nt, Homo sapiens
gaagugcuuuccaauccau

SEQ ID NO: 1116904 - RNA, 19 nt, Homo sapiens
agaauugccugaaacaucu

SEQ ID NO: 1116905 - RNA, 19 nt, Homo sapiens
guccugugcucacuuuauu

SEQ ID NO: 1116906 - RNA, 19 nt, Homo sapiens
gcugcuggaucgugaagaa

SEQ ID NO: 1116907 - RNA, 19 nt, Homo sapiens
gcgaagugcuuuccaaucc

SEQ ID NO: 1116908 - RNA, 19 nt, Homo sapiens
caacuauuaccuagaguga

SEQ ID NO: 1116909 - RNA, 19 nt, Homo sapiens
uaagagaauugccugaaac

SEQ ID NO: 1116910 - RNA, 19 nt, Homo sapiens
acgcauugcuuacuuacaa

SEQ ID NO: 1116911 - RNA, 19 nt, Homo sapiens
uuaccuagagugaacuuua

SEQ ID NO: 1116912 - RNA, 19 nt, Homo sapiens
auaacacucugaauugcua

SEQ ID NO: 1116913 - RNA, 19 nt, Homo sapiens
gaucagcaguggccaacag

SEQ ID NO: 1116914 - RNA, 19 nt, Homo sapiens
gcaaaucucucccauguag

SEQ ID NO: 1116915 - RNA, 19 nt, Homo sapiens
guaggagucuguuauuuaa

SEQ ID NO: 1116916 - RNA, 19 nt, Homo sapiens
aaucacagcuuuacucuuu

SEQ ID NO: 1116917 - RNA, 19 nt, Homo sapiens
caacacaugugaaccauug

SEQ ID NO: 1116918 - RNA, 19 nt, Homo sapiens
gaucauugcugcuacagaa

SEQ ID NO: 1116919 - RNA, 19 nt, Homo sapiens
aagcagaucugauguguuu

SEQ ID NO: 1116920 - RNA, 19 nt, Homo sapiens
gauguuaccugaaaucaau

SEQ ID NO: 1116921 - RNA, 19 nt, Homo sapiens
cuacagaagugcuuuaaga

SEQ ID NO: 1116922 - RNA, 19 nt, Homo sapiens
gagcaagauuuaaauguug

SEQ ID NO: 1116923 - RNA, 19 nt, Homo sapiens
caaagaacgaugagaauaa

SEQ ID NO: 1116924 - RNA, 19 nt, Homo sapiens
gaucugauguguuuccuau

SEQ ID NO: 1116925 - RNA, 19 nt, Homo sapiens
ggaccagacuuucuaaauc

SEQ ID NO: 1116926 - RNA, 19 nt, Homo sapiens
gguaggagucuguuauuua

SEQ ID NO: 1116927 - RNA, 19 nt, Homo sapiens
gaacgcauuuaacagguuu

SEQ ID NO: 1116928 - RNA, 19 nt, Homo sapiens
agagugaacuuuaagcuuu

SEQ ID NO: 1116929 - RNA, 19 nt, Homo sapiens
gagugaacuuuaagcuuua

SEQ ID NO: 1116930 - RNA, 19 nt, Homo sapiens
ugaaaucaaucucccauau

SEQ ID NO: 1116931 - RNA, 19 nt, Homo sapiens
acaauuaugugcacuuuga

SEQ ID NO: 1116932 - RNA, 19 nt, Homo sapiens
cagaagugcuuuaagagaa

SEQ ID NO: 1116933 - RNA, 19 nt, Homo sapiens
uuaccaaucugaccucuuu

SEQ ID NO: 1116934 - RNA, 19 nt, Homo sapiens
ggauaaagcuguuuuguuc

SEQ ID NO: 1116935 - RNA, 19 nt, Homo sapiens
ugacaacagugaccaguga

SEQ ID NO: 1116936 - RNA, 19 nt, Homo sapiens
gcgaagagcaagauuuaaa

SEQ ID NO: 1116937 - RNA, 19 nt, Homo sapiens
aggcuuagcucucaugauu

SEQ ID NO: 1116938 - RNA, 19 nt, Homo sapiens
cuaagacuccugaaauaua

SEQ ID NO: 1116939 - RNA, 19 nt, Homo sapiens
cagcggaaguuaucaguau

SEQ ID NO: 1116940 - RNA, 19 nt, Homo sapiens
ugaaggauguuaaugacaa

SEQ ID NO: 1116941 - RNA, 19 nt, Homo sapiens
ccuaugauguuaccugaaa

SEQ ID NO: 1116942 - RNA, 19 nt, Homo sapiens
cgaacagucugaauacgaa

SEQ ID NO: 1116943 - RNA, 19 nt, Homo sapiens
gaccagacuuucuaaaucu

SEQ ID NO: 1116944 - RNA, 19 nt, Homo sapiens
agcaacagcuggaccuuua

SEQ ID NO: 1116945 - RNA, 19 nt, Homo sapiens
gagaaucgggcuaauuuau

SEQ ID NO: 1116946 - RNA, 19 nt, Homo sapiens
ugaaauaucagcucauaga

SEQ ID NO: 1116947 - RNA, 19 nt, Homo sapiens
gcacacaauguuuaugaaa

SEQ ID NO: 1116948 - RNA, 19 nt, Homo sapiens
guacaaggaaggcaagaaa

SEQ ID NO: 1116949 - RNA, 19 nt, Homo sapiens
ggagaaucgggcuaauuua

SEQ ID NO: 1116950 - RNA, 19 nt, Homo sapiens
gcucauagaaaguaacaaa

SEQ ID NO: 1116951 - RNA, 19 nt, Homo sapiens
gcaauucccugcuccuuuu

SEQ ID NO: 1116952 - RNA, 19 nt, Homo sapiens
gguauuuccucuguuauug

SEQ ID NO: 1116953 - RNA, 19 nt, Homo sapiens
uggcaaaucucucccaugu

SEQ ID NO: 1116954 - RNA, 19 nt, Homo sapiens
gaagagcaagauuuaaaug

SEQ ID NO: 1116955 - RNA, 19 nt, Homo sapiens
gacaacggaacaacaguua

SEQ ID NO: 1116956 - RNA, 19 nt, Homo sapiens
aaaauuugcugucaccuua

SEQ ID NO: 1116957 - RNA, 19 nt, Homo sapiens
gaaauaucagcucauagaa

SEQ ID NO: 1116958 - RNA, 19 nt, Homo sapiens
ggaaugaauacugacaaua

SEQ ID NO: 1116959 - RNA, 19 nt, Homo sapiens
gggaauggauaaagcuguu

SEQ ID NO: 1116960 - RNA, 19 nt, Homo sapiens
aaaucaaucucccauaugu

SEQ ID NO: 1116961 - RNA, 19 nt, Homo sapiens
gaaaucaaucucccauaug

SEQ ID NO: 1116962 - RNA, 19 nt, Homo sapiens
aagagaaagucuauagcua

SEQ ID NO: 1116963 - RNA, 19 nt, Homo sapiens
gaaaguucccugugucugu

SEQ ID NO: 1116964 - RNA, 19 nt, Homo sapiens
ggugaaggaucauggugaa

SEQ ID NO: 1116965 - RNA, 19 nt, Homo sapiens
acgcguggcuuucguauga

SEQ ID NO: 1116966 - RNA, 19 nt, Homo sapiens
guguuaaccuacaggcuua

SEQ ID NO: 1116967 - RNA, 19 nt, Homo sapiens
ggagguaagucugcagaau

SEQ ID NO: 1116968 - RNA, 19 nt, Homo sapiens
gcccauguaucugaccuua

SEQ ID NO: 1116969 - RNA, 19 nt, Homo sapiens
caaauaaacagcggaaguu

SEQ ID NO: 1116970 - RNA, 19 nt, Homo sapiens
agaggaggcuggcauucua

SEQ ID NO: 1116971 - RNA, 19 nt, Homo sapiens
ugaagacgcucaauuuggu

SEQ ID NO: 1116972 - RNA, 19 nt, Homo sapiens
gcaagggaauggauaaagc

SEQ ID NO: 1116973 - RNA, 19 nt, Homo sapiens
ccucuugcauguauuacua

SEQ ID NO: 1116974 - RNA, 19 nt, Homo sapiens
gccugaaacaucuguauua

SEQ ID NO: 1116975 - RNA, 19 nt, Homo sapiens
gagaauugccugaaacauc

SEQ ID NO: 1116976 - RNA, 19 nt, Homo sapiens
uuaagagaauugccugaaa

SEQ ID NO: 1116977 - RNA, 19 nt, Homo sapiens
uaaagucuguuggcuguga

SEQ ID NO: 1116978 - RNA, 19 nt, Homo sapiens
gggcaaaccugagcucaca

SEQ ID NO: 1116979 - RNA, 19 nt, Homo sapiens
gcacaaauuuuaccaaucu

SEQ ID NO: 1116980 - RNA, 19 nt, Homo sapiens
gaagugcuuuaagagaauu

SEQ ID NO: 1116981 - RNA, 19 nt, Homo sapiens
uaacaagacccaggagaaa

SEQ ID NO: 1116982 - RNA, 19 nt, Homo sapiens
ucaaagaacgaugagaaua

SEQ ID NO: 1116983 - RNA, 19 nt, Homo sapiens
aaacugucuugucuacuuu

SEQ ID NO: 1116984 - RNA, 19 nt, Homo sapiens
aauaucagcucauagaaag

SEQ ID NO: 1116985 - RNA, 19 nt, Homo sapiens
ucaagauacuggugauuca

SEQ ID NO: 1116986 - RNA, 19 nt, Homo sapiens
gauacacaaccuucucuaa

SEQ ID NO: 1116987 - RNA, 19 nt, Homo sapiens
gaaaauccuuggacagaga

SEQ ID NO: 1116988 - RNA, 19 nt, Homo sapiens
uaccuagagugaacuuuaa

SEQ ID NO: 1116989 - RNA, 19 nt, Homo sapiens
uaagacuccugaaauauac

SEQ ID NO: 1116990 - RNA, 19 nt, Homo sapiens
ugcuaagacuccugaaaua

SEQ ID NO: 1116991 - RNA, 19 nt, Homo sapiens
guaacaagacccaggagaa

SEQ ID NO: 1116992 - RNA, 19 nt, Homo sapiens
agaacgcgcugguguccua

SEQ ID NO: 1116993 - RNA, 19 nt, Homo sapiens
cuucagcucugcaggauug

SEQ ID NO: 1116994 - RNA, 19 nt, Homo sapiens
aaucugaccucuuugaagu

SEQ ID NO: 1116995 - RNA, 19 nt, Homo sapiens
gcuucauucucccauauuu

SEQ ID NO: 1116996 - RNA, 19 nt, Homo sapiens
gguaugcgagugccagaua

SEQ ID NO: 1116997 - RNA, 19 nt, Homo sapiens
gaagugcuuuccaauccau

SEQ ID NO: 1116998 - RNA, 19 nt, Homo sapiens
agaauugccugaaacaucu

SEQ ID NO: 1116999 - RNA, 19 nt, Homo sapiens
guccugugcucacuuuauu

SEQ ID NO: 1117000 - RNA, 19 nt, Homo sapiens
uguccaccuucaagaauua

SEQ ID NO: 1117001 - RNA, 19 nt, Homo sapiens
gcgaagugcuuuccaaucc

SEQ ID NO: 1117002 - RNA, 19 nt, Homo sapiens
caacuauuaccuagaguga

SEQ ID NO: 1117003 - RNA, 19 nt, Homo sapiens
uaagagaauugccugaaac

SEQ ID NO: 1117004 - RNA, 19 nt, Homo sapiens
uaaacugguugagcucgua

SEQ ID NO: 1117005 - RNA, 19 nt, Homo sapiens
uuaccuagagugaacuuua

SEQ ID NO: 1117006 - RNA, 19 nt, Homo sapiens
auaacacucugaauugcua

SEQ ID NO: 1117007 - RNA, 19 nt, Homo sapiens
gaucagcaguggccaacag

SEQ ID NO: 1117008 - RNA, 19 nt, Homo sapiens
uaacgucccugagauagca

SEQ ID NO: 1117009 - RNA, 19 nt, Homo sapiens
gaaauacgggagaaauagu

SEQ ID NO: 1117010 - RNA, 19 nt, Homo sapiens
uagcauagaucgaaauacg

SEQ ID NO: 1117011 - RNA, 19 nt, Homo sapiens
gcuuagcucucaugauuac

SEQ ID NO: 1117012 - RNA, 19 nt, Homo sapiens
gaauuggugcuauugguau

SEQ ID NO: 1117013 - RNA, 19 nt, Homo sapiens
uauguaugcuguaugcuau

SEQ ID NO: 1117014 - RNA, 19 nt, Homo sapiens
gaucauggccucaaaguaa

SEQ ID NO: 1117015 - RNA, 19 nt, Homo sapiens
gagcaagauuuaaauguug

SEQ ID NO: 1117016 - RNA, 19 nt, Homo sapiens
caaagaacgaugagaauaa

SEQ ID NO: 1117017 - RNA, 19 nt, Homo sapiens
gcgaagagcaagauuuaaa

SEQ ID NO: 1117018 - RNA, 19 nt, Homo sapiens
aggcuuagcucucaugauu

SEQ ID NO: 1117019 - RNA, 19 nt, Homo sapiens
ugaaggauguuaaugacaa

SEQ ID NO: 1117020 - RNA, 19 nt, Homo sapiens
cgaacagucugaauacgaa

SEQ ID NO: 1117021 - RNA, 19 nt, Homo sapiens
gaagagcaagauuuaaaug

SEQ ID NO: 1117022 - RNA, 19 nt, Homo sapiens
gacaacggaacaacaguua

SEQ ID NO: 1117023 - RNA, 19 nt, Homo sapiens
ggugaaggaucauggugaa

SEQ ID NO: 1117024 - RNA, 19 nt, Homo sapiens
acgcguggcuuucguauga

SEQ ID NO: 1117025 - RNA, 19 nt, Homo sapiens
guguuaaccuacaggcuua

SEQ ID NO: 1117026 - RNA, 19 nt, Homo sapiens
ugaagacgcucaauuuggu

SEQ ID NO: 1117027 - RNA, 19 nt, Homo sapiens
ggagguaagucugcagaau

SEQ ID NO: 1117028 - RNA, 19 nt, Homo sapiens
gggcaaaccugagcucaca

SEQ ID NO: 1117029 - RNA, 19 nt, Homo sapiens
ucaaagaacgaugagaaua

SEQ ID NO: 1117030 - RNA, 19 nt, Homo sapiens
gaaaauccuuggacagaga

SEQ ID NO: 1117031 - RNA, 19 nt, Homo sapiens
agaacgcgcugguguccua

SEQ ID NO: 1117032 - RNA, 19 nt, Homo sapiens
uguccaccuucaagaauua

SEQ ID NO: 1117033 - RNA, 19 nt, Homo sapiens
uaaacugguugagcucgua

SEQ ID NO: 1117034 - RNA, 19 nt, Homo sapiens
uaacgucccugagauagca

SEQ ID NO: 1117035 - RNA, 19 nt, Homo sapiens
gaaauacgggagaaauagu

SEQ ID NO: 1117036 - RNA, 19 nt, Homo sapiens
uagcauagaucgaaauacg

SEQ ID NO: 1117037 - RNA, 19 nt, Homo sapiens
gcuuagcucucaugauuac

SEQ ID NO: 1117038 - RNA, 19 nt, Homo sapiens
gaagacgcucaauuuggua

SEQ ID NO: 1117039 - RNA, 19 nt, Homo sapiens
gagguaagucugcagaaug

SEQ ID NO: 1117040 - RNA, 19 nt, Homo sapiens
aggcgaagagcaagauuua

SEQ ID NO: 1117041 - RNA, 19 nt, Homo sapiens
caaacugaaugcuucugau

SEQ ID NO: 1117042 - RNA, 19 nt, Homo sapiens
ugauaaugcucccacuuuc

SEQ ID NO: 1117043 - RNA, 19 nt, Homo sapiens
cggaacaacaguuaucaaa

SEQ ID NO: 1117044 - RNA, 19 nt, Homo sapiens
caacggaacaacaguuauc

SEQ ID NO: 1117045 - RNA, 19 nt, Homo sapiens
uuaauagccuuguugaaac

SEQ ID NO: 1117046 - RNA, 19 nt, Homo sapiens
ggugaaggauguuaaugac

SEQ ID NO: 1117047 - RNA, 19 nt, Homo sapiens
gcagucggcuggcguuuug

SEQ ID NO: 1117048 - RNA, 19 nt, Homo sapiens
agauagcacugacuuccuu

SEQ ID NO: 1117049 - RNA, 19 nt, Homo sapiens
ugauaacgucccugagaua

SEQ ID NO: 1117050 - RNA, 19 nt, Homo sapiens
ucgaaauacgggagaaaua

SEQ ID NO: 1117051 - RNA, 19 nt, Homo sapiens
cgaagagcaagauuuaaau

SEQ ID NO: 1117052 - RNA, 19 nt, Homo sapiens
gcacugacuuccuuauccu

SEQ ID NO: 1117053 - RNA, 19 nt, Homo sapiens
cgaaauacgggagaaauag

SEQ ID NO: 1117054 - RNA, 19 nt, Homo sapiens
guugagcucguauuaagaa

SEQ ID NO: 1117055 - RNA, 19 nt, Homo sapiens
gaacgaugagaauaaacug

SEQ ID NO: 1117056 - RNA, 19 nt, Homo sapiens
ugaauucaaagaacgauga

SEQ ID NO: 1117057 - RNA, 19 nt, Homo sapiens
gaaggauguuaaugacaac

SEQ ID NO: 1117058 - RNA, 19 nt, Homo sapiens
ccucaaaguaaguccauuu

SEQ ID NO: 1117059 - RNA, 19 nt, Homo sapiens
guacugucaucgcccuaau

SEQ ID NO: 1117060 - RNA, 19 nt, Homo sapiens
gcgggucauugcaccguuu

SEQ ID NO: 1117061 - RNA, 19 nt, Homo sapiens
ugcuagaugugaauucaaa

SEQ ID NO: 1117062 - RNA, 19 nt, Homo sapiens
caugcuagaugugaauuca

SEQ ID NO: 1117063 - RNA, 19 nt, Homo sapiens
gauagcacugacuuccuua

SEQ ID NO: 1117064 - RNA, 19 nt, Homo sapiens
ggucauacucgcaacaaca

SEQ ID NO: 1117065 - RNA, 19 nt, Homo sapiens
ucaauuugguacugucauc

SEQ ID NO: 1117066 - RNA, 19 nt, Homo sapiens
gcagacaacggaacaacag

SEQ ID NO: 1117067 - RNA, 19 nt, Homo sapiens
ugguugagcucguauuaag

SEQ ID NO: 1117068 - RNA, 19 nt, Homo sapiens
ugacaacccgccaguguuc

SEQ ID NO: 1117069 - RNA, 19 nt, Homo sapiens
gagagagugucggccuaug

SEQ ID NO: 1117070 - RNA, 19 nt, Homo sapiens
ggaggugaaggauguuaau

SEQ ID NO: 1117071 - RNA, 19 nt, Homo sapiens
guguccaccuucaagaauu

SEQ ID NO: 1117072 - RNA, 19 nt, Homo sapiens
acugucaucgcccuaauua

SEQ ID NO: 1117073 - RNA, 19 nt, Homo sapiens
gauaacgucccugagauag

SEQ ID NO: 1117074 - RNA, 19 nt, Homo sapiens
uaauagccuuguugaaacu

SEQ ID NO: 1117075 - RNA, 19 nt, Homo sapiens
cgaugagaauaaacugguu

SEQ ID NO: 1117076 - RNA, 19 nt, Homo sapiens
aaagcuguuuguuucagaa

SEQ ID NO: 1117077 - RNA, 19 nt, Homo sapiens
gaaggaucauggugaaccu

SEQ ID NO: 1117078 - RNA, 19 nt, Homo sapiens
gggcaauuucauauucuuu

SEQ ID NO: 1117079 - RNA, 19 nt, Homo sapiens
ggaacaacaguuaucaaac

SEQ ID NO: 1117080 - RNA, 19 nt, Homo sapiens
ggaugugaaugauaaugcu

SEQ ID NO: 1117081 - RNA, 19 nt, Homo sapiens
ugcuggaugugaaugauaa

SEQ ID NO: 1117082 - RNA, 19 nt, Homo sapiens
gagcucguauuaagaaaau

SEQ ID NO: 1117083 - RNA, 19 nt, Homo sapiens
ucaagaauuacuacucguu

SEQ ID NO: 1117084 - RNA, 19 nt, Homo sapiens
gugaagacgcucaauuugg

SEQ ID NO: 1117085 - RNA, 19 nt, Homo sapiens
aaugauaacgucccugaga

SEQ ID NO: 1117086 - RNA, 19 nt, Homo sapiens
gagugucggccuaugaguu

SEQ ID NO: 1117087 - RNA, 19 nt, Homo sapiens
gacaggccgcugcagguuu

SEQ ID NO: 1117088 - RNA, 19 nt, Homo sapiens
gaucgaaauacgggagaaa

SEQ ID NO: 1117089 - RNA, 19 nt, Homo sapiens
ucaaacugaaugcuucuga

SEQ ID NO: 1117090 - RNA, 19 nt, Homo sapiens
ccuacaggcuuagcucuca

SEQ ID NO: 1117091 - RNA, 19 nt, Homo sapiens
cucaaaguaaguccauuua

SEQ ID NO: 1117092 - RNA, 19 nt, Homo sapiens
acgugaagacgcucaauuu

SEQ ID NO: 1117093 - RNA, 19 nt, Homo sapiens
gggguaauuuggauuuuga

SEQ ID NO: 1117094 - RNA, 19 nt, Homo sapiens
augcagauguuggagcuaa

SEQ ID NO: 1117095 - RNA, 19 nt, Homo sapiens
gcugggauccuggcgacua

SEQ ID NO: 1117096 - RNA, 19 nt, Homo sapiens
cgugaagacgcucaauuug

SEQ ID NO: 1117097 - RNA, 19 nt, Homo sapiens
ugguggaugucaacgugua

SEQ ID NO: 1117098 - RNA, 19 nt, Homo sapiens
gccuaugaguuggugguaa

SEQ ID NO: 1117099 - RNA, 19 nt, Homo sapiens
ccgccaguguuccggguaa

SEQ ID NO: 1117100 - RNA, 19 nt, Homo sapiens
gcauuuuguuugugaauuc

SEQ ID NO: 1117101 - RNA, 19 nt, Homo sapiens
gugcuggaugugaaugaua

SEQ ID NO: 1117102 - RNA, 19 nt, Homo sapiens
ugauguaggcgaagagcaa

SEQ ID NO: 1117103 - RNA, 19 nt, Homo sapiens
guuaucaaacugaaugcuu

SEQ ID NO: 1117104 - RNA, 19 nt, Homo sapiens
agacaacggaacaacaguu

SEQ ID NO: 1117105 - RNA, 19 nt, Homo sapiens
caacguguaccugaucauc

SEQ ID NO: 1117106 - RNA, 19 nt, Homo sapiens
ccuaugaguuggugguaac

SEQ ID NO: 1117107 - RNA, 19 nt, Homo sapiens
aaacugaaugcuucugauc

SEQ ID NO: 1117108 - RNA, 19 nt, Homo sapiens
augauaaugcucccacuuu

SEQ ID NO: 1117109 - RNA, 19 nt, Homo sapiens
ggcuuagcucucaugauua

SEQ ID NO: 1117110 - RNA, 19 nt, Homo sapiens
ggacguggaggugaaggau

SEQ ID NO: 1117111 - RNA, 19 nt, Homo sapiens
agguaagucugcagaaugg

SEQ ID NO: 1117112 - RNA, 19 nt, Homo sapiens
agagagugucggccuauga

SEQ ID NO: 1117113 - RNA, 19 nt, Homo sapiens
guugaaacuaugguuauug

SEQ ID NO: 1117114 - RNA, 19 nt, Homo sapiens
gcaaaucucucccauguag

SEQ ID NO: 1117115 - RNA, 19 nt, Homo sapiens
guaggagucuguuauuuaa

SEQ ID NO: 1117116 - RNA, 19 nt, Homo sapiens
aaucacagcuuuacucuuu

SEQ ID NO: 1117117 - RNA, 19 nt, Homo sapiens
caacacaugugaaccauug

SEQ ID NO: 1117118 - RNA, 19 nt, Homo sapiens
gaucauugcugcuacagaa

SEQ ID NO: 1117119 - RNA, 19 nt, Homo sapiens
aagcagaucugauguguuu

SEQ ID NO: 1117120 - RNA, 19 nt, Homo sapiens
gauguuaccugaaaucaau

SEQ ID NO: 1117121 - RNA, 19 nt, Homo sapiens
cuacagaagugcuuuaaga

SEQ ID NO: 1117122 - RNA, 19 nt, Homo sapiens
gaaaguagagcacacaaga

SEQ ID NO: 1117123 - RNA, 19 nt, Homo sapiens
gaucugauguguuuccuau

SEQ ID NO: 1117124 - RNA, 19 nt, Homo sapiens
ggaccagacuuucuaaauc

SEQ ID NO: 1117125 - RNA, 19 nt, Homo sapiens
gguaggagucuguuauuua

SEQ ID NO: 1117126 - RNA, 19 nt, Homo sapiens
gaacgcauuuaacagguuu

SEQ ID NO: 1117127 - RNA, 19 nt, Homo sapiens
agagugaacuuuaagcuuu

SEQ ID NO: 1117128 - RNA, 19 nt, Homo sapiens
ugacaaugcuccacaguug

SEQ ID NO: 1117129 - RNA, 19 nt, Homo sapiens
gagugaacuuuaagcuuua

SEQ ID NO: 1117130 - RNA, 19 nt, Homo sapiens
ugaaaucaaucucccauau

SEQ ID NO: 1117131 - RNA, 19 nt, Homo sapiens
acaauuaugugcacuuuga

SEQ ID NO: 1117132 - RNA, 19 nt, Homo sapiens
cagaagugcuuuaagagaa

SEQ ID NO: 1117133 - RNA, 19 nt, Homo sapiens
uuaccaaucugaccucuuu

SEQ ID NO: 1117134 - RNA, 19 nt, Homo sapiens
ggauaaagcuguuuuguuc

SEQ ID NO: 1117135 - RNA, 19 nt, Homo sapiens
caucuacugcuguuuauua

SEQ ID NO: 1117136 - RNA, 19 nt, Homo sapiens
cgacaucuacugcuguuua

SEQ ID NO: 1117137 - RNA, 19 nt, Homo sapiens
ugacaacagugaccaguga

SEQ ID NO: 1117138 - RNA, 19 nt, Homo sapiens
agaacgcccugcucacuua

SEQ ID NO: 1117139 - RNA, 19 nt, Homo sapiens
cuaagacuccugaaauaua

SEQ ID NO: 1117140 - RNA, 19 nt, Homo sapiens
cagcggaaguuaucaguau

SEQ ID NO: 1117141 - RNA, 19 nt, Homo sapiens
ggagucaacggacagguua

SEQ ID NO: 1117142 - RNA, 19 nt, Homo sapiens
ccuaugauguuaccugaaa

SEQ ID NO: 1117143 - RNA, 19 nt, Homo sapiens
gaaaggccgcugcagguuu

SEQ ID NO: 1117144 - RNA, 19 nt, Homo sapiens
gaccagacuuucuaaaucu

SEQ ID NO: 1117145 - RNA, 19 nt, Homo sapiens
agcaacagcuggaccuuua

SEQ ID NO: 1117146 - RNA, 19 nt, Homo sapiens
guacaguucuuguggaagu

SEQ ID NO: 1117147 - RNA, 19 nt, Homo sapiens
gagaaucgggcuaauuuau

SEQ ID NO: 1117148 - RNA, 19 nt, Homo sapiens
ugaaauaucagcucauaga

SEQ ID NO: 1117149 - RNA, 19 nt, Homo sapiens
gcacacaauguuuaugaaa

SEQ ID NO: 1117150 - RNA, 19 nt, Homo sapiens
guacaaggaaggcaagaaa

SEQ ID NO: 1117151 - RNA, 19 nt, Homo sapiens
ugaaggacauuaacgacaa

SEQ ID NO: 1117152 - RNA, 19 nt, Homo sapiens
ggagaaucgggcuaauuua

SEQ ID NO: 1117153 - RNA, 19 nt, Homo sapiens
gcucauagaaaguaacaaa

SEQ ID NO: 1117154 - RNA, 19 nt, Homo sapiens
ggagguaaaucugcagaau

SEQ ID NO: 1117155 - RNA, 19 nt, Homo sapiens
gcaauucccugcuccuuuu

SEQ ID NO: 1117156 - RNA, 19 nt, Homo sapiens
gguauuuccucuguuauug

SEQ ID NO: 1117157 - RNA, 19 nt, Homo sapiens
uggcaaaucucucccaugu

SEQ ID NO: 1117158 - RNA, 19 nt, Homo sapiens
ggacuuguauuacggaaac

SEQ ID NO: 1117159 - RNA, 19 nt, Homo sapiens
aaaauuugcugucaccuua

SEQ ID NO: 1117160 - RNA, 19 nt, Homo sapiens
gaaauaucagcucauagaa

SEQ ID NO: 1117161 - RNA, 19 nt, Homo sapiens
ggaaugaauacugacaaua

SEQ ID NO: 1117162 - RNA, 19 nt, Homo sapiens
gggaauggauaaagcuguu

SEQ ID NO: 1117163 - RNA, 19 nt, Homo sapiens
aaaucaaucucccauaugu

SEQ ID NO: 1117164 - RNA, 19 nt, Homo sapiens
gaaaucaaucucccauaug

SEQ ID NO: 1117165 - RNA, 19 nt, Homo sapiens
aagagaaagucuauagcua

SEQ ID NO: 1117166 - RNA, 19 nt, Homo sapiens
gaaaguucccugugucugu

SEQ ID NO: 1117167 - RNA, 19 nt, Homo sapiens
acgcguggcuuucguauga

SEQ ID NO: 1117168 - RNA, 19 nt, Homo sapiens
gcccauguaucugaccuua

SEQ ID NO: 1117169 - RNA, 19 nt, Homo sapiens
caaauaaacagcggaaguu

SEQ ID NO: 1117170 - RNA, 19 nt, Homo sapiens
agaggaggcuggcauucua

SEQ ID NO: 1117171 - RNA, 19 nt, Homo sapiens
ugauguuucuccagauaua

SEQ ID NO: 1117172 - RNA, 19 nt, Homo sapiens
gacuggcaccguucaauua

SEQ ID NO: 1117173 - RNA, 19 nt, Homo sapiens
cuccggagcuucauuuauu

SEQ ID NO: 1117174 - RNA, 19 nt, Homo sapiens
gcaagggaauggauaaagc

SEQ ID NO: 1117175 - RNA, 19 nt, Homo sapiens
ccucuugcauguauuacua

SEQ ID NO: 1117176 - RNA, 19 nt, Homo sapiens
gccugaaacaucuguauua

SEQ ID NO: 1117177 - RNA, 19 nt, Homo sapiens
gagaauugccugaaacauc

SEQ ID NO: 1117178 - RNA, 19 nt, Homo sapiens
uuaagagaauugccugaaa

SEQ ID NO: 1117179 - RNA, 19 nt, Homo sapiens
uaaagucuguuggcuguga

SEQ ID NO: 1117180 - RNA, 19 nt, Homo sapiens
agaccgagcugguggaugu

SEQ ID NO: 1117181 - RNA, 19 nt, Homo sapiens
gaagguacgugcaguugac

SEQ ID NO: 1117182 - RNA, 19 nt, Homo sapiens
gcacaaauuuuaccaaucu

SEQ ID NO: 1117183 - RNA, 19 nt, Homo sapiens
gaagugcuuuaagagaauu

SEQ ID NO: 1117184 - RNA, 19 nt, Homo sapiens
uaacaagacccaggagaaa

SEQ ID NO: 1117185 - RNA, 19 nt, Homo sapiens
aaacugucuugucuacuuu

SEQ ID NO: 1117186 - RNA, 19 nt, Homo sapiens
aauaucagcucauagaaag

SEQ ID NO: 1117187 - RNA, 19 nt, Homo sapiens
cgacaacccuccgguguuc

SEQ ID NO: 1117188 - RNA, 19 nt, Homo sapiens
ucaagauacuggugauuca

SEQ ID NO: 1117189 - RNA, 19 nt, Homo sapiens
gauacacaaccuucucuaa

SEQ ID NO: 1117190 - RNA, 19 nt, Homo sapiens
uaccuagagugaacuuuaa

SEQ ID NO: 1117191 - RNA, 19 nt, Homo sapiens
uaagacuccugaaauauac

SEQ ID NO: 1117192 - RNA, 19 nt, Homo sapiens
ugcuaagacuccugaaaua

SEQ ID NO: 1117193 - RNA, 19 nt, Homo sapiens
guaacaagacccaggagaa

SEQ ID NO: 1117194 - RNA, 19 nt, Homo sapiens
gggcgcauguaguuuggua

SEQ ID NO: 1117195 - RNA, 19 nt, Homo sapiens
agaacgcgcugguguccua

SEQ ID NO: 1117196 - RNA, 19 nt, Homo sapiens
gaaauuaccagaaaacguu

SEQ ID NO: 1117197 - RNA, 19 nt, Homo sapiens
cuucagcucugcaggauug

SEQ ID NO: 1117198 - RNA, 19 nt, Homo sapiens
aaucugaccucuuugaagu

SEQ ID NO: 1117199 - RNA, 19 nt, Homo sapiens
gcuucauucucccauauuu

SEQ ID NO: 1117200 - RNA, 19 nt, Homo sapiens
gguaugcgagugccagaua

SEQ ID NO: 1117201 - RNA, 19 nt, Homo sapiens
gaagugcuuuccaauccau

SEQ ID NO: 1117202 - RNA, 19 nt, Homo sapiens
gacaucuacugcuguuuau

SEQ ID NO: 1117203 - RNA, 19 nt, Homo sapiens
agaauugccugaaacaucu

SEQ ID NO: 1117204 - RNA, 19 nt, Homo sapiens
guccugugcucacuuuauu

SEQ ID NO: 1117205 - RNA, 19 nt, Homo sapiens
ccuaugagcuggugguuac

SEQ ID NO: 1117206 - RNA, 19 nt, Homo sapiens
uguccaccuucaagaauua

SEQ ID NO: 1117207 - RNA, 19 nt, Homo sapiens
ucacgguacuggacaacaa

SEQ ID NO: 1117208 - RNA, 19 nt, Homo sapiens
gguaaaaccucuuggacuu

SEQ ID NO: 1117209 - RNA, 19 nt, Homo sapiens
gcgaagugcuuuccaaucc

SEQ ID NO: 1117210 - RNA, 19 nt, Homo sapiens
caacuauuaccuagaguga

SEQ ID NO: 1117211 - RNA, 19 nt, Homo sapiens
uaagagaauugccugaaac

SEQ ID NO: 1117212 - RNA, 19 nt, Homo sapiens
uuaccuagagugaacuuua

SEQ ID NO: 1117213 - RNA, 19 nt, Homo sapiens
auaacacucugaauugcua

SEQ ID NO: 1117214 - RNA, 19 nt, Homo sapiens
gaaaguagagcacacaaga

SEQ ID NO: 1117215 - RNA, 19 nt, Homo sapiens
ugacaaugcuccacaguug

SEQ ID NO: 1117216 - RNA, 19 nt, Homo sapiens
caucuacugcuguuuauua

SEQ ID NO: 1117217 - RNA, 19 nt, Homo sapiens
agaacgcccugcucacuua

SEQ ID NO: 1117218 - RNA, 19 nt, Homo sapiens
cgacaucuacugcuguuua

SEQ ID NO: 1117219 - RNA, 19 nt, Homo sapiens
ggagucaacggacagguua

SEQ ID NO: 1117220 - RNA, 19 nt, Homo sapiens
gaaaggccgcugcagguuu

SEQ ID NO: 1117221 - RNA, 19 nt, Homo sapiens
guacaguucuuguggaagu

SEQ ID NO: 1117222 - RNA, 19 nt, Homo sapiens
ugaaggacauuaacgacaa

SEQ ID NO: 1117223 - RNA, 19 nt, Homo sapiens
ggagguaaaucugcagaau

SEQ ID NO: 1117224 - RNA, 19 nt, Homo sapiens
ggacuuguauuacggaaac

SEQ ID NO: 1117225 - RNA, 19 nt, Homo sapiens
acgcguggcuuucguauga

SEQ ID NO: 1117226 - RNA, 19 nt, Homo sapiens
ugauguuucuccagauaua

SEQ ID NO: 1117227 - RNA, 19 nt, Homo sapiens
gacuggcaccguucaauua

SEQ ID NO: 1117228 - RNA, 19 nt, Homo sapiens
cuccggagcuucauuuauu

SEQ ID NO: 1117229 - RNA, 19 nt, Homo sapiens
agaccgagcugguggaugu

SEQ ID NO: 1117230 - RNA, 19 nt, Homo sapiens
gaagguacgugcaguugac

SEQ ID NO: 1117231 - RNA, 19 nt, Homo sapiens
cagacaaugugagucauaa

SEQ ID NO: 1117232 - RNA, 19 nt, Homo sapiens
cgacaacccuccgguguuc

SEQ ID NO: 1117233 - RNA, 19 nt, Homo sapiens
gggcgcauguaguuuggua

SEQ ID NO: 1117234 - RNA, 19 nt, Homo sapiens
agaacgcgcugguguccua

SEQ ID NO: 1117235 - RNA, 19 nt, Homo sapiens
gaaauuaccagaaaacguu

SEQ ID NO: 1117236 - RNA, 19 nt, Homo sapiens
ccuaugagcuggugguuac

SEQ ID NO: 1117237 - RNA, 19 nt, Homo sapiens
uguccaccuucaagaauua

SEQ ID NO: 1117238 - RNA, 19 nt, Homo sapiens
ucacgguacuggacaacaa

SEQ ID NO: 1117239 - RNA, 19 nt, Homo sapiens
gguaaaaccucuuggacuu

SEQ ID NO: 1117240 - RNA, 19 nt, Homo sapiens
gacaucuacugcuguuuau

SEQ ID NO: 1117241 - RNA, 19 nt, Homo sapiens
gcuguacacuggugagauc

SEQ ID NO: 1117242 - RNA, 19 nt, Homo sapiens
ucggaacgcuggugauuca

SEQ ID NO: 1117243 - RNA, 19 nt, Homo sapiens
cagguaccgucaucacauu

SEQ ID NO: 1117244 - RNA, 19 nt, Homo sapiens
ugauaggacauauggauuu

SEQ ID NO: 1117245 - RNA, 19 nt, Homo sapiens
ggcuaaacauggcaacuuc

SEQ ID NO: 1117246 - RNA, 19 nt, Homo sapiens
ggauguaaaugacaaugcu

SEQ ID NO: 1117247 - RNA, 19 nt, Homo sapiens
gggauauuauuuacuccuu

SEQ ID NO: 1117248 - RNA, 19 nt, Homo sapiens
agaagaaacuccggagcuu

SEQ ID NO: 1117249 - RNA, 19 nt, Homo sapiens
gacaaugugagucauaaau

SEQ ID NO: 1117250 - RNA, 19 nt, Homo sapiens
gaagaaaguagagcacaca

SEQ ID NO: 1117251 - RNA, 19 nt, Homo sapiens
gggaucuucuggagguaaa

SEQ ID NO: 1117252 - RNA, 19 nt, Homo sapiens
gaggccagcuccacuacuc

SEQ ID NO: 1117253 - RNA, 19 nt, Homo sapiens
ggaaguuguggauguaaau

SEQ ID NO: 1117254 - RNA, 19 nt, Homo sapiens
acggugaaauuaccagaaa

SEQ ID NO: 1117255 - RNA, 19 nt, Homo sapiens
ggaaaggccgcugcagguu

SEQ ID NO: 1117256 - RNA, 19 nt, Homo sapiens
ucacauugauuagcguguu

SEQ ID NO: 1117257 - RNA, 19 nt, Homo sapiens
gcuccacaguugacucuca

SEQ ID NO: 1117258 - RNA, 19 nt, Homo sapiens
agugauguuucuccagaua

SEQ ID NO: 1117259 - RNA, 19 nt, Homo sapiens
gagguaaaucugcagaaug

SEQ ID NO: 1117260 - RNA, 19 nt, Homo sapiens
gauaggacauauggauuuu

SEQ ID NO: 1117261 - RNA, 19 nt, Homo sapiens
aaacuccggagcuucauuu

SEQ ID NO: 1117262 - RNA, 19 nt, Homo sapiens
gaaacuccggagcuucauu

SEQ ID NO: 1117263 - RNA, 19 nt, Homo sapiens
gagaacgcccugcucacuu

SEQ ID NO: 1117264 - RNA, 19 nt, Homo sapiens
gaaggacauuaacgacaac

SEQ ID NO: 1117265 - RNA, 19 nt, Homo sapiens
cuacagacaaugugaguca

SEQ ID NO: 1117266 - RNA, 19 nt, Homo sapiens
gcgcauguaguuugguaaa

SEQ ID NO: 1117267 - RNA, 19 nt, Homo sapiens
cgacacgagcccuagauga

SEQ ID NO: 1117268 - RNA, 19 nt, Homo sapiens
cacauugauuagcguguuu

SEQ ID NO: 1117269 - RNA, 19 nt, Homo sapiens
gcuggucauuguacaguuc

SEQ ID NO: 1117270 - RNA, 19 nt, Homo sapiens
agguaaaucugcagaaugg

SEQ ID NO: 1117271 - RNA, 19 nt, Homo sapiens
ugacuggcaccguucaauu

SEQ ID NO: 1117272 - RNA, 19 nt, Homo sapiens
ccgcuugacucucgguuuc

SEQ ID NO: 1117273 - RNA, 19 nt, Homo sapiens
acaaaggaaucuguucauc

SEQ ID NO: 1117274 - RNA, 19 nt, Homo sapiens
gcauguaguuugguaaagc

SEQ ID NO: 1117275 - RNA, 19 nt, Homo sapiens
gaggacgcccaaccaggua

SEQ ID NO: 1117276 - RNA, 19 nt, Homo sapiens
gagaguguguccgccuaug

SEQ ID NO: 1117277 - RNA, 19 nt, Homo sapiens
guguccaccuucaagaauu

SEQ ID NO: 1117278 - RNA, 19 nt, Homo sapiens
ugccucagauuuagacgaa

SEQ ID NO: 1117279 - RNA, 19 nt, Homo sapiens
gccgacaucuacugcuguu

SEQ ID NO: 1117280 - RNA, 19 nt, Homo sapiens
uggaaguuguggauguaaa

SEQ ID NO: 1117281 - RNA, 19 nt, Homo sapiens
cgacacaaaggaaucuguu

SEQ ID NO: 1117282 - RNA, 19 nt, Homo sapiens
ccaaccagguaccgucauc

SEQ ID NO: 1117283 - RNA, 19 nt, Homo sapiens
gacaaugcuccacaguuga

SEQ ID NO: 1117284 - RNA, 19 nt, Homo sapiens
gaaguuguggauguaaaug

SEQ ID NO: 1117285 - RNA, 19 nt, Homo sapiens
uguggaaguuguggaugua

SEQ ID NO: 1117286 - RNA, 19 nt, Homo sapiens
gguccauccucuacagaca

SEQ ID NO: 1117287 - RNA, 19 nt, Homo sapiens
gaaagcggccaggcaccaa

SEQ ID NO: 1117288 - RNA, 19 nt, Homo sapiens
aguauacgguguucgugaa

SEQ ID NO: 1117289 - RNA, 19 nt, Homo sapiens
acagacaaugugagucaua

SEQ ID NO: 1117290 - RNA, 19 nt, Homo sapiens
ugagggcgcauguaguuug

SEQ ID NO: 1117291 - RNA, 19 nt, Homo sapiens
gcacgacacgagcccuaga

SEQ ID NO: 1117292 - RNA, 19 nt, Homo sapiens
ggagaacgcccugcucacu

SEQ ID NO: 1117293 - RNA, 19 nt, Homo sapiens
acacaaaggaaucuguuca

SEQ ID NO: 1117294 - RNA, 19 nt, Homo sapiens
gacacgagcccuagaugag

SEQ ID NO: 1117295 - RNA, 19 nt, Homo sapiens
gcgaagguacgugcaguug

SEQ ID NO: 1117296 - RNA, 19 nt, Homo sapiens
gcugccacaucuucacugu

SEQ ID NO: 1117297 - RNA, 19 nt, Homo sapiens
cccaaugccucagauuuag

SEQ ID NO: 1117298 - RNA, 19 nt, Homo sapiens
gugauaggacauauggauu

SEQ ID NO: 1117299 - RNA, 19 nt, Homo sapiens
gauguuucuccagauauaa

SEQ ID NO: 1117300 - RNA, 19 nt, Homo sapiens
gaauggggauauuauuuac

SEQ ID NO: 1117301 - RNA, 19 nt, Homo sapiens
guacuggacaacaaugaca

SEQ ID NO: 1117302 - RNA, 19 nt, Homo sapiens
ccagcaaccagcagguaaa

SEQ ID NO: 1117303 - RNA, 19 nt, Homo sapiens
gagggcgcauguaguuugg

SEQ ID NO: 1117304 - RNA, 19 nt, Homo sapiens
ucugagggcgcauguaguu

SEQ ID NO: 1117305 - RNA, 19 nt, Homo sapiens
ugguggaugucaacgugua

SEQ ID NO: 1117306 - RNA, 19 nt, Homo sapiens
cgaagguacgugcaguuga

SEQ ID NO: 1117307 - RNA, 19 nt, Homo sapiens
gcauuuuguuugugaauuc

SEQ ID NO: 1117308 - RNA, 19 nt, Homo sapiens
aaaggccgcugcagguuuu

SEQ ID NO: 1117309 - RNA, 19 nt, Homo sapiens
gacucucgguuuccacuag

SEQ ID NO: 1117310 - RNA, 19 nt, Homo sapiens
uccagucuguuggugcuua

SEQ ID NO: 1117311 - RNA, 19 nt, Homo sapiens
uaggacauauggauuuuga

SEQ ID NO: 1117312 - RNA, 19 nt, Homo sapiens
uaucggaacgcuggugauu

SEQ ID NO: 1117313 - RNA, 19 nt, Homo sapiens
aagaaacuccggagcuuca

SEQ ID NO: 1117314 - RNA, 19 nt, Homo sapiens
gaacaaagagugcugauuu

SEQ ID NO: 1117315 - RNA, 19 nt, Homo sapiens
gcaaaucucucccauguag

SEQ ID NO: 1117316 - RNA, 19 nt, Homo sapiens
guaggagucuguuauuuaa

SEQ ID NO: 1117317 - RNA, 19 nt, Homo sapiens
aaucacagcuuuacucuuu

SEQ ID NO: 1117318 - RNA, 19 nt, Homo sapiens
caacacaugugaaccauug

SEQ ID NO: 1117319 - RNA, 19 nt, Homo sapiens
gaucauugcugcuacagaa

SEQ ID NO: 1117320 - RNA, 19 nt, Homo sapiens
aagcagaucugauguguuu

SEQ ID NO: 1117321 - RNA, 19 nt, Homo sapiens
gauguuaccugaaaucaau

SEQ ID NO: 1117322 - RNA, 19 nt, Homo sapiens
caaauuccaucuuaaccua

SEQ ID NO: 1117323 - RNA, 19 nt, Homo sapiens
cuacagaagugcuuuaaga

SEQ ID NO: 1117324 - RNA, 19 nt, Homo sapiens
caaauugggcucuuauuaa

SEQ ID NO: 1117325 - RNA, 19 nt, Homo sapiens
gaucugauguguuuccuau

SEQ ID NO: 1117326 - RNA, 19 nt, Homo sapiens
ggaccagacuuucuaaauc

SEQ ID NO: 1117327 - RNA, 19 nt, Homo sapiens
gaacaacaguuaucagacu

SEQ ID NO: 1117328 - RNA, 19 nt, Homo sapiens
gguaggagucuguuauuua

SEQ ID NO: 1117329 - RNA, 19 nt, Homo sapiens
gaacgcauuuaacagguuu

SEQ ID NO: 1117330 - RNA, 19 nt, Homo sapiens
agagugaacuuuaagcuuu

SEQ ID NO: 1117331 - RNA, 19 nt, Homo sapiens
gagugaacuuuaagcuuua

SEQ ID NO: 1117332 - RNA, 19 nt, Homo sapiens
ugaaaucaaucucccauau

SEQ ID NO: 1117333 - RNA, 19 nt, Homo sapiens
acaauuaugugcacuuuga

SEQ ID NO: 1117334 - RNA, 19 nt, Homo sapiens
cagaagugcuuuaagagaa

SEQ ID NO: 1117335 - RNA, 19 nt, Homo sapiens
uuaccaaucugaccucuuu

SEQ ID NO: 1117336 - RNA, 19 nt, Homo sapiens
ggauaaagcuguuuuguuc

SEQ ID NO: 1117337 - RNA, 19 nt, Homo sapiens
uaaacaaauugggcucuua

SEQ ID NO: 1117338 - RNA, 19 nt, Homo sapiens
ugacaacagugaccaguga

SEQ ID NO: 1117339 - RNA, 19 nt, Homo sapiens
aacaaagagugcugauuua

SEQ ID NO: 1117340 - RNA, 19 nt, Homo sapiens
cuaagacuccugaaauaua

SEQ ID NO: 1117341 - RNA, 19 nt, Homo sapiens
cagcggaaguuaucaguau

SEQ ID NO: 1117342 - RNA, 19 nt, Homo sapiens
ccuaugauguuaccugaaa

SEQ ID NO: 1117343 - RNA, 19 nt, Homo sapiens
cgaacagucugaauacgaa

SEQ ID NO: 1117344 - RNA, 19 nt, Homo sapiens
uggcucaaauuccaucuua

SEQ ID NO: 1117345 - RNA, 19 nt, Homo sapiens
gaccagacuuucuaaaucu

SEQ ID NO: 1117346 - RNA, 19 nt, Homo sapiens
agcaacagcuggaccuuua

SEQ ID NO: 1117347 - RNA, 19 nt, Homo sapiens
acaaauugggcucuuauua

SEQ ID NO: 1117348 - RNA, 19 nt, Homo sapiens
gagaaucgggcuaauuuau

SEQ ID NO: 1117349 - RNA, 19 nt, Homo sapiens
ugaaauaucagcucauaga

SEQ ID NO: 1117350 - RNA, 19 nt, Homo sapiens
gcacacaauguuuaugaaa

SEQ ID NO: 1117351 - RNA, 19 nt, Homo sapiens
guacaaggaaggcaagaaa

SEQ ID NO: 1117352 - RNA, 19 nt, Homo sapiens
aaagagugcugauuuacga

SEQ ID NO: 1117353 - RNA, 19 nt, Homo sapiens
ggagaaucgggcuaauuua

SEQ ID NO: 1117354 - RNA, 19 nt, Homo sapiens
gcucauagaaaguaacaaa

SEQ ID NO: 1117355 - RNA, 19 nt, Homo sapiens
gcaauucccugcuccuuuu

SEQ ID NO: 1117356 - RNA, 19 nt, Homo sapiens
ggagguaaaucugcagaau

SEQ ID NO: 1117357 - RNA, 19 nt, Homo sapiens
gguauuuccucuguuauug

SEQ ID NO: 1117358 - RNA, 19 nt, Homo sapiens
uggcaaaucucucccaugu

SEQ ID NO: 1117359 - RNA, 19 nt, Homo sapiens
gacaacggaacaacaguua

SEQ ID NO: 1117360 - RNA, 19 nt, Homo sapiens
aaaauuugcugucaccuua

SEQ ID NO: 1117361 - RNA, 19 nt, Homo sapiens
gaaauaucagcucauagaa

SEQ ID NO: 1117362 - RNA, 19 nt, Homo sapiens
ggaaugaauacugacaaua

SEQ ID NO: 1117363 - RNA, 19 nt, Homo sapiens
gggaauggauaaagcuguu

SEQ ID NO: 1117364 - RNA, 19 nt, Homo sapiens
aaaucaaucucccauaugu

SEQ ID NO: 1117365 - RNA, 19 nt, Homo sapiens
gaaaucaaucucccauaug

SEQ ID NO: 1117366 - RNA, 19 nt, Homo sapiens
aagagaaagucuauagcua

SEQ ID NO: 1117367 - RNA, 19 nt, Homo sapiens
gaaaguucccugugucugu

SEQ ID NO: 1117368 - RNA, 19 nt, Homo sapiens
acgcguggcuuucguauga

SEQ ID NO: 1117369 - RNA, 19 nt, Homo sapiens
gcccauguaucugaccuua

SEQ ID NO: 1117370 - RNA, 19 nt, Homo sapiens
caaauaaacagcggaaguu

SEQ ID NO: 1117371 - RNA, 19 nt, Homo sapiens
agaggaggcuggcauucua

SEQ ID NO: 1117372 - RNA, 19 nt, Homo sapiens
ugaagacgcucaauuuggu

SEQ ID NO: 1117373 - RNA, 19 nt, Homo sapiens
gcaagggaauggauaaagc

SEQ ID NO: 1117374 - RNA, 19 nt, Homo sapiens
ccucuugcauguauuacua

SEQ ID NO: 1117375 - RNA, 19 nt, Homo sapiens
gccugaaacaucuguauua

SEQ ID NO: 1117376 - RNA, 19 nt, Homo sapiens
gagaauugccugaaacauc

SEQ ID NO: 1117377 - RNA, 19 nt, Homo sapiens
uuaagagaauugccugaaa

SEQ ID NO: 1117378 - RNA, 19 nt, Homo sapiens
uaaagucuguuggcuguga

SEQ ID NO: 1117379 - RNA, 19 nt, Homo sapiens
ggagguggccgacaugaau

SEQ ID NO: 1117380 - RNA, 19 nt, Homo sapiens
gggcaaaccugagcucaca

SEQ ID NO: 1117381 - RNA, 19 nt, Homo sapiens
gauguuggcucaaauucca

SEQ ID NO: 1117382 - RNA, 19 nt, Homo sapiens
gcacaaauuuuaccaaucu

SEQ ID NO: 1117383 - RNA, 19 nt, Homo sapiens
gaagugcuuuaagagaauu

SEQ ID NO: 1117384 - RNA, 19 nt, Homo sapiens
uaacaagacccaggagaaa

SEQ ID NO: 1117385 - RNA, 19 nt, Homo sapiens
aaacugucuugucuacuuu

SEQ ID NO: 1117386 - RNA, 19 nt, Homo sapiens
aauaucagcucauagaaag

SEQ ID NO: 1117387 - RNA, 19 nt, Homo sapiens
ucaagauacuggugauuca

SEQ ID NO: 1117388 - RNA, 19 nt, Homo sapiens
gauacacaaccuucucuaa

SEQ ID NO: 1117389 - RNA, 19 nt, Homo sapiens
uaccuagagugaacuuuaa

SEQ ID NO: 1117390 - RNA, 19 nt, Homo sapiens
uaagacuccugaaauauac

SEQ ID NO: 1117391 - RNA, 19 nt, Homo sapiens
ugcuaagacuccugaaaua

SEQ ID NO: 1117392 - RNA, 19 nt, Homo sapiens
guaacaagacccaggagaa

SEQ ID NO: 1117393 - RNA, 19 nt, Homo sapiens
agaacgcgcugguguccua

SEQ ID NO: 1117394 - RNA, 19 nt, Homo sapiens
cuucagcucugcaggauug

SEQ ID NO: 1117395 - RNA, 19 nt, Homo sapiens
aaucugaccucuuugaagu

SEQ ID NO: 1117396 - RNA, 19 nt, Homo sapiens
gcagauguuggcucaaauu

SEQ ID NO: 1117397 - RNA, 19 nt, Homo sapiens
gcuucauucucccauauuu

SEQ ID NO: 1117398 - RNA, 19 nt, Homo sapiens
gguaugcgagugccagaua

SEQ ID NO: 1117399 - RNA, 19 nt, Homo sapiens
gaggauagauugggaaagc

SEQ ID NO: 1117400 - RNA, 19 nt, Homo sapiens
gaagugcuuuccaauccau

SEQ ID NO: 1117401 - RNA, 19 nt, Homo sapiens
ugagggacauuaacgacaa

SEQ ID NO: 1117402 - RNA, 19 nt, Homo sapiens
ggaaauaaaaccagaggua

SEQ ID NO: 1117403 - RNA, 19 nt, Homo sapiens
agaauugccugaaacaucu

SEQ ID NO: 1117404 - RNA, 19 nt, Homo sapiens
guccugugcucacuuuauu

SEQ ID NO: 1117405 - RNA, 19 nt, Homo sapiens
uguccaccuucaagaauua

SEQ ID NO: 1117406 - RNA, 19 nt, Homo sapiens
gcgaagugcuuuccaaucc

SEQ ID NO: 1117407 - RNA, 19 nt, Homo sapiens
caacuauuaccuagaguga

SEQ ID NO: 1117408 - RNA, 19 nt, Homo sapiens
uaagagaauugccugaaac

SEQ ID NO: 1117409 - RNA, 19 nt, Homo sapiens
uuaccuagagugaacuuua

SEQ ID NO: 1117410 - RNA, 19 nt, Homo sapiens
auaacacucugaauugcua

SEQ ID NO: 1117411 - RNA, 19 nt, Homo sapiens
gaucagcaguggccaacag

SEQ ID NO: 1117412 - RNA, 19 nt, Homo sapiens
uaacgucccugagauagca

SEQ ID NO: 1117413 - RNA, 19 nt, Homo sapiens
gaaauacgggagaaauagu

SEQ ID NO: 1117414 - RNA, 19 nt, Homo sapiens
gaacaaagagugcugauuu

SEQ ID NO: 1117415 - RNA, 19 nt, Homo sapiens
caaauuccaucuuaaccua

SEQ ID NO: 1117416 - RNA, 19 nt, Homo sapiens
caaauugggcucuuauuaa

SEQ ID NO: 1117417 - RNA, 19 nt, Homo sapiens
gaacaacaguuaucagacu

SEQ ID NO: 1117418 - RNA, 19 nt, Homo sapiens
uaaacaaauugggcucuua

SEQ ID NO: 1117419 - RNA, 19 nt, Homo sapiens
aacaaagagugcugauuua

SEQ ID NO: 1117420 - RNA, 19 nt, Homo sapiens
cgaacagucugaauacgaa

SEQ ID NO: 1117421 - RNA, 19 nt, Homo sapiens
uggcucaaauuccaucuua

SEQ ID NO: 1117422 - RNA, 19 nt, Homo sapiens
acaaauugggcucuuauua

SEQ ID NO: 1117423 - RNA, 19 nt, Homo sapiens
aaagagugcugauuuacga

SEQ ID NO: 1117424 - RNA, 19 nt, Homo sapiens
ggagguaaaucugcagaau

SEQ ID NO: 1117425 - RNA, 19 nt, Homo sapiens
gacaacggaacaacaguua

SEQ ID NO: 1117426 - RNA, 19 nt, Homo sapiens
acgcguggcuuucguauga

SEQ ID NO: 1117427 - RNA, 19 nt, Homo sapiens
ugaagacgcucaauuuggu

SEQ ID NO: 1117428 - RNA, 19 nt, Homo sapiens
ggagguggccgacaugaau

SEQ ID NO: 1117429 - RNA, 19 nt, Homo sapiens
gggcaaaccugagcucaca

SEQ ID NO: 1117430 - RNA, 19 nt, Homo sapiens
gauguuggcucaaauucca

SEQ ID NO: 1117431 - RNA, 19 nt, Homo sapiens
gaucaugaugccaaaguaa

SEQ ID NO: 1117432 - RNA, 19 nt, Homo sapiens
agaacgcgcugguguccua

SEQ ID NO: 1117433 - RNA, 19 nt, Homo sapiens
gcagauguuggcucaaauu

SEQ ID NO: 1117434 - RNA, 19 nt, Homo sapiens
gaggauagauugggaaagc

SEQ ID NO: 1117435 - RNA, 19 nt, Homo sapiens
uguccaccuucaagaauua

SEQ ID NO: 1117436 - RNA, 19 nt, Homo sapiens
ggaaauaaaaccagaggua

SEQ ID NO: 1117437 - RNA, 19 nt, Homo sapiens
ugagggacauuaacgacaa

SEQ ID NO: 1117438 - RNA, 19 nt, Homo sapiens
uaacgucccugagauagca

SEQ ID NO: 1117439 - RNA, 19 nt, Homo sapiens
gaaauacgggagaaauagu

SEQ ID NO: 1117440 - RNA, 19 nt, Homo sapiens
uagcauagaucgaaauacg

SEQ ID NO: 1117441 - RNA, 19 nt, Homo sapiens
agaaauccuuggacagaga

SEQ ID NO: 1117442 - RNA, 19 nt, Homo sapiens
aaagaaauccuuggacaga

SEQ ID NO: 1117443 - RNA, 19 nt, Homo sapiens
gaagacgcucaauuuggua

SEQ ID NO: 1117444 - RNA, 19 nt, Homo sapiens
ugaagaucaugaugccaaa

SEQ ID NO: 1117445 - RNA, 19 nt, Homo sapiens
ugauaaugcucccacuuuc

SEQ ID NO: 1117446 - RNA, 19 nt, Homo sapiens
caucuuaaccuauaaacuc

SEQ ID NO: 1117447 - RNA, 19 nt, Homo sapiens
caacggaacaacaguuauc

SEQ ID NO: 1117448 - RNA, 19 nt, Homo sapiens
cgacaugaaugacaaugcu

SEQ ID NO: 1117449 - RNA, 19 nt, Homo sapiens
agauagcacugacuuccuu

SEQ ID NO: 1117450 - RNA, 19 nt, Homo sapiens
ugauaacgucccugagaua

SEQ ID NO: 1117451 - RNA, 19 nt, Homo sapiens
ucgaaauacgggagaaaua

SEQ ID NO: 1117452 - RNA, 19 nt, Homo sapiens
gcacugacuuccuuauccu

SEQ ID NO: 1117453 - RNA, 19 nt, Homo sapiens
cgaaauacgggagaaauag

SEQ ID NO: 1117454 - RNA, 19 nt, Homo sapiens
uugcagccaugguuauuga

SEQ ID NO: 1117455 - RNA, 19 nt, Homo sapiens
aaacaaauugggcucuuau

SEQ ID NO: 1117456 - RNA, 19 nt, Homo sapiens
ggaacaaagagugcugauu

SEQ ID NO: 1117457 - RNA, 19 nt, Homo sapiens
gagguaaaucugcagaaug

SEQ ID NO: 1117458 - RNA, 19 nt, Homo sapiens
guacugucaucgcccuaau

SEQ ID NO: 1117459 - RNA, 19 nt, Homo sapiens
gcgggucauugcaccguuu

SEQ ID NO: 1117460 - RNA, 19 nt, Homo sapiens
guauuugacaugguguuua

SEQ ID NO: 1117461 - RNA, 19 nt, Homo sapiens
ggaagcuccugcacacaac

SEQ ID NO: 1117462 - RNA, 19 nt, Homo sapiens
gauagcacugacuuccuua

SEQ ID NO: 1117463 - RNA, 19 nt, Homo sapiens
agguaaaucugcagaaugg

SEQ ID NO: 1117464 - RNA, 19 nt, Homo sapiens
agaucaugaugccaaagua

SEQ ID NO: 1117465 - RNA, 19 nt, Homo sapiens
ucaauuugguacugucauc

SEQ ID NO: 1117466 - RNA, 19 nt, Homo sapiens
gcagacaacggaacaacag

SEQ ID NO: 1117467 - RNA, 19 nt, Homo sapiens
guccuauuaugauggguaa

SEQ ID NO: 1117468 - RNA, 19 nt, Homo sapiens
guguccaccuucaagaauu

SEQ ID NO: 1117469 - RNA, 19 nt, Homo sapiens
acugucaucgcccuaauua

SEQ ID NO: 1117470 - RNA, 19 nt, Homo sapiens
gauaacgucccugagauag

SEQ ID NO: 1117471 - RNA, 19 nt, Homo sapiens
ccuuucaccuuguccuauu

SEQ ID NO: 1117472 - RNA, 19 nt, Homo sapiens
gggcaauuucauauucuuu

SEQ ID NO: 1117473 - RNA, 19 nt, Homo sapiens
cggaacaacaguuaucaga

SEQ ID NO: 1117474 - RNA, 19 nt, Homo sapiens
ggaugugaaugauaaugcu

SEQ ID NO: 1117475 - RNA, 19 nt, Homo sapiens
ugcuggaugugaaugauaa

SEQ ID NO: 1117476 - RNA, 19 nt, Homo sapiens
ggauagauugggaaagcaa

SEQ ID NO: 1117477 - RNA, 19 nt, Homo sapiens
gaaauaaaaccagagguau

SEQ ID NO: 1117478 - RNA, 19 nt, Homo sapiens
ucaagaauuacuacucguu

SEQ ID NO: 1117479 - RNA, 19 nt, Homo sapiens
gugaagacgcucaauuugg

SEQ ID NO: 1117480 - RNA, 19 nt, Homo sapiens
aaugauaacgucccugaga

SEQ ID NO: 1117481 - RNA, 19 nt, Homo sapiens
gaauacuucgggcuagaug

SEQ ID NO: 1117482 - RNA, 19 nt, Homo sapiens
gcucaaauuccaucuuaac

SEQ ID NO: 1117483 - RNA, 19 nt, Homo sapiens
gacaggccgcugcagguuu

SEQ ID NO: 1117484 - RNA, 19 nt, Homo sapiens
gaucgaaauacgggagaaa

SEQ ID NO: 1117485 - RNA, 19 nt, Homo sapiens
ugccaaaguaagugaauuu

SEQ ID NO: 1117486 - RNA, 19 nt, Homo sapiens
uauuugacaugguguuuac

SEQ ID NO: 1117487 - RNA, 19 nt, Homo sapiens
cgaaggugcgcgcaguuga

SEQ ID NO: 1117488 - RNA, 19 nt, Homo sapiens
acgugaagacgcucaauuu

SEQ ID NO: 1117489 - RNA, 19 nt, Homo sapiens
gggguaauuuggauuuuga

SEQ ID NO: 1117490 - RNA, 19 nt, Homo sapiens
aaccagagguauuugacau

SEQ ID NO: 1117491 - RNA, 19 nt, Homo sapiens
ggcucaaauuccaucuuaa

SEQ ID NO: 1117492 - RNA, 19 nt, Homo sapiens
ucaccuuguccuauuauga

SEQ ID NO: 1117493 - RNA, 19 nt, Homo sapiens
cgugaagacgcucaauuug

SEQ ID NO: 1117494 - RNA, 19 nt, Homo sapiens
ggcuagaugugaaaauaaa

SEQ ID NO: 1117495 - RNA, 19 nt, Homo sapiens
augcagauguuggcucaaa

SEQ ID NO: 1117496 - RNA, 19 nt, Homo sapiens
ugguggaugucaacgugua

SEQ ID NO: 1117497 - RNA, 19 nt, Homo sapiens
gccuaugaguuggugguaa

SEQ ID NO: 1117498 - RNA, 19 nt, Homo sapiens
cuuucaccuuguccuauua

SEQ ID NO: 1117499 - RNA, 19 nt, Homo sapiens
gcauuuuguuugugaauuc

SEQ ID NO: 1117500 - RNA, 19 nt, Homo sapiens
gguauuugacaugguguuu

SEQ ID NO: 1117501 - RNA, 19 nt, Homo sapiens
gugcuggaugugaaugaua

SEQ ID NO: 1117502 - RNA, 19 nt, Homo sapiens
uggguaaggcggagaauca

SEQ ID NO: 1117503 - RNA, 19 nt, Homo sapiens
uggccgacaugaaugacaa

SEQ ID NO: 1117504 - RNA, 19 nt, Homo sapiens
agacaacggaacaacaguu

SEQ ID NO: 1117505 - RNA, 19 nt, Homo sapiens
caacguguaccugaucauc

SEQ ID NO: 1117506 - RNA, 19 nt, Homo sapiens
ccuaugaguuggugguaac

SEQ ID NO: 1117507 - RNA, 19 nt, Homo sapiens
augauaaugcucccacuuu

SEQ ID NO: 1117508 - RNA, 19 nt, Homo sapiens
acagugaugacaauaaaca

SEQ ID NO: 1117509 - RNA, 19 nt, Homo sapiens
caggauggccuccaaagac

SEQ ID NO: 1117510 - RNA, 19 nt, Homo sapiens
caccuuguccuauuaugau

SEQ ID NO: 1117511 - RNA, 19 nt, Homo sapiens
gagaguggccaggcuccaa

SEQ ID NO: 1117512 - RNA, 19 nt, Homo sapiens
ucaggauggccuccaaaga

SEQ ID NO: 1117513 - RNA, 19 nt, Homo sapiens
gaaaauaaacagugaugac

SEQ ID NO: 1117514 - RNA, 19 nt, Homo sapiens
gaacaaagagugcugauuu

SEQ ID NO: 1117515 - RNA, 19 nt, Homo sapiens
gcaaaucucucccauguag

SEQ ID NO: 1117516 - RNA, 19 nt, Homo sapiens
guaggagucuguuauuuaa

SEQ ID NO: 1117517 - RNA, 19 nt, Homo sapiens
aaucacagcuuuacucuuu

SEQ ID NO: 1117518 - RNA, 19 nt, Homo sapiens
caacacaugugaaccauug

SEQ ID NO: 1117519 - RNA, 19 nt, Homo sapiens
gaucauugcugcuacagaa

SEQ ID NO: 1117520 - RNA, 19 nt, Homo sapiens
aagcagaucugauguguuu

SEQ ID NO: 1117521 - RNA, 19 nt, Homo sapiens
gauguuaccugaaaucaau

SEQ ID NO: 1117522 - RNA, 19 nt, Homo sapiens
caaauuccaucuuaaccua

SEQ ID NO: 1117523 - RNA, 19 nt, Homo sapiens
cuacagaagugcuuuaaga

SEQ ID NO: 1117524 - RNA, 19 nt, Homo sapiens
caaauugggcucuuauuaa

SEQ ID NO: 1117525 - RNA, 19 nt, Homo sapiens
gaucugauguguuuccuau

SEQ ID NO: 1117526 - RNA, 19 nt, Homo sapiens
ggaccagacuuucuaaauc

SEQ ID NO: 1117527 - RNA, 19 nt, Homo sapiens
gaacaacaguuaucagacu

SEQ ID NO: 1117528 - RNA, 19 nt, Homo sapiens
gguaggagucuguuauuua

SEQ ID NO: 1117529 - RNA, 19 nt, Homo sapiens
gaacgcauuuaacagguuu

SEQ ID NO: 1117530 - RNA, 19 nt, Homo sapiens
agagugaacuuuaagcuuu

SEQ ID NO: 1117531 - RNA, 19 nt, Homo sapiens
gagugaacuuuaagcuuua

SEQ ID NO: 1117532 - RNA, 19 nt, Homo sapiens
ugaaaucaaucucccauau

SEQ ID NO: 1117533 - RNA, 19 nt, Homo sapiens
acaauuaugugcacuuuga

SEQ ID NO: 1117534 - RNA, 19 nt, Homo sapiens
cagaagugcuuuaagagaa

SEQ ID NO: 1117535 - RNA, 19 nt, Homo sapiens
uuaccaaucugaccucuuu

SEQ ID NO: 1117536 - RNA, 19 nt, Homo sapiens
ggauaaagcuguuuuguuc

SEQ ID NO: 1117537 - RNA, 19 nt, Homo sapiens
uaaacaaauugggcucuua

SEQ ID NO: 1117538 - RNA, 19 nt, Homo sapiens
ugacaacagugaccaguga

SEQ ID NO: 1117539 - RNA, 19 nt, Homo sapiens
aacaaagagugcugauuua

SEQ ID NO: 1117540 - RNA, 19 nt, Homo sapiens
cuaagacuccugaaauaua

SEQ ID NO: 1117541 - RNA, 19 nt, Homo sapiens
cagcggaaguuaucaguau

SEQ ID NO: 1117542 - RNA, 19 nt, Homo sapiens
ccuaugauguuaccugaaa

SEQ ID NO: 1117543 - RNA, 19 nt, Homo sapiens
cgaacagucugaauacgaa

SEQ ID NO: 1117544 - RNA, 19 nt, Homo sapiens
uggcucaaauuccaucuua

SEQ ID NO: 1117545 - RNA, 19 nt, Homo sapiens
gaccagacuuucuaaaucu

SEQ ID NO: 1117546 - RNA, 19 nt, Homo sapiens
agcaacagcuggaccuuua

SEQ ID NO: 1117547 - RNA, 19 nt, Homo sapiens
acaaauugggcucuuauua

SEQ ID NO: 1117548 - RNA, 19 nt, Homo sapiens
gagaaucgggcuaauuuau

SEQ ID NO: 1117549 - RNA, 19 nt, Homo sapiens
ugaaauaucagcucauaga

SEQ ID NO: 1117550 - RNA, 19 nt, Homo sapiens
gcacacaauguuuaugaaa

SEQ ID NO: 1117551 - RNA, 19 nt, Homo sapiens
guacaaggaaggcaagaaa

SEQ ID NO: 1117552 - RNA, 19 nt, Homo sapiens
aaagagugcugauuuacga

SEQ ID NO: 1117553 - RNA, 19 nt, Homo sapiens
ggagaaucgggcuaauuua

SEQ ID NO: 1117554 - RNA, 19 nt, Homo sapiens
gcucauagaaaguaacaaa

SEQ ID NO: 1117555 - RNA, 19 nt, Homo sapiens
gcaauucccugcuccuuuu

SEQ ID NO: 1117556 - RNA, 19 nt, Homo sapiens
ggagguaaaucugcagaau

SEQ ID NO: 1117557 - RNA, 19 nt, Homo sapiens
gguauuuccucuguuauug

SEQ ID NO: 1117558 - RNA, 19 nt, Homo sapiens
uggcaaaucucucccaugu

SEQ ID NO: 1117559 - RNA, 19 nt, Homo sapiens
gacaacggaacaacaguua

SEQ ID NO: 1117560 - RNA, 19 nt, Homo sapiens
aaaauuugcugucaccuua

SEQ ID NO: 1117561 - RNA, 19 nt, Homo sapiens
gaaauaucagcucauagaa

SEQ ID NO: 1117562 - RNA, 19 nt, Homo sapiens
ggaaugaauacugacaaua

SEQ ID NO: 1117563 - RNA, 19 nt, Homo sapiens
gggaauggauaaagcuguu

SEQ ID NO: 1117564 - RNA, 19 nt, Homo sapiens
aaaucaaucucccauaugu

SEQ ID NO: 1117565 - RNA, 19 nt, Homo sapiens
gaaaucaaucucccauaug

SEQ ID NO: 1117566 - RNA, 19 nt, Homo sapiens
aagagaaagucuauagcua

SEQ ID NO: 1117567 - RNA, 19 nt, Homo sapiens
gaaaguucccugugucugu

SEQ ID NO: 1117568 - RNA, 19 nt, Homo sapiens
gcccauguaucugaccuua

SEQ ID NO: 1117569 - RNA, 19 nt, Homo sapiens
caaauaaacagcggaaguu

SEQ ID NO: 1117570 - RNA, 19 nt, Homo sapiens
agaggaggcuggcauucua

SEQ ID NO: 1117571 - RNA, 19 nt, Homo sapiens
ugaagacgcucaauuuggu

SEQ ID NO: 1117572 - RNA, 19 nt, Homo sapiens
gcaagggaauggauaaagc

SEQ ID NO: 1117573 - RNA, 19 nt, Homo sapiens
ccucuugcauguauuacua

SEQ ID NO: 1117574 - RNA, 19 nt, Homo sapiens
gccugaaacaucuguauua

SEQ ID NO: 1117575 - RNA, 19 nt, Homo sapiens
gagaauugccugaaacauc

SEQ ID NO: 1117576 - RNA, 19 nt, Homo sapiens
uuaagagaauugccugaaa

SEQ ID NO: 1117577 - RNA, 19 nt, Homo sapiens
uaaagucuguuggcuguga

SEQ ID NO: 1117578 - RNA, 19 nt, Homo sapiens
ggagguggccgacaugaau

SEQ ID NO: 1117579 - RNA, 19 nt, Homo sapiens
gggcaaaccugagcucaca

SEQ ID NO: 1117580 - RNA, 19 nt, Homo sapiens
gauguuggcucaaauucca

SEQ ID NO: 1117581 - RNA, 19 nt, Homo sapiens
gcacaaauuuuaccaaucu

SEQ ID NO: 1117582 - RNA, 19 nt, Homo sapiens
gaagugcuuuaagagaauu

SEQ ID NO: 1117583 - RNA, 19 nt, Homo sapiens
uaacaagacccaggagaaa

SEQ ID NO: 1117584 - RNA, 19 nt, Homo sapiens
aaacugucuugucuacuuu

SEQ ID NO: 1117585 - RNA, 19 nt, Homo sapiens
aauaucagcucauagaaag

SEQ ID NO: 1117586 - RNA, 19 nt, Homo sapiens
ucaagauacuggugauuca

SEQ ID NO: 1117587 - RNA, 19 nt, Homo sapiens
gauacacaaccuucucuaa

SEQ ID NO: 1117588 - RNA, 19 nt, Homo sapiens
uaccuagagugaacuuuaa

SEQ ID NO: 1117589 - RNA, 19 nt, Homo sapiens
uaagacuccugaaauauac

SEQ ID NO: 1117590 - RNA, 19 nt, Homo sapiens
ugcuaagacuccugaaaua

SEQ ID NO: 1117591 - RNA, 19 nt, Homo sapiens
guaacaagacccaggagaa

SEQ ID NO: 1117592 - RNA, 19 nt, Homo sapiens
agaacgcgcugguguccua

SEQ ID NO: 1117593 - RNA, 19 nt, Homo sapiens
cuucagcucugcaggauug

SEQ ID NO: 1117594 - RNA, 19 nt, Homo sapiens
aaucugaccucuuugaagu

SEQ ID NO: 1117595 - RNA, 19 nt, Homo sapiens
gcagauguuggcucaaauu

SEQ ID NO: 1117596 - RNA, 19 nt, Homo sapiens
gcuucauucucccauauuu

SEQ ID NO: 1117597 - RNA, 19 nt, Homo sapiens
gguaugcgagugccagaua

SEQ ID NO: 1117598 - RNA, 19 nt, Homo sapiens
gaggauagauugggaaagc

SEQ ID NO: 1117599 - RNA, 19 nt, Homo sapiens
gaagugcuuuccaauccau

SEQ ID NO: 1117600 - RNA, 19 nt, Homo sapiens
ugagggacauuaacgacaa

SEQ ID NO: 1117601 - RNA, 19 nt, Homo sapiens
agaauugccugaaacaucu

SEQ ID NO: 1117602 - RNA, 19 nt, Homo sapiens
guccugugcucacuuuauu

SEQ ID NO: 1117603 - RNA, 19 nt, Homo sapiens
uguccaccuucaagaauua

SEQ ID NO: 1117604 - RNA, 19 nt, Homo sapiens
ggaaauaaaaccagaggua

SEQ ID NO: 1117605 - RNA, 19 nt, Homo sapiens
gcgaagugcuuuccaaucc

SEQ ID NO: 1117606 - RNA, 19 nt, Homo sapiens
caacuauuaccuagaguga

SEQ ID NO: 1117607 - RNA, 19 nt, Homo sapiens
uaagagaauugccugaaac

SEQ ID NO: 1117608 - RNA, 19 nt, Homo sapiens
uuaccuagagugaacuuua

SEQ ID NO: 1117609 - RNA, 19 nt, Homo sapiens
auaacacucugaauugcua

SEQ ID NO: 1117610 - RNA, 19 nt, Homo sapiens
gaucagcaguggccaacag

SEQ ID NO: 1117611 - RNA, 19 nt, Homo sapiens
uaacgucccugagauagca

SEQ ID NO: 1117612 - RNA, 19 nt, Homo sapiens
gaaauacgggagaaauagu

SEQ ID NO: 1117613 - RNA, 19 nt, Homo sapiens
uagcauagaucgaaauacg

SEQ ID NO: 1117614 - RNA, 19 nt, Homo sapiens
gaacaccguuuauuaguga

SEQ ID NO: 1117615 - RNA, 19 nt, Homo sapiens
gcaaaucucucccauguag

SEQ ID NO: 1117616 - RNA, 19 nt, Homo sapiens
guaggagucuguuauuuaa

SEQ ID NO: 1117617 - RNA, 19 nt, Homo sapiens
aaucacagcuuuacucuuu

SEQ ID NO: 1117618 - RNA, 19 nt, Homo sapiens
caacacaugugaaccauug

SEQ ID NO: 1117619 - RNA, 19 nt, Homo sapiens
gaucauugcugcuacagaa

SEQ ID NO: 1117620 - RNA, 19 nt, Homo sapiens
aagcagaucugauguguuu

SEQ ID NO: 1117621 - RNA, 19 nt, Homo sapiens
gauguuaccugaaaucaau

SEQ ID NO: 1117622 - RNA, 19 nt, Homo sapiens
cuacagaagugcuuuaaga

SEQ ID NO: 1117623 - RNA, 19 nt, Homo sapiens
gaucugauguguuuccuau

SEQ ID NO: 1117624 - RNA, 19 nt, Homo sapiens
ggaccagacuuucuaaauc

SEQ ID NO: 1117625 - RNA, 19 nt, Homo sapiens
gguaggagucuguuauuua

SEQ ID NO: 1117626 - RNA, 19 nt, Homo sapiens
gaacgcauuuaacagguuu

SEQ ID NO: 1117627 - RNA, 19 nt, Homo sapiens
acaagaacaccguuuauua

SEQ ID NO: 1117628 - RNA, 19 nt, Homo sapiens
agagugaacuuuaagcuuu

SEQ ID NO: 1117629 - RNA, 19 nt, Homo sapiens
caauugagauacagguuaa

SEQ ID NO: 1117630 - RNA, 19 nt, Homo sapiens
gagugaacuuuaagcuuua

SEQ ID NO: 1117631 - RNA, 19 nt, Homo sapiens
ugaaaucaaucucccauau

SEQ ID NO: 1117632 - RNA, 19 nt, Homo sapiens
acaauuaugugcacuuuga

SEQ ID NO: 1117633 - RNA, 19 nt, Homo sapiens
cagaagugcuuuaagagaa

SEQ ID NO: 1117634 - RNA, 19 nt, Homo sapiens
uuaccaaucugaccucuuu

SEQ ID NO: 1117635 - RNA, 19 nt, Homo sapiens
ggauaaagcuguuuuguuc

SEQ ID NO: 1117636 - RNA, 19 nt, Homo sapiens
ggaaauccuuagauagaga

SEQ ID NO: 1117637 - RNA, 19 nt, Homo sapiens
gggcaucaauaaggaaaua

SEQ ID NO: 1117638 - RNA, 19 nt, Homo sapiens
ugacaacagugaccaguga

SEQ ID NO: 1117639 - RNA, 19 nt, Homo sapiens
ccaagugggacauuaguua

SEQ ID NO: 1117640 - RNA, 19 nt, Homo sapiens
caaaugcacaauugagaua

SEQ ID NO: 1117641 - RNA, 19 nt, Homo sapiens
cuaagacuccugaaauaua

SEQ ID NO: 1117642 - RNA, 19 nt, Homo sapiens
cagcggaaguuaucaguau

SEQ ID NO: 1117643 - RNA, 19 nt, Homo sapiens
ccuaugauguuaccugaaa

SEQ ID NO: 1117644 - RNA, 19 nt, Homo sapiens
gguuaaauccaaacgaaua

SEQ ID NO: 1117645 - RNA, 19 nt, Homo sapiens
gaccagacuuucuaaaucu

SEQ ID NO: 1117646 - RNA, 19 nt, Homo sapiens
agcaacagcuggaccuuua

SEQ ID NO: 1117647 - RNA, 19 nt, Homo sapiens
cagacaagaacaaagauua

SEQ ID NO: 1117648 - RNA, 19 nt, Homo sapiens
gagaaucgggcuaauuuau

SEQ ID NO: 1117649 - RNA, 19 nt, Homo sapiens
ugaaauaucagcucauaga

SEQ ID NO: 1117650 - RNA, 19 nt, Homo sapiens
gcacacaauguuuaugaaa

SEQ ID NO: 1117651 - RNA, 19 nt, Homo sapiens
guacaaggaaggcaagaaa

SEQ ID NO: 1117652 - RNA, 19 nt, Homo sapiens
acgcuuggcuuucguauga

SEQ ID NO: 1117653 - RNA, 19 nt, Homo sapiens
ugaaggacaucaaugacaa

SEQ ID NO: 1117654 - RNA, 19 nt, Homo sapiens
ggagaaucgggcuaauuua

SEQ ID NO: 1117655 - RNA, 19 nt, Homo sapiens
gcucauagaaaguaacaaa

SEQ ID NO: 1117656 - RNA, 19 nt, Homo sapiens
ggagguaaaucugcagaau

SEQ ID NO: 1117657 - RNA, 19 nt, Homo sapiens
gcaauucccugcuccuuuu

SEQ ID NO: 1117658 - RNA, 19 nt, Homo sapiens
caagaacaccguuuauuag

SEQ ID NO: 1117659 - RNA, 19 nt, Homo sapiens
gguauuuccucuguuauug

SEQ ID NO: 1117660 - RNA, 19 nt, Homo sapiens
uggcaaaucucucccaugu

SEQ ID NO: 1117661 - RNA, 19 nt, Homo sapiens
aaaauuugcugucaccuua

SEQ ID NO: 1117662 - RNA, 19 nt, Homo sapiens
gaaauaucagcucauagaa

SEQ ID NO: 1117663 - RNA, 19 nt, Homo sapiens
ggaaugaauacugacaaua

SEQ ID NO: 1117664 - RNA, 19 nt, Homo sapiens
gggaauggauaaagcuguu

SEQ ID NO: 1117665 - RNA, 19 nt, Homo sapiens
aaaucaaucucccauaugu

SEQ ID NO: 1117666 - RNA, 19 nt, Homo sapiens
gaaaucaaucucccauaug

SEQ ID NO: 1117667 - RNA, 19 nt, Homo sapiens
aagagaaagucuauagcua

SEQ ID NO: 1117668 - RNA, 19 nt, Homo sapiens
gaaaguucccugugucugu

SEQ ID NO: 1117669 - RNA, 19 nt, Homo sapiens
ggaacuggauuaugaagac

SEQ ID NO: 1117670 - RNA, 19 nt, Homo sapiens
gcccauguaucugaccuua

SEQ ID NO: 1117671 - RNA, 19 nt, Homo sapiens
caaauaaacagcggaaguu

SEQ ID NO: 1117672 - RNA, 19 nt, Homo sapiens
agaggaggcuggcauucua

SEQ ID NO: 1117673 - RNA, 19 nt, Homo sapiens
cagguuaaauccaaacgaa

SEQ ID NO: 1117674 - RNA, 19 nt, Homo sapiens
gcaagggaauggauaaagc

SEQ ID NO: 1117675 - RNA, 19 nt, Homo sapiens
ccucuugcauguauuacua

SEQ ID NO: 1117676 - RNA, 19 nt, Homo sapiens
gccugaaacaucuguauua

SEQ ID NO: 1117677 - RNA, 19 nt, Homo sapiens
gagaauugccugaaacauc

SEQ ID NO: 1117678 - RNA, 19 nt, Homo sapiens
uuaagagaauugccugaaa

SEQ ID NO: 1117679 - RNA, 19 nt, Homo sapiens
uaaagucuguuggcuguga

SEQ ID NO: 1117680 - RNA, 19 nt, Homo sapiens
gcacaaauuuuaccaaucu

SEQ ID NO: 1117681 - RNA, 19 nt, Homo sapiens
gaagugcuuuaagagaauu

SEQ ID NO: 1117682 - RNA, 19 nt, Homo sapiens
uaacaagacccaggagaaa

SEQ ID NO: 1117683 - RNA, 19 nt, Homo sapiens
aaacugucuugucuacuuu

SEQ ID NO: 1117684 - RNA, 19 nt, Homo sapiens
aauaucagcucauagaaag

SEQ ID NO: 1117685 - RNA, 19 nt, Homo sapiens
ucaagauacuggugauuca

SEQ ID NO: 1117686 - RNA, 19 nt, Homo sapiens
gauacacaaccuucucuaa

SEQ ID NO: 1117687 - RNA, 19 nt, Homo sapiens
ucaggacacuguaaaguag

SEQ ID NO: 1117688 - RNA, 19 nt, Homo sapiens
agugggacauuaguuauua

SEQ ID NO: 1117689 - RNA, 19 nt, Homo sapiens
uaccuagagugaacuuuaa

SEQ ID NO: 1117690 - RNA, 19 nt, Homo sapiens
uaagacuccugaaauauac

SEQ ID NO: 1117691 - RNA, 19 nt, Homo sapiens
ugcuaagacuccugaaaua

SEQ ID NO: 1117692 - RNA, 19 nt, Homo sapiens
guaacaagacccaggagaa

SEQ ID NO: 1117693 - RNA, 19 nt, Homo sapiens
gauacagguuaaauccaaa

SEQ ID NO: 1117694 - RNA, 19 nt, Homo sapiens
cuucagcucugcaggauug

SEQ ID NO: 1117695 - RNA, 19 nt, Homo sapiens
aaucugaccucuuugaagu

SEQ ID NO: 1117696 - RNA, 19 nt, Homo sapiens
gcuucauucucccauauuu

SEQ ID NO: 1117697 - RNA, 19 nt, Homo sapiens
gguaugcgagugccagaua

SEQ ID NO: 1117698 - RNA, 19 nt, Homo sapiens
cgauguaaaguccaaauuu

SEQ ID NO: 1117699 - RNA, 19 nt, Homo sapiens
gaagugcuuuccaauccau

SEQ ID NO: 1117700 - RNA, 19 nt, Homo sapiens
agaauugccugaaacaucu

SEQ ID NO: 1117701 - RNA, 19 nt, Homo sapiens
guccugugcucacuuuauu

SEQ ID NO: 1117702 - RNA, 19 nt, Homo sapiens
uguccaccuucaagaauua

SEQ ID NO: 1117703 - RNA, 19 nt, Homo sapiens
gagaagaaacacaagaaca

SEQ ID NO: 1117704 - RNA, 19 nt, Homo sapiens
gcgaagugcuuuccaaucc

SEQ ID NO: 1117705 - RNA, 19 nt, Homo sapiens
caacuauuaccuagaguga

SEQ ID NO: 1117706 - RNA, 19 nt, Homo sapiens
uaagagaauugccugaaac

SEQ ID NO: 1117707 - RNA, 19 nt, Homo sapiens
uggagcaaaugcacaauug

SEQ ID NO: 1117708 - RNA, 19 nt, Homo sapiens
uuaccuagagugaacuuua

SEQ ID NO: 1117709 - RNA, 19 nt, Homo sapiens
auaacacucugaauugcua

SEQ ID NO: 1117710 - RNA, 19 nt, Homo sapiens
gcaaaugcacaauugagau

SEQ ID NO: 1117711 - RNA, 19 nt, Homo sapiens
gaucagcaguggccaacag

SEQ ID NO: 1117712 - RNA, 19 nt, Homo sapiens
ggaaguggccgacgugaac

SEQ ID NO: 1117713 - RNA, 19 nt, Homo sapiens
caaaugaagaagaaacgaa

SEQ ID NO: 1117714 - RNA, 19 nt, Homo sapiens
gaacaccguuuauuaguga

SEQ ID NO: 1117715 - RNA, 19 nt, Homo sapiens
acaagaacaccguuuauua

SEQ ID NO: 1117716 - RNA, 19 nt, Homo sapiens
caauugagauacagguuaa

SEQ ID NO: 1117717 - RNA, 19 nt, Homo sapiens
ggaaauccuuagauagaga

SEQ ID NO: 1117718 - RNA, 19 nt, Homo sapiens
caacgugaguuuucuaaua

SEQ ID NO: 1117719 - RNA, 19 nt, Homo sapiens
gggcaucaauaaggaaaua

SEQ ID NO: 1117720 - RNA, 19 nt, Homo sapiens
ccaagugggacauuaguua

SEQ ID NO: 1117721 - RNA, 19 nt, Homo sapiens
caaaugcacaauugagaua

SEQ ID NO: 1117722 - RNA, 19 nt, Homo sapiens
gguuaaauccaaacgaaua

SEQ ID NO: 1117723 - RNA, 19 nt, Homo sapiens
cagacaagaacaaagauua

SEQ ID NO: 1117724 - RNA, 19 nt, Homo sapiens
acgcuuggcuuucguauga

SEQ ID NO: 1117725 - RNA, 19 nt, Homo sapiens
ugaaggacaucaaugacaa

SEQ ID NO: 1117726 - RNA, 19 nt, Homo sapiens
caagaacaccguuuauuag

SEQ ID NO: 1117727 - RNA, 19 nt, Homo sapiens
ggagguaaaucugcagaau

SEQ ID NO: 1117728 - RNA, 19 nt, Homo sapiens
ggaacuggauuaugaagac

SEQ ID NO: 1117729 - RNA, 19 nt, Homo sapiens
cagguuaaauccaaacgaa

SEQ ID NO: 1117730 - RNA, 19 nt, Homo sapiens
ucaggacacuguaaaguag

SEQ ID NO: 1117731 - RNA, 19 nt, Homo sapiens
agugggacauuaguuauua

SEQ ID NO: 1117732 - RNA, 19 nt, Homo sapiens
cuacagacaacgugaguuu

SEQ ID NO: 1117733 - RNA, 19 nt, Homo sapiens
gauacagguuaaauccaaa

SEQ ID NO: 1117734 - RNA, 19 nt, Homo sapiens
cgauguaaaguccaaauuu

SEQ ID NO: 1117735 - RNA, 19 nt, Homo sapiens
caucuuucccucccaauuu

SEQ ID NO: 1117736 - RNA, 19 nt, Homo sapiens
uguccaccuucaagaauua

SEQ ID NO: 1117737 - RNA, 19 nt, Homo sapiens
gagaagaaacacaagaaca

SEQ ID NO: 1117738 - RNA, 19 nt, Homo sapiens
uggagcaaaugcacaauug

SEQ ID NO: 1117739 - RNA, 19 nt, Homo sapiens
ggaaguggccgacgugaac

SEQ ID NO: 1117740 - RNA, 19 nt, Homo sapiens
caaaugaagaagaaacgaa

SEQ ID NO: 1117741 - RNA, 19 nt, Homo sapiens
gcaaaugcacaauugagau

SEQ ID NO: 1117742 - RNA, 19 nt, Homo sapiens
agauacagguuaaauccaa

SEQ ID NO: 1117743 - RNA, 19 nt, Homo sapiens
aaugucagauuguuggaaa

SEQ ID NO: 1117744 - RNA, 19 nt, Homo sapiens
guucaguuguugaucaaug

SEQ ID NO: 1117745 - RNA, 19 nt, Homo sapiens
ugaaacuccuggaugugaa

SEQ ID NO: 1117746 - RNA, 19 nt, Homo sapiens
uaauauugaugccauggau

SEQ ID NO: 1117747 - RNA, 19 nt, Homo sapiens
uauuagugauugcaacuga

SEQ ID NO: 1117748 - RNA, 19 nt, Homo sapiens
agaacgcccugguguccua

SEQ ID NO: 1117749 - RNA, 19 nt, Homo sapiens
uagugaaacuccuggaugu

SEQ ID NO: 1117750 - RNA, 19 nt, Homo sapiens
guaaaguaguagugaaacu

SEQ ID NO: 1117751 - RNA, 19 nt, Homo sapiens
uaacagguacaguucaguu

SEQ ID NO: 1117752 - RNA, 19 nt, Homo sapiens
gaaauccuuagauagagaa

SEQ ID NO: 1117753 - RNA, 19 nt, Homo sapiens
acaauugagauacagguua

SEQ ID NO: 1117754 - RNA, 19 nt, Homo sapiens
gcgagagcgugucggucua

SEQ ID NO: 1117755 - RNA, 19 nt, Homo sapiens
ggucccaccucuacagaca

SEQ ID NO: 1117756 - RNA, 19 nt, Homo sapiens
acaguucaguuguugauca

SEQ ID NO: 1117757 - RNA, 19 nt, Homo sapiens
cagguacaguucaguuguu

SEQ ID NO: 1117758 - RNA, 19 nt, Homo sapiens
caacacgcucucuggauga

SEQ ID NO: 1117759 - RNA, 19 nt, Homo sapiens
gcacggucauugcucugau

SEQ ID NO: 1117760 - RNA, 19 nt, Homo sapiens
gaacgccucagaugcagau

SEQ ID NO: 1117761 - RNA, 19 nt, Homo sapiens
agaacaccguuuauuagug

SEQ ID NO: 1117762 - RNA, 19 nt, Homo sapiens
gagguaaaucugcagaaug

SEQ ID NO: 1117763 - RNA, 19 nt, Homo sapiens
caagugggacauuaguuau

SEQ ID NO: 1117764 - RNA, 19 nt, Homo sapiens
uguauuggaugcuaaugau

SEQ ID NO: 1117765 - RNA, 19 nt, Homo sapiens
ugaagaagaaacgaacuuu

SEQ ID NO: 1117766 - RNA, 19 nt, Homo sapiens
cuacaacgcuuggcuuucg

SEQ ID NO: 1117767 - RNA, 19 nt, Homo sapiens
cagcgugucuguggaagug

SEQ ID NO: 1117768 - RNA, 19 nt, Homo sapiens
gugggacauuaguuauuaa

SEQ ID NO: 1117769 - RNA, 19 nt, Homo sapiens
gcaccaagugggacauuag

SEQ ID NO: 1117770 - RNA, 19 nt, Homo sapiens
ggagcaaaugcacaauuga

SEQ ID NO: 1117771 - RNA, 19 nt, Homo sapiens
agguaaaucugcagaaugg

SEQ ID NO: 1117772 - RNA, 19 nt, Homo sapiens
gcagugaaggacaucaaug

SEQ ID NO: 1117773 - RNA, 19 nt, Homo sapiens
gugaaacuccuggauguga

SEQ ID NO: 1117774 - RNA, 19 nt, Homo sapiens
cagugaaggacaucaauga

SEQ ID NO: 1117775 - RNA, 19 nt, Homo sapiens
uagagaagaaacacaagaa

SEQ ID NO: 1117776 - RNA, 19 nt, Homo sapiens
gaagaagaaacgaacuuuu

SEQ ID NO: 1117777 - RNA, 19 nt, Homo sapiens
gagcaaaugcacaauugag

SEQ ID NO: 1117778 - RNA, 19 nt, Homo sapiens
ccacucagcacggucauug

SEQ ID NO: 1117779 - RNA, 19 nt, Homo sapiens
aaaguacauucccauuauc

SEQ ID NO: 1117780 - RNA, 19 nt, Homo sapiens
gaaggacaucaaugacaau

SEQ ID NO: 1117781 - RNA, 19 nt, Homo sapiens
guguccaccuucaagaauu

SEQ ID NO: 1117782 - RNA, 19 nt, Homo sapiens
guacaguucaguuguugau

SEQ ID NO: 1117783 - RNA, 19 nt, Homo sapiens
cacaagaacaccguuuauu

SEQ ID NO: 1117784 - RNA, 19 nt, Homo sapiens
gcgcgucggauuuggauau

SEQ ID NO: 1117785 - RNA, 19 nt, Homo sapiens
gagucaagaaugccagauu

SEQ ID NO: 1117786 - RNA, 19 nt, Homo sapiens
uccuggaugugaaugauaa

SEQ ID NO: 1117787 - RNA, 19 nt, Homo sapiens
gaacuggauuaugaagacu

SEQ ID NO: 1117788 - RNA, 19 nt, Homo sapiens
gaaacuccuggaugugaau

SEQ ID NO: 1117789 - RNA, 19 nt, Homo sapiens
ugauaacgccccagaauuu

SEQ ID NO: 1117790 - RNA, 19 nt, Homo sapiens
guauuggaugcuaaugaua

SEQ ID NO: 1117791 - RNA, 19 nt, Homo sapiens
ucaagaauuacuacucguu

SEQ ID NO: 1117792 - RNA, 19 nt, Homo sapiens
aaagaggacgcuccacuca

SEQ ID NO: 1117793 - RNA, 19 nt, Homo sapiens
gagggcaucaauaaggaaa

SEQ ID NO: 1117794 - RNA, 19 nt, Homo sapiens
acacaagaacaccguuuau

SEQ ID NO: 1117795 - RNA, 19 nt, Homo sapiens
gacaggccgcugcagguuu

SEQ ID NO: 1117796 - RNA, 19 nt, Homo sapiens
ccagacaagaacaaagauu

SEQ ID NO: 1117797 - RNA, 19 nt, Homo sapiens
gcaagcccacucuguugug

SEQ ID NO: 1117798 - RNA, 19 nt, Homo sapiens
cgucggauuuggauauugg

SEQ ID NO: 1117799 - RNA, 19 nt, Homo sapiens
auccuuagauagagaagaa

SEQ ID NO: 1117800 - RNA, 19 nt, Homo sapiens
gugaaggacaucaaugaca

SEQ ID NO: 1117801 - RNA, 19 nt, Homo sapiens
aggacacuguaaaguagua

SEQ ID NO: 1117802 - RNA, 19 nt, Homo sapiens
auauugaugccauggauaa

SEQ ID NO: 1117803 - RNA, 19 nt, Homo sapiens
ugguggaugucaacgugua

SEQ ID NO: 1117804 - RNA, 19 nt, Homo sapiens
caguucaguuguugaucaa

SEQ ID NO: 1117805 - RNA, 19 nt, Homo sapiens
aacacaagaacaccguuua

SEQ ID NO: 1117806 - RNA, 19 nt, Homo sapiens
agauagagaagaaacacaa

SEQ ID NO: 1117807 - RNA, 19 nt, Homo sapiens
ggaugugaaugauaauacc

SEQ ID NO: 1117808 - RNA, 19 nt, Homo sapiens
aaacccgaacuaacaggua

SEQ ID NO: 1117809 - RNA, 19 nt, Homo sapiens
gcauuuuguuugugaauuc

SEQ ID NO: 1117810 - RNA, 19 nt, Homo sapiens
caaacacggaaccuucguu

SEQ ID NO: 1117811 - RNA, 19 nt, Homo sapiens
caacguguaccugaucauc

SEQ ID NO: 1117812 - RNA, 19 nt, Homo sapiens
aggcugcccugguggaugu

SEQ ID NO: 1117813 - RNA, 19 nt, Homo sapiens
gagagcgugucggucuaug

SEQ ID NO: 1117814 - RNA, 19 nt, Homo sapiens
gcacuugacugaccgauua

SEQ ID NO: 1117815 - RNA, 19 nt, Homo sapiens
gaaagcaaauccuaugaaa

SEQ ID NO: 1117816 - RNA, 19 nt, Homo sapiens
gcaaaucucucccauguag

SEQ ID NO: 1117817 - RNA, 19 nt, Homo sapiens
guaggagucuguuauuuaa

SEQ ID NO: 1117818 - RNA, 19 nt, Homo sapiens
aaucacagcuuuacucuuu

SEQ ID NO: 1117819 - RNA, 19 nt, Homo sapiens
caacacaugugaaccauug

SEQ ID NO: 1117820 - RNA, 19 nt, Homo sapiens
gaucauugcugcuacagaa

SEQ ID NO: 1117821 - RNA, 19 nt, Homo sapiens
aagcagaucugauguguuu

SEQ ID NO: 1117822 - RNA, 19 nt, Homo sapiens
gauguuaccugaaaucaau

SEQ ID NO: 1117823 - RNA, 19 nt, Homo sapiens
cuacagaagugcuuuaaga

SEQ ID NO: 1117824 - RNA, 19 nt, Homo sapiens
ggacauuguuuauucauuc

SEQ ID NO: 1117825 - RNA, 19 nt, Homo sapiens
gaucugauguguuuccuau

SEQ ID NO: 1117826 - RNA, 19 nt, Homo sapiens
ggaccagacuuucuaaauc

SEQ ID NO: 1117827 - RNA, 19 nt, Homo sapiens
gguaggagucuguuauuua

SEQ ID NO: 1117828 - RNA, 19 nt, Homo sapiens
gaacgcauuuaacagguuu

SEQ ID NO: 1117829 - RNA, 19 nt, Homo sapiens
agagugaacuuuaagcuuu

SEQ ID NO: 1117830 - RNA, 19 nt, Homo sapiens
ugagggacauuaacgauaa

SEQ ID NO: 1117831 - RNA, 19 nt, Homo sapiens
gagugaacuuuaagcuuua

SEQ ID NO: 1117832 - RNA, 19 nt, Homo sapiens
gaagaaagcaaauccuaug

SEQ ID NO: 1117833 - RNA, 19 nt, Homo sapiens
gagcccaaaugaauacuuu

SEQ ID NO: 1117834 - RNA, 19 nt, Homo sapiens
ugaaaucaaucucccauau

SEQ ID NO: 1117835 - RNA, 19 nt, Homo sapiens
acaauuaugugcacuuuga

SEQ ID NO: 1117836 - RNA, 19 nt, Homo sapiens
cagaagugcuuuaagagaa

SEQ ID NO: 1117837 - RNA, 19 nt, Homo sapiens
uuaccaaucugaccucuuu

SEQ ID NO: 1117838 - RNA, 19 nt, Homo sapiens
ggauaaagcuguuuuguuc

SEQ ID NO: 1117839 - RNA, 19 nt, Homo sapiens
ggaaaucuuuagacagaga

SEQ ID NO: 1117840 - RNA, 19 nt, Homo sapiens
ugacaacagugaccaguga

SEQ ID NO: 1117841 - RNA, 19 nt, Homo sapiens
ucacauagauccaauuacu

SEQ ID NO: 1117842 - RNA, 19 nt, Homo sapiens
agaagaagcuccggagauu

SEQ ID NO: 1117843 - RNA, 19 nt, Homo sapiens
gggcuuauauuacggaaau

SEQ ID NO: 1117844 - RNA, 19 nt, Homo sapiens
agaacgcccugcucacuua

SEQ ID NO: 1117845 - RNA, 19 nt, Homo sapiens
cuaagacuccugaaauaua

SEQ ID NO: 1117846 - RNA, 19 nt, Homo sapiens
cagcggaaguuaucaguau

SEQ ID NO: 1117847 - RNA, 19 nt, Homo sapiens
gcugguggaugucaacgua

SEQ ID NO: 1117848 - RNA, 19 nt, Homo sapiens
ccuaugauguuaccugaaa

SEQ ID NO: 1117849 - RNA, 19 nt, Homo sapiens
gaccagacuuucuaaaucu

SEQ ID NO: 1117850 - RNA, 19 nt, Homo sapiens
agcaacagcuggaccuuua

SEQ ID NO: 1117851 - RNA, 19 nt, Homo sapiens
ggagguggcugaugugaac

SEQ ID NO: 1117852 - RNA, 19 nt, Homo sapiens
aaggugagauuacuagaaa

SEQ ID NO: 1117853 - RNA, 19 nt, Homo sapiens
gagaaucgggcuaauuuau

SEQ ID NO: 1117854 - RNA, 19 nt, Homo sapiens
ugaaauaucagcucauaga

SEQ ID NO: 1117855 - RNA, 19 nt, Homo sapiens
gcacacaauguuuaugaaa

SEQ ID NO: 1117856 - RNA, 19 nt, Homo sapiens
guacaaggaaggcaagaaa

SEQ ID NO: 1117857 - RNA, 19 nt, Homo sapiens
ggagaaucgggcuaauuua

SEQ ID NO: 1117858 - RNA, 19 nt, Homo sapiens
gcucauagaaaguaacaaa

SEQ ID NO: 1117859 - RNA, 19 nt, Homo sapiens
gcaauucccugcuccuuuu

SEQ ID NO: 1117860 - RNA, 19 nt, Homo sapiens
ggaauucaagucuuuauca

SEQ ID NO: 1117861 - RNA, 19 nt, Homo sapiens
ggagguaaaucugcagaau

SEQ ID NO: 1117862 - RNA, 19 nt, Homo sapiens
gguauuuccucuguuauug

SEQ ID NO: 1117863 - RNA, 19 nt, Homo sapiens
uggcaaaucucucccaugu

SEQ ID NO: 1117864 - RNA, 19 nt, Homo sapiens
guaaagggauauauugacu

SEQ ID NO: 1117865 - RNA, 19 nt, Homo sapiens
aaacuuaacgccucagauu

SEQ ID NO: 1117866 - RNA, 19 nt, Homo sapiens
aaaauuugcugucaccuua

SEQ ID NO: 1117867 - RNA, 19 nt, Homo sapiens
gaaauaucagcucauagaa

SEQ ID NO: 1117868 - RNA, 19 nt, Homo sapiens
ggaaugaauacugacaaua

SEQ ID NO: 1117869 - RNA, 19 nt, Homo sapiens
gggaauggauaaagcuguu

SEQ ID NO: 1117870 - RNA, 19 nt, Homo sapiens
aaaucaaucucccauaugu

SEQ ID NO: 1117871 - RNA, 19 nt, Homo sapiens
gaaaucaaucucccauaug

SEQ ID NO: 1117872 - RNA, 19 nt, Homo sapiens
aagagaaagucuauagcua

SEQ ID NO: 1117873 - RNA, 19 nt, Homo sapiens
gaaaguucccugugucugu

SEQ ID NO: 1117874 - RNA, 19 nt, Homo sapiens
gcccauguaucugaccuua

SEQ ID NO: 1117875 - RNA, 19 nt, Homo sapiens
caaauaaacagcggaaguu

SEQ ID NO: 1117876 - RNA, 19 nt, Homo sapiens
agaggaggcuggcauucua

SEQ ID NO: 1117877 - RNA, 19 nt, Homo sapiens
gcaagggaauggauaaagc

SEQ ID NO: 1117878 - RNA, 19 nt, Homo sapiens
ccucuugcauguauuacua

SEQ ID NO: 1117879 - RNA, 19 nt, Homo sapiens
gccugaaacaucuguauua

SEQ ID NO: 1117880 - RNA, 19 nt, Homo sapiens
gagaauugccugaaacauc

SEQ ID NO: 1117881 - RNA, 19 nt, Homo sapiens
uuaagagaauugccugaaa

SEQ ID NO: 1117882 - RNA, 19 nt, Homo sapiens
uaaagucuguuggcuguga

SEQ ID NO: 1117883 - RNA, 19 nt, Homo sapiens
gaagaucagcugcagacaa

SEQ ID NO: 1117884 - RNA, 19 nt, Homo sapiens
acgauaaugucccagauuu

SEQ ID NO: 1117885 - RNA, 19 nt, Homo sapiens
gcacaaauuuuaccaaucu

SEQ ID NO: 1117886 - RNA, 19 nt, Homo sapiens
gaagugcuuuaagagaauu

SEQ ID NO: 1117887 - RNA, 19 nt, Homo sapiens
uaacaagacccaggagaaa

SEQ ID NO: 1117888 - RNA, 19 nt, Homo sapiens
caacguauaccugaucauu

SEQ ID NO: 1117889 - RNA, 19 nt, Homo sapiens
acggaaaucuuuagacaga

SEQ ID NO: 1117890 - RNA, 19 nt, Homo sapiens
agacugagcccaaaugaau

SEQ ID NO: 1117891 - RNA, 19 nt, Homo sapiens
aaacugucuugucuacuuu

SEQ ID NO: 1117892 - RNA, 19 nt, Homo sapiens
aauaucagcucauagaaag

SEQ ID NO: 1117893 - RNA, 19 nt, Homo sapiens
ucaagauacuggugauuca

SEQ ID NO: 1117894 - RNA, 19 nt, Homo sapiens
gauacacaaccuucucuaa

SEQ ID NO: 1117895 - RNA, 19 nt, Homo sapiens
uagaagacaacaacgauaa

SEQ ID NO: 1117896 - RNA, 19 nt, Homo sapiens
uaccuagagugaacuuuaa

SEQ ID NO: 1117897 - RNA, 19 nt, Homo sapiens
uaagacuccugaaauauac

SEQ ID NO: 1117898 - RNA, 19 nt, Homo sapiens
ugcuaagacuccugaaaua

SEQ ID NO: 1117899 - RNA, 19 nt, Homo sapiens
guaacaagacccaggagaa

SEQ ID NO: 1117900 - RNA, 19 nt, Homo sapiens
agaacgcgcugguguccua

SEQ ID NO: 1117901 - RNA, 19 nt, Homo sapiens
ggacagcucccacuuucug

SEQ ID NO: 1117902 - RNA, 19 nt, Homo sapiens
agggauauauugacuuuga

SEQ ID NO: 1117903 - RNA, 19 nt, Homo sapiens
cuucagcucugcaggauug

SEQ ID NO: 1117904 - RNA, 19 nt, Homo sapiens
aaucugaccucuuugaagu

SEQ ID NO: 1117905 - RNA, 19 nt, Homo sapiens
gaagacaacaacgauaaug

SEQ ID NO: 1117906 - RNA, 19 nt, Homo sapiens
guagaagacaacaacgaua

SEQ ID NO: 1117907 - RNA, 19 nt, Homo sapiens
gaagaagcuccggagauuu

SEQ ID NO: 1117908 - RNA, 19 nt, Homo sapiens
gcuucauucucccauauuu

SEQ ID NO: 1117909 - RNA, 19 nt, Homo sapiens
gguaugcgagugccagaua

SEQ ID NO: 1117910 - RNA, 19 nt, Homo sapiens
uuacggaaaucuuuagaca

SEQ ID NO: 1117911 - RNA, 19 nt, Homo sapiens
agauuucccuugacuuuga

SEQ ID NO: 1117912 - RNA, 19 nt, Homo sapiens
gaagugcuuuccaauccau

SEQ ID NO: 1117913 - RNA, 19 nt, Homo sapiens
agaauugccugaaacaucu

SEQ ID NO: 1117914 - RNA, 19 nt, Homo sapiens
gcacuugacugaccgauua

SEQ ID NO: 1117915 - RNA, 19 nt, Homo sapiens
gaaagcaaauccuaugaaa

SEQ ID NO: 1117916 - RNA, 19 nt, Homo sapiens
ggacauuguuuauucauuc

SEQ ID NO: 1117917 - RNA, 19 nt, Homo sapiens
ugagggacauuaacgauaa

SEQ ID NO: 1117918 - RNA, 19 nt, Homo sapiens
gaagaaagcaaauccuaug

SEQ ID NO: 1117919 - RNA, 19 nt, Homo sapiens
gagcccaaaugaauacuuu

SEQ ID NO: 1117920 - RNA, 19 nt, Homo sapiens
ggaaaucuuuagacagaga

SEQ ID NO: 1117921 - RNA, 19 nt, Homo sapiens
ucacauagauccaauuacu

SEQ ID NO: 1117922 - RNA, 19 nt, Homo sapiens
agaagaagcuccggagauu

SEQ ID NO: 1117923 - RNA, 19 nt, Homo sapiens
gggcuuauauuacggaaau

SEQ ID NO: 1117924 - RNA, 19 nt, Homo sapiens
agaacgcccugcucacuua

SEQ ID NO: 1117925 - RNA, 19 nt, Homo sapiens
gcugguggaugucaacgua

SEQ ID NO: 1117926 - RNA, 19 nt, Homo sapiens
ggagguggcugaugugaac

SEQ ID NO: 1117927 - RNA, 19 nt, Homo sapiens
aaggugagauuacuagaaa

SEQ ID NO: 1117928 - RNA, 19 nt, Homo sapiens
ggaauucaagucuuuauca

SEQ ID NO: 1117929 - RNA, 19 nt, Homo sapiens
ggagguaaaucugcagaau

SEQ ID NO: 1117930 - RNA, 19 nt, Homo sapiens
guaaagggauauauugacu

SEQ ID NO: 1117931 - RNA, 19 nt, Homo sapiens
aaacuuaacgccucagauu

SEQ ID NO: 1117932 - RNA, 19 nt, Homo sapiens
gaagaucagcugcagacaa

SEQ ID NO: 1117933 - RNA, 19 nt, Homo sapiens
acgauaaugucccagauuu

SEQ ID NO: 1117934 - RNA, 19 nt, Homo sapiens
caacguauaccugaucauu

SEQ ID NO: 1117935 - RNA, 19 nt, Homo sapiens
acggaaaucuuuagacaga

SEQ ID NO: 1117936 - RNA, 19 nt, Homo sapiens
agacugagcccaaaugaau

SEQ ID NO: 1117937 - RNA, 19 nt, Homo sapiens
uugcaaagguuaguguaua

SEQ ID NO: 1117938 - RNA, 19 nt, Homo sapiens
uagaagacaacaacgauaa

SEQ ID NO: 1117939 - RNA, 19 nt, Homo sapiens
agaacgcgcugguguccua

SEQ ID NO: 1117940 - RNA, 19 nt, Homo sapiens
ggacagcucccacuuucug

SEQ ID NO: 1117941 - RNA, 19 nt, Homo sapiens
agggauauauugacuuuga

SEQ ID NO: 1117942 - RNA, 19 nt, Homo sapiens
gaagacaacaacgauaaug

SEQ ID NO: 1117943 - RNA, 19 nt, Homo sapiens
guagaagacaacaacgaua

SEQ ID NO: 1117944 - RNA, 19 nt, Homo sapiens
gaagaagcuccggagauuu

SEQ ID NO: 1117945 - RNA, 19 nt, Homo sapiens
agauuucccuugacuuuga

SEQ ID NO: 1117946 - RNA, 19 nt, Homo sapiens
uuacggaaaucuuuagaca

SEQ ID NO: 1117947 - RNA, 19 nt, Homo sapiens
ugcaaagguuaguguauaa

SEQ ID NO: 1117948 - RNA, 19 nt, Homo sapiens
uguccaccuucaagaauua

SEQ ID NO: 1117949 - RNA, 19 nt, Homo sapiens
ggaaguagaagacaacaac

SEQ ID NO: 1117950 - RNA, 19 nt, Homo sapiens
ugacagaaccauuuauaag

SEQ ID NO: 1117951 - RNA, 19 nt, Homo sapiens
gagaagaagcuccggagau

SEQ ID NO: 1117952 - RNA, 19 nt, Homo sapiens
gcagacaacugaggaaucc

SEQ ID NO: 1117953 - RNA, 19 nt, Homo sapiens
gggacauuguuuauucauu

SEQ ID NO: 1117954 - RNA, 19 nt, Homo sapiens
caacgauaaugucccagau

SEQ ID NO: 1117955 - RNA, 19 nt, Homo sapiens
acuuaacgccucagauuua

SEQ ID NO: 1117956 - RNA, 19 nt, Homo sapiens
guagaguuauuguggaagu

SEQ ID NO: 1117957 - RNA, 19 nt, Homo sapiens
gcuguacacuggcgagauc

SEQ ID NO: 1117958 - RNA, 19 nt, Homo sapiens
cgccaaaugugaaauccaa

SEQ ID NO: 1117959 - RNA, 19 nt, Homo sapiens
aauccaaguuucacauaga

SEQ ID NO: 1117960 - RNA, 19 nt, Homo sapiens
acagaaccauuuauaaggu

SEQ ID NO: 1117961 - RNA, 19 nt, Homo sapiens
ggaacggucagcuccacua

SEQ ID NO: 1117962 - RNA, 19 nt, Homo sapiens
gggauauauugacuuugaa

SEQ ID NO: 1117963 - RNA, 19 nt, Homo sapiens
gauaaugucccagauuugg

SEQ ID NO: 1117964 - RNA, 19 nt, Homo sapiens
gacagaaccauuuauaagg

SEQ ID NO: 1117965 - RNA, 19 nt, Homo sapiens
gcucacagccacugaugga

SEQ ID NO: 1117966 - RNA, 19 nt, Homo sapiens
ccacugugcuggugucacu

SEQ ID NO: 1117967 - RNA, 19 nt, Homo sapiens
gaauucaagucuuuaucac

SEQ ID NO: 1117968 - RNA, 19 nt, Homo sapiens
gugagggacauuaacgaua

SEQ ID NO: 1117969 - RNA, 19 nt, Homo sapiens
gauuuggaauucaagucuu

SEQ ID NO: 1117970 - RNA, 19 nt, Homo sapiens
caaaugugaaauccaaguu

SEQ ID NO: 1117971 - RNA, 19 nt, Homo sapiens
agauuuagacgaaggauug

SEQ ID NO: 1117972 - RNA, 19 nt, Homo sapiens
cgccucagauuuagacgaa

SEQ ID NO: 1117973 - RNA, 19 nt, Homo sapiens
cugcugcucuuacuucuuc

SEQ ID NO: 1117974 - RNA, 19 nt, Homo sapiens
gagaacgcccugcucacuu

SEQ ID NO: 1117975 - RNA, 19 nt, Homo sapiens
gagguaaaucugcagaaug

SEQ ID NO: 1117976 - RNA, 19 nt, Homo sapiens
uaaggugagauuacuagaa

SEQ ID NO: 1117977 - RNA, 19 nt, Homo sapiens
aagaucagcugcagacaac

SEQ ID NO: 1117978 - RNA, 19 nt, Homo sapiens
ugguggaugucaacguaua

SEQ ID NO: 1117979 - RNA, 19 nt, Homo sapiens
guacagucaucgcccugau

SEQ ID NO: 1117980 - RNA, 19 nt, Homo sapiens
ugaagaaagcaaauccuau

SEQ ID NO: 1117981 - RNA, 19 nt, Homo sapiens
ccgcuugacucucgguuuc

SEQ ID NO: 1117982 - RNA, 19 nt, Homo sapiens
agguaaaucugcagaaugg

SEQ ID NO: 1117983 - RNA, 19 nt, Homo sapiens
uggcugaugugaacgacaa

SEQ ID NO: 1117984 - RNA, 19 nt, Homo sapiens
ccauuuauaaggugagauu

SEQ ID NO: 1117985 - RNA, 19 nt, Homo sapiens
ggucuugggcuuauauuac

SEQ ID NO: 1117986 - RNA, 19 nt, Homo sapiens
gacugagcccaaaugaaua

SEQ ID NO: 1117987 - RNA, 19 nt, Homo sapiens
guguccaccuucaagaauu

SEQ ID NO: 1117988 - RNA, 19 nt, Homo sapiens
uaaaaggucuugggcuuau

SEQ ID NO: 1117989 - RNA, 19 nt, Homo sapiens
acgcguggcuuucguacga

SEQ ID NO: 1117990 - RNA, 19 nt, Homo sapiens
cuuuaucacuuccaauuag

SEQ ID NO: 1117991 - RNA, 19 nt, Homo sapiens
uagaaaauguuccuaaugg

SEQ ID NO: 1117992 - RNA, 19 nt, Homo sapiens
agaaagcaaauccuaugaa

SEQ ID NO: 1117993 - RNA, 19 nt, Homo sapiens
ucaagaauuacuacucguu

SEQ ID NO: 1117994 - RNA, 19 nt, Homo sapiens
gaguuauuguggaaguaga

SEQ ID NO: 1117995 - RNA, 19 nt, Homo sapiens
ucuggccauuguagaguua

SEQ ID NO: 1117996 - RNA, 19 nt, Homo sapiens
gaucagcugcagacaacug

SEQ ID NO: 1117997 - RNA, 19 nt, Homo sapiens
gacaggccgcugcagguuu

SEQ ID NO: 1117998 - RNA, 19 nt, Homo sapiens
uagaguuauuguggaagua

SEQ ID NO: 1117999 - RNA, 19 nt, Homo sapiens
gaaaucuuuagacagagaa

SEQ ID NO: 1118000 - RNA, 19 nt, Homo sapiens
ggagaacgcccugcucacu

SEQ ID NO: 1118001 - RNA, 19 nt, Homo sapiens
gcugccacaucuucacugu

SEQ ID NO: 1118002 - RNA, 19 nt, Homo sapiens
ucccagauuuggaauucaa

SEQ ID NO: 1118003 - RNA, 19 nt, Homo sapiens
uaaugucccagauuuggaa

SEQ ID NO: 1118004 - RNA, 19 nt, Homo sapiens
acaaaauacugugcacuaa

SEQ ID NO: 1118005 - RNA, 19 nt, Homo sapiens
aaauccaaguuucacauag

SEQ ID NO: 1118006 - RNA, 19 nt, Homo sapiens
gaggccuucuggagguaaa

SEQ ID NO: 1118007 - RNA, 19 nt, Homo sapiens
guagagggcauugauaagg

SEQ ID NO: 1118008 - RNA, 19 nt, Homo sapiens
gagcuacguuucggugcau

SEQ ID NO: 1118009 - RNA, 19 nt, Homo sapiens
aagaaagcaaauccuauga

SEQ ID NO: 1118010 - RNA, 19 nt, Homo sapiens
aaaauacugugcacuaaag

SEQ ID NO: 1118011 - RNA, 19 nt, Homo sapiens
uaaaagauuucccuugacu

SEQ ID NO: 1118012 - RNA, 19 nt, Homo sapiens
gcauuuuguuugugaauuc

SEQ ID NO: 1118013 - RNA, 19 nt, Homo sapiens
guaaaaggucuugggcuua

SEQ ID NO: 1118014 - RNA, 19 nt, Homo sapiens
caaauucguuguugacuua

SEQ ID NO: 1118015 - RNA, 19 nt, Homo sapiens
uaacauagauuucgaggaa

SEQ ID NO: 1118016 - RNA, 19 nt, Homo sapiens
gcaaaucucucccauguag

SEQ ID NO: 1118017 - RNA, 19 nt, Homo sapiens
guaggagucuguuauuuaa

SEQ ID NO: 1118018 - RNA, 19 nt, Homo sapiens
aaucacagcuuuacucuuu

SEQ ID NO: 1118019 - RNA, 19 nt, Homo sapiens
gcagauaucggaacaaauu

SEQ ID NO: 1118020 - RNA, 19 nt, Homo sapiens
caacacaugugaaccauug

SEQ ID NO: 1118021 - RNA, 19 nt, Homo sapiens
gaucauugcugcuacagaa

SEQ ID NO: 1118022 - RNA, 19 nt, Homo sapiens
aagcagaucugauguguuu

SEQ ID NO: 1118023 - RNA, 19 nt, Homo sapiens
gauguuaccugaaaucaau

SEQ ID NO: 1118024 - RNA, 19 nt, Homo sapiens
uuagaagacucuccacuua

SEQ ID NO: 1118025 - RNA, 19 nt, Homo sapiens
cuacagaagugcuuuaaga

SEQ ID NO: 1118026 - RNA, 19 nt, Homo sapiens
gaucugauguguuuccuau

SEQ ID NO: 1118027 - RNA, 19 nt, Homo sapiens
ggaccagacuuucuaaauc

SEQ ID NO: 1118028 - RNA, 19 nt, Homo sapiens
gguaggagucuguuauuua

SEQ ID NO: 1118029 - RNA, 19 nt, Homo sapiens
gaacgcauuuaacagguuu

SEQ ID NO: 1118030 - RNA, 19 nt, Homo sapiens
agagugaacuuuaagcuuu

SEQ ID NO: 1118031 - RNA, 19 nt, Homo sapiens
gagugaacuuuaagcuuua

SEQ ID NO: 1118032 - RNA, 19 nt, Homo sapiens
ggacaugucagcagauauu

SEQ ID NO: 1118033 - RNA, 19 nt, Homo sapiens
ugaaaucaaucucccauau

SEQ ID NO: 1118034 - RNA, 19 nt, Homo sapiens
acaauuaugugcacuuuga

SEQ ID NO: 1118035 - RNA, 19 nt, Homo sapiens
cagaagugcuuuaagagaa

SEQ ID NO: 1118036 - RNA, 19 nt, Homo sapiens
uuaccaaucugaccucuuu

SEQ ID NO: 1118037 - RNA, 19 nt, Homo sapiens
caacuaaagaucacuguuu

SEQ ID NO: 1118038 - RNA, 19 nt, Homo sapiens
ggauaaagcuguuuuguuc

SEQ ID NO: 1118039 - RNA, 19 nt, Homo sapiens
gcacaguucuacucgaaau

SEQ ID NO: 1118040 - RNA, 19 nt, Homo sapiens
ugacaacagugaccaguga

SEQ ID NO: 1118041 - RNA, 19 nt, Homo sapiens
gaaacaggauguggacguu

SEQ ID NO: 1118042 - RNA, 19 nt, Homo sapiens
cuaagacuccugaaauaua

SEQ ID NO: 1118043 - RNA, 19 nt, Homo sapiens
cagcggaaguuaucaguau

SEQ ID NO: 1118044 - RNA, 19 nt, Homo sapiens
aaagucagauuacucgaaa

SEQ ID NO: 1118045 - RNA, 19 nt, Homo sapiens
ugaaggacauuaaugacaa

SEQ ID NO: 1118046 - RNA, 19 nt, Homo sapiens
ccuaugauguuaccugaaa

SEQ ID NO: 1118047 - RNA, 19 nt, Homo sapiens
uaauguaccugaguuaguu

SEQ ID NO: 1118048 - RNA, 19 nt, Homo sapiens
cgauuuggaugaaggagua

SEQ ID NO: 1118049 - RNA, 19 nt, Homo sapiens
gaccagacuuucuaaaucu

SEQ ID NO: 1118050 - RNA, 19 nt, Homo sapiens
agcaacagcuggaccuuua

SEQ ID NO: 1118051 - RNA, 19 nt, Homo sapiens
gagaaucgggcuaauuuau

SEQ ID NO: 1118052 - RNA, 19 nt, Homo sapiens
ugaaauaucagcucauaga

SEQ ID NO: 1118053 - RNA, 19 nt, Homo sapiens
gcacacaauguuuaugaaa

SEQ ID NO: 1118054 - RNA, 19 nt, Homo sapiens
guacaaggaaggcaagaaa

SEQ ID NO: 1118055 - RNA, 19 nt, Homo sapiens
ccauuuagauccagucaau

SEQ ID NO: 1118056 - RNA, 19 nt, Homo sapiens
ggagaaucgggcuaauuua

SEQ ID NO: 1118057 - RNA, 19 nt, Homo sapiens
gcucauagaaaguaacaaa

SEQ ID NO: 1118058 - RNA, 19 nt, Homo sapiens
ggagguaaaucugcagaau

SEQ ID NO: 1118059 - RNA, 19 nt, Homo sapiens
gcaauucccugcuccuuuu

SEQ ID NO: 1118060 - RNA, 19 nt, Homo sapiens
agaccgaccucauggcuuu

SEQ ID NO: 1118061 - RNA, 19 nt, Homo sapiens
gguauuuccucuguuauug

SEQ ID NO: 1118062 - RNA, 19 nt, Homo sapiens
uggcaaaucucucccaugu

SEQ ID NO: 1118063 - RNA, 19 nt, Homo sapiens
aaaauuugcugucaccuua

SEQ ID NO: 1118064 - RNA, 19 nt, Homo sapiens
gaaauaucagcucauagaa

SEQ ID NO: 1118065 - RNA, 19 nt, Homo sapiens
ggaaugaauacugacaaua

SEQ ID NO: 1118066 - RNA, 19 nt, Homo sapiens
gggaauggauaaagcuguu

SEQ ID NO: 1118067 - RNA, 19 nt, Homo sapiens
aaaucaaucucccauaugu

SEQ ID NO: 1118068 - RNA, 19 nt, Homo sapiens
gaaaucaaucucccauaug

SEQ ID NO: 1118069 - RNA, 19 nt, Homo sapiens
aagagaaagucuauagcua

SEQ ID NO: 1118070 - RNA, 19 nt, Homo sapiens
gaaaguucccugugucugu

SEQ ID NO: 1118071 - RNA, 19 nt, Homo sapiens
acgcguggcuuucguauga

SEQ ID NO: 1118072 - RNA, 19 nt, Homo sapiens
cauaugaaauccagguaga

SEQ ID NO: 1118073 - RNA, 19 nt, Homo sapiens
gaagugaaggacauuaaug

SEQ ID NO: 1118074 - RNA, 19 nt, Homo sapiens
gcccauguaucugaccuua

SEQ ID NO: 1118075 - RNA, 19 nt, Homo sapiens
caaauaaacagcggaaguu

SEQ ID NO: 1118076 - RNA, 19 nt, Homo sapiens
agaggaggcuggcauucua

SEQ ID NO: 1118077 - RNA, 19 nt, Homo sapiens
gcaagggaauggauaaagc

SEQ ID NO: 1118078 - RNA, 19 nt, Homo sapiens
ccucuugcauguauuacua

SEQ ID NO: 1118079 - RNA, 19 nt, Homo sapiens
gccugaaacaucuguauua

SEQ ID NO: 1118080 - RNA, 19 nt, Homo sapiens
gagaauugccugaaacauc

SEQ ID NO: 1118081 - RNA, 19 nt, Homo sapiens
uuaagagaauugccugaaa

SEQ ID NO: 1118082 - RNA, 19 nt, Homo sapiens
uaaagucuguuggcuguga

SEQ ID NO: 1118083 - RNA, 19 nt, Homo sapiens
ucacacugcugcuauauac

SEQ ID NO: 1118084 - RNA, 19 nt, Homo sapiens
auaaggauaucgcguauuc

SEQ ID NO: 1118085 - RNA, 19 nt, Homo sapiens
gcacaaauuuuaccaaucu

SEQ ID NO: 1118086 - RNA, 19 nt, Homo sapiens
gaagugcuuuaagagaauu

SEQ ID NO: 1118087 - RNA, 19 nt, Homo sapiens
uaacaagacccaggagaaa

SEQ ID NO: 1118088 - RNA, 19 nt, Homo sapiens
gaaggaguaaauaaggaua

SEQ ID NO: 1118089 - RNA, 19 nt, Homo sapiens
aaacugucuugucuacuuu

SEQ ID NO: 1118090 - RNA, 19 nt, Homo sapiens
aauaucagcucauagaaag

SEQ ID NO: 1118091 - RNA, 19 nt, Homo sapiens
ucaagauacuggugauuca

SEQ ID NO: 1118092 - RNA, 19 nt, Homo sapiens
gauacacaaccuucucuaa

SEQ ID NO: 1118093 - RNA, 19 nt, Homo sapiens
uaccuagagugaacuuuaa

SEQ ID NO: 1118094 - RNA, 19 nt, Homo sapiens
uaagacuccugaaauauac

SEQ ID NO: 1118095 - RNA, 19 nt, Homo sapiens
ugcuaagacuccugaaaua

SEQ ID NO: 1118096 - RNA, 19 nt, Homo sapiens
guaacaagacccaggagaa

SEQ ID NO: 1118097 - RNA, 19 nt, Homo sapiens
ggacaaaucaguguaaagg

SEQ ID NO: 1118098 - RNA, 19 nt, Homo sapiens
uccaauggcuguaaagaau

SEQ ID NO: 1118099 - RNA, 19 nt, Homo sapiens
cuucagcucugcaggauug

SEQ ID NO: 1118100 - RNA, 19 nt, Homo sapiens
aaucugaccucuuugaagu

SEQ ID NO: 1118101 - RNA, 19 nt, Homo sapiens
ggauaucgcguauucuuuc

SEQ ID NO: 1118102 - RNA, 19 nt, Homo sapiens
gcuucauucucccauauuu

SEQ ID NO: 1118103 - RNA, 19 nt, Homo sapiens
gguaugcgagugccagaua

SEQ ID NO: 1118104 - RNA, 19 nt, Homo sapiens
caagaauuacuacucauug

SEQ ID NO: 1118105 - RNA, 19 nt, Homo sapiens
ggaaaguaagucauaugaa

SEQ ID NO: 1118106 - RNA, 19 nt, Homo sapiens
ggacacuccuaagcauuau

SEQ ID NO: 1118107 - RNA, 19 nt, Homo sapiens
gaagugcuuuccaauccau

SEQ ID NO: 1118108 - RNA, 19 nt, Homo sapiens
agaauugccugaaacaucu

SEQ ID NO: 1118109 - RNA, 19 nt, Homo sapiens
guccugugcucacuuuauu

SEQ ID NO: 1118110 - RNA, 19 nt, Homo sapiens
uguccaccuucaagaauua

SEQ ID NO: 1118111 - RNA, 19 nt, Homo sapiens
guaccugaguuaguuauuc

SEQ ID NO: 1118112 - RNA, 19 nt, Homo sapiens
gacgaucuauaaagucaga

SEQ ID NO: 1118113 - RNA, 19 nt, Homo sapiens
gcgaagugcuuuccaaucc

SEQ ID NO: 1118114 - RNA, 19 nt, Homo sapiens
caaauucguuguugacuua

SEQ ID NO: 1118115 - RNA, 19 nt, Homo sapiens
uaacauagauuucgaggaa

SEQ ID NO: 1118116 - RNA, 19 nt, Homo sapiens
gcagauaucggaacaaauu

SEQ ID NO: 1118117 - RNA, 19 nt, Homo sapiens
uuagaagacucuccacuua

SEQ ID NO: 1118118 - RNA, 19 nt, Homo sapiens
ggacaugucagcagauauu

SEQ ID NO: 1118119 - RNA, 19 nt, Homo sapiens
caacuaaagaucacuguuu

SEQ ID NO: 1118120 - RNA, 19 nt, Homo sapiens
gcacaguucuacucgaaau

SEQ ID NO: 1118121 - RNA, 19 nt, Homo sapiens
gaaacaggauguggacguu

SEQ ID NO: 1118122 - RNA, 19 nt, Homo sapiens
aaagucagauuacucgaaa

SEQ ID NO: 1118123 - RNA, 19 nt, Homo sapiens
ugaaggacauuaaugacaa

SEQ ID NO: 1118124 - RNA, 19 nt, Homo sapiens
uaauguaccugaguuaguu

SEQ ID NO: 1118125 - RNA, 19 nt, Homo sapiens
cgauuuggaugaaggagua

SEQ ID NO: 1118126 - RNA, 19 nt, Homo sapiens
ccauuuagauccagucaau

SEQ ID NO: 1118127 - RNA, 19 nt, Homo sapiens
agaccgaccucauggcuuu

SEQ ID NO: 1118128 - RNA, 19 nt, Homo sapiens
ggagguaaaucugcagaau

SEQ ID NO: 1118129 - RNA, 19 nt, Homo sapiens
cagccaaagugaguaauuu

SEQ ID NO: 1118130 - RNA, 19 nt, Homo sapiens
acgcguggcuuucguauga

SEQ ID NO: 1118131 - RNA, 19 nt, Homo sapiens
cauaugaaauccagguaga

SEQ ID NO: 1118132 - RNA, 19 nt, Homo sapiens
gaagugaaggacauuaaug

SEQ ID NO: 1118133 - RNA, 19 nt, Homo sapiens
ucacacugcugcuauauac

SEQ ID NO: 1118134 - RNA, 19 nt, Homo sapiens
auaaggauaucgcguauuc

SEQ ID NO: 1118135 - RNA, 19 nt, Homo sapiens
gaaggaguaaauaaggaua

SEQ ID NO: 1118136 - RNA, 19 nt, Homo sapiens
ggacaaaucaguguaaagg

SEQ ID NO: 1118137 - RNA, 19 nt, Homo sapiens
uccaauggcuguaaagaau

SEQ ID NO: 1118138 - RNA, 19 nt, Homo sapiens
ggauaucgcguauucuuuc

SEQ ID NO: 1118139 - RNA, 19 nt, Homo sapiens
caagaauuacuacucauug

SEQ ID NO: 1118140 - RNA, 19 nt, Homo sapiens
ggaaaguaagucauaugaa

SEQ ID NO: 1118141 - RNA, 19 nt, Homo sapiens
ggacacuccuaagcauuau

SEQ ID NO: 1118142 - RNA, 19 nt, Homo sapiens
ccacuccucuggaaauaca

SEQ ID NO: 1118143 - RNA, 19 nt, Homo sapiens
uguccaccuucaagaauua

SEQ ID NO: 1118144 - RNA, 19 nt, Homo sapiens
guaccugaguuaguuauuc

SEQ ID NO: 1118145 - RNA, 19 nt, Homo sapiens
gacgaucuauaaagucaga

SEQ ID NO: 1118146 - RNA, 19 nt, Homo sapiens
gcacagucaucgcucugau

SEQ ID NO: 1118147 - RNA, 19 nt, Homo sapiens
gguagaagccacggauaaa

SEQ ID NO: 1118148 - RNA, 19 nt, Homo sapiens
aaauaaggauaucgcguau

SEQ ID NO: 1118149 - RNA, 19 nt, Homo sapiens
agaggacgaucuauaaagu

SEQ ID NO: 1118150 - RNA, 19 nt, Homo sapiens
guaaaggguaacauagauu

SEQ ID NO: 1118151 - RNA, 19 nt, Homo sapiens
gauaucgcguauucuuuca

SEQ ID NO: 1118152 - RNA, 19 nt, Homo sapiens
ggaagugaaggacauuaau

SEQ ID NO: 1118153 - RNA, 19 nt, Homo sapiens
cuucaagaauuacuacuca

SEQ ID NO: 1118154 - RNA, 19 nt, Homo sapiens
cgaggaaaguaagucauau

SEQ ID NO: 1118155 - RNA, 19 nt, Homo sapiens
uguaaaggguaacauagau

SEQ ID NO: 1118156 - RNA, 19 nt, Homo sapiens
gcacgacucaacuaaagau

SEQ ID NO: 1118157 - RNA, 19 nt, Homo sapiens
ggagagggguugcccaaga

SEQ ID NO: 1118158 - RNA, 19 nt, Homo sapiens
agaacgcccugguguccua

SEQ ID NO: 1118159 - RNA, 19 nt, Homo sapiens
gagaggacgaucuauaaag

SEQ ID NO: 1118160 - RNA, 19 nt, Homo sapiens
cuuccuccuuguccaauua

SEQ ID NO: 1118161 - RNA, 19 nt, Homo sapiens
guuugugaauucucggaua

SEQ ID NO: 1118162 - RNA, 19 nt, Homo sapiens
gaaggacauuaaugacaac

SEQ ID NO: 1118163 - RNA, 19 nt, Homo sapiens
ccaauuagccgggauagag

SEQ ID NO: 1118164 - RNA, 19 nt, Homo sapiens
ucacuaucuuuaccuguau

SEQ ID NO: 1118165 - RNA, 19 nt, Homo sapiens
gagaggagaaacaggaugu

SEQ ID NO: 1118166 - RNA, 19 nt, Homo sapiens
gaugaaggaguaaauaagg

SEQ ID NO: 1118167 - RNA, 19 nt, Homo sapiens
ggaugaaggaguaaauaag

SEQ ID NO: 1118168 - RNA, 19 nt, Homo sapiens
uaaagucagauuacucgaa

SEQ ID NO: 1118169 - RNA, 19 nt, Homo sapiens
ggaaauuaaaucccuugga

SEQ ID NO: 1118170 - RNA, 19 nt, Homo sapiens
aagcugcacugguggaugu

SEQ ID NO: 1118171 - RNA, 19 nt, Homo sapiens
gagguaaaucugcagaaug

SEQ ID NO: 1118172 - RNA, 19 nt, Homo sapiens
gaggaaaguaagucauaug

SEQ ID NO: 1118173 - RNA, 19 nt, Homo sapiens
gcccagugccugcugcuuu

SEQ ID NO: 1118174 - RNA, 19 nt, Homo sapiens
ucgaggaaaguaagucaua

SEQ ID NO: 1118175 - RNA, 19 nt, Homo sapiens
cuaauaacagcaauugaug

SEQ ID NO: 1118176 - RNA, 19 nt, Homo sapiens
uaccugaguuaguuauuca

SEQ ID NO: 1118177 - RNA, 19 nt, Homo sapiens
cugcacaguucuacucgaa

SEQ ID NO: 1118178 - RNA, 19 nt, Homo sapiens
agguaaaucugcagaaugg

SEQ ID NO: 1118179 - RNA, 19 nt, Homo sapiens
uugagaggacgaucuauaa

SEQ ID NO: 1118180 - RNA, 19 nt, Homo sapiens
gaucacuguuuuagaugua

SEQ ID NO: 1118181 - RNA, 19 nt, Homo sapiens
uggcacgacucaacuaaag

SEQ ID NO: 1118182 - RNA, 19 nt, Homo sapiens
caauggcuguaaagaaucu

SEQ ID NO: 1118183 - RNA, 19 nt, Homo sapiens
ugagaggacgaucuauaaa

SEQ ID NO: 1118184 - RNA, 19 nt, Homo sapiens
aacaggauguggacguuga

SEQ ID NO: 1118185 - RNA, 19 nt, Homo sapiens
gcccaagaccgaccucaug

SEQ ID NO: 1118186 - RNA, 19 nt, Homo sapiens
guguccaccuucaagaauu

SEQ ID NO: 1118187 - RNA, 19 nt, Homo sapiens
caguguaaaggguaacaua

SEQ ID NO: 1118188 - RNA, 19 nt, Homo sapiens
uaucgcguauucuuucaau

SEQ ID NO: 1118189 - RNA, 19 nt, Homo sapiens
gaaggugcgcgcaguggau

SEQ ID NO: 1118190 - RNA, 19 nt, Homo sapiens
uggaugaaggaguaaauaa

SEQ ID NO: 1118191 - RNA, 19 nt, Homo sapiens
acacuccuaagcauuauuu

SEQ ID NO: 1118192 - RNA, 19 nt, Homo sapiens
gauaauguaccugaguuag

SEQ ID NO: 1118193 - RNA, 19 nt, Homo sapiens
ugauaauguaccugaguua

SEQ ID NO: 1118194 - RNA, 19 nt, Homo sapiens
caauuagccgggauagaga

SEQ ID NO: 1118195 - RNA, 19 nt, Homo sapiens
ggugaaggaccacggugaa

SEQ ID NO: 1118196 - RNA, 19 nt, Homo sapiens
aggacgaucuauaaaguca

SEQ ID NO: 1118197 - RNA, 19 nt, Homo sapiens
gugaaggacauuaaugaca

SEQ ID NO: 1118198 - RNA, 19 nt, Homo sapiens
augcagauaucggaacaaa

SEQ ID NO: 1118199 - RNA, 19 nt, Homo sapiens
cgcaguggaugcagacuca

SEQ ID NO: 1118200 - RNA, 19 nt, Homo sapiens
gacaggccgcugcagguuu

SEQ ID NO: 1118201 - RNA, 19 nt, Homo sapiens
agaagacucuccacuuagc

SEQ ID NO: 1118202 - RNA, 19 nt, Homo sapiens
ggauagaccgcgaggaacu

SEQ ID NO: 1118203 - RNA, 19 nt, Homo sapiens
guguaaaggguaacauaga

SEQ ID NO: 1118204 - RNA, 19 nt, Homo sapiens
aaaucaguguaaaggguaa

SEQ ID NO: 1118205 - RNA, 19 nt, Homo sapiens
aaugacaacgcgccaguuu

SEQ ID NO: 1118206 - RNA, 19 nt, Homo sapiens
guugaucucucagccaaag

SEQ ID NO: 1118207 - RNA, 19 nt, Homo sapiens
aagaauuacuacucauugg

SEQ ID NO: 1118208 - RNA, 19 nt, Homo sapiens
aagugaaggacauuaauga

SEQ ID NO: 1118209 - RNA, 19 nt, Homo sapiens
uaacgccaccgauuuggau

SEQ ID NO: 1118210 - RNA, 19 nt, Homo sapiens
cgacucaacuaaagaucac

SEQ ID NO: 1118211 - RNA, 19 nt, Homo sapiens
aucacuaucuuuaccugua

SEQ ID NO: 1118212 - RNA, 19 nt, Homo sapiens
aggaaaguaagucauauga

SEQ ID NO: 1118213 - RNA, 19 nt, Homo sapiens
caauggacaaaucagugua

SEQ ID NO: 1118214 - RNA, 19 nt, Homo sapiens
ggaaaucgcuggacagaga

SEQ ID NO: 1118215 - RNA, 19 nt, Homo sapiens
gcaaaucucucccauguag

SEQ ID NO: 1118216 - RNA, 19 nt, Homo sapiens
guaggagucuguuauuuaa

SEQ ID NO: 1118217 - RNA, 19 nt, Homo sapiens
aaucacagcuuuacucuuu

SEQ ID NO: 1118218 - RNA, 19 nt, Homo sapiens
caacacaugugaaccauug

SEQ ID NO: 1118219 - RNA, 19 nt, Homo sapiens
ccaaucaguuuacaaagua

SEQ ID NO: 1118220 - RNA, 19 nt, Homo sapiens
gaucauugcugcuacagaa

SEQ ID NO: 1118221 - RNA, 19 nt, Homo sapiens
aagcagaucugauguguuu

SEQ ID NO: 1118222 - RNA, 19 nt, Homo sapiens
gauguuaccugaaaucaau

SEQ ID NO: 1118223 - RNA, 19 nt, Homo sapiens
uaaaugcucuucucuccua

SEQ ID NO: 1118224 - RNA, 19 nt, Homo sapiens
cuacagaagugcuuuaaga

SEQ ID NO: 1118225 - RNA, 19 nt, Homo sapiens
gaucugauguguuuccuau

SEQ ID NO: 1118226 - RNA, 19 nt, Homo sapiens
ggaccagacuuucuaaauc

SEQ ID NO: 1118227 - RNA, 19 nt, Homo sapiens
gaacuaagcgaaucuuugu

SEQ ID NO: 1118228 - RNA, 19 nt, Homo sapiens
gguaggagucuguuauuua

SEQ ID NO: 1118229 - RNA, 19 nt, Homo sapiens
gaacgcauuuaacagguuu

SEQ ID NO: 1118230 - RNA, 19 nt, Homo sapiens
agagugaacuuuaagcuuu

SEQ ID NO: 1118231 - RNA, 19 nt, Homo sapiens
gagugaacuuuaagcuuua

SEQ ID NO: 1118232 - RNA, 19 nt, Homo sapiens
ugaaaucaaucucccauau

SEQ ID NO: 1118233 - RNA, 19 nt, Homo sapiens
acaauuaugugcacuuuga

SEQ ID NO: 1118234 - RNA, 19 nt, Homo sapiens
cagaagugcuuuaagagaa

SEQ ID NO: 1118235 - RNA, 19 nt, Homo sapiens
uuaccaaucugaccucuuu

SEQ ID NO: 1118236 - RNA, 19 nt, Homo sapiens
guaauggcgucuucuauca

SEQ ID NO: 1118237 - RNA, 19 nt, Homo sapiens
ggauaaagcuguuuuguuc

SEQ ID NO: 1118238 - RNA, 19 nt, Homo sapiens
agaaacagcucucagaauc

SEQ ID NO: 1118239 - RNA, 19 nt, Homo sapiens
cgacaacccgccaauauuu

SEQ ID NO: 1118240 - RNA, 19 nt, Homo sapiens
ugacaacagugaccaguga

SEQ ID NO: 1118241 - RNA, 19 nt, Homo sapiens
gaacagcgagauuguguau

SEQ ID NO: 1118242 - RNA, 19 nt, Homo sapiens
cuaagacuccugaaauaua

SEQ ID NO: 1118243 - RNA, 19 nt, Homo sapiens
cagcggaaguuaucaguau

SEQ ID NO: 1118244 - RNA, 19 nt, Homo sapiens
agacuaaguuuaccauaga

SEQ ID NO: 1118245 - RNA, 19 nt, Homo sapiens
ccuaugauguuaccugaaa

SEQ ID NO: 1118246 - RNA, 19 nt, Homo sapiens
ggaaacugcugagguuaau

SEQ ID NO: 1118247 - RNA, 19 nt, Homo sapiens
gaccagacuuucuaaaucu

SEQ ID NO: 1118248 - RNA, 19 nt, Homo sapiens
agcaacagcuggaccuuua

SEQ ID NO: 1118249 - RNA, 19 nt, Homo sapiens
gagaaucgggcuaauuuau

SEQ ID NO: 1118250 - RNA, 19 nt, Homo sapiens
ugaaauaucagcucauaga

SEQ ID NO: 1118251 - RNA, 19 nt, Homo sapiens
gcacacaauguuuaugaaa

SEQ ID NO: 1118252 - RNA, 19 nt, Homo sapiens
guacaaggaaggcaagaaa

SEQ ID NO: 1118253 - RNA, 19 nt, Homo sapiens
ugaaggacauuaacgacaa

SEQ ID NO: 1118254 - RNA, 19 nt, Homo sapiens
ggagaaucgggcuaauuua

SEQ ID NO: 1118255 - RNA, 19 nt, Homo sapiens
gcucauagaaaguaacaaa

SEQ ID NO: 1118256 - RNA, 19 nt, Homo sapiens
gcaauucccugcuccuuuu

SEQ ID NO: 1118257 - RNA, 19 nt, Homo sapiens
guuaaacgcuucugaugca

SEQ ID NO: 1118258 - RNA, 19 nt, Homo sapiens
ggagguaaaucugcagaau

SEQ ID NO: 1118259 - RNA, 19 nt, Homo sapiens
gguauuuccucuguuauug

SEQ ID NO: 1118260 - RNA, 19 nt, Homo sapiens
uggcaaaucucucccaugu

SEQ ID NO: 1118261 - RNA, 19 nt, Homo sapiens
gguauuagauguaaaugac

SEQ ID NO: 1118262 - RNA, 19 nt, Homo sapiens
aaaauuugcugucaccuua

SEQ ID NO: 1118263 - RNA, 19 nt, Homo sapiens
gaaauaucagcucauagaa

SEQ ID NO: 1118264 - RNA, 19 nt, Homo sapiens
ggaaugaauacugacaaua

SEQ ID NO: 1118265 - RNA, 19 nt, Homo sapiens
gggaauggauaaagcuguu

SEQ ID NO: 1118266 - RNA, 19 nt, Homo sapiens
aaaucaaucucccauaugu

SEQ ID NO: 1118267 - RNA, 19 nt, Homo sapiens
gaaaucaaucucccauaug

SEQ ID NO: 1118268 - RNA, 19 nt, Homo sapiens
aagagaaagucuauagcua

SEQ ID NO: 1118269 - RNA, 19 nt, Homo sapiens
gaaaguucccugugucugu

SEQ ID NO: 1118270 - RNA, 19 nt, Homo sapiens
agaggaaacugcugagguu

SEQ ID NO: 1118271 - RNA, 19 nt, Homo sapiens
gcccauguaucugaccuua

SEQ ID NO: 1118272 - RNA, 19 nt, Homo sapiens
caaauaaacagcggaaguu

SEQ ID NO: 1118273 - RNA, 19 nt, Homo sapiens
agaggaggcuggcauucua

SEQ ID NO: 1118274 - RNA, 19 nt, Homo sapiens
ccgccaauauuuccaauga

SEQ ID NO: 1118275 - RNA, 19 nt, Homo sapiens
gcaagggaauggauaaagc

SEQ ID NO: 1118276 - RNA, 19 nt, Homo sapiens
ccucuugcauguauuacua

SEQ ID NO: 1118277 - RNA, 19 nt, Homo sapiens
gccugaaacaucuguauua

SEQ ID NO: 1118278 - RNA, 19 nt, Homo sapiens
gagaauugccugaaacauc

SEQ ID NO: 1118279 - RNA, 19 nt, Homo sapiens
uuaagagaauugccugaaa

SEQ ID NO: 1118280 - RNA, 19 nt, Homo sapiens
uaaagucuguuggcuguga

SEQ ID NO: 1118281 - RNA, 19 nt, Homo sapiens
gcaaaguccuacgagauuc

SEQ ID NO: 1118282 - RNA, 19 nt, Homo sapiens
gcacaaauuuuaccaaucu

SEQ ID NO: 1118283 - RNA, 19 nt, Homo sapiens
gaagugcuuuaagagaauu

SEQ ID NO: 1118284 - RNA, 19 nt, Homo sapiens
uaacaagacccaggagaaa

SEQ ID NO: 1118285 - RNA, 19 nt, Homo sapiens
ccagaagucucaauaacgu

SEQ ID NO: 1118286 - RNA, 19 nt, Homo sapiens
acagcgagauuguguauuc

SEQ ID NO: 1118287 - RNA, 19 nt, Homo sapiens
aaugggaccuuagugguua

SEQ ID NO: 1118288 - RNA, 19 nt, Homo sapiens
aaacugucuugucuacuuu

SEQ ID NO: 1118289 - RNA, 19 nt, Homo sapiens
aauaucagcucauagaaag

SEQ ID NO: 1118290 - RNA, 19 nt, Homo sapiens
ucaagauacuggugauuca

SEQ ID NO: 1118291 - RNA, 19 nt, Homo sapiens
gauacacaaccuucucuaa

SEQ ID NO: 1118292 - RNA, 19 nt, Homo sapiens
gcagauauaggaguaaaug

SEQ ID NO: 1118293 - RNA, 19 nt, Homo sapiens
uaccuagagugaacuuuaa

SEQ ID NO: 1118294 - RNA, 19 nt, Homo sapiens
uaagacuccugaaauauac

SEQ ID NO: 1118295 - RNA, 19 nt, Homo sapiens
ugcuaagacuccugaaaua

SEQ ID NO: 1118296 - RNA, 19 nt, Homo sapiens
agaagcagcaggacuuuaa

SEQ ID NO: 1118297 - RNA, 19 nt, Homo sapiens
guaacaagacccaggagaa

SEQ ID NO: 1118298 - RNA, 19 nt, Homo sapiens
agaacgcgcugguguccua

SEQ ID NO: 1118299 - RNA, 19 nt, Homo sapiens
cugcugagguuaauuuguu

SEQ ID NO: 1118300 - RNA, 19 nt, Homo sapiens
aaacugcugagguuaauuu

SEQ ID NO: 1118301 - RNA, 19 nt, Homo sapiens
acaggcaaaugaugaacua

SEQ ID NO: 1118302 - RNA, 19 nt, Homo sapiens
cuucagcucugcaggauug

SEQ ID NO: 1118303 - RNA, 19 nt, Homo sapiens
aaucugaccucuuugaagu

SEQ ID NO: 1118304 - RNA, 19 nt, Homo sapiens
uaacacaccagaagucuca

SEQ ID NO: 1118305 - RNA, 19 nt, Homo sapiens
gggcaccguucaaauacuu

SEQ ID NO: 1118306 - RNA, 19 nt, Homo sapiens
gccaauauuuccaaugaca

SEQ ID NO: 1118307 - RNA, 19 nt, Homo sapiens
gcuucauucucccauauuu

SEQ ID NO: 1118308 - RNA, 19 nt, Homo sapiens
aacaugcucuucuaauuug

SEQ ID NO: 1118309 - RNA, 19 nt, Homo sapiens
gguaugcgagugccagaua

SEQ ID NO: 1118310 - RNA, 19 nt, Homo sapiens
gaaacagcucucagaauca

SEQ ID NO: 1118311 - RNA, 19 nt, Homo sapiens
cagacuaaguuuaccauag

SEQ ID NO: 1118312 - RNA, 19 nt, Homo sapiens
ccaaugacaguaaagacua

SEQ ID NO: 1118313 - RNA, 19 nt, Homo sapiens
gaagugcuuuccaauccau

SEQ ID NO: 1118314 - RNA, 19 nt, Homo sapiens
ggaaaucgcuggacagaga

SEQ ID NO: 1118315 - RNA, 19 nt, Homo sapiens
ccaaucaguuuacaaagua

SEQ ID NO: 1118316 - RNA, 19 nt, Homo sapiens
uaaaugcucuucucuccua

SEQ ID NO: 1118317 - RNA, 19 nt, Homo sapiens
gaacuaagcgaaucuuugu

SEQ ID NO: 1118318 - RNA, 19 nt, Homo sapiens
guaauggcgucuucuauca

SEQ ID NO: 1118319 - RNA, 19 nt, Homo sapiens
agaaacagcucucagaauc

SEQ ID NO: 1118320 - RNA, 19 nt, Homo sapiens
cgacaacccgccaauauuu

SEQ ID NO: 1118321 - RNA, 19 nt, Homo sapiens
gaacagcgagauuguguau

SEQ ID NO: 1118322 - RNA, 19 nt, Homo sapiens
agacuaaguuuaccauaga

SEQ ID NO: 1118323 - RNA, 19 nt, Homo sapiens
ggaaacugcugagguuaau

SEQ ID NO: 1118324 - RNA, 19 nt, Homo sapiens
ugaaggacauuaacgacaa

SEQ ID NO: 1118325 - RNA, 19 nt, Homo sapiens
guuaaacgcuucugaugca

SEQ ID NO: 1118326 - RNA, 19 nt, Homo sapiens
ggagguaaaucugcagaau

SEQ ID NO: 1118327 - RNA, 19 nt, Homo sapiens
gguauuagauguaaaugac

SEQ ID NO: 1118328 - RNA, 19 nt, Homo sapiens
agaggaaacugcugagguu

SEQ ID NO: 1118329 - RNA, 19 nt, Homo sapiens
ccgccaauauuuccaauga

SEQ ID NO: 1118330 - RNA, 19 nt, Homo sapiens
gcaaaguccuacgagauuc

SEQ ID NO: 1118331 - RNA, 19 nt, Homo sapiens
ccagaagucucaauaacgu

SEQ ID NO: 1118332 - RNA, 19 nt, Homo sapiens
acagcgagauuguguauuc

SEQ ID NO: 1118333 - RNA, 19 nt, Homo sapiens
aaugggaccuuagugguua

SEQ ID NO: 1118334 - RNA, 19 nt, Homo sapiens
gcagauauaggaguaaaug

SEQ ID NO: 1118335 - RNA, 19 nt, Homo sapiens
agaacgcgcugguguccua

SEQ ID NO: 1118336 - RNA, 19 nt, Homo sapiens
cugcugagguuaauuuguu

SEQ ID NO: 1118337 - RNA, 19 nt, Homo sapiens
aaacugcugagguuaauuu

SEQ ID NO: 1118338 - RNA, 19 nt, Homo sapiens
acaggcaaaugaugaacua

SEQ ID NO: 1118339 - RNA, 19 nt, Homo sapiens
agaagcagcaggacuuuaa

SEQ ID NO: 1118340 - RNA, 19 nt, Homo sapiens
uaacacaccagaagucuca

SEQ ID NO: 1118341 - RNA, 19 nt, Homo sapiens
gggcaccguucaaauacuu

SEQ ID NO: 1118342 - RNA, 19 nt, Homo sapiens
gccaauauuuccaaugaca

SEQ ID NO: 1118343 - RNA, 19 nt, Homo sapiens
gaaacagcucucagaauca

SEQ ID NO: 1118344 - RNA, 19 nt, Homo sapiens
cagacuaaguuuaccauag

SEQ ID NO: 1118345 - RNA, 19 nt, Homo sapiens
aacaugcucuucuaauuug

SEQ ID NO: 1118346 - RNA, 19 nt, Homo sapiens
ccaaugacaguaaagacua

SEQ ID NO: 1118347 - RNA, 19 nt, Homo sapiens
uguccaccuucaagaauua

SEQ ID NO: 1118348 - RNA, 19 nt, Homo sapiens
gauguguccuccacuauac

SEQ ID NO: 1118349 - RNA, 19 nt, Homo sapiens
caaugacaguaaagacuau

SEQ ID NO: 1118350 - RNA, 19 nt, Homo sapiens
ugaugcagauauaggagua

SEQ ID NO: 1118351 - RNA, 19 nt, Homo sapiens
aguaaagacuauccgguuu

SEQ ID NO: 1118352 - RNA, 19 nt, Homo sapiens
aaacauugaggauugguaa

SEQ ID NO: 1118353 - RNA, 19 nt, Homo sapiens
gcagcaggacuuuaacaga

SEQ ID NO: 1118354 - RNA, 19 nt, Homo sapiens
gagaagcagcaggacuuua

SEQ ID NO: 1118355 - RNA, 19 nt, Homo sapiens
aauaacgucucucucacuu

SEQ ID NO: 1118356 - RNA, 19 nt, Homo sapiens
ggaccgaacagcgagauug

SEQ ID NO: 1118357 - RNA, 19 nt, Homo sapiens
uaacgacaacccgccaaua

SEQ ID NO: 1118358 - RNA, 19 nt, Homo sapiens
gguaauggcgucuucuauc

SEQ ID NO: 1118359 - RNA, 19 nt, Homo sapiens
gauauacaggcaaaugaug

SEQ ID NO: 1118360 - RNA, 19 nt, Homo sapiens
caccagaagucucaauaac

SEQ ID NO: 1118361 - RNA, 19 nt, Homo sapiens
ccacuauacagacuaaguu

SEQ ID NO: 1118362 - RNA, 19 nt, Homo sapiens
gaggaaacugcugagguua

SEQ ID NO: 1118363 - RNA, 19 nt, Homo sapiens
gauucucgguuuccucuag

SEQ ID NO: 1118364 - RNA, 19 nt, Homo sapiens
gcugcuugauucucgguuu

SEQ ID NO: 1118365 - RNA, 19 nt, Homo sapiens
cccaaucaguuuacaaagu

SEQ ID NO: 1118366 - RNA, 19 nt, Homo sapiens
gaaggacauuaacgacaac

SEQ ID NO: 1118367 - RNA, 19 nt, Homo sapiens
gagguaaaucugcagaaug

SEQ ID NO: 1118368 - RNA, 19 nt, Homo sapiens
guaaagacuauccgguuuc

SEQ ID NO: 1118369 - RNA, 19 nt, Homo sapiens
ggccuucagcccuagcuua

SEQ ID NO: 1118370 - RNA, 19 nt, Homo sapiens
aggcuacgcugguggaugu

SEQ ID NO: 1118371 - RNA, 19 nt, Homo sapiens
gaucgcgacucugguacga

SEQ ID NO: 1118372 - RNA, 19 nt, Homo sapiens
ugauguguccuccacuaua

SEQ ID NO: 1118373 - RNA, 19 nt, Homo sapiens
ugaacuaagcgaaucuuug

SEQ ID NO: 1118374 - RNA, 19 nt, Homo sapiens
agguaaaucugcagaaugg

SEQ ID NO: 1118375 - RNA, 19 nt, Homo sapiens
aaacagcucucagaaucag

SEQ ID NO: 1118376 - RNA, 19 nt, Homo sapiens
gcacugucauugcucucau

SEQ ID NO: 1118377 - RNA, 19 nt, Homo sapiens
ccuccacuauacagacuaa

SEQ ID NO: 1118378 - RNA, 19 nt, Homo sapiens
gaaucagaauacguaggaa

SEQ ID NO: 1118379 - RNA, 19 nt, Homo sapiens
acacaguauucgugaagga

SEQ ID NO: 1118380 - RNA, 19 nt, Homo sapiens
guguccaccuucaagaauu

SEQ ID NO: 1118381 - RNA, 19 nt, Homo sapiens
ggcaaaugaugaacuaagc

SEQ ID NO: 1118382 - RNA, 19 nt, Homo sapiens
cagaauacguaggaaaggu

SEQ ID NO: 1118383 - RNA, 19 nt, Homo sapiens
gcucucagaaucagaauac

SEQ ID NO: 1118384 - RNA, 19 nt, Homo sapiens
acgcguggcuuucguacga

SEQ ID NO: 1118385 - RNA, 19 nt, Homo sapiens
gcaaaacaugcucuucuaa

SEQ ID NO: 1118386 - RNA, 19 nt, Homo sapiens
guacacaguauucgugaag

SEQ ID NO: 1118387 - RNA, 19 nt, Homo sapiens
gucaggacauuguaaaauu

SEQ ID NO: 1118388 - RNA, 19 nt, Homo sapiens
gcagaugaaggaccgaaca

SEQ ID NO: 1118389 - RNA, 19 nt, Homo sapiens
uagauauacaggcaaauga

SEQ ID NO: 1118390 - RNA, 19 nt, Homo sapiens
agacuccgcagaagagaaa

SEQ ID NO: 1118391 - RNA, 19 nt, Homo sapiens
acaccagaagucucaauaa

SEQ ID NO: 1118392 - RNA, 19 nt, Homo sapiens
uaaguuaaacgcuucugau

SEQ ID NO: 1118393 - RNA, 19 nt, Homo sapiens
agaaucagaauacguagga

SEQ ID NO: 1118394 - RNA, 19 nt, Homo sapiens
ucaagaauuacuacucguu

SEQ ID NO: 1118395 - RNA, 19 nt, Homo sapiens
gauugguaauggcgucuuc

SEQ ID NO: 1118396 - RNA, 19 nt, Homo sapiens
cuucagcccuagcuuaucu

SEQ ID NO: 1118397 - RNA, 19 nt, Homo sapiens
gacaggccgcugcagguuu

SEQ ID NO: 1118398 - RNA, 19 nt, Homo sapiens
aauggcgucuucuaucaga

SEQ ID NO: 1118399 - RNA, 19 nt, Homo sapiens
cacugcaacugacaaagga

SEQ ID NO: 1118400 - RNA, 19 nt, Homo sapiens
uagagaauacggcaaaugg

SEQ ID NO: 1118401 - RNA, 19 nt, Homo sapiens
guaaaugacaaugaaccaa

SEQ ID NO: 1118402 - RNA, 19 nt, Homo sapiens
ggacuuuaacagagacuag

SEQ ID NO: 1118403 - RNA, 19 nt, Homo sapiens
cagccugaguacacaguau

SEQ ID NO: 1118404 - RNA, 19 nt, Homo sapiens
ucgcgacucugguacgaau

SEQ ID NO: 1118405 - RNA, 19 nt, Homo sapiens
gacaacccgccaauauuuc

SEQ ID NO: 1118406 - RNA, 19 nt, Homo sapiens
gaaggaccacggcgaacca

SEQ ID NO: 1118407 - RNA, 19 nt, Homo sapiens
caguauucgugaaggagaa

SEQ ID NO: 1118408 - RNA, 19 nt, Homo sapiens
gagauucaggucacugcaa

SEQ ID NO: 1118409 - RNA, 19 nt, Homo sapiens
caaaguccuacgagauuca

SEQ ID NO: 1118410 - RNA, 19 nt, Homo sapiens
aaaugggaccuuagugguu

SEQ ID NO: 1118411 - RNA, 19 nt, Homo sapiens
aagagaagcagcaggacuu

SEQ ID NO: 1118412 - RNA, 19 nt, Homo sapiens
ggaguaaaugcucuucucu

SEQ ID NO: 1118413 - RNA, 19 nt, Homo sapiens
cucagaaucagaauacgua

SEQ ID NO: 1118414 - RNA, 19 nt, Homo sapiens
ggaaaucgcuggacagaga

SEQ ID NO: 1118415 - RNA, 19 nt, Homo sapiens
gaacuucaaucuucaaauc

SEQ ID NO: 1118416 - RNA, 19 nt, Homo sapiens
ggaaagauauggaacuuca

SEQ ID NO: 1118417 - RNA, 19 nt, Homo sapiens
ccaaucaguuuacaaagua

SEQ ID NO: 1118418 - RNA, 19 nt, Homo sapiens
uaaaugcucuucucuccua

SEQ ID NO: 1118419 - RNA, 19 nt, Homo sapiens
gaacuaagcgaaucuuugu

SEQ ID NO: 1118420 - RNA, 19 nt, Homo sapiens
guaauggcgucuucuauca

SEQ ID NO: 1118421 - RNA, 19 nt, Homo sapiens
agaaacagcucucagaauc

SEQ ID NO: 1118422 - RNA, 19 nt, Homo sapiens
cgacaacccgccaauauuu

SEQ ID NO: 1118423 - RNA, 19 nt, Homo sapiens
gaacagcgagauuguguau

SEQ ID NO: 1118424 - RNA, 19 nt, Homo sapiens
ucagaaauuugguggguuu

SEQ ID NO: 1118425 - RNA, 19 nt, Homo sapiens
gaguguaguucuucaauag

SEQ ID NO: 1118426 - RNA, 19 nt, Homo sapiens
agacuaaguuuaccauaga

SEQ ID NO: 1118427 - RNA, 19 nt, Homo sapiens
ggaaacugcugagguuaau

SEQ ID NO: 1118428 - RNA, 19 nt, Homo sapiens
ugaaggacauuaacgacaa

SEQ ID NO: 1118429 - RNA, 19 nt, Homo sapiens
guuaaacgcuucugaugca

SEQ ID NO: 1118430 - RNA, 19 nt, Homo sapiens
ggagguaaaucugcagaau

SEQ ID NO: 1118431 - RNA, 19 nt, Homo sapiens
aaaguacucugguuucugu

SEQ ID NO: 1118432 - RNA, 19 nt, Homo sapiens
gguauuagauguaaaugac

SEQ ID NO: 1118433 - RNA, 19 nt, Homo sapiens
agaggaaacugcugagguu

SEQ ID NO: 1118434 - RNA, 19 nt, Homo sapiens
ugaguguaguucuucaaua

SEQ ID NO: 1118435 - RNA, 19 nt, Homo sapiens
guacugaugcuaugccaaa

SEQ ID NO: 1118436 - RNA, 19 nt, Homo sapiens
ccgccaauauuuccaauga

SEQ ID NO: 1118437 - RNA, 19 nt, Homo sapiens
caauagagagggagcguaa

SEQ ID NO: 1118438 - RNA, 19 nt, Homo sapiens
gcaaaguccuacgagauuc

SEQ ID NO: 1118439 - RNA, 19 nt, Homo sapiens
ggauauaggaggcaaggaa

SEQ ID NO: 1118440 - RNA, 19 nt, Homo sapiens
cugaugcuaugccaaauaa

SEQ ID NO: 1118441 - RNA, 19 nt, Homo sapiens
ccagaagucucaauaacgu

SEQ ID NO: 1118442 - RNA, 19 nt, Homo sapiens
acagcgagauuguguauuc

SEQ ID NO: 1118443 - RNA, 19 nt, Homo sapiens
aaugggaccuuagugguua

SEQ ID NO: 1118444 - RNA, 19 nt, Homo sapiens
gcagauauaggaguaaaug

SEQ ID NO: 1118445 - RNA, 19 nt, Homo sapiens
agaacgcgcugguguccua

SEQ ID NO: 1118446 - RNA, 19 nt, Homo sapiens
cugcugagguuaauuuguu

SEQ ID NO: 1118447 - RNA, 19 nt, Homo sapiens
aaacugcugagguuaauuu

SEQ ID NO: 1118448 - RNA, 19 nt, Homo sapiens
acaggcaaaugaugaacua

SEQ ID NO: 1118449 - RNA, 19 nt, Homo sapiens
agaagcagcaggacuuuaa

SEQ ID NO: 1118450 - RNA, 19 nt, Homo sapiens
uggcuaccauuaugucuuu

SEQ ID NO: 1118451 - RNA, 19 nt, Homo sapiens
guacucugguuucuguuug

SEQ ID NO: 1118452 - RNA, 19 nt, Homo sapiens
aaauccagcuugccucuug

SEQ ID NO: 1118453 - RNA, 19 nt, Homo sapiens
uaacacaccagaagucuca

SEQ ID NO: 1118454 - RNA, 19 nt, Homo sapiens
gggcaccguucaaauacuu

SEQ ID NO: 1118455 - RNA, 19 nt, Homo sapiens
gccaauauuuccaaugaca

SEQ ID NO: 1118456 - RNA, 19 nt, Homo sapiens
aacaugcucuucuaauuug

SEQ ID NO: 1118457 - RNA, 19 nt, Homo sapiens
gaaacagcucucagaauca

SEQ ID NO: 1118458 - RNA, 19 nt, Homo sapiens
cagacuaaguuuaccauag

SEQ ID NO: 1118459 - RNA, 19 nt, Homo sapiens
ccaaugacaguaaagacua

SEQ ID NO: 1118460 - RNA, 19 nt, Homo sapiens
gaauagcuaccaaauaaac

SEQ ID NO: 1118461 - RNA, 19 nt, Homo sapiens
uguccaccuucaagaauua

SEQ ID NO: 1118462 - RNA, 19 nt, Homo sapiens
gauguguccuccacuauac

SEQ ID NO: 1118463 - RNA, 19 nt, Homo sapiens
caaugacaguaaagacuau

SEQ ID NO: 1118464 - RNA, 19 nt, Homo sapiens
gauauaggaggcaaggaaa

SEQ ID NO: 1118465 - RNA, 19 nt, Homo sapiens
cuucacagauguacugaug

SEQ ID NO: 1118466 - RNA, 19 nt, Homo sapiens
ugaugcagauauaggagua

SEQ ID NO: 1118467 - RNA, 19 nt, Homo sapiens
aguaaagacuauccgguuu

SEQ ID NO: 1118468 - RNA, 19 nt, Homo sapiens
caaaugaaaugggugaaaa

SEQ ID NO: 1118469 - RNA, 19 nt, Homo sapiens
aaacauugaggauugguaa

SEQ ID NO: 1118470 - RNA, 19 nt, Homo sapiens
gaugcuaugccaaauaaau

SEQ ID NO: 1118471 - RNA, 19 nt, Homo sapiens
guaaagcuauuuucacuag

SEQ ID NO: 1118472 - RNA, 19 nt, Homo sapiens
gcagcaggacuuuaacaga

SEQ ID NO: 1118473 - RNA, 19 nt, Homo sapiens
cagcuugccucuugaaacu

SEQ ID NO: 1118474 - RNA, 19 nt, Homo sapiens
auauggaacuucaaucuuc

SEQ ID NO: 1118475 - RNA, 19 nt, Homo sapiens
gaauacguaggaaagauau

SEQ ID NO: 1118476 - RNA, 19 nt, Homo sapiens
gagagggagcguaaagcua

SEQ ID NO: 1118477 - RNA, 19 nt, Homo sapiens
gauauggaacuucaaucuu

SEQ ID NO: 1118478 - RNA, 19 nt, Homo sapiens
gagaagcagcaggacuuua

SEQ ID NO: 1118479 - RNA, 19 nt, Homo sapiens
gagggagcguaaagcuauu

SEQ ID NO: 1118480 - RNA, 19 nt, Homo sapiens
gcuugccucuugaaacuau

SEQ ID NO: 1118481 - RNA, 19 nt, Homo sapiens
uaggaaagauauggaacuu

SEQ ID NO: 1118482 - RNA, 19 nt, Homo sapiens
cagaauacguaggaaagau

SEQ ID NO: 1118483 - RNA, 19 nt, Homo sapiens
cagauguacugaugcuaug

SEQ ID NO: 1118484 - RNA, 19 nt, Homo sapiens
agaauacguaggaaagaua

SEQ ID NO: 1118485 - RNA, 19 nt, Homo sapiens
aauaacgucucucucacuu

SEQ ID NO: 1118486 - RNA, 19 nt, Homo sapiens
ggaccgaacagcgagauug

SEQ ID NO: 1118487 - RNA, 19 nt, Homo sapiens
uaacgacaacccgccaaua

SEQ ID NO: 1118488 - RNA, 19 nt, Homo sapiens
gguaauggcgucuucuauc

SEQ ID NO: 1118489 - RNA, 19 nt, Homo sapiens
gauauacaggcaaaugaug

SEQ ID NO: 1118490 - RNA, 19 nt, Homo sapiens
caccagaagucucaauaac

SEQ ID NO: 1118491 - RNA, 19 nt, Homo sapiens
ccacuauacagacuaaguu

SEQ ID NO: 1118492 - RNA, 19 nt, Homo sapiens
gaggaaacugcugagguua

SEQ ID NO: 1118493 - RNA, 19 nt, Homo sapiens
gauucucgguuuccucuag

SEQ ID NO: 1118494 - RNA, 19 nt, Homo sapiens
gcugcuugauucucgguuu

SEQ ID NO: 1118495 - RNA, 19 nt, Homo sapiens
gcuaccaaauaaacauugu

SEQ ID NO: 1118496 - RNA, 19 nt, Homo sapiens
gagguaaaucugcagaaug

SEQ ID NO: 1118497 - RNA, 19 nt, Homo sapiens
cccaaucaguuuacaaagu

SEQ ID NO: 1118498 - RNA, 19 nt, Homo sapiens
gaaggacauuaacgacaac

SEQ ID NO: 1118499 - RNA, 19 nt, Homo sapiens
guaaagacuauccgguuuc

SEQ ID NO: 1118500 - RNA, 19 nt, Homo sapiens
ugaaaugggugaaaaugga

SEQ ID NO: 1118501 - RNA, 19 nt, Homo sapiens
agguaaaucugcagaaugg

SEQ ID NO: 1118502 - RNA, 19 nt, Homo sapiens
ggccuucagcccuagcuua

SEQ ID NO: 1118503 - RNA, 19 nt, Homo sapiens
aggcuacgcugguggaugu

SEQ ID NO: 1118504 - RNA, 19 nt, Homo sapiens
gaucgcgacucugguacga

SEQ ID NO: 1118505 - RNA, 19 nt, Homo sapiens
ugauguguccuccacuaua

SEQ ID NO: 1118506 - RNA, 19 nt, Homo sapiens
ugaacuaagcgaaucuuug

SEQ ID NO: 1118507 - RNA, 19 nt, Homo sapiens
agagggagcguaaagcuau

SEQ ID NO: 1118508 - RNA, 19 nt, Homo sapiens
aaacagcucucagaaucag

SEQ ID NO: 1118509 - RNA, 19 nt, Homo sapiens
gcacugucauugcucucau

SEQ ID NO: 1118510 - RNA, 19 nt, Homo sapiens
ccuccacuauacagacuaa

SEQ ID NO: 1118511 - RNA, 19 nt, Homo sapiens
ucacagauguacugaugcu

SEQ ID NO: 1118512 - RNA, 19 nt, Homo sapiens
gaaucagaauacguaggaa

SEQ ID NO: 1118513 - RNA, 19 nt, Homo sapiens
acacaguauucgugaagga

SEQ ID NO: 1118514 - RNA, 19 nt, Homo sapiens
gaacuucacuuauuacuga

SEQ ID NO: 1118515 - RNA, 19 nt, Homo sapiens
gcaggugacuugcuccuua

SEQ ID NO: 1118516 - RNA, 19 nt, Homo sapiens
gcaaaucucucccauguag

SEQ ID NO: 1118517 - RNA, 19 nt, Homo sapiens
gaacauuagugaccacauu

SEQ ID NO: 1118518 - RNA, 19 nt, Homo sapiens
guaggagucuguuauuuaa

SEQ ID NO: 1118519 - RNA, 19 nt, Homo sapiens
ucaaaucacuguaagguuu

SEQ ID NO: 1118520 - RNA, 19 nt, Homo sapiens
aaucacagcuuuacucuuu

SEQ ID NO: 1118521 - RNA, 19 nt, Homo sapiens
caacacaugugaaccauug

SEQ ID NO: 1118522 - RNA, 19 nt, Homo sapiens
gaucauugcugcuacagaa

SEQ ID NO: 1118523 - RNA, 19 nt, Homo sapiens
aagcagaucugauguguuu

SEQ ID NO: 1118524 - RNA, 19 nt, Homo sapiens
gggcagagaacaaauaaua

SEQ ID NO: 1118525 - RNA, 19 nt, Homo sapiens
gauguuaccugaaaucaau

SEQ ID NO: 1118526 - RNA, 19 nt, Homo sapiens
cuacagaagugcuuuaaga

SEQ ID NO: 1118527 - RNA, 19 nt, Homo sapiens
caccagaacuucacuuauu

SEQ ID NO: 1118528 - RNA, 19 nt, Homo sapiens
gaucugauguguuuccuau

SEQ ID NO: 1118529 - RNA, 19 nt, Homo sapiens
ggaccagacuuucuaaauc

SEQ ID NO: 1118530 - RNA, 19 nt, Homo sapiens
gguaggagucuguuauuua

SEQ ID NO: 1118531 - RNA, 19 nt, Homo sapiens
gaacgcauuuaacagguuu

SEQ ID NO: 1118532 - RNA, 19 nt, Homo sapiens
gaacugaguaaaucucuuu

SEQ ID NO: 1118533 - RNA, 19 nt, Homo sapiens
agagugaacuuuaagcuuu

SEQ ID NO: 1118534 - RNA, 19 nt, Homo sapiens
guaaaucucuuuggcuuga

SEQ ID NO: 1118535 - RNA, 19 nt, Homo sapiens
ugaaagugcuggauguaaa

SEQ ID NO: 1118536 - RNA, 19 nt, Homo sapiens
gagugaacuuuaagcuuua

SEQ ID NO: 1118537 - RNA, 19 nt, Homo sapiens
gaagcaaauuuggaucuuu

SEQ ID NO: 1118538 - RNA, 19 nt, Homo sapiens
ugaaaucaaucucccauau

SEQ ID NO: 1118539 - RNA, 19 nt, Homo sapiens
acaauuaugugcacuuuga

SEQ ID NO: 1118540 - RNA, 19 nt, Homo sapiens
cagaagugcuuuaagagaa

SEQ ID NO: 1118541 - RNA, 19 nt, Homo sapiens
uuaccaaucugaccucuuu

SEQ ID NO: 1118542 - RNA, 19 nt, Homo sapiens
ggauaaagcuguuuuguuc

SEQ ID NO: 1118543 - RNA, 19 nt, Homo sapiens
ugacaacagugaccaguga

SEQ ID NO: 1118544 - RNA, 19 nt, Homo sapiens
gaaucuagacuccugaauu

SEQ ID NO: 1118545 - RNA, 19 nt, Homo sapiens
cuaagacuccugaaauaua

SEQ ID NO: 1118546 - RNA, 19 nt, Homo sapiens
cagcggaaguuaucaguau

SEQ ID NO: 1118547 - RNA, 19 nt, Homo sapiens
ccuaugauguuaccugaaa

SEQ ID NO: 1118548 - RNA, 19 nt, Homo sapiens
auacagaguccacuuguua

SEQ ID NO: 1118549 - RNA, 19 nt, Homo sapiens
gaccagacuuucuaaaucu

SEQ ID NO: 1118550 - RNA, 19 nt, Homo sapiens
agcaacagcuggaccuuua

SEQ ID NO: 1118551 - RNA, 19 nt, Homo sapiens
gaaguccuccgaugucaaa

SEQ ID NO: 1118552 - RNA, 19 nt, Homo sapiens
cuaacgcucuucuaacgua

SEQ ID NO: 1118553 - RNA, 19 nt, Homo sapiens
gagaaucgggcuaauuuau

SEQ ID NO: 1118554 - RNA, 19 nt, Homo sapiens
ugaaauaucagcucauaga

SEQ ID NO: 1118555 - RNA, 19 nt, Homo sapiens
gcacacaauguuuaugaaa

SEQ ID NO: 1118556 - RNA, 19 nt, Homo sapiens
guacaaggaaggcaagaaa

SEQ ID NO: 1118557 - RNA, 19 nt, Homo sapiens
gaaacaaaauccuacgaaa

SEQ ID NO: 1118558 - RNA, 19 nt, Homo sapiens
ggagaaucgggcuaauuua

SEQ ID NO: 1118559 - RNA, 19 nt, Homo sapiens
gcucauagaaaguaacaaa

SEQ ID NO: 1118560 - RNA, 19 nt, Homo sapiens
ggagguaaaucugcagaau

SEQ ID NO: 1118561 - RNA, 19 nt, Homo sapiens
gcaauucccugcuccuuuu

SEQ ID NO: 1118562 - RNA, 19 nt, Homo sapiens
gguauuuccucuguuauug

SEQ ID NO: 1118563 - RNA, 19 nt, Homo sapiens
uggcaaaucucucccaugu

SEQ ID NO: 1118564 - RNA, 19 nt, Homo sapiens
aaaauuugcugucaccuua

SEQ ID NO: 1118565 - RNA, 19 nt, Homo sapiens
gaaauaucagcucauagaa

SEQ ID NO: 1118566 - RNA, 19 nt, Homo sapiens
ggaaugaauacugacaaua

SEQ ID NO: 1118567 - RNA, 19 nt, Homo sapiens
gggaauggauaaagcuguu

SEQ ID NO: 1118568 - RNA, 19 nt, Homo sapiens
aaaucaaucucccauaugu

SEQ ID NO: 1118569 - RNA, 19 nt, Homo sapiens
gaaaucaaucucccauaug

SEQ ID NO: 1118570 - RNA, 19 nt, Homo sapiens
aagagaaagucuauagcua

SEQ ID NO: 1118571 - RNA, 19 nt, Homo sapiens
gaaaguucccugugucugu

SEQ ID NO: 1118572 - RNA, 19 nt, Homo sapiens
aaucuagacuccugaauuc

SEQ ID NO: 1118573 - RNA, 19 nt, Homo sapiens
gcccauguaucugaccuua

SEQ ID NO: 1118574 - RNA, 19 nt, Homo sapiens
caaauaaacagcggaaguu

SEQ ID NO: 1118575 - RNA, 19 nt, Homo sapiens
agaggaggcuggcauucua

SEQ ID NO: 1118576 - RNA, 19 nt, Homo sapiens
agaaagaaaugaacaacca

SEQ ID NO: 1118577 - RNA, 19 nt, Homo sapiens
accagaacuucacuuauua

SEQ ID NO: 1118578 - RNA, 19 nt, Homo sapiens
agaaggagcugcugaugca

SEQ ID NO: 1118579 - RNA, 19 nt, Homo sapiens
gcaagggaauggauaaagc

SEQ ID NO: 1118580 - RNA, 19 nt, Homo sapiens
ccucuugcauguauuacua

SEQ ID NO: 1118581 - RNA, 19 nt, Homo sapiens
gccugaaacaucuguauua

SEQ ID NO: 1118582 - RNA, 19 nt, Homo sapiens
gagaauugccugaaacauc

SEQ ID NO: 1118583 - RNA, 19 nt, Homo sapiens
uuaagagaauugccugaaa

SEQ ID NO: 1118584 - RNA, 19 nt, Homo sapiens
uaaagucuguuggcuguga

SEQ ID NO: 1118585 - RNA, 19 nt, Homo sapiens
gaacaaccagaagcaaauu

SEQ ID NO: 1118586 - RNA, 19 nt, Homo sapiens
ugacgaagguguaaauggu

SEQ ID NO: 1118587 - RNA, 19 nt, Homo sapiens
gugaugaacugaguaaauc

SEQ ID NO: 1118588 - RNA, 19 nt, Homo sapiens
gugaaagacauuaacgaua

SEQ ID NO: 1118589 - RNA, 19 nt, Homo sapiens
gcacaaauuuuaccaaucu

SEQ ID NO: 1118590 - RNA, 19 nt, Homo sapiens
gaagugcuuuaagagaauu

SEQ ID NO: 1118591 - RNA, 19 nt, Homo sapiens
uaacaagacccaggagaaa

SEQ ID NO: 1118592 - RNA, 19 nt, Homo sapiens
acgcguggcuguccuauga

SEQ ID NO: 1118593 - RNA, 19 nt, Homo sapiens
uaaaggcaguugauaaagg

SEQ ID NO: 1118594 - RNA, 19 nt, Homo sapiens
aaacugucuugucuacuuu

SEQ ID NO: 1118595 - RNA, 19 nt, Homo sapiens
aauaucagcucauagaaag

SEQ ID NO: 1118596 - RNA, 19 nt, Homo sapiens
ucaagauacuggugauuca

SEQ ID NO: 1118597 - RNA, 19 nt, Homo sapiens
gauacacaaccuucucuaa

SEQ ID NO: 1118598 - RNA, 19 nt, Homo sapiens
ccacugugcuuguaucucu

SEQ ID NO: 1118599 - RNA, 19 nt, Homo sapiens
gcgagagccugucggucua

SEQ ID NO: 1118600 - RNA, 19 nt, Homo sapiens
uaccuagagugaacuuuaa

SEQ ID NO: 1118601 - RNA, 19 nt, Homo sapiens
uaagacuccugaaauauac

SEQ ID NO: 1118602 - RNA, 19 nt, Homo sapiens
ugcuaagacuccugaaaua

SEQ ID NO: 1118603 - RNA, 19 nt, Homo sapiens
guaacaagacccaggagaa

SEQ ID NO: 1118604 - RNA, 19 nt, Homo sapiens
agaacgcgcugguguccua

SEQ ID NO: 1118605 - RNA, 19 nt, Homo sapiens
ggagguggccgacgugaau

SEQ ID NO: 1118606 - RNA, 19 nt, Homo sapiens
gaaagugcuggauguaaau

SEQ ID NO: 1118607 - RNA, 19 nt, Homo sapiens
cuacgaaauucaaguaaag

SEQ ID NO: 1118608 - RNA, 19 nt, Homo sapiens
cuucagcucugcaggauug

SEQ ID NO: 1118609 - RNA, 19 nt, Homo sapiens
aaucugaccucuuugaagu

SEQ ID NO: 1118610 - RNA, 19 nt, Homo sapiens
aaaggcaguugauaaagga

SEQ ID NO: 1118611 - RNA, 19 nt, Homo sapiens
gcuucauucucccauauuu

SEQ ID NO: 1118612 - RNA, 19 nt, Homo sapiens
gguaugcgagugccagaua

SEQ ID NO: 1118613 - RNA, 19 nt, Homo sapiens
ggcggucacuucauuguau

SEQ ID NO: 1118614 - RNA, 19 nt, Homo sapiens
gaacuucacuuauuacuga

SEQ ID NO: 1118615 - RNA, 19 nt, Homo sapiens
gcaggugacuugcuccuua

SEQ ID NO: 1118616 - RNA, 19 nt, Homo sapiens
gaacauuagugaccacauu

SEQ ID NO: 1118617 - RNA, 19 nt, Homo sapiens
ucaaaucacuguaagguuu

SEQ ID NO: 1118618 - RNA, 19 nt, Homo sapiens
gggcagagaacaaauaaua

SEQ ID NO: 1118619 - RNA, 19 nt, Homo sapiens
caccagaacuucacuuauu

SEQ ID NO: 1118620 - RNA, 19 nt, Homo sapiens
gaacugaguaaaucucuuu

SEQ ID NO: 1118621 - RNA, 19 nt, Homo sapiens
guaaaucucuuuggcuuga

SEQ ID NO: 1118622 - RNA, 19 nt, Homo sapiens
ugaaagugcuggauguaaa

SEQ ID NO: 1118623 - RNA, 19 nt, Homo sapiens
gaagcaaauuuggaucuuu

SEQ ID NO: 1118624 - RNA, 19 nt, Homo sapiens
guagauauccuauuaaugg

SEQ ID NO: 1118625 - RNA, 19 nt, Homo sapiens
gaaucuagacuccugaauu

SEQ ID NO: 1118626 - RNA, 19 nt, Homo sapiens
auacagaguccacuuguua

SEQ ID NO: 1118627 - RNA, 19 nt, Homo sapiens
gaaguccuccgaugucaaa

SEQ ID NO: 1118628 - RNA, 19 nt, Homo sapiens
cuaacgcucuucuaacgua

SEQ ID NO: 1118629 - RNA, 19 nt, Homo sapiens
gaaacaaaauccuacgaaa

SEQ ID NO: 1118630 - RNA, 19 nt, Homo sapiens
ggaucuuucugguaaugua

SEQ ID NO: 1118631 - RNA, 19 nt, Homo sapiens
ggagguaaaucugcagaau

SEQ ID NO: 1118632 - RNA, 19 nt, Homo sapiens
aaucuagacuccugaauuc

SEQ ID NO: 1118633 - RNA, 19 nt, Homo sapiens
agaaagaaaugaacaacca

SEQ ID NO: 1118634 - RNA, 19 nt, Homo sapiens
accagaacuucacuuauua

SEQ ID NO: 1118635 - RNA, 19 nt, Homo sapiens
agaaggagcugcugaugca

SEQ ID NO: 1118636 - RNA, 19 nt, Homo sapiens
gaacaaccagaagcaaauu

SEQ ID NO: 1118637 - RNA, 19 nt, Homo sapiens
ugacgaagguguaaauggu

SEQ ID NO: 1118638 - RNA, 19 nt, Homo sapiens
gugaugaacugaguaaauc

SEQ ID NO: 1118639 - RNA, 19 nt, Homo sapiens
acgcguggcuguccuauga

SEQ ID NO: 1118640 - RNA, 19 nt, Homo sapiens
uaaaggcaguugauaaagg

SEQ ID NO: 1118641 - RNA, 19 nt, Homo sapiens
gugaaagacauuaacgaua

SEQ ID NO: 1118642 - RNA, 19 nt, Homo sapiens
ccacugugcuuguaucucu

SEQ ID NO: 1118643 - RNA, 19 nt, Homo sapiens
gcgagagccugucggucua

SEQ ID NO: 1118644 - RNA, 19 nt, Homo sapiens
agaacgcgcugguguccua

SEQ ID NO: 1118645 - RNA, 19 nt, Homo sapiens
ggagguggccgacgugaau

SEQ ID NO: 1118646 - RNA, 19 nt, Homo sapiens
gaaagugcuggauguaaau

SEQ ID NO: 1118647 - RNA, 19 nt, Homo sapiens
cuacgaaauucaaguaaag

SEQ ID NO: 1118648 - RNA, 19 nt, Homo sapiens
aaaggcaguugauaaagga

SEQ ID NO: 1118649 - RNA, 19 nt, Homo sapiens
ggcggucacuucauuguau

SEQ ID NO: 1118650 - RNA, 19 nt, Homo sapiens
uguccaccuucaagaauua

SEQ ID NO: 1118651 - RNA, 19 nt, Homo sapiens
caaguaaaggcaguugaua

SEQ ID NO: 1118652 - RNA, 19 nt, Homo sapiens
caagugaugaacugaguaa

SEQ ID NO: 1118653 - RNA, 19 nt, Homo sapiens
ccuacgaaauucaaguaaa

SEQ ID NO: 1118654 - RNA, 19 nt, Homo sapiens
caggugacuugcuccuuaa

SEQ ID NO: 1118655 - RNA, 19 nt, Homo sapiens
ggauguaaaugauaaugcu

SEQ ID NO: 1118656 - RNA, 19 nt, Homo sapiens
gauuccagcucaggagaaa

SEQ ID NO: 1118657 - RNA, 19 nt, Homo sapiens
gugauuauuucucuuugga

SEQ ID NO: 1118658 - RNA, 19 nt, Homo sapiens
ccacugagggugcguaugu

SEQ ID NO: 1118659 - RNA, 19 nt, Homo sapiens
gaagucgucuuuuccuuug

SEQ ID NO: 1118660 - RNA, 19 nt, Homo sapiens
guuagagacuacagcaaau

SEQ ID NO: 1118661 - RNA, 19 nt, Homo sapiens
aagcaaauuuggaucuuuc

SEQ ID NO: 1118662 - RNA, 19 nt, Homo sapiens
uaacacgucagaaagaaau

SEQ ID NO: 1118663 - RNA, 19 nt, Homo sapiens
ugauaaugcuccagaacug

SEQ ID NO: 1118664 - RNA, 19 nt, Homo sapiens
cgagugauuauuucucuuu

SEQ ID NO: 1118665 - RNA, 19 nt, Homo sapiens
ggugcuaacgcucuucuaa

SEQ ID NO: 1118666 - RNA, 19 nt, Homo sapiens
ucuucaagguguucacuaa

SEQ ID NO: 1118667 - RNA, 19 nt, Homo sapiens
gaugucaaaucacuguaag

SEQ ID NO: 1118668 - RNA, 19 nt, Homo sapiens
agaagaaacaccagaacuu

SEQ ID NO: 1118669 - RNA, 19 nt, Homo sapiens
aguaaaggcaguugauaaa

SEQ ID NO: 1118670 - RNA, 19 nt, Homo sapiens
agaguccacuuguuagaga

SEQ ID NO: 1118671 - RNA, 19 nt, Homo sapiens
gagugauuauuucucuuug

SEQ ID NO: 1118672 - RNA, 19 nt, Homo sapiens
gcaagugaugaacugagua

SEQ ID NO: 1118673 - RNA, 19 nt, Homo sapiens
ggugaaagacauuaacgau

SEQ ID NO: 1118674 - RNA, 19 nt, Homo sapiens
gagguaaaucugcagaaug

SEQ ID NO: 1118675 - RNA, 19 nt, Homo sapiens
gcggucacuucauuguauu

SEQ ID NO: 1118676 - RNA, 19 nt, Homo sapiens
gagacuacagcaaauggaa

SEQ ID NO: 1118677 - RNA, 19 nt, Homo sapiens
ugaccaggccguauacaga

SEQ ID NO: 1118678 - RNA, 19 nt, Homo sapiens
gagcugcaagguacaguug

SEQ ID NO: 1118679 - RNA, 19 nt, Homo sapiens
ggcaagugaugaacugagu

SEQ ID NO: 1118680 - RNA, 19 nt, Homo sapiens
gaucuuucugguaauguaa

SEQ ID NO: 1118681 - RNA, 19 nt, Homo sapiens
agguaaaucugcagaaugg

SEQ ID NO: 1118682 - RNA, 19 nt, Homo sapiens
ccaacgggcaggugacuug

SEQ ID NO: 1118683 - RNA, 19 nt, Homo sapiens
guccuccgaugucaaauca

SEQ ID NO: 1118684 - RNA, 19 nt, Homo sapiens
aaguaaaggcaguugauaa

SEQ ID NO: 1118685 - RNA, 19 nt, Homo sapiens
cccgggaucugcuucuuug

SEQ ID NO: 1118686 - RNA, 19 nt, Homo sapiens
gauagaaggagcugcugau

SEQ ID NO: 1118687 - RNA, 19 nt, Homo sapiens
gaauucgcguuuuccgaua

SEQ ID NO: 1118688 - RNA, 19 nt, Homo sapiens
auuuggaucuuucugguaa

SEQ ID NO: 1118689 - RNA, 19 nt, Homo sapiens
ugaacaaccagaagcaaau

SEQ ID NO: 1118690 - RNA, 19 nt, Homo sapiens
cuuaacacgucagaaagaa

SEQ ID NO: 1118691 - RNA, 19 nt, Homo sapiens
acacaguauucgugaagga

SEQ ID NO: 1118692 - RNA, 19 nt, Homo sapiens
guguccaccuucaagaauu

SEQ ID NO: 1118693 - RNA, 19 nt, Homo sapiens
gugaaagugcuggauguaa

SEQ ID NO: 1118694 - RNA, 19 nt, Homo sapiens
uauacagaguccacuuguu

SEQ ID NO: 1118695 - RNA, 19 nt, Homo sapiens
gagaagaaacaccagaacu

SEQ ID NO: 1118696 - RNA, 19 nt, Homo sapiens
gcucagcccgagugauuau

SEQ ID NO: 1118697 - RNA, 19 nt, Homo sapiens
guacacaguauucgugaag

SEQ ID NO: 1118698 - RNA, 19 nt, Homo sapiens
ggcagagaacaaauaauau

SEQ ID NO: 1118699 - RNA, 19 nt, Homo sapiens
ggugaaagugcuggaugua

SEQ ID NO: 1118700 - RNA, 19 nt, Homo sapiens
ugguauuucucgugacauu

SEQ ID NO: 1118701 - RNA, 19 nt, Homo sapiens
ugucuugaauggaacuaga

SEQ ID NO: 1118702 - RNA, 19 nt, Homo sapiens
agucuuaacacgucagaaa

SEQ ID NO: 1118703 - RNA, 19 nt, Homo sapiens
ucaagaauuacuacucguu

SEQ ID NO: 1118704 - RNA, 19 nt, Homo sapiens
gaacuggcggucacuucau

SEQ ID NO: 1118705 - RNA, 19 nt, Homo sapiens
aaaugauaaugcuccagaa

SEQ ID NO: 1118706 - RNA, 19 nt, Homo sapiens
caaacacggcaccuucguu

SEQ ID NO: 1118707 - RNA, 19 nt, Homo sapiens
gaaggugaaagacauuaac

SEQ ID NO: 1118708 - RNA, 19 nt, Homo sapiens
agaagcaaauuuggaucuu

SEQ ID NO: 1118709 - RNA, 19 nt, Homo sapiens
gcagcccgaguacacagua

SEQ ID NO: 1118710 - RNA, 19 nt, Homo sapiens
gugacuugcuccuuaaugc

SEQ ID NO: 1118711 - RNA, 19 nt, Homo sapiens
cgaugucaaaucacuguaa

SEQ ID NO: 1118712 - RNA, 19 nt, Homo sapiens
gacaggccgcugcagguuu

SEQ ID NO: 1118713 - RNA, 19 nt, Homo sapiens
guauuucucgugacauuca

SEQ ID NO: 1118714 - RNA, 19 nt, Homo sapiens
gaacuucacuuauuacuga

SEQ ID NO: 1118715 - RNA, 19 nt, Homo sapiens
gcaggugacuugcuccuua

SEQ ID NO: 1118716 - RNA, 19 nt, Homo sapiens
gcaaaucucucccauguag

SEQ ID NO: 1118717 - RNA, 19 nt, Homo sapiens
gaacauuagugaccacauu

SEQ ID NO: 1118718 - RNA, 19 nt, Homo sapiens
guaggagucuguuauuuaa

SEQ ID NO: 1118719 - RNA, 19 nt, Homo sapiens
ucaaaucacuguaagguuu

SEQ ID NO: 1118720 - RNA, 19 nt, Homo sapiens
aaucacagcuuuacucuuu

SEQ ID NO: 1118721 - RNA, 19 nt, Homo sapiens
caacacaugugaaccauug

SEQ ID NO: 1118722 - RNA, 19 nt, Homo sapiens
gaucauugcugcuacagaa

SEQ ID NO: 1118723 - RNA, 19 nt, Homo sapiens
aagcagaucugauguguuu

SEQ ID NO: 1118724 - RNA, 19 nt, Homo sapiens
gggcagagaacaaauaaua

SEQ ID NO: 1118725 - RNA, 19 nt, Homo sapiens
gauguuaccugaaaucaau

SEQ ID NO: 1118726 - RNA, 19 nt, Homo sapiens
cuacagaagugcuuuaaga

SEQ ID NO: 1118727 - RNA, 19 nt, Homo sapiens
caccagaacuucacuuauu

SEQ ID NO: 1118728 - RNA, 19 nt, Homo sapiens
gaucugauguguuuccuau

SEQ ID NO: 1118729 - RNA, 19 nt, Homo sapiens
ggaccagacuuucuaaauc

SEQ ID NO: 1118730 - RNA, 19 nt, Homo sapiens
gguaggagucuguuauuua

SEQ ID NO: 1118731 - RNA, 19 nt, Homo sapiens
gaacgcauuuaacagguuu

SEQ ID NO: 1118732 - RNA, 19 nt, Homo sapiens
gaacugaguaaaucucuuu

SEQ ID NO: 1118733 - RNA, 19 nt, Homo sapiens
agagugaacuuuaagcuuu

SEQ ID NO: 1118734 - RNA, 19 nt, Homo sapiens
guaaaucucuuuggcuuga

SEQ ID NO: 1118735 - RNA, 19 nt, Homo sapiens
ugaaagugcuggauguaaa

SEQ ID NO: 1118736 - RNA, 19 nt, Homo sapiens
gagugaacuuuaagcuuua

SEQ ID NO: 1118737 - RNA, 19 nt, Homo sapiens
ugaaaucaaucucccauau

SEQ ID NO: 1118738 - RNA, 19 nt, Homo sapiens
acaauuaugugcacuuuga

SEQ ID NO: 1118739 - RNA, 19 nt, Homo sapiens
cagaagugcuuuaagagaa

SEQ ID NO: 1118740 - RNA, 19 nt, Homo sapiens
uuaccaaucugaccucuuu

SEQ ID NO: 1118741 - RNA, 19 nt, Homo sapiens
ggauaaagcuguuuuguuc

SEQ ID NO: 1118742 - RNA, 19 nt, Homo sapiens
ugacaacagugaccaguga

SEQ ID NO: 1118743 - RNA, 19 nt, Homo sapiens
gaaucuagacuccugaauu

SEQ ID NO: 1118744 - RNA, 19 nt, Homo sapiens
cuaagacuccugaaauaua

SEQ ID NO: 1118745 - RNA, 19 nt, Homo sapiens
cagcggaaguuaucaguau

SEQ ID NO: 1118746 - RNA, 19 nt, Homo sapiens
ccuaugauguuaccugaaa

SEQ ID NO: 1118747 - RNA, 19 nt, Homo sapiens
auacagaguccacuuguua

SEQ ID NO: 1118748 - RNA, 19 nt, Homo sapiens
gaccagacuuucuaaaucu

SEQ ID NO: 1118749 - RNA, 19 nt, Homo sapiens
agcaacagcuggaccuuua

SEQ ID NO: 1118750 - RNA, 19 nt, Homo sapiens
gaaguccuccgaugucaaa

SEQ ID NO: 1118751 - RNA, 19 nt, Homo sapiens
cuaacgcucuucuaacgua

SEQ ID NO: 1118752 - RNA, 19 nt, Homo sapiens
gagaaucgggcuaauuuau

SEQ ID NO: 1118753 - RNA, 19 nt, Homo sapiens
ugaaauaucagcucauaga

SEQ ID NO: 1118754 - RNA, 19 nt, Homo sapiens
gcacacaauguuuaugaaa

SEQ ID NO: 1118755 - RNA, 19 nt, Homo sapiens
guacaaggaaggcaagaaa

SEQ ID NO: 1118756 - RNA, 19 nt, Homo sapiens
gaaacaaaauccuacgaaa

SEQ ID NO: 1118757 - RNA, 19 nt, Homo sapiens
ggagaaucgggcuaauuua

SEQ ID NO: 1118758 - RNA, 19 nt, Homo sapiens
gcucauagaaaguaacaaa

SEQ ID NO: 1118759 - RNA, 19 nt, Homo sapiens
gcaauucccugcuccuuuu

SEQ ID NO: 1118760 - RNA, 19 nt, Homo sapiens
ggagguaaaucugcagaau

SEQ ID NO: 1118761 - RNA, 19 nt, Homo sapiens
gguauuuccucuguuauug

SEQ ID NO: 1118762 - RNA, 19 nt, Homo sapiens
uggcaaaucucucccaugu

SEQ ID NO: 1118763 - RNA, 19 nt, Homo sapiens
aaaauuugcugucaccuua

SEQ ID NO: 1118764 - RNA, 19 nt, Homo sapiens
gaaauaucagcucauagaa

SEQ ID NO: 1118765 - RNA, 19 nt, Homo sapiens
ggaaugaauacugacaaua

SEQ ID NO: 1118766 - RNA, 19 nt, Homo sapiens
gggaauggauaaagcuguu

SEQ ID NO: 1118767 - RNA, 19 nt, Homo sapiens
aaaucaaucucccauaugu

SEQ ID NO: 1118768 - RNA, 19 nt, Homo sapiens
gaaaucaaucucccauaug

SEQ ID NO: 1118769 - RNA, 19 nt, Homo sapiens
aagagaaagucuauagcua

SEQ ID NO: 1118770 - RNA, 19 nt, Homo sapiens
gaaaguucccugugucugu

SEQ ID NO: 1118771 - RNA, 19 nt, Homo sapiens
aaucuagacuccugaauuc

SEQ ID NO: 1118772 - RNA, 19 nt, Homo sapiens
gcccauguaucugaccuua

SEQ ID NO: 1118773 - RNA, 19 nt, Homo sapiens
caaauaaacagcggaaguu

SEQ ID NO: 1118774 - RNA, 19 nt, Homo sapiens
agaggaggcuggcauucua

SEQ ID NO: 1118775 - RNA, 19 nt, Homo sapiens
accagaacuucacuuauua

SEQ ID NO: 1118776 - RNA, 19 nt, Homo sapiens
agaaggagcugcugaugca

SEQ ID NO: 1118777 - RNA, 19 nt, Homo sapiens
gcaagggaauggauaaagc

SEQ ID NO: 1118778 - RNA, 19 nt, Homo sapiens
ccucuugcauguauuacua

SEQ ID NO: 1118779 - RNA, 19 nt, Homo sapiens
gccugaaacaucuguauua

SEQ ID NO: 1118780 - RNA, 19 nt, Homo sapiens
gagaauugccugaaacauc

SEQ ID NO: 1118781 - RNA, 19 nt, Homo sapiens
uuaagagaauugccugaaa

SEQ ID NO: 1118782 - RNA, 19 nt, Homo sapiens
uaaagucuguuggcuguga

SEQ ID NO: 1118783 - RNA, 19 nt, Homo sapiens
ugacgaagguguaaauggu

SEQ ID NO: 1118784 - RNA, 19 nt, Homo sapiens
gugaugaacugaguaaauc

SEQ ID NO: 1118785 - RNA, 19 nt, Homo sapiens
gcacaaauuuuaccaaucu

SEQ ID NO: 1118786 - RNA, 19 nt, Homo sapiens
gaagugcuuuaagagaauu

SEQ ID NO: 1118787 - RNA, 19 nt, Homo sapiens
gugaaagacauuaacgaua

SEQ ID NO: 1118788 - RNA, 19 nt, Homo sapiens
uaacaagacccaggagaaa

SEQ ID NO: 1118789 - RNA, 19 nt, Homo sapiens
uaaaggcaguugauaaagg

SEQ ID NO: 1118790 - RNA, 19 nt, Homo sapiens
aaacugucuugucuacuuu

SEQ ID NO: 1118791 - RNA, 19 nt, Homo sapiens
aauaucagcucauagaaag

SEQ ID NO: 1118792 - RNA, 19 nt, Homo sapiens
ucaagauacuggugauuca

SEQ ID NO: 1118793 - RNA, 19 nt, Homo sapiens
gauacacaaccuucucuaa

SEQ ID NO: 1118794 - RNA, 19 nt, Homo sapiens
gcgagagccugucggucua

SEQ ID NO: 1118795 - RNA, 19 nt, Homo sapiens
uaccuagagugaacuuuaa

SEQ ID NO: 1118796 - RNA, 19 nt, Homo sapiens
uaagacuccugaaauauac

SEQ ID NO: 1118797 - RNA, 19 nt, Homo sapiens
ugcuaagacuccugaaaua

SEQ ID NO: 1118798 - RNA, 19 nt, Homo sapiens
guaacaagacccaggagaa

SEQ ID NO: 1118799 - RNA, 19 nt, Homo sapiens
agaacgcgcugguguccua

SEQ ID NO: 1118800 - RNA, 19 nt, Homo sapiens
ggagguggccgacgugaau

SEQ ID NO: 1118801 - RNA, 19 nt, Homo sapiens
gaaagugcuggauguaaau

SEQ ID NO: 1118802 - RNA, 19 nt, Homo sapiens
cuacgaaauucaaguaaag

SEQ ID NO: 1118803 - RNA, 19 nt, Homo sapiens
cuucagcucugcaggauug

SEQ ID NO: 1118804 - RNA, 19 nt, Homo sapiens
aaucugaccucuuugaagu

SEQ ID NO: 1118805 - RNA, 19 nt, Homo sapiens
aaaggcaguugauaaagga

SEQ ID NO: 1118806 - RNA, 19 nt, Homo sapiens
gcuucauucucccauauuu

SEQ ID NO: 1118807 - RNA, 19 nt, Homo sapiens
gguaugcgagugccagaua

SEQ ID NO: 1118808 - RNA, 19 nt, Homo sapiens
ggcggucacuucauuguau

SEQ ID NO: 1118809 - RNA, 19 nt, Homo sapiens
gaagugcuuuccaauccau

SEQ ID NO: 1118810 - RNA, 19 nt, Homo sapiens
agaauugccugaaacaucu

SEQ ID NO: 1118811 - RNA, 19 nt, Homo sapiens
guccugugcucacuuuauu

SEQ ID NO: 1118812 - RNA, 19 nt, Homo sapiens
uguccaccuucaagaauua

SEQ ID NO: 1118813 - RNA, 19 nt, Homo sapiens
caaguaaaggcaguugaua

SEQ ID NO: 1118814 - RNA, 19 nt, Homo sapiens
gaacauauauggagacaaa

SEQ ID NO: 1118815 - RNA, 19 nt, Homo sapiens
gaacagugcucuucaggua

SEQ ID NO: 1118816 - RNA, 19 nt, Homo sapiens
gagcagagcuguagagaaa

SEQ ID NO: 1118817 - RNA, 19 nt, Homo sapiens
ggaagcagauguuucuuua

SEQ ID NO: 1118818 - RNA, 19 nt, Homo sapiens
caaagcaguuguucacuua

SEQ ID NO: 1118819 - RNA, 19 nt, Homo sapiens
gaacuuaccagcccaauuu

SEQ ID NO: 1118820 - RNA, 19 nt, Homo sapiens
gaaaugaucuccucaaagg

SEQ ID NO: 1118821 - RNA, 19 nt, Homo sapiens
ggaguuaacuuuggagaua

SEQ ID NO: 1118822 - RNA, 19 nt, Homo sapiens
gagguagaaucaagaauua

SEQ ID NO: 1118823 - RNA, 19 nt, Homo sapiens
gaagaauccugcuuaaaug

SEQ ID NO: 1118824 - RNA, 19 nt, Homo sapiens
uaaggaagauggagaaauu

SEQ ID NO: 1118825 - RNA, 19 nt, Homo sapiens
gaagaaguguagagcauuu

SEQ ID NO: 1118826 - RNA, 19 nt, Homo sapiens
gaauagugcuucaugugua

SEQ ID NO: 1118827 - RNA, 19 nt, Homo sapiens
gaucaacuguuaauacuga

SEQ ID NO: 1118828 - RNA, 19 nt, Homo sapiens
gaacauaccacauaaagau

SEQ ID NO: 1118829 - RNA, 19 nt, Homo sapiens
gaucagaacauaccacaua

SEQ ID NO: 1118830 - RNA, 19 nt, Homo sapiens
caaagaaacuagacaaaca

SEQ ID NO: 1118831 - RNA, 19 nt, Homo sapiens
caagagaacuguugguaga

SEQ ID NO: 1118832 - RNA, 19 nt, Homo sapiens
gcagagaauucuuacugua

SEQ ID NO: 1118833 - RNA, 19 nt, Homo sapiens
gaagacaguuccaaacaug

SEQ ID NO: 1118834 - RNA, 19 nt, Homo sapiens
aaagauaacucaacagaug

SEQ ID NO: 1118835 - RNA, 19 nt, Homo sapiens
aaagaaaccuggaaguaaa

SEQ ID NO: 1118836 - RNA, 19 nt, Homo sapiens
ccacauauauugacuuugu

SEQ ID NO: 1118837 - RNA, 19 nt, Homo sapiens
aaacaaaugucacugagaa

SEQ ID NO: 1118838 - RNA, 19 nt, Homo sapiens
uaaaugaucucuaccaaca

SEQ ID NO: 1118839 - RNA, 19 nt, Homo sapiens
aaagucagaucauccaaua

SEQ ID NO: 1118840 - RNA, 19 nt, Homo sapiens
gcagauguuucuuuacaaa

SEQ ID NO: 1118841 - RNA, 19 nt, Homo sapiens
ggacaucaauuucuaacau

SEQ ID NO: 1118842 - RNA, 19 nt, Homo sapiens
gaaagacacugaggacaga

SEQ ID NO: 1118843 - RNA, 19 nt, Homo sapiens
gaaguaaaguggacagauc

SEQ ID NO: 1118844 - RNA, 19 nt, Homo sapiens
gagaagaguucagauaaug

SEQ ID NO: 1118845 - RNA, 19 nt, Homo sapiens
ucaaauaccugcuucuaau

SEQ ID NO: 1118846 - RNA, 19 nt, Homo sapiens
gaagaaaccugcgucauac

SEQ ID NO: 1118847 - RNA, 19 nt, Homo sapiens
ucagaaacauguauuguga

SEQ ID NO: 1118848 - RNA, 19 nt, Homo sapiens
ccaauacugugcauacuuu

SEQ ID NO: 1118849 - RNA, 19 nt, Homo sapiens
guaauugccuccauacaga

SEQ ID NO: 1118850 - RNA, 19 nt, Homo sapiens
gcucauaugcuauucauuu

SEQ ID NO: 1118851 - RNA, 19 nt, Homo sapiens
caacuaacuugauugauuc

SEQ ID NO: 1118852 - RNA, 19 nt, Homo sapiens
guacaagucagucaguuua

SEQ ID NO: 1118853 - RNA, 19 nt, Homo sapiens
guauguaacugcagucuug

SEQ ID NO: 1118854 - RNA, 19 nt, Homo sapiens
gaaacuuguucuucugaaa

SEQ ID NO: 1118855 - RNA, 19 nt, Homo sapiens
gaaccagugucauuagaga

SEQ ID NO: 1118856 - RNA, 19 nt, Homo sapiens
cgaaagaaguaagagauuu

SEQ ID NO: 1118857 - RNA, 19 nt, Homo sapiens
caagagaacuucaagaacu

SEQ ID NO: 1118858 - RNA, 19 nt, Homo sapiens
ccauuuaccuguggaguua

SEQ ID NO: 1118859 - RNA, 19 nt, Homo sapiens
gacuuaccaugaucaauua

SEQ ID NO: 1118860 - RNA, 19 nt, Homo sapiens
caaaugucacugagaauua

SEQ ID NO: 1118861 - RNA, 19 nt, Homo sapiens
gauauauggcugaauguua

SEQ ID NO: 1118862 - RNA, 19 nt, Homo sapiens
ggauaaggaugaacuagau

SEQ ID NO: 1118863 - RNA, 19 nt, Homo sapiens
aaacuucgcugaccuggaa

SEQ ID NO: 1118864 - RNA, 19 nt, Homo sapiens
guuaauugcucauaugcua

SEQ ID NO: 1118865 - RNA, 19 nt, Homo sapiens
ugaagaaaccugcgucaua

SEQ ID NO: 1118866 - RNA, 19 nt, Homo sapiens
ugucaaagcacaagucuua

SEQ ID NO: 1118867 - RNA, 19 nt, Homo sapiens
uaaugacgaucaccagaua

SEQ ID NO: 1118868 - RNA, 19 nt, Homo sapiens
ucaagaacauccugaauca

SEQ ID NO: 1118869 - RNA, 19 nt, Homo sapiens
gcaacaggauauaguaugu

SEQ ID NO: 1118870 - RNA, 19 nt, Homo sapiens
uaaugaaugugaagccaua

SEQ ID NO: 1118871 - RNA, 19 nt, Homo sapiens
gaaaguaagcauugaugaa

SEQ ID NO: 1118872 - RNA, 19 nt, Homo sapiens
gcaagauguuacagcauuu

SEQ ID NO: 1118873 - RNA, 19 nt, Homo sapiens
ugaagaaguccaaguauuu

SEQ ID NO: 1118874 - RNA, 19 nt, Homo sapiens
gcucugaagucucguauca

SEQ ID NO: 1118875 - RNA, 19 nt, Homo sapiens
gcauugaauuggaaaguga

SEQ ID NO: 1118876 - RNA, 19 nt, Homo sapiens
gcaacugcauuauuagaga

SEQ ID NO: 1118877 - RNA, 19 nt, Homo sapiens
gaucaaaguuaagcaauag

SEQ ID NO: 1118878 - RNA, 19 nt, Homo sapiens
gaccaucuguggauuauca

SEQ ID NO: 1118879 - RNA, 19 nt, Homo sapiens
gcacaagucuuauaaaaca

SEQ ID NO: 1118880 - RNA, 19 nt, Homo sapiens
caccagauauaccaguuua

SEQ ID NO: 1118881 - RNA, 19 nt, Homo sapiens
gaaagaaguaagagauuug

SEQ ID NO: 1118882 - RNA, 19 nt, Homo sapiens
ggaagcaauuguaguuaau

SEQ ID NO: 1118883 - RNA, 19 nt, Homo sapiens
uaaaucauaugguccuuug

SEQ ID NO: 1118884 - RNA, 19 nt, Homo sapiens
ugacagaguuagaauacaa

SEQ ID NO: 1118885 - RNA, 19 nt, Homo sapiens
guacagaucacuuagaaau

SEQ ID NO: 1118886 - RNA, 19 nt, Homo sapiens
caagucagucaguuuauua

SEQ ID NO: 1118887 - RNA, 19 nt, Homo sapiens
ggagguagaaucaagaauu

SEQ ID NO: 1118888 - RNA, 19 nt, Homo sapiens
aaacaugcuuugugaagaa

SEQ ID NO: 1118889 - RNA, 19 nt, Homo sapiens
gggaaaagcugugauaaaa

SEQ ID NO: 1118890 - RNA, 19 nt, Homo sapiens
guacgugacagaauauuaa

SEQ ID NO: 1118891 - RNA, 19 nt, Homo sapiens
gaauaacagccauuugauu

SEQ ID NO: 1118892 - RNA, 19 nt, Homo sapiens
cauauaacccuuaauguga

SEQ ID NO: 1118893 - RNA, 19 nt, Homo sapiens
caacagcagucuaauuucu

SEQ ID NO: 1118894 - RNA, 19 nt, Homo sapiens
uguaagcaauccaaguuua

SEQ ID NO: 1118895 - RNA, 19 nt, Homo sapiens
caaagcacaagucuuauaa

SEQ ID NO: 1118896 - RNA, 19 nt, Homo sapiens
cacaaucuguucuguaauu

SEQ ID NO: 1118897 - RNA, 19 nt, Homo sapiens
ucagagagacuauaaagaa

SEQ ID NO: 1118898 - RNA, 19 nt, Homo sapiens
ggcaagauguuacagcauu

SEQ ID NO: 1118899 - RNA, 19 nt, Homo sapiens
acugaaggaucaacuguua

SEQ ID NO: 1118900 - RNA, 19 nt, Homo sapiens
uaaaguaggagaagaaaga

SEQ ID NO: 1118901 - RNA, 19 nt, Homo sapiens
gcuuauaacuaaaguagga

SEQ ID NO: 1118902 - RNA, 19 nt, Homo sapiens
cuaaauauccuaagugaug

SEQ ID NO: 1118903 - RNA, 19 nt, Homo sapiens
aaaggaagcuacauauauc

SEQ ID NO: 1118904 - RNA, 19 nt, Homo sapiens
gaaggucuguuagcacuug

SEQ ID NO: 1118905 - RNA, 19 nt, Homo sapiens
agaaacagcucaugacagu

SEQ ID NO: 1118906 - RNA, 19 nt, Homo sapiens
aaagcaaacuucauggaaa

SEQ ID NO: 1118907 - RNA, 19 nt, Homo sapiens
ggaaaguugugaccuucaa

SEQ ID NO: 1118908 - RNA, 19 nt, Homo sapiens
gaauagugaucagcauuau

SEQ ID NO: 1118909 - RNA, 19 nt, Homo sapiens
cagagagacuauaaagaaa

SEQ ID NO: 1118910 - RNA, 19 nt, Homo sapiens
gcaaauuacuccaaguuuu

SEQ ID NO: 1118911 - RNA, 19 nt, Homo sapiens
gcauauaacccuuaaugug

SEQ ID NO: 1118912 - RNA, 19 nt, Homo sapiens
gaaaagaaaugugaacuuc

SEQ ID NO: 1118913 - RNA, 19 nt, Homo sapiens
gagauguacagaucacuua

SEQ ID NO: 1118914 - RNA, 19 nt, Homo sapiens
gaacacagaugaacaauuu

SEQ ID NO: 1118915 - RNA, 19 nt, Homo sapiens
caaaggaacugaaagagaa

SEQ ID NO: 1118916 - RNA, 19 nt, Homo sapiens
guagagaaaucuuacagua

SEQ ID NO: 1118917 - RNA, 19 nt, Homo sapiens
uaaggaagcuucaugcaaa

SEQ ID NO: 1118918 - RNA, 19 nt, Homo sapiens
ugaaagaaauggcaaagaa

SEQ ID NO: 1118919 - RNA, 19 nt, Homo sapiens
gaugauaggcugaggaaua

SEQ ID NO: 1118920 - RNA, 19 nt, Homo sapiens
gaagaggacuuugaaggaa

SEQ ID NO: 1118921 - RNA, 19 nt, Homo sapiens
gaagauaguaguaugcuuu

SEQ ID NO: 1118922 - RNA, 19 nt, Homo sapiens
ccagguagaugaacugaaa

SEQ ID NO: 1118923 - RNA, 19 nt, Homo sapiens
gcacuuagaagaacaagaa

SEQ ID NO: 1118924 - RNA, 19 nt, Homo sapiens
gaaggagccugccuaaagu

SEQ ID NO: 1118925 - RNA, 19 nt, Homo sapiens
gaaacaagcaggauccaaa

SEQ ID NO: 1118926 - RNA, 19 nt, Homo sapiens
gaaacuggauucucuccuu

SEQ ID NO: 1118927 - RNA, 19 nt, Homo sapiens
uauaaagacugccuugaaa

SEQ ID NO: 1118928 - RNA, 19 nt, Homo sapiens
uaaagaugauggaaaggua

SEQ ID NO: 1118929 - RNA, 19 nt, Homo sapiens
aagaagagcuggauaagau

SEQ ID NO: 1118930 - RNA, 19 nt, Homo sapiens
cagaggaaauggcaaguuu

SEQ ID NO: 1118931 - RNA, 19 nt, Homo sapiens
caauagacaucaucguuug

SEQ ID NO: 1118932 - RNA, 19 nt, Homo sapiens
gaaagaaauggcaaagaaa

SEQ ID NO: 1118933 - RNA, 19 nt, Homo sapiens
gagaaagacauaucauuga

SEQ ID NO: 1118934 - RNA, 19 nt, Homo sapiens
guuguaagcuccuuucuuc

SEQ ID NO: 1118935 - RNA, 19 nt, Homo sapiens
gaaaucagaggguguucua

SEQ ID NO: 1118936 - RNA, 19 nt, Homo sapiens
cuaccaagauuuccaagaa

SEQ ID NO: 1118937 - RNA, 19 nt, Homo sapiens
ggagacaaauaucaaagau

SEQ ID NO: 1118938 - RNA, 19 nt, Homo sapiens
aaacuggauucucuccuua

SEQ ID NO: 1118939 - RNA, 19 nt, Homo sapiens
aggaguaucucaucaguaa

SEQ ID NO: 1118940 - RNA, 19 nt, Homo sapiens
caccaaggguucacucuuu

SEQ ID NO: 1118941 - RNA, 19 nt, Homo sapiens
gaaagagaaagacauauca

SEQ ID NO: 1118942 - RNA, 19 nt, Homo sapiens
gcagaaagaccgaacuaug

SEQ ID NO: 1118943 - RNA, 19 nt, Homo sapiens
ugaaauccauggaagaaga

SEQ ID NO: 1118944 - RNA, 19 nt, Homo sapiens
cagaaagaccgaacuauga

SEQ ID NO: 1118945 - RNA, 19 nt, Homo sapiens
gaacacagcaagugaugga

SEQ ID NO: 1118946 - RNA, 19 nt, Homo sapiens
ggagcuacuugaugacauu

SEQ ID NO: 1118947 - RNA, 19 nt, Homo sapiens
gaaagggagacaaauauca

SEQ ID NO: 1118948 - RNA, 19 nt, Homo sapiens
gaaagaaugcugagauuuu

SEQ ID NO: 1118949 - RNA, 19 nt, Homo sapiens
ucaagucucuggugaggaa

SEQ ID NO: 1118950 - RNA, 19 nt, Homo sapiens
gagcagauauuagaugaag

SEQ ID NO: 1118951 - RNA, 19 nt, Homo sapiens
gcagcacauucaaccauuu

SEQ ID NO: 1118952 - RNA, 19 nt, Homo sapiens
gcacccaucucccagacaa

SEQ ID NO: 1118953 - RNA, 19 nt, Homo sapiens
cuuggaagcuucaccagua

SEQ ID NO: 1118954 - RNA, 19 nt, Homo sapiens
gaugagagcucuucaaaag

SEQ ID NO: 1118955 - RNA, 19 nt, Homo sapiens
acauugagcucuugaaaca

SEQ ID NO: 1118956 - RNA, 19 nt, Homo sapiens
gagccugccuaaaguagaa

SEQ ID NO: 1118957 - RNA, 19 nt, Homo sapiens
gcagcgaguuauugaguau

SEQ ID NO: 1118958 - RNA, 19 nt, Homo sapiens
ggaaagaaugcugagauuu

SEQ ID NO: 1118959 - RNA, 19 nt, Homo sapiens
aaauggaggugaaagaaau

SEQ ID NO: 1118960 - RNA, 19 nt, Homo sapiens
caagaaugcugccgacucu

SEQ ID NO: 1118961 - RNA, 19 nt, Homo sapiens
guauaaagacugccuugaa

SEQ ID NO: 1118962 - RNA, 19 nt, Homo sapiens
gcaaaacacccaaaauaaa

SEQ ID NO: 1118963 - RNA, 19 nt, Homo sapiens
ggaaauggcaaguuugaca

SEQ ID NO: 1118964 - RNA, 19 nt, Homo sapiens
gaagaagagcuggauaaga

SEQ ID NO: 1118965 - RNA, 19 nt, Homo sapiens
gaagaaugacuuaaaggau

SEQ ID NO: 1118966 - RNA, 19 nt, Homo sapiens
gcccaggucucaauuucaa

SEQ ID NO: 1118967 - RNA, 19 nt, Homo sapiens
uagaugaagucgagaugaa

SEQ ID NO: 1118968 - RNA, 19 nt, Homo sapiens
uaaaggaaaugggcaguca

SEQ ID NO: 1118969 - RNA, 19 nt, Homo sapiens
agagacaccugacauggaa

SEQ ID NO: 1118970 - RNA, 19 nt, Homo sapiens
gaggaaauggcaaguuuga

SEQ ID NO: 1118971 - RNA, 19 nt, Homo sapiens
gcacgagaaugaugauagg

SEQ ID NO: 1118972 - RNA, 19 nt, Homo sapiens
caauaaugcacgagaauga

SEQ ID NO: 1118973 - RNA, 19 nt, Homo sapiens
uggauaagauggagagaga

SEQ ID NO: 1118974 - RNA, 19 nt, Homo sapiens
gaggaggcacugcaaauga

SEQ ID NO: 1118975 - RNA, 19 nt, Homo sapiens
gagcaaagaaacuggauuc

SEQ ID NO: 1118976 - RNA, 19 nt, Homo sapiens
gaucaaaggcacuuagaag

SEQ ID NO: 1118977 - RNA, 19 nt, Homo sapiens
cuggaacagucaagaauuu

SEQ ID NO: 1118978 - RNA, 19 nt, Homo sapiens
aguaucacauuucagguua

SEQ ID NO: 1118979 - RNA, 19 nt, Homo sapiens
gaaaacagaacacagauga

SEQ ID NO: 1118980 - RNA, 19 nt, Homo sapiens
cgugggcccuccaucuuua

SEQ ID NO: 1118981 - RNA, 19 nt, Homo sapiens
uagaugaacugaaauccau

SEQ ID NO: 1118982 - RNA, 19 nt, Homo sapiens
ucaaaggcacuuagaagaa

SEQ ID NO: 1118983 - RNA, 19 nt, Homo sapiens
uaaggcaugugacucauca

SEQ ID NO: 1118984 - RNA, 19 nt, Homo sapiens
ugucuaguaucuccuauga

SEQ ID NO: 1118985 - RNA, 19 nt, Homo sapiens
uggaaagaaugcugagauu

SEQ ID NO: 1118986 - RNA, 19 nt, Homo sapiens
gaaauggcaaguuugacaa

SEQ ID NO: 1118987 - RNA, 19 nt, Homo sapiens
ccaaagccacacaguuuaa

SEQ ID NO: 1118988 - RNA, 19 nt, Homo sapiens
gccaaagccacacaguuua

SEQ ID NO: 1118989 - RNA, 19 nt, Homo sapiens
cauccacgguguugcauga

SEQ ID NO: 1118990 - RNA, 19 nt, Homo sapiens
gaacugaaagagaaagaca

SEQ ID NO: 1118991 - RNA, 19 nt, Homo sapiens
ccgaaaccuuacuaugaua

SEQ ID NO: 1118992 - RNA, 19 nt, Homo sapiens
ccagggagacucagaauca

SEQ ID NO: 1118993 - RNA, 19 nt, Homo sapiens
ccaaagaaacugaagaucu

SEQ ID NO: 1118994 - RNA, 19 nt, Homo sapiens
agagaaagacauaucauug

SEQ ID NO: 1118995 - RNA, 19 nt, Homo sapiens
ccaaaggaacugaaagaga

SEQ ID NO: 1118996 - RNA, 19 nt, Homo sapiens
caucaaaggagucaccaaa

SEQ ID NO: 1118997 - RNA, 19 nt, Homo sapiens
gaacaagaagagacaucaa

SEQ ID NO: 1118998 - RNA, 19 nt, Homo sapiens
guacugaagaugaacaaga

SEQ ID NO: 1118999 - RNA, 19 nt, Homo sapiens
agaggacuuugaaggaaua

SEQ ID NO: 1119000 - RNA, 19 nt, Homo sapiens
gauggaaagguacacuuaa

SEQ ID NO: 1119001 - RNA, 19 nt, Homo sapiens
gagaagccaagagcaauuu

SEQ ID NO: 1119002 - RNA, 19 nt, Homo sapiens
ggauaaucgugcuggauca

SEQ ID NO: 1119003 - RNA, 19 nt, Homo sapiens
gaaccagacagcucuuuua

SEQ ID NO: 1119004 - RNA, 19 nt, Homo sapiens
ccaagcaaguucugacaca

SEQ ID NO: 1119005 - RNA, 19 nt, Homo sapiens
guaagugugugcuggaucu

SEQ ID NO: 1119006 - RNA, 19 nt, Homo sapiens
gcaaaacgguucacucagu

SEQ ID NO: 1119007 - RNA, 19 nt, Homo sapiens
gauuggaauuggaucauag

SEQ ID NO: 1119008 - RNA, 19 nt, Homo sapiens
uagaagaacaagaaacuga

SEQ ID NO: 1119009 - RNA, 19 nt, Homo sapiens
caaaggcacuuagaagaac

SEQ ID NO: 1119010 - RNA, 19 nt, Homo sapiens
agaaggagccugccuaaag

SEQ ID NO: 1119011 - RNA, 19 nt, Homo sapiens
ucaaaggagucaccaaagg

SEQ ID NO: 1119012 - RNA, 19 nt, Homo sapiens
cgaugucaaugucuaucua

SEQ ID NO: 1119013 - RNA, 19 nt, Homo sapiens
ggaaaucauagaacuaaag

SEQ ID NO: 1119014 - RNA, 19 nt, Homo sapiens
gagaagaccuccaguauau

SEQ ID NO: 1119015 - RNA, 19 nt, Homo sapiens
gcaggcaaauuacaccuuu

SEQ ID NO: 1119016 - RNA, 19 nt, Homo sapiens
caacucagaugccuuucaa

SEQ ID NO: 1119017 - RNA, 19 nt, Homo sapiens
gaucucaggucaguacaaa

SEQ ID NO: 1119018 - RNA, 19 nt, Homo sapiens
uauuguagcaggcaaauua

SEQ ID NO: 1119019 - RNA, 19 nt, Homo sapiens
ugacggaacucaaggaaca

SEQ ID NO: 1119020 - RNA, 19 nt, Homo sapiens
gguguaaagcugugaauuu

SEQ ID NO: 1119021 - RNA, 19 nt, Homo sapiens
gcagagaagaccuccagua

SEQ ID NO: 1119022 - RNA, 19 nt, Homo sapiens
gggccaggcuacaguguuu

SEQ ID NO: 1119023 - RNA, 19 nt, Homo sapiens
gggaggagguggaagacaa

SEQ ID NO: 1119024 - RNA, 19 nt, Homo sapiens
gaagagggcuagugaaacc

SEQ ID NO: 1119025 - RNA, 19 nt, Homo sapiens
gagaauauauccuuauccu

SEQ ID NO: 1119026 - RNA, 19 nt, Homo sapiens
agaaagaucucaggucagu

SEQ ID NO: 1119027 - RNA, 19 nt, Homo sapiens
cagagaagaccuccaguau

SEQ ID NO: 1119028 - RNA, 19 nt, Homo sapiens
agagaagaccuccaguaua

SEQ ID NO: 1119029 - RNA, 19 nt, Homo sapiens
gggaauagacccucaagag

SEQ ID NO: 1119030 - RNA, 19 nt, Homo sapiens
ccucaaaccugacggaacu

SEQ ID NO: 1119031 - RNA, 19 nt, Homo sapiens
gaaacgugguggccuucau

SEQ ID NO: 1119032 - RNA, 19 nt, Homo sapiens
cuucgagaauauauccuua

SEQ ID NO: 1119033 - RNA, 19 nt, Homo sapiens
gcaaugaggcgaccuucca

SEQ ID NO: 1119034 - RNA, 19 nt, Homo sapiens
ucucagccauacccaauau

SEQ ID NO: 1119035 - RNA, 19 nt, Homo sapiens
gggcuuggguccacagucu

SEQ ID NO: 1119036 - RNA, 19 nt, Homo sapiens
gaaaaggagaggagaggua

SEQ ID NO: 1119037 - RNA, 19 nt, Homo sapiens
gcagagagagcgggacaug

SEQ ID NO: 1119038 - RNA, 19 nt, Homo sapiens
gaacagcaggagauggaau

SEQ ID NO: 1119039 - RNA, 19 nt, Homo sapiens
guguaaagcugugaauuuu

SEQ ID NO: 1119040 - RNA, 19 nt, Homo sapiens
gaagaccuccaguauaucg

SEQ ID NO: 1119041 - RNA, 19 nt, Homo sapiens
gcuagccuguggucagaug

SEQ ID NO: 1119042 - RNA, 19 nt, Homo sapiens
ggccuugggugugcgcuuu

SEQ ID NO: 1119043 - RNA, 19 nt, Homo sapiens
ggacugcccgugguguaaa

SEQ ID NO: 1119044 - RNA, 19 nt, Homo sapiens
gggacaugcugagauggaa

SEQ ID NO: 1119045 - RNA, 19 nt, Homo sapiens
ggagauggaaugcaaugag

SEQ ID NO: 1119046 - RNA, 19 nt, Homo sapiens
cugaagagggcuagugaaa

SEQ ID NO: 1119047 - RNA, 19 nt, Homo sapiens
uugcggaggugcagagaga

SEQ ID NO: 1119048 - RNA, 19 nt, Homo sapiens
gagagacuccgaacuccau

SEQ ID NO: 1119049 - RNA, 19 nt, Homo sapiens
ccagcucccuaccucauuc

SEQ ID NO: 1119050 - RNA, 19 nt, Homo sapiens
gaacuccaucagcagagaa

SEQ ID NO: 1119051 - RNA, 19 nt, Homo sapiens
ucaaggaacagcaggagau

SEQ ID NO: 1119052 - RNA, 19 nt, Homo sapiens
ucgagaauauauccuuauc

SEQ ID NO: 1119053 - RNA, 19 nt, Homo sapiens
cgaacuccaucagcagaga

SEQ ID NO: 1119054 - RNA, 19 nt, Homo sapiens
gggcagagggagaaagauc

SEQ ID NO: 1119055 - RNA, 19 nt, Homo sapiens
gaaagaucucaggucagua

SEQ ID NO: 1119056 - RNA, 19 nt, Homo sapiens
ccucauucacauacucaua

SEQ ID NO: 1119057 - RNA, 19 nt, Homo sapiens
gagcgggacaugcugagau

SEQ ID NO: 1119058 - RNA, 19 nt, Homo sapiens
agcaggagauggaaugcaa

SEQ ID NO: 1119059 - RNA, 19 nt, Homo sapiens
gcgcuggucuuggccucaa

SEQ ID NO: 1119060 - RNA, 19 nt, Homo sapiens
aaagaucucaggucaguac

SEQ ID NO: 1119061 - RNA, 19 nt, Homo sapiens
gggacugcccgugguguaa

SEQ ID NO: 1119062 - RNA, 19 nt, Homo sapiens
ucauacccaugcccuuugu

SEQ ID NO: 1119063 - RNA, 19 nt, Homo sapiens
ugaggcgaccuuccaguug

SEQ ID NO: 1119064 - RNA, 19 nt, Homo sapiens
uugccaaacugcacagauc

SEQ ID NO: 1119065 - RNA, 19 nt, Homo sapiens
ucucaggucaguacaaaca

SEQ ID NO: 1119066 - RNA, 19 nt, Homo sapiens
agccaugucugucuucucu

SEQ ID NO: 1119067 - RNA, 19 nt, Homo sapiens
caaggaacagcaggagaug

SEQ ID NO: 1119068 - RNA, 19 nt, Homo sapiens
gggcuagugaaaccguuaa

SEQ ID NO: 1119069 - RNA, 19 nt, Homo sapiens
uguggaggcccagggaaua

SEQ ID NO: 1119070 - RNA, 19 nt, Homo sapiens
ggaggagguggaagacaag

SEQ ID NO: 1119071 - RNA, 19 nt, Homo sapiens
gcaaagaccuccaguauau

SEQ ID NO: 1119072 - RNA, 19 nt, Homo sapiens
cagagaagcuggagagaau

SEQ ID NO: 1119073 - RNA, 19 nt, Homo sapiens
gaaacagccacaucuuauu

SEQ ID NO: 1119074 - RNA, 19 nt, Homo sapiens
gggagaagguggaagacaa

SEQ ID NO: 1119075 - RNA, 19 nt, Homo sapiens
gcagagggauguggagguu

SEQ ID NO: 1119076 - RNA, 19 nt, Homo sapiens
gaagagggcuagugaaacc

SEQ ID NO: 1119077 - RNA, 19 nt, Homo sapiens
gguguaacgcugugaauuu

SEQ ID NO: 1119078 - RNA, 19 nt, Homo sapiens
aaacagccacaucuuauuu

SEQ ID NO: 1119079 - RNA, 19 nt, Homo sapiens
cagcaaagaccuccaguau

SEQ ID NO: 1119080 - RNA, 19 nt, Homo sapiens
gagaauauauccuuauccu

SEQ ID NO: 1119081 - RNA, 19 nt, Homo sapiens
cgaaacagccacaucuuau

SEQ ID NO: 1119082 - RNA, 19 nt, Homo sapiens
guccagagccucaucagaa

SEQ ID NO: 1119083 - RNA, 19 nt, Homo sapiens
gaaccgaagcauguauaaa

SEQ ID NO: 1119084 - RNA, 19 nt, Homo sapiens
aagggaaucuggcugcaaa

SEQ ID NO: 1119085 - RNA, 19 nt, Homo sapiens
ucgaaacagccacaucuua

SEQ ID NO: 1119086 - RNA, 19 nt, Homo sapiens
aaauagaaccgaagcaugu

SEQ ID NO: 1119087 - RNA, 19 nt, Homo sapiens
ucagacauacccacuauau

SEQ ID NO: 1119088 - RNA, 19 nt, Homo sapiens
ucucagacauacccacuau

SEQ ID NO: 1119089 - RNA, 19 nt, Homo sapiens
gcagaaagagagagacaag

SEQ ID NO: 1119090 - RNA, 19 nt, Homo sapiens
gcacaggccuuggcaucag

SEQ ID NO: 1119091 - RNA, 19 nt, Homo sapiens
acagcgaggugcccaguga

SEQ ID NO: 1119092 - RNA, 19 nt, Homo sapiens
ccucauacucauacucaua

SEQ ID NO: 1119093 - RNA, 19 nt, Homo sapiens
gaucuccggucggucgaaa

SEQ ID NO: 1119094 - RNA, 19 nt, Homo sapiens
ucgccaaacugcacaaauc

SEQ ID NO: 1119095 - RNA, 19 nt, Homo sapiens
uggagaugcugaucaggaa

SEQ ID NO: 1119096 - RNA, 19 nt, Homo sapiens
gcagaaaugcaaaauagaa

SEQ ID NO: 1119097 - RNA, 19 nt, Homo sapiens
ggacugcccuugguguaac

SEQ ID NO: 1119098 - RNA, 19 nt, Homo sapiens
gggaggccuuugauacuag

SEQ ID NO: 1119099 - RNA, 19 nt, Homo sapiens
ugggaggccuuugauacua

SEQ ID NO: 1119100 - RNA, 19 nt, Homo sapiens
auacuagccuguggucuga

SEQ ID NO: 1119101 - RNA, 19 nt, Homo sapiens
agaaagagagagacaagga

SEQ ID NO: 1119102 - RNA, 19 nt, Homo sapiens
ccauggagaccacagagaa

SEQ ID NO: 1119103 - RNA, 19 nt, Homo sapiens
gagcagcugaggaggaaga

SEQ ID NO: 1119104 - RNA, 19 nt, Homo sapiens
ucguggaggugcagaaaga

SEQ ID NO: 1119105 - RNA, 19 nt, Homo sapiens
ggccuugggugugcgcuuu

SEQ ID NO: 1119106 - RNA, 19 nt, Homo sapiens
cagcugaggaggaagaaga

SEQ ID NO: 1119107 - RNA, 19 nt, Homo sapiens
uagaaccgaagcauguaua

SEQ ID NO: 1119108 - RNA, 19 nt, Homo sapiens
cugaagagggcuagugaaa

SEQ ID NO: 1119109 - RNA, 19 nt, Homo sapiens
gcaacgugguggccuucau

SEQ ID NO: 1119110 - RNA, 19 nt, Homo sapiens
agagggauguggagguugu

SEQ ID NO: 1119111 - RNA, 19 nt, Homo sapiens
gaaaaggagcagaagaaga

SEQ ID NO: 1119112 - RNA, 19 nt, Homo sapiens
ccacaggcaggcacagcua

SEQ ID NO: 1119113 - RNA, 19 nt, Homo sapiens
ggucgaaacagccacaucu

SEQ ID NO: 1119114 - RNA, 19 nt, Homo sapiens
ggagaagguggaagacaag

SEQ ID NO: 1119115 - RNA, 19 nt, Homo sapiens
gaagggaaucuggcugcaa

SEQ ID NO: 1119116 - RNA, 19 nt, Homo sapiens
ccagcucccugccucauac

SEQ ID NO: 1119117 - RNA, 19 nt, Homo sapiens
gggacugcccuugguguaa

SEQ ID NO: 1119118 - RNA, 19 nt, Homo sapiens
cuccgaaccucaucagcaa

SEQ ID NO: 1119119 - RNA, 19 nt, Homo sapiens
gagauacuccgaaccucau

SEQ ID NO: 1119120 - RNA, 19 nt, Homo sapiens
aguagcggguuccggcaua

SEQ ID NO: 1119121 - RNA, 19 nt, Homo sapiens
agcaaagaccuccaguaua

SEQ ID NO: 1119122 - RNA, 19 nt, Homo sapiens
agccacaucuuauuucucu

SEQ ID NO: 1119123 - RNA, 19 nt, Homo sapiens
agacauacccacuauaucc

SEQ ID NO: 1119124 - RNA, 19 nt, Homo sapiens
gcacggcuucgccaaacug

SEQ ID NO: 1119125 - RNA, 19 nt, Homo sapiens
guguaacgcugugaauuuu

SEQ ID NO: 1119126 - RNA, 19 nt, Homo sapiens
gcagaaggagggagaucuc

SEQ ID NO: 1119127 - RNA, 19 nt, Homo sapiens
ggagaugcugaucaggaaa

SEQ ID NO: 1119128 - RNA, 19 nt, Homo sapiens
aagaagagcagagggaugu

SEQ ID NO: 1119129 - RNA, 19 nt, Homo sapiens
aggagcagcugaggaggaa

SEQ ID NO: 1119130 - RNA, 19 nt, Homo sapiens
ggagggauacuugcuucga

SEQ ID NO: 1119131 - RNA, 19 nt, Homo sapiens
ucagcaaagaccuccagua

SEQ ID NO: 1119132 - RNA, 19 nt, Homo sapiens
caggagcacccaagagaca

SEQ ID NO: 1119133 - RNA, 19 nt, Homo sapiens
caacgugguggccuucauc

SEQ ID NO: 1119134 - RNA, 19 nt, Homo sapiens
ggaggugcagaaagagaga

SEQ ID NO: 1119135 - RNA, 19 nt, Homo sapiens
agaaccgaagcauguauaa

SEQ ID NO: 1119136 - RNA, 19 nt, Homo sapiens
cacaggccuuggcaucaga

SEQ ID NO: 1119137 - RNA, 19 nt, Homo sapiens
gggcuagugaaaccguuaa

SEQ ID NO: 1119138 - RNA, 19 nt, Homo sapiens
cgacugggaggccuuugau

SEQ ID NO: 1119139 - RNA, 19 nt, Homo sapiens
auacucauacucauacuca

SEQ ID NO: 1119140 - RNA, 19 nt, Homo sapiens
caggaaaaguacaccuauu

SEQ ID NO: 1119141 - RNA, 19 nt, Homo sapiens
acagagaagcuggagagaa

SEQ ID NO: 1119142 - RNA, 19 nt, Homo sapiens
gacugggaggccuuugaua

SEQ ID NO: 1119143 - RNA, 19 nt, Homo sapiens
gcaggcacagcuacaaagg

SEQ ID NO: 1119144 - RNA, 19 nt, Homo sapiens
cgacagagguuuacaguga

SEQ ID NO: 1119145 - RNA, 19 nt, Homo sapiens
gcaaacacauuacacagau

SEQ ID NO: 1119146 - RNA, 19 nt, Homo sapiens
ugagauagaugaacucuuc

SEQ ID NO: 1119147 - RNA, 19 nt, Homo sapiens
ugaaagcucucgaguuguu

SEQ ID NO: 1119148 - RNA, 19 nt, Homo sapiens
caaagaagccaaugcuauu

SEQ ID NO: 1119149 - RNA, 19 nt, Homo sapiens
gaugugagcaaggaaauua

SEQ ID NO: 1119150 - RNA, 19 nt, Homo sapiens
gauggcaaaucaccuugua

SEQ ID NO: 1119151 - RNA, 19 nt, Homo sapiens
ccacagcuguccucucuug

SEQ ID NO: 1119152 - RNA, 19 nt, Homo sapiens
gcugagaauuuaaccuauu

SEQ ID NO: 1119153 - RNA, 19 nt, Homo sapiens
caaacacauuacacagaua

SEQ ID NO: 1119154 - RNA, 19 nt, Homo sapiens
uuugaaagcucucgaguug

SEQ ID NO: 1119155 - RNA, 19 nt, Homo sapiens
uaaaugaugugagcaagga

SEQ ID NO: 1119156 - RNA, 19 nt, Homo sapiens
uguaaagccugauaauaga

SEQ ID NO: 1119157 - RNA, 19 nt, Homo sapiens
gcaagaggccaagagaauu

SEQ ID NO: 1119158 - RNA, 19 nt, Homo sapiens
gagcaaggaaauuaaucua

SEQ ID NO: 1119159 - RNA, 19 nt, Homo sapiens
ucaaagaagccaaugcuau

SEQ ID NO: 1119160 - RNA, 19 nt, Homo sapiens
caagaggccaagagaauug

SEQ ID NO: 1119161 - RNA, 19 nt, Homo sapiens
gcuggugccuucggaauau

SEQ ID NO: 1119162 - RNA, 19 nt, Homo sapiens
gaugaagccuuggagaaag

SEQ ID NO: 1119163 - RNA, 19 nt, Homo sapiens
ugagagagcagcaguagau

SEQ ID NO: 1119164 - RNA, 19 nt, Homo sapiens
gcaaagcuuuuaagugaga

SEQ ID NO: 1119165 - RNA, 19 nt, Homo sapiens
gcaaaucaccuuguaaagc

SEQ ID NO: 1119166 - RNA, 19 nt, Homo sapiens
cagcuguccucucuuggaa

SEQ ID NO: 1119167 - RNA, 19 nt, Homo sapiens
gguuuacagugauugcaaa

SEQ ID NO: 1119168 - RNA, 19 nt, Homo sapiens
guccacagcuguccucucu

SEQ ID NO: 1119169 - RNA, 19 nt, Homo sapiens
augcaaagcuuuuaaguga

SEQ ID NO: 1119170 - RNA, 19 nt, Homo sapiens
uggcaaaucaccuuguaaa

SEQ ID NO: 1119171 - RNA, 19 nt, Homo sapiens
guaaagccugauaauagaa

SEQ ID NO: 1119172 - RNA, 19 nt, Homo sapiens
aagcugagaauuuaaccua

SEQ ID NO: 1119173 - RNA, 19 nt, Homo sapiens
gacagagguuuacagugau

SEQ ID NO: 1119174 - RNA, 19 nt, Homo sapiens
acagagguuuacagugauu

SEQ ID NO: 1119175 - RNA, 19 nt, Homo sapiens
gagagcagcaguagaugca

SEQ ID NO: 1119176 - RNA, 19 nt, Homo sapiens
uuguaaagccugauaauag

SEQ ID NO: 1119177 - RNA, 19 nt, Homo sapiens
cuaauguugucuaccuaug

SEQ ID NO: 1119178 - RNA, 19 nt, Homo sapiens
agaugaagccuuggagaaa

SEQ ID NO: 1119179 - RNA, 19 nt, Homo sapiens
ccauaccgcgaacuuugua

SEQ ID NO: 1119180 - RNA, 19 nt, Homo sapiens
agugauugcaaacacauua

SEQ ID NO: 1119181 - RNA, 19 nt, Homo sapiens
aagaugaagccuuggagaa

SEQ ID NO: 1119182 - RNA, 19 nt, Homo sapiens
cuuguaaagccugauaaua

SEQ ID NO: 1119183 - RNA, 19 nt, Homo sapiens
ucugaaauuuccggacuau

SEQ ID NO: 1119184 - RNA, 19 nt, Homo sapiens
aaucuaauguugucuaccu

SEQ ID NO: 1119185 - RNA, 19 nt, Homo sapiens
uuacagugauugcaaacac

SEQ ID NO: 1119186 - RNA, 19 nt, Homo sapiens
ugcaagaggccaagagaau

SEQ ID NO: 1119187 - RNA, 19 nt, Homo sapiens
acauugaugagauagauga

SEQ ID NO: 1119188 - RNA, 19 nt, Homo sapiens
augaagccuuggagaaaga

SEQ ID NO: 1119189 - RNA, 19 nt, Homo sapiens
gcuguccucucuuggaaaa

SEQ ID NO: 1119190 - RNA, 19 nt, Homo sapiens
agagaguuccugcgacaga

SEQ ID NO: 1119191 - RNA, 19 nt, Homo sapiens
gagucuccagugccagaua

SEQ ID NO: 1119192 - RNA, 19 nt, Homo sapiens
gcaaugacauccauaauuu

SEQ ID NO: 1119193 - RNA, 19 nt, Homo sapiens
gaauagagccuuugugaaa

SEQ ID NO: 1119194 - RNA, 19 nt, Homo sapiens
uaacagacauucagauuga

SEQ ID NO: 1119195 - RNA, 19 nt, Homo sapiens
gagguuggcuuguaaauga

SEQ ID NO: 1119196 - RNA, 19 nt, Homo sapiens
gaacuuggcugugcaaugu

SEQ ID NO: 1119197 - RNA, 19 nt, Homo sapiens
guacugcaauguaaagaua

SEQ ID NO: 1119198 - RNA, 19 nt, Homo sapiens
gcaaauguaugcacaacuu

SEQ ID NO: 1119199 - RNA, 19 nt, Homo sapiens
ggaguugccucauuuagaa

SEQ ID NO: 1119200 - RNA, 19 nt, Homo sapiens
gaagaagccuuaaguuugg

SEQ ID NO: 1119201 - RNA, 19 nt, Homo sapiens
gaacugggcacuuaccaua

SEQ ID NO: 1119202 - RNA, 19 nt, Homo sapiens
cgaaacaucuaaugaagaa

SEQ ID NO: 1119203 - RNA, 19 nt, Homo sapiens
gggaugacaccaaauauua

SEQ ID NO: 1119204 - RNA, 19 nt, Homo sapiens
ggaagaaccaauugauaua

SEQ ID NO: 1119205 - RNA, 19 nt, Homo sapiens
ugacaaagauccagugaug

SEQ ID NO: 1119206 - RNA, 19 nt, Homo sapiens
gaaguuagagccaaauuga

SEQ ID NO: 1119207 - RNA, 19 nt, Homo sapiens
gaugcugacuguuuaaauu

SEQ ID NO: 1119208 - RNA, 19 nt, Homo sapiens
guagaaacccagaagaaua

SEQ ID NO: 1119209 - RNA, 19 nt, Homo sapiens
gaagauuacuguugagagu

SEQ ID NO: 1119210 - RNA, 19 nt, Homo sapiens
ggaggagguuggcuuguaa

SEQ ID NO: 1119211 - RNA, 19 nt, Homo sapiens
gaugaagagucagaagaua

SEQ ID NO: 1119212 - RNA, 19 nt, Homo sapiens
guaaagauauguugaugag

SEQ ID NO: 1119213 - RNA, 19 nt, Homo sapiens
uaaugaagcucagugguuu

SEQ ID NO: 1119214 - RNA, 19 nt, Homo sapiens
gagaauggacaacaaauug

SEQ ID NO: 1119215 - RNA, 19 nt, Homo sapiens
ucaaugaacugguuacaca

SEQ ID NO: 1119216 - RNA, 19 nt, Homo sapiens
ucuaaucgcugaugaaugu

SEQ ID NO: 1119217 - RNA, 19 nt, Homo sapiens
ucaccaagcugcagaggaa

SEQ ID NO: 1119218 - RNA, 19 nt, Homo sapiens
aagagaaucuguuggguuu

SEQ ID NO: 1119219 - RNA, 19 nt, Homo sapiens
ugaagaagccuuaaguuug

SEQ ID NO: 1119220 - RNA, 19 nt, Homo sapiens
ugaauaugcuguauaguca

SEQ ID NO: 1119221 - RNA, 19 nt, Homo sapiens
gcaauaauagcaauggaaa

SEQ ID NO: 1119222 - RNA, 19 nt, Homo sapiens
uaaaguguuugcuucguuu

SEQ ID NO: 1119223 - RNA, 19 nt, Homo sapiens
gcaaacaaggaacauuuaa

SEQ ID NO: 1119224 - RNA, 19 nt, Homo sapiens
ccgagaugcugacuguuua

SEQ ID NO: 1119225 - RNA, 19 nt, Homo sapiens
ggaaaagccugcacacuau

SEQ ID NO: 1119226 - RNA, 19 nt, Homo sapiens
acagggaccuucucaaaug

SEQ ID NO: 1119227 - RNA, 19 nt, Homo sapiens
gaagcucagugguuucgaa

SEQ ID NO: 1119228 - RNA, 19 nt, Homo sapiens
guaaaguguuugcuucguu

SEQ ID NO: 1119229 - RNA, 19 nt, Homo sapiens
cuaccaugcuucuaaguuu

SEQ ID NO: 1119230 - RNA, 19 nt, Homo sapiens
ucaaagagcaucuaugugu

SEQ ID NO: 1119231 - RNA, 19 nt, Homo sapiens
gaaauaacagacauucaga

SEQ ID NO: 1119232 - RNA, 19 nt, Homo sapiens
aaguuuagcugcccaguuu

SEQ ID NO: 1119233 - RNA, 19 nt, Homo sapiens
gagacaagcugccaguagu

SEQ ID NO: 1119234 - RNA, 19 nt, Homo sapiens
cagaaaugcuggcuaaagu

SEQ ID NO: 1119235 - RNA, 19 nt, Homo sapiens
gugaagaagccuuaaguuu

SEQ ID NO: 1119236 - RNA, 19 nt, Homo sapiens
cagaaucaaugaacugguu

SEQ ID NO: 1119237 - RNA, 19 nt, Homo sapiens
aaacagggaccuucucaaa

SEQ ID NO: 1119238 - RNA, 19 nt, Homo sapiens
uagaaacccagaagaauaa

SEQ ID NO: 1119239 - RNA, 19 nt, Homo sapiens
cuauggaacugggcacuua

SEQ ID NO: 1119240 - RNA, 19 nt, Homo sapiens
guacgaguuugaaguuaga

SEQ ID NO: 1119241 - RNA, 19 nt, Homo sapiens
ucucaaugcuguaaaccua

SEQ ID NO: 1119242 - RNA, 19 nt, Homo sapiens
uggagaagauuacuguuga

SEQ ID NO: 1119243 - RNA, 19 nt, Homo sapiens
caacuugguuaaccucuca

SEQ ID NO: 1119244 - RNA, 19 nt, Homo sapiens
uaacauaccagaggcaauu

SEQ ID NO: 1119245 - RNA, 19 nt, Homo sapiens
gagaaucuguuggguuuca

SEQ ID NO: 1119246 - RNA, 19 nt, Homo sapiens
ccaguuugcucuagagaau

SEQ ID NO: 1119247 - RNA, 19 nt, Homo sapiens
ugaaauggaucuggacuuc

SEQ ID NO: 1119248 - RNA, 19 nt, Homo sapiens
gaaaugcuggcuaaaguuc

SEQ ID NO: 1119249 - RNA, 19 nt, Homo sapiens
cgacugauuaugaugaaua

SEQ ID NO: 1119250 - RNA, 19 nt, Homo sapiens
gaaauggcaguaaaccuau

SEQ ID NO: 1119251 - RNA, 19 nt, Homo sapiens
uaccaugcuucuaaguuua

SEQ ID NO: 1119252 - RNA, 19 nt, Homo sapiens
gcuguuaccugaauuugca

SEQ ID NO: 1119253 - RNA, 19 nt, Homo sapiens
gaacugguuacacaacauu

SEQ ID NO: 1119254 - RNA, 19 nt, Homo sapiens
ggcagaagcugaacgacau

SEQ ID NO: 1119255 - RNA, 19 nt, Homo sapiens
gaaacccagaagaauaaua

SEQ ID NO: 1119256 - RNA, 19 nt, Homo sapiens
uuacaacuuuggaguagaa

SEQ ID NO: 1119257 - RNA, 19 nt, Homo sapiens
agaaauggcaguaaaccua

SEQ ID NO: 1119258 - RNA, 19 nt, Homo sapiens
cuuauaagaugucccaguu

SEQ ID NO: 1119259 - RNA, 19 nt, Homo sapiens
gaaagaaauggaucgacuu

SEQ ID NO: 1119260 - RNA, 19 nt, Homo sapiens
gaguagaaacccagaagaa

SEQ ID NO: 1119261 - RNA, 19 nt, Homo sapiens
caucaucucuguuacaacu

SEQ ID NO: 1119262 - RNA, 19 nt, Homo sapiens
ccaaggagaagauugaaga

SEQ ID NO: 1119263 - RNA, 19 nt, Homo sapiens
gaaauacuacaucuugaca

SEQ ID NO: 1119264 - RNA, 19 nt, Homo sapiens
ccuugaagcugucauggaa

SEQ ID NO: 1119265 - RNA, 19 nt, Homo sapiens
uagcaaacaaggaacauuu

SEQ ID NO: 1119266 - RNA, 19 nt, Homo sapiens
gcuaugauauugggaagau

SEQ ID NO: 1119267 - RNA, 19 nt, Homo sapiens
gcuaugaaacucagaugaa

SEQ ID NO: 1119268 - RNA, 19 nt, Homo sapiens
uaaagacuacccagaaaug

SEQ ID NO: 1119269 - RNA, 19 nt, Homo sapiens
caacgacugauuaugauga

SEQ ID NO: 1119270 - RNA, 19 nt, Homo sapiens
caaaguauucaacgacuga

SEQ ID NO: 1119271 - RNA, 19 nt, Homo sapiens
gcaguaaaccuauggaacu

SEQ ID NO: 1119272 - RNA, 19 nt, Homo sapiens
gaaauugcuucugcuguac

SEQ ID NO: 1119273 - RNA, 19 nt, Homo sapiens
ucaccuaccaugcuucuaa

SEQ ID NO: 1119274 - RNA, 19 nt, Homo sapiens
aggagaagauugaagaaau

SEQ ID NO: 1119275 - RNA, 19 nt, Homo sapiens
ugacaugcccuuagacuuc

SEQ ID NO: 1119276 - RNA, 19 nt, Homo sapiens
gggagucuauggcugaaau

SEQ ID NO: 1119277 - RNA, 19 nt, Homo sapiens
gauauugggaagauggaua

SEQ ID NO: 1119278 - RNA, 19 nt, Homo sapiens
gauggaucaugaaagagaa

SEQ ID NO: 1119279 - RNA, 19 nt, Homo sapiens
agccaaagcuaugauauug

SEQ ID NO: 1119280 - RNA, 19 nt, Homo sapiens
agaugaauaugcuguauag

SEQ ID NO: 1119281 - RNA, 19 nt, Homo sapiens
acuaaagacuacccagaaa

SEQ ID NO: 1119282 - RNA, 19 nt, Homo sapiens
uugaagaaauggcaguaaa

SEQ ID NO: 1119283 - RNA, 19 nt, Homo sapiens
gcaauguaaagauauguug

SEQ ID NO: 1119284 - RNA, 19 nt, Homo sapiens
uggaauaccggaguacuua

SEQ ID NO: 1119285 - RNA, 19 nt, Homo sapiens
ugugggaguugccucauuu

SEQ ID NO: 1119286 - RNA, 19 nt, Homo sapiens
ucagcgacauagcaaauau

SEQ ID NO: 1119287 - RNA, 19 nt, Homo sapiens
caaacaggaagacaacuga

SEQ ID NO: 1119288 - RNA, 19 nt, Homo sapiens
gucuauggcugaaauaaca

SEQ ID NO: 1119289 - RNA, 19 nt, Homo sapiens
ggcgaaacaucuaaugaag

SEQ ID NO: 1119290 - RNA, 19 nt, Homo sapiens
ggaugacaccaaauauuau

SEQ ID NO: 1119291 - RNA, 19 nt, Homo sapiens
cgacauagcaaauaucaac

SEQ ID NO: 1119292 - RNA, 19 nt, Homo sapiens
gaacuaugcuuguuaauga

SEQ ID NO: 1119293 - RNA, 19 nt, Homo sapiens
gaacauagcaagagcauua

SEQ ID NO: 1119294 - RNA, 19 nt, Homo sapiens
ggaacuaggugcaagaaua

SEQ ID NO: 1119295 - RNA, 19 nt, Homo sapiens
gaagaaugcaccacaauua

SEQ ID NO: 1119296 - RNA, 19 nt, Homo sapiens
gaaccugugugaagaauuu

SEQ ID NO: 1119297 - RNA, 19 nt, Homo sapiens
gcacaaccaugcucauuga

SEQ ID NO: 1119298 - RNA, 19 nt, Homo sapiens
ggaaagagaaagaguuaua

SEQ ID NO: 1119299 - RNA, 19 nt, Homo sapiens
ggaaaguucugcagagcua

SEQ ID NO: 1119300 - RNA, 19 nt, Homo sapiens
gcaagagcauuacaauuau

SEQ ID NO: 1119301 - RNA, 19 nt, Homo sapiens
gcaguuaacuucagauagu

SEQ ID NO: 1119302 - RNA, 19 nt, Homo sapiens
gaacuuucuuguuacgaua

SEQ ID NO: 1119303 - RNA, 19 nt, Homo sapiens
gaaauuagacagaauguuc

SEQ ID NO: 1119304 - RNA, 19 nt, Homo sapiens
caagaacuacugaugauua

SEQ ID NO: 1119305 - RNA, 19 nt, Homo sapiens
ccaugaaguugcacuaaua

SEQ ID NO: 1119306 - RNA, 19 nt, Homo sapiens
agaagaaggugaaugaauu

SEQ ID NO: 1119307 - RNA, 19 nt, Homo sapiens
gaggaacuaucacagaauu

SEQ ID NO: 1119308 - RNA, 19 nt, Homo sapiens
ccaaaguacuggagaagaa

SEQ ID NO: 1119309 - RNA, 19 nt, Homo sapiens
gaggaaagagaaagaguua

SEQ ID NO: 1119310 - RNA, 19 nt, Homo sapiens
gaacucaucagcuguaaug

SEQ ID NO: 1119311 - RNA, 19 nt, Homo sapiens
gaagaaggugaaugaauuu

SEQ ID NO: 1119312 - RNA, 19 nt, Homo sapiens
gaagauggugugcuuauug

SEQ ID NO: 1119313 - RNA, 19 nt, Homo sapiens
gaaguugcacuaauacaaa

SEQ ID NO: 1119314 - RNA, 19 nt, Homo sapiens
gagaaagaguuauagaagu

SEQ ID NO: 1119315 - RNA, 19 nt, Homo sapiens
acaauuauaugcccugauu

SEQ ID NO: 1119316 - RNA, 19 nt, Homo sapiens
gaacuaggugcaagaauau

SEQ ID NO: 1119317 - RNA, 19 nt, Homo sapiens
aaggaaaucugaaccauau

SEQ ID NO: 1119318 - RNA, 19 nt, Homo sapiens
ggaauguggugucgaggaa

SEQ ID NO: 1119319 - RNA, 19 nt, Homo sapiens
cuaagacgauaaagaauug

SEQ ID NO: 1119320 - RNA, 19 nt, Homo sapiens
ucagcuaacuacugguuua

SEQ ID NO: 1119321 - RNA, 19 nt, Homo sapiens
gaauuguucucaggacuuu

SEQ ID NO: 1119322 - RNA, 19 nt, Homo sapiens
agcaagagcauuacaauua

SEQ ID NO: 1119323 - RNA, 19 nt, Homo sapiens
agaaauugaugaagcauug

SEQ ID NO: 1119324 - RNA, 19 nt, Homo sapiens
cccaauggcuggauauauu

SEQ ID NO: 1119325 - RNA, 19 nt, Homo sapiens
gcccugaugugauaauuga

SEQ ID NO: 1119326 - RNA, 19 nt, Homo sapiens
gaagaagaacuuaaagcuu

SEQ ID NO: 1119327 - RNA, 19 nt, Homo sapiens
ggaacuaucacagaauuaa

SEQ ID NO: 1119328 - RNA, 19 nt, Homo sapiens
gaacacaugcagaagcaaa

SEQ ID NO: 1119329 - RNA, 19 nt, Homo sapiens
gaaugcaccacaauuauau

SEQ ID NO: 1119330 - RNA, 19 nt, Homo sapiens
caacauauugcacuaaaug

SEQ ID NO: 1119331 - RNA, 19 nt, Homo sapiens
uaaggaagacuccauaaug

SEQ ID NO: 1119332 - RNA, 19 nt, Homo sapiens
gaacuuaaagcuuccuaau

SEQ ID NO: 1119333 - RNA, 19 nt, Homo sapiens
gaaggaggguauccagauc

SEQ ID NO: 1119334 - RNA, 19 nt, Homo sapiens
agaggaagcuaaaguggaa

SEQ ID NO: 1119335 - RNA, 19 nt, Homo sapiens
agaagaagauggugugcuu

SEQ ID NO: 1119336 - RNA, 19 nt, Homo sapiens
ccaauagaggguagaaaua

SEQ ID NO: 1119337 - RNA, 19 nt, Homo sapiens
gaagacaacguggaaaguu

SEQ ID NO: 1119338 - RNA, 19 nt, Homo sapiens
gaacauacugugaccugaa

SEQ ID NO: 1119339 - RNA, 19 nt, Homo sapiens
uaauagauccuugccauuu

SEQ ID NO: 1119340 - RNA, 19 nt, Homo sapiens
gaaaagcacuugaacacau

SEQ ID NO: 1119341 - RNA, 19 nt, Homo sapiens
ucucaggacuuuaagaaga

SEQ ID NO: 1119342 - RNA, 19 nt, Homo sapiens
guuaaugacugaagaaugc

SEQ ID NO: 1119343 - RNA, 19 nt, Homo sapiens
gauugucacuggaguuguu

SEQ ID NO: 1119344 - RNA, 19 nt, Homo sapiens
cagauuauuuguccaugaa

SEQ ID NO: 1119345 - RNA, 19 nt, Homo sapiens
ggaacuuucuuguuacgau

SEQ ID NO: 1119346 - RNA, 19 nt, Homo sapiens
ccaauggcuggauauauua

SEQ ID NO: 1119347 - RNA, 19 nt, Homo sapiens
caaccaugcucauugaaag

SEQ ID NO: 1119348 - RNA, 19 nt, Homo sapiens
gaauauuugucagcaguau

SEQ ID NO: 1119349 - RNA, 19 nt, Homo sapiens
ugggaaagauugaauuuag

SEQ ID NO: 1119350 - RNA, 19 nt, Homo sapiens
gagaagaaggugaaugaau

SEQ ID NO: 1119351 - RNA, 19 nt, Homo sapiens
ggacuuugcaguuaacuuc

SEQ ID NO: 1119352 - RNA, 19 nt, Homo sapiens
gaacuacugaugauuaucu

SEQ ID NO: 1119353 - RNA, 19 nt, Homo sapiens
uauccggacuuugcaguua

SEQ ID NO: 1119354 - RNA, 19 nt, Homo sapiens
aaagcuacauugaagagaa

SEQ ID NO: 1119355 - RNA, 19 nt, Homo sapiens
gaauacagcacaccauagu

SEQ ID NO: 1119356 - RNA, 19 nt, Homo sapiens
cacucuggcuuaccuguua

SEQ ID NO: 1119357 - RNA, 19 nt, Homo sapiens
gauaugccugugucucuua

SEQ ID NO: 1119358 - RNA, 19 nt, Homo sapiens
ggaagaggaagcuaaagug

SEQ ID NO: 1119359 - RNA, 19 nt, Homo sapiens
caaguuaguucuccacaac

SEQ ID NO: 1119360 - RNA, 19 nt, Homo sapiens
cuaauaaaguugguugaga

SEQ ID NO: 1119361 - RNA, 19 nt, Homo sapiens
uaaaagacauccagccauu

SEQ ID NO: 1119362 - RNA, 19 nt, Homo sapiens
uaaggaaaucugaaccaua

SEQ ID NO: 1119363 - RNA, 19 nt, Homo sapiens
uauagaaguuguggagaaa

SEQ ID NO: 1119364 - RNA, 19 nt, Homo sapiens
ggacacuaauacugcagaa

SEQ ID NO: 1119365 - RNA, 19 nt, Homo sapiens
gaagaagauggugugcuua

SEQ ID NO: 1119366 - RNA, 19 nt, Homo sapiens
agaaugcaccacaauuaua

SEQ ID NO: 1119367 - RNA, 19 nt, Homo sapiens
ggaaggaggguauccagau

SEQ ID NO: 1119368 - RNA, 19 nt, Homo sapiens
caauaggaguucacaccuu

SEQ ID NO: 1119369 - RNA, 19 nt, Homo sapiens
gaagaauuugcaagaacua

SEQ ID NO: 1119370 - RNA, 19 nt, Homo sapiens
gaugaagcauugaauacag

SEQ ID NO: 1119371 - RNA, 19 nt, Homo sapiens
uggcuuaccuguuaaugga

SEQ ID NO: 1119372 - RNA, 19 nt, Homo sapiens
ggaagaagaacuuaaagcu

SEQ ID NO: 1119373 - RNA, 19 nt, Homo sapiens
ccagauuauuuguccauga

SEQ ID NO: 1119374 - RNA, 19 nt, Homo sapiens
uaaaaccauugcuguguua

SEQ ID NO: 1119375 - RNA, 19 nt, Homo sapiens
gaauuuagggacucaacaa

SEQ ID NO: 1119376 - RNA, 19 nt, Homo sapiens
ugaauuagcacaaguuagu

SEQ ID NO: 1119377 - RNA, 19 nt, Homo sapiens
gaaagagaaagaguuauag

SEQ ID NO: 1119378 - RNA, 19 nt, Homo sapiens
gaagcaaacgauagaggaa

SEQ ID NO: 1119379 - RNA, 19 nt, Homo sapiens
acuuaaagcuuccuaaucu

SEQ ID NO: 1119380 - RNA, 19 nt, Homo sapiens
uuauagaaguuguggagaa

SEQ ID NO: 1119381 - RNA, 19 nt, Homo sapiens
gcuguaauguuggacacua

SEQ ID NO: 1119382 - RNA, 19 nt, Homo sapiens
ugagacaaaugauguacau

SEQ ID NO: 1119383 - RNA, 19 nt, Homo sapiens
gacagaauguucaaaagaa

SEQ ID NO: 1119384 - RNA, 19 nt, Homo sapiens
ugugaacuaugcuuguuaa

SEQ ID NO: 1119385 - RNA, 19 nt, Homo sapiens
cuggauauauuaaggaaga

SEQ ID NO: 1119386 - RNA, 19 nt, Homo sapiens
gcuaaaagcuacauugaag

SEQ ID NO: 1119387 - RNA, 19 nt, Homo sapiens
cucaucagcuguaauguug

SEQ ID NO: 1119388 - RNA, 19 nt, Homo sapiens
uaagaagacugcugaucag

SEQ ID NO: 1119389 - RNA, 19 nt, Homo sapiens
ucgaggaacuaucacagaa

SEQ ID NO: 1119390 - RNA, 19 nt, Homo sapiens
caagagcauuacaauuauc

SEQ ID NO: 1119391 - RNA, 19 nt, Homo sapiens
gaucauccggucaccauug

SEQ ID NO: 1119392 - RNA, 19 nt, Homo sapiens
gaacuaugcuuguuaauga

SEQ ID NO: 1119393 - RNA, 19 nt, Homo sapiens
gaacauagcaagagcauua

SEQ ID NO: 1119394 - RNA, 19 nt, Homo sapiens
gaagaaugcaccacaauua

SEQ ID NO: 1119395 - RNA, 19 nt, Homo sapiens
gaaccugugugaagaauuu

SEQ ID NO: 1119396 - RNA, 19 nt, Homo sapiens
ggaaagagaaagaguuaua

SEQ ID NO: 1119397 - RNA, 19 nt, Homo sapiens
gcaagagcauuacaauuau

SEQ ID NO: 1119398 - RNA, 19 nt, Homo sapiens
gcaguuaacuucagauagu

SEQ ID NO: 1119399 - RNA, 19 nt, Homo sapiens
gaacuuucuuguuacgaua

SEQ ID NO: 1119400 - RNA, 19 nt, Homo sapiens
gaaauuagacagaauguuc

SEQ ID NO: 1119401 - RNA, 19 nt, Homo sapiens
caagaacuacugaugauua

SEQ ID NO: 1119402 - RNA, 19 nt, Homo sapiens
ccaaaguacuggagaagaa

SEQ ID NO: 1119403 - RNA, 19 nt, Homo sapiens
gaggaaagagaaagaguua

SEQ ID NO: 1119404 - RNA, 19 nt, Homo sapiens
ggaguuuacuguaugugua

SEQ ID NO: 1119405 - RNA, 19 nt, Homo sapiens
gaacucaucagcuguaaug

SEQ ID NO: 1119406 - RNA, 19 nt, Homo sapiens
gagaaagaguuauagaagu

SEQ ID NO: 1119407 - RNA, 19 nt, Homo sapiens
acaauuauaugcccugauu

SEQ ID NO: 1119408 - RNA, 19 nt, Homo sapiens
cuaagacgauaaagaauug

SEQ ID NO: 1119409 - RNA, 19 nt, Homo sapiens
ucagcuaacuacugguuua

SEQ ID NO: 1119410 - RNA, 19 nt, Homo sapiens
gaauuguucucaggacuuu

SEQ ID NO: 1119411 - RNA, 19 nt, Homo sapiens
agcaagagcauuacaauua

SEQ ID NO: 1119412 - RNA, 19 nt, Homo sapiens
agaaauugaugaagcauug

SEQ ID NO: 1119413 - RNA, 19 nt, Homo sapiens
cccaauggcuggauauauu

SEQ ID NO: 1119414 - RNA, 19 nt, Homo sapiens
gcccugaugugauaauuga

SEQ ID NO: 1119415 - RNA, 19 nt, Homo sapiens
gaacacaugcagaagcaaa

SEQ ID NO: 1119416 - RNA, 19 nt, Homo sapiens
gaaugcaccacaauuauau

SEQ ID NO: 1119417 - RNA, 19 nt, Homo sapiens
guaguggaguuuacuguau

SEQ ID NO: 1119418 - RNA, 19 nt, Homo sapiens
uaaggaagacuccauaaug

SEQ ID NO: 1119419 - RNA, 19 nt, Homo sapiens
gaaggaggguauccagauc

SEQ ID NO: 1119420 - RNA, 19 nt, Homo sapiens
gaacauacugugaccugaa

SEQ ID NO: 1119421 - RNA, 19 nt, Homo sapiens
uaauagauccuugccauuu

SEQ ID NO: 1119422 - RNA, 19 nt, Homo sapiens
gaaaagcacuugaacacau

SEQ ID NO: 1119423 - RNA, 19 nt, Homo sapiens
ucucaggacuuuaagaaga

SEQ ID NO: 1119424 - RNA, 19 nt, Homo sapiens
guuaaugacugaagaaugc

SEQ ID NO: 1119425 - RNA, 19 nt, Homo sapiens
ggaacuuucuuguuacgau

SEQ ID NO: 1119426 - RNA, 19 nt, Homo sapiens
ccaauggcuggauauauua

SEQ ID NO: 1119427 - RNA, 19 nt, Homo sapiens
ugggaaagauugaauuuag

SEQ ID NO: 1119428 - RNA, 19 nt, Homo sapiens
ggacuuugcaguuaacuuc

SEQ ID NO: 1119429 - RNA, 19 nt, Homo sapiens
gaacuacugaugauuaucu

SEQ ID NO: 1119430 - RNA, 19 nt, Homo sapiens
uauccggacuuugcaguua

SEQ ID NO: 1119431 - RNA, 19 nt, Homo sapiens
aaagcuacauugaagagaa

SEQ ID NO: 1119432 - RNA, 19 nt, Homo sapiens
gaauacagcacaccauagu

SEQ ID NO: 1119433 - RNA, 19 nt, Homo sapiens
caaguuaguucuccacaac

SEQ ID NO: 1119434 - RNA, 19 nt, Homo sapiens
uauagaaguuguggagaaa

SEQ ID NO: 1119435 - RNA, 19 nt, Homo sapiens
ggacacuaauacugcagaa

SEQ ID NO: 1119436 - RNA, 19 nt, Homo sapiens
ggagacaccuagauaucca

SEQ ID NO: 1119437 - RNA, 19 nt, Homo sapiens
gaagaauuugcaagaacua

SEQ ID NO: 1119438 - RNA, 19 nt, Homo sapiens
gaugaagcauugaauacag

SEQ ID NO: 1119439 - RNA, 19 nt, Homo sapiens
ggaaggaggguauccagau

SEQ ID NO: 1119440 - RNA, 19 nt, Homo sapiens
agaaugcaccacaauuaua

SEQ ID NO: 1119441 - RNA, 19 nt, Homo sapiens
uaaaaccauugcuguguua

SEQ ID NO: 1119442 - RNA, 19 nt, Homo sapiens
gaauuuagggacucaacaa

SEQ ID NO: 1119443 - RNA, 19 nt, Homo sapiens
ugaauuagcacaaguuagu

SEQ ID NO: 1119444 - RNA, 19 nt, Homo sapiens
gaaagagaaagaguuauag

SEQ ID NO: 1119445 - RNA, 19 nt, Homo sapiens
gaagcaaacgauagaggaa

SEQ ID NO: 1119446 - RNA, 19 nt, Homo sapiens
uuauagaaguuguggagaa

SEQ ID NO: 1119447 - RNA, 19 nt, Homo sapiens
gcuguaauguuggacacua

SEQ ID NO: 1119448 - RNA, 19 nt, Homo sapiens
ugucugagcuugauguagu

SEQ ID NO: 1119449 - RNA, 19 nt, Homo sapiens
aaacucaucuguuccuuuu

SEQ ID NO: 1119450 - RNA, 19 nt, Homo sapiens
gaaacaugcggcacagaug

SEQ ID NO: 1119451 - RNA, 19 nt, Homo sapiens
ggaaacaugcggcacagau

SEQ ID NO: 1119452 - RNA, 19 nt, Homo sapiens
ugagacaaaugauguacau

SEQ ID NO: 1119453 - RNA, 19 nt, Homo sapiens
gacagaauguucaaaagaa

SEQ ID NO: 1119454 - RNA, 19 nt, Homo sapiens
gcuaaaagcuacauugaag

SEQ ID NO: 1119455 - RNA, 19 nt, Homo sapiens
ugugaacuaugcuuguuaa

SEQ ID NO: 1119456 - RNA, 19 nt, Homo sapiens
cucaucagcuguaauguug

SEQ ID NO: 1119457 - RNA, 19 nt, Homo sapiens
uaagaagacugcugaucag

SEQ ID NO: 1119458 - RNA, 19 nt, Homo sapiens
cuggauauauuaaggaaga

SEQ ID NO: 1119459 - RNA, 19 nt, Homo sapiens
caagagcauuacaauuauc

SEQ ID NO: 1119460 - RNA, 19 nt, Homo sapiens
gaucauccggucaccauug

SEQ ID NO: 1119461 - RNA, 19 nt, Homo sapiens
ggaucuagcccugauguga

SEQ ID NO: 1119462 - RNA, 19 nt, Homo sapiens
gauagaggaaagagaaaga

SEQ ID NO: 1119463 - RNA, 19 nt, Homo sapiens
agaagaaauugaugaagca

SEQ ID NO: 1119464 - RNA, 19 nt, Homo sapiens
uguaagccauguaauagau

SEQ ID NO: 1119465 - RNA, 19 nt, Homo sapiens
gaugggaucuagcccugau

SEQ ID NO: 1119466 - RNA, 19 nt, Homo sapiens
gcaacagcauccccuaaaa

SEQ ID NO: 1119467 - RNA, 19 nt, Homo sapiens
gaaagaguuauagaaguug

SEQ ID NO: 1119468 - RNA, 19 nt, Homo sapiens
gaucagcuaacuacugguu

SEQ ID NO: 1119469 - RNA, 19 nt, Homo sapiens
gaauugcagugagaucauc

SEQ ID NO: 1119470 - RNA, 19 nt, Homo sapiens
gauagugaauuagcacaag

SEQ ID NO: 1119471 - RNA, 19 nt, Homo sapiens
guaauguuggacacuaaua

SEQ ID NO: 1119472 - RNA, 19 nt, Homo sapiens
uuaagaagacugcugauca

SEQ ID NO: 1119473 - RNA, 19 nt, Homo sapiens
ccuaagacgauaaagaauu

SEQ ID NO: 1119474 - RNA, 19 nt, Homo sapiens
ugauguacauuuagaagca

SEQ ID NO: 1119475 - RNA, 19 nt, Homo sapiens
gcaagaacuacugaugauu

SEQ ID NO: 1119476 - RNA, 19 nt, Homo sapiens
ugaagaaugcaccacaauu

SEQ ID NO: 1119477 - RNA, 19 nt, Homo sapiens
auacagcacaccauaguuu

SEQ ID NO: 1119478 - RNA, 19 nt, Homo sapiens
gcagauacuguaacaacug

SEQ ID NO: 1119479 - RNA, 19 nt, Homo sapiens
gaagacaacguggaaacau

SEQ ID NO: 1119480 - RNA, 19 nt, Homo sapiens
gggaaagauugaauuuagg

SEQ ID NO: 1119481 - RNA, 19 nt, Homo sapiens
uaauuugaaugcagcuaug

SEQ ID NO: 1119482 - RNA, 19 nt, Homo sapiens
acacuaauacugcagaaga

SEQ ID NO: 1119483 - RNA, 19 nt, Homo sapiens
caucagcuguaauguugga

SEQ ID NO: 1119484 - RNA, 19 nt, Homo sapiens
aaacaugcggcacagauga

SEQ ID NO: 1119485 - RNA, 19 nt, Homo sapiens
ucaacaauaugggaaagau

SEQ ID NO: 1119486 - RNA, 19 nt, Homo sapiens
acaauuaucgccuucucua

SEQ ID NO: 1119487 - RNA, 19 nt, Homo sapiens
aagcuacauugaagagaaa

SEQ ID NO: 1119488 - RNA, 19 nt, Homo sapiens
ugaagaauuugcaagaacu

SEQ ID NO: 1119489 - RNA, 19 nt, Homo sapiens
gugaagaauuugcaagaac

SEQ ID NO: 1119490 - RNA, 19 nt, Homo sapiens
cagauacuguaacaacugu

SEQ ID NO: 1119491 - RNA, 19 nt, Homo sapiens
caacaauaugggaaagauu

SEQ ID NO: 1119492 - RNA, 19 nt, Homo sapiens
gcauaaggcugacauaauu

SEQ ID NO: 1119493 - RNA, 19 nt, Homo sapiens
gaaaugaaaugcagcagaa

SEQ ID NO: 1119494 - RNA, 19 nt, Homo sapiens
gaaaggauuugcagagaaa

SEQ ID NO: 1119495 - RNA, 19 nt, Homo sapiens
caacaugccuuuaaauuca

SEQ ID NO: 1119496 - RNA, 19 nt, Homo sapiens
gcagagaaaugcagacuug

SEQ ID NO: 1119497 - RNA, 19 nt, Homo sapiens
gggaagaggugcuuaagaa

SEQ ID NO: 1119498 - RNA, 19 nt, Homo sapiens
uaacucagcugcgcaauaa

SEQ ID NO: 1119499 - RNA, 19 nt, Homo sapiens
caagauuuaugguggauua

SEQ ID NO: 1119500 - RNA, 19 nt, Homo sapiens
ggauuugacuaaccacuua

SEQ ID NO: 1119501 - RNA, 19 nt, Homo sapiens
gaugaagggugcuuuacua

SEQ ID NO: 1119502 - RNA, 19 nt, Homo sapiens
gcaaagagcuggagauagc

SEQ ID NO: 1119503 - RNA, 19 nt, Homo sapiens
gaaaaugacucuugacuug

SEQ ID NO: 1119504 - RNA, 19 nt, Homo sapiens
gaacuuggauaaauguaug

SEQ ID NO: 1119505 - RNA, 19 nt, Homo sapiens
gaagauacacauuacgaua

SEQ ID NO: 1119506 - RNA, 19 nt, Homo sapiens
ggaaauuuaucaugagaga

SEQ ID NO: 1119507 - RNA, 19 nt, Homo sapiens
ggagauagcucugguugau

SEQ ID NO: 1119508 - RNA, 19 nt, Homo sapiens
ggaacgagaucuucuugau

SEQ ID NO: 1119509 - RNA, 19 nt, Homo sapiens
cugaagaccuauauagaua

SEQ ID NO: 1119510 - RNA, 19 nt, Homo sapiens
ccugauggcucucaaauug

SEQ ID NO: 1119511 - RNA, 19 nt, Homo sapiens
cauagaagaugcaguaaca

SEQ ID NO: 1119512 - RNA, 19 nt, Homo sapiens
guucagacuuauaugcuua

SEQ ID NO: 1119513 - RNA, 19 nt, Homo sapiens
ucaagaaguuacccaguuu

SEQ ID NO: 1119514 - RNA, 19 nt, Homo sapiens
ugaaggagacucaggguua

SEQ ID NO: 1119515 - RNA, 19 nt, Homo sapiens
gaagaucaguguugguaca

SEQ ID NO: 1119516 - RNA, 19 nt, Homo sapiens
ugacauaauucauggauca

SEQ ID NO: 1119517 - RNA, 19 nt, Homo sapiens
ucaaaucccuccucuguag

SEQ ID NO: 1119518 - RNA, 19 nt, Homo sapiens
caaggacaguauugaguuu

SEQ ID NO: 1119519 - RNA, 19 nt, Homo sapiens
gagaggaguucaccagugu

SEQ ID NO: 1119520 - RNA, 19 nt, Homo sapiens
gaagggugcuuuacuacuc

SEQ ID NO: 1119521 - RNA, 19 nt, Homo sapiens
gaagauggaacaguuauug

SEQ ID NO: 1119522 - RNA, 19 nt, Homo sapiens
ucacauagaagaugcagua

SEQ ID NO: 1119523 - RNA, 19 nt, Homo sapiens
caggcaaucuuauaacauu

SEQ ID NO: 1119524 - RNA, 19 nt, Homo sapiens
gaagccaacuuugauuguu

SEQ ID NO: 1119525 - RNA, 19 nt, Homo sapiens
ccauagagcuuggagagaa

SEQ ID NO: 1119526 - RNA, 19 nt, Homo sapiens
caacggaaagugugaguuu

SEQ ID NO: 1119527 - RNA, 19 nt, Homo sapiens
cagcaagcguccuuuggua

SEQ ID NO: 1119528 - RNA, 19 nt, Homo sapiens
gaugucaccugaguugaaa

SEQ ID NO: 1119529 - RNA, 19 nt, Homo sapiens
gaauaugagaugcuaacua

SEQ ID NO: 1119530 - RNA, 19 nt, Homo sapiens
cuaaaucgaucugauauag

SEQ ID NO: 1119531 - RNA, 19 nt, Homo sapiens
cuaguugaguuguaucuuu

SEQ ID NO: 1119532 - RNA, 19 nt, Homo sapiens
gcuuauggcugccucuuau

SEQ ID NO: 1119533 - RNA, 19 nt, Homo sapiens
ggacaguauugaguuuaaa

SEQ ID NO: 1119534 - RNA, 19 nt, Homo sapiens
gcagacaaggagauaauuu

SEQ ID NO: 1119535 - RNA, 19 nt, Homo sapiens
ggauuugucagucucuuua

SEQ ID NO: 1119536 - RNA, 19 nt, Homo sapiens
gagauaauaugggcagaau

SEQ ID NO: 1119537 - RNA, 19 nt, Homo sapiens
gaaguuacccaguuugauc

SEQ ID NO: 1119538 - RNA, 19 nt, Homo sapiens
aauaugagaugcuaacuag

SEQ ID NO: 1119539 - RNA, 19 nt, Homo sapiens
gaucacuugcuauccauua

SEQ ID NO: 1119540 - RNA, 19 nt, Homo sapiens
ggaaauacugaaagaaaug

SEQ ID NO: 1119541 - RNA, 19 nt, Homo sapiens
gaucaaaccagucaaccuu

SEQ ID NO: 1119542 - RNA, 19 nt, Homo sapiens
aagccaacuuugauuguua

SEQ ID NO: 1119543 - RNA, 19 nt, Homo sapiens
ggaugaagauacacauuac

SEQ ID NO: 1119544 - RNA, 19 nt, Homo sapiens
gcuauucuguggauguuga

SEQ ID NO: 1119545 - RNA, 19 nt, Homo sapiens
guuauaaggcguuagaauu

SEQ ID NO: 1119546 - RNA, 19 nt, Homo sapiens
gaacucugguggucuccuu

SEQ ID NO: 1119547 - RNA, 19 nt, Homo sapiens
gaugaaauccuagagaaga

SEQ ID NO: 1119548 - RNA, 19 nt, Homo sapiens
gaagacgcaauggauaaua

SEQ ID NO: 1119549 - RNA, 19 nt, Homo sapiens
gaggaguucaccaguguua

SEQ ID NO: 1119550 - RNA, 19 nt, Homo sapiens
gagcaaauucugaugaaau

SEQ ID NO: 1119551 - RNA, 19 nt, Homo sapiens
ugaaagaaaugaggcaugu

SEQ ID NO: 1119552 - RNA, 19 nt, Homo sapiens
gaauuaaagcaaccucuga

SEQ ID NO: 1119553 - RNA, 19 nt, Homo sapiens
cugaauacacccuauauaa

SEQ ID NO: 1119554 - RNA, 19 nt, Homo sapiens
guuggugacuugaguuuga

SEQ ID NO: 1119555 - RNA, 19 nt, Homo sapiens
uaacuaguuuggcacagaa

SEQ ID NO: 1119556 - RNA, 19 nt, Homo sapiens
ucagauggaugaagauaca

SEQ ID NO: 1119557 - RNA, 19 nt, Homo sapiens
gguuggaagucacauagaa

SEQ ID NO: 1119558 - RNA, 19 nt, Homo sapiens
gaacgagaucuucuugaug

SEQ ID NO: 1119559 - RNA, 19 nt, Homo sapiens
gauaauaugggcagaauac

SEQ ID NO: 1119560 - RNA, 19 nt, Homo sapiens
ggaagaggugcuuaagaaa

SEQ ID NO: 1119561 - RNA, 19 nt, Homo sapiens
caugaugguuggugacuug

SEQ ID NO: 1119562 - RNA, 19 nt, Homo sapiens
ugaaggaacuuagcagcaa

SEQ ID NO: 1119563 - RNA, 19 nt, Homo sapiens
ggagcaaauucugaugaaa

SEQ ID NO: 1119564 - RNA, 19 nt, Homo sapiens
guacaugucaguagaagau

SEQ ID NO: 1119565 - RNA, 19 nt, Homo sapiens
cuauauagauaccagaaug

SEQ ID NO: 1119566 - RNA, 19 nt, Homo sapiens
aaaugacucuugacuugaa

SEQ ID NO: 1119567 - RNA, 19 nt, Homo sapiens
gaagaggugcuuaagaaag

SEQ ID NO: 1119568 - RNA, 19 nt, Homo sapiens
uaaauaagagucccagugu

SEQ ID NO: 1119569 - RNA, 19 nt, Homo sapiens
cagaagacgcaauggauaa

SEQ ID NO: 1119570 - RNA, 19 nt, Homo sapiens
gacuacacauuccuucuga

SEQ ID NO: 1119571 - RNA, 19 nt, Homo sapiens
agacggagaacuuggauaa

SEQ ID NO: 1119572 - RNA, 19 nt, Homo sapiens
gccuuuaaauucagaagaa

SEQ ID NO: 1119573 - RNA, 19 nt, Homo sapiens
gguggucuccuuacaauga

SEQ ID NO: 1119574 - RNA, 19 nt, Homo sapiens
cagcuaagauggaaauacu

SEQ ID NO: 1119575 - RNA, 19 nt, Homo sapiens
gaugcaggcaaucuuauaa

SEQ ID NO: 1119576 - RNA, 19 nt, Homo sapiens
uaaagcaaccucugaagau

SEQ ID NO: 1119577 - RNA, 19 nt, Homo sapiens
guacauugacuauggaaau

SEQ ID NO: 1119578 - RNA, 19 nt, Homo sapiens
ugagguacauugacuaugg

SEQ ID NO: 1119579 - RNA, 19 nt, Homo sapiens
gaaauguucugggacuagu

SEQ ID NO: 1119580 - RNA, 19 nt, Homo sapiens
aaucaggaguuugagauaa

SEQ ID NO: 1119581 - RNA, 19 nt, Homo sapiens
uauuauggcuuucuguuca

SEQ ID NO: 1119582 - RNA, 19 nt, Homo sapiens
gccaacaugccuuuaaauu

SEQ ID NO: 1119583 - RNA, 19 nt, Homo sapiens
cccaggagcugcagcaaga

SEQ ID NO: 1119584 - RNA, 19 nt, Homo sapiens
guuggugacuuuaauuuag

SEQ ID NO: 1119585 - RNA, 19 nt, Homo sapiens
gaucaguguugguacagau

SEQ ID NO: 1119586 - RNA, 19 nt, Homo sapiens
aaauaaagacggagaacuu

SEQ ID NO: 1119587 - RNA, 19 nt, Homo sapiens
aaagauucauucagaggaa

SEQ ID NO: 1119588 - RNA, 19 nt, Homo sapiens
guagcaugguuccaaagaa

SEQ ID NO: 1119589 - RNA, 19 nt, Homo sapiens
cuauacaaguguuggauga

SEQ ID NO: 1119590 - RNA, 19 nt, Homo sapiens
uauaaggcguuagaauuga

SEQ ID NO: 1119591 - RNA, 19 nt, Homo sapiens
agaaaggauuugcagagaa

SEQ ID NO: 1119592 - RNA, 19 nt, Homo sapiens
gcauaaggcugacauaauu

SEQ ID NO: 1119593 - RNA, 19 nt, Homo sapiens
gaaaugaaaugcagcagaa

SEQ ID NO: 1119594 - RNA, 19 nt, Homo sapiens
gaaaggauuugcagagaaa

SEQ ID NO: 1119595 - RNA, 19 nt, Homo sapiens
caacaugccuuuaaauuca

SEQ ID NO: 1119596 - RNA, 19 nt, Homo sapiens
gcagagaaaugcagacuug

SEQ ID NO: 1119597 - RNA, 19 nt, Homo sapiens
gggaagaggugcuuaagaa

SEQ ID NO: 1119598 - RNA, 19 nt, Homo sapiens
uaacucagcugcgcaauaa

SEQ ID NO: 1119599 - RNA, 19 nt, Homo sapiens
caagauuuaugguggauua

SEQ ID NO: 1119600 - RNA, 19 nt, Homo sapiens
ggauuugacuaaccacuua

SEQ ID NO: 1119601 - RNA, 19 nt, Homo sapiens
gaugaagggugcuuuacua

SEQ ID NO: 1119602 - RNA, 19 nt, Homo sapiens
gcaaagagcuggagauagc

SEQ ID NO: 1119603 - RNA, 19 nt, Homo sapiens
gaaaaugacucuugacuug

SEQ ID NO: 1119604 - RNA, 19 nt, Homo sapiens
gaacuuggauaaauguaug

SEQ ID NO: 1119605 - RNA, 19 nt, Homo sapiens
gaagauacacauuacgaua

SEQ ID NO: 1119606 - RNA, 19 nt, Homo sapiens
ggaaauuuaucaugagaga

SEQ ID NO: 1119607 - RNA, 19 nt, Homo sapiens
ugaaugaucuccaugaaga

SEQ ID NO: 1119608 - RNA, 19 nt, Homo sapiens
ggagauagcucugguugau

SEQ ID NO: 1119609 - RNA, 19 nt, Homo sapiens
ggaacgagaucuucuugau

SEQ ID NO: 1119610 - RNA, 19 nt, Homo sapiens
cugaagaccuauauagaua

SEQ ID NO: 1119611 - RNA, 19 nt, Homo sapiens
ccugauggcucucaaauug

SEQ ID NO: 1119612 - RNA, 19 nt, Homo sapiens
cauagaagaugcaguaaca

SEQ ID NO: 1119613 - RNA, 19 nt, Homo sapiens
guucagacuuauaugcuua

SEQ ID NO: 1119614 - RNA, 19 nt, Homo sapiens
ucaagaaguuacccaguuu

SEQ ID NO: 1119615 - RNA, 19 nt, Homo sapiens
ugaaggagacucaggguua

SEQ ID NO: 1119616 - RNA, 19 nt, Homo sapiens
gaagaucaguguugguaca

SEQ ID NO: 1119617 - RNA, 19 nt, Homo sapiens
ugacauaauucauggauca

SEQ ID NO: 1119618 - RNA, 19 nt, Homo sapiens
ucaaaucccuccucuguag

SEQ ID NO: 1119619 - RNA, 19 nt, Homo sapiens
caaggacaguauugaguuu

SEQ ID NO: 1119620 - RNA, 19 nt, Homo sapiens
gagaggaguucaccagugu

SEQ ID NO: 1119621 - RNA, 19 nt, Homo sapiens
gaagggugcuuuacuacuc

SEQ ID NO: 1119622 - RNA, 19 nt, Homo sapiens
gaagauggaacaguuauug

SEQ ID NO: 1119623 - RNA, 19 nt, Homo sapiens
ucacauagaagaugcagua

SEQ ID NO: 1119624 - RNA, 19 nt, Homo sapiens
caggcaaucuuauaacauu

SEQ ID NO: 1119625 - RNA, 19 nt, Homo sapiens
gaagccaacuuugauuguu

SEQ ID NO: 1119626 - RNA, 19 nt, Homo sapiens
ccauagagcuuggagagaa

SEQ ID NO: 1119627 - RNA, 19 nt, Homo sapiens
cagcaagcguccuuuggua

SEQ ID NO: 1119628 - RNA, 19 nt, Homo sapiens
gaugucaccugaguugaaa

SEQ ID NO: 1119629 - RNA, 19 nt, Homo sapiens
gaauaugagaugcuaacua

SEQ ID NO: 1119630 - RNA, 19 nt, Homo sapiens
cuaaaucgaucugauauag

SEQ ID NO: 1119631 - RNA, 19 nt, Homo sapiens
gaaaguggguacggcauca

SEQ ID NO: 1119632 - RNA, 19 nt, Homo sapiens
cuaguugaguuguaucuuu

SEQ ID NO: 1119633 - RNA, 19 nt, Homo sapiens
gcuuauggcugccucuuau

SEQ ID NO: 1119634 - RNA, 19 nt, Homo sapiens
ggacaguauugaguuuaaa

SEQ ID NO: 1119635 - RNA, 19 nt, Homo sapiens
gcagacaaggagauaauuu

SEQ ID NO: 1119636 - RNA, 19 nt, Homo sapiens
ggauuugucagucucuuua

SEQ ID NO: 1119637 - RNA, 19 nt, Homo sapiens
gagauaauaugggcagaau

SEQ ID NO: 1119638 - RNA, 19 nt, Homo sapiens
gaaguuacccaguuugauc

SEQ ID NO: 1119639 - RNA, 19 nt, Homo sapiens
aauaugagaugcuaacuag

SEQ ID NO: 1119640 - RNA, 19 nt, Homo sapiens
gaucacuugcuauccauua

SEQ ID NO: 1119641 - RNA, 19 nt, Homo sapiens
ggaaauacugaaagaaaug

SEQ ID NO: 1119642 - RNA, 19 nt, Homo sapiens
gaucaaaccagucaaccuu

SEQ ID NO: 1119643 - RNA, 19 nt, Homo sapiens
aagccaacuuugauuguua

SEQ ID NO: 1119644 - RNA, 19 nt, Homo sapiens
gcuauucuguggauguuga

SEQ ID NO: 1119645 - RNA, 19 nt, Homo sapiens
guuauaaggcguuagaauu

SEQ ID NO: 1119646 - RNA, 19 nt, Homo sapiens
ggaugaagauacacauuac

SEQ ID NO: 1119647 - RNA, 19 nt, Homo sapiens
gaacucugguggucuccuu

SEQ ID NO: 1119648 - RNA, 19 nt, Homo sapiens
gaugaaauccuagagaaga

SEQ ID NO: 1119649 - RNA, 19 nt, Homo sapiens
gaagacgcaauggauaaua

SEQ ID NO: 1119650 - RNA, 19 nt, Homo sapiens
gaggaguucaccaguguua

SEQ ID NO: 1119651 - RNA, 19 nt, Homo sapiens
gagcaaauucugaugaaau

SEQ ID NO: 1119652 - RNA, 19 nt, Homo sapiens
ugaaagaaaugaggcaugu

SEQ ID NO: 1119653 - RNA, 19 nt, Homo sapiens
gaauuaaagcaaccucuga

SEQ ID NO: 1119654 - RNA, 19 nt, Homo sapiens
cugaauacacccuauauaa

SEQ ID NO: 1119655 - RNA, 19 nt, Homo sapiens
guuggugacuugaguuuga

SEQ ID NO: 1119656 - RNA, 19 nt, Homo sapiens
uaacuaguuuggcacagaa

SEQ ID NO: 1119657 - RNA, 19 nt, Homo sapiens
gguuggaagucacauagaa

SEQ ID NO: 1119658 - RNA, 19 nt, Homo sapiens
ucagauggaugaagauaca

SEQ ID NO: 1119659 - RNA, 19 nt, Homo sapiens
gaacgagaucuucuugaug

SEQ ID NO: 1119660 - RNA, 19 nt, Homo sapiens
gauaauaugggcagaauac

SEQ ID NO: 1119661 - RNA, 19 nt, Homo sapiens
ggaagaggugcuuaagaaa

SEQ ID NO: 1119662 - RNA, 19 nt, Homo sapiens
caugaugguuggugacuug

SEQ ID NO: 1119663 - RNA, 19 nt, Homo sapiens
ugaaggaacuuagcagcaa

SEQ ID NO: 1119664 - RNA, 19 nt, Homo sapiens
ggagcaaauucugaugaaa

SEQ ID NO: 1119665 - RNA, 19 nt, Homo sapiens
guacaugucaguagaagau

SEQ ID NO: 1119666 - RNA, 19 nt, Homo sapiens
cuauauagauaccagaaug

SEQ ID NO: 1119667 - RNA, 19 nt, Homo sapiens
aaaugacucuugacuugaa

SEQ ID NO: 1119668 - RNA, 19 nt, Homo sapiens
gaagaggugcuuaagaaag

SEQ ID NO: 1119669 - RNA, 19 nt, Homo sapiens
uaaauaagagucccagugu

SEQ ID NO: 1119670 - RNA, 19 nt, Homo sapiens
gaaaguggcucgaaaagac

SEQ ID NO: 1119671 - RNA, 19 nt, Homo sapiens
cagaagacgcaauggauaa

SEQ ID NO: 1119672 - RNA, 19 nt, Homo sapiens
gacuacacauuccuucuga

SEQ ID NO: 1119673 - RNA, 19 nt, Homo sapiens
agacggagaacuuggauaa

SEQ ID NO: 1119674 - RNA, 19 nt, Homo sapiens
gccuuuaaauucagaagaa

SEQ ID NO: 1119675 - RNA, 19 nt, Homo sapiens
gguggucuccuuacaauga

SEQ ID NO: 1119676 - RNA, 19 nt, Homo sapiens
cagcuaagauggaaauacu

SEQ ID NO: 1119677 - RNA, 19 nt, Homo sapiens
gaugcaggcaaucuuauaa

SEQ ID NO: 1119678 - RNA, 19 nt, Homo sapiens
uaaagcaaccucugaagau

SEQ ID NO: 1119679 - RNA, 19 nt, Homo sapiens
guacauugacuauggaaau

SEQ ID NO: 1119680 - RNA, 19 nt, Homo sapiens
ugagguacauugacuaugg

SEQ ID NO: 1119681 - RNA, 19 nt, Homo sapiens
gaaauguucugggacuagu

SEQ ID NO: 1119682 - RNA, 19 nt, Homo sapiens
aaucaggaguuugagauaa

SEQ ID NO: 1119683 - RNA, 19 nt, Homo sapiens
uauuauggcuuucuguuca

SEQ ID NO: 1119684 - RNA, 19 nt, Homo sapiens
gccaacaugccuuuaaauu

SEQ ID NO: 1119685 - RNA, 19 nt, Homo sapiens
cccaggagcugcagcaaga

SEQ ID NO: 1119686 - RNA, 19 nt, Homo sapiens
guuggugacuuuaauuuag

SEQ ID NO: 1119687 - RNA, 19 nt, Homo sapiens
gaucaguguugguacagau

SEQ ID NO: 1119688 - RNA, 19 nt, Homo sapiens
aaauaaagacggagaacuu

SEQ ID NO: 1119689 - RNA, 19 nt, Homo sapiens
aaagauucauucagaggaa

SEQ ID NO: 1119690 - RNA, 19 nt, Homo sapiens
guagcaugguuccaaagaa

SEQ ID NO: 1119691 - RNA, 19 nt, Homo sapiens
cuauacaaguguuggauga

SEQ ID NO: 1119692 - RNA, 19 nt, Homo sapiens
gcacaugucuuauauauug

SEQ ID NO: 1119693 - RNA, 19 nt, Homo sapiens
guugacagcugaauuauua

SEQ ID NO: 1119694 - RNA, 19 nt, Homo sapiens
gaauguaggugaugaguuu

SEQ ID NO: 1119695 - RNA, 19 nt, Homo sapiens
gaaggcacaugucuuauau

SEQ ID NO: 1119696 - RNA, 19 nt, Homo sapiens
gaacagagcaaucauacaa

SEQ ID NO: 1119697 - RNA, 19 nt, Homo sapiens
gaaugggacugucgaugua

SEQ ID NO: 1119698 - RNA, 19 nt, Homo sapiens
gaaguuaccuaaugguuuc

SEQ ID NO: 1119699 - RNA, 19 nt, Homo sapiens
gcacagaguuacagaaaca

SEQ ID NO: 1119700 - RNA, 19 nt, Homo sapiens
cauaaagacuuaccaaaug

SEQ ID NO: 1119701 - RNA, 19 nt, Homo sapiens
gcgcuuccuuuccaaauua

SEQ ID NO: 1119702 - RNA, 19 nt, Homo sapiens
ccaaaugacagacuuguua

SEQ ID NO: 1119703 - RNA, 19 nt, Homo sapiens
gaacaagucauuagcagaa

SEQ ID NO: 1119704 - RNA, 19 nt, Homo sapiens
gcagagugcuuuaaauaca

SEQ ID NO: 1119705 - RNA, 19 nt, Homo sapiens
gaagcuauuugucucauga

SEQ ID NO: 1119706 - RNA, 19 nt, Homo sapiens
gaugagacuuugucccaua

SEQ ID NO: 1119707 - RNA, 19 nt, Homo sapiens
guaaagccaucauuaggaa

SEQ ID NO: 1119708 - RNA, 19 nt, Homo sapiens
ggagugaaaccuauuguaa

SEQ ID NO: 1119709 - RNA, 19 nt, Homo sapiens
cagcagaaguuaccuaaug

SEQ ID NO: 1119710 - RNA, 19 nt, Homo sapiens
ggucggauauguagauuau

SEQ ID NO: 1119711 - RNA, 19 nt, Homo sapiens
caaagaauguccauacagu

SEQ ID NO: 1119712 - RNA, 19 nt, Homo sapiens
gaacuucaggcaucccuua

SEQ ID NO: 1119713 - RNA, 19 nt, Homo sapiens
ggaaacaucgaagaaguua

SEQ ID NO: 1119714 - RNA, 19 nt, Homo sapiens
aaggaaaucuuaccaaaug

SEQ ID NO: 1119715 - RNA, 19 nt, Homo sapiens
ucaaggaaaucuuaccaaa

SEQ ID NO: 1119716 - RNA, 19 nt, Homo sapiens
gauauacagucuagaaaca

SEQ ID NO: 1119717 - RNA, 19 nt, Homo sapiens
gaaaugggauauggcuuga

SEQ ID NO: 1119718 - RNA, 19 nt, Homo sapiens
ggaauacggugccaguuag

SEQ ID NO: 1119719 - RNA, 19 nt, Homo sapiens
gaaguugagcugccaaauu

SEQ ID NO: 1119720 - RNA, 19 nt, Homo sapiens
gcagaugaacuccgaauga

SEQ ID NO: 1119721 - RNA, 19 nt, Homo sapiens
gcuguacuuucgugauuua

SEQ ID NO: 1119722 - RNA, 19 nt, Homo sapiens
gcagauauacagucuagaa

SEQ ID NO: 1119723 - RNA, 19 nt, Homo sapiens
gggaauacggugccaguua

SEQ ID NO: 1119724 - RNA, 19 nt, Homo sapiens
uaggacaucuucaggcaua

SEQ ID NO: 1119725 - RNA, 19 nt, Homo sapiens
ucaccgaucucuccacuug

SEQ ID NO: 1119726 - RNA, 19 nt, Homo sapiens
gaagaagccauaacaagau

SEQ ID NO: 1119727 - RNA, 19 nt, Homo sapiens
guacuuucgugauuuaaug

SEQ ID NO: 1119728 - RNA, 19 nt, Homo sapiens
ugaaagugguggacaaguu

SEQ ID NO: 1119729 - RNA, 19 nt, Homo sapiens
guacagggacuucaagcua

SEQ ID NO: 1119730 - RNA, 19 nt, Homo sapiens
gaaacaaacauuggucuga

SEQ ID NO: 1119731 - RNA, 19 nt, Homo sapiens
gaugaacuccgaaugauau

SEQ ID NO: 1119732 - RNA, 19 nt, Homo sapiens
gaaaagcugugcauguuga

SEQ ID NO: 1119733 - RNA, 19 nt, Homo sapiens
caaaagggaugccagaaaa

SEQ ID NO: 1119734 - RNA, 19 nt, Homo sapiens
aaagugaccuaaucccaaa

SEQ ID NO: 1119735 - RNA, 19 nt, Homo sapiens
uaucaaagcuacuaaacca

SEQ ID NO: 1119736 - RNA, 19 nt, Homo sapiens
cugauaagcuagugacauu

SEQ ID NO: 1119737 - RNA, 19 nt, Homo sapiens
agaggaugcuuuaaagaaa

SEQ ID NO: 1119738 - RNA, 19 nt, Homo sapiens
uagcaaaguucuccuagau

SEQ ID NO: 1119739 - RNA, 19 nt, Homo sapiens
gaaagugguggacaaguug

SEQ ID NO: 1119740 - RNA, 19 nt, Homo sapiens
aaacaaacauuggucugaa

SEQ ID NO: 1119741 - RNA, 19 nt, Homo sapiens
cauguugacagcugaauua

SEQ ID NO: 1119742 - RNA, 19 nt, Homo sapiens
ugaagaagccauaacaaga

SEQ ID NO: 1119743 - RNA, 19 nt, Homo sapiens
gugaaugccuauguuauug

SEQ ID NO: 1119744 - RNA, 19 nt, Homo sapiens
uuagugauguucugauuga

SEQ ID NO: 1119745 - RNA, 19 nt, Homo sapiens
gauauauaguccuggagaa

SEQ ID NO: 1119746 - RNA, 19 nt, Homo sapiens
ucaaagugauccugaagau

SEQ ID NO: 1119747 - RNA, 19 nt, Homo sapiens
gugauguucugauugauga

SEQ ID NO: 1119748 - RNA, 19 nt, Homo sapiens
uaacaagauuccagaugug

SEQ ID NO: 1119749 - RNA, 19 nt, Homo sapiens
gaaacccaguggacaagau

SEQ ID NO: 1119750 - RNA, 19 nt, Homo sapiens
gauaagcuagugacauuug

SEQ ID NO: 1119751 - RNA, 19 nt, Homo sapiens
aaguugagcugccaaauuc

SEQ ID NO: 1119752 - RNA, 19 nt, Homo sapiens
ccauaaagauugucgacau

SEQ ID NO: 1119753 - RNA, 19 nt, Homo sapiens
guacugcuccauaaagauu

SEQ ID NO: 1119754 - RNA, 19 nt, Homo sapiens
cuaaaccacuguuaaugga

SEQ ID NO: 1119755 - RNA, 19 nt, Homo sapiens
gaauguccauacaguguca

SEQ ID NO: 1119756 - RNA, 19 nt, Homo sapiens
gaaucagaauguaaugcuu

SEQ ID NO: 1119757 - RNA, 19 nt, Homo sapiens
caaaugacagacuuguuaa

SEQ ID NO: 1119758 - RNA, 19 nt, Homo sapiens
ggaguaaagccaucauuag

SEQ ID NO: 1119759 - RNA, 19 nt, Homo sapiens
gaccaugugcuuauagaaa

SEQ ID NO: 1119760 - RNA, 19 nt, Homo sapiens
caacaggaacauugacuug

SEQ ID NO: 1119761 - RNA, 19 nt, Homo sapiens
gauguguguugcugggaua

SEQ ID NO: 1119762 - RNA, 19 nt, Homo sapiens
caaauggacauguuaaagu

SEQ ID NO: 1119763 - RNA, 19 nt, Homo sapiens
agaguauggugacagauaa

SEQ ID NO: 1119764 - RNA, 19 nt, Homo sapiens
gcuauaaaguguguacuag

SEQ ID NO: 1119765 - RNA, 19 nt, Homo sapiens
aacaugagcuucaaguuca

SEQ ID NO: 1119766 - RNA, 19 nt, Homo sapiens
gccgaaagcuugcugaacu

SEQ ID NO: 1119767 - RNA, 19 nt, Homo sapiens
aggcacaugucuuauauau

SEQ ID NO: 1119768 - RNA, 19 nt, Homo sapiens
cauaaugcuucugcuguuu

SEQ ID NO: 1119769 - RNA, 19 nt, Homo sapiens
gcuaauggagugaaaccua

SEQ ID NO: 1119770 - RNA, 19 nt, Homo sapiens
uagcagauauacagucuag

SEQ ID NO: 1119771 - RNA, 19 nt, Homo sapiens
gaaggaaaaugcagaucaa

SEQ ID NO: 1119772 - RNA, 19 nt, Homo sapiens
gaaugccuauguuauugau

SEQ ID NO: 1119773 - RNA, 19 nt, Homo sapiens
ccaaguacacuguugauca

SEQ ID NO: 1119774 - RNA, 19 nt, Homo sapiens
cgaagaaguuacugcagau

SEQ ID NO: 1119775 - RNA, 19 nt, Homo sapiens
auauaguccuggagaauuu

SEQ ID NO: 1119776 - RNA, 19 nt, Homo sapiens
cagaguauggugacagaua

SEQ ID NO: 1119777 - RNA, 19 nt, Homo sapiens
gaaauccuuaguuugauga

SEQ ID NO: 1119778 - RNA, 19 nt, Homo sapiens
uaccuuugcuguagaaguu

SEQ ID NO: 1119779 - RNA, 19 nt, Homo sapiens
cuaauggagugaaaccuau

SEQ ID NO: 1119780 - RNA, 19 nt, Homo sapiens
agaaggcacaugucuuaua

SEQ ID NO: 1119781 - RNA, 19 nt, Homo sapiens
agaaguuacugcagaugaa

SEQ ID NO: 1119782 - RNA, 19 nt, Homo sapiens
uauaaaguguguacuagca

SEQ ID NO: 1119783 - RNA, 19 nt, Homo sapiens
aaagugauccugaagaugu

SEQ ID NO: 1119784 - RNA, 19 nt, Homo sapiens
aaugggauauggcuugaaa

SEQ ID NO: 1119785 - RNA, 19 nt, Homo sapiens
gugaaaggaauuacaaaga

SEQ ID NO: 1119786 - RNA, 19 nt, Homo sapiens
auaacaagauuccagaugu

SEQ ID NO: 1119787 - RNA, 19 nt, Homo sapiens
gcagagauaggacaaccuu

SEQ ID NO: 1119788 - RNA, 19 nt, Homo sapiens
uaaacccagugacgugaaa

SEQ ID NO: 1119789 - RNA, 19 nt, Homo sapiens
ucuccuagaugcaggcuuu

SEQ ID NO: 1119790 - RNA, 19 nt, Homo sapiens
ugaaauccuuaguuugaug

SEQ ID NO: 1119791 - RNA, 19 nt, Homo sapiens
aggcaucccuuagcaagua

SEQ ID NO: 1119792 - RNA, 19 nt, Homo sapiens
gaaagcagcugguuaucaa

SEQ ID NO: 1119793 - RNA, 19 nt, Homo sapiens
ggagauacauaauuagaug

SEQ ID NO: 1119794 - RNA, 19 nt, Homo sapiens
ggugauggcuuauaagaga

SEQ ID NO: 1119795 - RNA, 19 nt, Homo sapiens
caaaggauguucaggaugu

SEQ ID NO: 1119796 - RNA, 19 nt, Homo sapiens
gaaaauugcucuuuggauu

SEQ ID NO: 1119797 - RNA, 19 nt, Homo sapiens
gcauggugauggcuuauaa

SEQ ID NO: 1119798 - RNA, 19 nt, Homo sapiens
gagcuaagguucugugauc

SEQ ID NO: 1119799 - RNA, 19 nt, Homo sapiens
gaaggauucucguucauca

SEQ ID NO: 1119800 - RNA, 19 nt, Homo sapiens
gaacagagaaccuuucaag

SEQ ID NO: 1119801 - RNA, 19 nt, Homo sapiens
gaugucauguucuacagua

SEQ ID NO: 1119802 - RNA, 19 nt, Homo sapiens
gaggaacccuucuggcaaa

SEQ ID NO: 1119803 - RNA, 19 nt, Homo sapiens
cagagaaccuuucaagaug

SEQ ID NO: 1119804 - RNA, 19 nt, Homo sapiens
ucaaagagauuggagcaaa

SEQ ID NO: 1119805 - RNA, 19 nt, Homo sapiens
caagaugaguacgaaauuu

SEQ ID NO: 1119806 - RNA, 19 nt, Homo sapiens
gguagagacuuuaggaaau

SEQ ID NO: 1119807 - RNA, 19 nt, Homo sapiens
ggacagcucaggucauuug

SEQ ID NO: 1119808 - RNA, 19 nt, Homo sapiens
ggacaaagggauauauaau

SEQ ID NO: 1119809 - RNA, 19 nt, Homo sapiens
caccauuccuggcuaauuu

SEQ ID NO: 1119810 - RNA, 19 nt, Homo sapiens
gcugaggacuugagagcua

SEQ ID NO: 1119811 - RNA, 19 nt, Homo sapiens
ucaaagacuugcucagcua

SEQ ID NO: 1119812 - RNA, 19 nt, Homo sapiens
ccaaguagcugggauuaca

SEQ ID NO: 1119813 - RNA, 19 nt, Homo sapiens
gaaagccauucucaucuca

SEQ ID NO: 1119814 - RNA, 19 nt, Homo sapiens
gaagagaacagugaacaga

SEQ ID NO: 1119815 - RNA, 19 nt, Homo sapiens
gaacugaucaacaauacug

SEQ ID NO: 1119816 - RNA, 19 nt, Homo sapiens
auaauuagaugccacuuga

SEQ ID NO: 1119817 - RNA, 19 nt, Homo sapiens
gaaaugggugugacucuga

SEQ ID NO: 1119818 - RNA, 19 nt, Homo sapiens
guagagacuuuaggaaaug

SEQ ID NO: 1119819 - RNA, 19 nt, Homo sapiens
caccaaaccuggaagacuu

SEQ ID NO: 1119820 - RNA, 19 nt, Homo sapiens
guaagcguuucacuaugua

SEQ ID NO: 1119821 - RNA, 19 nt, Homo sapiens
gauacugcauuggaaauug

SEQ ID NO: 1119822 - RNA, 19 nt, Homo sapiens
gguggaauacucuauauau

SEQ ID NO: 1119823 - RNA, 19 nt, Homo sapiens
gcaguagugugaauauuuu

SEQ ID NO: 1119824 - RNA, 19 nt, Homo sapiens
gaauguugguauagaagug

SEQ ID NO: 1119825 - RNA, 19 nt, Homo sapiens
ccuagaaacuguugugaca

SEQ ID NO: 1119826 - RNA, 19 nt, Homo sapiens
gccaaguucuucaguccua

SEQ ID NO: 1119827 - RNA, 19 nt, Homo sapiens
gggaauccaugaaucaaag

SEQ ID NO: 1119828 - RNA, 19 nt, Homo sapiens
ugaugaacaugcuggaauu

SEQ ID NO: 1119829 - RNA, 19 nt, Homo sapiens
cguaagcguuucacuaugu

SEQ ID NO: 1119830 - RNA, 19 nt, Homo sapiens
gacguaagcguuucacuau

SEQ ID NO: 1119831 - RNA, 19 nt, Homo sapiens
aguaauggguagagacuuu

SEQ ID NO: 1119832 - RNA, 19 nt, Homo sapiens
aaagaaacuucaacaggau

SEQ ID NO: 1119833 - RNA, 19 nt, Homo sapiens
caacaauacugugcuguac

SEQ ID NO: 1119834 - RNA, 19 nt, Homo sapiens
ggauucucguucaucauuu

SEQ ID NO: 1119835 - RNA, 19 nt, Homo sapiens
cuacucaauugugcuauuu

SEQ ID NO: 1119836 - RNA, 19 nt, Homo sapiens
uggcucagcucucaaagga

SEQ ID NO: 1119837 - RNA, 19 nt, Homo sapiens
gcacauauaccagaggaau

SEQ ID NO: 1119838 - RNA, 19 nt, Homo sapiens
gaugcucccucgaguuuca

SEQ ID NO: 1119839 - RNA, 19 nt, Homo sapiens
ccaaagugcugggauuaca

SEQ ID NO: 1119840 - RNA, 19 nt, Homo sapiens
agagaaccuuucaagauga

SEQ ID NO: 1119841 - RNA, 19 nt, Homo sapiens
gggugugaauguugguaua

SEQ ID NO: 1119842 - RNA, 19 nt, Homo sapiens
caaagagauuggagcaaag

SEQ ID NO: 1119843 - RNA, 19 nt, Homo sapiens
gacaaagggauauauaauc

SEQ ID NO: 1119844 - RNA, 19 nt, Homo sapiens
ccaggauacugcauuggaa

SEQ ID NO: 1119845 - RNA, 19 nt, Homo sapiens
guuaaagacguaagcguuu

SEQ ID NO: 1119846 - RNA, 19 nt, Homo sapiens
ggguagagacuuuaggaaa

SEQ ID NO: 1119847 - RNA, 19 nt, Homo sapiens
ggauguagaagcaaagaug

SEQ ID NO: 1119848 - RNA, 19 nt, Homo sapiens
ggagcauccuggagccaaa

SEQ ID NO: 1119849 - RNA, 19 nt, Homo sapiens
gaaccuuucaagaugagua

SEQ ID NO: 1119850 - RNA, 19 nt, Homo sapiens
acagagaaccuuucaagau

SEQ ID NO: 1119851 - RNA, 19 nt, Homo sapiens
uugcuaccaucauuucaua

SEQ ID NO: 1119852 - RNA, 19 nt, Homo sapiens
guccagugauugaauucua

SEQ ID NO: 1119853 - RNA, 19 nt, Homo sapiens
gacuuacucuucuggaaau

SEQ ID NO: 1119854 - RNA, 19 nt, Homo sapiens
cagcucaggucauuuggau

SEQ ID NO: 1119855 - RNA, 19 nt, Homo sapiens
agagaacagugaacagaau

SEQ ID NO: 1119856 - RNA, 19 nt, Homo sapiens
ugaacaugcuggaauugga

SEQ ID NO: 1119857 - RNA, 19 nt, Homo sapiens
agagaaagcagcugguuau

SEQ ID NO: 1119858 - RNA, 19 nt, Homo sapiens
ggauauauaaucugcaaca

SEQ ID NO: 1119859 - RNA, 19 nt, Homo sapiens
gguguccagugauugaauu

SEQ ID NO: 1119860 - RNA, 19 nt, Homo sapiens
ggaauacgagccaaagaag

SEQ ID NO: 1119861 - RNA, 19 nt, Homo sapiens
gaacccuucuggcaaaauu

SEQ ID NO: 1119862 - RNA, 19 nt, Homo sapiens
ugacuauguuccaguugaa

SEQ ID NO: 1119863 - RNA, 19 nt, Homo sapiens
ggugagaagagaacaguga

SEQ ID NO: 1119864 - RNA, 19 nt, Homo sapiens
ggacuugagagcuaagguu

SEQ ID NO: 1119865 - RNA, 19 nt, Homo sapiens
ugucaaaacucucaaauag

SEQ ID NO: 1119866 - RNA, 19 nt, Homo sapiens
gauagcaguagugugaaua

SEQ ID NO: 1119867 - RNA, 19 nt, Homo sapiens
uacgauagcaguaguguga

SEQ ID NO: 1119868 - RNA, 19 nt, Homo sapiens
agacguaagcguuucacua

SEQ ID NO: 1119869 - RNA, 19 nt, Homo sapiens
guaauggguagagacuuua

SEQ ID NO: 1119870 - RNA, 19 nt, Homo sapiens
guggugccauccuaaagaa

SEQ ID NO: 1119871 - RNA, 19 nt, Homo sapiens
caggacaaagggauauaua

SEQ ID NO: 1119872 - RNA, 19 nt, Homo sapiens
gagaagagaacagugaaca

SEQ ID NO: 1119873 - RNA, 19 nt, Homo sapiens
gacacuggcucagcucuca

SEQ ID NO: 1119874 - RNA, 19 nt, Homo sapiens
ucaagaugaguacgaaauu

SEQ ID NO: 1119875 - RNA, 19 nt, Homo sapiens
auacugugcuguacgauag

SEQ ID NO: 1119876 - RNA, 19 nt, Homo sapiens
acaauacugugcuguacga

SEQ ID NO: 1119877 - RNA, 19 nt, Homo sapiens
ucaacaauacugugcugua

SEQ ID NO: 1119878 - RNA, 19 nt, Homo sapiens
gugguggaauacucuauau

SEQ ID NO: 1119879 - RNA, 19 nt, Homo sapiens
ggugguggaauacucuaua

SEQ ID NO: 1119880 - RNA, 19 nt, Homo sapiens
gagccaaacuucagauacc

SEQ ID NO: 1119881 - RNA, 19 nt, Homo sapiens
gacaggaccguuccacuuc

SEQ ID NO: 1119882 - RNA, 19 nt, Homo sapiens
ugacaggaccguuccacuu

SEQ ID NO: 1119883 - RNA, 19 nt, Homo sapiens
gggaacaaucugacuaugu

SEQ ID NO: 1119884 - RNA, 19 nt, Homo sapiens
ccuauugagugccaccaaa

SEQ ID NO: 1119885 - RNA, 19 nt, Homo sapiens
agacaggguuucaccaucu

SEQ ID NO: 1119886 - RNA, 19 nt, Homo sapiens
auacugcauuggaaauuga

SEQ ID NO: 1119887 - RNA, 19 nt, Homo sapiens
ggauccagagccaucauuu

SEQ ID NO: 1119888 - RNA, 19 nt, Homo sapiens
uggccuggcugaucuugaa

SEQ ID NO: 1119889 - RNA, 19 nt, Homo sapiens
gcguuucacuauguauaaa

SEQ ID NO: 1119890 - RNA, 19 nt, Homo sapiens
uugcucagcuaguucugua

SEQ ID NO: 1119891 - RNA, 19 nt, Homo sapiens
ggcagucaguccagagaug

SEQ ID NO: 1119892 - RNA, 19 nt, Homo sapiens
gaaagaagcuccuccaauu

SEQ ID NO: 1119893 - RNA, 19 nt, Homo sapiens
gaucagaacugccagauaa

SEQ ID NO: 1119894 - RNA, 19 nt, Homo sapiens
gaucaaagguggaagauuu

SEQ ID NO: 1119895 - RNA, 19 nt, Homo sapiens
gcaacaagaugcugacuua

SEQ ID NO: 1119896 - RNA, 19 nt, Homo sapiens
ucacugaccugguuuauua

SEQ ID NO: 1119897 - RNA, 19 nt, Homo sapiens
gaaagagucuguagaaguu

SEQ ID NO: 1119898 - RNA, 19 nt, Homo sapiens
gauaagacauggagagaua

SEQ ID NO: 1119899 - RNA, 19 nt, Homo sapiens
gcaaagagguugaugaaau

SEQ ID NO: 1119900 - RNA, 19 nt, Homo sapiens
gaacagagauuaguggauu

SEQ ID NO: 1119901 - RNA, 19 nt, Homo sapiens
gaaaugaucgagaaacuua

SEQ ID NO: 1119902 - RNA, 19 nt, Homo sapiens
ggagguaacugauaugauu

SEQ ID NO: 1119903 - RNA, 19 nt, Homo sapiens
gaaaggagaugauaagaag

SEQ ID NO: 1119904 - RNA, 19 nt, Homo sapiens
gaaguacucuuguuaaugu

SEQ ID NO: 1119905 - RNA, 19 nt, Homo sapiens
gaaauuagccagcaaagaa

SEQ ID NO: 1119906 - RNA, 19 nt, Homo sapiens
gaaagucugugaggaguua

SEQ ID NO: 1119907 - RNA, 19 nt, Homo sapiens
gcaagaagguggccucuga

SEQ ID NO: 1119908 - RNA, 19 nt, Homo sapiens
gaaagcugaugaaacaaua

SEQ ID NO: 1119909 - RNA, 19 nt, Homo sapiens
gaaaguaagucuaaaccaa

SEQ ID NO: 1119910 - RNA, 19 nt, Homo sapiens
gaagcuggcucaucaacua

SEQ ID NO: 1119911 - RNA, 19 nt, Homo sapiens
gggcaaaucuccacauaaa

SEQ ID NO: 1119912 - RNA, 19 nt, Homo sapiens
gcacuguuaugucaacuua

SEQ ID NO: 1119913 - RNA, 19 nt, Homo sapiens
guacauggcuuccucagaa

SEQ ID NO: 1119914 - RNA, 19 nt, Homo sapiens
gaaacuacauguaugaaga

SEQ ID NO: 1119915 - RNA, 19 nt, Homo sapiens
gcaauggauucauaugaua

SEQ ID NO: 1119916 - RNA, 19 nt, Homo sapiens
guaaggaaauguucugaaa

SEQ ID NO: 1119917 - RNA, 19 nt, Homo sapiens
gcaaaugaguuucaaagga

SEQ ID NO: 1119918 - RNA, 19 nt, Homo sapiens
ccagaaccauuuaguguua

SEQ ID NO: 1119919 - RNA, 19 nt, Homo sapiens
ccacauggcugauuauuca

SEQ ID NO: 1119920 - RNA, 19 nt, Homo sapiens
gagaaugguugucuuugua

SEQ ID NO: 1119921 - RNA, 19 nt, Homo sapiens
ggagagaaaugaucgagaa

SEQ ID NO: 1119922 - RNA, 19 nt, Homo sapiens
cauuagagcugucaaguuu

SEQ ID NO: 1119923 - RNA, 19 nt, Homo sapiens
aaacucagcugcuauuuga

SEQ ID NO: 1119924 - RNA, 19 nt, Homo sapiens
ucaagaaggucugaaguua

SEQ ID NO: 1119925 - RNA, 19 nt, Homo sapiens
gcacaaugacucuguauaa

SEQ ID NO: 1119926 - RNA, 19 nt, Homo sapiens
gacaugaggcuaaauaaua

SEQ ID NO: 1119927 - RNA, 19 nt, Homo sapiens
guaaggaaauccauaguug

SEQ ID NO: 1119928 - RNA, 19 nt, Homo sapiens
gcaaaugcagcuaaacuua

SEQ ID NO: 1119929 - RNA, 19 nt, Homo sapiens
gaugauagauccucaaagu

SEQ ID NO: 1119930 - RNA, 19 nt, Homo sapiens
gaaaagaagugaaguaaug

SEQ ID NO: 1119931 - RNA, 19 nt, Homo sapiens
gaauuuagcagcaacuaua

SEQ ID NO: 1119932 - RNA, 19 nt, Homo sapiens
gcuaauaaauggaucaaga

SEQ ID NO: 1119933 - RNA, 19 nt, Homo sapiens
gcaaaugggucauagcaau

SEQ ID NO: 1119934 - RNA, 19 nt, Homo sapiens
ugaauggcaugaagauuua

SEQ ID NO: 1119935 - RNA, 19 nt, Homo sapiens
gcaggugccuugccaauau

SEQ ID NO: 1119936 - RNA, 19 nt, Homo sapiens
gaauuaaucuccaccuuca

SEQ ID NO: 1119937 - RNA, 19 nt, Homo sapiens
ggaagaaauugaaauguca

SEQ ID NO: 1119938 - RNA, 19 nt, Homo sapiens
ugaaacugcugucgaauuu

SEQ ID NO: 1119939 - RNA, 19 nt, Homo sapiens
ggagguacccaacaacuua

SEQ ID NO: 1119940 - RNA, 19 nt, Homo sapiens
caagaaaccaguaagauuu

SEQ ID NO: 1119941 - RNA, 19 nt, Homo sapiens
gacuuccgcuucuauauua

SEQ ID NO: 1119942 - RNA, 19 nt, Homo sapiens
gaagcuauaugcaucuuga

SEQ ID NO: 1119943 - RNA, 19 nt, Homo sapiens
cuacaaaccucugcuaauu

SEQ ID NO: 1119944 - RNA, 19 nt, Homo sapiens
gaaacugggacauuuauuu

SEQ ID NO: 1119945 - RNA, 19 nt, Homo sapiens
gaauauuccuuaugaguuc

SEQ ID NO: 1119946 - RNA, 19 nt, Homo sapiens
ggaagaaaguauaugauag

SEQ ID NO: 1119947 - RNA, 19 nt, Homo sapiens
ggaaggcaauauauuagaa

SEQ ID NO: 1119948 - RNA, 19 nt, Homo sapiens
gacagaagcuggcucauca

SEQ ID NO: 1119949 - RNA, 19 nt, Homo sapiens
gaagaaauuuugcugcuua

SEQ ID NO: 1119950 - RNA, 19 nt, Homo sapiens
gcaggcagcuccaucauuc

SEQ ID NO: 1119951 - RNA, 19 nt, Homo sapiens
ugaaugaggucgcuaguga

SEQ ID NO: 1119952 - RNA, 19 nt, Homo sapiens
caagaaagacggaaauuug

SEQ ID NO: 1119953 - RNA, 19 nt, Homo sapiens
gaugaaauaugucgauuag

SEQ ID NO: 1119954 - RNA, 19 nt, Homo sapiens
gaagaugaaacugcuauua

SEQ ID NO: 1119955 - RNA, 19 nt, Homo sapiens
caaagagguugaugaaaug

SEQ ID NO: 1119956 - RNA, 19 nt, Homo sapiens
ggcacuacauccucaauua

SEQ ID NO: 1119957 - RNA, 19 nt, Homo sapiens
caagagauaugugauaaga

SEQ ID NO: 1119958 - RNA, 19 nt, Homo sapiens
gaagugucaugcaggauaa

SEQ ID NO: 1119959 - RNA, 19 nt, Homo sapiens
gaggaaggcagacgauuua

SEQ ID NO: 1119960 - RNA, 19 nt, Homo sapiens
uaauggaaaugaaggcuua

SEQ ID NO: 1119961 - RNA, 19 nt, Homo sapiens
ucaaggaucacuuuacuua

SEQ ID NO: 1119962 - RNA, 19 nt, Homo sapiens
gggagaagcugugacaauu

SEQ ID NO: 1119963 - RNA, 19 nt, Homo sapiens
ggauuuagcugcagauaag

SEQ ID NO: 1119964 - RNA, 19 nt, Homo sapiens
ccagaaaucuuugggauga

SEQ ID NO: 1119965 - RNA, 19 nt, Homo sapiens
gagcacaucagcagaauuu

SEQ ID NO: 1119966 - RNA, 19 nt, Homo sapiens
acaaaccucugcuaauuaa

SEQ ID NO: 1119967 - RNA, 19 nt, Homo sapiens
gcacauuccucucauucaa

SEQ ID NO: 1119968 - RNA, 19 nt, Homo sapiens
gaagcgagcagauauuauu

SEQ ID NO: 1119969 - RNA, 19 nt, Homo sapiens
gcaaaucuccacauaaaga

SEQ ID NO: 1119970 - RNA, 19 nt, Homo sapiens
caaaugaguuucaaaggau

SEQ ID NO: 1119971 - RNA, 19 nt, Homo sapiens
gaguggagauuucugcuaa

SEQ ID NO: 1119972 - RNA, 19 nt, Homo sapiens
gaaacuggauucugcuuca

SEQ ID NO: 1119973 - RNA, 19 nt, Homo sapiens
cagauuagcugcccacaug

SEQ ID NO: 1119974 - RNA, 19 nt, Homo sapiens
caaugacucuguauaaaga

SEQ ID NO: 1119975 - RNA, 19 nt, Homo sapiens
guucagagaucaucaggaa

SEQ ID NO: 1119976 - RNA, 19 nt, Homo sapiens
caaguuauguugcuccauu

SEQ ID NO: 1119977 - RNA, 19 nt, Homo sapiens
gcgaagaacuagauccuau

SEQ ID NO: 1119978 - RNA, 19 nt, Homo sapiens
aaagaaggcugaccuggaa

SEQ ID NO: 1119979 - RNA, 19 nt, Homo sapiens
gccaauggauuuagaaguu

SEQ ID NO: 1119980 - RNA, 19 nt, Homo sapiens
gcauuugccucuucaguga

SEQ ID NO: 1119981 - RNA, 19 nt, Homo sapiens
gcugaaauauccaaaugaa

SEQ ID NO: 1119982 - RNA, 19 nt, Homo sapiens
gaguagagaaagcauauua

SEQ ID NO: 1119983 - RNA, 19 nt, Homo sapiens
ggaaguagccgaagagaca

SEQ ID NO: 1119984 - RNA, 19 nt, Homo sapiens
gguggaagcagaugacuua

SEQ ID NO: 1119985 - RNA, 19 nt, Homo sapiens
ccagaugaauuucuagauu

SEQ ID NO: 1119986 - RNA, 19 nt, Homo sapiens
gaacugguaugaucuaaaa

SEQ ID NO: 1119987 - RNA, 19 nt, Homo sapiens
gaagugguugguugaauua

SEQ ID NO: 1119988 - RNA, 19 nt, Homo sapiens
ggaaauuacuggagaggau

SEQ ID NO: 1119989 - RNA, 19 nt, Homo sapiens
cagauaagauugagcaguu

SEQ ID NO: 1119990 - RNA, 19 nt, Homo sapiens
caaaggaugcuuauuauuc

SEQ ID NO: 1119991 - RNA, 19 nt, Homo sapiens
ggccagaccuugaagaaga

SEQ ID NO: 1119992 - RNA, 19 nt, Homo sapiens
ugaaagaggccuugauuua

SEQ ID NO: 1119993 - RNA, 19 nt, Homo sapiens
gaaagaggccuugauuuaa

SEQ ID NO: 1119994 - RNA, 19 nt, Homo sapiens
ggaaauccgugcuguguau

SEQ ID NO: 1119995 - RNA, 19 nt, Homo sapiens
aaagaggccuugauuuaaa

SEQ ID NO: 1119996 - RNA, 19 nt, Homo sapiens
uaagaaagaugcugagcuu

SEQ ID NO: 1119997 - RNA, 19 nt, Homo sapiens
ggccaucgcugccgucuuu

SEQ ID NO: 1119998 - RNA, 19 nt, Homo sapiens
gaagugcucuuuauguauc

SEQ ID NO: 1119999 - RNA, 19 nt, Homo sapiens
ucaauaaacugcaccaugu

SEQ ID NO: 1120000 - RNA, 19 nt, Homo sapiens
caacauagccaucgacuuc

SEQ ID NO: 1120001 - RNA, 19 nt, Homo sapiens
ucaaauagguuucauacuc

SEQ ID NO: 1120002 - RNA, 19 nt, Homo sapiens
ggaagacucugccaugaca

SEQ ID NO: 1120003 - RNA, 19 nt, Homo sapiens
ugacagacaucguggaaau

SEQ ID NO: 1120004 - RNA, 19 nt, Homo sapiens
ccaaagccguccuguguau

SEQ ID NO: 1120005 - RNA, 19 nt, Homo sapiens
ugagagaggagaaugaaua

SEQ ID NO: 1120006 - RNA, 19 nt, Homo sapiens
aaaagaagauggagaauga

SEQ ID NO: 1120007 - RNA, 19 nt, Homo sapiens
caaauagguuucauacucu

SEQ ID NO: 1120008 - RNA, 19 nt, Homo sapiens
ggacuuugccuuugcagaa

SEQ ID NO: 1120009 - RNA, 19 nt, Homo sapiens
gagaaaaucuugauagaca

SEQ ID NO: 1120010 - RNA, 19 nt, Homo sapiens
gaccaaagccguccugugu

SEQ ID NO: 1120011 - RNA, 19 nt, Homo sapiens
cguaugagauccuacaaug

SEQ ID NO: 1120012 - RNA, 19 nt, Homo sapiens
uuaaggaagugcucuuuau

SEQ ID NO: 1120013 - RNA, 19 nt, Homo sapiens
gagagaggagaaugaauaa

SEQ ID NO: 1120014 - RNA, 19 nt, Homo sapiens
gaaagaugcugagcuucug

SEQ ID NO: 1120015 - RNA, 19 nt, Homo sapiens
guugaaaccaaucacauua

SEQ ID NO: 1120016 - RNA, 19 nt, Homo sapiens
aggaagugcucuuuaugua

SEQ ID NO: 1120017 - RNA, 19 nt, Homo sapiens
cuacagcggucaguauaaa

SEQ ID NO: 1120018 - RNA, 19 nt, Homo sapiens
ggaguggacuuugccuuug

SEQ ID NO: 1120019 - RNA, 19 nt, Homo sapiens
ugucauagcucagguuguu

SEQ ID NO: 1120020 - RNA, 19 nt, Homo sapiens
gcccauagguuugucaguu

SEQ ID NO: 1120021 - RNA, 19 nt, Homo sapiens
ggagaugcaacaauaagaa

SEQ ID NO: 1120022 - RNA, 19 nt, Homo sapiens
gaacauuagcagugaucua

SEQ ID NO: 1120023 - RNA, 19 nt, Homo sapiens
caucaucccugacagaagu

SEQ ID NO: 1120024 - RNA, 19 nt, Homo sapiens
gguauaaacuguugaaacc

SEQ ID NO: 1120025 - RNA, 19 nt, Homo sapiens
gagaaucagucggccuauu

SEQ ID NO: 1120026 - RNA, 19 nt, Homo sapiens
gggcauugcugcugucaag

SEQ ID NO: 1120027 - RNA, 19 nt, Homo sapiens
ggaagugcucuuuauguau

SEQ ID NO: 1120028 - RNA, 19 nt, Homo sapiens
gaacauucacgacaucauc

SEQ ID NO: 1120029 - RNA, 19 nt, Homo sapiens
caagaacauucacgacauc

SEQ ID NO: 1120030 - RNA, 19 nt, Homo sapiens
uuucaggguuuauggauuu

SEQ ID NO: 1120031 - RNA, 19 nt, Homo sapiens
cggcagaucuuuguugugu

SEQ ID NO: 1120032 - RNA, 19 nt, Homo sapiens
gaaaugagagaggagaaug

SEQ ID NO: 1120033 - RNA, 19 nt, Homo sapiens
cgacagaggaggugacaga

SEQ ID NO: 1120034 - RNA, 19 nt, Homo sapiens
gcaggaggaucgcuuaagc

SEQ ID NO: 1120035 - RNA, 19 nt, Homo sapiens
gguaugcccuuccugaucu

SEQ ID NO: 1120036 - RNA, 19 nt, Homo sapiens
ucaauucucuagcauacug

SEQ ID NO: 1120037 - RNA, 19 nt, Homo sapiens
gagaugcaacaauaagaaa

SEQ ID NO: 1120038 - RNA, 19 nt, Homo sapiens
caucaaaacuguggguaua

SEQ ID NO: 1120039 - RNA, 19 nt, Homo sapiens
acugauagcuuauagugau

SEQ ID NO: 1120040 - RNA, 19 nt, Homo sapiens
uuaaacacuuggcauacaa

SEQ ID NO: 1120041 - RNA, 19 nt, Homo sapiens
ggacagucagucaggauga

SEQ ID NO: 1120042 - RNA, 19 nt, Homo sapiens
gagaggagaaugaauaagg

SEQ ID NO: 1120043 - RNA, 19 nt, Homo sapiens
cagaggaggugacagacau

SEQ ID NO: 1120044 - RNA, 19 nt, Homo sapiens
guacaugggcgcacuugug

SEQ ID NO: 1120045 - RNA, 19 nt, Homo sapiens
cguacucccucaugaaguu

SEQ ID NO: 1120046 - RNA, 19 nt, Homo sapiens
gacuacagcggucaguaua

SEQ ID NO: 1120047 - RNA, 19 nt, Homo sapiens
cccauagguuugucaguuu

SEQ ID NO: 1120048 - RNA, 19 nt, Homo sapiens
gauuuagaacgucguauga

SEQ ID NO: 1120049 - RNA, 19 nt, Homo sapiens
caggguuuauggauuugua

SEQ ID NO: 1120050 - RNA, 19 nt, Homo sapiens
uuaaagguuucgugucaau

SEQ ID NO: 1120051 - RNA, 19 nt, Homo sapiens
cagcccacaucaagaaguu

SEQ ID NO: 1120052 - RNA, 19 nt, Homo sapiens
acaagaacauucacgacau

SEQ ID NO: 1120053 - RNA, 19 nt, Homo sapiens
ggugggaugugccucaauc

SEQ ID NO: 1120054 - RNA, 19 nt, Homo sapiens
gcaaaaccccgucucuaaa

SEQ ID NO: 1120055 - RNA, 19 nt, Homo sapiens
gaauccagccugagcaaca

SEQ ID NO: 1120056 - RNA, 19 nt, Homo sapiens
uaugagauccuacaaugga

SEQ ID NO: 1120057 - RNA, 19 nt, Homo sapiens
gaugcaacaauaagaaaga

SEQ ID NO: 1120058 - RNA, 19 nt, Homo sapiens
caagagagacaggaccaaa

SEQ ID NO: 1120059 - RNA, 19 nt, Homo sapiens
gcauugguaagagcauuua

SEQ ID NO: 1120060 - RNA, 19 nt, Homo sapiens
ggauuuagaacgucguaug

SEQ ID NO: 1120061 - RNA, 19 nt, Homo sapiens
cagcagggauggacuugag

SEQ ID NO: 1120062 - RNA, 19 nt, Homo sapiens
ucccaugagugacuucaaa

SEQ ID NO: 1120063 - RNA, 19 nt, Homo sapiens
cauuagcagugaucuagau

SEQ ID NO: 1120064 - RNA, 19 nt, Homo sapiens
gggaugugccucaaucuca

SEQ ID NO: 1120065 - RNA, 19 nt, Homo sapiens
uaaggaagugcucuuuaug

SEQ ID NO: 1120066 - RNA, 19 nt, Homo sapiens
gaggcaggaggaucgcuua

SEQ ID NO: 1120067 - RNA, 19 nt, Homo sapiens
uuuagaacgucguaugaga

SEQ ID NO: 1120068 - RNA, 19 nt, Homo sapiens
ggaggaugcagucgagaug

SEQ ID NO: 1120069 - RNA, 19 nt, Homo sapiens
aaugaaagaggccuugauu

SEQ ID NO: 1120070 - RNA, 19 nt, Homo sapiens
agaaucagucggccuauug

SEQ ID NO: 1120071 - RNA, 19 nt, Homo sapiens
acacacugauagcuuauag

SEQ ID NO: 1120072 - RNA, 19 nt, Homo sapiens
uaaaaucaccucauucuuc

SEQ ID NO: 1120073 - RNA, 19 nt, Homo sapiens
ggaaaugagagaggagaau

SEQ ID NO: 1120074 - RNA, 19 nt, Homo sapiens
uagcagugaucuagauuuu

SEQ ID NO: 1120075 - RNA, 19 nt, Homo sapiens
ucaccucauucuucauuuc

SEQ ID NO: 1120076 - RNA, 19 nt, Homo sapiens
uucacacacugauagcuua

SEQ ID NO: 1120077 - RNA, 19 nt, Homo sapiens
ugucaauucucuagcauac

SEQ ID NO: 1120078 - RNA, 19 nt, Homo sapiens
caucaucggaguggacuuu

SEQ ID NO: 1120079 - RNA, 19 nt, Homo sapiens
cacccaacgugucugagaa

SEQ ID NO: 1120080 - RNA, 19 nt, Homo sapiens
cgacaucaucccugacaga

SEQ ID NO: 1120081 - RNA, 19 nt, Homo sapiens
ucuaacagauggaaguuuu

SEQ ID NO: 1120082 - RNA, 19 nt, Homo sapiens
ccauagguuugucaguuuc

SEQ ID NO: 1120083 - RNA, 19 nt, Homo sapiens
aaaaucaccucauucuuca

SEQ ID NO: 1120084 - RNA, 19 nt, Homo sapiens
caacgugucugagaaaauc

SEQ ID NO: 1120085 - RNA, 19 nt, Homo sapiens
ggaccuugguggcaguucu

SEQ ID NO: 1120086 - RNA, 19 nt, Homo sapiens
gggagaugcaacaauaaga

SEQ ID NO: 1120087 - RNA, 19 nt, Homo sapiens
caaaaccccgucucuaaaa

SEQ ID NO: 1120088 - RNA, 19 nt, Homo sapiens
ccucauucuucauuucaga

SEQ ID NO: 1120089 - RNA, 19 nt, Homo sapiens
gcauugcugcugucaagga

SEQ ID NO: 1120090 - RNA, 19 nt, Homo sapiens
gcugaugacacugaagaaa

SEQ ID NO: 1120091 - RNA, 19 nt, Homo sapiens
cggaguggacuuugccuuu

SEQ ID NO: 1120092 - RNA, 19 nt, Homo sapiens
cgaaacaacugacuucaua

SEQ ID NO: 1120093 - RNA, 19 nt, Homo sapiens
ugaaagaggccuugauuua

SEQ ID NO: 1120094 - RNA, 19 nt, Homo sapiens
gaaagaggccuugauuuaa

SEQ ID NO: 1120095 - RNA, 19 nt, Homo sapiens
ggaaauccgugcuguguau

SEQ ID NO: 1120096 - RNA, 19 nt, Homo sapiens
guagauauauuaccugguu

SEQ ID NO: 1120097 - RNA, 19 nt, Homo sapiens
gacagaaucucccguagaa

SEQ ID NO: 1120098 - RNA, 19 nt, Homo sapiens
guagaaagguuugguuuga

SEQ ID NO: 1120099 - RNA, 19 nt, Homo sapiens
aaagaggccuugauuuaaa

SEQ ID NO: 1120100 - RNA, 19 nt, Homo sapiens
gaaacccugucucuacuaa

SEQ ID NO: 1120101 - RNA, 19 nt, Homo sapiens
gcuuaaagauccaaacuga

SEQ ID NO: 1120102 - RNA, 19 nt, Homo sapiens
uaagaaagaugcugagcuu

SEQ ID NO: 1120103 - RNA, 19 nt, Homo sapiens
ggccaucgcugccgucuuu

SEQ ID NO: 1120104 - RNA, 19 nt, Homo sapiens
gcagcaaacugacaugguu

SEQ ID NO: 1120105 - RNA, 19 nt, Homo sapiens
ugaauggucuuuacuguug

SEQ ID NO: 1120106 - RNA, 19 nt, Homo sapiens
ucaauaaacugcaccaugu

SEQ ID NO: 1120107 - RNA, 19 nt, Homo sapiens
caacauagccaucgacuuc

SEQ ID NO: 1120108 - RNA, 19 nt, Homo sapiens
ggaagacucugccaugaca

SEQ ID NO: 1120109 - RNA, 19 nt, Homo sapiens
aaacugacaugguugaaug

SEQ ID NO: 1120110 - RNA, 19 nt, Homo sapiens
ugacagacaucguggaaau

SEQ ID NO: 1120111 - RNA, 19 nt, Homo sapiens
gaaauaacgcauucgaaau

SEQ ID NO: 1120112 - RNA, 19 nt, Homo sapiens
ucacauggccguacaaaga

SEQ ID NO: 1120113 - RNA, 19 nt, Homo sapiens
gaacugaagcuuuaagucu

SEQ ID NO: 1120114 - RNA, 19 nt, Homo sapiens
ccaaagccguccuguguau

SEQ ID NO: 1120115 - RNA, 19 nt, Homo sapiens
ugagagaggagaaugaaua

SEQ ID NO: 1120116 - RNA, 19 nt, Homo sapiens
aaaagaagauggagaauga

SEQ ID NO: 1120117 - RNA, 19 nt, Homo sapiens
ugaaauaacgcauucgaaa

SEQ ID NO: 1120118 - RNA, 19 nt, Homo sapiens
ccagguugcuguaggguaa

SEQ ID NO: 1120119 - RNA, 19 nt, Homo sapiens
ggacuuugccuuugcagaa

SEQ ID NO: 1120120 - RNA, 19 nt, Homo sapiens
gagaaaaucuugauagaca

SEQ ID NO: 1120121 - RNA, 19 nt, Homo sapiens
gaccaaagccguccugugu

SEQ ID NO: 1120122 - RNA, 19 nt, Homo sapiens
ugacaugguugaaugauag

SEQ ID NO: 1120123 - RNA, 19 nt, Homo sapiens
ccgguggccucuuaaauuu

SEQ ID NO: 1120124 - RNA, 19 nt, Homo sapiens
agacacgguucacuaaauu

SEQ ID NO: 1120125 - RNA, 19 nt, Homo sapiens
gagagaggagaaugaauaa

SEQ ID NO: 1120126 - RNA, 19 nt, Homo sapiens
gaaagaugcugagcuucug

SEQ ID NO: 1120127 - RNA, 19 nt, Homo sapiens
agaaagguuugguuugaaa

SEQ ID NO: 1120128 - RNA, 19 nt, Homo sapiens
gcugacagauggacagaau

SEQ ID NO: 1120129 - RNA, 19 nt, Homo sapiens
cuucaucgcucuuaagaau

SEQ ID NO: 1120130 - RNA, 19 nt, Homo sapiens
ggaguggacuuugccuuug

SEQ ID NO: 1120131 - RNA, 19 nt, Homo sapiens
ugucauagcucagguuguu

SEQ ID NO: 1120132 - RNA, 19 nt, Homo sapiens
guugaaacguauuguauca

SEQ ID NO: 1120133 - RNA, 19 nt, Homo sapiens
cagaauuccuagacugaaa

SEQ ID NO: 1120134 - RNA, 19 nt, Homo sapiens
ggagaugcaacaauaagaa

SEQ ID NO: 1120135 - RNA, 19 nt, Homo sapiens
caaggaggguggaucacuu

SEQ ID NO: 1120136 - RNA, 19 nt, Homo sapiens
ucucaaauguaucagcuuu

SEQ ID NO: 1120137 - RNA, 19 nt, Homo sapiens
caucaucccugacagaagu

SEQ ID NO: 1120138 - RNA, 19 nt, Homo sapiens
cauggagcauccuaacuuu

SEQ ID NO: 1120139 - RNA, 19 nt, Homo sapiens
gagaaucagucggccuauu

SEQ ID NO: 1120140 - RNA, 19 nt, Homo sapiens
gauccaaacugagaaagca

SEQ ID NO: 1120141 - RNA, 19 nt, Homo sapiens
aaacucggcuuccuuugau

SEQ ID NO: 1120142 - RNA, 19 nt, Homo sapiens
gggcauugcugcugucaag

SEQ ID NO: 1120143 - RNA, 19 nt, Homo sapiens
uaaguugcauagcugcuuu

SEQ ID NO: 1120144 - RNA, 19 nt, Homo sapiens
ggacagaaucucccguaga

SEQ ID NO: 1120145 - RNA, 19 nt, Homo sapiens
gaacauucacgacaucauc

SEQ ID NO: 1120146 - RNA, 19 nt, Homo sapiens
gcaguugaaacguauugua

SEQ ID NO: 1120147 - RNA, 19 nt, Homo sapiens
caagaacauucacgacauc

SEQ ID NO: 1120148 - RNA, 19 nt, Homo sapiens
ggcauaauguuagcuguga

SEQ ID NO: 1120149 - RNA, 19 nt, Homo sapiens
gaauguaaggcucaguaaa

SEQ ID NO: 1120150 - RNA, 19 nt, Homo sapiens
cggcagaucuuuguugugu

SEQ ID NO: 1120151 - RNA, 19 nt, Homo sapiens
gaaaugagagaggagaaug

SEQ ID NO: 1120152 - RNA, 19 nt, Homo sapiens
cgacagaggaggugacaga

SEQ ID NO: 1120153 - RNA, 19 nt, Homo sapiens
gaggguggaucacuuaagg

SEQ ID NO: 1120154 - RNA, 19 nt, Homo sapiens
ucaauucucuagcauacug

SEQ ID NO: 1120155 - RNA, 19 nt, Homo sapiens
ccuguaaucccaacacuuu

SEQ ID NO: 1120156 - RNA, 19 nt, Homo sapiens
uuaaagauccaaacugaga

SEQ ID NO: 1120157 - RNA, 19 nt, Homo sapiens
aaacaaacgaaacaacuga

SEQ ID NO: 1120158 - RNA, 19 nt, Homo sapiens
ggucuuuacuguugcuaug

SEQ ID NO: 1120159 - RNA, 19 nt, Homo sapiens
gagaugcaacaauaagaaa

SEQ ID NO: 1120160 - RNA, 19 nt, Homo sapiens
gcugugugaucauauuguu

SEQ ID NO: 1120161 - RNA, 19 nt, Homo sapiens
ucagugcugugugaucaua

SEQ ID NO: 1120162 - RNA, 19 nt, Homo sapiens
acugauagcuuauagugau

SEQ ID NO: 1120163 - RNA, 19 nt, Homo sapiens
uaaaguccgucauuugcau

SEQ ID NO: 1120164 - RNA, 19 nt, Homo sapiens
uagacacgguucacuaaau

SEQ ID NO: 1120165 - RNA, 19 nt, Homo sapiens
ccacggaguucgaaaccau

SEQ ID NO: 1120166 - RNA, 19 nt, Homo sapiens
cguacucccucaugaaguu

SEQ ID NO: 1120167 - RNA, 19 nt, Homo sapiens
ggacagucagucaggauga

SEQ ID NO: 1120168 - RNA, 19 nt, Homo sapiens
gagaggagaaugaauaagg

SEQ ID NO: 1120169 - RNA, 19 nt, Homo sapiens
cagaggaggugacagacau

SEQ ID NO: 1120170 - RNA, 19 nt, Homo sapiens
guacaugggcgcacuugug

SEQ ID NO: 1120171 - RNA, 19 nt, Homo sapiens
guucugcuauccuuaguca

SEQ ID NO: 1120172 - RNA, 19 nt, Homo sapiens
gaggaacggagaccuguga

SEQ ID NO: 1120173 - RNA, 19 nt, Homo sapiens
caggagaauuugcuugauc

SEQ ID NO: 1120174 - RNA, 19 nt, Homo sapiens
gcgaaacccugucucuacu

SEQ ID NO: 1120175 - RNA, 19 nt, Homo sapiens
gaacauuguaccuuauugg

SEQ ID NO: 1120176 - RNA, 19 nt, Homo sapiens
uaccugcaguugaaacgua

SEQ ID NO: 1120177 - RNA, 19 nt, Homo sapiens
uauagacacgguucacuaa

SEQ ID NO: 1120178 - RNA, 19 nt, Homo sapiens
ucaucgcucuuaagaauca

SEQ ID NO: 1120179 - RNA, 19 nt, Homo sapiens
uaaaugggucacuggagua

SEQ ID NO: 1120180 - RNA, 19 nt, Homo sapiens
guauauacaugagcuaacu

SEQ ID NO: 1120181 - RNA, 19 nt, Homo sapiens
ugagcaagcugucaguucu

SEQ ID NO: 1120182 - RNA, 19 nt, Homo sapiens
uagaaagguuugguuugaa

SEQ ID NO: 1120183 - RNA, 19 nt, Homo sapiens
uuaaagguuucgugucaau

SEQ ID NO: 1120184 - RNA, 19 nt, Homo sapiens
cagcccacaucaagaaguu

SEQ ID NO: 1120185 - RNA, 19 nt, Homo sapiens
acaagaacauucacgacau

SEQ ID NO: 1120186 - RNA, 19 nt, Homo sapiens
ggugggaugugccucaauc

SEQ ID NO: 1120187 - RNA, 19 nt, Homo sapiens
gcaggagaauuugcuugau

SEQ ID NO: 1120188 - RNA, 19 nt, Homo sapiens
gaucauauuguuccucaca

SEQ ID NO: 1120189 - RNA, 19 nt, Homo sapiens
aaauaacgcauucgaaauc

SEQ ID NO: 1120190 - RNA, 19 nt, Homo sapiens
acagguaauugagaaugua

SEQ ID NO: 1120191 - RNA, 19 nt, Homo sapiens
gaugcaacaauaagaaaga

SEQ ID NO: 1120192 - RNA, 19 nt, Homo sapiens
guaggcaucuguuuaauua

SEQ ID NO: 1120193 - RNA, 19 nt, Homo sapiens
gcaacaaacuauugaauga

SEQ ID NO: 1120194 - RNA, 19 nt, Homo sapiens
gaagagaggacauauuuaa

SEQ ID NO: 1120195 - RNA, 19 nt, Homo sapiens
gagcaaggauuucaauuga

SEQ ID NO: 1120196 - RNA, 19 nt, Homo sapiens
gcacaacuauuuacauuuc

SEQ ID NO: 1120197 - RNA, 19 nt, Homo sapiens
gaugaucagucaacacaua

SEQ ID NO: 1120198 - RNA, 19 nt, Homo sapiens
gcuuauaucuuaggucuua

SEQ ID NO: 1120199 - RNA, 19 nt, Homo sapiens
ccacggagcucauauuuua

SEQ ID NO: 1120200 - RNA, 19 nt, Homo sapiens
gaagguaggcaucuguuua

SEQ ID NO: 1120201 - RNA, 19 nt, Homo sapiens
gcaaacaaagcauaaagua

SEQ ID NO: 1120202 - RNA, 19 nt, Homo sapiens
caucagcguuauuauguua

SEQ ID NO: 1120203 - RNA, 19 nt, Homo sapiens
ccagauaccaggugauuua

SEQ ID NO: 1120204 - RNA, 19 nt, Homo sapiens
caaauuccgucuccaaguu

SEQ ID NO: 1120205 - RNA, 19 nt, Homo sapiens
caaggaugcuucugaguga

SEQ ID NO: 1120206 - RNA, 19 nt, Homo sapiens
cagaagagaggacauauuu

SEQ ID NO: 1120207 - RNA, 19 nt, Homo sapiens
gauaccaggugauuuaugu

SEQ ID NO: 1120208 - RNA, 19 nt, Homo sapiens
gaaggacugcagaacauua

SEQ ID NO: 1120209 - RNA, 19 nt, Homo sapiens
guacaaucccuaugaguuu

SEQ ID NO: 1120210 - RNA, 19 nt, Homo sapiens
gaaguagggugaccucucu

SEQ ID NO: 1120211 - RNA, 19 nt, Homo sapiens
cauguaugcuucgaaguua

SEQ ID NO: 1120212 - RNA, 19 nt, Homo sapiens
gaaguaaaucugucuugaa

SEQ ID NO: 1120213 - RNA, 19 nt, Homo sapiens
ggaaauccucacuguuuaa

SEQ ID NO: 1120214 - RNA, 19 nt, Homo sapiens
uagagacgcugacaaagga

SEQ ID NO: 1120215 - RNA, 19 nt, Homo sapiens
ccuaugaguuugccuuaaa

SEQ ID NO: 1120216 - RNA, 19 nt, Homo sapiens
gugaggagccuaagucauu

SEQ ID NO: 1120217 - RNA, 19 nt, Homo sapiens
ucuaagaguucuaaaggaa

SEQ ID NO: 1120218 - RNA, 19 nt, Homo sapiens
acaaacaucagcguuauua

SEQ ID NO: 1120219 - RNA, 19 nt, Homo sapiens
gcaaggauuucaauugacu

SEQ ID NO: 1120220 - RNA, 19 nt, Homo sapiens
uaucuuaggucuuaucaca

SEQ ID NO: 1120221 - RNA, 19 nt, Homo sapiens
ggacugcagaacauuauuu

SEQ ID NO: 1120222 - RNA, 19 nt, Homo sapiens
gcuacaaacaucagcguua

SEQ ID NO: 1120223 - RNA, 19 nt, Homo sapiens
gccuuaaaguucaaaguuu

SEQ ID NO: 1120224 - RNA, 19 nt, Homo sapiens
ugaggagccuaagucauua

SEQ ID NO: 1120225 - RNA, 19 nt, Homo sapiens
ugaaguaaaucugucuuga

SEQ ID NO: 1120226 - RNA, 19 nt, Homo sapiens
ggaaggcuuugggaagaaa

SEQ ID NO: 1120227 - RNA, 19 nt, Homo sapiens
caguaaagccucaguguug

SEQ ID NO: 1120228 - RNA, 19 nt, Homo sapiens
ggccauacuuagaacauga

SEQ ID NO: 1120229 - RNA, 19 nt, Homo sapiens
cauaguaacugaucuuuug

SEQ ID NO: 1120230 - RNA, 19 nt, Homo sapiens
auaaguauguugucguuga

SEQ ID NO: 1120231 - RNA, 19 nt, Homo sapiens
gaguuugccuuaaaguuca

SEQ ID NO: 1120232 - RNA, 19 nt, Homo sapiens
cuacaaacaucagcguuau

SEQ ID NO: 1120233 - RNA, 19 nt, Homo sapiens
gauuucaauugacuucuga

SEQ ID NO: 1120234 - RNA, 19 nt, Homo sapiens
ccagacaccaagaaucaua

SEQ ID NO: 1120235 - RNA, 19 nt, Homo sapiens
uuaaacggaucaugucugu

SEQ ID NO: 1120236 - RNA, 19 nt, Homo sapiens
aaacuucuaugucuagucu

SEQ ID NO: 1120237 - RNA, 19 nt, Homo sapiens
aaacaucagcguuauuaug

SEQ ID NO: 1120238 - RNA, 19 nt, Homo sapiens
agugacaccuaggaaauua

SEQ ID NO: 1120239 - RNA, 19 nt, Homo sapiens
uguauugagucucuugaaa

SEQ ID NO: 1120240 - RNA, 19 nt, Homo sapiens
ccuagggucucacagaaga

SEQ ID NO: 1120241 - RNA, 19 nt, Homo sapiens
aauuauaccuugcccucua

SEQ ID NO: 1120242 - RNA, 19 nt, Homo sapiens
gaauguggacugccuuuua

SEQ ID NO: 1120243 - RNA, 19 nt, Homo sapiens
gcaguaaagccucaguguu

SEQ ID NO: 1120244 - RNA, 19 nt, Homo sapiens
ugucuagucuuccauagga

SEQ ID NO: 1120245 - RNA, 19 nt, Homo sapiens
gaacaugagcaaggauuuc

SEQ ID NO: 1120246 - RNA, 19 nt, Homo sapiens
gagccuaagucauuaaacg

SEQ ID NO: 1120247 - RNA, 19 nt, Homo sapiens
cuuaugcacugcuacugua

SEQ ID NO: 1120248 - RNA, 19 nt, Homo sapiens
ccugaaagcacaauguauu

SEQ ID NO: 1120249 - RNA, 19 nt, Homo sapiens
ggaagguaggcaucuguuu

SEQ ID NO: 1120250 - RNA, 19 nt, Homo sapiens
ucacagaagagaggacaua

SEQ ID NO: 1120251 - RNA, 19 nt, Homo sapiens
cuauuucacuccauuaaca

SEQ ID NO: 1120252 - RNA, 19 nt, Homo sapiens
ggauuucaauugacuucug

SEQ ID NO: 1120253 - RNA, 19 nt, Homo sapiens
aguggcugcuuauaucuua

SEQ ID NO: 1120254 - RNA, 19 nt, Homo sapiens
gcagucguuucaaccagaa

SEQ ID NO: 1120255 - RNA, 19 nt, Homo sapiens
ucugaucucuaacacauau

SEQ ID NO: 1120256 - RNA, 19 nt, Homo sapiens
caucucaaguccugugugu

SEQ ID NO: 1120257 - RNA, 19 nt, Homo sapiens
gguaggcaucuguuuaauu

SEQ ID NO: 1120258 - RNA, 19 nt, Homo sapiens
gauguucgauccugucacu

SEQ ID NO: 1120259 - RNA, 19 nt, Homo sapiens
gagggcaaacaaagcauaa

SEQ ID NO: 1120260 - RNA, 19 nt, Homo sapiens
ugagcaaggauuucaauug

SEQ ID NO: 1120261 - RNA, 19 nt, Homo sapiens
acauguguguguguaauaa

SEQ ID NO: 1120262 - RNA, 19 nt, Homo sapiens
aacagucucugcuucuaaa

SEQ ID NO: 1120263 - RNA, 19 nt, Homo sapiens
gcaucuguuuaauuaguug

SEQ ID NO: 1120264 - RNA, 19 nt, Homo sapiens
gacauuuauucccuagcua

SEQ ID NO: 1120265 - RNA, 19 nt, Homo sapiens
aaggaaggcuuugggaaga

SEQ ID NO: 1120266 - RNA, 19 nt, Homo sapiens
aaacagucucugcuucuaa

SEQ ID NO: 1120267 - RNA, 19 nt, Homo sapiens
ugauuuauguggagaugau

SEQ ID NO: 1120268 - RNA, 19 nt, Homo sapiens
acaauggccauacuuagaa

SEQ ID NO: 1120269 - RNA, 19 nt, Homo sapiens
cagaguuaguggaaggaaa

SEQ ID NO: 1120270 - RNA, 19 nt, Homo sapiens
ggucuaagaguucuaaagg

SEQ ID NO: 1120271 - RNA, 19 nt, Homo sapiens
agaagagaggacauauuua

SEQ ID NO: 1120272 - RNA, 19 nt, Homo sapiens
guacuaagggaucaugcuu

SEQ ID NO: 1120273 - RNA, 19 nt, Homo sapiens
cuauaccuguuguguaaga

SEQ ID NO: 1120274 - RNA, 19 nt, Homo sapiens
aucuauaccuguuguguaa

SEQ ID NO: 1120275 - RNA, 19 nt, Homo sapiens
cacaauggccauacuuaga

SEQ ID NO: 1120276 - RNA, 19 nt, Homo sapiens
aaacggaucaugucuguac

SEQ ID NO: 1120277 - RNA, 19 nt, Homo sapiens
gaacuuaugcacugcuacu

SEQ ID NO: 1120278 - RNA, 19 nt, Homo sapiens
ucuaacacauaugcaguuu

SEQ ID NO: 1120279 - RNA, 19 nt, Homo sapiens
cuucugaucucuaacacau

SEQ ID NO: 1120280 - RNA, 19 nt, Homo sapiens
ugguuaaugcuuuguguua

SEQ ID NO: 1120281 - RNA, 19 nt, Homo sapiens
uuuauucccuagcuacaaa

SEQ ID NO: 1120282 - RNA, 19 nt, Homo sapiens
gccuagagacgcugacaaa

SEQ ID NO: 1120283 - RNA, 19 nt, Homo sapiens
ccauuaacaugcaacaaac

SEQ ID NO: 1120284 - RNA, 19 nt, Homo sapiens
ucuuaggucuuaucacaau

SEQ ID NO: 1120285 - RNA, 19 nt, Homo sapiens
ugaguuugccuuaaaguuc

SEQ ID NO: 1120286 - RNA, 19 nt, Homo sapiens
ggcaucuguuuaauuaguu

SEQ ID NO: 1120287 - RNA, 19 nt, Homo sapiens
aagguaggcaucuguuuaa

SEQ ID NO: 1120288 - RNA, 19 nt, Homo sapiens
uagggugaccucucucuuu

SEQ ID NO: 1120289 - RNA, 19 nt, Homo sapiens
guccagacaccaagaauca

SEQ ID NO: 1120290 - RNA, 19 nt, Homo sapiens
gagugacaccuaggaaauu

SEQ ID NO: 1120291 - RNA, 19 nt, Homo sapiens
uguggaggcuauucuuguu

SEQ ID NO: 1120292 - RNA, 19 nt, Homo sapiens
gagaagagcuggauuauau

SEQ ID NO: 1120293 - RNA, 19 nt, Homo sapiens
gaaguuugcucuaaaggaa

SEQ ID NO: 1120294 - RNA, 19 nt, Homo sapiens
gaaugaagcaucuuaguuu

SEQ ID NO: 1120295 - RNA, 19 nt, Homo sapiens
ggaagaagauaucaguaga

SEQ ID NO: 1120296 - RNA, 19 nt, Homo sapiens
caacaucucugaccugugu

SEQ ID NO: 1120297 - RNA, 19 nt, Homo sapiens
ggauagaucuucugcaaca

SEQ ID NO: 1120298 - RNA, 19 nt, Homo sapiens
ggaggaaguuugcucuaaa

SEQ ID NO: 1120299 - RNA, 19 nt, Homo sapiens
ggaaggacuuggagagaga

SEQ ID NO: 1120300 - RNA, 19 nt, Homo sapiens
gauuugaccugagacauuu

SEQ ID NO: 1120301 - RNA, 19 nt, Homo sapiens
ggaagacccugcugugcuu

SEQ ID NO: 1120302 - RNA, 19 nt, Homo sapiens
ggaccaaccuacccuugaa

SEQ ID NO: 1120303 - RNA, 19 nt, Homo sapiens
gaucugaaccggaguuuau

SEQ ID NO: 1120304 - RNA, 19 nt, Homo sapiens
aaaugucucuucucccuua

SEQ ID NO: 1120305 - RNA, 19 nt, Homo sapiens
aaagagaagagcuggauua

SEQ ID NO: 1120306 - RNA, 19 nt, Homo sapiens
gaaccggaguuuauugaag

SEQ ID NO: 1120307 - RNA, 19 nt, Homo sapiens
gaaggacuuucaccgaaug

SEQ ID NO: 1120308 - RNA, 19 nt, Homo sapiens
gaagagcuggauuauauau

SEQ ID NO: 1120309 - RNA, 19 nt, Homo sapiens
gggccaagguuuguaugua

SEQ ID NO: 1120310 - RNA, 19 nt, Homo sapiens
gaagaagauaucaguagaa

SEQ ID NO: 1120311 - RNA, 19 nt, Homo sapiens
gcagccagauugcaaagau

SEQ ID NO: 1120312 - RNA, 19 nt, Homo sapiens
caacuuccuuugucauuag

SEQ ID NO: 1120313 - RNA, 19 nt, Homo sapiens
ccagauggccugauaugaa

SEQ ID NO: 1120314 - RNA, 19 nt, Homo sapiens
ucauaaaccuacaccaaug

SEQ ID NO: 1120315 - RNA, 19 nt, Homo sapiens
agacauuuguuucagguaa

SEQ ID NO: 1120316 - RNA, 19 nt, Homo sapiens
gaagcacuaccugacauua

SEQ ID NO: 1120317 - RNA, 19 nt, Homo sapiens
gaccucaggcuucuaguuu

SEQ ID NO: 1120318 - RNA, 19 nt, Homo sapiens
gcaaucacccuccucacuu

SEQ ID NO: 1120319 - RNA, 19 nt, Homo sapiens
ugacugacuucacugcauu

SEQ ID NO: 1120320 - RNA, 19 nt, Homo sapiens
ccucagcucugcaaacuca

SEQ ID NO: 1120321 - RNA, 19 nt, Homo sapiens
ggcuaugaauguuuguaua

SEQ ID NO: 1120322 - RNA, 19 nt, Homo sapiens
gagcuuggacugaaagaga

SEQ ID NO: 1120323 - RNA, 19 nt, Homo sapiens
aaggauagaucuucugcaa

SEQ ID NO: 1120324 - RNA, 19 nt, Homo sapiens
ggagcugguucaaauguca

SEQ ID NO: 1120325 - RNA, 19 nt, Homo sapiens
cuaaaugacugacuucacu

SEQ ID NO: 1120326 - RNA, 19 nt, Homo sapiens
gcuagagcuuggacugaaa

SEQ ID NO: 1120327 - RNA, 19 nt, Homo sapiens
gaggaaguuugcucuaaag

SEQ ID NO: 1120328 - RNA, 19 nt, Homo sapiens
gagcuggauuauauauuuc

SEQ ID NO: 1120329 - RNA, 19 nt, Homo sapiens
gguccuaaaugacugacuu

SEQ ID NO: 1120330 - RNA, 19 nt, Homo sapiens
ccaggaaguucaaaugucu

SEQ ID NO: 1120331 - RNA, 19 nt, Homo sapiens
ggaauggaagccacuguga

SEQ ID NO: 1120332 - RNA, 19 nt, Homo sapiens
gcccuugacugcuccuuug

SEQ ID NO: 1120333 - RNA, 19 nt, Homo sapiens
gguaagagagaaguuguuu

SEQ ID NO: 1120334 - RNA, 19 nt, Homo sapiens
gcuaaggcuugugauuuga

SEQ ID NO: 1120335 - RNA, 19 nt, Homo sapiens
cagauggccugauaugaag

SEQ ID NO: 1120336 - RNA, 19 nt, Homo sapiens
uggaauaccuucaauagcu

SEQ ID NO: 1120337 - RNA, 19 nt, Homo sapiens
gaagauaucaguagaaaag

SEQ ID NO: 1120338 - RNA, 19 nt, Homo sapiens
gaaugaaacagagucaaga

SEQ ID NO: 1120339 - RNA, 19 nt, Homo sapiens
ugcaggagcugguucaaau

SEQ ID NO: 1120340 - RNA, 19 nt, Homo sapiens
cagccagauugcaaagaua

SEQ ID NO: 1120341 - RNA, 19 nt, Homo sapiens
ucaaaugucaggaauggaa

SEQ ID NO: 1120342 - RNA, 19 nt, Homo sapiens
ugacuucacugcauuagac

SEQ ID NO: 1120343 - RNA, 19 nt, Homo sapiens
guucaaaugucaggaaugg

SEQ ID NO: 1120344 - RNA, 19 nt, Homo sapiens
aaacccagcccucugauug

SEQ ID NO: 1120345 - RNA, 19 nt, Homo sapiens
ucaggucccuuucucuaug

SEQ ID NO: 1120346 - RNA, 19 nt, Homo sapiens
gaaagagaagagcuggauu

SEQ ID NO: 1120347 - RNA, 19 nt, Homo sapiens
caaucacccuccucacuuc

SEQ ID NO: 1120348 - RNA, 19 nt, Homo sapiens
ggaaguuugcucuaaagga

SEQ ID NO: 1120349 - RNA, 19 nt, Homo sapiens
gcuuaucacugagguccua

SEQ ID NO: 1120350 - RNA, 19 nt, Homo sapiens
ucacuuccuugucuagaug

SEQ ID NO: 1120351 - RNA, 19 nt, Homo sapiens
cugcugugcuuaucacuga

SEQ ID NO: 1120352 - RNA, 19 nt, Homo sapiens
gaaacccagcccucugauu

SEQ ID NO: 1120353 - RNA, 19 nt, Homo sapiens
cagcagcuuugcagacaug

SEQ ID NO: 1120354 - RNA, 19 nt, Homo sapiens
cgaaguguaguaagaagaa

SEQ ID NO: 1120355 - RNA, 19 nt, Homo sapiens
ggccaagguuuguauguac

SEQ ID NO: 1120356 - RNA, 19 nt, Homo sapiens
gaggaugacugcgucucuu

SEQ ID NO: 1120357 - RNA, 19 nt, Homo sapiens
gcagcgcaaugccucuguu

SEQ ID NO: 1120358 - RNA, 19 nt, Homo sapiens
gaaguguaguaagaagaau

SEQ ID NO: 1120359 - RNA, 19 nt, Homo sapiens
agaaugaagcaucuuaguu

SEQ ID NO: 1120360 - RNA, 19 nt, Homo sapiens
gaccuguguuugagagaug

SEQ ID NO: 1120361 - RNA, 19 nt, Homo sapiens
agcacuaccugacauuaaa

SEQ ID NO: 1120362 - RNA, 19 nt, Homo sapiens
aggaggaaguuugcucuaa

SEQ ID NO: 1120363 - RNA, 19 nt, Homo sapiens
uugcagacaugauggguau

SEQ ID NO: 1120364 - RNA, 19 nt, Homo sapiens
gcccuaagccgcacuacug

SEQ ID NO: 1120365 - RNA, 19 nt, Homo sapiens
gcugacaucgccuggauug

SEQ ID NO: 1120366 - RNA, 19 nt, Homo sapiens
cccuauagcuggucucaca

SEQ ID NO: 1120367 - RNA, 19 nt, Homo sapiens
gacauuuguuucagguaau

SEQ ID NO: 1120368 - RNA, 19 nt, Homo sapiens
gaccugagacauuuguuuc

SEQ ID NO: 1120369 - RNA, 19 nt, Homo sapiens
agauguuucugccucuuaa

SEQ ID NO: 1120370 - RNA, 19 nt, Homo sapiens
ucauuccacucuacaacuu

SEQ ID NO: 1120371 - RNA, 19 nt, Homo sapiens
uuucuuaucuccaggaagu

SEQ ID NO: 1120372 - RNA, 19 nt, Homo sapiens
ggaugaagaggagacauau

SEQ ID NO: 1120373 - RNA, 19 nt, Homo sapiens
cggaugaagaggagacaua

SEQ ID NO: 1120374 - RNA, 19 nt, Homo sapiens
ggaaggggcuaugaauguu

SEQ ID NO: 1120375 - RNA, 19 nt, Homo sapiens
uguagaaugaagcaucuua

SEQ ID NO: 1120376 - RNA, 19 nt, Homo sapiens
guaaucguguagaaugaag

SEQ ID NO: 1120377 - RNA, 19 nt, Homo sapiens
gaagcaucuuaguuuaaag

SEQ ID NO: 1120378 - RNA, 19 nt, Homo sapiens
cagguaaucguguagaaug

SEQ ID NO: 1120379 - RNA, 19 nt, Homo sapiens
ugauuugaccugagacauu

SEQ ID NO: 1120380 - RNA, 19 nt, Homo sapiens
gcucuaaaggaagaagaua

SEQ ID NO: 1120381 - RNA, 19 nt, Homo sapiens
caugauggguauccugaag

SEQ ID NO: 1120382 - RNA, 19 nt, Homo sapiens
gccagcagcuuugcagaca

SEQ ID NO: 1120383 - RNA, 19 nt, Homo sapiens
gauaguggcagcugaugca

SEQ ID NO: 1120384 - RNA, 19 nt, Homo sapiens
cuacaccaaugcccagcaa

SEQ ID NO: 1120385 - RNA, 19 nt, Homo sapiens
cgucauaaaccuacaccaa

SEQ ID NO: 1120386 - RNA, 19 nt, Homo sapiens
agcuaaggcuugugauuug

SEQ ID NO: 1120387 - RNA, 19 nt, Homo sapiens
gaagacccugcugugcuua

SEQ ID NO: 1120388 - RNA, 19 nt, Homo sapiens
uugcaaaccagaacacaaa

SEQ ID NO: 1120389 - RNA, 19 nt, Homo sapiens
gacauuaaaggaaggacuu

SEQ ID NO: 1120390 - RNA, 19 nt, Homo sapiens
aaaggaagaagauaucagu

SEQ ID NO: 1120391 - RNA, 19 nt, Homo sapiens
ugaaacagagucaagaucu

SEQ ID NO: 1120392 - RNA, 19 nt, Homo sapiens
gaucauuucugcaacuuug

SEQ ID NO: 1120393 - RNA, 19 nt, Homo sapiens
gggaggagcuggaggauca

SEQ ID NO: 1120394 - RNA, 19 nt, Homo sapiens
ggauggaccugaaaggaau

SEQ ID NO: 1120395 - RNA, 19 nt, Homo sapiens
gacacaggcugcaccauga

SEQ ID NO: 1120396 - RNA, 19 nt, Homo sapiens
caacaaagugucaaugaug

SEQ ID NO: 1120397 - RNA, 19 nt, Homo sapiens
cuugauaccugggcauuua

SEQ ID NO: 1120398 - RNA, 19 nt, Homo sapiens
caacucagaugugguggaa

SEQ ID NO: 1120399 - RNA, 19 nt, Homo sapiens
ccucggcacuccaggcuua

SEQ ID NO: 1120400 - RNA, 19 nt, Homo sapiens
gcaccaacuucacauucaa

SEQ ID NO: 1120401 - RNA, 19 nt, Homo sapiens
agugugaucugcagguuua

SEQ ID NO: 1120402 - RNA, 19 nt, Homo sapiens
ggacuacggcugugacaug

SEQ ID NO: 1120403 - RNA, 19 nt, Homo sapiens
ggacagggucuccaucaug

SEQ ID NO: 1120404 - RNA, 19 nt, Homo sapiens
ugucaccucugcucuauga

SEQ ID NO: 1120405 - RNA, 19 nt, Homo sapiens
ccugggaccuggauacuug

SEQ ID NO: 1120406 - RNA, 19 nt, Homo sapiens
ggacuucugccuggagaua

SEQ ID NO: 1120407 - RNA, 19 nt, Homo sapiens
ccaacaaagugucaaugau

SEQ ID NO: 1120408 - RNA, 19 nt, Homo sapiens
caaauacucacggcucuaa

SEQ ID NO: 1120409 - RNA, 19 nt, Homo sapiens
ggaccuggauacuugauac

SEQ ID NO: 1120410 - RNA, 19 nt, Homo sapiens
gcacuccaggcuuauaauu

SEQ ID NO: 1120411 - RNA, 19 nt, Homo sapiens
caaaguggucguaccugua

SEQ ID NO: 1120412 - RNA, 19 nt, Homo sapiens
ucacaggaguggacugcaa

SEQ ID NO: 1120413 - RNA, 19 nt, Homo sapiens
gcaagugcacuguguguca

SEQ ID NO: 1120414 - RNA, 19 nt, Homo sapiens
acaagaggcagccaaacua

SEQ ID NO: 1120415 - RNA, 19 nt, Homo sapiens
ggagauauugcccuacuca

SEQ ID NO: 1120416 - RNA, 19 nt, Homo sapiens
ggcaccaacuucacauuca

SEQ ID NO: 1120417 - RNA, 19 nt, Homo sapiens
gaaggucacucaggaacac

SEQ ID NO: 1120418 - RNA, 19 nt, Homo sapiens
aggaucagcugcccaacuu

SEQ ID NO: 1120419 - RNA, 19 nt, Homo sapiens
acuccaggcuuauaauuuc

SEQ ID NO: 1120420 - RNA, 19 nt, Homo sapiens
caagaggcagccaaacuau

SEQ ID NO: 1120421 - RNA, 19 nt, Homo sapiens
ggccaagacuccugagaac

SEQ ID NO: 1120422 - RNA, 19 nt, Homo sapiens
gcgccuuguuuccuucaaa

SEQ ID NO: 1120423 - RNA, 19 nt, Homo sapiens
gcuguugggcaucaucuuu

SEQ ID NO: 1120424 - RNA, 19 nt, Homo sapiens
cgguugcgcucgucuaugu

SEQ ID NO: 1120425 - RNA, 19 nt, Homo sapiens
ccaucuacuuccacuguga

SEQ ID NO: 1120426 - RNA, 19 nt, Homo sapiens
cuucggagacccacacuuu

SEQ ID NO: 1120427 - RNA, 19 nt, Homo sapiens
ggacugcaaaguggucgua

SEQ ID NO: 1120428 - RNA, 19 nt, Homo sapiens
gcaccugagcgaugacuuc

SEQ ID NO: 1120429 - RNA, 19 nt, Homo sapiens
caacuggaccgugcacaau

SEQ ID NO: 1120430 - RNA, 19 nt, Homo sapiens
guccucagcuucuauuacu

SEQ ID NO: 1120431 - RNA, 19 nt, Homo sapiens
gcaccugcugcuuggauuu

SEQ ID NO: 1120432 - RNA, 19 nt, Homo sapiens
gggauucuaauaccuaugu

SEQ ID NO: 1120433 - RNA, 19 nt, Homo sapiens
cguccucccugcucaccua

SEQ ID NO: 1120434 - RNA, 19 nt, Homo sapiens
agacaggaaugcccuacuc

SEQ ID NO: 1120435 - RNA, 19 nt, Homo sapiens
ggaccugaaaggaauguuc

SEQ ID NO: 1120436 - RNA, 19 nt, Homo sapiens
gaagucaggcuggccaaca

SEQ ID NO: 1120437 - RNA, 19 nt, Homo sapiens
acucagaugugguggaagu

SEQ ID NO: 1120438 - RNA, 19 nt, Homo sapiens
caauagcucacucccuaga

SEQ ID NO: 1120439 - RNA, 19 nt, Homo sapiens
ggagggcaacucagaugug

SEQ ID NO: 1120440 - RNA, 19 nt, Homo sapiens
gaccaucaccaucgaacug

SEQ ID NO: 1120441 - RNA, 19 nt, Homo sapiens
ccacagcagaugcccaaga

SEQ ID NO: 1120442 - RNA, 19 nt, Homo sapiens
gggacgaucauuucugcaa

SEQ ID NO: 1120443 - RNA, 19 nt, Homo sapiens
ggaaggucacucaggaaca

SEQ ID NO: 1120444 - RNA, 19 nt, Homo sapiens
cacagcagaugcccaagag

SEQ ID NO: 1120445 - RNA, 19 nt, Homo sapiens
agaggcagccaaacuaugu

SEQ ID NO: 1120446 - RNA, 19 nt, Homo sapiens
gagcuggauggaccugaaa

SEQ ID NO: 1120447 - RNA, 19 nt, Homo sapiens
cccacuggcucuacgaugu

SEQ ID NO: 1120448 - RNA, 19 nt, Homo sapiens
ugucaaugauggagaagag

SEQ ID NO: 1120449 - RNA, 19 nt, Homo sapiens
ccaagacuccugagaacag

SEQ ID NO: 1120450 - RNA, 19 nt, Homo sapiens
ccagugugaucugcagguu

SEQ ID NO: 1120451 - RNA, 19 nt, Homo sapiens
gggacagggucuccaucau

SEQ ID NO: 1120452 - RNA, 19 nt, Homo sapiens
gauguccucagcuucuauu

SEQ ID NO: 1120453 - RNA, 19 nt, Homo sapiens
gagacgcguuggcaauacu

SEQ ID NO: 1120454 - RNA, 19 nt, Homo sapiens
gcuuauaauuucgaacucu

SEQ ID NO: 1120455 - RNA, 19 nt, Homo sapiens
gaagagcgaguuggugaac

SEQ ID NO: 1120456 - RNA, 19 nt, Homo sapiens
gagccucagauuccaauag

SEQ ID NO: 1120457 - RNA, 19 nt, Homo sapiens
cuacucaggauccaugaug

SEQ ID NO: 1120458 - RNA, 19 nt, Homo sapiens
gacgaucauuucugcaacu

SEQ ID NO: 1120459 - RNA, 19 nt, Homo sapiens
ccuggcaccugagcgauga

SEQ ID NO: 1120460 - RNA, 19 nt, Homo sapiens
agagcgaguuggugaacga

SEQ ID NO: 1120461 - RNA, 19 nt, Homo sapiens
cccaacaaagugucaauga

SEQ ID NO: 1120462 - RNA, 19 nt, Homo sapiens
aauacucacggcucuaauu

SEQ ID NO: 1120463 - RNA, 19 nt, Homo sapiens
ucgggacacucaacaacga

SEQ ID NO: 1120464 - RNA, 19 nt, Homo sapiens
ggcaccugcugcuuggauu

SEQ ID NO: 1120465 - RNA, 19 nt, Homo sapiens
agagcuggauggaccugaa

SEQ ID NO: 1120466 - RNA, 19 nt, Homo sapiens
cggcacuccaggcuuauaa

SEQ ID NO: 1120467 - RNA, 19 nt, Homo sapiens
aaaaggagggcaacaggua

SEQ ID NO: 1120468 - RNA, 19 nt, Homo sapiens
ccaacuggaccgugcacaa

SEQ ID NO: 1120469 - RNA, 19 nt, Homo sapiens
uggauggaccugaaaggaa

SEQ ID NO: 1120470 - RNA, 19 nt, Homo sapiens
cgacggcaccaacuucaca

SEQ ID NO: 1120471 - RNA, 19 nt, Homo sapiens
ucuacgauguccucagcuu

SEQ ID NO: 1120472 - RNA, 19 nt, Homo sapiens
caggaaugcccuacucaca

SEQ ID NO: 1120473 - RNA, 19 nt, Homo sapiens
ccaggcuuauaauuucgaa

SEQ ID NO: 1120474 - RNA, 19 nt, Homo sapiens
cacuccaggcuuauaauuu

SEQ ID NO: 1120475 - RNA, 19 nt, Homo sapiens
gggcaagugcacugugugu

SEQ ID NO: 1120476 - RNA, 19 nt, Homo sapiens
ugugucaccucugcucuau

SEQ ID NO: 1120477 - RNA, 19 nt, Homo sapiens
ccaaugacugccgcaacua

SEQ ID NO: 1120478 - RNA, 19 nt, Homo sapiens
ccacgcagaccaucaccau

SEQ ID NO: 1120479 - RNA, 19 nt, Homo sapiens
caccaucuacuuccacugu

SEQ ID NO: 1120480 - RNA, 19 nt, Homo sapiens
caggagggcaacucagaug

SEQ ID NO: 1120481 - RNA, 19 nt, Homo sapiens
aagugucaaugauggagaa

SEQ ID NO: 1120482 - RNA, 19 nt, Homo sapiens
cgagacgcguuggcaauac

SEQ ID NO: 1120483 - RNA, 19 nt, Homo sapiens
ccucccagcuaccagagau

SEQ ID NO: 1120484 - RNA, 19 nt, Homo sapiens
caacuccggcucuuucacu

SEQ ID NO: 1120485 - RNA, 19 nt, Homo sapiens
ucaccucugcucuaugaga

SEQ ID NO: 1120486 - RNA, 19 nt, Homo sapiens
gcggugcuguugggcauca

SEQ ID NO: 1120487 - RNA, 19 nt, Homo sapiens
ucaccuacgauuccugguu

SEQ ID NO: 1120488 - RNA, 19 nt, Homo sapiens
accaggaggugcugagcuu

SEQ ID NO: 1120489 - RNA, 19 nt, Homo sapiens
gucuggaggugcugcugaa

SEQ ID NO: 1120490 - RNA, 19 nt, Homo sapiens
gacaggaaugcccuacuca

SEQ ID NO: 1120491 - RNA, 19 nt, Homo sapiens
gcuacgaggagacaggaau

SEQ ID NO: 1120492 - RNA, 19 nt, Homo sapiens
ggaaagacaugagaugauu

SEQ ID NO: 1120493 - RNA, 19 nt, Homo sapiens
caaaggagguuauaaugga

SEQ ID NO: 1120494 - RNA, 19 nt, Homo sapiens
gacaagacauacuggaaua

SEQ ID NO: 1120495 - RNA, 19 nt, Homo sapiens
agagaaaccuuacaaaugu

SEQ ID NO: 1120496 - RNA, 19 nt, Homo sapiens
ggacuuaaccaauguuuga

SEQ ID NO: 1120497 - RNA, 19 nt, Homo sapiens
gagagaaaccuuacaaaug

SEQ ID NO: 1120498 - RNA, 19 nt, Homo sapiens
gagaagauaugaagaaugc

SEQ ID NO: 1120499 - RNA, 19 nt, Homo sapiens
gcacagcggaauuuauaua

SEQ ID NO: 1120500 - RNA, 19 nt, Homo sapiens
acacaaacccuacaaauau

SEQ ID NO: 1120501 - RNA, 19 nt, Homo sapiens
ccucagaccuuaauaaaca

SEQ ID NO: 1120502 - RNA, 19 nt, Homo sapiens
gcacaaaggagguuauaau

SEQ ID NO: 1120503 - RNA, 19 nt, Homo sapiens
cacaaacccuacaaauaua

SEQ ID NO: 1120504 - RNA, 19 nt, Homo sapiens
gaacacaaacccuacaaau

SEQ ID NO: 1120505 - RNA, 19 nt, Homo sapiens
uuacagaugugaagaaugu

SEQ ID NO: 1120506 - RNA, 19 nt, Homo sapiens
aaacgguccucaacccuua

SEQ ID NO: 1120507 - RNA, 19 nt, Homo sapiens
uaaccaaucugcaaaccuu

SEQ ID NO: 1120508 - RNA, 19 nt, Homo sapiens
agagaaaccuuacagaugu

SEQ ID NO: 1120509 - RNA, 19 nt, Homo sapiens
gagagaaacccuaugaaug

SEQ ID NO: 1120510 - RNA, 19 nt, Homo sapiens
gagagaaaccuuacagaug

SEQ ID NO: 1120511 - RNA, 19 nt, Homo sapiens
ggagagaaaccuuacaaau

SEQ ID NO: 1120512 - RNA, 19 nt, Homo sapiens
augcagacaugacaauuua

SEQ ID NO: 1120513 - RNA, 19 nt, Homo sapiens
ccaaguagcugggauuaca

SEQ ID NO: 1120514 - RNA, 19 nt, Homo sapiens
aaccagcccucgacucuua

SEQ ID NO: 1120515 - RNA, 19 nt, Homo sapiens
cuacaagugugaagaaugu

SEQ ID NO: 1120516 - RNA, 19 nt, Homo sapiens
ggagagaaacccuaugaau

SEQ ID NO: 1120517 - RNA, 19 nt, Homo sapiens
ggagugcaaugacaugauc

SEQ ID NO: 1120518 - RNA, 19 nt, Homo sapiens
gaguuuauauggaacacaa

SEQ ID NO: 1120519 - RNA, 19 nt, Homo sapiens
gaaguucucaacccuuauu

SEQ ID NO: 1120520 - RNA, 19 nt, Homo sapiens
gcaaaccuuacuacacaua

SEQ ID NO: 1120521 - RNA, 19 nt, Homo sapiens
ggagagaaaccuuacagau

SEQ ID NO: 1120522 - RNA, 19 nt, Homo sapiens
agagaaacccuaugaaugu

SEQ ID NO: 1120523 - RNA, 19 nt, Homo sapiens
gaagaaugcagacaugaca

SEQ ID NO: 1120524 - RNA, 19 nt, Homo sapiens
aggaaguucucaacccuua

SEQ ID NO: 1120525 - RNA, 19 nt, Homo sapiens
ccucgacucuuaguaaauu

SEQ ID NO: 1120526 - RNA, 19 nt, Homo sapiens
ugaagaaugugacagaucu

SEQ ID NO: 1120527 - RNA, 19 nt, Homo sapiens
gagaaacccuaugaaugug

SEQ ID NO: 1120528 - RNA, 19 nt, Homo sapiens
auaauggacuuaaccaaug

SEQ ID NO: 1120529 - RNA, 19 nt, Homo sapiens
aaagaaaugugacaaagcu

SEQ ID NO: 1120530 - RNA, 19 nt, Homo sapiens
uuagagauguggccauaga

SEQ ID NO: 1120531 - RNA, 19 nt, Homo sapiens
guuuagagauguggccaua

SEQ ID NO: 1120532 - RNA, 19 nt, Homo sapiens
cugcaaaccuuacuacaca

SEQ ID NO: 1120533 - RNA, 19 nt, Homo sapiens
cuaugaaugugaugaaugu

SEQ ID NO: 1120534 - RNA, 19 nt, Homo sapiens
gagaaaccuuacaaaugug

SEQ ID NO: 1120535 - RNA, 19 nt, Homo sapiens
ccucaacccuuacuacaca

SEQ ID NO: 1120536 - RNA, 19 nt, Homo sapiens
caacuacccagaaagaaau

SEQ ID NO: 1120537 - RNA, 19 nt, Homo sapiens
caaauagggaugcugagaa

SEQ ID NO: 1120538 - RNA, 19 nt, Homo sapiens
ucucaacccuuauuacaca

SEQ ID NO: 1120539 - RNA, 19 nt, Homo sapiens
gagauguggccauagaauu

SEQ ID NO: 1120540 - RNA, 19 nt, Homo sapiens
gaaacccuaugaaugugau

SEQ ID NO: 1120541 - RNA, 19 nt, Homo sapiens
ugacaacuacccagaaaga

SEQ ID NO: 1120542 - RNA, 19 nt, Homo sapiens
gcugagaagauaugaagaa

SEQ ID NO: 1120543 - RNA, 19 nt, Homo sapiens
aacacaaacccuacaaaua

SEQ ID NO: 1120544 - RNA, 19 nt, Homo sapiens
cugcacagcggaauuuaua

SEQ ID NO: 1120545 - RNA, 19 nt, Homo sapiens
uauaauauguggcaaagcu

SEQ ID NO: 1120546 - RNA, 19 nt, Homo sapiens
gaaugugacagaucuuuua

SEQ ID NO: 1120547 - RNA, 19 nt, Homo sapiens
cgaaaacccuacauaguga

SEQ ID NO: 1120548 - RNA, 19 nt, Homo sapiens
gagaaaccuuacagaugug

SEQ ID NO: 1120549 - RNA, 19 nt, Homo sapiens
ggucuuccuugguauuguu

SEQ ID NO: 1120550 - RNA, 19 nt, Homo sapiens
caagacauacuggaauaaa

SEQ ID NO: 1120551 - RNA, 19 nt, Homo sapiens
gaaagacaugagaugauug

SEQ ID NO: 1120552 - RNA, 19 nt, Homo sapiens
ccaaacagaagcccuacaa

SEQ ID NO: 1120553 - RNA, 19 nt, Homo sapiens
uuagagaacuacagaaacu

SEQ ID NO: 1120554 - RNA, 19 nt, Homo sapiens
uaugaagaaugcagacaug

SEQ ID NO: 1120555 - RNA, 19 nt, Homo sapiens
uagggaugcugagaagaua

SEQ ID NO: 1120556 - RNA, 19 nt, Homo sapiens
gcccucgacucuuaguaaa

SEQ ID NO: 1120557 - RNA, 19 nt, Homo sapiens
aaacagaagcccuacaagu

SEQ ID NO: 1120558 - RNA, 19 nt, Homo sapiens
ggaacacaaacccuacaaa

SEQ ID NO: 1120559 - RNA, 19 nt, Homo sapiens
ugaagaauguggcaaagcu

SEQ ID NO: 1120560 - RNA, 19 nt, Homo sapiens
ugaagaauguggcaaagcu

SEQ ID NO: 1120561 - RNA, 19 nt, Homo sapiens
gaccauugcaguuuagaga

SEQ ID NO: 1120562 - RNA, 19 nt, Homo sapiens
aaauagggaugcugagaag

SEQ ID NO: 1120563 - RNA, 19 nt, Homo sapiens
caagaccuuuggccagaga

SEQ ID NO: 1120564 - RNA, 19 nt, Homo sapiens
ggcaaaaccuauaaaccua

SEQ ID NO: 1120565 - RNA, 19 nt, Homo sapiens
gauguuagagaacuacaga

SEQ ID NO: 1120566 - RNA, 19 nt, Homo sapiens
uaauggacuuaaccaaugu

SEQ ID NO: 1120567 - RNA, 19 nt, Homo sapiens
gagcauaaggugcacaaag

SEQ ID NO: 1120568 - RNA, 19 nt, Homo sapiens
gacaugacaauuuacaguu

SEQ ID NO: 1120569 - RNA, 19 nt, Homo sapiens
gaucuccguucacugcaau

SEQ ID NO: 1120570 - RNA, 19 nt, Homo sapiens
caccgaggcuggagugcaa

SEQ ID NO: 1120571 - RNA, 19 nt, Homo sapiens
ccauugcaguuuagagaug

SEQ ID NO: 1120572 - RNA, 19 nt, Homo sapiens
uuaaauguuccuccacuuu

SEQ ID NO: 1120573 - RNA, 19 nt, Homo sapiens
gaacgaaaacccuacauag

SEQ ID NO: 1120574 - RNA, 19 nt, Homo sapiens
gcagacaugacaauuuaca

SEQ ID NO: 1120575 - RNA, 19 nt, Homo sapiens
ccagagaacauacaaaauu

SEQ ID NO: 1120576 - RNA, 19 nt, Homo sapiens
gacaugaucuccguucacu

SEQ ID NO: 1120577 - RNA, 19 nt, Homo sapiens
agaaaugugacaaagcuuu

SEQ ID NO: 1120578 - RNA, 19 nt, Homo sapiens
gcaaagcuuuuaaccaauc

SEQ ID NO: 1120579 - RNA, 19 nt, Homo sapiens
uggcaaagcuuuuaaccaa

SEQ ID NO: 1120580 - RNA, 19 nt, Homo sapiens
gaaugcagacaugacaauu

SEQ ID NO: 1120581 - RNA, 19 nt, Homo sapiens
acaacuacccagaaagaaa

SEQ ID NO: 1120582 - RNA, 19 nt, Homo sapiens
aaccaauguuugacaacua

SEQ ID NO: 1120583 - RNA, 19 nt, Homo sapiens
cacaaaggagguuauaaug

SEQ ID NO: 1120584 - RNA, 19 nt, Homo sapiens
gagguuauaauggacuuaa

SEQ ID NO: 1120585 - RNA, 19 nt, Homo sapiens
gaagaauguggcaaagcuu

SEQ ID NO: 1120586 - RNA, 19 nt, Homo sapiens
caaaccuuacuacacauaa

SEQ ID NO: 1120587 - RNA, 19 nt, Homo sapiens
gaagaauguggcaaagcuu

SEQ ID NO: 1120588 - RNA, 19 nt, Homo sapiens
uaauauguggcaaagcuuu

SEQ ID NO: 1120589 - RNA, 19 nt, Homo sapiens
gcauaaggugcacaaagga

SEQ ID NO: 1120590 - RNA, 19 nt, Homo sapiens
aacagaagcccuacaagug

SEQ ID NO: 1120591 - RNA, 19 nt, Homo sapiens
aaauguuccuccacuuuua

SEQ ID NO: 1120592 - RNA, 19 nt, Homo sapiens
gcaagaagauggagaaaug

SEQ ID NO: 1120593 - RNA, 19 nt, Homo sapiens
agacugagcuggcuucuuu

SEQ ID NO: 1120594 - RNA, 19 nt, Homo sapiens
gaacuacuguggagaaaca

SEQ ID NO: 1120595 - RNA, 19 nt, Homo sapiens
gagagcagauggcagagua

SEQ ID NO: 1120596 - RNA, 19 nt, Homo sapiens
ggacaauacuggugccauu

SEQ ID NO: 1120597 - RNA, 19 nt, Homo sapiens
cagagaaacuccagacuga

SEQ ID NO: 1120598 - RNA, 19 nt, Homo sapiens
gaaagacgauaccaucauc

SEQ ID NO: 1120599 - RNA, 19 nt, Homo sapiens
ggagggacauggaaggaaa

SEQ ID NO: 1120600 - RNA, 19 nt, Homo sapiens
gggagaagauauacagcua

SEQ ID NO: 1120601 - RNA, 19 nt, Homo sapiens
ugacugagaugcagaugga

SEQ ID NO: 1120602 - RNA, 19 nt, Homo sapiens
gcagucgccuccuuccuau

SEQ ID NO: 1120603 - RNA, 19 nt, Homo sapiens
ggaaauguggcacugaaga

SEQ ID NO: 1120604 - RNA, 19 nt, Homo sapiens
caaugaagcagucagaaga

SEQ ID NO: 1120605 - RNA, 19 nt, Homo sapiens
gagaagauauacagcuaac

SEQ ID NO: 1120606 - RNA, 19 nt, Homo sapiens
caagcuugcugcucaaagu

SEQ ID NO: 1120607 - RNA, 19 nt, Homo sapiens
gaguggaggugacugagau

SEQ ID NO: 1120608 - RNA, 19 nt, Homo sapiens
ggagaagauauacagcuaa

SEQ ID NO: 1120609 - RNA, 19 nt, Homo sapiens
gcacugaagauacacaaca

SEQ ID NO: 1120610 - RNA, 19 nt, Homo sapiens
gcagauggcagaguacaga

SEQ ID NO: 1120611 - RNA, 19 nt, Homo sapiens
ggaaagacgauaccaucau

SEQ ID NO: 1120612 - RNA, 19 nt, Homo sapiens
ggagaaaugcagccgaugu

SEQ ID NO: 1120613 - RNA, 19 nt, Homo sapiens
cagagugggagaagauaua

SEQ ID NO: 1120614 - RNA, 19 nt, Homo sapiens
gaaauguggcacugaagau

SEQ ID NO: 1120615 - RNA, 19 nt, Homo sapiens
agaugcagauggaggagua

SEQ ID NO: 1120616 - RNA, 19 nt, Homo sapiens
gaagaugcccuguuaaccu

SEQ ID NO: 1120617 - RNA, 19 nt, Homo sapiens
ccgaugugcucuucagaug

SEQ ID NO: 1120618 - RNA, 19 nt, Homo sapiens
gggaacuacuguggagaaa

SEQ ID NO: 1120619 - RNA, 19 nt, Homo sapiens
gaagauauacagcuaaccu

SEQ ID NO: 1120620 - RNA, 19 nt, Homo sapiens
ugagcuggcuucuuuaaaa

SEQ ID NO: 1120621 - RNA, 19 nt, Homo sapiens
aaacaagcuugcugcucaa

SEQ ID NO: 1120622 - RNA, 19 nt, Homo sapiens
gaaggaaagacgauaccau

SEQ ID NO: 1120623 - RNA, 19 nt, Homo sapiens
gagaaaugcagccgaugug

SEQ ID NO: 1120624 - RNA, 19 nt, Homo sapiens
uagaguggauagagaaugg

SEQ ID NO: 1120625 - RNA, 19 nt, Homo sapiens
guacagaggcuggguagag

SEQ ID NO: 1120626 - RNA, 19 nt, Homo sapiens
ggaccgaucccaccguuac

SEQ ID NO: 1120627 - RNA, 19 nt, Homo sapiens
gcagauggaggaguacaga

SEQ ID NO: 1120628 - RNA, 19 nt, Homo sapiens
gacaauacuggugccauuu

SEQ ID NO: 1120629 - RNA, 19 nt, Homo sapiens
gaggccaguuuggaucuga

SEQ ID NO: 1120630 - RNA, 19 nt, Homo sapiens
aagauggccuguucuaugc

SEQ ID NO: 1120631 - RNA, 19 nt, Homo sapiens
aaauguggcacugaagaua

SEQ ID NO: 1120632 - RNA, 19 nt, Homo sapiens
gacgucacuuguuccauca

SEQ ID NO: 1120633 - RNA, 19 nt, Homo sapiens
ccuguuaaccugccagcua

SEQ ID NO: 1120634 - RNA, 19 nt, Homo sapiens
uggggaagaugcccuguua

SEQ ID NO: 1120635 - RNA, 19 nt, Homo sapiens
agacugacccugcagauac

SEQ ID NO: 1120636 - RNA, 19 nt, Homo sapiens
gggaagaugcccuguuaac

SEQ ID NO: 1120637 - RNA, 19 nt, Homo sapiens
ggaguggaggugacugaga

SEQ ID NO: 1120638 - RNA, 19 nt, Homo sapiens
caucagccucccagagaaa

SEQ ID NO: 1120639 - RNA, 19 nt, Homo sapiens
ucaucagccucccagagaa

SEQ ID NO: 1120640 - RNA, 19 nt, Homo sapiens
agggaaauguggcacugaa

SEQ ID NO: 1120641 - RNA, 19 nt, Homo sapiens
cagacugacccugcagaua

SEQ ID NO: 1120642 - RNA, 19 nt, Homo sapiens
ccaagaggaccacaaugca

SEQ ID NO: 1120643 - RNA, 19 nt, Homo sapiens
gucaucagccucccagaga

SEQ ID NO: 1120644 - RNA, 19 nt, Homo sapiens
gagaaggggucggucauca

SEQ ID NO: 1120645 - RNA, 19 nt, Homo sapiens
ggguagaguggauagagaa

SEQ ID NO: 1120646 - RNA, 19 nt, Homo sapiens
gaggcuggguagaguggau

SEQ ID NO: 1120647 - RNA, 19 nt, Homo sapiens
gcuguggacgucacuuguu

SEQ ID NO: 1120648 - RNA, 19 nt, Homo sapiens
gcuaagggucacaaacauc

SEQ ID NO: 1120649 - RNA, 19 nt, Homo sapiens
aggagaaaaucgcaacuuu

SEQ ID NO: 1120650 - RNA, 19 nt, Homo sapiens
uggguagaguggauagaga

SEQ ID NO: 1120651 - RNA, 19 nt, Homo sapiens
gaucugaaggugguaaguc

SEQ ID NO: 1120652 - RNA, 19 nt, Homo sapiens
ccaggaggccaguuuggau

SEQ ID NO: 1120653 - RNA, 19 nt, Homo sapiens
gacaaugaagcagucagaa

SEQ ID NO: 1120654 - RNA, 19 nt, Homo sapiens
cgucagagugggagaagau

SEQ ID NO: 1120655 - RNA, 19 nt, Homo sapiens
gaagacauccggggagaga

SEQ ID NO: 1120656 - RNA, 19 nt, Homo sapiens
cacugaagauacacaacau

SEQ ID NO: 1120657 - RNA, 19 nt, Homo sapiens
uacagaggcuggguagagu

SEQ ID NO: 1120658 - RNA, 19 nt, Homo sapiens
gacugacccugcagauacu

SEQ ID NO: 1120659 - RNA, 19 nt, Homo sapiens
ccacgugcagacauugcua

SEQ ID NO: 1120660 - RNA, 19 nt, Homo sapiens
ugcagucgccuccuuccua

SEQ ID NO: 1120661 - RNA, 19 nt, Homo sapiens
gagcagauggcagaguaca

SEQ ID NO: 1120662 - RNA, 19 nt, Homo sapiens
uuuccaggcuacaaucugu

SEQ ID NO: 1120663 - RNA, 19 nt, Homo sapiens
gaaauaaggccgugagaua

SEQ ID NO: 1120664 - RNA, 19 nt, Homo sapiens
gaaggaaucuggaaauaag

SEQ ID NO: 1120665 - RNA, 19 nt, Homo sapiens
caacaacuuuccugacuuu

SEQ ID NO: 1120666 - RNA, 19 nt, Homo sapiens
caacagggacucagccuua

SEQ ID NO: 1120667 - RNA, 19 nt, Homo sapiens
gagagaagcccaugugguu

SEQ ID NO: 1120668 - RNA, 19 nt, Homo sapiens
gaagacagccaugcacuga

SEQ ID NO: 1120669 - RNA, 19 nt, Homo sapiens
ugaauaauuugcagaagga

SEQ ID NO: 1120670 - RNA, 19 nt, Homo sapiens
gacagugacuccagagaga

SEQ ID NO: 1120671 - RNA, 19 nt, Homo sapiens
gacucagccuuaaaucaua

SEQ ID NO: 1120672 - RNA, 19 nt, Homo sapiens
ggacucagccuuaaaucau

SEQ ID NO: 1120673 - RNA, 19 nt, Homo sapiens
gagcgaaccagcuacaaug

SEQ ID NO: 1120674 - RNA, 19 nt, Homo sapiens
cagcauugccaacaacuuu

SEQ ID NO: 1120675 - RNA, 19 nt, Homo sapiens
gcacugagcuggggacaug

SEQ ID NO: 1120676 - RNA, 19 nt, Homo sapiens
caggugaguuccaacaaau

SEQ ID NO: 1120677 - RNA, 19 nt, Homo sapiens
ccaauaaccagcucucugu

SEQ ID NO: 1120678 - RNA, 19 nt, Homo sapiens
cgguggaacucucagauga

SEQ ID NO: 1120679 - RNA, 19 nt, Homo sapiens
ugaagaggcugcgcaucaa

SEQ ID NO: 1120680 - RNA, 19 nt, Homo sapiens
acaggugaguuccaacaaa

SEQ ID NO: 1120681 - RNA, 19 nt, Homo sapiens
ccaacaacuuuccugacuu

SEQ ID NO: 1120682 - RNA, 19 nt, Homo sapiens
gccaacaacuuuccugacu

SEQ ID NO: 1120683 - RNA, 19 nt, Homo sapiens
uccaagaccugaagcuuuc

SEQ ID NO: 1120684 - RNA, 19 nt, Homo sapiens
gcacugucuucuucugauc

SEQ ID NO: 1120685 - RNA, 19 nt, Homo sapiens
cagccacacauaccaauaa

SEQ ID NO: 1120686 - RNA, 19 nt, Homo sapiens
gggauugugacuacaguuu

SEQ ID NO: 1120687 - RNA, 19 nt, Homo sapiens
ggacgcacauacagaagac

SEQ ID NO: 1120688 - RNA, 19 nt, Homo sapiens
agaaggaaucuggaaauaa

SEQ ID NO: 1120689 - RNA, 19 nt, Homo sapiens
caaaagcuauguugucaca

SEQ ID NO: 1120690 - RNA, 19 nt, Homo sapiens
gaacuucacgcugguccaa

SEQ ID NO: 1120691 - RNA, 19 nt, Homo sapiens
aaccugaugugcaacugua

SEQ ID NO: 1120692 - RNA, 19 nt, Homo sapiens
cugggugucuuugcacuua

SEQ ID NO: 1120693 - RNA, 19 nt, Homo sapiens
gagaguggacgcacauaca

SEQ ID NO: 1120694 - RNA, 19 nt, Homo sapiens
guccaagaccugaagcuuu

SEQ ID NO: 1120695 - RNA, 19 nt, Homo sapiens
ggugaguuccaacaaauug

SEQ ID NO: 1120696 - RNA, 19 nt, Homo sapiens
ggaaauaaggccgugagau

SEQ ID NO: 1120697 - RNA, 19 nt, Homo sapiens
gauugugacuacaguuugg

SEQ ID NO: 1120698 - RNA, 19 nt, Homo sapiens
ggacaugcaacaauaacag

SEQ ID NO: 1120699 - RNA, 19 nt, Homo sapiens
aauaacaggugaguuccaa

SEQ ID NO: 1120700 - RNA, 19 nt, Homo sapiens
gaugaauaauuugcagaag

SEQ ID NO: 1120701 - RNA, 19 nt, Homo sapiens
uuuagaaccuucccaaugc

SEQ ID NO: 1120702 - RNA, 19 nt, Homo sapiens
ccagagagaagcccaugug

SEQ ID NO: 1120703 - RNA, 19 nt, Homo sapiens
ggauugugacuacaguuug

SEQ ID NO: 1120704 - RNA, 19 nt, Homo sapiens
ccacacauaccaauaacca

SEQ ID NO: 1120705 - RNA, 19 nt, Homo sapiens
uggccaaccugaugugcaa

SEQ ID NO: 1120706 - RNA, 19 nt, Homo sapiens
gagaagcccaugugguuac

SEQ ID NO: 1120707 - RNA, 19 nt, Homo sapiens
caccaaaggucagaagaac

SEQ ID NO: 1120708 - RNA, 19 nt, Homo sapiens
ucaccaaaggucagaagaa

SEQ ID NO: 1120709 - RNA, 19 nt, Homo sapiens
uaacaggugaguuccaaca

SEQ ID NO: 1120710 - RNA, 19 nt, Homo sapiens
ccaacugcgagaacacuuu

SEQ ID NO: 1120711 - RNA, 19 nt, Homo sapiens
uuaccagcauugccaacaa

SEQ ID NO: 1120712 - RNA, 19 nt, Homo sapiens
guggaacucucagaugaca

SEQ ID NO: 1120713 - RNA, 19 nt, Homo sapiens
gcaagcauggcaccaccuu

SEQ ID NO: 1120714 - RNA, 19 nt, Homo sapiens
caguagagcgaaccagcua

SEQ ID NO: 1120715 - RNA, 19 nt, Homo sapiens
ccaaaggucagaagaacag

SEQ ID NO: 1120716 - RNA, 19 nt, Homo sapiens
aacaauaacaggugaguuc

SEQ ID NO: 1120717 - RNA, 19 nt, Homo sapiens
gcaacacagccacacauac

SEQ ID NO: 1120718 - RNA, 19 nt, Homo sapiens
gggacucagccuuaaauca

SEQ ID NO: 1120719 - RNA, 19 nt, Homo sapiens
agagaagcccaugugguua

SEQ ID NO: 1120720 - RNA, 19 nt, Homo sapiens
ccaacacucuccccacuga

SEQ ID NO: 1120721 - RNA, 19 nt, Homo sapiens
cagcuacaauggccaucug

SEQ ID NO: 1120722 - RNA, 19 nt, Homo sapiens
uccaggcacugucuucuuc

SEQ ID NO: 1120723 - RNA, 19 nt, Homo sapiens
aaauaaggccgugagauag

SEQ ID NO: 1120724 - RNA, 19 nt, Homo sapiens
gcaugcaggcaccaagaga

SEQ ID NO: 1120725 - RNA, 19 nt, Homo sapiens
cugaagaggcugcgcauca

SEQ ID NO: 1120726 - RNA, 19 nt, Homo sapiens
auucggaacugcagcuguu

SEQ ID NO: 1120727 - RNA, 19 nt, Homo sapiens
caacacagccacacauacc

SEQ ID NO: 1120728 - RNA, 19 nt, Homo sapiens
caagagaguggacgcacau

SEQ ID NO: 1120729 - RNA, 19 nt, Homo sapiens
aacagggacucagccuuaa

SEQ ID NO: 1120730 - RNA, 19 nt, Homo sapiens
ggcacugucuucuucugau

SEQ ID NO: 1120731 - RNA, 19 nt, Homo sapiens
auaaccagcucucuguucu

SEQ ID NO: 1120732 - RNA, 19 nt, Homo sapiens
caacuuuccugacuuuucu

SEQ ID NO: 1120733 - RNA, 19 nt, Homo sapiens
acucagccuuaaaucauau

SEQ ID NO: 1120734 - RNA, 19 nt, Homo sapiens
ccacugaauaccuggcuau

SEQ ID NO: 1120735 - RNA, 19 nt, Homo sapiens
cuuaacugcuucaccaaag

SEQ ID NO: 1120736 - RNA, 19 nt, Homo sapiens
gcagccauguauguauauc

SEQ ID NO: 1120737 - RNA, 19 nt, Homo sapiens
agagcuuacucauccauag

SEQ ID NO: 1120738 - RNA, 19 nt, Homo sapiens
ccagagcagagcuuacuca

SEQ ID NO: 1120739 - RNA, 19 nt, Homo sapiens
gaaaacaccauucggaacu

SEQ ID NO: 1120740 - RNA, 19 nt, Homo sapiens
caauaaccagcucucuguu

SEQ ID NO: 1120741 - RNA, 19 nt, Homo sapiens
ugaaaacguuaccagcauu

SEQ ID NO: 1120742 - RNA, 19 nt, Homo sapiens
cagggacucagccuuaaau

SEQ ID NO: 1120743 - RNA, 19 nt, Homo sapiens
ccauguauguauaucucau

SEQ ID NO: 1120744 - RNA, 19 nt, Homo sapiens
caacaauaacaggugaguu

SEQ ID NO: 1120745 - RNA, 19 nt, Homo sapiens
ucuuugcacuuaacugcuu

SEQ ID NO: 1120746 - RNA, 19 nt, Homo sapiens
gaguggacgcacauacaga

SEQ ID NO: 1120747 - RNA, 19 nt, Homo sapiens
cagcaugcaggcaccaaga

SEQ ID NO: 1120748 - RNA, 19 nt, Homo sapiens
cuuuagaaccuucccaaug

SEQ ID NO: 1120749 - RNA, 19 nt, Homo sapiens
gcaacaauaacaggugagu

SEQ ID NO: 1120750 - RNA, 19 nt, Homo sapiens
gaaaacguuaccagcauug

SEQ ID NO: 1120751 - RNA, 19 nt, Homo sapiens
gaagaggcugcgcaucaac

SEQ ID NO: 1120752 - RNA, 19 nt, Homo sapiens
gggaagaaauguaauacua

SEQ ID NO: 1120753 - RNA, 19 nt, Homo sapiens
gaagaaacaucaucugaag

SEQ ID NO: 1120754 - RNA, 19 nt, Homo sapiens
gaggaaagcacaugugaua

SEQ ID NO: 1120755 - RNA, 19 nt, Homo sapiens
gcauuuauguggagcauuu

SEQ ID NO: 1120756 - RNA, 19 nt, Homo sapiens
gaaauuccaugaccaauac

SEQ ID NO: 1120757 - RNA, 19 nt, Homo sapiens
gcucaugccuguaauccua

SEQ ID NO: 1120758 - RNA, 19 nt, Homo sapiens
gaacaaaccacucaagauc

SEQ ID NO: 1120759 - RNA, 19 nt, Homo sapiens
gagcggaccuugucuguca

SEQ ID NO: 1120760 - RNA, 19 nt, Homo sapiens
gcacauaaagcuuguaguu

SEQ ID NO: 1120761 - RNA, 19 nt, Homo sapiens
cagauaaccuggcuacuug

SEQ ID NO: 1120762 - RNA, 19 nt, Homo sapiens
gaaacucucuauccucuca

SEQ ID NO: 1120763 - RNA, 19 nt, Homo sapiens
ggguugaauuuacugauua

SEQ ID NO: 1120764 - RNA, 19 nt, Homo sapiens
gucaagaucucaccacuga

SEQ ID NO: 1120765 - RNA, 19 nt, Homo sapiens
gaccaaaccaugcacauaa

SEQ ID NO: 1120766 - RNA, 19 nt, Homo sapiens
gaacacacacuagaaaguu

SEQ ID NO: 1120767 - RNA, 19 nt, Homo sapiens
caucggagauugacaagga

SEQ ID NO: 1120768 - RNA, 19 nt, Homo sapiens
gaaagcacaugugauaugg

SEQ ID NO: 1120769 - RNA, 19 nt, Homo sapiens
ggaaagcacaugugauaug

SEQ ID NO: 1120770 - RNA, 19 nt, Homo sapiens
gcuaacauccuaccucaaa

SEQ ID NO: 1120771 - RNA, 19 nt, Homo sapiens
gaucaaggucaaauaauga

SEQ ID NO: 1120772 - RNA, 19 nt, Homo sapiens
caaaggaagugaaagugau

SEQ ID NO: 1120773 - RNA, 19 nt, Homo sapiens
cgaagcaaauccucaguau

SEQ ID NO: 1120774 - RNA, 19 nt, Homo sapiens
cauccuaccucaaauggaa

SEQ ID NO: 1120775 - RNA, 19 nt, Homo sapiens
caaaguaccuaaagaucuc

SEQ ID NO: 1120776 - RNA, 19 nt, Homo sapiens
gccagacgcucacucuaaa

SEQ ID NO: 1120777 - RNA, 19 nt, Homo sapiens
gcacaaaggaagugaaagu

SEQ ID NO: 1120778 - RNA, 19 nt, Homo sapiens
aaaugaguauccugcuuua

SEQ ID NO: 1120779 - RNA, 19 nt, Homo sapiens
gcagauaaccuggcuacuu

SEQ ID NO: 1120780 - RNA, 19 nt, Homo sapiens
gagcuuaauugcugagaca

SEQ ID NO: 1120781 - RNA, 19 nt, Homo sapiens
gaugggaagaaauguaaua

SEQ ID NO: 1120782 - RNA, 19 nt, Homo sapiens
caagcuauacuuccuguuu

SEQ ID NO: 1120783 - RNA, 19 nt, Homo sapiens
cgaauuccuuagauuacua

SEQ ID NO: 1120784 - RNA, 19 nt, Homo sapiens
gaugcaaaguaccuaaaga

SEQ ID NO: 1120785 - RNA, 19 nt, Homo sapiens
gugagcagcuaacauccua

SEQ ID NO: 1120786 - RNA, 19 nt, Homo sapiens
ggaccaaaccaugcacaua

SEQ ID NO: 1120787 - RNA, 19 nt, Homo sapiens
gcacaugugauauggaaga

SEQ ID NO: 1120788 - RNA, 19 nt, Homo sapiens
uaaaugaguauccugcuuu

SEQ ID NO: 1120789 - RNA, 19 nt, Homo sapiens
gacaauaaaugagucagau

SEQ ID NO: 1120790 - RNA, 19 nt, Homo sapiens
gcagaauagauguuuguuu

SEQ ID NO: 1120791 - RNA, 19 nt, Homo sapiens
caaagauucgaauuccuua

SEQ ID NO: 1120792 - RNA, 19 nt, Homo sapiens
caauaaaugagucagauga

SEQ ID NO: 1120793 - RNA, 19 nt, Homo sapiens
ggagugauacaugacaaua

SEQ ID NO: 1120794 - RNA, 19 nt, Homo sapiens
gcaaaguaccuaaagaucu

SEQ ID NO: 1120795 - RNA, 19 nt, Homo sapiens
ccaaauaccagcuucuuca

SEQ ID NO: 1120796 - RNA, 19 nt, Homo sapiens
ccuggaagcuucaguuauc

SEQ ID NO: 1120797 - RNA, 19 nt, Homo sapiens
gcaccuguagucucagaua

SEQ ID NO: 1120798 - RNA, 19 nt, Homo sapiens
ggccagacgcucacucuaa

SEQ ID NO: 1120799 - RNA, 19 nt, Homo sapiens
aacaucaucugaagagaaa

SEQ ID NO: 1120800 - RNA, 19 nt, Homo sapiens
gaaacaucaucugaagaga

SEQ ID NO: 1120801 - RNA, 19 nt, Homo sapiens
uaccagcacucucauaauc

SEQ ID NO: 1120802 - RNA, 19 nt, Homo sapiens
gaacgcuccaugaauuuga

SEQ ID NO: 1120803 - RNA, 19 nt, Homo sapiens
gauucgaauuccuuagauu

SEQ ID NO: 1120804 - RNA, 19 nt, Homo sapiens
gagguaggcagaucacuug

SEQ ID NO: 1120805 - RNA, 19 nt, Homo sapiens
cagagaguauuguguagug

SEQ ID NO: 1120806 - RNA, 19 nt, Homo sapiens
agaucaaggucaaauaaug

SEQ ID NO: 1120807 - RNA, 19 nt, Homo sapiens
aagcuucaguuaucagaaa

SEQ ID NO: 1120808 - RNA, 19 nt, Homo sapiens
aauaccagcuucuucauca

SEQ ID NO: 1120809 - RNA, 19 nt, Homo sapiens
aagcacaugugauauggaa

SEQ ID NO: 1120810 - RNA, 19 nt, Homo sapiens
gaagcaaauccucaguauu

SEQ ID NO: 1120811 - RNA, 19 nt, Homo sapiens
gcaauggaacaugugauuu

SEQ ID NO: 1120812 - RNA, 19 nt, Homo sapiens
cuagaaaguuacagaucaa

SEQ ID NO: 1120813 - RNA, 19 nt, Homo sapiens
aacacacacuagaaaguua

SEQ ID NO: 1120814 - RNA, 19 nt, Homo sapiens
ccacagcagcccaccagua

SEQ ID NO: 1120815 - RNA, 19 nt, Homo sapiens
aagauuugguuacugauga

SEQ ID NO: 1120816 - RNA, 19 nt, Homo sapiens
guagcacccuuccgguuug

SEQ ID NO: 1120817 - RNA, 19 nt, Homo sapiens
ugagucagaugagcaagaa

SEQ ID NO: 1120818 - RNA, 19 nt, Homo sapiens
gugcgcaccuguagucuca

SEQ ID NO: 1120819 - RNA, 19 nt, Homo sapiens
gaaaguuacagaucaaggu

SEQ ID NO: 1120820 - RNA, 19 nt, Homo sapiens
guacaucggagauugacaa

SEQ ID NO: 1120821 - RNA, 19 nt, Homo sapiens
gaagauuugguuacugaug

SEQ ID NO: 1120822 - RNA, 19 nt, Homo sapiens
uugaagauuugguuacuga

SEQ ID NO: 1120823 - RNA, 19 nt, Homo sapiens
aaacugaugggaagaaaug

SEQ ID NO: 1120824 - RNA, 19 nt, Homo sapiens
gggaauagcauggaagugu

SEQ ID NO: 1120825 - RNA, 19 nt, Homo sapiens
ccaaagauucgaauuccuu

SEQ ID NO: 1120826 - RNA, 19 nt, Homo sapiens
gaggagugauacaugacaa

SEQ ID NO: 1120827 - RNA, 19 nt, Homo sapiens
ucucugauccuaagaaguu

SEQ ID NO: 1120828 - RNA, 19 nt, Homo sapiens
uacaagugcuuacauuaca

SEQ ID NO: 1120829 - RNA, 19 nt, Homo sapiens
ugaagaaacaucaucugaa

SEQ ID NO: 1120830 - RNA, 19 nt, Homo sapiens
acagaucaaggucaaauaa

SEQ ID NO: 1120831 - RNA, 19 nt, Homo sapiens
ucagaacacacacuagaaa

SEQ ID NO: 1120832 - RNA, 19 nt, Homo sapiens
agaagaacauguuguacuc

SEQ ID NO: 1120833 - RNA, 19 nt, Homo sapiens
guacaagugcuuacauuac

SEQ ID NO: 1120834 - RNA, 19 nt, Homo sapiens
aagaugguguccucggaua

SEQ ID NO: 1120835 - RNA, 19 nt, Homo sapiens
caauggaacaugugauuuc

SEQ ID NO: 1120836 - RNA, 19 nt, Homo sapiens
uaacguaacccugcaagau

SEQ ID NO: 1120837 - RNA, 19 nt, Homo sapiens
gaaagaacaaaccacucaa

SEQ ID NO: 1120838 - RNA, 19 nt, Homo sapiens
caaggaagagaaagaacaa

SEQ ID NO: 1120839 - RNA, 19 nt, Homo sapiens
gaugaaggcguguacaagu

SEQ ID NO: 1120840 - RNA, 19 nt, Homo sapiens
ggaagaaauguaauacuac

SEQ ID NO: 1120841 - RNA, 19 nt, Homo sapiens
ucaguuaucagaaagcaaa

SEQ ID NO: 1120842 - RNA, 19 nt, Homo sapiens
gagugauacaugacaauaa

SEQ ID NO: 1120843 - RNA, 19 nt, Homo sapiens
gaaaccccgucucuacuaa

SEQ ID NO: 1120844 - RNA, 19 nt, Homo sapiens
guagugcucucugcaaugg

SEQ ID NO: 1120845 - RNA, 19 nt, Homo sapiens
acuagaaaguuacagauca

SEQ ID NO: 1120846 - RNA, 19 nt, Homo sapiens
gaagagaaagaacaaacca

SEQ ID NO: 1120847 - RNA, 19 nt, Homo sapiens
ugaaacugaugggaagaaa

SEQ ID NO: 1120848 - RNA, 19 nt, Homo sapiens
gcuggcaacuccuuucaag

SEQ ID NO: 1120849 - RNA, 19 nt, Homo sapiens
ccaaucagcucuccaucac

SEQ ID NO: 1120850 - RNA, 19 nt, Homo sapiens
gaagagagaaaacgaaguu

SEQ ID NO: 1120851 - RNA, 19 nt, Homo sapiens
gagaagaacauguuguacu

SEQ ID NO: 1120852 - RNA, 19 nt, Homo sapiens
gaaauuaugucuaggauga

SEQ ID NO: 1120853 - RNA, 19 nt, Homo sapiens
ggacugagcuggugaagaa

SEQ ID NO: 1120854 - RNA, 19 nt, Homo sapiens
uggaagagauuaaggauua

SEQ ID NO: 1120855 - RNA, 19 nt, Homo sapiens
ccaaugaaaucaagucuaa

SEQ ID NO: 1120856 - RNA, 19 nt, Homo sapiens
gcaaaugucccaaguguaa

SEQ ID NO: 1120857 - RNA, 19 nt, Homo sapiens
uaaggaaacuccagaauau

SEQ ID NO: 1120858 - RNA, 19 nt, Homo sapiens
gaaggcagcuguugaagau

SEQ ID NO: 1120859 - RNA, 19 nt, Homo sapiens
gucaggaacuuauucauua

SEQ ID NO: 1120860 - RNA, 19 nt, Homo sapiens
agaagaagcuacaugauuu

SEQ ID NO: 1120861 - RNA, 19 nt, Homo sapiens
gaugaugccucacuauuga

SEQ ID NO: 1120862 - RNA, 19 nt, Homo sapiens
gaacaagcaggcccuauaa

SEQ ID NO: 1120863 - RNA, 19 nt, Homo sapiens
ggagaaggaugaugcaaau

SEQ ID NO: 1120864 - RNA, 19 nt, Homo sapiens
gcugaggacugaaguaauu

SEQ ID NO: 1120865 - RNA, 19 nt, Homo sapiens
ucagcuggcuuucuuguua

SEQ ID NO: 1120866 - RNA, 19 nt, Homo sapiens
gcaaacuucuugugaaugu

SEQ ID NO: 1120867 - RNA, 19 nt, Homo sapiens
uaaggaaacuggaagagaa

SEQ ID NO: 1120868 - RNA, 19 nt, Homo sapiens
ccaaucagauccauaaguu

SEQ ID NO: 1120869 - RNA, 19 nt, Homo sapiens
ggaaaugaaugcagagcuu

SEQ ID NO: 1120870 - RNA, 19 nt, Homo sapiens
gcacaaaguuuucuucauu

SEQ ID NO: 1120871 - RNA, 19 nt, Homo sapiens
uagaauaccuacagaagaa

SEQ ID NO: 1120872 - RNA, 19 nt, Homo sapiens
gaacaaaaguggaaacaug

SEQ ID NO: 1120873 - RNA, 19 nt, Homo sapiens
gaaggaugaugcaaauuuc

SEQ ID NO: 1120874 - RNA, 19 nt, Homo sapiens
gaggacaucucuagacuuc

SEQ ID NO: 1120875 - RNA, 19 nt, Homo sapiens
gcagugggauauugacaaa

SEQ ID NO: 1120876 - RNA, 19 nt, Homo sapiens
gaagaaggcagcuguugaa

SEQ ID NO: 1120877 - RNA, 19 nt, Homo sapiens
gaggaugccuugaggaaga

SEQ ID NO: 1120878 - RNA, 19 nt, Homo sapiens
gaaaauggcugaugaggau

SEQ ID NO: 1120879 - RNA, 19 nt, Homo sapiens
uaaacgggaugaagaagaa

SEQ ID NO: 1120880 - RNA, 19 nt, Homo sapiens
guggaaacauggcuacuuu

SEQ ID NO: 1120881 - RNA, 19 nt, Homo sapiens
gaagaaaucaaguugguau

SEQ ID NO: 1120882 - RNA, 19 nt, Homo sapiens
gaagaaagagaacacgaaa

SEQ ID NO: 1120883 - RNA, 19 nt, Homo sapiens
gagagaacuuggugagcua

SEQ ID NO: 1120884 - RNA, 19 nt, Homo sapiens
gagagaagcagaagcuaaa

SEQ ID NO: 1120885 - RNA, 19 nt, Homo sapiens
gcgcaaaugucccaagugu

SEQ ID NO: 1120886 - RNA, 19 nt, Homo sapiens
caaagaaaccagacaaugu

SEQ ID NO: 1120887 - RNA, 19 nt, Homo sapiens
acaaagaguuggcucagaa

SEQ ID NO: 1120888 - RNA, 19 nt, Homo sapiens
agaaaggacugguaaauac

SEQ ID NO: 1120889 - RNA, 19 nt, Homo sapiens
gaccagguguugacucuga

SEQ ID NO: 1120890 - RNA, 19 nt, Homo sapiens
ugcaggagcugaacucuuu

SEQ ID NO: 1120891 - RNA, 19 nt, Homo sapiens
guagcaaacuucuugugaa

SEQ ID NO: 1120892 - RNA, 19 nt, Homo sapiens
aaagaaaccagacaaugua

SEQ ID NO: 1120893 - RNA, 19 nt, Homo sapiens
gagauucugcuaaggauaa

SEQ ID NO: 1120894 - RNA, 19 nt, Homo sapiens
gcuaaacaguggagauaau

SEQ ID NO: 1120895 - RNA, 19 nt, Homo sapiens
gaagaacgagaacgagaaa

SEQ ID NO: 1120896 - RNA, 19 nt, Homo sapiens
gagaugagguuagucuuca

SEQ ID NO: 1120897 - RNA, 19 nt, Homo sapiens
gaaaacgacugucuucuuc

SEQ ID NO: 1120898 - RNA, 19 nt, Homo sapiens
gcuaggaggugucucuuca

SEQ ID NO: 1120899 - RNA, 19 nt, Homo sapiens
gaagcacuccucucugaaa

SEQ ID NO: 1120900 - RNA, 19 nt, Homo sapiens
aagaagcacuccucucuga

SEQ ID NO: 1120901 - RNA, 19 nt, Homo sapiens
uaucaaugcucggaaguuu

SEQ ID NO: 1120902 - RNA, 19 nt, Homo sapiens
gaauguuucuguaggacuu

SEQ ID NO: 1120903 - RNA, 19 nt, Homo sapiens
gaaauuugauacggagaga

SEQ ID NO: 1120904 - RNA, 19 nt, Homo sapiens
cagaaaggacugguaaaua

SEQ ID NO: 1120905 - RNA, 19 nt, Homo sapiens
aagaggagcuggcuaguca

SEQ ID NO: 1120906 - RNA, 19 nt, Homo sapiens
auaagaagcugaggacuga

SEQ ID NO: 1120907 - RNA, 19 nt, Homo sapiens
ggagcuggcuagucaggaa

SEQ ID NO: 1120908 - RNA, 19 nt, Homo sapiens
gugaugagauucugaugga

SEQ ID NO: 1120909 - RNA, 19 nt, Homo sapiens
cagcccagcuugcagauga

SEQ ID NO: 1120910 - RNA, 19 nt, Homo sapiens
ggaagcagaaauuaucaaa

SEQ ID NO: 1120911 - RNA, 19 nt, Homo sapiens
gggagguccugagauauaa

SEQ ID NO: 1120912 - RNA, 19 nt, Homo sapiens
guaucauccuuaaacguua

SEQ ID NO: 1120913 - RNA, 19 nt, Homo sapiens
ccacaagcuugaauuaaag

SEQ ID NO: 1120914 - RNA, 19 nt, Homo sapiens
ggacauguucaauuucaaa

SEQ ID NO: 1120915 - RNA, 19 nt, Homo sapiens
cagaagaagcuacaugauu

SEQ ID NO: 1120916 - RNA, 19 nt, Homo sapiens
gagaaggagcugggucuua

SEQ ID NO: 1120917 - RNA, 19 nt, Homo sapiens
ucaguagccuccagaauca

SEQ ID NO: 1120918 - RNA, 19 nt, Homo sapiens
gagcaagucguuaaggaaa

SEQ ID NO: 1120919 - RNA, 19 nt, Homo sapiens
uccacaagcuugaauuaaa

SEQ ID NO: 1120920 - RNA, 19 nt, Homo sapiens
ggaguuggcucagaagaag

SEQ ID NO: 1120921 - RNA, 19 nt, Homo sapiens
ggagagggaacgagaaaga

SEQ ID NO: 1120922 - RNA, 19 nt, Homo sapiens
gaauguggauuacaaaaug

SEQ ID NO: 1120923 - RNA, 19 nt, Homo sapiens
gaaaaggacauguucaauu

SEQ ID NO: 1120924 - RNA, 19 nt, Homo sapiens
uuaaggaaacuccagaaua

SEQ ID NO: 1120925 - RNA, 19 nt, Homo sapiens
ugucaggaauuggaaauaa

SEQ ID NO: 1120926 - RNA, 19 nt, Homo sapiens
cagcugagaagaagucuaa

SEQ ID NO: 1120927 - RNA, 19 nt, Homo sapiens
gagaaaggcaaacaugaug

SEQ ID NO: 1120928 - RNA, 19 nt, Homo sapiens
guuaagaucagcuggcuuu

SEQ ID NO: 1120929 - RNA, 19 nt, Homo sapiens
uagcaaacuucuugugaau

SEQ ID NO: 1120930 - RNA, 19 nt, Homo sapiens
gcagaaaggacugguaaau

SEQ ID NO: 1120931 - RNA, 19 nt, Homo sapiens
ggaaacaauuaagcuagga

SEQ ID NO: 1120932 - RNA, 19 nt, Homo sapiens
agaaggaugaugcaaauuu

SEQ ID NO: 1120933 - RNA, 19 nt, Homo sapiens
uggaggagcagauagaaua

SEQ ID NO: 1120934 - RNA, 19 nt, Homo sapiens
gaucuaaggcaaagacuca

SEQ ID NO: 1120935 - RNA, 19 nt, Homo sapiens
gagagauucugcuaaggau

SEQ ID NO: 1120936 - RNA, 19 nt, Homo sapiens
gauauaagcggaaauugag

SEQ ID NO: 1120937 - RNA, 19 nt, Homo sapiens
gaaaugcugaggauagaau

SEQ ID NO: 1120938 - RNA, 19 nt, Homo sapiens
guaauucagcuagaagaua

SEQ ID NO: 1120939 - RNA, 19 nt, Homo sapiens
augcagagcuugaggagaa

SEQ ID NO: 1120940 - RNA, 19 nt, Homo sapiens
agagaaggagcaucuguua

SEQ ID NO: 1120941 - RNA, 19 nt, Homo sapiens
gcacuccucucugaaaugg

SEQ ID NO: 1120942 - RNA, 19 nt, Homo sapiens
gcaccagguugagcuuauu

SEQ ID NO: 1120943 - RNA, 19 nt, Homo sapiens
ggaauugacagaucuucuu

SEQ ID NO: 1120944 - RNA, 19 nt, Homo sapiens
gauugugacuguuuaugau

SEQ ID NO: 1120945 - RNA, 19 nt, Homo sapiens
caccaaaccucuaccucuu

SEQ ID NO: 1120946 - RNA, 19 nt, Homo sapiens
gcuugcagaugaccucaaa

SEQ ID NO: 1120947 - RNA, 19 nt, Homo sapiens
gaagauaaagagaagaaag

SEQ ID NO: 1120948 - RNA, 19 nt, Homo sapiens
ugaacaagcaggcccuaua

SEQ ID NO: 1120949 - RNA, 19 nt, Homo sapiens
ugaaagcacacuuggauga

SEQ ID NO: 1120950 - RNA, 19 nt, Homo sapiens
gaggaggucacuacacaaa

SEQ ID NO: 1120951 - RNA, 19 nt, Homo sapiens
gcgacucgaccgacacuua

SEQ ID NO: 1120952 - RNA, 19 nt, Homo sapiens
ucgaagaccugcagaauua

SEQ ID NO: 1120953 - RNA, 19 nt, Homo sapiens
ccaaacaucucaaaugaaa

SEQ ID NO: 1120954 - RNA, 19 nt, Homo sapiens
gaagguagaugucauucaa

SEQ ID NO: 1120955 - RNA, 19 nt, Homo sapiens
guaaaucucucaauacuca

SEQ ID NO: 1120956 - RNA, 19 nt, Homo sapiens
gcaguaagccucauguaua

SEQ ID NO: 1120957 - RNA, 19 nt, Homo sapiens
acaagggacuguagauuua

SEQ ID NO: 1120958 - RNA, 19 nt, Homo sapiens
ucauagagcugaacaguug

SEQ ID NO: 1120959 - RNA, 19 nt, Homo sapiens
gaaauucgauuccaagcau

SEQ ID NO: 1120960 - RNA, 19 nt, Homo sapiens
ugagcaagcuucucuuaaa

SEQ ID NO: 1120961 - RNA, 19 nt, Homo sapiens
ggucagaggacuccaauaa

SEQ ID NO: 1120962 - RNA, 19 nt, Homo sapiens
gaagugaggccaaugauca

SEQ ID NO: 1120963 - RNA, 19 nt, Homo sapiens
acacagaggugguggaaga

SEQ ID NO: 1120964 - RNA, 19 nt, Homo sapiens
ggguuuagauaaucaguaa

SEQ ID NO: 1120965 - RNA, 19 nt, Homo sapiens
gacaagggacuguagauuu

SEQ ID NO: 1120966 - RNA, 19 nt, Homo sapiens
ucucuuaccugauuuaugu

SEQ ID NO: 1120967 - RNA, 19 nt, Homo sapiens
guagaagccuugcauccuu

SEQ ID NO: 1120968 - RNA, 19 nt, Homo sapiens
caucucaaaugaaauguug

SEQ ID NO: 1120969 - RNA, 19 nt, Homo sapiens
gaagaccugcagaauuaua

SEQ ID NO: 1120970 - RNA, 19 nt, Homo sapiens
gaagaaaaguugaauacug

SEQ ID NO: 1120971 - RNA, 19 nt, Homo sapiens
ucagaggacuccaauaaca

SEQ ID NO: 1120972 - RNA, 19 nt, Homo sapiens
gacuguagauuuaaugaug

SEQ ID NO: 1120973 - RNA, 19 nt, Homo sapiens
ugccaaacaucucaaauga

SEQ ID NO: 1120974 - RNA, 19 nt, Homo sapiens
ccaauaacagccagguuua

SEQ ID NO: 1120975 - RNA, 19 nt, Homo sapiens
uccacacucuucacuauua

SEQ ID NO: 1120976 - RNA, 19 nt, Homo sapiens
uauggcaucuucacaacua

SEQ ID NO: 1120977 - RNA, 19 nt, Homo sapiens
gagaagaaauggcaaucag

SEQ ID NO: 1120978 - RNA, 19 nt, Homo sapiens
aagaugcucucuagucauu

SEQ ID NO: 1120979 - RNA, 19 nt, Homo sapiens
gguaauaucagaauguuuc

SEQ ID NO: 1120980 - RNA, 19 nt, Homo sapiens
cacagugacucuuggaauu

SEQ ID NO: 1120981 - RNA, 19 nt, Homo sapiens
ggucuggucuuggugguaa

SEQ ID NO: 1120982 - RNA, 19 nt, Homo sapiens
ggagagaagugaggccaau

SEQ ID NO: 1120983 - RNA, 19 nt, Homo sapiens
gaucagaggaggcucauag

SEQ ID NO: 1120984 - RNA, 19 nt, Homo sapiens
gaauuaaugaacuccagua

SEQ ID NO: 1120985 - RNA, 19 nt, Homo sapiens
gaugcucucuagucauuug

SEQ ID NO: 1120986 - RNA, 19 nt, Homo sapiens
ccugcagaauuauaucuua

SEQ ID NO: 1120987 - RNA, 19 nt, Homo sapiens
ccuuguagaugaugaagaa

SEQ ID NO: 1120988 - RNA, 19 nt, Homo sapiens
gauaaucaguaaccauaac

SEQ ID NO: 1120989 - RNA, 19 nt, Homo sapiens
gaacuccaguaccugaaag

SEQ ID NO: 1120990 - RNA, 19 nt, Homo sapiens
guaagccucauguauacua

SEQ ID NO: 1120991 - RNA, 19 nt, Homo sapiens
gagcaagcuucucuuaaaa

SEQ ID NO: 1120992 - RNA, 19 nt, Homo sapiens
uagaagccuugcauccuuu

SEQ ID NO: 1120993 - RNA, 19 nt, Homo sapiens
ggaugaagcagaggaagaa

SEQ ID NO: 1120994 - RNA, 19 nt, Homo sapiens
gcagaauuauaucuuagag

SEQ ID NO: 1120995 - RNA, 19 nt, Homo sapiens
ucaccacucucccagcauu

SEQ ID NO: 1120996 - RNA, 19 nt, Homo sapiens
gauauggcaucuucacaac

SEQ ID NO: 1120997 - RNA, 19 nt, Homo sapiens
caguaagccucauguauac

SEQ ID NO: 1120998 - RNA, 19 nt, Homo sapiens
aagacagccuuguagauga

SEQ ID NO: 1120999 - RNA, 19 nt, Homo sapiens
uacaugaacuguguuuguu

SEQ ID NO: 1121000 - RNA, 19 nt, Homo sapiens
caaagacagccuuguagau

SEQ ID NO: 1121001 - RNA, 19 nt, Homo sapiens
gcauuuaucugagcguucu

SEQ ID NO: 1121002 - RNA, 19 nt, Homo sapiens
cgucauagccaccuugguu

SEQ ID NO: 1121003 - RNA, 19 nt, Homo sapiens
cagaaguccucuaagucuu

SEQ ID NO: 1121004 - RNA, 19 nt, Homo sapiens
aaucuccugugcuauguuu

SEQ ID NO: 1121005 - RNA, 19 nt, Homo sapiens
caaauugcaggaaacauca

SEQ ID NO: 1121006 - RNA, 19 nt, Homo sapiens
caagccagaaguccucuaa

SEQ ID NO: 1121007 - RNA, 19 nt, Homo sapiens
uaacagccagguuuacaug

SEQ ID NO: 1121008 - RNA, 19 nt, Homo sapiens
ccacacucuucacuauuau

SEQ ID NO: 1121009 - RNA, 19 nt, Homo sapiens
uaugucagcuucccuuugg

SEQ ID NO: 1121010 - RNA, 19 nt, Homo sapiens
aaagacagccuuguagaug

SEQ ID NO: 1121011 - RNA, 19 nt, Homo sapiens
uccaucuacuucucucuua

SEQ ID NO: 1121012 - RNA, 19 nt, Homo sapiens
uaagccucauguauacuaa

SEQ ID NO: 1121013 - RNA, 19 nt, Homo sapiens
uccaguaccugaaagugaa

SEQ ID NO: 1121014 - RNA, 19 nt, Homo sapiens
uuaaugaacuccaguaccu

SEQ ID NO: 1121015 - RNA, 19 nt, Homo sapiens
ggucuugaacuacuuuaau

SEQ ID NO: 1121016 - RNA, 19 nt, Homo sapiens
ucuccacacucuucacuau

SEQ ID NO: 1121017 - RNA, 19 nt, Homo sapiens
gugguaauaucagaauguu

SEQ ID NO: 1121018 - RNA, 19 nt, Homo sapiens
caaaaggaaguaaggauuu

SEQ ID NO: 1121019 - RNA, 19 nt, Homo sapiens
acagccagguuuacaugaa

SEQ ID NO: 1121020 - RNA, 19 nt, Homo sapiens
ggcaguaagccucauguau

SEQ ID NO: 1121021 - RNA, 19 nt, Homo sapiens
ggugaaagaauuaaugaac

SEQ ID NO: 1121022 - RNA, 19 nt, Homo sapiens
ccagaaguccucuaagucu

SEQ ID NO: 1121023 - RNA, 19 nt, Homo sapiens
ucacagcuagaaauugaaa

SEQ ID NO: 1121024 - RNA, 19 nt, Homo sapiens
ucaaauugcaggaaacauc

SEQ ID NO: 1121025 - RNA, 19 nt, Homo sapiens
cccaaaguguaacguagaa

SEQ ID NO: 1121026 - RNA, 19 nt, Homo sapiens
aaugagcaagcuucucuua

SEQ ID NO: 1121027 - RNA, 19 nt, Homo sapiens
ugaagaagagaaagaagau

SEQ ID NO: 1121028 - RNA, 19 nt, Homo sapiens
ucaugaaauucgauuccaa

SEQ ID NO: 1121029 - RNA, 19 nt, Homo sapiens
gagcauccccaaaguguaa

SEQ ID NO: 1121030 - RNA, 19 nt, Homo sapiens
caagggacuguagauuuaa

SEQ ID NO: 1121031 - RNA, 19 nt, Homo sapiens
aaauucgauuccaagcaua

SEQ ID NO: 1121032 - RNA, 19 nt, Homo sapiens
uaacguagaagccuugcau

SEQ ID NO: 1121033 - RNA, 19 nt, Homo sapiens
aaucagcaccuuccagaga

SEQ ID NO: 1121034 - RNA, 19 nt, Homo sapiens
aaaagaugcucucuaguca

SEQ ID NO: 1121035 - RNA, 19 nt, Homo sapiens
agacagccuuguagaugau

SEQ ID NO: 1121036 - RNA, 19 nt, Homo sapiens
ggucuuggugguaauauca

SEQ ID NO: 1121037 - RNA, 19 nt, Homo sapiens
ugcaaaggaugggauauuc

SEQ ID NO: 1121038 - RNA, 19 nt, Homo sapiens
ugacaagggacuguagauu

SEQ ID NO: 1121039 - RNA, 19 nt, Homo sapiens
ccacuuccaaggcauuuau

SEQ ID NO: 1121040 - RNA, 19 nt, Homo sapiens
uugguguucuuaugucuuu

SEQ ID NO: 1121041 - RNA, 19 nt, Homo sapiens
agguagaugucauucaaga

SEQ ID NO: 1121042 - RNA, 19 nt, Homo sapiens
uuacaugaacuguguuugu

SEQ ID NO: 1121043 - RNA, 19 nt, Homo sapiens
uccaauaacagccagguuu

SEQ ID NO: 1121044 - RNA, 19 nt, Homo sapiens
guagaugucauucaagaac

SEQ ID NO: 1121045 - RNA, 19 nt, Homo sapiens
ggaagguagaugucauuca

SEQ ID NO: 1121046 - RNA, 19 nt, Homo sapiens
ugaaugagcaagcuucucu

SEQ ID NO: 1121047 - RNA, 19 nt, Homo sapiens
cuagucauuuggucucaug

SEQ ID NO: 1121048 - RNA, 19 nt, Homo sapiens
guuuccaucuucuguaauc

SEQ ID NO: 1121049 - RNA, 19 nt, Homo sapiens
ugaaucuccugugcuaugu

SEQ ID NO: 1121050 - RNA, 19 nt, Homo sapiens
accugaaagugaaagauuu

SEQ ID NO: 1121051 - RNA, 19 nt, Homo sapiens
agccagaaguccucuaagu

SEQ ID NO: 1121052 - RNA, 19 nt, Homo sapiens
ggaaggagcugcugaaauu

SEQ ID NO: 1121053 - RNA, 19 nt, Homo sapiens
caaggaaacuauugacuua

SEQ ID NO: 1121054 - RNA, 19 nt, Homo sapiens
gaagaucuguccuuauaaa

SEQ ID NO: 1121055 - RNA, 19 nt, Homo sapiens
ccgaagaucuguccuuaua

SEQ ID NO: 1121056 - RNA, 19 nt, Homo sapiens
ggaaguauguggaagaaga

SEQ ID NO: 1121057 - RNA, 19 nt, Homo sapiens
gaaaugaccuugcuuuuga

SEQ ID NO: 1121058 - RNA, 19 nt, Homo sapiens
ucaguuagcucucguaaau

SEQ ID NO: 1121059 - RNA, 19 nt, Homo sapiens
caagagugauggccagaua

SEQ ID NO: 1121060 - RNA, 19 nt, Homo sapiens
ccagauaccugccaaugaa

SEQ ID NO: 1121061 - RNA, 19 nt, Homo sapiens
ucagcgagcuucuuauaaa

SEQ ID NO: 1121062 - RNA, 19 nt, Homo sapiens
gaucuguccuuauaaacaa

SEQ ID NO: 1121063 - RNA, 19 nt, Homo sapiens
ucacauacuuuaagaggaa

SEQ ID NO: 1121064 - RNA, 19 nt, Homo sapiens
gagaaauuaucaugcagaa

SEQ ID NO: 1121065 - RNA, 19 nt, Homo sapiens
caacauccaagaucacaua

SEQ ID NO: 1121066 - RNA, 19 nt, Homo sapiens
gauaccugcuucuucuaua

SEQ ID NO: 1121067 - RNA, 19 nt, Homo sapiens
gaacgagcccacauccuuu

SEQ ID NO: 1121068 - RNA, 19 nt, Homo sapiens
uagaugaaauggcuuaaug

SEQ ID NO: 1121069 - RNA, 19 nt, Homo sapiens
ggaguuauuugguaagcaa

SEQ ID NO: 1121070 - RNA, 19 nt, Homo sapiens
gaccggauauaaugaaaga

SEQ ID NO: 1121071 - RNA, 19 nt, Homo sapiens
ggaaacuauugacuuaaug

SEQ ID NO: 1121072 - RNA, 19 nt, Homo sapiens
gagcccacauccuuuauau

SEQ ID NO: 1121073 - RNA, 19 nt, Homo sapiens
guagguagugcaucuauuu

SEQ ID NO: 1121074 - RNA, 19 nt, Homo sapiens
cauccaagaucacauacuu

SEQ ID NO: 1121075 - RNA, 19 nt, Homo sapiens
uaauggugcuguuaaguau

SEQ ID NO: 1121076 - RNA, 19 nt, Homo sapiens
gaccacggauggccaaaga

SEQ ID NO: 1121077 - RNA, 19 nt, Homo sapiens
ggaacgagcccacauccuu

SEQ ID NO: 1121078 - RNA, 19 nt, Homo sapiens
ccaaggagccugucacuag

SEQ ID NO: 1121079 - RNA, 19 nt, Homo sapiens
gguauucccugcaaguuuc

SEQ ID NO: 1121080 - RNA, 19 nt, Homo sapiens
cuacauguuugccaguuaa

SEQ ID NO: 1121081 - RNA, 19 nt, Homo sapiens
gaggaaguauguggaagaa

SEQ ID NO: 1121082 - RNA, 19 nt, Homo sapiens
cauguuugccaguuaauua

SEQ ID NO: 1121083 - RNA, 19 nt, Homo sapiens
gucacuagcuaagaaauuu

SEQ ID NO: 1121084 - RNA, 19 nt, Homo sapiens
gagagcagauugcguaaaa

SEQ ID NO: 1121085 - RNA, 19 nt, Homo sapiens
ccaguuaauuagggaguua

SEQ ID NO: 1121086 - RNA, 19 nt, Homo sapiens
caucagcgagcuucuuaua

SEQ ID NO: 1121087 - RNA, 19 nt, Homo sapiens
acagggagcuagaugaaau

SEQ ID NO: 1121088 - RNA, 19 nt, Homo sapiens
aguuagcucucguaaauuu

SEQ ID NO: 1121089 - RNA, 19 nt, Homo sapiens
gagaccggauauaaugaaa

SEQ ID NO: 1121090 - RNA, 19 nt, Homo sapiens
acaaugugcccuugcaaua

SEQ ID NO: 1121091 - RNA, 19 nt, Homo sapiens
caauauaaccagcaaagau

SEQ ID NO: 1121092 - RNA, 19 nt, Homo sapiens
gcgagcuucuuauaaaugu

SEQ ID NO: 1121093 - RNA, 19 nt, Homo sapiens
ggaaaaggccaaauuaaau

SEQ ID NO: 1121094 - RNA, 19 nt, Homo sapiens
aaggauccauggagaaauu

SEQ ID NO: 1121095 - RNA, 19 nt, Homo sapiens
gaugagaaagcaaaugaug

SEQ ID NO: 1121096 - RNA, 19 nt, Homo sapiens
gguagugcaucuauuuaca

SEQ ID NO: 1121097 - RNA, 19 nt, Homo sapiens
cagcagggauuuaacaaac

SEQ ID NO: 1121098 - RNA, 19 nt, Homo sapiens
ugaaauugcuggguaccaa

SEQ ID NO: 1121099 - RNA, 19 nt, Homo sapiens
gguggccacuaccuaaauu

SEQ ID NO: 1121100 - RNA, 19 nt, Homo sapiens
uccaagaucacauacuuua

SEQ ID NO: 1121101 - RNA, 19 nt, Homo sapiens
uuagggaguuauuugguaa

SEQ ID NO: 1121102 - RNA, 19 nt, Homo sapiens
gaaauugcuggguaccaaa

SEQ ID NO: 1121103 - RNA, 19 nt, Homo sapiens
aaugugcccuugcaauauu

SEQ ID NO: 1121104 - RNA, 19 nt, Homo sapiens
ggcaucagcgagcuucuua

SEQ ID NO: 1121105 - RNA, 19 nt, Homo sapiens
gaaguguaccuccgaagau

SEQ ID NO: 1121106 - RNA, 19 nt, Homo sapiens
uuagagagguguuauacag

SEQ ID NO: 1121107 - RNA, 19 nt, Homo sapiens
ccaaggaaacuauugacuu

SEQ ID NO: 1121108 - RNA, 19 nt, Homo sapiens
gugcaucuauuuacaagag

SEQ ID NO: 1121109 - RNA, 19 nt, Homo sapiens
caaauccuauaacaacauc

SEQ ID NO: 1121110 - RNA, 19 nt, Homo sapiens
caacagucuuacacagaga

SEQ ID NO: 1121111 - RNA, 19 nt, Homo sapiens
cagcgagcuucuuauaaau

SEQ ID NO: 1121112 - RNA, 19 nt, Homo sapiens
gaaaaggccaaauuaaaug

SEQ ID NO: 1121113 - RNA, 19 nt, Homo sapiens
gcccaagagugguuuaugg

SEQ ID NO: 1121114 - RNA, 19 nt, Homo sapiens
caagaucacauacuuuaag

SEQ ID NO: 1121115 - RNA, 19 nt, Homo sapiens
guaccuaacagucuugugu

SEQ ID NO: 1121116 - RNA, 19 nt, Homo sapiens
gcggcaaucaacagucuua

SEQ ID NO: 1121117 - RNA, 19 nt, Homo sapiens
gcaaaggccaauuuuauga

SEQ ID NO: 1121118 - RNA, 19 nt, Homo sapiens
cuaacagucuugugugaca

SEQ ID NO: 1121119 - RNA, 19 nt, Homo sapiens
gaucaguuagcucucguaa

SEQ ID NO: 1121120 - RNA, 19 nt, Homo sapiens
ucagaucacuugguguuca

SEQ ID NO: 1121121 - RNA, 19 nt, Homo sapiens
guuuaucgaugauccugaa

SEQ ID NO: 1121122 - RNA, 19 nt, Homo sapiens
gcagggauuuaacaaacag

SEQ ID NO: 1121123 - RNA, 19 nt, Homo sapiens
auaacaacauccaagauca

SEQ ID NO: 1121124 - RNA, 19 nt, Homo sapiens
aaagaucaguagaugagau

SEQ ID NO: 1121125 - RNA, 19 nt, Homo sapiens
ccagguggauuuugaugua

SEQ ID NO: 1121126 - RNA, 19 nt, Homo sapiens
cuccgaagaucuguccuua

SEQ ID NO: 1121127 - RNA, 19 nt, Homo sapiens
ucgaugauccugaagugua

SEQ ID NO: 1121128 - RNA, 19 nt, Homo sapiens
guuucuggcuugccuguga

SEQ ID NO: 1121129 - RNA, 19 nt, Homo sapiens
ucuacauguuugccaguua

SEQ ID NO: 1121130 - RNA, 19 nt, Homo sapiens
gaaaagaucaguagaugag

SEQ ID NO: 1121131 - RNA, 19 nt, Homo sapiens
cugguucuguccaugaaua

SEQ ID NO: 1121132 - RNA, 19 nt, Homo sapiens
uaucgaugauccugaagug

SEQ ID NO: 1121133 - RNA, 19 nt, Homo sapiens
ugcacagcaugaucaguua

SEQ ID NO: 1121134 - RNA, 19 nt, Homo sapiens
uaagaggaaguauguggaa

SEQ ID NO: 1121135 - RNA, 19 nt, Homo sapiens
cagcaaaggaaguaaaaua

SEQ ID NO: 1121136 - RNA, 19 nt, Homo sapiens
ccaagaucacauacuuuaa

SEQ ID NO: 1121137 - RNA, 19 nt, Homo sapiens
ugucaaugcuaauguugga

SEQ ID NO: 1121138 - RNA, 19 nt, Homo sapiens
agaggaaugugaaaaguuu

SEQ ID NO: 1121139 - RNA, 19 nt, Homo sapiens
ggccaaagaggaaugugaa

SEQ ID NO: 1121140 - RNA, 19 nt, Homo sapiens
ggguauucccugcaaguuu

SEQ ID NO: 1121141 - RNA, 19 nt, Homo sapiens
agucuugugugacagauga

SEQ ID NO: 1121142 - RNA, 19 nt, Homo sapiens
caaugugcccuugcaauau

SEQ ID NO: 1121143 - RNA, 19 nt, Homo sapiens
ccggauauaaugaaagaaa

SEQ ID NO: 1121144 - RNA, 19 nt, Homo sapiens
ggaaaugaccuugcuuuug

SEQ ID NO: 1121145 - RNA, 19 nt, Homo sapiens
gaaaucuuugucacuaaug

SEQ ID NO: 1121146 - RNA, 19 nt, Homo sapiens
ugagugcaaaggccaauuu

SEQ ID NO: 1121147 - RNA, 19 nt, Homo sapiens
gugccuuacuuuuaucuua

SEQ ID NO: 1121148 - RNA, 19 nt, Homo sapiens
auggugcuguuaaguauuu

SEQ ID NO: 1121149 - RNA, 19 nt, Homo sapiens
gaaggagcugcugaaauug

SEQ ID NO: 1121150 - RNA, 19 nt, Homo sapiens
auuagggaguuauuuggua

SEQ ID NO: 1121151 - RNA, 19 nt, Homo sapiens
gaugacaccaacagagaug

SEQ ID NO: 1121152 - RNA, 19 nt, Homo sapiens
ggagagagauucccauuuc

SEQ ID NO: 1121153 - RNA, 19 nt, Homo sapiens
agaaauagcuguaauguag

SEQ ID NO: 1121154 - RNA, 19 nt, Homo sapiens
gcugaccucuguucucuua

SEQ ID NO: 1121155 - RNA, 19 nt, Homo sapiens
cagaaacgaucuacaagaa

SEQ ID NO: 1121156 - RNA, 19 nt, Homo sapiens
gcacgcagguacugugaaa

SEQ ID NO: 1121157 - RNA, 19 nt, Homo sapiens
ggacugugacucuguguua

SEQ ID NO: 1121158 - RNA, 19 nt, Homo sapiens
ugaauagccuccuggauga

SEQ ID NO: 1121159 - RNA, 19 nt, Homo sapiens
gaaacgaucuacaagaacu

SEQ ID NO: 1121160 - RNA, 19 nt, Homo sapiens
caauaaacuugaugucuag

SEQ ID NO: 1121161 - RNA, 19 nt, Homo sapiens
caaauucucuagcccuuuc

SEQ ID NO: 1121162 - RNA, 19 nt, Homo sapiens
gaaagugucccaaggucuu

SEQ ID NO: 1121163 - RNA, 19 nt, Homo sapiens
gaacuacuaccgaauccaa

SEQ ID NO: 1121164 - RNA, 19 nt, Homo sapiens
gagaaauagcuguaaugua

SEQ ID NO: 1121165 - RNA, 19 nt, Homo sapiens
ccaagugggugcaucugaa

SEQ ID NO: 1121166 - RNA, 19 nt, Homo sapiens
gaggagaaauagcuguaau

SEQ ID NO: 1121167 - RNA, 19 nt, Homo sapiens
ccaaacaccugaguaugau

SEQ ID NO: 1121168 - RNA, 19 nt, Homo sapiens
gggaggaaaugaucgagau

SEQ ID NO: 1121169 - RNA, 19 nt, Homo sapiens
caucugacccugagcauug

SEQ ID NO: 1121170 - RNA, 19 nt, Homo sapiens
guaugggaauuauugcaaa

SEQ ID NO: 1121171 - RNA, 19 nt, Homo sapiens
ggugggaggauaucaaauu

SEQ ID NO: 1121172 - RNA, 19 nt, Homo sapiens
gaggauaucaaauucucua

SEQ ID NO: 1121173 - RNA, 19 nt, Homo sapiens
gcgguugaguccucgagua

SEQ ID NO: 1121174 - RNA, 19 nt, Homo sapiens
ggagaaauagcuguaaugu

SEQ ID NO: 1121175 - RNA, 19 nt, Homo sapiens
caugggaggugggaggaua

SEQ ID NO: 1121176 - RNA, 19 nt, Homo sapiens
gaacucaacacagccauca

SEQ ID NO: 1121177 - RNA, 19 nt, Homo sapiens
guugaguccucgaguaguu

SEQ ID NO: 1121178 - RNA, 19 nt, Homo sapiens
uguguuaccuuccaacuuc

SEQ ID NO: 1121179 - RNA, 19 nt, Homo sapiens
uuacagaaacgaucuacaa

SEQ ID NO: 1121180 - RNA, 19 nt, Homo sapiens
guugaagccugagugguuu

SEQ ID NO: 1121181 - RNA, 19 nt, Homo sapiens
ggagugcgcaugcgugguu

SEQ ID NO: 1121182 - RNA, 19 nt, Homo sapiens
gggaggauaucaaauucuc

SEQ ID NO: 1121183 - RNA, 19 nt, Homo sapiens
uggauggcauggacuguuu

SEQ ID NO: 1121184 - RNA, 19 nt, Homo sapiens
ucccagagccguuaaguug

SEQ ID NO: 1121185 - RNA, 19 nt, Homo sapiens
gagagagauucccauuucu

SEQ ID NO: 1121186 - RNA, 19 nt, Homo sapiens
gccguuaaguugguucgua

SEQ ID NO: 1121187 - RNA, 19 nt, Homo sapiens
gugggaggauaucaaauuc

SEQ ID NO: 1121188 - RNA, 19 nt, Homo sapiens
gaggugggaggauaucaaa

SEQ ID NO: 1121189 - RNA, 19 nt, Homo sapiens
cccaaacaccugaguauga

SEQ ID NO: 1121190 - RNA, 19 nt, Homo sapiens
ucaaacauccggccuucaa

SEQ ID NO: 1121191 - RNA, 19 nt, Homo sapiens
caagaacuacuaccgaauc

SEQ ID NO: 1121192 - RNA, 19 nt, Homo sapiens
auagagggacugaggguua

SEQ ID NO: 1121193 - RNA, 19 nt, Homo sapiens
aaacagaaagugugaagag

SEQ ID NO: 1121194 - RNA, 19 nt, Homo sapiens
gaaaagggccgagggaguu

SEQ ID NO: 1121195 - RNA, 19 nt, Homo sapiens
gacccgcucagucucaaua

SEQ ID NO: 1121196 - RNA, 19 nt, Homo sapiens
ggaccaccaccguucgaaa

SEQ ID NO: 1121197 - RNA, 19 nt, Homo sapiens
cagagcaguucaguuccua

SEQ ID NO: 1121198 - RNA, 19 nt, Homo sapiens
cagcgcaaguuccaguaug

SEQ ID NO: 1121199 - RNA, 19 nt, Homo sapiens
ccagagccguuaaguuggu

SEQ ID NO: 1121200 - RNA, 19 nt, Homo sapiens
gaugagggccauguaguuc

SEQ ID NO: 1121201 - RNA, 19 nt, Homo sapiens
uaaacucccagagccguua

SEQ ID NO: 1121202 - RNA, 19 nt, Homo sapiens
ggaggugggaggauaucaa

SEQ ID NO: 1121203 - RNA, 19 nt, Homo sapiens
caacugcagggaugaagug

SEQ ID NO: 1121204 - RNA, 19 nt, Homo sapiens
gguaguggcggaggagaaa

SEQ ID NO: 1121205 - RNA, 19 nt, Homo sapiens
gcaaacgucgcaggacuuc

SEQ ID NO: 1121206 - RNA, 19 nt, Homo sapiens
ugagggccauguaguucuu

SEQ ID NO: 1121207 - RNA, 19 nt, Homo sapiens
aaacauccggccuucaaga

SEQ ID NO: 1121208 - RNA, 19 nt, Homo sapiens
cauuguaccuagcucuugu

SEQ ID NO: 1121209 - RNA, 19 nt, Homo sapiens
acagaaacgaucuacaaga

SEQ ID NO: 1121210 - RNA, 19 nt, Homo sapiens
gaggaaagugucccaaggu

SEQ ID NO: 1121211 - RNA, 19 nt, Homo sapiens
gcacugaugagggccaugu

SEQ ID NO: 1121212 - RNA, 19 nt, Homo sapiens
guucuugcuucgccacuca

SEQ ID NO: 1121213 - RNA, 19 nt, Homo sapiens
cucaauacuugcacugaug

SEQ ID NO: 1121214 - RNA, 19 nt, Homo sapiens
gaauucggacugugacucu

SEQ ID NO: 1121215 - RNA, 19 nt, Homo sapiens
cgucguauggcaagagaaa

SEQ ID NO: 1121216 - RNA, 19 nt, Homo sapiens
caacccuggucgucguaug

SEQ ID NO: 1121217 - RNA, 19 nt, Homo sapiens
cgucacggguaauuaugug

SEQ ID NO: 1121218 - RNA, 19 nt, Homo sapiens
gggguuggguuuucaaugu

SEQ ID NO: 1121219 - RNA, 19 nt, Homo sapiens
aaacauccgacacuaccuu

SEQ ID NO: 1121220 - RNA, 19 nt, Homo sapiens
ggaggaaaugaucgagaug

SEQ ID NO: 1121221 - RNA, 19 nt, Homo sapiens
ugaugagggccauguaguu

SEQ ID NO: 1121222 - RNA, 19 nt, Homo sapiens
ucaauacuugcacugauga

SEQ ID NO: 1121223 - RNA, 19 nt, Homo sapiens
ucucaauacuugcacugau

SEQ ID NO: 1121224 - RNA, 19 nt, Homo sapiens
cgaucuacaagaacuacua

SEQ ID NO: 1121225 - RNA, 19 nt, Homo sapiens
ggcccaaacaccugaguau

SEQ ID NO: 1121226 - RNA, 19 nt, Homo sapiens
ccagcugccucaguuaucu

SEQ ID NO: 1121227 - RNA, 19 nt, Homo sapiens
ggcgagauccgguggagau

SEQ ID NO: 1121228 - RNA, 19 nt, Homo sapiens
gugaaaauccuucccuuug

SEQ ID NO: 1121229 - RNA, 19 nt, Homo sapiens
ggaauaaggggaggaaaug

SEQ ID NO: 1121230 - RNA, 19 nt, Homo sapiens
gucccuagcugcauuucag

SEQ ID NO: 1121231 - RNA, 19 nt, Homo sapiens
gagcggacacaucagucuu

SEQ ID NO: 1121232 - RNA, 19 nt, Homo sapiens
gaccaccaccguucgaaag

SEQ ID NO: 1121233 - RNA, 19 nt, Homo sapiens
gcgcgagacuaggcgugaa

SEQ ID NO: 1121234 - RNA, 19 nt, Homo sapiens
aagaggagaaauagcugua

SEQ ID NO: 1121235 - RNA, 19 nt, Homo sapiens
aaacaccugaguaugaugu

SEQ ID NO: 1121236 - RNA, 19 nt, Homo sapiens
gccgggacguccuagaucu

SEQ ID NO: 1121237 - RNA, 19 nt, Homo sapiens
uguugaagccugagugguu

SEQ ID NO: 1121238 - RNA, 19 nt, Homo sapiens
uagagggacugaggguuag

SEQ ID NO: 1121239 - RNA, 19 nt, Homo sapiens
ggcaagaggagaaauagcu

SEQ ID NO: 1121240 - RNA, 19 nt, Homo sapiens
cuacuaccgaauccaauug

SEQ ID NO: 1121241 - RNA, 19 nt, Homo sapiens
gggccugaagcgcauguuu

SEQ ID NO: 1121242 - RNA, 19 nt, Homo sapiens
uccaguaugggaauuauug

SEQ ID NO: 1121243 - RNA, 19 nt, Homo sapiens
ugaccucuguucucuuagg

SEQ ID NO: 1121244 - RNA, 19 nt, Homo sapiens
acuguuugcugaccucugu

SEQ ID NO: 1121245 - RNA, 19 nt, Homo sapiens
auaguuuccuuucuuggau

SEQ ID NO: 1121246 - RNA, 19 nt, Homo sapiens
agccagagcaguucaguuc

SEQ ID NO: 1121247 - RNA, 19 nt, Homo sapiens
gcgggugaauucggacugu

SEQ ID NO: 1121248 - RNA, 19 nt, Homo sapiens
gggugaauucggacuguga

SEQ ID NO: 1121249 - RNA, 19 nt, Homo sapiens
cgacuggcacggaauaagg

SEQ ID NO: 1121250 - RNA, 19 nt, Homo sapiens
gugcuggagucaccaucau

SEQ ID NO: 1121251 - RNA, 19 nt, Homo sapiens
aaacgaucuacaagaacua

SEQ ID NO: 1121252 - RNA, 19 nt, Homo sapiens
gcagggaaguggaguauuu

SEQ ID NO: 1121253 - RNA, 19 nt, Homo sapiens
ggacccggcuucugaauaa

SEQ ID NO: 1121254 - RNA, 19 nt, Homo sapiens
gaugaaagcucagugaaga

SEQ ID NO: 1121255 - RNA, 19 nt, Homo sapiens
ggaagcggaugaugacaaa

SEQ ID NO: 1121256 - RNA, 19 nt, Homo sapiens
gaggagagaucaucgacaa

SEQ ID NO: 1121257 - RNA, 19 nt, Homo sapiens
ugaagaggcugaaggcaaa

SEQ ID NO: 1121258 - RNA, 19 nt, Homo sapiens
gaaggaacaugaagagcau

SEQ ID NO: 1121259 - RNA, 19 nt, Homo sapiens
ccaggaagaucaagaaagu

SEQ ID NO: 1121260 - RNA, 19 nt, Homo sapiens
gaagaugcgucggaaacaa

SEQ ID NO: 1121261 - RNA, 19 nt, Homo sapiens
gcaguuauccguguuuaaa

SEQ ID NO: 1121262 - RNA, 19 nt, Homo sapiens
gugaagugcuggccauauu

SEQ ID NO: 1121263 - RNA, 19 nt, Homo sapiens
ggauuaaguuuccagacaa

SEQ ID NO: 1121264 - RNA, 19 nt, Homo sapiens
uaauacagauguguccaua

SEQ ID NO: 1121265 - RNA, 19 nt, Homo sapiens
gcacagacaacugccauaa

SEQ ID NO: 1121266 - RNA, 19 nt, Homo sapiens
cuucaggaauuaacagaua

SEQ ID NO: 1121267 - RNA, 19 nt, Homo sapiens
aaccaagaauugcggauua

SEQ ID NO: 1121268 - RNA, 19 nt, Homo sapiens
gcacaucugcuacaucaug

SEQ ID NO: 1121269 - RNA, 19 nt, Homo sapiens
ccacaacacucuggcuauu

SEQ ID NO: 1121270 - RNA, 19 nt, Homo sapiens
ccauagcuguggucgauuu

SEQ ID NO: 1121271 - RNA, 19 nt, Homo sapiens
ccagagaaguucauggaau

SEQ ID NO: 1121272 - RNA, 19 nt, Homo sapiens
ugagaagguugacagacua

SEQ ID NO: 1121273 - RNA, 19 nt, Homo sapiens
gaaucgaugugcuucuuca

SEQ ID NO: 1121274 - RNA, 19 nt, Homo sapiens
ggaauuaacagauauagac

SEQ ID NO: 1121275 - RNA, 19 nt, Homo sapiens
cgaggaagcuccaucaaaa

SEQ ID NO: 1121276 - RNA, 19 nt, Homo sapiens
ccacugagaaggaacauga

SEQ ID NO: 1121277 - RNA, 19 nt, Homo sapiens
gaggagccauuggaugaaa

SEQ ID NO: 1121278 - RNA, 19 nt, Homo sapiens
acagacaacugccauaagu

SEQ ID NO: 1121279 - RNA, 19 nt, Homo sapiens
aauccgagcuggaccuaaa

SEQ ID NO: 1121280 - RNA, 19 nt, Homo sapiens
uuaaauaucugggugcaau

SEQ ID NO: 1121281 - RNA, 19 nt, Homo sapiens
ccauaaguuuguugacauu

SEQ ID NO: 1121282 - RNA, 19 nt, Homo sapiens
gaugauggagaaucuguuu

SEQ ID NO: 1121283 - RNA, 19 nt, Homo sapiens
cagagaaguucauggaauc

SEQ ID NO: 1121284 - RNA, 19 nt, Homo sapiens
cgauuugcuucaggaauua

SEQ ID NO: 1121285 - RNA, 19 nt, Homo sapiens
ucgauuugcuucaggaauu

SEQ ID NO: 1121286 - RNA, 19 nt, Homo sapiens
ggagagaucaucgacaaug

SEQ ID NO: 1121287 - RNA, 19 nt, Homo sapiens
gcagauggcguccacaaca

SEQ ID NO: 1121288 - RNA, 19 nt, Homo sapiens
ggagcuggauggaaucgau

SEQ ID NO: 1121289 - RNA, 19 nt, Homo sapiens
gcgaggaagcuccaucaaa

SEQ ID NO: 1121290 - RNA, 19 nt, Homo sapiens
gaagguugacagacuaaug

SEQ ID NO: 1121291 - RNA, 19 nt, Homo sapiens
cagcaguuauccguguuua

SEQ ID NO: 1121292 - RNA, 19 nt, Homo sapiens
ccauauugcuccaggacaa

SEQ ID NO: 1121293 - RNA, 19 nt, Homo sapiens
gaucugcaaugccaauguc

SEQ ID NO: 1121294 - RNA, 19 nt, Homo sapiens
gauuaaguuuccagacaau

SEQ ID NO: 1121295 - RNA, 19 nt, Homo sapiens
gggaaccacugagaaggaa

SEQ ID NO: 1121296 - RNA, 19 nt, Homo sapiens
ggccugagauguguacaga

SEQ ID NO: 1121297 - RNA, 19 nt, Homo sapiens
gcagauuauugacagagau

SEQ ID NO: 1121298 - RNA, 19 nt, Homo sapiens
ggcauaucaucaaggagua

SEQ ID NO: 1121299 - RNA, 19 nt, Homo sapiens
ucaggcauaucaucaagga

SEQ ID NO: 1121300 - RNA, 19 nt, Homo sapiens
gagcuggaccuaaaugaca

SEQ ID NO: 1121301 - RNA, 19 nt, Homo sapiens
ggacaaauuaaagcuaguu

SEQ ID NO: 1121302 - RNA, 19 nt, Homo sapiens
ccagaggguucaccagauc

SEQ ID NO: 1121303 - RNA, 19 nt, Homo sapiens
caaugcagguggcggacaa

SEQ ID NO: 1121304 - RNA, 19 nt, Homo sapiens
guccauagcuguggucgau

SEQ ID NO: 1121305 - RNA, 19 nt, Homo sapiens
cggauuaaguuuccagaca

SEQ ID NO: 1121306 - RNA, 19 nt, Homo sapiens
gugagaagguugacagacu

SEQ ID NO: 1121307 - RNA, 19 nt, Homo sapiens
gccauaaguuuguugacau

SEQ ID NO: 1121308 - RNA, 19 nt, Homo sapiens
caggaucaguuucuacaca

SEQ ID NO: 1121309 - RNA, 19 nt, Homo sapiens
gcgagggucuucagcugau

SEQ ID NO: 1121310 - RNA, 19 nt, Homo sapiens
gaauugcggauuaaguuuc

SEQ ID NO: 1121311 - RNA, 19 nt, Homo sapiens
gagaagguugacagacuaa

SEQ ID NO: 1121312 - RNA, 19 nt, Homo sapiens
gaagaggaggagcagaaga

SEQ ID NO: 1121313 - RNA, 19 nt, Homo sapiens
ggaugagucugugaaagag

SEQ ID NO: 1121314 - RNA, 19 nt, Homo sapiens
ggaagaggaggagccauug

SEQ ID NO: 1121315 - RNA, 19 nt, Homo sapiens
gggaagaggaagaggaaga

SEQ ID NO: 1121316 - RNA, 19 nt, Homo sapiens
caaggaguaugcagagaac

SEQ ID NO: 1121317 - RNA, 19 nt, Homo sapiens
ugaaagcucagugaagaaa

SEQ ID NO: 1121318 - RNA, 19 nt, Homo sapiens
ggacgugggcgaacuucug

SEQ ID NO: 1121319 - RNA, 19 nt, Homo sapiens
gagcagugcccugaaagug

SEQ ID NO: 1121320 - RNA, 19 nt, Homo sapiens
gcagguggcggacaagaag

SEQ ID NO: 1121321 - RNA, 19 nt, Homo sapiens
cagacaauccagagaaguu

SEQ ID NO: 1121322 - RNA, 19 nt, Homo sapiens
aagaauugcggauuaaguu

SEQ ID NO: 1121323 - RNA, 19 nt, Homo sapiens
gccagaggguucaccagau

SEQ ID NO: 1121324 - RNA, 19 nt, Homo sapiens
ccggagcagugcccugaaa

SEQ ID NO: 1121325 - RNA, 19 nt, Homo sapiens
ggaggaagcggaugaugac

SEQ ID NO: 1121326 - RNA, 19 nt, Homo sapiens
ucaaggaguaugcagagaa

SEQ ID NO: 1121327 - RNA, 19 nt, Homo sapiens
ugauggagaaucuguuuga

SEQ ID NO: 1121328 - RNA, 19 nt, Homo sapiens
agcaggagaugauggagaa

SEQ ID NO: 1121329 - RNA, 19 nt, Homo sapiens
gcucggacacgauaauaca

SEQ ID NO: 1121330 - RNA, 19 nt, Homo sapiens
caagaauugcggauuaagu

SEQ ID NO: 1121331 - RNA, 19 nt, Homo sapiens
ugggcgaacuucugagcua

SEQ ID NO: 1121332 - RNA, 19 nt, Homo sapiens
gauggagaaucuguuugau

SEQ ID NO: 1121333 - RNA, 19 nt, Homo sapiens
gcacugcugguacagaauc

SEQ ID NO: 1121334 - RNA, 19 nt, Homo sapiens
ggaugaaagcucagugaag

SEQ ID NO: 1121335 - RNA, 19 nt, Homo sapiens
gaagcuccaucaaaauugu

SEQ ID NO: 1121336 - RNA, 19 nt, Homo sapiens
gggaagaagaaaugacugu

SEQ ID NO: 1121337 - RNA, 19 nt, Homo sapiens
gaaccacugagaaggaaca

SEQ ID NO: 1121338 - RNA, 19 nt, Homo sapiens
ugacauucuuggcuuacga

SEQ ID NO: 1121339 - RNA, 19 nt, Homo sapiens
gcagaagaugcgucggaaa

SEQ ID NO: 1121340 - RNA, 19 nt, Homo sapiens
ccucugcuccugucuaaug

SEQ ID NO: 1121341 - RNA, 19 nt, Homo sapiens
gagugaagagggagcagaa

SEQ ID NO: 1121342 - RNA, 19 nt, Homo sapiens
ggagcugaaugcuguacag

SEQ ID NO: 1121343 - RNA, 19 nt, Homo sapiens
acaaacugguacucgagaa

SEQ ID NO: 1121344 - RNA, 19 nt, Homo sapiens
uggaugagucugugaaaga

SEQ ID NO: 1121345 - RNA, 19 nt, Homo sapiens
aggaggagccauuggauga

SEQ ID NO: 1121346 - RNA, 19 nt, Homo sapiens
cgucggaaacaaacuggua

SEQ ID NO: 1121347 - RNA, 19 nt, Homo sapiens
gaagagcaugucuguucga

SEQ ID NO: 1121348 - RNA, 19 nt, Homo sapiens
ucccucugcuccugucuaa

SEQ ID NO: 1121349 - RNA, 19 nt, Homo sapiens
ggaggagccauuggaugaa

SEQ ID NO: 1121350 - RNA, 19 nt, Homo sapiens
uggaaucgaugugcuucuu

SEQ ID NO: 1121351 - RNA, 19 nt, Homo sapiens
auacagauguguccauagc

SEQ ID NO: 1121352 - RNA, 19 nt, Homo sapiens
gaucaaagcuuaccaauaa

SEQ ID NO: 1121353 - RNA, 19 nt, Homo sapiens
gaggauagccuuucacuua

SEQ ID NO: 1121354 - RNA, 19 nt, Homo sapiens
caacgaaugucuuacaaau

SEQ ID NO: 1121355 - RNA, 19 nt, Homo sapiens
ugacacacauuuacccaua

SEQ ID NO: 1121356 - RNA, 19 nt, Homo sapiens
guucaucuauucugucuaa

SEQ ID NO: 1121357 - RNA, 19 nt, Homo sapiens
gaccuugucucuacugaaa

SEQ ID NO: 1121358 - RNA, 19 nt, Homo sapiens
gaccagauguaccgaguuu

SEQ ID NO: 1121359 - RNA, 19 nt, Homo sapiens
ggagucuucuguucucuaa

SEQ ID NO: 1121360 - RNA, 19 nt, Homo sapiens
uaaaggagauaaugugaca

SEQ ID NO: 1121361 - RNA, 19 nt, Homo sapiens
cuaauucagugcuuuguuu

SEQ ID NO: 1121362 - RNA, 19 nt, Homo sapiens
gaaaugaggaagaaugaga

SEQ ID NO: 1121363 - RNA, 19 nt, Homo sapiens
uagcauaccugcaugaaca

SEQ ID NO: 1121364 - RNA, 19 nt, Homo sapiens
ugaauaguaucaccacuga

SEQ ID NO: 1121365 - RNA, 19 nt, Homo sapiens
acucuuagcuuugucauuu

SEQ ID NO: 1121366 - RNA, 19 nt, Homo sapiens
ggauagccuuucacuuauu

SEQ ID NO: 1121367 - RNA, 19 nt, Homo sapiens
caacagugauggcucuaga

SEQ ID NO: 1121368 - RNA, 19 nt, Homo sapiens
ugaggaagaaugagaguua

SEQ ID NO: 1121369 - RNA, 19 nt, Homo sapiens
gcacacaacacuagaagau

SEQ ID NO: 1121370 - RNA, 19 nt, Homo sapiens
caucuauucugucuaauuc

SEQ ID NO: 1121371 - RNA, 19 nt, Homo sapiens
uaacaucucuggucguucu

SEQ ID NO: 1121372 - RNA, 19 nt, Homo sapiens
gcacauuguuucauaucga

SEQ ID NO: 1121373 - RNA, 19 nt, Homo sapiens
gaaacccacuaaccagaau

SEQ ID NO: 1121374 - RNA, 19 nt, Homo sapiens
caauauuucucagaggaua

SEQ ID NO: 1121375 - RNA, 19 nt, Homo sapiens
gcuaacaucucuggucguu

SEQ ID NO: 1121376 - RNA, 19 nt, Homo sapiens
ugacauacuuucuacaucu

SEQ ID NO: 1121377 - RNA, 19 nt, Homo sapiens
acacaacacuagaagaugu

SEQ ID NO: 1121378 - RNA, 19 nt, Homo sapiens
ggccaagguggguaaauua

SEQ ID NO: 1121379 - RNA, 19 nt, Homo sapiens
gagauugccauaauugcua

SEQ ID NO: 1121380 - RNA, 19 nt, Homo sapiens
gaauaaaugaaacccacua

SEQ ID NO: 1121381 - RNA, 19 nt, Homo sapiens
gauagccuuucacuuauuc

SEQ ID NO: 1121382 - RNA, 19 nt, Homo sapiens
gacacacauuuacccauaa

SEQ ID NO: 1121383 - RNA, 19 nt, Homo sapiens
gaaaauuagccagguauua

SEQ ID NO: 1121384 - RNA, 19 nt, Homo sapiens
agugauggcucuagaaugu

SEQ ID NO: 1121385 - RNA, 19 nt, Homo sapiens
ggaaaagacuguccaaagg

SEQ ID NO: 1121386 - RNA, 19 nt, Homo sapiens
gaaaccccaucuuuacuaa

SEQ ID NO: 1121387 - RNA, 19 nt, Homo sapiens
gaggaagaaugagaguuau

SEQ ID NO: 1121388 - RNA, 19 nt, Homo sapiens
gaacagauuaacguaguug

SEQ ID NO: 1121389 - RNA, 19 nt, Homo sapiens
gaggaugugucuccaagag

SEQ ID NO: 1121390 - RNA, 19 nt, Homo sapiens
uagaacagauuaacguagu

SEQ ID NO: 1121391 - RNA, 19 nt, Homo sapiens
gauaaggagagaacaugaa

SEQ ID NO: 1121392 - RNA, 19 nt, Homo sapiens
aaagaagggcuuaauguca

SEQ ID NO: 1121393 - RNA, 19 nt, Homo sapiens
cuaaggacauugugacucu

SEQ ID NO: 1121394 - RNA, 19 nt, Homo sapiens
uaucaccacugacacacaa

SEQ ID NO: 1121395 - RNA, 19 nt, Homo sapiens
ccagagagcaacagugaug

SEQ ID NO: 1121396 - RNA, 19 nt, Homo sapiens
ccagauguaccgaguuuga

SEQ ID NO: 1121397 - RNA, 19 nt, Homo sapiens
uacaaaugcugacugaaca

SEQ ID NO: 1121398 - RNA, 19 nt, Homo sapiens
guaccugacauacuuucua

SEQ ID NO: 1121399 - RNA, 19 nt, Homo sapiens
acacauuuacccauaauug

SEQ ID NO: 1121400 - RNA, 19 nt, Homo sapiens
ccuguuaccucggacauga

SEQ ID NO: 1121401 - RNA, 19 nt, Homo sapiens
cagauuaacguaguugaaa

SEQ ID NO: 1121402 - RNA, 19 nt, Homo sapiens
gacaugauacucuuagcuu

SEQ ID NO: 1121403 - RNA, 19 nt, Homo sapiens
uaauaggucuucucauagc

SEQ ID NO: 1121404 - RNA, 19 nt, Homo sapiens
auaagaaguaccugacaua

SEQ ID NO: 1121405 - RNA, 19 nt, Homo sapiens
acgaaugucuuacaaaugc

SEQ ID NO: 1121406 - RNA, 19 nt, Homo sapiens
acaugauacucuuagcuuu

SEQ ID NO: 1121407 - RNA, 19 nt, Homo sapiens
gaauaagaaguaccugaca

SEQ ID NO: 1121408 - RNA, 19 nt, Homo sapiens
uagccagguauuagaauua

SEQ ID NO: 1121409 - RNA, 19 nt, Homo sapiens
cccuucagaucaaagcuua

SEQ ID NO: 1121410 - RNA, 19 nt, Homo sapiens
aaucuauccugucagagaa

SEQ ID NO: 1121411 - RNA, 19 nt, Homo sapiens
guuuacaacgaaugucuua

SEQ ID NO: 1121412 - RNA, 19 nt, Homo sapiens
ggaagaaugagaguuaucu

SEQ ID NO: 1121413 - RNA, 19 nt, Homo sapiens
uaaucuauccugucagaga

SEQ ID NO: 1121414 - RNA, 19 nt, Homo sapiens
aggauagccuuucacuuau

SEQ ID NO: 1121415 - RNA, 19 nt, Homo sapiens
ggaagguuuugaacaauau

SEQ ID NO: 1121416 - RNA, 19 nt, Homo sapiens
gauuaacguaguugaaaug

SEQ ID NO: 1121417 - RNA, 19 nt, Homo sapiens
gaucuuguuuaucuuucug

SEQ ID NO: 1121418 - RNA, 19 nt, Homo sapiens
gaauuaucagucucucauu

SEQ ID NO: 1121419 - RNA, 19 nt, Homo sapiens
guauggaacccuucagauc

SEQ ID NO: 1121420 - RNA, 19 nt, Homo sapiens
acacacauuuacccauaau

SEQ ID NO: 1121421 - RNA, 19 nt, Homo sapiens
gcugacgacugccucaucu

SEQ ID NO: 1121422 - RNA, 19 nt, Homo sapiens
uacaacgaaugucuuacaa

SEQ ID NO: 1121423 - RNA, 19 nt, Homo sapiens
ucucauagccuuucuuugc

SEQ ID NO: 1121424 - RNA, 19 nt, Homo sapiens
caugaacaacagguaaaua

SEQ ID NO: 1121425 - RNA, 19 nt, Homo sapiens
ugacugaacacuagcauac

SEQ ID NO: 1121426 - RNA, 19 nt, Homo sapiens
ucuuacaaaugcugacuga

SEQ ID NO: 1121427 - RNA, 19 nt, Homo sapiens
caucuguaguugcggaaga

SEQ ID NO: 1121428 - RNA, 19 nt, Homo sapiens
uauggaacccuucagauca

SEQ ID NO: 1121429 - RNA, 19 nt, Homo sapiens
cauaauugagauugccaua

SEQ ID NO: 1121430 - RNA, 19 nt, Homo sapiens
gacauacuuucuacaucug

SEQ ID NO: 1121431 - RNA, 19 nt, Homo sapiens
caugauacucuuagcuuug

SEQ ID NO: 1121432 - RNA, 19 nt, Homo sapiens
ccucggacaugauacucuu

SEQ ID NO: 1121433 - RNA, 19 nt, Homo sapiens
cccagaagcccaagaggaa

SEQ ID NO: 1121434 - RNA, 19 nt, Homo sapiens
uuagccagguauuagaauu

SEQ ID NO: 1121435 - RNA, 19 nt, Homo sapiens
aauaagaaguaccugacau

SEQ ID NO: 1121436 - RNA, 19 nt, Homo sapiens
ggccaaggcaggcagauca

SEQ ID NO: 1121437 - RNA, 19 nt, Homo sapiens
uaguugaaaugaggaagaa

SEQ ID NO: 1121438 - RNA, 19 nt, Homo sapiens
gaguauggaacccuucaga

SEQ ID NO: 1121439 - RNA, 19 nt, Homo sapiens
aggccaagguggguaaauu

SEQ ID NO: 1121440 - RNA, 19 nt, Homo sapiens
cacauuuacccauaauuga

SEQ ID NO: 1121441 - RNA, 19 nt, Homo sapiens
auuaaucuauccugucaga

SEQ ID NO: 1121442 - RNA, 19 nt, Homo sapiens
ggcaacauuuggccagauc

SEQ ID NO: 1121443 - RNA, 19 nt, Homo sapiens
ugaaacccacuaaccagaa

SEQ ID NO: 1121444 - RNA, 19 nt, Homo sapiens
caguauguagaacagauua

SEQ ID NO: 1121445 - RNA, 19 nt, Homo sapiens
agaucaaagcuuaccaaua

SEQ ID NO: 1121446 - RNA, 19 nt, Homo sapiens
ggaagacauuuuaauaggu

SEQ ID NO: 1121447 - RNA, 19 nt, Homo sapiens
ccuguaaucccagcacuuu

SEQ ID NO: 1121448 - RNA, 19 nt, Homo sapiens
gaguugggcagguuguuau

SEQ ID NO: 1121449 - RNA, 19 nt, Homo sapiens
guaguugaaaugaggaaga

SEQ ID NO: 1121450 - RNA, 19 nt, Homo sapiens
gccuuucacuuauucaucu

SEQ ID NO: 1121451 - RNA, 19 nt, Homo sapiens
guugaaaugaggaagaaug

SEQ ID NO: 1121452 - RNA, 19 nt, Homo sapiens
gcauagcacuuugaaauua

SEQ ID NO: 1121453 - RNA, 19 nt, Homo sapiens
gaucuuaccuguuguuuga

SEQ ID NO: 1121454 - RNA, 19 nt, Homo sapiens
gaaauaagauuacguuugc

SEQ ID NO: 1121455 - RNA, 19 nt, Homo sapiens
gcaggaaacucuacaacaa

SEQ ID NO: 1121456 - RNA, 19 nt, Homo sapiens
ggguacagcuugucucuua

SEQ ID NO: 1121457 - RNA, 19 nt, Homo sapiens
ugacugcacugaaaucuaa

SEQ ID NO: 1121458 - RNA, 19 nt, Homo sapiens
ggauaaauguacauacuga

SEQ ID NO: 1121459 - RNA, 19 nt, Homo sapiens
uaaauuacuuggccaggua

SEQ ID NO: 1121460 - RNA, 19 nt, Homo sapiens
gcagauauuugcacaaugg

SEQ ID NO: 1121461 - RNA, 19 nt, Homo sapiens
gaugguaacuuaucaacau

SEQ ID NO: 1121462 - RNA, 19 nt, Homo sapiens
ggaggaagaugacgaugau

SEQ ID NO: 1121463 - RNA, 19 nt, Homo sapiens
gccagaagauguaggguuu

SEQ ID NO: 1121464 - RNA, 19 nt, Homo sapiens
gaucacaacauacaaauuc

SEQ ID NO: 1121465 - RNA, 19 nt, Homo sapiens
ggaguuaauggucuaauuu

SEQ ID NO: 1121466 - RNA, 19 nt, Homo sapiens
gaaagaaucugugguucag

SEQ ID NO: 1121467 - RNA, 19 nt, Homo sapiens
aaugugggaugguaacuua

SEQ ID NO: 1121468 - RNA, 19 nt, Homo sapiens
gcaggguaauuuaauguau

SEQ ID NO: 1121469 - RNA, 19 nt, Homo sapiens
ucaauucagugcaugcuuu

SEQ ID NO: 1121470 - RNA, 19 nt, Homo sapiens
gaauagaucacaacauaca

SEQ ID NO: 1121471 - RNA, 19 nt, Homo sapiens
gccagucagucucuuuaua

SEQ ID NO: 1121472 - RNA, 19 nt, Homo sapiens
cagauaaccuggaacuaau

SEQ ID NO: 1121473 - RNA, 19 nt, Homo sapiens
cuacaguucuugcaaguau

SEQ ID NO: 1121474 - RNA, 19 nt, Homo sapiens
cagguugccuuugaaauaa

SEQ ID NO: 1121475 - RNA, 19 nt, Homo sapiens
gaagaggagaauaguguuu

SEQ ID NO: 1121476 - RNA, 19 nt, Homo sapiens
gauggaaugugggauggua

SEQ ID NO: 1121477 - RNA, 19 nt, Homo sapiens
gaaauuugaugcugaucca

SEQ ID NO: 1121478 - RNA, 19 nt, Homo sapiens
agugagaguugacuauaua

SEQ ID NO: 1121479 - RNA, 19 nt, Homo sapiens
cuacaaccacgaucaauaa

SEQ ID NO: 1121480 - RNA, 19 nt, Homo sapiens
gauuguacauguuuacugu

SEQ ID NO: 1121481 - RNA, 19 nt, Homo sapiens
gaaggaaauugaaggaacu

SEQ ID NO: 1121482 - RNA, 19 nt, Homo sapiens
cagaagauguaggguuuaa

SEQ ID NO: 1121483 - RNA, 19 nt, Homo sapiens
ucagguugccuuugaaaua

SEQ ID NO: 1121484 - RNA, 19 nt, Homo sapiens
aaauggaucugccagcaaa

SEQ ID NO: 1121485 - RNA, 19 nt, Homo sapiens
gaauuugacguacaccuuu

SEQ ID NO: 1121486 - RNA, 19 nt, Homo sapiens
ggauacaguugugacauga

SEQ ID NO: 1121487 - RNA, 19 nt, Homo sapiens
gucagucucuuuauaguga

SEQ ID NO: 1121488 - RNA, 19 nt, Homo sapiens
cuaagggacuagucauauu

SEQ ID NO: 1121489 - RNA, 19 nt, Homo sapiens
guaguuaaauuuccaugca

SEQ ID NO: 1121490 - RNA, 19 nt, Homo sapiens
gugcguguguuauacagua

SEQ ID NO: 1121491 - RNA, 19 nt, Homo sapiens
ucagaaacccauccuauau

SEQ ID NO: 1121492 - RNA, 19 nt, Homo sapiens
gaagauguaggguuuaaca

SEQ ID NO: 1121493 - RNA, 19 nt, Homo sapiens
ggaaagaaucugugguuca

SEQ ID NO: 1121494 - RNA, 19 nt, Homo sapiens
uaggguaucucccacugua

SEQ ID NO: 1121495 - RNA, 19 nt, Homo sapiens
uagaaggccuggaggaaga

SEQ ID NO: 1121496 - RNA, 19 nt, Homo sapiens
gggugaagcugacacuaga

SEQ ID NO: 1121497 - RNA, 19 nt, Homo sapiens
gugcaugcuuuagguguua

SEQ ID NO: 1121498 - RNA, 19 nt, Homo sapiens
ucugaaaucuuuagcacuu

SEQ ID NO: 1121499 - RNA, 19 nt, Homo sapiens
gaaaacagaaggaaauuga

SEQ ID NO: 1121500 - RNA, 19 nt, Homo sapiens
uguuaaagcucacucaugu

SEQ ID NO: 1121501 - RNA, 19 nt, Homo sapiens
ggaaagagugcuggaauuc

SEQ ID NO: 1121502 - RNA, 19 nt, Homo sapiens
gugaaagcaugcuauggaa

SEQ ID NO: 1121503 - RNA, 19 nt, Homo sapiens
aauuauaccugaccaugaa

SEQ ID NO: 1121504 - RNA, 19 nt, Homo sapiens
agaaacccauccuauauuc

SEQ ID NO: 1121505 - RNA, 19 nt, Homo sapiens
uaagaaaugcugcuaguca

SEQ ID NO: 1121506 - RNA, 19 nt, Homo sapiens
cagcuugucucuuaucauc

SEQ ID NO: 1121507 - RNA, 19 nt, Homo sapiens
gaaagcaugcuauggaaag

SEQ ID NO: 1121508 - RNA, 19 nt, Homo sapiens
gcucauauuuacacuuaca

SEQ ID NO: 1121509 - RNA, 19 nt, Homo sapiens
gcaccgcuguucuggguau

SEQ ID NO: 1121510 - RNA, 19 nt, Homo sapiens
gaaauugaaggaacuugga

SEQ ID NO: 1121511 - RNA, 19 nt, Homo sapiens
ggcaaaagcagaacaaaua

SEQ ID NO: 1121512 - RNA, 19 nt, Homo sapiens
ucaugugacugcacugaaa

SEQ ID NO: 1121513 - RNA, 19 nt, Homo sapiens
gaccucagaucucggacaa

SEQ ID NO: 1121514 - RNA, 19 nt, Homo sapiens
ccacaaugguguugaaacu

SEQ ID NO: 1121515 - RNA, 19 nt, Homo sapiens
gucaaggacuggacguauu

SEQ ID NO: 1121516 - RNA, 19 nt, Homo sapiens
ggaaaaugacuaugcauaa

SEQ ID NO: 1121517 - RNA, 19 nt, Homo sapiens
gggcuucucaguucaauga

SEQ ID NO: 1121518 - RNA, 19 nt, Homo sapiens
gauaggauauaugauugga

SEQ ID NO: 1121519 - RNA, 19 nt, Homo sapiens
gugcagccuuuguagaauu

SEQ ID NO: 1121520 - RNA, 19 nt, Homo sapiens
guugugacaugaaaucuuc

SEQ ID NO: 1121521 - RNA, 19 nt, Homo sapiens
uaaccuggaacuaaucuuu

SEQ ID NO: 1121522 - RNA, 19 nt, Homo sapiens
ggugguccaugucaaguga

SEQ ID NO: 1121523 - RNA, 19 nt, Homo sapiens
gaaagcaaccauuguacuc

SEQ ID NO: 1121524 - RNA, 19 nt, Homo sapiens
gcucagaaacccauccuau

SEQ ID NO: 1121525 - RNA, 19 nt, Homo sapiens
gggaagaggagaauagugu

SEQ ID NO: 1121526 - RNA, 19 nt, Homo sapiens
caacugcccagcuggcuaa

SEQ ID NO: 1121527 - RNA, 19 nt, Homo sapiens
ggugaaagcaugcuaugga

SEQ ID NO: 1121528 - RNA, 19 nt, Homo sapiens
aagcauagcacuuugaaau

SEQ ID NO: 1121529 - RNA, 19 nt, Homo sapiens
cagaaacccauccuauauu

SEQ ID NO: 1121530 - RNA, 19 nt, Homo sapiens
gauuuauccugaacucaug

SEQ ID NO: 1121531 - RNA, 19 nt, Homo sapiens
gagaaugacacaggugaaa

SEQ ID NO: 1121532 - RNA, 19 nt, Homo sapiens
uggaaagagugcuggaauu

SEQ ID NO: 1121533 - RNA, 19 nt, Homo sapiens
gcacguaguucagggugau

SEQ ID NO: 1121534 - RNA, 19 nt, Homo sapiens
gauuacguuugcauuauuc

SEQ ID NO: 1121535 - RNA, 19 nt, Homo sapiens
ucaaaaugcugcaggguaa

SEQ ID NO: 1121536 - RNA, 19 nt, Homo sapiens
aaaccagccugaaggugaa

SEQ ID NO: 1121537 - RNA, 19 nt, Homo sapiens
cguggagaaugcuuaguuu

SEQ ID NO: 1121538 - RNA, 19 nt, Homo sapiens
gcaaagugagaguugacua

SEQ ID NO: 1121539 - RNA, 19 nt, Homo sapiens
ucaaggacuggacguauuu

SEQ ID NO: 1121540 - RNA, 19 nt, Homo sapiens
auaaguaccucaaaugcau

SEQ ID NO: 1121541 - RNA, 19 nt, Homo sapiens
caaagugagaguugacuau

SEQ ID NO: 1121542 - RNA, 19 nt, Homo sapiens
gcuuggagauauccuuaau

SEQ ID NO: 1121543 - RNA, 19 nt, Homo sapiens
gugggagacucaucuacaa

SEQ ID NO: 1121544 - RNA, 19 nt, Homo sapiens
guagaggaguaucaguuca

SEQ ID NO: 1121545 - RNA, 19 nt, Homo sapiens
gaaaaucuacuggggauaa

SEQ ID NO: 1121546 - RNA, 19 nt, Homo sapiens
auacaguugugacaugaaa

SEQ ID NO: 1121547 - RNA, 19 nt, Homo sapiens
gacuaucggugguccaugu

SEQ ID NO: 1121548 - RNA, 19 nt, Homo sapiens
gcugcaggguaauuuaaug

SEQ ID NO: 1121549 - RNA, 19 nt, Homo sapiens
cuucucagguugccuuuga

SEQ ID NO: 1121550 - RNA, 19 nt, Homo sapiens
gcuaagggacuagucauau

SEQ ID NO: 1121551 - RNA, 19 nt, Homo sapiens
aaugagcuuugcacaguuu

SEQ ID NO: 1121552 - RNA, 19 nt, Homo sapiens
gaaaucagaugccuaugua

SEQ ID NO: 1121553 - RNA, 19 nt, Homo sapiens
ggacaacucuucaauuuag

SEQ ID NO: 1121554 - RNA, 19 nt, Homo sapiens
ggaacuaacucaacuucua

SEQ ID NO: 1121555 - RNA, 19 nt, Homo sapiens
ggaggaagccgaucugaua

SEQ ID NO: 1121556 - RNA, 19 nt, Homo sapiens
ccagacaccuguuugauaa

SEQ ID NO: 1121557 - RNA, 19 nt, Homo sapiens
gaacuuggguauuauagau

SEQ ID NO: 1121558 - RNA, 19 nt, Homo sapiens
ugagaaagcucuugaaaca

SEQ ID NO: 1121559 - RNA, 19 nt, Homo sapiens
guacuaguguuguaacuuu

SEQ ID NO: 1121560 - RNA, 19 nt, Homo sapiens
gaacauagaacuuggguau

SEQ ID NO: 1121561 - RNA, 19 nt, Homo sapiens
ugaagugucuugucaguaa

SEQ ID NO: 1121562 - RNA, 19 nt, Homo sapiens
acauagaacuuggguauua

SEQ ID NO: 1121563 - RNA, 19 nt, Homo sapiens
gaaaucaaaugcuaagagu

SEQ ID NO: 1121564 - RNA, 19 nt, Homo sapiens
guaaaggugucccuaaaga

SEQ ID NO: 1121565 - RNA, 19 nt, Homo sapiens
cagcaaagaugguugaaga

SEQ ID NO: 1121566 - RNA, 19 nt, Homo sapiens
caaacaagcuagcuauuag

SEQ ID NO: 1121567 - RNA, 19 nt, Homo sapiens
gaugauggguauucuacua

SEQ ID NO: 1121568 - RNA, 19 nt, Homo sapiens
gcaaugaauuuaucuccaa

SEQ ID NO: 1121569 - RNA, 19 nt, Homo sapiens
gaacuaacucaacuucuaa

SEQ ID NO: 1121570 - RNA, 19 nt, Homo sapiens
caaagaugguugaagauug

SEQ ID NO: 1121571 - RNA, 19 nt, Homo sapiens
gacuugaguuguuggauua

SEQ ID NO: 1121572 - RNA, 19 nt, Homo sapiens
uaagagaucugcaccuuca

SEQ ID NO: 1121573 - RNA, 19 nt, Homo sapiens
gaaaguaacaaccaugcua

SEQ ID NO: 1121574 - RNA, 19 nt, Homo sapiens
uggcaaauauggacgaaua

SEQ ID NO: 1121575 - RNA, 19 nt, Homo sapiens
gaaagucauuagauggaaa

SEQ ID NO: 1121576 - RNA, 19 nt, Homo sapiens
ccagagacaugaauggaaa

SEQ ID NO: 1121577 - RNA, 19 nt, Homo sapiens
guaauguucucaaaggaaa

SEQ ID NO: 1121578 - RNA, 19 nt, Homo sapiens
ccuaaaggcuuaugacuuc

SEQ ID NO: 1121579 - RNA, 19 nt, Homo sapiens
uaacugaaaucucacuguu

SEQ ID NO: 1121580 - RNA, 19 nt, Homo sapiens
gauuaacacucauaacuag

SEQ ID NO: 1121581 - RNA, 19 nt, Homo sapiens
uuaagucccuuccguaauu

SEQ ID NO: 1121582 - RNA, 19 nt, Homo sapiens
gcuaagaguuguugaagca

SEQ ID NO: 1121583 - RNA, 19 nt, Homo sapiens
caggaaagcucuucauugg

SEQ ID NO: 1121584 - RNA, 19 nt, Homo sapiens
gcuaaacaacuacggaaua

SEQ ID NO: 1121585 - RNA, 19 nt, Homo sapiens
uaucauaacuacccaagga

SEQ ID NO: 1121586 - RNA, 19 nt, Homo sapiens
guagagauguuuauuuguc

SEQ ID NO: 1121587 - RNA, 19 nt, Homo sapiens
gaaagcucuugaaacagua

SEQ ID NO: 1121588 - RNA, 19 nt, Homo sapiens
gucaguaagugaaacauuu

SEQ ID NO: 1121589 - RNA, 19 nt, Homo sapiens
uaaaggaacagcuugauug

SEQ ID NO: 1121590 - RNA, 19 nt, Homo sapiens
ugaaagagguagacaugga

SEQ ID NO: 1121591 - RNA, 19 nt, Homo sapiens
caaggguaaugaccaaauu

SEQ ID NO: 1121592 - RNA, 19 nt, Homo sapiens
cuacagagauucauaugag

SEQ ID NO: 1121593 - RNA, 19 nt, Homo sapiens
gcauccagauugcgcagua

SEQ ID NO: 1121594 - RNA, 19 nt, Homo sapiens
gcaaagaugguugaagauu

SEQ ID NO: 1121595 - RNA, 19 nt, Homo sapiens
ggaaagucauuagauggaa

SEQ ID NO: 1121596 - RNA, 19 nt, Homo sapiens
aaacaacuacggaauacua

SEQ ID NO: 1121597 - RNA, 19 nt, Homo sapiens
uauagcagcucacgugaug

SEQ ID NO: 1121598 - RNA, 19 nt, Homo sapiens
aaagacagcuauucaagca

SEQ ID NO: 1121599 - RNA, 19 nt, Homo sapiens
ucacagaccacaaggguaa

SEQ ID NO: 1121600 - RNA, 19 nt, Homo sapiens
ggagguuccuacagagauu

SEQ ID NO: 1121601 - RNA, 19 nt, Homo sapiens
agaaagcucuugaaacagu

SEQ ID NO: 1121602 - RNA, 19 nt, Homo sapiens
caaagcaaggaguauguua

SEQ ID NO: 1121603 - RNA, 19 nt, Homo sapiens
ccacaaggguaaugaccaa

SEQ ID NO: 1121604 - RNA, 19 nt, Homo sapiens
acaaacaagcuagcuauua

SEQ ID NO: 1121605 - RNA, 19 nt, Homo sapiens
guuaagccuuguaguacua

SEQ ID NO: 1121606 - RNA, 19 nt, Homo sapiens
gagauucauaugagaguua

SEQ ID NO: 1121607 - RNA, 19 nt, Homo sapiens
gauuauacuuaccgugauu

SEQ ID NO: 1121608 - RNA, 19 nt, Homo sapiens
gaaguacucuugauaaaag

SEQ ID NO: 1121609 - RNA, 19 nt, Homo sapiens
agugacaucuggaaaguaa

SEQ ID NO: 1121610 - RNA, 19 nt, Homo sapiens
ggggacaacucuucaauuu

SEQ ID NO: 1121611 - RNA, 19 nt, Homo sapiens
aaagaugguugaagauugu

SEQ ID NO: 1121612 - RNA, 19 nt, Homo sapiens
ccaacuuccuaaaggcuua

SEQ ID NO: 1121613 - RNA, 19 nt, Homo sapiens
ggaacagcuugauugcaaa

SEQ ID NO: 1121614 - RNA, 19 nt, Homo sapiens
gcucuuacucuuucaaauu

SEQ ID NO: 1121615 - RNA, 19 nt, Homo sapiens
gcaagcaauucuaagaucu

SEQ ID NO: 1121616 - RNA, 19 nt, Homo sapiens
ucaagaggcuauggcgaua

SEQ ID NO: 1121617 - RNA, 19 nt, Homo sapiens
agacaugaauggaaaguca

SEQ ID NO: 1121618 - RNA, 19 nt, Homo sapiens
gcauuccacaucagauuua

SEQ ID NO: 1121619 - RNA, 19 nt, Homo sapiens
caaaggugcuugcucuuac

SEQ ID NO: 1121620 - RNA, 19 nt, Homo sapiens
uaugguaacucacguagug

SEQ ID NO: 1121621 - RNA, 19 nt, Homo sapiens
ucguagagauguuuauuug

SEQ ID NO: 1121622 - RNA, 19 nt, Homo sapiens
gggacaacucuucaauuua

SEQ ID NO: 1121623 - RNA, 19 nt, Homo sapiens
gggaaguaauuaaggaaau

SEQ ID NO: 1121624 - RNA, 19 nt, Homo sapiens
gcagaaggcggcugauugu

SEQ ID NO: 1121625 - RNA, 19 nt, Homo sapiens
caucagauuuaaagcauca

SEQ ID NO: 1121626 - RNA, 19 nt, Homo sapiens
guaaaugaggcaagcaauu

SEQ ID NO: 1121627 - RNA, 19 nt, Homo sapiens
gaagcagucgcuaugauga

SEQ ID NO: 1121628 - RNA, 19 nt, Homo sapiens
aagcagagauuacccaagu

SEQ ID NO: 1121629 - RNA, 19 nt, Homo sapiens
gaacaagccaccaaaccau

SEQ ID NO: 1121630 - RNA, 19 nt, Homo sapiens
uggaaguacucuugauaaa

SEQ ID NO: 1121631 - RNA, 19 nt, Homo sapiens
guaauugaccaaauggaaa

SEQ ID NO: 1121632 - RNA, 19 nt, Homo sapiens
caaaacaucuagccaucua

SEQ ID NO: 1121633 - RNA, 19 nt, Homo sapiens
caaaugagaaagcucuuga

SEQ ID NO: 1121634 - RNA, 19 nt, Homo sapiens
ggaaacaaaugagaaagcu

SEQ ID NO: 1121635 - RNA, 19 nt, Homo sapiens
gacaccuguuugauaaaua

SEQ ID NO: 1121636 - RNA, 19 nt, Homo sapiens
gguaaugaccaaauuuaug

SEQ ID NO: 1121637 - RNA, 19 nt, Homo sapiens
guagauaacgcuggcagua

SEQ ID NO: 1121638 - RNA, 19 nt, Homo sapiens
cgauagagauggauauggu

SEQ ID NO: 1121639 - RNA, 19 nt, Homo sapiens
gauauagaguuuguaccaa

SEQ ID NO: 1121640 - RNA, 19 nt, Homo sapiens
uuauggcacugucauguuu

SEQ ID NO: 1121641 - RNA, 19 nt, Homo sapiens
gaaacaauugggccacuug

SEQ ID NO: 1121642 - RNA, 19 nt, Homo sapiens
gaaaaggggaaguaauuaa

SEQ ID NO: 1121643 - RNA, 19 nt, Homo sapiens
gcaguaagagaaaucaaau

SEQ ID NO: 1121644 - RNA, 19 nt, Homo sapiens
gcugauugauucacaguag

SEQ ID NO: 1121645 - RNA, 19 nt, Homo sapiens
guggagugcugauugauuc

SEQ ID NO: 1121646 - RNA, 19 nt, Homo sapiens
aggaacagcuugauugcaa

SEQ ID NO: 1121647 - RNA, 19 nt, Homo sapiens
caaguaaaggugucccuaa

SEQ ID NO: 1121648 - RNA, 19 nt, Homo sapiens
agacuugaguuguuggauu

SEQ ID NO: 1121649 - RNA, 19 nt, Homo sapiens
ggaaacaauugggccacuu

SEQ ID NO: 1121650 - RNA, 19 nt, Homo sapiens
cagcucacgugauggauau

SEQ ID NO: 1121651 - RNA, 19 nt, Homo sapiens
ggaagcagucgcuaugaug

SEQ ID NO: 1121652 - RNA, 19 nt, Homo sapiens
gaacaagugugcagaugua

SEQ ID NO: 1121653 - RNA, 19 nt, Homo sapiens
gaaauacccucccaacaaa

SEQ ID NO: 1121654 - RNA, 19 nt, Homo sapiens
gaagaagacuguuauugaa

SEQ ID NO: 1121655 - RNA, 19 nt, Homo sapiens
aagaauagcuacacacuaa

SEQ ID NO: 1121656 - RNA, 19 nt, Homo sapiens
gggaugaccugaagaagaa

SEQ ID NO: 1121657 - RNA, 19 nt, Homo sapiens
gaacuuugaacauucguua

SEQ ID NO: 1121658 - RNA, 19 nt, Homo sapiens
gcacgaacuuugaacauuc

SEQ ID NO: 1121659 - RNA, 19 nt, Homo sapiens
gaaagggacgcuuauaaga

SEQ ID NO: 1121660 - RNA, 19 nt, Homo sapiens
gagaaagggacgcuuauaa

SEQ ID NO: 1121661 - RNA, 19 nt, Homo sapiens
ggauguugcuguaaaguau

SEQ ID NO: 1121662 - RNA, 19 nt, Homo sapiens
gaguucagcugugacguua

SEQ ID NO: 1121663 - RNA, 19 nt, Homo sapiens
cgaaauacccucccaacaa

SEQ ID NO: 1121664 - RNA, 19 nt, Homo sapiens
ugauuaagguguucacauu

SEQ ID NO: 1121665 - RNA, 19 nt, Homo sapiens
ggacucccauuuccaguau

SEQ ID NO: 1121666 - RNA, 19 nt, Homo sapiens
guuaugggcucuacauugu

SEQ ID NO: 1121667 - RNA, 19 nt, Homo sapiens
cugcaacuauuuagcuuua

SEQ ID NO: 1121668 - RNA, 19 nt, Homo sapiens
gaaggagaggcacauaauu

SEQ ID NO: 1121669 - RNA, 19 nt, Homo sapiens
agaagaagacuguuauuga

SEQ ID NO: 1121670 - RNA, 19 nt, Homo sapiens
ggaaggagaggcacauaau

SEQ ID NO: 1121671 - RNA, 19 nt, Homo sapiens
gaaaacauccuuuaacuuc

SEQ ID NO: 1121672 - RNA, 19 nt, Homo sapiens
gaucugggaugaccugaag

SEQ ID NO: 1121673 - RNA, 19 nt, Homo sapiens
gaaaauggauuccgagucu

SEQ ID NO: 1121674 - RNA, 19 nt, Homo sapiens
gaagaagaagacuguuauu

SEQ ID NO: 1121675 - RNA, 19 nt, Homo sapiens
cuauaacacugauccacua

SEQ ID NO: 1121676 - RNA, 19 nt, Homo sapiens
gcacacuuauuuguaaugu

SEQ ID NO: 1121677 - RNA, 19 nt, Homo sapiens
gcagauuccgucguucuua

SEQ ID NO: 1121678 - RNA, 19 nt, Homo sapiens
gauuucagauugcaaacau

SEQ ID NO: 1121679 - RNA, 19 nt, Homo sapiens
guagggaacagcagaguga

SEQ ID NO: 1121680 - RNA, 19 nt, Homo sapiens
aaagagagaaucaucauca

SEQ ID NO: 1121681 - RNA, 19 nt, Homo sapiens
gugguugucugcuuuccua

SEQ ID NO: 1121682 - RNA, 19 nt, Homo sapiens
gacggcagcuacuacaaau

SEQ ID NO: 1121683 - RNA, 19 nt, Homo sapiens
cuauuuagcuuuaguuggu

SEQ ID NO: 1121684 - RNA, 19 nt, Homo sapiens
aaggagaggcacauaauuu

SEQ ID NO: 1121685 - RNA, 19 nt, Homo sapiens
uuauuucgcugcaacuauu

SEQ ID NO: 1121686 - RNA, 19 nt, Homo sapiens
cuaauucucuguggauguu

SEQ ID NO: 1121687 - RNA, 19 nt, Homo sapiens
gccaauauuuacugcauca

SEQ ID NO: 1121688 - RNA, 19 nt, Homo sapiens
aagggacgcuuauaagaau

SEQ ID NO: 1121689 - RNA, 19 nt, Homo sapiens
aaagggacgcuuauaagaa

SEQ ID NO: 1121690 - RNA, 19 nt, Homo sapiens
ggaguuggccauguugaaa

SEQ ID NO: 1121691 - RNA, 19 nt, Homo sapiens
gcagagugaugcacgaacu

SEQ ID NO: 1121692 - RNA, 19 nt, Homo sapiens
ccaguuuccuuccaaaaua

SEQ ID NO: 1121693 - RNA, 19 nt, Homo sapiens
ugaagaagaagacuguuau

SEQ ID NO: 1121694 - RNA, 19 nt, Homo sapiens
gggaaggagaggcacauaa

SEQ ID NO: 1121695 - RNA, 19 nt, Homo sapiens
uagcuacacacuaacauuu

SEQ ID NO: 1121696 - RNA, 19 nt, Homo sapiens
gaauagcuacacacuaaca

SEQ ID NO: 1121697 - RNA, 19 nt, Homo sapiens
caaacgccgucauugcaau

SEQ ID NO: 1121698 - RNA, 19 nt, Homo sapiens
gaucucaagcagccaauau

SEQ ID NO: 1121699 - RNA, 19 nt, Homo sapiens
uaacacugauccacuaaaa

SEQ ID NO: 1121700 - RNA, 19 nt, Homo sapiens
ucagauugcaaacauguaa

SEQ ID NO: 1121701 - RNA, 19 nt, Homo sapiens
acucccauuuccaguauua

SEQ ID NO: 1121702 - RNA, 19 nt, Homo sapiens
auacgugguugucugcuuu

SEQ ID NO: 1121703 - RNA, 19 nt, Homo sapiens
gcgaagaggaucucaagca

SEQ ID NO: 1121704 - RNA, 19 nt, Homo sapiens
gguuaugggcucuacauug

SEQ ID NO: 1121705 - RNA, 19 nt, Homo sapiens
caucaaggcaccguaggua

SEQ ID NO: 1121706 - RNA, 19 nt, Homo sapiens
cgagaaagggacgcuuaua

SEQ ID NO: 1121707 - RNA, 19 nt, Homo sapiens
uaagaauagcuacacacua

SEQ ID NO: 1121708 - RNA, 19 nt, Homo sapiens
ggacgcuuauaagaauauu

SEQ ID NO: 1121709 - RNA, 19 nt, Homo sapiens
ugaaccuccugccguguaa

SEQ ID NO: 1121710 - RNA, 19 nt, Homo sapiens
ugaaccuccugccguguaa

SEQ ID NO: 1121711 - RNA, 19 nt, Homo sapiens
uggccauguugaaauguua

SEQ ID NO: 1121712 - RNA, 19 nt, Homo sapiens
uaaauucccguuaaacucu

SEQ ID NO: 1121713 - RNA, 19 nt, Homo sapiens
gacgaguucagguuuguuu

SEQ ID NO: 1121714 - RNA, 19 nt, Homo sapiens
ccaacaaaguaaugaucug

SEQ ID NO: 1121715 - RNA, 19 nt, Homo sapiens
ucucaagcagccaauauuu

SEQ ID NO: 1121716 - RNA, 19 nt, Homo sapiens
cugaagaagaagacuguua

SEQ ID NO: 1121717 - RNA, 19 nt, Homo sapiens
gcuguaaaguaugcauguu

SEQ ID NO: 1121718 - RNA, 19 nt, Homo sapiens
gugaacaagugugcagaug

SEQ ID NO: 1121719 - RNA, 19 nt, Homo sapiens
caagugugcagauguaagu

SEQ ID NO: 1121720 - RNA, 19 nt, Homo sapiens
aagagagaaucaucaucaa

SEQ ID NO: 1121721 - RNA, 19 nt, Homo sapiens
cagccaauauuuacugcau

SEQ ID NO: 1121722 - RNA, 19 nt, Homo sapiens
ucaagcagccaauauuuac

SEQ ID NO: 1121723 - RNA, 19 nt, Homo sapiens
cucaagcagccaauauuua

SEQ ID NO: 1121724 - RNA, 19 nt, Homo sapiens
gucaaacugcggcgagaua

SEQ ID NO: 1121725 - RNA, 19 nt, Homo sapiens
uaugggcucuacauuguca

SEQ ID NO: 1121726 - RNA, 19 nt, Homo sapiens
gggaaaacauccuuuaacu

SEQ ID NO: 1121727 - RNA, 19 nt, Homo sapiens
gcaacugcauccgagaaag

SEQ ID NO: 1121728 - RNA, 19 nt, Homo sapiens
ggaacaagaauugcaacug

SEQ ID NO: 1121729 - RNA, 19 nt, Homo sapiens
gauagaauuguggugguuu

SEQ ID NO: 1121730 - RNA, 19 nt, Homo sapiens
gcggcgagauagaauugug

SEQ ID NO: 1121731 - RNA, 19 nt, Homo sapiens
aaacugcggcgagauagaa

SEQ ID NO: 1121732 - RNA, 19 nt, Homo sapiens
ucagcuacuugggauauau

SEQ ID NO: 1121733 - RNA, 19 nt, Homo sapiens
gcagacaccaggccacucu

SEQ ID NO: 1121734 - RNA, 19 nt, Homo sapiens
ccagcagcuugccuuagaa

SEQ ID NO: 1121735 - RNA, 19 nt, Homo sapiens
cggcagcuacuacaaauuc

SEQ ID NO: 1121736 - RNA, 19 nt, Homo sapiens
agaaagggacgcuuauaag

SEQ ID NO: 1121737 - RNA, 19 nt, Homo sapiens
cagcuacuugggauauaua

SEQ ID NO: 1121738 - RNA, 19 nt, Homo sapiens
cugguuacauuuuggauua

SEQ ID NO: 1121739 - RNA, 19 nt, Homo sapiens
accagcagcuugccuuaga

SEQ ID NO: 1121740 - RNA, 19 nt, Homo sapiens
caugauaagcagauugaau

SEQ ID NO: 1121741 - RNA, 19 nt, Homo sapiens
gcagacggcagcuacuaca

SEQ ID NO: 1121742 - RNA, 19 nt, Homo sapiens
gagccaaacgccgucauug

SEQ ID NO: 1121743 - RNA, 19 nt, Homo sapiens
gugcauuugugccuuugga

SEQ ID NO: 1121744 - RNA, 19 nt, Homo sapiens
caaaauacuucaguuccaa

SEQ ID NO: 1121745 - RNA, 19 nt, Homo sapiens
guuccuuucauguguauuu

SEQ ID NO: 1121746 - RNA, 19 nt, Homo sapiens
aggaggaguuggccauguu

SEQ ID NO: 1121747 - RNA, 19 nt, Homo sapiens
gguggacgaguucagguuu

SEQ ID NO: 1121748 - RNA, 19 nt, Homo sapiens
agacggcagcuacuacaaa

SEQ ID NO: 1121749 - RNA, 19 nt, Homo sapiens
gccaaacgccgucauugca

SEQ ID NO: 1121750 - RNA, 19 nt, Homo sapiens
gcagggaacaagaauugca

SEQ ID NO: 1121751 - RNA, 19 nt, Homo sapiens
aagaagaagacuguuauug

SEQ ID NO: 1121752 - RNA, 19 nt, Homo sapiens
ggaauuccaucugggauua

SEQ ID NO: 1121753 - RNA, 19 nt, Homo sapiens
guggagaacuaaacaauuu

SEQ ID NO: 1121754 - RNA, 19 nt, Homo sapiens
gagacacgguggagaacua

SEQ ID NO: 1121755 - RNA, 19 nt, Homo sapiens
ggaugggacuccuggaauu

SEQ ID NO: 1121756 - RNA, 19 nt, Homo sapiens
gaaguucacaauugucuuu

SEQ ID NO: 1121757 - RNA, 19 nt, Homo sapiens
aaaagaagcuucaggguaa

SEQ ID NO: 1121758 - RNA, 19 nt, Homo sapiens
caacaacaaugcuggaagu

SEQ ID NO: 1121759 - RNA, 19 nt, Homo sapiens
aaacaugugucgugggauu

SEQ ID NO: 1121760 - RNA, 19 nt, Homo sapiens
gcaaccagacucuuucaaa

SEQ ID NO: 1121761 - RNA, 19 nt, Homo sapiens
ggauuuagucaucugaaua

SEQ ID NO: 1121762 - RNA, 19 nt, Homo sapiens
caucugggauuauggaaau

SEQ ID NO: 1121763 - RNA, 19 nt, Homo sapiens
uggccaauguugacaauaa

SEQ ID NO: 1121764 - RNA, 19 nt, Homo sapiens
ugaauaugcugugcagaaa

SEQ ID NO: 1121765 - RNA, 19 nt, Homo sapiens
aauaugggcuccagugguu

SEQ ID NO: 1121766 - RNA, 19 nt, Homo sapiens
gucgugggauuccaacaua

SEQ ID NO: 1121767 - RNA, 19 nt, Homo sapiens
uuaaagccacuauggauuu

SEQ ID NO: 1121768 - RNA, 19 nt, Homo sapiens
gaagucaugcccuccauuc

SEQ ID NO: 1121769 - RNA, 19 nt, Homo sapiens
caaccagacucuuucaaaa

SEQ ID NO: 1121770 - RNA, 19 nt, Homo sapiens
ccaagggccugauguacuc

SEQ ID NO: 1121771 - RNA, 19 nt, Homo sapiens
gaagugggcagcagucagu

SEQ ID NO: 1121772 - RNA, 19 nt, Homo sapiens
auacauggcugaggagaug

SEQ ID NO: 1121773 - RNA, 19 nt, Homo sapiens
cagugagugucaacaauga

SEQ ID NO: 1121774 - RNA, 19 nt, Homo sapiens
gugaagacaagaugaaguu

SEQ ID NO: 1121775 - RNA, 19 nt, Homo sapiens
ucgaugaccugagcaaguu

SEQ ID NO: 1121776 - RNA, 19 nt, Homo sapiens
ugucaacaaugaacacaau

SEQ ID NO: 1121777 - RNA, 19 nt, Homo sapiens
ccaugucauucugaaauuu

SEQ ID NO: 1121778 - RNA, 19 nt, Homo sapiens
ucaaugaugacaacaacaa

SEQ ID NO: 1121779 - RNA, 19 nt, Homo sapiens
gucaugcccuccauucaau

SEQ ID NO: 1121780 - RNA, 19 nt, Homo sapiens
gguggagaacuaaacaauu

SEQ ID NO: 1121781 - RNA, 19 nt, Homo sapiens
caaaagaagacaugcauug

SEQ ID NO: 1121782 - RNA, 19 nt, Homo sapiens
ugucuuugcuggacuucuu

SEQ ID NO: 1121783 - RNA, 19 nt, Homo sapiens
aaagaagacaugcauugug

SEQ ID NO: 1121784 - RNA, 19 nt, Homo sapiens
ggaagucaugcccuccauu

SEQ ID NO: 1121785 - RNA, 19 nt, Homo sapiens
ugcccuagcuaacuauaau

SEQ ID NO: 1121786 - RNA, 19 nt, Homo sapiens
gucagugagugucaacaau

SEQ ID NO: 1121787 - RNA, 19 nt, Homo sapiens
cugaauaugcugugcagaa

SEQ ID NO: 1121788 - RNA, 19 nt, Homo sapiens
guggagacacgguggagaa

SEQ ID NO: 1121789 - RNA, 19 nt, Homo sapiens
ccacugcuuucgugaagac

SEQ ID NO: 1121790 - RNA, 19 nt, Homo sapiens
ucagugagugucaacaaug

SEQ ID NO: 1121791 - RNA, 19 nt, Homo sapiens
cgaccaguguacuauggau

SEQ ID NO: 1121792 - RNA, 19 nt, Homo sapiens
ucagucaacccaaacaaag

SEQ ID NO: 1121793 - RNA, 19 nt, Homo sapiens
uaccaugucauucugaaau

SEQ ID NO: 1121794 - RNA, 19 nt, Homo sapiens
gcccuagcuaacuauaaua

SEQ ID NO: 1121795 - RNA, 19 nt, Homo sapiens
cuccugcccuagcuaacua

SEQ ID NO: 1121796 - RNA, 19 nt, Homo sapiens
guccacugcuuucgugaag

SEQ ID NO: 1121797 - RNA, 19 nt, Homo sapiens
uguacucagucaacccaaa

SEQ ID NO: 1121798 - RNA, 19 nt, Homo sapiens
ggauuauggaaauggcuuu

SEQ ID NO: 1121799 - RNA, 19 nt, Homo sapiens
acaauguggccaauguuga

SEQ ID NO: 1121800 - RNA, 19 nt, Homo sapiens
accaugucauucugaaauu

SEQ ID NO: 1121801 - RNA, 19 nt, Homo sapiens
uuagucaucugaauaugcu

SEQ ID NO: 1121802 - RNA, 19 nt, Homo sapiens
uggauuuagucaucugaau

SEQ ID NO: 1121803 - RNA, 19 nt, Homo sapiens
uauggauuguggacauuuc

SEQ ID NO: 1121804 - RNA, 19 nt, Homo sapiens
gaugggacuccuggaauuc

SEQ ID NO: 1121805 - RNA, 19 nt, Homo sapiens
ggccaauguugacaauaac

SEQ ID NO: 1121806 - RNA, 19 nt, Homo sapiens
ucaacaaugaacacaaugu

SEQ ID NO: 1121807 - RNA, 19 nt, Homo sapiens
gacaacaacaaugcuggaa

SEQ ID NO: 1121808 - RNA, 19 nt, Homo sapiens
ccaguguacuauggauugu

SEQ ID NO: 1121809 - RNA, 19 nt, Homo sapiens
gaccaguguacuauggauu

SEQ ID NO: 1121810 - RNA, 19 nt, Homo sapiens
guucacaauugucuuugcu

SEQ ID NO: 1121811 - RNA, 19 nt, Homo sapiens
uuuaaagccacuauggauu

SEQ ID NO: 1121812 - RNA, 19 nt, Homo sapiens
cacgaccaguguacuaugg

SEQ ID NO: 1121813 - RNA, 19 nt, Homo sapiens
uggcugaggagaugcaaga

SEQ ID NO: 1121814 - RNA, 19 nt, Homo sapiens
gcacaaaaugaacaaggaa

SEQ ID NO: 1121815 - RNA, 19 nt, Homo sapiens
gaacaacuaucccaaagug

SEQ ID NO: 1121816 - RNA, 19 nt, Homo sapiens
gaagaaagauagagauaag

SEQ ID NO: 1121817 - RNA, 19 nt, Homo sapiens
gcaaguggcuggagaaaca

SEQ ID NO: 1121818 - RNA, 19 nt, Homo sapiens
gaccugagcugcccauuga

SEQ ID NO: 1121819 - RNA, 19 nt, Homo sapiens
gaaggucuaugucuacuga

SEQ ID NO: 1121820 - RNA, 19 nt, Homo sapiens
ggaaugauccagcuuauug

SEQ ID NO: 1121821 - RNA, 19 nt, Homo sapiens
gaacgaagaauuucccauu

SEQ ID NO: 1121822 - RNA, 19 nt, Homo sapiens
gauagacucucacucaaga

SEQ ID NO: 1121823 - RNA, 19 nt, Homo sapiens
gaaacagcguuggaugaua

SEQ ID NO: 1121824 - RNA, 19 nt, Homo sapiens
gagcaaauaugccucuuca

SEQ ID NO: 1121825 - RNA, 19 nt, Homo sapiens
gggaauuucugacauuuga

SEQ ID NO: 1121826 - RNA, 19 nt, Homo sapiens
gcaaauaugccucuucaug

SEQ ID NO: 1121827 - RNA, 19 nt, Homo sapiens
gagauaaggagaaggauaa

SEQ ID NO: 1121828 - RNA, 19 nt, Homo sapiens
gcaagaggcuuaauaucca

SEQ ID NO: 1121829 - RNA, 19 nt, Homo sapiens
aaagcaagaugaagaugua

SEQ ID NO: 1121830 - RNA, 19 nt, Homo sapiens
ggagacauguucagguuug

SEQ ID NO: 1121831 - RNA, 19 nt, Homo sapiens
gaagaaaguucaagaucag

SEQ ID NO: 1121832 - RNA, 19 nt, Homo sapiens
ggaagaagacacagaagaa

SEQ ID NO: 1121833 - RNA, 19 nt, Homo sapiens
ggagaaaggugguaaagcu

SEQ ID NO: 1121834 - RNA, 19 nt, Homo sapiens
ggaaggagcagcagaugaa

SEQ ID NO: 1121835 - RNA, 19 nt, Homo sapiens
gauagagaacgaagaauuu

SEQ ID NO: 1121836 - RNA, 19 nt, Homo sapiens
gcagauagacucucacuca

SEQ ID NO: 1121837 - RNA, 19 nt, Homo sapiens
gcaacuaugacucguauaa

SEQ ID NO: 1121838 - RNA, 19 nt, Homo sapiens
aagcauggauuuagguaua

SEQ ID NO: 1121839 - RNA, 19 nt, Homo sapiens
caaauaaagagcaguauga

SEQ ID NO: 1121840 - RNA, 19 nt, Homo sapiens
ggauaaaacuggaaaagaa

SEQ ID NO: 1121841 - RNA, 19 nt, Homo sapiens
cuaagaaggucuaugucua

SEQ ID NO: 1121842 - RNA, 19 nt, Homo sapiens
gaacaagcacaacauaugu

SEQ ID NO: 1121843 - RNA, 19 nt, Homo sapiens
gaagaaagaugaaaacuac

SEQ ID NO: 1121844 - RNA, 19 nt, Homo sapiens
gaggagaggauacgaauga

SEQ ID NO: 1121845 - RNA, 19 nt, Homo sapiens
gaaguuguuucgcuguuga

SEQ ID NO: 1121846 - RNA, 19 nt, Homo sapiens
gaauggaaaccaagagaaa

SEQ ID NO: 1121847 - RNA, 19 nt, Homo sapiens
aaaccaagaugccauggaa

SEQ ID NO: 1121848 - RNA, 19 nt, Homo sapiens
acauggagauggaggaaua

SEQ ID NO: 1121849 - RNA, 19 nt, Homo sapiens
gaugaugaguuaauguaug

SEQ ID NO: 1121850 - RNA, 19 nt, Homo sapiens
ggagaggauucaagccaaa

SEQ ID NO: 1121851 - RNA, 19 nt, Homo sapiens
agacuaaacucaauacagu

SEQ ID NO: 1121852 - RNA, 19 nt, Homo sapiens
uuccagagauguaacaaua

SEQ ID NO: 1121853 - RNA, 19 nt, Homo sapiens
ggaaggccaucgccaagga

SEQ ID NO: 1121854 - RNA, 19 nt, Homo sapiens
gaaaggugguaaagcugaa

SEQ ID NO: 1121855 - RNA, 19 nt, Homo sapiens
uaagaaagguacagaaggu

SEQ ID NO: 1121856 - RNA, 19 nt, Homo sapiens
ggucacaccuucaguccuu

SEQ ID NO: 1121857 - RNA, 19 nt, Homo sapiens
agaagaaaguucaagauca

SEQ ID NO: 1121858 - RNA, 19 nt, Homo sapiens
gaagaagacacagaagaaa

SEQ ID NO: 1121859 - RNA, 19 nt, Homo sapiens
gggcaaaucccaagaggaa

SEQ ID NO: 1121860 - RNA, 19 nt, Homo sapiens
guacacccaucauuugguu

SEQ ID NO: 1121861 - RNA, 19 nt, Homo sapiens
uaugauggaugcuuuguau

SEQ ID NO: 1121862 - RNA, 19 nt, Homo sapiens
aaauaugccucuucauguu

SEQ ID NO: 1121863 - RNA, 19 nt, Homo sapiens
aaacagcguuggaugauag

SEQ ID NO: 1121864 - RNA, 19 nt, Homo sapiens
agacagacuuauagaggua

SEQ ID NO: 1121865 - RNA, 19 nt, Homo sapiens
gggaguuucuucuuaugaa

SEQ ID NO: 1121866 - RNA, 19 nt, Homo sapiens
gugauaagacugauagaaa

SEQ ID NO: 1121867 - RNA, 19 nt, Homo sapiens
ccagggaauuucugacauu

SEQ ID NO: 1121868 - RNA, 19 nt, Homo sapiens
gauggcgaccuucgaaaua

SEQ ID NO: 1121869 - RNA, 19 nt, Homo sapiens
gagcugccaucgacaaauc

SEQ ID NO: 1121870 - RNA, 19 nt, Homo sapiens
gaggaaugauccagcuuau

SEQ ID NO: 1121871 - RNA, 19 nt, Homo sapiens
cagaauguauuuaguacga

SEQ ID NO: 1121872 - RNA, 19 nt, Homo sapiens
ugguaaagcugaacaugaa

SEQ ID NO: 1121873 - RNA, 19 nt, Homo sapiens
ggagaaggauaaaaugaaa

SEQ ID NO: 1121874 - RNA, 19 nt, Homo sapiens
gguagaugaugaugaugaa

SEQ ID NO: 1121875 - RNA, 19 nt, Homo sapiens
gaugauagagaacgaagaa

SEQ ID NO: 1121876 - RNA, 19 nt, Homo sapiens
caaauaugccucuucaugu

SEQ ID NO: 1121877 - RNA, 19 nt, Homo sapiens
gaucgucggcggaccuaua

SEQ ID NO: 1121878 - RNA, 19 nt, Homo sapiens
gaucaacuccuagcaauca

SEQ ID NO: 1121879 - RNA, 19 nt, Homo sapiens
gagaagggcauaugaugga

SEQ ID NO: 1121880 - RNA, 19 nt, Homo sapiens
uggcugugaugaugaguua

SEQ ID NO: 1121881 - RNA, 19 nt, Homo sapiens
gagcgugacuaugcugaaa

SEQ ID NO: 1121882 - RNA, 19 nt, Homo sapiens
gaaaagaugacaagauuga

SEQ ID NO: 1121883 - RNA, 19 nt, Homo sapiens
ggccaaggcugcaaucagu

SEQ ID NO: 1121884 - RNA, 19 nt, Homo sapiens
gcaaggagaauaagcaagu

SEQ ID NO: 1121885 - RNA, 19 nt, Homo sapiens
cagcaucacuuccagagau

SEQ ID NO: 1121886 - RNA, 19 nt, Homo sapiens
ccagagauauuugguagug

SEQ ID NO: 1121887 - RNA, 19 nt, Homo sapiens
cagcaacuaugacucguau

SEQ ID NO: 1121888 - RNA, 19 nt, Homo sapiens
acaaaugaauggaaaccaa

SEQ ID NO: 1121889 - RNA, 19 nt, Homo sapiens
ggauuuggacgucagagua

SEQ ID NO: 1121890 - RNA, 19 nt, Homo sapiens
gaaaugcugcccucaguag

SEQ ID NO: 1121891 - RNA, 19 nt, Homo sapiens
uggcucagcuccaaucuau

SEQ ID NO: 1121892 - RNA, 19 nt, Homo sapiens
guacagaagguuugggauu

SEQ ID NO: 1121893 - RNA, 19 nt, Homo sapiens
gaggaauacuagaccuuga

SEQ ID NO: 1121894 - RNA, 19 nt, Homo sapiens
gcaagaugaagauguagaa

SEQ ID NO: 1121895 - RNA, 19 nt, Homo sapiens
gcaagaauuucagcaagca

SEQ ID NO: 1121896 - RNA, 19 nt, Homo sapiens
agagacaaaugaauggaaa

SEQ ID NO: 1121897 - RNA, 19 nt, Homo sapiens
gugcaucgcuuggaacaug

SEQ ID NO: 1121898 - RNA, 19 nt, Homo sapiens
gaaagcagaagaugaggau

SEQ ID NO: 1121899 - RNA, 19 nt, Homo sapiens
gaaagguacagaagguuug

SEQ ID NO: 1121900 - RNA, 19 nt, Homo sapiens
uagcaaucaugaucggaua

SEQ ID NO: 1121901 - RNA, 19 nt, Homo sapiens
aguaacagaucaacuccua

SEQ ID NO: 1121902 - RNA, 19 nt, Homo sapiens
gaagaggagaggauacgaa

SEQ ID NO: 1121903 - RNA, 19 nt, Homo sapiens
ugacgagacuaaacucaau

SEQ ID NO: 1121904 - RNA, 19 nt, Homo sapiens
ggaaguuguuucgcuguug

SEQ ID NO: 1121905 - RNA, 19 nt, Homo sapiens
gugagaagaacaauuacua

SEQ ID NO: 1121906 - RNA, 19 nt, Homo sapiens
gagaaaacggguaaaauaa

SEQ ID NO: 1121907 - RNA, 19 nt, Homo sapiens
gcauggagaccuuggaaga

SEQ ID NO: 1121908 - RNA, 19 nt, Homo sapiens
caacaaugucucagccuuu

SEQ ID NO: 1121909 - RNA, 19 nt, Homo sapiens
gcaaauaaagagcaguaug

SEQ ID NO: 1121910 - RNA, 19 nt, Homo sapiens
gaauccauguagugccuuu

SEQ ID NO: 1121911 - RNA, 19 nt, Homo sapiens
cagaucaacuccuagcaau

SEQ ID NO: 1121912 - RNA, 19 nt, Homo sapiens
ggagauggaggaauacuag

SEQ ID NO: 1121913 - RNA, 19 nt, Homo sapiens
gcgugacuaugcugaaauu

SEQ ID NO: 1121914 - RNA, 19 nt, Homo sapiens
cgauaaagacagacuggua

SEQ ID NO: 1121915 - RNA, 19 nt, Homo sapiens
caacacugccuuugaauua

SEQ ID NO: 1121916 - RNA, 19 nt, Homo sapiens
ccagaaauguguuuguauu

SEQ ID NO: 1121917 - RNA, 19 nt, Homo sapiens
acacugagcuuucuucuag

SEQ ID NO: 1121918 - RNA, 19 nt, Homo sapiens
guauaaggcuguccucuca

SEQ ID NO: 1121919 - RNA, 19 nt, Homo sapiens
gaaauguguuuguauugug

SEQ ID NO: 1121920 - RNA, 19 nt, Homo sapiens
gggcaaggcugcuguuauc

SEQ ID NO: 1121921 - RNA, 19 nt, Homo sapiens
ccacaaggcaucugcauga

SEQ ID NO: 1121922 - RNA, 19 nt, Homo sapiens
gaagggccgucuaucaauc

SEQ ID NO: 1121923 - RNA, 19 nt, Homo sapiens
gcugaucucuguuucuguu

SEQ ID NO: 1121924 - RNA, 19 nt, Homo sapiens
gaagaagaagcaauuacuu

SEQ ID NO: 1121925 - RNA, 19 nt, Homo sapiens
caaucaauguguaaaccua

SEQ ID NO: 1121926 - RNA, 19 nt, Homo sapiens
auacaacacugccuuugaa

SEQ ID NO: 1121927 - RNA, 19 nt, Homo sapiens
cauccagucuuuauauguu

SEQ ID NO: 1121928 - RNA, 19 nt, Homo sapiens
gauaucauccagucuuuau

SEQ ID NO: 1121929 - RNA, 19 nt, Homo sapiens
gagcugaucucuguuucug

SEQ ID NO: 1121930 - RNA, 19 nt, Homo sapiens
cagcuuggucuuugucuua

SEQ ID NO: 1121931 - RNA, 19 nt, Homo sapiens
caggagagcugggugguau

SEQ ID NO: 1121932 - RNA, 19 nt, Homo sapiens
gagaacagcccacauugca

SEQ ID NO: 1121933 - RNA, 19 nt, Homo sapiens
uuacugggacuauuaauga

SEQ ID NO: 1121934 - RNA, 19 nt, Homo sapiens
gaggaagggccgucuauca

SEQ ID NO: 1121935 - RNA, 19 nt, Homo sapiens
acacugccuuugaauuaaa

SEQ ID NO: 1121936 - RNA, 19 nt, Homo sapiens
gcauuaagaccuuguaaac

SEQ ID NO: 1121937 - RNA, 19 nt, Homo sapiens
ugagacaaccacacuauga

SEQ ID NO: 1121938 - RNA, 19 nt, Homo sapiens
ccuauuacugggacuauua

SEQ ID NO: 1121939 - RNA, 19 nt, Homo sapiens
ggaagggccgucuaucaau

SEQ ID NO: 1121940 - RNA, 19 nt, Homo sapiens
ucagagcucaugcgcguua

SEQ ID NO: 1121941 - RNA, 19 nt, Homo sapiens
ggagagcugggugguauaa

SEQ ID NO: 1121942 - RNA, 19 nt, Homo sapiens
caaggcugcuguuaucauc

SEQ ID NO: 1121943 - RNA, 19 nt, Homo sapiens
gaccagcccaucauucuga

SEQ ID NO: 1121944 - RNA, 19 nt, Homo sapiens
gaggggaucccauuuauuu

SEQ ID NO: 1121945 - RNA, 19 nt, Homo sapiens
gguggcagcuuggucuuug

SEQ ID NO: 1121946 - RNA, 19 nt, Homo sapiens
gaccaaacacugagcuuuc

SEQ ID NO: 1121947 - RNA, 19 nt, Homo sapiens
cauagcaacugaagaacag

SEQ ID NO: 1121948 - RNA, 19 nt, Homo sapiens
ggccgucuaucaaucaaug

SEQ ID NO: 1121949 - RNA, 19 nt, Homo sapiens
gcagaggggaucccauuua

SEQ ID NO: 1121950 - RNA, 19 nt, Homo sapiens
cagcccacauugcagcuaa

SEQ ID NO: 1121951 - RNA, 19 nt, Homo sapiens
cugggacuauuaaugauuu

SEQ ID NO: 1121952 - RNA, 19 nt, Homo sapiens
ggauguggccucagaagca

SEQ ID NO: 1121953 - RNA, 19 nt, Homo sapiens
gugagaagguuggagaaca

SEQ ID NO: 1121954 - RNA, 19 nt, Homo sapiens
gcugagacaaccacacuau

SEQ ID NO: 1121955 - RNA, 19 nt, Homo sapiens
cauacaacacugccuuuga

SEQ ID NO: 1121956 - RNA, 19 nt, Homo sapiens
gagagaccagcccaucauu

SEQ ID NO: 1121957 - RNA, 19 nt, Homo sapiens
cagaaauguguuuguauug

SEQ ID NO: 1121958 - RNA, 19 nt, Homo sapiens
caacugaagaacaggaugu

SEQ ID NO: 1121959 - RNA, 19 nt, Homo sapiens
gcagcuuggucuuugucuu

SEQ ID NO: 1121960 - RNA, 19 nt, Homo sapiens
gagaccagcccaucauucu

SEQ ID NO: 1121961 - RNA, 19 nt, Homo sapiens
aauccagaauccagaaaug

SEQ ID NO: 1121962 - RNA, 19 nt, Homo sapiens
gucuaucaaucaaugugua

SEQ ID NO: 1121963 - RNA, 19 nt, Homo sapiens
gcaaggcugcuguuaucau

SEQ ID NO: 1121964 - RNA, 19 nt, Homo sapiens
gaauccagaauccagaaau

SEQ ID NO: 1121965 - RNA, 19 nt, Homo sapiens
guuaucacaugcaaguauc

SEQ ID NO: 1121966 - RNA, 19 nt, Homo sapiens
ccacgaagugacaguguga

SEQ ID NO: 1121967 - RNA, 19 nt, Homo sapiens
cucauuguguguaauagaa

SEQ ID NO: 1121968 - RNA, 19 nt, Homo sapiens
ggaauccagaauccagaaa

SEQ ID NO: 1121969 - RNA, 19 nt, Homo sapiens
gcaguuccacgaagugaca

SEQ ID NO: 1121970 - RNA, 19 nt, Homo sapiens
gcaggagagcuggguggua

SEQ ID NO: 1121971 - RNA, 19 nt, Homo sapiens
aacacugccuuugaauuaa

SEQ ID NO: 1121972 - RNA, 19 nt, Homo sapiens
ugagaagguuggagaacag

SEQ ID NO: 1121973 - RNA, 19 nt, Homo sapiens
aacaggauguggccucaga

SEQ ID NO: 1121974 - RNA, 19 nt, Homo sapiens
gcuguuaucacaugcaagu

SEQ ID NO: 1121975 - RNA, 19 nt, Homo sapiens
uauaccucauuguguguaa

SEQ ID NO: 1121976 - RNA, 19 nt, Homo sapiens
ucaagcuggugcuguguag

SEQ ID NO: 1121977 - RNA, 19 nt, Homo sapiens
ccuggacuguagauaaaga

SEQ ID NO: 1121978 - RNA, 19 nt, Homo sapiens
ccuccacccuugagucugu

SEQ ID NO: 1121979 - RNA, 19 nt, Homo sapiens
caaacacugagcuuucuuc

SEQ ID NO: 1121980 - RNA, 19 nt, Homo sapiens
ugaagaagaagcaauuacu

SEQ ID NO: 1121981 - RNA, 19 nt, Homo sapiens
gcuguuaucaucucauuuu

SEQ ID NO: 1121982 - RNA, 19 nt, Homo sapiens
ggagaacagcccacauugc

SEQ ID NO: 1121983 - RNA, 19 nt, Homo sapiens
uguccuaauuguaaugugu

SEQ ID NO: 1121984 - RNA, 19 nt, Homo sapiens
uaaaagagcagaagaucau

SEQ ID NO: 1121985 - RNA, 19 nt, Homo sapiens
cugcaugagugacuuuaag

SEQ ID NO: 1121986 - RNA, 19 nt, Homo sapiens
cugcuguuaucaucucauu

SEQ ID NO: 1121987 - RNA, 19 nt, Homo sapiens
gagacaaccacacuaugag

SEQ ID NO: 1121988 - RNA, 19 nt, Homo sapiens
auccagaaauguguuugua

SEQ ID NO: 1121989 - RNA, 19 nt, Homo sapiens
ccagaauccagaaaugugu

SEQ ID NO: 1121990 - RNA, 19 nt, Homo sapiens
cagaggggaucccauuuau

SEQ ID NO: 1121991 - RNA, 19 nt, Homo sapiens
agacaaccacacuaugaga

SEQ ID NO: 1121992 - RNA, 19 nt, Homo sapiens
gcuuggucuuugucuuaaa

SEQ ID NO: 1121993 - RNA, 19 nt, Homo sapiens
acaacacugccuuugaauu

SEQ ID NO: 1121994 - RNA, 19 nt, Homo sapiens
ucagaaccuuguggcaguu

SEQ ID NO: 1121995 - RNA, 19 nt, Homo sapiens
uaccucauuguguguaaua

SEQ ID NO: 1121996 - RNA, 19 nt, Homo sapiens
agcaauuacuucauagcaa

SEQ ID NO: 1121997 - RNA, 19 nt, Homo sapiens
gggaauccagaauccagaa

SEQ ID NO: 1121998 - RNA, 19 nt, Homo sapiens
aggaagggccgucuaucaa

SEQ ID NO: 1121999 - RNA, 19 nt, Homo sapiens
cuugggaagucauacaaca

SEQ ID NO: 1122000 - RNA, 19 nt, Homo sapiens
ccacauugcagcuaaaaga

SEQ ID NO: 1122001 - RNA, 19 nt, Homo sapiens
gucuuuauauguugccaau

SEQ ID NO: 1122002 - RNA, 19 nt, Homo sapiens
ugauaucauccagucuuua

SEQ ID NO: 1122003 - RNA, 19 nt, Homo sapiens
ugucuuaaaguuucugguu

SEQ ID NO: 1122004 - RNA, 19 nt, Homo sapiens
agaccaaacacugagcuuu

SEQ ID NO: 1122005 - RNA, 19 nt, Homo sapiens
gcaucugcaugagugacuu

SEQ ID NO: 1122006 - RNA, 19 nt, Homo sapiens
auaaggcuguccucucaag

SEQ ID NO: 1122007 - RNA, 19 nt, Homo sapiens
ucacgcuggugcugagaca

SEQ ID NO: 1122008 - RNA, 19 nt, Homo sapiens
cuauuacugggacuauuaa

SEQ ID NO: 1122009 - RNA, 19 nt, Homo sapiens
uucauugccuccuccaaga

SEQ ID NO: 1122010 - RNA, 19 nt, Homo sapiens
cauuaagaccuuguaaaca

SEQ ID NO: 1122011 - RNA, 19 nt, Homo sapiens
uagcauuaagaccuuguaa

SEQ ID NO: 1122012 - RNA, 19 nt, Homo sapiens
gaucucuguuucuguuuug

SEQ ID NO: 1122013 - RNA, 19 nt, Homo sapiens
cacuguugcuguuaucaca

SEQ ID NO: 1122014 - RNA, 19 nt, Homo sapiens
agagcugggugguauaagg

SEQ ID NO: 1122015 - RNA, 19 nt, Homo sapiens
gaucaaugguuaccuguuc

SEQ ID NO: 1122016 - RNA, 19 nt, Homo sapiens
cguacacgcucaucaacua

SEQ ID NO: 1122017 - RNA, 19 nt, Homo sapiens
ucggagggaucaaugguua

SEQ ID NO: 1122018 - RNA, 19 nt, Homo sapiens
ggacuacgccuacgucaca

SEQ ID NO: 1122019 - RNA, 19 nt, Homo sapiens
aagcaguuguuucuguuua

SEQ ID NO: 1122020 - RNA, 19 nt, Homo sapiens
ggacuggguuuccugucuu

SEQ ID NO: 1122021 - RNA, 19 nt, Homo sapiens
gaagcaaaccaaagugugu

SEQ ID NO: 1122022 - RNA, 19 nt, Homo sapiens
ucaccaacauugccuacuu

SEQ ID NO: 1122023 - RNA, 19 nt, Homo sapiens
gacuggguuuccugucuua

SEQ ID NO: 1122024 - RNA, 19 nt, Homo sapiens
ugaagcaguuguuucuguu

SEQ ID NO: 1122025 - RNA, 19 nt, Homo sapiens
ggguggcgcucaagaagga

SEQ ID NO: 1122026 - RNA, 19 nt, Homo sapiens
ggaagcugcuggccuuguc

SEQ ID NO: 1122027 - RNA, 19 nt, Homo sapiens
gcgccguccucaucaugua

SEQ ID NO: 1122028 - RNA, 19 nt, Homo sapiens
gaagcaguuguuucuguuu

SEQ ID NO: 1122029 - RNA, 19 nt, Homo sapiens
ggccacagccgucaucaug

SEQ ID NO: 1122030 - RNA, 19 nt, Homo sapiens
ccugcuagcucuuccugaa

SEQ ID NO: 1122031 - RNA, 19 nt, Homo sapiens
ccacagacaagcccucgaa

SEQ ID NO: 1122032 - RNA, 19 nt, Homo sapiens
gagaagcaaaccaaagugu

SEQ ID NO: 1122033 - RNA, 19 nt, Homo sapiens
aaagauacgacucucagaa

SEQ ID NO: 1122034 - RNA, 19 nt, Homo sapiens
ucacagaguccaugacaca

SEQ ID NO: 1122035 - RNA, 19 nt, Homo sapiens
uaaggaagcccuaaaaugu

SEQ ID NO: 1122036 - RNA, 19 nt, Homo sapiens
ccaugaccuucuccaacua

SEQ ID NO: 1122037 - RNA, 19 nt, Homo sapiens
cugaaaaggccuauaaaua

SEQ ID NO: 1122038 - RNA, 19 nt, Homo sapiens
gcaguuguuucuguuuaca

SEQ ID NO: 1122039 - RNA, 19 nt, Homo sapiens
ccucgaagccacaaugaga

SEQ ID NO: 1122040 - RNA, 19 nt, Homo sapiens
ucaacuauguguccuucau

SEQ ID NO: 1122041 - RNA, 19 nt, Homo sapiens
ggcgucaucaucauccuua

SEQ ID NO: 1122042 - RNA, 19 nt, Homo sapiens
cugaagcaguuguuucugu

SEQ ID NO: 1122043 - RNA, 19 nt, Homo sapiens
gaagcugcugggcuacuuu

SEQ ID NO: 1122044 - RNA, 19 nt, Homo sapiens
caccaacauugccuacuuc

SEQ ID NO: 1122045 - RNA, 19 nt, Homo sapiens
gcacuccacaggcccauca

SEQ ID NO: 1122046 - RNA, 19 nt, Homo sapiens
augguuaccuguucaccua

SEQ ID NO: 1122047 - RNA, 19 nt, Homo sapiens
ggagaagcaaaccaaagug

SEQ ID NO: 1122048 - RNA, 19 nt, Homo sapiens
ggucuucagcuucaucuca

SEQ ID NO: 1122049 - RNA, 19 nt, Homo sapiens
gaucuuccaaggacacuuc

SEQ ID NO: 1122050 - RNA, 19 nt, Homo sapiens
ccacagccgucaucaugcu

SEQ ID NO: 1122051 - RNA, 19 nt, Homo sapiens
guccauggccugccugaug

SEQ ID NO: 1122052 - RNA, 19 nt, Homo sapiens
gaacuuccucaacuauguc

SEQ ID NO: 1122053 - RNA, 19 nt, Homo sapiens
gccaggagcuguguuucgu

SEQ ID NO: 1122054 - RNA, 19 nt, Homo sapiens
guacacguucaccaacauu

SEQ ID NO: 1122055 - RNA, 19 nt, Homo sapiens
ccgaagaggaggagaaugg

SEQ ID NO: 1122056 - RNA, 19 nt, Homo sapiens
ucaccgaggagaugguuga

SEQ ID NO: 1122057 - RNA, 19 nt, Homo sapiens
gcgcauccaggacauguuc

SEQ ID NO: 1122058 - RNA, 19 nt, Homo sapiens
acacgcucaucaacuaugu

SEQ ID NO: 1122059 - RNA, 19 nt, Homo sapiens
acacguacacgcucaucaa

SEQ ID NO: 1122060 - RNA, 19 nt, Homo sapiens
gcgugggccuucuccagau

SEQ ID NO: 1122061 - RNA, 19 nt, Homo sapiens
gccugaugcuccugacaug

SEQ ID NO: 1122062 - RNA, 19 nt, Homo sapiens
gcucgggcaucuucaucuc

SEQ ID NO: 1122063 - RNA, 19 nt, Homo sapiens
ggagcgccguccucaucau

SEQ ID NO: 1122064 - RNA, 19 nt, Homo sapiens
guacacgcucaucaacuau

SEQ ID NO: 1122065 - RNA, 19 nt, Homo sapiens
guguacacguucaccaaca

SEQ ID NO: 1122066 - RNA, 19 nt, Homo sapiens
gccuuugcuuucuggauga

SEQ ID NO: 1122067 - RNA, 19 nt, Homo sapiens
ucagaagccuguuuuaagg

SEQ ID NO: 1122068 - RNA, 19 nt, Homo sapiens
gagcgccguccucaucaug

SEQ ID NO: 1122069 - RNA, 19 nt, Homo sapiens
agaagcugcugggcuacuu

SEQ ID NO: 1122070 - RNA, 19 nt, Homo sapiens
uccaugaccuucuccaacu

SEQ ID NO: 1122071 - RNA, 19 nt, Homo sapiens
uggagaagcaaaccaaagu

SEQ ID NO: 1122072 - RNA, 19 nt, Homo sapiens
ggaucaaugguuaccuguu

SEQ ID NO: 1122073 - RNA, 19 nt, Homo sapiens
ggccuugucccucaucauc

SEQ ID NO: 1122074 - RNA, 19 nt, Homo sapiens
caucggcucgggcaucuuc

SEQ ID NO: 1122075 - RNA, 19 nt, Homo sapiens
gaagccacaaugagauuuu

SEQ ID NO: 1122076 - RNA, 19 nt, Homo sapiens
cgaagccacaaugagauuu

SEQ ID NO: 1122077 - RNA, 19 nt, Homo sapiens
caacuauguguccuucauc

SEQ ID NO: 1122078 - RNA, 19 nt, Homo sapiens
ccacgcgcauccaggacau

SEQ ID NO: 1122079 - RNA, 19 nt, Homo sapiens
gagaggaggucuaccauuu

SEQ ID NO: 1122080 - RNA, 19 nt, Homo sapiens
gaaccacaaugaucagaau

SEQ ID NO: 1122081 - RNA, 19 nt, Homo sapiens
uaacaucgcuaucacucuu

SEQ ID NO: 1122082 - RNA, 19 nt, Homo sapiens
aggcagggaugcuagauua

SEQ ID NO: 1122083 - RNA, 19 nt, Homo sapiens
ggucaugccucacacuuca

SEQ ID NO: 1122084 - RNA, 19 nt, Homo sapiens
gaagaggauucuagagucu

SEQ ID NO: 1122085 - RNA, 19 nt, Homo sapiens
ggacuugcccuucauguuc

SEQ ID NO: 1122086 - RNA, 19 nt, Homo sapiens
ggugcagugucauguauuu

SEQ ID NO: 1122087 - RNA, 19 nt, Homo sapiens
ggacugcaccugugacguu

SEQ ID NO: 1122088 - RNA, 19 nt, Homo sapiens
guauuucacucgaggauuc

SEQ ID NO: 1122089 - RNA, 19 nt, Homo sapiens
acacuucacaucagaauuu

SEQ ID NO: 1122090 - RNA, 19 nt, Homo sapiens
ggagcacccuuuguccuuu

SEQ ID NO: 1122091 - RNA, 19 nt, Homo sapiens
uagcagcccucuaugacaa

SEQ ID NO: 1122092 - RNA, 19 nt, Homo sapiens
gaaaaugaccugucuguuc

SEQ ID NO: 1122093 - RNA, 19 nt, Homo sapiens
ggagaccucugccuaugca

SEQ ID NO: 1122094 - RNA, 19 nt, Homo sapiens
gaaacacaguauuacacau

SEQ ID NO: 1122095 - RNA, 19 nt, Homo sapiens
ggaaacacaguauuacaca

SEQ ID NO: 1122096 - RNA, 19 nt, Homo sapiens
ggucuccucugauaaacga

SEQ ID NO: 1122097 - RNA, 19 nt, Homo sapiens
ggagacggcgcugcacaua

SEQ ID NO: 1122098 - RNA, 19 nt, Homo sapiens
aaucuuggacugaaccuua

SEQ ID NO: 1122099 - RNA, 19 nt, Homo sapiens
gcaccugcaugcacacaca

SEQ ID NO: 1122100 - RNA, 19 nt, Homo sapiens
cuuguggucuccucugaua

SEQ ID NO: 1122101 - RNA, 19 nt, Homo sapiens
gagcacccuuuguccuuug

SEQ ID NO: 1122102 - RNA, 19 nt, Homo sapiens
ccacacugcucaugcucaa

SEQ ID NO: 1122103 - RNA, 19 nt, Homo sapiens
gcacacacaccaccucaca

SEQ ID NO: 1122104 - RNA, 19 nt, Homo sapiens
cagggaugcuagauuaaug

SEQ ID NO: 1122105 - RNA, 19 nt, Homo sapiens
uacaggagauaaacucaga

SEQ ID NO: 1122106 - RNA, 19 nt, Homo sapiens
guucagcauugucaacuuc

SEQ ID NO: 1122107 - RNA, 19 nt, Homo sapiens
caacuacgacguggacuug

SEQ ID NO: 1122108 - RNA, 19 nt, Homo sapiens
ugagacacgugaagauauc

SEQ ID NO: 1122109 - RNA, 19 nt, Homo sapiens
ccugggaaacacaguauua

SEQ ID NO: 1122110 - RNA, 19 nt, Homo sapiens
ggagaggaggucuaccauu

SEQ ID NO: 1122111 - RNA, 19 nt, Homo sapiens
uuggagaccuaaugcguuu

SEQ ID NO: 1122112 - RNA, 19 nt, Homo sapiens
guuggugccucucgcuauu

SEQ ID NO: 1122113 - RNA, 19 nt, Homo sapiens
uacaugaucugcuuuacca

SEQ ID NO: 1122114 - RNA, 19 nt, Homo sapiens
gcacugcacaucgcuguug

SEQ ID NO: 1122115 - RNA, 19 nt, Homo sapiens
agacagaacaaucccuaaa

SEQ ID NO: 1122116 - RNA, 19 nt, Homo sapiens
ugggagauccuucgucaaa

SEQ ID NO: 1122117 - RNA, 19 nt, Homo sapiens
gacguggacuugcccuuca

SEQ ID NO: 1122118 - RNA, 19 nt, Homo sapiens
cauccuggcugccuuguac

SEQ ID NO: 1122119 - RNA, 19 nt, Homo sapiens
gcacuguucaccaccuuug

SEQ ID NO: 1122120 - RNA, 19 nt, Homo sapiens
uaugagacacgugaagaua

SEQ ID NO: 1122121 - RNA, 19 nt, Homo sapiens
aaugaccugucuguucuua

SEQ ID NO: 1122122 - RNA, 19 nt, Homo sapiens
gcagggaugcuagauuaau

SEQ ID NO: 1122123 - RNA, 19 nt, Homo sapiens
ccucacacuucacaucaga

SEQ ID NO: 1122124 - RNA, 19 nt, Homo sapiens
gagcauccaucugagaaac

SEQ ID NO: 1122125 - RNA, 19 nt, Homo sapiens
guggucaucuugggauuug

SEQ ID NO: 1122126 - RNA, 19 nt, Homo sapiens
gguggcaaccgcacucauu

SEQ ID NO: 1122127 - RNA, 19 nt, Homo sapiens
guugugaaccagaauguga

SEQ ID NO: 1122128 - RNA, 19 nt, Homo sapiens
gagguuguggcccuucuuu

SEQ ID NO: 1122129 - RNA, 19 nt, Homo sapiens
acagaacaaucccuaaagg

SEQ ID NO: 1122130 - RNA, 19 nt, Homo sapiens
gacuugcccuucauguuca

SEQ ID NO: 1122131 - RNA, 19 nt, Homo sapiens
gccauuccaugucaucauc

SEQ ID NO: 1122132 - RNA, 19 nt, Homo sapiens
gaacucagacaaggaggau

SEQ ID NO: 1122133 - RNA, 19 nt, Homo sapiens
ucuagagucuccacugcuu

SEQ ID NO: 1122134 - RNA, 19 nt, Homo sapiens
gaucugugggugcgaauuc

SEQ ID NO: 1122135 - RNA, 19 nt, Homo sapiens
gagacagaacaaucccuaa

SEQ ID NO: 1122136 - RNA, 19 nt, Homo sapiens
caagucauacaggagauaa

SEQ ID NO: 1122137 - RNA, 19 nt, Homo sapiens
ugaccuccauucucuacga

SEQ ID NO: 1122138 - RNA, 19 nt, Homo sapiens
uggcuggaguggaggguaa

SEQ ID NO: 1122139 - RNA, 19 nt, Homo sapiens
aaacacaguauuacacauc

SEQ ID NO: 1122140 - RNA, 19 nt, Homo sapiens
gagcauggagcugacauca

SEQ ID NO: 1122141 - RNA, 19 nt, Homo sapiens
ugaccugucuguucuuagg

SEQ ID NO: 1122142 - RNA, 19 nt, Homo sapiens
uaaagggucaugccucaca

SEQ ID NO: 1122143 - RNA, 19 nt, Homo sapiens
gacagaacaaucccuaaag

SEQ ID NO: 1122144 - RNA, 19 nt, Homo sapiens
gcuaucacucuugaccuua

SEQ ID NO: 1122145 - RNA, 19 nt, Homo sapiens
gcacacacacacaccuaca

SEQ ID NO: 1122146 - RNA, 19 nt, Homo sapiens
ucuacgaccucacagagau

SEQ ID NO: 1122147 - RNA, 19 nt, Homo sapiens
acaaccugcugcuguccua

SEQ ID NO: 1122148 - RNA, 19 nt, Homo sapiens
gggagcacccuuuguccuu

SEQ ID NO: 1122149 - RNA, 19 nt, Homo sapiens
ggagcauccaucugagaaa

SEQ ID NO: 1122150 - RNA, 19 nt, Homo sapiens
ucaccaucaugauccagaa

SEQ ID NO: 1122151 - RNA, 19 nt, Homo sapiens
ucugggcucuugcaaguca

SEQ ID NO: 1122152 - RNA, 19 nt, Homo sapiens
uuucugggcucuugcaagu

SEQ ID NO: 1122153 - RNA, 19 nt, Homo sapiens
guugagaaccacaaugauc

SEQ ID NO: 1122154 - RNA, 19 nt, Homo sapiens
ucaaguggaacaaguaugg

SEQ ID NO: 1122155 - RNA, 19 nt, Homo sapiens
uccagcaccugaugcagaa

SEQ ID NO: 1122156 - RNA, 19 nt, Homo sapiens
agacggcgcugcacauagc

SEQ ID NO: 1122157 - RNA, 19 nt, Homo sapiens
agaaaguaguaagcuguga

SEQ ID NO: 1122158 - RNA, 19 nt, Homo sapiens
gcaaugggcaauggucauc

SEQ ID NO: 1122159 - RNA, 19 nt, Homo sapiens
ugaugcaccugccaacuac

SEQ ID NO: 1122160 - RNA, 19 nt, Homo sapiens
gagaggcucgccaaauucu

SEQ ID NO: 1122161 - RNA, 19 nt, Homo sapiens
gaggguaacacugugaugu

SEQ ID NO: 1122162 - RNA, 19 nt, Homo sapiens
gcaaccucaucuacuuugg

SEQ ID NO: 1122163 - RNA, 19 nt, Homo sapiens
aaaaugaccugucuguucu

SEQ ID NO: 1122164 - RNA, 19 nt, Homo sapiens
uccuagaccuguuucuuuc

SEQ ID NO: 1122165 - RNA, 19 nt, Homo sapiens
gcuucaaguggaacaagua

SEQ ID NO: 1122166 - RNA, 19 nt, Homo sapiens
cauacugcaugcacacaca

SEQ ID NO: 1122167 - RNA, 19 nt, Homo sapiens
gagcauccaaggaaaauga

SEQ ID NO: 1122168 - RNA, 19 nt, Homo sapiens
cuucgagcauccaaggaaa

SEQ ID NO: 1122169 - RNA, 19 nt, Homo sapiens
uggacaagcuucauaugcu

SEQ ID NO: 1122170 - RNA, 19 nt, Homo sapiens
gaaacuucugcccuccuuu

SEQ ID NO: 1122171 - RNA, 19 nt, Homo sapiens
gaggcagggaugcuagauu

SEQ ID NO: 1122172 - RNA, 19 nt, Homo sapiens
cgccacauuucuauaaucu

SEQ ID NO: 1122173 - RNA, 19 nt, Homo sapiens
cccgcaaccucaucuacuu

SEQ ID NO: 1122174 - RNA, 19 nt, Homo sapiens
caaggaaaaugaccugucu

SEQ ID NO: 1122175 - RNA, 19 nt, Homo sapiens
gacggagaccucugccuau

SEQ ID NO: 1122176 - RNA, 19 nt, Homo sapiens
gcugcauacacaagucaua

SEQ ID NO: 1122177 - RNA, 19 nt, Homo sapiens
caccuggacaagcuucaua

SEQ ID NO: 1122178 - RNA, 19 nt, Homo sapiens
caugggagggugagacaga

SEQ ID NO: 1122179 - RNA, 19 nt, Homo sapiens
ugaagaagcugaaggaaua

SEQ ID NO: 1122180 - RNA, 19 nt, Homo sapiens
gaagaaacaugcuaaauag

SEQ ID NO: 1122181 - RNA, 19 nt, Homo sapiens
gaaccaccauguuuaguaa

SEQ ID NO: 1122182 - RNA, 19 nt, Homo sapiens
gaacccauuucuacaauuu

SEQ ID NO: 1122183 - RNA, 19 nt, Homo sapiens
gaaagaaccgguuaaguga

SEQ ID NO: 1122184 - RNA, 19 nt, Homo sapiens
gaaagaagaaacaugcuaa

SEQ ID NO: 1122185 - RNA, 19 nt, Homo sapiens
ggaauuauguuacgaaggu

SEQ ID NO: 1122186 - RNA, 19 nt, Homo sapiens
gaaaacaaauccccauuga

SEQ ID NO: 1122187 - RNA, 19 nt, Homo sapiens
ucagcaagguguggaauua

SEQ ID NO: 1122188 - RNA, 19 nt, Homo sapiens
gaaacaugcuaaauagaca

SEQ ID NO: 1122189 - RNA, 19 nt, Homo sapiens
auacgaagcugaucuugaa

SEQ ID NO: 1122190 - RNA, 19 nt, Homo sapiens
gagcaacaaugcaaaauaa

SEQ ID NO: 1122191 - RNA, 19 nt, Homo sapiens
ugagggauauucguuauaa

SEQ ID NO: 1122192 - RNA, 19 nt, Homo sapiens
gaaaggggcugaugugaau

SEQ ID NO: 1122193 - RNA, 19 nt, Homo sapiens
ugaaagaaccgguuaagug

SEQ ID NO: 1122194 - RNA, 19 nt, Homo sapiens
ggaaagaagaaacaugcua

SEQ ID NO: 1122195 - RNA, 19 nt, Homo sapiens
gcauagauacccacaauuc

SEQ ID NO: 1122196 - RNA, 19 nt, Homo sapiens
ucaaagaacagcccuuauu

SEQ ID NO: 1122197 - RNA, 19 nt, Homo sapiens
uaguaaagcuucuucuuca

SEQ ID NO: 1122198 - RNA, 19 nt, Homo sapiens
uggguauacuccacuauua

SEQ ID NO: 1122199 - RNA, 19 nt, Homo sapiens
ccgguuaagugaacuauga

SEQ ID NO: 1122200 - RNA, 19 nt, Homo sapiens
caaagaacagcccuuauuc

SEQ ID NO: 1122201 - RNA, 19 nt, Homo sapiens
gaaacuguguuaggcaugu

SEQ ID NO: 1122202 - RNA, 19 nt, Homo sapiens
cagaacaccuuugcaccua

SEQ ID NO: 1122203 - RNA, 19 nt, Homo sapiens
ggaacccauuucuacaauu

SEQ ID NO: 1122204 - RNA, 19 nt, Homo sapiens
aggaauaccuucagaucaa

SEQ ID NO: 1122205 - RNA, 19 nt, Homo sapiens
cagcugaggaauauguuua

SEQ ID NO: 1122206 - RNA, 19 nt, Homo sapiens
uaucaaagaacagcccuua

SEQ ID NO: 1122207 - RNA, 19 nt, Homo sapiens
guucuucacuaugcuguuu

SEQ ID NO: 1122208 - RNA, 19 nt, Homo sapiens
ggauggguauacuccacua

SEQ ID NO: 1122209 - RNA, 19 nt, Homo sapiens
gaucugagggauauucguu

SEQ ID NO: 1122210 - RNA, 19 nt, Homo sapiens
gaauuauguuacgaaggua

SEQ ID NO: 1122211 - RNA, 19 nt, Homo sapiens
ugaaccaccauguuuagua

SEQ ID NO: 1122212 - RNA, 19 nt, Homo sapiens
gcuaauggacauacagaug

SEQ ID NO: 1122213 - RNA, 19 nt, Homo sapiens
cugcauagauacccacaau

SEQ ID NO: 1122214 - RNA, 19 nt, Homo sapiens
uuacgaagguauuguggau

SEQ ID NO: 1122215 - RNA, 19 nt, Homo sapiens
gauuaaggcaguacagugu

SEQ ID NO: 1122216 - RNA, 19 nt, Homo sapiens
ugacuacccaguugaagaa

SEQ ID NO: 1122217 - RNA, 19 nt, Homo sapiens
gauugugccuacuauucuu

SEQ ID NO: 1122218 - RNA, 19 nt, Homo sapiens
gcaguacagugucaaaaug

SEQ ID NO: 1122219 - RNA, 19 nt, Homo sapiens
ggaauaccuucagaucaag

SEQ ID NO: 1122220 - RNA, 19 nt, Homo sapiens
uaaauguccgggauaguga

SEQ ID NO: 1122221 - RNA, 19 nt, Homo sapiens
aaauaaauguccgggauag

SEQ ID NO: 1122222 - RNA, 19 nt, Homo sapiens
gcaagguguggaauuaugu

SEQ ID NO: 1122223 - RNA, 19 nt, Homo sapiens
accuucagaucaagaaaua

SEQ ID NO: 1122224 - RNA, 19 nt, Homo sapiens
acgaagguauuguggauuc

SEQ ID NO: 1122225 - RNA, 19 nt, Homo sapiens
gagggauauucguuauaau

SEQ ID NO: 1122226 - RNA, 19 nt, Homo sapiens
gaaccgguuaagugaacua

SEQ ID NO: 1122227 - RNA, 19 nt, Homo sapiens
ucacagcugaggaauaugu

SEQ ID NO: 1122228 - RNA, 19 nt, Homo sapiens
ugaggauugugccuacuau

SEQ ID NO: 1122229 - RNA, 19 nt, Homo sapiens
gcacuacaugugacuaaag

SEQ ID NO: 1122230 - RNA, 19 nt, Homo sapiens
acaugugacuaaaggaaga

SEQ ID NO: 1122231 - RNA, 19 nt, Homo sapiens
acccagaucugagggauau

SEQ ID NO: 1122232 - RNA, 19 nt, Homo sapiens
guuagaagaaugaaugaag

SEQ ID NO: 1122233 - RNA, 19 nt, Homo sapiens
cuacaugugacuaaaggaa

SEQ ID NO: 1122234 - RNA, 19 nt, Homo sapiens
ggcacuacaugugacuaaa

SEQ ID NO: 1122235 - RNA, 19 nt, Homo sapiens
ucugagggauauucguuau

SEQ ID NO: 1122236 - RNA, 19 nt, Homo sapiens
ggauugugccuacuauucu

SEQ ID NO: 1122237 - RNA, 19 nt, Homo sapiens
guguuaggcauguauuaaa

SEQ ID NO: 1122238 - RNA, 19 nt, Homo sapiens
aaacuguguuaggcaugua

SEQ ID NO: 1122239 - RNA, 19 nt, Homo sapiens
gguuaagugaacuaugaua

SEQ ID NO: 1122240 - RNA, 19 nt, Homo sapiens
uggaacccauuucuacaau

SEQ ID NO: 1122241 - RNA, 19 nt, Homo sapiens
cauagauacccacaauuca

SEQ ID NO: 1122242 - RNA, 19 nt, Homo sapiens
uuaguaaagcuucuucuuc

SEQ ID NO: 1122243 - RNA, 19 nt, Homo sapiens
ugccuacuauucuucuaaa

SEQ ID NO: 1122244 - RNA, 19 nt, Homo sapiens
uuaaggcaguacaguguca

SEQ ID NO: 1122245 - RNA, 19 nt, Homo sapiens
ucacugcgagccauggaaa

SEQ ID NO: 1122246 - RNA, 19 nt, Homo sapiens
accaucagcugaaaagaua

SEQ ID NO: 1122247 - RNA, 19 nt, Homo sapiens
gaauacgaagcugaucuug

SEQ ID NO: 1122248 - RNA, 19 nt, Homo sapiens
ugaauacgaagcugaucuu

SEQ ID NO: 1122249 - RNA, 19 nt, Homo sapiens
gaauaccuucagaucaaga

SEQ ID NO: 1122250 - RNA, 19 nt, Homo sapiens
ugugaaccaucagcugaaa

SEQ ID NO: 1122251 - RNA, 19 nt, Homo sapiens
caugcuaaauagacaccuu

SEQ ID NO: 1122252 - RNA, 19 nt, Homo sapiens
auacuguucuucacuaugc

SEQ ID NO: 1122253 - RNA, 19 nt, Homo sapiens
aagaaccgguuaagugaac

SEQ ID NO: 1122254 - RNA, 19 nt, Homo sapiens
cuucagaucaagaaauaug

SEQ ID NO: 1122255 - RNA, 19 nt, Homo sapiens
cacguuagaagaaugaaug

SEQ ID NO: 1122256 - RNA, 19 nt, Homo sapiens
agcaagguguggaauuaug

SEQ ID NO: 1122257 - RNA, 19 nt, Homo sapiens
aaauaaggauggguauacu

SEQ ID NO: 1122258 - RNA, 19 nt, Homo sapiens
gugccuacuauucuucuaa

SEQ ID NO: 1122259 - RNA, 19 nt, Homo sapiens
aaagaaccgguuaagugaa

SEQ ID NO: 1122260 - RNA, 19 nt, Homo sapiens
acuaaaggaagauauggaa

SEQ ID NO: 1122261 - RNA, 19 nt, Homo sapiens
agaaacaugcuaaauagac

SEQ ID NO: 1122262 - RNA, 19 nt, Homo sapiens
caagguguggaauuauguu

SEQ ID NO: 1122263 - RNA, 19 nt, Homo sapiens
ggguauacuccacuauuag

SEQ ID NO: 1122264 - RNA, 19 nt, Homo sapiens
gaggauugugccuacuauu

SEQ ID NO: 1122265 - RNA, 19 nt, Homo sapiens
gacuaaaggaagauaugga

SEQ ID NO: 1122266 - RNA, 19 nt, Homo sapiens
cgaagguauuguggauuca

SEQ ID NO: 1122267 - RNA, 19 nt, Homo sapiens
gguguggaauuauguuacg

SEQ ID NO: 1122268 - RNA, 19 nt, Homo sapiens
uguguuaggcauguauuaa

SEQ ID NO: 1122269 - RNA, 19 nt, Homo sapiens
auaaauguccgggauagug

SEQ ID NO: 1122270 - RNA, 19 nt, Homo sapiens
gauguuguacuuuuccuaa

SEQ ID NO: 1122271 - RNA, 19 nt, Homo sapiens
guaaauaugcaggacaaaa

SEQ ID NO: 1122272 - RNA, 19 nt, Homo sapiens
aauacgaagcugaucuuga

SEQ ID NO: 1122273 - RNA, 19 nt, Homo sapiens
gacccagaucugagggaua

SEQ ID NO: 1122274 - RNA, 19 nt, Homo sapiens
gugacuaaaggaagauaug

SEQ ID NO: 1122275 - RNA, 19 nt, Homo sapiens
ggagaaaggggcugaugug

SEQ ID NO: 1122276 - RNA, 19 nt, Homo sapiens
ccagaucugagggauauuc

SEQ ID NO: 1122277 - RNA, 19 nt, Homo sapiens
gcaaguauguucacuauga

SEQ ID NO: 1122278 - RNA, 19 nt, Homo sapiens
gaagacaaaucaacugcaa

SEQ ID NO: 1122279 - RNA, 19 nt, Homo sapiens
gaacaggacucgacuacag

SEQ ID NO: 1122280 - RNA, 19 nt, Homo sapiens
gguaucaucucuaaaccua

SEQ ID NO: 1122281 - RNA, 19 nt, Homo sapiens
gaugaaaucuauggcauga

SEQ ID NO: 1122282 - RNA, 19 nt, Homo sapiens
cagcacagcuucagcaguu

SEQ ID NO: 1122283 - RNA, 19 nt, Homo sapiens
gcacuuggaucuacggaau

SEQ ID NO: 1122284 - RNA, 19 nt, Homo sapiens
caguggaucuguugugaua

SEQ ID NO: 1122285 - RNA, 19 nt, Homo sapiens
ggugacugcucuuuccuua

SEQ ID NO: 1122286 - RNA, 19 nt, Homo sapiens
caaaggagccagccaagaa

SEQ ID NO: 1122287 - RNA, 19 nt, Homo sapiens
gaaacaugcugccucagau

SEQ ID NO: 1122288 - RNA, 19 nt, Homo sapiens
gaacggguagaugaaauua

SEQ ID NO: 1122289 - RNA, 19 nt, Homo sapiens
gaaggaacacugcuugguu

SEQ ID NO: 1122290 - RNA, 19 nt, Homo sapiens
gcaagaauucugugacuau

SEQ ID NO: 1122291 - RNA, 19 nt, Homo sapiens
ugacugcucuuuccuuaau

SEQ ID NO: 1122292 - RNA, 19 nt, Homo sapiens
gaagagugauauuuguaca

SEQ ID NO: 1122293 - RNA, 19 nt, Homo sapiens
ucaauaaacacacugauga

SEQ ID NO: 1122294 - RNA, 19 nt, Homo sapiens
gcacauccuacucuuguaa

SEQ ID NO: 1122295 - RNA, 19 nt, Homo sapiens
uagaaagccuccugcagaa

SEQ ID NO: 1122296 - RNA, 19 nt, Homo sapiens
gcucuuuccuuaauacaug

SEQ ID NO: 1122297 - RNA, 19 nt, Homo sapiens
ggaaacaugcugccucaga

SEQ ID NO: 1122298 - RNA, 19 nt, Homo sapiens
cuacagauccugaguuaga

SEQ ID NO: 1122299 - RNA, 19 nt, Homo sapiens
ccauggcucuguaagcuaa

SEQ ID NO: 1122300 - RNA, 19 nt, Homo sapiens
caacauacccguacuacag

SEQ ID NO: 1122301 - RNA, 19 nt, Homo sapiens
gcacuuccuuacagagcua

SEQ ID NO: 1122302 - RNA, 19 nt, Homo sapiens
gguaugaacggguagauga

SEQ ID NO: 1122303 - RNA, 19 nt, Homo sapiens
gggagagaaugucuaaauc

SEQ ID NO: 1122304 - RNA, 19 nt, Homo sapiens
gaucuggccuuaacauugc

SEQ ID NO: 1122305 - RNA, 19 nt, Homo sapiens
gauccuagagcuauuaaau

SEQ ID NO: 1122306 - RNA, 19 nt, Homo sapiens
caagcucucugccaugaug

SEQ ID NO: 1122307 - RNA, 19 nt, Homo sapiens
ggagauccuagagcuauua

SEQ ID NO: 1122308 - RNA, 19 nt, Homo sapiens
uaaacacacugaugagucu

SEQ ID NO: 1122309 - RNA, 19 nt, Homo sapiens
gaaagccagugaugcugau

SEQ ID NO: 1122310 - RNA, 19 nt, Homo sapiens
aaagcgaggucuccuacaa

SEQ ID NO: 1122311 - RNA, 19 nt, Homo sapiens
gaucguagcugagguucgu

SEQ ID NO: 1122312 - RNA, 19 nt, Homo sapiens
ggauugugaugugaucgua

SEQ ID NO: 1122313 - RNA, 19 nt, Homo sapiens
acggguagaugaaauuauu

SEQ ID NO: 1122314 - RNA, 19 nt, Homo sapiens
agaagcagcuggacucucu

SEQ ID NO: 1122315 - RNA, 19 nt, Homo sapiens
caagaauucugugacuaug

SEQ ID NO: 1122316 - RNA, 19 nt, Homo sapiens
gaaagccuccugcagaagu

SEQ ID NO: 1122317 - RNA, 19 nt, Homo sapiens
ccugacagaugaugagaug

SEQ ID NO: 1122318 - RNA, 19 nt, Homo sapiens
acacacugaugagucuuua

SEQ ID NO: 1122319 - RNA, 19 nt, Homo sapiens
gaaggucagucaggagauc

SEQ ID NO: 1122320 - RNA, 19 nt, Homo sapiens
gccaagaaaucaaggaaac

SEQ ID NO: 1122321 - RNA, 19 nt, Homo sapiens
gggcccaagugcaagaauu

SEQ ID NO: 1122322 - RNA, 19 nt, Homo sapiens
caacugcaacgcaucauuc

SEQ ID NO: 1122323 - RNA, 19 nt, Homo sapiens
ggagagaaugucuaaaucu

SEQ ID NO: 1122324 - RNA, 19 nt, Homo sapiens
aagcugcacuucagacgaa

SEQ ID NO: 1122325 - RNA, 19 nt, Homo sapiens
caaggaggagugcaugaaa

SEQ ID NO: 1122326 - RNA, 19 nt, Homo sapiens
ucgcaagauugaguuauuu

SEQ ID NO: 1122327 - RNA, 19 nt, Homo sapiens
cugcaaguauguucacuau

SEQ ID NO: 1122328 - RNA, 19 nt, Homo sapiens
ucuguaagcuaaaccugaa

SEQ ID NO: 1122329 - RNA, 19 nt, Homo sapiens
ugucagggcugggagacua

SEQ ID NO: 1122330 - RNA, 19 nt, Homo sapiens
agaauucugugacuaugga

SEQ ID NO: 1122331 - RNA, 19 nt, Homo sapiens
ucucuggucugaacucuuc

SEQ ID NO: 1122332 - RNA, 19 nt, Homo sapiens
gaugggugcuguggcagaa

SEQ ID NO: 1122333 - RNA, 19 nt, Homo sapiens
ugaauuagcuacagauccu

SEQ ID NO: 1122334 - RNA, 19 nt, Homo sapiens
gagauagagagccuucuga

SEQ ID NO: 1122335 - RNA, 19 nt, Homo sapiens
gcaaaggagccagccaaga

SEQ ID NO: 1122336 - RNA, 19 nt, Homo sapiens
uaaccuaugcugaccauuc

SEQ ID NO: 1122337 - RNA, 19 nt, Homo sapiens
gauccugaguuagagaaga

SEQ ID NO: 1122338 - RNA, 19 nt, Homo sapiens
agcuacagauccugaguua

SEQ ID NO: 1122339 - RNA, 19 nt, Homo sapiens
ccugaagagugauauuugu

SEQ ID NO: 1122340 - RNA, 19 nt, Homo sapiens
uaucaucucuaaaccuaag

SEQ ID NO: 1122341 - RNA, 19 nt, Homo sapiens
uggcaugauugaaagacua

SEQ ID NO: 1122342 - RNA, 19 nt, Homo sapiens
acauggaacugcccuaugg

SEQ ID NO: 1122343 - RNA, 19 nt, Homo sapiens
gaaccaaggaggagugcau

SEQ ID NO: 1122344 - RNA, 19 nt, Homo sapiens
gaggucuccuacaagauga

SEQ ID NO: 1122345 - RNA, 19 nt, Homo sapiens
gaugggauccaccuacuag

SEQ ID NO: 1122346 - RNA, 19 nt, Homo sapiens
gagaugcgcaggcucaaca

SEQ ID NO: 1122347 - RNA, 19 nt, Homo sapiens
caaguuugcaguugugaug

SEQ ID NO: 1122348 - RNA, 19 nt, Homo sapiens
ucuccaaccuuccguagug

SEQ ID NO: 1122349 - RNA, 19 nt, Homo sapiens
ugaaccaacaguccacuaa

SEQ ID NO: 1122350 - RNA, 19 nt, Homo sapiens
ggaguugauugagguaaag

SEQ ID NO: 1122351 - RNA, 19 nt, Homo sapiens
guacaauagcuuucuucuu

SEQ ID NO: 1122352 - RNA, 19 nt, Homo sapiens
ggucuggauugugauguga

SEQ ID NO: 1122353 - RNA, 19 nt, Homo sapiens
gcacuucagacgaauuauc

SEQ ID NO: 1122354 - RNA, 19 nt, Homo sapiens
agcuaaaccugaagaguga

SEQ ID NO: 1122355 - RNA, 19 nt, Homo sapiens
caagauugaguuauuugga

SEQ ID NO: 1122356 - RNA, 19 nt, Homo sapiens
guacaggucacugguugaa

SEQ ID NO: 1122357 - RNA, 19 nt, Homo sapiens
guggaucuguugugauauc

SEQ ID NO: 1122358 - RNA, 19 nt, Homo sapiens
caacagccaaggaacaauc

SEQ ID NO: 1122359 - RNA, 19 nt, Homo sapiens
cgaggucuccuacaagaug

SEQ ID NO: 1122360 - RNA, 19 nt, Homo sapiens
gaauccagaggcagcauug

SEQ ID NO: 1122361 - RNA, 19 nt, Homo sapiens
uuacagagcuaagaaucca

SEQ ID NO: 1122362 - RNA, 19 nt, Homo sapiens
ggagauagagagccuucug

SEQ ID NO: 1122363 - RNA, 19 nt, Homo sapiens
caucggaaccagcaaagga

SEQ ID NO: 1122364 - RNA, 19 nt, Homo sapiens
guuagucucuggucugaac

SEQ ID NO: 1122365 - RNA, 19 nt, Homo sapiens
guagcugccuuugccaguu

SEQ ID NO: 1122366 - RNA, 19 nt, Homo sapiens
gcagaagcggcgugcagaa

SEQ ID NO: 1122367 - RNA, 19 nt, Homo sapiens
gaaccaacaguccacuaag

SEQ ID NO: 1122368 - RNA, 19 nt, Homo sapiens
uagagagccuucugaacca

SEQ ID NO: 1122369 - RNA, 19 nt, Homo sapiens
gcagaacaggacucgacua

SEQ ID NO: 1122370 - RNA, 19 nt, Homo sapiens
gaagcggcgugcagaacag

SEQ ID NO: 1122371 - RNA, 19 nt, Homo sapiens
gaggcagcauugucuccaa

SEQ ID NO: 1122372 - RNA, 19 nt, Homo sapiens
cugcuugguuggugucaaa

SEQ ID NO: 1122373 - RNA, 19 nt, Homo sapiens
acuacaggaugauggcuuu

SEQ ID NO: 1122374 - RNA, 19 nt, Homo sapiens
gcucaacauacccguacua

SEQ ID NO: 1122375 - RNA, 19 nt, Homo sapiens
ccugggauauucacaugga

SEQ ID NO: 1122376 - RNA, 19 nt, Homo sapiens
gugcaagaauucugugacu

SEQ ID NO: 1122377 - RNA, 19 nt, Homo sapiens
caaagaaggugaagucaga

SEQ ID NO: 1122378 - RNA, 19 nt, Homo sapiens
gaugaugccuuaacuguga

SEQ ID NO: 1122379 - RNA, 19 nt, Homo sapiens
gcaccaagcuauacugaga

SEQ ID NO: 1122380 - RNA, 19 nt, Homo sapiens
gaaaugaucccagaaagaa

SEQ ID NO: 1122381 - RNA, 19 nt, Homo sapiens
ccacagaagucaccgauga

SEQ ID NO: 1122382 - RNA, 19 nt, Homo sapiens
ggaacaagacuauuuagaa

SEQ ID NO: 1122383 - RNA, 19 nt, Homo sapiens
gaaaguaagugguucuucu

SEQ ID NO: 1122384 - RNA, 19 nt, Homo sapiens
gagaaagauuugcuacauu

SEQ ID NO: 1122385 - RNA, 19 nt, Homo sapiens
acugagaggucuaauauaa

SEQ ID NO: 1122386 - RNA, 19 nt, Homo sapiens
ggaaaugcaccaagcuaua

SEQ ID NO: 1122387 - RNA, 19 nt, Homo sapiens
ggaggaaucugaugugucu

SEQ ID NO: 1122388 - RNA, 19 nt, Homo sapiens
cgaaauuucuucaguuaug

SEQ ID NO: 1122389 - RNA, 19 nt, Homo sapiens
gagagaaacaauuccaaua

SEQ ID NO: 1122390 - RNA, 19 nt, Homo sapiens
agaaagugauggaugauuu

SEQ ID NO: 1122391 - RNA, 19 nt, Homo sapiens
ugccagaacucacagaaua

SEQ ID NO: 1122392 - RNA, 19 nt, Homo sapiens
gaagacaguuauaaacaag

SEQ ID NO: 1122393 - RNA, 19 nt, Homo sapiens
gagaaacaauuccaauagu

SEQ ID NO: 1122394 - RNA, 19 nt, Homo sapiens
caagaugcauucaauagca

SEQ ID NO: 1122395 - RNA, 19 nt, Homo sapiens
agaaagauuugcuacauuc

SEQ ID NO: 1122396 - RNA, 19 nt, Homo sapiens
gagaaaugaucccagaaag

SEQ ID NO: 1122397 - RNA, 19 nt, Homo sapiens
gaaggaaagaauacugaaa

SEQ ID NO: 1122398 - RNA, 19 nt, Homo sapiens
acaaauggguggccugaga

SEQ ID NO: 1122399 - RNA, 19 nt, Homo sapiens
aggaggcgcugaaagauuu

SEQ ID NO: 1122400 - RNA, 19 nt, Homo sapiens
gagaaacuauacaggaaca

SEQ ID NO: 1122401 - RNA, 19 nt, Homo sapiens
gaaaugaaggaaagaauac

SEQ ID NO: 1122402 - RNA, 19 nt, Homo sapiens
agaagaggaugaagaggaa

SEQ ID NO: 1122403 - RNA, 19 nt, Homo sapiens
caaacgacuuccagcgaaa

SEQ ID NO: 1122404 - RNA, 19 nt, Homo sapiens
ggaugaagaggaagaagaa

SEQ ID NO: 1122405 - RNA, 19 nt, Homo sapiens
agaaucugaugaugccuua

SEQ ID NO: 1122406 - RNA, 19 nt, Homo sapiens
guacagaagaggaugaaga

SEQ ID NO: 1122407 - RNA, 19 nt, Homo sapiens
gaaggugaagucagagaaa

SEQ ID NO: 1122408 - RNA, 19 nt, Homo sapiens
cagcgaaauuucuucaguu

SEQ ID NO: 1122409 - RNA, 19 nt, Homo sapiens
ucagugagcccuuugagaa

SEQ ID NO: 1122410 - RNA, 19 nt, Homo sapiens
ugagaaagauuugcuacau

SEQ ID NO: 1122411 - RNA, 19 nt, Homo sapiens
uggagaaagugauggauga

SEQ ID NO: 1122412 - RNA, 19 nt, Homo sapiens
ucagaaguuuccucaguga

SEQ ID NO: 1122413 - RNA, 19 nt, Homo sapiens
gaacauccaugagcuucca

SEQ ID NO: 1122414 - RNA, 19 nt, Homo sapiens
ggacacaauugccagaacu

SEQ ID NO: 1122415 - RNA, 19 nt, Homo sapiens
ugacugccgugaaacagaa

SEQ ID NO: 1122416 - RNA, 19 nt, Homo sapiens
gaaauuucuucaguuaugg

SEQ ID NO: 1122417 - RNA, 19 nt, Homo sapiens
uacaggaacagacaaauuu

SEQ ID NO: 1122418 - RNA, 19 nt, Homo sapiens
cagaagaggaugaagaaga

SEQ ID NO: 1122419 - RNA, 19 nt, Homo sapiens
agcgaaauuucuucaguua

SEQ ID NO: 1122420 - RNA, 19 nt, Homo sapiens
gugagcccuuugagaaaua

SEQ ID NO: 1122421 - RNA, 19 nt, Homo sapiens
gaaugaauggugugauguu

SEQ ID NO: 1122422 - RNA, 19 nt, Homo sapiens
ggagaaacaaugauucagu

SEQ ID NO: 1122423 - RNA, 19 nt, Homo sapiens
aagauuugcuacauucuga

SEQ ID NO: 1122424 - RNA, 19 nt, Homo sapiens
agaugaagaugcuguggaa

SEQ ID NO: 1122425 - RNA, 19 nt, Homo sapiens
guuguuagcuguguuuauc

SEQ ID NO: 1122426 - RNA, 19 nt, Homo sapiens
gucacuggauuuaauggua

SEQ ID NO: 1122427 - RNA, 19 nt, Homo sapiens
auucaguggucccaauuua

SEQ ID NO: 1122428 - RNA, 19 nt, Homo sapiens
cgaaggcccugaaaguaag

SEQ ID NO: 1122429 - RNA, 19 nt, Homo sapiens
aaacgaaggcccugaaagu

SEQ ID NO: 1122430 - RNA, 19 nt, Homo sapiens
aaucagaaguuuccucagu

SEQ ID NO: 1122431 - RNA, 19 nt, Homo sapiens
uggauacgcuugugaucaa

SEQ ID NO: 1122432 - RNA, 19 nt, Homo sapiens
gaaacagccagucaaacga

SEQ ID NO: 1122433 - RNA, 19 nt, Homo sapiens
gaaaugcaccaagcuauac

SEQ ID NO: 1122434 - RNA, 19 nt, Homo sapiens
ucacuggauuuaaugguau

SEQ ID NO: 1122435 - RNA, 19 nt, Homo sapiens
agaagaggaugaagaagag

SEQ ID NO: 1122436 - RNA, 19 nt, Homo sapiens
caggauaaagacaaagaua

SEQ ID NO: 1122437 - RNA, 19 nt, Homo sapiens
ucaguggucccaauuuaaa

SEQ ID NO: 1122438 - RNA, 19 nt, Homo sapiens
guaagugguucuucugacu

SEQ ID NO: 1122439 - RNA, 19 nt, Homo sapiens
ugacaaagaaggugaaguc

SEQ ID NO: 1122440 - RNA, 19 nt, Homo sapiens
ucacagaauagaaguauca

SEQ ID NO: 1122441 - RNA, 19 nt, Homo sapiens
caaguaaagcagguuguaa

SEQ ID NO: 1122442 - RNA, 19 nt, Homo sapiens
gaaacuauacaggaacaga

SEQ ID NO: 1122443 - RNA, 19 nt, Homo sapiens
aggagaaacuauacaggaa

SEQ ID NO: 1122444 - RNA, 19 nt, Homo sapiens
auacugagaggucuaauau

SEQ ID NO: 1122445 - RNA, 19 nt, Homo sapiens
ucgaaugaauggugugaug

SEQ ID NO: 1122446 - RNA, 19 nt, Homo sapiens
gauuuaaugguaucccuuu

SEQ ID NO: 1122447 - RNA, 19 nt, Homo sapiens
cggcagcacuguacagaag

SEQ ID NO: 1122448 - RNA, 19 nt, Homo sapiens
ccagcgaaauuucuucagu

SEQ ID NO: 1122449 - RNA, 19 nt, Homo sapiens
ggacacccaggccacguaa

SEQ ID NO: 1122450 - RNA, 19 nt, Homo sapiens
agugauggaugauuucaga

SEQ ID NO: 1122451 - RNA, 19 nt, Homo sapiens
gaaacauuuacaugcagua

SEQ ID NO: 1122452 - RNA, 19 nt, Homo sapiens
ugacgaagccacagaaguc

SEQ ID NO: 1122453 - RNA, 19 nt, Homo sapiens
gaaccaauucccaguaaaa

SEQ ID NO: 1122454 - RNA, 19 nt, Homo sapiens
gaaacagaagcaucaucuu

SEQ ID NO: 1122455 - RNA, 19 nt, Homo sapiens
agaaguaucagcaccgaaa

SEQ ID NO: 1122456 - RNA, 19 nt, Homo sapiens
acgaaggcccugaaaguaa

SEQ ID NO: 1122457 - RNA, 19 nt, Homo sapiens
ggaacagacaaauuucuca

SEQ ID NO: 1122458 - RNA, 19 nt, Homo sapiens
gagaaagugauggaugauu

SEQ ID NO: 1122459 - RNA, 19 nt, Homo sapiens
ucaguuucuuugucaugua

SEQ ID NO: 1122460 - RNA, 19 nt, Homo sapiens
gaacucacagaauagaagu

SEQ ID NO: 1122461 - RNA, 19 nt, Homo sapiens
agagaaaugaucccagaaa

SEQ ID NO: 1122462 - RNA, 19 nt, Homo sapiens
caucuucaucucaggauaa

SEQ ID NO: 1122463 - RNA, 19 nt, Homo sapiens
ugugacaccugcugcauca

SEQ ID NO: 1122464 - RNA, 19 nt, Homo sapiens
aaugaauggugugauguuu

SEQ ID NO: 1122465 - RNA, 19 nt, Homo sapiens
gcugaaagauuuugagaag

SEQ ID NO: 1122466 - RNA, 19 nt, Homo sapiens
cacggaaccucaccaugga

SEQ ID NO: 1122467 - RNA, 19 nt, Homo sapiens
accgaaaccucacaggaaa

SEQ ID NO: 1122468 - RNA, 19 nt, Homo sapiens
agagaaacaauuccaauag

SEQ ID NO: 1122469 - RNA, 19 nt, Homo sapiens
gauggaugauuucagaacu

SEQ ID NO: 1122470 - RNA, 19 nt, Homo sapiens
acacacaguucugguuuua

SEQ ID NO: 1122471 - RNA, 19 nt, Homo sapiens
agaaaugaucccagaaaga

SEQ ID NO: 1122472 - RNA, 19 nt, Homo sapiens
caccgaaaccucacaggaa

SEQ ID NO: 1122473 - RNA, 19 nt, Homo sapiens
agagaaacagccagucaaa

SEQ ID NO: 1122474 - RNA, 19 nt, Homo sapiens
gagcacagacagcaaagag

SEQ ID NO: 1122475 - RNA, 19 nt, Homo sapiens
uggaucaguuucuuuguca

SEQ ID NO: 1122476 - RNA, 19 nt, Homo sapiens
caggaaggaacauccauga

SEQ ID NO: 1122477 - RNA, 19 nt, Homo sapiens
gagaugaccucgagagauu

SEQ ID NO: 1122478 - RNA, 19 nt, Homo sapiens
agacauagcaucuuugaua

SEQ ID NO: 1122479 - RNA, 19 nt, Homo sapiens
gcagcauaguugauauuua

SEQ ID NO: 1122480 - RNA, 19 nt, Homo sapiens
gcuacugucuguucuauga

SEQ ID NO: 1122481 - RNA, 19 nt, Homo sapiens
gaccaaugccuguuugaua

SEQ ID NO: 1122482 - RNA, 19 nt, Homo sapiens
acuagaaccuggagacaua

SEQ ID NO: 1122483 - RNA, 19 nt, Homo sapiens
gaagagcuaucguucacau

SEQ ID NO: 1122484 - RNA, 19 nt, Homo sapiens
gauagcauaagccagauua

SEQ ID NO: 1122485 - RNA, 19 nt, Homo sapiens
cagcauaguugauauuuac

SEQ ID NO: 1122486 - RNA, 19 nt, Homo sapiens
caacaucaucaccauauuu

SEQ ID NO: 1122487 - RNA, 19 nt, Homo sapiens
aaacacacaugagaacaaa

SEQ ID NO: 1122488 - RNA, 19 nt, Homo sapiens
gagaaugucuauggcuuug

SEQ ID NO: 1122489 - RNA, 19 nt, Homo sapiens
uagcaucuuugauagcaua

SEQ ID NO: 1122490 - RNA, 19 nt, Homo sapiens
gaaacauucucuguacuag

SEQ ID NO: 1122491 - RNA, 19 nt, Homo sapiens
ggacagauugcuuccacua

SEQ ID NO: 1122492 - RNA, 19 nt, Homo sapiens
ggaaaucuacgggaccaua

SEQ ID NO: 1122493 - RNA, 19 nt, Homo sapiens
ucacgaaggcuuuguguug

SEQ ID NO: 1122494 - RNA, 19 nt, Homo sapiens
agaccucgauuucacagua

SEQ ID NO: 1122495 - RNA, 19 nt, Homo sapiens
cgacuccuaugcccacuuu

SEQ ID NO: 1122496 - RNA, 19 nt, Homo sapiens
ggacaacaucaucaccaua

SEQ ID NO: 1122497 - RNA, 19 nt, Homo sapiens
ggaacuccauguaccacaa

SEQ ID NO: 1122498 - RNA, 19 nt, Homo sapiens
gacauagcaucuuugauag

SEQ ID NO: 1122499 - RNA, 19 nt, Homo sapiens
ggagacauagcaucuuuga

SEQ ID NO: 1122500 - RNA, 19 nt, Homo sapiens
ggacagcugugugaaacau

SEQ ID NO: 1122501 - RNA, 19 nt, Homo sapiens
accaaugccuguuugauaa

SEQ ID NO: 1122502 - RNA, 19 nt, Homo sapiens
gaucgaaugcuccaguauu

SEQ ID NO: 1122503 - RNA, 19 nt, Homo sapiens
gaggagauucuguugcuuu

SEQ ID NO: 1122504 - RNA, 19 nt, Homo sapiens
ucaauaaacacacaugaga

SEQ ID NO: 1122505 - RNA, 19 nt, Homo sapiens
guacugggauccuuuccau

SEQ ID NO: 1122506 - RNA, 19 nt, Homo sapiens
ggacaaagugguacuggau

SEQ ID NO: 1122507 - RNA, 19 nt, Homo sapiens
aggaaaugcugaaggauga

SEQ ID NO: 1122508 - RNA, 19 nt, Homo sapiens
agaccuagguguucucuca

SEQ ID NO: 1122509 - RNA, 19 nt, Homo sapiens
gacaacaucaucaccauau

SEQ ID NO: 1122510 - RNA, 19 nt, Homo sapiens
gggaucgaaugcuccagua

SEQ ID NO: 1122511 - RNA, 19 nt, Homo sapiens
ccauauccaugaagccaaa

SEQ ID NO: 1122512 - RNA, 19 nt, Homo sapiens
ggagaaugucuauggcuuu

SEQ ID NO: 1122513 - RNA, 19 nt, Homo sapiens
gcuccaguauuucugacua

SEQ ID NO: 1122514 - RNA, 19 nt, Homo sapiens
aacauucucuguacuaguu

SEQ ID NO: 1122515 - RNA, 19 nt, Homo sapiens
guugauauuuacccacaaa

SEQ ID NO: 1122516 - RNA, 19 nt, Homo sapiens
caucguggauccaaagcaa

SEQ ID NO: 1122517 - RNA, 19 nt, Homo sapiens
gaagguguuugggaucgaa

SEQ ID NO: 1122518 - RNA, 19 nt, Homo sapiens
ugaaacauucucuguacua

SEQ ID NO: 1122519 - RNA, 19 nt, Homo sapiens
uaugaaacauucucuguac

SEQ ID NO: 1122520 - RNA, 19 nt, Homo sapiens
gcgugugccuagaauauau

SEQ ID NO: 1122521 - RNA, 19 nt, Homo sapiens
acagauugcuuccacuaga

SEQ ID NO: 1122522 - RNA, 19 nt, Homo sapiens
aagcagcuaugaaacauuc

SEQ ID NO: 1122523 - RNA, 19 nt, Homo sapiens
cagauugcuuccacuagaa

SEQ ID NO: 1122524 - RNA, 19 nt, Homo sapiens
gaaaucuacgggaccauau

SEQ ID NO: 1122525 - RNA, 19 nt, Homo sapiens
ugaccucgagagauuauua

SEQ ID NO: 1122526 - RNA, 19 nt, Homo sapiens
gauaaaggagguggacauu

SEQ ID NO: 1122527 - RNA, 19 nt, Homo sapiens
caauaaacacacaugagaa

SEQ ID NO: 1122528 - RNA, 19 nt, Homo sapiens
cgugggcgcucaauaaaca

SEQ ID NO: 1122529 - RNA, 19 nt, Homo sapiens
gugaaacaucuguaucuaa

SEQ ID NO: 1122530 - RNA, 19 nt, Homo sapiens
ucagggacguggccaugaa

SEQ ID NO: 1122531 - RNA, 19 nt, Homo sapiens
gagauucuguugcuuuuga

SEQ ID NO: 1122532 - RNA, 19 nt, Homo sapiens
gcucaacacggugaucuuu

SEQ ID NO: 1122533 - RNA, 19 nt, Homo sapiens
gaagguggacaucaucauc

SEQ ID NO: 1122534 - RNA, 19 nt, Homo sapiens
guucaaggacaaaguggua

SEQ ID NO: 1122535 - RNA, 19 nt, Homo sapiens
acaagcacguguucaagga

SEQ ID NO: 1122536 - RNA, 19 nt, Homo sapiens
ccacaaacaccuguauaug

SEQ ID NO: 1122537 - RNA, 19 nt, Homo sapiens
gagcagcauaguugauauu

SEQ ID NO: 1122538 - RNA, 19 nt, Homo sapiens
cuggagacauagcaucuuu

SEQ ID NO: 1122539 - RNA, 19 nt, Homo sapiens
gcaaugcguccaucaugug

SEQ ID NO: 1122540 - RNA, 19 nt, Homo sapiens
cucgagagauuauuacuuc

SEQ ID NO: 1122541 - RNA, 19 nt, Homo sapiens
gggcuacugucuguucuau

SEQ ID NO: 1122542 - RNA, 19 nt, Homo sapiens
gaaugugagcagcauaguu

SEQ ID NO: 1122543 - RNA, 19 nt, Homo sapiens
cauagcaucuuugauagca

SEQ ID NO: 1122544 - RNA, 19 nt, Homo sapiens
ggaggaaaauggcggagaa

SEQ ID NO: 1122545 - RNA, 19 nt, Homo sapiens
gauguuaagcagcuaugaa

SEQ ID NO: 1122546 - RNA, 19 nt, Homo sapiens
gcgcgugugccuagaauau

SEQ ID NO: 1122547 - RNA, 19 nt, Homo sapiens
gugagcagcauaguugaua

SEQ ID NO: 1122548 - RNA, 19 nt, Homo sapiens
ggugaccaaugccuguuug

SEQ ID NO: 1122549 - RNA, 19 nt, Homo sapiens
gaaugucuauggcuuugac

SEQ ID NO: 1122550 - RNA, 19 nt, Homo sapiens
uaaacacacaugagaacaa

SEQ ID NO: 1122551 - RNA, 19 nt, Homo sapiens
ugugaaacaucuguaucua

SEQ ID NO: 1122552 - RNA, 19 nt, Homo sapiens
ggacaucguggauccaaag

SEQ ID NO: 1122553 - RNA, 19 nt, Homo sapiens
gucuauggcuuugacauga

SEQ ID NO: 1122554 - RNA, 19 nt, Homo sapiens
cuccgggucuucugaguuu

SEQ ID NO: 1122555 - RNA, 19 nt, Homo sapiens
caacucugccuugaagauu

SEQ ID NO: 1122556 - RNA, 19 nt, Homo sapiens
acaaagugguacuggaugu

SEQ ID NO: 1122557 - RNA, 19 nt, Homo sapiens
gcuaugaaacauucucugu

SEQ ID NO: 1122558 - RNA, 19 nt, Homo sapiens
caucauguguccacucaac

SEQ ID NO: 1122559 - RNA, 19 nt, Homo sapiens
aaugugagcagcauaguug

SEQ ID NO: 1122560 - RNA, 19 nt, Homo sapiens
aucgaaugcuccaguauuu

SEQ ID NO: 1122561 - RNA, 19 nt, Homo sapiens
ggagaugaccucgagagau

SEQ ID NO: 1122562 - RNA, 19 nt, Homo sapiens
acgaggaaaugcugaagga

SEQ ID NO: 1122563 - RNA, 19 nt, Homo sapiens
ccugguagcccuucacgaa

SEQ ID NO: 1122564 - RNA, 19 nt, Homo sapiens
uugcaggacuacacacuug

SEQ ID NO: 1122565 - RNA, 19 nt, Homo sapiens
gaaacaucuguaucuaaug

SEQ ID NO: 1122566 - RNA, 19 nt, Homo sapiens
ucacaguagacuuggauuu

SEQ ID NO: 1122567 - RNA, 19 nt, Homo sapiens
acucacagaagaucauuaa

SEQ ID NO: 1122568 - RNA, 19 nt, Homo sapiens
gcucaauaaacacacauga

SEQ ID NO: 1122569 - RNA, 19 nt, Homo sapiens
guuaagcagcuaugaaaca

SEQ ID NO: 1122570 - RNA, 19 nt, Homo sapiens
gagcuaucguucacaucug

SEQ ID NO: 1122571 - RNA, 19 nt, Homo sapiens
ggagguggacauuuacaca

SEQ ID NO: 1122572 - RNA, 19 nt, Homo sapiens
gguagcgauugaagacaga

SEQ ID NO: 1122573 - RNA, 19 nt, Homo sapiens
uggaugggcuacugucugu

SEQ ID NO: 1122574 - RNA, 19 nt, Homo sapiens
ucaccauauuuaaggguaa

SEQ ID NO: 1122575 - RNA, 19 nt, Homo sapiens
acaacaucaucaccauauu

SEQ ID NO: 1122576 - RNA, 19 nt, Homo sapiens
ucacagaagaucauuaagg

SEQ ID NO: 1122577 - RNA, 19 nt, Homo sapiens
gaccagaaguuucccaaga

SEQ ID NO: 1122578 - RNA, 19 nt, Homo sapiens
ggacgaugaugaacaggaa

SEQ ID NO: 1122579 - RNA, 19 nt, Homo sapiens
aaagugauguuccacaguu

SEQ ID NO: 1122580 - RNA, 19 nt, Homo sapiens
agaagaagcugcggcugaa

SEQ ID NO: 1122581 - RNA, 19 nt, Homo sapiens
guaagaagaacucgcugaa

SEQ ID NO: 1122582 - RNA, 19 nt, Homo sapiens
ggaguugggugaggacgau

SEQ ID NO: 1122583 - RNA, 19 nt, Homo sapiens
cacuauagcaucaaaguug

SEQ ID NO: 1122584 - RNA, 19 nt, Homo sapiens
gagauguggcccucgguuu

SEQ ID NO: 1122585 - RNA, 19 nt, Homo sapiens
ggucacacacuuucugauc

SEQ ID NO: 1122586 - RNA, 19 nt, Homo sapiens
ggcccucgguuuccuuuca

SEQ ID NO: 1122587 - RNA, 19 nt, Homo sapiens
ugaggacgaugaugaacag

SEQ ID NO: 1122588 - RNA, 19 nt, Homo sapiens
gaacaggaagaugaugaca

SEQ ID NO: 1122589 - RNA, 19 nt, Homo sapiens
ccucugggaucccuucaag

SEQ ID NO: 1122590 - RNA, 19 nt, Homo sapiens
gaaccugaacaccaucaag

SEQ ID NO: 1122591 - RNA, 19 nt, Homo sapiens
cggaagcggugggaaaugg

SEQ ID NO: 1122592 - RNA, 19 nt, Homo sapiens
gagaaguuccccaacauga

SEQ ID NO: 1122593 - RNA, 19 nt, Homo sapiens
ccacuauagcaucaaaguu

SEQ ID NO: 1122594 - RNA, 19 nt, Homo sapiens
gcaaaacagagaccaaugu

SEQ ID NO: 1122595 - RNA, 19 nt, Homo sapiens
ugacggcgaccacaacauc

SEQ ID NO: 1122596 - RNA, 19 nt, Homo sapiens
agaagaacucgcugaagga

SEQ ID NO: 1122597 - RNA, 19 nt, Homo sapiens
cacugcagcucaucaaggu

SEQ ID NO: 1122598 - RNA, 19 nt, Homo sapiens
ccgccacuauagcaucaaa

SEQ ID NO: 1122599 - RNA, 19 nt, Homo sapiens
ccaucaacgugcacaaggu

SEQ ID NO: 1122600 - RNA, 19 nt, Homo sapiens
acuauagcaucaaaguugu

SEQ ID NO: 1122601 - RNA, 19 nt, Homo sapiens
aaagaacugaauuggcaaa

SEQ ID NO: 1122602 - RNA, 19 nt, Homo sapiens
gggaggcccacagaaagaa

SEQ ID NO: 1122603 - RNA, 19 nt, Homo sapiens
gaccaaugucuacuuuaag

SEQ ID NO: 1122604 - RNA, 19 nt, Homo sapiens
ggaagcggugggaaaugga

SEQ ID NO: 1122605 - RNA, 19 nt, Homo sapiens
gggugaggacgaugaugaa

SEQ ID NO: 1122606 - RNA, 19 nt, Homo sapiens
aagugauguuccacaguuu

SEQ ID NO: 1122607 - RNA, 19 nt, Homo sapiens
ggacuuccgccacuauagc

SEQ ID NO: 1122608 - RNA, 19 nt, Homo sapiens
gcugccuccucaucgacua

SEQ ID NO: 1122609 - RNA, 19 nt, Homo sapiens
gcccuuccacuccaguaaa

SEQ ID NO: 1122610 - RNA, 19 nt, Homo sapiens
gaagcggugggaaauggau

SEQ ID NO: 1122611 - RNA, 19 nt, Homo sapiens
augaugaacaggaagauga

SEQ ID NO: 1122612 - RNA, 19 nt, Homo sapiens
gaugaugaacaggaagaug

SEQ ID NO: 1122613 - RNA, 19 nt, Homo sapiens
caaagugauguuccacagu

SEQ ID NO: 1122614 - RNA, 19 nt, Homo sapiens
guaugcaugugaagcucau

SEQ ID NO: 1122615 - RNA, 19 nt, Homo sapiens
ggauugaacgccccagauu

SEQ ID NO: 1122616 - RNA, 19 nt, Homo sapiens
agaaguuucccaagaccaa

SEQ ID NO: 1122617 - RNA, 19 nt, Homo sapiens
ugacacugcagcucaucaa

SEQ ID NO: 1122618 - RNA, 19 nt, Homo sapiens
gaacuuggguggccgugua

SEQ ID NO: 1122619 - RNA, 19 nt, Homo sapiens
gaaaggcauugcugagaaa

SEQ ID NO: 1122620 - RNA, 19 nt, Homo sapiens
ggaaaggcauugcugagaa

SEQ ID NO: 1122621 - RNA, 19 nt, Homo sapiens
gcaaaggagugcuggagaa

SEQ ID NO: 1122622 - RNA, 19 nt, Homo sapiens
ggaagcauuucuugaguuc

SEQ ID NO: 1122623 - RNA, 19 nt, Homo sapiens
gaacuagguuaagaaggaa

SEQ ID NO: 1122624 - RNA, 19 nt, Homo sapiens
ggaagagucuguggaugga

SEQ ID NO: 1122625 - RNA, 19 nt, Homo sapiens
agaacuagguuaagaagga

SEQ ID NO: 1122626 - RNA, 19 nt, Homo sapiens
caaauugcuugcagaaaca

SEQ ID NO: 1122627 - RNA, 19 nt, Homo sapiens
ccaaauugcuugcagaaac

SEQ ID NO: 1122628 - RNA, 19 nt, Homo sapiens
gcacuuguacucccuaaau

SEQ ID NO: 1122629 - RNA, 19 nt, Homo sapiens
guucaucucuuguaaggau

SEQ ID NO: 1122630 - RNA, 19 nt, Homo sapiens
ccacggagauggaacugau

SEQ ID NO: 1122631 - RNA, 19 nt, Homo sapiens
gggaagcauuucuugaguu

SEQ ID NO: 1122632 - RNA, 19 nt, Homo sapiens
gaaggaagagucuguggau

SEQ ID NO: 1122633 - RNA, 19 nt, Homo sapiens
gcaaaucccguuucucucu

SEQ ID NO: 1122634 - RNA, 19 nt, Homo sapiens
ggagaucucugagguuguc

SEQ ID NO: 1122635 - RNA, 19 nt, Homo sapiens
gggacaagaugagauugaa

SEQ ID NO: 1122636 - RNA, 19 nt, Homo sapiens
agaaacagcugggaugauc

SEQ ID NO: 1122637 - RNA, 19 nt, Homo sapiens
aggaagagguggcaaagga

SEQ ID NO: 1122638 - RNA, 19 nt, Homo sapiens
ggggacaaauuauacuuua

SEQ ID NO: 1122639 - RNA, 19 nt, Homo sapiens
ggaaagaccacugggacaa

SEQ ID NO: 1122640 - RNA, 19 nt, Homo sapiens
gacaagaugagauugaaga

SEQ ID NO: 1122641 - RNA, 19 nt, Homo sapiens
caaugauucuugacaucuu

SEQ ID NO: 1122642 - RNA, 19 nt, Homo sapiens
cggcacaguugacuuugaa

SEQ ID NO: 1122643 - RNA, 19 nt, Homo sapiens
gaagaguuugugaagauga

SEQ ID NO: 1122644 - RNA, 19 nt, Homo sapiens
gcagaaacagcugggauga

SEQ ID NO: 1122645 - RNA, 19 nt, Homo sapiens
ggaggcugauguuaaugga

SEQ ID NO: 1122646 - RNA, 19 nt, Homo sapiens
uguagacuuugaugacuuu

SEQ ID NO: 1122647 - RNA, 19 nt, Homo sapiens
aauagucucuucuccuguu

SEQ ID NO: 1122648 - RNA, 19 nt, Homo sapiens
uugaagaguuugugaagau

SEQ ID NO: 1122649 - RNA, 19 nt, Homo sapiens
gcacaguugacuuugaaga

SEQ ID NO: 1122650 - RNA, 19 nt, Homo sapiens
gcaaauccgcaugaacuug

SEQ ID NO: 1122651 - RNA, 19 nt, Homo sapiens
cugcagaacuagguuaaga

SEQ ID NO: 1122652 - RNA, 19 nt, Homo sapiens
ggguggccguguagacuuu

SEQ ID NO: 1122653 - RNA, 19 nt, Homo sapiens
uguacucccuaaaucuaua

SEQ ID NO: 1122654 - RNA, 19 nt, Homo sapiens
caaggaguuugacacgaau

SEQ ID NO: 1122655 - RNA, 19 nt, Homo sapiens
ggagugcuggagaagauaa

SEQ ID NO: 1122656 - RNA, 19 nt, Homo sapiens
agacggcacaguugacuuu

SEQ ID NO: 1122657 - RNA, 19 nt, Homo sapiens
uaauggagacggcacaguu

SEQ ID NO: 1122658 - RNA, 19 nt, Homo sapiens
agacuuugaugacuuugug

SEQ ID NO: 1122659 - RNA, 19 nt, Homo sapiens
ucaugaggacgauggguua

SEQ ID NO: 1122660 - RNA, 19 nt, Homo sapiens
aaagaccacugggacaaga

SEQ ID NO: 1122661 - RNA, 19 nt, Homo sapiens
gcaauauauccauguaaca

SEQ ID NO: 1122662 - RNA, 19 nt, Homo sapiens
ggugaugguuacaugaaca

SEQ ID NO: 1122663 - RNA, 19 nt, Homo sapiens
aagagucuguggauggaaa

SEQ ID NO: 1122664 - RNA, 19 nt, Homo sapiens
aaggagugcuggagaagau

SEQ ID NO: 1122665 - RNA, 19 nt, Homo sapiens
gcagaacuagguuaagaag

SEQ ID NO: 1122666 - RNA, 19 nt, Homo sapiens
cagcaaauccgcaugaacu

SEQ ID NO: 1122667 - RNA, 19 nt, Homo sapiens
gcccagacuucaccacuac

SEQ ID NO: 1122668 - RNA, 19 nt, Homo sapiens
gaugcgggaugccuucaag

SEQ ID NO: 1122669 - RNA, 19 nt, Homo sapiens
ggguucaucucuuguaagg

SEQ ID NO: 1122670 - RNA, 19 nt, Homo sapiens
ucaccacuacgcaauauau

SEQ ID NO: 1122671 - RNA, 19 nt, Homo sapiens
caguugacuuugaagaguu

SEQ ID NO: 1122672 - RNA, 19 nt, Homo sapiens
gguaaggggacaaauuaua

SEQ ID NO: 1122673 - RNA, 19 nt, Homo sapiens
cucccuaaaucuauagaaa

SEQ ID NO: 1122674 - RNA, 19 nt, Homo sapiens
gaaagaccacugggacaag

SEQ ID NO: 1122675 - RNA, 19 nt, Homo sapiens
aagcauuucuugaguucga

SEQ ID NO: 1122676 - RNA, 19 nt, Homo sapiens
gacccagagcgguaucuuu

SEQ ID NO: 1122677 - RNA, 19 nt, Homo sapiens
ugaagaguuugugaagaug

SEQ ID NO: 1122678 - RNA, 19 nt, Homo sapiens
guguagacuuugaugacuu

SEQ ID NO: 1122679 - RNA, 19 nt, Homo sapiens
guaaggaucuggggaaucu

SEQ ID NO: 1122680 - RNA, 19 nt, Homo sapiens
uacgcaauauauccaugua

SEQ ID NO: 1122681 - RNA, 19 nt, Homo sapiens
ucacuucacguaguccuaa

SEQ ID NO: 1122682 - RNA, 19 nt, Homo sapiens
cgcaauauauccauguaac

SEQ ID NO: 1122683 - RNA, 19 nt, Homo sapiens
acaguugacuuugaagagu

SEQ ID NO: 1122684 - RNA, 19 nt, Homo sapiens
cgggaagcauuucuugagu

SEQ ID NO: 1122685 - RNA, 19 nt, Homo sapiens
gcgggaagcauuucuugag

SEQ ID NO: 1122686 - RNA, 19 nt, Homo sapiens
ggacaagaugagauugaag

SEQ ID NO: 1122687 - RNA, 19 nt, Homo sapiens
gaauggagauggggagauc

SEQ ID NO: 1122688 - RNA, 19 nt, Homo sapiens
gccagcaaauccgcaugaa

SEQ ID NO: 1122689 - RNA, 19 nt, Homo sapiens
ugagaaacagcgggaaaga

SEQ ID NO: 1122690 - RNA, 19 nt, Homo sapiens
gcaggaagagguggcaaag

SEQ ID NO: 1122691 - RNA, 19 nt, Homo sapiens
ggccagcaaauccgcauga

SEQ ID NO: 1122692 - RNA, 19 nt, Homo sapiens
ugaggacgauggguuacau

SEQ ID NO: 1122693 - RNA, 19 nt, Homo sapiens
ggaaucucaugaggacgau

SEQ ID NO: 1122694 - RNA, 19 nt, Homo sapiens
cuucaccacuacgcaauau

SEQ ID NO: 1122695 - RNA, 19 nt, Homo sapiens
caugaacagcccagacuuc

SEQ ID NO: 1122696 - RNA, 19 nt, Homo sapiens
caggugaugguuacaugaa

SEQ ID NO: 1122697 - RNA, 19 nt, Homo sapiens
gcauuucuugaguucgaua

SEQ ID NO: 1122698 - RNA, 19 nt, Homo sapiens
acccagagcgguaucuuug

SEQ ID NO: 1122699 - RNA, 19 nt, Homo sapiens
gaagagcugcgggaagcau

SEQ ID NO: 1122700 - RNA, 19 nt, Homo sapiens
aaaggaugcaaaucaacaa

SEQ ID NO: 1122701 - RNA, 19 nt, Homo sapiens
ccgguaaggggacaaauua

SEQ ID NO: 1122702 - RNA, 19 nt, Homo sapiens
uuaagaaggaagagucugu

SEQ ID NO: 1122703 - RNA, 19 nt, Homo sapiens
uugcaaaucccguuucucu

SEQ ID NO: 1122704 - RNA, 19 nt, Homo sapiens
ggagauggaacugauugag

SEQ ID NO: 1122705 - RNA, 19 nt, Homo sapiens
cuuguacucccuaaaucua

SEQ ID NO: 1122706 - RNA, 19 nt, Homo sapiens
uuuauucaggugaugguua

SEQ ID NO: 1122707 - RNA, 19 nt, Homo sapiens
caaaggagugcuggagaag

SEQ ID NO: 1122708 - RNA, 19 nt, Homo sapiens
ccacugggacaagaugaga

SEQ ID NO: 1122709 - RNA, 19 nt, Homo sapiens
aguugacuuugaagaguuu

SEQ ID NO: 1122710 - RNA, 19 nt, Homo sapiens
ggcaggaagagguggcaaa

SEQ ID NO: 1122711 - RNA, 19 nt, Homo sapiens
ggagagggcugcuucuuag

SEQ ID NO: 1122712 - RNA, 19 nt, Homo sapiens
ggaagaacccaaacuaaga

SEQ ID NO: 1122713 - RNA, 19 nt, Homo sapiens
ugaguuaaccucccaaaua

SEQ ID NO: 1122714 - RNA, 19 nt, Homo sapiens
gcccuuagcucaagaauac

SEQ ID NO: 1122715 - RNA, 19 nt, Homo sapiens
cagcagaguccuccuauuu

SEQ ID NO: 1122716 - RNA, 19 nt, Homo sapiens
ccaagaaggaguuguguuu

SEQ ID NO: 1122717 - RNA, 19 nt, Homo sapiens
gcucccagcuugguaagua

SEQ ID NO: 1122718 - RNA, 19 nt, Homo sapiens
gaguuaaccucccaaauac

SEQ ID NO: 1122719 - RNA, 19 nt, Homo sapiens
guagcccacucauuaagua

SEQ ID NO: 1122720 - RNA, 19 nt, Homo sapiens
gcccagaugugcuagaaug

SEQ ID NO: 1122721 - RNA, 19 nt, Homo sapiens
gcaaggcgguguacuacgu

SEQ ID NO: 1122722 - RNA, 19 nt, Homo sapiens
caacauacacacugcagaa

SEQ ID NO: 1122723 - RNA, 19 nt, Homo sapiens
gaauggggcuggacaaaga

SEQ ID NO: 1122724 - RNA, 19 nt, Homo sapiens
aagaaggaguuguguuuga

SEQ ID NO: 1122725 - RNA, 19 nt, Homo sapiens
gagggcugcuucuuaguau

SEQ ID NO: 1122726 - RNA, 19 nt, Homo sapiens
agagagaccaggcaacaua

SEQ ID NO: 1122727 - RNA, 19 nt, Homo sapiens
caagcaaccucaaguucug

SEQ ID NO: 1122728 - RNA, 19 nt, Homo sapiens
gcucaagaauacaggauca

SEQ ID NO: 1122729 - RNA, 19 nt, Homo sapiens
gcuuuccucucucuuguuu

SEQ ID NO: 1122730 - RNA, 19 nt, Homo sapiens
aauaaaugcuuuggacuga

SEQ ID NO: 1122731 - RNA, 19 nt, Homo sapiens
gaagggacuuaacauacuc

SEQ ID NO: 1122732 - RNA, 19 nt, Homo sapiens
cugcugagcuggaagacuu

SEQ ID NO: 1122733 - RNA, 19 nt, Homo sapiens
uaaaugcuuuggacugauc

SEQ ID NO: 1122734 - RNA, 19 nt, Homo sapiens
uggagacucugaccgcuuu

SEQ ID NO: 1122735 - RNA, 19 nt, Homo sapiens
cuuaauggcuuuccucucu

SEQ ID NO: 1122736 - RNA, 19 nt, Homo sapiens
ugaagggacuuaacauacu

SEQ ID NO: 1122737 - RNA, 19 nt, Homo sapiens
gaggaguggugguagagau

SEQ ID NO: 1122738 - RNA, 19 nt, Homo sapiens
gaucugugcacgucccuuu

SEQ ID NO: 1122739 - RNA, 19 nt, Homo sapiens
caggagaggcccaggauga

SEQ ID NO: 1122740 - RNA, 19 nt, Homo sapiens
gagcagaggccuuucuuuu

SEQ ID NO: 1122741 - RNA, 19 nt, Homo sapiens
ucucuucauuuccaaguuu

SEQ ID NO: 1122742 - RNA, 19 nt, Homo sapiens
caugacucccuaaccauua

SEQ ID NO: 1122743 - RNA, 19 nt, Homo sapiens
gaacccaaacuaagacagu

SEQ ID NO: 1122744 - RNA, 19 nt, Homo sapiens
guagaacaacucucucuca

SEQ ID NO: 1122745 - RNA, 19 nt, Homo sapiens
cgcuguagcccacucauua

SEQ ID NO: 1122746 - RNA, 19 nt, Homo sapiens
gaaggaugucggucugcua

SEQ ID NO: 1122747 - RNA, 19 nt, Homo sapiens
gcagaguccuccuauuucc

SEQ ID NO: 1122748 - RNA, 19 nt, Homo sapiens
caaggcaggcucucacaug

SEQ ID NO: 1122749 - RNA, 19 nt, Homo sapiens
ccaccaccagggaaucuua

SEQ ID NO: 1122750 - RNA, 19 nt, Homo sapiens
gcuguagcccacucauuaa

SEQ ID NO: 1122751 - RNA, 19 nt, Homo sapiens
gcugcaaggcgguguacua

SEQ ID NO: 1122752 - RNA, 19 nt, Homo sapiens
ggaucuggguuccaagaag

SEQ ID NO: 1122753 - RNA, 19 nt, Homo sapiens
ccauggagcuccgaacuac

SEQ ID NO: 1122754 - RNA, 19 nt, Homo sapiens
gaagaacccaaacuaagac

SEQ ID NO: 1122755 - RNA, 19 nt, Homo sapiens
cuugggcaaucuauacuuu

SEQ ID NO: 1122756 - RNA, 19 nt, Homo sapiens
cauacacacugcagaaggu

SEQ ID NO: 1122757 - RNA, 19 nt, Homo sapiens
cuagaggaguggugguaga

SEQ ID NO: 1122758 - RNA, 19 nt, Homo sapiens
cuacugcugcuuaaccuuu

SEQ ID NO: 1122759 - RNA, 19 nt, Homo sapiens
aggagagggcugcuucuua

SEQ ID NO: 1122760 - RNA, 19 nt, Homo sapiens
caagaaggaguuguguuug

SEQ ID NO: 1122761 - RNA, 19 nt, Homo sapiens
ugucaugacucccuaacca

SEQ ID NO: 1122762 - RNA, 19 nt, Homo sapiens
ggaaacaggcaaggauaag

SEQ ID NO: 1122763 - RNA, 19 nt, Homo sapiens
gccuuggccuucuucaguu

SEQ ID NO: 1122764 - RNA, 19 nt, Homo sapiens
agacacugcugagcuggaa

SEQ ID NO: 1122765 - RNA, 19 nt, Homo sapiens
cuacucauccuuuccuuuc

SEQ ID NO: 1122766 - RNA, 19 nt, Homo sapiens
agagggcugcuucuuagua

SEQ ID NO: 1122767 - RNA, 19 nt, Homo sapiens
gaucacccugccagucuuu

SEQ ID NO: 1122768 - RNA, 19 nt, Homo sapiens
gaacuaccccucagcugaa

SEQ ID NO: 1122769 - RNA, 19 nt, Homo sapiens
ugucuuacccucugcaaau

SEQ ID NO: 1122770 - RNA, 19 nt, Homo sapiens
gaagcaggaccaggauuca

SEQ ID NO: 1122771 - RNA, 19 nt, Homo sapiens
ggagggaugagaacagaag

SEQ ID NO: 1122772 - RNA, 19 nt, Homo sapiens
gggacuuaacauacucuua

SEQ ID NO: 1122773 - RNA, 19 nt, Homo sapiens
ucugaccgcuuucgugcuu

SEQ ID NO: 1122774 - RNA, 19 nt, Homo sapiens
ccgcuuucgugcuuccuuu

SEQ ID NO: 1122775 - RNA, 19 nt, Homo sapiens
ucagcagaguccuccuauu

SEQ ID NO: 1122776 - RNA, 19 nt, Homo sapiens
guugugaggauacgcugua

SEQ ID NO: 1122777 - RNA, 19 nt, Homo sapiens
uggaaacaggcaaggauaa

SEQ ID NO: 1122778 - RNA, 19 nt, Homo sapiens
ccaagcaaccucaaguucu

SEQ ID NO: 1122779 - RNA, 19 nt, Homo sapiens
acugaagggacuuaacaua

SEQ ID NO: 1122780 - RNA, 19 nt, Homo sapiens
cuacugaagggacuuaaca

SEQ ID NO: 1122781 - RNA, 19 nt, Homo sapiens
ggugagcgccaucgugcuu

SEQ ID NO: 1122782 - RNA, 19 nt, Homo sapiens
gcccugaaccaaauaccuu

SEQ ID NO: 1122783 - RNA, 19 nt, Homo sapiens
gaaggugggcugggaggau

SEQ ID NO: 1122784 - RNA, 19 nt, Homo sapiens
ccagagagaccaggcaaca

SEQ ID NO: 1122785 - RNA, 19 nt, Homo sapiens
uuuccuuucuugucuugua

SEQ ID NO: 1122786 - RNA, 19 nt, Homo sapiens
gggcugcuucuuaguaugu

SEQ ID NO: 1122787 - RNA, 19 nt, Homo sapiens
ccucaaguucuggcuguua

SEQ ID NO: 1122788 - RNA, 19 nt, Homo sapiens
ccagguagaacaacucucu

SEQ ID NO: 1122789 - RNA, 19 nt, Homo sapiens
gaaacaggcaaggauaagg

SEQ ID NO: 1122790 - RNA, 19 nt, Homo sapiens
gcccuggcccugaaccaaa

SEQ ID NO: 1122791 - RNA, 19 nt, Homo sapiens
uggaagaacccaaacuaag

SEQ ID NO: 1122792 - RNA, 19 nt, Homo sapiens
ggucuggguccucguggaa

SEQ ID NO: 1122793 - RNA, 19 nt, Homo sapiens
aggacuuuaugccuguuua

SEQ ID NO: 1122794 - RNA, 19 nt, Homo sapiens
gacuagaggagugguggua

SEQ ID NO: 1122795 - RNA, 19 nt, Homo sapiens
ucaugacucccuaaccauu

SEQ ID NO: 1122796 - RNA, 19 nt, Homo sapiens
cuucaccgcuggagaucug

SEQ ID NO: 1122797 - RNA, 19 nt, Homo sapiens
ggaggaggcauggcaccuu

SEQ ID NO: 1122798 - RNA, 19 nt, Homo sapiens
agaaggaguuguguuugag

SEQ ID NO: 1122799 - RNA, 19 nt, Homo sapiens
cugcuuaaccuuucagcuu

SEQ ID NO: 1122800 - RNA, 19 nt, Homo sapiens
aaggugggcugggaggauu

SEQ ID NO: 1122801 - RNA, 19 nt, Homo sapiens
gaggagagggcugcuucuu

SEQ ID NO: 1122802 - RNA, 19 nt, Homo sapiens
ccaagcccuuagcucaaga

SEQ ID NO: 1122803 - RNA, 19 nt, Homo sapiens
cuugaacccucguaaacuc

SEQ ID NO: 1122804 - RNA, 19 nt, Homo sapiens
ugugcgcgcucagcaugua

SEQ ID NO: 1122805 - RNA, 19 nt, Homo sapiens
gaccaggauucagcagagu

SEQ ID NO: 1122806 - RNA, 19 nt, Homo sapiens
uuuccucucucuuguuuua

SEQ ID NO: 1122807 - RNA, 19 nt, Homo sapiens
caucacaggugggguuuug

SEQ ID NO: 1122808 - RNA, 19 nt, Homo sapiens
aaccuagcaccaugccuua

SEQ ID NO: 1122809 - RNA, 19 nt, Homo sapiens
acucauccuuuccuuucuu

SEQ ID NO: 1122810 - RNA, 19 nt, Homo sapiens
ccucgccuacugcugcuua

SEQ ID NO: 1122811 - RNA, 19 nt, Homo sapiens
gcacaacccuggcaauuug

SEQ ID NO: 1122812 - RNA, 19 nt, Homo sapiens
ggaacuaucugaagaaauc

SEQ ID NO: 1122813 - RNA, 19 nt, Homo sapiens
gaaacugccuuaacuugaa

SEQ ID NO: 1122814 - RNA, 19 nt, Homo sapiens
agaaaucacuacacucuua

SEQ ID NO: 1122815 - RNA, 19 nt, Homo sapiens
ggaauaagaagaacuguuu

SEQ ID NO: 1122816 - RNA, 19 nt, Homo sapiens
gcaagaaacugccuuaacu

SEQ ID NO: 1122817 - RNA, 19 nt, Homo sapiens
ugacagguaugaaagguua

SEQ ID NO: 1122818 - RNA, 19 nt, Homo sapiens
ggaaauaagcugaaaugaa

SEQ ID NO: 1122819 - RNA, 19 nt, Homo sapiens
gaacucagccacagauuug

SEQ ID NO: 1122820 - RNA, 19 nt, Homo sapiens
gaaccugaaugccuacuug

SEQ ID NO: 1122821 - RNA, 19 nt, Homo sapiens
ccucgaggcuuuagucaua

SEQ ID NO: 1122822 - RNA, 19 nt, Homo sapiens
gaguaucccuuaugugaaa

SEQ ID NO: 1122823 - RNA, 19 nt, Homo sapiens
caaguugucccucacauua

SEQ ID NO: 1122824 - RNA, 19 nt, Homo sapiens
gagaaaguguguucauguu

SEQ ID NO: 1122825 - RNA, 19 nt, Homo sapiens
gaagauauaucagcaugug

SEQ ID NO: 1122826 - RNA, 19 nt, Homo sapiens
gggagggaaugcugaauaa

SEQ ID NO: 1122827 - RNA, 19 nt, Homo sapiens
agggaaugcugaauaauua

SEQ ID NO: 1122828 - RNA, 19 nt, Homo sapiens
gaaauucacguaacauaga

SEQ ID NO: 1122829 - RNA, 19 nt, Homo sapiens
gaacaugcuguaaguaauu

SEQ ID NO: 1122830 - RNA, 19 nt, Homo sapiens
gaaauauggcugacaggua

SEQ ID NO: 1122831 - RNA, 19 nt, Homo sapiens
gccuaaagguaauuugaua

SEQ ID NO: 1122832 - RNA, 19 nt, Homo sapiens
auacauagccuaaagguaa

SEQ ID NO: 1122833 - RNA, 19 nt, Homo sapiens
ugaaggaacuaucugaaga

SEQ ID NO: 1122834 - RNA, 19 nt, Homo sapiens
gaacuggccuuaggagauc

SEQ ID NO: 1122835 - RNA, 19 nt, Homo sapiens
ggaaucaagaucagcaaua

SEQ ID NO: 1122836 - RNA, 19 nt, Homo sapiens
gaagaaaucacuacacucu

SEQ ID NO: 1122837 - RNA, 19 nt, Homo sapiens
gagaucaguuauggaauuu

SEQ ID NO: 1122838 - RNA, 19 nt, Homo sapiens
gaagaaagacacagacauc

SEQ ID NO: 1122839 - RNA, 19 nt, Homo sapiens
gaaacuuuauggugauguu

SEQ ID NO: 1122840 - RNA, 19 nt, Homo sapiens
ugauagaguuugcaagaaa

SEQ ID NO: 1122841 - RNA, 19 nt, Homo sapiens
ugagaucaguuauggaauu

SEQ ID NO: 1122842 - RNA, 19 nt, Homo sapiens
ggaacaugcuguaaguaau

SEQ ID NO: 1122843 - RNA, 19 nt, Homo sapiens
gaaaguguguucauguuuu

SEQ ID NO: 1122844 - RNA, 19 nt, Homo sapiens
cgaggacccugugaaauuu

SEQ ID NO: 1122845 - RNA, 19 nt, Homo sapiens
aaauauggcugacagguau

SEQ ID NO: 1122846 - RNA, 19 nt, Homo sapiens
ccagugaaguucuuuacaa

SEQ ID NO: 1122847 - RNA, 19 nt, Homo sapiens
gagcaaccaccaccuuuaa

SEQ ID NO: 1122848 - RNA, 19 nt, Homo sapiens
ucauugaacuggcaaauca

SEQ ID NO: 1122849 - RNA, 19 nt, Homo sapiens
guacauagacuccauugau

SEQ ID NO: 1122850 - RNA, 19 nt, Homo sapiens
gagggaaugcugaauaauu

SEQ ID NO: 1122851 - RNA, 19 nt, Homo sapiens
guucuucugugcucucaua

SEQ ID NO: 1122852 - RNA, 19 nt, Homo sapiens
ccaccaccuuuaacuauuu

SEQ ID NO: 1122853 - RNA, 19 nt, Homo sapiens
ccaguuccauccugaguuu

SEQ ID NO: 1122854 - RNA, 19 nt, Homo sapiens
ccacagaguuuaggccaaa

SEQ ID NO: 1122855 - RNA, 19 nt, Homo sapiens
ugaggccucugaaauaauu

SEQ ID NO: 1122856 - RNA, 19 nt, Homo sapiens
gggaacaugcuguaaguaa

SEQ ID NO: 1122857 - RNA, 19 nt, Homo sapiens
gggaaucugauaauacaua

SEQ ID NO: 1122858 - RNA, 19 nt, Homo sapiens
gaaucaagaucagcaauac

SEQ ID NO: 1122859 - RNA, 19 nt, Homo sapiens
guggagaaguugauuuaga

SEQ ID NO: 1122860 - RNA, 19 nt, Homo sapiens
ccacuauucugccaaugaa

SEQ ID NO: 1122861 - RNA, 19 nt, Homo sapiens
ucagucaggcuuccauuua

SEQ ID NO: 1122862 - RNA, 19 nt, Homo sapiens
gaaggaacuaucugaagaa

SEQ ID NO: 1122863 - RNA, 19 nt, Homo sapiens
augcaaagcugaugguauu

SEQ ID NO: 1122864 - RNA, 19 nt, Homo sapiens
gaaaaugagucacuguguu

SEQ ID NO: 1122865 - RNA, 19 nt, Homo sapiens
cagggaaucugauaauaca

SEQ ID NO: 1122866 - RNA, 19 nt, Homo sapiens
ggaacucagccacagauuu

SEQ ID NO: 1122867 - RNA, 19 nt, Homo sapiens
ggucucggcuugccaggaa

SEQ ID NO: 1122868 - RNA, 19 nt, Homo sapiens
gguaaacccuaaccugauc

SEQ ID NO: 1122869 - RNA, 19 nt, Homo sapiens
acaaugagacugggaauaa

SEQ ID NO: 1122870 - RNA, 19 nt, Homo sapiens
ggagaaaguguguucaugu

SEQ ID NO: 1122871 - RNA, 19 nt, Homo sapiens
agacaucgguucgagguaa

SEQ ID NO: 1122872 - RNA, 19 nt, Homo sapiens
gaacaggucauauguaucc

SEQ ID NO: 1122873 - RNA, 19 nt, Homo sapiens
gcucagugcuaccggagaa

SEQ ID NO: 1122874 - RNA, 19 nt, Homo sapiens
cagaugaugcuaaccuaua

SEQ ID NO: 1122875 - RNA, 19 nt, Homo sapiens
ucauaaugcuuaaccaugu

SEQ ID NO: 1122876 - RNA, 19 nt, Homo sapiens
aaggauagcugaguuggaa

SEQ ID NO: 1122877 - RNA, 19 nt, Homo sapiens
cugaacaggucauauguau

SEQ ID NO: 1122878 - RNA, 19 nt, Homo sapiens
cugcuaaccucgaggcuuu

SEQ ID NO: 1122879 - RNA, 19 nt, Homo sapiens
aagcugaaaugaauacaug

SEQ ID NO: 1122880 - RNA, 19 nt, Homo sapiens
cacagggaaucugauaaua

SEQ ID NO: 1122881 - RNA, 19 nt, Homo sapiens
ugugaggccucugaaauaa

SEQ ID NO: 1122882 - RNA, 19 nt, Homo sapiens
gcauggcguuugcaagguu

SEQ ID NO: 1122883 - RNA, 19 nt, Homo sapiens
gaauacaugacugggaaua

SEQ ID NO: 1122884 - RNA, 19 nt, Homo sapiens
ggauggaaaucauugaacu

SEQ ID NO: 1122885 - RNA, 19 nt, Homo sapiens
cagaaugacuuaaguuuug

SEQ ID NO: 1122886 - RNA, 19 nt, Homo sapiens
gaagugccuuugcaaaauu

SEQ ID NO: 1122887 - RNA, 19 nt, Homo sapiens
gagcacaacccuggcaauu

SEQ ID NO: 1122888 - RNA, 19 nt, Homo sapiens
ggaacuggccuuaggagau

SEQ ID NO: 1122889 - RNA, 19 nt, Homo sapiens
caauauauguggucuuuug

SEQ ID NO: 1122890 - RNA, 19 nt, Homo sapiens
ugaacaauuugguugcauu

SEQ ID NO: 1122891 - RNA, 19 nt, Homo sapiens
gggagaaaguguguucaug

SEQ ID NO: 1122892 - RNA, 19 nt, Homo sapiens
caaagcugaugguauucuu

SEQ ID NO: 1122893 - RNA, 19 nt, Homo sapiens
ccgaggacccugugaaauu

SEQ ID NO: 1122894 - RNA, 19 nt, Homo sapiens
ccugagcgcuccugcaguu

SEQ ID NO: 1122895 - RNA, 19 nt, Homo sapiens
caaccaccaccuuuaacua

SEQ ID NO: 1122896 - RNA, 19 nt, Homo sapiens
caagaucauugcaguuucu

SEQ ID NO: 1122897 - RNA, 19 nt, Homo sapiens
ugccuuaacuugaaagaug

SEQ ID NO: 1122898 - RNA, 19 nt, Homo sapiens
aaacugccuuaacuugaaa

SEQ ID NO: 1122899 - RNA, 19 nt, Homo sapiens
gaucauugccagcagcauu

SEQ ID NO: 1122900 - RNA, 19 nt, Homo sapiens
caaauagggaaccaagauu

SEQ ID NO: 1122901 - RNA, 19 nt, Homo sapiens
ggaaucugauaauacauac

SEQ ID NO: 1122902 - RNA, 19 nt, Homo sapiens
caaaauaaaugccuguaca

SEQ ID NO: 1122903 - RNA, 19 nt, Homo sapiens
caugagaucaguuauggaa

SEQ ID NO: 1122904 - RNA, 19 nt, Homo sapiens
uugaauagguccaagacuu

SEQ ID NO: 1122905 - RNA, 19 nt, Homo sapiens
gcaaggacaaagaagauuc

SEQ ID NO: 1122906 - RNA, 19 nt, Homo sapiens
gcaaguugucccucacauu

SEQ ID NO: 1122907 - RNA, 19 nt, Homo sapiens
ccuuggaaauuaugaaaga

SEQ ID NO: 1122908 - RNA, 19 nt, Homo sapiens
ccaaauagggaaccaagau

SEQ ID NO: 1122909 - RNA, 19 nt, Homo sapiens
gaacaauuugguugcauuc

SEQ ID NO: 1122910 - RNA, 19 nt, Homo sapiens
ggcaugagaucaguuaugg

SEQ ID NO: 1122911 - RNA, 19 nt, Homo sapiens
gcacaacccuggcaauuug

SEQ ID NO: 1122912 - RNA, 19 nt, Homo sapiens
ggaacuaucugaagaaauc

SEQ ID NO: 1122913 - RNA, 19 nt, Homo sapiens
gaaacugccuuaacuugaa

SEQ ID NO: 1122914 - RNA, 19 nt, Homo sapiens
agaaaucacuacacucuua

SEQ ID NO: 1122915 - RNA, 19 nt, Homo sapiens
ggaauaagaagaacuguuu

SEQ ID NO: 1122916 - RNA, 19 nt, Homo sapiens
gcaagaaacugccuuaacu

SEQ ID NO: 1122917 - RNA, 19 nt, Homo sapiens
ugacagguaugaaagguua

SEQ ID NO: 1122918 - RNA, 19 nt, Homo sapiens
ggaaauaagcugaaaugaa

SEQ ID NO: 1122919 - RNA, 19 nt, Homo sapiens
gaacucagccacagauuug

SEQ ID NO: 1122920 - RNA, 19 nt, Homo sapiens
gaaccugaaugccuacuug

SEQ ID NO: 1122921 - RNA, 19 nt, Homo sapiens
ccucgaggcuuuagucaua

SEQ ID NO: 1122922 - RNA, 19 nt, Homo sapiens
gaguaucccuuaugugaaa

SEQ ID NO: 1122923 - RNA, 19 nt, Homo sapiens
caaguugucccucacauua

SEQ ID NO: 1122924 - RNA, 19 nt, Homo sapiens
gagaaaguguguucauguu

SEQ ID NO: 1122925 - RNA, 19 nt, Homo sapiens
gaagauauaucagcaugug

SEQ ID NO: 1122926 - RNA, 19 nt, Homo sapiens
gggagggaaugcugaauaa

SEQ ID NO: 1122927 - RNA, 19 nt, Homo sapiens
agggaaugcugaauaauua

SEQ ID NO: 1122928 - RNA, 19 nt, Homo sapiens
gaaauucacguaacauaga

SEQ ID NO: 1122929 - RNA, 19 nt, Homo sapiens
gaacaugcuguaaguaauu

SEQ ID NO: 1122930 - RNA, 19 nt, Homo sapiens
gaaauauggcugacaggua

SEQ ID NO: 1122931 - RNA, 19 nt, Homo sapiens
gccuaaagguaauuugaua

SEQ ID NO: 1122932 - RNA, 19 nt, Homo sapiens
auacauagccuaaagguaa

SEQ ID NO: 1122933 - RNA, 19 nt, Homo sapiens
ugaaggaacuaucugaaga

SEQ ID NO: 1122934 - RNA, 19 nt, Homo sapiens
gaacuggccuuaggagauc

SEQ ID NO: 1122935 - RNA, 19 nt, Homo sapiens
ggaaucaagaucagcaaua

SEQ ID NO: 1122936 - RNA, 19 nt, Homo sapiens
gaagaaaucacuacacucu

SEQ ID NO: 1122937 - RNA, 19 nt, Homo sapiens
gagaucaguuauggaauuu

SEQ ID NO: 1122938 - RNA, 19 nt, Homo sapiens
gaagaaagacacagacauc

SEQ ID NO: 1122939 - RNA, 19 nt, Homo sapiens
gaaacuuuauggugauguu

SEQ ID NO: 1122940 - RNA, 19 nt, Homo sapiens
ugauagaguuugcaagaaa

SEQ ID NO: 1122941 - RNA, 19 nt, Homo sapiens
ugagaucaguuauggaauu

SEQ ID NO: 1122942 - RNA, 19 nt, Homo sapiens
ggaacaugcuguaaguaau

SEQ ID NO: 1122943 - RNA, 19 nt, Homo sapiens
gaaaguguguucauguuuu

SEQ ID NO: 1122944 - RNA, 19 nt, Homo sapiens
cgaggacccugugaaauuu

SEQ ID NO: 1122945 - RNA, 19 nt, Homo sapiens
aaauauggcugacagguau

SEQ ID NO: 1122946 - RNA, 19 nt, Homo sapiens
gagcaaccaccaccuuuaa

SEQ ID NO: 1122947 - RNA, 19 nt, Homo sapiens
ucauugaacuggcaaauca

SEQ ID NO: 1122948 - RNA, 19 nt, Homo sapiens
guacauagacuccauugau

SEQ ID NO: 1122949 - RNA, 19 nt, Homo sapiens
gagggaaugcugaauaauu

SEQ ID NO: 1122950 - RNA, 19 nt, Homo sapiens
guucuucugugcucucaua

SEQ ID NO: 1122951 - RNA, 19 nt, Homo sapiens
ccaccaccuuuaacuauuu

SEQ ID NO: 1122952 - RNA, 19 nt, Homo sapiens
ccaguuccauccugaguuu

SEQ ID NO: 1122953 - RNA, 19 nt, Homo sapiens
ccacagaguuuaggccaaa

SEQ ID NO: 1122954 - RNA, 19 nt, Homo sapiens
ugaggccucugaaauaauu

SEQ ID NO: 1122955 - RNA, 19 nt, Homo sapiens
gggaacaugcuguaaguaa

SEQ ID NO: 1122956 - RNA, 19 nt, Homo sapiens
gggaaucugauaauacaua

SEQ ID NO: 1122957 - RNA, 19 nt, Homo sapiens
ccacuauucugccaaugaa

SEQ ID NO: 1122958 - RNA, 19 nt, Homo sapiens
gaaucaagaucagcaauac

SEQ ID NO: 1122959 - RNA, 19 nt, Homo sapiens
guggagaaguugauuuaga

SEQ ID NO: 1122960 - RNA, 19 nt, Homo sapiens
ucagucaggcuuccauuua

SEQ ID NO: 1122961 - RNA, 19 nt, Homo sapiens
gaaggaacuaucugaagaa

SEQ ID NO: 1122962 - RNA, 19 nt, Homo sapiens
augcaaagcugaugguauu

SEQ ID NO: 1122963 - RNA, 19 nt, Homo sapiens
gaaaaugagucacuguguu

SEQ ID NO: 1122964 - RNA, 19 nt, Homo sapiens
cagggaaucugauaauaca

SEQ ID NO: 1122965 - RNA, 19 nt, Homo sapiens
ggaacucagccacagauuu

SEQ ID NO: 1122966 - RNA, 19 nt, Homo sapiens
gguaaacccuaaccugauc

SEQ ID NO: 1122967 - RNA, 19 nt, Homo sapiens
acaaugagacugggaauaa

SEQ ID NO: 1122968 - RNA, 19 nt, Homo sapiens
ggagaaaguguguucaugu

SEQ ID NO: 1122969 - RNA, 19 nt, Homo sapiens
agacaucgguucgagguaa

SEQ ID NO: 1122970 - RNA, 19 nt, Homo sapiens
gaacaggucauauguaucc

SEQ ID NO: 1122971 - RNA, 19 nt, Homo sapiens
gcucagugcuaccggagaa

SEQ ID NO: 1122972 - RNA, 19 nt, Homo sapiens
cagaugaugcuaaccuaua

SEQ ID NO: 1122973 - RNA, 19 nt, Homo sapiens
ucauaaugcuuaaccaugu

SEQ ID NO: 1122974 - RNA, 19 nt, Homo sapiens
aaggauagcugaguuggaa

SEQ ID NO: 1122975 - RNA, 19 nt, Homo sapiens
cugaacaggucauauguau

SEQ ID NO: 1122976 - RNA, 19 nt, Homo sapiens
cugcuaaccucgaggcuuu

SEQ ID NO: 1122977 - RNA, 19 nt, Homo sapiens
aagcugaaaugaauacaug

SEQ ID NO: 1122978 - RNA, 19 nt, Homo sapiens
cacagggaaucugauaaua

SEQ ID NO: 1122979 - RNA, 19 nt, Homo sapiens
ugugaggccucugaaauaa

SEQ ID NO: 1122980 - RNA, 19 nt, Homo sapiens
gcauggcguuugcaagguu

SEQ ID NO: 1122981 - RNA, 19 nt, Homo sapiens
gaauacaugacugggaaua

SEQ ID NO: 1122982 - RNA, 19 nt, Homo sapiens
ggauggaaaucauugaacu

SEQ ID NO: 1122983 - RNA, 19 nt, Homo sapiens
cagaaugacuuaaguuuug

SEQ ID NO: 1122984 - RNA, 19 nt, Homo sapiens
gagcacaacccuggcaauu

SEQ ID NO: 1122985 - RNA, 19 nt, Homo sapiens
ggaacuggccuuaggagau

SEQ ID NO: 1122986 - RNA, 19 nt, Homo sapiens
caauauauguggucuuuug

SEQ ID NO: 1122987 - RNA, 19 nt, Homo sapiens
ugaacaauuugguugcauu

SEQ ID NO: 1122988 - RNA, 19 nt, Homo sapiens
gggagaaaguguguucaug

SEQ ID NO: 1122989 - RNA, 19 nt, Homo sapiens
caaagcugaugguauucuu

SEQ ID NO: 1122990 - RNA, 19 nt, Homo sapiens
ccgaggacccugugaaauu

SEQ ID NO: 1122991 - RNA, 19 nt, Homo sapiens
caaccaccaccuuuaacua

SEQ ID NO: 1122992 - RNA, 19 nt, Homo sapiens
caagaucauugcaguuucu

SEQ ID NO: 1122993 - RNA, 19 nt, Homo sapiens
gaucauugccagcagcauu

SEQ ID NO: 1122994 - RNA, 19 nt, Homo sapiens
ugccuuaacuugaaagaug

SEQ ID NO: 1122995 - RNA, 19 nt, Homo sapiens
aaacugccuuaacuugaaa

SEQ ID NO: 1122996 - RNA, 19 nt, Homo sapiens
caaauagggaaccaagauu

SEQ ID NO: 1122997 - RNA, 19 nt, Homo sapiens
ggaaucugauaauacauac

SEQ ID NO: 1122998 - RNA, 19 nt, Homo sapiens
caaaauaaaugccuguaca

SEQ ID NO: 1122999 - RNA, 19 nt, Homo sapiens
caugagaucaguuauggaa

SEQ ID NO: 1123000 - RNA, 19 nt, Homo sapiens
uugaauagguccaagacuu

SEQ ID NO: 1123001 - RNA, 19 nt, Homo sapiens
gcaaggacaaagaagauuc

SEQ ID NO: 1123002 - RNA, 19 nt, Homo sapiens
gcaaguugucccucacauu

SEQ ID NO: 1123003 - RNA, 19 nt, Homo sapiens
ccuuggaaauuaugaaaga

SEQ ID NO: 1123004 - RNA, 19 nt, Homo sapiens
ccaaauagggaaccaagau

SEQ ID NO: 1123005 - RNA, 19 nt, Homo sapiens
gaacaauuugguugcauuc

SEQ ID NO: 1123006 - RNA, 19 nt, Homo sapiens
ggcaugagaucaguuaugg

SEQ ID NO: 1123007 - RNA, 19 nt, Homo sapiens
caaaguuucgacugcauuu

SEQ ID NO: 1123008 - RNA, 19 nt, Homo sapiens
cagcagcauuggaacgauu

SEQ ID NO: 1123009 - RNA, 19 nt, Homo sapiens
gagacaggauggaaaucau

SEQ ID NO: 1123010 - RNA, 19 nt, Homo sapiens
gagcagaaugacuuaaguu

SEQ ID NO: 1123011 - RNA, 19 nt, Homo sapiens
gagcguagccuguacauaa

SEQ ID NO: 1123012 - RNA, 19 nt, Homo sapiens
ggacaaagacccagaauag

SEQ ID NO: 1123013 - RNA, 19 nt, Homo sapiens
ggaaagaagcgaccgguuu

SEQ ID NO: 1123014 - RNA, 19 nt, Homo sapiens
ggaagcugcuacuuacuug

SEQ ID NO: 1123015 - RNA, 19 nt, Homo sapiens
gcaaucugcucaucaaguc

SEQ ID NO: 1123016 - RNA, 19 nt, Homo sapiens
ccggaagagugaccuguua

SEQ ID NO: 1123017 - RNA, 19 nt, Homo sapiens
acaaagacccagaauagaa

SEQ ID NO: 1123018 - RNA, 19 nt, Homo sapiens
gcaagaagagggcgauuag

SEQ ID NO: 1123019 - RNA, 19 nt, Homo sapiens
gcagaaaguggcaagaaga

SEQ ID NO: 1123020 - RNA, 19 nt, Homo sapiens
cgauaaauaccuuugauug

SEQ ID NO: 1123021 - RNA, 19 nt, Homo sapiens
ggaagagugaccuguuaaa

SEQ ID NO: 1123022 - RNA, 19 nt, Homo sapiens
gcugcaaucugcucaucaa

SEQ ID NO: 1123023 - RNA, 19 nt, Homo sapiens
gcggacggcuuuagaagag

SEQ ID NO: 1123024 - RNA, 19 nt, Homo sapiens
caaaagugcucuugacauc

SEQ ID NO: 1123025 - RNA, 19 nt, Homo sapiens
gggacaaagacccagaaua

SEQ ID NO: 1123026 - RNA, 19 nt, Homo sapiens
ggacgagcguagccuguac

SEQ ID NO: 1123027 - RNA, 19 nt, Homo sapiens
guguuuguuugcuugaaua

SEQ ID NO: 1123028 - RNA, 19 nt, Homo sapiens
gcgauaaauaccuuugauu

SEQ ID NO: 1123029 - RNA, 19 nt, Homo sapiens
augcaacauuuaagcguua

SEQ ID NO: 1123030 - RNA, 19 nt, Homo sapiens
gacaaagacccagaauaga

SEQ ID NO: 1123031 - RNA, 19 nt, Homo sapiens
ggcaagaagagggcgauua

SEQ ID NO: 1123032 - RNA, 19 nt, Homo sapiens
gcaaaccugucggagucaa

SEQ ID NO: 1123033 - RNA, 19 nt, Homo sapiens
ggcgauaaauaccuuugau

SEQ ID NO: 1123034 - RNA, 19 nt, Homo sapiens
gcagcggacggcuuuagaa

SEQ ID NO: 1123035 - RNA, 19 nt, Homo sapiens
ggggugaguuguuucuuuu

SEQ ID NO: 1123036 - RNA, 19 nt, Homo sapiens
ucccacgccugcccacuuu

SEQ ID NO: 1123037 - RNA, 19 nt, Homo sapiens
ccgagggcaugaucaacuu

SEQ ID NO: 1123038 - RNA, 19 nt, Homo sapiens
caaagacccagaauagaac

SEQ ID NO: 1123039 - RNA, 19 nt, Homo sapiens
gaagagugaccuguuaaaa

SEQ ID NO: 1123040 - RNA, 19 nt, Homo sapiens
cggagucaauuauuucucu

SEQ ID NO: 1123041 - RNA, 19 nt, Homo sapiens
aauuauuucucucgacuuc

SEQ ID NO: 1123042 - RNA, 19 nt, Homo sapiens
cagcagaaaguggcaagaa

SEQ ID NO: 1123043 - RNA, 19 nt, Homo sapiens
ggucuucggcaucuucuuc

SEQ ID NO: 1123044 - RNA, 19 nt, Homo sapiens
cagaauagaacucguagcu

SEQ ID NO: 1123045 - RNA, 19 nt, Homo sapiens
gaguuacaguuuugucauu

SEQ ID NO: 1123046 - RNA, 19 nt, Homo sapiens
uugccugccugaggaguua

SEQ ID NO: 1123047 - RNA, 19 nt, Homo sapiens
uuuggaagcugcuacuuac

SEQ ID NO: 1123048 - RNA, 19 nt, Homo sapiens
cuuuggaagcugcuacuua

SEQ ID NO: 1123049 - RNA, 19 nt, Homo sapiens
gcacgguuuacgccacaaa

SEQ ID NO: 1123050 - RNA, 19 nt, Homo sapiens
cggaagagugaccuguuaa

SEQ ID NO: 1123051 - RNA, 19 nt, Homo sapiens
gcucuugacauccgugaca

SEQ ID NO: 1123052 - RNA, 19 nt, Homo sapiens
cugucggagucaauuauuu

SEQ ID NO: 1123053 - RNA, 19 nt, Homo sapiens
uaagagguuuuguguuugu

SEQ ID NO: 1123054 - RNA, 19 nt, Homo sapiens
gggcgauaaauaccuuuga

SEQ ID NO: 1123055 - RNA, 19 nt, Homo sapiens
uggaagcugcuacuuacuu

SEQ ID NO: 1123056 - RNA, 19 nt, Homo sapiens
ucucucgacuucggccuuu

SEQ ID NO: 1123057 - RNA, 19 nt, Homo sapiens
gggagccugcgaauuugaa

SEQ ID NO: 1123058 - RNA, 19 nt, Homo sapiens
ggucaugugcgugcucuca

SEQ ID NO: 1123059 - RNA, 19 nt, Homo sapiens
gugcagaucgcggucaugu

SEQ ID NO: 1123060 - RNA, 19 nt, Homo sapiens
ccacaaaagugcucuugac

SEQ ID NO: 1123061 - RNA, 19 nt, Homo sapiens
gaacucguagcucgugacu

SEQ ID NO: 1123062 - RNA, 19 nt, Homo sapiens
gccugaggaguuacaguuu

SEQ ID NO: 1123063 - RNA, 19 nt, Homo sapiens
gagaggcuccugggaaacu

SEQ ID NO: 1123064 - RNA, 19 nt, Homo sapiens
aaaccugucggagucaauu

SEQ ID NO: 1123065 - RNA, 19 nt, Homo sapiens
gauaacagcuugaacauua

SEQ ID NO: 1123066 - RNA, 19 nt, Homo sapiens
gcaccuggccuacguauua

SEQ ID NO: 1123067 - RNA, 19 nt, Homo sapiens
gaagcuaaaucaucaaaga

SEQ ID NO: 1123068 - RNA, 19 nt, Homo sapiens
gcacggagguuucacauca

SEQ ID NO: 1123069 - RNA, 19 nt, Homo sapiens
ggcuauugcuucagaauua

SEQ ID NO: 1123070 - RNA, 19 nt, Homo sapiens
gaagagagggugagaaaca

SEQ ID NO: 1123071 - RNA, 19 nt, Homo sapiens
ccaaguagcugggauuaca

SEQ ID NO: 1123072 - RNA, 19 nt, Homo sapiens
ggagucuguuacaagauua

SEQ ID NO: 1123073 - RNA, 19 nt, Homo sapiens
cguauuaggcuuuauguaa

SEQ ID NO: 1123074 - RNA, 19 nt, Homo sapiens
gcacaaccauacuguuaag

SEQ ID NO: 1123075 - RNA, 19 nt, Homo sapiens
cuuaacugcucuauagaua

SEQ ID NO: 1123076 - RNA, 19 nt, Homo sapiens
gcuaaaucaucaaagaaug

SEQ ID NO: 1123077 - RNA, 19 nt, Homo sapiens
agaauuauguggagucugu

SEQ ID NO: 1123078 - RNA, 19 nt, Homo sapiens
ggaaagagugaauaugugu

SEQ ID NO: 1123079 - RNA, 19 nt, Homo sapiens
gcaccacauucagcauuaa

SEQ ID NO: 1123080 - RNA, 19 nt, Homo sapiens
guauuaggcuuuauguaag

SEQ ID NO: 1123081 - RNA, 19 nt, Homo sapiens
cgaaacauacggccauaaa

SEQ ID NO: 1123082 - RNA, 19 nt, Homo sapiens
caucaaagaaugcaauuuc

SEQ ID NO: 1123083 - RNA, 19 nt, Homo sapiens
uggcugggcuggucucaaa

SEQ ID NO: 1123084 - RNA, 19 nt, Homo sapiens
ccgcacaaccauacuguua

SEQ ID NO: 1123085 - RNA, 19 nt, Homo sapiens
caauuuccauauccuaaug

SEQ ID NO: 1123086 - RNA, 19 nt, Homo sapiens
cgaacagccucacuugugu

SEQ ID NO: 1123087 - RNA, 19 nt, Homo sapiens
gagagggugagaaacauaa

SEQ ID NO: 1123088 - RNA, 19 nt, Homo sapiens
uaacugcucuauagauaac

SEQ ID NO: 1123089 - RNA, 19 nt, Homo sapiens
ccaaagugcugggauuaca

SEQ ID NO: 1123090 - RNA, 19 nt, Homo sapiens
gaucgaacagccucacuug

SEQ ID NO: 1123091 - RNA, 19 nt, Homo sapiens
caguacgccuggcuaguuu

SEQ ID NO: 1123092 - RNA, 19 nt, Homo sapiens
gaaggcuccuggaaagagu

SEQ ID NO: 1123093 - RNA, 19 nt, Homo sapiens
ggagguuucacaucauauu

SEQ ID NO: 1123094 - RNA, 19 nt, Homo sapiens
agaaugcaauuuccauauc

SEQ ID NO: 1123095 - RNA, 19 nt, Homo sapiens
agugcaagcugccaagaaa

SEQ ID NO: 1123096 - RNA, 19 nt, Homo sapiens
ucagcaccauguaaucauu

SEQ ID NO: 1123097 - RNA, 19 nt, Homo sapiens
uggagucuguuacaagauu

SEQ ID NO: 1123098 - RNA, 19 nt, Homo sapiens
aagaagagagggugagaaa

SEQ ID NO: 1123099 - RNA, 19 nt, Homo sapiens
guuaagcaguggaugaaag

SEQ ID NO: 1123100 - RNA, 19 nt, Homo sapiens
ccuccuaccuccugacuca

SEQ ID NO: 1123101 - RNA, 19 nt, Homo sapiens
ucaaacuucugaucucaag

SEQ ID NO: 1123102 - RNA, 19 nt, Homo sapiens
gggcuggucucaaacuucu

SEQ ID NO: 1123103 - RNA, 19 nt, Homo sapiens
uaaacucucugcugcaaaa

SEQ ID NO: 1123104 - RNA, 19 nt, Homo sapiens
ccaaucaguggcccaaauu

SEQ ID NO: 1123105 - RNA, 19 nt, Homo sapiens
gcuauugcuucagaauuau

SEQ ID NO: 1123106 - RNA, 19 nt, Homo sapiens
gcaauuuccauauccuaau

SEQ ID NO: 1123107 - RNA, 19 nt, Homo sapiens
accagaagcuaaaucauca

SEQ ID NO: 1123108 - RNA, 19 nt, Homo sapiens
uuacaggugugcgccagua

SEQ ID NO: 1123109 - RNA, 19 nt, Homo sapiens
gagguuucacaucauauuu

SEQ ID NO: 1123110 - RNA, 19 nt, Homo sapiens
gaaugcaauuuccauaucc

SEQ ID NO: 1123111 - RNA, 19 nt, Homo sapiens
cagagacaauuccucaagu

SEQ ID NO: 1123112 - RNA, 19 nt, Homo sapiens
ggcccuacaugccucagaa

SEQ ID NO: 1123113 - RNA, 19 nt, Homo sapiens
ugaaggacccuaccagaag

SEQ ID NO: 1123114 - RNA, 19 nt, Homo sapiens
uguggagucuguuacaaga

SEQ ID NO: 1123115 - RNA, 19 nt, Homo sapiens
ugcaccacauucagcauua

SEQ ID NO: 1123116 - RNA, 19 nt, Homo sapiens
gaagaagagagggugagaa

SEQ ID NO: 1123117 - RNA, 19 nt, Homo sapiens
uggaaagagugaauaugug

SEQ ID NO: 1123118 - RNA, 19 nt, Homo sapiens
caaagaaugcaauuuccau

SEQ ID NO: 1123119 - RNA, 19 nt, Homo sapiens
gaaacuguuccuauaaacu

SEQ ID NO: 1123120 - RNA, 19 nt, Homo sapiens
agagacaauuccucaagug

SEQ ID NO: 1123121 - RNA, 19 nt, Homo sapiens
gagagucuacagauaaauc

SEQ ID NO: 1123122 - RNA, 19 nt, Homo sapiens
acggagguuucacaucaua

SEQ ID NO: 1123123 - RNA, 19 nt, Homo sapiens
ccacauucagcauuaauca

SEQ ID NO: 1123124 - RNA, 19 nt, Homo sapiens
gggugagaaacauaaauaa

SEQ ID NO: 1123125 - RNA, 19 nt, Homo sapiens
ugccucagccuuccaagua

SEQ ID NO: 1123126 - RNA, 19 nt, Homo sapiens
gcugucauccuucauguca

SEQ ID NO: 1123127 - RNA, 19 nt, Homo sapiens
gaaauguuugccacaggaa

SEQ ID NO: 1123128 - RNA, 19 nt, Homo sapiens
gacccuaccagaagcuaaa

SEQ ID NO: 1123129 - RNA, 19 nt, Homo sapiens
ugaugaaacuacugauguc

SEQ ID NO: 1123130 - RNA, 19 nt, Homo sapiens
ugacucagcaccauguaau

SEQ ID NO: 1123131 - RNA, 19 nt, Homo sapiens
gguccugcauacugaugaa

SEQ ID NO: 1123132 - RNA, 19 nt, Homo sapiens
cagcuugaacauuaugaaa

SEQ ID NO: 1123133 - RNA, 19 nt, Homo sapiens
ugaaacuguuccuauaaac

SEQ ID NO: 1123134 - RNA, 19 nt, Homo sapiens
cacgaaacauacggccaua

SEQ ID NO: 1123135 - RNA, 19 nt, Homo sapiens
cagaagcuaaaucaucaaa

SEQ ID NO: 1123136 - RNA, 19 nt, Homo sapiens
cacaucauauuuccagaag

SEQ ID NO: 1123137 - RNA, 19 nt, Homo sapiens
caaucaguggcccaaauuu

SEQ ID NO: 1123138 - RNA, 19 nt, Homo sapiens
cauucagcauuaaucacua

SEQ ID NO: 1123139 - RNA, 19 nt, Homo sapiens
ucucaaacuucugaucuca

SEQ ID NO: 1123140 - RNA, 19 nt, Homo sapiens
ucgaacagccucacuugug

SEQ ID NO: 1123141 - RNA, 19 nt, Homo sapiens
ucacaucauauuuccagaa

SEQ ID NO: 1123142 - RNA, 19 nt, Homo sapiens
agggugagaaacauaaaua

SEQ ID NO: 1123143 - RNA, 19 nt, Homo sapiens
ggccaugauugguuagucu

SEQ ID NO: 1123144 - RNA, 19 nt, Homo sapiens
gaaacauacggccauaaaa

SEQ ID NO: 1123145 - RNA, 19 nt, Homo sapiens
ggcaagaggaacaguaaca

SEQ ID NO: 1123146 - RNA, 19 nt, Homo sapiens
uuccauauccuaaugauuc

SEQ ID NO: 1123147 - RNA, 19 nt, Homo sapiens
uaaauaauccaagcuugca

SEQ ID NO: 1123148 - RNA, 19 nt, Homo sapiens
gcauacugaugaaacuacu

SEQ ID NO: 1123149 - RNA, 19 nt, Homo sapiens
guuuggcuauugcuucaga

SEQ ID NO: 1123150 - RNA, 19 nt, Homo sapiens
cuggaaagagugaauaugu

SEQ ID NO: 1123151 - RNA, 19 nt, Homo sapiens
acuuggccaugauugguua

SEQ ID NO: 1123152 - RNA, 19 nt, Homo sapiens
ggacuuggccaugauuggu

SEQ ID NO: 1123153 - RNA, 19 nt, Homo sapiens
uaccagaagcuaaaucauc

SEQ ID NO: 1123154 - RNA, 19 nt, Homo sapiens
uaacagcuugaacauuaug

SEQ ID NO: 1123155 - RNA, 19 nt, Homo sapiens
gucaagcgcagaagaaucu

SEQ ID NO: 1123156 - RNA, 19 nt, Homo sapiens
ggacccuaccagaagcuaa

SEQ ID NO: 1123157 - RNA, 19 nt, Homo sapiens
auagauaacagcuugaaca

SEQ ID NO: 1123158 - RNA, 19 nt, Homo sapiens
caugucaagcgcagaagaa

SEQ ID NO: 1123159 - RNA, 19 nt, Homo sapiens
agagagggugagaaacaua

SEQ ID NO: 1123160 - RNA, 19 nt, Homo sapiens
cccauugccuccagcuguu

SEQ ID NO: 1123161 - RNA, 19 nt, Homo sapiens
gcuggucucaaacuucuga

SEQ ID NO: 1123162 - RNA, 19 nt, Homo sapiens
cugaaggacccuaccagaa

SEQ ID NO: 1123163 - RNA, 19 nt, Homo sapiens
gaugaaacuacugauguca

SEQ ID NO: 1123164 - RNA, 19 nt, Homo sapiens
ggucucaaacuucugaucu

SEQ ID NO: 1123165 - RNA, 19 nt, Homo sapiens
gaagcuaaaucaucaaaga

SEQ ID NO: 1123166 - RNA, 19 nt, Homo sapiens
gcacggagguuucacauca

SEQ ID NO: 1123167 - RNA, 19 nt, Homo sapiens
gcacaaccauacuguuaag

SEQ ID NO: 1123168 - RNA, 19 nt, Homo sapiens
gcuaaaucaucaaagaaug

SEQ ID NO: 1123169 - RNA, 19 nt, Homo sapiens
ggaaagagugaauaugugu

SEQ ID NO: 1123170 - RNA, 19 nt, Homo sapiens
cgaaacauacggccauaaa

SEQ ID NO: 1123171 - RNA, 19 nt, Homo sapiens
caucaaagaaugcaauuuc

SEQ ID NO: 1123172 - RNA, 19 nt, Homo sapiens
ccgcacaaccauacuguua

SEQ ID NO: 1123173 - RNA, 19 nt, Homo sapiens
caauuuccauauccuaaug

SEQ ID NO: 1123174 - RNA, 19 nt, Homo sapiens
cgaacagccucacuugugu

SEQ ID NO: 1123175 - RNA, 19 nt, Homo sapiens
gaucgaacagccucacuug

SEQ ID NO: 1123176 - RNA, 19 nt, Homo sapiens
gaaggcuccuggaaagagu

SEQ ID NO: 1123177 - RNA, 19 nt, Homo sapiens
ggagguuucacaucauauu

SEQ ID NO: 1123178 - RNA, 19 nt, Homo sapiens
agaaugcaauuuccauauc

SEQ ID NO: 1123179 - RNA, 19 nt, Homo sapiens
agugcaagcugccaagaaa

SEQ ID NO: 1123180 - RNA, 19 nt, Homo sapiens
ucagcaccauguaaucauu

SEQ ID NO: 1123181 - RNA, 19 nt, Homo sapiens
guuaagcaguggaugaaag

SEQ ID NO: 1123182 - RNA, 19 nt, Homo sapiens
ccuccuaccuccugacuca

SEQ ID NO: 1123183 - RNA, 19 nt, Homo sapiens
uaaacucucugcugcaaaa

SEQ ID NO: 1123184 - RNA, 19 nt, Homo sapiens
ccaaucaguggcccaaauu

SEQ ID NO: 1123185 - RNA, 19 nt, Homo sapiens
gcaauuuccauauccuaau

SEQ ID NO: 1123186 - RNA, 19 nt, Homo sapiens
accagaagcuaaaucauca

SEQ ID NO: 1123187 - RNA, 19 nt, Homo sapiens
gagguuucacaucauauuu

SEQ ID NO: 1123188 - RNA, 19 nt, Homo sapiens
gaaugcaauuuccauaucc

SEQ ID NO: 1123189 - RNA, 19 nt, Homo sapiens
cagagacaauuccucaagu

SEQ ID NO: 1123190 - RNA, 19 nt, Homo sapiens
ggcccuacaugccucagaa

SEQ ID NO: 1123191 - RNA, 19 nt, Homo sapiens
ugaaggacccuaccagaag

SEQ ID NO: 1123192 - RNA, 19 nt, Homo sapiens
uggaaagagugaauaugug

SEQ ID NO: 1123193 - RNA, 19 nt, Homo sapiens
caaagaaugcaauuuccau

SEQ ID NO: 1123194 - RNA, 19 nt, Homo sapiens
agagacaauuccucaagug

SEQ ID NO: 1123195 - RNA, 19 nt, Homo sapiens
gagagucuacagauaaauc

SEQ ID NO: 1123196 - RNA, 19 nt, Homo sapiens
gcugucauccuucauguca

SEQ ID NO: 1123197 - RNA, 19 nt, Homo sapiens
acggagguuucacaucaua

SEQ ID NO: 1123198 - RNA, 19 nt, Homo sapiens
gaaauguuugccacaggaa

SEQ ID NO: 1123199 - RNA, 19 nt, Homo sapiens
gacccuaccagaagcuaaa

SEQ ID NO: 1123200 - RNA, 19 nt, Homo sapiens
ugaugaaacuacugauguc

SEQ ID NO: 1123201 - RNA, 19 nt, Homo sapiens
ugacucagcaccauguaau

SEQ ID NO: 1123202 - RNA, 19 nt, Homo sapiens
cacgaaacauacggccaua

SEQ ID NO: 1123203 - RNA, 19 nt, Homo sapiens
cagaagcuaaaucaucaaa

SEQ ID NO: 1123204 - RNA, 19 nt, Homo sapiens
cacaucauauuuccagaag

SEQ ID NO: 1123205 - RNA, 19 nt, Homo sapiens
caaucaguggcccaaauuu

SEQ ID NO: 1123206 - RNA, 19 nt, Homo sapiens
ucgaacagccucacuugug

SEQ ID NO: 1123207 - RNA, 19 nt, Homo sapiens
gaaacauacggccauaaaa

SEQ ID NO: 1123208 - RNA, 19 nt, Homo sapiens
ggcaagaggaacaguaaca

SEQ ID NO: 1123209 - RNA, 19 nt, Homo sapiens
ucacaucauauuuccagaa

SEQ ID NO: 1123210 - RNA, 19 nt, Homo sapiens
uuccauauccuaaugauuc

SEQ ID NO: 1123211 - RNA, 19 nt, Homo sapiens
gcauacugaugaaacuacu

SEQ ID NO: 1123212 - RNA, 19 nt, Homo sapiens
ggacuuggccaugauuggu

SEQ ID NO: 1123213 - RNA, 19 nt, Homo sapiens
cuggaaagagugaauaugu

SEQ ID NO: 1123214 - RNA, 19 nt, Homo sapiens
uaccagaagcuaaaucauc

SEQ ID NO: 1123215 - RNA, 19 nt, Homo sapiens
ggacccuaccagaagcuaa

SEQ ID NO: 1123216 - RNA, 19 nt, Homo sapiens
gucaagcgcagaagaaucu

SEQ ID NO: 1123217 - RNA, 19 nt, Homo sapiens
caugucaagcgcagaagaa

SEQ ID NO: 1123218 - RNA, 19 nt, Homo sapiens
cccauugccuccagcuguu

SEQ ID NO: 1123219 - RNA, 19 nt, Homo sapiens
cugaaggacccuaccagaa

SEQ ID NO: 1123220 - RNA, 19 nt, Homo sapiens
gaugaaacuacugauguca

SEQ ID NO: 1123221 - RNA, 19 nt, Homo sapiens
agagaggacucgccaucgu

SEQ ID NO: 1123222 - RNA, 19 nt, Homo sapiens
cccuuacccugaccaauca

SEQ ID NO: 1123223 - RNA, 19 nt, Homo sapiens
ugucauccuucaugucaag

SEQ ID NO: 1123224 - RNA, 19 nt, Homo sapiens
cugaugaaacuacugaugu

SEQ ID NO: 1123225 - RNA, 19 nt, Homo sapiens
auacugaugaaacuacuga

SEQ ID NO: 1123226 - RNA, 19 nt, Homo sapiens
gauugguuguccugcauac

SEQ ID NO: 1123227 - RNA, 19 nt, Homo sapiens
gcaagaggaacaguaacag

SEQ ID NO: 1123228 - RNA, 19 nt, Homo sapiens
cauggcaagaggaacagua

SEQ ID NO: 1123229 - RNA, 19 nt, Homo sapiens
cgcacaaccauacuguuaa

SEQ ID NO: 1123230 - RNA, 19 nt, Homo sapiens
ugguuguccugcauacuga

SEQ ID NO: 1123231 - RNA, 19 nt, Homo sapiens
uggcugcugucauccuuca

SEQ ID NO: 1123232 - RNA, 19 nt, Homo sapiens
gaaagaagaugacuuagau

SEQ ID NO: 1123233 - RNA, 19 nt, Homo sapiens
gaagaugacuuagauguug

SEQ ID NO: 1123234 - RNA, 19 nt, Homo sapiens
gaagaaagacggagacaug

SEQ ID NO: 1123235 - RNA, 19 nt, Homo sapiens
gaacaagauuaucgaccua

SEQ ID NO: 1123236 - RNA, 19 nt, Homo sapiens
gaauucaacucccuucaug

SEQ ID NO: 1123237 - RNA, 19 nt, Homo sapiens
ggaauuacuuugcuccuau

SEQ ID NO: 1123238 - RNA, 19 nt, Homo sapiens
gaaggaagguauaguagag

SEQ ID NO: 1123239 - RNA, 19 nt, Homo sapiens
gaauuacuuugcuccuaua

SEQ ID NO: 1123240 - RNA, 19 nt, Homo sapiens
gaaaugauucuuacacaga

SEQ ID NO: 1123241 - RNA, 19 nt, Homo sapiens
agaaagaguuggauacaga

SEQ ID NO: 1123242 - RNA, 19 nt, Homo sapiens
guaaagaggauacucagaa

SEQ ID NO: 1123243 - RNA, 19 nt, Homo sapiens
caggagacuuugacuuuaa

SEQ ID NO: 1123244 - RNA, 19 nt, Homo sapiens
ccaggagacuuugacuuua

SEQ ID NO: 1123245 - RNA, 19 nt, Homo sapiens
gagcguagaagaaaugauu

SEQ ID NO: 1123246 - RNA, 19 nt, Homo sapiens
ggagagaguuuggagauag

SEQ ID NO: 1123247 - RNA, 19 nt, Homo sapiens
uaaggguucugaggaaaua

SEQ ID NO: 1123248 - RNA, 19 nt, Homo sapiens
cacagcaucuuccaaguuu

SEQ ID NO: 1123249 - RNA, 19 nt, Homo sapiens
aaagaaagcucacauucag

SEQ ID NO: 1123250 - RNA, 19 nt, Homo sapiens
uggaaagucugaagaaaga

SEQ ID NO: 1123251 - RNA, 19 nt, Homo sapiens
ggacagaaccagagaugga

SEQ ID NO: 1123252 - RNA, 19 nt, Homo sapiens
agaauaccaucaccaauug

SEQ ID NO: 1123253 - RNA, 19 nt, Homo sapiens
uuacagaggucuucguguu

SEQ ID NO: 1123254 - RNA, 19 nt, Homo sapiens
gcaacaggcagcuuuagaa

SEQ ID NO: 1123255 - RNA, 19 nt, Homo sapiens
ugacuggcuuugaugauaa

SEQ ID NO: 1123256 - RNA, 19 nt, Homo sapiens
ggacagaacucggggaauu

SEQ ID NO: 1123257 - RNA, 19 nt, Homo sapiens
agagauggauucagaaaca

SEQ ID NO: 1123258 - RNA, 19 nt, Homo sapiens
gauuugaaaccucuucuuu

SEQ ID NO: 1123259 - RNA, 19 nt, Homo sapiens
gcagagcauuguagaccaa

SEQ ID NO: 1123260 - RNA, 19 nt, Homo sapiens
gaguguacauugucugaau

SEQ ID NO: 1123261 - RNA, 19 nt, Homo sapiens
uaaagaaagcucacauuca

SEQ ID NO: 1123262 - RNA, 19 nt, Homo sapiens
gagaaggaucaccgucuua

SEQ ID NO: 1123263 - RNA, 19 nt, Homo sapiens
gaaguccauuagagaaaga

SEQ ID NO: 1123264 - RNA, 19 nt, Homo sapiens
ugugaaagaagaugacuua

SEQ ID NO: 1123265 - RNA, 19 nt, Homo sapiens
caguguagaugaauuggaa

SEQ ID NO: 1123266 - RNA, 19 nt, Homo sapiens
gcuccaaacuggugugcuu

SEQ ID NO: 1123267 - RNA, 19 nt, Homo sapiens
aaccagagauggauucaga

SEQ ID NO: 1123268 - RNA, 19 nt, Homo sapiens
uggcuuugaugauaagaua

SEQ ID NO: 1123269 - RNA, 19 nt, Homo sapiens
gaagaaagaguuggauaca

SEQ ID NO: 1123270 - RNA, 19 nt, Homo sapiens
gaauacaggaugcacaaug

SEQ ID NO: 1123271 - RNA, 19 nt, Homo sapiens
gggaauuacuuugcuccua

SEQ ID NO: 1123272 - RNA, 19 nt, Homo sapiens
gaacugacuggcuuugaug

SEQ ID NO: 1123273 - RNA, 19 nt, Homo sapiens
gcuagucacccucucuuaa

SEQ ID NO: 1123274 - RNA, 19 nt, Homo sapiens
uaaagaggauacucagaag

SEQ ID NO: 1123275 - RNA, 19 nt, Homo sapiens
gagagcgugugaaagaaga

SEQ ID NO: 1123276 - RNA, 19 nt, Homo sapiens
gaucaccgucuuagcgaua

SEQ ID NO: 1123277 - RNA, 19 nt, Homo sapiens
gcagaacaccuagaagaga

SEQ ID NO: 1123278 - RNA, 19 nt, Homo sapiens
ggaaguccauuagagaaag

SEQ ID NO: 1123279 - RNA, 19 nt, Homo sapiens
ggccaaccguuacaccaaa

SEQ ID NO: 1123280 - RNA, 19 nt, Homo sapiens
gaccaaggagccauggaua

SEQ ID NO: 1123281 - RNA, 19 nt, Homo sapiens
aagaauaccaucaccaauu

SEQ ID NO: 1123282 - RNA, 19 nt, Homo sapiens
gaagagcuagagagacuug

SEQ ID NO: 1123283 - RNA, 19 nt, Homo sapiens
ggugugguccgcauuauga

SEQ ID NO: 1123284 - RNA, 19 nt, Homo sapiens
ugaaagaagaugacuuaga

SEQ ID NO: 1123285 - RNA, 19 nt, Homo sapiens
ucagaaggccagugaagaa

SEQ ID NO: 1123286 - RNA, 19 nt, Homo sapiens
cagccuuucugcaaauaaa

SEQ ID NO: 1123287 - RNA, 19 nt, Homo sapiens
caccaaagaacaagauuau

SEQ ID NO: 1123288 - RNA, 19 nt, Homo sapiens
cuaccucagugauucguaa

SEQ ID NO: 1123289 - RNA, 19 nt, Homo sapiens
ggaagaccaugcugaaaau

SEQ ID NO: 1123290 - RNA, 19 nt, Homo sapiens
cgaacugacuggcuuugau

SEQ ID NO: 1123291 - RNA, 19 nt, Homo sapiens
ugacuuagauguuguuuuc

SEQ ID NO: 1123292 - RNA, 19 nt, Homo sapiens
gaagccuccugccuccaaa

SEQ ID NO: 1123293 - RNA, 19 nt, Homo sapiens
gaaguaugggugaaacaga

SEQ ID NO: 1123294 - RNA, 19 nt, Homo sapiens
gauaagauacuagaagaag

SEQ ID NO: 1123295 - RNA, 19 nt, Homo sapiens
gcgcucaggaaguccauua

SEQ ID NO: 1123296 - RNA, 19 nt, Homo sapiens
cgaguggaguguacauugu

SEQ ID NO: 1123297 - RNA, 19 nt, Homo sapiens
gaauuggaauaccgacagu

SEQ ID NO: 1123298 - RNA, 19 nt, Homo sapiens
ccaagaauaccaucaccaa

SEQ ID NO: 1123299 - RNA, 19 nt, Homo sapiens
ggucaacaccacaugaaga

SEQ ID NO: 1123300 - RNA, 19 nt, Homo sapiens
gagagaguuuggagauagu

SEQ ID NO: 1123301 - RNA, 19 nt, Homo sapiens
ugagaaggaucaccgucuu

SEQ ID NO: 1123302 - RNA, 19 nt, Homo sapiens
guauagacccuuauguaca

SEQ ID NO: 1123303 - RNA, 19 nt, Homo sapiens
cgccaaaguuaucagugua

SEQ ID NO: 1123304 - RNA, 19 nt, Homo sapiens
gggaguacauccacagcau

SEQ ID NO: 1123305 - RNA, 19 nt, Homo sapiens
gacuuugacuuuaaugagu

SEQ ID NO: 1123306 - RNA, 19 nt, Homo sapiens
ccaaacagaggccuucaug

SEQ ID NO: 1123307 - RNA, 19 nt, Homo sapiens
cugacuggcuuugaugaua

SEQ ID NO: 1123308 - RNA, 19 nt, Homo sapiens
ccacagcaucuuccaaguu

SEQ ID NO: 1123309 - RNA, 19 nt, Homo sapiens
caaagaacaagauuaucga

SEQ ID NO: 1123310 - RNA, 19 nt, Homo sapiens
cacaugaccuugcuguaca

SEQ ID NO: 1123311 - RNA, 19 nt, Homo sapiens
gguagaagcaggucugaag

SEQ ID NO: 1123312 - RNA, 19 nt, Homo sapiens
gaagaucacaaagggagaa

SEQ ID NO: 1123313 - RNA, 19 nt, Homo sapiens
gaugauaagauacuagaag

SEQ ID NO: 1123314 - RNA, 19 nt, Homo sapiens
aauacaggaugcacaaugu

SEQ ID NO: 1123315 - RNA, 19 nt, Homo sapiens
gauuaucgaccuaaagcaa

SEQ ID NO: 1123316 - RNA, 19 nt, Homo sapiens
ccaaagaacaagauuaucg

SEQ ID NO: 1123317 - RNA, 19 nt, Homo sapiens
guacgagagcaaagagaaa

SEQ ID NO: 1123318 - RNA, 19 nt, Homo sapiens
caacagcgagugaccaagu

SEQ ID NO: 1123319 - RNA, 19 nt, Homo sapiens
gaaagacggagacaugacu

SEQ ID NO: 1123320 - RNA, 19 nt, Homo sapiens
gaccagcaagugaagaauu

SEQ ID NO: 1123321 - RNA, 19 nt, Homo sapiens
ugaagggcuugaagguuga

SEQ ID NO: 1123322 - RNA, 19 nt, Homo sapiens
cccaggagacuuugacuuu

SEQ ID NO: 1123323 - RNA, 19 nt, Homo sapiens
gauaguaagcgugucuuug

SEQ ID NO: 1123324 - RNA, 19 nt, Homo sapiens
acaagauuaucgaccuaaa

SEQ ID NO: 1123325 - RNA, 19 nt, Homo sapiens
augcuuggcuucgaugaua

SEQ ID NO: 1123326 - RNA, 19 nt, Homo sapiens
ggagaaguaugggugaaac

SEQ ID NO: 1123327 - RNA, 19 nt, Homo sapiens
gagagagggacuucaagga

SEQ ID NO: 1123328 - RNA, 19 nt, Homo sapiens
ccucagagacggagcuuug

SEQ ID NO: 1123329 - RNA, 19 nt, Homo sapiens
uauagacccuuauguacag

SEQ ID NO: 1123330 - RNA, 19 nt, Homo sapiens
guacauccacagcaucuuc

SEQ ID NO: 1123331 - RNA, 19 nt, Homo sapiens
ccagagauggauucagaaa

SEQ ID NO: 1123332 - RNA, 19 nt, Homo sapiens
cgaaagcccuucuguguua

SEQ ID NO: 1123333 - RNA, 19 nt, Homo sapiens
guaaacaccuucaaauuuc

SEQ ID NO: 1123334 - RNA, 19 nt, Homo sapiens
gaacaugaaaggcaguuua

SEQ ID NO: 1123335 - RNA, 19 nt, Homo sapiens
gagaaacucuguugucugu

SEQ ID NO: 1123336 - RNA, 19 nt, Homo sapiens
gggaggcacuuggaaauua

SEQ ID NO: 1123337 - RNA, 19 nt, Homo sapiens
gacauguuguguagaauua

SEQ ID NO: 1123338 - RNA, 19 nt, Homo sapiens
caacacaggugccaauuag

SEQ ID NO: 1123339 - RNA, 19 nt, Homo sapiens
gggcaaaucacaucagaua

SEQ ID NO: 1123340 - RNA, 19 nt, Homo sapiens
gcacugaugauguauauga

SEQ ID NO: 1123341 - RNA, 19 nt, Homo sapiens
gacauuaacccacucauuu

SEQ ID NO: 1123342 - RNA, 19 nt, Homo sapiens
caaggugcaucgacauuaa

SEQ ID NO: 1123343 - RNA, 19 nt, Homo sapiens
uaacuuggcugggaagauu

SEQ ID NO: 1123344 - RNA, 19 nt, Homo sapiens
ggaaaaggaugccaauaaa

SEQ ID NO: 1123345 - RNA, 19 nt, Homo sapiens
aaucacagcuugguacaua

SEQ ID NO: 1123346 - RNA, 19 nt, Homo sapiens
aaacacagcuaaugcuaug

SEQ ID NO: 1123347 - RNA, 19 nt, Homo sapiens
uuacgcagcugaugagaaa

SEQ ID NO: 1123348 - RNA, 19 nt, Homo sapiens
caaaucacaucagauaaga

SEQ ID NO: 1123349 - RNA, 19 nt, Homo sapiens
caugaaaggcaguuuauaa

SEQ ID NO: 1123350 - RNA, 19 nt, Homo sapiens
cagcuugccucaugucaaa

SEQ ID NO: 1123351 - RNA, 19 nt, Homo sapiens
gagggaauccaaauuguuu

SEQ ID NO: 1123352 - RNA, 19 nt, Homo sapiens
gcaacacaggugccaauua

SEQ ID NO: 1123353 - RNA, 19 nt, Homo sapiens
gaguaaacaccuucaaauu

SEQ ID NO: 1123354 - RNA, 19 nt, Homo sapiens
uagcaguucuuuagccaua

SEQ ID NO: 1123355 - RNA, 19 nt, Homo sapiens
uagaagauuugacacugua

SEQ ID NO: 1123356 - RNA, 19 nt, Homo sapiens
gaaacucuguugucugucu

SEQ ID NO: 1123357 - RNA, 19 nt, Homo sapiens
gcagucagaagcuaaguuu

SEQ ID NO: 1123358 - RNA, 19 nt, Homo sapiens
ccagaaacacuuugagaaa

SEQ ID NO: 1123359 - RNA, 19 nt, Homo sapiens
ggaacugaauauacaacuu

SEQ ID NO: 1123360 - RNA, 19 nt, Homo sapiens
gaacaacaccgccagaaac

SEQ ID NO: 1123361 - RNA, 19 nt, Homo sapiens
ggaguaaacaccuucaaau

SEQ ID NO: 1123362 - RNA, 19 nt, Homo sapiens
agucaaaucucaccaagga

SEQ ID NO: 1123363 - RNA, 19 nt, Homo sapiens
gcaagaaucgggaagaaca

SEQ ID NO: 1123364 - RNA, 19 nt, Homo sapiens
agacagagacagacacuuu

SEQ ID NO: 1123365 - RNA, 19 nt, Homo sapiens
gcaaaucacaucagauaag

SEQ ID NO: 1123366 - RNA, 19 nt, Homo sapiens
caaggaagacugagguuug

SEQ ID NO: 1123367 - RNA, 19 nt, Homo sapiens
gaaauuaugggaguaaaca

SEQ ID NO: 1123368 - RNA, 19 nt, Homo sapiens
uuaacccacucauuuagua

SEQ ID NO: 1123369 - RNA, 19 nt, Homo sapiens
gcaucagacucucuaagga

SEQ ID NO: 1123370 - RNA, 19 nt, Homo sapiens
ggacauguuguguagaauu

SEQ ID NO: 1123371 - RNA, 19 nt, Homo sapiens
gcccucagcuugccucaug

SEQ ID NO: 1123372 - RNA, 19 nt, Homo sapiens
aaacauuacguccauauga

SEQ ID NO: 1123373 - RNA, 19 nt, Homo sapiens
ccgaggaacugaauauaca

SEQ ID NO: 1123374 - RNA, 19 nt, Homo sapiens
gcuaugggguguaugaaua

SEQ ID NO: 1123375 - RNA, 19 nt, Homo sapiens
guuuauaacugaugaagag

SEQ ID NO: 1123376 - RNA, 19 nt, Homo sapiens
gauaagaagagccgagaga

SEQ ID NO: 1123377 - RNA, 19 nt, Homo sapiens
ggaugccaauaaagaguuu

SEQ ID NO: 1123378 - RNA, 19 nt, Homo sapiens
uauagaggauggcaaggaa

SEQ ID NO: 1123379 - RNA, 19 nt, Homo sapiens
ggaagccgcucucuuacac

SEQ ID NO: 1123380 - RNA, 19 nt, Homo sapiens
caacagguccuucggaaag

SEQ ID NO: 1123381 - RNA, 19 nt, Homo sapiens
ggaaacauuacguccauau

SEQ ID NO: 1123382 - RNA, 19 nt, Homo sapiens
cgagcuaucagaauuauga

SEQ ID NO: 1123383 - RNA, 19 nt, Homo sapiens
caacaccauugcaaaccaa

SEQ ID NO: 1123384 - RNA, 19 nt, Homo sapiens
acacagcccuuggcacuga

SEQ ID NO: 1123385 - RNA, 19 nt, Homo sapiens
uaaacacaauggcuaucaa

SEQ ID NO: 1123386 - RNA, 19 nt, Homo sapiens
acauuaacccacucauuua

SEQ ID NO: 1123387 - RNA, 19 nt, Homo sapiens
guacagaugcccucagcuu

SEQ ID NO: 1123388 - RNA, 19 nt, Homo sapiens
ccacagacgaucucaguau

SEQ ID NO: 1123389 - RNA, 19 nt, Homo sapiens
agacugagguuugcucgaa

SEQ ID NO: 1123390 - RNA, 19 nt, Homo sapiens
caucucagagcauuuguaa

SEQ ID NO: 1123391 - RNA, 19 nt, Homo sapiens
gcgcuuagcccuacuaugc

SEQ ID NO: 1123392 - RNA, 19 nt, Homo sapiens
ggccugcaguucauucuga

SEQ ID NO: 1123393 - RNA, 19 nt, Homo sapiens
gaaaauaacagcagaacau

SEQ ID NO: 1123394 - RNA, 19 nt, Homo sapiens
uaagaagagccgagagaaa

SEQ ID NO: 1123395 - RNA, 19 nt, Homo sapiens
gaagauuugacacuguauu

SEQ ID NO: 1123396 - RNA, 19 nt, Homo sapiens
aguaauguaccuugaguua

SEQ ID NO: 1123397 - RNA, 19 nt, Homo sapiens
gaucaucucagagcauuug

SEQ ID NO: 1123398 - RNA, 19 nt, Homo sapiens
cagggaagcugccuuugca

SEQ ID NO: 1123399 - RNA, 19 nt, Homo sapiens
ggagggaauccaaauuguu

SEQ ID NO: 1123400 - RNA, 19 nt, Homo sapiens
ccaaggugcaucgacauua

SEQ ID NO: 1123401 - RNA, 19 nt, Homo sapiens
ggaagcugccuuugcauca

SEQ ID NO: 1123402 - RNA, 19 nt, Homo sapiens
gugcagaacuaccuguaca

SEQ ID NO: 1123403 - RNA, 19 nt, Homo sapiens
gcaaggaagacugagguuu

SEQ ID NO: 1123404 - RNA, 19 nt, Homo sapiens
gcucacagcaaggaauuaa

SEQ ID NO: 1123405 - RNA, 19 nt, Homo sapiens
guucuuaucgcuucaauag

SEQ ID NO: 1123406 - RNA, 19 nt, Homo sapiens
gaaagcccuucuguguuau

SEQ ID NO: 1123407 - RNA, 19 nt, Homo sapiens
cgugaugauugucgucuuu

SEQ ID NO: 1123408 - RNA, 19 nt, Homo sapiens
gggaguaaacaccuucaaa

SEQ ID NO: 1123409 - RNA, 19 nt, Homo sapiens
ccaaacacagcuaaugcua

SEQ ID NO: 1123410 - RNA, 19 nt, Homo sapiens
gaaggucacgaucaucuca

SEQ ID NO: 1123411 - RNA, 19 nt, Homo sapiens
gaagagacagagacagaca

SEQ ID NO: 1123412 - RNA, 19 nt, Homo sapiens
cugaugauguauaugauga

SEQ ID NO: 1123413 - RNA, 19 nt, Homo sapiens
gcagcggcaugaaggaugu

SEQ ID NO: 1123414 - RNA, 19 nt, Homo sapiens
aggcauuucugcuuuguga

SEQ ID NO: 1123415 - RNA, 19 nt, Homo sapiens
cccaacaacuuuacagauc

SEQ ID NO: 1123416 - RNA, 19 nt, Homo sapiens
caccauugcaaaccaaaua

SEQ ID NO: 1123417 - RNA, 19 nt, Homo sapiens
cgagaggccugcaguucau

SEQ ID NO: 1123418 - RNA, 19 nt, Homo sapiens
caagcuggacugccuacua

SEQ ID NO: 1123419 - RNA, 19 nt, Homo sapiens
gaaacauuacguccauaug

SEQ ID NO: 1123420 - RNA, 19 nt, Homo sapiens
ccaccaaagugcagaagag

SEQ ID NO: 1123421 - RNA, 19 nt, Homo sapiens
ugacaacuauuggcuaugg

SEQ ID NO: 1123422 - RNA, 19 nt, Homo sapiens
ggaggcacuuggaaauuac

SEQ ID NO: 1123423 - RNA, 19 nt, Homo sapiens
guaauguaccuugaguuaa

SEQ ID NO: 1123424 - RNA, 19 nt, Homo sapiens
cgacauuaacccacucauu

SEQ ID NO: 1123425 - RNA, 19 nt, Homo sapiens
ugcaugaacuauuucgaaa

SEQ ID NO: 1123426 - RNA, 19 nt, Homo sapiens
caaggaaaauguucagguu

SEQ ID NO: 1123427 - RNA, 19 nt, Homo sapiens
acaaaacaguggcugcuua

SEQ ID NO: 1123428 - RNA, 19 nt, Homo sapiens
gcccuucuguguuauagau

SEQ ID NO: 1123429 - RNA, 19 nt, Homo sapiens
uuucaggcauuucugcuuu

SEQ ID NO: 1123430 - RNA, 19 nt, Homo sapiens
gaauaugucaaguuuaggu

SEQ ID NO: 1123431 - RNA, 19 nt, Homo sapiens
cccuaacccugcaggcuua

SEQ ID NO: 1123432 - RNA, 19 nt, Homo sapiens
ggaacaugcugcucuaauu

SEQ ID NO: 1123433 - RNA, 19 nt, Homo sapiens
caaaggagauucugaccaa

SEQ ID NO: 1123434 - RNA, 19 nt, Homo sapiens
cagaagauacugaagauua

SEQ ID NO: 1123435 - RNA, 19 nt, Homo sapiens
gcaaagagaaagaaagaaa

SEQ ID NO: 1123436 - RNA, 19 nt, Homo sapiens
ggaagaaucugacaagacu

SEQ ID NO: 1123437 - RNA, 19 nt, Homo sapiens
gaacaaauccuggcagaau

SEQ ID NO: 1123438 - RNA, 19 nt, Homo sapiens
gaagaaggacugauuaagu

SEQ ID NO: 1123439 - RNA, 19 nt, Homo sapiens
gaagauuacuacacauuac

SEQ ID NO: 1123440 - RNA, 19 nt, Homo sapiens
ugaaucaguucucauaaug

SEQ ID NO: 1123441 - RNA, 19 nt, Homo sapiens
gugaauugcugaguacuaa

SEQ ID NO: 1123442 - RNA, 19 nt, Homo sapiens
gagcaaagagaaagaaaga

SEQ ID NO: 1123443 - RNA, 19 nt, Homo sapiens
caaggaugcucccucagaa

SEQ ID NO: 1123444 - RNA, 19 nt, Homo sapiens
cuaaauggaugcaauacug

SEQ ID NO: 1123445 - RNA, 19 nt, Homo sapiens
gacauacugugaucucuau

SEQ ID NO: 1123446 - RNA, 19 nt, Homo sapiens
gaacaugcugcucuaauuc

SEQ ID NO: 1123447 - RNA, 19 nt, Homo sapiens
uggaugcaauacugaauua

SEQ ID NO: 1123448 - RNA, 19 nt, Homo sapiens
ggaauguaaugagcaaaga

SEQ ID NO: 1123449 - RNA, 19 nt, Homo sapiens
gaaauaucucugcuucaaa

SEQ ID NO: 1123450 - RNA, 19 nt, Homo sapiens
uaucuucgguugaacaaau

SEQ ID NO: 1123451 - RNA, 19 nt, Homo sapiens
ccaccaagauggaaaauga

SEQ ID NO: 1123452 - RNA, 19 nt, Homo sapiens
ugaacuaucuucgguugaa

SEQ ID NO: 1123453 - RNA, 19 nt, Homo sapiens
gacuuacaaugaaauguga

SEQ ID NO: 1123454 - RNA, 19 nt, Homo sapiens
gggaagaaggacugauuaa

SEQ ID NO: 1123455 - RNA, 19 nt, Homo sapiens
gagggaagaaggacugauu

SEQ ID NO: 1123456 - RNA, 19 nt, Homo sapiens
ugaaauuacuugucugaac

SEQ ID NO: 1123457 - RNA, 19 nt, Homo sapiens
gcugaguacuaauugauuc

SEQ ID NO: 1123458 - RNA, 19 nt, Homo sapiens
cauacugugaucucuauua

SEQ ID NO: 1123459 - RNA, 19 nt, Homo sapiens
gaaucugacaagacucaua

SEQ ID NO: 1123460 - RNA, 19 nt, Homo sapiens
gggaugugaugaacuaucu

SEQ ID NO: 1123461 - RNA, 19 nt, Homo sapiens
ucaaugcacuggguuguca

SEQ ID NO: 1123462 - RNA, 19 nt, Homo sapiens
gcagaaggcaaaggagauu

SEQ ID NO: 1123463 - RNA, 19 nt, Homo sapiens
acugugaucucuauuagug

SEQ ID NO: 1123464 - RNA, 19 nt, Homo sapiens
gagcaagacuguccccuau

SEQ ID NO: 1123465 - RNA, 19 nt, Homo sapiens
aauuacaggucagaagaua

SEQ ID NO: 1123466 - RNA, 19 nt, Homo sapiens
aagaggagcuggcuucaac

SEQ ID NO: 1123467 - RNA, 19 nt, Homo sapiens
ccaaggaugcucccucaga

SEQ ID NO: 1123468 - RNA, 19 nt, Homo sapiens
aacaaauccuggcagaauu

SEQ ID NO: 1123469 - RNA, 19 nt, Homo sapiens
ugaggaauguaaugagcaa

SEQ ID NO: 1123470 - RNA, 19 nt, Homo sapiens
gaaggagccagaugucgau

SEQ ID NO: 1123471 - RNA, 19 nt, Homo sapiens
aggagauucugaccaauga

SEQ ID NO: 1123472 - RNA, 19 nt, Homo sapiens
ggcagaauuuaaagucaga

SEQ ID NO: 1123473 - RNA, 19 nt, Homo sapiens
gaagcucacugugccucuu

SEQ ID NO: 1123474 - RNA, 19 nt, Homo sapiens
ucaguucucauaaugcuuu

SEQ ID NO: 1123475 - RNA, 19 nt, Homo sapiens
gauuaagucaucuaaaugg

SEQ ID NO: 1123476 - RNA, 19 nt, Homo sapiens
gcagugggaagcuuugaau

SEQ ID NO: 1123477 - RNA, 19 nt, Homo sapiens
ggaagaaggacugauuaag

SEQ ID NO: 1123478 - RNA, 19 nt, Homo sapiens
acugggaugugaugaacua

SEQ ID NO: 1123479 - RNA, 19 nt, Homo sapiens
agaagauacugaagauuac

SEQ ID NO: 1123480 - RNA, 19 nt, Homo sapiens
ugaauuacaggucagaaga

SEQ ID NO: 1123481 - RNA, 19 nt, Homo sapiens
uaugaccacuggcgaagga

SEQ ID NO: 1123482 - RNA, 19 nt, Homo sapiens
uaaauggaugcaauacuga

SEQ ID NO: 1123483 - RNA, 19 nt, Homo sapiens
cugcucuaauucagauuua

SEQ ID NO: 1123484 - RNA, 19 nt, Homo sapiens
aaagcaaucucuguacagu

SEQ ID NO: 1123485 - RNA, 19 nt, Homo sapiens
ccuugaaucaguucucaua

SEQ ID NO: 1123486 - RNA, 19 nt, Homo sapiens
gaaagaggagcuggcuuca

SEQ ID NO: 1123487 - RNA, 19 nt, Homo sapiens
gaauuacaggucagaagau

SEQ ID NO: 1123488 - RNA, 19 nt, Homo sapiens
uuaaagcucuuagauacag

SEQ ID NO: 1123489 - RNA, 19 nt, Homo sapiens
caaagagaaagaaagaaag

SEQ ID NO: 1123490 - RNA, 19 nt, Homo sapiens
gaaaaugaggaauguaaug

SEQ ID NO: 1123491 - RNA, 19 nt, Homo sapiens
auacugugaucucuauuag

SEQ ID NO: 1123492 - RNA, 19 nt, Homo sapiens
ugacauacugugaucucua

SEQ ID NO: 1123493 - RNA, 19 nt, Homo sapiens
agcaaucucuguacagugu

SEQ ID NO: 1123494 - RNA, 19 nt, Homo sapiens
gaugcaauacugaauuaca

SEQ ID NO: 1123495 - RNA, 19 nt, Homo sapiens
guaaugagcaaagagaaag

SEQ ID NO: 1123496 - RNA, 19 nt, Homo sapiens
ccagacaagcauccugaaa

SEQ ID NO: 1123497 - RNA, 19 nt, Homo sapiens
ugacuuacaaugaaaugug

SEQ ID NO: 1123498 - RNA, 19 nt, Homo sapiens
acccuugacuuacaaugaa

SEQ ID NO: 1123499 - RNA, 19 nt, Homo sapiens
uaugucaugucugugaauu

SEQ ID NO: 1123500 - RNA, 19 nt, Homo sapiens
uugaaugacucagugaaga

SEQ ID NO: 1123501 - RNA, 19 nt, Homo sapiens
uacugaagauuacuacaca

SEQ ID NO: 1123502 - RNA, 19 nt, Homo sapiens
ucacugugccucuuguuuc

SEQ ID NO: 1123503 - RNA, 19 nt, Homo sapiens
gaugugaugaacuaucuuc

SEQ ID NO: 1123504 - RNA, 19 nt, Homo sapiens
uguggaacaugcugcucua

SEQ ID NO: 1123505 - RNA, 19 nt, Homo sapiens
ucauugacauacugugauc

SEQ ID NO: 1123506 - RNA, 19 nt, Homo sapiens
caugcagucuuuguuuaug

SEQ ID NO: 1123507 - RNA, 19 nt, Homo sapiens
ugaggaagagcaagacugu

SEQ ID NO: 1123508 - RNA, 19 nt, Homo sapiens
aauccuggcagaauuuaaa

SEQ ID NO: 1123509 - RNA, 19 nt, Homo sapiens
gaacuaucuucgguugaac

SEQ ID NO: 1123510 - RNA, 19 nt, Homo sapiens
guuuaugucaugucuguga

SEQ ID NO: 1123511 - RNA, 19 nt, Homo sapiens
gucugugaauugcugagua

SEQ ID NO: 1123512 - RNA, 19 nt, Homo sapiens
gauggaaaaugaggaaugu

SEQ ID NO: 1123513 - RNA, 19 nt, Homo sapiens
uuagauacagaguagauug

SEQ ID NO: 1123514 - RNA, 19 nt, Homo sapiens
gagagucgagcccgcuaug

SEQ ID NO: 1123515 - RNA, 19 nt, Homo sapiens
uaaagcucuuagauacaga

SEQ ID NO: 1123516 - RNA, 19 nt, Homo sapiens
gcugcucuaauucagauuu

SEQ ID NO: 1123517 - RNA, 19 nt, Homo sapiens
uguaaugagcaaagagaaa

SEQ ID NO: 1123518 - RNA, 19 nt, Homo sapiens
gcuggaagaaucugacaag

SEQ ID NO: 1123519 - RNA, 19 nt, Homo sapiens
gugggaagcuuugaaugac

SEQ ID NO: 1123520 - RNA, 19 nt, Homo sapiens
gagauucugaccaaugaag

SEQ ID NO: 1123521 - RNA, 19 nt, Homo sapiens
gcaagacuguccccuaugc

SEQ ID NO: 1123522 - RNA, 19 nt, Homo sapiens
gaaaacggagcagaaagaa

SEQ ID NO: 1123523 - RNA, 19 nt, Homo sapiens
agugggaagcuuugaauga

SEQ ID NO: 1123524 - RNA, 19 nt, Homo sapiens
agggaagaaggacugauua

SEQ ID NO: 1123525 - RNA, 19 nt, Homo sapiens
agaaacugcagaaggcaaa

SEQ ID NO: 1123526 - RNA, 19 nt, Homo sapiens
ugugaucucuauuagugau

SEQ ID NO: 1123527 - RNA, 19 nt, Homo sapiens
gaccugaugcuggaagaau

SEQ ID NO: 1123528 - RNA, 19 nt, Homo sapiens
aaucaguucucauaaugcu

SEQ ID NO: 1123529 - RNA, 19 nt, Homo sapiens
agacucauaccaccaagau

SEQ ID NO: 1123530 - RNA, 19 nt, Homo sapiens
acaagacucauaccaccaa

SEQ ID NO: 1123531 - RNA, 19 nt, Homo sapiens
cugaagauuacuacacauu

SEQ ID NO: 1123532 - RNA, 19 nt, Homo sapiens
aaucagagcuccauaaugu

SEQ ID NO: 1123533 - RNA, 19 nt, Homo sapiens
gaagaugguuggcccuuug

SEQ ID NO: 1123534 - RNA, 19 nt, Homo sapiens
ggacagaccuacuugacau

SEQ ID NO: 1123535 - RNA, 19 nt, Homo sapiens
aaacacagcuccugcaaca

SEQ ID NO: 1123536 - RNA, 19 nt, Homo sapiens
gcacagaggacuuauucaa

SEQ ID NO: 1123537 - RNA, 19 nt, Homo sapiens
ggaugaagcccuaaagaau

SEQ ID NO: 1123538 - RNA, 19 nt, Homo sapiens
gaagaugcaaguggaauaa

SEQ ID NO: 1123539 - RNA, 19 nt, Homo sapiens
gcaugcagcucgucaucuu

SEQ ID NO: 1123540 - RNA, 19 nt, Homo sapiens
ggaagaugcaaguggaaua

SEQ ID NO: 1123541 - RNA, 19 nt, Homo sapiens
caucugacauaccuuaaug

SEQ ID NO: 1123542 - RNA, 19 nt, Homo sapiens
gaagccauccgcagugaaa

SEQ ID NO: 1123543 - RNA, 19 nt, Homo sapiens
gaugaagcccuaaagaaug

SEQ ID NO: 1123544 - RNA, 19 nt, Homo sapiens
gcuacugagucacaauaaa

SEQ ID NO: 1123545 - RNA, 19 nt, Homo sapiens
gguugcaacucaugagauu

SEQ ID NO: 1123546 - RNA, 19 nt, Homo sapiens
uccaaaggauccagcauuu

SEQ ID NO: 1123547 - RNA, 19 nt, Homo sapiens
gcagugggcccaugaagau

SEQ ID NO: 1123548 - RNA, 19 nt, Homo sapiens
ucaauuacccacaugauau

SEQ ID NO: 1123549 - RNA, 19 nt, Homo sapiens
ggaauaagcacacucuaac

SEQ ID NO: 1123550 - RNA, 19 nt, Homo sapiens
ggaaucagagcuccauaau

SEQ ID NO: 1123551 - RNA, 19 nt, Homo sapiens
gcagugaaagacaguauau

SEQ ID NO: 1123552 - RNA, 19 nt, Homo sapiens
cucgucaucuuaagaguua

SEQ ID NO: 1123553 - RNA, 19 nt, Homo sapiens
acucuaacuuacaggauua

SEQ ID NO: 1123554 - RNA, 19 nt, Homo sapiens
gggaaucagagcuccauaa

SEQ ID NO: 1123555 - RNA, 19 nt, Homo sapiens
gaggaucaaagaacugaaa

SEQ ID NO: 1123556 - RNA, 19 nt, Homo sapiens
guucaucugacauaccuua

SEQ ID NO: 1123557 - RNA, 19 nt, Homo sapiens
gaucaaagaacugaaagca

SEQ ID NO: 1123558 - RNA, 19 nt, Homo sapiens
ggaguuuauuggaggauca

SEQ ID NO: 1123559 - RNA, 19 nt, Homo sapiens
gacacuggauauaaucugu

SEQ ID NO: 1123560 - RNA, 19 nt, Homo sapiens
ugggccaggugguaucuua

SEQ ID NO: 1123561 - RNA, 19 nt, Homo sapiens
gauuaucaauuacccacau

SEQ ID NO: 1123562 - RNA, 19 nt, Homo sapiens
gaaugggacagaccuacuu

SEQ ID NO: 1123563 - RNA, 19 nt, Homo sapiens
ggacuuuguugagggcuau

SEQ ID NO: 1123564 - RNA, 19 nt, Homo sapiens
gaaucagagcuccauaaug

SEQ ID NO: 1123565 - RNA, 19 nt, Homo sapiens
aaugaacacuggucagcuu

SEQ ID NO: 1123566 - RNA, 19 nt, Homo sapiens
uggaauaagcacacucuaa

SEQ ID NO: 1123567 - RNA, 19 nt, Homo sapiens
ucaaaacgcuacugaguca

SEQ ID NO: 1123568 - RNA, 19 nt, Homo sapiens
gcucagugccgaugauauc

SEQ ID NO: 1123569 - RNA, 19 nt, Homo sapiens
ugaagaugguuggcccuuu

SEQ ID NO: 1123570 - RNA, 19 nt, Homo sapiens
acacagcuccugcaacaau

SEQ ID NO: 1123571 - RNA, 19 nt, Homo sapiens
caaagaacugaaagcacua

SEQ ID NO: 1123572 - RNA, 19 nt, Homo sapiens
uagcacagaggacuuauuc

SEQ ID NO: 1123573 - RNA, 19 nt, Homo sapiens
cuucagacacuggauauaa

SEQ ID NO: 1123574 - RNA, 19 nt, Homo sapiens
gggcuauuuccaucaauuu

SEQ ID NO: 1123575 - RNA, 19 nt, Homo sapiens
uaaagaaugcaaccuaguc

SEQ ID NO: 1123576 - RNA, 19 nt, Homo sapiens
ggagcaaugugaccccuuu

SEQ ID NO: 1123577 - RNA, 19 nt, Homo sapiens
ugagggcuauuuccaucaa

SEQ ID NO: 1123578 - RNA, 19 nt, Homo sapiens
uauucaaccuguccuuuca

SEQ ID NO: 1123579 - RNA, 19 nt, Homo sapiens
cacucuaacuuacaggauu

SEQ ID NO: 1123580 - RNA, 19 nt, Homo sapiens
caauuacccacaugauaug

SEQ ID NO: 1123581 - RNA, 19 nt, Homo sapiens
gaacacuggucagcuucag

SEQ ID NO: 1123582 - RNA, 19 nt, Homo sapiens
gaauaagcacacucuaacu

SEQ ID NO: 1123583 - RNA, 19 nt, Homo sapiens
ggauccagcauuuguaugg

SEQ ID NO: 1123584 - RNA, 19 nt, Homo sapiens
aauaagcacacucuaacuu

SEQ ID NO: 1123585 - RNA, 19 nt, Homo sapiens
cagcauuuguauggagaaa

SEQ ID NO: 1123586 - RNA, 19 nt, Homo sapiens
gagauugggcauucuuugg

SEQ ID NO: 1123587 - RNA, 19 nt, Homo sapiens
cacagcuccugcaacaauu

SEQ ID NO: 1123588 - RNA, 19 nt, Homo sapiens
gcagcucgucaucuuaaga

SEQ ID NO: 1123589 - RNA, 19 nt, Homo sapiens
aaaggauccagcauuugua

SEQ ID NO: 1123590 - RNA, 19 nt, Homo sapiens
cagcuucagacacuggaua

SEQ ID NO: 1123591 - RNA, 19 nt, Homo sapiens
cuacugagucacaauaaag

SEQ ID NO: 1123592 - RNA, 19 nt, Homo sapiens
uagcugaaccgacacucaa

SEQ ID NO: 1123593 - RNA, 19 nt, Homo sapiens
gcucgucaucuuaagaguu

SEQ ID NO: 1123594 - RNA, 19 nt, Homo sapiens
gaugguuggcccuuugaug

SEQ ID NO: 1123595 - RNA, 19 nt, Homo sapiens
augcagacaucaagguuuc

SEQ ID NO: 1123596 - RNA, 19 nt, Homo sapiens
caaugugaccccuuugaua

SEQ ID NO: 1123597 - RNA, 19 nt, Homo sapiens
aaagaaugcaaccuaguca

SEQ ID NO: 1123598 - RNA, 19 nt, Homo sapiens
aggaugaagcccuaaagaa

SEQ ID NO: 1123599 - RNA, 19 nt, Homo sapiens
acaucaagguuucuuucug

SEQ ID NO: 1123600 - RNA, 19 nt, Homo sapiens
uucagacacuggauauaau

SEQ ID NO: 1123601 - RNA, 19 nt, Homo sapiens
ggcagugggcccaugaaga

SEQ ID NO: 1123602 - RNA, 19 nt, Homo sapiens
gcagacaucaagguuucuu

SEQ ID NO: 1123603 - RNA, 19 nt, Homo sapiens
gggacagaccuacuugaca

SEQ ID NO: 1123604 - RNA, 19 nt, Homo sapiens
caugcagcucgucaucuua

SEQ ID NO: 1123605 - RNA, 19 nt, Homo sapiens
ucagagcuccauaauguac

SEQ ID NO: 1123606 - RNA, 19 nt, Homo sapiens
cacuggauauaaucuguuc

SEQ ID NO: 1123607 - RNA, 19 nt, Homo sapiens
uggaaauccuggaguuguc

SEQ ID NO: 1123608 - RNA, 19 nt, Homo sapiens
gcaagugcagaauggagau

SEQ ID NO: 1123609 - RNA, 19 nt, Homo sapiens
auaaugcaguuuccaucug

SEQ ID NO: 1123610 - RNA, 19 nt, Homo sapiens
uuacccacaugauaugaag

SEQ ID NO: 1123611 - RNA, 19 nt, Homo sapiens
aaacgcuacugagucacaa

SEQ ID NO: 1123612 - RNA, 19 nt, Homo sapiens
uuaccaaauucuggaaauc

SEQ ID NO: 1123613 - RNA, 19 nt, Homo sapiens
agacaucaagguuucuuuc

SEQ ID NO: 1123614 - RNA, 19 nt, Homo sapiens
caucuuaagaguuacuauc

SEQ ID NO: 1123615 - RNA, 19 nt, Homo sapiens
ugagauugggcauucuuug

SEQ ID NO: 1123616 - RNA, 19 nt, Homo sapiens
cucaugagauugggcauuc

SEQ ID NO: 1123617 - RNA, 19 nt, Homo sapiens
ggaaugggacagaccuacu

SEQ ID NO: 1123618 - RNA, 19 nt, Homo sapiens
gagggcuauuuccaucaau

SEQ ID NO: 1123619 - RNA, 19 nt, Homo sapiens
cagugccgaugauauccaa

SEQ ID NO: 1123620 - RNA, 19 nt, Homo sapiens
ccagcucagugccgaugau

SEQ ID NO: 1123621 - RNA, 19 nt, Homo sapiens
gaugcaaguggaauaagca

SEQ ID NO: 1123622 - RNA, 19 nt, Homo sapiens
cagugaaagacaguauaua

SEQ ID NO: 1123623 - RNA, 19 nt, Homo sapiens
agggcuauuuccaucaauu

SEQ ID NO: 1123624 - RNA, 19 nt, Homo sapiens
gcagcacucugggaaucag

SEQ ID NO: 1123625 - RNA, 19 nt, Homo sapiens
cuaacuuacaggauuauca

SEQ ID NO: 1123626 - RNA, 19 nt, Homo sapiens
gaagagaugugauuuggua

SEQ ID NO: 1123627 - RNA, 19 nt, Homo sapiens
gagaugaaguuuccaguaa

SEQ ID NO: 1123628 - RNA, 19 nt, Homo sapiens
ggacuugacuugcuaccaa

SEQ ID NO: 1123629 - RNA, 19 nt, Homo sapiens
gcaguccugucuugauuaa

SEQ ID NO: 1123630 - RNA, 19 nt, Homo sapiens
gagggucggugaacgauga

SEQ ID NO: 1123631 - RNA, 19 nt, Homo sapiens
caacaaagaagagauguga

SEQ ID NO: 1123632 - RNA, 19 nt, Homo sapiens
aucaugagcuguucaauaa

SEQ ID NO: 1123633 - RNA, 19 nt, Homo sapiens
gaacugaaacacacuuuua

SEQ ID NO: 1123634 - RNA, 19 nt, Homo sapiens
caacaacugcugugcaauu

SEQ ID NO: 1123635 - RNA, 19 nt, Homo sapiens
gaugugauuugguaccauu

SEQ ID NO: 1123636 - RNA, 19 nt, Homo sapiens
gcacgggauuucugaggaa

SEQ ID NO: 1123637 - RNA, 19 nt, Homo sapiens
ggucugggcaguauuguuu

SEQ ID NO: 1123638 - RNA, 19 nt, Homo sapiens
caacaaggcauccucacaa

SEQ ID NO: 1123639 - RNA, 19 nt, Homo sapiens
caugagcuguucaauaaug

SEQ ID NO: 1123640 - RNA, 19 nt, Homo sapiens
gugcaguccugucuugauu

SEQ ID NO: 1123641 - RNA, 19 nt, Homo sapiens
gcgagaagcagcacaucua

SEQ ID NO: 1123642 - RNA, 19 nt, Homo sapiens
caaagaagagaugugauuu

SEQ ID NO: 1123643 - RNA, 19 nt, Homo sapiens
uaucaugagcuguucaaua

SEQ ID NO: 1123644 - RNA, 19 nt, Homo sapiens
gagcccauguggcaucuau

SEQ ID NO: 1123645 - RNA, 19 nt, Homo sapiens
uaauaggucugggcaguau

SEQ ID NO: 1123646 - RNA, 19 nt, Homo sapiens
caacugcugugcaauucug

SEQ ID NO: 1123647 - RNA, 19 nt, Homo sapiens
agugcaauguggauauuua

SEQ ID NO: 1123648 - RNA, 19 nt, Homo sapiens
gcaggugucuggacgaaaa

SEQ ID NO: 1123649 - RNA, 19 nt, Homo sapiens
acaaagaagagaugugauu

SEQ ID NO: 1123650 - RNA, 19 nt, Homo sapiens
caaggcauccucacaacaa

SEQ ID NO: 1123651 - RNA, 19 nt, Homo sapiens
ggaauaucaugagcuguuc

SEQ ID NO: 1123652 - RNA, 19 nt, Homo sapiens
gaagugacagugcaaugug

SEQ ID NO: 1123653 - RNA, 19 nt, Homo sapiens
ggaaaacccuaaugaacug

SEQ ID NO: 1123654 - RNA, 19 nt, Homo sapiens
gaugaaguuuccaguaagg

SEQ ID NO: 1123655 - RNA, 19 nt, Homo sapiens
gcacaacucgcgccucaag

SEQ ID NO: 1123656 - RNA, 19 nt, Homo sapiens
gcaauguggauauuuaugg

SEQ ID NO: 1123657 - RNA, 19 nt, Homo sapiens
ggaagugacagugcaaugu

SEQ ID NO: 1123658 - RNA, 19 nt, Homo sapiens
aagaagagaugugauuugg

SEQ ID NO: 1123659 - RNA, 19 nt, Homo sapiens
ugagaugaaguuuccagua

SEQ ID NO: 1123660 - RNA, 19 nt, Homo sapiens
ggacuaacaaggucaucug

SEQ ID NO: 1123661 - RNA, 19 nt, Homo sapiens
aaagaagagaugugauuug

SEQ ID NO: 1123662 - RNA, 19 nt, Homo sapiens
agacgccgcuggagaugga

SEQ ID NO: 1123663 - RNA, 19 nt, Homo sapiens
aguccugucuugauuaaau

SEQ ID NO: 1123664 - RNA, 19 nt, Homo sapiens
caaguucgcgcugcuguug

SEQ ID NO: 1123665 - RNA, 19 nt, Homo sapiens
aaacccuaaugaacugaaa

SEQ ID NO: 1123666 - RNA, 19 nt, Homo sapiens
caccaccgccuuccaaguu

SEQ ID NO: 1123667 - RNA, 19 nt, Homo sapiens
cagcaggugucuggacgaa

SEQ ID NO: 1123668 - RNA, 19 nt, Homo sapiens
ucacaacaaagaagagaug

SEQ ID NO: 1123669 - RNA, 19 nt, Homo sapiens
ucauccagcuguccuucaa

SEQ ID NO: 1123670 - RNA, 19 nt, Homo sapiens
ccagcuguccuucaaauag

SEQ ID NO: 1123671 - RNA, 19 nt, Homo sapiens
gugauuugguaccauuuca

SEQ ID NO: 1123672 - RNA, 19 nt, Homo sapiens
acgcauugguugagaugaa

SEQ ID NO: 1123673 - RNA, 19 nt, Homo sapiens
guccugucuugauuaaauu

SEQ ID NO: 1123674 - RNA, 19 nt, Homo sapiens
gagaugugauuugguacca

SEQ ID NO: 1123675 - RNA, 19 nt, Homo sapiens
acagugcaauguggauauu

SEQ ID NO: 1123676 - RNA, 19 nt, Homo sapiens
ggacgcauugguugagaug

SEQ ID NO: 1123677 - RNA, 19 nt, Homo sapiens
uguacacgcuggugcuguu

SEQ ID NO: 1123678 - RNA, 19 nt, Homo sapiens
aauaggaagagcuuuaguu

SEQ ID NO: 1123679 - RNA, 19 nt, Homo sapiens
guggauauuuauggcugua

SEQ ID NO: 1123680 - RNA, 19 nt, Homo sapiens
gacagugcaauguggauau

SEQ ID NO: 1123681 - RNA, 19 nt, Homo sapiens
ggaccuggcacgggauuuc

SEQ ID NO: 1123682 - RNA, 19 nt, Homo sapiens
ccggacacggccaaucuua

SEQ ID NO: 1123683 - RNA, 19 nt, Homo sapiens
gcuggagccauuucaacaa

SEQ ID NO: 1123684 - RNA, 19 nt, Homo sapiens
ugacggacgcauugguuga

SEQ ID NO: 1123685 - RNA, 19 nt, Homo sapiens
accaacaacugcugugcaa

SEQ ID NO: 1123686 - RNA, 19 nt, Homo sapiens
ucugggacuugacuugcua

SEQ ID NO: 1123687 - RNA, 19 nt, Homo sapiens
gcaaguucgcgcugcuguu

SEQ ID NO: 1123688 - RNA, 19 nt, Homo sapiens
ccucuacccagaacugauu

SEQ ID NO: 1123689 - RNA, 19 nt, Homo sapiens
ugacagugcaauguggaua

SEQ ID NO: 1123690 - RNA, 19 nt, Homo sapiens
ccuaaugaacugaaacaca

SEQ ID NO: 1123691 - RNA, 19 nt, Homo sapiens
aggaauaucaugagcuguu

SEQ ID NO: 1123692 - RNA, 19 nt, Homo sapiens
gcucuuccgcugcgacuuc

SEQ ID NO: 1123693 - RNA, 19 nt, Homo sapiens
ccaccgccuuccaaguuuc

SEQ ID NO: 1123694 - RNA, 19 nt, Homo sapiens
aaggcauccucacaacaaa

SEQ ID NO: 1123695 - RNA, 19 nt, Homo sapiens
agaugaaguuuccaguaag

SEQ ID NO: 1123696 - RNA, 19 nt, Homo sapiens
aacaacugcugugcaauuc

SEQ ID NO: 1123697 - RNA, 19 nt, Homo sapiens
ggcauccucacaacaaaga

SEQ ID NO: 1123698 - RNA, 19 nt, Homo sapiens
gcaccaccgccuuccaagu

SEQ ID NO: 1123699 - RNA, 19 nt, Homo sapiens
gauuugguaccauuucaca

SEQ ID NO: 1123700 - RNA, 19 nt, Homo sapiens
auaggaagagcuuuaguuc

SEQ ID NO: 1123701 - RNA, 19 nt, Homo sapiens
gugcaauguggauauuuau

SEQ ID NO: 1123702 - RNA, 19 nt, Homo sapiens
ccgggucagucaccacgaa

SEQ ID NO: 1123703 - RNA, 19 nt, Homo sapiens
ugaagguggugcagcuuuu

SEQ ID NO: 1123704 - RNA, 19 nt, Homo sapiens
cagcuguccuucaaauagc

SEQ ID NO: 1123705 - RNA, 19 nt, Homo sapiens
ucaacaaggcauccucaca

SEQ ID NO: 1123706 - RNA, 19 nt, Homo sapiens
ugccacugcuggagccauu

SEQ ID NO: 1123707 - RNA, 19 nt, Homo sapiens
gaauaucaugagcuguuca

SEQ ID NO: 1123708 - RNA, 19 nt, Homo sapiens
ggacacggccaaucuuacc

SEQ ID NO: 1123709 - RNA, 19 nt, Homo sapiens
gaggccgagugccgaaagu

SEQ ID NO: 1123710 - RNA, 19 nt, Homo sapiens
ccagauggcuauaauauua

SEQ ID NO: 1123711 - RNA, 19 nt, Homo sapiens
gaagagagcugaagaaagc

SEQ ID NO: 1123712 - RNA, 19 nt, Homo sapiens
ugucaaagcuugcaacaua

SEQ ID NO: 1123713 - RNA, 19 nt, Homo sapiens
ggaaggagaugaccaugca

SEQ ID NO: 1123714 - RNA, 19 nt, Homo sapiens
gaggaaagaaggaucauuu

SEQ ID NO: 1123715 - RNA, 19 nt, Homo sapiens
cagaauggguaaagacuug

SEQ ID NO: 1123716 - RNA, 19 nt, Homo sapiens
gcacuuguguguuuuguuu

SEQ ID NO: 1123717 - RNA, 19 nt, Homo sapiens
gcacacagggcaaggacua

SEQ ID NO: 1123718 - RNA, 19 nt, Homo sapiens
gguaaagacuugucaaagc

SEQ ID NO: 1123719 - RNA, 19 nt, Homo sapiens
gagaagagagcugaagaaa

SEQ ID NO: 1123720 - RNA, 19 nt, Homo sapiens
guaaagacuugucaaagcu

SEQ ID NO: 1123721 - RNA, 19 nt, Homo sapiens
agucucagauguuucauuu

SEQ ID NO: 1123722 - RNA, 19 nt, Homo sapiens
ucauacagcuagcauuaga

SEQ ID NO: 1123723 - RNA, 19 nt, Homo sapiens
ucaccaguuuggacaauuu

SEQ ID NO: 1123724 - RNA, 19 nt, Homo sapiens
ggagauugcccuucccuau

SEQ ID NO: 1123725 - RNA, 19 nt, Homo sapiens
gcaagcaccuggccaagcu

SEQ ID NO: 1123726 - RNA, 19 nt, Homo sapiens
gcaccucacucaucaugca

SEQ ID NO: 1123727 - RNA, 19 nt, Homo sapiens
acgaggcccuggagaguua

SEQ ID NO: 1123728 - RNA, 19 nt, Homo sapiens
gggugauguuucuuacuua

SEQ ID NO: 1123729 - RNA, 19 nt, Homo sapiens
gcugagcgccacagucuaa

SEQ ID NO: 1123730 - RNA, 19 nt, Homo sapiens
agaguuaccugcccaagau

SEQ ID NO: 1123731 - RNA, 19 nt, Homo sapiens
gccacgggcuugcagauug

SEQ ID NO: 1123732 - RNA, 19 nt, Homo sapiens
caaaggcagugagaagaga

SEQ ID NO: 1123733 - RNA, 19 nt, Homo sapiens
gcaaggagcacgggaagga

SEQ ID NO: 1123734 - RNA, 19 nt, Homo sapiens
ggugauguuucuuacuuau

SEQ ID NO: 1123735 - RNA, 19 nt, Homo sapiens
cccaaaggcuggaguguca

SEQ ID NO: 1123736 - RNA, 19 nt, Homo sapiens
uggagaagcugcgggauga

SEQ ID NO: 1123737 - RNA, 19 nt, Homo sapiens
ccacgggcuugcagauuga

SEQ ID NO: 1123738 - RNA, 19 nt, Homo sapiens
uauugcaacuugaccuuaa

SEQ ID NO: 1123739 - RNA, 19 nt, Homo sapiens
ccuuucagcucucuaguga

SEQ ID NO: 1123740 - RNA, 19 nt, Homo sapiens
ggaucccuguguuguaauu

SEQ ID NO: 1123741 - RNA, 19 nt, Homo sapiens
gcuggagugucauguauag

SEQ ID NO: 1123742 - RNA, 19 nt, Homo sapiens
cggccacgauuuccuguuu

SEQ ID NO: 1123743 - RNA, 19 nt, Homo sapiens
ccuucgagcuugaugguuu

SEQ ID NO: 1123744 - RNA, 19 nt, Homo sapiens
gccagcaccucacucauca

SEQ ID NO: 1123745 - RNA, 19 nt, Homo sapiens
gcaacaagcgcaaggucuu

SEQ ID NO: 1123746 - RNA, 19 nt, Homo sapiens
gcccagauggcuauaauau

SEQ ID NO: 1123747 - RNA, 19 nt, Homo sapiens
uguaauuggucccuccuuu

SEQ ID NO: 1123748 - RNA, 19 nt, Homo sapiens
cuaugccacugucugcuua

SEQ ID NO: 1123749 - RNA, 19 nt, Homo sapiens
gggcauuauuuggguuuaa

SEQ ID NO: 1123750 - RNA, 19 nt, Homo sapiens
uugaagcacuuucgauguu

SEQ ID NO: 1123751 - RNA, 19 nt, Homo sapiens
guucaagacgcauuuguug

SEQ ID NO: 1123752 - RNA, 19 nt, Homo sapiens
uuucauacagcuagcauua

SEQ ID NO: 1123753 - RNA, 19 nt, Homo sapiens
ggagguucauuuuccuuua

SEQ ID NO: 1123754 - RNA, 19 nt, Homo sapiens
cagccacccugaagauaga

SEQ ID NO: 1123755 - RNA, 19 nt, Homo sapiens
cacccucccucaccaguuu

SEQ ID NO: 1123756 - RNA, 19 nt, Homo sapiens
gagauugcccuucccuaug

SEQ ID NO: 1123757 - RNA, 19 nt, Homo sapiens
ugaaacugguaccguguga

SEQ ID NO: 1123758 - RNA, 19 nt, Homo sapiens
gaaggggucucuggucaaa

SEQ ID NO: 1123759 - RNA, 19 nt, Homo sapiens
uggccaagcuguuccugaa

SEQ ID NO: 1123760 - RNA, 19 nt, Homo sapiens
guugggcgcuggcguuugu

SEQ ID NO: 1123761 - RNA, 19 nt, Homo sapiens
uuagaugggugauguuucu

SEQ ID NO: 1123762 - RNA, 19 nt, Homo sapiens
gcggagaacgugcgcaaga

SEQ ID NO: 1123763 - RNA, 19 nt, Homo sapiens
gagaguuaccugcccaaga

SEQ ID NO: 1123764 - RNA, 19 nt, Homo sapiens
ccacugugcuggagaagcu

SEQ ID NO: 1123765 - RNA, 19 nt, Homo sapiens
gaaguauggcaacguguuc

SEQ ID NO: 1123766 - RNA, 19 nt, Homo sapiens
ugggugauguuucuuacuu

SEQ ID NO: 1123767 - RNA, 19 nt, Homo sapiens
ggaaagaaggaucauuugc

SEQ ID NO: 1123768 - RNA, 19 nt, Homo sapiens
gaaaaucgaaaacacagaa

SEQ ID NO: 1123769 - RNA, 19 nt, Homo sapiens
gaacaucuccuccccuuca

SEQ ID NO: 1123770 - RNA, 19 nt, Homo sapiens
ggaccuugggcaccucuuu

SEQ ID NO: 1123771 - RNA, 19 nt, Homo sapiens
uaucaucccuaacuauugc

SEQ ID NO: 1123772 - RNA, 19 nt, Homo sapiens
cgaaaacacagaagaauga

SEQ ID NO: 1123773 - RNA, 19 nt, Homo sapiens
ggagugucauguauagcau

SEQ ID NO: 1123774 - RNA, 19 nt, Homo sapiens
ugaagcacuuucgauguug

SEQ ID NO: 1123775 - RNA, 19 nt, Homo sapiens
gaugggugauguuucuuac

SEQ ID NO: 1123776 - RNA, 19 nt, Homo sapiens
gagguucauuuuccuuuaa

SEQ ID NO: 1123777 - RNA, 19 nt, Homo sapiens
cgucuucccuuccuuaacu

SEQ ID NO: 1123778 - RNA, 19 nt, Homo sapiens
gagcaagggccuccgucuu

SEQ ID NO: 1123779 - RNA, 19 nt, Homo sapiens
ccgaggccaucaacgugua

SEQ ID NO: 1123780 - RNA, 19 nt, Homo sapiens
ucacugauagagaaucuug

SEQ ID NO: 1123781 - RNA, 19 nt, Homo sapiens
guaauuggucccuccuuuc

SEQ ID NO: 1123782 - RNA, 19 nt, Homo sapiens
ugaauccccuuuacaagaa

SEQ ID NO: 1123783 - RNA, 19 nt, Homo sapiens
gcccuggaccuccucauug

SEQ ID NO: 1123784 - RNA, 19 nt, Homo sapiens
gugcguguguguuucauac

SEQ ID NO: 1123785 - RNA, 19 nt, Homo sapiens
uaauuggucccuccuuuca

SEQ ID NO: 1123786 - RNA, 19 nt, Homo sapiens
acagaagaaugaaggacau

SEQ ID NO: 1123787 - RNA, 19 nt, Homo sapiens
gccacagucuaacccaaga

SEQ ID NO: 1123788 - RNA, 19 nt, Homo sapiens
cccuggaccuccucauuga

SEQ ID NO: 1123789 - RNA, 19 nt, Homo sapiens
ggagaacgugcgcaagauc

SEQ ID NO: 1123790 - RNA, 19 nt, Homo sapiens
ugagaagagagcugaagaa

SEQ ID NO: 1123791 - RNA, 19 nt, Homo sapiens
gucaaagcuugcaacauag

SEQ ID NO: 1123792 - RNA, 19 nt, Homo sapiens
ucacagccacccugaagau

SEQ ID NO: 1123793 - RNA, 19 nt, Homo sapiens
gggaugacugggugaaaga

SEQ ID NO: 1123794 - RNA, 19 nt, Homo sapiens
ggaggaaagaaggaucauu

SEQ ID NO: 1123795 - RNA, 19 nt, Homo sapiens
guccggugccucugccuua

SEQ ID NO: 1123796 - RNA, 19 nt, Homo sapiens
gcgagacuucugugaguga

SEQ ID NO: 1123797 - RNA, 19 nt, Homo sapiens
gcaugcccgugacaguguu

SEQ ID NO: 1123798 - RNA, 19 nt, Homo sapiens
cgacauccaccgcaacaag

SEQ ID NO: 1123799 - RNA, 19 nt, Homo sapiens
ucgcagcacccgcauguug

SEQ ID NO: 1123800 - RNA, 19 nt, Homo sapiens
ugauccagcuggcccugaa

SEQ ID NO: 1123801 - RNA, 19 nt, Homo sapiens
ggccacgauuuccuguuug

SEQ ID NO: 1123802 - RNA, 19 nt, Homo sapiens
ccuccucccucuccuguca

SEQ ID NO: 1123803 - RNA, 19 nt, Homo sapiens
uggcgagacuucugugagu

SEQ ID NO: 1123804 - RNA, 19 nt, Homo sapiens
ggucuggagugaacaucuc

SEQ ID NO: 1123805 - RNA, 19 nt, Homo sapiens
ggcaaacccuacccaaagc

SEQ ID NO: 1123806 - RNA, 19 nt, Homo sapiens
gcaccuggccaagcuguuc

SEQ ID NO: 1123807 - RNA, 19 nt, Homo sapiens
cacagucguuuuaauauug

SEQ ID NO: 1123808 - RNA, 19 nt, Homo sapiens
cccuaacuauugcaacuug

SEQ ID NO: 1123809 - RNA, 19 nt, Homo sapiens
cacacagacugcucuccaa

SEQ ID NO: 1123810 - RNA, 19 nt, Homo sapiens
caacacagccguccaggaa

SEQ ID NO: 1123811 - RNA, 19 nt, Homo sapiens
acuaugcgcucguucauuu

SEQ ID NO: 1123812 - RNA, 19 nt, Homo sapiens
gcaccuguguggaaguaaa

SEQ ID NO: 1123813 - RNA, 19 nt, Homo sapiens
ggugaucucugaugaacau

SEQ ID NO: 1123814 - RNA, 19 nt, Homo sapiens
gggaggugaucucugauga

SEQ ID NO: 1123815 - RNA, 19 nt, Homo sapiens
gggcauggaugagauggaa

SEQ ID NO: 1123816 - RNA, 19 nt, Homo sapiens
guacccuucugcucaguaa

SEQ ID NO: 1123817 - RNA, 19 nt, Homo sapiens
gaugagaccuuuugcauag

SEQ ID NO: 1123818 - RNA, 19 nt, Homo sapiens
ugauggacguugucagaaa

SEQ ID NO: 1123819 - RNA, 19 nt, Homo sapiens
cgagggagaaggaguauga

SEQ ID NO: 1123820 - RNA, 19 nt, Homo sapiens
ucacaucuccugcugcauu

SEQ ID NO: 1123821 - RNA, 19 nt, Homo sapiens
ugaacgacuuggugucuga

SEQ ID NO: 1123822 - RNA, 19 nt, Homo sapiens
gcagauguuugaugcuaag

SEQ ID NO: 1123823 - RNA, 19 nt, Homo sapiens
gaagggaccauagcaagga

SEQ ID NO: 1123824 - RNA, 19 nt, Homo sapiens
uaagaacagcagcuacuuu

SEQ ID NO: 1123825 - RNA, 19 nt, Homo sapiens
ucugggaggugaucucuga

SEQ ID NO: 1123826 - RNA, 19 nt, Homo sapiens
ucagagcaguuuacagcaa

SEQ ID NO: 1123827 - RNA, 19 nt, Homo sapiens
aggaggagguggccuagaa

SEQ ID NO: 1123828 - RNA, 19 nt, Homo sapiens
gcauggaugagauggaauu

SEQ ID NO: 1123829 - RNA, 19 nt, Homo sapiens
gauggacguugucagaaag

SEQ ID NO: 1123830 - RNA, 19 nt, Homo sapiens
gaggugaucucugaugaac

SEQ ID NO: 1123831 - RNA, 19 nt, Homo sapiens
gaagcuggccgugaacaug

SEQ ID NO: 1123832 - RNA, 19 nt, Homo sapiens
cgacuuggugucugaauau

SEQ ID NO: 1123833 - RNA, 19 nt, Homo sapiens
guaagauccgggaggagua

SEQ ID NO: 1123834 - RNA, 19 nt, Homo sapiens
gcgcugugcucguggaucu

SEQ ID NO: 1123835 - RNA, 19 nt, Homo sapiens
gugcaccuguguggaagua

SEQ ID NO: 1123836 - RNA, 19 nt, Homo sapiens
gauaagaacagcagcuacu

SEQ ID NO: 1123837 - RNA, 19 nt, Homo sapiens
gauguuugaugcuaagaac

SEQ ID NO: 1123838 - RNA, 19 nt, Homo sapiens
uaacgaagcgcuauaugac

SEQ ID NO: 1123839 - RNA, 19 nt, Homo sapiens
caacguggaagggaccaua

SEQ ID NO: 1123840 - RNA, 19 nt, Homo sapiens
cacaucuccugcugcauuu

SEQ ID NO: 1123841 - RNA, 19 nt, Homo sapiens
ucacccagcagauguuuga

SEQ ID NO: 1123842 - RNA, 19 nt, Homo sapiens
ccagacaggaucauaaaca

SEQ ID NO: 1123843 - RNA, 19 nt, Homo sapiens
ucacugaggccgagagcaa

SEQ ID NO: 1123844 - RNA, 19 nt, Homo sapiens
gcgagggcauggaugagau

SEQ ID NO: 1123845 - RNA, 19 nt, Homo sapiens
cuacaacgccacccucuca

SEQ ID NO: 1123846 - RNA, 19 nt, Homo sapiens
aagaacagcagcuacuuug

SEQ ID NO: 1123847 - RNA, 19 nt, Homo sapiens
ggaggugaucucugaugaa

SEQ ID NO: 1123848 - RNA, 19 nt, Homo sapiens
gagcucacccagcagaugu

SEQ ID NO: 1123849 - RNA, 19 nt, Homo sapiens
gauaacgaagcgcuauaug

SEQ ID NO: 1123850 - RNA, 19 nt, Homo sapiens
auaacgaagcgcuauauga

SEQ ID NO: 1123851 - RNA, 19 nt, Homo sapiens
gacaggaucauaaacacau

SEQ ID NO: 1123852 - RNA, 19 nt, Homo sapiens
guacccagacaggaucaua

SEQ ID NO: 1123853 - RNA, 19 nt, Homo sapiens
ggagguggccuagaacucu

SEQ ID NO: 1123854 - RNA, 19 nt, Homo sapiens
acgacuuggugucugaaua

SEQ ID NO: 1123855 - RNA, 19 nt, Homo sapiens
ggccagacaacuucauuuc

SEQ ID NO: 1123856 - RNA, 19 nt, Homo sapiens
gaacucuccuuuucuaggu

SEQ ID NO: 1123857 - RNA, 19 nt, Homo sapiens
agagcaacaugaacgacuu

SEQ ID NO: 1123858 - RNA, 19 nt, Homo sapiens
gagcaacaugaacgacuug

SEQ ID NO: 1123859 - RNA, 19 nt, Homo sapiens
acgaagcgcuauaugacau

SEQ ID NO: 1123860 - RNA, 19 nt, Homo sapiens
ugcggaagcuggccgugaa

SEQ ID NO: 1123861 - RNA, 19 nt, Homo sapiens
acaggaucauaaacacauu

SEQ ID NO: 1123862 - RNA, 19 nt, Homo sapiens
uagauaacgaagcgcuaua

SEQ ID NO: 1123863 - RNA, 19 nt, Homo sapiens
guggauccuucacuguguu

SEQ ID NO: 1123864 - RNA, 19 nt, Homo sapiens
ggccgagggagaaggagua

SEQ ID NO: 1123865 - RNA, 19 nt, Homo sapiens
acacagccguccaggaacu

SEQ ID NO: 1123866 - RNA, 19 nt, Homo sapiens
aauccugccuuggccauga

SEQ ID NO: 1123867 - RNA, 19 nt, Homo sapiens
caacauucaagauaagaac

SEQ ID NO: 1123868 - RNA, 19 nt, Homo sapiens
cagacaggaucauaaacac

SEQ ID NO: 1123869 - RNA, 19 nt, Homo sapiens
gccuagaacucuccuuuuc

SEQ ID NO: 1123870 - RNA, 19 nt, Homo sapiens
gaacgacuuggugucugaa

SEQ ID NO: 1123871 - RNA, 19 nt, Homo sapiens
uggaugagauggaauucac

SEQ ID NO: 1123872 - RNA, 19 nt, Homo sapiens
ggaagcuggccgugaacau

SEQ ID NO: 1123873 - RNA, 19 nt, Homo sapiens
gcgggucucagagcaguuu

SEQ ID NO: 1123874 - RNA, 19 nt, Homo sapiens
uaaagacgugggaggaagu

SEQ ID NO: 1123875 - RNA, 19 nt, Homo sapiens
ggaagcaguguggauccuu

SEQ ID NO: 1123876 - RNA, 19 nt, Homo sapiens
aagauaagaacagcagcua

SEQ ID NO: 1123877 - RNA, 19 nt, Homo sapiens
gcucacccagcagauguuu

SEQ ID NO: 1123878 - RNA, 19 nt, Homo sapiens
guguggaaguaaagcuguu

SEQ ID NO: 1123879 - RNA, 19 nt, Homo sapiens
agucagugauggacguugu

SEQ ID NO: 1123880 - RNA, 19 nt, Homo sapiens
gaacugcccugaagauauu

SEQ ID NO: 1123881 - RNA, 19 nt, Homo sapiens
gaugauugcuugugugaua

SEQ ID NO: 1123882 - RNA, 19 nt, Homo sapiens
ggaaauaguugcucuuuua

SEQ ID NO: 1123883 - RNA, 19 nt, Homo sapiens
aagaauaucucccguauaa

SEQ ID NO: 1123884 - RNA, 19 nt, Homo sapiens
ggaaggcuuucuacaagua

SEQ ID NO: 1123885 - RNA, 19 nt, Homo sapiens
gguacaagaucuagaguuu

SEQ ID NO: 1123886 - RNA, 19 nt, Homo sapiens
caagaaggcucaagaaucu

SEQ ID NO: 1123887 - RNA, 19 nt, Homo sapiens
gaugagaaauccauguuug

SEQ ID NO: 1123888 - RNA, 19 nt, Homo sapiens
gauggccacuguucaauaa

SEQ ID NO: 1123889 - RNA, 19 nt, Homo sapiens
gaauaucucccguauaaug

SEQ ID NO: 1123890 - RNA, 19 nt, Homo sapiens
gcucaauugucgaucuuua

SEQ ID NO: 1123891 - RNA, 19 nt, Homo sapiens
gaagcgaccuuguccuuuc

SEQ ID NO: 1123892 - RNA, 19 nt, Homo sapiens
acacauggcuagaagguuu

SEQ ID NO: 1123893 - RNA, 19 nt, Homo sapiens
ugucaaagguggcuccaua

SEQ ID NO: 1123894 - RNA, 19 nt, Homo sapiens
gaaagacacuaaucugacu

SEQ ID NO: 1123895 - RNA, 19 nt, Homo sapiens
gaauuccgauuacauuuca

SEQ ID NO: 1123896 - RNA, 19 nt, Homo sapiens
uuacagaaauuccugaaga

SEQ ID NO: 1123897 - RNA, 19 nt, Homo sapiens
ggaacagcaucuaugaaga

SEQ ID NO: 1123898 - RNA, 19 nt, Homo sapiens
ggcaagauaugaugauuca

SEQ ID NO: 1123899 - RNA, 19 nt, Homo sapiens
caacccuccuuuaagcuua

SEQ ID NO: 1123900 - RNA, 19 nt, Homo sapiens
agaaaacacugcagaaaua

SEQ ID NO: 1123901 - RNA, 19 nt, Homo sapiens
caaagguggcuccauauuu

SEQ ID NO: 1123902 - RNA, 19 nt, Homo sapiens
gaagauggccacuguucaa

SEQ ID NO: 1123903 - RNA, 19 nt, Homo sapiens
gcucagggcuggugucagu

SEQ ID NO: 1123904 - RNA, 19 nt, Homo sapiens
gagaauaguccaucuaaag

SEQ ID NO: 1123905 - RNA, 19 nt, Homo sapiens
ucaagaauaucucccguau

SEQ ID NO: 1123906 - RNA, 19 nt, Homo sapiens
ggcuaugucugcauucuaa

SEQ ID NO: 1123907 - RNA, 19 nt, Homo sapiens
ucuaaaggcuuccaacuca

SEQ ID NO: 1123908 - RNA, 19 nt, Homo sapiens
gauauugacagcaucgaua

SEQ ID NO: 1123909 - RNA, 19 nt, Homo sapiens
gcagauacaauuuggaaga

SEQ ID NO: 1123910 - RNA, 19 nt, Homo sapiens
ggaaauugucaguuacuuu

SEQ ID NO: 1123911 - RNA, 19 nt, Homo sapiens
acacuaaucugacuucaag

SEQ ID NO: 1123912 - RNA, 19 nt, Homo sapiens
caacacaguagguaauaaa

SEQ ID NO: 1123913 - RNA, 19 nt, Homo sapiens
ucacuggaguucuggauga

SEQ ID NO: 1123914 - RNA, 19 nt, Homo sapiens
gaauggcccuuucaaugca

SEQ ID NO: 1123915 - RNA, 19 nt, Homo sapiens
agaagaagaugcugacaca

SEQ ID NO: 1123916 - RNA, 19 nt, Homo sapiens
ggaacugcccugaagauau

SEQ ID NO: 1123917 - RNA, 19 nt, Homo sapiens
gcguuacacuggcuauaaa

SEQ ID NO: 1123918 - RNA, 19 nt, Homo sapiens
cagcaucgauaacuucaau

SEQ ID NO: 1123919 - RNA, 19 nt, Homo sapiens
gcaggucacuggaguucug

SEQ ID NO: 1123920 - RNA, 19 nt, Homo sapiens
caacucacccgacaggaaa

SEQ ID NO: 1123921 - RNA, 19 nt, Homo sapiens
aaaggaggaauuccgauua

SEQ ID NO: 1123922 - RNA, 19 nt, Homo sapiens
ggcaaacaauaccaaagaa

SEQ ID NO: 1123923 - RNA, 19 nt, Homo sapiens
ccgauuacauuucaagaau

SEQ ID NO: 1123924 - RNA, 19 nt, Homo sapiens
gaggaauuccgauuacauu

SEQ ID NO: 1123925 - RNA, 19 nt, Homo sapiens
uuacaucuaugcgcaaauu

SEQ ID NO: 1123926 - RNA, 19 nt, Homo sapiens
ggcagaagauggccacugu

SEQ ID NO: 1123927 - RNA, 19 nt, Homo sapiens
uauaaacgguacuuucugu

SEQ ID NO: 1123928 - RNA, 19 nt, Homo sapiens
ggucaacccuccuuuaagc

SEQ ID NO: 1123929 - RNA, 19 nt, Homo sapiens
ggaacugucaccaugauga

SEQ ID NO: 1123930 - RNA, 19 nt, Homo sapiens
gaacagcaucuaugaagag

SEQ ID NO: 1123931 - RNA, 19 nt, Homo sapiens
uugcaucuguguagaagua

SEQ ID NO: 1123932 - RNA, 19 nt, Homo sapiens
gaacugucaccaugaugaa

SEQ ID NO: 1123933 - RNA, 19 nt, Homo sapiens
aaagguggcuccauauuuu

SEQ ID NO: 1123934 - RNA, 19 nt, Homo sapiens
aagcugggcauucuaauaa

SEQ ID NO: 1123935 - RNA, 19 nt, Homo sapiens
uuugugaacuugaugauga

SEQ ID NO: 1123936 - RNA, 19 nt, Homo sapiens
ugagcaagcuaauaaacug

SEQ ID NO: 1123937 - RNA, 19 nt, Homo sapiens
aaucugacuucaagaauuc

SEQ ID NO: 1123938 - RNA, 19 nt, Homo sapiens
cagagaauaguccaucuaa

SEQ ID NO: 1123939 - RNA, 19 nt, Homo sapiens
ccaagaaggcucaagaauc

SEQ ID NO: 1123940 - RNA, 19 nt, Homo sapiens
ggaauuccgauuacauuuc

SEQ ID NO: 1123941 - RNA, 19 nt, Homo sapiens
cuaauaaacugggagcaau

SEQ ID NO: 1123942 - RNA, 19 nt, Homo sapiens
gcaaacaauaccaaagaau

SEQ ID NO: 1123943 - RNA, 19 nt, Homo sapiens
ggacuuucugugauucaua

SEQ ID NO: 1123944 - RNA, 19 nt, Homo sapiens
caaaaucuuccccaaaaua

SEQ ID NO: 1123945 - RNA, 19 nt, Homo sapiens
ucgauaacuucaauaccua

SEQ ID NO: 1123946 - RNA, 19 nt, Homo sapiens
aagaagaugcugacacaaa

SEQ ID NO: 1123947 - RNA, 19 nt, Homo sapiens
caagggagaagguccaaga

SEQ ID NO: 1123948 - RNA, 19 nt, Homo sapiens
aggcgaagaugauggagaa

SEQ ID NO: 1123949 - RNA, 19 nt, Homo sapiens
uaaaggaggaauuccgauu

SEQ ID NO: 1123950 - RNA, 19 nt, Homo sapiens
uacaaaaucuuccccaaaa

SEQ ID NO: 1123951 - RNA, 19 nt, Homo sapiens
guauauaaacgguacuuuc

SEQ ID NO: 1123952 - RNA, 19 nt, Homo sapiens
gaauacaaucuaugcaauc

SEQ ID NO: 1123953 - RNA, 19 nt, Homo sapiens
ggagaacuagggaacaaau

SEQ ID NO: 1123954 - RNA, 19 nt, Homo sapiens
ugaacuugaugaugagaga

SEQ ID NO: 1123955 - RNA, 19 nt, Homo sapiens
cagcagauacaauuuggaa

SEQ ID NO: 1123956 - RNA, 19 nt, Homo sapiens
uaaacgguacuuucuguga

SEQ ID NO: 1123957 - RNA, 19 nt, Homo sapiens
ugugacaaaugcagauuau

SEQ ID NO: 1123958 - RNA, 19 nt, Homo sapiens
aaagcugggcauucuaaua

SEQ ID NO: 1123959 - RNA, 19 nt, Homo sapiens
ugacaaaugcagauuaugg

SEQ ID NO: 1123960 - RNA, 19 nt, Homo sapiens
agagucuucuauaagcuua

SEQ ID NO: 1123961 - RNA, 19 nt, Homo sapiens
aaagggaccucugcaugga

SEQ ID NO: 1123962 - RNA, 19 nt, Homo sapiens
cagaaauuccugaagauuc

SEQ ID NO: 1123963 - RNA, 19 nt, Homo sapiens
cccuuucaaugcauaguua

SEQ ID NO: 1123964 - RNA, 19 nt, Homo sapiens
uuauggacauucaucagaa

SEQ ID NO: 1123965 - RNA, 19 nt, Homo sapiens
uaaagugacuguggaaagc

SEQ ID NO: 1123966 - RNA, 19 nt, Homo sapiens
agagaauaguccaucuaaa

SEQ ID NO: 1123967 - RNA, 19 nt, Homo sapiens
caagaauaucucccguaua

SEQ ID NO: 1123968 - RNA, 19 nt, Homo sapiens
cagcaucuaugaagagaac

SEQ ID NO: 1123969 - RNA, 19 nt, Homo sapiens
gaucuccagcugcucagua

SEQ ID NO: 1123970 - RNA, 19 nt, Homo sapiens
aaacgguacuuucugugau

SEQ ID NO: 1123971 - RNA, 19 nt, Homo sapiens
uaggucaacccuccuuuaa

SEQ ID NO: 1123972 - RNA, 19 nt, Homo sapiens
caugaugaauggcccuuuc

SEQ ID NO: 1123973 - RNA, 19 nt, Homo sapiens
gugugucacuuucuauaau

SEQ ID NO: 1123974 - RNA, 19 nt, Homo sapiens
ggacauucaucagaaagac

SEQ ID NO: 1123975 - RNA, 19 nt, Homo sapiens
aauaaacugggagcaauua

SEQ ID NO: 1123976 - RNA, 19 nt, Homo sapiens
guacuuucugugauucaua

SEQ ID NO: 1123977 - RNA, 19 nt, Homo sapiens
uauggacauucaucagaaa

SEQ ID NO: 1123978 - RNA, 19 nt, Homo sapiens
uaacuagagacauaaagug

SEQ ID NO: 1123979 - RNA, 19 nt, Homo sapiens
acaacacaguagguaauaa

SEQ ID NO: 1123980 - RNA, 19 nt, Homo sapiens
gaagaugauuggaaagguu

SEQ ID NO: 1123981 - RNA, 19 nt, Homo sapiens
acacuuugcuggccaauaa

SEQ ID NO: 1123982 - RNA, 19 nt, Homo sapiens
ggacauuaauugugaagau

SEQ ID NO: 1123983 - RNA, 19 nt, Homo sapiens
ggaaggccuuaacaaguuu

SEQ ID NO: 1123984 - RNA, 19 nt, Homo sapiens
aaacagaaccuaugcagaa

SEQ ID NO: 1123985 - RNA, 19 nt, Homo sapiens
gaaagguucuugggaggaa

SEQ ID NO: 1123986 - RNA, 19 nt, Homo sapiens
gcucaugggccucuucuuu

SEQ ID NO: 1123987 - RNA, 19 nt, Homo sapiens
guaaaccuguacuaaucua

SEQ ID NO: 1123988 - RNA, 19 nt, Homo sapiens
uggaaggccuuaacaaguu

SEQ ID NO: 1123989 - RNA, 19 nt, Homo sapiens
ucaacuggcucuccaacuu

SEQ ID NO: 1123990 - RNA, 19 nt, Homo sapiens
caucuugacuggugaguuc

SEQ ID NO: 1123991 - RNA, 19 nt, Homo sapiens
ggcaggagccuuugaaaug

SEQ ID NO: 1123992 - RNA, 19 nt, Homo sapiens
aaacaggauugucuacaug

SEQ ID NO: 1123993 - RNA, 19 nt, Homo sapiens
ggacaccuacuguuuccua

SEQ ID NO: 1123994 - RNA, 19 nt, Homo sapiens
aagcagacguuucccaaga

SEQ ID NO: 1123995 - RNA, 19 nt, Homo sapiens
ugaaagccuuccaaacguu

SEQ ID NO: 1123996 - RNA, 19 nt, Homo sapiens
ugucacugaugguaagaua

SEQ ID NO: 1123997 - RNA, 19 nt, Homo sapiens
uaucacaggugcuaucuac

SEQ ID NO: 1123998 - RNA, 19 nt, Homo sapiens
caacuggcucuccaacuuu

SEQ ID NO: 1123999 - RNA, 19 nt, Homo sapiens
gaauugaagcuaugcaagu

SEQ ID NO: 1124000 - RNA, 19 nt, Homo sapiens
ggugcuaucuaccuguauu

SEQ ID NO: 1124001 - RNA, 19 nt, Homo sapiens
uugggaagcuuaaaugaau

SEQ ID NO: 1124002 - RNA, 19 nt, Homo sapiens
ucacugaugguaagauaaa

SEQ ID NO: 1124003 - RNA, 19 nt, Homo sapiens
gacuuuggcugccgucuuc

SEQ ID NO: 1124004 - RNA, 19 nt, Homo sapiens
ucaaugcaauuugguucua

SEQ ID NO: 1124005 - RNA, 19 nt, Homo sapiens
gcaggagccuuugaaaugc

SEQ ID NO: 1124006 - RNA, 19 nt, Homo sapiens
gacauuaauugugaagaug

SEQ ID NO: 1124007 - RNA, 19 nt, Homo sapiens
cuacauggaugaucucacu

SEQ ID NO: 1124008 - RNA, 19 nt, Homo sapiens
caaagcauacccaccagaa

SEQ ID NO: 1124009 - RNA, 19 nt, Homo sapiens
cagaaccuaugcagaaauc

SEQ ID NO: 1124010 - RNA, 19 nt, Homo sapiens
gggcuccucuucccauuca

SEQ ID NO: 1124011 - RNA, 19 nt, Homo sapiens
gaugguaagauaaauggaa

SEQ ID NO: 1124012 - RNA, 19 nt, Homo sapiens
gugaaagccuuccaaacgu

SEQ ID NO: 1124013 - RNA, 19 nt, Homo sapiens
gagaguaccuggccauacc

SEQ ID NO: 1124014 - RNA, 19 nt, Homo sapiens
ggugaguucuuccagcaau

SEQ ID NO: 1124015 - RNA, 19 nt, Homo sapiens
ccuagucuuugcuacaauu

SEQ ID NO: 1124016 - RNA, 19 nt, Homo sapiens
uggcaaagaucccauacgu

SEQ ID NO: 1124017 - RNA, 19 nt, Homo sapiens
acucugcucuggucuguga

SEQ ID NO: 1124018 - RNA, 19 nt, Homo sapiens
ccaaggaacugggccuagu

SEQ ID NO: 1124019 - RNA, 19 nt, Homo sapiens
auaauggguuugcaauuuc

SEQ ID NO: 1124020 - RNA, 19 nt, Homo sapiens
agaaaagucuggacaccua

SEQ ID NO: 1124021 - RNA, 19 nt, Homo sapiens
gcuaccugcucuuggagaa

SEQ ID NO: 1124022 - RNA, 19 nt, Homo sapiens
caauaauggguuugcaauu

SEQ ID NO: 1124023 - RNA, 19 nt, Homo sapiens
caaacguucuuggguaaag

SEQ ID NO: 1124024 - RNA, 19 nt, Homo sapiens
ugacugccaucuuuaucug

SEQ ID NO: 1124025 - RNA, 19 nt, Homo sapiens
ugagacccauggcaaggaa

SEQ ID NO: 1124026 - RNA, 19 nt, Homo sapiens
ggaucccucuggcaaagau

SEQ ID NO: 1124027 - RNA, 19 nt, Homo sapiens
caaugcaauuugguucuau

SEQ ID NO: 1124028 - RNA, 19 nt, Homo sapiens
ccaauaauggguuugcaau

SEQ ID NO: 1124029 - RNA, 19 nt, Homo sapiens
uaaauggaaggccuuaaca

SEQ ID NO: 1124030 - RNA, 19 nt, Homo sapiens
aagcauacccaccagaaga

SEQ ID NO: 1124031 - RNA, 19 nt, Homo sapiens
agacguuucccaagaggua

SEQ ID NO: 1124032 - RNA, 19 nt, Homo sapiens
caauagacccagacacucu

SEQ ID NO: 1124033 - RNA, 19 nt, Homo sapiens
gggaagcuuaaaugaauug

SEQ ID NO: 1124034 - RNA, 19 nt, Homo sapiens
ccagguggaaggagaagaa

SEQ ID NO: 1124035 - RNA, 19 nt, Homo sapiens
aacagaaccuaugcagaaa

SEQ ID NO: 1124036 - RNA, 19 nt, Homo sapiens
ugcccgagcugcugggaaa

SEQ ID NO: 1124037 - RNA, 19 nt, Homo sapiens
ccaaaaggaacaaagcaua

SEQ ID NO: 1124038 - RNA, 19 nt, Homo sapiens
ccggcugccuucaucauug

SEQ ID NO: 1124039 - RNA, 19 nt, Homo sapiens
ucucugguuuggucauuga

SEQ ID NO: 1124040 - RNA, 19 nt, Homo sapiens
gcuggccaauaauggguuu

SEQ ID NO: 1124041 - RNA, 19 nt, Homo sapiens
ccacguuggacaauuaugu

SEQ ID NO: 1124042 - RNA, 19 nt, Homo sapiens
ggcaucccguucaucuuga

SEQ ID NO: 1124043 - RNA, 19 nt, Homo sapiens
guaccuggccauaccuguu

SEQ ID NO: 1124044 - RNA, 19 nt, Homo sapiens
uugugaagaugauuggaaa

SEQ ID NO: 1124045 - RNA, 19 nt, Homo sapiens
gcugccgucuucucugguu

SEQ ID NO: 1124046 - RNA, 19 nt, Homo sapiens
ccauacgucaccuugagua

SEQ ID NO: 1124047 - RNA, 19 nt, Homo sapiens
ccauaccuguuuggaguga

SEQ ID NO: 1124048 - RNA, 19 nt, Homo sapiens
ucaaggccuuuuacaauga

SEQ ID NO: 1124049 - RNA, 19 nt, Homo sapiens
uaucugcauuggcguguuc

SEQ ID NO: 1124050 - RNA, 19 nt, Homo sapiens
gaaccuaugcagaaaucag

SEQ ID NO: 1124051 - RNA, 19 nt, Homo sapiens
caccuacuguuuccuaguc

SEQ ID NO: 1124052 - RNA, 19 nt, Homo sapiens
ucaugggccucuucuuugg

SEQ ID NO: 1124053 - RNA, 19 nt, Homo sapiens
gcaaggaaacaaaauagga

SEQ ID NO: 1124054 - RNA, 19 nt, Homo sapiens
gcugugaaagccuuccaaa

SEQ ID NO: 1124055 - RNA, 19 nt, Homo sapiens
caggugacugccaucuuua

SEQ ID NO: 1124056 - RNA, 19 nt, Homo sapiens
cgccaucgguggacuugug

SEQ ID NO: 1124057 - RNA, 19 nt, Homo sapiens
ccagcucuguggccucaau

SEQ ID NO: 1124058 - RNA, 19 nt, Homo sapiens
ugaagaugauuggaaaggu

SEQ ID NO: 1124059 - RNA, 19 nt, Homo sapiens
ugggaagcuuaaaugaauu

SEQ ID NO: 1124060 - RNA, 19 nt, Homo sapiens
gauaaauggaaggccuuaa

SEQ ID NO: 1124061 - RNA, 19 nt, Homo sapiens
caucaaggccuuuuacaau

SEQ ID NO: 1124062 - RNA, 19 nt, Homo sapiens
uggcaucccguucaucuug

SEQ ID NO: 1124063 - RNA, 19 nt, Homo sapiens
ggacuuguggggacauuaa

SEQ ID NO: 1124064 - RNA, 19 nt, Homo sapiens
caacagcaucuuuggaaaa

SEQ ID NO: 1124065 - RNA, 19 nt, Homo sapiens
cacgcuaccugcucuugga

SEQ ID NO: 1124066 - RNA, 19 nt, Homo sapiens
ugacucugcucuggucugu

SEQ ID NO: 1124067 - RNA, 19 nt, Homo sapiens
uggaugaucucacuuuuca

SEQ ID NO: 1124068 - RNA, 19 nt, Homo sapiens
acauggaugaucucacuuu

SEQ ID NO: 1124069 - RNA, 19 nt, Homo sapiens
gaagcacaacgaggcaaga

SEQ ID NO: 1124070 - RNA, 19 nt, Homo sapiens
ucagugugcuccccaugua

SEQ ID NO: 1124071 - RNA, 19 nt, Homo sapiens
uaauggguuugcaauuucu

SEQ ID NO: 1124072 - RNA, 19 nt, Homo sapiens
guggggacauuaauuguga

SEQ ID NO: 1124073 - RNA, 19 nt, Homo sapiens
cugcugagccuucccuuuc

SEQ ID NO: 1124074 - RNA, 19 nt, Homo sapiens
auaccuguuuggagugauu

SEQ ID NO: 1124075 - RNA, 19 nt, Homo sapiens
uaccuggccauaccuguuu

SEQ ID NO: 1124076 - RNA, 19 nt, Homo sapiens
cuacuguuuccuagucuuu

SEQ ID NO: 1124077 - RNA, 19 nt, Homo sapiens
ucuguggccucaaugcaau

SEQ ID NO: 1124078 - RNA, 19 nt, Homo sapiens
cgaggcaagagcugugaaa

SEQ ID NO: 1124079 - RNA, 19 nt, Homo sapiens
cagcugucacugaugguaa

SEQ ID NO: 1124080 - RNA, 19 nt, Homo sapiens
ggagaagaguguaagauuu

SEQ ID NO: 1124081 - RNA, 19 nt, Homo sapiens
gagcugagaugacuucaaa

SEQ ID NO: 1124082 - RNA, 19 nt, Homo sapiens
caacaggacuuaacaucaa

SEQ ID NO: 1124083 - RNA, 19 nt, Homo sapiens
cagcugcucuuacccauuu

SEQ ID NO: 1124084 - RNA, 19 nt, Homo sapiens
cagcguaacuucauucuuc

SEQ ID NO: 1124085 - RNA, 19 nt, Homo sapiens
uaacuucauucuucaggua

SEQ ID NO: 1124086 - RNA, 19 nt, Homo sapiens
gauugaagcuauuacugaa

SEQ ID NO: 1124087 - RNA, 19 nt, Homo sapiens
ccacauaugcguugauuga

SEQ ID NO: 1124088 - RNA, 19 nt, Homo sapiens
gauagcaccucuaccuuuc

SEQ ID NO: 1124089 - RNA, 19 nt, Homo sapiens
uagaagagcuccgucagaa

SEQ ID NO: 1124090 - RNA, 19 nt, Homo sapiens
gcagaucaggccucuauaa

SEQ ID NO: 1124091 - RNA, 19 nt, Homo sapiens
gcaacuguuuaaccuguuu

SEQ ID NO: 1124092 - RNA, 19 nt, Homo sapiens
gagccucauucccuuagua

SEQ ID NO: 1124093 - RNA, 19 nt, Homo sapiens
gauaagaccauggcacaaa

SEQ ID NO: 1124094 - RNA, 19 nt, Homo sapiens
ccgacaauauacaaguuua

SEQ ID NO: 1124095 - RNA, 19 nt, Homo sapiens
gaccacauaugcguugauu

SEQ ID NO: 1124096 - RNA, 19 nt, Homo sapiens
gcgcagaucaggccucuau

SEQ ID NO: 1124097 - RNA, 19 nt, Homo sapiens
ggagagcagugucuuuggu

SEQ ID NO: 1124098 - RNA, 19 nt, Homo sapiens
guacagacaguguuugugu

SEQ ID NO: 1124099 - RNA, 19 nt, Homo sapiens
gcgcuggaccugguucuua

SEQ ID NO: 1124100 - RNA, 19 nt, Homo sapiens
gaagagcuccgucagaaaa

SEQ ID NO: 1124101 - RNA, 19 nt, Homo sapiens
uaccuuaacuucucuuuac

SEQ ID NO: 1124102 - RNA, 19 nt, Homo sapiens
acgauuggcuuuggaguaa

SEQ ID NO: 1124103 - RNA, 19 nt, Homo sapiens
gaagcugcauaucaaacug

SEQ ID NO: 1124104 - RNA, 19 nt, Homo sapiens
ggaaaccacuuggaugacu

SEQ ID NO: 1124105 - RNA, 19 nt, Homo sapiens
gaggagagcagugucuuug

SEQ ID NO: 1124106 - RNA, 19 nt, Homo sapiens
gcaguuggucuuucagaga

SEQ ID NO: 1124107 - RNA, 19 nt, Homo sapiens
gcacaauggcggcucugaa

SEQ ID NO: 1124108 - RNA, 19 nt, Homo sapiens
gagagcagugucuuuggua

SEQ ID NO: 1124109 - RNA, 19 nt, Homo sapiens
uuucugauguguucucuga

SEQ ID NO: 1124110 - RNA, 19 nt, Homo sapiens
gggaaccuguccaguuugu

SEQ ID NO: 1124111 - RNA, 19 nt, Homo sapiens
gagaagaguguaagauuuu

SEQ ID NO: 1124112 - RNA, 19 nt, Homo sapiens
ccaaaggagaagaguguaa

SEQ ID NO: 1124113 - RNA, 19 nt, Homo sapiens
ggacagcugaggccaagga

SEQ ID NO: 1124114 - RNA, 19 nt, Homo sapiens
guuugcaucugaaagagaa

SEQ ID NO: 1124115 - RNA, 19 nt, Homo sapiens
agacaguguuuguguguuc

SEQ ID NO: 1124116 - RNA, 19 nt, Homo sapiens
gggcacugcacccuguuua

SEQ ID NO: 1124117 - RNA, 19 nt, Homo sapiens
gaaccuguccaguuuguac

SEQ ID NO: 1124118 - RNA, 19 nt, Homo sapiens
uaaccuguuuucagucuua

SEQ ID NO: 1124119 - RNA, 19 nt, Homo sapiens
ccucacacccaaagcauuu

SEQ ID NO: 1124120 - RNA, 19 nt, Homo sapiens
cagaagcacagauagaaga

SEQ ID NO: 1124121 - RNA, 19 nt, Homo sapiens
guuuauaccuuaacuucuc

SEQ ID NO: 1124122 - RNA, 19 nt, Homo sapiens
uaacagauagcaccucuac

SEQ ID NO: 1124123 - RNA, 19 nt, Homo sapiens
gcuggcagaagcacagaua

SEQ ID NO: 1124124 - RNA, 19 nt, Homo sapiens
gaauauacuaaggcuguuu

SEQ ID NO: 1124125 - RNA, 19 nt, Homo sapiens
gacgauuggcuuuggagua

SEQ ID NO: 1124126 - RNA, 19 nt, Homo sapiens
gagaaggggugcagagugu

SEQ ID NO: 1124127 - RNA, 19 nt, Homo sapiens
guacuuguucccucuguug

SEQ ID NO: 1124128 - RNA, 19 nt, Homo sapiens
ugauugaagcuauuacuga

SEQ ID NO: 1124129 - RNA, 19 nt, Homo sapiens
uaacaucaacaggacuuaa

SEQ ID NO: 1124130 - RNA, 19 nt, Homo sapiens
ggcagaagcacagauagaa

SEQ ID NO: 1124131 - RNA, 19 nt, Homo sapiens
auacuaaggcuguuuauac

SEQ ID NO: 1124132 - RNA, 19 nt, Homo sapiens
caccagcucucccggaaag

SEQ ID NO: 1124133 - RNA, 19 nt, Homo sapiens
ucucuuuaccgacaauaua

SEQ ID NO: 1124134 - RNA, 19 nt, Homo sapiens
agagcagugucuuugguaa

SEQ ID NO: 1124135 - RNA, 19 nt, Homo sapiens
guauguauuucugaugugu

SEQ ID NO: 1124136 - RNA, 19 nt, Homo sapiens
agauagcaccucuaccuuu

SEQ ID NO: 1124137 - RNA, 19 nt, Homo sapiens
gaaaucagagccucauucc

SEQ ID NO: 1124138 - RNA, 19 nt, Homo sapiens
ucaacaggacuuaacauca

SEQ ID NO: 1124139 - RNA, 19 nt, Homo sapiens
uaccgacaauauacaaguu

SEQ ID NO: 1124140 - RNA, 19 nt, Homo sapiens
guacgauuucuuuguaugu

SEQ ID NO: 1124141 - RNA, 19 nt, Homo sapiens
gcagaagcacagauagaag

SEQ ID NO: 1124142 - RNA, 19 nt, Homo sapiens
caguuggucuuucagagau

SEQ ID NO: 1124143 - RNA, 19 nt, Homo sapiens
caguuuguacgauuucuuu

SEQ ID NO: 1124144 - RNA, 19 nt, Homo sapiens
uguccaguuuguacgauuu

SEQ ID NO: 1124145 - RNA, 19 nt, Homo sapiens
gacugcaguuggucuuuca

SEQ ID NO: 1124146 - RNA, 19 nt, Homo sapiens
ucagguacagacaguguuu

SEQ ID NO: 1124147 - RNA, 19 nt, Homo sapiens
aggagaagaguguaagauu

SEQ ID NO: 1124148 - RNA, 19 nt, Homo sapiens
cuuguuccuuccuuucuuu

SEQ ID NO: 1124149 - RNA, 19 nt, Homo sapiens
acauaugcguugauugaag

SEQ ID NO: 1124150 - RNA, 19 nt, Homo sapiens
ucagagccucauucccuua

SEQ ID NO: 1124151 - RNA, 19 nt, Homo sapiens
gcacugcacccuguuuaac

SEQ ID NO: 1124152 - RNA, 19 nt, Homo sapiens
ugaaacugcagguggaaga

SEQ ID NO: 1124153 - RNA, 19 nt, Homo sapiens
ugacugcaguuggucuuuc

SEQ ID NO: 1124154 - RNA, 19 nt, Homo sapiens
cuggaaaccacuuggauga

SEQ ID NO: 1124155 - RNA, 19 nt, Homo sapiens
gaauucagaggaggaagau

SEQ ID NO: 1124156 - RNA, 19 nt, Homo sapiens
ccucuaccuuucucucuca

SEQ ID NO: 1124157 - RNA, 19 nt, Homo sapiens
caaaggagaagaguguaag

SEQ ID NO: 1124158 - RNA, 19 nt, Homo sapiens
ucugauguguucucugauc

SEQ ID NO: 1124159 - RNA, 19 nt, Homo sapiens
acacaggccucuuguuccu

SEQ ID NO: 1124160 - RNA, 19 nt, Homo sapiens
ugucaugcccuuaaguuca

SEQ ID NO: 1124161 - RNA, 19 nt, Homo sapiens
ugaauauacuaaggcuguu

SEQ ID NO: 1124162 - RNA, 19 nt, Homo sapiens
ccuuaguagugaagcauug

SEQ ID NO: 1124163 - RNA, 19 nt, Homo sapiens
ccucauucccuuaguagug

SEQ ID NO: 1124164 - RNA, 19 nt, Homo sapiens
agaaaucagagccucauuc

SEQ ID NO: 1124165 - RNA, 19 nt, Homo sapiens
cuaccugcgugaggauuga

SEQ ID NO: 1124166 - RNA, 19 nt, Homo sapiens
gcaccagcucucccggaaa

SEQ ID NO: 1124167 - RNA, 19 nt, Homo sapiens
ccagagcugagaugacuuc

SEQ ID NO: 1124168 - RNA, 19 nt, Homo sapiens
ugaauucagaggaggaaga

SEQ ID NO: 1124169 - RNA, 19 nt, Homo sapiens
ugaggagagcagugucuuu

SEQ ID NO: 1124170 - RNA, 19 nt, Homo sapiens
cucauucccuuaguaguga

SEQ ID NO: 1124171 - RNA, 19 nt, Homo sapiens
uguacgauuucuuuguaug

SEQ ID NO: 1124172 - RNA, 19 nt, Homo sapiens
ggcacugcacccuguuuaa

SEQ ID NO: 1124173 - RNA, 19 nt, Homo sapiens
ugagcacacugcccugucu

SEQ ID NO: 1124174 - RNA, 19 nt, Homo sapiens
auucagaggaggaagauga

SEQ ID NO: 1124175 - RNA, 19 nt, Homo sapiens
uauuguauccaaaggagaa

SEQ ID NO: 1124176 - RNA, 19 nt, Homo sapiens
gcccaggguuggcaugacu

SEQ ID NO: 1124177 - RNA, 19 nt, Homo sapiens
gaaaccaagcuggcagaag

SEQ ID NO: 1124178 - RNA, 19 nt, Homo sapiens
ggagccagagcugagauga

SEQ ID NO: 1124179 - RNA, 19 nt, Homo sapiens
ccuguuguggcuaacuuua

SEQ ID NO: 1124180 - RNA, 19 nt, Homo sapiens
ggagaagaguguaagauuu

SEQ ID NO: 1124181 - RNA, 19 nt, Homo sapiens
gagcugagaugacuucaaa

SEQ ID NO: 1124182 - RNA, 19 nt, Homo sapiens
caacaggacuuaacaucaa

SEQ ID NO: 1124183 - RNA, 19 nt, Homo sapiens
cagcugcucuuacccauuu

SEQ ID NO: 1124184 - RNA, 19 nt, Homo sapiens
cagcguaacuucauucuuc

SEQ ID NO: 1124185 - RNA, 19 nt, Homo sapiens
uaacuucauucuucaggua

SEQ ID NO: 1124186 - RNA, 19 nt, Homo sapiens
uagaagagcuccgucagaa

SEQ ID NO: 1124187 - RNA, 19 nt, Homo sapiens
gcagaucaggccucuauaa

SEQ ID NO: 1124188 - RNA, 19 nt, Homo sapiens
gcaacuguuuaaccuguuu

SEQ ID NO: 1124189 - RNA, 19 nt, Homo sapiens
gauaagaccauggcacaaa

SEQ ID NO: 1124190 - RNA, 19 nt, Homo sapiens
ccgacaauauacaaguuua

SEQ ID NO: 1124191 - RNA, 19 nt, Homo sapiens
gcgcagaucaggccucuau

SEQ ID NO: 1124192 - RNA, 19 nt, Homo sapiens
guacagacaguguuugugu

SEQ ID NO: 1124193 - RNA, 19 nt, Homo sapiens
gcgcuggaccugguucuua

SEQ ID NO: 1124194 - RNA, 19 nt, Homo sapiens
gaagagcuccgucagaaaa

SEQ ID NO: 1124195 - RNA, 19 nt, Homo sapiens
uaccuuaacuucucuuuac

SEQ ID NO: 1124196 - RNA, 19 nt, Homo sapiens
acgauuggcuuuggaguaa

SEQ ID NO: 1124197 - RNA, 19 nt, Homo sapiens
gaagcugcauaucaaacug

SEQ ID NO: 1124198 - RNA, 19 nt, Homo sapiens
ggaaaccacuuggaugacu

SEQ ID NO: 1124199 - RNA, 19 nt, Homo sapiens
gcaguuggucuuucagaga

SEQ ID NO: 1124200 - RNA, 19 nt, Homo sapiens
gcacaauggcggcucugaa

SEQ ID NO: 1124201 - RNA, 19 nt, Homo sapiens
uuucugauguguucucuga

SEQ ID NO: 1124202 - RNA, 19 nt, Homo sapiens
gggaaccuguccaguuugu

SEQ ID NO: 1124203 - RNA, 19 nt, Homo sapiens
gagaagaguguaagauuuu

SEQ ID NO: 1124204 - RNA, 19 nt, Homo sapiens
ccaaaggagaagaguguaa

SEQ ID NO: 1124205 - RNA, 19 nt, Homo sapiens
ggacagcugaggccaagga

SEQ ID NO: 1124206 - RNA, 19 nt, Homo sapiens
guuugcaucugaaagagaa

SEQ ID NO: 1124207 - RNA, 19 nt, Homo sapiens
gggcacugcacccuguuua

SEQ ID NO: 1124208 - RNA, 19 nt, Homo sapiens
agacaguguuuguguguuc

SEQ ID NO: 1124209 - RNA, 19 nt, Homo sapiens
gaaccuguccaguuuguac

SEQ ID NO: 1124210 - RNA, 19 nt, Homo sapiens
uaaccuguuuucagucuua

SEQ ID NO: 1124211 - RNA, 19 nt, Homo sapiens
ccucacacccaaagcauuu

SEQ ID NO: 1124212 - RNA, 19 nt, Homo sapiens
cagaagcacagauagaaga

SEQ ID NO: 1124213 - RNA, 19 nt, Homo sapiens
guuuauaccuuaacuucuc

SEQ ID NO: 1124214 - RNA, 19 nt, Homo sapiens
gcuggcagaagcacagaua

SEQ ID NO: 1124215 - RNA, 19 nt, Homo sapiens
gacgauuggcuuuggagua

SEQ ID NO: 1124216 - RNA, 19 nt, Homo sapiens
gagaaggggugcagagugu

SEQ ID NO: 1124217 - RNA, 19 nt, Homo sapiens
guacuuguucccucuguug

SEQ ID NO: 1124218 - RNA, 19 nt, Homo sapiens
uaacaucaacaggacuuaa

SEQ ID NO: 1124219 - RNA, 19 nt, Homo sapiens
ggcagaagcacagauagaa

SEQ ID NO: 1124220 - RNA, 19 nt, Homo sapiens
caccagcucucccggaaag

SEQ ID NO: 1124221 - RNA, 19 nt, Homo sapiens
ucucuuuaccgacaauaua

SEQ ID NO: 1124222 - RNA, 19 nt, Homo sapiens
guauguauuucugaugugu

SEQ ID NO: 1124223 - RNA, 19 nt, Homo sapiens
ucaacaggacuuaacauca

SEQ ID NO: 1124224 - RNA, 19 nt, Homo sapiens
uaccgacaauauacaaguu

SEQ ID NO: 1124225 - RNA, 19 nt, Homo sapiens
guacgauuucuuuguaugu

SEQ ID NO: 1124226 - RNA, 19 nt, Homo sapiens
gcagaagcacagauagaag

SEQ ID NO: 1124227 - RNA, 19 nt, Homo sapiens
caguuggucuuucagagau

SEQ ID NO: 1124228 - RNA, 19 nt, Homo sapiens
caguuuguacgauuucuuu

SEQ ID NO: 1124229 - RNA, 19 nt, Homo sapiens
uguccaguuuguacgauuu

SEQ ID NO: 1124230 - RNA, 19 nt, Homo sapiens
gacugcaguuggucuuuca

SEQ ID NO: 1124231 - RNA, 19 nt, Homo sapiens
ucagguacagacaguguuu

SEQ ID NO: 1124232 - RNA, 19 nt, Homo sapiens
aggagaagaguguaagauu

SEQ ID NO: 1124233 - RNA, 19 nt, Homo sapiens
cuuguuccuuccuuucuuu

SEQ ID NO: 1124234 - RNA, 19 nt, Homo sapiens
gcacugcacccuguuuaac

SEQ ID NO: 1124235 - RNA, 19 nt, Homo sapiens
ugaaacugcagguggaaga

SEQ ID NO: 1124236 - RNA, 19 nt, Homo sapiens
ugacugcaguuggucuuuc

SEQ ID NO: 1124237 - RNA, 19 nt, Homo sapiens
cuggaaaccacuuggauga

SEQ ID NO: 1124238 - RNA, 19 nt, Homo sapiens
gaauucagaggaggaagau

SEQ ID NO: 1124239 - RNA, 19 nt, Homo sapiens
caaaggagaagaguguaag

SEQ ID NO: 1124240 - RNA, 19 nt, Homo sapiens
ucugauguguucucugauc

SEQ ID NO: 1124241 - RNA, 19 nt, Homo sapiens
acacaggccucuuguuccu

SEQ ID NO: 1124242 - RNA, 19 nt, Homo sapiens
ugucaugcccuuaaguuca

SEQ ID NO: 1124243 - RNA, 19 nt, Homo sapiens
cuaccugcgugaggauuga

SEQ ID NO: 1124244 - RNA, 19 nt, Homo sapiens
gcaccagcucucccggaaa

SEQ ID NO: 1124245 - RNA, 19 nt, Homo sapiens
ccagagcugagaugacuuc

SEQ ID NO: 1124246 - RNA, 19 nt, Homo sapiens
ugaauucagaggaggaaga

SEQ ID NO: 1124247 - RNA, 19 nt, Homo sapiens
uguacgauuucuuuguaug

SEQ ID NO: 1124248 - RNA, 19 nt, Homo sapiens
ggcacugcacccuguuuaa

SEQ ID NO: 1124249 - RNA, 19 nt, Homo sapiens
ugagcacacugcccugucu

SEQ ID NO: 1124250 - RNA, 19 nt, Homo sapiens
auucagaggaggaagauga

SEQ ID NO: 1124251 - RNA, 19 nt, Homo sapiens
uauuguauccaaaggagaa

SEQ ID NO: 1124252 - RNA, 19 nt, Homo sapiens
gcccaggguuggcaugacu

SEQ ID NO: 1124253 - RNA, 19 nt, Homo sapiens
gaaaccaagcuggcagaag

SEQ ID NO: 1124254 - RNA, 19 nt, Homo sapiens
ggagccagagcugagauga

SEQ ID NO: 1124255 - RNA, 19 nt, Homo sapiens
ccuguuguggcuaacuuua

SEQ ID NO: 1124256 - RNA, 19 nt, Homo sapiens
ucuuuccguuucucuauug

SEQ ID NO: 1124257 - RNA, 19 nt, Homo sapiens
gaaggggugcagaguguuu

SEQ ID NO: 1124258 - RNA, 19 nt, Homo sapiens
guguuccuguuguggcuaa

SEQ ID NO: 1124259 - RNA, 19 nt, Homo sapiens
agaagagcuccgucagaaa

SEQ ID NO: 1124260 - RNA, 19 nt, Homo sapiens
ggaaagcagaaaccaagcu

SEQ ID NO: 1124261 - RNA, 19 nt, Homo sapiens
caggcuguuuauaccuuaa

SEQ ID NO: 1124262 - RNA, 19 nt, Homo sapiens
uuccguuucucuauuguau

SEQ ID NO: 1124263 - RNA, 19 nt, Homo sapiens
cacaauggcggcucugaag

SEQ ID NO: 1124264 - RNA, 19 nt, Homo sapiens
ccuauuacuacuaagagaa

SEQ ID NO: 1124265 - RNA, 19 nt, Homo sapiens
gaaguguggcaggugauca

SEQ ID NO: 1124266 - RNA, 19 nt, Homo sapiens
gcgcagcguaacuucauuc

SEQ ID NO: 1124267 - RNA, 19 nt, Homo sapiens
guguuuguguguuccuguu

SEQ ID NO: 1124268 - RNA, 19 nt, Homo sapiens
uggcagaagcacagauaga

SEQ ID NO: 1124269 - RNA, 19 nt, Homo sapiens
caaaacaccaagaguacuu

SEQ ID NO: 1124270 - RNA, 19 nt, Homo sapiens
ggagaagaguguaagauuu

SEQ ID NO: 1124271 - RNA, 19 nt, Homo sapiens
gagcugagaugacuucaaa

SEQ ID NO: 1124272 - RNA, 19 nt, Homo sapiens
caacaggacuuaacaucaa

SEQ ID NO: 1124273 - RNA, 19 nt, Homo sapiens
gcgcagggcucucuaccua

SEQ ID NO: 1124274 - RNA, 19 nt, Homo sapiens
cagcugcucuuacccauuu

SEQ ID NO: 1124275 - RNA, 19 nt, Homo sapiens
gauugaagcuauuacugaa

SEQ ID NO: 1124276 - RNA, 19 nt, Homo sapiens
ccacauaugcguugauuga

SEQ ID NO: 1124277 - RNA, 19 nt, Homo sapiens
gauagcaccucuaccuuuc

SEQ ID NO: 1124278 - RNA, 19 nt, Homo sapiens
uagaagagcuccgucagaa

SEQ ID NO: 1124279 - RNA, 19 nt, Homo sapiens
gcagaucaggccucuauaa

SEQ ID NO: 1124280 - RNA, 19 nt, Homo sapiens
gauuggcggucgugccuua

SEQ ID NO: 1124281 - RNA, 19 nt, Homo sapiens
ggucgugccuuaugaaauc

SEQ ID NO: 1124282 - RNA, 19 nt, Homo sapiens
gcaacuguuuaaccuguuu

SEQ ID NO: 1124283 - RNA, 19 nt, Homo sapiens
gagccucauucccuuagua

SEQ ID NO: 1124284 - RNA, 19 nt, Homo sapiens
uaugaaaucugacuucuac

SEQ ID NO: 1124285 - RNA, 19 nt, Homo sapiens
ucaggcagauuucgaauuc

SEQ ID NO: 1124286 - RNA, 19 nt, Homo sapiens
ccgacaauauacaaguuua

SEQ ID NO: 1124287 - RNA, 19 nt, Homo sapiens
gaccacauaugcguugauu

SEQ ID NO: 1124288 - RNA, 19 nt, Homo sapiens
uaaacuugguguauguuga

SEQ ID NO: 1124289 - RNA, 19 nt, Homo sapiens
gaaaucugacuucuacuuc

SEQ ID NO: 1124290 - RNA, 19 nt, Homo sapiens
guucguccaucuucuagaa

SEQ ID NO: 1124291 - RNA, 19 nt, Homo sapiens
gcgcagaucaggccucuau

SEQ ID NO: 1124292 - RNA, 19 nt, Homo sapiens
ggagagcagugucuuuggu

SEQ ID NO: 1124293 - RNA, 19 nt, Homo sapiens
cugcuuggcucgaguuuga

SEQ ID NO: 1124294 - RNA, 19 nt, Homo sapiens
gcgcuggaccugguucuua

SEQ ID NO: 1124295 - RNA, 19 nt, Homo sapiens
gaagagcuccgucagaaaa

SEQ ID NO: 1124296 - RNA, 19 nt, Homo sapiens
uaccuuaacuucucuuuac

SEQ ID NO: 1124297 - RNA, 19 nt, Homo sapiens
gaagcugcauaucaaacug

SEQ ID NO: 1124298 - RNA, 19 nt, Homo sapiens
ggaaaccacuuggaugacu

SEQ ID NO: 1124299 - RNA, 19 nt, Homo sapiens
uguccugcauccucauuua

SEQ ID NO: 1124300 - RNA, 19 nt, Homo sapiens
ggagugcaguggcgagauc

SEQ ID NO: 1124301 - RNA, 19 nt, Homo sapiens
gaggagagcagugucuuug

SEQ ID NO: 1124302 - RNA, 19 nt, Homo sapiens
gcaguuggucuuucagaga

SEQ ID NO: 1124303 - RNA, 19 nt, Homo sapiens
gagagcagugucuuuggua

SEQ ID NO: 1124304 - RNA, 19 nt, Homo sapiens
uuucugauguguucucuga

SEQ ID NO: 1124305 - RNA, 19 nt, Homo sapiens
gggaaccuguccaguuugu

SEQ ID NO: 1124306 - RNA, 19 nt, Homo sapiens
gagaagaguguaagauuuu

SEQ ID NO: 1124307 - RNA, 19 nt, Homo sapiens
ccaaaggagaagaguguaa

SEQ ID NO: 1124308 - RNA, 19 nt, Homo sapiens
ggacagcugaggccaagga

SEQ ID NO: 1124309 - RNA, 19 nt, Homo sapiens
guuugcaucugaaagagaa

SEQ ID NO: 1124310 - RNA, 19 nt, Homo sapiens
gggcacugcacccuguuua

SEQ ID NO: 1124311 - RNA, 19 nt, Homo sapiens
ccgaguagcugggauuaca

SEQ ID NO: 1124312 - RNA, 19 nt, Homo sapiens
gaaccuguccaguuuguac

SEQ ID NO: 1124313 - RNA, 19 nt, Homo sapiens
uaaccuguuuucagucuua

SEQ ID NO: 1124314 - RNA, 19 nt, Homo sapiens
ccucacacccaaagcauuu

SEQ ID NO: 1124315 - RNA, 19 nt, Homo sapiens
cagaagcacagauagaaga

SEQ ID NO: 1124316 - RNA, 19 nt, Homo sapiens
guuuauaccuuaacuucuc

SEQ ID NO: 1124317 - RNA, 19 nt, Homo sapiens
uaacagauagcaccucuac

SEQ ID NO: 1124318 - RNA, 19 nt, Homo sapiens
gcuggcagaagcacagaua

SEQ ID NO: 1124319 - RNA, 19 nt, Homo sapiens
gaauauacuaaggcuguuu

SEQ ID NO: 1124320 - RNA, 19 nt, Homo sapiens
uaaauccaagagccuguua

SEQ ID NO: 1124321 - RNA, 19 nt, Homo sapiens
gagaaggggugcagagugu

SEQ ID NO: 1124322 - RNA, 19 nt, Homo sapiens
guacuuguucccucuguug

SEQ ID NO: 1124323 - RNA, 19 nt, Homo sapiens
ugauugaagcuauuacuga

SEQ ID NO: 1124324 - RNA, 19 nt, Homo sapiens
uaacaucaacaggacuuaa

SEQ ID NO: 1124325 - RNA, 19 nt, Homo sapiens
ggcagaagcacagauagaa

SEQ ID NO: 1124326 - RNA, 19 nt, Homo sapiens
ccgccucggccuuuauuua

SEQ ID NO: 1124327 - RNA, 19 nt, Homo sapiens
auacuaaggcuguuuauac

SEQ ID NO: 1124328 - RNA, 19 nt, Homo sapiens
ugaaaucugacuucuacuu

SEQ ID NO: 1124329 - RNA, 19 nt, Homo sapiens
caccagcucucccggaaag

SEQ ID NO: 1124330 - RNA, 19 nt, Homo sapiens
ucucuuuaccgacaauaua

SEQ ID NO: 1124331 - RNA, 19 nt, Homo sapiens
agagcagugucuuugguaa

SEQ ID NO: 1124332 - RNA, 19 nt, Homo sapiens
gaacuccugggcucaagug

SEQ ID NO: 1124333 - RNA, 19 nt, Homo sapiens
guauguauuucugaugugu

SEQ ID NO: 1124334 - RNA, 19 nt, Homo sapiens
agauagcaccucuaccuuu

SEQ ID NO: 1124335 - RNA, 19 nt, Homo sapiens
gaaaucagagccucauucc

SEQ ID NO: 1124336 - RNA, 19 nt, Homo sapiens
ucaacaggacuuaacauca

SEQ ID NO: 1124337 - RNA, 19 nt, Homo sapiens
uaccgacaauauacaaguu

SEQ ID NO: 1124338 - RNA, 19 nt, Homo sapiens
ccgaguagcugggauugca

SEQ ID NO: 1124339 - RNA, 19 nt, Homo sapiens
aaacuugguguauguugaa

SEQ ID NO: 1124340 - RNA, 19 nt, Homo sapiens
guacgauuucuuuguaugu

SEQ ID NO: 1124341 - RNA, 19 nt, Homo sapiens
gcagaagcacagauagaag

SEQ ID NO: 1124342 - RNA, 19 nt, Homo sapiens
caguuggucuuucagagau

SEQ ID NO: 1124343 - RNA, 19 nt, Homo sapiens
caguuuguacgauuucuuu

SEQ ID NO: 1124344 - RNA, 19 nt, Homo sapiens
uguccaguuuguacgauuu

SEQ ID NO: 1124345 - RNA, 19 nt, Homo sapiens
gacugcaguuggucuuuca

SEQ ID NO: 1124346 - RNA, 19 nt, Homo sapiens
gaggcaacauuuuaaacuu

SEQ ID NO: 1124347 - RNA, 19 nt, Homo sapiens
ccucggccuuuauuuacuu

SEQ ID NO: 1124348 - RNA, 19 nt, Homo sapiens
gcgggaccgucacacacaa

SEQ ID NO: 1124349 - RNA, 19 nt, Homo sapiens
cggccuuuauuuacuuauu

SEQ ID NO: 1124350 - RNA, 19 nt, Homo sapiens
ccaccacuccgggcuaauu

SEQ ID NO: 1124351 - RNA, 19 nt, Homo sapiens
aggagaagaguguaagauu

SEQ ID NO: 1124352 - RNA, 19 nt, Homo sapiens
cuuguuccuuccuuucuuu

SEQ ID NO: 1124353 - RNA, 19 nt, Homo sapiens
acauaugcguugauugaag

SEQ ID NO: 1124354 - RNA, 19 nt, Homo sapiens
ucagagccucauucccuua

SEQ ID NO: 1124355 - RNA, 19 nt, Homo sapiens
gcacugcacccuguuuaac

SEQ ID NO: 1124356 - RNA, 19 nt, Homo sapiens
ucaguucguccaucuucua

SEQ ID NO: 1124357 - RNA, 19 nt, Homo sapiens
ugaaacugcagguggaaga

SEQ ID NO: 1124358 - RNA, 19 nt, Homo sapiens
ugacugcaguuggucuuuc

SEQ ID NO: 1124359 - RNA, 19 nt, Homo sapiens
cuggaaaccacuuggauga

SEQ ID NO: 1124360 - RNA, 19 nt, Homo sapiens
gaauucagaggaggaagau

SEQ ID NO: 1124361 - RNA, 19 nt, Homo sapiens
ccucuaccuuucucucuca

SEQ ID NO: 1124362 - RNA, 19 nt, Homo sapiens
ucgaauuccugaccucaag

SEQ ID NO: 1124363 - RNA, 19 nt, Homo sapiens
caaaggagaagaguguaag

SEQ ID NO: 1124364 - RNA, 19 nt, Homo sapiens
ucugauguguucucugauc

SEQ ID NO: 1124365 - RNA, 19 nt, Homo sapiens
uggcggucgugccuuauga

SEQ ID NO: 1124366 - RNA, 19 nt, Homo sapiens
uggcucgaguuugaguuua

SEQ ID NO: 1124367 - RNA, 19 nt, Homo sapiens
cuuccaagugcuaggauua

SEQ ID NO: 1124368 - RNA, 19 nt, Homo sapiens
acacaggccucuuguuccu

SEQ ID NO: 1124369 - RNA, 19 nt, Homo sapiens
ugucaugcccuuaaguuca

SEQ ID NO: 1124370 - RNA, 19 nt, Homo sapiens
ggauuuagguuccauucua

SEQ ID NO: 1124371 - RNA, 19 nt, Homo sapiens
gcucaugccuguaaucuga

SEQ ID NO: 1124372 - RNA, 19 nt, Homo sapiens
gaaauuggacagcauauga

SEQ ID NO: 1124373 - RNA, 19 nt, Homo sapiens
cagcugaucuuccggauug

SEQ ID NO: 1124374 - RNA, 19 nt, Homo sapiens
gaaauuagcaagggaaaga

SEQ ID NO: 1124375 - RNA, 19 nt, Homo sapiens
ggaaguaugucugaaaugg

SEQ ID NO: 1124376 - RNA, 19 nt, Homo sapiens
cagcauaacuccuaucucu

SEQ ID NO: 1124377 - RNA, 19 nt, Homo sapiens
gauaugaagagccugguua

SEQ ID NO: 1124378 - RNA, 19 nt, Homo sapiens
gaaagaggauagcuugacu

SEQ ID NO: 1124379 - RNA, 19 nt, Homo sapiens
guugagcucugguaacuga

SEQ ID NO: 1124380 - RNA, 19 nt, Homo sapiens
ggacagauguaucauuuug

SEQ ID NO: 1124381 - RNA, 19 nt, Homo sapiens
gccauaauuuagcacuuua

SEQ ID NO: 1124382 - RNA, 19 nt, Homo sapiens
acacccagguaauuuauuu

SEQ ID NO: 1124383 - RNA, 19 nt, Homo sapiens
ggaaagaggaaagaggaua

SEQ ID NO: 1124384 - RNA, 19 nt, Homo sapiens
guaaauaggcccagaaagg

SEQ ID NO: 1124385 - RNA, 19 nt, Homo sapiens
cauaucagauggacagaug

SEQ ID NO: 1124386 - RNA, 19 nt, Homo sapiens
ggccauaauuuagcacuuu

SEQ ID NO: 1124387 - RNA, 19 nt, Homo sapiens
ggaaaucaacgagaacuug

SEQ ID NO: 1124388 - RNA, 19 nt, Homo sapiens
ggacugcaguggcgugauc

SEQ ID NO: 1124389 - RNA, 19 nt, Homo sapiens
ccaaauaggucacauucac

SEQ ID NO: 1124390 - RNA, 19 nt, Homo sapiens
gaagaaaacccaggaaauu

SEQ ID NO: 1124391 - RNA, 19 nt, Homo sapiens
ggaagaugcacgaggauau

SEQ ID NO: 1124392 - RNA, 19 nt, Homo sapiens
agauguaacuuagcacuuu

SEQ ID NO: 1124393 - RNA, 19 nt, Homo sapiens
gguauuacuuggcuuaugg

SEQ ID NO: 1124394 - RNA, 19 nt, Homo sapiens
ccuguaaucugagcacuuu

SEQ ID NO: 1124395 - RNA, 19 nt, Homo sapiens
ggacagcauaugaagauug

SEQ ID NO: 1124396 - RNA, 19 nt, Homo sapiens
gaagauuggacaucacaug

SEQ ID NO: 1124397 - RNA, 19 nt, Homo sapiens
ugaagagccugguuacagu

SEQ ID NO: 1124398 - RNA, 19 nt, Homo sapiens
uaaagaaauuggacagcau

SEQ ID NO: 1124399 - RNA, 19 nt, Homo sapiens
gaaagaggaaagaggauag

SEQ ID NO: 1124400 - RNA, 19 nt, Homo sapiens
ccaaagugcugggauuaca

SEQ ID NO: 1124401 - RNA, 19 nt, Homo sapiens
ucugguaacugaucuuaau

SEQ ID NO: 1124402 - RNA, 19 nt, Homo sapiens
ggccacaccucccucugaa

SEQ ID NO: 1124403 - RNA, 19 nt, Homo sapiens
gugaaugcaugauaugaag

SEQ ID NO: 1124404 - RNA, 19 nt, Homo sapiens
aaagaaauuggacagcaua

SEQ ID NO: 1124405 - RNA, 19 nt, Homo sapiens
gaagaugcacgaggauaug

SEQ ID NO: 1124406 - RNA, 19 nt, Homo sapiens
auggacagauguaucauuu

SEQ ID NO: 1124407 - RNA, 19 nt, Homo sapiens
uaggucacauucacgcaua

SEQ ID NO: 1124408 - RNA, 19 nt, Homo sapiens
gacagcauaugaagauugg

SEQ ID NO: 1124409 - RNA, 19 nt, Homo sapiens
gaagagccugguuacaguu

SEQ ID NO: 1124410 - RNA, 19 nt, Homo sapiens
caguuggccucugugaaua

SEQ ID NO: 1124411 - RNA, 19 nt, Homo sapiens
ccagguauuacuuggcuua

SEQ ID NO: 1124412 - RNA, 19 nt, Homo sapiens
gagcgaggcagcugaucuu

SEQ ID NO: 1124413 - RNA, 19 nt, Homo sapiens
ccaccacgcccagcuaauu

SEQ ID NO: 1124414 - RNA, 19 nt, Homo sapiens
gccacacccagguaauuua

SEQ ID NO: 1124415 - RNA, 19 nt, Homo sapiens
gcucugguaacugaucuua

SEQ ID NO: 1124416 - RNA, 19 nt, Homo sapiens
gucacuccauuuaucuuaa

SEQ ID NO: 1124417 - RNA, 19 nt, Homo sapiens
aaauaggcccagaaaggua

SEQ ID NO: 1124418 - RNA, 19 nt, Homo sapiens
uaaauaggcccagaaaggu

SEQ ID NO: 1124419 - RNA, 19 nt, Homo sapiens
gauggacagauguaucauu

SEQ ID NO: 1124420 - RNA, 19 nt, Homo sapiens
cagauggacagauguauca

SEQ ID NO: 1124421 - RNA, 19 nt, Homo sapiens
uaucucugccuuugucuuu

SEQ ID NO: 1124422 - RNA, 19 nt, Homo sapiens
ggagaauccuugcuuuccu

SEQ ID NO: 1124423 - RNA, 19 nt, Homo sapiens
uaucagauggacagaugua

SEQ ID NO: 1124424 - RNA, 19 nt, Homo sapiens
gcaagggaaagaggaaaga

SEQ ID NO: 1124425 - RNA, 19 nt, Homo sapiens
uaagggaaguaugucugaa

SEQ ID NO: 1124426 - RNA, 19 nt, Homo sapiens
ggaccucacggagaugaaa

SEQ ID NO: 1124427 - RNA, 19 nt, Homo sapiens
acuguucucugcaaguaaa

SEQ ID NO: 1124428 - RNA, 19 nt, Homo sapiens
cggcauggcccguggaaau

SEQ ID NO: 1124429 - RNA, 19 nt, Homo sapiens
ccagagaaccguugcuuuu

SEQ ID NO: 1124430 - RNA, 19 nt, Homo sapiens
aauccuugcuuuccucuuc

SEQ ID NO: 1124431 - RNA, 19 nt, Homo sapiens
caaguaaauaggcccagaa

SEQ ID NO: 1124432 - RNA, 19 nt, Homo sapiens
cuccugaccucgugauuca

SEQ ID NO: 1124433 - RNA, 19 nt, Homo sapiens
gcccuggugugcccuuaau

SEQ ID NO: 1124434 - RNA, 19 nt, Homo sapiens
caccacgcccagcuaauuu

SEQ ID NO: 1124435 - RNA, 19 nt, Homo sapiens
ccacacccagguaauuuau

SEQ ID NO: 1124436 - RNA, 19 nt, Homo sapiens
ggaaagaggauagcuugac

SEQ ID NO: 1124437 - RNA, 19 nt, Homo sapiens
ccguggaaaucaacgagaa

SEQ ID NO: 1124438 - RNA, 19 nt, Homo sapiens
gguaacugaucuuaauagc

SEQ ID NO: 1124439 - RNA, 19 nt, Homo sapiens
gacuuuugcuguuggauuu

SEQ ID NO: 1124440 - RNA, 19 nt, Homo sapiens
guuggccucugugaauauu

SEQ ID NO: 1124441 - RNA, 19 nt, Homo sapiens
gaaugcaugauaugaagag

SEQ ID NO: 1124442 - RNA, 19 nt, Homo sapiens
ggagaugaaacggaagaug

SEQ ID NO: 1124443 - RNA, 19 nt, Homo sapiens
gauguaacuuagcacuuuu

SEQ ID NO: 1124444 - RNA, 19 nt, Homo sapiens
uuugggaagucugaaauga

SEQ ID NO: 1124445 - RNA, 19 nt, Homo sapiens
gccagagaaccguugcuuu

SEQ ID NO: 1124446 - RNA, 19 nt, Homo sapiens
gagccugguuacaguuucu

SEQ ID NO: 1124447 - RNA, 19 nt, Homo sapiens
aagaaaacccaggaaauua

SEQ ID NO: 1124448 - RNA, 19 nt, Homo sapiens
agggaaguaugucugaaau

SEQ ID NO: 1124449 - RNA, 19 nt, Homo sapiens
auaugaagauuggacauca

SEQ ID NO: 1124450 - RNA, 19 nt, Homo sapiens
agucacuccauuuaucuua

SEQ ID NO: 1124451 - RNA, 19 nt, Homo sapiens
gcagagcgaggcagcugau

SEQ ID NO: 1124452 - RNA, 19 nt, Homo sapiens
gagcucugguaacugaucu

SEQ ID NO: 1124453 - RNA, 19 nt, Homo sapiens
cugaguagaugggauuaca

SEQ ID NO: 1124454 - RNA, 19 nt, Homo sapiens
uuaagggaaguaugucuga

SEQ ID NO: 1124455 - RNA, 19 nt, Homo sapiens
aaauuggacagcauaugaa

SEQ ID NO: 1124456 - RNA, 19 nt, Homo sapiens
guuccauucuaaccuagga

SEQ ID NO: 1124457 - RNA, 19 nt, Homo sapiens
acaaguugagcucugguaa

SEQ ID NO: 1124458 - RNA, 19 nt, Homo sapiens
gcccagaaagguauaagag

SEQ ID NO: 1124459 - RNA, 19 nt, Homo sapiens
cacauucacgcauaucaga

SEQ ID NO: 1124460 - RNA, 19 nt, Homo sapiens
cuggguagcugggauuaca

SEQ ID NO: 1124461 - RNA, 19 nt, Homo sapiens
gggaaguaugucugaaaug

SEQ ID NO: 1124462 - RNA, 19 nt, Homo sapiens
caaacuccauuuucuagca

SEQ ID NO: 1124463 - RNA, 19 nt, Homo sapiens
gcauggcccguggaaauca

SEQ ID NO: 1124464 - RNA, 19 nt, Homo sapiens
gcagcugaucuuccggauu

SEQ ID NO: 1124465 - RNA, 19 nt, Homo sapiens
ggauuacaggcgugaguca

SEQ ID NO: 1124466 - RNA, 19 nt, Homo sapiens
acuccuaucucugccuuug

SEQ ID NO: 1124467 - RNA, 19 nt, Homo sapiens
acgaggauaugaucuccau

SEQ ID NO: 1124468 - RNA, 19 nt, Homo sapiens
ccgaguugcucuucuucca

SEQ ID NO: 1124469 - RNA, 19 nt, Homo sapiens
cggaagaugcacgaggaua

SEQ ID NO: 1124470 - RNA, 19 nt, Homo sapiens
gaacuguacuuacuaggaa

SEQ ID NO: 1124471 - RNA, 19 nt, Homo sapiens
gcagggaccucaucugguu

SEQ ID NO: 1124472 - RNA, 19 nt, Homo sapiens
gacauucaaucuagucuuu

SEQ ID NO: 1124473 - RNA, 19 nt, Homo sapiens
guuggcagcuggcaaauuu

SEQ ID NO: 1124474 - RNA, 19 nt, Homo sapiens
ccacaagggugacaucugu

SEQ ID NO: 1124475 - RNA, 19 nt, Homo sapiens
guagaccguuugcuucuuu

SEQ ID NO: 1124476 - RNA, 19 nt, Homo sapiens
gaugagguguucugguuug

SEQ ID NO: 1124477 - RNA, 19 nt, Homo sapiens
gagcgagccuguccucugu

SEQ ID NO: 1124478 - RNA, 19 nt, Homo sapiens
gaaaugugcccgacaccaa

SEQ ID NO: 1124479 - RNA, 19 nt, Homo sapiens
ggccaagccuauuguguga

SEQ ID NO: 1124480 - RNA, 19 nt, Homo sapiens
gaaaccgucucauggucuu

SEQ ID NO: 1124481 - RNA, 19 nt, Homo sapiens
ccaagccuauugugugaaa

SEQ ID NO: 1124482 - RNA, 19 nt, Homo sapiens
gcagcuggcaaauuugaua

SEQ ID NO: 1124483 - RNA, 19 nt, Homo sapiens
aaagacggauuucgaagga

SEQ ID NO: 1124484 - RNA, 19 nt, Homo sapiens
caaauuugauagagaacug

SEQ ID NO: 1124485 - RNA, 19 nt, Homo sapiens
ggaaaggguccaucuucaa

SEQ ID NO: 1124486 - RNA, 19 nt, Homo sapiens
caggagggcuguucugaca

SEQ ID NO: 1124487 - RNA, 19 nt, Homo sapiens
gaaaggguccaucuucaag

SEQ ID NO: 1124488 - RNA, 19 nt, Homo sapiens
uggcaaauuugauagagaa

SEQ ID NO: 1124489 - RNA, 19 nt, Homo sapiens
gaccgcgucuuguacagaa

SEQ ID NO: 1124490 - RNA, 19 nt, Homo sapiens
ucgaugagguguucugguu

SEQ ID NO: 1124491 - RNA, 19 nt, Homo sapiens
acucggaucuugcagacua

SEQ ID NO: 1124492 - RNA, 19 nt, Homo sapiens
ugauagagaacuguacuua

SEQ ID NO: 1124493 - RNA, 19 nt, Homo sapiens
gggcaucagcuucaccuuu

SEQ ID NO: 1124494 - RNA, 19 nt, Homo sapiens
gaagcaggcguccaucugu

SEQ ID NO: 1124495 - RNA, 19 nt, Homo sapiens
ggaauuaaaagacggauuu

SEQ ID NO: 1124496 - RNA, 19 nt, Homo sapiens
cggaaaggguccaucuuca

SEQ ID NO: 1124497 - RNA, 19 nt, Homo sapiens
gcacuuccuuccucuucau

SEQ ID NO: 1124498 - RNA, 19 nt, Homo sapiens
gaacaugcagggccagaag

SEQ ID NO: 1124499 - RNA, 19 nt, Homo sapiens
guacagaagccgccacaag

SEQ ID NO: 1124500 - RNA, 19 nt, Homo sapiens
ugacguagaccguuugcuu

SEQ ID NO: 1124501 - RNA, 19 nt, Homo sapiens
gcagcaagcacuacagagu

SEQ ID NO: 1124502 - RNA, 19 nt, Homo sapiens
auagagaacuguacuuacu

SEQ ID NO: 1124503 - RNA, 19 nt, Homo sapiens
ccacugggaaggacaaaga

SEQ ID NO: 1124504 - RNA, 19 nt, Homo sapiens
acacggaccgcgucuugua

SEQ ID NO: 1124505 - RNA, 19 nt, Homo sapiens
caucugcuccguuucuuga

SEQ ID NO: 1124506 - RNA, 19 nt, Homo sapiens
gcggaaaggguccaucuuc

SEQ ID NO: 1124507 - RNA, 19 nt, Homo sapiens
ggcaucagcuucaccuuuu

SEQ ID NO: 1124508 - RNA, 19 nt, Homo sapiens
cccauuccaucucuugaaa

SEQ ID NO: 1124509 - RNA, 19 nt, Homo sapiens
ccaccaccuugaacaccua

SEQ ID NO: 1124510 - RNA, 19 nt, Homo sapiens
gaccguccaugccguccaa

SEQ ID NO: 1124511 - RNA, 19 nt, Homo sapiens
agagaacuguacuuacuag

SEQ ID NO: 1124512 - RNA, 19 nt, Homo sapiens
ggauuucgaaggagauuca

SEQ ID NO: 1124513 - RNA, 19 nt, Homo sapiens
gaaaaucuagggacauuca

SEQ ID NO: 1124514 - RNA, 19 nt, Homo sapiens
acacggguauccagagcaa

SEQ ID NO: 1124515 - RNA, 19 nt, Homo sapiens
uagaccguuugcuucuuua

SEQ ID NO: 1124516 - RNA, 19 nt, Homo sapiens
guucugguuuggagacuuc

SEQ ID NO: 1124517 - RNA, 19 nt, Homo sapiens
caucgugucucagaucaag

SEQ ID NO: 1124518 - RNA, 19 nt, Homo sapiens
ccaugucccggguuucuuu

SEQ ID NO: 1124519 - RNA, 19 nt, Homo sapiens
uagagaacuguacuuacua

SEQ ID NO: 1124520 - RNA, 19 nt, Homo sapiens
ggacauucaaucuagucuu

SEQ ID NO: 1124521 - RNA, 19 nt, Homo sapiens
ccagagcccagcugaggaa

SEQ ID NO: 1124522 - RNA, 19 nt, Homo sapiens
gauagagaacuguacuuac

SEQ ID NO: 1124523 - RNA, 19 nt, Homo sapiens
cuacaugucgcucuucauc

SEQ ID NO: 1124524 - RNA, 19 nt, Homo sapiens
gugaaaaucuagggacauu

SEQ ID NO: 1124525 - RNA, 19 nt, Homo sapiens
caucauacaaguuugacau

SEQ ID NO: 1124526 - RNA, 19 nt, Homo sapiens
ugggaaggacaaagaguuu

SEQ ID NO: 1124527 - RNA, 19 nt, Homo sapiens
ccucccaucauacaaguuu

SEQ ID NO: 1124528 - RNA, 19 nt, Homo sapiens
uccacuuccucccaucaua

SEQ ID NO: 1124529 - RNA, 19 nt, Homo sapiens
guuuggagacuucaacuuc

SEQ ID NO: 1124530 - RNA, 19 nt, Homo sapiens
ccgcuucgaugagguguuc

SEQ ID NO: 1124531 - RNA, 19 nt, Homo sapiens
ucaccacccgcuucgauga

SEQ ID NO: 1124532 - RNA, 19 nt, Homo sapiens
aauguagucuuugaaugug

SEQ ID NO: 1124533 - RNA, 19 nt, Homo sapiens
caggaugccaccaccuuga

SEQ ID NO: 1124534 - RNA, 19 nt, Homo sapiens
gcacuacagagucagaacu

SEQ ID NO: 1124535 - RNA, 19 nt, Homo sapiens
gcuggcaaauuugauagag

SEQ ID NO: 1124536 - RNA, 19 nt, Homo sapiens
ucuagggacauucaaucua

SEQ ID NO: 1124537 - RNA, 19 nt, Homo sapiens
cgaagcaggcguccaucug

SEQ ID NO: 1124538 - RNA, 19 nt, Homo sapiens
agcaagcacuacagaguca

SEQ ID NO: 1124539 - RNA, 19 nt, Homo sapiens
ucagaggcagcaagcacua

SEQ ID NO: 1124540 - RNA, 19 nt, Homo sapiens
ggaccuggaagcccggaau

SEQ ID NO: 1124541 - RNA, 19 nt, Homo sapiens
ggaccgcgucuuguacaga

SEQ ID NO: 1124542 - RNA, 19 nt, Homo sapiens
ggaacaugcagggccagaa

SEQ ID NO: 1124543 - RNA, 19 nt, Homo sapiens
ucauggucuuggugacgua

SEQ ID NO: 1124544 - RNA, 19 nt, Homo sapiens
ucauggucuuggugacgua

SEQ ID NO: 1124545 - RNA, 19 nt, Homo sapiens
agaacuguacuuacuagga

SEQ ID NO: 1124546 - RNA, 19 nt, Homo sapiens
caaggucgacucggaucuu

SEQ ID NO: 1124547 - RNA, 19 nt, Homo sapiens
cgaccaccgcccuguguau

SEQ ID NO: 1124548 - RNA, 19 nt, Homo sapiens
auacacggaccgcgucuug

SEQ ID NO: 1124549 - RNA, 19 nt, Homo sapiens
ggcacuuccuuccucuuca

SEQ ID NO: 1124550 - RNA, 19 nt, Homo sapiens
gaccaccgcccuguguaug

SEQ ID NO: 1124551 - RNA, 19 nt, Homo sapiens
ggaaguugcugaaguuaua

SEQ ID NO: 1124552 - RNA, 19 nt, Homo sapiens
ggagaugacuugggccuua

SEQ ID NO: 1124553 - RNA, 19 nt, Homo sapiens
cacauuacauuaccacuua

SEQ ID NO: 1124554 - RNA, 19 nt, Homo sapiens
ggaaagccaucugaagaaa

SEQ ID NO: 1124555 - RNA, 19 nt, Homo sapiens
gaacaacaguaaccaucuu

SEQ ID NO: 1124556 - RNA, 19 nt, Homo sapiens
gaccaugucuggacgaaga

SEQ ID NO: 1124557 - RNA, 19 nt, Homo sapiens
caauagcacuugucccauu

SEQ ID NO: 1124558 - RNA, 19 nt, Homo sapiens
ggcaaaaucuucaucaaua

SEQ ID NO: 1124559 - RNA, 19 nt, Homo sapiens
ccuggaaucuacagaauaa

SEQ ID NO: 1124560 - RNA, 19 nt, Homo sapiens
ugaacagacugcagaguaa

SEQ ID NO: 1124561 - RNA, 19 nt, Homo sapiens
aaagccaucugaagaaauu

SEQ ID NO: 1124562 - RNA, 19 nt, Homo sapiens
ugacagcacacaaauuaua

SEQ ID NO: 1124563 - RNA, 19 nt, Homo sapiens
gaagagcauugacauagca

SEQ ID NO: 1124564 - RNA, 19 nt, Homo sapiens
gaagaacaaaggauaucua

SEQ ID NO: 1124565 - RNA, 19 nt, Homo sapiens
gaggcagcaucgacaauuu

SEQ ID NO: 1124566 - RNA, 19 nt, Homo sapiens
cagaagagauaaugucauc

SEQ ID NO: 1124567 - RNA, 19 nt, Homo sapiens
gaacuucaguggcuaccau

SEQ ID NO: 1124568 - RNA, 19 nt, Homo sapiens
cgcauuaucugcuuacauu

SEQ ID NO: 1124569 - RNA, 19 nt, Homo sapiens
ugacauagcacacacaaau

SEQ ID NO: 1124570 - RNA, 19 nt, Homo sapiens
ucugaagccugcugucaua

SEQ ID NO: 1124571 - RNA, 19 nt, Homo sapiens
gaagccugcugucauacuu

SEQ ID NO: 1124572 - RNA, 19 nt, Homo sapiens
acauucagcucuucagaaa

SEQ ID NO: 1124573 - RNA, 19 nt, Homo sapiens
gaacaaaggauaucuaccu

SEQ ID NO: 1124574 - RNA, 19 nt, Homo sapiens
gcaggauauuuccaguaua

SEQ ID NO: 1124575 - RNA, 19 nt, Homo sapiens
guaaauauggcucccugua

SEQ ID NO: 1124576 - RNA, 19 nt, Homo sapiens
caacaguaaccaucuugua

SEQ ID NO: 1124577 - RNA, 19 nt, Homo sapiens
cauggucacugguaucuug

SEQ ID NO: 1124578 - RNA, 19 nt, Homo sapiens
cauuaccacuuaugaagaa

SEQ ID NO: 1124579 - RNA, 19 nt, Homo sapiens
gacaaggaaaugauaguuu

SEQ ID NO: 1124580 - RNA, 19 nt, Homo sapiens
cagauaguguguaaugaug

SEQ ID NO: 1124581 - RNA, 19 nt, Homo sapiens
gggaaagccaucugaagaa

SEQ ID NO: 1124582 - RNA, 19 nt, Homo sapiens
gacauagcacacacaaaua

SEQ ID NO: 1124583 - RNA, 19 nt, Homo sapiens
gugcuaacccgaagaauuc

SEQ ID NO: 1124584 - RNA, 19 nt, Homo sapiens
guaaccaucuuguaaacag

SEQ ID NO: 1124585 - RNA, 19 nt, Homo sapiens
caguauaccguguuuguaa

SEQ ID NO: 1124586 - RNA, 19 nt, Homo sapiens
gaacagacugcagaguaaa

SEQ ID NO: 1124587 - RNA, 19 nt, Homo sapiens
acaaguagcagauaucaau

SEQ ID NO: 1124588 - RNA, 19 nt, Homo sapiens
gcagauaguguguaaugau

SEQ ID NO: 1124589 - RNA, 19 nt, Homo sapiens
caacgucuauacacauuac

SEQ ID NO: 1124590 - RNA, 19 nt, Homo sapiens
gugacugucuggcucaauu

SEQ ID NO: 1124591 - RNA, 19 nt, Homo sapiens
ggacgggccauguaucaga

SEQ ID NO: 1124592 - RNA, 19 nt, Homo sapiens
caggauauuuccaguauac

SEQ ID NO: 1124593 - RNA, 19 nt, Homo sapiens
aaauauggcucccuguaca

SEQ ID NO: 1124594 - RNA, 19 nt, Homo sapiens
ugacugcacaggacaagua

SEQ ID NO: 1124595 - RNA, 19 nt, Homo sapiens
cuucucagccucuuguuua

SEQ ID NO: 1124596 - RNA, 19 nt, Homo sapiens
ggaguuggaggccucaauu

SEQ ID NO: 1124597 - RNA, 19 nt, Homo sapiens
gaaauaugaggcuacuuca

SEQ ID NO: 1124598 - RNA, 19 nt, Homo sapiens
aagcagaauuugcaucuca

SEQ ID NO: 1124599 - RNA, 19 nt, Homo sapiens
ggaagcaggacauucugaa

SEQ ID NO: 1124600 - RNA, 19 nt, Homo sapiens
ccgaagaauucaguacaaa

SEQ ID NO: 1124601 - RNA, 19 nt, Homo sapiens
caaagcccauccuucuuca

SEQ ID NO: 1124602 - RNA, 19 nt, Homo sapiens
gggccuagcaugugcauug

SEQ ID NO: 1124603 - RNA, 19 nt, Homo sapiens
ggacaaguagcagauauca

SEQ ID NO: 1124604 - RNA, 19 nt, Homo sapiens
cgacauaggcaugguauca

SEQ ID NO: 1124605 - RNA, 19 nt, Homo sapiens
ccugauggguccaaucgaa

SEQ ID NO: 1124606 - RNA, 19 nt, Homo sapiens
ggagaaauaugaggcuacu

SEQ ID NO: 1124607 - RNA, 19 nt, Homo sapiens
ccaaagcccauccuucuuc

SEQ ID NO: 1124608 - RNA, 19 nt, Homo sapiens
aagagaagaacaaaggaua

SEQ ID NO: 1124609 - RNA, 19 nt, Homo sapiens
gagaugacuugggccuuau

SEQ ID NO: 1124610 - RNA, 19 nt, Homo sapiens
aaacuucuccagugccuuu

SEQ ID NO: 1124611 - RNA, 19 nt, Homo sapiens
cguggcagauaguguguaa

SEQ ID NO: 1124612 - RNA, 19 nt, Homo sapiens
ggugcuaacccgaagaauu

SEQ ID NO: 1124613 - RNA, 19 nt, Homo sapiens
gaaagccaucugaagaaau

SEQ ID NO: 1124614 - RNA, 19 nt, Homo sapiens
ccauuaauuccuaguauug

SEQ ID NO: 1124615 - RNA, 19 nt, Homo sapiens
gcaacgucuauacacauua

SEQ ID NO: 1124616 - RNA, 19 nt, Homo sapiens
ccacagccacucaaacuuc

SEQ ID NO: 1124617 - RNA, 19 nt, Homo sapiens
ggguggauaugacagaugu

SEQ ID NO: 1124618 - RNA, 19 nt, Homo sapiens
uaaaggaaauguggauggu

SEQ ID NO: 1124619 - RNA, 19 nt, Homo sapiens
guacagaagagauaauguc

SEQ ID NO: 1124620 - RNA, 19 nt, Homo sapiens
caggacaaguagcagauau

SEQ ID NO: 1124621 - RNA, 19 nt, Homo sapiens
caaauacagacaaggaaau

SEQ ID NO: 1124622 - RNA, 19 nt, Homo sapiens
cauuguugauguucagauu

SEQ ID NO: 1124623 - RNA, 19 nt, Homo sapiens
gagcaaaggaacucuaugc

SEQ ID NO: 1124624 - RNA, 19 nt, Homo sapiens
ucaaauacagacaaggaaa

SEQ ID NO: 1124625 - RNA, 19 nt, Homo sapiens
ugcaggauauuuccaguau

SEQ ID NO: 1124626 - RNA, 19 nt, Homo sapiens
agaaauaugaggcuacuuc

SEQ ID NO: 1124627 - RNA, 19 nt, Homo sapiens
gcauugggcuacaguuuug

SEQ ID NO: 1124628 - RNA, 19 nt, Homo sapiens
aguagcagauaucaauuug

SEQ ID NO: 1124629 - RNA, 19 nt, Homo sapiens
gcugucauacuuucauuug

SEQ ID NO: 1124630 - RNA, 19 nt, Homo sapiens
ucacuguggagaaauauga

SEQ ID NO: 1124631 - RNA, 19 nt, Homo sapiens
uuauggaccgcacgcauua

SEQ ID NO: 1124632 - RNA, 19 nt, Homo sapiens
gcaagagaagaacaaagga

SEQ ID NO: 1124633 - RNA, 19 nt, Homo sapiens
uguaaacagugacaaugug

SEQ ID NO: 1124634 - RNA, 19 nt, Homo sapiens
aacaguaaccaucuuguaa

SEQ ID NO: 1124635 - RNA, 19 nt, Homo sapiens
cagcauugggcuacaguuu

SEQ ID NO: 1124636 - RNA, 19 nt, Homo sapiens
ggacaggauauguuugaca

SEQ ID NO: 1124637 - RNA, 19 nt, Homo sapiens
acaguaaccaucuuguaaa

SEQ ID NO: 1124638 - RNA, 19 nt, Homo sapiens
uucaguggcuaccauauug

SEQ ID NO: 1124639 - RNA, 19 nt, Homo sapiens
agaggcaguucaagcagaa

SEQ ID NO: 1124640 - RNA, 19 nt, Homo sapiens
ccacagccacccagcauuc

SEQ ID NO: 1124641 - RNA, 19 nt, Homo sapiens
gagaagaacaaaggauauc

SEQ ID NO: 1124642 - RNA, 19 nt, Homo sapiens
cugaacagacugcagagua

SEQ ID NO: 1124643 - RNA, 19 nt, Homo sapiens
gcaaauccggccagaaugc

SEQ ID NO: 1124644 - RNA, 19 nt, Homo sapiens
gcaacaguggaauggcaua

SEQ ID NO: 1124645 - RNA, 19 nt, Homo sapiens
gaguuggaggccucaauuu

SEQ ID NO: 1124646 - RNA, 19 nt, Homo sapiens
cagcacauggucacuggua

SEQ ID NO: 1124647 - RNA, 19 nt, Homo sapiens
guaaugcaacaguggaaug

SEQ ID NO: 1124648 - RNA, 19 nt, Homo sapiens
ggcagauaguguguaauga

SEQ ID NO: 1124649 - RNA, 19 nt, Homo sapiens
caacaucguggcagauagu

SEQ ID NO: 1124650 - RNA, 19 nt, Homo sapiens
cagcaucgacaauuuaugg

SEQ ID NO: 1124651 - RNA, 19 nt, Homo sapiens
gaauugcucugucauaaua

SEQ ID NO: 1124652 - RNA, 19 nt, Homo sapiens
aaagaaagcugcguuaaug

SEQ ID NO: 1124653 - RNA, 19 nt, Homo sapiens
caaucaagaucaacucuaa

SEQ ID NO: 1124654 - RNA, 19 nt, Homo sapiens
aaagaaaccuagcaacaaa

SEQ ID NO: 1124655 - RNA, 19 nt, Homo sapiens
gaucucaaauguuaggauu

SEQ ID NO: 1124656 - RNA, 19 nt, Homo sapiens
gaagacagcaaugaugaua

SEQ ID NO: 1124657 - RNA, 19 nt, Homo sapiens
gaaagcugcguuaauguuu

SEQ ID NO: 1124658 - RNA, 19 nt, Homo sapiens
gaacuaacagaucucuuaa

SEQ ID NO: 1124659 - RNA, 19 nt, Homo sapiens
gcaaugaugauauggauga

SEQ ID NO: 1124660 - RNA, 19 nt, Homo sapiens
ucugaaggcuggacuaauu

SEQ ID NO: 1124661 - RNA, 19 nt, Homo sapiens
guucuacgcuucugugaga

SEQ ID NO: 1124662 - RNA, 19 nt, Homo sapiens
cauaauaagucagggauau

SEQ ID NO: 1124663 - RNA, 19 nt, Homo sapiens
caagaucaacucuaaguga

SEQ ID NO: 1124664 - RNA, 19 nt, Homo sapiens
gagaagaacugugaaaaga

SEQ ID NO: 1124665 - RNA, 19 nt, Homo sapiens
agaacuaacagaucucuua

SEQ ID NO: 1124666 - RNA, 19 nt, Homo sapiens
cuucaugacuguuggaauu

SEQ ID NO: 1124667 - RNA, 19 nt, Homo sapiens
gaacacugcagaacuaaca

SEQ ID NO: 1124668 - RNA, 19 nt, Homo sapiens
uugaacagcuggacaaguu

SEQ ID NO: 1124669 - RNA, 19 nt, Homo sapiens
agacagcaaugaugauaug

SEQ ID NO: 1124670 - RNA, 19 nt, Homo sapiens
ugugaacacugcagaacua

SEQ ID NO: 1124671 - RNA, 19 nt, Homo sapiens
gaaaggguacccagugugu

SEQ ID NO: 1124672 - RNA, 19 nt, Homo sapiens
uggaauugcucugucauaa

SEQ ID NO: 1124673 - RNA, 19 nt, Homo sapiens
ugacagcccugguuucucu

SEQ ID NO: 1124674 - RNA, 19 nt, Homo sapiens
gauuaugacggaauuaaga

SEQ ID NO: 1124675 - RNA, 19 nt, Homo sapiens
ugaagacgaugaugacagu

SEQ ID NO: 1124676 - RNA, 19 nt, Homo sapiens
ggacuaauucaaucaagau

SEQ ID NO: 1124677 - RNA, 19 nt, Homo sapiens
gcaagugacagcccugguu

SEQ ID NO: 1124678 - RNA, 19 nt, Homo sapiens
caaaugcagaggaagaauu

SEQ ID NO: 1124679 - RNA, 19 nt, Homo sapiens
cagaagacagcaaugauga

SEQ ID NO: 1124680 - RNA, 19 nt, Homo sapiens
acgaggaagugaauauuga

SEQ ID NO: 1124681 - RNA, 19 nt, Homo sapiens
cagcaaugaugauauggau

SEQ ID NO: 1124682 - RNA, 19 nt, Homo sapiens
ggagugugauuaagcaaac

SEQ ID NO: 1124683 - RNA, 19 nt, Homo sapiens
acagaucucuuaauucaac

SEQ ID NO: 1124684 - RNA, 19 nt, Homo sapiens
ggaauugcucugucauaau

SEQ ID NO: 1124685 - RNA, 19 nt, Homo sapiens
gggcacacagaaccaauaa

SEQ ID NO: 1124686 - RNA, 19 nt, Homo sapiens
caagugacagcccugguuu

SEQ ID NO: 1124687 - RNA, 19 nt, Homo sapiens
gcguuaauguuugcaaaug

SEQ ID NO: 1124688 - RNA, 19 nt, Homo sapiens
gcacacagaaccaauaagc

SEQ ID NO: 1124689 - RNA, 19 nt, Homo sapiens
uaaugucccuccacagauc

SEQ ID NO: 1124690 - RNA, 19 nt, Homo sapiens
cauauugggagugugauua

SEQ ID NO: 1124691 - RNA, 19 nt, Homo sapiens
gaagaggacgaggucauug

SEQ ID NO: 1124692 - RNA, 19 nt, Homo sapiens
accagcagcuucagaaaga

SEQ ID NO: 1124693 - RNA, 19 nt, Homo sapiens
ggccuucuccuaagugaaa

SEQ ID NO: 1124694 - RNA, 19 nt, Homo sapiens
ucuaaaggcuccugugaac

SEQ ID NO: 1124695 - RNA, 19 nt, Homo sapiens
gacgaggaagugaauauug

SEQ ID NO: 1124696 - RNA, 19 nt, Homo sapiens
ucagugucuuucagaguuu

SEQ ID NO: 1124697 - RNA, 19 nt, Homo sapiens
uaaaacaucucggcaccua

SEQ ID NO: 1124698 - RNA, 19 nt, Homo sapiens
aaagcugcguuaauguuug

SEQ ID NO: 1124699 - RNA, 19 nt, Homo sapiens
aguuugagauaccuuguuu

SEQ ID NO: 1124700 - RNA, 19 nt, Homo sapiens
aaaugaggaugaagacgau

SEQ ID NO: 1124701 - RNA, 19 nt, Homo sapiens
ugaagcuuauucccuauca

SEQ ID NO: 1124702 - RNA, 19 nt, Homo sapiens
gagauaccuuguuuucauu

SEQ ID NO: 1124703 - RNA, 19 nt, Homo sapiens
agaaagcugcguuaauguu

SEQ ID NO: 1124704 - RNA, 19 nt, Homo sapiens
ucuccuaagugaaagauuc

SEQ ID NO: 1124705 - RNA, 19 nt, Homo sapiens
aagaaaggguacccagugu

SEQ ID NO: 1124706 - RNA, 19 nt, Homo sapiens
ugauauggaugaagaugag

SEQ ID NO: 1124707 - RNA, 19 nt, Homo sapiens
cugcagaacuaacagaucu

SEQ ID NO: 1124708 - RNA, 19 nt, Homo sapiens
gcucugucauaauaaguca

SEQ ID NO: 1124709 - RNA, 19 nt, Homo sapiens
ugaugacagugacaaggaa

SEQ ID NO: 1124710 - RNA, 19 nt, Homo sapiens
ucagaagacagcaaugaug

SEQ ID NO: 1124711 - RNA, 19 nt, Homo sapiens
augaugauauggaugaaga

SEQ ID NO: 1124712 - RNA, 19 nt, Homo sapiens
agaucgcucugcccaugua

SEQ ID NO: 1124713 - RNA, 19 nt, Homo sapiens
ccugugggccuucuccuaa

SEQ ID NO: 1124714 - RNA, 19 nt, Homo sapiens
uggacuaauucaaucaaga

SEQ ID NO: 1124715 - RNA, 19 nt, Homo sapiens
uaagacauuuguggaagca

SEQ ID NO: 1124716 - RNA, 19 nt, Homo sapiens
ugagauaccuuguuuucau

SEQ ID NO: 1124717 - RNA, 19 nt, Homo sapiens
cucagugucuuucagaguu

SEQ ID NO: 1124718 - RNA, 19 nt, Homo sapiens
ugaagaggacgaggucauu

SEQ ID NO: 1124719 - RNA, 19 nt, Homo sapiens
gaaaagagcaugguugaac

SEQ ID NO: 1124720 - RNA, 19 nt, Homo sapiens
cacaagaagaggauuggaa

SEQ ID NO: 1124721 - RNA, 19 nt, Homo sapiens
ggagguccagacacaagaa

SEQ ID NO: 1124722 - RNA, 19 nt, Homo sapiens
guaccagcagcuucagaaa

SEQ ID NO: 1124723 - RNA, 19 nt, Homo sapiens
ggaugaagacgaugaugac

SEQ ID NO: 1124724 - RNA, 19 nt, Homo sapiens
ggaaccuucaugacuguug

SEQ ID NO: 1124725 - RNA, 19 nt, Homo sapiens
gaacagcuggacaaguuuu

SEQ ID NO: 1124726 - RNA, 19 nt, Homo sapiens
gggagugugauuaagcaaa

SEQ ID NO: 1124727 - RNA, 19 nt, Homo sapiens
ccagggaaccuucaugacu

SEQ ID NO: 1124728 - RNA, 19 nt, Homo sapiens
gaggaagugaauauugaau

SEQ ID NO: 1124729 - RNA, 19 nt, Homo sapiens
caaugaugauauggaugaa

SEQ ID NO: 1124730 - RNA, 19 nt, Homo sapiens
gaugacagugacaaggaaa

SEQ ID NO: 1124731 - RNA, 19 nt, Homo sapiens
cgaggaagugaauauugaa

SEQ ID NO: 1124732 - RNA, 19 nt, Homo sapiens
ugacgaggaagugaauauu

SEQ ID NO: 1124733 - RNA, 19 nt, Homo sapiens
gcaccuaguaaugguaaau

SEQ ID NO: 1124734 - RNA, 19 nt, Homo sapiens
ucaaucaagaucaacucua

SEQ ID NO: 1124735 - RNA, 19 nt, Homo sapiens
gcaaaugcagaggaagaau

SEQ ID NO: 1124736 - RNA, 19 nt, Homo sapiens
gcgcgacgaggaagaggaa

SEQ ID NO: 1124737 - RNA, 19 nt, Homo sapiens
aaacaucucggcaccuagu

SEQ ID NO: 1124738 - RNA, 19 nt, Homo sapiens
gaaggcuggacuaauucaa

SEQ ID NO: 1124739 - RNA, 19 nt, Homo sapiens
gaugauauggaugaagaug

SEQ ID NO: 1124740 - RNA, 19 nt, Homo sapiens
ugauuaagcaaacggaugu

SEQ ID NO: 1124741 - RNA, 19 nt, Homo sapiens
uaaaggcuccugugaacac

SEQ ID NO: 1124742 - RNA, 19 nt, Homo sapiens
ucugugagaagaacuguga

SEQ ID NO: 1124743 - RNA, 19 nt, Homo sapiens
ucucuuaauucaacagaac

SEQ ID NO: 1124744 - RNA, 19 nt, Homo sapiens
gaagucucagugucuuuca

SEQ ID NO: 1124745 - RNA, 19 nt, Homo sapiens
agacacaagaagaggauug

SEQ ID NO: 1124746 - RNA, 19 nt, Homo sapiens
ucuaugaggagcagggaaa

SEQ ID NO: 1124747 - RNA, 19 nt, Homo sapiens
aagcuuauucccuaucaga

SEQ ID NO: 1124748 - RNA, 19 nt, Homo sapiens
aagaggacgaggucauuga

SEQ ID NO: 1124749 - RNA, 19 nt, Homo sapiens
aggcuggacuaauucaauc

SEQ ID NO: 1124750 - RNA, 19 nt, Homo sapiens
cuaacagaucucuuaauuc

SEQ ID NO: 1124751 - RNA, 19 nt, Homo sapiens
aaagaaagcugcguuaaug

SEQ ID NO: 1124752 - RNA, 19 nt, Homo sapiens
aaagaaaccuagcaacaaa

SEQ ID NO: 1124753 - RNA, 19 nt, Homo sapiens
ugaacgaaaucauggauaa

SEQ ID NO: 1124754 - RNA, 19 nt, Homo sapiens
gaagacagcaaugaugaua

SEQ ID NO: 1124755 - RNA, 19 nt, Homo sapiens
gaaagcugcguuaauguuu

SEQ ID NO: 1124756 - RNA, 19 nt, Homo sapiens
gaacuaacagaucucuuaa

SEQ ID NO: 1124757 - RNA, 19 nt, Homo sapiens
gcaaugaugauauggauga

SEQ ID NO: 1124758 - RNA, 19 nt, Homo sapiens
gaaggcaauucucaaguuc

SEQ ID NO: 1124759 - RNA, 19 nt, Homo sapiens
guucuacgcuucugugaga

SEQ ID NO: 1124760 - RNA, 19 nt, Homo sapiens
gcgacaagaugaacgaaau

SEQ ID NO: 1124761 - RNA, 19 nt, Homo sapiens
gaaaucauggauaaacuga

SEQ ID NO: 1124762 - RNA, 19 nt, Homo sapiens
gagaagaacugugaaaaga

SEQ ID NO: 1124763 - RNA, 19 nt, Homo sapiens
agaacuaacagaucucuua

SEQ ID NO: 1124764 - RNA, 19 nt, Homo sapiens
ggacagugaugggcuuguu

SEQ ID NO: 1124765 - RNA, 19 nt, Homo sapiens
gaacacugcagaacuaaca

SEQ ID NO: 1124766 - RNA, 19 nt, Homo sapiens
uugaacagcuggacaaguu

SEQ ID NO: 1124767 - RNA, 19 nt, Homo sapiens
gaacugugauguuaauucc

SEQ ID NO: 1124768 - RNA, 19 nt, Homo sapiens
agacagcaaugaugauaug

SEQ ID NO: 1124769 - RNA, 19 nt, Homo sapiens
ugugaacacugcagaacua

SEQ ID NO: 1124770 - RNA, 19 nt, Homo sapiens
gaaaggguacccagugugu

SEQ ID NO: 1124771 - RNA, 19 nt, Homo sapiens
gaacgaaaucauggauaaa

SEQ ID NO: 1124772 - RNA, 19 nt, Homo sapiens
gauuaugacggaauuaaga

SEQ ID NO: 1124773 - RNA, 19 nt, Homo sapiens
ugaagacgaugaugacagu

SEQ ID NO: 1124774 - RNA, 19 nt, Homo sapiens
caaaugcagaggaagaauu

SEQ ID NO: 1124775 - RNA, 19 nt, Homo sapiens
cagaagacagcaaugauga

SEQ ID NO: 1124776 - RNA, 19 nt, Homo sapiens
acgaggaagugaauauuga

SEQ ID NO: 1124777 - RNA, 19 nt, Homo sapiens
cagauuaaguuccucuaca

SEQ ID NO: 1124778 - RNA, 19 nt, Homo sapiens
cagcaaugaugauauggau

SEQ ID NO: 1124779 - RNA, 19 nt, Homo sapiens
ggagugugauuaagcaaac

SEQ ID NO: 1124780 - RNA, 19 nt, Homo sapiens
acagaucucuuaauucaac

SEQ ID NO: 1124781 - RNA, 19 nt, Homo sapiens
guaggguucugucccaugu

SEQ ID NO: 1124782 - RNA, 19 nt, Homo sapiens
agauuaaguuccucuacaa

SEQ ID NO: 1124783 - RNA, 19 nt, Homo sapiens
gggcacacagaaccaauaa

SEQ ID NO: 1124784 - RNA, 19 nt, Homo sapiens
aaaacucaguggagauuua

SEQ ID NO: 1124785 - RNA, 19 nt, Homo sapiens
cuugcgaacugugauguua

SEQ ID NO: 1124786 - RNA, 19 nt, Homo sapiens
gcguuaauguuugcaaaug

SEQ ID NO: 1124787 - RNA, 19 nt, Homo sapiens
gcacacagaaccaauaagc

SEQ ID NO: 1124788 - RNA, 19 nt, Homo sapiens
uaaugucccuccacagauc

SEQ ID NO: 1124789 - RNA, 19 nt, Homo sapiens
cauauugggagugugauua

SEQ ID NO: 1124790 - RNA, 19 nt, Homo sapiens
gaagaggacgaggucauug

SEQ ID NO: 1124791 - RNA, 19 nt, Homo sapiens
accagcagcuucagaaaga

SEQ ID NO: 1124792 - RNA, 19 nt, Homo sapiens
ggccuucuccuaagugaaa

SEQ ID NO: 1124793 - RNA, 19 nt, Homo sapiens
ucuaaaggcuccugugaac

SEQ ID NO: 1124794 - RNA, 19 nt, Homo sapiens
ggucaaauuaugagugguu

SEQ ID NO: 1124795 - RNA, 19 nt, Homo sapiens
gaauaucuaucugucuaac

SEQ ID NO: 1124796 - RNA, 19 nt, Homo sapiens
gacgaggaagugaauauug

SEQ ID NO: 1124797 - RNA, 19 nt, Homo sapiens
gauuaaguuccucuacaaa

SEQ ID NO: 1124798 - RNA, 19 nt, Homo sapiens
aaagcugcguuaauguuug

SEQ ID NO: 1124799 - RNA, 19 nt, Homo sapiens
aaaugaggaugaagacgau

SEQ ID NO: 1124800 - RNA, 19 nt, Homo sapiens
ugaagcuuauucccuauca

SEQ ID NO: 1124801 - RNA, 19 nt, Homo sapiens
cuaucugucuaacccauuu

SEQ ID NO: 1124802 - RNA, 19 nt, Homo sapiens
agaaagcugcguuaauguu

SEQ ID NO: 1124803 - RNA, 19 nt, Homo sapiens
ucuccuaagugaaagauuc

SEQ ID NO: 1124804 - RNA, 19 nt, Homo sapiens
aagaaaggguacccagugu

SEQ ID NO: 1124805 - RNA, 19 nt, Homo sapiens
ugauauggaugaagaugag

SEQ ID NO: 1124806 - RNA, 19 nt, Homo sapiens
cugcagaacuaacagaucu

SEQ ID NO: 1124807 - RNA, 19 nt, Homo sapiens
ucagaagacagcaaugaug

SEQ ID NO: 1124808 - RNA, 19 nt, Homo sapiens
ugaugacagugacaaggaa

SEQ ID NO: 1124809 - RNA, 19 nt, Homo sapiens
augaugauauggaugaaga

SEQ ID NO: 1124810 - RNA, 19 nt, Homo sapiens
acucagacuuuauucagau

SEQ ID NO: 1124811 - RNA, 19 nt, Homo sapiens
agaucgcucugcccaugua

SEQ ID NO: 1124812 - RNA, 19 nt, Homo sapiens
ccugugggccuucuccuaa

SEQ ID NO: 1124813 - RNA, 19 nt, Homo sapiens
uaagacauuuguggaagca

SEQ ID NO: 1124814 - RNA, 19 nt, Homo sapiens
aggcaauucucaaguucaa

SEQ ID NO: 1124815 - RNA, 19 nt, Homo sapiens
ugaagaggacgaggucauu

SEQ ID NO: 1124816 - RNA, 19 nt, Homo sapiens
gaaaagagcaugguugaac

SEQ ID NO: 1124817 - RNA, 19 nt, Homo sapiens
caaauuaugagugguugau

SEQ ID NO: 1124818 - RNA, 19 nt, Homo sapiens
cgaacugugauguuaauuc

SEQ ID NO: 1124819 - RNA, 19 nt, Homo sapiens
guaccagcagcuucagaaa

SEQ ID NO: 1124820 - RNA, 19 nt, Homo sapiens
ggaugaagacgaugaugac

SEQ ID NO: 1124821 - RNA, 19 nt, Homo sapiens
gaacagcuggacaaguuuu

SEQ ID NO: 1124822 - RNA, 19 nt, Homo sapiens
gggagugugauuaagcaaa

SEQ ID NO: 1124823 - RNA, 19 nt, Homo sapiens
ucucugacacauuuacaaa

SEQ ID NO: 1124824 - RNA, 19 nt, Homo sapiens
gaugacagugacaaggaaa

SEQ ID NO: 1124825 - RNA, 19 nt, Homo sapiens
gacagugaugggcuuguuu

SEQ ID NO: 1124826 - RNA, 19 nt, Homo sapiens
gacaagaugaacgaaauca

SEQ ID NO: 1124827 - RNA, 19 nt, Homo sapiens
ggaggagagcgacacuugu

SEQ ID NO: 1124828 - RNA, 19 nt, Homo sapiens
gaggaagugaauauugaau

SEQ ID NO: 1124829 - RNA, 19 nt, Homo sapiens
caaugaugauauggaugaa

SEQ ID NO: 1124830 - RNA, 19 nt, Homo sapiens
cgaaaucauggauaaacug

SEQ ID NO: 1124831 - RNA, 19 nt, Homo sapiens
ugacgaggaagugaauauu

SEQ ID NO: 1124832 - RNA, 19 nt, Homo sapiens
gcaaaugcagaggaagaau

SEQ ID NO: 1124833 - RNA, 19 nt, Homo sapiens
cgaggaagugaauauugaa

SEQ ID NO: 1124834 - RNA, 19 nt, Homo sapiens
gcgcgacgaggaagaggaa

SEQ ID NO: 1124835 - RNA, 19 nt, Homo sapiens
aaacucagacuuuauucag

SEQ ID NO: 1124836 - RNA, 19 nt, Homo sapiens
gaugauauggaugaagaug

SEQ ID NO: 1124837 - RNA, 19 nt, Homo sapiens
ugauuaagcaaacggaugu

SEQ ID NO: 1124838 - RNA, 19 nt, Homo sapiens
uaaaggcuccugugaacac

SEQ ID NO: 1124839 - RNA, 19 nt, Homo sapiens
ucugugagaagaacuguga

SEQ ID NO: 1124840 - RNA, 19 nt, Homo sapiens
uuugaugacguaccaauga

SEQ ID NO: 1124841 - RNA, 19 nt, Homo sapiens
ucucuuaauucaacagaac

SEQ ID NO: 1124842 - RNA, 19 nt, Homo sapiens
aagaggacgaggucauuga

SEQ ID NO: 1124843 - RNA, 19 nt, Homo sapiens
cuaacagaucucuuaauuc

SEQ ID NO: 1124844 - RNA, 19 nt, Homo sapiens
ugcgaacugugauguuaau

SEQ ID NO: 1124845 - RNA, 19 nt, Homo sapiens
cugcguuaauguuugcaaa

SEQ ID NO: 1124846 - RNA, 19 nt, Homo sapiens
uaguaagacauuuguggaa

SEQ ID NO: 1124847 - RNA, 19 nt, Homo sapiens
ccagcagcuucagaaagaa

SEQ ID NO: 1124848 - RNA, 19 nt, Homo sapiens
aagcuuauucccuaucaga

SEQ ID NO: 1124849 - RNA, 19 nt, Homo sapiens
gaucucuuaauucaacaga

SEQ ID NO: 1124850 - RNA, 19 nt, Homo sapiens
aaggguacccaguguguug

SEQ ID NO: 1124851 - RNA, 19 nt, Homo sapiens
aaagaaagcugcguuaaug

SEQ ID NO: 1124852 - RNA, 19 nt, Homo sapiens
aaagaaaccuagcaacaaa

SEQ ID NO: 1124853 - RNA, 19 nt, Homo sapiens
gaucagcgcauguguguaa

SEQ ID NO: 1124854 - RNA, 19 nt, Homo sapiens
ggaauagucauuaaggaua

SEQ ID NO: 1124855 - RNA, 19 nt, Homo sapiens
gaacaguggugcugacaca

SEQ ID NO: 1124856 - RNA, 19 nt, Homo sapiens
ggacaaagcucaaaaguac

SEQ ID NO: 1124857 - RNA, 19 nt, Homo sapiens
gaagacagcaaugaugaua

SEQ ID NO: 1124858 - RNA, 19 nt, Homo sapiens
gaaugaagccaauaggaaa

SEQ ID NO: 1124859 - RNA, 19 nt, Homo sapiens
gaaagcugcguuaauguuu

SEQ ID NO: 1124860 - RNA, 19 nt, Homo sapiens
gaacuaacagaucucuuaa

SEQ ID NO: 1124861 - RNA, 19 nt, Homo sapiens
gcaaugaugauauggauga

SEQ ID NO: 1124862 - RNA, 19 nt, Homo sapiens
gaaggauagugauucuuga

SEQ ID NO: 1124863 - RNA, 19 nt, Homo sapiens
guucuacgcuucugugaga

SEQ ID NO: 1124864 - RNA, 19 nt, Homo sapiens
uggaaaaccucaugauuua

SEQ ID NO: 1124865 - RNA, 19 nt, Homo sapiens
caucugcacugauuauuuc

SEQ ID NO: 1124866 - RNA, 19 nt, Homo sapiens
gaaacaagcaaacaaugga

SEQ ID NO: 1124867 - RNA, 19 nt, Homo sapiens
aaacaggcacacaacauua

SEQ ID NO: 1124868 - RNA, 19 nt, Homo sapiens
ggaacucgcggucacagua

SEQ ID NO: 1124869 - RNA, 19 nt, Homo sapiens
gagaagaacugugaaaaga

SEQ ID NO: 1124870 - RNA, 19 nt, Homo sapiens
agaacuaacagaucucuua

SEQ ID NO: 1124871 - RNA, 19 nt, Homo sapiens
caaauucacaggacgcuaa

SEQ ID NO: 1124872 - RNA, 19 nt, Homo sapiens
gaacacugcagaacuaaca

SEQ ID NO: 1124873 - RNA, 19 nt, Homo sapiens
ucacaguacuggagagaga

SEQ ID NO: 1124874 - RNA, 19 nt, Homo sapiens
uugaacagcuggacaaguu

SEQ ID NO: 1124875 - RNA, 19 nt, Homo sapiens
gaauagucauuaaggauac

SEQ ID NO: 1124876 - RNA, 19 nt, Homo sapiens
agacagcaaugaugauaug

SEQ ID NO: 1124877 - RNA, 19 nt, Homo sapiens
ucauuaaggauaccuguua

SEQ ID NO: 1124878 - RNA, 19 nt, Homo sapiens
gcacaaugguuggucuguu

SEQ ID NO: 1124879 - RNA, 19 nt, Homo sapiens
ugugaacacugcagaacua

SEQ ID NO: 1124880 - RNA, 19 nt, Homo sapiens
gugagaagauuagaaggaa

SEQ ID NO: 1124881 - RNA, 19 nt, Homo sapiens
gacaugaugauuccaaauu

SEQ ID NO: 1124882 - RNA, 19 nt, Homo sapiens
gaaaggguacccagugugu

SEQ ID NO: 1124883 - RNA, 19 nt, Homo sapiens
agacaaagauguuauuucc

SEQ ID NO: 1124884 - RNA, 19 nt, Homo sapiens
uaagauagacuucgagagu

SEQ ID NO: 1124885 - RNA, 19 nt, Homo sapiens
gaaagagccaugugagaag

SEQ ID NO: 1124886 - RNA, 19 nt, Homo sapiens
gaaauaguagacaaagaug

SEQ ID NO: 1124887 - RNA, 19 nt, Homo sapiens
gagaaagagccaugugaga

SEQ ID NO: 1124888 - RNA, 19 nt, Homo sapiens
ggagagagacacacagauc

SEQ ID NO: 1124889 - RNA, 19 nt, Homo sapiens
uggcuaagauggagaaaca

SEQ ID NO: 1124890 - RNA, 19 nt, Homo sapiens
cgaucuaaaucuauaccua

SEQ ID NO: 1124891 - RNA, 19 nt, Homo sapiens
ugaagacgaugaugacagu

SEQ ID NO: 1124892 - RNA, 19 nt, Homo sapiens
gauuaugacggaauuaaga

SEQ ID NO: 1124893 - RNA, 19 nt, Homo sapiens
gcacagcccuacugaucag

SEQ ID NO: 1124894 - RNA, 19 nt, Homo sapiens
gauuccaaauucagaaaga

SEQ ID NO: 1124895 - RNA, 19 nt, Homo sapiens
uaaucuaagucuuccaaug

SEQ ID NO: 1124896 - RNA, 19 nt, Homo sapiens
caaaugcagaggaagaauu

SEQ ID NO: 1124897 - RNA, 19 nt, Homo sapiens
cagaagacagcaaugauga

SEQ ID NO: 1124898 - RNA, 19 nt, Homo sapiens
acgaggaagugaauauuga

SEQ ID NO: 1124899 - RNA, 19 nt, Homo sapiens
gagagacacacagaucuaa

SEQ ID NO: 1124900 - RNA, 19 nt, Homo sapiens
aggaaacucugacaugaug

SEQ ID NO: 1124901 - RNA, 19 nt, Homo sapiens
ugaaugaagccaauaggaa

SEQ ID NO: 1124902 - RNA, 19 nt, Homo sapiens
cagcaaugaugauauggau

SEQ ID NO: 1124903 - RNA, 19 nt, Homo sapiens
aauauucagugcccaagaa

SEQ ID NO: 1124904 - RNA, 19 nt, Homo sapiens
agaaacagguacuggacuu

SEQ ID NO: 1124905 - RNA, 19 nt, Homo sapiens
uaagauggagaaacaggua

SEQ ID NO: 1124906 - RNA, 19 nt, Homo sapiens
ggagugugauuaagcaaac

SEQ ID NO: 1124907 - RNA, 19 nt, Homo sapiens
acagaucucuuaauucaac

SEQ ID NO: 1124908 - RNA, 19 nt, Homo sapiens
aaucacaacugaccuggau

SEQ ID NO: 1124909 - RNA, 19 nt, Homo sapiens
ugaaggauagugauucuug

SEQ ID NO: 1124910 - RNA, 19 nt, Homo sapiens
ggagugaaggauagugauu

SEQ ID NO: 1124911 - RNA, 19 nt, Homo sapiens
gcaaacaauggacaaaaua

SEQ ID NO: 1124912 - RNA, 19 nt, Homo sapiens
cgagaguuguggaucaaga

SEQ ID NO: 1124913 - RNA, 19 nt, Homo sapiens
aaacaccucuagugacaca

SEQ ID NO: 1124914 - RNA, 19 nt, Homo sapiens
gauaaucuaagucuuccaa

SEQ ID NO: 1124915 - RNA, 19 nt, Homo sapiens
caugaugauuccaaauuca

SEQ ID NO: 1124916 - RNA, 19 nt, Homo sapiens
agauagacuucgagaguug

SEQ ID NO: 1124917 - RNA, 19 nt, Homo sapiens
ugaagccaauaggaaauaa

SEQ ID NO: 1124918 - RNA, 19 nt, Homo sapiens
cacaaugguuggucuguuc

SEQ ID NO: 1124919 - RNA, 19 nt, Homo sapiens
gggcacacagaaccaauaa

SEQ ID NO: 1124920 - RNA, 19 nt, Homo sapiens
gaagaggacgaggucauug

SEQ ID NO: 1124921 - RNA, 19 nt, Homo sapiens
gaaacagguacuggacuuu

SEQ ID NO: 1124922 - RNA, 19 nt, Homo sapiens
gcguuaauguuugcaaaug

SEQ ID NO: 1124923 - RNA, 19 nt, Homo sapiens
gcacacagaaccaauaagc

SEQ ID NO: 1124924 - RNA, 19 nt, Homo sapiens
uaaugucccuccacagauc

SEQ ID NO: 1124925 - RNA, 19 nt, Homo sapiens
cauauugggagugugauua

SEQ ID NO: 1124926 - RNA, 19 nt, Homo sapiens
gcuagaaauaguagacaaa

SEQ ID NO: 1124927 - RNA, 19 nt, Homo sapiens
ccaccacccuagcuggaaa

SEQ ID NO: 1124928 - RNA, 19 nt, Homo sapiens
agaaagagccaugugagaa

SEQ ID NO: 1124929 - RNA, 19 nt, Homo sapiens
cagcacagcccuacugauc

SEQ ID NO: 1124930 - RNA, 19 nt, Homo sapiens
gcaugaaacaagcaaacaa

SEQ ID NO: 1124931 - RNA, 19 nt, Homo sapiens
ucuaaaggcuccugugaac

SEQ ID NO: 1124932 - RNA, 19 nt, Homo sapiens
uaccauggcugcgauuguu

SEQ ID NO: 1124933 - RNA, 19 nt, Homo sapiens
accagcagcuucagaaaga

SEQ ID NO: 1124934 - RNA, 19 nt, Homo sapiens
ggccuucuccuaagugaaa

SEQ ID NO: 1124935 - RNA, 19 nt, Homo sapiens
aaagagccaugugagaaga

SEQ ID NO: 1124936 - RNA, 19 nt, Homo sapiens
caucuacacagucaaauuc

SEQ ID NO: 1124937 - RNA, 19 nt, Homo sapiens
gagaagauuagaaggaaca

SEQ ID NO: 1124938 - RNA, 19 nt, Homo sapiens
gacgaggaagugaauauug

SEQ ID NO: 1124939 - RNA, 19 nt, Homo sapiens
cagccucccugcaguagga

SEQ ID NO: 1124940 - RNA, 19 nt, Homo sapiens
gaagccaauaggaaauaaa

SEQ ID NO: 1124941 - RNA, 19 nt, Homo sapiens
caggaugaaugaagccaau

SEQ ID NO: 1124942 - RNA, 19 nt, Homo sapiens
aaagcugcguuaauguuug

SEQ ID NO: 1124943 - RNA, 19 nt, Homo sapiens
ucagaugcuagaaauagua

SEQ ID NO: 1124944 - RNA, 19 nt, Homo sapiens
gaaaaccucaugauuuaug

SEQ ID NO: 1124945 - RNA, 19 nt, Homo sapiens
ucacaggacgcuaagauag

SEQ ID NO: 1124946 - RNA, 19 nt, Homo sapiens
aaaugaggaugaagacgau

SEQ ID NO: 1124947 - RNA, 19 nt, Homo sapiens
ugaagcuuauucccuauca

SEQ ID NO: 1124948 - RNA, 19 nt, Homo sapiens
gaaauaaagauagcaagcu

SEQ ID NO: 1124949 - RNA, 19 nt, Homo sapiens
cugcagaacuaacagaucu

SEQ ID NO: 1124950 - RNA, 19 nt, Homo sapiens
ccaaauaccagggagugaa

SEQ ID NO: 1124951 - RNA, 19 nt, Homo sapiens
gaacugcucugcauuaauu

SEQ ID NO: 1124952 - RNA, 19 nt, Homo sapiens
gcaaaucauuccuguguuu

SEQ ID NO: 1124953 - RNA, 19 nt, Homo sapiens
ggaaauagcauuaguaaca

SEQ ID NO: 1124954 - RNA, 19 nt, Homo sapiens
caagauagcuucagcagau

SEQ ID NO: 1124955 - RNA, 19 nt, Homo sapiens
gaagcaagauacuuuaaga

SEQ ID NO: 1124956 - RNA, 19 nt, Homo sapiens
gaagcagcauuacuuuaua

SEQ ID NO: 1124957 - RNA, 19 nt, Homo sapiens
gaagggcacugaacuguug

SEQ ID NO: 1124958 - RNA, 19 nt, Homo sapiens
gcaaagaaauagagggaaa

SEQ ID NO: 1124959 - RNA, 19 nt, Homo sapiens
caaagaggguugauuaaau

SEQ ID NO: 1124960 - RNA, 19 nt, Homo sapiens
ggaagaagcaagauacuuu

SEQ ID NO: 1124961 - RNA, 19 nt, Homo sapiens
uaagcaaccucauuucuuu

SEQ ID NO: 1124962 - RNA, 19 nt, Homo sapiens
gcaagauacuuuaagagaa

SEQ ID NO: 1124963 - RNA, 19 nt, Homo sapiens
gcaaccaugugauuacuuu

SEQ ID NO: 1124964 - RNA, 19 nt, Homo sapiens
gaaaguuaguuagcaagua

SEQ ID NO: 1124965 - RNA, 19 nt, Homo sapiens
caaacuugauguaaccuua

SEQ ID NO: 1124966 - RNA, 19 nt, Homo sapiens
gaagaagcaagauacuuua

SEQ ID NO: 1124967 - RNA, 19 nt, Homo sapiens
ucacauaagucaauagaug

SEQ ID NO: 1124968 - RNA, 19 nt, Homo sapiens
ggagugaucugcuuuacau

SEQ ID NO: 1124969 - RNA, 19 nt, Homo sapiens
caaacgcuauuuaugcaua

SEQ ID NO: 1124970 - RNA, 19 nt, Homo sapiens
ggaaauuucuaaagcacaa

SEQ ID NO: 1124971 - RNA, 19 nt, Homo sapiens
ggaagcagcauuacuuuau

SEQ ID NO: 1124972 - RNA, 19 nt, Homo sapiens
uaccagcgcuuuauguuaa

SEQ ID NO: 1124973 - RNA, 19 nt, Homo sapiens
caacugauaugcauucaag

SEQ ID NO: 1124974 - RNA, 19 nt, Homo sapiens
gcaaagaggguugauuaaa

SEQ ID NO: 1124975 - RNA, 19 nt, Homo sapiens
ugaaucaacugcagaucua

SEQ ID NO: 1124976 - RNA, 19 nt, Homo sapiens
gcaaauaaacggaaacauc

SEQ ID NO: 1124977 - RNA, 19 nt, Homo sapiens
aauaggagauacugcaaua

SEQ ID NO: 1124978 - RNA, 19 nt, Homo sapiens
caaugcaggugaagaugua

SEQ ID NO: 1124979 - RNA, 19 nt, Homo sapiens
auacugcucuaguuucuua

SEQ ID NO: 1124980 - RNA, 19 nt, Homo sapiens
caaaggaaauuucuaaagc

SEQ ID NO: 1124981 - RNA, 19 nt, Homo sapiens
caaauaaacggaaacauca

SEQ ID NO: 1124982 - RNA, 19 nt, Homo sapiens
ccaagaaacaaacaagaua

SEQ ID NO: 1124983 - RNA, 19 nt, Homo sapiens
ugacaccacugcauuucua

SEQ ID NO: 1124984 - RNA, 19 nt, Homo sapiens
gcaaguaagauuauaagga

SEQ ID NO: 1124985 - RNA, 19 nt, Homo sapiens
gggcaaacacaaauccuua

SEQ ID NO: 1124986 - RNA, 19 nt, Homo sapiens
gaauggcaaacgcuauuua

SEQ ID NO: 1124987 - RNA, 19 nt, Homo sapiens
caucaugccuugaccucua

SEQ ID NO: 1124988 - RNA, 19 nt, Homo sapiens
gagcaaaucauuccugugu

SEQ ID NO: 1124989 - RNA, 19 nt, Homo sapiens
cacaagaaauagugaggua

SEQ ID NO: 1124990 - RNA, 19 nt, Homo sapiens
aacagaagaucccaaguuu

SEQ ID NO: 1124991 - RNA, 19 nt, Homo sapiens
ugaacuaggcaaagaaaua

SEQ ID NO: 1124992 - RNA, 19 nt, Homo sapiens
guacagugauaagccauuu

SEQ ID NO: 1124993 - RNA, 19 nt, Homo sapiens
ugauguaacugaucuaauc

SEQ ID NO: 1124994 - RNA, 19 nt, Homo sapiens
uaacauagaacagaaguga

SEQ ID NO: 1124995 - RNA, 19 nt, Homo sapiens
uaacagaagaucccaaguu

SEQ ID NO: 1124996 - RNA, 19 nt, Homo sapiens
caaacaauguagcauaaag

SEQ ID NO: 1124997 - RNA, 19 nt, Homo sapiens
gcuauagccuucauaagca

SEQ ID NO: 1124998 - RNA, 19 nt, Homo sapiens
guucuaaguugucaccaaa

SEQ ID NO: 1124999 - RNA, 19 nt, Homo sapiens
guaccagcgcuuuauguua

SEQ ID NO: 1125000 - RNA, 19 nt, Homo sapiens
uggcaaagaggguugauua

SEQ ID NO: 1125001 - RNA, 19 nt, Homo sapiens
cuaauuugguucuaaguug

SEQ ID NO: 1125002 - RNA, 19 nt, Homo sapiens
cuacauuccuuccaguauu

SEQ ID NO: 1125003 - RNA, 19 nt, Homo sapiens
gaaauagcauuaguaacag

SEQ ID NO: 1125004 - RNA, 19 nt, Homo sapiens
ugacuuagcauuugcauca

SEQ ID NO: 1125005 - RNA, 19 nt, Homo sapiens
gaucauaucauugcuacuu

SEQ ID NO: 1125006 - RNA, 19 nt, Homo sapiens
gcaaacacaaauccuuaaa

SEQ ID NO: 1125007 - RNA, 19 nt, Homo sapiens
gaacuaggcaaagaaauag

SEQ ID NO: 1125008 - RNA, 19 nt, Homo sapiens
gcuacaacauagaucauau

SEQ ID NO: 1125009 - RNA, 19 nt, Homo sapiens
cagaagaucccaaguuuua

SEQ ID NO: 1125010 - RNA, 19 nt, Homo sapiens
cagcagaugugauuugucu

SEQ ID NO: 1125011 - RNA, 19 nt, Homo sapiens
cauaaaacccugcaaauaa

SEQ ID NO: 1125012 - RNA, 19 nt, Homo sapiens
ggacugucauguugauauc

SEQ ID NO: 1125013 - RNA, 19 nt, Homo sapiens
uauagaauguggacuguca

SEQ ID NO: 1125014 - RNA, 19 nt, Homo sapiens
cgaguuaccauguauagaa

SEQ ID NO: 1125015 - RNA, 19 nt, Homo sapiens
gaaacaaacaagauagcuu

SEQ ID NO: 1125016 - RNA, 19 nt, Homo sapiens
gaucuaauuugguucuaag

SEQ ID NO: 1125017 - RNA, 19 nt, Homo sapiens
gaauguggacugucauguu

SEQ ID NO: 1125018 - RNA, 19 nt, Homo sapiens
gcuacugguuggcauugua

SEQ ID NO: 1125019 - RNA, 19 nt, Homo sapiens
caaaaucacuaucucagaa

SEQ ID NO: 1125020 - RNA, 19 nt, Homo sapiens
uaaagggagugaucugcuu

SEQ ID NO: 1125021 - RNA, 19 nt, Homo sapiens
ggugaaaguuaguuagcaa

SEQ ID NO: 1125022 - RNA, 19 nt, Homo sapiens
ugaagaaacuguugcuaac

SEQ ID NO: 1125023 - RNA, 19 nt, Homo sapiens
aaucauggaagcagcauua

SEQ ID NO: 1125024 - RNA, 19 nt, Homo sapiens
cugcagaucuaauuugguu

SEQ ID NO: 1125025 - RNA, 19 nt, Homo sapiens
gcauuugcaucauaaacau

SEQ ID NO: 1125026 - RNA, 19 nt, Homo sapiens
gaaguguaaauacucgaua

SEQ ID NO: 1125027 - RNA, 19 nt, Homo sapiens
uaaugcaucucuaucuuca

SEQ ID NO: 1125028 - RNA, 19 nt, Homo sapiens
ccacugcauuucuauuuca

SEQ ID NO: 1125029 - RNA, 19 nt, Homo sapiens
ugucuaggcuggucuugaa

SEQ ID NO: 1125030 - RNA, 19 nt, Homo sapiens
caucaggcaugaacacugu

SEQ ID NO: 1125031 - RNA, 19 nt, Homo sapiens
guugaacugcucugcauua

SEQ ID NO: 1125032 - RNA, 19 nt, Homo sapiens
ggcaaacgcuauuuaugca

SEQ ID NO: 1125033 - RNA, 19 nt, Homo sapiens
augcaucucuaucuucaua

SEQ ID NO: 1125034 - RNA, 19 nt, Homo sapiens
caaauuaaggguguacaaa

SEQ ID NO: 1125035 - RNA, 19 nt, Homo sapiens
ccaaagugcugggauuaca

SEQ ID NO: 1125036 - RNA, 19 nt, Homo sapiens
gaguuaccauguauagaau

SEQ ID NO: 1125037 - RNA, 19 nt, Homo sapiens
cauuguaacucauaggaau

SEQ ID NO: 1125038 - RNA, 19 nt, Homo sapiens
ggagaugucaacuuccaaa

SEQ ID NO: 1125039 - RNA, 19 nt, Homo sapiens
caacugcagaucuaauuug

SEQ ID NO: 1125040 - RNA, 19 nt, Homo sapiens
caccauggcagacgaaauu

SEQ ID NO: 1125041 - RNA, 19 nt, Homo sapiens
cagagcaugauaucuauaa

SEQ ID NO: 1125042 - RNA, 19 nt, Homo sapiens
ugauaucauuguacaguga

SEQ ID NO: 1125043 - RNA, 19 nt, Homo sapiens
aaucacgaguuaccaugua

SEQ ID NO: 1125044 - RNA, 19 nt, Homo sapiens
uuaguacucuguaaugugu

SEQ ID NO: 1125045 - RNA, 19 nt, Homo sapiens
caaaggacgaccaugcaaa

SEQ ID NO: 1125046 - RNA, 19 nt, Homo sapiens
ugcaaugagugaagaauau

SEQ ID NO: 1125047 - RNA, 19 nt, Homo sapiens
gaaguucgugaggaucuua

SEQ ID NO: 1125048 - RNA, 19 nt, Homo sapiens
aauguggacugucauguug

SEQ ID NO: 1125049 - RNA, 19 nt, Homo sapiens
cuacauacugcucuaguuu

SEQ ID NO: 1125050 - RNA, 19 nt, Homo sapiens
cgucuuuccuacaacauuu

SEQ ID NO: 1125051 - RNA, 19 nt, Homo sapiens
gaagcaggcugucuuguaa

SEQ ID NO: 1125052 - RNA, 19 nt, Homo sapiens
caagaaaccaguuguaaua

SEQ ID NO: 1125053 - RNA, 19 nt, Homo sapiens
ucacagagccagcauguua

SEQ ID NO: 1125054 - RNA, 19 nt, Homo sapiens
gcuauggccacuauuauua

SEQ ID NO: 1125055 - RNA, 19 nt, Homo sapiens
ggaagcaggcugucuugua

SEQ ID NO: 1125056 - RNA, 19 nt, Homo sapiens
ucaaggugauucuggauaa

SEQ ID NO: 1125057 - RNA, 19 nt, Homo sapiens
gaacagccucgaugucaaa

SEQ ID NO: 1125058 - RNA, 19 nt, Homo sapiens
uuaaagagcuguguaacau

SEQ ID NO: 1125059 - RNA, 19 nt, Homo sapiens
gcccacagccucagcauuu

SEQ ID NO: 1125060 - RNA, 19 nt, Homo sapiens
gcaagaaaccaguuguaau

SEQ ID NO: 1125061 - RNA, 19 nt, Homo sapiens
ucaacuggaucuacaaugu

SEQ ID NO: 1125062 - RNA, 19 nt, Homo sapiens
ccaagaucaucaucauuga

SEQ ID NO: 1125063 - RNA, 19 nt, Homo sapiens
aaagagcuguguaacauca

SEQ ID NO: 1125064 - RNA, 19 nt, Homo sapiens
gaggagcacugugucaaga

SEQ ID NO: 1125065 - RNA, 19 nt, Homo sapiens
ggaucuggauguuguugaa

SEQ ID NO: 1125066 - RNA, 19 nt, Homo sapiens
gagcaagaaaccaguugua

SEQ ID NO: 1125067 - RNA, 19 nt, Homo sapiens
gccaagaucaucaucauug

SEQ ID NO: 1125068 - RNA, 19 nt, Homo sapiens
gaagucaccgagaagauga

SEQ ID NO: 1125069 - RNA, 19 nt, Homo sapiens
uuucagagcuguggagauu

SEQ ID NO: 1125070 - RNA, 19 nt, Homo sapiens
uuacagcuauggccacuau

SEQ ID NO: 1125071 - RNA, 19 nt, Homo sapiens
cgaggaagcagcuguguga

SEQ ID NO: 1125072 - RNA, 19 nt, Homo sapiens
gcacugcccuacuguuggu

SEQ ID NO: 1125073 - RNA, 19 nt, Homo sapiens
cagcaaagggccucaauuc

SEQ ID NO: 1125074 - RNA, 19 nt, Homo sapiens
cagccuaucucaacuggau

SEQ ID NO: 1125075 - RNA, 19 nt, Homo sapiens
cagcaaacccacuuucaga

SEQ ID NO: 1125076 - RNA, 19 nt, Homo sapiens
gagagacacagcccacuga

SEQ ID NO: 1125077 - RNA, 19 nt, Homo sapiens
ggaaggcugagcuguaaug

SEQ ID NO: 1125078 - RNA, 19 nt, Homo sapiens
ggaagucaccgagaagaug

SEQ ID NO: 1125079 - RNA, 19 nt, Homo sapiens
gaucaucaucauugaauuc

SEQ ID NO: 1125080 - RNA, 19 nt, Homo sapiens
ugacaucgcccucaugaag

SEQ ID NO: 1125081 - RNA, 19 nt, Homo sapiens
gaucacagagccagcaugu

SEQ ID NO: 1125082 - RNA, 19 nt, Homo sapiens
caaggugauucuggauaaa

SEQ ID NO: 1125083 - RNA, 19 nt, Homo sapiens
ccauggagaccuucagaaa

SEQ ID NO: 1125084 - RNA, 19 nt, Homo sapiens
gcaaagggccucaauuccu

SEQ ID NO: 1125085 - RNA, 19 nt, Homo sapiens
cuggaaggcugagcuguaa

SEQ ID NO: 1125086 - RNA, 19 nt, Homo sapiens
ugacuaccguuaccuacug

SEQ ID NO: 1125087 - RNA, 19 nt, Homo sapiens
gaacuuucccacacuacug

SEQ ID NO: 1125088 - RNA, 19 nt, Homo sapiens
ugucugcccuucuuugaug

SEQ ID NO: 1125089 - RNA, 19 nt, Homo sapiens
acagcuauggccacuauua

SEQ ID NO: 1125090 - RNA, 19 nt, Homo sapiens
agacacagcccacugaaca

SEQ ID NO: 1125091 - RNA, 19 nt, Homo sapiens
uaucucaacuggaucuaca

SEQ ID NO: 1125092 - RNA, 19 nt, Homo sapiens
gcagcaaagggccucaauu

SEQ ID NO: 1125093 - RNA, 19 nt, Homo sapiens
ggauguuguugaaaucaca

SEQ ID NO: 1125094 - RNA, 19 nt, Homo sapiens
cuacuguugucauuguuau

SEQ ID NO: 1125095 - RNA, 19 nt, Homo sapiens
gaagucagcagcccuagcu

SEQ ID NO: 1125096 - RNA, 19 nt, Homo sapiens
aggugauucuggauaaaua

SEQ ID NO: 1125097 - RNA, 19 nt, Homo sapiens
uggccacuauuauuaaaga

SEQ ID NO: 1125098 - RNA, 19 nt, Homo sapiens
ugaacagccucgaugucaa

SEQ ID NO: 1125099 - RNA, 19 nt, Homo sapiens
gcaguucccacucacuuuc

SEQ ID NO: 1125100 - RNA, 19 nt, Homo sapiens
ucagagcuguggagauugg

SEQ ID NO: 1125101 - RNA, 19 nt, Homo sapiens
caagaucaucaucauugaa

SEQ ID NO: 1125102 - RNA, 19 nt, Homo sapiens
ggucucagccuaucucaac

SEQ ID NO: 1125103 - RNA, 19 nt, Homo sapiens
cagcauccaguacgacaaa

SEQ ID NO: 1125104 - RNA, 19 nt, Homo sapiens
guuaccuacuguugucauu

SEQ ID NO: 1125105 - RNA, 19 nt, Homo sapiens
cagaauggagggaagaugu

SEQ ID NO: 1125106 - RNA, 19 nt, Homo sapiens
cagacaaacugggcagcuu

SEQ ID NO: 1125107 - RNA, 19 nt, Homo sapiens
gcgggcaggcucagacaaa

SEQ ID NO: 1125108 - RNA, 19 nt, Homo sapiens
uaccuacuguugucauugu

SEQ ID NO: 1125109 - RNA, 19 nt, Homo sapiens
ggaggccucuguggauucu

SEQ ID NO: 1125110 - RNA, 19 nt, Homo sapiens
gauucuggauaaauacuac

SEQ ID NO: 1125111 - RNA, 19 nt, Homo sapiens
cuauggccacuauuauuaa

SEQ ID NO: 1125112 - RNA, 19 nt, Homo sapiens
guaugacuaccguuaccua

SEQ ID NO: 1125113 - RNA, 19 nt, Homo sapiens
uggcgaguaucaucauugu

SEQ ID NO: 1125114 - RNA, 19 nt, Homo sapiens
cagcuauggccacuauuau

SEQ ID NO: 1125115 - RNA, 19 nt, Homo sapiens
ggaucuacaaugucuggaa

SEQ ID NO: 1125116 - RNA, 19 nt, Homo sapiens
aagcugcaguucccacuca

SEQ ID NO: 1125117 - RNA, 19 nt, Homo sapiens
agagcuguguaacaucaaa

SEQ ID NO: 1125118 - RNA, 19 nt, Homo sapiens
ggguauugcuaagccaaga

SEQ ID NO: 1125119 - RNA, 19 nt, Homo sapiens
ccaucugucugcccuucuu

SEQ ID NO: 1125120 - RNA, 19 nt, Homo sapiens
auaccgauguguucaacug

SEQ ID NO: 1125121 - RNA, 19 nt, Homo sapiens
gagcuucgcaugcggaacu

SEQ ID NO: 1125122 - RNA, 19 nt, Homo sapiens
gcagcaaacccacuuucag

SEQ ID NO: 1125123 - RNA, 19 nt, Homo sapiens
ccgauguguucaacuggaa

SEQ ID NO: 1125124 - RNA, 19 nt, Homo sapiens
caagccuacuagagcaaga

SEQ ID NO: 1125125 - RNA, 19 nt, Homo sapiens
cauguggugggcaucguua

SEQ ID NO: 1125126 - RNA, 19 nt, Homo sapiens
gcccacugcuucaggaaac

SEQ ID NO: 1125127 - RNA, 19 nt, Homo sapiens
aaaaugcacugcccuacug

SEQ ID NO: 1125128 - RNA, 19 nt, Homo sapiens
caacuggaucuacaauguc

SEQ ID NO: 1125129 - RNA, 19 nt, Homo sapiens
uggccaagaucaucaucau

SEQ ID NO: 1125130 - RNA, 19 nt, Homo sapiens
ucuggaaggcugagcugua

SEQ ID NO: 1125131 - RNA, 19 nt, Homo sapiens
gaucuggauguuguugaaa

SEQ ID NO: 1125132 - RNA, 19 nt, Homo sapiens
ucaccgagaagaugaugug

SEQ ID NO: 1125133 - RNA, 19 nt, Homo sapiens
gggaagucaccgagaagau

SEQ ID NO: 1125134 - RNA, 19 nt, Homo sapiens
gcagaauggagggaagaug

SEQ ID NO: 1125135 - RNA, 19 nt, Homo sapiens
ccuacuguugucauuguua

SEQ ID NO: 1125136 - RNA, 19 nt, Homo sapiens
ggccaagaucaucaucauu

SEQ ID NO: 1125137 - RNA, 19 nt, Homo sapiens
guuguugaaaucacagaaa

SEQ ID NO: 1125138 - RNA, 19 nt, Homo sapiens
gaugggcuacagcagcaaa

SEQ ID NO: 1125139 - RNA, 19 nt, Homo sapiens
gacagugaucaaccucuga

SEQ ID NO: 1125140 - RNA, 19 nt, Homo sapiens
gagccuggcgaguaucauc

SEQ ID NO: 1125141 - RNA, 19 nt, Homo sapiens
cgucaguccaggucauuga

SEQ ID NO: 1125142 - RNA, 19 nt, Homo sapiens
ucaagugggcccugucucu

SEQ ID NO: 1125143 - RNA, 19 nt, Homo sapiens
cauugugguuguccucauc

SEQ ID NO: 1125144 - RNA, 19 nt, Homo sapiens
uaaagagcuguguaacauc

SEQ ID NO: 1125145 - RNA, 19 nt, Homo sapiens
agcaagaaaccaguuguaa

SEQ ID NO: 1125146 - RNA, 19 nt, Homo sapiens
gacacagcccacugaacaa

SEQ ID NO: 1125147 - RNA, 19 nt, Homo sapiens
aaagucagacacagagcaa

SEQ ID NO: 1125148 - RNA, 19 nt, Homo sapiens
cauggagaccuucagaaag

SEQ ID NO: 1125149 - RNA, 19 nt, Homo sapiens
gcauguggugggcaucguu

SEQ ID NO: 1125150 - RNA, 19 nt, Homo sapiens
cugguucucugccuguuuc

SEQ ID NO: 1125151 - RNA, 19 nt, Homo sapiens
gcaagaaacugccugcuuu

SEQ ID NO: 1125152 - RNA, 19 nt, Homo sapiens
uaaagaacguuucaccaua

SEQ ID NO: 1125153 - RNA, 19 nt, Homo sapiens
gauagagacuugacacaaa

SEQ ID NO: 1125154 - RNA, 19 nt, Homo sapiens
gaaacugccugcuuuacaa

SEQ ID NO: 1125155 - RNA, 19 nt, Homo sapiens
aaagaacguuucaccauaa

SEQ ID NO: 1125156 - RNA, 19 nt, Homo sapiens
guugauauguugagaguuu

SEQ ID NO: 1125157 - RNA, 19 nt, Homo sapiens
caauguauccggugaauuu

SEQ ID NO: 1125158 - RNA, 19 nt, Homo sapiens
ucacauaccaggguuauua

SEQ ID NO: 1125159 - RNA, 19 nt, Homo sapiens
agaaagaaauggauagaga

SEQ ID NO: 1125160 - RNA, 19 nt, Homo sapiens
gaacguuucaccauaauga

SEQ ID NO: 1125161 - RNA, 19 nt, Homo sapiens
uaacaaacaucuucaacuc

SEQ ID NO: 1125162 - RNA, 19 nt, Homo sapiens
caacuauggucuuuauuuc

SEQ ID NO: 1125163 - RNA, 19 nt, Homo sapiens
ugucauugcucuuaucuuu

SEQ ID NO: 1125164 - RNA, 19 nt, Homo sapiens
ggaaaccucucaucgucaa

SEQ ID NO: 1125165 - RNA, 19 nt, Homo sapiens
ucaguaaguuguuauguug

SEQ ID NO: 1125166 - RNA, 19 nt, Homo sapiens
gcucuuaucuuuccugagu

SEQ ID NO: 1125167 - RNA, 19 nt, Homo sapiens
gcaugucuauuguuuguau

SEQ ID NO: 1125168 - RNA, 19 nt, Homo sapiens
agaaauggauagagacuug

SEQ ID NO: 1125169 - RNA, 19 nt, Homo sapiens
gaaagaguacaccuuaaug

SEQ ID NO: 1125170 - RNA, 19 nt, Homo sapiens
ggaaagaguacaccuuaau

SEQ ID NO: 1125171 - RNA, 19 nt, Homo sapiens
gaaaggacagagucauuug

SEQ ID NO: 1125172 - RNA, 19 nt, Homo sapiens
guaauugcuugugugcuua

SEQ ID NO: 1125173 - RNA, 19 nt, Homo sapiens
gggcaugucuauuguuugu

SEQ ID NO: 1125174 - RNA, 19 nt, Homo sapiens
gcuccugacucuuaccuuu

SEQ ID NO: 1125175 - RNA, 19 nt, Homo sapiens
ggacagagucauuugaugu

SEQ ID NO: 1125176 - RNA, 19 nt, Homo sapiens
ucacuuugcuguuguagau

SEQ ID NO: 1125177 - RNA, 19 nt, Homo sapiens
uugaggagguucagaagua

SEQ ID NO: 1125178 - RNA, 19 nt, Homo sapiens
caagaaacugccugcuuua

SEQ ID NO: 1125179 - RNA, 19 nt, Homo sapiens
guaugcaggugauagacua

SEQ ID NO: 1125180 - RNA, 19 nt, Homo sapiens
guauggcuccugacucuua

SEQ ID NO: 1125181 - RNA, 19 nt, Homo sapiens
ccaacuauggucuuuauuu

SEQ ID NO: 1125182 - RNA, 19 nt, Homo sapiens
uggcuuagcuuuaauggau

SEQ ID NO: 1125183 - RNA, 19 nt, Homo sapiens
gguaauaugaugugccuuu

SEQ ID NO: 1125184 - RNA, 19 nt, Homo sapiens
uguagcaauugacagauua

SEQ ID NO: 1125185 - RNA, 19 nt, Homo sapiens
ccauuaaccuccaacuaug

SEQ ID NO: 1125186 - RNA, 19 nt, Homo sapiens
ccucaacugcuauuuauuu

SEQ ID NO: 1125187 - RNA, 19 nt, Homo sapiens
gcgaggauuaguauuauuu

SEQ ID NO: 1125188 - RNA, 19 nt, Homo sapiens
gaauuuggaugguccuucu

SEQ ID NO: 1125189 - RNA, 19 nt, Homo sapiens
gaucugccuugagucauuu

SEQ ID NO: 1125190 - RNA, 19 nt, Homo sapiens
gggcgaggauuaguauuau

SEQ ID NO: 1125191 - RNA, 19 nt, Homo sapiens
gaauaucgaaguccaguuc

SEQ ID NO: 1125192 - RNA, 19 nt, Homo sapiens
gagaguagauaggagugaa

SEQ ID NO: 1125193 - RNA, 19 nt, Homo sapiens
acacauucaccacuaaaua

SEQ ID NO: 1125194 - RNA, 19 nt, Homo sapiens
agauaggagugaagcauuu

SEQ ID NO: 1125195 - RNA, 19 nt, Homo sapiens
gagacuugacacaaauuua

SEQ ID NO: 1125196 - RNA, 19 nt, Homo sapiens
guuuguaucuguaaugugu

SEQ ID NO: 1125197 - RNA, 19 nt, Homo sapiens
agagcaagauuucuguuga

SEQ ID NO: 1125198 - RNA, 19 nt, Homo sapiens
caagaaaauuccagugauu

SEQ ID NO: 1125199 - RNA, 19 nt, Homo sapiens
aagcuuauaucccaccauu

SEQ ID NO: 1125200 - RNA, 19 nt, Homo sapiens
gugauagacuagagaacaa

SEQ ID NO: 1125201 - RNA, 19 nt, Homo sapiens
guucagaaguauaaggaau

SEQ ID NO: 1125202 - RNA, 19 nt, Homo sapiens
ggagagagcaagauuucug

SEQ ID NO: 1125203 - RNA, 19 nt, Homo sapiens
ugggagggaucauuuaguu

SEQ ID NO: 1125204 - RNA, 19 nt, Homo sapiens
gcggucacguguauacuug

SEQ ID NO: 1125205 - RNA, 19 nt, Homo sapiens
gaaagaaaauugggaguag

SEQ ID NO: 1125206 - RNA, 19 nt, Homo sapiens
ccggaaagaguacaccuua

SEQ ID NO: 1125207 - RNA, 19 nt, Homo sapiens
ggacuuugugcuugcauuu

SEQ ID NO: 1125208 - RNA, 19 nt, Homo sapiens
cacaagaucuaaaguucug

SEQ ID NO: 1125209 - RNA, 19 nt, Homo sapiens
uaaaauuccucaacugcua

SEQ ID NO: 1125210 - RNA, 19 nt, Homo sapiens
guagauagccagucaacca

SEQ ID NO: 1125211 - RNA, 19 nt, Homo sapiens
cggaaagaguacaccuuaa

SEQ ID NO: 1125212 - RNA, 19 nt, Homo sapiens
agagcucccugacaaugua

SEQ ID NO: 1125213 - RNA, 19 nt, Homo sapiens
uguaauugcuugugugcuu

SEQ ID NO: 1125214 - RNA, 19 nt, Homo sapiens
caauuuccacugcuucuuu

SEQ ID NO: 1125215 - RNA, 19 nt, Homo sapiens
gagcaagauuucuguugag

SEQ ID NO: 1125216 - RNA, 19 nt, Homo sapiens
uuucuuuccucuucacaua

SEQ ID NO: 1125217 - RNA, 19 nt, Homo sapiens
cuuuguaacugcaagaauu

SEQ ID NO: 1125218 - RNA, 19 nt, Homo sapiens
guuuguaucugcacugugu

SEQ ID NO: 1125219 - RNA, 19 nt, Homo sapiens
aacuguaucuguucaacua

SEQ ID NO: 1125220 - RNA, 19 nt, Homo sapiens
cgaucugccuugagucauu

SEQ ID NO: 1125221 - RNA, 19 nt, Homo sapiens
ccacuaaauacacacuuaa

SEQ ID NO: 1125222 - RNA, 19 nt, Homo sapiens
aaagaguacaccuuaauga

SEQ ID NO: 1125223 - RNA, 19 nt, Homo sapiens
ggaaucgggagaguagaua

SEQ ID NO: 1125224 - RNA, 19 nt, Homo sapiens
cagucaaccagcaguauua

SEQ ID NO: 1125225 - RNA, 19 nt, Homo sapiens
ggauagagacuugacacaa

SEQ ID NO: 1125226 - RNA, 19 nt, Homo sapiens
agacagaaagaaauggaua

SEQ ID NO: 1125227 - RNA, 19 nt, Homo sapiens
gacaauguauccggugaau

SEQ ID NO: 1125228 - RNA, 19 nt, Homo sapiens
gaacuacuccaccagaaac

SEQ ID NO: 1125229 - RNA, 19 nt, Homo sapiens
gaaguccaguucaagaaaa

SEQ ID NO: 1125230 - RNA, 19 nt, Homo sapiens
aaaccuaccacaagaucua

SEQ ID NO: 1125231 - RNA, 19 nt, Homo sapiens
ggaaaccuaccacaagauc

SEQ ID NO: 1125232 - RNA, 19 nt, Homo sapiens
ugggaaaccuaccacaaga

SEQ ID NO: 1125233 - RNA, 19 nt, Homo sapiens
uauacacauucaccacuaa

SEQ ID NO: 1125234 - RNA, 19 nt, Homo sapiens
cagaaaggacagagucauu

SEQ ID NO: 1125235 - RNA, 19 nt, Homo sapiens
gagagcaagauuucuguug

SEQ ID NO: 1125236 - RNA, 19 nt, Homo sapiens
guaauaugaugugccuuuc

SEQ ID NO: 1125237 - RNA, 19 nt, Homo sapiens
uuaacucuccguaagauuu

SEQ ID NO: 1125238 - RNA, 19 nt, Homo sapiens
guaggaaugugaccgaaaa

SEQ ID NO: 1125239 - RNA, 19 nt, Homo sapiens
cgggcgaggauuaguauua

SEQ ID NO: 1125240 - RNA, 19 nt, Homo sapiens
uauguucacuuugcuguug

SEQ ID NO: 1125241 - RNA, 19 nt, Homo sapiens
uuauacacauucaccacua

SEQ ID NO: 1125242 - RNA, 19 nt, Homo sapiens
guauguccauuucaguguu

SEQ ID NO: 1125243 - RNA, 19 nt, Homo sapiens
gcacugugucugucuacaa

SEQ ID NO: 1125244 - RNA, 19 nt, Homo sapiens
uauggcagcuguuuguauc

SEQ ID NO: 1125245 - RNA, 19 nt, Homo sapiens
guuguuauguugcuggaau

SEQ ID NO: 1125246 - RNA, 19 nt, Homo sapiens
gaaacugggagaagccaau

SEQ ID NO: 1125247 - RNA, 19 nt, Homo sapiens
uaaggaaucgggagaguag

SEQ ID NO: 1125248 - RNA, 19 nt, Homo sapiens
cacugugucugucuacaaa

SEQ ID NO: 1125249 - RNA, 19 nt, Homo sapiens
agaaaggacagagucauuu

SEQ ID NO: 1125250 - RNA, 19 nt, Homo sapiens
cgaaguccaguucaagaaa

SEQ ID NO: 1125251 - RNA, 19 nt, Homo sapiens
gaaauuaccugcugaagac

SEQ ID NO: 1125252 - RNA, 19 nt, Homo sapiens
gaauuuaugucuccagcuu

SEQ ID NO: 1125253 - RNA, 19 nt, Homo sapiens
uagcuaaccuaaccacuaa

SEQ ID NO: 1125254 - RNA, 19 nt, Homo sapiens
ggaauguacugaccaagau

SEQ ID NO: 1125255 - RNA, 19 nt, Homo sapiens
ggagaugucugugaagaau

SEQ ID NO: 1125256 - RNA, 19 nt, Homo sapiens
guagggagaugucugugaa

SEQ ID NO: 1125257 - RNA, 19 nt, Homo sapiens
gagauuuacugcgacauuu

SEQ ID NO: 1125258 - RNA, 19 nt, Homo sapiens
agaugucugugaagaauua

SEQ ID NO: 1125259 - RNA, 19 nt, Homo sapiens
ucaacuagauguggaauau

SEQ ID NO: 1125260 - RNA, 19 nt, Homo sapiens
guucuaaacucagcaaaug

SEQ ID NO: 1125261 - RNA, 19 nt, Homo sapiens
gagauuggcaugcagauga

SEQ ID NO: 1125262 - RNA, 19 nt, Homo sapiens
uaagcucaccuaagauaua

SEQ ID NO: 1125263 - RNA, 19 nt, Homo sapiens
gaugagggaugcaauuguc

SEQ ID NO: 1125264 - RNA, 19 nt, Homo sapiens
aaacagacagugcauguga

SEQ ID NO: 1125265 - RNA, 19 nt, Homo sapiens
caagagacaauucuaagga

SEQ ID NO: 1125266 - RNA, 19 nt, Homo sapiens
gcaaugucuuuauuucauc

SEQ ID NO: 1125267 - RNA, 19 nt, Homo sapiens
ggaggagcaugcaacaaca

SEQ ID NO: 1125268 - RNA, 19 nt, Homo sapiens
gagcaugcaacaacaagaa

SEQ ID NO: 1125269 - RNA, 19 nt, Homo sapiens
auuguaagcucaccuaaga

SEQ ID NO: 1125270 - RNA, 19 nt, Homo sapiens
ggagauuuacugcgacauu

SEQ ID NO: 1125271 - RNA, 19 nt, Homo sapiens
gaauguacugaccaagaua

SEQ ID NO: 1125272 - RNA, 19 nt, Homo sapiens
agacaauucuaaggacuuu

SEQ ID NO: 1125273 - RNA, 19 nt, Homo sapiens
gcaacaacaagaaacaaau

SEQ ID NO: 1125274 - RNA, 19 nt, Homo sapiens
uguaagcucaccuaagaua

SEQ ID NO: 1125275 - RNA, 19 nt, Homo sapiens
cgccaacacauuuguauuu

SEQ ID NO: 1125276 - RNA, 19 nt, Homo sapiens
gacacugguucuaaacuca

SEQ ID NO: 1125277 - RNA, 19 nt, Homo sapiens
gacagaaaaugcagaaaau

SEQ ID NO: 1125278 - RNA, 19 nt, Homo sapiens
aacaggcucugacuucuga

SEQ ID NO: 1125279 - RNA, 19 nt, Homo sapiens
cauggucucucaagugcuu

SEQ ID NO: 1125280 - RNA, 19 nt, Homo sapiens
gccaacacauuuguauuuc

SEQ ID NO: 1125281 - RNA, 19 nt, Homo sapiens
gaagacacagccucuacug

SEQ ID NO: 1125282 - RNA, 19 nt, Homo sapiens
uaggaauugugguaucuga

SEQ ID NO: 1125283 - RNA, 19 nt, Homo sapiens
gugagacugugggagauuu

SEQ ID NO: 1125284 - RNA, 19 nt, Homo sapiens
ccugaucaccauagcuuua

SEQ ID NO: 1125285 - RNA, 19 nt, Homo sapiens
gcucugacuucugacauuc

SEQ ID NO: 1125286 - RNA, 19 nt, Homo sapiens
guuaacaggcucugacuuc

SEQ ID NO: 1125287 - RNA, 19 nt, Homo sapiens
caacacauuuguauuuccu

SEQ ID NO: 1125288 - RNA, 19 nt, Homo sapiens
ccacuaaugacgcaagaga

SEQ ID NO: 1125289 - RNA, 19 nt, Homo sapiens
ucacauggucucucaagug

SEQ ID NO: 1125290 - RNA, 19 nt, Homo sapiens
agaaauuaccugcugaaga

SEQ ID NO: 1125291 - RNA, 19 nt, Homo sapiens
caucggccagucugaauuu

SEQ ID NO: 1125292 - RNA, 19 nt, Homo sapiens
ggaauugugguaucugagu

SEQ ID NO: 1125293 - RNA, 19 nt, Homo sapiens
cuucugacauucaacuaga

SEQ ID NO: 1125294 - RNA, 19 nt, Homo sapiens
ccucgaguuuggaauuuau

SEQ ID NO: 1125295 - RNA, 19 nt, Homo sapiens
cgacacugguucuaaacuc

SEQ ID NO: 1125296 - RNA, 19 nt, Homo sapiens
ccaugcaacuucaaaauau

SEQ ID NO: 1125297 - RNA, 19 nt, Homo sapiens
cagccucuacuguacuuua

SEQ ID NO: 1125298 - RNA, 19 nt, Homo sapiens
caagaaauuaccugcugaa

SEQ ID NO: 1125299 - RNA, 19 nt, Homo sapiens
gcaagagacaauucuaagg

SEQ ID NO: 1125300 - RNA, 19 nt, Homo sapiens
uauuuccucuguacuguga

SEQ ID NO: 1125301 - RNA, 19 nt, Homo sapiens
cauggaauguacugaccaa

SEQ ID NO: 1125302 - RNA, 19 nt, Homo sapiens
aaacucagcaaauguucuu

SEQ ID NO: 1125303 - RNA, 19 nt, Homo sapiens
ccacccacauucccacauc

SEQ ID NO: 1125304 - RNA, 19 nt, Homo sapiens
ucucaagugcuuaugcuuu

SEQ ID NO: 1125305 - RNA, 19 nt, Homo sapiens
ggcucugacuucugacauu

SEQ ID NO: 1125306 - RNA, 19 nt, Homo sapiens
gcuaaccuaaccacuaaug

SEQ ID NO: 1125307 - RNA, 19 nt, Homo sapiens
gagacaauucuaaggacuu

SEQ ID NO: 1125308 - RNA, 19 nt, Homo sapiens
agauuuacugcgacauuua

SEQ ID NO: 1125309 - RNA, 19 nt, Homo sapiens
acauuuguauuuccucugu

SEQ ID NO: 1125310 - RNA, 19 nt, Homo sapiens
gggaugagggaugcaauug

SEQ ID NO: 1125311 - RNA, 19 nt, Homo sapiens
ucuaaacucagcaaauguu

SEQ ID NO: 1125312 - RNA, 19 nt, Homo sapiens
uuuagaaccugagauaugg

SEQ ID NO: 1125313 - RNA, 19 nt, Homo sapiens
ggaugagggaugcaauugu

SEQ ID NO: 1125314 - RNA, 19 nt, Homo sapiens
gggagaugucugugaagaa

SEQ ID NO: 1125315 - RNA, 19 nt, Homo sapiens
caccacacccuccugauca

SEQ ID NO: 1125316 - RNA, 19 nt, Homo sapiens
gcucaccuaagauauacuu

SEQ ID NO: 1125317 - RNA, 19 nt, Homo sapiens
guaagcucaccuaagauau

SEQ ID NO: 1125318 - RNA, 19 nt, Homo sapiens
cuccgacacugguucuaaa

SEQ ID NO: 1125319 - RNA, 19 nt, Homo sapiens
uacuuuagaaccugagaua

SEQ ID NO: 1125320 - RNA, 19 nt, Homo sapiens
ccucauucuuaaaggauau

SEQ ID NO: 1125321 - RNA, 19 nt, Homo sapiens
gucauggugauuagaagua

SEQ ID NO: 1125322 - RNA, 19 nt, Homo sapiens
ugagucauggugauuagaa

SEQ ID NO: 1125323 - RNA, 19 nt, Homo sapiens
ucuaaggacuuucaaaaca

SEQ ID NO: 1125324 - RNA, 19 nt, Homo sapiens
gaauuauaacugguacaga

SEQ ID NO: 1125325 - RNA, 19 nt, Homo sapiens
gauuuacugcgacauuuag

SEQ ID NO: 1125326 - RNA, 19 nt, Homo sapiens
ugagacugugggagauuua

SEQ ID NO: 1125327 - RNA, 19 nt, Homo sapiens
gggaagacacagccucuac

SEQ ID NO: 1125328 - RNA, 19 nt, Homo sapiens
gagaugucugugaagaauu

SEQ ID NO: 1125329 - RNA, 19 nt, Homo sapiens
acgcaagagacaauucuaa

SEQ ID NO: 1125330 - RNA, 19 nt, Homo sapiens
gauccucagcccacucuca

SEQ ID NO: 1125331 - RNA, 19 nt, Homo sapiens
ggaagacacagccucuacu

SEQ ID NO: 1125332 - RNA, 19 nt, Homo sapiens
gaggagcaugcaacaacaa

SEQ ID NO: 1125333 - RNA, 19 nt, Homo sapiens
gacaucggccagucugaau

SEQ ID NO: 1125334 - RNA, 19 nt, Homo sapiens
uuugaaauuccuccucuaa

SEQ ID NO: 1125335 - RNA, 19 nt, Homo sapiens
uaaacaaggagacagaaaa

SEQ ID NO: 1125336 - RNA, 19 nt, Homo sapiens
ugccauuucuugaccacuu

SEQ ID NO: 1125337 - RNA, 19 nt, Homo sapiens
ugaccaagauaaaaugugu

SEQ ID NO: 1125338 - RNA, 19 nt, Homo sapiens
guacugaccaagauaaaau

SEQ ID NO: 1125339 - RNA, 19 nt, Homo sapiens
uggaauguacugaccaaga

SEQ ID NO: 1125340 - RNA, 19 nt, Homo sapiens
ggagcaugcaacaacaaga

SEQ ID NO: 1125341 - RNA, 19 nt, Homo sapiens
ccucagcccacucucagaa

SEQ ID NO: 1125342 - RNA, 19 nt, Homo sapiens
cuuuagaaccugagauaug

SEQ ID NO: 1125343 - RNA, 19 nt, Homo sapiens
cuacuguacuuuagaaccu

SEQ ID NO: 1125344 - RNA, 19 nt, Homo sapiens
ugacaucggccagucugaa

SEQ ID NO: 1125345 - RNA, 19 nt, Homo sapiens
uucaugcuauuggcuauuu

SEQ ID NO: 1125346 - RNA, 19 nt, Homo sapiens
gagucauggugauuagaag

SEQ ID NO: 1125347 - RNA, 19 nt, Homo sapiens
uaacaggcucugacuucug

SEQ ID NO: 1125348 - RNA, 19 nt, Homo sapiens
uaaugacgcaagagacaau

SEQ ID NO: 1125349 - RNA, 19 nt, Homo sapiens
ugguacagauuuuguguuu

SEQ ID NO: 1125350 - RNA, 19 nt, Homo sapiens
agggagaugucugugaaga

SEQ ID NO: 1125351 - RNA, 19 nt, Homo sapiens
gacaauaacugccauguga

SEQ ID NO: 1125352 - RNA, 19 nt, Homo sapiens
guagauaaguggucugaaa

SEQ ID NO: 1125353 - RNA, 19 nt, Homo sapiens
gaaaugagccugauaggau

SEQ ID NO: 1125354 - RNA, 19 nt, Homo sapiens
gugcagagcuggucacuga

SEQ ID NO: 1125355 - RNA, 19 nt, Homo sapiens
ucaagaagaucaaggauga

SEQ ID NO: 1125356 - RNA, 19 nt, Homo sapiens
gaaagaggaugaugacaag

SEQ ID NO: 1125357 - RNA, 19 nt, Homo sapiens
ggaaugagcaggucagauu

SEQ ID NO: 1125358 - RNA, 19 nt, Homo sapiens
aagaucaacuggacaaaua

SEQ ID NO: 1125359 - RNA, 19 nt, Homo sapiens
gaacggaggcuucaaucuu

SEQ ID NO: 1125360 - RNA, 19 nt, Homo sapiens
gauacaauguuuggccuua

SEQ ID NO: 1125361 - RNA, 19 nt, Homo sapiens
ucacugggcugaccgcuuu

SEQ ID NO: 1125362 - RNA, 19 nt, Homo sapiens
uaggagaacugucaaaugu

SEQ ID NO: 1125363 - RNA, 19 nt, Homo sapiens
gagcagguuuccauaguga

SEQ ID NO: 1125364 - RNA, 19 nt, Homo sapiens
gaucgcagcucaagacuac

SEQ ID NO: 1125365 - RNA, 19 nt, Homo sapiens
ggaaagaggaugaugacaa

SEQ ID NO: 1125366 - RNA, 19 nt, Homo sapiens
caucaggacuguaauagau

SEQ ID NO: 1125367 - RNA, 19 nt, Homo sapiens
ggagugagcuacgaggaaa

SEQ ID NO: 1125368 - RNA, 19 nt, Homo sapiens
gcaagcaaugaacaaauua

SEQ ID NO: 1125369 - RNA, 19 nt, Homo sapiens
caaagcaucaggacuguaa

SEQ ID NO: 1125370 - RNA, 19 nt, Homo sapiens
ggaaagacgacauucauca

SEQ ID NO: 1125371 - RNA, 19 nt, Homo sapiens
gaagggagcugggaagacu

SEQ ID NO: 1125372 - RNA, 19 nt, Homo sapiens
gaucagcaaugugagacua

SEQ ID NO: 1125373 - RNA, 19 nt, Homo sapiens
acaaguccaucguaucuuu

SEQ ID NO: 1125374 - RNA, 19 nt, Homo sapiens
aaaugagccugauaggaua

SEQ ID NO: 1125375 - RNA, 19 nt, Homo sapiens
uagcaaggcaccagaauuu

SEQ ID NO: 1125376 - RNA, 19 nt, Homo sapiens
uuaccaagguuacagauga

SEQ ID NO: 1125377 - RNA, 19 nt, Homo sapiens
gagguggcauguacuagaa

SEQ ID NO: 1125378 - RNA, 19 nt, Homo sapiens
gcaaggcaccagaauuuga

SEQ ID NO: 1125379 - RNA, 19 nt, Homo sapiens
gcuuagcccugcaauauca

SEQ ID NO: 1125380 - RNA, 19 nt, Homo sapiens
gcagacuacugagaaacua

SEQ ID NO: 1125381 - RNA, 19 nt, Homo sapiens
aggauaggcuggagcauaa

SEQ ID NO: 1125382 - RNA, 19 nt, Homo sapiens
gaucuggaaccgagcaaua

SEQ ID NO: 1125383 - RNA, 19 nt, Homo sapiens
guacuagaauuggauccua

SEQ ID NO: 1125384 - RNA, 19 nt, Homo sapiens
gcacaaguccaucguaucu

SEQ ID NO: 1125385 - RNA, 19 nt, Homo sapiens
gaagagacaagcaagcaau

SEQ ID NO: 1125386 - RNA, 19 nt, Homo sapiens
cgacauucaucagugagua

SEQ ID NO: 1125387 - RNA, 19 nt, Homo sapiens
aacggaggcuucaaucuuu

SEQ ID NO: 1125388 - RNA, 19 nt, Homo sapiens
gaaccgcuuugauggagau

SEQ ID NO: 1125389 - RNA, 19 nt, Homo sapiens
ccuagacacugaugccauu

SEQ ID NO: 1125390 - RNA, 19 nt, Homo sapiens
caaauuagcagaaaaccua

SEQ ID NO: 1125391 - RNA, 19 nt, Homo sapiens
ccaggaagcagacaauguu

SEQ ID NO: 1125392 - RNA, 19 nt, Homo sapiens
gcuucaaucuuucucguau

SEQ ID NO: 1125393 - RNA, 19 nt, Homo sapiens
gugcuuagcccugcaauau

SEQ ID NO: 1125394 - RNA, 19 nt, Homo sapiens
cugagaaacuacuguguug

SEQ ID NO: 1125395 - RNA, 19 nt, Homo sapiens
gcagagcuggucacugaaa

SEQ ID NO: 1125396 - RNA, 19 nt, Homo sapiens
gaagaucaacuggacaaau

SEQ ID NO: 1125397 - RNA, 19 nt, Homo sapiens
ccaaguuguuugcacgaaa

SEQ ID NO: 1125398 - RNA, 19 nt, Homo sapiens
ggaagccgccaaguuguuu

SEQ ID NO: 1125399 - RNA, 19 nt, Homo sapiens
uguuugagguccuguauau

SEQ ID NO: 1125400 - RNA, 19 nt, Homo sapiens
cuacgucuaugacauuugu

SEQ ID NO: 1125401 - RNA, 19 nt, Homo sapiens
gagacaagcaagcaaugaa

SEQ ID NO: 1125402 - RNA, 19 nt, Homo sapiens
ucugggagcugccugauca

SEQ ID NO: 1125403 - RNA, 19 nt, Homo sapiens
gugaguaugcccuggauuu

SEQ ID NO: 1125404 - RNA, 19 nt, Homo sapiens
ccgcuuugauggagaugua

SEQ ID NO: 1125405 - RNA, 19 nt, Homo sapiens
agacgacauucaucaguga

SEQ ID NO: 1125406 - RNA, 19 nt, Homo sapiens
ucauagagccauagaagga

SEQ ID NO: 1125407 - RNA, 19 nt, Homo sapiens
gguggcauguacuagaauu

SEQ ID NO: 1125408 - RNA, 19 nt, Homo sapiens
ggagagagccacgugaaca

SEQ ID NO: 1125409 - RNA, 19 nt, Homo sapiens
agcaagcaaugaacaaauu

SEQ ID NO: 1125410 - RNA, 19 nt, Homo sapiens
gagcuggucacugaaauga

SEQ ID NO: 1125411 - RNA, 19 nt, Homo sapiens
ggucauagagccauagaag

SEQ ID NO: 1125412 - RNA, 19 nt, Homo sapiens
gaaguuugcaacagacaau

SEQ ID NO: 1125413 - RNA, 19 nt, Homo sapiens
agaccucaaucguaucuug

SEQ ID NO: 1125414 - RNA, 19 nt, Homo sapiens
ggacccaggcagagagaaa

SEQ ID NO: 1125415 - RNA, 19 nt, Homo sapiens
ucccuuaccuggaacaguu

SEQ ID NO: 1125416 - RNA, 19 nt, Homo sapiens
gcaguggaaagacgacauu

SEQ ID NO: 1125417 - RNA, 19 nt, Homo sapiens
uagagcagguuuccauagu

SEQ ID NO: 1125418 - RNA, 19 nt, Homo sapiens
caagaaccgcuuugaugga

SEQ ID NO: 1125419 - RNA, 19 nt, Homo sapiens
uuccagaccucaaucguau

SEQ ID NO: 1125420 - RNA, 19 nt, Homo sapiens
gcuggcugauacaauguuu

SEQ ID NO: 1125421 - RNA, 19 nt, Homo sapiens
ggaagagacaagcaagcaa

SEQ ID NO: 1125422 - RNA, 19 nt, Homo sapiens
gaaagacgacauucaucag

SEQ ID NO: 1125423 - RNA, 19 nt, Homo sapiens
caagcaagcaaugaacaaa

SEQ ID NO: 1125424 - RNA, 19 nt, Homo sapiens
gaucaacuggacaaauaug

SEQ ID NO: 1125425 - RNA, 19 nt, Homo sapiens
ggagucaggacauuuuaua

SEQ ID NO: 1125426 - RNA, 19 nt, Homo sapiens
aaauagaaaugcgauagag

SEQ ID NO: 1125427 - RNA, 19 nt, Homo sapiens
ugaagcuccuagaggcuaa

SEQ ID NO: 1125428 - RNA, 19 nt, Homo sapiens
uaggauaggcuggagcaua

SEQ ID NO: 1125429 - RNA, 19 nt, Homo sapiens
gaagaucaaggaugacacu

SEQ ID NO: 1125430 - RNA, 19 nt, Homo sapiens
agaggaugaugacaaggaa

SEQ ID NO: 1125431 - RNA, 19 nt, Homo sapiens
gcaucaggacuguaauaga

SEQ ID NO: 1125432 - RNA, 19 nt, Homo sapiens
caacuggacaaauaugauc

SEQ ID NO: 1125433 - RNA, 19 nt, Homo sapiens
uggcacaaguccaucguau

SEQ ID NO: 1125434 - RNA, 19 nt, Homo sapiens
caaucuuucucguauucuu

SEQ ID NO: 1125435 - RNA, 19 nt, Homo sapiens
aaagcccucuucuggcaaa

SEQ ID NO: 1125436 - RNA, 19 nt, Homo sapiens
gggaagccgccaaguuguu

SEQ ID NO: 1125437 - RNA, 19 nt, Homo sapiens
gcagguuuccauagugaga

SEQ ID NO: 1125438 - RNA, 19 nt, Homo sapiens
ccgaggaacgaccugcuua

SEQ ID NO: 1125439 - RNA, 19 nt, Homo sapiens
cuccaagcguucaaaguga

SEQ ID NO: 1125440 - RNA, 19 nt, Homo sapiens
aagcaucaggacuguaaua

SEQ ID NO: 1125441 - RNA, 19 nt, Homo sapiens
gcuucgagaucagcaaugu

SEQ ID NO: 1125442 - RNA, 19 nt, Homo sapiens
ucgagaugcugagguggua

SEQ ID NO: 1125443 - RNA, 19 nt, Homo sapiens
gaggagguccggaggaucu

SEQ ID NO: 1125444 - RNA, 19 nt, Homo sapiens
agacacugaugccauugug

SEQ ID NO: 1125445 - RNA, 19 nt, Homo sapiens
ucacugaaaugagccugau

SEQ ID NO: 1125446 - RNA, 19 nt, Homo sapiens
uccaagaaccgcuuugaug

SEQ ID NO: 1125447 - RNA, 19 nt, Homo sapiens
gcaaagcaucaggacugua

SEQ ID NO: 1125448 - RNA, 19 nt, Homo sapiens
ggaggaggugcuaggagaa

SEQ ID NO: 1125449 - RNA, 19 nt, Homo sapiens
gagagagccacgugaacau

SEQ ID NO: 1125450 - RNA, 19 nt, Homo sapiens
gcaggcuaguguagauaag

SEQ ID NO: 1125451 - RNA, 19 nt, Homo sapiens
gcgcggagauguaccacua

SEQ ID NO: 1125452 - RNA, 19 nt, Homo sapiens
gccuggagcuucccacuaa

SEQ ID NO: 1125453 - RNA, 19 nt, Homo sapiens
gcacagagcgcggagaugu

SEQ ID NO: 1125454 - RNA, 19 nt, Homo sapiens
gaacggguggguaauucua

SEQ ID NO: 1125455 - RNA, 19 nt, Homo sapiens
gaaugaggacggagacuuc

SEQ ID NO: 1125456 - RNA, 19 nt, Homo sapiens
ccaauuaaaguccauuuca

SEQ ID NO: 1125457 - RNA, 19 nt, Homo sapiens
ggguaauucuagagacaaa

SEQ ID NO: 1125458 - RNA, 19 nt, Homo sapiens
gcccgugccuuuccucuuc

SEQ ID NO: 1125459 - RNA, 19 nt, Homo sapiens
auaaagagccacccaagga

SEQ ID NO: 1125460 - RNA, 19 nt, Homo sapiens
caauuaaaguccauuucag

SEQ ID NO: 1125461 - RNA, 19 nt, Homo sapiens
gcaccaacggcaacagaug

SEQ ID NO: 1125462 - RNA, 19 nt, Homo sapiens
gacaaaagccaauuaaagu

SEQ ID NO: 1125463 - RNA, 19 nt, Homo sapiens
ugacucagaaggccgacua

SEQ ID NO: 1125464 - RNA, 19 nt, Homo sapiens
guggguaauucuagagaca

SEQ ID NO: 1125465 - RNA, 19 nt, Homo sapiens
caccucuccuguucgguuu

SEQ ID NO: 1125466 - RNA, 19 nt, Homo sapiens
gccuggagcggcauaaaga

SEQ ID NO: 1125467 - RNA, 19 nt, Homo sapiens
acggagacuucacggugua

SEQ ID NO: 1125468 - RNA, 19 nt, Homo sapiens
gaccaacggcuggcacaga

SEQ ID NO: 1125469 - RNA, 19 nt, Homo sapiens
cagacuggaagaugagauu

SEQ ID NO: 1125470 - RNA, 19 nt, Homo sapiens
aagaugagauugacuuccu

SEQ ID NO: 1125471 - RNA, 19 nt, Homo sapiens
gacuggaagaugagauuga

SEQ ID NO: 1125472 - RNA, 19 nt, Homo sapiens
caggaacggguggguaauu

SEQ ID NO: 1125473 - RNA, 19 nt, Homo sapiens
aggaacggguggguaauuc

SEQ ID NO: 1125474 - RNA, 19 nt, Homo sapiens
cgcaggaacggguggguaa

SEQ ID NO: 1125475 - RNA, 19 nt, Homo sapiens
gggcauggagaaccguaga

SEQ ID NO: 1125476 - RNA, 19 nt, Homo sapiens
cacagagcgcggagaugua

SEQ ID NO: 1125477 - RNA, 19 nt, Homo sapiens
cagcaccaacggcaacaga

SEQ ID NO: 1125478 - RNA, 19 nt, Homo sapiens
uggaagaugagauugacuu

SEQ ID NO: 1125479 - RNA, 19 nt, Homo sapiens
ggaagguacuuuagauuga

SEQ ID NO: 1125480 - RNA, 19 nt, Homo sapiens
agacuuggauaaugcaaua

SEQ ID NO: 1125481 - RNA, 19 nt, Homo sapiens
ggagagacuuggauaaugc

SEQ ID NO: 1125482 - RNA, 19 nt, Homo sapiens
uagaagcuguggaugaauu

SEQ ID NO: 1125483 - RNA, 19 nt, Homo sapiens
caauagaagcuguggauga

SEQ ID NO: 1125484 - RNA, 19 nt, Homo sapiens
aauagaagcuguggaugaa

SEQ ID NO: 1125485 - RNA, 19 nt, Homo sapiens
gaggagagacuuggauaau

SEQ ID NO: 1125486 - RNA, 19 nt, Homo sapiens
caaaagaugccuacuguug

SEQ ID NO: 1125487 - RNA, 19 nt, Homo sapiens
cagaggagagacuuggaua

SEQ ID NO: 1125488 - RNA, 19 nt, Homo sapiens
ugaauuugcuuuucuggaa

SEQ ID NO: 1125489 - RNA, 19 nt, Homo sapiens
ucuggaagguacuuuagau

SEQ ID NO: 1125490 - RNA, 19 nt, Homo sapiens
gagugaaggccuuggugaa

SEQ ID NO: 1125491 - RNA, 19 nt, Homo sapiens
uggaagguacuuuagauug

SEQ ID NO: 1125492 - RNA, 19 nt, Homo sapiens
aggagagacuuggauaaug

SEQ ID NO: 1125493 - RNA, 19 nt, Homo sapiens
gacgcuagcgggacaggaa

SEQ ID NO: 1125494 - RNA, 19 nt, Homo sapiens
agaggagagacuuggauaa

SEQ ID NO: 1125495 - RNA, 19 nt, Homo sapiens
cuuggauaaugcaauagaa

SEQ ID NO: 1125496 - RNA, 19 nt, Homo sapiens
ggagaccauugcaaaagau

SEQ ID NO: 1125497 - RNA, 19 nt, Homo sapiens
gcauggaggugacgaaugu

SEQ ID NO: 1125498 - RNA, 19 nt, Homo sapiens
gcagauggcacucuccuuu

SEQ ID NO: 1125499 - RNA, 19 nt, Homo sapiens
guucaucucuuucuccuau

SEQ ID NO: 1125500 - RNA, 19 nt, Homo sapiens
ggagacugcugagaccaaa

SEQ ID NO: 1125501 - RNA, 19 nt, Homo sapiens
gauucuggcuguucuaaag

SEQ ID NO: 1125502 - RNA, 19 nt, Homo sapiens
caauucagcugcccuucug

SEQ ID NO: 1125503 - RNA, 19 nt, Homo sapiens
gugcugacauuuccaucaa

SEQ ID NO: 1125504 - RNA, 19 nt, Homo sapiens
ccaaaaggcuucacucagu

SEQ ID NO: 1125505 - RNA, 19 nt, Homo sapiens
cuggacaucugcuucacua

SEQ ID NO: 1125506 - RNA, 19 nt, Homo sapiens
ggaaaccaucuccuucuca

SEQ ID NO: 1125507 - RNA, 19 nt, Homo sapiens
ugagcaugauggcauuuga

SEQ ID NO: 1125508 - RNA, 19 nt, Homo sapiens
uacgggaccuuauucuuca

SEQ ID NO: 1125509 - RNA, 19 nt, Homo sapiens
cuacgggaccuuauucuuc

SEQ ID NO: 1125510 - RNA, 19 nt, Homo sapiens
gaaugugaucuuccuagga

SEQ ID NO: 1125511 - RNA, 19 nt, Homo sapiens
gagauucuggcuguucuaa

SEQ ID NO: 1125512 - RNA, 19 nt, Homo sapiens
gcccauguacuucuuccua

SEQ ID NO: 1125513 - RNA, 19 nt, Homo sapiens
ggaagccuaagucuaagga

SEQ ID NO: 1125514 - RNA, 19 nt, Homo sapiens
ucuauagccugaggaacaa

SEQ ID NO: 1125515 - RNA, 19 nt, Homo sapiens
gcacacgcccauguacuuc

SEQ ID NO: 1125516 - RNA, 19 nt, Homo sapiens
gcaauucagcugcccuucu

SEQ ID NO: 1125517 - RNA, 19 nt, Homo sapiens
gagcagacaaagaggaucu

SEQ ID NO: 1125518 - RNA, 19 nt, Homo sapiens
ugacgaaugugaucuuccu

SEQ ID NO: 1125519 - RNA, 19 nt, Homo sapiens
ggugacgaaugugaucuuc

SEQ ID NO: 1125520 - RNA, 19 nt, Homo sapiens
ucaaugugaucagcaugga

SEQ ID NO: 1125521 - RNA, 19 nt, Homo sapiens
gaugugaaggcugcuguga

SEQ ID NO: 1125522 - RNA, 19 nt, Homo sapiens
agaggaucuuucagacaaa

SEQ ID NO: 1125523 - RNA, 19 nt, Homo sapiens
caugggagcagacaaagag

SEQ ID NO: 1125524 - RNA, 19 nt, Homo sapiens
uccuaugucuucaucauca

SEQ ID NO: 1125525 - RNA, 19 nt, Homo sapiens
ggaggugacgaaugugauc

SEQ ID NO: 1125526 - RNA, 19 nt, Homo sapiens
guuggccugugcugacauu

SEQ ID NO: 1125527 - RNA, 19 nt, Homo sapiens
acacgcccauguacuucuu

SEQ ID NO: 1125528 - RNA, 19 nt, Homo sapiens
gagcaugauggcauuugau

SEQ ID NO: 1125529 - RNA, 19 nt, Homo sapiens
gaggaacaaggaugugaag

SEQ ID NO: 1125530 - RNA, 19 nt, Homo sapiens
gaggaucuuucagacaaac

SEQ ID NO: 1125531 - RNA, 19 nt, Homo sapiens
gcugauguaccucgugauc

SEQ ID NO: 1125532 - RNA, 19 nt, Homo sapiens
cagauggcacucuccuuug

SEQ ID NO: 1125533 - RNA, 19 nt, Homo sapiens
gacaucugcuucacuaccu

SEQ ID NO: 1125534 - RNA, 19 nt, Homo sapiens
gguacuccgugaucaugag

SEQ ID NO: 1125535 - RNA, 19 nt, Homo sapiens
gugagauucuggcuguucu

SEQ ID NO: 1125536 - RNA, 19 nt, Homo sapiens
gggaccuuauucuucaugu

SEQ ID NO: 1125537 - RNA, 19 nt, Homo sapiens
ucaucucuuucuccuaugu

SEQ ID NO: 1125538 - RNA, 19 nt, Homo sapiens
ugaggaacaaggaugugaa

SEQ ID NO: 1125539 - RNA, 19 nt, Homo sapiens
gggagcagacaaagaggau

SEQ ID NO: 1125540 - RNA, 19 nt, Homo sapiens
cgucuucuacgggaccuua

SEQ ID NO: 1125541 - RNA, 19 nt, Homo sapiens
gaaggaaccugucaucauu

SEQ ID NO: 1125542 - RNA, 19 nt, Homo sapiens
gaaaagaacuucagcaauu

SEQ ID NO: 1125543 - RNA, 19 nt, Homo sapiens
gaacagugguagaaacaaa

SEQ ID NO: 1125544 - RNA, 19 nt, Homo sapiens
ggaagagggugguauauag

SEQ ID NO: 1125545 - RNA, 19 nt, Homo sapiens
gaacagauuccuagagauu

SEQ ID NO: 1125546 - RNA, 19 nt, Homo sapiens
gaagaaugcugcaccacuu

SEQ ID NO: 1125547 - RNA, 19 nt, Homo sapiens
gaaaucaacagaugugaaa

SEQ ID NO: 1125548 - RNA, 19 nt, Homo sapiens
caaauugucagccuucuua

SEQ ID NO: 1125549 - RNA, 19 nt, Homo sapiens
caagacacaucuauccuuu

SEQ ID NO: 1125550 - RNA, 19 nt, Homo sapiens
cagcagaguuggcuuauug

SEQ ID NO: 1125551 - RNA, 19 nt, Homo sapiens
ggagaaguaugcugagcua

SEQ ID NO: 1125552 - RNA, 19 nt, Homo sapiens
gagaagaaucugcaguuua

SEQ ID NO: 1125553 - RNA, 19 nt, Homo sapiens
gaaaggagagucagguauu

SEQ ID NO: 1125554 - RNA, 19 nt, Homo sapiens
gaagagauccugcaagaca

SEQ ID NO: 1125555 - RNA, 19 nt, Homo sapiens
gaagugggcuaaaggaaca

SEQ ID NO: 1125556 - RNA, 19 nt, Homo sapiens
caauuuggauuaucugcua

SEQ ID NO: 1125557 - RNA, 19 nt, Homo sapiens
acaaagcccuggccuuaaa

SEQ ID NO: 1125558 - RNA, 19 nt, Homo sapiens
ggacacgcaucccuuccua

SEQ ID NO: 1125559 - RNA, 19 nt, Homo sapiens
gaauauuccuagaaaguuc

SEQ ID NO: 1125560 - RNA, 19 nt, Homo sapiens
ggaaagagaaggguauuug

SEQ ID NO: 1125561 - RNA, 19 nt, Homo sapiens
aaaggagagucagguauua

SEQ ID NO: 1125562 - RNA, 19 nt, Homo sapiens
ggagggagguuucuuuggu

SEQ ID NO: 1125563 - RNA, 19 nt, Homo sapiens
gggcagagauuggacauca

SEQ ID NO: 1125564 - RNA, 19 nt, Homo sapiens
gauccguccuggugccuua

SEQ ID NO: 1125565 - RNA, 19 nt, Homo sapiens
cggguaaucuucacagaaa

SEQ ID NO: 1125566 - RNA, 19 nt, Homo sapiens
agagaaggguauuuguaua

SEQ ID NO: 1125567 - RNA, 19 nt, Homo sapiens
agaagaaucugcaguuuac

SEQ ID NO: 1125568 - RNA, 19 nt, Homo sapiens
caacuuauaggguacauau

SEQ ID NO: 1125569 - RNA, 19 nt, Homo sapiens
uggaagagauccugcaaga

SEQ ID NO: 1125570 - RNA, 19 nt, Homo sapiens
ucucaugggucuagauauu

SEQ ID NO: 1125571 - RNA, 19 nt, Homo sapiens
gggcacaacuucugcaaag

SEQ ID NO: 1125572 - RNA, 19 nt, Homo sapiens
caagauacuuugguugguu

SEQ ID NO: 1125573 - RNA, 19 nt, Homo sapiens
cgacaguacuuugcccuaa

SEQ ID NO: 1125574 - RNA, 19 nt, Homo sapiens
gaaaugacugagagaagaa

SEQ ID NO: 1125575 - RNA, 19 nt, Homo sapiens
agacacaucuauccuuuca

SEQ ID NO: 1125576 - RNA, 19 nt, Homo sapiens
ccauagagcuggaaaagaa

SEQ ID NO: 1125577 - RNA, 19 nt, Homo sapiens
gagagaagaaucugcaguu

SEQ ID NO: 1125578 - RNA, 19 nt, Homo sapiens
agaaaugacugagagaaga

SEQ ID NO: 1125579 - RNA, 19 nt, Homo sapiens
ccagauaggcaacuucauu

SEQ ID NO: 1125580 - RNA, 19 nt, Homo sapiens
auacaaagcccuggccuua

SEQ ID NO: 1125581 - RNA, 19 nt, Homo sapiens
gaaguaugcugagcuagag

SEQ ID NO: 1125582 - RNA, 19 nt, Homo sapiens
gagauugucccugaaguuu

SEQ ID NO: 1125583 - RNA, 19 nt, Homo sapiens
gaaagagaaggguauuugu

SEQ ID NO: 1125584 - RNA, 19 nt, Homo sapiens
acagauuccuagagauuaa

SEQ ID NO: 1125585 - RNA, 19 nt, Homo sapiens
ucacagaccgcucucauau

SEQ ID NO: 1125586 - RNA, 19 nt, Homo sapiens
aaagagaaggguauuugua

SEQ ID NO: 1125587 - RNA, 19 nt, Homo sapiens
gccacgacguuuccucuuu

SEQ ID NO: 1125588 - RNA, 19 nt, Homo sapiens
guacuuugcccuaaggaaa

SEQ ID NO: 1125589 - RNA, 19 nt, Homo sapiens
gagaaagcagaguuaaauu

SEQ ID NO: 1125590 - RNA, 19 nt, Homo sapiens
aagcuucucuuucuaacaa

SEQ ID NO: 1125591 - RNA, 19 nt, Homo sapiens
gguauuagaggaaagagaa

SEQ ID NO: 1125592 - RNA, 19 nt, Homo sapiens
ggaggugacuucaguaucc

SEQ ID NO: 1125593 - RNA, 19 nt, Homo sapiens
guuagaaacguaugucaaa

SEQ ID NO: 1125594 - RNA, 19 nt, Homo sapiens
aagauacuuugguugguua

SEQ ID NO: 1125595 - RNA, 19 nt, Homo sapiens
gcccuggccuuaaagaaug

SEQ ID NO: 1125596 - RNA, 19 nt, Homo sapiens
cuuauugccugccucuaua

SEQ ID NO: 1125597 - RNA, 19 nt, Homo sapiens
gaaaauccuuaaacagcua

SEQ ID NO: 1125598 - RNA, 19 nt, Homo sapiens
gcaagacacaucuauccuu

SEQ ID NO: 1125599 - RNA, 19 nt, Homo sapiens
gaggcagggucaagugcua

SEQ ID NO: 1125600 - RNA, 19 nt, Homo sapiens
gauacagugucuggaacua

SEQ ID NO: 1125601 - RNA, 19 nt, Homo sapiens
acacaucuauccuuucaca

SEQ ID NO: 1125602 - RNA, 19 nt, Homo sapiens
gcucucauaucuacaccuu

SEQ ID NO: 1125603 - RNA, 19 nt, Homo sapiens
gcuguaugcuugauaugug

SEQ ID NO: 1125604 - RNA, 19 nt, Homo sapiens
gaggcuguaugcuugauau

SEQ ID NO: 1125605 - RNA, 19 nt, Homo sapiens
ccauuucucucaccacuuc

SEQ ID NO: 1125606 - RNA, 19 nt, Homo sapiens
agagaagaaucugcaguuu

SEQ ID NO: 1125607 - RNA, 19 nt, Homo sapiens
ggaaaggagagucagguau

SEQ ID NO: 1125608 - RNA, 19 nt, Homo sapiens
ggagguuucuuuggucuuc

SEQ ID NO: 1125609 - RNA, 19 nt, Homo sapiens
ggaaggaaggagaggcuuu

SEQ ID NO: 1125610 - RNA, 19 nt, Homo sapiens
ucucauaucuacaccuuca

SEQ ID NO: 1125611 - RNA, 19 nt, Homo sapiens
cagauaggcaacuucauuu

SEQ ID NO: 1125612 - RNA, 19 nt, Homo sapiens
acagaccgcucucauaucu

SEQ ID NO: 1125613 - RNA, 19 nt, Homo sapiens
aagcagaguuaaauuaugg

SEQ ID NO: 1125614 - RNA, 19 nt, Homo sapiens
gcacucaaggucucacuau

SEQ ID NO: 1125615 - RNA, 19 nt, Homo sapiens
ccacgacguuuccucuuuc

SEQ ID NO: 1125616 - RNA, 19 nt, Homo sapiens
gcgauuauggguaagauug

SEQ ID NO: 1125617 - RNA, 19 nt, Homo sapiens
aggauagucuugcuucuug

SEQ ID NO: 1125618 - RNA, 19 nt, Homo sapiens
caagagaaagcagaguuaa

SEQ ID NO: 1125619 - RNA, 19 nt, Homo sapiens
ucaugggucuagauauuga

SEQ ID NO: 1125620 - RNA, 19 nt, Homo sapiens
ugacuucaguauccauaga

SEQ ID NO: 1125621 - RNA, 19 nt, Homo sapiens
gcuucgagaugcuuaagga

SEQ ID NO: 1125622 - RNA, 19 nt, Homo sapiens
acacaggaguacaaggaaa

SEQ ID NO: 1125623 - RNA, 19 nt, Homo sapiens
gaaccugucaucauugagu

SEQ ID NO: 1125624 - RNA, 19 nt, Homo sapiens
acaagagaaagcagaguua

SEQ ID NO: 1125625 - RNA, 19 nt, Homo sapiens
uacagugucuggaacuauu

SEQ ID NO: 1125626 - RNA, 19 nt, Homo sapiens
gaggauacagugucuggaa

SEQ ID NO: 1125627 - RNA, 19 nt, Homo sapiens
gguggaagagggugguaua

SEQ ID NO: 1125628 - RNA, 19 nt, Homo sapiens
ggauagucuugcuucuuga

SEQ ID NO: 1125629 - RNA, 19 nt, Homo sapiens
ccauggaggugacuucagu

SEQ ID NO: 1125630 - RNA, 19 nt, Homo sapiens
ccacuucuuugccagucua

SEQ ID NO: 1125631 - RNA, 19 nt, Homo sapiens
gaggcaaaguggaagagau

SEQ ID NO: 1125632 - RNA, 19 nt, Homo sapiens
gcucucaugggucuagaua

SEQ ID NO: 1125633 - RNA, 19 nt, Homo sapiens
ucaagagacuaguggaaag

SEQ ID NO: 1125634 - RNA, 19 nt, Homo sapiens
aacagaagcugcaggagau

SEQ ID NO: 1125635 - RNA, 19 nt, Homo sapiens
gcaguaugguggaaauugc

SEQ ID NO: 1125636 - RNA, 19 nt, Homo sapiens
gcaagauacuuugguuggu

SEQ ID NO: 1125637 - RNA, 19 nt, Homo sapiens
agagaaagcagaguuaaau

SEQ ID NO: 1125638 - RNA, 19 nt, Homo sapiens
ucagauuccuuucuugucu

SEQ ID NO: 1125639 - RNA, 19 nt, Homo sapiens
cgucucagauuccuuucuu

SEQ ID NO: 1125640 - RNA, 19 nt, Homo sapiens
aggguaagguugcgauuau

SEQ ID NO: 1125641 - RNA, 19 nt, Homo sapiens
gaaggaaccugucaucauu

SEQ ID NO: 1125642 - RNA, 19 nt, Homo sapiens
gaaaagaacuucagcaauu

SEQ ID NO: 1125643 - RNA, 19 nt, Homo sapiens
gaacagugguagaaacaaa

SEQ ID NO: 1125644 - RNA, 19 nt, Homo sapiens
ggaagagggugguauauag

SEQ ID NO: 1125645 - RNA, 19 nt, Homo sapiens
gaacagauuccuagagauu

SEQ ID NO: 1125646 - RNA, 19 nt, Homo sapiens
gaagaaugcugcaccacuu

SEQ ID NO: 1125647 - RNA, 19 nt, Homo sapiens
caaauugucagccuucuua

SEQ ID NO: 1125648 - RNA, 19 nt, Homo sapiens
caagacacaucuauccuuu

SEQ ID NO: 1125649 - RNA, 19 nt, Homo sapiens
cagcagaguuggcuuauug

SEQ ID NO: 1125650 - RNA, 19 nt, Homo sapiens
ggagaaguaugcugagcua

SEQ ID NO: 1125651 - RNA, 19 nt, Homo sapiens
gagaagaaucugcaguuua

SEQ ID NO: 1125652 - RNA, 19 nt, Homo sapiens
gaaaggagagucagguauu

SEQ ID NO: 1125653 - RNA, 19 nt, Homo sapiens
gaagagauccugcaagaca

SEQ ID NO: 1125654 - RNA, 19 nt, Homo sapiens
gaagugggcuaaaggaaca

SEQ ID NO: 1125655 - RNA, 19 nt, Homo sapiens
caauuuggauuaucugcua

SEQ ID NO: 1125656 - RNA, 19 nt, Homo sapiens
acaaagcccuggccuuaaa

SEQ ID NO: 1125657 - RNA, 19 nt, Homo sapiens
ggacacgcaucccuuccua

SEQ ID NO: 1125658 - RNA, 19 nt, Homo sapiens
ggaaagagaaggguauuug

SEQ ID NO: 1125659 - RNA, 19 nt, Homo sapiens
aaaggagagucagguauua

SEQ ID NO: 1125660 - RNA, 19 nt, Homo sapiens
ggagggagguuucuuuggu

SEQ ID NO: 1125661 - RNA, 19 nt, Homo sapiens
gggcagagauuggacauca

SEQ ID NO: 1125662 - RNA, 19 nt, Homo sapiens
gauccguccuggugccuua

SEQ ID NO: 1125663 - RNA, 19 nt, Homo sapiens
cggguaaucuucacagaaa

SEQ ID NO: 1125664 - RNA, 19 nt, Homo sapiens
agagaaggguauuuguaua

SEQ ID NO: 1125665 - RNA, 19 nt, Homo sapiens
agaagaaucugcaguuuac

SEQ ID NO: 1125666 - RNA, 19 nt, Homo sapiens
caacuuauaggguacauau

SEQ ID NO: 1125667 - RNA, 19 nt, Homo sapiens
uggaagagauccugcaaga

SEQ ID NO: 1125668 - RNA, 19 nt, Homo sapiens
ucucaugggucuagauauu

SEQ ID NO: 1125669 - RNA, 19 nt, Homo sapiens
gggcacaacuucugcaaag

SEQ ID NO: 1125670 - RNA, 19 nt, Homo sapiens
caagauacuuugguugguu

SEQ ID NO: 1125671 - RNA, 19 nt, Homo sapiens
cgacaguacuuugcccuaa

SEQ ID NO: 1125672 - RNA, 19 nt, Homo sapiens
gaaaugacugagagaagaa

SEQ ID NO: 1125673 - RNA, 19 nt, Homo sapiens
agacacaucuauccuuuca

SEQ ID NO: 1125674 - RNA, 19 nt, Homo sapiens
ccauagagcuggaaaagaa

SEQ ID NO: 1125675 - RNA, 19 nt, Homo sapiens
gagagaagaaucugcaguu

SEQ ID NO: 1125676 - RNA, 19 nt, Homo sapiens
agaaaugacugagagaaga

SEQ ID NO: 1125677 - RNA, 19 nt, Homo sapiens
ccagauaggcaacuucauu

SEQ ID NO: 1125678 - RNA, 19 nt, Homo sapiens
auacaaagcccuggccuua

SEQ ID NO: 1125679 - RNA, 19 nt, Homo sapiens
gaaguaugcugagcuagag

SEQ ID NO: 1125680 - RNA, 19 nt, Homo sapiens
gagauugucccugaaguuu

SEQ ID NO: 1125681 - RNA, 19 nt, Homo sapiens
gaaagagaaggguauuugu

SEQ ID NO: 1125682 - RNA, 19 nt, Homo sapiens
acagauuccuagagauuaa

SEQ ID NO: 1125683 - RNA, 19 nt, Homo sapiens
ucacagaccgcucucauau

SEQ ID NO: 1125684 - RNA, 19 nt, Homo sapiens
gccacgacguuuccucuuu

SEQ ID NO: 1125685 - RNA, 19 nt, Homo sapiens
aaagagaaggguauuugua

SEQ ID NO: 1125686 - RNA, 19 nt, Homo sapiens
guacuuugcccuaaggaaa

SEQ ID NO: 1125687 - RNA, 19 nt, Homo sapiens
gagaaagcagaguuaaauu

SEQ ID NO: 1125688 - RNA, 19 nt, Homo sapiens
aagcuucucuuucuaacaa

SEQ ID NO: 1125689 - RNA, 19 nt, Homo sapiens
gguauuagaggaaagagaa

SEQ ID NO: 1125690 - RNA, 19 nt, Homo sapiens
ggaggugacuucaguaucc

SEQ ID NO: 1125691 - RNA, 19 nt, Homo sapiens
guuagaaacguaugucaaa

SEQ ID NO: 1125692 - RNA, 19 nt, Homo sapiens
aagauacuuugguugguua

SEQ ID NO: 1125693 - RNA, 19 nt, Homo sapiens
gcccuggccuuaaagaaug

SEQ ID NO: 1125694 - RNA, 19 nt, Homo sapiens
cuuauugccugccucuaua

SEQ ID NO: 1125695 - RNA, 19 nt, Homo sapiens
gaaaauccuuaaacagcua

SEQ ID NO: 1125696 - RNA, 19 nt, Homo sapiens
gcaagacacaucuauccuu

SEQ ID NO: 1125697 - RNA, 19 nt, Homo sapiens
gaggcagggucaagugcua

SEQ ID NO: 1125698 - RNA, 19 nt, Homo sapiens
gauacagugucuggaacua

SEQ ID NO: 1125699 - RNA, 19 nt, Homo sapiens
acacaucuauccuuucaca

SEQ ID NO: 1125700 - RNA, 19 nt, Homo sapiens
gcucucauaucuacaccuu

SEQ ID NO: 1125701 - RNA, 19 nt, Homo sapiens
gcuguaugcuugauaugug

SEQ ID NO: 1125702 - RNA, 19 nt, Homo sapiens
gaggcuguaugcuugauau

SEQ ID NO: 1125703 - RNA, 19 nt, Homo sapiens
ccauuucucucaccacuuc

SEQ ID NO: 1125704 - RNA, 19 nt, Homo sapiens
agagaagaaucugcaguuu

SEQ ID NO: 1125705 - RNA, 19 nt, Homo sapiens
ggaaaggagagucagguau

SEQ ID NO: 1125706 - RNA, 19 nt, Homo sapiens
ggagguuucuuuggucuuc

SEQ ID NO: 1125707 - RNA, 19 nt, Homo sapiens
ggaaggaaggagaggcuuu

SEQ ID NO: 1125708 - RNA, 19 nt, Homo sapiens
ucucauaucuacaccuuca

SEQ ID NO: 1125709 - RNA, 19 nt, Homo sapiens
cagauaggcaacuucauuu

SEQ ID NO: 1125710 - RNA, 19 nt, Homo sapiens
acagaccgcucucauaucu

SEQ ID NO: 1125711 - RNA, 19 nt, Homo sapiens
aagcagaguuaaauuaugg

SEQ ID NO: 1125712 - RNA, 19 nt, Homo sapiens
gcacucaaggucucacuau

SEQ ID NO: 1125713 - RNA, 19 nt, Homo sapiens
ccacgacguuuccucuuuc

SEQ ID NO: 1125714 - RNA, 19 nt, Homo sapiens
gcgauuauggguaagauug

SEQ ID NO: 1125715 - RNA, 19 nt, Homo sapiens
aggauagucuugcuucuug

SEQ ID NO: 1125716 - RNA, 19 nt, Homo sapiens
caagagaaagcagaguuaa

SEQ ID NO: 1125717 - RNA, 19 nt, Homo sapiens
ucaugggucuagauauuga

SEQ ID NO: 1125718 - RNA, 19 nt, Homo sapiens
ugacuucaguauccauaga

SEQ ID NO: 1125719 - RNA, 19 nt, Homo sapiens
gcuucgagaugcuuaagga

SEQ ID NO: 1125720 - RNA, 19 nt, Homo sapiens
acacaggaguacaaggaaa

SEQ ID NO: 1125721 - RNA, 19 nt, Homo sapiens
gaaccugucaucauugagu

SEQ ID NO: 1125722 - RNA, 19 nt, Homo sapiens
acaagagaaagcagaguua

SEQ ID NO: 1125723 - RNA, 19 nt, Homo sapiens
uacagugucuggaacuauu

SEQ ID NO: 1125724 - RNA, 19 nt, Homo sapiens
gaggauacagugucuggaa

SEQ ID NO: 1125725 - RNA, 19 nt, Homo sapiens
gguggaagagggugguaua

SEQ ID NO: 1125726 - RNA, 19 nt, Homo sapiens
ggauagucuugcuucuuga

SEQ ID NO: 1125727 - RNA, 19 nt, Homo sapiens
ccauggaggugacuucagu

SEQ ID NO: 1125728 - RNA, 19 nt, Homo sapiens
ccacuucuuugccagucua

SEQ ID NO: 1125729 - RNA, 19 nt, Homo sapiens
gaggcaaaguggaagagau

SEQ ID NO: 1125730 - RNA, 19 nt, Homo sapiens
gcucucaugggucuagaua

SEQ ID NO: 1125731 - RNA, 19 nt, Homo sapiens
ucaagagacuaguggaaag

SEQ ID NO: 1125732 - RNA, 19 nt, Homo sapiens
aacagaagcugcaggagau

SEQ ID NO: 1125733 - RNA, 19 nt, Homo sapiens
gcaguaugguggaaauugc

SEQ ID NO: 1125734 - RNA, 19 nt, Homo sapiens
gcaagauacuuugguuggu

SEQ ID NO: 1125735 - RNA, 19 nt, Homo sapiens
agagaaagcagaguuaaau

SEQ ID NO: 1125736 - RNA, 19 nt, Homo sapiens
ucagauuccuuucuugucu

SEQ ID NO: 1125737 - RNA, 19 nt, Homo sapiens
cgucucagauuccuuucuu

SEQ ID NO: 1125738 - RNA, 19 nt, Homo sapiens
aggguaagguugcgauuau

SEQ ID NO: 1125739 - RNA, 19 nt, Homo sapiens
gcacacugucuuucuacaa

SEQ ID NO: 1125740 - RNA, 19 nt, Homo sapiens
aaacgaggauacagugucu

SEQ ID NO: 1125741 - RNA, 19 nt, Homo sapiens
gcaaagaugaugacuauuu

SEQ ID NO: 1125742 - RNA, 19 nt, Homo sapiens
gcaagcaucuuuagaaauc

SEQ ID NO: 1125743 - RNA, 19 nt, Homo sapiens
gacauugccuuguuucauu

SEQ ID NO: 1125744 - RNA, 19 nt, Homo sapiens
gcagcaagaugguggugua

SEQ ID NO: 1125745 - RNA, 19 nt, Homo sapiens
ggagauagguuuuccuuaa

SEQ ID NO: 1125746 - RNA, 19 nt, Homo sapiens
gaaaaugucuguuguacuc

SEQ ID NO: 1125747 - RNA, 19 nt, Homo sapiens
ucacacagaccauuucauu

SEQ ID NO: 1125748 - RNA, 19 nt, Homo sapiens
ccgcaagcaucuuuagaaa

SEQ ID NO: 1125749 - RNA, 19 nt, Homo sapiens
caucaucgccuacaucaug

SEQ ID NO: 1125750 - RNA, 19 nt, Homo sapiens
augcaaagaugaugacuau

SEQ ID NO: 1125751 - RNA, 19 nt, Homo sapiens
agacucaucuuucccuaga

SEQ ID NO: 1125752 - RNA, 19 nt, Homo sapiens
gaagcucucucuguuccuu

SEQ ID NO: 1125753 - RNA, 19 nt, Homo sapiens
cauuagacauugccuuguu

SEQ ID NO: 1125754 - RNA, 19 nt, Homo sapiens
gcuggaagcccuccgugua

SEQ ID NO: 1125755 - RNA, 19 nt, Homo sapiens
cccgggaccuucagcguua

SEQ ID NO: 1125756 - RNA, 19 nt, Homo sapiens
agaccucaauguaauaaga

SEQ ID NO: 1125757 - RNA, 19 nt, Homo sapiens
acauugccuuguuucauua

SEQ ID NO: 1125758 - RNA, 19 nt, Homo sapiens
agaagcaacugucugagau

SEQ ID NO: 1125759 - RNA, 19 nt, Homo sapiens
agaguagaauggaggauga

SEQ ID NO: 1125760 - RNA, 19 nt, Homo sapiens
ccuuuaaacugcagcaaga

SEQ ID NO: 1125761 - RNA, 19 nt, Homo sapiens
aagcauaccugccaauggu

SEQ ID NO: 1125762 - RNA, 19 nt, Homo sapiens
gcuugucuccugauccuua

SEQ ID NO: 1125763 - RNA, 19 nt, Homo sapiens
gcugcaacaucuccauaga

SEQ ID NO: 1125764 - RNA, 19 nt, Homo sapiens
caaggccucuaucgcuuug

SEQ ID NO: 1125765 - RNA, 19 nt, Homo sapiens
caccgucguuuccaccaua

SEQ ID NO: 1125766 - RNA, 19 nt, Homo sapiens
ggugggagccuuugcaauc

SEQ ID NO: 1125767 - RNA, 19 nt, Homo sapiens
gccagaacgcccacuauga

SEQ ID NO: 1125768 - RNA, 19 nt, Homo sapiens
ccugauccuuauucuuuaa

SEQ ID NO: 1125769 - RNA, 19 nt, Homo sapiens
cuuuauaccuguuucuguu

SEQ ID NO: 1125770 - RNA, 19 nt, Homo sapiens
guagaauggaggaugauug

SEQ ID NO: 1125771 - RNA, 19 nt, Homo sapiens
cuccugauccuuauucuuu

SEQ ID NO: 1125772 - RNA, 19 nt, Homo sapiens
cggaaccgcugcaacaucu

SEQ ID NO: 1125773 - RNA, 19 nt, Homo sapiens
ugccaauggugucugcaua

SEQ ID NO: 1125774 - RNA, 19 nt, Homo sapiens
uugccaggcuuccuucaaa

SEQ ID NO: 1125775 - RNA, 19 nt, Homo sapiens
ggaagcccuccguguacua

SEQ ID NO: 1125776 - RNA, 19 nt, Homo sapiens
ugucaucucuauccucauc

SEQ ID NO: 1125777 - RNA, 19 nt, Homo sapiens
gcaccaucuuguucuucaa

SEQ ID NO: 1125778 - RNA, 19 nt, Homo sapiens
acacagaccauuucauuuu

SEQ ID NO: 1125779 - RNA, 19 nt, Homo sapiens
ggcagaggccagaguagaa

SEQ ID NO: 1125780 - RNA, 19 nt, Homo sapiens
gaagcaacugucugagaug

SEQ ID NO: 1125781 - RNA, 19 nt, Homo sapiens
ggagcuacuuugacucacu

SEQ ID NO: 1125782 - RNA, 19 nt, Homo sapiens
gagagacucacuuuuguaa

SEQ ID NO: 1125783 - RNA, 19 nt, Homo sapiens
ggaugugucugggcuuucu

SEQ ID NO: 1125784 - RNA, 19 nt, Homo sapiens
uuagcugccugaggagaua

SEQ ID NO: 1125785 - RNA, 19 nt, Homo sapiens
caaaacaaaucacaaaagc

SEQ ID NO: 1125786 - RNA, 19 nt, Homo sapiens
aaucugaucucggcuccaa

SEQ ID NO: 1125787 - RNA, 19 nt, Homo sapiens
ucucuauccucaucaaaca

SEQ ID NO: 1125788 - RNA, 19 nt, Homo sapiens
ccagaacgcccacuaugag

SEQ ID NO: 1125789 - RNA, 19 nt, Homo sapiens
ggacccaaugcaaagauga

SEQ ID NO: 1125790 - RNA, 19 nt, Homo sapiens
ugacaacuccggcgacagu

SEQ ID NO: 1125791 - RNA, 19 nt, Homo sapiens
gcagaggccagaguagaau

SEQ ID NO: 1125792 - RNA, 19 nt, Homo sapiens
guagaagccaggaauggau

SEQ ID NO: 1125793 - RNA, 19 nt, Homo sapiens
gugggagccuuugcaauca

SEQ ID NO: 1125794 - RNA, 19 nt, Homo sapiens
aaagcagcauuagacauug

SEQ ID NO: 1125795 - RNA, 19 nt, Homo sapiens
gggcagaggccagaguaga

SEQ ID NO: 1125796 - RNA, 19 nt, Homo sapiens
ccaaggccucuaucgcuuu

SEQ ID NO: 1125797 - RNA, 19 nt, Homo sapiens
gaccucaauguaauaagaa

SEQ ID NO: 1125798 - RNA, 19 nt, Homo sapiens
caaagcauaccugccaaug

SEQ ID NO: 1125799 - RNA, 19 nt, Homo sapiens
gguagaagccaggaaugga

SEQ ID NO: 1125800 - RNA, 19 nt, Homo sapiens
gggagccuuugcaaucaug

SEQ ID NO: 1125801 - RNA, 19 nt, Homo sapiens
ccuccauccucaucucuug

SEQ ID NO: 1125802 - RNA, 19 nt, Homo sapiens
ggcucgagcuugcccugaa

SEQ ID NO: 1125803 - RNA, 19 nt, Homo sapiens
gggacccaaugcaaagaug

SEQ ID NO: 1125804 - RNA, 19 nt, Homo sapiens
gggagagacucacuuuugu

SEQ ID NO: 1125805 - RNA, 19 nt, Homo sapiens
acagggagagacucacuuu

SEQ ID NO: 1125806 - RNA, 19 nt, Homo sapiens
ccagcaccaucuuguucuu

SEQ ID NO: 1125807 - RNA, 19 nt, Homo sapiens
ccgggacaaugaauucuca

SEQ ID NO: 1125808 - RNA, 19 nt, Homo sapiens
gcagccagaacgcccacua

SEQ ID NO: 1125809 - RNA, 19 nt, Homo sapiens
aaaugucuguuguacucuu

SEQ ID NO: 1125810 - RNA, 19 nt, Homo sapiens
aaaagcagcauuagacauu

SEQ ID NO: 1125811 - RNA, 19 nt, Homo sapiens
uccugauccuuauucuuua

SEQ ID NO: 1125812 - RNA, 19 nt, Homo sapiens
cacacagaccauuucauuu

SEQ ID NO: 1125813 - RNA, 19 nt, Homo sapiens
acucugaauggaugaauuu

SEQ ID NO: 1125814 - RNA, 19 nt, Homo sapiens
aaagcggauuugaaacuag

SEQ ID NO: 1125815 - RNA, 19 nt, Homo sapiens
auuagacauugccuuguuu

SEQ ID NO: 1125816 - RNA, 19 nt, Homo sapiens
gaaggcuggagcuacuuug

SEQ ID NO: 1125817 - RNA, 19 nt, Homo sapiens
ggagagacucacuuuugua

SEQ ID NO: 1125818 - RNA, 19 nt, Homo sapiens
ggacagggagagacucacu

SEQ ID NO: 1125819 - RNA, 19 nt, Homo sapiens
gaacucugaauggaugaau

SEQ ID NO: 1125820 - RNA, 19 nt, Homo sapiens
uccugaagcucucucuguu

SEQ ID NO: 1125821 - RNA, 19 nt, Homo sapiens
gagauagguuuuccuuaag

SEQ ID NO: 1125822 - RNA, 19 nt, Homo sapiens
aaucuuguuucagagcuuu

SEQ ID NO: 1125823 - RNA, 19 nt, Homo sapiens
ccuuugcaaucaugaacaa

SEQ ID NO: 1125824 - RNA, 19 nt, Homo sapiens
caucuacuccuuguucaau

SEQ ID NO: 1125825 - RNA, 19 nt, Homo sapiens
gcaccgucguuuccaccau

SEQ ID NO: 1125826 - RNA, 19 nt, Homo sapiens
gagacucacuuuuguaacu

SEQ ID NO: 1125827 - RNA, 19 nt, Homo sapiens
aaugucuguuguacucuuu

SEQ ID NO: 1125828 - RNA, 19 nt, Homo sapiens
gcucgagcuugcccugaag

SEQ ID NO: 1125829 - RNA, 19 nt, Homo sapiens
gauuugaaacuaggaguca

SEQ ID NO: 1125830 - RNA, 19 nt, Homo sapiens
uguucaaugucaucucuau

SEQ ID NO: 1125831 - RNA, 19 nt, Homo sapiens
ugaaggcuggagcuacuuu

SEQ ID NO: 1125832 - RNA, 19 nt, Homo sapiens
ucgccuacaucaugaaguc

SEQ ID NO: 1125833 - RNA, 19 nt, Homo sapiens
cagaacgcccacuaugaga

SEQ ID NO: 1125834 - RNA, 19 nt, Homo sapiens
cuaaagaacauagcuuaac

SEQ ID NO: 1125835 - RNA, 19 nt, Homo sapiens
guacucuuuauaccuguuu

SEQ ID NO: 1125836 - RNA, 19 nt, Homo sapiens
ggcuggagcuacuuugacu

SEQ ID NO: 1125837 - RNA, 19 nt, Homo sapiens
ccaauggugucugcauagg

SEQ ID NO: 1125838 - RNA, 19 nt, Homo sapiens
ucucucuguuccuuauuug

SEQ ID NO: 1125839 - RNA, 19 nt, Homo sapiens
cgccuuggcucuguuccuu

SEQ ID NO: 1125840 - RNA, 19 nt, Homo sapiens
ucuacuccuuguucaaugu

SEQ ID NO: 1125841 - RNA, 19 nt, Homo sapiens
ggaccauccuguucuucaa

SEQ ID NO: 1125842 - RNA, 19 nt, Homo sapiens
gcuggaagcccucggugua

SEQ ID NO: 1125843 - RNA, 19 nt, Homo sapiens
ggcgcuuucuuaaucuuua

SEQ ID NO: 1125844 - RNA, 19 nt, Homo sapiens
gggcgugguuugcuucucu

SEQ ID NO: 1125845 - RNA, 19 nt, Homo sapiens
gcgcuuucuuaaucuuuau

SEQ ID NO: 1125846 - RNA, 19 nt, Homo sapiens
gugguuugcuucucucagu

SEQ ID NO: 1125847 - RNA, 19 nt, Homo sapiens
gcgcugggcaucaugaaca

SEQ ID NO: 1125848 - RNA, 19 nt, Homo sapiens
gcauuuacucgcucuucaa

SEQ ID NO: 1125849 - RNA, 19 nt, Homo sapiens
gcugcuggccuucaucaug

SEQ ID NO: 1125850 - RNA, 19 nt, Homo sapiens
gcaacuuccucuucauccu

SEQ ID NO: 1125851 - RNA, 19 nt, Homo sapiens
gcgcugggaccauccuguu

SEQ ID NO: 1125852 - RNA, 19 nt, Homo sapiens
cgggcgagcucaucuccau

SEQ ID NO: 1125853 - RNA, 19 nt, Homo sapiens
uggacucgcucuacuucug

SEQ ID NO: 1125854 - RNA, 19 nt, Homo sapiens
gggaccauccuguucuuca

SEQ ID NO: 1125855 - RNA, 19 nt, Homo sapiens
gggcaacuuccucuucauc

SEQ ID NO: 1125856 - RNA, 19 nt, Homo sapiens
ugcuggcgcuuucuuaauc

SEQ ID NO: 1125857 - RNA, 19 nt, Homo sapiens
gcuggcgcuuucuuaaucu

SEQ ID NO: 1125858 - RNA, 19 nt, Homo sapiens
ggcgugugcugcauuuacu

SEQ ID NO: 1125859 - RNA, 19 nt, Homo sapiens
gcaagaagaugaaguggau

SEQ ID NO: 1125860 - RNA, 19 nt, Homo sapiens
gcccugaggugaagaguuu

SEQ ID NO: 1125861 - RNA, 19 nt, Homo sapiens
aggaacccauuuacuguua

SEQ ID NO: 1125862 - RNA, 19 nt, Homo sapiens
cgagaacggucgugaguac

SEQ ID NO: 1125863 - RNA, 19 nt, Homo sapiens
gaacggucgugaguacugu

SEQ ID NO: 1125864 - RNA, 19 nt, Homo sapiens
gaacccauuuacuguuaca

SEQ ID NO: 1125865 - RNA, 19 nt, Homo sapiens
gcaacuucaucuucgacaa

SEQ ID NO: 1125866 - RNA, 19 nt, Homo sapiens
agaagcagauccaguccaa

SEQ ID NO: 1125867 - RNA, 19 nt, Homo sapiens
gaaccgcgaccacaucaag

SEQ ID NO: 1125868 - RNA, 19 nt, Homo sapiens
ucgcagaggaacccauuua

SEQ ID NO: 1125869 - RNA, 19 nt, Homo sapiens
ucaacacgcuauccucauc

SEQ ID NO: 1125870 - RNA, 19 nt, Homo sapiens
cagaggaacccauuuacug

SEQ ID NO: 1125871 - RNA, 19 nt, Homo sapiens
gaggaacccauuuacuguu

SEQ ID NO: 1125872 - RNA, 19 nt, Homo sapiens
caacgagagcgaccucaug

SEQ ID NO: 1125873 - RNA, 19 nt, Homo sapiens
ucgacaagcugcacaaggu

SEQ ID NO: 1125874 - RNA, 19 nt, Homo sapiens
agagcgaccucauguacga

SEQ ID NO: 1125875 - RNA, 19 nt, Homo sapiens
caagaacuucgcagaggaa

SEQ ID NO: 1125876 - RNA, 19 nt, Homo sapiens
cgugaguacuguggaguuu

SEQ ID NO: 1125877 - RNA, 19 nt, Homo sapiens
gcacaaggugggcaucaag

SEQ ID NO: 1125878 - RNA, 19 nt, Homo sapiens
gagaaccgcgaccacauca

SEQ ID NO: 1125879 - RNA, 19 nt, Homo sapiens
gcaacuuccuggccaagcu

SEQ ID NO: 1125880 - RNA, 19 nt, Homo sapiens
ggagaucgacaacuguuac

SEQ ID NO: 1125881 - RNA, 19 nt, Homo sapiens
gcagaggaacccauuuacu

SEQ ID NO: 1125882 - RNA, 19 nt, Homo sapiens
gcgagaagcgcgagaucau

SEQ ID NO: 1125883 - RNA, 19 nt, Homo sapiens
gaacagcaaggcggagaag

SEQ ID NO: 1125884 - RNA, 19 nt, Homo sapiens
cgagagcgaccucauguac

SEQ ID NO: 1125885 - RNA, 19 nt, Homo sapiens
gugcugcugugcgucauga

SEQ ID NO: 1125886 - RNA, 19 nt, Homo sapiens
agaagagcccggagcagaa

SEQ ID NO: 1125887 - RNA, 19 nt, Homo sapiens
ugcaggagaucgacaacug

SEQ ID NO: 1125888 - RNA, 19 nt, Homo sapiens
caacuucaucuucgacaag

SEQ ID NO: 1125889 - RNA, 19 nt, Homo sapiens
ucuccuaccugugcaccua

SEQ ID NO: 1125890 - RNA, 19 nt, Homo sapiens
gcccggagcagaaccuguu

SEQ ID NO: 1125891 - RNA, 19 nt, Homo sapiens
gcaggagaucgacaacugu

SEQ ID NO: 1125892 - RNA, 19 nt, Homo sapiens
ggaacccauuuacuguuac

SEQ ID NO: 1125893 - RNA, 19 nt, Homo sapiens
ucaaccggcuggacuucau

SEQ ID NO: 1125894 - RNA, 19 nt, Homo sapiens
agaggaacccauuuacugu

SEQ ID NO: 1125895 - RNA, 19 nt, Homo sapiens
ucauccaccucuucaucuu

SEQ ID NO: 1125896 - RNA, 19 nt, Homo sapiens
cgcagaagcagaacgaguu

SEQ ID NO: 1125897 - RNA, 19 nt, Homo sapiens
ccacgcagaagcagaacga

SEQ ID NO: 1125898 - RNA, 19 nt, Homo sapiens
caaccucauccaccucuuc

SEQ ID NO: 1125899 - RNA, 19 nt, Homo sapiens
gaagagcccggagcagaac

SEQ ID NO: 1125900 - RNA, 19 nt, Homo sapiens
cgcccaagaucgagaagca

SEQ ID NO: 1125901 - RNA, 19 nt, Homo sapiens
caggagaucgacaacuguu

SEQ ID NO: 1125902 - RNA, 19 nt, Homo sapiens
ucaccauccugagccgaaa

SEQ ID NO: 1125903 - RNA, 19 nt, Homo sapiens
cgagaaccgcgaccacauc

SEQ ID NO: 1125904 - RNA, 19 nt, Homo sapiens
gcaacugcagcgcaucauc

SEQ ID NO: 1125905 - RNA, 19 nt, Homo sapiens
ugaguacuguggaguuuug

SEQ ID NO: 1125906 - RNA, 19 nt, Homo sapiens
aaacauugcucuugaguua

SEQ ID NO: 1125907 - RNA, 19 nt, Homo sapiens
agacauaucucucagcuuu

SEQ ID NO: 1125908 - RNA, 19 nt, Homo sapiens
caaaggagcacuucucuaa

SEQ ID NO: 1125909 - RNA, 19 nt, Homo sapiens
gaauggaaguugugaaugu

SEQ ID NO: 1125910 - RNA, 19 nt, Homo sapiens
caagaagacuggaaagaga

SEQ ID NO: 1125911 - RNA, 19 nt, Homo sapiens
gcccagagcuugcaaccua

SEQ ID NO: 1125912 - RNA, 19 nt, Homo sapiens
ccagcucacuugcuaaaua

SEQ ID NO: 1125913 - RNA, 19 nt, Homo sapiens
gaauccagcucacuugcua

SEQ ID NO: 1125914 - RNA, 19 nt, Homo sapiens
gaagggagcgucuuuccua

SEQ ID NO: 1125915 - RNA, 19 nt, Homo sapiens
gaugaucccugugcagaua

SEQ ID NO: 1125916 - RNA, 19 nt, Homo sapiens
gcaacuuucuaaacuauga

SEQ ID NO: 1125917 - RNA, 19 nt, Homo sapiens
ggauccaccuucuuccuua

SEQ ID NO: 1125918 - RNA, 19 nt, Homo sapiens
ugaguuaagugaccuaauu

SEQ ID NO: 1125919 - RNA, 19 nt, Homo sapiens
gaagugagcaccaguaaag

SEQ ID NO: 1125920 - RNA, 19 nt, Homo sapiens
cuacaacucuucuacaugu

SEQ ID NO: 1125921 - RNA, 19 nt, Homo sapiens
caagcaacuuucuaaacua

SEQ ID NO: 1125922 - RNA, 19 nt, Homo sapiens
gacaguaucagaaacauuu

SEQ ID NO: 1125923 - RNA, 19 nt, Homo sapiens
uagaaagacugauggagaa

SEQ ID NO: 1125924 - RNA, 19 nt, Homo sapiens
ucacaaugguuccuucuga

SEQ ID NO: 1125925 - RNA, 19 nt, Homo sapiens
caagaaccauuuccaaucu

SEQ ID NO: 1125926 - RNA, 19 nt, Homo sapiens
cagcucacuugcuaaauaa

SEQ ID NO: 1125927 - RNA, 19 nt, Homo sapiens
cgaagcauauugaagaaga

SEQ ID NO: 1125928 - RNA, 19 nt, Homo sapiens
aaacgaagcauauugaaga

SEQ ID NO: 1125929 - RNA, 19 nt, Homo sapiens
ggacaaauuucagcugauc

SEQ ID NO: 1125930 - RNA, 19 nt, Homo sapiens
gcaaccacauccaguacaa

SEQ ID NO: 1125931 - RNA, 19 nt, Homo sapiens
gagcacuucucuaaucaug

SEQ ID NO: 1125932 - RNA, 19 nt, Homo sapiens
cagcugauccucacuauug

SEQ ID NO: 1125933 - RNA, 19 nt, Homo sapiens
guucuugacuguuaauugu

SEQ ID NO: 1125934 - RNA, 19 nt, Homo sapiens
gcggaugacugccucaaug

SEQ ID NO: 1125935 - RNA, 19 nt, Homo sapiens
acacauaguuccuccacaa

SEQ ID NO: 1125936 - RNA, 19 nt, Homo sapiens
acacauaguuccuccacaa

SEQ ID NO: 1125937 - RNA, 19 nt, Homo sapiens
caaccaauguacaagcuau

SEQ ID NO: 1125938 - RNA, 19 nt, Homo sapiens
agaaguagcucaagcaacu

SEQ ID NO: 1125939 - RNA, 19 nt, Homo sapiens
gaacuugauugacgaagac

SEQ ID NO: 1125940 - RNA, 19 nt, Homo sapiens
ucaagcaacuuucuaaacu

SEQ ID NO: 1125941 - RNA, 19 nt, Homo sapiens
gcagaaaccacaagugaca

SEQ ID NO: 1125942 - RNA, 19 nt, Homo sapiens
guguuaagcugcauaauac

SEQ ID NO: 1125943 - RNA, 19 nt, Homo sapiens
gcaauuagaaguagcucaa

SEQ ID NO: 1125944 - RNA, 19 nt, Homo sapiens
gaaugguaaugcaauaaag

SEQ ID NO: 1125945 - RNA, 19 nt, Homo sapiens
gaaauuggagacaaacugu

SEQ ID NO: 1125946 - RNA, 19 nt, Homo sapiens
gaagaagagaacuugauug

SEQ ID NO: 1125947 - RNA, 19 nt, Homo sapiens
agacuugcauagugaaauu

SEQ ID NO: 1125948 - RNA, 19 nt, Homo sapiens
cauaguuccuccacaauuc

SEQ ID NO: 1125949 - RNA, 19 nt, Homo sapiens
cauaguuccuccacaauuc

SEQ ID NO: 1125950 - RNA, 19 nt, Homo sapiens
cagcaaauacaccuucuuu

SEQ ID NO: 1125951 - RNA, 19 nt, Homo sapiens
gagagauucuggcaaccuu

SEQ ID NO: 1125952 - RNA, 19 nt, Homo sapiens
caacaagaaccauuuccaa

SEQ ID NO: 1125953 - RNA, 19 nt, Homo sapiens
uauuagcgcuugucagaga

SEQ ID NO: 1125954 - RNA, 19 nt, Homo sapiens
gagaagugagcaccaguaa

SEQ ID NO: 1125955 - RNA, 19 nt, Homo sapiens
guauuuggcacaucuguuu

SEQ ID NO: 1125956 - RNA, 19 nt, Homo sapiens
gaagauuucagugacagua

SEQ ID NO: 1125957 - RNA, 19 nt, Homo sapiens
gaagagaggcaaaggaaac

SEQ ID NO: 1125958 - RNA, 19 nt, Homo sapiens
caagcucacucucugacaa

SEQ ID NO: 1125959 - RNA, 19 nt, Homo sapiens
ggagaagugagcaccagua

SEQ ID NO: 1125960 - RNA, 19 nt, Homo sapiens
acagcaagaucaaauaaca

SEQ ID NO: 1125961 - RNA, 19 nt, Homo sapiens
agaagacaaucaaucauca

SEQ ID NO: 1125962 - RNA, 19 nt, Homo sapiens
gaaacacaaaguaacaaug

SEQ ID NO: 1125963 - RNA, 19 nt, Homo sapiens
caaggcaacucagcugaug

SEQ ID NO: 1125964 - RNA, 19 nt, Homo sapiens
caacgaauccagcucacuu

SEQ ID NO: 1125965 - RNA, 19 nt, Homo sapiens
ucacagcaagaucaaauaa

SEQ ID NO: 1125966 - RNA, 19 nt, Homo sapiens
agaaacauuugacccagaa

SEQ ID NO: 1125967 - RNA, 19 nt, Homo sapiens
ccacagaaacugcgacuag

SEQ ID NO: 1125968 - RNA, 19 nt, Homo sapiens
aaagccaucauucaucuua

SEQ ID NO: 1125969 - RNA, 19 nt, Homo sapiens
gacuagugguccuacagua

SEQ ID NO: 1125970 - RNA, 19 nt, Homo sapiens
aagaagagaacuugauuga

SEQ ID NO: 1125971 - RNA, 19 nt, Homo sapiens
gcaaaggagcacuucucua

SEQ ID NO: 1125972 - RNA, 19 nt, Homo sapiens
agaagacugugacugagaa

SEQ ID NO: 1125973 - RNA, 19 nt, Homo sapiens
uggcacaucuguuuaugga

SEQ ID NO: 1125974 - RNA, 19 nt, Homo sapiens
cagcacaggucccagcaau

SEQ ID NO: 1125975 - RNA, 19 nt, Homo sapiens
uuagcuaccucugacauaa

SEQ ID NO: 1125976 - RNA, 19 nt, Homo sapiens
gcaaauacaccuucuuucc

SEQ ID NO: 1125977 - RNA, 19 nt, Homo sapiens
gcucagcuguggccaccaa

SEQ ID NO: 1125978 - RNA, 19 nt, Homo sapiens
aaggagcacuucucuaauc

SEQ ID NO: 1125979 - RNA, 19 nt, Homo sapiens
ggauaacggccuccagaga

SEQ ID NO: 1125980 - RNA, 19 nt, Homo sapiens
cgacaggcuucaccaaucu

SEQ ID NO: 1125981 - RNA, 19 nt, Homo sapiens
ugaagaagagaacuugauu

SEQ ID NO: 1125982 - RNA, 19 nt, Homo sapiens
uguguuaagcugcauaaua

SEQ ID NO: 1125983 - RNA, 19 nt, Homo sapiens
gagucaaccacaaauguaa

SEQ ID NO: 1125984 - RNA, 19 nt, Homo sapiens
ggaagagaggcaaaggaaa

SEQ ID NO: 1125985 - RNA, 19 nt, Homo sapiens
gcugauaccacugaaacua

SEQ ID NO: 1125986 - RNA, 19 nt, Homo sapiens
guaaccagacugcggauga

SEQ ID NO: 1125987 - RNA, 19 nt, Homo sapiens
gcuagcaccacagcaaaua

SEQ ID NO: 1125988 - RNA, 19 nt, Homo sapiens
gacagugagucaaccacaa

SEQ ID NO: 1125989 - RNA, 19 nt, Homo sapiens
ugugaaugguaaugcaaua

SEQ ID NO: 1125990 - RNA, 19 nt, Homo sapiens
guacaagcuuuuacaaaug

SEQ ID NO: 1125991 - RNA, 19 nt, Homo sapiens
aaacacagccaccaaccaa

SEQ ID NO: 1125992 - RNA, 19 nt, Homo sapiens
uagaaggccuggacuaaaa

SEQ ID NO: 1125993 - RNA, 19 nt, Homo sapiens
gcaagaacagcuaaaauga

SEQ ID NO: 1125994 - RNA, 19 nt, Homo sapiens
caccaucgcuggcauuguc

SEQ ID NO: 1125995 - RNA, 19 nt, Homo sapiens
gagaagacugugacugaga

SEQ ID NO: 1125996 - RNA, 19 nt, Homo sapiens
gguuaggguuguuuucuua

SEQ ID NO: 1125997 - RNA, 19 nt, Homo sapiens
guacugagacaaugguuag

SEQ ID NO: 1125998 - RNA, 19 nt, Homo sapiens
ggaaagcuccccagcauug

SEQ ID NO: 1125999 - RNA, 19 nt, Homo sapiens
acaaaguacugagacaaug

SEQ ID NO: 1126000 - RNA, 19 nt, Homo sapiens
cgacuguaaggacaaauuu

SEQ ID NO: 1126001 - RNA, 19 nt, Homo sapiens
ccacagaagacaaucaauc

SEQ ID NO: 1126002 - RNA, 19 nt, Homo sapiens
aaagacugauggagaagug

SEQ ID NO: 1126003 - RNA, 19 nt, Homo sapiens
gcaaaucugaccugcaaag

SEQ ID NO: 1126004 - RNA, 19 nt, Homo sapiens
guaagaaaggaaagguauu

SEQ ID NO: 1126005 - RNA, 19 nt, Homo sapiens
cacaaugguuccuucugaa

SEQ ID NO: 1126006 - RNA, 19 nt, Homo sapiens
cagcauagaucgauacuug

SEQ ID NO: 1126007 - RNA, 19 nt, Homo sapiens
ggaaauaccauuguuguuu

SEQ ID NO: 1126008 - RNA, 19 nt, Homo sapiens
caucaacccugucuucuau

SEQ ID NO: 1126009 - RNA, 19 nt, Homo sapiens
gcacucaggucgucaucaa

SEQ ID NO: 1126010 - RNA, 19 nt, Homo sapiens
guauaaggcuuucucaauc

SEQ ID NO: 1126011 - RNA, 19 nt, Homo sapiens
cgacaagaauguacugguu

SEQ ID NO: 1126012 - RNA, 19 nt, Homo sapiens
ucaaaucccuuacauccuu

SEQ ID NO: 1126013 - RNA, 19 nt, Homo sapiens
ggaacagcaguaauauuua

SEQ ID NO: 1126014 - RNA, 19 nt, Homo sapiens
caaguugucugcauuugau

SEQ ID NO: 1126015 - RNA, 19 nt, Homo sapiens
cagagagugucacagauuu

SEQ ID NO: 1126016 - RNA, 19 nt, Homo sapiens
uggaacagcaguaauauuu

SEQ ID NO: 1126017 - RNA, 19 nt, Homo sapiens
gcucaugaacuccuacuuu

SEQ ID NO: 1126018 - RNA, 19 nt, Homo sapiens
ggaguuaugccaauggaaa

SEQ ID NO: 1126019 - RNA, 19 nt, Homo sapiens
uaacucagcagaauuuguu

SEQ ID NO: 1126020 - RNA, 19 nt, Homo sapiens
ccaacuacaaccucauuua

SEQ ID NO: 1126021 - RNA, 19 nt, Homo sapiens
gaucacuggucagauugua

SEQ ID NO: 1126022 - RNA, 19 nt, Homo sapiens
uaaguauccuuuccgagaa

SEQ ID NO: 1126023 - RNA, 19 nt, Homo sapiens
gaacuccuacuuucauuca

SEQ ID NO: 1126024 - RNA, 19 nt, Homo sapiens
ucaacccugucuucuauuu

SEQ ID NO: 1126025 - RNA, 19 nt, Homo sapiens
aauggaaacuggauauaug

SEQ ID NO: 1126026 - RNA, 19 nt, Homo sapiens
ggagacgugcucugcauaa

SEQ ID NO: 1126027 - RNA, 19 nt, Homo sapiens
uauaaggcuuucucaauca

SEQ ID NO: 1126028 - RNA, 19 nt, Homo sapiens
ccaguuacaguuugccuua

SEQ ID NO: 1126029 - RNA, 19 nt, Homo sapiens
gacaauggcaccaccugua

SEQ ID NO: 1126030 - RNA, 19 nt, Homo sapiens
ggcuacaucuucucucuga

SEQ ID NO: 1126031 - RNA, 19 nt, Homo sapiens
guacugguuucuuccucua

SEQ ID NO: 1126032 - RNA, 19 nt, Homo sapiens
ggcaccaccuguaaugauu

SEQ ID NO: 1126033 - RNA, 19 nt, Homo sapiens
gagagugucacagauuuaa

SEQ ID NO: 1126034 - RNA, 19 nt, Homo sapiens
cagaugggcucaugaacuc

SEQ ID NO: 1126035 - RNA, 19 nt, Homo sapiens
caacugagacacaacuuca

SEQ ID NO: 1126036 - RNA, 19 nt, Homo sapiens
ggaguuggaagcaguauca

SEQ ID NO: 1126037 - RNA, 19 nt, Homo sapiens
caaaucccuuacauccuuu

SEQ ID NO: 1126038 - RNA, 19 nt, Homo sapiens
guaaucuucucugugcuuu

SEQ ID NO: 1126039 - RNA, 19 nt, Homo sapiens
ugaaaagccucucaacuug

SEQ ID NO: 1126040 - RNA, 19 nt, Homo sapiens
caaccucuauaccagcauu

SEQ ID NO: 1126041 - RNA, 19 nt, Homo sapiens
gcauguaacuccaaaauac

SEQ ID NO: 1126042 - RNA, 19 nt, Homo sapiens
gacaagaauguacugguuu

SEQ ID NO: 1126043 - RNA, 19 nt, Homo sapiens
ucacagauuuaaccuugau

SEQ ID NO: 1126044 - RNA, 19 nt, Homo sapiens
ugaaucaacugagacacaa

SEQ ID NO: 1126045 - RNA, 19 nt, Homo sapiens
uaaccuugaucuaaagaca

SEQ ID NO: 1126046 - RNA, 19 nt, Homo sapiens
gcagaggaauaggcagguu

SEQ ID NO: 1126047 - RNA, 19 nt, Homo sapiens
uuugaucacuggucagauu

SEQ ID NO: 1126048 - RNA, 19 nt, Homo sapiens
ugaacugccuuauguuugg

SEQ ID NO: 1126049 - RNA, 19 nt, Homo sapiens
caaguuguacccagaguau

SEQ ID NO: 1126050 - RNA, 19 nt, Homo sapiens
guuuaacucagcagaauuu

SEQ ID NO: 1126051 - RNA, 19 nt, Homo sapiens
guugaacugccuuauguuu

SEQ ID NO: 1126052 - RNA, 19 nt, Homo sapiens
acaagaauguacugguuuc

SEQ ID NO: 1126053 - RNA, 19 nt, Homo sapiens
guacccagaguaugugaaa

SEQ ID NO: 1126054 - RNA, 19 nt, Homo sapiens
agauugcucucuuccuaaa

SEQ ID NO: 1126055 - RNA, 19 nt, Homo sapiens
ucagagagugucacagauu

SEQ ID NO: 1126056 - RNA, 19 nt, Homo sapiens
gcaccaccuguaaugauuu

SEQ ID NO: 1126057 - RNA, 19 nt, Homo sapiens
gcauucucuuucucacuuu

SEQ ID NO: 1126058 - RNA, 19 nt, Homo sapiens
caauggaaacuggauauau

SEQ ID NO: 1126059 - RNA, 19 nt, Homo sapiens
caacuacaaccucauuuac

SEQ ID NO: 1126060 - RNA, 19 nt, Homo sapiens
guaaugauuuugcaaguuc

SEQ ID NO: 1126061 - RNA, 19 nt, Homo sapiens
gcauagaucgauacuugau

SEQ ID NO: 1126062 - RNA, 19 nt, Homo sapiens
gcagaugggcucaugaacu

SEQ ID NO: 1126063 - RNA, 19 nt, Homo sapiens
ucacuggucagauuguaaa

SEQ ID NO: 1126064 - RNA, 19 nt, Homo sapiens
acaauggcaccaccuguaa

SEQ ID NO: 1126065 - RNA, 19 nt, Homo sapiens
aaucagagagugucacaga

SEQ ID NO: 1126066 - RNA, 19 nt, Homo sapiens
acagauuguucuacagaug

SEQ ID NO: 1126067 - RNA, 19 nt, Homo sapiens
ccaauggaaacuggauaua

SEQ ID NO: 1126068 - RNA, 19 nt, Homo sapiens
gugggaguccuuggaaaua

SEQ ID NO: 1126069 - RNA, 19 nt, Homo sapiens
gaaugggacgacaagaaug

SEQ ID NO: 1126070 - RNA, 19 nt, Homo sapiens
caaccgauaugugcuucau

SEQ ID NO: 1126071 - RNA, 19 nt, Homo sapiens
cucaugaacuccuacuuuc

SEQ ID NO: 1126072 - RNA, 19 nt, Homo sapiens
ccucucaacuuggucauca

SEQ ID NO: 1126073 - RNA, 19 nt, Homo sapiens
caacuucaaaucccuuaca

SEQ ID NO: 1126074 - RNA, 19 nt, Homo sapiens
ggucaucauggcaguggua

SEQ ID NO: 1126075 - RNA, 19 nt, Homo sapiens
cuagguaguauaaggcuuu

SEQ ID NO: 1126076 - RNA, 19 nt, Homo sapiens
agaaugggacgacaagaau

SEQ ID NO: 1126077 - RNA, 19 nt, Homo sapiens
aagaaugggacgacaagaa

SEQ ID NO: 1126078 - RNA, 19 nt, Homo sapiens
cagauuguucuacagauga

SEQ ID NO: 1126079 - RNA, 19 nt, Homo sapiens
uuaaucuccuuggccauuu

SEQ ID NO: 1126080 - RNA, 19 nt, Homo sapiens
cauagaucgauacuugaua

SEQ ID NO: 1126081 - RNA, 19 nt, Homo sapiens
cagaguaugugaaaagaau

SEQ ID NO: 1126082 - RNA, 19 nt, Homo sapiens
agagagugucacagauuua

SEQ ID NO: 1126083 - RNA, 19 nt, Homo sapiens
ugccuuaacucauagacau

SEQ ID NO: 1126084 - RNA, 19 nt, Homo sapiens
caucaacuccuuuuacauu

SEQ ID NO: 1126085 - RNA, 19 nt, Homo sapiens
caucauggcagugguaauc

SEQ ID NO: 1126086 - RNA, 19 nt, Homo sapiens
gagacgugcucugcauaag

SEQ ID NO: 1126087 - RNA, 19 nt, Homo sapiens
aguauaaggcuuucucaau

SEQ ID NO: 1126088 - RNA, 19 nt, Homo sapiens
uagcagaugggcucaugaa

SEQ ID NO: 1126089 - RNA, 19 nt, Homo sapiens
ucaucaacccugucuucua

SEQ ID NO: 1126090 - RNA, 19 nt, Homo sapiens
gguaaucuucucugugcuu

SEQ ID NO: 1126091 - RNA, 19 nt, Homo sapiens
uaaucuccuuggccauuug

SEQ ID NO: 1126092 - RNA, 19 nt, Homo sapiens
gaacaccuucugcaaaaga

SEQ ID NO: 1126093 - RNA, 19 nt, Homo sapiens
gaaaagaaugggacgacaa

SEQ ID NO: 1126094 - RNA, 19 nt, Homo sapiens
gccaauggaaacuggauau

SEQ ID NO: 1126095 - RNA, 19 nt, Homo sapiens
ccaugcugauaaggaguua

SEQ ID NO: 1126096 - RNA, 19 nt, Homo sapiens
aguacuaccuuuccauuuu

SEQ ID NO: 1126097 - RNA, 19 nt, Homo sapiens
ggacgacaagaauguacug

SEQ ID NO: 1126098 - RNA, 19 nt, Homo sapiens
caguuacaguuugccuuaa

SEQ ID NO: 1126099 - RNA, 19 nt, Homo sapiens
gugaggggcuugugaaaca

SEQ ID NO: 1126100 - RNA, 19 nt, Homo sapiens
gaguuacuacccauacuuc

SEQ ID NO: 1126101 - RNA, 19 nt, Homo sapiens
ucccuuacauccuuuagca

SEQ ID NO: 1126102 - RNA, 19 nt, Homo sapiens
ugagacacaacuucaaauc

SEQ ID NO: 1126103 - RNA, 19 nt, Homo sapiens
ucauggcagugguaaucuu

SEQ ID NO: 1126104 - RNA, 19 nt, Homo sapiens
ccuuggaaauaccauuguu

SEQ ID NO: 1126105 - RNA, 19 nt, Homo sapiens
acuacaaccucauuuacag

SEQ ID NO: 1126106 - RNA, 19 nt, Homo sapiens
gaauaaagccacuguauga

SEQ ID NO: 1126107 - RNA, 19 nt, Homo sapiens
caagaagacucauguggua

SEQ ID NO: 1126108 - RNA, 19 nt, Homo sapiens
ggaggcagcuaucaaauau

SEQ ID NO: 1126109 - RNA, 19 nt, Homo sapiens
ucaaaugacuuaaccaaga

SEQ ID NO: 1126110 - RNA, 19 nt, Homo sapiens
caacccaugucuaucguua

SEQ ID NO: 1126111 - RNA, 19 nt, Homo sapiens
caaaugacuuaaccaagaa

SEQ ID NO: 1126112 - RNA, 19 nt, Homo sapiens
uaaagccacuguaugauuc

SEQ ID NO: 1126113 - RNA, 19 nt, Homo sapiens
gaccaucacugccaucaca

SEQ ID NO: 1126114 - RNA, 19 nt, Homo sapiens
aacaauggcugaauucaug

SEQ ID NO: 1126115 - RNA, 19 nt, Homo sapiens
ccagggaccuauucuguca

SEQ ID NO: 1126116 - RNA, 19 nt, Homo sapiens
gaacaauggcugaauucau

SEQ ID NO: 1126117 - RNA, 19 nt, Homo sapiens
gaacuggagucugucucuu

SEQ ID NO: 1126118 - RNA, 19 nt, Homo sapiens
gcaguugauucuggacaaa

SEQ ID NO: 1126119 - RNA, 19 nt, Homo sapiens
ggagugcaguggcgugauc

SEQ ID NO: 1126120 - RNA, 19 nt, Homo sapiens
cauagggaauggucagaga

SEQ ID NO: 1126121 - RNA, 19 nt, Homo sapiens
uaaugaugcugucugaaca

SEQ ID NO: 1126122 - RNA, 19 nt, Homo sapiens
agucgaagcugcacaugug

SEQ ID NO: 1126123 - RNA, 19 nt, Homo sapiens
ggucuucccugugugaugu

SEQ ID NO: 1126124 - RNA, 19 nt, Homo sapiens
aggcagcuaucaaauauca

SEQ ID NO: 1126125 - RNA, 19 nt, Homo sapiens
gcucaaaugacuuaaccaa

SEQ ID NO: 1126126 - RNA, 19 nt, Homo sapiens
gcagcuaucaaauaucaga

SEQ ID NO: 1126127 - RNA, 19 nt, Homo sapiens
uaaccaagaagacucaugu

SEQ ID NO: 1126128 - RNA, 19 nt, Homo sapiens
gucagugugggaaauauua

SEQ ID NO: 1126129 - RNA, 19 nt, Homo sapiens
caagucagugugggaaaua

SEQ ID NO: 1126130 - RNA, 19 nt, Homo sapiens
gccugaaaguaauauaaug

SEQ ID NO: 1126131 - RNA, 19 nt, Homo sapiens
ggaccuauucugucacugu

SEQ ID NO: 1126132 - RNA, 19 nt, Homo sapiens
uggcugaauucauggacua

SEQ ID NO: 1126133 - RNA, 19 nt, Homo sapiens
uggaggcagcuaucaaaua

SEQ ID NO: 1126134 - RNA, 19 nt, Homo sapiens
ccuuagugcuuccuucaga

SEQ ID NO: 1126135 - RNA, 19 nt, Homo sapiens
auauaaugaugcugucuga

SEQ ID NO: 1126136 - RNA, 19 nt, Homo sapiens
gcuauacauuaauccuguu

SEQ ID NO: 1126137 - RNA, 19 nt, Homo sapiens
auaaagccacuguaugauu

SEQ ID NO: 1126138 - RNA, 19 nt, Homo sapiens
aagaauaaagccacuguau

SEQ ID NO: 1126139 - RNA, 19 nt, Homo sapiens
guaagaauaaagccacugu

SEQ ID NO: 1126140 - RNA, 19 nt, Homo sapiens
gaagacucaugugguagca

SEQ ID NO: 1126141 - RNA, 19 nt, Homo sapiens
ucaagucagugugggaaau

SEQ ID NO: 1126142 - RNA, 19 nt, Homo sapiens
gagccauggacaacuguuu

SEQ ID NO: 1126143 - RNA, 19 nt, Homo sapiens
agaauaaagccacuguaug

SEQ ID NO: 1126144 - RNA, 19 nt, Homo sapiens
ucacugugggcucaaauga

SEQ ID NO: 1126145 - RNA, 19 nt, Homo sapiens
aaggcuggcucuagaagug

SEQ ID NO: 1126146 - RNA, 19 nt, Homo sapiens
gaauucauggacuauacuu

SEQ ID NO: 1126147 - RNA, 19 nt, Homo sapiens
cuacauagaaguauaucca

SEQ ID NO: 1126148 - RNA, 19 nt, Homo sapiens
ucuaaggaccucuacauag

SEQ ID NO: 1126149 - RNA, 19 nt, Homo sapiens
uaagaauaaagccacugua

SEQ ID NO: 1126150 - RNA, 19 nt, Homo sapiens
ggccuggucccucuuccua

SEQ ID NO: 1126151 - RNA, 19 nt, Homo sapiens
ggucccucuuccuagaaua

SEQ ID NO: 1126152 - RNA, 19 nt, Homo sapiens
ccuggucccucuuccuaga

SEQ ID NO: 1126153 - RNA, 19 nt, Homo sapiens
cuuguuugccugaaaguaa

SEQ ID NO: 1126154 - RNA, 19 nt, Homo sapiens
gauggucucgaucucuuga

SEQ ID NO: 1126155 - RNA, 19 nt, Homo sapiens
ggaacuggagucugucucu

SEQ ID NO: 1126156 - RNA, 19 nt, Homo sapiens
ccacuguaugauucucuua

SEQ ID NO: 1126157 - RNA, 19 nt, Homo sapiens
gcaaggcuggcucuagaag

SEQ ID NO: 1126158 - RNA, 19 nt, Homo sapiens
cagaacaauggcugaauuc

SEQ ID NO: 1126159 - RNA, 19 nt, Homo sapiens
gggcucaaaugacuuaacc

SEQ ID NO: 1126160 - RNA, 19 nt, Homo sapiens
guaugauucucuuaauagc

SEQ ID NO: 1126161 - RNA, 19 nt, Homo sapiens
ccuggaggcagcuaucaaa

SEQ ID NO: 1126162 - RNA, 19 nt, Homo sapiens
gcugaauucauggacuaua

SEQ ID NO: 1126163 - RNA, 19 nt, Homo sapiens
ugucuaucguuaucacaga

SEQ ID NO: 1126164 - RNA, 19 nt, Homo sapiens
gggcaacccaugucuaucg

SEQ ID NO: 1126165 - RNA, 19 nt, Homo sapiens
uaaccauguuggccaggau

SEQ ID NO: 1126166 - RNA, 19 nt, Homo sapiens
uccgggaacuggagucugu

SEQ ID NO: 1126167 - RNA, 19 nt, Homo sapiens
guauauccagggaccuauu

SEQ ID NO: 1126168 - RNA, 19 nt, Homo sapiens
cugaauucauggacuauac

SEQ ID NO: 1126169 - RNA, 19 nt, Homo sapiens
ugccucagccucccgagua

SEQ ID NO: 1126170 - RNA, 19 nt, Homo sapiens
uagggaauggucagagaaa

SEQ ID NO: 1126171 - RNA, 19 nt, Homo sapiens
ugugggcucaaaugacuua

SEQ ID NO: 1126172 - RNA, 19 nt, Homo sapiens
gggagagagagaagagaga

SEQ ID NO: 1126173 - RNA, 19 nt, Homo sapiens
aggauggucucgaucucuu

SEQ ID NO: 1126174 - RNA, 19 nt, Homo sapiens
gccacuguaugauucucuu

SEQ ID NO: 1126175 - RNA, 19 nt, Homo sapiens
caucacugccaucacauca

SEQ ID NO: 1126176 - RNA, 19 nt, Homo sapiens
cuuagugcuuccuucagaa

SEQ ID NO: 1126177 - RNA, 19 nt, Homo sapiens
acuggagucugucucuuuc

SEQ ID NO: 1126178 - RNA, 19 nt, Homo sapiens
caugcgccuugacgaguga

SEQ ID NO: 1126179 - RNA, 19 nt, Homo sapiens
ggaauggucagagaaaaga

SEQ ID NO: 1126180 - RNA, 19 nt, Homo sapiens
ggaucuagguaaagaauaa

SEQ ID NO: 1126181 - RNA, 19 nt, Homo sapiens
ccaaggagcuggucucgaa

SEQ ID NO: 1126182 - RNA, 19 nt, Homo sapiens
gaacaagaauucccguuag

SEQ ID NO: 1126183 - RNA, 19 nt, Homo sapiens
gcagagagcacaaacugua

SEQ ID NO: 1126184 - RNA, 19 nt, Homo sapiens
uggcaaagcugcuaaagug

SEQ ID NO: 1126185 - RNA, 19 nt, Homo sapiens
gaucccaucuuucuugaga

SEQ ID NO: 1126186 - RNA, 19 nt, Homo sapiens
gagcuggucucgaaagcaa

SEQ ID NO: 1126187 - RNA, 19 nt, Homo sapiens
gaagaccucccugcagaua

SEQ ID NO: 1126188 - RNA, 19 nt, Homo sapiens
gaaagcaacccacaugaag

SEQ ID NO: 1126189 - RNA, 19 nt, Homo sapiens
gcagagaguggucuuagaa

SEQ ID NO: 1126190 - RNA, 19 nt, Homo sapiens
gaacagugcagucaacaca

SEQ ID NO: 1126191 - RNA, 19 nt, Homo sapiens
ccagagagcaucaaaggaa

SEQ ID NO: 1126192 - RNA, 19 nt, Homo sapiens
gaagggaagcagaugguuu

SEQ ID NO: 1126193 - RNA, 19 nt, Homo sapiens
gggaagagcuggagaugcu

SEQ ID NO: 1126194 - RNA, 19 nt, Homo sapiens
caaauaaccaccaguaucu

SEQ ID NO: 1126195 - RNA, 19 nt, Homo sapiens
acagguaacagucaaauaa

SEQ ID NO: 1126196 - RNA, 19 nt, Homo sapiens
uaagagcccugaggaucua

SEQ ID NO: 1126197 - RNA, 19 nt, Homo sapiens
caacaucugcaaagaagaa

SEQ ID NO: 1126198 - RNA, 19 nt, Homo sapiens
gcgcaucacuaaugagcuu

SEQ ID NO: 1126199 - RNA, 19 nt, Homo sapiens
gaggagaguuauacagagu

SEQ ID NO: 1126200 - RNA, 19 nt, Homo sapiens
gaggacaggccacagguaa

SEQ ID NO: 1126201 - RNA, 19 nt, Homo sapiens
gaguggagguauuggaaga

SEQ ID NO: 1126202 - RNA, 19 nt, Homo sapiens
ucacugggcgcaucacuaa

SEQ ID NO: 1126203 - RNA, 19 nt, Homo sapiens
guacaugagugacauuuug

SEQ ID NO: 1126204 - RNA, 19 nt, Homo sapiens
cagagagcaucaaaggaaa

SEQ ID NO: 1126205 - RNA, 19 nt, Homo sapiens
gaacaagauauuccaacau

SEQ ID NO: 1126206 - RNA, 19 nt, Homo sapiens
gaugagagauccccagaga

SEQ ID NO: 1126207 - RNA, 19 nt, Homo sapiens
uggugaaacugcuuuaaga

SEQ ID NO: 1126208 - RNA, 19 nt, Homo sapiens
ggagguauuggaagagaaa

SEQ ID NO: 1126209 - RNA, 19 nt, Homo sapiens
cauaaagccuaguuguaca

SEQ ID NO: 1126210 - RNA, 19 nt, Homo sapiens
ucagagccuugcaauaugu

SEQ ID NO: 1126211 - RNA, 19 nt, Homo sapiens
cgaaagcaacccacaugaa

SEQ ID NO: 1126212 - RNA, 19 nt, Homo sapiens
gguaaagaauaaacauggu

SEQ ID NO: 1126213 - RNA, 19 nt, Homo sapiens
gagagcacaaacuguagua

SEQ ID NO: 1126214 - RNA, 19 nt, Homo sapiens
aacaagauauuccaacauc

SEQ ID NO: 1126215 - RNA, 19 nt, Homo sapiens
ggaugucauuccucucuca

SEQ ID NO: 1126216 - RNA, 19 nt, Homo sapiens
gucagagccuugcaauaug

SEQ ID NO: 1126217 - RNA, 19 nt, Homo sapiens
agucagagccuugcaauau

SEQ ID NO: 1126218 - RNA, 19 nt, Homo sapiens
gguggaggcugggaguuug

SEQ ID NO: 1126219 - RNA, 19 nt, Homo sapiens
ugugagggcuauaggaaug

SEQ ID NO: 1126220 - RNA, 19 nt, Homo sapiens
ucaaauaaccaccaguauc

SEQ ID NO: 1126221 - RNA, 19 nt, Homo sapiens
ugacaaggccuucuucaac

SEQ ID NO: 1126222 - RNA, 19 nt, Homo sapiens
ggaagccaggaacaagaua

SEQ ID NO: 1126223 - RNA, 19 nt, Homo sapiens
ggaauggcaaagcugcuaa

SEQ ID NO: 1126224 - RNA, 19 nt, Homo sapiens
ggacaggccacagguaaca

SEQ ID NO: 1126225 - RNA, 19 nt, Homo sapiens
cagaagucauggccagaga

SEQ ID NO: 1126226 - RNA, 19 nt, Homo sapiens
guauggcccuggcacuguu

SEQ ID NO: 1126227 - RNA, 19 nt, Homo sapiens
gcccugaggaucuagguaa

SEQ ID NO: 1126228 - RNA, 19 nt, Homo sapiens
gagaugcugccaacacaug

SEQ ID NO: 1126229 - RNA, 19 nt, Homo sapiens
aacaagaauucccguuaga

SEQ ID NO: 1126230 - RNA, 19 nt, Homo sapiens
gaagccaggaacaagauau

SEQ ID NO: 1126231 - RNA, 19 nt, Homo sapiens
uggagaggcugcacaaguc

SEQ ID NO: 1126232 - RNA, 19 nt, Homo sapiens
gugaaacugcuuuaagaug

SEQ ID NO: 1126233 - RNA, 19 nt, Homo sapiens
ccauaaagccuaguuguac

SEQ ID NO: 1126234 - RNA, 19 nt, Homo sapiens
gaggaucuagguaaagaau

SEQ ID NO: 1126235 - RNA, 19 nt, Homo sapiens
gagcacaaacuguaguagu

SEQ ID NO: 1126236 - RNA, 19 nt, Homo sapiens
cagcagagagcacaaacug

SEQ ID NO: 1126237 - RNA, 19 nt, Homo sapiens
acagugcagucaacacaga

SEQ ID NO: 1126238 - RNA, 19 nt, Homo sapiens
gcaagaagggaagcagaug

SEQ ID NO: 1126239 - RNA, 19 nt, Homo sapiens
ccuggaagguccuaaagag

SEQ ID NO: 1126240 - RNA, 19 nt, Homo sapiens
gaauggcaaagcugcuaaa

SEQ ID NO: 1126241 - RNA, 19 nt, Homo sapiens
ggccacagguaacagucaa

SEQ ID NO: 1126242 - RNA, 19 nt, Homo sapiens
aaauauucgaggagaguua

SEQ ID NO: 1126243 - RNA, 19 nt, Homo sapiens
cugaggaucuagguaaaga

SEQ ID NO: 1126244 - RNA, 19 nt, Homo sapiens
caacacauggguccuagca

SEQ ID NO: 1126245 - RNA, 19 nt, Homo sapiens
uccaacaucugcaaagaag

SEQ ID NO: 1126246 - RNA, 19 nt, Homo sapiens
gauauuccaacaucugcaa

SEQ ID NO: 1126247 - RNA, 19 nt, Homo sapiens
ggugaacagugcagucaac

SEQ ID NO: 1126248 - RNA, 19 nt, Homo sapiens
ucuguaggauacucacuga

SEQ ID NO: 1126249 - RNA, 19 nt, Homo sapiens
cccauaaagccuaguugua

SEQ ID NO: 1126250 - RNA, 19 nt, Homo sapiens
agucaaauaaccaccagua

SEQ ID NO: 1126251 - RNA, 19 nt, Homo sapiens
guaaauauucgaggagagu

SEQ ID NO: 1126252 - RNA, 19 nt, Homo sapiens
gcagcagagaguggucuua

SEQ ID NO: 1126253 - RNA, 19 nt, Homo sapiens
ggagucagagccuugcaau

SEQ ID NO: 1126254 - RNA, 19 nt, Homo sapiens
cagccugaguggagguauu

SEQ ID NO: 1126255 - RNA, 19 nt, Homo sapiens
aagaauucccguuagacua

SEQ ID NO: 1126256 - RNA, 19 nt, Homo sapiens
gagucagagccuugcaaua

SEQ ID NO: 1126257 - RNA, 19 nt, Homo sapiens
cuuagaagaggaugucauu

SEQ ID NO: 1126258 - RNA, 19 nt, Homo sapiens
ucugccaccuucccauaaa

SEQ ID NO: 1126259 - RNA, 19 nt, Homo sapiens
agaccucccugcagauaag

SEQ ID NO: 1126260 - RNA, 19 nt, Homo sapiens
gggaagcugaacacagaaa

SEQ ID NO: 1126261 - RNA, 19 nt, Homo sapiens
cccagagacugauggugaa

SEQ ID NO: 1126262 - RNA, 19 nt, Homo sapiens
ggugaaacugcuuuaagau

SEQ ID NO: 1126263 - RNA, 19 nt, Homo sapiens
caauaugucaguggaacaa

SEQ ID NO: 1126264 - RNA, 19 nt, Homo sapiens
agcacaaacuguaguagug

SEQ ID NO: 1126265 - RNA, 19 nt, Homo sapiens
guggagguauuggaagaga

SEQ ID NO: 1126266 - RNA, 19 nt, Homo sapiens
ugagugacauuuuguuuca

SEQ ID NO: 1126267 - RNA, 19 nt, Homo sapiens
caagaauucccguuagacu

SEQ ID NO: 1126268 - RNA, 19 nt, Homo sapiens
uggagaugcugccaacaca

SEQ ID NO: 1126269 - RNA, 19 nt, Homo sapiens
guugugagggcuauaggaa

SEQ ID NO: 1126270 - RNA, 19 nt, Homo sapiens
guggguggauccucugaag

SEQ ID NO: 1126271 - RNA, 19 nt, Homo sapiens
ucgaggagaguuauacaga

SEQ ID NO: 1126272 - RNA, 19 nt, Homo sapiens
aaacagcagagagcacaaa

SEQ ID NO: 1126273 - RNA, 19 nt, Homo sapiens
gggaagccaggaacaagau

SEQ ID NO: 1126274 - RNA, 19 nt, Homo sapiens
uaaagaggagaaaguagca

SEQ ID NO: 1126275 - RNA, 19 nt, Homo sapiens
uaaccaggaccucagaagu

SEQ ID NO: 1126276 - RNA, 19 nt, Homo sapiens
ucacuguucauuucuggaa

SEQ ID NO: 1126277 - RNA, 19 nt, Homo sapiens
uauacagaguggcugacaa

SEQ ID NO: 1126278 - RNA, 19 nt, Homo sapiens
ggguccugcuuguggaauu

SEQ ID NO: 1126279 - RNA, 19 nt, Homo sapiens
gcaaagaagaaaaggauca

SEQ ID NO: 1126280 - RNA, 19 nt, Homo sapiens
gaaagaagcucugucacaa

SEQ ID NO: 1126281 - RNA, 19 nt, Homo sapiens
gaugucagauguaaaugua

SEQ ID NO: 1126282 - RNA, 19 nt, Homo sapiens
ucaaagagcugacuuacuc

SEQ ID NO: 1126283 - RNA, 19 nt, Homo sapiens
gaagaaagaagcucuguca

SEQ ID NO: 1126284 - RNA, 19 nt, Homo sapiens
caaggugacuagaaagaaa

SEQ ID NO: 1126285 - RNA, 19 nt, Homo sapiens
ugaaaggucuaaccauuau

SEQ ID NO: 1126286 - RNA, 19 nt, Homo sapiens
gaaagaaacaggcagacaa

SEQ ID NO: 1126287 - RNA, 19 nt, Homo sapiens
caaucaagguuaccauuau

SEQ ID NO: 1126288 - RNA, 19 nt, Homo sapiens
gcucaaagucagccaauaa

SEQ ID NO: 1126289 - RNA, 19 nt, Homo sapiens
gcagacaacuggaaagaac

SEQ ID NO: 1126290 - RNA, 19 nt, Homo sapiens
gagcugacuuacucauuug

SEQ ID NO: 1126291 - RNA, 19 nt, Homo sapiens
uaucugcccucccuauaaa

SEQ ID NO: 1126292 - RNA, 19 nt, Homo sapiens
gagccaacgugcugaacaa

SEQ ID NO: 1126293 - RNA, 19 nt, Homo sapiens
ccaagaauuucgaggaugu

SEQ ID NO: 1126294 - RNA, 19 nt, Homo sapiens
gaagcucugucacaaucaa

SEQ ID NO: 1126295 - RNA, 19 nt, Homo sapiens
ucagaaagauugugauugc

SEQ ID NO: 1126296 - RNA, 19 nt, Homo sapiens
ucugaaaggucuaaccauu

SEQ ID NO: 1126297 - RNA, 19 nt, Homo sapiens
uaaaaugccugguggcuuu

SEQ ID NO: 1126298 - RNA, 19 nt, Homo sapiens
agagcugacuuacucauuu

SEQ ID NO: 1126299 - RNA, 19 nt, Homo sapiens
acagagugaugaugauauu

SEQ ID NO: 1126300 - RNA, 19 nt, Homo sapiens
ggccugauguagaagcaua

SEQ ID NO: 1126301 - RNA, 19 nt, Homo sapiens
cuaaggacuuggacacuug

SEQ ID NO: 1126302 - RNA, 19 nt, Homo sapiens
ugucugcacuucaugguaa

SEQ ID NO: 1126303 - RNA, 19 nt, Homo sapiens
gaaagaacugacuggguuu

SEQ ID NO: 1126304 - RNA, 19 nt, Homo sapiens
gaggaugucagauguaaau

SEQ ID NO: 1126305 - RNA, 19 nt, Homo sapiens
aagccucccuggauugaua

SEQ ID NO: 1126306 - RNA, 19 nt, Homo sapiens
gaacaagguagaauaugca

SEQ ID NO: 1126307 - RNA, 19 nt, Homo sapiens
gcaaauaugaagaaagaag

SEQ ID NO: 1126308 - RNA, 19 nt, Homo sapiens
gugggugccucuucugaaa

SEQ ID NO: 1126309 - RNA, 19 nt, Homo sapiens
cauguacugugaugucuga

SEQ ID NO: 1126310 - RNA, 19 nt, Homo sapiens
acaaucaagguuaccauua

SEQ ID NO: 1126311 - RNA, 19 nt, Homo sapiens
aagaagcucugucacaauc

SEQ ID NO: 1126312 - RNA, 19 nt, Homo sapiens
gaauuucgaggaugucaga

SEQ ID NO: 1126313 - RNA, 19 nt, Homo sapiens
uagccagccucaucaaaga

SEQ ID NO: 1126314 - RNA, 19 nt, Homo sapiens
gaccuuaccuucuauuuuc

SEQ ID NO: 1126315 - RNA, 19 nt, Homo sapiens
gaauucaaggugacuagaa

SEQ ID NO: 1126316 - RNA, 19 nt, Homo sapiens
cugaaaggucuaaccauua

SEQ ID NO: 1126317 - RNA, 19 nt, Homo sapiens
gcaaugcauccuagaacaa

SEQ ID NO: 1126318 - RNA, 19 nt, Homo sapiens
gauacagagugaugaugau

SEQ ID NO: 1126319 - RNA, 19 nt, Homo sapiens
gugauugccuucauguugu

SEQ ID NO: 1126320 - RNA, 19 nt, Homo sapiens
ugugaugucugaugcaaug

SEQ ID NO: 1126321 - RNA, 19 nt, Homo sapiens
guaucugcccucccuauaa

SEQ ID NO: 1126322 - RNA, 19 nt, Homo sapiens
ugaaguccuuuaccuggaa

SEQ ID NO: 1126323 - RNA, 19 nt, Homo sapiens
gccuguaaauuaucuugaa

SEQ ID NO: 1126324 - RNA, 19 nt, Homo sapiens
ugaacaagguagaauaugc

SEQ ID NO: 1126325 - RNA, 19 nt, Homo sapiens
ucgaggaugucagauguaa

SEQ ID NO: 1126326 - RNA, 19 nt, Homo sapiens
uguuugagcuccaaugugu

SEQ ID NO: 1126327 - RNA, 19 nt, Homo sapiens
gucuaaccauuauuggaua

SEQ ID NO: 1126328 - RNA, 19 nt, Homo sapiens
ggucuaaccauuauuggau

SEQ ID NO: 1126329 - RNA, 19 nt, Homo sapiens
cuuggacacuugcaauaaa

SEQ ID NO: 1126330 - RNA, 19 nt, Homo sapiens
ggaacaagcacucucuuuu

SEQ ID NO: 1126331 - RNA, 19 nt, Homo sapiens
ggacacuugcaauaaagaa

SEQ ID NO: 1126332 - RNA, 19 nt, Homo sapiens
ggacuuggacacuugcaau

SEQ ID NO: 1126333 - RNA, 19 nt, Homo sapiens
caucuucuaguaccuuuaa

SEQ ID NO: 1126334 - RNA, 19 nt, Homo sapiens
gccaauaagucuuuuccua

SEQ ID NO: 1126335 - RNA, 19 nt, Homo sapiens
caaagucagccaauaaguc

SEQ ID NO: 1126336 - RNA, 19 nt, Homo sapiens
gcugaacaagguagaauau

SEQ ID NO: 1126337 - RNA, 19 nt, Homo sapiens
ccaacgugcugaacaaggu

SEQ ID NO: 1126338 - RNA, 19 nt, Homo sapiens
auacacauuugucagcauu

SEQ ID NO: 1126339 - RNA, 19 nt, Homo sapiens
aagaacauaucucagaaag

SEQ ID NO: 1126340 - RNA, 19 nt, Homo sapiens
ccugggaagugguuaacaa

SEQ ID NO: 1126341 - RNA, 19 nt, Homo sapiens
aauucaaggugacuagaaa

SEQ ID NO: 1126342 - RNA, 19 nt, Homo sapiens
ggacaugcacaguugauac

SEQ ID NO: 1126343 - RNA, 19 nt, Homo sapiens
aaacauagucuuggugugu

SEQ ID NO: 1126344 - RNA, 19 nt, Homo sapiens
uaaauagaccuuaccuucu

SEQ ID NO: 1126345 - RNA, 19 nt, Homo sapiens
gcugugaaugcaaauauga

SEQ ID NO: 1126346 - RNA, 19 nt, Homo sapiens
gugagaggcagcuguuuga

SEQ ID NO: 1126347 - RNA, 19 nt, Homo sapiens
gacuuacucauuugacuuu

SEQ ID NO: 1126348 - RNA, 19 nt, Homo sapiens
cuacuucuguacaugguau

SEQ ID NO: 1126349 - RNA, 19 nt, Homo sapiens
aaaggucuaaccauuauug

SEQ ID NO: 1126350 - RNA, 19 nt, Homo sapiens
ggugagaggcagcuguuug

SEQ ID NO: 1126351 - RNA, 19 nt, Homo sapiens
ucccuggauugauaauaua

SEQ ID NO: 1126352 - RNA, 19 nt, Homo sapiens
caaugcauccuagaacaaa

SEQ ID NO: 1126353 - RNA, 19 nt, Homo sapiens
gauugugauugccuucaug

SEQ ID NO: 1126354 - RNA, 19 nt, Homo sapiens
agaaagaagcucugucaca

SEQ ID NO: 1126355 - RNA, 19 nt, Homo sapiens
gacuuggacacuugcaaua

SEQ ID NO: 1126356 - RNA, 19 nt, Homo sapiens
ccuaaggacuuggacacuu

SEQ ID NO: 1126357 - RNA, 19 nt, Homo sapiens
ugauacagagugaugauga

SEQ ID NO: 1126358 - RNA, 19 nt, Homo sapiens
gaaaggucuaaccauuauu

SEQ ID NO: 1126359 - RNA, 19 nt, Homo sapiens
ugucagauguaaauguauc

SEQ ID NO: 1126360 - RNA, 19 nt, Homo sapiens
ggaugucagauguaaaugu

SEQ ID NO: 1126361 - RNA, 19 nt, Homo sapiens
cacaguugauacagaguga

SEQ ID NO: 1126362 - RNA, 19 nt, Homo sapiens
uagaacaaacuggccauuu

SEQ ID NO: 1126363 - RNA, 19 nt, Homo sapiens
ucaucaaagagcugacuua

SEQ ID NO: 1126364 - RNA, 19 nt, Homo sapiens
uguccucuuuggaauguaa

SEQ ID NO: 1126365 - RNA, 19 nt, Homo sapiens
caugguaaacgggaucuaa

SEQ ID NO: 1126366 - RNA, 19 nt, Homo sapiens
ggcauguuguccucagcua

SEQ ID NO: 1126367 - RNA, 19 nt, Homo sapiens
caugcacaguugauacaga

SEQ ID NO: 1126368 - RNA, 19 nt, Homo sapiens
cucccuggauugauaauau

SEQ ID NO: 1126369 - RNA, 19 nt, Homo sapiens
cauacugucuacgcuguga

SEQ ID NO: 1126370 - RNA, 19 nt, Homo sapiens
acacauuugucagcauuuc

SEQ ID NO: 1126371 - RNA, 19 nt, Homo sapiens
gccauuugcuaguuuacuc

SEQ ID NO: 1126372 - RNA, 19 nt, Homo sapiens
guagccagccucaucaaag

SEQ ID NO: 1126373 - RNA, 19 nt, Homo sapiens
gcuggaagauucaaaacug

SEQ ID NO: 1126374 - RNA, 19 nt, Homo sapiens
gcauguuguccucagcuaa

SEQ ID NO: 1126375 - RNA, 19 nt, Homo sapiens
ugugauugccuucauguug

SEQ ID NO: 1126376 - RNA, 19 nt, Homo sapiens
uccaaugugugcagcuuug

SEQ ID NO: 1126377 - RNA, 19 nt, Homo sapiens
gcuccaaugugugcagcuu

SEQ ID NO: 1126378 - RNA, 19 nt, Homo sapiens
uuucgaggaugucagaugu

SEQ ID NO: 1126379 - RNA, 19 nt, Homo sapiens
cuugguguguguggucuua

SEQ ID NO: 1126380 - RNA, 19 nt, Homo sapiens
ccagggacauuauccauua

SEQ ID NO: 1126381 - RNA, 19 nt, Homo sapiens
gcaaagaggugagaaugug

SEQ ID NO: 1126382 - RNA, 19 nt, Homo sapiens
ucaaacaggugccaggaua

SEQ ID NO: 1126383 - RNA, 19 nt, Homo sapiens
gcaagugaauugucuaagu

SEQ ID NO: 1126384 - RNA, 19 nt, Homo sapiens
caagugaauugucuaaguu

SEQ ID NO: 1126385 - RNA, 19 nt, Homo sapiens
uuagagaucuugucugguu

SEQ ID NO: 1126386 - RNA, 19 nt, Homo sapiens
ccacaagcaugaaggagaa

SEQ ID NO: 1126387 - RNA, 19 nt, Homo sapiens
ggauaccuaugucuuagaa

SEQ ID NO: 1126388 - RNA, 19 nt, Homo sapiens
caugcaaccucauaauauu

SEQ ID NO: 1126389 - RNA, 19 nt, Homo sapiens
caagaacgcagaccugauu

SEQ ID NO: 1126390 - RNA, 19 nt, Homo sapiens
cagucuaacucuuucauuu

SEQ ID NO: 1126391 - RNA, 19 nt, Homo sapiens
caaaugccguagugacuug

SEQ ID NO: 1126392 - RNA, 19 nt, Homo sapiens
ucucugaagugcaucauaa

SEQ ID NO: 1126393 - RNA, 19 nt, Homo sapiens
gacaugcaaccucauaaua

SEQ ID NO: 1126394 - RNA, 19 nt, Homo sapiens
ugaggaggaugacaugauu

SEQ ID NO: 1126395 - RNA, 19 nt, Homo sapiens
gauaagcaccggcugauca

SEQ ID NO: 1126396 - RNA, 19 nt, Homo sapiens
gaggugagaauguguuaaa

SEQ ID NO: 1126397 - RNA, 19 nt, Homo sapiens
ucagaccucucuagacuau

SEQ ID NO: 1126398 - RNA, 19 nt, Homo sapiens
ccaggauaccuaugucuua

SEQ ID NO: 1126399 - RNA, 19 nt, Homo sapiens
gaagacagacaaggaagaa

SEQ ID NO: 1126400 - RNA, 19 nt, Homo sapiens
gaccaaguccuuccaucua

SEQ ID NO: 1126401 - RNA, 19 nt, Homo sapiens
gacagucucuuugaaugaa

SEQ ID NO: 1126402 - RNA, 19 nt, Homo sapiens
caaaguagugggccagauu

SEQ ID NO: 1126403 - RNA, 19 nt, Homo sapiens
ucaaggagcaugucaaauc

SEQ ID NO: 1126404 - RNA, 19 nt, Homo sapiens
ucucaaguauggauuaugu

SEQ ID NO: 1126405 - RNA, 19 nt, Homo sapiens
ucaaaucccacaagcauga

SEQ ID NO: 1126406 - RNA, 19 nt, Homo sapiens
gaaagagcccagggacauu

SEQ ID NO: 1126407 - RNA, 19 nt, Homo sapiens
ggacaugcaaccucauaau

SEQ ID NO: 1126408 - RNA, 19 nt, Homo sapiens
cagguucugugucuccaua

SEQ ID NO: 1126409 - RNA, 19 nt, Homo sapiens
acgcagaccugauuuccaa

SEQ ID NO: 1126410 - RNA, 19 nt, Homo sapiens
caaguccuuccaucuaaua

SEQ ID NO: 1126411 - RNA, 19 nt, Homo sapiens
aaaccaaccugucuaagcu

SEQ ID NO: 1126412 - RNA, 19 nt, Homo sapiens
caugcugccucauuuguau

SEQ ID NO: 1126413 - RNA, 19 nt, Homo sapiens
guucauauauuaggucagu

SEQ ID NO: 1126414 - RNA, 19 nt, Homo sapiens
aaagagcccagggacauua

SEQ ID NO: 1126415 - RNA, 19 nt, Homo sapiens
ggaagacagacaaggaaga

SEQ ID NO: 1126416 - RNA, 19 nt, Homo sapiens
gaaaccaaccugucuaagc

SEQ ID NO: 1126417 - RNA, 19 nt, Homo sapiens
aaacuugucccuuggucua

SEQ ID NO: 1126418 - RNA, 19 nt, Homo sapiens
cauuauccauuacagucua

SEQ ID NO: 1126419 - RNA, 19 nt, Homo sapiens
uagagaucuugucugguua

SEQ ID NO: 1126420 - RNA, 19 nt, Homo sapiens
cagagaggcaagugaauug

SEQ ID NO: 1126421 - RNA, 19 nt, Homo sapiens
ucauaaacuuggauaagca

SEQ ID NO: 1126422 - RNA, 19 nt, Homo sapiens
aaagaagucugaggaggau

SEQ ID NO: 1126423 - RNA, 19 nt, Homo sapiens
agaccucucuagacuauag

SEQ ID NO: 1126424 - RNA, 19 nt, Homo sapiens
ggacagauugggacucaag

SEQ ID NO: 1126425 - RNA, 19 nt, Homo sapiens
ugacugaagggaccaagaa

SEQ ID NO: 1126426 - RNA, 19 nt, Homo sapiens
cauuacagucuaacucuuu

SEQ ID NO: 1126427 - RNA, 19 nt, Homo sapiens
ucaaguauggauuauguga

SEQ ID NO: 1126428 - RNA, 19 nt, Homo sapiens
ucucacuuguggccuauuu

SEQ ID NO: 1126429 - RNA, 19 nt, Homo sapiens
ccaaguccuuccaucuaau

SEQ ID NO: 1126430 - RNA, 19 nt, Homo sapiens
accaaguccuuccaucuaa

SEQ ID NO: 1126431 - RNA, 19 nt, Homo sapiens
ugaaccaaaugccguagug

SEQ ID NO: 1126432 - RNA, 19 nt, Homo sapiens
gugaaagccuugguugaca

SEQ ID NO: 1126433 - RNA, 19 nt, Homo sapiens
ccagagaggcaagugaauu

SEQ ID NO: 1126434 - RNA, 19 nt, Homo sapiens
cuacuuugaucacuuaacu

SEQ ID NO: 1126435 - RNA, 19 nt, Homo sapiens
gaaccaaaugccguaguga

SEQ ID NO: 1126436 - RNA, 19 nt, Homo sapiens
acaccggguugacagauug

SEQ ID NO: 1126437 - RNA, 19 nt, Homo sapiens
cagcugugguugaugacaa

SEQ ID NO: 1126438 - RNA, 19 nt, Homo sapiens
caaggagcaugucaaaucc

SEQ ID NO: 1126439 - RNA, 19 nt, Homo sapiens
gggcaaagaggugagaaug

SEQ ID NO: 1126440 - RNA, 19 nt, Homo sapiens
caggauaccuaugucuuag

SEQ ID NO: 1126441 - RNA, 19 nt, Homo sapiens
ggacauuauccauuacagu

SEQ ID NO: 1126442 - RNA, 19 nt, Homo sapiens
acaugcaaccucauaauau

SEQ ID NO: 1126443 - RNA, 19 nt, Homo sapiens
agacagacaaggaagaaau

SEQ ID NO: 1126444 - RNA, 19 nt, Homo sapiens
ugaaagagcccagggacau

SEQ ID NO: 1126445 - RNA, 19 nt, Homo sapiens
ugaagcaggcggugcaguu

SEQ ID NO: 1126446 - RNA, 19 nt, Homo sapiens
ccaggaauuugcuuuuauu

SEQ ID NO: 1126447 - RNA, 19 nt, Homo sapiens
guggacagauugggacuca

SEQ ID NO: 1126448 - RNA, 19 nt, Homo sapiens
gaagcaggcggugcaguuc

SEQ ID NO: 1126449 - RNA, 19 nt, Homo sapiens
guauggauuaugugaaaga

SEQ ID NO: 1126450 - RNA, 19 nt, Homo sapiens
gaggaggaugacaugauuu

SEQ ID NO: 1126451 - RNA, 19 nt, Homo sapiens
ccauuacagucuaacucuu

SEQ ID NO: 1126452 - RNA, 19 nt, Homo sapiens
ggacucaaggagcauguca

SEQ ID NO: 1126453 - RNA, 19 nt, Homo sapiens
ucauauauuaggucaguga

SEQ ID NO: 1126454 - RNA, 19 nt, Homo sapiens
caucauaaacuuggauaag

SEQ ID NO: 1126455 - RNA, 19 nt, Homo sapiens
uauaaucucaucucuuugg

SEQ ID NO: 1126456 - RNA, 19 nt, Homo sapiens
uggaaaccaaccugucuaa

SEQ ID NO: 1126457 - RNA, 19 nt, Homo sapiens
caaguauggauuaugugaa

SEQ ID NO: 1126458 - RNA, 19 nt, Homo sapiens
cacaccggguugacagauu

SEQ ID NO: 1126459 - RNA, 19 nt, Homo sapiens
ccucuaagacgaacaaacu

SEQ ID NO: 1126460 - RNA, 19 nt, Homo sapiens
caaagaggugagaaugugu

SEQ ID NO: 1126461 - RNA, 19 nt, Homo sapiens
ggcaaagaggugagaaugu

SEQ ID NO: 1126462 - RNA, 19 nt, Homo sapiens
ccaugcugccucauuugua

SEQ ID NO: 1126463 - RNA, 19 nt, Homo sapiens
gagaucuugucugguuaug

SEQ ID NO: 1126464 - RNA, 19 nt, Homo sapiens
auucagaccucucuagacu

SEQ ID NO: 1126465 - RNA, 19 nt, Homo sapiens
ccaaaugccguagugacuu

SEQ ID NO: 1126466 - RNA, 19 nt, Homo sapiens
ugucaaaucccacaagcau

SEQ ID NO: 1126467 - RNA, 19 nt, Homo sapiens
gaacgcagaccugauuucc

SEQ ID NO: 1126468 - RNA, 19 nt, Homo sapiens
agaggcaagugaauugucu

SEQ ID NO: 1126469 - RNA, 19 nt, Homo sapiens
caaacucaaucaggcuaag

SEQ ID NO: 1126470 - RNA, 19 nt, Homo sapiens
uucugugucuccauagaua

SEQ ID NO: 1126471 - RNA, 19 nt, Homo sapiens
gcugccagguucugugucu

SEQ ID NO: 1126472 - RNA, 19 nt, Homo sapiens
gacagacaaggaagaaauc

SEQ ID NO: 1126473 - RNA, 19 nt, Homo sapiens
gcaucauaaacuuggauaa

SEQ ID NO: 1126474 - RNA, 19 nt, Homo sapiens
agacgaacaaacucaauca

SEQ ID NO: 1126475 - RNA, 19 nt, Homo sapiens
cucccaugcugccucauuu

SEQ ID NO: 1126476 - RNA, 19 nt, Homo sapiens
gguucugugucuccauaga

SEQ ID NO: 1126477 - RNA, 19 nt, Homo sapiens
cagauugagcaccuaguga

SEQ ID NO: 1126478 - RNA, 19 nt, Homo sapiens
acucaaggagcaugucaaa

SEQ ID NO: 1126479 - RNA, 19 nt, Homo sapiens
gaaagccuugguugacaca

SEQ ID NO: 1126480 - RNA, 19 nt, Homo sapiens
gaguugcuguuuccaaaua

SEQ ID NO: 1126481 - RNA, 19 nt, Homo sapiens
ggugaaaugugucaaugaa

SEQ ID NO: 1126482 - RNA, 19 nt, Homo sapiens
gacccuauguucagaauug

SEQ ID NO: 1126483 - RNA, 19 nt, Homo sapiens
ugacaaacuuccuaucuuc

SEQ ID NO: 1126484 - RNA, 19 nt, Homo sapiens
gaauaacccuggaaaaguu

SEQ ID NO: 1126485 - RNA, 19 nt, Homo sapiens
guucagaauuguuugaguu

SEQ ID NO: 1126486 - RNA, 19 nt, Homo sapiens
aagcugagaccaagaauaa

SEQ ID NO: 1126487 - RNA, 19 nt, Homo sapiens
gagcugcgaucaaguacau

SEQ ID NO: 1126488 - RNA, 19 nt, Homo sapiens
cgacaaaacucagguuaaa

SEQ ID NO: 1126489 - RNA, 19 nt, Homo sapiens
ucagagcugcgaucaagua

SEQ ID NO: 1126490 - RNA, 19 nt, Homo sapiens
cuuccuaucuucccugauu

SEQ ID NO: 1126491 - RNA, 19 nt, Homo sapiens
ggaaaugauggacaacaga

SEQ ID NO: 1126492 - RNA, 19 nt, Homo sapiens
ccucagagcugcgaucaag

SEQ ID NO: 1126493 - RNA, 19 nt, Homo sapiens
gagaagcgacucagcaaag

SEQ ID NO: 1126494 - RNA, 19 nt, Homo sapiens
aaaguuuccuccaugauag

SEQ ID NO: 1126495 - RNA, 19 nt, Homo sapiens
gcugcgaucaaguacauua

SEQ ID NO: 1126496 - RNA, 19 nt, Homo sapiens
aagaggaaaugauggacaa

SEQ ID NO: 1126497 - RNA, 19 nt, Homo sapiens
ccaagaauaacccuggaaa

SEQ ID NO: 1126498 - RNA, 19 nt, Homo sapiens
ucaaguacauuaacuaccu

SEQ ID NO: 1126499 - RNA, 19 nt, Homo sapiens
ccaccaugcugacccuaug

SEQ ID NO: 1126500 - RNA, 19 nt, Homo sapiens
ucucuucuguacccugaua

SEQ ID NO: 1126501 - RNA, 19 nt, Homo sapiens
ggagaagcgacucagcaaa

SEQ ID NO: 1126502 - RNA, 19 nt, Homo sapiens
gguuaaagaggaaaugaug

SEQ ID NO: 1126503 - RNA, 19 nt, Homo sapiens
uuaacuaccugcagucucu

SEQ ID NO: 1126504 - RNA, 19 nt, Homo sapiens
gaucaaguacauuaacuac

SEQ ID NO: 1126505 - RNA, 19 nt, Homo sapiens
aaaggcagcgggugaaaug

SEQ ID NO: 1126506 - RNA, 19 nt, Homo sapiens
gaaaggcagcgggugaaau

SEQ ID NO: 1126507 - RNA, 19 nt, Homo sapiens
ggaaaggcagcgggugaaa

SEQ ID NO: 1126508 - RNA, 19 nt, Homo sapiens
ccugggaaauuacagugaa

SEQ ID NO: 1126509 - RNA, 19 nt, Homo sapiens
ucucuuauccugggaaauu

SEQ ID NO: 1126510 - RNA, 19 nt, Homo sapiens
uagucuaccugacaaacuu

SEQ ID NO: 1126511 - RNA, 19 nt, Homo sapiens
gcgaucaaguacauuaacu

SEQ ID NO: 1126512 - RNA, 19 nt, Homo sapiens
caaaguggaaacccucaga

SEQ ID NO: 1126513 - RNA, 19 nt, Homo sapiens
cugacaaacuuccuaucuu

SEQ ID NO: 1126514 - RNA, 19 nt, Homo sapiens
uugaguugcuguuuccaaa

SEQ ID NO: 1126515 - RNA, 19 nt, Homo sapiens
cccgaugccuuauccaaau

SEQ ID NO: 1126516 - RNA, 19 nt, Homo sapiens
ccgaugccuuauccaaauu

SEQ ID NO: 1126517 - RNA, 19 nt, Homo sapiens
ggcagcgggugaaaugugu

SEQ ID NO: 1126518 - RNA, 19 nt, Homo sapiens
cagaggaguauuuggagaa

SEQ ID NO: 1126519 - RNA, 19 nt, Homo sapiens
ccuauguucagaauuguuu

SEQ ID NO: 1126520 - RNA, 19 nt, Homo sapiens
uggagcccauggucacuuu

SEQ ID NO: 1126521 - RNA, 19 nt, Homo sapiens
acagcauccugacgacaaa

SEQ ID NO: 1126522 - RNA, 19 nt, Homo sapiens
gaagcgacucagcaaagug

SEQ ID NO: 1126523 - RNA, 19 nt, Homo sapiens
uuaaagaggaaaugaugga

SEQ ID NO: 1126524 - RNA, 19 nt, Homo sapiens
caacucagcccaaaauaca

SEQ ID NO: 1126525 - RNA, 19 nt, Homo sapiens
cgaucaaguacauuaacua

SEQ ID NO: 1126526 - RNA, 19 nt, Homo sapiens
ucucuuucccgaugccuua

SEQ ID NO: 1126527 - RNA, 19 nt, Homo sapiens
aaagcugagaccaagaaua

SEQ ID NO: 1126528 - RNA, 19 nt, Homo sapiens
aaaaguuuccuccaugaua

SEQ ID NO: 1126529 - RNA, 19 nt, Homo sapiens
gauaaagcugagaccaaga

SEQ ID NO: 1126530 - RNA, 19 nt, Homo sapiens
cgaugccuuauccaaauua

SEQ ID NO: 1126531 - RNA, 19 nt, Homo sapiens
uaccugcagucucuucugu

SEQ ID NO: 1126532 - RNA, 19 nt, Homo sapiens
agaagcgacucagcaaagu

SEQ ID NO: 1126533 - RNA, 19 nt, Homo sapiens
gggugaaaugugucaauga

SEQ ID NO: 1126534 - RNA, 19 nt, Homo sapiens
cgggugaaaugugucaaug

SEQ ID NO: 1126535 - RNA, 19 nt, Homo sapiens
auaaagcugagaccaagaa

SEQ ID NO: 1126536 - RNA, 19 nt, Homo sapiens
cgacucagcaaaguggaaa

SEQ ID NO: 1126537 - RNA, 19 nt, Homo sapiens
uuacagagggugcgaguac

SEQ ID NO: 1126538 - RNA, 19 nt, Homo sapiens
gaggaaaugauggacaaca

SEQ ID NO: 1126539 - RNA, 19 nt, Homo sapiens
gggaaaggcagcgggugaa

SEQ ID NO: 1126540 - RNA, 19 nt, Homo sapiens
gagggugcgaguacuccua

SEQ ID NO: 1126541 - RNA, 19 nt, Homo sapiens
acucuagucuaccugacaa

SEQ ID NO: 1126542 - RNA, 19 nt, Homo sapiens
cagaauuguuugaguugcu

SEQ ID NO: 1126543 - RNA, 19 nt, Homo sapiens
ucugcccgcuugccacuga

SEQ ID NO: 1126544 - RNA, 19 nt, Homo sapiens
guugcuguuuccaaauaga

SEQ ID NO: 1126545 - RNA, 19 nt, Homo sapiens
acaaaacucagguuaaaga

SEQ ID NO: 1126546 - RNA, 19 nt, Homo sapiens
cucuuauccugggaaauua

SEQ ID NO: 1126547 - RNA, 19 nt, Homo sapiens
cgaagaagcuuucagacua

SEQ ID NO: 1126548 - RNA, 19 nt, Homo sapiens
ggauaacacugcuuugaaa

SEQ ID NO: 1126549 - RNA, 19 nt, Homo sapiens
gcucagaaauggaagaauu

SEQ ID NO: 1126550 - RNA, 19 nt, Homo sapiens
gagauuagcucaccuuucu

SEQ ID NO: 1126551 - RNA, 19 nt, Homo sapiens
gaacgaagaagcuuucaga

SEQ ID NO: 1126552 - RNA, 19 nt, Homo sapiens
aagaggagcucaagagauu

SEQ ID NO: 1126553 - RNA, 19 nt, Homo sapiens
cagcggaggugcaguguuu

SEQ ID NO: 1126554 - RNA, 19 nt, Homo sapiens
gcauauuucucccuccuaa

SEQ ID NO: 1126555 - RNA, 19 nt, Homo sapiens
gcgcggugaugauuguuua

SEQ ID NO: 1126556 - RNA, 19 nt, Homo sapiens
uaacucugcuucacuguug

SEQ ID NO: 1126557 - RNA, 19 nt, Homo sapiens
gaagaagcuuucagacuac

SEQ ID NO: 1126558 - RNA, 19 nt, Homo sapiens
agaaucagcuguccucuca

SEQ ID NO: 1126559 - RNA, 19 nt, Homo sapiens
gcauggaguuugaaaauaa

SEQ ID NO: 1126560 - RNA, 19 nt, Homo sapiens
gaaguucaccagcugauga

SEQ ID NO: 1126561 - RNA, 19 nt, Homo sapiens
ugaugaugaugccuauuua

SEQ ID NO: 1126562 - RNA, 19 nt, Homo sapiens
gacauaaaguggagaccaa

SEQ ID NO: 1126563 - RNA, 19 nt, Homo sapiens
gaugaugccuauuuaaacu

SEQ ID NO: 1126564 - RNA, 19 nt, Homo sapiens
ggaagccggugucuguguu

SEQ ID NO: 1126565 - RNA, 19 nt, Homo sapiens
gaugacacuuccaaagaga

SEQ ID NO: 1126566 - RNA, 19 nt, Homo sapiens
gaagaacgaagaagcuuuc

SEQ ID NO: 1126567 - RNA, 19 nt, Homo sapiens
gaaauugaaggaugaaugg

SEQ ID NO: 1126568 - RNA, 19 nt, Homo sapiens
gcccgagagccuauuauua

SEQ ID NO: 1126569 - RNA, 19 nt, Homo sapiens
gauauuggacgaaggaaug

SEQ ID NO: 1126570 - RNA, 19 nt, Homo sapiens
gagcugagaagaacgaaga

SEQ ID NO: 1126571 - RNA, 19 nt, Homo sapiens
ccaaggagcugagaagaac

SEQ ID NO: 1126572 - RNA, 19 nt, Homo sapiens
ggaagaaaaugaugaugau

SEQ ID NO: 1126573 - RNA, 19 nt, Homo sapiens
gaugaugaugccuauuuaa

SEQ ID NO: 1126574 - RNA, 19 nt, Homo sapiens
agccgaacauggcauauuu

SEQ ID NO: 1126575 - RNA, 19 nt, Homo sapiens
gaagccggugucuguguua

SEQ ID NO: 1126576 - RNA, 19 nt, Homo sapiens
ugcaaggacugaccgauga

SEQ ID NO: 1126577 - RNA, 19 nt, Homo sapiens
ggacugugagcggcuguua

SEQ ID NO: 1126578 - RNA, 19 nt, Homo sapiens
cucaagagauuggaagaaa

SEQ ID NO: 1126579 - RNA, 19 nt, Homo sapiens
gcagggcucaacgucauua

SEQ ID NO: 1126580 - RNA, 19 nt, Homo sapiens
ggaaugggcaagaaacaag

SEQ ID NO: 1126581 - RNA, 19 nt, Homo sapiens
aaucagcuguccucucaga

SEQ ID NO: 1126582 - RNA, 19 nt, Homo sapiens
ccacucggguucugagcuu

SEQ ID NO: 1126583 - RNA, 19 nt, Homo sapiens
gcagugaggagcagaagca

SEQ ID NO: 1126584 - RNA, 19 nt, Homo sapiens
gcggauaacacugcuuuga

SEQ ID NO: 1126585 - RNA, 19 nt, Homo sapiens
gggcggauaacacugcuuu

SEQ ID NO: 1126586 - RNA, 19 nt, Homo sapiens
gaugauauuggacgaagga

SEQ ID NO: 1126587 - RNA, 19 nt, Homo sapiens
ggagugaaagacauaaagu

SEQ ID NO: 1126588 - RNA, 19 nt, Homo sapiens
gaagacaagaggagcucaa

SEQ ID NO: 1126589 - RNA, 19 nt, Homo sapiens
gacaagaggagcucaagag

SEQ ID NO: 1126590 - RNA, 19 nt, Homo sapiens
gaaggaaugggcaagaaac

SEQ ID NO: 1126591 - RNA, 19 nt, Homo sapiens
cgaaggaaugggcaagaaa

SEQ ID NO: 1126592 - RNA, 19 nt, Homo sapiens
gaccgaugaucagauugaa

SEQ ID NO: 1126593 - RNA, 19 nt, Homo sapiens
aaaugaugaugaugccuau

SEQ ID NO: 1126594 - RNA, 19 nt, Homo sapiens
gccaaggagcugagaagaa

SEQ ID NO: 1126595 - RNA, 19 nt, Homo sapiens
ggaagaauuagccgaacau

SEQ ID NO: 1126596 - RNA, 19 nt, Homo sapiens
ugaugacacuuccaaagag

SEQ ID NO: 1126597 - RNA, 19 nt, Homo sapiens
caagaggagcucaagagau

SEQ ID NO: 1126598 - RNA, 19 nt, Homo sapiens
cccgagagccuauuauuag

SEQ ID NO: 1126599 - RNA, 19 nt, Homo sapiens
gagaagaacgaagaagcuu

SEQ ID NO: 1126600 - RNA, 19 nt, Homo sapiens
gcuggcggcucuuuaacuc

SEQ ID NO: 1126601 - RNA, 19 nt, Homo sapiens
ggcucaacgucauuaaaga

SEQ ID NO: 1126602 - RNA, 19 nt, Homo sapiens
ugaaauugaaggaugaaug

SEQ ID NO: 1126603 - RNA, 19 nt, Homo sapiens
gaucagauugaagaauuga

SEQ ID NO: 1126604 - RNA, 19 nt, Homo sapiens
ccgaugaucagauugaaga

SEQ ID NO: 1126605 - RNA, 19 nt, Homo sapiens
gaacacaggcagggcucaa

SEQ ID NO: 1126606 - RNA, 19 nt, Homo sapiens
gggcaagaaacaaguggaa

SEQ ID NO: 1126607 - RNA, 19 nt, Homo sapiens
gcggaggugcaguguuuaa

SEQ ID NO: 1126608 - RNA, 19 nt, Homo sapiens
ugaucagauugaagaauug

SEQ ID NO: 1126609 - RNA, 19 nt, Homo sapiens
gggcucaacgucauuaaag

SEQ ID NO: 1126610 - RNA, 19 nt, Homo sapiens
uaaaguggagaccaagaug

SEQ ID NO: 1126611 - RNA, 19 nt, Homo sapiens
cggauaacacugcuuugaa

SEQ ID NO: 1126612 - RNA, 19 nt, Homo sapiens
gagugaaagacauaaagug

SEQ ID NO: 1126613 - RNA, 19 nt, Homo sapiens
ugaccgaugaucagauuga

SEQ ID NO: 1126614 - RNA, 19 nt, Homo sapiens
ucgccaagauucagcaaag

SEQ ID NO: 1126615 - RNA, 19 nt, Homo sapiens
cucagaaauggaagaauua

SEQ ID NO: 1126616 - RNA, 19 nt, Homo sapiens
ugacacuuccaaagagauu

SEQ ID NO: 1126617 - RNA, 19 nt, Homo sapiens
gaagaauuagccgaacaug

SEQ ID NO: 1126618 - RNA, 19 nt, Homo sapiens
ugaugccuauuuaaacuca

SEQ ID NO: 1126619 - RNA, 19 nt, Homo sapiens
gcucaagagauuggaagaa

SEQ ID NO: 1126620 - RNA, 19 nt, Homo sapiens
cugaugacacuuccaaaga

SEQ ID NO: 1126621 - RNA, 19 nt, Homo sapiens
agaagaacgaagaagcuuu

SEQ ID NO: 1126622 - RNA, 19 nt, Homo sapiens
ucauggagugaaagacaua

SEQ ID NO: 1126623 - RNA, 19 nt, Homo sapiens
gcugaugacacuuccaaag

SEQ ID NO: 1126624 - RNA, 19 nt, Homo sapiens
aaaguggagaccaagauga

SEQ ID NO: 1126625 - RNA, 19 nt, Homo sapiens
ucaagagauuggaagaaaa

SEQ ID NO: 1126626 - RNA, 19 nt, Homo sapiens
cagacugugugggugguuu

SEQ ID NO: 1126627 - RNA, 19 nt, Homo sapiens
acaagaggagcucaagaga

SEQ ID NO: 1126628 - RNA, 19 nt, Homo sapiens
gaaugggcaagaaacaagu

SEQ ID NO: 1126629 - RNA, 19 nt, Homo sapiens
acgaaggaaugggcaagaa

SEQ ID NO: 1126630 - RNA, 19 nt, Homo sapiens
gcucaacgucauuaaagag

SEQ ID NO: 1126631 - RNA, 19 nt, Homo sapiens
uggaagaauuagccgaaca

SEQ ID NO: 1126632 - RNA, 19 nt, Homo sapiens
augaugaugaugccuauuu

SEQ ID NO: 1126633 - RNA, 19 nt, Homo sapiens
ccuaauaugcaaggacuga

SEQ ID NO: 1126634 - RNA, 19 nt, Homo sapiens
ccagcccgagagccuauua

SEQ ID NO: 1126635 - RNA, 19 nt, Homo sapiens
aaaauuaucgccaagauuc

SEQ ID NO: 1126636 - RNA, 19 nt, Homo sapiens
gaugaucagauugaagaau

SEQ ID NO: 1126637 - RNA, 19 nt, Homo sapiens
ccaaaauuaucgccaagau

SEQ ID NO: 1126638 - RNA, 19 nt, Homo sapiens
cugcuucacuguugcucuu

SEQ ID NO: 1126639 - RNA, 19 nt, Homo sapiens
aaagagauuagcucaccuu

SEQ ID NO: 1126640 - RNA, 19 nt, Homo sapiens
aggcagggcucaacgucau

SEQ ID NO: 1126641 - RNA, 19 nt, Homo sapiens
cagcugaugacacuuccaa

SEQ ID NO: 1126642 - RNA, 19 nt, Homo sapiens
ggaggugcaguguuuaaaa

SEQ ID NO: 1126643 - RNA, 19 nt, Homo sapiens
cauaaaguggagaccaaga

SEQ ID NO: 1126644 - RNA, 19 nt, Homo sapiens
gaggagcucaagagauugg

SEQ ID NO: 1126645 - RNA, 19 nt, Homo sapiens
gcaaggacugaccgaugau

SEQ ID NO: 1126646 - RNA, 19 nt, Homo sapiens
cgaagaagcuuucagacua

SEQ ID NO: 1126647 - RNA, 19 nt, Homo sapiens
ggauaacacugcuuugaaa

SEQ ID NO: 1126648 - RNA, 19 nt, Homo sapiens
gcucagaaauggaagaauu

SEQ ID NO: 1126649 - RNA, 19 nt, Homo sapiens
gaagaugaagcaaguguua

SEQ ID NO: 1126650 - RNA, 19 nt, Homo sapiens
gagauuagcucaccuuucu

SEQ ID NO: 1126651 - RNA, 19 nt, Homo sapiens
gaacgaagaagcuuucaga

SEQ ID NO: 1126652 - RNA, 19 nt, Homo sapiens
aagaggagcucaagagauu

SEQ ID NO: 1126653 - RNA, 19 nt, Homo sapiens
cagcggaggugcaguguuu

SEQ ID NO: 1126654 - RNA, 19 nt, Homo sapiens
gcauauuucucccuccuaa

SEQ ID NO: 1126655 - RNA, 19 nt, Homo sapiens
gcgcggugaugauuguuua

SEQ ID NO: 1126656 - RNA, 19 nt, Homo sapiens
agaagaagccaaagcaaua

SEQ ID NO: 1126657 - RNA, 19 nt, Homo sapiens
ugaagcaaguguuaaagaa

SEQ ID NO: 1126658 - RNA, 19 nt, Homo sapiens
gaagaagccaaagcaauaa

SEQ ID NO: 1126659 - RNA, 19 nt, Homo sapiens
gaagaagcuuucagacuac

SEQ ID NO: 1126660 - RNA, 19 nt, Homo sapiens
gcauggaguuugaaaauaa

SEQ ID NO: 1126661 - RNA, 19 nt, Homo sapiens
gaaguucaccagcugauga

SEQ ID NO: 1126662 - RNA, 19 nt, Homo sapiens
ugaugaugaugccuauuua

SEQ ID NO: 1126663 - RNA, 19 nt, Homo sapiens
gacauaaaguggagaccaa

SEQ ID NO: 1126664 - RNA, 19 nt, Homo sapiens
gaugaugccuauuuaaacu

SEQ ID NO: 1126665 - RNA, 19 nt, Homo sapiens
ggaagccggugucuguguu

SEQ ID NO: 1126666 - RNA, 19 nt, Homo sapiens
gaugacacuuccaaagaga

SEQ ID NO: 1126667 - RNA, 19 nt, Homo sapiens
gaagaacgaagaagcuuuc

SEQ ID NO: 1126668 - RNA, 19 nt, Homo sapiens
gaaauugaaggaugaaugg

SEQ ID NO: 1126669 - RNA, 19 nt, Homo sapiens
gcccgagagccuauuauua

SEQ ID NO: 1126670 - RNA, 19 nt, Homo sapiens
gauauuggacgaaggaaug

SEQ ID NO: 1126671 - RNA, 19 nt, Homo sapiens
gagcugagaagaacgaaga

SEQ ID NO: 1126672 - RNA, 19 nt, Homo sapiens
caaaugagaagaugaagca

SEQ ID NO: 1126673 - RNA, 19 nt, Homo sapiens
ccaaggagcugagaagaac

SEQ ID NO: 1126674 - RNA, 19 nt, Homo sapiens
gaagccaaagcaauaauau

SEQ ID NO: 1126675 - RNA, 19 nt, Homo sapiens
aagcaaguguuaaagaaga

SEQ ID NO: 1126676 - RNA, 19 nt, Homo sapiens
ggaaugggcaagcuccaaa

SEQ ID NO: 1126677 - RNA, 19 nt, Homo sapiens
ggaagaaaaugaugaugau

SEQ ID NO: 1126678 - RNA, 19 nt, Homo sapiens
gaugaugaugccuauuuaa

SEQ ID NO: 1126679 - RNA, 19 nt, Homo sapiens
agccgaacauggcauauuu

SEQ ID NO: 1126680 - RNA, 19 nt, Homo sapiens
ugcaaggacugaccgauga

SEQ ID NO: 1126681 - RNA, 19 nt, Homo sapiens
gaagccggugucuguguua

SEQ ID NO: 1126682 - RNA, 19 nt, Homo sapiens
cucaagagauuggaagaaa

SEQ ID NO: 1126683 - RNA, 19 nt, Homo sapiens
gcagggcucaacgucauua

SEQ ID NO: 1126684 - RNA, 19 nt, Homo sapiens
gagaagaugaagcaagugu

SEQ ID NO: 1126685 - RNA, 19 nt, Homo sapiens
gcagugaggagcagaagca

SEQ ID NO: 1126686 - RNA, 19 nt, Homo sapiens
gaagcaaguguuaaagaag

SEQ ID NO: 1126687 - RNA, 19 nt, Homo sapiens
gcggauaacacugcuuuga

SEQ ID NO: 1126688 - RNA, 19 nt, Homo sapiens
gggcggauaacacugcuuu

SEQ ID NO: 1126689 - RNA, 19 nt, Homo sapiens
gacuauagaagaagccaaa

SEQ ID NO: 1126690 - RNA, 19 nt, Homo sapiens
gaugauauuggacgaagga

SEQ ID NO: 1126691 - RNA, 19 nt, Homo sapiens
ggagugaaagacauaaagu

SEQ ID NO: 1126692 - RNA, 19 nt, Homo sapiens
gaagacaagaggagcucaa

SEQ ID NO: 1126693 - RNA, 19 nt, Homo sapiens
gaccgaugaucagauugaa

SEQ ID NO: 1126694 - RNA, 19 nt, Homo sapiens
gacaagaggagcucaagag

SEQ ID NO: 1126695 - RNA, 19 nt, Homo sapiens
agaagccaaagcaauaaua

SEQ ID NO: 1126696 - RNA, 19 nt, Homo sapiens
aaaugaugaugaugccuau

SEQ ID NO: 1126697 - RNA, 19 nt, Homo sapiens
gccaaggagcugagaagaa

SEQ ID NO: 1126698 - RNA, 19 nt, Homo sapiens
ggaagaauuagccgaacau

SEQ ID NO: 1126699 - RNA, 19 nt, Homo sapiens
ugaugacacuuccaaagag

SEQ ID NO: 1126700 - RNA, 19 nt, Homo sapiens
gaucagauugaagaauuga

SEQ ID NO: 1126701 - RNA, 19 nt, Homo sapiens
caagaggagcucaagagau

SEQ ID NO: 1126702 - RNA, 19 nt, Homo sapiens
cccgagagccuauuauuag

SEQ ID NO: 1126703 - RNA, 19 nt, Homo sapiens
gagaagaacgaagaagcuu

SEQ ID NO: 1126704 - RNA, 19 nt, Homo sapiens
ggcucaacgucauuaaaga

SEQ ID NO: 1126705 - RNA, 19 nt, Homo sapiens
gccaaagcaauaauaucua

SEQ ID NO: 1126706 - RNA, 19 nt, Homo sapiens
ugaaauugaaggaugaaug

SEQ ID NO: 1126707 - RNA, 19 nt, Homo sapiens
ccgaugaucagauugaaga

SEQ ID NO: 1126708 - RNA, 19 nt, Homo sapiens
ugaucagauugaagaauug

SEQ ID NO: 1126709 - RNA, 19 nt, Homo sapiens
gcggaggugcaguguuuaa

SEQ ID NO: 1126710 - RNA, 19 nt, Homo sapiens
gaacacaggcagggcucaa

SEQ ID NO: 1126711 - RNA, 19 nt, Homo sapiens
uagaagaagccaaagcaau

SEQ ID NO: 1126712 - RNA, 19 nt, Homo sapiens
ggcaagcuccaaaugagaa

SEQ ID NO: 1126713 - RNA, 19 nt, Homo sapiens
gggcucaacgucauuaaag

SEQ ID NO: 1126714 - RNA, 19 nt, Homo sapiens
uaaaguggagaccaagaug

SEQ ID NO: 1126715 - RNA, 19 nt, Homo sapiens
cggauaacacugcuuugaa

SEQ ID NO: 1126716 - RNA, 19 nt, Homo sapiens
agaugaagcaaguguuaaa

SEQ ID NO: 1126717 - RNA, 19 nt, Homo sapiens
gagugaaagacauaaagug

SEQ ID NO: 1126718 - RNA, 19 nt, Homo sapiens
gggcaagcuccaaaugaga

SEQ ID NO: 1126719 - RNA, 19 nt, Homo sapiens
ugaccgaugaucagauuga

SEQ ID NO: 1126720 - RNA, 19 nt, Homo sapiens
ucgccaagauucagcaaag

SEQ ID NO: 1126721 - RNA, 19 nt, Homo sapiens
cucagaaauggaagaauua

SEQ ID NO: 1126722 - RNA, 19 nt, Homo sapiens
ugacacuuccaaagagauu

SEQ ID NO: 1126723 - RNA, 19 nt, Homo sapiens
gaagaauuagccgaacaug

SEQ ID NO: 1126724 - RNA, 19 nt, Homo sapiens
ugaugccuauuuaaacuca

SEQ ID NO: 1126725 - RNA, 19 nt, Homo sapiens
augagaagaugaagcaagu

SEQ ID NO: 1126726 - RNA, 19 nt, Homo sapiens
gcucaagagauuggaagaa

SEQ ID NO: 1126727 - RNA, 19 nt, Homo sapiens
gaaugggcaagcuccaaau

SEQ ID NO: 1126728 - RNA, 19 nt, Homo sapiens
cugaugacacuuccaaaga

SEQ ID NO: 1126729 - RNA, 19 nt, Homo sapiens
agaagaacgaagaagcuuu

SEQ ID NO: 1126730 - RNA, 19 nt, Homo sapiens
uauagaagaagccaaagca

SEQ ID NO: 1126731 - RNA, 19 nt, Homo sapiens
ucauggagugaaagacaua

SEQ ID NO: 1126732 - RNA, 19 nt, Homo sapiens
gcugaugacacuuccaaag

SEQ ID NO: 1126733 - RNA, 19 nt, Homo sapiens
aaaguggagaccaagauga

SEQ ID NO: 1126734 - RNA, 19 nt, Homo sapiens
ucaagagauuggaagaaaa

SEQ ID NO: 1126735 - RNA, 19 nt, Homo sapiens
acaagaggagcucaagaga

SEQ ID NO: 1126736 - RNA, 19 nt, Homo sapiens
uggaagaauuagccgaaca

SEQ ID NO: 1126737 - RNA, 19 nt, Homo sapiens
gcucaacgucauuaaagag

SEQ ID NO: 1126738 - RNA, 19 nt, Homo sapiens
ccuaauaugcaaggacuga

SEQ ID NO: 1126739 - RNA, 19 nt, Homo sapiens
augaugaugaugccuauuu

SEQ ID NO: 1126740 - RNA, 19 nt, Homo sapiens
gaugaucagauugaagaau

SEQ ID NO: 1126741 - RNA, 19 nt, Homo sapiens
ccagcccgagagccuauua

SEQ ID NO: 1126742 - RNA, 19 nt, Homo sapiens
aaaauuaucgccaagauuc

SEQ ID NO: 1126743 - RNA, 19 nt, Homo sapiens
ccaaaauuaucgccaagau

SEQ ID NO: 1126744 - RNA, 19 nt, Homo sapiens
aaagagauuagcucaccuu

SEQ ID NO: 1126745 - RNA, 19 nt, Homo sapiens
ugggcaagcuccaaaugag

SEQ ID NO: 1126746 - RNA, 19 nt, Homo sapiens
ccaauggcaugaaguauga

SEQ ID NO: 1126747 - RNA, 19 nt, Homo sapiens
gaucagcuuuggcgaugua

SEQ ID NO: 1126748 - RNA, 19 nt, Homo sapiens
gggcgagacucaaccaaga

SEQ ID NO: 1126749 - RNA, 19 nt, Homo sapiens
gaaccaaaguggaaauagc

SEQ ID NO: 1126750 - RNA, 19 nt, Homo sapiens
gaagguggacagagcaauu

SEQ ID NO: 1126751 - RNA, 19 nt, Homo sapiens
ggagcugcauucucaguau

SEQ ID NO: 1126752 - RNA, 19 nt, Homo sapiens
gaacuugcuauaccaaaga

SEQ ID NO: 1126753 - RNA, 19 nt, Homo sapiens
gccaugagcagaauuaguu

SEQ ID NO: 1126754 - RNA, 19 nt, Homo sapiens
caaagaauccagcaagcaa

SEQ ID NO: 1126755 - RNA, 19 nt, Homo sapiens
caaaggcucccacgaagga

SEQ ID NO: 1126756 - RNA, 19 nt, Homo sapiens
aaaggaguguggcugauga

SEQ ID NO: 1126757 - RNA, 19 nt, Homo sapiens
gaaauagcaaauucaagga

SEQ ID NO: 1126758 - RNA, 19 nt, Homo sapiens
gaugccaacuccacgauca

SEQ ID NO: 1126759 - RNA, 19 nt, Homo sapiens
gaggguaccuggaguaacg

SEQ ID NO: 1126760 - RNA, 19 nt, Homo sapiens
cgauguagauugugauuuu

SEQ ID NO: 1126761 - RNA, 19 nt, Homo sapiens
gcuacuacgugaagcugaa

SEQ ID NO: 1126762 - RNA, 19 nt, Homo sapiens
uaacaagaggcauggauau

SEQ ID NO: 1126763 - RNA, 19 nt, Homo sapiens
gaaggggagugggcaaaua

SEQ ID NO: 1126764 - RNA, 19 nt, Homo sapiens
gcugucaccugauuucuac

SEQ ID NO: 1126765 - RNA, 19 nt, Homo sapiens
ggcccuaauucaaucauga

SEQ ID NO: 1126766 - RNA, 19 nt, Homo sapiens
gaagaaaagguaccagaaa

SEQ ID NO: 1126767 - RNA, 19 nt, Homo sapiens
ggaauuaggaaaguugaau

SEQ ID NO: 1126768 - RNA, 19 nt, Homo sapiens
gcuccaauggcaugaagua

SEQ ID NO: 1126769 - RNA, 19 nt, Homo sapiens
caaaaccaguugccaaaga

SEQ ID NO: 1126770 - RNA, 19 nt, Homo sapiens
gagacucaaccaagacaaa

SEQ ID NO: 1126771 - RNA, 19 nt, Homo sapiens
gaauccaagucuuccaucu

SEQ ID NO: 1126772 - RNA, 19 nt, Homo sapiens
ggccagaaccaaaguggaa

SEQ ID NO: 1126773 - RNA, 19 nt, Homo sapiens
ggaguaacgggcugcaaga

SEQ ID NO: 1126774 - RNA, 19 nt, Homo sapiens
ccacgcagacgcugagcua

SEQ ID NO: 1126775 - RNA, 19 nt, Homo sapiens
uaacuugauuggaauuagg

SEQ ID NO: 1126776 - RNA, 19 nt, Homo sapiens
uaacuugauuggaauuagg

SEQ ID NO: 1126777 - RNA, 19 nt, Homo sapiens
caaaguggaaauagcaaau

SEQ ID NO: 1126778 - RNA, 19 nt, Homo sapiens
agguguagaugcuaaagaa

SEQ ID NO: 1126779 - RNA, 19 nt, Homo sapiens
gagcugcauucucaguauc

SEQ ID NO: 1126780 - RNA, 19 nt, Homo sapiens
gguacggcguggagaccua

SEQ ID NO: 1126781 - RNA, 19 nt, Homo sapiens
gaauaucggguuggccauu

SEQ ID NO: 1126782 - RNA, 19 nt, Homo sapiens
uuaggaaaguugaauaucg

SEQ ID NO: 1126783 - RNA, 19 nt, Homo sapiens
gaauaucggguuggccauu

SEQ ID NO: 1126784 - RNA, 19 nt, Homo sapiens
aagcaaagcugagccaaaa

SEQ ID NO: 1126785 - RNA, 19 nt, Homo sapiens
ugucaaaggcucccacgaa

SEQ ID NO: 1126786 - RNA, 19 nt, Homo sapiens
aagaaaagguaccagaaaa

SEQ ID NO: 1126787 - RNA, 19 nt, Homo sapiens
gaagagggaaaauacaaaa

SEQ ID NO: 1126788 - RNA, 19 nt, Homo sapiens
ggaguggucacaugguuuc

SEQ ID NO: 1126789 - RNA, 19 nt, Homo sapiens
gauuggaauuaggaaaguu

SEQ ID NO: 1126790 - RNA, 19 nt, Homo sapiens
ggagugggcaaauaacaag

SEQ ID NO: 1126791 - RNA, 19 nt, Homo sapiens
caacuccacgaucagcuuu

SEQ ID NO: 1126792 - RNA, 19 nt, Homo sapiens
caauaagcccuugauguca

SEQ ID NO: 1126793 - RNA, 19 nt, Homo sapiens
ggaagguguagaugcuaaa

SEQ ID NO: 1126794 - RNA, 19 nt, Homo sapiens
aggaagguguagaugcuaa

SEQ ID NO: 1126795 - RNA, 19 nt, Homo sapiens
ucaggaagguguagaugcu

SEQ ID NO: 1126796 - RNA, 19 nt, Homo sapiens
gcggccaugagcagaauua

SEQ ID NO: 1126797 - RNA, 19 nt, Homo sapiens
ugaacuugcuauaccaaag

SEQ ID NO: 1126798 - RNA, 19 nt, Homo sapiens
caaacagagauuucaggaa

SEQ ID NO: 1126799 - RNA, 19 nt, Homo sapiens
gggagugggcaaauaacaa

SEQ ID NO: 1126800 - RNA, 19 nt, Homo sapiens
gcacaagccauccgcuaac

SEQ ID NO: 1126801 - RNA, 19 nt, Homo sapiens
gaaaagccaccuacaccaa

SEQ ID NO: 1126802 - RNA, 19 nt, Homo sapiens
ggagcugucaccugauuuc

SEQ ID NO: 1126803 - RNA, 19 nt, Homo sapiens
ccugacggcuccaaagaag

SEQ ID NO: 1126804 - RNA, 19 nt, Homo sapiens
gggagcugcauucucagua

SEQ ID NO: 1126805 - RNA, 19 nt, Homo sapiens
cagaaccaaaguggaaaua

SEQ ID NO: 1126806 - RNA, 19 nt, Homo sapiens
ccaaagaagagggaaaaua

SEQ ID NO: 1126807 - RNA, 19 nt, Homo sapiens
auaacaagaggcauggaua

SEQ ID NO: 1126808 - RNA, 19 nt, Homo sapiens
cuuucuaacuugauuggaa

SEQ ID NO: 1126809 - RNA, 19 nt, Homo sapiens
cuuucuaacuugauuggaa

SEQ ID NO: 1126810 - RNA, 19 nt, Homo sapiens
aaguggaaauagcaaauuc

SEQ ID NO: 1126811 - RNA, 19 nt, Homo sapiens
ccaaaguggaaauagcaaa

SEQ ID NO: 1126812 - RNA, 19 nt, Homo sapiens
gcagcgagcagagcaaugg

SEQ ID NO: 1126813 - RNA, 19 nt, Homo sapiens
gcgguuucgugcucaacuu

SEQ ID NO: 1126814 - RNA, 19 nt, Homo sapiens
gagauuucaggaaggugua

SEQ ID NO: 1126815 - RNA, 19 nt, Homo sapiens
gagcuagcgggcaagaaga

SEQ ID NO: 1126816 - RNA, 19 nt, Homo sapiens
caaaagcuaagaagucuga

SEQ ID NO: 1126817 - RNA, 19 nt, Homo sapiens
aaagcaaagcugagccaaa

SEQ ID NO: 1126818 - RNA, 19 nt, Homo sapiens
agggagcugucaccugauu

SEQ ID NO: 1126819 - RNA, 19 nt, Homo sapiens
caaagaagagggaaaauac

SEQ ID NO: 1126820 - RNA, 19 nt, Homo sapiens
gggaguggucacaugguuu

SEQ ID NO: 1126821 - RNA, 19 nt, Homo sapiens
guggaaauagcaaauucaa

SEQ ID NO: 1126822 - RNA, 19 nt, Homo sapiens
gcgcuccaauggcaugaag

SEQ ID NO: 1126823 - RNA, 19 nt, Homo sapiens
cagcaagcaacgauucaug

SEQ ID NO: 1126824 - RNA, 19 nt, Homo sapiens
gacaaaaccaguugccaaa

SEQ ID NO: 1126825 - RNA, 19 nt, Homo sapiens
caagccauccgcuaacaag

SEQ ID NO: 1126826 - RNA, 19 nt, Homo sapiens
cacaagccauccgcuaaca

SEQ ID NO: 1126827 - RNA, 19 nt, Homo sapiens
gagcaggugacggccauug

SEQ ID NO: 1126828 - RNA, 19 nt, Homo sapiens
gcgaguggaagaacgacaa

SEQ ID NO: 1126829 - RNA, 19 nt, Homo sapiens
ccaccaccacggaaaccua

SEQ ID NO: 1126830 - RNA, 19 nt, Homo sapiens
ccaaagaauccagcaagca

SEQ ID NO: 1126831 - RNA, 19 nt, Homo sapiens
aaaaccaguugccaaagaa

SEQ ID NO: 1126832 - RNA, 19 nt, Homo sapiens
gcaggugacggccauuguc

SEQ ID NO: 1126833 - RNA, 19 nt, Homo sapiens
caaagccccugaagaagca

SEQ ID NO: 1126834 - RNA, 19 nt, Homo sapiens
cacagccacucuccugcuu

SEQ ID NO: 1126835 - RNA, 19 nt, Homo sapiens
aaagccaccuacaccaaag

SEQ ID NO: 1126836 - RNA, 19 nt, Homo sapiens
guggucacaugguuucaag

SEQ ID NO: 1126837 - RNA, 19 nt, Homo sapiens
gucaugcuguugaauaucg

SEQ ID NO: 1126838 - RNA, 19 nt, Homo sapiens
cuugucaugcuguugaaua

SEQ ID NO: 1126839 - RNA, 19 nt, Homo sapiens
gaauccagcaagcaacgau

SEQ ID NO: 1126840 - RNA, 19 nt, Homo sapiens
gcaaguccgaauccaaguc

SEQ ID NO: 1126841 - RNA, 19 nt, Homo sapiens
ccagcacccuccaguagac

SEQ ID NO: 1126842 - RNA, 19 nt, Homo sapiens
gaggcaagucccaaacaca

SEQ ID NO: 1126843 - RNA, 19 nt, Homo sapiens
acagagauuucaggaaggu

SEQ ID NO: 1126844 - RNA, 19 nt, Homo sapiens
gagaagguggacagagcaa

SEQ ID NO: 1126845 - RNA, 19 nt, Homo sapiens
ugauuggaauuaggaaagu

SEQ ID NO: 1126846 - RNA, 19 nt, Homo sapiens
gaaauaaaccuggagauga

SEQ ID NO: 1126847 - RNA, 19 nt, Homo sapiens
gaagaagccaucaaugaga

SEQ ID NO: 1126848 - RNA, 19 nt, Homo sapiens
aaauaaaccuggagaugau

SEQ ID NO: 1126849 - RNA, 19 nt, Homo sapiens
ggaaauaaaccuggagaug

SEQ ID NO: 1126850 - RNA, 19 nt, Homo sapiens
gagaugaugaugaugauga

SEQ ID NO: 1126851 - RNA, 19 nt, Homo sapiens
ggaagaagccaucaaugag

SEQ ID NO: 1126852 - RNA, 19 nt, Homo sapiens
uggaagaagccaucaauga

SEQ ID NO: 1126853 - RNA, 19 nt, Homo sapiens
gcaagacccugugcuccau

SEQ ID NO: 1126854 - RNA, 19 nt, Homo sapiens
agaggcgccugcaggauga

SEQ ID NO: 1126855 - RNA, 19 nt, Homo sapiens
gcgccgagaccacauguca

SEQ ID NO: 1126856 - RNA, 19 nt, Homo sapiens
ggaugaaagcucucugucu

SEQ ID NO: 1126857 - RNA, 19 nt, Homo sapiens
gccggcucccuaauauuua

SEQ ID NO: 1126858 - RNA, 19 nt, Homo sapiens
ugaugaugaugaugaugau

SEQ ID NO: 1126859 - RNA, 19 nt, Homo sapiens
uggagaugaugaugaugau

SEQ ID NO: 1126860 - RNA, 19 nt, Homo sapiens
agaugaugaugaugaugau

SEQ ID NO: 1126861 - RNA, 19 nt, Homo sapiens
cuggagaugaugaugauga

SEQ ID NO: 1126862 - RNA, 19 nt, Homo sapiens
caaagugccucuaaagaaa

SEQ ID NO: 1126863 - RNA, 19 nt, Homo sapiens
gaacauaagcuaccaccuu

SEQ ID NO: 1126864 - RNA, 19 nt, Homo sapiens
gaugggaccuggccaguga

SEQ ID NO: 1126865 - RNA, 19 nt, Homo sapiens
ucaaagugccucuaaagaa

SEQ ID NO: 1126866 - RNA, 19 nt, Homo sapiens
gaggaggacuucuacuaca

SEQ ID NO: 1126867 - RNA, 19 nt, Homo sapiens
ccacaccgcuguccccuua

SEQ ID NO: 1126868 - RNA, 19 nt, Homo sapiens
gcagcccacuuucuguuug

SEQ ID NO: 1126869 - RNA, 19 nt, Homo sapiens
uuacaagccuguccaccaa

SEQ ID NO: 1126870 - RNA, 19 nt, Homo sapiens
gcgaagagagaaauuaaag

SEQ ID NO: 1126871 - RNA, 19 nt, Homo sapiens
gugaggaggacuucuacua

SEQ ID NO: 1126872 - RNA, 19 nt, Homo sapiens
ggcagagccugaucagagu

SEQ ID NO: 1126873 - RNA, 19 nt, Homo sapiens
cgaagagagaaauuaaaga

SEQ ID NO: 1126874 - RNA, 19 nt, Homo sapiens
cgucggcgaugcagagaca

SEQ ID NO: 1126875 - RNA, 19 nt, Homo sapiens
caggcgaagagagaaauua

SEQ ID NO: 1126876 - RNA, 19 nt, Homo sapiens
agaagugccggaaggugua

SEQ ID NO: 1126877 - RNA, 19 nt, Homo sapiens
ggcgaagagagaaauuaaa

SEQ ID NO: 1126878 - RNA, 19 nt, Homo sapiens
agauuuaucaaggguguua

SEQ ID NO: 1126879 - RNA, 19 nt, Homo sapiens
ggaggacuucuacuacaca

SEQ ID NO: 1126880 - RNA, 19 nt, Homo sapiens
aggcgaagagagaaauuaa

SEQ ID NO: 1126881 - RNA, 19 nt, Homo sapiens
ucaagaacauaagcuacca

SEQ ID NO: 1126882 - RNA, 19 nt, Homo sapiens
cgaggcagcccacuuucug

SEQ ID NO: 1126883 - RNA, 19 nt, Homo sapiens
gcaccaggcgaagagagaa

SEQ ID NO: 1126884 - RNA, 19 nt, Homo sapiens
ggcagcccacuuucuguuu

SEQ ID NO: 1126885 - RNA, 19 nt, Homo sapiens
gggagcccacccugagaaa

SEQ ID NO: 1126886 - RNA, 19 nt, Homo sapiens
cagucccgaugcacuuuga

SEQ ID NO: 1126887 - RNA, 19 nt, Homo sapiens
ugaggaggacuucuacuac

SEQ ID NO: 1126888 - RNA, 19 nt, Homo sapiens
gaagugccggaagguguau

SEQ ID NO: 1126889 - RNA, 19 nt, Homo sapiens
cuacacagagcuggauguu

SEQ ID NO: 1126890 - RNA, 19 nt, Homo sapiens
ggaaggcuccaauggcuuu

SEQ ID NO: 1126891 - RNA, 19 nt, Homo sapiens
gcaaaguguauaugaaguu

SEQ ID NO: 1126892 - RNA, 19 nt, Homo sapiens
gcggaggacuuuagagaca

SEQ ID NO: 1126893 - RNA, 19 nt, Homo sapiens
guacauaccgugugcaaag

SEQ ID NO: 1126894 - RNA, 19 nt, Homo sapiens
ccucucggguucucucuuu

SEQ ID NO: 1126895 - RNA, 19 nt, Homo sapiens
gagacaagcuggacaaaag

SEQ ID NO: 1126896 - RNA, 19 nt, Homo sapiens
ggucgcagcuuggcuaugg

SEQ ID NO: 1126897 - RNA, 19 nt, Homo sapiens
ggauguucccgucgccuua

SEQ ID NO: 1126898 - RNA, 19 nt, Homo sapiens
caaaugccaaguccacuga

SEQ ID NO: 1126899 - RNA, 19 nt, Homo sapiens
uaccagaaccgcaggacua

SEQ ID NO: 1126900 - RNA, 19 nt, Homo sapiens
ggaggcaggcaauuacuca

SEQ ID NO: 1126901 - RNA, 19 nt, Homo sapiens
gggaucgacuccauucucu

SEQ ID NO: 1126902 - RNA, 19 nt, Homo sapiens
cagaaccgcaggacuaaau

SEQ ID NO: 1126903 - RNA, 19 nt, Homo sapiens
ggaggacuuuagagacaag

SEQ ID NO: 1126904 - RNA, 19 nt, Homo sapiens
ugugcaaaguguauaugaa

SEQ ID NO: 1126905 - RNA, 19 nt, Homo sapiens
uggcggaggcaggcaauua

SEQ ID NO: 1126906 - RNA, 19 nt, Homo sapiens
ugaccguguccguggauua

SEQ ID NO: 1126907 - RNA, 19 nt, Homo sapiens
gugcaaaguguauaugaag

SEQ ID NO: 1126908 - RNA, 19 nt, Homo sapiens
cggcugagcuguacauacc

SEQ ID NO: 1126909 - RNA, 19 nt, Homo sapiens
gcugaacuccguccaaggu

SEQ ID NO: 1126910 - RNA, 19 nt, Homo sapiens
caccgucaccuccuccuuu

SEQ ID NO: 1126911 - RNA, 19 nt, Homo sapiens
gaaccgcaggacuaaaugg

SEQ ID NO: 1126912 - RNA, 19 nt, Homo sapiens
ucccgucgccuuauuucua

SEQ ID NO: 1126913 - RNA, 19 nt, Homo sapiens
gcuuugggaucgacuccau

SEQ ID NO: 1126914 - RNA, 19 nt, Homo sapiens
ucgccagccucuccaggaa

SEQ ID NO: 1126915 - RNA, 19 nt, Homo sapiens
ccgcggaggacuuuagaga

SEQ ID NO: 1126916 - RNA, 19 nt, Homo sapiens
cauaccgugugcaaagugu

SEQ ID NO: 1126917 - RNA, 19 nt, Homo sapiens
cuaaugcgcagaggagguu

SEQ ID NO: 1126918 - RNA, 19 nt, Homo sapiens
gaaauugugugagacauua

SEQ ID NO: 1126919 - RNA, 19 nt, Homo sapiens
gaacaaacuucuucuacaa

SEQ ID NO: 1126920 - RNA, 19 nt, Homo sapiens
agacaugacucuggaauua

SEQ ID NO: 1126921 - RNA, 19 nt, Homo sapiens
uaacaaagaucgcuaugug

SEQ ID NO: 1126922 - RNA, 19 nt, Homo sapiens
gaagagguguguagacaga

SEQ ID NO: 1126923 - RNA, 19 nt, Homo sapiens
uaacuacaauucacuguug

SEQ ID NO: 1126924 - RNA, 19 nt, Homo sapiens
cguauuaucuccgaaauuu

SEQ ID NO: 1126925 - RNA, 19 nt, Homo sapiens
gcagauggcuuuggauuag

SEQ ID NO: 1126926 - RNA, 19 nt, Homo sapiens
uguaaaguauggucucuua

SEQ ID NO: 1126927 - RNA, 19 nt, Homo sapiens
ccacgacuuucacaaauuu

SEQ ID NO: 1126928 - RNA, 19 nt, Homo sapiens
ccaaaugcuuucuucagua

SEQ ID NO: 1126929 - RNA, 19 nt, Homo sapiens
gaaagccugugaaguugaa

SEQ ID NO: 1126930 - RNA, 19 nt, Homo sapiens
gcagaagccuuuugucaua

SEQ ID NO: 1126931 - RNA, 19 nt, Homo sapiens
gacaauagcagaagccuuu

SEQ ID NO: 1126932 - RNA, 19 nt, Homo sapiens
gauuagacauucuuccaaa

SEQ ID NO: 1126933 - RNA, 19 nt, Homo sapiens
gagggaaacuaccgucauu

SEQ ID NO: 1126934 - RNA, 19 nt, Homo sapiens
uaacaugaauggaggaaau

SEQ ID NO: 1126935 - RNA, 19 nt, Homo sapiens
cuacagaaauugugugaga

SEQ ID NO: 1126936 - RNA, 19 nt, Homo sapiens
gaagaaagagaacaaacuu

SEQ ID NO: 1126937 - RNA, 19 nt, Homo sapiens
ugacagagacucauaaaug

SEQ ID NO: 1126938 - RNA, 19 nt, Homo sapiens
caaaugcuuucuucaguau

SEQ ID NO: 1126939 - RNA, 19 nt, Homo sapiens
gcaaaccaauuauggaaag

SEQ ID NO: 1126940 - RNA, 19 nt, Homo sapiens
ccucacagaugaaguuuga

SEQ ID NO: 1126941 - RNA, 19 nt, Homo sapiens
cuagacaguucacuaauug

SEQ ID NO: 1126942 - RNA, 19 nt, Homo sapiens
cagaugaaguuugaaguuu

SEQ ID NO: 1126943 - RNA, 19 nt, Homo sapiens
caaagaaacaguagugguu

SEQ ID NO: 1126944 - RNA, 19 nt, Homo sapiens
gaucuucguugcaaguuau

SEQ ID NO: 1126945 - RNA, 19 nt, Homo sapiens
gaaagcaacuuaagaaaac

SEQ ID NO: 1126946 - RNA, 19 nt, Homo sapiens
cuagaccaguggagaauuu

SEQ ID NO: 1126947 - RNA, 19 nt, Homo sapiens
ggguugcucuccauaacua

SEQ ID NO: 1126948 - RNA, 19 nt, Homo sapiens
acacuuuccuuucuacuga

SEQ ID NO: 1126949 - RNA, 19 nt, Homo sapiens
ucaguuucaugucuaagua

SEQ ID NO: 1126950 - RNA, 19 nt, Homo sapiens
gacagagacucauaaaugc

SEQ ID NO: 1126951 - RNA, 19 nt, Homo sapiens
caugaaaacuugaacauug

SEQ ID NO: 1126952 - RNA, 19 nt, Homo sapiens
gcucugacuuuaaagacuu

SEQ ID NO: 1126953 - RNA, 19 nt, Homo sapiens
cggcauauuucuucaugaa

SEQ ID NO: 1126954 - RNA, 19 nt, Homo sapiens
ucuagacaguucacuaauu

SEQ ID NO: 1126955 - RNA, 19 nt, Homo sapiens
acaugacucuggaauuaaa

SEQ ID NO: 1126956 - RNA, 19 nt, Homo sapiens
ccacaucacagcauuuaga

SEQ ID NO: 1126957 - RNA, 19 nt, Homo sapiens
gccacgacuuucacaaauu

SEQ ID NO: 1126958 - RNA, 19 nt, Homo sapiens
uuaaugaucuucguugcaa

SEQ ID NO: 1126959 - RNA, 19 nt, Homo sapiens
guagacagaagaaaggaaa

SEQ ID NO: 1126960 - RNA, 19 nt, Homo sapiens
gagcauaugcagccuuuca

SEQ ID NO: 1126961 - RNA, 19 nt, Homo sapiens
uauaccaggucuccucaaa

SEQ ID NO: 1126962 - RNA, 19 nt, Homo sapiens
caaaacagcauguguaaga

SEQ ID NO: 1126963 - RNA, 19 nt, Homo sapiens
gcaaagauaagcaugaaaa

SEQ ID NO: 1126964 - RNA, 19 nt, Homo sapiens
cuugaaagccugugaaguu

SEQ ID NO: 1126965 - RNA, 19 nt, Homo sapiens
uuucaggccucacagauga

SEQ ID NO: 1126966 - RNA, 19 nt, Homo sapiens
ggaaagcaacuuaagaaaa

SEQ ID NO: 1126967 - RNA, 19 nt, Homo sapiens
guaucaguuucaugucuaa

SEQ ID NO: 1126968 - RNA, 19 nt, Homo sapiens
ucacagcauuuagacauau

SEQ ID NO: 1126969 - RNA, 19 nt, Homo sapiens
gagaauauuccucgucaca

SEQ ID NO: 1126970 - RNA, 19 nt, Homo sapiens
acaguucacuaauuguuga

SEQ ID NO: 1126971 - RNA, 19 nt, Homo sapiens
ggaagaaagagaacaaacu

SEQ ID NO: 1126972 - RNA, 19 nt, Homo sapiens
caaguuauaguuguggaua

SEQ ID NO: 1126973 - RNA, 19 nt, Homo sapiens
ggucagcucguaaugcauu

SEQ ID NO: 1126974 - RNA, 19 nt, Homo sapiens
uggagaauuugacaccuuu

SEQ ID NO: 1126975 - RNA, 19 nt, Homo sapiens
aagcaaagauaagcaugaa

SEQ ID NO: 1126976 - RNA, 19 nt, Homo sapiens
ggcagauggcuuuggauua

SEQ ID NO: 1126977 - RNA, 19 nt, Homo sapiens
aaagaucgcuaugugcaau

SEQ ID NO: 1126978 - RNA, 19 nt, Homo sapiens
guaaugcauugugaugguu

SEQ ID NO: 1126979 - RNA, 19 nt, Homo sapiens
guacuagaccaguggagaa

SEQ ID NO: 1126980 - RNA, 19 nt, Homo sapiens
aagagcauaugcagccuuu

SEQ ID NO: 1126981 - RNA, 19 nt, Homo sapiens
uuaugcagguucuagguuu

SEQ ID NO: 1126982 - RNA, 19 nt, Homo sapiens
caaccaguccuccacauca

SEQ ID NO: 1126983 - RNA, 19 nt, Homo sapiens
ucacugacagagacucaua

SEQ ID NO: 1126984 - RNA, 19 nt, Homo sapiens
uaagugcaaagaaacagua

SEQ ID NO: 1126985 - RNA, 19 nt, Homo sapiens
gaccacggcauauuucuuc

SEQ ID NO: 1126986 - RNA, 19 nt, Homo sapiens
ggagaccacggcauauuuc

SEQ ID NO: 1126987 - RNA, 19 nt, Homo sapiens
ggaaaacauggaacaauuu

SEQ ID NO: 1126988 - RNA, 19 nt, Homo sapiens
ugaugaggaugcugggaaa

SEQ ID NO: 1126989 - RNA, 19 nt, Homo sapiens
ccgaagagguguguagaca

SEQ ID NO: 1126990 - RNA, 19 nt, Homo sapiens
caagagcagugacaauagc

SEQ ID NO: 1126991 - RNA, 19 nt, Homo sapiens
ugaucuucguugcaaguua

SEQ ID NO: 1126992 - RNA, 19 nt, Homo sapiens
cucaacaugcuaaacauua

SEQ ID NO: 1126993 - RNA, 19 nt, Homo sapiens
guggagaauuugacaccuu

SEQ ID NO: 1126994 - RNA, 19 nt, Homo sapiens
gacaugacucuggaauuaa

SEQ ID NO: 1126995 - RNA, 19 nt, Homo sapiens
ccaagucucuggacaaacc

SEQ ID NO: 1126996 - RNA, 19 nt, Homo sapiens
guucuagguuugguucuug

SEQ ID NO: 1126997 - RNA, 19 nt, Homo sapiens
guuuguaguuuaagugcaa

SEQ ID NO: 1126998 - RNA, 19 nt, Homo sapiens
uguaucaguuucaugucua

SEQ ID NO: 1126999 - RNA, 19 nt, Homo sapiens
gugaauuguuuguaucagu

SEQ ID NO: 1127000 - RNA, 19 nt, Homo sapiens
cugcucauguuucuucuug

SEQ ID NO: 1127001 - RNA, 19 nt, Homo sapiens
cccaaaugcuuucuucagu

SEQ ID NO: 1127002 - RNA, 19 nt, Homo sapiens
gggagaauuuauugcucuu

SEQ ID NO: 1127003 - RNA, 19 nt, Homo sapiens
gcauugugaugguuuugua

SEQ ID NO: 1127004 - RNA, 19 nt, Homo sapiens
uaucugcacuaauucucaa

SEQ ID NO: 1127005 - RNA, 19 nt, Homo sapiens
ggauuagacauucuuccaa

SEQ ID NO: 1127006 - RNA, 19 nt, Homo sapiens
caucacagcauuuagacau

SEQ ID NO: 1127007 - RNA, 19 nt, Homo sapiens
cuaauucucaacaugcuaa

SEQ ID NO: 1127008 - RNA, 19 nt, Homo sapiens
ggaaacuaccgucauucug

SEQ ID NO: 1127009 - RNA, 19 nt, Homo sapiens
gagagugggagggaaacua

SEQ ID NO: 1127010 - RNA, 19 nt, Homo sapiens
acucuggaauuaaagcaaa

SEQ ID NO: 1127011 - RNA, 19 nt, Homo sapiens
uugaaagccugugaaguug

SEQ ID NO: 1127012 - RNA, 19 nt, Homo sapiens
acaggcagauggcuuugga

SEQ ID NO: 1127013 - RNA, 19 nt, Homo sapiens
gugcaaagaaacaguagug

SEQ ID NO: 1127014 - RNA, 19 nt, Homo sapiens
aaucagugcuuucccaacu

SEQ ID NO: 1127015 - RNA, 19 nt, Homo sapiens
cuagugaauuguuuguauc

SEQ ID NO: 1127016 - RNA, 19 nt, Homo sapiens
gacaguucacuaauuguug

SEQ ID NO: 1127017 - RNA, 19 nt, Homo sapiens
uucuugaccucuugcauaa

SEQ ID NO: 1127018 - RNA, 19 nt, Homo sapiens
gguaaaggcugauuucuaa

SEQ ID NO: 1127019 - RNA, 19 nt, Homo sapiens
gaaucuaucuguucgaaua

SEQ ID NO: 1127020 - RNA, 19 nt, Homo sapiens
gcaaagaccucgucagugu

SEQ ID NO: 1127021 - RNA, 19 nt, Homo sapiens
aauaagagcuggcaaguaa

SEQ ID NO: 1127022 - RNA, 19 nt, Homo sapiens
gcacuuaccuugcuuccaa

SEQ ID NO: 1127023 - RNA, 19 nt, Homo sapiens
gcacauggauucaguaugg

SEQ ID NO: 1127024 - RNA, 19 nt, Homo sapiens
gacaaagccugcgugauua

SEQ ID NO: 1127025 - RNA, 19 nt, Homo sapiens
ucaccaaaguuuccuguua

SEQ ID NO: 1127026 - RNA, 19 nt, Homo sapiens
guagaaacauggcauauag

SEQ ID NO: 1127027 - RNA, 19 nt, Homo sapiens
gcaagcacaugcagaagaa

SEQ ID NO: 1127028 - RNA, 19 nt, Homo sapiens
acucagagcuccuggauaa

SEQ ID NO: 1127029 - RNA, 19 nt, Homo sapiens
gaacaaagaggaauuagca

SEQ ID NO: 1127030 - RNA, 19 nt, Homo sapiens
gcagacaaguuauaaguca

SEQ ID NO: 1127031 - RNA, 19 nt, Homo sapiens
gaaauaucaucaccuagga

SEQ ID NO: 1127032 - RNA, 19 nt, Homo sapiens
caacauuccuuaccaguca

SEQ ID NO: 1127033 - RNA, 19 nt, Homo sapiens
ggaguuaauugcccauuug

SEQ ID NO: 1127034 - RNA, 19 nt, Homo sapiens
gaagaaagauugugaaaag

SEQ ID NO: 1127035 - RNA, 19 nt, Homo sapiens
uaaccauucuguuccuuua

SEQ ID NO: 1127036 - RNA, 19 nt, Homo sapiens
gaguagagaucgguucuuu

SEQ ID NO: 1127037 - RNA, 19 nt, Homo sapiens
caaauauucucaugagguu

SEQ ID NO: 1127038 - RNA, 19 nt, Homo sapiens
gaucaugacucagaggaaa

SEQ ID NO: 1127039 - RNA, 19 nt, Homo sapiens
ggugagaucuagccucuug

SEQ ID NO: 1127040 - RNA, 19 nt, Homo sapiens
agacaaagccugcgugauu

SEQ ID NO: 1127041 - RNA, 19 nt, Homo sapiens
uaaagaagaucgagaacuc

SEQ ID NO: 1127042 - RNA, 19 nt, Homo sapiens
gcccagagcuccuucuuca

SEQ ID NO: 1127043 - RNA, 19 nt, Homo sapiens
cuacggagaugaaauuugu

SEQ ID NO: 1127044 - RNA, 19 nt, Homo sapiens
guaggaaguuauacaauca

SEQ ID NO: 1127045 - RNA, 19 nt, Homo sapiens
agagaaauaucaucaccua

SEQ ID NO: 1127046 - RNA, 19 nt, Homo sapiens
gaaaggugcuggccaucau

SEQ ID NO: 1127047 - RNA, 19 nt, Homo sapiens
gcagggccauuccuacuga

SEQ ID NO: 1127048 - RNA, 19 nt, Homo sapiens
acacaagcauaacugauaa

SEQ ID NO: 1127049 - RNA, 19 nt, Homo sapiens
cauuugggcucuuuguaua

SEQ ID NO: 1127050 - RNA, 19 nt, Homo sapiens
ucaccuacauccagaauau

SEQ ID NO: 1127051 - RNA, 19 nt, Homo sapiens
gaaaucuaaucaugccuau

SEQ ID NO: 1127052 - RNA, 19 nt, Homo sapiens
gaauacagcgucagaagga

SEQ ID NO: 1127053 - RNA, 19 nt, Homo sapiens
ggcagaugcuuauugguaa

SEQ ID NO: 1127054 - RNA, 19 nt, Homo sapiens
agacauggcugcaguacug

SEQ ID NO: 1127055 - RNA, 19 nt, Homo sapiens
gauauaacuucuaccagau

SEQ ID NO: 1127056 - RNA, 19 nt, Homo sapiens
uggauuauguggaauugua

SEQ ID NO: 1127057 - RNA, 19 nt, Homo sapiens
uggaagaaaucgcagauga

SEQ ID NO: 1127058 - RNA, 19 nt, Homo sapiens
ccacagauauaacuucuac

SEQ ID NO: 1127059 - RNA, 19 nt, Homo sapiens
ucacagagaucuccacaac

SEQ ID NO: 1127060 - RNA, 19 nt, Homo sapiens
gaguagcacuuguuaacga

SEQ ID NO: 1127061 - RNA, 19 nt, Homo sapiens
gcagaugcuuauugguaaa

SEQ ID NO: 1127062 - RNA, 19 nt, Homo sapiens
caaguaaggcucagagaga

SEQ ID NO: 1127063 - RNA, 19 nt, Homo sapiens
gaagugcuauugcagacau

SEQ ID NO: 1127064 - RNA, 19 nt, Homo sapiens
gaggugugcugcuucauca

SEQ ID NO: 1127065 - RNA, 19 nt, Homo sapiens
uuaauuagcaucagaguug

SEQ ID NO: 1127066 - RNA, 19 nt, Homo sapiens
caccaaaguuuccuguuau

SEQ ID NO: 1127067 - RNA, 19 nt, Homo sapiens
caaagaacaauaucccaaa

SEQ ID NO: 1127068 - RNA, 19 nt, Homo sapiens
ggaagaaaucgcagaugaa

SEQ ID NO: 1127069 - RNA, 19 nt, Homo sapiens
ggaaauuugucuugaccau

SEQ ID NO: 1127070 - RNA, 19 nt, Homo sapiens
caaacuccauccagguuga

SEQ ID NO: 1127071 - RNA, 19 nt, Homo sapiens
caucagaagaccaacauuu

SEQ ID NO: 1127072 - RNA, 19 nt, Homo sapiens
aaacauagcuuccaaaacu

SEQ ID NO: 1127073 - RNA, 19 nt, Homo sapiens
guagagaucgguucuuuca

SEQ ID NO: 1127074 - RNA, 19 nt, Homo sapiens
aaacgcgagugcuauugua

SEQ ID NO: 1127075 - RNA, 19 nt, Homo sapiens
gauaaacgcgagugcuauu

SEQ ID NO: 1127076 - RNA, 19 nt, Homo sapiens
uagcagcggucacagagaa

SEQ ID NO: 1127077 - RNA, 19 nt, Homo sapiens
gagcacagaaucagaacaa

SEQ ID NO: 1127078 - RNA, 19 nt, Homo sapiens
ucucagauguaacugguaa

SEQ ID NO: 1127079 - RNA, 19 nt, Homo sapiens
gaaaguuuaccuugucuca

SEQ ID NO: 1127080 - RNA, 19 nt, Homo sapiens
gaaggaugccauaaccauu

SEQ ID NO: 1127081 - RNA, 19 nt, Homo sapiens
gagaaaggcuacuguaacc

SEQ ID NO: 1127082 - RNA, 19 nt, Homo sapiens
uuaaagcccuucugaugau

SEQ ID NO: 1127083 - RNA, 19 nt, Homo sapiens
gaagaaaucgcagaugaag

SEQ ID NO: 1127084 - RNA, 19 nt, Homo sapiens
ggacggacuuugagcacau

SEQ ID NO: 1127085 - RNA, 19 nt, Homo sapiens
ggaguggccacagauauaa

SEQ ID NO: 1127086 - RNA, 19 nt, Homo sapiens
ucucuuggcucucugcaaa

SEQ ID NO: 1127087 - RNA, 19 nt, Homo sapiens
gaaauccaggcagcacuua

SEQ ID NO: 1127088 - RNA, 19 nt, Homo sapiens
ucucuggacugaacaaaga

SEQ ID NO: 1127089 - RNA, 19 nt, Homo sapiens
cacacaagcauaacugaua

SEQ ID NO: 1127090 - RNA, 19 nt, Homo sapiens
gugcuaggauuacagguau

SEQ ID NO: 1127091 - RNA, 19 nt, Homo sapiens
gcgccaggcaguuguauuu

SEQ ID NO: 1127092 - RNA, 19 nt, Homo sapiens
agacaaacauagcuuccaa

SEQ ID NO: 1127093 - RNA, 19 nt, Homo sapiens
ucuaccagauccuuaaauu

SEQ ID NO: 1127094 - RNA, 19 nt, Homo sapiens
acagagaucuccacaacuc

SEQ ID NO: 1127095 - RNA, 19 nt, Homo sapiens
gaauugcaauaaccagcuu

SEQ ID NO: 1127096 - RNA, 19 nt, Homo sapiens
cauuacagccuuagaagaa

SEQ ID NO: 1127097 - RNA, 19 nt, Homo sapiens
agaaucaucugggagguuu

SEQ ID NO: 1127098 - RNA, 19 nt, Homo sapiens
aagccugcgugauuaguua

SEQ ID NO: 1127099 - RNA, 19 nt, Homo sapiens
cagagcuccuggauaaauu

SEQ ID NO: 1127100 - RNA, 19 nt, Homo sapiens
gcagugcuccuccuccaaa

SEQ ID NO: 1127101 - RNA, 19 nt, Homo sapiens
ccacaacuccuuggcuuaa

SEQ ID NO: 1127102 - RNA, 19 nt, Homo sapiens
gaucagguuuacccacaau

SEQ ID NO: 1127103 - RNA, 19 nt, Homo sapiens
ucagaaagaucagguuuac

SEQ ID NO: 1127104 - RNA, 19 nt, Homo sapiens
cagaggaaauuugucuuga

SEQ ID NO: 1127105 - RNA, 19 nt, Homo sapiens
gaucagugguccccaaauu

SEQ ID NO: 1127106 - RNA, 19 nt, Homo sapiens
gugccuauguggaaucuau

SEQ ID NO: 1127107 - RNA, 19 nt, Homo sapiens
gaacucagagcuccuggau

SEQ ID NO: 1127108 - RNA, 19 nt, Homo sapiens
uccagaauaugucagagua

SEQ ID NO: 1127109 - RNA, 19 nt, Homo sapiens
gaagagagggccagaccau

SEQ ID NO: 1127110 - RNA, 19 nt, Homo sapiens
caagugagccaagaaccua

SEQ ID NO: 1127111 - RNA, 19 nt, Homo sapiens
ugggagaaaucuaaucaug

SEQ ID NO: 1127112 - RNA, 19 nt, Homo sapiens
agaaaucgcagaugaagga

SEQ ID NO: 1127113 - RNA, 19 nt, Homo sapiens
guucaagacuccacaucug

SEQ ID NO: 1127114 - RNA, 19 nt, Homo sapiens
ccaaagaggcccugugucu

SEQ ID NO: 1127115 - RNA, 19 nt, Homo sapiens
uaccuugucucagauguaa

SEQ ID NO: 1127116 - RNA, 19 nt, Homo sapiens
gacaagccgugccuaugug

SEQ ID NO: 1127117 - RNA, 19 nt, Homo sapiens
aaucgcagaugaaggaaga

SEQ ID NO: 1127118 - RNA, 19 nt, Homo sapiens
gcacuuaccuugcuuccaa

SEQ ID NO: 1127119 - RNA, 19 nt, Homo sapiens
gcacauggauucaguaugg

SEQ ID NO: 1127120 - RNA, 19 nt, Homo sapiens
gaagagagggccagaguaa

SEQ ID NO: 1127121 - RNA, 19 nt, Homo sapiens
gugaagagcuggauugaug

SEQ ID NO: 1127122 - RNA, 19 nt, Homo sapiens
guagaaacauggcauauag

SEQ ID NO: 1127123 - RNA, 19 nt, Homo sapiens
gcaagcacaugcagaagaa

SEQ ID NO: 1127124 - RNA, 19 nt, Homo sapiens
gaacaaagaggaauuagca

SEQ ID NO: 1127125 - RNA, 19 nt, Homo sapiens
ugaguaagaugcuuguuaa

SEQ ID NO: 1127126 - RNA, 19 nt, Homo sapiens
gcaguacaccuaaggaaua

SEQ ID NO: 1127127 - RNA, 19 nt, Homo sapiens
gaaauaucaucaccuagga

SEQ ID NO: 1127128 - RNA, 19 nt, Homo sapiens
gaguagagaucgguucuuu

SEQ ID NO: 1127129 - RNA, 19 nt, Homo sapiens
caaauauucucaugagguu

SEQ ID NO: 1127130 - RNA, 19 nt, Homo sapiens
gaucaugacucagaggaaa

SEQ ID NO: 1127131 - RNA, 19 nt, Homo sapiens
gagcgagucuccuaaauac

SEQ ID NO: 1127132 - RNA, 19 nt, Homo sapiens
ggugagaucuagccucuug

SEQ ID NO: 1127133 - RNA, 19 nt, Homo sapiens
ucaguaaacucuacauugu

SEQ ID NO: 1127134 - RNA, 19 nt, Homo sapiens
gcccagagcuccuucuuca

SEQ ID NO: 1127135 - RNA, 19 nt, Homo sapiens
guaggaaguuauacaauca

SEQ ID NO: 1127136 - RNA, 19 nt, Homo sapiens
agagaaauaucaucaccua

SEQ ID NO: 1127137 - RNA, 19 nt, Homo sapiens
gaaaggugcuggccaucau

SEQ ID NO: 1127138 - RNA, 19 nt, Homo sapiens
gcaguuuccauuugcauua

SEQ ID NO: 1127139 - RNA, 19 nt, Homo sapiens
gagcuggauugaugcagua

SEQ ID NO: 1127140 - RNA, 19 nt, Homo sapiens
ggcagaugcuuauugguaa

SEQ ID NO: 1127141 - RNA, 19 nt, Homo sapiens
gacagaugcuugagauguu

SEQ ID NO: 1127142 - RNA, 19 nt, Homo sapiens
gauauaacuucuaccagau

SEQ ID NO: 1127143 - RNA, 19 nt, Homo sapiens
ggugagagauaauauugau

SEQ ID NO: 1127144 - RNA, 19 nt, Homo sapiens
gggaugagcuagcuguuag

SEQ ID NO: 1127145 - RNA, 19 nt, Homo sapiens
ccacagauauaacuucuac

SEQ ID NO: 1127146 - RNA, 19 nt, Homo sapiens
gaguagcacuuguuaacga

SEQ ID NO: 1127147 - RNA, 19 nt, Homo sapiens
gcagaugcuuauugguaaa

SEQ ID NO: 1127148 - RNA, 19 nt, Homo sapiens
gaggugugcugcuucauca

SEQ ID NO: 1127149 - RNA, 19 nt, Homo sapiens
ggaaauuugucuugaccau

SEQ ID NO: 1127150 - RNA, 19 nt, Homo sapiens
caucagaagaccaacauuu

SEQ ID NO: 1127151 - RNA, 19 nt, Homo sapiens
aaacauagcuuccaaaacu

SEQ ID NO: 1127152 - RNA, 19 nt, Homo sapiens
guagagaucgguucuuuca

SEQ ID NO: 1127153 - RNA, 19 nt, Homo sapiens
uagcagcggucacagagaa

SEQ ID NO: 1127154 - RNA, 19 nt, Homo sapiens
gagaaaggcuacuguaacc

SEQ ID NO: 1127155 - RNA, 19 nt, Homo sapiens
gaagggauuuuaaaggaaa

SEQ ID NO: 1127156 - RNA, 19 nt, Homo sapiens
ccauuugcauuaucgauga

SEQ ID NO: 1127157 - RNA, 19 nt, Homo sapiens
gcugacagaugcuugagau

SEQ ID NO: 1127158 - RNA, 19 nt, Homo sapiens
ggacggacuuugagcacau

SEQ ID NO: 1127159 - RNA, 19 nt, Homo sapiens
ggaguggccacagauauaa

SEQ ID NO: 1127160 - RNA, 19 nt, Homo sapiens
ucucuuggcucucugcaaa

SEQ ID NO: 1127161 - RNA, 19 nt, Homo sapiens
gaaauccaggcagcacuua

SEQ ID NO: 1127162 - RNA, 19 nt, Homo sapiens
ucucuggacugaacaaaga

SEQ ID NO: 1127163 - RNA, 19 nt, Homo sapiens
gcuuugcuguggauucuuu

SEQ ID NO: 1127164 - RNA, 19 nt, Homo sapiens
agacaaacauagcuuccaa

SEQ ID NO: 1127165 - RNA, 19 nt, Homo sapiens
ucuaccagauccuuaaauu

SEQ ID NO: 1127166 - RNA, 19 nt, Homo sapiens
gcagugcuccuccuccaaa

SEQ ID NO: 1127167 - RNA, 19 nt, Homo sapiens
ccaaagugcugggauuaca

SEQ ID NO: 1127168 - RNA, 19 nt, Homo sapiens
caguacaccuaaggaauaa

SEQ ID NO: 1127169 - RNA, 19 nt, Homo sapiens
cagaggaaauuugucuuga

SEQ ID NO: 1127170 - RNA, 19 nt, Homo sapiens
ugagcgagucuccuaaaua

SEQ ID NO: 1127171 - RNA, 19 nt, Homo sapiens
guucaagacuccacaucug

SEQ ID NO: 1127172 - RNA, 19 nt, Homo sapiens
gaguaaguguucugaagca

SEQ ID NO: 1127173 - RNA, 19 nt, Homo sapiens
aaguuucgauuuccgauuu

SEQ ID NO: 1127174 - RNA, 19 nt, Homo sapiens
ucacagagaaauaucauca

SEQ ID NO: 1127175 - RNA, 19 nt, Homo sapiens
ccagauccuuaaauuacaa

SEQ ID NO: 1127176 - RNA, 19 nt, Homo sapiens
cuaccagauccuuaaauua

SEQ ID NO: 1127177 - RNA, 19 nt, Homo sapiens
cauuguaacucuccuugug

SEQ ID NO: 1127178 - RNA, 19 nt, Homo sapiens
gaauccaccucuguucugu

SEQ ID NO: 1127179 - RNA, 19 nt, Homo sapiens
aaugguagcugcagcaaag

SEQ ID NO: 1127180 - RNA, 19 nt, Homo sapiens
acaaguaccacaucuucua

SEQ ID NO: 1127181 - RNA, 19 nt, Homo sapiens
uaucugaugucacaaguac

SEQ ID NO: 1127182 - RNA, 19 nt, Homo sapiens
gcauauagggcuagaagca

SEQ ID NO: 1127183 - RNA, 19 nt, Homo sapiens
gcuguuagagcaaggguuu

SEQ ID NO: 1127184 - RNA, 19 nt, Homo sapiens
cuucauaccuggagucucu

SEQ ID NO: 1127185 - RNA, 19 nt, Homo sapiens
ccaccucuguucuguagga

SEQ ID NO: 1127186 - RNA, 19 nt, Homo sapiens
uggcagaugcuuauuggua

SEQ ID NO: 1127187 - RNA, 19 nt, Homo sapiens
gaccaaggcgccaggagaa

SEQ ID NO: 1127188 - RNA, 19 nt, Homo sapiens
aguaaacucuacauuguuc

SEQ ID NO: 1127189 - RNA, 19 nt, Homo sapiens
caccuaaggaauaaucaua

SEQ ID NO: 1127190 - RNA, 19 nt, Homo sapiens
ucaccaagccagccaauuc

SEQ ID NO: 1127191 - RNA, 19 nt, Homo sapiens
ggaccugcuucccgagaug

SEQ ID NO: 1127192 - RNA, 19 nt, Homo sapiens
uaacucuccuugugaacug

SEQ ID NO: 1127193 - RNA, 19 nt, Homo sapiens
cgagcggaauuuaugcaaa

SEQ ID NO: 1127194 - RNA, 19 nt, Homo sapiens
ggaaauccaggcagcacuu

SEQ ID NO: 1127195 - RNA, 19 nt, Homo sapiens
guccaaggcuacugaucuu

SEQ ID NO: 1127196 - RNA, 19 nt, Homo sapiens
gaucucacccgcaaguuca

SEQ ID NO: 1127197 - RNA, 19 nt, Homo sapiens
gcuguaaaccugccacuag

SEQ ID NO: 1127198 - RNA, 19 nt, Homo sapiens
ccuaaauacucugggcuuu

SEQ ID NO: 1127199 - RNA, 19 nt, Homo sapiens
cgacgccucuccacuccuu

SEQ ID NO: 1127200 - RNA, 19 nt, Homo sapiens
gguggcagaugcuuauugg

SEQ ID NO: 1127201 - RNA, 19 nt, Homo sapiens
aaauuugucuugaccaucu

SEQ ID NO: 1127202 - RNA, 19 nt, Homo sapiens
gguggaugaucaugacuca

SEQ ID NO: 1127203 - RNA, 19 nt, Homo sapiens
ucacaaguaccacaucuuc

SEQ ID NO: 1127204 - RNA, 19 nt, Homo sapiens
gaucaucaauggcaaaagu

SEQ ID NO: 1127205 - RNA, 19 nt, Homo sapiens
ucagggcagccaagaauuu

SEQ ID NO: 1127206 - RNA, 19 nt, Homo sapiens
aaaguuccuguuugcauua

SEQ ID NO: 1127207 - RNA, 19 nt, Homo sapiens
agagaaagacaaacggaaa

SEQ ID NO: 1127208 - RNA, 19 nt, Homo sapiens
gauggaguggccacagaua

SEQ ID NO: 1127209 - RNA, 19 nt, Homo sapiens
uuaccuugcuuccaauuca

SEQ ID NO: 1127210 - RNA, 19 nt, Homo sapiens
gagggucggcagcagauuu

SEQ ID NO: 1127211 - RNA, 19 nt, Homo sapiens
cguagaaacauggcauaua

SEQ ID NO: 1127212 - RNA, 19 nt, Homo sapiens
cacgaacucucuggacuga

SEQ ID NO: 1127213 - RNA, 19 nt, Homo sapiens
gaacuccugagcucaagug

SEQ ID NO: 1127214 - RNA, 19 nt, Homo sapiens
gauacuagaucggaaaaug

SEQ ID NO: 1127215 - RNA, 19 nt, Homo sapiens
uggugugacugaaaggaua

SEQ ID NO: 1127216 - RNA, 19 nt, Homo sapiens
gcauuacucugcaguuucc

SEQ ID NO: 1127217 - RNA, 19 nt, Homo sapiens
gaugauucagacaaacaua

SEQ ID NO: 1127218 - RNA, 19 nt, Homo sapiens
caacacaccuucaaauauu

SEQ ID NO: 1127219 - RNA, 19 nt, Homo sapiens
gcagaguuguuccagauua

SEQ ID NO: 1127220 - RNA, 19 nt, Homo sapiens
gcagaaggaucagacaaua

SEQ ID NO: 1127221 - RNA, 19 nt, Homo sapiens
gaaagagaaugagaugaaa

SEQ ID NO: 1127222 - RNA, 19 nt, Homo sapiens
gcgcagggcccaaauguua

SEQ ID NO: 1127223 - RNA, 19 nt, Homo sapiens
ugacuguucucucuaauaa

SEQ ID NO: 1127224 - RNA, 19 nt, Homo sapiens
caccaaaccugauaugauu

SEQ ID NO: 1127225 - RNA, 19 nt, Homo sapiens
aaacauagcuuuugaguug

SEQ ID NO: 1127226 - RNA, 19 nt, Homo sapiens
gaaguuagaagagauguuu

SEQ ID NO: 1127227 - RNA, 19 nt, Homo sapiens
cagaguaccugaaccaaug

SEQ ID NO: 1127228 - RNA, 19 nt, Homo sapiens
cccaagaguuucugcaaua

SEQ ID NO: 1127229 - RNA, 19 nt, Homo sapiens
gaaaucagaagauguuugu

SEQ ID NO: 1127230 - RNA, 19 nt, Homo sapiens
ggagauauuuccacaggau

SEQ ID NO: 1127231 - RNA, 19 nt, Homo sapiens
gagagacaccucaaacaaa

SEQ ID NO: 1127232 - RNA, 19 nt, Homo sapiens
gaaaugaaagagaaugaga

SEQ ID NO: 1127233 - RNA, 19 nt, Homo sapiens
gcaauucauuuccuguaga

SEQ ID NO: 1127234 - RNA, 19 nt, Homo sapiens
gaaagagagacaccucaaa

SEQ ID NO: 1127235 - RNA, 19 nt, Homo sapiens
caaauguuauagccaaaga

SEQ ID NO: 1127236 - RNA, 19 nt, Homo sapiens
gccaacacaccuucaaaua

SEQ ID NO: 1127237 - RNA, 19 nt, Homo sapiens
guaaaggaguuaggacaug

SEQ ID NO: 1127238 - RNA, 19 nt, Homo sapiens
ugaaagagaaugagaugaa

SEQ ID NO: 1127239 - RNA, 19 nt, Homo sapiens
agagacaccucaaacaaau

SEQ ID NO: 1127240 - RNA, 19 nt, Homo sapiens
gcaauacacccaaccuaug

SEQ ID NO: 1127241 - RNA, 19 nt, Homo sapiens
gcaccaaaccugauaugau

SEQ ID NO: 1127242 - RNA, 19 nt, Homo sapiens
gcaagcuacugagcauaaa

SEQ ID NO: 1127243 - RNA, 19 nt, Homo sapiens
ugagacaucugaguaguau

SEQ ID NO: 1127244 - RNA, 19 nt, Homo sapiens
cagcagaguuguuccagau

SEQ ID NO: 1127245 - RNA, 19 nt, Homo sapiens
cagaguuguuccagauuaa

SEQ ID NO: 1127246 - RNA, 19 nt, Homo sapiens
ccaacacaccuucaaauau

SEQ ID NO: 1127247 - RNA, 19 nt, Homo sapiens
caauacacccaaccuauga

SEQ ID NO: 1127248 - RNA, 19 nt, Homo sapiens
caauucauuuccuguagaa

SEQ ID NO: 1127249 - RNA, 19 nt, Homo sapiens
ccaagaaguuagaagagau

SEQ ID NO: 1127250 - RNA, 19 nt, Homo sapiens
gcagggcccaaauguuaua

SEQ ID NO: 1127251 - RNA, 19 nt, Homo sapiens
gccaaacuguucagauuca

SEQ ID NO: 1127252 - RNA, 19 nt, Homo sapiens
cuacaggccuucaacaucu

SEQ ID NO: 1127253 - RNA, 19 nt, Homo sapiens
agaaggaucagacaauaaa

SEQ ID NO: 1127254 - RNA, 19 nt, Homo sapiens
gccaagaaguuagaagaga

SEQ ID NO: 1127255 - RNA, 19 nt, Homo sapiens
cuguucagauucaagauua

SEQ ID NO: 1127256 - RNA, 19 nt, Homo sapiens
aagcaagaauuaacagaga

SEQ ID NO: 1127257 - RNA, 19 nt, Homo sapiens
ggaaauaagaaucaucuac

SEQ ID NO: 1127258 - RNA, 19 nt, Homo sapiens
caaauuuacagcucuauuc

SEQ ID NO: 1127259 - RNA, 19 nt, Homo sapiens
gaagacaugaaagaaauga

SEQ ID NO: 1127260 - RNA, 19 nt, Homo sapiens
gaaugaaaaugaagacaug

SEQ ID NO: 1127261 - RNA, 19 nt, Homo sapiens
ccucaaacaaauccaaaua

SEQ ID NO: 1127262 - RNA, 19 nt, Homo sapiens
gagcaauucauuuccugua

SEQ ID NO: 1127263 - RNA, 19 nt, Homo sapiens
gcaagaauuaacagagauu

SEQ ID NO: 1127264 - RNA, 19 nt, Homo sapiens
ggaggaagacgagaaugaa

SEQ ID NO: 1127265 - RNA, 19 nt, Homo sapiens
ucaaacaaauccaaauagg

SEQ ID NO: 1127266 - RNA, 19 nt, Homo sapiens
gaagagggacaucaagaag

SEQ ID NO: 1127267 - RNA, 19 nt, Homo sapiens
caugguauaugcaggcuau

SEQ ID NO: 1127268 - RNA, 19 nt, Homo sapiens
cagaagauguuuguauuac

SEQ ID NO: 1127269 - RNA, 19 nt, Homo sapiens
ggaaagagagacaccucaa

SEQ ID NO: 1127270 - RNA, 19 nt, Homo sapiens
cugccaaacuguucagauu

SEQ ID NO: 1127271 - RNA, 19 nt, Homo sapiens
ggaaaucagaagauguuug

SEQ ID NO: 1127272 - RNA, 19 nt, Homo sapiens
gaaaagaaauacagugacu

SEQ ID NO: 1127273 - RNA, 19 nt, Homo sapiens
gaacugaggagauauuucc

SEQ ID NO: 1127274 - RNA, 19 nt, Homo sapiens
uaagaaucaucuaccuuca

SEQ ID NO: 1127275 - RNA, 19 nt, Homo sapiens
gccuggaacugaggagaua

SEQ ID NO: 1127276 - RNA, 19 nt, Homo sapiens
caaacaaauccaaauagga

SEQ ID NO: 1127277 - RNA, 19 nt, Homo sapiens
gauuguggcuacgcaaaug

SEQ ID NO: 1127278 - RNA, 19 nt, Homo sapiens
gaggaagacgagaaugaaa

SEQ ID NO: 1127279 - RNA, 19 nt, Homo sapiens
gcuaucagcagaaggauca

SEQ ID NO: 1127280 - RNA, 19 nt, Homo sapiens
caaauuguggaucauggua

SEQ ID NO: 1127281 - RNA, 19 nt, Homo sapiens
aauuguggaucaugguaua

SEQ ID NO: 1127282 - RNA, 19 nt, Homo sapiens
gcaaauuucagccaagaag

SEQ ID NO: 1127283 - RNA, 19 nt, Homo sapiens
ggauagacaauuuccugaa

SEQ ID NO: 1127284 - RNA, 19 nt, Homo sapiens
agacaucugaguaguauga

SEQ ID NO: 1127285 - RNA, 19 nt, Homo sapiens
cagaaggaucagacaauaa

SEQ ID NO: 1127286 - RNA, 19 nt, Homo sapiens
ccuuauggguauauucauu

SEQ ID NO: 1127287 - RNA, 19 nt, Homo sapiens
gaguggaaaucagaagaug

SEQ ID NO: 1127288 - RNA, 19 nt, Homo sapiens
gagaugaaacccucagaag

SEQ ID NO: 1127289 - RNA, 19 nt, Homo sapiens
uaccuucaagcaagaauua

SEQ ID NO: 1127290 - RNA, 19 nt, Homo sapiens
caucuaccuucaagcaaga

SEQ ID NO: 1127291 - RNA, 19 nt, Homo sapiens
gcagaguaccugaaccaau

SEQ ID NO: 1127292 - RNA, 19 nt, Homo sapiens
aaucugagacaucugagua

SEQ ID NO: 1127293 - RNA, 19 nt, Homo sapiens
agaaucaucuaccuucaag

SEQ ID NO: 1127294 - RNA, 19 nt, Homo sapiens
gaggaaauaagaaucaucu

SEQ ID NO: 1127295 - RNA, 19 nt, Homo sapiens
cccuaucccuggacuguaa

SEQ ID NO: 1127296 - RNA, 19 nt, Homo sapiens
guggaaaucagaagauguu

SEQ ID NO: 1127297 - RNA, 19 nt, Homo sapiens
gagauuguccgaguggaaa

SEQ ID NO: 1127298 - RNA, 19 nt, Homo sapiens
ugaagagggacaucaagaa

SEQ ID NO: 1127299 - RNA, 19 nt, Homo sapiens
ugaguaguaugagcaauuc

SEQ ID NO: 1127300 - RNA, 19 nt, Homo sapiens
ggagauuguccgaguggaa

SEQ ID NO: 1127301 - RNA, 19 nt, Homo sapiens
gagauauuuccacaggaua

SEQ ID NO: 1127302 - RNA, 19 nt, Homo sapiens
agagagacaccucaaacaa

SEQ ID NO: 1127303 - RNA, 19 nt, Homo sapiens
gagauuguggcuacgcaaa

SEQ ID NO: 1127304 - RNA, 19 nt, Homo sapiens
gaacguucaccugagaaga

SEQ ID NO: 1127305 - RNA, 19 nt, Homo sapiens
uccacaggauagacaauuu

SEQ ID NO: 1127306 - RNA, 19 nt, Homo sapiens
aauaggacuugaucagcaa

SEQ ID NO: 1127307 - RNA, 19 nt, Homo sapiens
ccaaauaggacuugaucag

SEQ ID NO: 1127308 - RNA, 19 nt, Homo sapiens
gaguuagugcaaaccauuu

SEQ ID NO: 1127309 - RNA, 19 nt, Homo sapiens
caagaaguuagaagagaug

SEQ ID NO: 1127310 - RNA, 19 nt, Homo sapiens
gcaagcagaguaccugaac

SEQ ID NO: 1127311 - RNA, 19 nt, Homo sapiens
ugagauccuuauggguaua

SEQ ID NO: 1127312 - RNA, 19 nt, Homo sapiens
aaacuguucagauucaaga

SEQ ID NO: 1127313 - RNA, 19 nt, Homo sapiens
ucuaugaaaugucccuaca

SEQ ID NO: 1127314 - RNA, 19 nt, Homo sapiens
ccaagaguuucugcaauac

SEQ ID NO: 1127315 - RNA, 19 nt, Homo sapiens
cagccaagaaguuagaaga

SEQ ID NO: 1127316 - RNA, 19 nt, Homo sapiens
gacugugccugggagauug

SEQ ID NO: 1127317 - RNA, 19 nt, Homo sapiens
ugaguuagugcaaaccauu

SEQ ID NO: 1127318 - RNA, 19 nt, Homo sapiens
ggaaagagguauugaagaa

SEQ ID NO: 1127319 - RNA, 19 nt, Homo sapiens
gauccacacugcucuaaua

SEQ ID NO: 1127320 - RNA, 19 nt, Homo sapiens
gaaaagcucuggaguauug

SEQ ID NO: 1127321 - RNA, 19 nt, Homo sapiens
gcucagagguucccuguug

SEQ ID NO: 1127322 - RNA, 19 nt, Homo sapiens
ccacaugccuggucacuga

SEQ ID NO: 1127323 - RNA, 19 nt, Homo sapiens
gcgaaacccuugccuuuga

SEQ ID NO: 1127324 - RNA, 19 nt, Homo sapiens
gcaggaaacaccauauuaa

SEQ ID NO: 1127325 - RNA, 19 nt, Homo sapiens
gcagaagacuuaccuuagu

SEQ ID NO: 1127326 - RNA, 19 nt, Homo sapiens
ggaaacaccauauuaauag

SEQ ID NO: 1127327 - RNA, 19 nt, Homo sapiens
uaaccuggcuuuaucaaau

SEQ ID NO: 1127328 - RNA, 19 nt, Homo sapiens
ccuaaggacuuucagguaa

SEQ ID NO: 1127329 - RNA, 19 nt, Homo sapiens
cugauaagguucacaguuu

SEQ ID NO: 1127330 - RNA, 19 nt, Homo sapiens
guacauuucuuggcacuug

SEQ ID NO: 1127331 - RNA, 19 nt, Homo sapiens
acaaagugcuucugugaga

SEQ ID NO: 1127332 - RNA, 19 nt, Homo sapiens
ggaacauuauggagagaaa

SEQ ID NO: 1127333 - RNA, 19 nt, Homo sapiens
ccacacugcucuaauaaag

SEQ ID NO: 1127334 - RNA, 19 nt, Homo sapiens
gaucaaagcagcucuggau

SEQ ID NO: 1127335 - RNA, 19 nt, Homo sapiens
ugggauagcugucaucaug

SEQ ID NO: 1127336 - RNA, 19 nt, Homo sapiens
ccugggagguucuggauuu

SEQ ID NO: 1127337 - RNA, 19 nt, Homo sapiens
uaauaaaguucccauccuu

SEQ ID NO: 1127338 - RNA, 19 nt, Homo sapiens
acacugcucuaauaaaguu

SEQ ID NO: 1127339 - RNA, 19 nt, Homo sapiens
gaacugaugccuggacuau

SEQ ID NO: 1127340 - RNA, 19 nt, Homo sapiens
acagagauguggccuauuc

SEQ ID NO: 1127341 - RNA, 19 nt, Homo sapiens
cuacuucccauuacaguua

SEQ ID NO: 1127342 - RNA, 19 nt, Homo sapiens
aaugagcccugguggauuu

SEQ ID NO: 1127343 - RNA, 19 nt, Homo sapiens
cagaagacuuaccuuaguu

SEQ ID NO: 1127344 - RNA, 19 nt, Homo sapiens
guacugaggcacucuagaa

SEQ ID NO: 1127345 - RNA, 19 nt, Homo sapiens
ugagacugaugcuuuguaa

SEQ ID NO: 1127346 - RNA, 19 nt, Homo sapiens
gcaaucacuucaccuugga

SEQ ID NO: 1127347 - RNA, 19 nt, Homo sapiens
gggaaggccuccuacaaag

SEQ ID NO: 1127348 - RNA, 19 nt, Homo sapiens
caugggcccucaaagguaa

SEQ ID NO: 1127349 - RNA, 19 nt, Homo sapiens
ccaaggcauugcuguaaga

SEQ ID NO: 1127350 - RNA, 19 nt, Homo sapiens
gaaagagguauugaagaaa

SEQ ID NO: 1127351 - RNA, 19 nt, Homo sapiens
agacagagauguggccuau

SEQ ID NO: 1127352 - RNA, 19 nt, Homo sapiens
ccacaacaaauauugauug

SEQ ID NO: 1127353 - RNA, 19 nt, Homo sapiens
aaagguaaauugcaguugu

SEQ ID NO: 1127354 - RNA, 19 nt, Homo sapiens
ggagacaaccauggacuuu

SEQ ID NO: 1127355 - RNA, 19 nt, Homo sapiens
caacuggcaccaaggaauu

SEQ ID NO: 1127356 - RNA, 19 nt, Homo sapiens
guucauugcuguagaaagg

SEQ ID NO: 1127357 - RNA, 19 nt, Homo sapiens
caaagcagcucuggaugag

SEQ ID NO: 1127358 - RNA, 19 nt, Homo sapiens
gcagaaggaacauuaugga

SEQ ID NO: 1127359 - RNA, 19 nt, Homo sapiens
ggacguucuugcacaacuu

SEQ ID NO: 1127360 - RNA, 19 nt, Homo sapiens
gaaauaggugaaagugaga

SEQ ID NO: 1127361 - RNA, 19 nt, Homo sapiens
gaaggccuccuacaaagau

SEQ ID NO: 1127362 - RNA, 19 nt, Homo sapiens
gagcccagcuacacagcaa

SEQ ID NO: 1127363 - RNA, 19 nt, Homo sapiens
uaauuaacccuccaccaaa

SEQ ID NO: 1127364 - RNA, 19 nt, Homo sapiens
agagaaagauggucaugag

SEQ ID NO: 1127365 - RNA, 19 nt, Homo sapiens
ggacagggguuucucuuuc

SEQ ID NO: 1127366 - RNA, 19 nt, Homo sapiens
ccaccacuauucauaaagu

SEQ ID NO: 1127367 - RNA, 19 nt, Homo sapiens
gaucugccauaaaggacaa

SEQ ID NO: 1127368 - RNA, 19 nt, Homo sapiens
gaaaaggucuagaaauagg

SEQ ID NO: 1127369 - RNA, 19 nt, Homo sapiens
ggaaggccuccuacaaaga

SEQ ID NO: 1127370 - RNA, 19 nt, Homo sapiens
guaagucacaccacaacaa

SEQ ID NO: 1127371 - RNA, 19 nt, Homo sapiens
ucaaagcagcucuggauga

SEQ ID NO: 1127372 - RNA, 19 nt, Homo sapiens
gaggaaagagguauugaag

SEQ ID NO: 1127373 - RNA, 19 nt, Homo sapiens
agacuuaccuuaguucaag

SEQ ID NO: 1127374 - RNA, 19 nt, Homo sapiens
aaacugagagagugaagaa

SEQ ID NO: 1127375 - RNA, 19 nt, Homo sapiens
uaauagacauccucaccau

SEQ ID NO: 1127376 - RNA, 19 nt, Homo sapiens
caagaugagccaagcagaa

SEQ ID NO: 1127377 - RNA, 19 nt, Homo sapiens
agucacaccacaacaaaua

SEQ ID NO: 1127378 - RNA, 19 nt, Homo sapiens
gcaccagggccuuguugaa

SEQ ID NO: 1127379 - RNA, 19 nt, Homo sapiens
ugucagcccuguccaagga

SEQ ID NO: 1127380 - RNA, 19 nt, Homo sapiens
aagguaaauugcaguugua

SEQ ID NO: 1127381 - RNA, 19 nt, Homo sapiens
ccucucccaucuucucaua

SEQ ID NO: 1127382 - RNA, 19 nt, Homo sapiens
cuaauuaacccuccaccaa

SEQ ID NO: 1127383 - RNA, 19 nt, Homo sapiens
gggccucaauccagucuug

SEQ ID NO: 1127384 - RNA, 19 nt, Homo sapiens
uaagucacaccacaacaaa

SEQ ID NO: 1127385 - RNA, 19 nt, Homo sapiens
aaagagguauugaagaaac

SEQ ID NO: 1127386 - RNA, 19 nt, Homo sapiens
gagaguuuauggucuggau

SEQ ID NO: 1127387 - RNA, 19 nt, Homo sapiens
aagcgaaacccuugccuuu

SEQ ID NO: 1127388 - RNA, 19 nt, Homo sapiens
cauugagacugaugcuuug

SEQ ID NO: 1127389 - RNA, 19 nt, Homo sapiens
aagcagcucuggaugagau

SEQ ID NO: 1127390 - RNA, 19 nt, Homo sapiens
guauugaucacuacuggaa

SEQ ID NO: 1127391 - RNA, 19 nt, Homo sapiens
uagaaaagcucuggaguau

SEQ ID NO: 1127392 - RNA, 19 nt, Homo sapiens
cauaacuggugccuggaaa

SEQ ID NO: 1127393 - RNA, 19 nt, Homo sapiens
uggagacucuguaccauuc

SEQ ID NO: 1127394 - RNA, 19 nt, Homo sapiens
aaaaugauguggaaaggaa

SEQ ID NO: 1127395 - RNA, 19 nt, Homo sapiens
caggaaacaccauauuaau

SEQ ID NO: 1127396 - RNA, 19 nt, Homo sapiens
cuaaggacuuucagguaau

SEQ ID NO: 1127397 - RNA, 19 nt, Homo sapiens
ggaagcaccagcacguuuc

SEQ ID NO: 1127398 - RNA, 19 nt, Homo sapiens
uaaaggacaauaugaacug

SEQ ID NO: 1127399 - RNA, 19 nt, Homo sapiens
cagaguggguccagagaca

SEQ ID NO: 1127400 - RNA, 19 nt, Homo sapiens
gaaccacacagccucuuca

SEQ ID NO: 1127401 - RNA, 19 nt, Homo sapiens
agacaaccauggacuuugg

SEQ ID NO: 1127402 - RNA, 19 nt, Homo sapiens
aauaaaguucccauccuua

SEQ ID NO: 1127403 - RNA, 19 nt, Homo sapiens
ggccaaggcauugcuguaa

SEQ ID NO: 1127404 - RNA, 19 nt, Homo sapiens
cccagacccugcaguuuga

SEQ ID NO: 1127405 - RNA, 19 nt, Homo sapiens
ucagcgaaauaaccuauag

SEQ ID NO: 1127406 - RNA, 19 nt, Homo sapiens
gcugauaagguucacaguu

SEQ ID NO: 1127407 - RNA, 19 nt, Homo sapiens
ggagacagcggcaacuucu

SEQ ID NO: 1127408 - RNA, 19 nt, Homo sapiens
caccacuauucauaaagua

SEQ ID NO: 1127409 - RNA, 19 nt, Homo sapiens
aaaguucccauccuuaaug

SEQ ID NO: 1127410 - RNA, 19 nt, Homo sapiens
ggaaaggaaagcccaggau

SEQ ID NO: 1127411 - RNA, 19 nt, Homo sapiens
ccacucaaccugucagcuu

SEQ ID NO: 1127412 - RNA, 19 nt, Homo sapiens
ugauaagguucacaguuuc

SEQ ID NO: 1127413 - RNA, 19 nt, Homo sapiens
cuaugcagaaggaacauua

SEQ ID NO: 1127414 - RNA, 19 nt, Homo sapiens
ugcaggaaacaccauauua

SEQ ID NO: 1127415 - RNA, 19 nt, Homo sapiens
gagguucccuguugguaac

SEQ ID NO: 1127416 - RNA, 19 nt, Homo sapiens
ucacuucaccuuggacaaa

SEQ ID NO: 1127417 - RNA, 19 nt, Homo sapiens
gagagagugaagaaccaua

SEQ ID NO: 1127418 - RNA, 19 nt, Homo sapiens
gggcagcuuucgagaauua

SEQ ID NO: 1127419 - RNA, 19 nt, Homo sapiens
gcacaagcgucucagcuau

SEQ ID NO: 1127420 - RNA, 19 nt, Homo sapiens
gauuacggcugguacaaug

SEQ ID NO: 1127421 - RNA, 19 nt, Homo sapiens
aggcggaccuggugaauga

SEQ ID NO: 1127422 - RNA, 19 nt, Homo sapiens
guaccacccucuucuccuu

SEQ ID NO: 1127423 - RNA, 19 nt, Homo sapiens
ucccugacauggagaguaa

SEQ ID NO: 1127424 - RNA, 19 nt, Homo sapiens
gcuuaugaaccucuacuuu

SEQ ID NO: 1127425 - RNA, 19 nt, Homo sapiens
ccacagcacccuggcauga

SEQ ID NO: 1127426 - RNA, 19 nt, Homo sapiens
gggccucgcugcucuuucu

SEQ ID NO: 1127427 - RNA, 19 nt, Homo sapiens
ggcuggacaccuucgauua

SEQ ID NO: 1127428 - RNA, 19 nt, Homo sapiens
gcugggcacugugaagaug

SEQ ID NO: 1127429 - RNA, 19 nt, Homo sapiens
gcugguacaaugugucuga

SEQ ID NO: 1127430 - RNA, 19 nt, Homo sapiens
cuuaugaaccucuacuuug

SEQ ID NO: 1127431 - RNA, 19 nt, Homo sapiens
cugcaguucuucaccuuga

SEQ ID NO: 1127432 - RNA, 19 nt, Homo sapiens
acaagcgucucagcuauca

SEQ ID NO: 1127433 - RNA, 19 nt, Homo sapiens
ggugagcgacucccuguuc

SEQ ID NO: 1127434 - RNA, 19 nt, Homo sapiens
ggcacaagcgucucagcua

SEQ ID NO: 1127435 - RNA, 19 nt, Homo sapiens
uguaugcccugcucuucuu

SEQ ID NO: 1127436 - RNA, 19 nt, Homo sapiens
ccuugcugcuccugucaua

SEQ ID NO: 1127437 - RNA, 19 nt, Homo sapiens
uuaugaaccucuacuuugc

SEQ ID NO: 1127438 - RNA, 19 nt, Homo sapiens
ccucuucuccuucuacuuc

SEQ ID NO: 1127439 - RNA, 19 nt, Homo sapiens
ccagccacauccucaaugg

SEQ ID NO: 1127440 - RNA, 19 nt, Homo sapiens
gcgccaugguccugcucua

SEQ ID NO: 1127441 - RNA, 19 nt, Homo sapiens
gcucuucuucuccgucuau

SEQ ID NO: 1127442 - RNA, 19 nt, Homo sapiens
ugacgcuuaugaaccucua

SEQ ID NO: 1127443 - RNA, 19 nt, Homo sapiens
ugaaugaccuggggaacaa

SEQ ID NO: 1127444 - RNA, 19 nt, Homo sapiens
gcaccagccacauccucaa

SEQ ID NO: 1127445 - RNA, 19 nt, Homo sapiens
gccugccacucaauaaaca

SEQ ID NO: 1127446 - RNA, 19 nt, Homo sapiens
gcgacucccuguucgucau

SEQ ID NO: 1127447 - RNA, 19 nt, Homo sapiens
uucuucaccuugacgcuua

SEQ ID NO: 1127448 - RNA, 19 nt, Homo sapiens
ggcuggugcuucuguaugg

SEQ ID NO: 1127449 - RNA, 19 nt, Homo sapiens
gggcugggcacugugaaga

SEQ ID NO: 1127450 - RNA, 19 nt, Homo sapiens
gcuggacaccuucgauuac

SEQ ID NO: 1127451 - RNA, 19 nt, Homo sapiens
gccaugguccugcucuaug

SEQ ID NO: 1127452 - RNA, 19 nt, Homo sapiens
gugccugccacucaauaaa

SEQ ID NO: 1127453 - RNA, 19 nt, Homo sapiens
ucaaugggcaggucuuugc

SEQ ID NO: 1127454 - RNA, 19 nt, Homo sapiens
uauuuggccucauccucuu

SEQ ID NO: 1127455 - RNA, 19 nt, Homo sapiens
ccugguauuuggccucauc

SEQ ID NO: 1127456 - RNA, 19 nt, Homo sapiens
ccaugguccugcucuaugc

SEQ ID NO: 1127457 - RNA, 19 nt, Homo sapiens
aggcaucccucccugacau

SEQ ID NO: 1127458 - RNA, 19 nt, Homo sapiens
ucucgguccuacuucuuug

SEQ ID NO: 1127459 - RNA, 19 nt, Homo sapiens
ucaccuugacgcuuaugaa

SEQ ID NO: 1127460 - RNA, 19 nt, Homo sapiens
ccuucuggcuucucuacug

SEQ ID NO: 1127461 - RNA, 19 nt, Homo sapiens
gguagugccugaucaauga

SEQ ID NO: 1127462 - RNA, 19 nt, Homo sapiens
ggaggaagcugugaagaug

SEQ ID NO: 1127463 - RNA, 19 nt, Homo sapiens
gaaaaggucuaugcaauaa

SEQ ID NO: 1127464 - RNA, 19 nt, Homo sapiens
ccauuuagcuggccaauca

SEQ ID NO: 1127465 - RNA, 19 nt, Homo sapiens
caaggcagcucuacacuca

SEQ ID NO: 1127466 - RNA, 19 nt, Homo sapiens
gagacgggcugcuccauga

SEQ ID NO: 1127467 - RNA, 19 nt, Homo sapiens
uaaaggcagucgcuucauu

SEQ ID NO: 1127468 - RNA, 19 nt, Homo sapiens
gcagaugaauggacaccuu

SEQ ID NO: 1127469 - RNA, 19 nt, Homo sapiens
gcuaggauuugcacuaaug

SEQ ID NO: 1127470 - RNA, 19 nt, Homo sapiens
gcgcuaggauuugcacuaa

SEQ ID NO: 1127471 - RNA, 19 nt, Homo sapiens
gcagaggaccagcagauga

SEQ ID NO: 1127472 - RNA, 19 nt, Homo sapiens
aaacuaaacaagcuuggua

SEQ ID NO: 1127473 - RNA, 19 nt, Homo sapiens
ggauugcgcucgcuuucau

SEQ ID NO: 1127474 - RNA, 19 nt, Homo sapiens
gggagcagguggaguaugg

SEQ ID NO: 1127475 - RNA, 19 nt, Homo sapiens
gcuccuccauggcgaguuu

SEQ ID NO: 1127476 - RNA, 19 nt, Homo sapiens
gaacaagcgcaacguccaa

SEQ ID NO: 1127477 - RNA, 19 nt, Homo sapiens
aaaggucuaugcaauaaag

SEQ ID NO: 1127478 - RNA, 19 nt, Homo sapiens
gauaacggcagagagcaua

SEQ ID NO: 1127479 - RNA, 19 nt, Homo sapiens
gcauagagcgcaggaacaa

SEQ ID NO: 1127480 - RNA, 19 nt, Homo sapiens
ccacuccggugccuccauu

SEQ ID NO: 1127481 - RNA, 19 nt, Homo sapiens
cgggagcccugaaacuaaa

SEQ ID NO: 1127482 - RNA, 19 nt, Homo sapiens
ccacugcccucaccugucu

SEQ ID NO: 1127483 - RNA, 19 nt, Homo sapiens
gcgggagcccugaaacuaa

SEQ ID NO: 1127484 - RNA, 19 nt, Homo sapiens
gaauggacaccuugaagca

SEQ ID NO: 1127485 - RNA, 19 nt, Homo sapiens
gagcagaggaccagcagau

SEQ ID NO: 1127486 - RNA, 19 nt, Homo sapiens
aagcugggcuguccuucaa

SEQ ID NO: 1127487 - RNA, 19 nt, Homo sapiens
ggucaggccaggacaguga

SEQ ID NO: 1127488 - RNA, 19 nt, Homo sapiens
ggacuuugugcucauguug

SEQ ID NO: 1127489 - RNA, 19 nt, Homo sapiens
gaucaccccugaccugcua

SEQ ID NO: 1127490 - RNA, 19 nt, Homo sapiens
gggaggaagcugugaagau

SEQ ID NO: 1127491 - RNA, 19 nt, Homo sapiens
cgucacgguuaaagagaaa

SEQ ID NO: 1127492 - RNA, 19 nt, Homo sapiens
cagaggaccagcagaugaa

SEQ ID NO: 1127493 - RNA, 19 nt, Homo sapiens
gcuccuaccagccuacuau

SEQ ID NO: 1127494 - RNA, 19 nt, Homo sapiens
uggccuggcugcuagaguu

SEQ ID NO: 1127495 - RNA, 19 nt, Homo sapiens
ugaaaaggucuaugcaaua

SEQ ID NO: 1127496 - RNA, 19 nt, Homo sapiens
ccacgugcuucccaugauc

SEQ ID NO: 1127497 - RNA, 19 nt, Homo sapiens
ggcgggagcccugaaacua

SEQ ID NO: 1127498 - RNA, 19 nt, Homo sapiens
gaugaauggacaccuugaa

SEQ ID NO: 1127499 - RNA, 19 nt, Homo sapiens
ucgcuucauuccucucaaa

SEQ ID NO: 1127500 - RNA, 19 nt, Homo sapiens
ccagggucccguugaugua

SEQ ID NO: 1127501 - RNA, 19 nt, Homo sapiens
cgauagcuuuccggaagaa

SEQ ID NO: 1127502 - RNA, 19 nt, Homo sapiens
gggacuuugugcucauguu

SEQ ID NO: 1127503 - RNA, 19 nt, Homo sapiens
ucgccacacugcacaccua

SEQ ID NO: 1127504 - RNA, 19 nt, Homo sapiens
agacucagcggccuacuuc

SEQ ID NO: 1127505 - RNA, 19 nt, Homo sapiens
ggguagugccugaucaaug

SEQ ID NO: 1127506 - RNA, 19 nt, Homo sapiens
cgaggguagugccugauca

SEQ ID NO: 1127507 - RNA, 19 nt, Homo sapiens
aauaaaggcagucgcuuca

SEQ ID NO: 1127508 - RNA, 19 nt, Homo sapiens
uugcucaacugcucacugu

SEQ ID NO: 1127509 - RNA, 19 nt, Homo sapiens
gaggguagugccugaucaa

SEQ ID NO: 1127510 - RNA, 19 nt, Homo sapiens
gccuggcagugguguaaga

SEQ ID NO: 1127511 - RNA, 19 nt, Homo sapiens
gcugagggcggagucuauu

SEQ ID NO: 1127512 - RNA, 19 nt, Homo sapiens
caugggaccagacgugaug

SEQ ID NO: 1127513 - RNA, 19 nt, Homo sapiens
gaaacuaaacaagcuuggu

SEQ ID NO: 1127514 - RNA, 19 nt, Homo sapiens
agucggagcugacccuaac

SEQ ID NO: 1127515 - RNA, 19 nt, Homo sapiens
gcugaacgggcuccuagau

SEQ ID NO: 1127516 - RNA, 19 nt, Homo sapiens
aaaggcagucgcuucauuc

SEQ ID NO: 1127517 - RNA, 19 nt, Homo sapiens
gccguguucucgauagcuu

SEQ ID NO: 1127518 - RNA, 19 nt, Homo sapiens
gccagggucccguugaugu

SEQ ID NO: 1127519 - RNA, 19 nt, Homo sapiens
ucgauagcuuuccggaaga

SEQ ID NO: 1127520 - RNA, 19 nt, Homo sapiens
gcuuugcccucacccuuac

SEQ ID NO: 1127521 - RNA, 19 nt, Homo sapiens
gcagagccacucgcaccuu

SEQ ID NO: 1127522 - RNA, 19 nt, Homo sapiens
cggacccacugcugucuuc

SEQ ID NO: 1127523 - RNA, 19 nt, Homo sapiens
agacagaacgacagaacca

SEQ ID NO: 1127524 - RNA, 19 nt, Homo sapiens
uaagaggucucauucauuu

SEQ ID NO: 1127525 - RNA, 19 nt, Homo sapiens
gacccaaucuuauucauuu

SEQ ID NO: 1127526 - RNA, 19 nt, Homo sapiens
aaaggaaagugucugauuu

SEQ ID NO: 1127527 - RNA, 19 nt, Homo sapiens
gcaaaacaguguauacaua

SEQ ID NO: 1127528 - RNA, 19 nt, Homo sapiens
caccaaagguuaacaguga

SEQ ID NO: 1127529 - RNA, 19 nt, Homo sapiens
ggaaggcaaugaaacacuu

SEQ ID NO: 1127530 - RNA, 19 nt, Homo sapiens
ggucugagaaagaaauuua

SEQ ID NO: 1127531 - RNA, 19 nt, Homo sapiens
ggagggagaugagauggaa

SEQ ID NO: 1127532 - RNA, 19 nt, Homo sapiens
gcacagaguuaagcaggaa

SEQ ID NO: 1127533 - RNA, 19 nt, Homo sapiens
ugucugcacuuucuugaua

SEQ ID NO: 1127534 - RNA, 19 nt, Homo sapiens
gaacuugucaaucgccuuu

SEQ ID NO: 1127535 - RNA, 19 nt, Homo sapiens
caaaggaaagugucugauu

SEQ ID NO: 1127536 - RNA, 19 nt, Homo sapiens
gcugguugauccacagaua

SEQ ID NO: 1127537 - RNA, 19 nt, Homo sapiens
gcucugcauucuaaccaua

SEQ ID NO: 1127538 - RNA, 19 nt, Homo sapiens
gaaagguguuuggaagaga

SEQ ID NO: 1127539 - RNA, 19 nt, Homo sapiens
ggaaacaacaacaacauca

SEQ ID NO: 1127540 - RNA, 19 nt, Homo sapiens
ggcaaugaaacacuuaaua

SEQ ID NO: 1127541 - RNA, 19 nt, Homo sapiens
gaaggcaaugaaacacuua

SEQ ID NO: 1127542 - RNA, 19 nt, Homo sapiens
guccuuaucccauuuaauu

SEQ ID NO: 1127543 - RNA, 19 nt, Homo sapiens
ggaaagguguuuggaagag

SEQ ID NO: 1127544 - RNA, 19 nt, Homo sapiens
gaaauguaaaccuccaauu

SEQ ID NO: 1127545 - RNA, 19 nt, Homo sapiens
uaaaagaacuugucaaucg

SEQ ID NO: 1127546 - RNA, 19 nt, Homo sapiens
ggaaggaagagcugguuga

SEQ ID NO: 1127547 - RNA, 19 nt, Homo sapiens
gaaaauaacgaguugcaaa

SEQ ID NO: 1127548 - RNA, 19 nt, Homo sapiens
aauaagaggucucauucau

SEQ ID NO: 1127549 - RNA, 19 nt, Homo sapiens
uuaaagaggacauagacua

SEQ ID NO: 1127550 - RNA, 19 nt, Homo sapiens
gaagggaauuuuagacaga

SEQ ID NO: 1127551 - RNA, 19 nt, Homo sapiens
cauuguauauugcaaagug

SEQ ID NO: 1127552 - RNA, 19 nt, Homo sapiens
uugcugagauuuacauaug

SEQ ID NO: 1127553 - RNA, 19 nt, Homo sapiens
gaccguccuuaucccauuu

SEQ ID NO: 1127554 - RNA, 19 nt, Homo sapiens
caacaacaacaucaugcaa

SEQ ID NO: 1127555 - RNA, 19 nt, Homo sapiens
ccaauuaccucuggaucuc

SEQ ID NO: 1127556 - RNA, 19 nt, Homo sapiens
gaaacaacaacaacaucau

SEQ ID NO: 1127557 - RNA, 19 nt, Homo sapiens
ugacauaaugcaaaggaaa

SEQ ID NO: 1127558 - RNA, 19 nt, Homo sapiens
gcaggaaacaacaacaaca

SEQ ID NO: 1127559 - RNA, 19 nt, Homo sapiens
guguguauauuacuugugu

SEQ ID NO: 1127560 - RNA, 19 nt, Homo sapiens
gauggaaagguguuuggaa

SEQ ID NO: 1127561 - RNA, 19 nt, Homo sapiens
uuaauaagaggucucauuc

SEQ ID NO: 1127562 - RNA, 19 nt, Homo sapiens
aaacaacaacaacaucaug

SEQ ID NO: 1127563 - RNA, 19 nt, Homo sapiens
gugaaucucugugugaucu

SEQ ID NO: 1127564 - RNA, 19 nt, Homo sapiens
gaaggaagagcugguugau

SEQ ID NO: 1127565 - RNA, 19 nt, Homo sapiens
agacagaggcugcuucagu

SEQ ID NO: 1127566 - RNA, 19 nt, Homo sapiens
gcaaagaaaacgaaggaaa

SEQ ID NO: 1127567 - RNA, 19 nt, Homo sapiens
acccuaaaguagacaguaa

SEQ ID NO: 1127568 - RNA, 19 nt, Homo sapiens
caaagugcagcgugccaaa

SEQ ID NO: 1127569 - RNA, 19 nt, Homo sapiens
gcaaacagaagggaauuuu

SEQ ID NO: 1127570 - RNA, 19 nt, Homo sapiens
caucuucucacuugccaaa

SEQ ID NO: 1127571 - RNA, 19 nt, Homo sapiens
gucaacaucucaucuuuug

SEQ ID NO: 1127572 - RNA, 19 nt, Homo sapiens
uucagucucucgaagaauu

SEQ ID NO: 1127573 - RNA, 19 nt, Homo sapiens
cucaauaacagaagcguaa

SEQ ID NO: 1127574 - RNA, 19 nt, Homo sapiens
ucauucauuugcauggaaa

SEQ ID NO: 1127575 - RNA, 19 nt, Homo sapiens
gaguuaagcaggaaacaac

SEQ ID NO: 1127576 - RNA, 19 nt, Homo sapiens
gcucauuguauauugcaaa

SEQ ID NO: 1127577 - RNA, 19 nt, Homo sapiens
aaauuuagggcucugcauu

SEQ ID NO: 1127578 - RNA, 19 nt, Homo sapiens
aaagguguuuggaagagau

SEQ ID NO: 1127579 - RNA, 19 nt, Homo sapiens
gaugagauggaaagguguu

SEQ ID NO: 1127580 - RNA, 19 nt, Homo sapiens
ggaaagugucugauuuuau

SEQ ID NO: 1127581 - RNA, 19 nt, Homo sapiens
gagauuuacauaugacucu

SEQ ID NO: 1127582 - RNA, 19 nt, Homo sapiens
ucgauguugcugagauuua

SEQ ID NO: 1127583 - RNA, 19 nt, Homo sapiens
acaacaacaucaugcaaaa

SEQ ID NO: 1127584 - RNA, 19 nt, Homo sapiens
ugacaagggagggagauga

SEQ ID NO: 1127585 - RNA, 19 nt, Homo sapiens
caaacagaagggaauuuua

SEQ ID NO: 1127586 - RNA, 19 nt, Homo sapiens
gaaucucugugugaucucu

SEQ ID NO: 1127587 - RNA, 19 nt, Homo sapiens
gacauaaugcaaaggaaag

SEQ ID NO: 1127588 - RNA, 19 nt, Homo sapiens
auaagaggucucauucauu

SEQ ID NO: 1127589 - RNA, 19 nt, Homo sapiens
gugacauaaugcaaaggaa

SEQ ID NO: 1127590 - RNA, 19 nt, Homo sapiens
uaauaagaggucucauuca

SEQ ID NO: 1127591 - RNA, 19 nt, Homo sapiens
ugccacugcuuucuguuug

SEQ ID NO: 1127592 - RNA, 19 nt, Homo sapiens
gaaaaggagcaggaaacua

SEQ ID NO: 1127593 - RNA, 19 nt, Homo sapiens
gaacgccagcaaacagaag

SEQ ID NO: 1127594 - RNA, 19 nt, Homo sapiens
cagaguaauaaacugguaa

SEQ ID NO: 1127595 - RNA, 19 nt, Homo sapiens
gaagaaaaggagcaggaaa

SEQ ID NO: 1127596 - RNA, 19 nt, Homo sapiens
ugacccaaucuuauucauu

SEQ ID NO: 1127597 - RNA, 19 nt, Homo sapiens
gcugagauuuacauaugac

SEQ ID NO: 1127598 - RNA, 19 nt, Homo sapiens
gaaauuuagggcucugcau

SEQ ID NO: 1127599 - RNA, 19 nt, Homo sapiens
uaaggggucugagaaagaa

SEQ ID NO: 1127600 - RNA, 19 nt, Homo sapiens
gaauuuaaagaggacauag

SEQ ID NO: 1127601 - RNA, 19 nt, Homo sapiens
gucugcacuuucuugauaa

SEQ ID NO: 1127602 - RNA, 19 nt, Homo sapiens
gaagagauaaggggucuga

SEQ ID NO: 1127603 - RNA, 19 nt, Homo sapiens
caagggagggagaugagau

SEQ ID NO: 1127604 - RNA, 19 nt, Homo sapiens
uugucaacaucucaucuuu

SEQ ID NO: 1127605 - RNA, 19 nt, Homo sapiens
cgauguugcugagauuuac

SEQ ID NO: 1127606 - RNA, 19 nt, Homo sapiens
gauaaggggucugagaaag

SEQ ID NO: 1127607 - RNA, 19 nt, Homo sapiens
gagauaaggggucugagaa

SEQ ID NO: 1127608 - RNA, 19 nt, Homo sapiens
aacaacaacaucaugcaaa

SEQ ID NO: 1127609 - RNA, 19 nt, Homo sapiens
acgcccguauggagaauuu

SEQ ID NO: 1127610 - RNA, 19 nt, Homo sapiens
gcaaaggaaagugucugau

SEQ ID NO: 1127611 - RNA, 19 nt, Homo sapiens
caggaaacaacaacaacau

SEQ ID NO: 1127612 - RNA, 19 nt, Homo sapiens
gcccguauggagaauuuga

SEQ ID NO: 1127613 - RNA, 19 nt, Homo sapiens
gagauggaaagguguuugg

SEQ ID NO: 1127614 - RNA, 19 nt, Homo sapiens
gauuuacauaugacucuug

SEQ ID NO: 1127615 - RNA, 19 nt, Homo sapiens
cagcaaacagaagggaauu

SEQ ID NO: 1127616 - RNA, 19 nt, Homo sapiens
cagugaaucucugugugau

SEQ ID NO: 1127617 - RNA, 19 nt, Homo sapiens
aggaaagugucugauuuua

SEQ ID NO: 1127618 - RNA, 19 nt, Homo sapiens
caaagaaaacgaaggaaag

SEQ ID NO: 1127619 - RNA, 19 nt, Homo sapiens
ccagcaaacagaagggaau

SEQ ID NO: 1127620 - RNA, 19 nt, Homo sapiens
cauucgauguugcugagau

SEQ ID NO: 1127621 - RNA, 19 nt, Homo sapiens
ucucgaagaauuuaaagag

SEQ ID NO: 1127622 - RNA, 19 nt, Homo sapiens
gccacugcuuucuguuugu

SEQ ID NO: 1127623 - RNA, 19 nt, Homo sapiens
uuaauguugccacugcuuu

SEQ ID NO: 1127624 - RNA, 19 nt, Homo sapiens
ggaacaacuucaagaaaua

SEQ ID NO: 1127625 - RNA, 19 nt, Homo sapiens
ggaaguggcugagcucuuu

SEQ ID NO: 1127626 - RNA, 19 nt, Homo sapiens
gcacaaggauauggaaguu

SEQ ID NO: 1127627 - RNA, 19 nt, Homo sapiens
ggaaggccaugcuggauga

SEQ ID NO: 1127628 - RNA, 19 nt, Homo sapiens
gaaguucugucccaggaaa

SEQ ID NO: 1127629 - RNA, 19 nt, Homo sapiens
gcaguugacccaggaauua

SEQ ID NO: 1127630 - RNA, 19 nt, Homo sapiens
gcuagaggccugaugguua

SEQ ID NO: 1127631 - RNA, 19 nt, Homo sapiens
acaagaagcugcagaacau

SEQ ID NO: 1127632 - RNA, 19 nt, Homo sapiens
gcaaagacccaagaacuga

SEQ ID NO: 1127633 - RNA, 19 nt, Homo sapiens
uggaaacgcugcaagagaa

SEQ ID NO: 1127634 - RNA, 19 nt, Homo sapiens
ucaaauagcuugggagacu

SEQ ID NO: 1127635 - RNA, 19 nt, Homo sapiens
gcagggauuucuccuucuu

SEQ ID NO: 1127636 - RNA, 19 nt, Homo sapiens
ggaagagcgccaucauuga

SEQ ID NO: 1127637 - RNA, 19 nt, Homo sapiens
ggauuucuccuucuucuug

SEQ ID NO: 1127638 - RNA, 19 nt, Homo sapiens
uggaacaacuucaagaaau

SEQ ID NO: 1127639 - RNA, 19 nt, Homo sapiens
gagcagauccaaacagcaa

SEQ ID NO: 1127640 - RNA, 19 nt, Homo sapiens
cgggagaucuugcgggaaa

SEQ ID NO: 1127641 - RNA, 19 nt, Homo sapiens
gcaguagcaucuccuccuu

SEQ ID NO: 1127642 - RNA, 19 nt, Homo sapiens
uguuaaugauccugucuua

SEQ ID NO: 1127643 - RNA, 19 nt, Homo sapiens
uggcagagcugagagauca

SEQ ID NO: 1127644 - RNA, 19 nt, Homo sapiens
cccaagggcuucugucuuc

SEQ ID NO: 1127645 - RNA, 19 nt, Homo sapiens
ggccugaugguuaguguua

SEQ ID NO: 1127646 - RNA, 19 nt, Homo sapiens
gaagagcgccaucauugag

SEQ ID NO: 1127647 - RNA, 19 nt, Homo sapiens
cggaagagcgccaucauug

SEQ ID NO: 1127648 - RNA, 19 nt, Homo sapiens
agacacagcaggagaaaug

SEQ ID NO: 1127649 - RNA, 19 nt, Homo sapiens
gagcggaaacgggcagaua

SEQ ID NO: 1127650 - RNA, 19 nt, Homo sapiens
uccgagagcugcaugaaga

SEQ ID NO: 1127651 - RNA, 19 nt, Homo sapiens
aacaaugccuugaggacua

SEQ ID NO: 1127652 - RNA, 19 nt, Homo sapiens
gccaagggcugguuugaac

SEQ ID NO: 1127653 - RNA, 19 nt, Homo sapiens
acagaaagaugaccucaac

SEQ ID NO: 1127654 - RNA, 19 nt, Homo sapiens
ggcagaggauccuggagaa

SEQ ID NO: 1127655 - RNA, 19 nt, Homo sapiens
gaacaacuucaagaaauag

SEQ ID NO: 1127656 - RNA, 19 nt, Homo sapiens
uggaugagcuagcaaugga

SEQ ID NO: 1127657 - RNA, 19 nt, Homo sapiens
ucagguacauuccauggau

SEQ ID NO: 1127658 - RNA, 19 nt, Homo sapiens
cuagaggccugaugguuag

SEQ ID NO: 1127659 - RNA, 19 nt, Homo sapiens
aaggagagcucggcuguuc

SEQ ID NO: 1127660 - RNA, 19 nt, Homo sapiens
gaaggaagccgaggaaucc

SEQ ID NO: 1127661 - RNA, 19 nt, Homo sapiens
gaacaaguggaagggcuuu

SEQ ID NO: 1127662 - RNA, 19 nt, Homo sapiens
gcagacaguggaagaacuu

SEQ ID NO: 1127663 - RNA, 19 nt, Homo sapiens
guucagcguucuagcaaca

SEQ ID NO: 1127664 - RNA, 19 nt, Homo sapiens
ucaagcggcagcugcauuu

SEQ ID NO: 1127665 - RNA, 19 nt, Homo sapiens
agaggauccuggagaagaa

SEQ ID NO: 1127666 - RNA, 19 nt, Homo sapiens
gcaaggaggaggagcuaca

SEQ ID NO: 1127667 - RNA, 19 nt, Homo sapiens
acaaggauauggaaguucu

SEQ ID NO: 1127668 - RNA, 19 nt, Homo sapiens
gaugguuaguguuaaugau

SEQ ID NO: 1127669 - RNA, 19 nt, Homo sapiens
uugggagacuggacauuaa

SEQ ID NO: 1127670 - RNA, 19 nt, Homo sapiens
aggaggagcuacaggaugu

SEQ ID NO: 1127671 - RNA, 19 nt, Homo sapiens
ggaacaugcagcagcuuug

SEQ ID NO: 1127672 - RNA, 19 nt, Homo sapiens
gcugggagcaguucgucua

SEQ ID NO: 1127673 - RNA, 19 nt, Homo sapiens
caauggaaacgcugcaaga

SEQ ID NO: 1127674 - RNA, 19 nt, Homo sapiens
gaugagcuagcaauggaaa

SEQ ID NO: 1127675 - RNA, 19 nt, Homo sapiens
gcugucagaugaggaagug

SEQ ID NO: 1127676 - RNA, 19 nt, Homo sapiens
cacgggagcuggagacucu

SEQ ID NO: 1127677 - RNA, 19 nt, Homo sapiens
gcuggaacaacuucaagaa

SEQ ID NO: 1127678 - RNA, 19 nt, Homo sapiens
cagcaaagacccaagaacu

SEQ ID NO: 1127679 - RNA, 19 nt, Homo sapiens
aaacagcaaagacccaaga

SEQ ID NO: 1127680 - RNA, 19 nt, Homo sapiens
ugaauaugcuccgggaaca

SEQ ID NO: 1127681 - RNA, 19 nt, Homo sapiens
ugaacaagaagcugcagaa

SEQ ID NO: 1127682 - RNA, 19 nt, Homo sapiens
aauggaugcuggaggagaa

SEQ ID NO: 1127683 - RNA, 19 nt, Homo sapiens
caaagacccaagaacugaa

SEQ ID NO: 1127684 - RNA, 19 nt, Homo sapiens
aaauagggcaggagaagga

SEQ ID NO: 1127685 - RNA, 19 nt, Homo sapiens
cccaagaacugaauaugcu

SEQ ID NO: 1127686 - RNA, 19 nt, Homo sapiens
gugaagcaccuggaaguga

SEQ ID NO: 1127687 - RNA, 19 nt, Homo sapiens
gcgccaucauugagaccua

SEQ ID NO: 1127688 - RNA, 19 nt, Homo sapiens
cagaggauccuggagaaga

SEQ ID NO: 1127689 - RNA, 19 nt, Homo sapiens
gcagcaggaacaagaggaa

SEQ ID NO: 1127690 - RNA, 19 nt, Homo sapiens
gaagagcugggagcaguuc

SEQ ID NO: 1127691 - RNA, 19 nt, Homo sapiens
gaagucccagcacaaggaa

SEQ ID NO: 1127692 - RNA, 19 nt, Homo sapiens
ggugugugguccauguuca

SEQ ID NO: 1127693 - RNA, 19 nt, Homo sapiens
uucgggagaugaacaagaa

SEQ ID NO: 1127694 - RNA, 19 nt, Homo sapiens
ugaaggaagccgaggaauc

SEQ ID NO: 1127695 - RNA, 19 nt, Homo sapiens
gggcuucugucuucaucuc

SEQ ID NO: 1127696 - RNA, 19 nt, Homo sapiens
uuaaugauccugucuuagg

SEQ ID NO: 1127697 - RNA, 19 nt, Homo sapiens
ccugaugguuaguguuaau

SEQ ID NO: 1127698 - RNA, 19 nt, Homo sapiens
cuugggagacuggacauua

SEQ ID NO: 1127699 - RNA, 19 nt, Homo sapiens
ucaccaagaauaugcacuu

SEQ ID NO: 1127700 - RNA, 19 nt, Homo sapiens
gaacaagaagcugcagaac

SEQ ID NO: 1127701 - RNA, 19 nt, Homo sapiens
ggaggaggagcuacaggau

SEQ ID NO: 1127702 - RNA, 19 nt, Homo sapiens
ggaagagcugggagcaguu

SEQ ID NO: 1127703 - RNA, 19 nt, Homo sapiens
aguagcaucuccuccuuca

SEQ ID NO: 1127704 - RNA, 19 nt, Homo sapiens
ugaagcaggaggugaagga

SEQ ID NO: 1127705 - RNA, 19 nt, Homo sapiens
ggcaggagaaggagcaguu

SEQ ID NO: 1127706 - RNA, 19 nt, Homo sapiens
cgagaaccuucgggagaug

SEQ ID NO: 1127707 - RNA, 19 nt, Homo sapiens
cagagacacagcaggagaa

SEQ ID NO: 1127708 - RNA, 19 nt, Homo sapiens
ggaaacgggcagauaagcu

SEQ ID NO: 1127709 - RNA, 19 nt, Homo sapiens
ggacagccggaucgaugug

SEQ ID NO: 1127710 - RNA, 19 nt, Homo sapiens
gaacaugcagcagcuuugc

SEQ ID NO: 1127711 - RNA, 19 nt, Homo sapiens
gugggugugugguccaugu

SEQ ID NO: 1127712 - RNA, 19 nt, Homo sapiens
gaagccaggcgacgagaac

SEQ ID NO: 1127713 - RNA, 19 nt, Homo sapiens
ccugagagaccuagugaag

SEQ ID NO: 1127714 - RNA, 19 nt, Homo sapiens
gagagcugcaugaagacaa

SEQ ID NO: 1127715 - RNA, 19 nt, Homo sapiens
gcuugaggcugccaaucag

SEQ ID NO: 1127716 - RNA, 19 nt, Homo sapiens
acaggaggcucggaagagu

SEQ ID NO: 1127717 - RNA, 19 nt, Homo sapiens
gaccuuaugggacagaaag

SEQ ID NO: 1127718 - RNA, 19 nt, Homo sapiens
gaggccugaugguuagugu

SEQ ID NO: 1127719 - RNA, 19 nt, Homo sapiens
ggcuugaggcugccaauca

SEQ ID NO: 1127720 - RNA, 19 nt, Homo sapiens
ggagagcucggcuguucca

SEQ ID NO: 1127721 - RNA, 19 nt, Homo sapiens
gggcaaggaggaggagcua

SEQ ID NO: 1127722 - RNA, 19 nt, Homo sapiens
agaagucccagcacaagga

SEQ ID NO: 1127723 - RNA, 19 nt, Homo sapiens
ggcccuacaagaucaggua

SEQ ID NO: 1127724 - RNA, 19 nt, Homo sapiens
ggagaucgcuucaagauug

SEQ ID NO: 1127725 - RNA, 19 nt, Homo sapiens
ggacagacuuucuaaugaa

SEQ ID NO: 1127726 - RNA, 19 nt, Homo sapiens
gaugaugguucuuccuuua

SEQ ID NO: 1127727 - RNA, 19 nt, Homo sapiens
aaacccagcuuucaucuuu

SEQ ID NO: 1127728 - RNA, 19 nt, Homo sapiens
gagaagagcacgucgguuu

SEQ ID NO: 1127729 - RNA, 19 nt, Homo sapiens
gagcaagauaugugaauua

SEQ ID NO: 1127730 - RNA, 19 nt, Homo sapiens
gaaauggagcagucaauga

SEQ ID NO: 1127731 - RNA, 19 nt, Homo sapiens
gaaguuguaucuccagcuu

SEQ ID NO: 1127732 - RNA, 19 nt, Homo sapiens
gcacgucgguuuccuuaag

SEQ ID NO: 1127733 - RNA, 19 nt, Homo sapiens
ggauaucacuucgaaagga

SEQ ID NO: 1127734 - RNA, 19 nt, Homo sapiens
gauaucacuucgaaaggaa

SEQ ID NO: 1127735 - RNA, 19 nt, Homo sapiens
gagcacgucgguuuccuua

SEQ ID NO: 1127736 - RNA, 19 nt, Homo sapiens
gaucuuauguaguggaagu

SEQ ID NO: 1127737 - RNA, 19 nt, Homo sapiens
cgacguugaucucuuacaa

SEQ ID NO: 1127738 - RNA, 19 nt, Homo sapiens
cauaggagaucgcuucaag

SEQ ID NO: 1127739 - RNA, 19 nt, Homo sapiens
caauauugaugucacugaa

SEQ ID NO: 1127740 - RNA, 19 nt, Homo sapiens
ccaccuucuuacuuuauua

SEQ ID NO: 1127741 - RNA, 19 nt, Homo sapiens
gguccaccuucuuacuuua

SEQ ID NO: 1127742 - RNA, 19 nt, Homo sapiens
caucagagguugucagacu

SEQ ID NO: 1127743 - RNA, 19 nt, Homo sapiens
ugauauaccuucuggaucu

SEQ ID NO: 1127744 - RNA, 19 nt, Homo sapiens
uggacagacuuucuaauga

SEQ ID NO: 1127745 - RNA, 19 nt, Homo sapiens
uaauuacaguguccuauag

SEQ ID NO: 1127746 - RNA, 19 nt, Homo sapiens
gaugguucuuccuuuauug

SEQ ID NO: 1127747 - RNA, 19 nt, Homo sapiens
gguucuuccuuuauugaua

SEQ ID NO: 1127748 - RNA, 19 nt, Homo sapiens
acuauaaacuugagucauc

SEQ ID NO: 1127749 - RNA, 19 nt, Homo sapiens
ugaagcaacuacuauaaac

SEQ ID NO: 1127750 - RNA, 19 nt, Homo sapiens
gcacaaacacggcaacacu

SEQ ID NO: 1127751 - RNA, 19 nt, Homo sapiens
ggaaauggagcagucaaug

SEQ ID NO: 1127752 - RNA, 19 nt, Homo sapiens
caacuacuauaaacuugag

SEQ ID NO: 1127753 - RNA, 19 nt, Homo sapiens
gugaagcaacuacuauaaa

SEQ ID NO: 1127754 - RNA, 19 nt, Homo sapiens
ucccgacguugaucucuua

SEQ ID NO: 1127755 - RNA, 19 nt, Homo sapiens
gcccuauccucuccaaaug

SEQ ID NO: 1127756 - RNA, 19 nt, Homo sapiens
gcaacuacuauaaacuuga

SEQ ID NO: 1127757 - RNA, 19 nt, Homo sapiens
ugaugguucuuccuuuauu

SEQ ID NO: 1127758 - RNA, 19 nt, Homo sapiens
cuaaaguggucaacacaag

SEQ ID NO: 1127759 - RNA, 19 nt, Homo sapiens
uauuugugcuucugccuaa

SEQ ID NO: 1127760 - RNA, 19 nt, Homo sapiens
ugaguugccugauguuucu

SEQ ID NO: 1127761 - RNA, 19 nt, Homo sapiens
ccuauccucuccaaaugaa

SEQ ID NO: 1127762 - RNA, 19 nt, Homo sapiens
aaauggagcagucaaugaa

SEQ ID NO: 1127763 - RNA, 19 nt, Homo sapiens
caagugauccugacaugag

SEQ ID NO: 1127764 - RNA, 19 nt, Homo sapiens
cacaagugauccugacaug

SEQ ID NO: 1127765 - RNA, 19 nt, Homo sapiens
ugaugaugguucuuccuuu

SEQ ID NO: 1127766 - RNA, 19 nt, Homo sapiens
auggagcagucaaugaaua

SEQ ID NO: 1127767 - RNA, 19 nt, Homo sapiens
gggcuggacagacuuucua

SEQ ID NO: 1127768 - RNA, 19 nt, Homo sapiens
gauauaccuucuggaucuu

SEQ ID NO: 1127769 - RNA, 19 nt, Homo sapiens
aaaaucaucuggcaaaucu

SEQ ID NO: 1127770 - RNA, 19 nt, Homo sapiens
agagcaagauaugugaauu

SEQ ID NO: 1127771 - RNA, 19 nt, Homo sapiens
gagagcaagauaugugaau

SEQ ID NO: 1127772 - RNA, 19 nt, Homo sapiens
ugccugauguuucugaguu

SEQ ID NO: 1127773 - RNA, 19 nt, Homo sapiens
uaagacagaugggaguuuu

SEQ ID NO: 1127774 - RNA, 19 nt, Homo sapiens
caugauauaccuucuggau

SEQ ID NO: 1127775 - RNA, 19 nt, Homo sapiens
caacuguguauguuaacuu

SEQ ID NO: 1127776 - RNA, 19 nt, Homo sapiens
ugugaagcaacuacuauaa

SEQ ID NO: 1127777 - RNA, 19 nt, Homo sapiens
gugugaagcaacuacuaua

SEQ ID NO: 1127778 - RNA, 19 nt, Homo sapiens
uaggagaucgcuucaagau

SEQ ID NO: 1127779 - RNA, 19 nt, Homo sapiens
ggaguuuugugguucauga

SEQ ID NO: 1127780 - RNA, 19 nt, Homo sapiens
uuacaguguccuauagaaa

SEQ ID NO: 1127781 - RNA, 19 nt, Homo sapiens
ugagucaucccgacguuga

SEQ ID NO: 1127782 - RNA, 19 nt, Homo sapiens
aaccaugaguugccugaug

SEQ ID NO: 1127783 - RNA, 19 nt, Homo sapiens
gacaugagacgggaaaugg

SEQ ID NO: 1127784 - RNA, 19 nt, Homo sapiens
gacagacuuucuaaugaac

SEQ ID NO: 1127785 - RNA, 19 nt, Homo sapiens
gaagcaacuacuauaaacu

SEQ ID NO: 1127786 - RNA, 19 nt, Homo sapiens
cagauuugaucccguucga

SEQ ID NO: 1127787 - RNA, 19 nt, Homo sapiens
ggaaaaccgugugaagcaa

SEQ ID NO: 1127788 - RNA, 19 nt, Homo sapiens
ucuagcagcggcagcagua

SEQ ID NO: 1127789 - RNA, 19 nt, Homo sapiens
gcugguagacggagaagag

SEQ ID NO: 1127790 - RNA, 19 nt, Homo sapiens
guggauaucacuucgaaag

SEQ ID NO: 1127791 - RNA, 19 nt, Homo sapiens
ugaauuccaaccaugaguu

SEQ ID NO: 1127792 - RNA, 19 nt, Homo sapiens
ucgguuuccuuaagacaga

SEQ ID NO: 1127793 - RNA, 19 nt, Homo sapiens
uuucugaguucaugacaag

SEQ ID NO: 1127794 - RNA, 19 nt, Homo sapiens
gggaaauggagcagucaau

SEQ ID NO: 1127795 - RNA, 19 nt, Homo sapiens
cuggacagacuuucuaaug

SEQ ID NO: 1127796 - RNA, 19 nt, Homo sapiens
uagcacauguuuuguacuu

SEQ ID NO: 1127797 - RNA, 19 nt, Homo sapiens
cacgucgguuuccuuaaga

SEQ ID NO: 1127798 - RNA, 19 nt, Homo sapiens
uagcagcggcagcaguaaa

SEQ ID NO: 1127799 - RNA, 19 nt, Homo sapiens
uaaaguggucaacacaagu

SEQ ID NO: 1127800 - RNA, 19 nt, Homo sapiens
aaugagagcaagauaugug

SEQ ID NO: 1127801 - RNA, 19 nt, Homo sapiens
uauaccuucuggaucuuau

SEQ ID NO: 1127802 - RNA, 19 nt, Homo sapiens
caaugguuaugaugauggu

SEQ ID NO: 1127803 - RNA, 19 nt, Homo sapiens
caucaaaacaucagagguu

SEQ ID NO: 1127804 - RNA, 19 nt, Homo sapiens
gcaagauaugugaauuaca

SEQ ID NO: 1127805 - RNA, 19 nt, Homo sapiens
ugauguuucugaguucaug

SEQ ID NO: 1127806 - RNA, 19 nt, Homo sapiens
accaugaguugccugaugu

SEQ ID NO: 1127807 - RNA, 19 nt, Homo sapiens
gagcagucaaugaauaugc

SEQ ID NO: 1127808 - RNA, 19 nt, Homo sapiens
uuauguaguggaaguugua

SEQ ID NO: 1127809 - RNA, 19 nt, Homo sapiens
gucaaugaauaugcugaau

SEQ ID NO: 1127810 - RNA, 19 nt, Homo sapiens
ugacaugagacgggaaaug

SEQ ID NO: 1127811 - RNA, 19 nt, Homo sapiens
aaaaugagagcaagauaug

SEQ ID NO: 1127812 - RNA, 19 nt, Homo sapiens
auuacaguguccuauagaa

SEQ ID NO: 1127813 - RNA, 19 nt, Homo sapiens
acucuucucuucaaaauca

SEQ ID NO: 1127814 - RNA, 19 nt, Homo sapiens
gcaagaaacaguugaguua

SEQ ID NO: 1127815 - RNA, 19 nt, Homo sapiens
gagcauggauuaucuauuc

SEQ ID NO: 1127816 - RNA, 19 nt, Homo sapiens
cauauuagaugaacuggua

SEQ ID NO: 1127817 - RNA, 19 nt, Homo sapiens
gcagacauuugauuucuuu

SEQ ID NO: 1127818 - RNA, 19 nt, Homo sapiens
gaaauggauuggucagaaa

SEQ ID NO: 1127819 - RNA, 19 nt, Homo sapiens
gaauagagaguaucaguuu

SEQ ID NO: 1127820 - RNA, 19 nt, Homo sapiens
ggaaagaugcuaaauucua

SEQ ID NO: 1127821 - RNA, 19 nt, Homo sapiens
gaaucuugcugucaaagua

SEQ ID NO: 1127822 - RNA, 19 nt, Homo sapiens
gaauuugcuucgaguauuu

SEQ ID NO: 1127823 - RNA, 19 nt, Homo sapiens
gaaacaagcguaauaggaa

SEQ ID NO: 1127824 - RNA, 19 nt, Homo sapiens
gcagguuaauggauaauuu

SEQ ID NO: 1127825 - RNA, 19 nt, Homo sapiens
gaaacaaguuacuaaagug

SEQ ID NO: 1127826 - RNA, 19 nt, Homo sapiens
gaaauaaguccaagacaga

SEQ ID NO: 1127827 - RNA, 19 nt, Homo sapiens
cacaucagcuuucaaauga

SEQ ID NO: 1127828 - RNA, 19 nt, Homo sapiens
gaacugaugugagguaagu

SEQ ID NO: 1127829 - RNA, 19 nt, Homo sapiens
gauaauaugaccucaguaa

SEQ ID NO: 1127830 - RNA, 19 nt, Homo sapiens
gauaauaccucaguguuca

SEQ ID NO: 1127831 - RNA, 19 nt, Homo sapiens
gggagcagguuaauggaua

SEQ ID NO: 1127832 - RNA, 19 nt, Homo sapiens
gcaguuugcuuuagaguca

SEQ ID NO: 1127833 - RNA, 19 nt, Homo sapiens
gagcucacauggauauauu

SEQ ID NO: 1127834 - RNA, 19 nt, Homo sapiens
uagaugaaauccacaguaa

SEQ ID NO: 1127835 - RNA, 19 nt, Homo sapiens
gauaauguguggagucuca

SEQ ID NO: 1127836 - RNA, 19 nt, Homo sapiens
gaaaauugcuggaauguca

SEQ ID NO: 1127837 - RNA, 19 nt, Homo sapiens
ggaauuugcuucgaguauu

SEQ ID NO: 1127838 - RNA, 19 nt, Homo sapiens
gaaaagcuaucuucuguau

SEQ ID NO: 1127839 - RNA, 19 nt, Homo sapiens
ccagaaagucacauuaaua

SEQ ID NO: 1127840 - RNA, 19 nt, Homo sapiens
cuacugcucucucuguaua

SEQ ID NO: 1127841 - RNA, 19 nt, Homo sapiens
ccaagaaacaagcguaaua

SEQ ID NO: 1127842 - RNA, 19 nt, Homo sapiens
aaggaaagaugcuaaauuc

SEQ ID NO: 1127843 - RNA, 19 nt, Homo sapiens
guucagacaucauaagaga

SEQ ID NO: 1127844 - RNA, 19 nt, Homo sapiens
gcucucugaucgugauuua

SEQ ID NO: 1127845 - RNA, 19 nt, Homo sapiens
gcauuuagacagcuguuua

SEQ ID NO: 1127846 - RNA, 19 nt, Homo sapiens
cauuauggcugagaguuua

SEQ ID NO: 1127847 - RNA, 19 nt, Homo sapiens
gaaauugcuaucuguguaa

SEQ ID NO: 1127848 - RNA, 19 nt, Homo sapiens
caaugaaaguguaaugguu

SEQ ID NO: 1127849 - RNA, 19 nt, Homo sapiens
uaaaguggauuguccuguu

SEQ ID NO: 1127850 - RNA, 19 nt, Homo sapiens
gaugaaauccacaguaaau

SEQ ID NO: 1127851 - RNA, 19 nt, Homo sapiens
ucacacagguaccagcuuu

SEQ ID NO: 1127852 - RNA, 19 nt, Homo sapiens
ccaagaauuuguacacaug

SEQ ID NO: 1127853 - RNA, 19 nt, Homo sapiens
agaaauugcuaucugugua

SEQ ID NO: 1127854 - RNA, 19 nt, Homo sapiens
ggacaggaagauaauauga

SEQ ID NO: 1127855 - RNA, 19 nt, Homo sapiens
gcacagggauuugguuugg

SEQ ID NO: 1127856 - RNA, 19 nt, Homo sapiens
gauaguaaaugcggcaaug

SEQ ID NO: 1127857 - RNA, 19 nt, Homo sapiens
ucacuugggucaaucaaau

SEQ ID NO: 1127858 - RNA, 19 nt, Homo sapiens
uuagaaacauugcgcauau

SEQ ID NO: 1127859 - RNA, 19 nt, Homo sapiens
gcuaguaaacucaaugaaa

SEQ ID NO: 1127860 - RNA, 19 nt, Homo sapiens
ggagcagguuaauggauaa

SEQ ID NO: 1127861 - RNA, 19 nt, Homo sapiens
ugaaauggauuggucagaa

SEQ ID NO: 1127862 - RNA, 19 nt, Homo sapiens
gagaguaucaguuuacaau

SEQ ID NO: 1127863 - RNA, 19 nt, Homo sapiens
caaggaaagaugcuaaauu

SEQ ID NO: 1127864 - RNA, 19 nt, Homo sapiens
ucuucuagcuguauugaua

SEQ ID NO: 1127865 - RNA, 19 nt, Homo sapiens
aaacacaucagcuuucaaa

SEQ ID NO: 1127866 - RNA, 19 nt, Homo sapiens
gaguauggguuagaaauca

SEQ ID NO: 1127867 - RNA, 19 nt, Homo sapiens
uuacacauuucucagagua

SEQ ID NO: 1127868 - RNA, 19 nt, Homo sapiens
ugaaagugcugagauugaa

SEQ ID NO: 1127869 - RNA, 19 nt, Homo sapiens
cuaguaaacucaaugaaag

SEQ ID NO: 1127870 - RNA, 19 nt, Homo sapiens
gaaaugagugguucuacau

SEQ ID NO: 1127871 - RNA, 19 nt, Homo sapiens
gaagacaauagaugauuug

SEQ ID NO: 1127872 - RNA, 19 nt, Homo sapiens
gcucacauggauauauuua

SEQ ID NO: 1127873 - RNA, 19 nt, Homo sapiens
aauaggagcucacauggau

SEQ ID NO: 1127874 - RNA, 19 nt, Homo sapiens
ccaaaucuccugcuucuuc

SEQ ID NO: 1127875 - RNA, 19 nt, Homo sapiens
uaagugagcaugucaaaca

SEQ ID NO: 1127876 - RNA, 19 nt, Homo sapiens
gaagugcagacauuugauu

SEQ ID NO: 1127877 - RNA, 19 nt, Homo sapiens
gauaguugaguauggguua

SEQ ID NO: 1127878 - RNA, 19 nt, Homo sapiens
gcagaacugaugugaggua

SEQ ID NO: 1127879 - RNA, 19 nt, Homo sapiens
acagugaagugcagacauu

SEQ ID NO: 1127880 - RNA, 19 nt, Homo sapiens
guaaaugcggcaauguuaa

SEQ ID NO: 1127881 - RNA, 19 nt, Homo sapiens
gaaagucacauuaauaagc

SEQ ID NO: 1127882 - RNA, 19 nt, Homo sapiens
caaagagacacguucugua

SEQ ID NO: 1127883 - RNA, 19 nt, Homo sapiens
ggaauuggaaccugacaga

SEQ ID NO: 1127884 - RNA, 19 nt, Homo sapiens
gaaauccacaguaaauauc

SEQ ID NO: 1127885 - RNA, 19 nt, Homo sapiens
gcuaaaagagcauggauua

SEQ ID NO: 1127886 - RNA, 19 nt, Homo sapiens
aaggaaagccucagaaguu

SEQ ID NO: 1127887 - RNA, 19 nt, Homo sapiens
aaaguggauuguccuguuu

SEQ ID NO: 1127888 - RNA, 19 nt, Homo sapiens
caucagcuuucaaaugaga

SEQ ID NO: 1127889 - RNA, 19 nt, Homo sapiens
ucagauucaugcaauaguu

SEQ ID NO: 1127890 - RNA, 19 nt, Homo sapiens
uggauuaucuauucaagga

SEQ ID NO: 1127891 - RNA, 19 nt, Homo sapiens
gaaggaaagccucagaagu

SEQ ID NO: 1127892 - RNA, 19 nt, Homo sapiens
ccaaacacaucagcuuuca

SEQ ID NO: 1127893 - RNA, 19 nt, Homo sapiens
gaagaaggaaagccucaga

SEQ ID NO: 1127894 - RNA, 19 nt, Homo sapiens
ucaaaucuguaacacugaa

SEQ ID NO: 1127895 - RNA, 19 nt, Homo sapiens
gcaugggacaggaagauaa

SEQ ID NO: 1127896 - RNA, 19 nt, Homo sapiens
aaagcuaucuucuguaugc

SEQ ID NO: 1127897 - RNA, 19 nt, Homo sapiens
cagaguaggauauuaguau

SEQ ID NO: 1127898 - RNA, 19 nt, Homo sapiens
caagaaacaguugaguuaa

SEQ ID NO: 1127899 - RNA, 19 nt, Homo sapiens
gagaauccagccucacaaa

SEQ ID NO: 1127900 - RNA, 19 nt, Homo sapiens
gguuugguuugguuugaua

SEQ ID NO: 1127901 - RNA, 19 nt, Homo sapiens
aauaugaccucaguaacaa

SEQ ID NO: 1127902 - RNA, 19 nt, Homo sapiens
gcaaugauaauaccucagu

SEQ ID NO: 1127903 - RNA, 19 nt, Homo sapiens
ugaguucccuguguuagaa

SEQ ID NO: 1127904 - RNA, 19 nt, Homo sapiens
gccagaugcuuccagaguu

SEQ ID NO: 1127905 - RNA, 19 nt, Homo sapiens
aaacaagcguaauaggaau

SEQ ID NO: 1127906 - RNA, 19 nt, Homo sapiens
cacaagagccgcugaaagu

SEQ ID NO: 1127907 - RNA, 19 nt, Homo sapiens
gcaauguuaagacaagaaa

SEQ ID NO: 1127908 - RNA, 19 nt, Homo sapiens
gcuuucaaaugagaugaua

SEQ ID NO: 1127909 - RNA, 19 nt, Homo sapiens
gaggauucuucuagcugua

SEQ ID NO: 1127910 - RNA, 19 nt, Homo sapiens
gaaauaaacaacagcucau

SEQ ID NO: 1127911 - RNA, 19 nt, Homo sapiens
gagauugaaccaagaaaca

SEQ ID NO: 1127912 - RNA, 19 nt, Homo sapiens
uaauaugaccucaguaaca

SEQ ID NO: 1127913 - RNA, 19 nt, Homo sapiens
acaaaggaccaaacagaaa

SEQ ID NO: 1127914 - RNA, 19 nt, Homo sapiens
gcuguaaccuguucaucua

SEQ ID NO: 1127915 - RNA, 19 nt, Homo sapiens
ccaucaagcuguucauugg

SEQ ID NO: 1127916 - RNA, 19 nt, Homo sapiens
auauaaagauggccacguu

SEQ ID NO: 1127917 - RNA, 19 nt, Homo sapiens
gaagcuguguucgccaaug

SEQ ID NO: 1127918 - RNA, 19 nt, Homo sapiens
ucacaggcaugcacaaagg

SEQ ID NO: 1127919 - RNA, 19 nt, Homo sapiens
gcacaugaacggauuaagc

SEQ ID NO: 1127920 - RNA, 19 nt, Homo sapiens
acgcugagcugaugcagau

SEQ ID NO: 1127921 - RNA, 19 nt, Homo sapiens
gggaacccgucgaccauuc

SEQ ID NO: 1127922 - RNA, 19 nt, Homo sapiens
ggugcgccuuugugaagua

SEQ ID NO: 1127923 - RNA, 19 nt, Homo sapiens
ggcaaaaucuacgagcuua

SEQ ID NO: 1127924 - RNA, 19 nt, Homo sapiens
uauaaagauggccacguua

SEQ ID NO: 1127925 - RNA, 19 nt, Homo sapiens
cgucgaccauucccaugaa

SEQ ID NO: 1127926 - RNA, 19 nt, Homo sapiens
gcagauguuccucccuuuc

SEQ ID NO: 1127927 - RNA, 19 nt, Homo sapiens
ucagauaagccaggccuuu

SEQ ID NO: 1127928 - RNA, 19 nt, Homo sapiens
gcaugaagaggcucaaggu

SEQ ID NO: 1127929 - RNA, 19 nt, Homo sapiens
cgagggcuguaaccuguuc

SEQ ID NO: 1127930 - RNA, 19 nt, Homo sapiens
ccucagccgccuccaauga

SEQ ID NO: 1127931 - RNA, 19 nt, Homo sapiens
ucuacgagcuuacgguucu

SEQ ID NO: 1127932 - RNA, 19 nt, Homo sapiens
gccaucaagcuguucauug

SEQ ID NO: 1127933 - RNA, 19 nt, Homo sapiens
gagagccgaggagguagua

SEQ ID NO: 1127934 - RNA, 19 nt, Homo sapiens
gacaacgcaagccucagua

SEQ ID NO: 1127935 - RNA, 19 nt, Homo sapiens
caaacggacaggcugacaa

SEQ ID NO: 1127936 - RNA, 19 nt, Homo sapiens
caugaacggcuuccagauc

SEQ ID NO: 1127937 - RNA, 19 nt, Homo sapiens
gcgccuuccucaccuacug

SEQ ID NO: 1127938 - RNA, 19 nt, Homo sapiens
cccgcaaccuggaugagaa

SEQ ID NO: 1127939 - RNA, 19 nt, Homo sapiens
ugacaacgcaagccucagu

SEQ ID NO: 1127940 - RNA, 19 nt, Homo sapiens
ccgggcacaugaacggauu

SEQ ID NO: 1127941 - RNA, 19 nt, Homo sapiens
cgaccauucccaugaagga

SEQ ID NO: 1127942 - RNA, 19 nt, Homo sapiens
cagauaagccaggccuuuc

SEQ ID NO: 1127943 - RNA, 19 nt, Homo sapiens
ugccuacccugcugccuau

SEQ ID NO: 1127944 - RNA, 19 nt, Homo sapiens
guucacaggcaugcacaaa

SEQ ID NO: 1127945 - RNA, 19 nt, Homo sapiens
ggcucaaggugcagcugaa

SEQ ID NO: 1127946 - RNA, 19 nt, Homo sapiens
gggcacaugaacggauuaa

SEQ ID NO: 1127947 - RNA, 19 nt, Homo sapiens
acgcaagccucaguaccaa

SEQ ID NO: 1127948 - RNA, 19 nt, Homo sapiens
caccagcugugccuagcau

SEQ ID NO: 1127949 - RNA, 19 nt, Homo sapiens
gcaaacggacaggcugaca

SEQ ID NO: 1127950 - RNA, 19 nt, Homo sapiens
gcugcgccuuccucaccua

SEQ ID NO: 1127951 - RNA, 19 nt, Homo sapiens
ggccagaugggcauguuca

SEQ ID NO: 1127952 - RNA, 19 nt, Homo sapiens
cuacugcgagcgugaguca

SEQ ID NO: 1127953 - RNA, 19 nt, Homo sapiens
aaagauggccacguuagca

SEQ ID NO: 1127954 - RNA, 19 nt, Homo sapiens
ggucauacauucccaauuu

SEQ ID NO: 1127955 - RNA, 19 nt, Homo sapiens
gagcauggaucaacuagga

SEQ ID NO: 1127956 - RNA, 19 nt, Homo sapiens
ggaaugaacuaaagcagau

SEQ ID NO: 1127957 - RNA, 19 nt, Homo sapiens
gacauaaucuccaaacaau

SEQ ID NO: 1127958 - RNA, 19 nt, Homo sapiens
gauaggaguucucuaggaa

SEQ ID NO: 1127959 - RNA, 19 nt, Homo sapiens
gcugaaguguucuuuguaa

SEQ ID NO: 1127960 - RNA, 19 nt, Homo sapiens
ugaagagucugcuuuaaau

SEQ ID NO: 1127961 - RNA, 19 nt, Homo sapiens
gaaaguaacccagcuuguu

SEQ ID NO: 1127962 - RNA, 19 nt, Homo sapiens
caacuaggagcccauauaa

SEQ ID NO: 1127963 - RNA, 19 nt, Homo sapiens
cgagaugccuuugacauuu

SEQ ID NO: 1127964 - RNA, 19 nt, Homo sapiens
cagugucucuuucuaguua

SEQ ID NO: 1127965 - RNA, 19 nt, Homo sapiens
gauaggccauggagcaauu

SEQ ID NO: 1127966 - RNA, 19 nt, Homo sapiens
acaaucaucugugaguuua

SEQ ID NO: 1127967 - RNA, 19 nt, Homo sapiens
cgaauaagaguuaagguaa

SEQ ID NO: 1127968 - RNA, 19 nt, Homo sapiens
uaaagcagaugucuaagca

SEQ ID NO: 1127969 - RNA, 19 nt, Homo sapiens
uaagauuggucauacauuc

SEQ ID NO: 1127970 - RNA, 19 nt, Homo sapiens
gaaguguucuuuguaagga

SEQ ID NO: 1127971 - RNA, 19 nt, Homo sapiens
gaacuaaagcagaugucua

SEQ ID NO: 1127972 - RNA, 19 nt, Homo sapiens
cagcaggacugaucaagug

SEQ ID NO: 1127973 - RNA, 19 nt, Homo sapiens
gaauaagaguuaagguaag

SEQ ID NO: 1127974 - RNA, 19 nt, Homo sapiens
cuaaaggguuaacaggaua

SEQ ID NO: 1127975 - RNA, 19 nt, Homo sapiens
ggaaagaaacccagaaugc

SEQ ID NO: 1127976 - RNA, 19 nt, Homo sapiens
cucaauaucucucugcuaa

SEQ ID NO: 1127977 - RNA, 19 nt, Homo sapiens
gggcugaaguguucuuugu

SEQ ID NO: 1127978 - RNA, 19 nt, Homo sapiens
cugaugacauuccauuuaa

SEQ ID NO: 1127979 - RNA, 19 nt, Homo sapiens
ggagagagaagcaguagau

SEQ ID NO: 1127980 - RNA, 19 nt, Homo sapiens
ccacaacucuaaagucaag

SEQ ID NO: 1127981 - RNA, 19 nt, Homo sapiens
ggaguggguuguccaaaca

SEQ ID NO: 1127982 - RNA, 19 nt, Homo sapiens
gagagaagcaguagauaca

SEQ ID NO: 1127983 - RNA, 19 nt, Homo sapiens
cauugaggauggugagaua

SEQ ID NO: 1127984 - RNA, 19 nt, Homo sapiens
guuccugucuccugaauga

SEQ ID NO: 1127985 - RNA, 19 nt, Homo sapiens
guuugagagucguaauuua

SEQ ID NO: 1127986 - RNA, 19 nt, Homo sapiens
ucuaauaccuguucuuugg

SEQ ID NO: 1127987 - RNA, 19 nt, Homo sapiens
gcugguugcucugaaagua

SEQ ID NO: 1127988 - RNA, 19 nt, Homo sapiens
guuagagacuccuagaaau

SEQ ID NO: 1127989 - RNA, 19 nt, Homo sapiens
gucauacauucccaauuua

SEQ ID NO: 1127990 - RNA, 19 nt, Homo sapiens
gcugaagagucugcuuuaa

SEQ ID NO: 1127991 - RNA, 19 nt, Homo sapiens
caguagggcugacauaauc

SEQ ID NO: 1127992 - RNA, 19 nt, Homo sapiens
caauaucucucugcuaaca

SEQ ID NO: 1127993 - RNA, 19 nt, Homo sapiens
gaucuucggccucauucua

SEQ ID NO: 1127994 - RNA, 19 nt, Homo sapiens
gguuagagacuccuagaaa

SEQ ID NO: 1127995 - RNA, 19 nt, Homo sapiens
caagcugguugcucugaaa

SEQ ID NO: 1127996 - RNA, 19 nt, Homo sapiens
gaaggcagaacaagacaga

SEQ ID NO: 1127997 - RNA, 19 nt, Homo sapiens
guuaaagguuccagggauu

SEQ ID NO: 1127998 - RNA, 19 nt, Homo sapiens
gugcauuacaggauauuua

SEQ ID NO: 1127999 - RNA, 19 nt, Homo sapiens
gaggauggugagauaaaua

SEQ ID NO: 1128000 - RNA, 19 nt, Homo sapiens
gaacaugagugaauuuugg

SEQ ID NO: 1128001 - RNA, 19 nt, Homo sapiens
ggauaggguggaaagguua

SEQ ID NO: 1128002 - RNA, 19 nt, Homo sapiens
ccucuaaucuucuguuucu

SEQ ID NO: 1128003 - RNA, 19 nt, Homo sapiens
ggucuaagauuggucauac

SEQ ID NO: 1128004 - RNA, 19 nt, Homo sapiens
cauaaucuccaaacaauuc

SEQ ID NO: 1128005 - RNA, 19 nt, Homo sapiens
caucaucuuacucaucuua

SEQ ID NO: 1128006 - RNA, 19 nt, Homo sapiens
ccugaugacauuccauuua

SEQ ID NO: 1128007 - RNA, 19 nt, Homo sapiens
ucaacuaggagcccauaua

SEQ ID NO: 1128008 - RNA, 19 nt, Homo sapiens
uagcuaccuucucuaauau

SEQ ID NO: 1128009 - RNA, 19 nt, Homo sapiens
ugacauaaucuccaaacaa

SEQ ID NO: 1128010 - RNA, 19 nt, Homo sapiens
gaagaggggucuggaaaga

SEQ ID NO: 1128011 - RNA, 19 nt, Homo sapiens
cuaggaaccuggaaugagu

SEQ ID NO: 1128012 - RNA, 19 nt, Homo sapiens
gcaguagauacacuccuua

SEQ ID NO: 1128013 - RNA, 19 nt, Homo sapiens
gggcugacauaaucuccaa

SEQ ID NO: 1128014 - RNA, 19 nt, Homo sapiens
aaccacaacucuaaaguca

SEQ ID NO: 1128015 - RNA, 19 nt, Homo sapiens
gaguuuaggagucuuaaga

SEQ ID NO: 1128016 - RNA, 19 nt, Homo sapiens
gaacuaggaguaaguccau

SEQ ID NO: 1128017 - RNA, 19 nt, Homo sapiens
uaugcuaccaucacuaaua

SEQ ID NO: 1128018 - RNA, 19 nt, Homo sapiens
gcuccugccugcucugaga

SEQ ID NO: 1128019 - RNA, 19 nt, Homo sapiens
gaaccacaacucuaaaguc

SEQ ID NO: 1128020 - RNA, 19 nt, Homo sapiens
caaccgagaugccuuugac

SEQ ID NO: 1128021 - RNA, 19 nt, Homo sapiens
uagccugaguguuauacua

SEQ ID NO: 1128022 - RNA, 19 nt, Homo sapiens
aaaguaacccagcuuguug

SEQ ID NO: 1128023 - RNA, 19 nt, Homo sapiens
caagguggacuucugauca

SEQ ID NO: 1128024 - RNA, 19 nt, Homo sapiens
ccgaauaagaguuaaggua

SEQ ID NO: 1128025 - RNA, 19 nt, Homo sapiens
ucuaaaggguuaacaggau

SEQ ID NO: 1128026 - RNA, 19 nt, Homo sapiens
acuaggagcccauauaaau

SEQ ID NO: 1128027 - RNA, 19 nt, Homo sapiens
ucuauacauugccagauuu

SEQ ID NO: 1128028 - RNA, 19 nt, Homo sapiens
ugaaaacaaucaucuguga

SEQ ID NO: 1128029 - RNA, 19 nt, Homo sapiens
ggaguaaguccaucucaag

SEQ ID NO: 1128030 - RNA, 19 nt, Homo sapiens
ccagaaugcggcagaacua

SEQ ID NO: 1128031 - RNA, 19 nt, Homo sapiens
gaucaagugacuacugguu

SEQ ID NO: 1128032 - RNA, 19 nt, Homo sapiens
ggacugaucaagugacuac

SEQ ID NO: 1128033 - RNA, 19 nt, Homo sapiens
gaagaagagaagacggauu

SEQ ID NO: 1128034 - RNA, 19 nt, Homo sapiens
augcuaccaucacuaauaa

SEQ ID NO: 1128035 - RNA, 19 nt, Homo sapiens
gaagagucugcuuuaaaug

SEQ ID NO: 1128036 - RNA, 19 nt, Homo sapiens
gagaagcaguagauacacu

SEQ ID NO: 1128037 - RNA, 19 nt, Homo sapiens
caucagggaacaugaguga

SEQ ID NO: 1128038 - RNA, 19 nt, Homo sapiens
cagggaacaugagugaauu

SEQ ID NO: 1128039 - RNA, 19 nt, Homo sapiens
ucaagugacuacugguuag

SEQ ID NO: 1128040 - RNA, 19 nt, Homo sapiens
ggucaggaauguaggaacu

SEQ ID NO: 1128041 - RNA, 19 nt, Homo sapiens
uaggagcccauauaaauga

SEQ ID NO: 1128042 - RNA, 19 nt, Homo sapiens
aaacaaucaucugugaguu

SEQ ID NO: 1128043 - RNA, 19 nt, Homo sapiens
aagaagagaagacggauug

SEQ ID NO: 1128044 - RNA, 19 nt, Homo sapiens
gcuaccuucucuaauaugu

SEQ ID NO: 1128045 - RNA, 19 nt, Homo sapiens
guggacuucugaucauuga

SEQ ID NO: 1128046 - RNA, 19 nt, Homo sapiens
gaaugcggcagaacuagga

SEQ ID NO: 1128047 - RNA, 19 nt, Homo sapiens
gcucuaaaauaccucagua

SEQ ID NO: 1128048 - RNA, 19 nt, Homo sapiens
gagagagaagcaguagaua

SEQ ID NO: 1128049 - RNA, 19 nt, Homo sapiens
caacucuaaagucaagaua

SEQ ID NO: 1128050 - RNA, 19 nt, Homo sapiens
gagaugccuuugacauuuu

SEQ ID NO: 1128051 - RNA, 19 nt, Homo sapiens
ggugcucucuugccuuuag

SEQ ID NO: 1128052 - RNA, 19 nt, Homo sapiens
gaucaacuaggagcccaua

SEQ ID NO: 1128053 - RNA, 19 nt, Homo sapiens
ccuccgcccuuaacucuau

SEQ ID NO: 1128054 - RNA, 19 nt, Homo sapiens
cuagagagcugguuuauua

SEQ ID NO: 1128055 - RNA, 19 nt, Homo sapiens
gcaaggaucucuuugauug

SEQ ID NO: 1128056 - RNA, 19 nt, Homo sapiens
gacccuagcuaacauauua

SEQ ID NO: 1128057 - RNA, 19 nt, Homo sapiens
gagaauugaugagguauua

SEQ ID NO: 1128058 - RNA, 19 nt, Homo sapiens
cagcuuauguuucuacuua

SEQ ID NO: 1128059 - RNA, 19 nt, Homo sapiens
gauggguccuuguauauua

SEQ ID NO: 1128060 - RNA, 19 nt, Homo sapiens
ggagauaagugcaagacua

SEQ ID NO: 1128061 - RNA, 19 nt, Homo sapiens
cuaaugagauugcgacaua

SEQ ID NO: 1128062 - RNA, 19 nt, Homo sapiens
aaacuccacuugacauuua

SEQ ID NO: 1128063 - RNA, 19 nt, Homo sapiens
cauaugagguuuggauuua

SEQ ID NO: 1128064 - RNA, 19 nt, Homo sapiens
gaugauggguccuuguaua

SEQ ID NO: 1128065 - RNA, 19 nt, Homo sapiens
guaauggacuuguagauau

SEQ ID NO: 1128066 - RNA, 19 nt, Homo sapiens
caagagaauugaugaggua

SEQ ID NO: 1128067 - RNA, 19 nt, Homo sapiens
gaaauuaacaccuaggaaa

SEQ ID NO: 1128068 - RNA, 19 nt, Homo sapiens
gauauggccuuaaauccua

SEQ ID NO: 1128069 - RNA, 19 nt, Homo sapiens
gaaauacucagcacaauau

SEQ ID NO: 1128070 - RNA, 19 nt, Homo sapiens
cagaugacauaaagcauua

SEQ ID NO: 1128071 - RNA, 19 nt, Homo sapiens
gcacuuaauccauuguuua

SEQ ID NO: 1128072 - RNA, 19 nt, Homo sapiens
caagaaaguucaagaguca

SEQ ID NO: 1128073 - RNA, 19 nt, Homo sapiens
aaacaucucuugcaccaaa

SEQ ID NO: 1128074 - RNA, 19 nt, Homo sapiens
gauaaagagucucaaggaa

SEQ ID NO: 1128075 - RNA, 19 nt, Homo sapiens
caccaaagcuuuccaaaca

SEQ ID NO: 1128076 - RNA, 19 nt, Homo sapiens
gaagauggaaucaaaguga

SEQ ID NO: 1128077 - RNA, 19 nt, Homo sapiens
gaacaugaaccauauaaag

SEQ ID NO: 1128078 - RNA, 19 nt, Homo sapiens
cauacuaaaugcucucaua

SEQ ID NO: 1128079 - RNA, 19 nt, Homo sapiens
gaaagacccuagcuaacau

SEQ ID NO: 1128080 - RNA, 19 nt, Homo sapiens
ggaagacucugcuagaaag

SEQ ID NO: 1128081 - RNA, 19 nt, Homo sapiens
caauaaggauguuuaagug

SEQ ID NO: 1128082 - RNA, 19 nt, Homo sapiens
gaucaggucugggugcuaa

SEQ ID NO: 1128083 - RNA, 19 nt, Homo sapiens
uuaaugggcuguugaaaug

SEQ ID NO: 1128084 - RNA, 19 nt, Homo sapiens
acacaaaucugcacauauc

SEQ ID NO: 1128085 - RNA, 19 nt, Homo sapiens
uaacgaauccuccuacuug

SEQ ID NO: 1128086 - RNA, 19 nt, Homo sapiens
ugaacuaacucaggugaua

SEQ ID NO: 1128087 - RNA, 19 nt, Homo sapiens
aaacuaaacugcagggaau

SEQ ID NO: 1128088 - RNA, 19 nt, Homo sapiens
gauauuacaccaaagcuuu

SEQ ID NO: 1128089 - RNA, 19 nt, Homo sapiens
ccaaacaacucacgcuuca

SEQ ID NO: 1128090 - RNA, 19 nt, Homo sapiens
gcaauaaggauguuuaagu

SEQ ID NO: 1128091 - RNA, 19 nt, Homo sapiens
gagaaggccagcagaagua

SEQ ID NO: 1128092 - RNA, 19 nt, Homo sapiens
ugagaucacugaaguugaa

SEQ ID NO: 1128093 - RNA, 19 nt, Homo sapiens
ggacgacucaauaaauuaa

SEQ ID NO: 1128094 - RNA, 19 nt, Homo sapiens
gaaagcaauuugacagagu

SEQ ID NO: 1128095 - RNA, 19 nt, Homo sapiens
gagacaaacuggaggugaa

SEQ ID NO: 1128096 - RNA, 19 nt, Homo sapiens
gaaaauaaguacugugguu

SEQ ID NO: 1128097 - RNA, 19 nt, Homo sapiens
gaugucaacugccuacaga

SEQ ID NO: 1128098 - RNA, 19 nt, Homo sapiens
gacuaaagccugcauacua

SEQ ID NO: 1128099 - RNA, 19 nt, Homo sapiens
gaaaucacaucagucacaa

SEQ ID NO: 1128100 - RNA, 19 nt, Homo sapiens
gaucagaaacuaagcauca

SEQ ID NO: 1128101 - RNA, 19 nt, Homo sapiens
acuaaagccugcauacuaa

SEQ ID NO: 1128102 - RNA, 19 nt, Homo sapiens
uaucugaucuggcauuuca

SEQ ID NO: 1128103 - RNA, 19 nt, Homo sapiens
aaacugaugugcucuuugu

SEQ ID NO: 1128104 - RNA, 19 nt, Homo sapiens
gaauuucagaggcacauua

SEQ ID NO: 1128105 - RNA, 19 nt, Homo sapiens
uguagacacugcuugauaa

SEQ ID NO: 1128106 - RNA, 19 nt, Homo sapiens
gcagaagaauggccuugga

SEQ ID NO: 1128107 - RNA, 19 nt, Homo sapiens
gaugaagucugucccaaag

SEQ ID NO: 1128108 - RNA, 19 nt, Homo sapiens
gaagucaucaccaacacua

SEQ ID NO: 1128109 - RNA, 19 nt, Homo sapiens
gccagaagaucagaaacua

SEQ ID NO: 1128110 - RNA, 19 nt, Homo sapiens
cgacauaucucggaagaag

SEQ ID NO: 1128111 - RNA, 19 nt, Homo sapiens
caaggacucucucuucauc

SEQ ID NO: 1128112 - RNA, 19 nt, Homo sapiens
caauuaacuugaaggacua

SEQ ID NO: 1128113 - RNA, 19 nt, Homo sapiens
ccaguuaaauuacacuaug

SEQ ID NO: 1128114 - RNA, 19 nt, Homo sapiens
ucacaucagucacaagaau

SEQ ID NO: 1128115 - RNA, 19 nt, Homo sapiens
gaagaaggucugggaauug

SEQ ID NO: 1128116 - RNA, 19 nt, Homo sapiens
gagaauaaaccucuuacau

SEQ ID NO: 1128117 - RNA, 19 nt, Homo sapiens
ggucuuagguuguauacag

SEQ ID NO: 1128118 - RNA, 19 nt, Homo sapiens
ccaggacaguggcuuguuu

SEQ ID NO: 1128119 - RNA, 19 nt, Homo sapiens
uuacacaaaucugcacaua

SEQ ID NO: 1128120 - RNA, 19 nt, Homo sapiens
agaugaagcugcacuacaa

SEQ ID NO: 1128121 - RNA, 19 nt, Homo sapiens
gucaaaggauuuaugauuc

SEQ ID NO: 1128122 - RNA, 19 nt, Homo sapiens
gaaggaaggccaaccaaag

SEQ ID NO: 1128123 - RNA, 19 nt, Homo sapiens
gcauuucaaccauccuuua

SEQ ID NO: 1128124 - RNA, 19 nt, Homo sapiens
ccauaugucucuccagaug

SEQ ID NO: 1128125 - RNA, 19 nt, Homo sapiens
agaagaaggucugggaauu

SEQ ID NO: 1128126 - RNA, 19 nt, Homo sapiens
gcagauggcuaugaacaag

SEQ ID NO: 1128127 - RNA, 19 nt, Homo sapiens
gaacuaacucaggugauaa

SEQ ID NO: 1128128 - RNA, 19 nt, Homo sapiens
acacuuguaucgcaaagaa

SEQ ID NO: 1128129 - RNA, 19 nt, Homo sapiens
ggacaaagugcuguucuga

SEQ ID NO: 1128130 - RNA, 19 nt, Homo sapiens
gacggagaauucuaugaaa

SEQ ID NO: 1128131 - RNA, 19 nt, Homo sapiens
guucaagagucaaaggauu

SEQ ID NO: 1128132 - RNA, 19 nt, Homo sapiens
gggaauuucagaugacaua

SEQ ID NO: 1128133 - RNA, 19 nt, Homo sapiens
cuagauggacgacucaaua

SEQ ID NO: 1128134 - RNA, 19 nt, Homo sapiens
guucugagcugugccauuc

SEQ ID NO: 1128135 - RNA, 19 nt, Homo sapiens
agacaguaauggacuugua

SEQ ID NO: 1128136 - RNA, 19 nt, Homo sapiens
gcaauuuucuuccuuguga

SEQ ID NO: 1128137 - RNA, 19 nt, Homo sapiens
gcccgacagugguaaguaa

SEQ ID NO: 1128138 - RNA, 19 nt, Homo sapiens
gagaugauggguccuugua

SEQ ID NO: 1128139 - RNA, 19 nt, Homo sapiens
aauccugucuucagucuuu

SEQ ID NO: 1128140 - RNA, 19 nt, Homo sapiens
gacagaguccuuauuguug

SEQ ID NO: 1128141 - RNA, 19 nt, Homo sapiens
gugaaaagcuccuuggauu

SEQ ID NO: 1128142 - RNA, 19 nt, Homo sapiens
gaaugaagcaggaguggau

SEQ ID NO: 1128143 - RNA, 19 nt, Homo sapiens
gcaaugugcgcuaugaaga

SEQ ID NO: 1128144 - RNA, 19 nt, Homo sapiens
gaauguuccuccagucauc

SEQ ID NO: 1128145 - RNA, 19 nt, Homo sapiens
uauagagcauuccaaguga

SEQ ID NO: 1128146 - RNA, 19 nt, Homo sapiens
gauuguacuuuguauguuc

SEQ ID NO: 1128147 - RNA, 19 nt, Homo sapiens
guaagucugucgcauacau

SEQ ID NO: 1128148 - RNA, 19 nt, Homo sapiens
ggcuuaaaguaauagcuua

SEQ ID NO: 1128149 - RNA, 19 nt, Homo sapiens
guaaggguucaguacauua

SEQ ID NO: 1128150 - RNA, 19 nt, Homo sapiens
gauacaacccauagaaugu

SEQ ID NO: 1128151 - RNA, 19 nt, Homo sapiens
uaagcaaugugcgcuauga

SEQ ID NO: 1128152 - RNA, 19 nt, Homo sapiens
ggaagacaucaaugacuuu

SEQ ID NO: 1128153 - RNA, 19 nt, Homo sapiens
gacgacauaucucggaaga

SEQ ID NO: 1128154 - RNA, 19 nt, Homo sapiens
gaacagaucugaaagaguu

SEQ ID NO: 1128155 - RNA, 19 nt, Homo sapiens
caagggaacuuuaggauua

SEQ ID NO: 1128156 - RNA, 19 nt, Homo sapiens
ucagaaacgugaagaauua

SEQ ID NO: 1128157 - RNA, 19 nt, Homo sapiens
gaagaaauauccguaugua

SEQ ID NO: 1128158 - RNA, 19 nt, Homo sapiens
caaaggagaucacagauau

SEQ ID NO: 1128159 - RNA, 19 nt, Homo sapiens
gcuagacccugaugaguua

SEQ ID NO: 1128160 - RNA, 19 nt, Homo sapiens
gcugugagcucagaacuua

SEQ ID NO: 1128161 - RNA, 19 nt, Homo sapiens
gcugagauguuccuuagua

SEQ ID NO: 1128162 - RNA, 19 nt, Homo sapiens
gaaugaagcucggguaaug

SEQ ID NO: 1128163 - RNA, 19 nt, Homo sapiens
ggaauggauuucagucuuu

SEQ ID NO: 1128164 - RNA, 19 nt, Homo sapiens
ccaaggaaaucuaugauga

SEQ ID NO: 1128165 - RNA, 19 nt, Homo sapiens
gaacgagacuaccuggauu

SEQ ID NO: 1128166 - RNA, 19 nt, Homo sapiens
gaaccgaaguggaagagaa

SEQ ID NO: 1128167 - RNA, 19 nt, Homo sapiens
uuaaagcucuguuggauuu

SEQ ID NO: 1128168 - RNA, 19 nt, Homo sapiens
ccaaagagauaagcuauga

SEQ ID NO: 1128169 - RNA, 19 nt, Homo sapiens
gaaaggaacugagguaaac

SEQ ID NO: 1128170 - RNA, 19 nt, Homo sapiens
caaccucucuuacaacaaa

SEQ ID NO: 1128171 - RNA, 19 nt, Homo sapiens
ugaacuaucugacaaagaa

SEQ ID NO: 1128172 - RNA, 19 nt, Homo sapiens
ccaaugaaauggcaccuuu

SEQ ID NO: 1128173 - RNA, 19 nt, Homo sapiens
gacaggaguuugcuauaaa

SEQ ID NO: 1128174 - RNA, 19 nt, Homo sapiens
cccaagaaguggaugauua

SEQ ID NO: 1128175 - RNA, 19 nt, Homo sapiens
gcagauagcagcugaugaa

SEQ ID NO: 1128176 - RNA, 19 nt, Homo sapiens
aguaugagcuuguucagua

SEQ ID NO: 1128177 - RNA, 19 nt, Homo sapiens
guagagagcaccaaugaaa

SEQ ID NO: 1128178 - RNA, 19 nt, Homo sapiens
ggaagcagcugugcggauu

SEQ ID NO: 1128179 - RNA, 19 nt, Homo sapiens
ugacaggaguuugcuauaa

SEQ ID NO: 1128180 - RNA, 19 nt, Homo sapiens
gaaaccaucacaaugcaua

SEQ ID NO: 1128181 - RNA, 19 nt, Homo sapiens
auagugagcucuuuaauca

SEQ ID NO: 1128182 - RNA, 19 nt, Homo sapiens
gagcugacauugcggaguu

SEQ ID NO: 1128183 - RNA, 19 nt, Homo sapiens
caucagaaauccaguaaca

SEQ ID NO: 1128184 - RNA, 19 nt, Homo sapiens
gagaagaaauauccguaug

SEQ ID NO: 1128185 - RNA, 19 nt, Homo sapiens
gaaauauccguauguagaa

SEQ ID NO: 1128186 - RNA, 19 nt, Homo sapiens
ucacauggauuuagauaca

SEQ ID NO: 1128187 - RNA, 19 nt, Homo sapiens
ggaagagaaucagaaguau

SEQ ID NO: 1128188 - RNA, 19 nt, Homo sapiens
aaacaugaaucugagagua

SEQ ID NO: 1128189 - RNA, 19 nt, Homo sapiens
gggcagcucuccaaacuca

SEQ ID NO: 1128190 - RNA, 19 nt, Homo sapiens
gagauaagcuaugagaaca

SEQ ID NO: 1128191 - RNA, 19 nt, Homo sapiens
aaagaagacuugugaaucu

SEQ ID NO: 1128192 - RNA, 19 nt, Homo sapiens
ggacuacaguuuaccuuag

SEQ ID NO: 1128193 - RNA, 19 nt, Homo sapiens
ucaauaauccugccaaaga

SEQ ID NO: 1128194 - RNA, 19 nt, Homo sapiens
gaucaauaauccugccaaa

SEQ ID NO: 1128195 - RNA, 19 nt, Homo sapiens
gaaagaagacuugugaauc

SEQ ID NO: 1128196 - RNA, 19 nt, Homo sapiens
gauuaaagcucuguuggau

SEQ ID NO: 1128197 - RNA, 19 nt, Homo sapiens
ccaagacuccugugaaauu

SEQ ID NO: 1128198 - RNA, 19 nt, Homo sapiens
uagaagagguggacagugu

SEQ ID NO: 1128199 - RNA, 19 nt, Homo sapiens
ggaugauuaugcuagauuu

SEQ ID NO: 1128200 - RNA, 19 nt, Homo sapiens
gaaggccuuucucugcaua

SEQ ID NO: 1128201 - RNA, 19 nt, Homo sapiens
ugaaggaucuuagucagaa

SEQ ID NO: 1128202 - RNA, 19 nt, Homo sapiens
ggaaagaagacuugugaau

SEQ ID NO: 1128203 - RNA, 19 nt, Homo sapiens
guaauaauccgaugaccaa

SEQ ID NO: 1128204 - RNA, 19 nt, Homo sapiens
gaauggcuuuggugugaaa

SEQ ID NO: 1128205 - RNA, 19 nt, Homo sapiens
ugaaagaacucagaaagca

SEQ ID NO: 1128206 - RNA, 19 nt, Homo sapiens
gauuggcucugaggaauuu

SEQ ID NO: 1128207 - RNA, 19 nt, Homo sapiens
acagauaucccucgucuaa

SEQ ID NO: 1128208 - RNA, 19 nt, Homo sapiens
gaaacgugaagaauuauga

SEQ ID NO: 1128209 - RNA, 19 nt, Homo sapiens
ccgagaagguccucagaaa

SEQ ID NO: 1128210 - RNA, 19 nt, Homo sapiens
uuaaaucccucccucaaga

SEQ ID NO: 1128211 - RNA, 19 nt, Homo sapiens
gggcgaaaguaucauauca

SEQ ID NO: 1128212 - RNA, 19 nt, Homo sapiens
gcuuggauccucagacuua

SEQ ID NO: 1128213 - RNA, 19 nt, Homo sapiens
gaacucagaaagcaucuug

SEQ ID NO: 1128214 - RNA, 19 nt, Homo sapiens
ugaaagcccuguggugauu

SEQ ID NO: 1128215 - RNA, 19 nt, Homo sapiens
aucaagaucugcccaauaa

SEQ ID NO: 1128216 - RNA, 19 nt, Homo sapiens
uaccuuacauggcaaauga

SEQ ID NO: 1128217 - RNA, 19 nt, Homo sapiens
gggacgcucugaagauauu

SEQ ID NO: 1128218 - RNA, 19 nt, Homo sapiens
gggaauggauuucagucuu

SEQ ID NO: 1128219 - RNA, 19 nt, Homo sapiens
caggauauauucagucugu

SEQ ID NO: 1128220 - RNA, 19 nt, Homo sapiens
gaagagaaucagaaguauu

SEQ ID NO: 1128221 - RNA, 19 nt, Homo sapiens
agaaggauguaauucguuu

SEQ ID NO: 1128222 - RNA, 19 nt, Homo sapiens
guuagaagccagugaguuu

SEQ ID NO: 1128223 - RNA, 19 nt, Homo sapiens
aagaauggcuuugguguga

SEQ ID NO: 1128224 - RNA, 19 nt, Homo sapiens
uaccaagacuccugugaaa

SEQ ID NO: 1128225 - RNA, 19 nt, Homo sapiens
gauuuaacagcgaguaaua

SEQ ID NO: 1128226 - RNA, 19 nt, Homo sapiens
uaaugacucugaagauguu

SEQ ID NO: 1128227 - RNA, 19 nt, Homo sapiens
ggauuuagauacacaggau

SEQ ID NO: 1128228 - RNA, 19 nt, Homo sapiens
uaccaaagccagagcaaua

SEQ ID NO: 1128229 - RNA, 19 nt, Homo sapiens
uaacagccuuucaaaucuu

SEQ ID NO: 1128230 - RNA, 19 nt, Homo sapiens
gcgaaaguaucauaucagu

SEQ ID NO: 1128231 - RNA, 19 nt, Homo sapiens
gcaagauaaagaugacaua

SEQ ID NO: 1128232 - RNA, 19 nt, Homo sapiens
gcagugaucagcaauggaa

SEQ ID NO: 1128233 - RNA, 19 nt, Homo sapiens
gagacuaccuggauuuaac

SEQ ID NO: 1128234 - RNA, 19 nt, Homo sapiens
ccaaagagcgguguacuug

SEQ ID NO: 1128235 - RNA, 19 nt, Homo sapiens
ucaauggacuucacaugga

SEQ ID NO: 1128236 - RNA, 19 nt, Homo sapiens
gagauuggcucugaggaau

SEQ ID NO: 1128237 - RNA, 19 nt, Homo sapiens
cuacagauccgcuuucaga

SEQ ID NO: 1128238 - RNA, 19 nt, Homo sapiens
gugaaauucugguucuuga

SEQ ID NO: 1128239 - RNA, 19 nt, Homo sapiens
ggaagugaagcaagauaaa

SEQ ID NO: 1128240 - RNA, 19 nt, Homo sapiens
ccagagauuucuuucacuu

SEQ ID NO: 1128241 - RNA, 19 nt, Homo sapiens
agaaauauccguauguaga

SEQ ID NO: 1128242 - RNA, 19 nt, Homo sapiens
ggagguugauagcagauau

SEQ ID NO: 1128243 - RNA, 19 nt, Homo sapiens
agaagacagucaagagaaa

SEQ ID NO: 1128244 - RNA, 19 nt, Homo sapiens
gaacgaagacuugcugagu

SEQ ID NO: 1128245 - RNA, 19 nt, Homo sapiens
gcagaagacagucaagaga

SEQ ID NO: 1128246 - RNA, 19 nt, Homo sapiens
gaagggacgcucugaagau

SEQ ID NO: 1128247 - RNA, 19 nt, Homo sapiens
gcacagagacuugcuccuu

SEQ ID NO: 1128248 - RNA, 19 nt, Homo sapiens
uaacagcgaguaauaacuu

SEQ ID NO: 1128249 - RNA, 19 nt, Homo sapiens
ggauugauucugcuuauga

SEQ ID NO: 1128250 - RNA, 19 nt, Homo sapiens
cagcugagauguuccuuag

SEQ ID NO: 1128251 - RNA, 19 nt, Homo sapiens
ggauauauucagucuguuu

SEQ ID NO: 1128252 - RNA, 19 nt, Homo sapiens
gauagcagcugaugaaccu

SEQ ID NO: 1128253 - RNA, 19 nt, Homo sapiens
cuacuaucaugcaauauug

SEQ ID NO: 1128254 - RNA, 19 nt, Homo sapiens
caacauagcuaauacagaa

SEQ ID NO: 1128255 - RNA, 19 nt, Homo sapiens
gcaaaaggcucuccuaaua

SEQ ID NO: 1128256 - RNA, 19 nt, Homo sapiens
gaagugauuuguccaauau

SEQ ID NO: 1128257 - RNA, 19 nt, Homo sapiens
cgaaguagcuuuugaauaa

SEQ ID NO: 1128258 - RNA, 19 nt, Homo sapiens
caacaacuaucuuggguuu

SEQ ID NO: 1128259 - RNA, 19 nt, Homo sapiens
gaguuaaccugaauuaugu

SEQ ID NO: 1128260 - RNA, 19 nt, Homo sapiens
gcuaugggcuguguagaua

SEQ ID NO: 1128261 - RNA, 19 nt, Homo sapiens
caacaaggcauacaacuga

SEQ ID NO: 1128262 - RNA, 19 nt, Homo sapiens
caacagaguuaaccugaau

SEQ ID NO: 1128263 - RNA, 19 nt, Homo sapiens
gaucaaacaugcacuuuac

SEQ ID NO: 1128264 - RNA, 19 nt, Homo sapiens
gcagaaacaucaacagaag

SEQ ID NO: 1128265 - RNA, 19 nt, Homo sapiens
gagcucagccugucucuuu

SEQ ID NO: 1128266 - RNA, 19 nt, Homo sapiens
uaaugaagcugcugugugu

SEQ ID NO: 1128267 - RNA, 19 nt, Homo sapiens
gaaaguggacaacaacuau

SEQ ID NO: 1128268 - RNA, 19 nt, Homo sapiens
gccuuuagauguugcuuua

SEQ ID NO: 1128269 - RNA, 19 nt, Homo sapiens
cagcugugaugcauguuua

SEQ ID NO: 1128270 - RNA, 19 nt, Homo sapiens
caaugaaaguggacaacaa

SEQ ID NO: 1128271 - RNA, 19 nt, Homo sapiens
gcccaaagcuuucccaaac

SEQ ID NO: 1128272 - RNA, 19 nt, Homo sapiens
gauauuaugccuuuagaug

SEQ ID NO: 1128273 - RNA, 19 nt, Homo sapiens
cagcucaucuuacacuuga

SEQ ID NO: 1128274 - RNA, 19 nt, Homo sapiens
guagaagacacaccaguaa

SEQ ID NO: 1128275 - RNA, 19 nt, Homo sapiens
uccaauaugugcagcguua

SEQ ID NO: 1128276 - RNA, 19 nt, Homo sapiens
agaagugauuuguccaaua

SEQ ID NO: 1128277 - RNA, 19 nt, Homo sapiens
ugaaucaccuuucuuugug

SEQ ID NO: 1128278 - RNA, 19 nt, Homo sapiens
guguagauauuaugccuuu

SEQ ID NO: 1128279 - RNA, 19 nt, Homo sapiens
caacaaccaacauagcuaa

SEQ ID NO: 1128280 - RNA, 19 nt, Homo sapiens
uaacucaucuguagaagac

SEQ ID NO: 1128281 - RNA, 19 nt, Homo sapiens
gcaacaacaacaaggcaua

SEQ ID NO: 1128282 - RNA, 19 nt, Homo sapiens
caaccaacauagcuaauac

SEQ ID NO: 1128283 - RNA, 19 nt, Homo sapiens
gcaggaggacagcuuaauu

SEQ ID NO: 1128284 - RNA, 19 nt, Homo sapiens
gggaagccauggauccuau

SEQ ID NO: 1128285 - RNA, 19 nt, Homo sapiens
gaaaguggugcaacaacaa

SEQ ID NO: 1128286 - RNA, 19 nt, Homo sapiens
uaccuuaacuacugcauga

SEQ ID NO: 1128287 - RNA, 19 nt, Homo sapiens
ggacuuucuucuucucaga

SEQ ID NO: 1128288 - RNA, 19 nt, Homo sapiens
ccacuacaaucacacaauc

SEQ ID NO: 1128289 - RNA, 19 nt, Homo sapiens
gaaggugucagcugugaug

SEQ ID NO: 1128290 - RNA, 19 nt, Homo sapiens
aauaaugucugccugaauc

SEQ ID NO: 1128291 - RNA, 19 nt, Homo sapiens
gcaacaaccaacauagcua

SEQ ID NO: 1128292 - RNA, 19 nt, Homo sapiens
ucgcagauauaaguguuua

SEQ ID NO: 1128293 - RNA, 19 nt, Homo sapiens
cuacagaauucccaguuuc

SEQ ID NO: 1128294 - RNA, 19 nt, Homo sapiens
uaacaaggguagauuuuga

SEQ ID NO: 1128295 - RNA, 19 nt, Homo sapiens
uuaacaagguugaaugauc

SEQ ID NO: 1128296 - RNA, 19 nt, Homo sapiens
gaacaugcagaaacaucaa

SEQ ID NO: 1128297 - RNA, 19 nt, Homo sapiens
ugaaaguggugcaacaaca

SEQ ID NO: 1128298 - RNA, 19 nt, Homo sapiens
ccugaauuauguugucuuu

SEQ ID NO: 1128299 - RNA, 19 nt, Homo sapiens
aagcugcuguguguauuua

SEQ ID NO: 1128300 - RNA, 19 nt, Homo sapiens
ugaaaucucuaaugaagcu

SEQ ID NO: 1128301 - RNA, 19 nt, Homo sapiens
ggucgcagauauaaguguu

SEQ ID NO: 1128302 - RNA, 19 nt, Homo sapiens
ccaaagcuuucccaaacau

SEQ ID NO: 1128303 - RNA, 19 nt, Homo sapiens
gaagcugcuguguguauuu

SEQ ID NO: 1128304 - RNA, 19 nt, Homo sapiens
ucaaacaugcacuuuacua

SEQ ID NO: 1128305 - RNA, 19 nt, Homo sapiens
aaggacauguuacuucuga

SEQ ID NO: 1128306 - RNA, 19 nt, Homo sapiens
aaagcuuucccaaacauua

SEQ ID NO: 1128307 - RNA, 19 nt, Homo sapiens
gagcgccaguccauggaaa

SEQ ID NO: 1128308 - RNA, 19 nt, Homo sapiens
ucaaggacauguuacuucu

SEQ ID NO: 1128309 - RNA, 19 nt, Homo sapiens
gggaagcuuucucuguaga

SEQ ID NO: 1128310 - RNA, 19 nt, Homo sapiens
agaguuaaccugaauuaug

SEQ ID NO: 1128311 - RNA, 19 nt, Homo sapiens
uaaagcuacuguuggaauc

SEQ ID NO: 1128312 - RNA, 19 nt, Homo sapiens
guaaagcuacuguuggaau

SEQ ID NO: 1128313 - RNA, 19 nt, Homo sapiens
gaaucaccuuucuuugugu

SEQ ID NO: 1128314 - RNA, 19 nt, Homo sapiens
ugaauaaugucugccugaa

SEQ ID NO: 1128315 - RNA, 19 nt, Homo sapiens
cagcagacucuacagaauu

SEQ ID NO: 1128316 - RNA, 19 nt, Homo sapiens
gcagaccgcagccuguuug

SEQ ID NO: 1128317 - RNA, 19 nt, Homo sapiens
gcacuuuacuagcaguucu

SEQ ID NO: 1128318 - RNA, 19 nt, Homo sapiens
cuaauacuccacauucaaa

SEQ ID NO: 1128319 - RNA, 19 nt, Homo sapiens
uguccucugugcuguauuu

SEQ ID NO: 1128320 - RNA, 19 nt, Homo sapiens
cccuagagauuuagaugaa

SEQ ID NO: 1128321 - RNA, 19 nt, Homo sapiens
uagagcagccacagucuuu

SEQ ID NO: 1128322 - RNA, 19 nt, Homo sapiens
uaaccugaauuauguuguc

SEQ ID NO: 1128323 - RNA, 19 nt, Homo sapiens
acagaguuaaccugaauua

SEQ ID NO: 1128324 - RNA, 19 nt, Homo sapiens
ugaaaguggacaacaacua

SEQ ID NO: 1128325 - RNA, 19 nt, Homo sapiens
uaugggcuguguagauauu

SEQ ID NO: 1128326 - RNA, 19 nt, Homo sapiens
gaggcgauccuaaucaugu

SEQ ID NO: 1128327 - RNA, 19 nt, Homo sapiens
agacacaccaguaaagcua

SEQ ID NO: 1128328 - RNA, 19 nt, Homo sapiens
uuagucaucuugccugugu

SEQ ID NO: 1128329 - RNA, 19 nt, Homo sapiens
ucagcagacucuacagaau

SEQ ID NO: 1128330 - RNA, 19 nt, Homo sapiens
cccuuccgcuucucaguua

SEQ ID NO: 1128331 - RNA, 19 nt, Homo sapiens
gagugguguucgacaugua

SEQ ID NO: 1128332 - RNA, 19 nt, Homo sapiens
gaauaaugucugccugaau

SEQ ID NO: 1128333 - RNA, 19 nt, Homo sapiens
ucuacagaauucccaguuu

SEQ ID NO: 1128334 - RNA, 19 nt, Homo sapiens
ucaacagaguuaaccugaa

SEQ ID NO: 1128335 - RNA, 19 nt, Homo sapiens
caacugaccacccaaugca

SEQ ID NO: 1128336 - RNA, 19 nt, Homo sapiens
gcuuggaugguuuaccuua

SEQ ID NO: 1128337 - RNA, 19 nt, Homo sapiens
caagguugaaugauccuaa

SEQ ID NO: 1128338 - RNA, 19 nt, Homo sapiens
gcucagccugucucuuuaa

SEQ ID NO: 1128339 - RNA, 19 nt, Homo sapiens
gugcuguauuugccaauga

SEQ ID NO: 1128340 - RNA, 19 nt, Homo sapiens
guagauauuaugccuuuag

SEQ ID NO: 1128341 - RNA, 19 nt, Homo sapiens
ucaguuaucaggagugaga

SEQ ID NO: 1128342 - RNA, 19 nt, Homo sapiens
acaaauccuguucauguuu

SEQ ID NO: 1128343 - RNA, 19 nt, Homo sapiens
gcugcuguguguauuuaug

SEQ ID NO: 1128344 - RNA, 19 nt, Homo sapiens
caaacaugcacuuuacuag

SEQ ID NO: 1128345 - RNA, 19 nt, Homo sapiens
ugucagcugugaugcaugu

SEQ ID NO: 1128346 - RNA, 19 nt, Homo sapiens
cuuuagauguugcuuuaga

SEQ ID NO: 1128347 - RNA, 19 nt, Homo sapiens
cgaggucgcagauauaagu

SEQ ID NO: 1128348 - RNA, 19 nt, Homo sapiens
uguagaagacacaccagua

SEQ ID NO: 1128349 - RNA, 19 nt, Homo sapiens
ugaagcugcuguguguauu

SEQ ID NO: 1128350 - RNA, 19 nt, Homo sapiens
caggaggacagcuuaauuc

SEQ ID NO: 1128351 - RNA, 19 nt, Homo sapiens
ggaagccauggauccuaua

SEQ ID NO: 1128352 - RNA, 19 nt, Homo sapiens
uagaagacacaccaguaaa

SEQ ID NO: 1128353 - RNA, 19 nt, Homo sapiens
gccugaaucaccuuucuuu

SEQ ID NO: 1128354 - RNA, 19 nt, Homo sapiens
gaagaucgauuugacaaua

SEQ ID NO: 1128355 - RNA, 19 nt, Homo sapiens
gaaguugucuuauggauga

SEQ ID NO: 1128356 - RNA, 19 nt, Homo sapiens
caacugcaaucuauguuua

SEQ ID NO: 1128357 - RNA, 19 nt, Homo sapiens
aaagagagaugcauuugua

SEQ ID NO: 1128358 - RNA, 19 nt, Homo sapiens
gaagagauuugggcuuuaa

SEQ ID NO: 1128359 - RNA, 19 nt, Homo sapiens
gggcauauaagaucuauua

SEQ ID NO: 1128360 - RNA, 19 nt, Homo sapiens
gaacaaugguggccguuug

SEQ ID NO: 1128361 - RNA, 19 nt, Homo sapiens
guacauagaugauuuacca

SEQ ID NO: 1128362 - RNA, 19 nt, Homo sapiens
gaagaggacaaauaguuua

SEQ ID NO: 1128363 - RNA, 19 nt, Homo sapiens
gcauggagauguauuuaga

SEQ ID NO: 1128364 - RNA, 19 nt, Homo sapiens
gaaacuggguuccaaauac

SEQ ID NO: 1128365 - RNA, 19 nt, Homo sapiens
ggaaauagauguguuugca

SEQ ID NO: 1128366 - RNA, 19 nt, Homo sapiens
gggcuuaguuucaaugauu

SEQ ID NO: 1128367 - RNA, 19 nt, Homo sapiens
gaaaucgaauuguugaugu

SEQ ID NO: 1128368 - RNA, 19 nt, Homo sapiens
ggaaggagauggauaaagc

SEQ ID NO: 1128369 - RNA, 19 nt, Homo sapiens
gauaauguguggagcgauu

SEQ ID NO: 1128370 - RNA, 19 nt, Homo sapiens
gaugauugguguagaaaug

SEQ ID NO: 1128371 - RNA, 19 nt, Homo sapiens
uauaucugcugucaucuua

SEQ ID NO: 1128372 - RNA, 19 nt, Homo sapiens
uaauauaucugcugucauc

SEQ ID NO: 1128373 - RNA, 19 nt, Homo sapiens
gagcugcgguuauuguuug

SEQ ID NO: 1128374 - RNA, 19 nt, Homo sapiens
ggaggaaggagauggauaa

SEQ ID NO: 1128375 - RNA, 19 nt, Homo sapiens
gaaagcaaaguguuaaaug

SEQ ID NO: 1128376 - RNA, 19 nt, Homo sapiens
ggaccaacuucccauuuau

SEQ ID NO: 1128377 - RNA, 19 nt, Homo sapiens
gagggaaacuuggaugcua

SEQ ID NO: 1128378 - RNA, 19 nt, Homo sapiens
ggagauggauaaagcagau

SEQ ID NO: 1128379 - RNA, 19 nt, Homo sapiens
uuaguggucuggauauuaa

SEQ ID NO: 1128380 - RNA, 19 nt, Homo sapiens
guacagccauauuugucua

SEQ ID NO: 1128381 - RNA, 19 nt, Homo sapiens
gaauuuaguggucuggaua

SEQ ID NO: 1128382 - RNA, 19 nt, Homo sapiens
ggagauguauuuagaccau

SEQ ID NO: 1128383 - RNA, 19 nt, Homo sapiens
aagaagagauuugggcuuu

SEQ ID NO: 1128384 - RNA, 19 nt, Homo sapiens
ggauauauggcgguauuua

SEQ ID NO: 1128385 - RNA, 19 nt, Homo sapiens
agaaauggaugauauggau

SEQ ID NO: 1128386 - RNA, 19 nt, Homo sapiens
agucagaugugaaauuuga

SEQ ID NO: 1128387 - RNA, 19 nt, Homo sapiens
gagagaugcauuuguauau

SEQ ID NO: 1128388 - RNA, 19 nt, Homo sapiens
gcauuuggauguacagauc

SEQ ID NO: 1128389 - RNA, 19 nt, Homo sapiens
uggaccaacuucccauuua

SEQ ID NO: 1128390 - RNA, 19 nt, Homo sapiens
ggaggaagucuguaugcua

SEQ ID NO: 1128391 - RNA, 19 nt, Homo sapiens
caucuuaauuccauccaaa

SEQ ID NO: 1128392 - RNA, 19 nt, Homo sapiens
guacaauacuuggccgaaa

SEQ ID NO: 1128393 - RNA, 19 nt, Homo sapiens
guuagaaagcaaaguguua

SEQ ID NO: 1128394 - RNA, 19 nt, Homo sapiens
ccagaugucauauucagua

SEQ ID NO: 1128395 - RNA, 19 nt, Homo sapiens
gcacugccuucuucaucaa

SEQ ID NO: 1128396 - RNA, 19 nt, Homo sapiens
aggaagaaauggaugauau

SEQ ID NO: 1128397 - RNA, 19 nt, Homo sapiens
gcucaguacagccauauuu

SEQ ID NO: 1128398 - RNA, 19 nt, Homo sapiens
ccuaggagaugaauaugga

SEQ ID NO: 1128399 - RNA, 19 nt, Homo sapiens
uaacguagguguagauucc

SEQ ID NO: 1128400 - RNA, 19 nt, Homo sapiens
gugaagaggacaaauaguu

SEQ ID NO: 1128401 - RNA, 19 nt, Homo sapiens
gaaauggaugauauggaua

SEQ ID NO: 1128402 - RNA, 19 nt, Homo sapiens
uaauccagaugucauauuc

SEQ ID NO: 1128403 - RNA, 19 nt, Homo sapiens
agacagaaguguacucucu

SEQ ID NO: 1128404 - RNA, 19 nt, Homo sapiens
ucagugaagaggacaaaua

SEQ ID NO: 1128405 - RNA, 19 nt, Homo sapiens
ucauggagcugcgguuauu

SEQ ID NO: 1128406 - RNA, 19 nt, Homo sapiens
ggaaaucgaauuguugaug

SEQ ID NO: 1128407 - RNA, 19 nt, Homo sapiens
ggaauuuaguggucuggau

SEQ ID NO: 1128408 - RNA, 19 nt, Homo sapiens
cugaaugucuaaagugauu

SEQ ID NO: 1128409 - RNA, 19 nt, Homo sapiens
gaagauacaguuugaagac

SEQ ID NO: 1128410 - RNA, 19 nt, Homo sapiens
ugaagaggacaaauaguuu

SEQ ID NO: 1128411 - RNA, 19 nt, Homo sapiens
ggauagagaccuaggagau

SEQ ID NO: 1128412 - RNA, 19 nt, Homo sapiens
gaugugaaauuugaagauc

SEQ ID NO: 1128413 - RNA, 19 nt, Homo sapiens
uauugaaucuggguucuuu

SEQ ID NO: 1128414 - RNA, 19 nt, Homo sapiens
ggugugcacugccuucuuc

SEQ ID NO: 1128415 - RNA, 19 nt, Homo sapiens
ggaagaaauggaugauaug

SEQ ID NO: 1128416 - RNA, 19 nt, Homo sapiens
uaaucuaacuagugaagga

SEQ ID NO: 1128417 - RNA, 19 nt, Homo sapiens
aaagcaaaguguuaaaugg

SEQ ID NO: 1128418 - RNA, 19 nt, Homo sapiens
gauacaguuugaagacaga

SEQ ID NO: 1128419 - RNA, 19 nt, Homo sapiens
gaagauuaccgguggcaau

SEQ ID NO: 1128420 - RNA, 19 nt, Homo sapiens
guaaagaggaagaaaugga

SEQ ID NO: 1128421 - RNA, 19 nt, Homo sapiens
ccaacuucccauuuauuua

SEQ ID NO: 1128422 - RNA, 19 nt, Homo sapiens
auaaauagagggaaacuug

SEQ ID NO: 1128423 - RNA, 19 nt, Homo sapiens
caagugccuuuguccgaaa

SEQ ID NO: 1128424 - RNA, 19 nt, Homo sapiens
ugauauggauagagaccua

SEQ ID NO: 1128425 - RNA, 19 nt, Homo sapiens
uggaugauauggauagaga

SEQ ID NO: 1128426 - RNA, 19 nt, Homo sapiens
acagaucgacuacagagua

SEQ ID NO: 1128427 - RNA, 19 nt, Homo sapiens
ccaaguuagucuuaaaucu

SEQ ID NO: 1128428 - RNA, 19 nt, Homo sapiens
gcugcuacgucuccaguga

SEQ ID NO: 1128429 - RNA, 19 nt, Homo sapiens
ucaagucacccacugauau

SEQ ID NO: 1128430 - RNA, 19 nt, Homo sapiens
cagaugucauauucaguaa

SEQ ID NO: 1128431 - RNA, 19 nt, Homo sapiens
gaaauagauguguuugcaa

SEQ ID NO: 1128432 - RNA, 19 nt, Homo sapiens
uaugaugauugguguagaa

SEQ ID NO: 1128433 - RNA, 19 nt, Homo sapiens
cgucuccagugaaugguua

SEQ ID NO: 1128434 - RNA, 19 nt, Homo sapiens
caagucacccacugauauu

SEQ ID NO: 1128435 - RNA, 19 nt, Homo sapiens
ccaugaaacucugggagaa

SEQ ID NO: 1128436 - RNA, 19 nt, Homo sapiens
ugaaacuggguuccaaaua

SEQ ID NO: 1128437 - RNA, 19 nt, Homo sapiens
agaggaaguugucuuaugg

SEQ ID NO: 1128438 - RNA, 19 nt, Homo sapiens
acaggugcauggagaugua

SEQ ID NO: 1128439 - RNA, 19 nt, Homo sapiens
agaugaauauggauggaaa

SEQ ID NO: 1128440 - RNA, 19 nt, Homo sapiens
ggaaaagucagaugugaaa

SEQ ID NO: 1128441 - RNA, 19 nt, Homo sapiens
uuaacacacuggguacuuu

SEQ ID NO: 1128442 - RNA, 19 nt, Homo sapiens
gaacuuuggaucaauuucu

SEQ ID NO: 1128443 - RNA, 19 nt, Homo sapiens
ucagauauuugcugugucu

SEQ ID NO: 1128444 - RNA, 19 nt, Homo sapiens
ggagaugaauauggaugga

SEQ ID NO: 1128445 - RNA, 19 nt, Homo sapiens
uguaauauaucugcuguca

SEQ ID NO: 1128446 - RNA, 19 nt, Homo sapiens
agaagagauuugggcuuua

SEQ ID NO: 1128447 - RNA, 19 nt, Homo sapiens
guuauccugugcauuguga

SEQ ID NO: 1128448 - RNA, 19 nt, Homo sapiens
ccacuuacugugaaauuga

SEQ ID NO: 1128449 - RNA, 19 nt, Homo sapiens
uaccagauguacauagaug

SEQ ID NO: 1128450 - RNA, 19 nt, Homo sapiens
agagagaugcauuuguaua

SEQ ID NO: 1128451 - RNA, 19 nt, Homo sapiens
gcuauaaacuaugcuacuc

SEQ ID NO: 1128452 - RNA, 19 nt, Homo sapiens
uagauguguuugcaauuug

SEQ ID NO: 1128453 - RNA, 19 nt, Homo sapiens
gguggguaauaaauguaua

SEQ ID NO: 1128454 - RNA, 19 nt, Homo sapiens
gaacacaagugaagacgua

SEQ ID NO: 1128455 - RNA, 19 nt, Homo sapiens
gaaagaaagucgugcugua

SEQ ID NO: 1128456 - RNA, 19 nt, Homo sapiens
gcaguuaccucaacaugaa

SEQ ID NO: 1128457 - RNA, 19 nt, Homo sapiens
acaaagaccuagauuauug

SEQ ID NO: 1128458 - RNA, 19 nt, Homo sapiens
gaugaacaauuugcaguua

SEQ ID NO: 1128459 - RNA, 19 nt, Homo sapiens
guacaaagaccuagauuau

SEQ ID NO: 1128460 - RNA, 19 nt, Homo sapiens
gaaacagugucuccugaaa

SEQ ID NO: 1128461 - RNA, 19 nt, Homo sapiens
aagcaaggaugaacaauuu

SEQ ID NO: 1128462 - RNA, 19 nt, Homo sapiens
aagcagagauggaauuaaa

SEQ ID NO: 1128463 - RNA, 19 nt, Homo sapiens
ccaugaaacugaauacaaa

SEQ ID NO: 1128464 - RNA, 19 nt, Homo sapiens
uaagaaagcuggauugacu

SEQ ID NO: 1128465 - RNA, 19 nt, Homo sapiens
ggacacauguaaagggaaa

SEQ ID NO: 1128466 - RNA, 19 nt, Homo sapiens
ggaagauucugaagacaau

SEQ ID NO: 1128467 - RNA, 19 nt, Homo sapiens
ggacgacaaugaagaggaa

SEQ ID NO: 1128468 - RNA, 19 nt, Homo sapiens
ggaaacauuggcauaauuu

SEQ ID NO: 1128469 - RNA, 19 nt, Homo sapiens
agaaugaccucucaggauu

SEQ ID NO: 1128470 - RNA, 19 nt, Homo sapiens
gaagagucccuuaccauga

SEQ ID NO: 1128471 - RNA, 19 nt, Homo sapiens
gacuuuggcuuacauuuga

SEQ ID NO: 1128472 - RNA, 19 nt, Homo sapiens
gacaauauccacaaauuug

SEQ ID NO: 1128473 - RNA, 19 nt, Homo sapiens
gaaguuggauguacaugag

SEQ ID NO: 1128474 - RNA, 19 nt, Homo sapiens
ggguuuaucuccagugaaa

SEQ ID NO: 1128475 - RNA, 19 nt, Homo sapiens
gaaauaucguggaagaaca

SEQ ID NO: 1128476 - RNA, 19 nt, Homo sapiens
auacauguuugcaguguua

SEQ ID NO: 1128477 - RNA, 19 nt, Homo sapiens
gaagcuuacuccuuggaaa

SEQ ID NO: 1128478 - RNA, 19 nt, Homo sapiens
uuacaucuaucccagagua

SEQ ID NO: 1128479 - RNA, 19 nt, Homo sapiens
caauagaacaguuuacuug

SEQ ID NO: 1128480 - RNA, 19 nt, Homo sapiens
caugaagccuuuaaugaug

SEQ ID NO: 1128481 - RNA, 19 nt, Homo sapiens
caaaucagguuaaagaacu

SEQ ID NO: 1128482 - RNA, 19 nt, Homo sapiens
acagaaaucuugaaacagu

SEQ ID NO: 1128483 - RNA, 19 nt, Homo sapiens
ggaagcagagauggaauua

SEQ ID NO: 1128484 - RNA, 19 nt, Homo sapiens
cauaagacuuugcagaaau

SEQ ID NO: 1128485 - RNA, 19 nt, Homo sapiens
ugacuguuguuccuucaua

SEQ ID NO: 1128486 - RNA, 19 nt, Homo sapiens
ucuuagagauccagaguuu

SEQ ID NO: 1128487 - RNA, 19 nt, Homo sapiens
ggacuuuggcuuacauuug

SEQ ID NO: 1128488 - RNA, 19 nt, Homo sapiens
cguaauaggugucauggau

SEQ ID NO: 1128489 - RNA, 19 nt, Homo sapiens
gaacagaggaaaagaauga

SEQ ID NO: 1128490 - RNA, 19 nt, Homo sapiens
cuaccaagguucuuucaga

SEQ ID NO: 1128491 - RNA, 19 nt, Homo sapiens
uagaacaguuuacuuggaa

SEQ ID NO: 1128492 - RNA, 19 nt, Homo sapiens
caacaugaagccuuuaaug

SEQ ID NO: 1128493 - RNA, 19 nt, Homo sapiens
gaaggaaccguuaguagca

SEQ ID NO: 1128494 - RNA, 19 nt, Homo sapiens
caaaaucucuggaguggaa

SEQ ID NO: 1128495 - RNA, 19 nt, Homo sapiens
ccauaagacuuugcagaaa

SEQ ID NO: 1128496 - RNA, 19 nt, Homo sapiens
gaaaacaccagcuguauau

SEQ ID NO: 1128497 - RNA, 19 nt, Homo sapiens
ugaagacaauauccacaaa

SEQ ID NO: 1128498 - RNA, 19 nt, Homo sapiens
gagagaacuugguggaauc

SEQ ID NO: 1128499 - RNA, 19 nt, Homo sapiens
cuacaagccauaagacuuu

SEQ ID NO: 1128500 - RNA, 19 nt, Homo sapiens
caucagagcauuagaucuu

SEQ ID NO: 1128501 - RNA, 19 nt, Homo sapiens
cgaauucagggcucucuua

SEQ ID NO: 1128502 - RNA, 19 nt, Homo sapiens
caagagaaguuggauguac

SEQ ID NO: 1128503 - RNA, 19 nt, Homo sapiens
ccagcucaguauuuauaua

SEQ ID NO: 1128504 - RNA, 19 nt, Homo sapiens
gcccagcucaguauuuaua

SEQ ID NO: 1128505 - RNA, 19 nt, Homo sapiens
cauauaaugccuugagaaa

SEQ ID NO: 1128506 - RNA, 19 nt, Homo sapiens
uggauagacuucugcguaa

SEQ ID NO: 1128507 - RNA, 19 nt, Homo sapiens
ggaacauucuaccaagguu

SEQ ID NO: 1128508 - RNA, 19 nt, Homo sapiens
ggaauggagcuaucucaga

SEQ ID NO: 1128509 - RNA, 19 nt, Homo sapiens
aaagcuggauugacuguug

SEQ ID NO: 1128510 - RNA, 19 nt, Homo sapiens
uaaggaaacauuggcauaa

SEQ ID NO: 1128511 - RNA, 19 nt, Homo sapiens
ggaaaagaaugaccucuca

SEQ ID NO: 1128512 - RNA, 19 nt, Homo sapiens
gugaagacguacagaaaca

SEQ ID NO: 1128513 - RNA, 19 nt, Homo sapiens
ugugucagcucccaccaua

SEQ ID NO: 1128514 - RNA, 19 nt, Homo sapiens
guagauaauggguuggaua

SEQ ID NO: 1128515 - RNA, 19 nt, Homo sapiens
aaccuuugcuguaguguuu

SEQ ID NO: 1128516 - RNA, 19 nt, Homo sapiens
uaauaggugucauggauag

SEQ ID NO: 1128517 - RNA, 19 nt, Homo sapiens
guaauaggugucauggaua

SEQ ID NO: 1128518 - RNA, 19 nt, Homo sapiens
acauaaaccuagcugaguu

SEQ ID NO: 1128519 - RNA, 19 nt, Homo sapiens
uaaggcagauaagaugaaa

SEQ ID NO: 1128520 - RNA, 19 nt, Homo sapiens
ggaggaggacgacaaugaa

SEQ ID NO: 1128521 - RNA, 19 nt, Homo sapiens
aaggaaauaucguggaaga

SEQ ID NO: 1128522 - RNA, 19 nt, Homo sapiens
aaaggcaguuuguuuggaa

SEQ ID NO: 1128523 - RNA, 19 nt, Homo sapiens
gauaauggguuggauagac

SEQ ID NO: 1128524 - RNA, 19 nt, Homo sapiens
ugagagaacuugguggaau

SEQ ID NO: 1128525 - RNA, 19 nt, Homo sapiens
gcagauaagaugaaagaag

SEQ ID NO: 1128526 - RNA, 19 nt, Homo sapiens
ggauguacaugagaaaucu

SEQ ID NO: 1128527 - RNA, 19 nt, Homo sapiens
aaacaccagcuguauauau

SEQ ID NO: 1128528 - RNA, 19 nt, Homo sapiens
gggcuggacuuagaucaga

SEQ ID NO: 1128529 - RNA, 19 nt, Homo sapiens
caccacauguuccauccua

SEQ ID NO: 1128530 - RNA, 19 nt, Homo sapiens
ccugaaaggaagaguaaua

SEQ ID NO: 1128531 - RNA, 19 nt, Homo sapiens
ggauguuauucaagaaaga

SEQ ID NO: 1128532 - RNA, 19 nt, Homo sapiens
aacaccagcuguauauauu

SEQ ID NO: 1128533 - RNA, 19 nt, Homo sapiens
gaccuagauuauugaauuc

SEQ ID NO: 1128534 - RNA, 19 nt, Homo sapiens
gcaucccucucgacgaauu

SEQ ID NO: 1128535 - RNA, 19 nt, Homo sapiens
gaagacaauauccacaaau

SEQ ID NO: 1128536 - RNA, 19 nt, Homo sapiens
gccauaagacuuugcagaa

SEQ ID NO: 1128537 - RNA, 19 nt, Homo sapiens
ucacgaaagagccaaguuu

SEQ ID NO: 1128538 - RNA, 19 nt, Homo sapiens
ggaguggaauggagcuauc

SEQ ID NO: 1128539 - RNA, 19 nt, Homo sapiens
ucacauguaacuuucguaa

SEQ ID NO: 1128540 - RNA, 19 nt, Homo sapiens
ucaauuaggcaucacgaaa

SEQ ID NO: 1128541 - RNA, 19 nt, Homo sapiens
ucucaggauuguuuagaaa

SEQ ID NO: 1128542 - RNA, 19 nt, Homo sapiens
caacaucagagcauuagau

SEQ ID NO: 1128543 - RNA, 19 nt, Homo sapiens
guuccaccauucaaaggua

SEQ ID NO: 1128544 - RNA, 19 nt, Homo sapiens
aggaaacauuggcauaauu

SEQ ID NO: 1128545 - RNA, 19 nt, Homo sapiens
uggcaucccucucgacgaa

SEQ ID NO: 1128546 - RNA, 19 nt, Homo sapiens
uaccaugacccacagauuu

SEQ ID NO: 1128547 - RNA, 19 nt, Homo sapiens
auacagagaacacaaguga

SEQ ID NO: 1128548 - RNA, 19 nt, Homo sapiens
ggaaauaucguggaagaac

SEQ ID NO: 1128549 - RNA, 19 nt, Homo sapiens
ggagauccuacaagccaua

SEQ ID NO: 1128550 - RNA, 19 nt, Homo sapiens
uagcugaguugccuuuauc

SEQ ID NO: 1128551 - RNA, 19 nt, Homo sapiens
gcgggaagauucugaagac

SEQ ID NO: 1128552 - RNA, 19 nt, Homo sapiens
ggagaaauuggguguguca

SEQ ID NO: 1128553 - RNA, 19 nt, Homo sapiens
guuaaagaacuccgagaaa

SEQ ID NO: 1128554 - RNA, 19 nt, Homo sapiens
caaggaaggugauguguga

SEQ ID NO: 1128555 - RNA, 19 nt, Homo sapiens
gaaaggacugagaguauua

SEQ ID NO: 1128556 - RNA, 19 nt, Homo sapiens
ggaaaggacugagaguauu

SEQ ID NO: 1128557 - RNA, 19 nt, Homo sapiens
ggacugagaguauuauauu

SEQ ID NO: 1128558 - RNA, 19 nt, Homo sapiens
uaagaaagcuggauugacu

SEQ ID NO: 1128559 - RNA, 19 nt, Homo sapiens
gcuguugacuuuaguuauu

SEQ ID NO: 1128560 - RNA, 19 nt, Homo sapiens
ccacauuucuuucuccauu

SEQ ID NO: 1128561 - RNA, 19 nt, Homo sapiens
gaagagucccuuaccauga

SEQ ID NO: 1128562 - RNA, 19 nt, Homo sapiens
ggauguuacucaagaaaga

SEQ ID NO: 1128563 - RNA, 19 nt, Homo sapiens
ccacugcucuucucugguu

SEQ ID NO: 1128564 - RNA, 19 nt, Homo sapiens
ucagagaucuugcauuucu

SEQ ID NO: 1128565 - RNA, 19 nt, Homo sapiens
ggagguagguucuagaaaa

SEQ ID NO: 1128566 - RNA, 19 nt, Homo sapiens
gaacaaggaaggugaugug

SEQ ID NO: 1128567 - RNA, 19 nt, Homo sapiens
gcucuucucugguucaugu

SEQ ID NO: 1128568 - RNA, 19 nt, Homo sapiens
ugacuguuguuccuucaua

SEQ ID NO: 1128569 - RNA, 19 nt, Homo sapiens
agaagaaucuguagcuugu

SEQ ID NO: 1128570 - RNA, 19 nt, Homo sapiens
gugcugagcugacuucuac

SEQ ID NO: 1128571 - RNA, 19 nt, Homo sapiens
gcauagaauucuucauugg

SEQ ID NO: 1128572 - RNA, 19 nt, Homo sapiens
cauauucacugcauuucuu

SEQ ID NO: 1128573 - RNA, 19 nt, Homo sapiens
cuaccaagguucuuucaga

SEQ ID NO: 1128574 - RNA, 19 nt, Homo sapiens
uugcauuucugcucucuua

SEQ ID NO: 1128575 - RNA, 19 nt, Homo sapiens
gaagacaaacagaaauuca

SEQ ID NO: 1128576 - RNA, 19 nt, Homo sapiens
caaaaucucuggaguggaa

SEQ ID NO: 1128577 - RNA, 19 nt, Homo sapiens
cauauaaugccuugagaaa

SEQ ID NO: 1128578 - RNA, 19 nt, Homo sapiens
uggauagacuucugcguaa

SEQ ID NO: 1128579 - RNA, 19 nt, Homo sapiens
ggagaagaaucuguagcuu

SEQ ID NO: 1128580 - RNA, 19 nt, Homo sapiens
ggaacauucuaccaagguu

SEQ ID NO: 1128581 - RNA, 19 nt, Homo sapiens
ggaauggagcuaucucaga

SEQ ID NO: 1128582 - RNA, 19 nt, Homo sapiens
aaagcuggauugacuguug

SEQ ID NO: 1128583 - RNA, 19 nt, Homo sapiens
ccacaaugcgcauguaguu

SEQ ID NO: 1128584 - RNA, 19 nt, Homo sapiens
aaaguuugcuguaccacaa

SEQ ID NO: 1128585 - RNA, 19 nt, Homo sapiens
guaauacauuucugaguac

SEQ ID NO: 1128586 - RNA, 19 nt, Homo sapiens
aaaggcaguuuguuuggaa

SEQ ID NO: 1128587 - RNA, 19 nt, Homo sapiens
acaagaagacaaacagaaa

SEQ ID NO: 1128588 - RNA, 19 nt, Homo sapiens
gcagcacauauacuaaaua

SEQ ID NO: 1128589 - RNA, 19 nt, Homo sapiens
acaaugcgcauguaguuaa

SEQ ID NO: 1128590 - RNA, 19 nt, Homo sapiens
gagaagggguguucauaga

SEQ ID NO: 1128591 - RNA, 19 nt, Homo sapiens
gggcuggacuuagaucaga

SEQ ID NO: 1128592 - RNA, 19 nt, Homo sapiens
ucagaguguuggagaagaa

SEQ ID NO: 1128593 - RNA, 19 nt, Homo sapiens
ucacgaaagagccaaguuu

SEQ ID NO: 1128594 - RNA, 19 nt, Homo sapiens
gcacuguagauuuaacauu

SEQ ID NO: 1128595 - RNA, 19 nt, Homo sapiens
gcgcauguaguuaacaauu

SEQ ID NO: 1128596 - RNA, 19 nt, Homo sapiens
guaccacaaugcgcaugua

SEQ ID NO: 1128597 - RNA, 19 nt, Homo sapiens
ucaauuaggcaucacgaaa

SEQ ID NO: 1128598 - RNA, 19 nt, Homo sapiens
cuaauaguccuuugauaga

SEQ ID NO: 1128599 - RNA, 19 nt, Homo sapiens
ggaguggaauggagcuauc

SEQ ID NO: 1128600 - RNA, 19 nt, Homo sapiens
uaccaugacccacagauuu

SEQ ID NO: 1128601 - RNA, 19 nt, Homo sapiens
guaccauuaucuuaucuag

SEQ ID NO: 1128602 - RNA, 19 nt, Homo sapiens
cgcauguaguuaacaauuu

SEQ ID NO: 1128603 - RNA, 19 nt, Homo sapiens
gccuaauaguccuuugaua

SEQ ID NO: 1128604 - RNA, 19 nt, Homo sapiens
aagaaucuguagcuuguug

SEQ ID NO: 1128605 - RNA, 19 nt, Homo sapiens
cuucagauguggaaaauaa

SEQ ID NO: 1128606 - RNA, 19 nt, Homo sapiens
gauagacuucugcguaaga

SEQ ID NO: 1128607 - RNA, 19 nt, Homo sapiens
ugaguaccauuaucuuauc

SEQ ID NO: 1128608 - RNA, 19 nt, Homo sapiens
cccaugggcuggacuuaga

SEQ ID NO: 1128609 - RNA, 19 nt, Homo sapiens
caagaagacaaacagaaau

SEQ ID NO: 1128610 - RNA, 19 nt, Homo sapiens
ucaaggggcugagugaaua

SEQ ID NO: 1128611 - RNA, 19 nt, Homo sapiens
guccuaggcuucugaugau

SEQ ID NO: 1128612 - RNA, 19 nt, Homo sapiens
gaacaguuggauagacuuc

SEQ ID NO: 1128613 - RNA, 19 nt, Homo sapiens
ugaagaaaguuugcuguac

SEQ ID NO: 1128614 - RNA, 19 nt, Homo sapiens
uaagggagagaucaaguug

SEQ ID NO: 1128615 - RNA, 19 nt, Homo sapiens
aaaaggauguuacucaaga

SEQ ID NO: 1128616 - RNA, 19 nt, Homo sapiens
guuguuccuucauauaaug

SEQ ID NO: 1128617 - RNA, 19 nt, Homo sapiens
ucagaucaauuaggcauca

SEQ ID NO: 1128618 - RNA, 19 nt, Homo sapiens
ccuaauaguccuuugauag

SEQ ID NO: 1128619 - RNA, 19 nt, Homo sapiens
auaaugaggguguaacaaa

SEQ ID NO: 1128620 - RNA, 19 nt, Homo sapiens
gccagaugcagcacauaua

SEQ ID NO: 1128621 - RNA, 19 nt, Homo sapiens
aaagaagagucccuuacca

SEQ ID NO: 1128622 - RNA, 19 nt, Homo sapiens
gaggguguaacaaaccaua

SEQ ID NO: 1128623 - RNA, 19 nt, Homo sapiens
guacaagaagacaaacaga

SEQ ID NO: 1128624 - RNA, 19 nt, Homo sapiens
guaggcauauucacugcau

SEQ ID NO: 1128625 - RNA, 19 nt, Homo sapiens
gaacuggaacauucuacca

SEQ ID NO: 1128626 - RNA, 19 nt, Homo sapiens
caaaccauacaccaguuaa

SEQ ID NO: 1128627 - RNA, 19 nt, Homo sapiens
uaaugaggguguaacaaac

SEQ ID NO: 1128628 - RNA, 19 nt, Homo sapiens
aaaggauguuacucaagaa

SEQ ID NO: 1128629 - RNA, 19 nt, Homo sapiens
gaaagagccaaguuuuauu

SEQ ID NO: 1128630 - RNA, 19 nt, Homo sapiens
aauuaggcaucacgaaaga

SEQ ID NO: 1128631 - RNA, 19 nt, Homo sapiens
ggugaaagggaacaaggaa

SEQ ID NO: 1128632 - RNA, 19 nt, Homo sapiens
uuucugcucucuuauguca

SEQ ID NO: 1128633 - RNA, 19 nt, Homo sapiens
gcauuucugcucucuuaug

SEQ ID NO: 1128634 - RNA, 19 nt, Homo sapiens
cauuucugcucucuuaugu

SEQ ID NO: 1128635 - RNA, 19 nt, Homo sapiens
ccauacaccaguuaaugaa

SEQ ID NO: 1128636 - RNA, 19 nt, Homo sapiens
uaaauaugagacaggguaa

SEQ ID NO: 1128637 - RNA, 19 nt, Homo sapiens
gaugcagcacauauacuaa

SEQ ID NO: 1128638 - RNA, 19 nt, Homo sapiens
ucugaguaccauuaucuua

SEQ ID NO: 1128639 - RNA, 19 nt, Homo sapiens
acaaaccauacaccaguua

SEQ ID NO: 1128640 - RNA, 19 nt, Homo sapiens
agaugcagcacauauacua

SEQ ID NO: 1128641 - RNA, 19 nt, Homo sapiens
gagccaaguuuuauuucaa

SEQ ID NO: 1128642 - RNA, 19 nt, Homo sapiens
ggaaaauaaugagggugua

SEQ ID NO: 1128643 - RNA, 19 nt, Homo sapiens
aagaaacugcuccagcuuu

SEQ ID NO: 1128644 - RNA, 19 nt, Homo sapiens
guggggaucucaaugcuuu

SEQ ID NO: 1128645 - RNA, 19 nt, Homo sapiens
gugaauaccagaggaacuu

SEQ ID NO: 1128646 - RNA, 19 nt, Homo sapiens
ggauagacuucugcguaag

SEQ ID NO: 1128647 - RNA, 19 nt, Homo sapiens
caauuaggcaucacgaaag

SEQ ID NO: 1128648 - RNA, 19 nt, Homo sapiens
gaagggguguucauagaag

SEQ ID NO: 1128649 - RNA, 19 nt, Homo sapiens
agcauagaauucuucauug

SEQ ID NO: 1128650 - RNA, 19 nt, Homo sapiens
acauuucugaguaccauua

SEQ ID NO: 1128651 - RNA, 19 nt, Homo sapiens
gacuguuguuccuucauau

SEQ ID NO: 1128652 - RNA, 19 nt, Homo sapiens
uaggaaaggacugagagua

SEQ ID NO: 1128653 - RNA, 19 nt, Homo sapiens
gaaucuguagcuuguugaa

SEQ ID NO: 1128654 - RNA, 19 nt, Homo sapiens
ggacaccgauccucacuuu

SEQ ID NO: 1128655 - RNA, 19 nt, Homo sapiens
gaggagaaaugcuacuauu

SEQ ID NO: 1128656 - RNA, 19 nt, Homo sapiens
ggacucagauauugcuuuc

SEQ ID NO: 1128657 - RNA, 19 nt, Homo sapiens
acacagaccugcaaacauc

SEQ ID NO: 1128658 - RNA, 19 nt, Homo sapiens
caaagggcaucucugaguu

SEQ ID NO: 1128659 - RNA, 19 nt, Homo sapiens
gauaugaggagaaaugcua

SEQ ID NO: 1128660 - RNA, 19 nt, Homo sapiens
ggagauaugaggagaaaug

SEQ ID NO: 1128661 - RNA, 19 nt, Homo sapiens
gcaaacaucuaugguugug

SEQ ID NO: 1128662 - RNA, 19 nt, Homo sapiens
ggaauacaagguaauggua

SEQ ID NO: 1128663 - RNA, 19 nt, Homo sapiens
gaauacaagguaaugguaa

SEQ ID NO: 1128664 - RNA, 19 nt, Homo sapiens
ccgaagagcugcccagaag

SEQ ID NO: 1128665 - RNA, 19 nt, Homo sapiens
ucucugaguugcagcauuu

SEQ ID NO: 1128666 - RNA, 19 nt, Homo sapiens
ccaacgcauuuacaacuuu

SEQ ID NO: 1128667 - RNA, 19 nt, Homo sapiens
acucagagauucacacaga

SEQ ID NO: 1128668 - RNA, 19 nt, Homo sapiens
ucacaaggaauacaaggua

SEQ ID NO: 1128669 - RNA, 19 nt, Homo sapiens
gaagagcugcccagaagga

SEQ ID NO: 1128670 - RNA, 19 nt, Homo sapiens
caacuuugcccaucgauuc

SEQ ID NO: 1128671 - RNA, 19 nt, Homo sapiens
acagaagacuggacacaau

SEQ ID NO: 1128672 - RNA, 19 nt, Homo sapiens
caacgcauuuacaacuuug

SEQ ID NO: 1128673 - RNA, 19 nt, Homo sapiens
cauuugagcugugcaucua

SEQ ID NO: 1128674 - RNA, 19 nt, Homo sapiens
cacaaggaauacaagguaa

SEQ ID NO: 1128675 - RNA, 19 nt, Homo sapiens
gcuacuauuuacccuuuga

SEQ ID NO: 1128676 - RNA, 19 nt, Homo sapiens
ggaggugaauuucuacacu

SEQ ID NO: 1128677 - RNA, 19 nt, Homo sapiens
caucuaugguugugacaga

SEQ ID NO: 1128678 - RNA, 19 nt, Homo sapiens
gccaacgcauuuacaacuu

SEQ ID NO: 1128679 - RNA, 19 nt, Homo sapiens
cgacugcacuuuggucauc

SEQ ID NO: 1128680 - RNA, 19 nt, Homo sapiens
gagaacaaugucaucacua

SEQ ID NO: 1128681 - RNA, 19 nt, Homo sapiens
ccaaagggcaucucugagu

SEQ ID NO: 1128682 - RNA, 19 nt, Homo sapiens
ggagagaacaaugucauca

SEQ ID NO: 1128683 - RNA, 19 nt, Homo sapiens
gagccuacuaacagaauaa

SEQ ID NO: 1128684 - RNA, 19 nt, Homo sapiens
cauacacacugccuguuuc

SEQ ID NO: 1128685 - RNA, 19 nt, Homo sapiens
ccauacacacugccuguuu

SEQ ID NO: 1128686 - RNA, 19 nt, Homo sapiens
agaacaaugucaucacuac

SEQ ID NO: 1128687 - RNA, 19 nt, Homo sapiens
cagaagacuggacacaauu

SEQ ID NO: 1128688 - RNA, 19 nt, Homo sapiens
ccccuacacuugaucauua

SEQ ID NO: 1128689 - RNA, 19 nt, Homo sapiens
caaggaauacaagguaaug

SEQ ID NO: 1128690 - RNA, 19 nt, Homo sapiens
caucacuacccguaccaua

SEQ ID NO: 1128691 - RNA, 19 nt, Homo sapiens
gaaggagagaacaauguca

SEQ ID NO: 1128692 - RNA, 19 nt, Homo sapiens
acaagguaaugguaaaugg

SEQ ID NO: 1128693 - RNA, 19 nt, Homo sapiens
cuauuuacccuuugaagau

SEQ ID NO: 1128694 - RNA, 19 nt, Homo sapiens
cugcaaucaugaacaguug

SEQ ID NO: 1128695 - RNA, 19 nt, Homo sapiens
ccuguuuccuugccuguug

SEQ ID NO: 1128696 - RNA, 19 nt, Homo sapiens
cagaaggagagaacaaugu

SEQ ID NO: 1128697 - RNA, 19 nt, Homo sapiens
acccacagcuggaggugaa

SEQ ID NO: 1128698 - RNA, 19 nt, Homo sapiens
augcuacuauuuacccuuu

SEQ ID NO: 1128699 - RNA, 19 nt, Homo sapiens
agagaacaaugucaucacu

SEQ ID NO: 1128700 - RNA, 19 nt, Homo sapiens
cuuggaaucuggcaugaag

SEQ ID NO: 1128701 - RNA, 19 nt, Homo sapiens
gugaagaugcugcaagucu

SEQ ID NO: 1128702 - RNA, 19 nt, Homo sapiens
gcaaucaugaacaguugug

SEQ ID NO: 1128703 - RNA, 19 nt, Homo sapiens
cccuacacuugaucauuaa

SEQ ID NO: 1128704 - RNA, 19 nt, Homo sapiens
ccagaaggagagaacaaug

SEQ ID NO: 1128705 - RNA, 19 nt, Homo sapiens
agagccuacuaacagaaua

SEQ ID NO: 1128706 - RNA, 19 nt, Homo sapiens
cccagagccuacuaacaga

SEQ ID NO: 1128707 - RNA, 19 nt, Homo sapiens
uuacaacuuugcccaucga

SEQ ID NO: 1128708 - RNA, 19 nt, Homo sapiens
uauuuacccuuugaagaug

SEQ ID NO: 1128709 - RNA, 19 nt, Homo sapiens
ccaauuccgacugcacuuu

SEQ ID NO: 1128710 - RNA, 19 nt, Homo sapiens
acucagauauugcuuucca

SEQ ID NO: 1128711 - RNA, 19 nt, Homo sapiens
guugugacagaguuucuuu

SEQ ID NO: 1128712 - RNA, 19 nt, Homo sapiens
caauuccgacugcacuuug

SEQ ID NO: 1128713 - RNA, 19 nt, Homo sapiens
ugaguugcagcauuuaaau

SEQ ID NO: 1128714 - RNA, 19 nt, Homo sapiens
uuaaaugaucccacucaga

SEQ ID NO: 1128715 - RNA, 19 nt, Homo sapiens
agacacagaccugcaaaca

SEQ ID NO: 1128716 - RNA, 19 nt, Homo sapiens
gauccucacuuuugucaag

SEQ ID NO: 1128717 - RNA, 19 nt, Homo sapiens
ggccaacgcauuuacaacu

SEQ ID NO: 1128718 - RNA, 19 nt, Homo sapiens
ucacuacccguaccauaca

SEQ ID NO: 1128719 - RNA, 19 nt, Homo sapiens
auggagauaugaggagaaa

SEQ ID NO: 1128720 - RNA, 19 nt, Homo sapiens
acacacugccuguuuccuu

SEQ ID NO: 1128721 - RNA, 19 nt, Homo sapiens
aaagggcaucucugaguug

SEQ ID NO: 1128722 - RNA, 19 nt, Homo sapiens
ugaggagaaaugcuacuau

SEQ ID NO: 1128723 - RNA, 19 nt, Homo sapiens
gacacagaccugcaaacau

SEQ ID NO: 1128724 - RNA, 19 nt, Homo sapiens
agcuggaggugaauuucua

SEQ ID NO: 1128725 - RNA, 19 nt, Homo sapiens
guugguucgugcgugauaa

SEQ ID NO: 1128726 - RNA, 19 nt, Homo sapiens
cagagauucacacagaaga

SEQ ID NO: 1128727 - RNA, 19 nt, Homo sapiens
ucugacaccugagucuuuc

SEQ ID NO: 1128728 - RNA, 19 nt, Homo sapiens
gcccagaaggagagaacaa

SEQ ID NO: 1128729 - RNA, 19 nt, Homo sapiens
ccacucagagauucacaca

SEQ ID NO: 1128730 - RNA, 19 nt, Homo sapiens
ccagagccuacuaacagaa

SEQ ID NO: 1128731 - RNA, 19 nt, Homo sapiens
ucccagagccuacuaacag

SEQ ID NO: 1128732 - RNA, 19 nt, Homo sapiens
agccaaagggcaucucuga

SEQ ID NO: 1128733 - RNA, 19 nt, Homo sapiens
gaccugcaaacaucuaugg

SEQ ID NO: 1128734 - RNA, 19 nt, Homo sapiens
ggacugaacagacugguua

SEQ ID NO: 1128735 - RNA, 19 nt, Homo sapiens
gaaaggcucuucagaaacu

SEQ ID NO: 1128736 - RNA, 19 nt, Homo sapiens
uagaaaggcucuucagaaa

SEQ ID NO: 1128737 - RNA, 19 nt, Homo sapiens
caaaugucaugcaacaaua

SEQ ID NO: 1128738 - RNA, 19 nt, Homo sapiens
caagugaguuugugagauu

SEQ ID NO: 1128739 - RNA, 19 nt, Homo sapiens
ccacaucgaugaaagcaaa

SEQ ID NO: 1128740 - RNA, 19 nt, Homo sapiens
gaagagaagaggauggaua

SEQ ID NO: 1128741 - RNA, 19 nt, Homo sapiens
caaagacuccaaacaauuu

SEQ ID NO: 1128742 - RNA, 19 nt, Homo sapiens
gaccaagaaucacuagaaa

SEQ ID NO: 1128743 - RNA, 19 nt, Homo sapiens
ggacagauguaaugagaac

SEQ ID NO: 1128744 - RNA, 19 nt, Homo sapiens
gcaaaugucaugcaacaau

SEQ ID NO: 1128745 - RNA, 19 nt, Homo sapiens
ggagagagccaagaucauu

SEQ ID NO: 1128746 - RNA, 19 nt, Homo sapiens
ugaacagacugguuacaaa

SEQ ID NO: 1128747 - RNA, 19 nt, Homo sapiens
agaugugucucuaacaaua

SEQ ID NO: 1128748 - RNA, 19 nt, Homo sapiens
aaagaugugucucuaacaa

SEQ ID NO: 1128749 - RNA, 19 nt, Homo sapiens
aaacacagaccaagaauca

SEQ ID NO: 1128750 - RNA, 19 nt, Homo sapiens
ggagaaugauuucacuaca

SEQ ID NO: 1128751 - RNA, 19 nt, Homo sapiens
ucaaagaccaagugaguuu

SEQ ID NO: 1128752 - RNA, 19 nt, Homo sapiens
gcaguaagcauuaggaagu

SEQ ID NO: 1128753 - RNA, 19 nt, Homo sapiens
gauugaugcugauagaaga

SEQ ID NO: 1128754 - RNA, 19 nt, Homo sapiens
ggaaagggaccaggacuga

SEQ ID NO: 1128755 - RNA, 19 nt, Homo sapiens
ggaaaggauugaugcugau

SEQ ID NO: 1128756 - RNA, 19 nt, Homo sapiens
agaagaggauggauaagga

SEQ ID NO: 1128757 - RNA, 19 nt, Homo sapiens
gacacagccucucguaaga

SEQ ID NO: 1128758 - RNA, 19 nt, Homo sapiens
uuacaaagacuccaaacaa

SEQ ID NO: 1128759 - RNA, 19 nt, Homo sapiens
gaacagacugguuacaaag

SEQ ID NO: 1128760 - RNA, 19 nt, Homo sapiens
agaaugauuucacuacaga

SEQ ID NO: 1128761 - RNA, 19 nt, Homo sapiens
gagaaaauaccaugcauaa

SEQ ID NO: 1128762 - RNA, 19 nt, Homo sapiens
uacaaagacuccaaacaau

SEQ ID NO: 1128763 - RNA, 19 nt, Homo sapiens
caagaaagcagaggagaga

SEQ ID NO: 1128764 - RNA, 19 nt, Homo sapiens
gaaaggauugaugcugaua

SEQ ID NO: 1128765 - RNA, 19 nt, Homo sapiens
gcauuuugcugcuaccuua

SEQ ID NO: 1128766 - RNA, 19 nt, Homo sapiens
uaaggacguuauccaagaa

SEQ ID NO: 1128767 - RNA, 19 nt, Homo sapiens
agaagagccuggacagaug

SEQ ID NO: 1128768 - RNA, 19 nt, Homo sapiens
ggagcugaauuccggaaga

SEQ ID NO: 1128769 - RNA, 19 nt, Homo sapiens
gagagagccaagaucauuu

SEQ ID NO: 1128770 - RNA, 19 nt, Homo sapiens
ugaguauugucuauuggua

SEQ ID NO: 1128771 - RNA, 19 nt, Homo sapiens
ggcuggagaugacauuuau

SEQ ID NO: 1128772 - RNA, 19 nt, Homo sapiens
gcugcuaccuuacaagcuu

SEQ ID NO: 1128773 - RNA, 19 nt, Homo sapiens
gaggagagagccaagauca

SEQ ID NO: 1128774 - RNA, 19 nt, Homo sapiens
gagaaugauuucacuacag

SEQ ID NO: 1128775 - RNA, 19 nt, Homo sapiens
cuagaaaggcucuucagaa

SEQ ID NO: 1128776 - RNA, 19 nt, Homo sapiens
acaaagacuccaaacaauu

SEQ ID NO: 1128777 - RNA, 19 nt, Homo sapiens
gaccaggacugaacagacu

SEQ ID NO: 1128778 - RNA, 19 nt, Homo sapiens
gaggauggauaaggacguu

SEQ ID NO: 1128779 - RNA, 19 nt, Homo sapiens
cuaaagaugugucucuaac

SEQ ID NO: 1128780 - RNA, 19 nt, Homo sapiens
uaaaucuucugacuaaugc

SEQ ID NO: 1128781 - RNA, 19 nt, Homo sapiens
gcaacucaguaaaaccuua

SEQ ID NO: 1128782 - RNA, 19 nt, Homo sapiens
aagagaagaggauggauaa

SEQ ID NO: 1128783 - RNA, 19 nt, Homo sapiens
uggcaaaugucaugcaaca

SEQ ID NO: 1128784 - RNA, 19 nt, Homo sapiens
gagcugaauuccggaagau

SEQ ID NO: 1128785 - RNA, 19 nt, Homo sapiens
cacagccucucguaagaaa

SEQ ID NO: 1128786 - RNA, 19 nt, Homo sapiens
ugccauagaucaagaugug

SEQ ID NO: 1128787 - RNA, 19 nt, Homo sapiens
ccaccaagccaucaucaug

SEQ ID NO: 1128788 - RNA, 19 nt, Homo sapiens
cagauguaaugagaacuaa

SEQ ID NO: 1128789 - RNA, 19 nt, Homo sapiens
gaugugucucuaacaauaa

SEQ ID NO: 1128790 - RNA, 19 nt, Homo sapiens
cgacacagccucucguaag

SEQ ID NO: 1128791 - RNA, 19 nt, Homo sapiens
gaaacucuggagacaagaa

SEQ ID NO: 1128792 - RNA, 19 nt, Homo sapiens
ccaagaaucacuagaaagg

SEQ ID NO: 1128793 - RNA, 19 nt, Homo sapiens
gaugcuuggucucaaagga

SEQ ID NO: 1128794 - RNA, 19 nt, Homo sapiens
gccugaguauugucuauug

SEQ ID NO: 1128795 - RNA, 19 nt, Homo sapiens
uuugugagauucuaacaga

SEQ ID NO: 1128796 - RNA, 19 nt, Homo sapiens
gaaaacgcgugcccugaug

SEQ ID NO: 1128797 - RNA, 19 nt, Homo sapiens
gauguaaugagaacuaaag

SEQ ID NO: 1128798 - RNA, 19 nt, Homo sapiens
cuggacagauguaaugaga

SEQ ID NO: 1128799 - RNA, 19 nt, Homo sapiens
uuacaagcuucucuucugu

SEQ ID NO: 1128800 - RNA, 19 nt, Homo sapiens
ugaaacugcggaaauauuc

SEQ ID NO: 1128801 - RNA, 19 nt, Homo sapiens
aauccaaaguacugugaaa

SEQ ID NO: 1128802 - RNA, 19 nt, Homo sapiens
cugauggccuugaagaaga

SEQ ID NO: 1128803 - RNA, 19 nt, Homo sapiens
ugucaggcccuaggacuua

SEQ ID NO: 1128804 - RNA, 19 nt, Homo sapiens
gaaagggaccaggacugaa

SEQ ID NO: 1128805 - RNA, 19 nt, Homo sapiens
uuuccaagccugaguauug

SEQ ID NO: 1128806 - RNA, 19 nt, Homo sapiens
gggaggacagggagagaaa

SEQ ID NO: 1128807 - RNA, 19 nt, Homo sapiens
gaagagccuggacagaugu

SEQ ID NO: 1128808 - RNA, 19 nt, Homo sapiens
ggauugaugcugauagaag

SEQ ID NO: 1128809 - RNA, 19 nt, Homo sapiens
agaccaagaaucacuagaa

SEQ ID NO: 1128810 - RNA, 19 nt, Homo sapiens
uaaauccaaaguacuguga

SEQ ID NO: 1128811 - RNA, 19 nt, Homo sapiens
acagauggcuggagaugac

SEQ ID NO: 1128812 - RNA, 19 nt, Homo sapiens
aaggauugaugcugauaga

SEQ ID NO: 1128813 - RNA, 19 nt, Homo sapiens
gcaaggauuugaaaacucu

SEQ ID NO: 1128814 - RNA, 19 nt, Homo sapiens
cuuacaagcuucucuucug

SEQ ID NO: 1128815 - RNA, 19 nt, Homo sapiens
gagaagaggauggauaagg

SEQ ID NO: 1128816 - RNA, 19 nt, Homo sapiens
ccaagugaguuugugagau

SEQ ID NO: 1128817 - RNA, 19 nt, Homo sapiens
acagauguaaugagaacua

SEQ ID NO: 1128818 - RNA, 19 nt, Homo sapiens
uagaagagccuggacagau

SEQ ID NO: 1128819 - RNA, 19 nt, Homo sapiens
acaagcuucucuucuguca

SEQ ID NO: 1128820 - RNA, 19 nt, Homo sapiens
caacaucuuugaaaacaca

SEQ ID NO: 1128821 - RNA, 19 nt, Homo sapiens
cccuaggacuuaaaucgaa

SEQ ID NO: 1128822 - RNA, 19 nt, Homo sapiens
ugugaugcuuggucucaaa

SEQ ID NO: 1128823 - RNA, 19 nt, Homo sapiens
cauuaggaagugaauauga

SEQ ID NO: 1128824 - RNA, 19 nt, Homo sapiens
ucaagaaaguaagaugucu

SEQ ID NO: 1128825 - RNA, 19 nt, Homo sapiens
aaagggaccgggacuggaa

SEQ ID NO: 1128826 - RNA, 19 nt, Homo sapiens
uucaugcccugugcuguua

SEQ ID NO: 1128827 - RNA, 19 nt, Homo sapiens
ggaaagccugggagcugaa

SEQ ID NO: 1128828 - RNA, 19 nt, Homo sapiens
agacaagcuuuuccaguuu

SEQ ID NO: 1128829 - RNA, 19 nt, Homo sapiens
ugacuaaugcuaaaacgua

SEQ ID NO: 1128830 - RNA, 19 nt, Homo sapiens
gaacuaaagaaaacagaug

SEQ ID NO: 1128831 - RNA, 19 nt, Homo sapiens
uggcuggagaugacauuua

SEQ ID NO: 1128832 - RNA, 19 nt, Homo sapiens
aagacaagcuuuuccaguu

SEQ ID NO: 1128833 - RNA, 19 nt, Homo sapiens
gaaagccgugggcaacauc

SEQ ID NO: 1128834 - RNA, 19 nt, Homo sapiens
gaacauagucuuccaucua

SEQ ID NO: 1128835 - RNA, 19 nt, Homo sapiens
guaacucucuuccuucuuu

SEQ ID NO: 1128836 - RNA, 19 nt, Homo sapiens
ggucagggauguucaauag

SEQ ID NO: 1128837 - RNA, 19 nt, Homo sapiens
caacgcagcuaucgagaga

SEQ ID NO: 1128838 - RNA, 19 nt, Homo sapiens
caauaacccugaacucaug

SEQ ID NO: 1128839 - RNA, 19 nt, Homo sapiens
guucuucugucaauccuua

SEQ ID NO: 1128840 - RNA, 19 nt, Homo sapiens
ggacaggaauuaacaaacg

SEQ ID NO: 1128841 - RNA, 19 nt, Homo sapiens
gcaacaaucccuucucuuc

SEQ ID NO: 1128842 - RNA, 19 nt, Homo sapiens
gaaagaggagggaaugaga

SEQ ID NO: 1128843 - RNA, 19 nt, Homo sapiens
ggugggaacuguuggaaau

SEQ ID NO: 1128844 - RNA, 19 nt, Homo sapiens
ccacuaggguuuugucuua

SEQ ID NO: 1128845 - RNA, 19 nt, Homo sapiens
cgacuuugcugcucagaug

SEQ ID NO: 1128846 - RNA, 19 nt, Homo sapiens
ggaggaagaugccuguucu

SEQ ID NO: 1128847 - RNA, 19 nt, Homo sapiens
gaucugaugcgucacauga

SEQ ID NO: 1128848 - RNA, 19 nt, Homo sapiens
ugaaacaggugguaauuuu

SEQ ID NO: 1128849 - RNA, 19 nt, Homo sapiens
gcucccagcucuccuaauc

SEQ ID NO: 1128850 - RNA, 19 nt, Homo sapiens
ggagacagccugaguaaaa

SEQ ID NO: 1128851 - RNA, 19 nt, Homo sapiens
guaaaaggcuuggaaguug

SEQ ID NO: 1128852 - RNA, 19 nt, Homo sapiens
ucagccacaugcucaauaa

SEQ ID NO: 1128853 - RNA, 19 nt, Homo sapiens
gagccucggucaaggaguu

SEQ ID NO: 1128854 - RNA, 19 nt, Homo sapiens
guucagugcugcccaggaa

SEQ ID NO: 1128855 - RNA, 19 nt, Homo sapiens
ugucacagaucauggagaa

SEQ ID NO: 1128856 - RNA, 19 nt, Homo sapiens
ggaacaguuuggcaacaau

SEQ ID NO: 1128857 - RNA, 19 nt, Homo sapiens
uccaggauaugaugucuaa

SEQ ID NO: 1128858 - RNA, 19 nt, Homo sapiens
guacugaccaccugucguu

SEQ ID NO: 1128859 - RNA, 19 nt, Homo sapiens
gaucucagcacccuacaug

SEQ ID NO: 1128860 - RNA, 19 nt, Homo sapiens
agaggaaauucgugugaaa

SEQ ID NO: 1128861 - RNA, 19 nt, Homo sapiens
gggagcagaagcacucaua

SEQ ID NO: 1128862 - RNA, 19 nt, Homo sapiens
gaggagggaaugagauuau

SEQ ID NO: 1128863 - RNA, 19 nt, Homo sapiens
gagcagcccagaggaaauu

SEQ ID NO: 1128864 - RNA, 19 nt, Homo sapiens
gauguucaauagcccagaa

SEQ ID NO: 1128865 - RNA, 19 nt, Homo sapiens
ucagaaggcucaagaucca

SEQ ID NO: 1128866 - RNA, 19 nt, Homo sapiens
gaagcacucauagcucuuu

SEQ ID NO: 1128867 - RNA, 19 nt, Homo sapiens
ggaaauucgugugaaagag

SEQ ID NO: 1128868 - RNA, 19 nt, Homo sapiens
gaacucaugaggcagacaa

SEQ ID NO: 1128869 - RNA, 19 nt, Homo sapiens
gaaggaggagcaggugaaa

SEQ ID NO: 1128870 - RNA, 19 nt, Homo sapiens
ggacaucaacgcagcuauc

SEQ ID NO: 1128871 - RNA, 19 nt, Homo sapiens
cagcagaugauccagcuuu

SEQ ID NO: 1128872 - RNA, 19 nt, Homo sapiens
gauguccaauccugagaug

SEQ ID NO: 1128873 - RNA, 19 nt, Homo sapiens
gcauucgguucuucuguca

SEQ ID NO: 1128874 - RNA, 19 nt, Homo sapiens
gagcggaacccugagauca

SEQ ID NO: 1128875 - RNA, 19 nt, Homo sapiens
gcucucugguuuacuggaa

SEQ ID NO: 1128876 - RNA, 19 nt, Homo sapiens
aagaguaguaguaguagua

SEQ ID NO: 1128877 - RNA, 19 nt, Homo sapiens
ccuuagcucugucugagaa

SEQ ID NO: 1128878 - RNA, 19 nt, Homo sapiens
caaacagcagggugacuuu

SEQ ID NO: 1128879 - RNA, 19 nt, Homo sapiens
ucugaugcgucacaugauu

SEQ ID NO: 1128880 - RNA, 19 nt, Homo sapiens
cagaggaaauucgugugaa

SEQ ID NO: 1128881 - RNA, 19 nt, Homo sapiens
gcagacgccagaagugaga

SEQ ID NO: 1128882 - RNA, 19 nt, Homo sapiens
ugucugagaauuaugguuu

SEQ ID NO: 1128883 - RNA, 19 nt, Homo sapiens
aaacagcagggugacuuua

SEQ ID NO: 1128884 - RNA, 19 nt, Homo sapiens
cuacugcuauuccauggau

SEQ ID NO: 1128885 - RNA, 19 nt, Homo sapiens
ggugaaacaggugguaauu

SEQ ID NO: 1128886 - RNA, 19 nt, Homo sapiens
gcagugcuacuuaaacagu

SEQ ID NO: 1128887 - RNA, 19 nt, Homo sapiens
gaaccagcacggaaucaag

SEQ ID NO: 1128888 - RNA, 19 nt, Homo sapiens
ccagaggaaauucguguga

SEQ ID NO: 1128889 - RNA, 19 nt, Homo sapiens
caaccaaugcuagaauuuc

SEQ ID NO: 1128890 - RNA, 19 nt, Homo sapiens
ugcagacgcuugcccagaa

SEQ ID NO: 1128891 - RNA, 19 nt, Homo sapiens
ccaaccaaugcuagaauuu

SEQ ID NO: 1128892 - RNA, 19 nt, Homo sapiens
cccaaccaaugcuagaauu

SEQ ID NO: 1128893 - RNA, 19 nt, Homo sapiens
cagcugaugcagaauguga

SEQ ID NO: 1128894 - RNA, 19 nt, Homo sapiens
gaacaguuuggcaacaauc

SEQ ID NO: 1128895 - RNA, 19 nt, Homo sapiens
ugagcaaccuugagagcau

SEQ ID NO: 1128896 - RNA, 19 nt, Homo sapiens
acagcucucuggacaggaa

SEQ ID NO: 1128897 - RNA, 19 nt, Homo sapiens
gugaaacaggugguaauuu

SEQ ID NO: 1128898 - RNA, 19 nt, Homo sapiens
uagcucugucugagaauua

SEQ ID NO: 1128899 - RNA, 19 nt, Homo sapiens
acagcagggugacuuuaga

SEQ ID NO: 1128900 - RNA, 19 nt, Homo sapiens
uccaugggcuucaucaauc

SEQ ID NO: 1128901 - RNA, 19 nt, Homo sapiens
ccaaggacaaggaggaaau

SEQ ID NO: 1128902 - RNA, 19 nt, Homo sapiens
caauagcccagaaaugcaa

SEQ ID NO: 1128903 - RNA, 19 nt, Homo sapiens
aguaguaguaguaguagua

SEQ ID NO: 1128904 - RNA, 19 nt, Homo sapiens
ggucaaggaguucaaagag

SEQ ID NO: 1128905 - RNA, 19 nt, Homo sapiens
ucaauaacccugaacucau

SEQ ID NO: 1128906 - RNA, 19 nt, Homo sapiens
gucuaacccugaucugaug

SEQ ID NO: 1128907 - RNA, 19 nt, Homo sapiens
uuugguaacucucuuccuu

SEQ ID NO: 1128908 - RNA, 19 nt, Homo sapiens
ccaaacagcagggugacuu

SEQ ID NO: 1128909 - RNA, 19 nt, Homo sapiens
ccugggcucugccaacuuc

SEQ ID NO: 1128910 - RNA, 19 nt, Homo sapiens
ugaaggaggagcaggugaa

SEQ ID NO: 1128911 - RNA, 19 nt, Homo sapiens
caagaguaguaguaguagu

SEQ ID NO: 1128912 - RNA, 19 nt, Homo sapiens
ggcuggaaguggaaacuca

SEQ ID NO: 1128913 - RNA, 19 nt, Homo sapiens
gaugcagaaugugaucuca

SEQ ID NO: 1128914 - RNA, 19 nt, Homo sapiens
gcuuggaaguuggaauuag

SEQ ID NO: 1128915 - RNA, 19 nt, Homo sapiens
caaggacaaggaggaaauu

SEQ ID NO: 1128916 - RNA, 19 nt, Homo sapiens
cgccagaagugagauuuca

SEQ ID NO: 1128917 - RNA, 19 nt, Homo sapiens
cugcucagaugauggugaa

SEQ ID NO: 1128918 - RNA, 19 nt, Homo sapiens
gcccugagcaaccuugaga

SEQ ID NO: 1128919 - RNA, 19 nt, Homo sapiens
gcaggugaaacagguggua

SEQ ID NO: 1128920 - RNA, 19 nt, Homo sapiens
ggguuccuguuccuccuuu

SEQ ID NO: 1128921 - RNA, 19 nt, Homo sapiens
gugcagacgccagaaguga

SEQ ID NO: 1128922 - RNA, 19 nt, Homo sapiens
ccagccacaucuucuccaa

SEQ ID NO: 1128923 - RNA, 19 nt, Homo sapiens
gcucagaugauggugaaug

SEQ ID NO: 1128924 - RNA, 19 nt, Homo sapiens
gacaugcugcuacugcuau

SEQ ID NO: 1128925 - RNA, 19 nt, Homo sapiens
uaugaugucuaacccugau

SEQ ID NO: 1128926 - RNA, 19 nt, Homo sapiens
guccauacucucuggcuuu

SEQ ID NO: 1128927 - RNA, 19 nt, Homo sapiens
gcucucuggacaggaauua

SEQ ID NO: 1128928 - RNA, 19 nt, Homo sapiens
guuuaaggcucagcaggau

SEQ ID NO: 1128929 - RNA, 19 nt, Homo sapiens
ccacaccacuuuugcaauc

SEQ ID NO: 1128930 - RNA, 19 nt, Homo sapiens
gcagauccagcagggacua

SEQ ID NO: 1128931 - RNA, 19 nt, Homo sapiens
guucaauagcccagaaaug

SEQ ID NO: 1128932 - RNA, 19 nt, Homo sapiens
gcuacugcguccauacucu

SEQ ID NO: 1128933 - RNA, 19 nt, Homo sapiens
uaguaguaguaguaccaua

SEQ ID NO: 1128934 - RNA, 19 nt, Homo sapiens
cuuauuaacuggugacuaa

SEQ ID NO: 1128935 - RNA, 19 nt, Homo sapiens
ggagauauauaaucagaag

SEQ ID NO: 1128936 - RNA, 19 nt, Homo sapiens
gcagcucaguggcuucaua

SEQ ID NO: 1128937 - RNA, 19 nt, Homo sapiens
caacauacauggcguuugc

SEQ ID NO: 1128938 - RNA, 19 nt, Homo sapiens
gcuccaagguccucgcuaa

SEQ ID NO: 1128939 - RNA, 19 nt, Homo sapiens
gggagcagcuuccuuugga

SEQ ID NO: 1128940 - RNA, 19 nt, Homo sapiens
ugacggugguauccaguua

SEQ ID NO: 1128941 - RNA, 19 nt, Homo sapiens
ccaagguccucgcuaagaa

SEQ ID NO: 1128942 - RNA, 19 nt, Homo sapiens
gcagcugucuaugauguaa

SEQ ID NO: 1128943 - RNA, 19 nt, Homo sapiens
gguauccaguuaacucaaa

SEQ ID NO: 1128944 - RNA, 19 nt, Homo sapiens
gauaggaguaacugagaua

SEQ ID NO: 1128945 - RNA, 19 nt, Homo sapiens
caggagauauauaaucaga

SEQ ID NO: 1128946 - RNA, 19 nt, Homo sapiens
gagccaagaguaaagaauu

SEQ ID NO: 1128947 - RNA, 19 nt, Homo sapiens
caucacaguuggagucaga

SEQ ID NO: 1128948 - RNA, 19 nt, Homo sapiens
ggaguucgcagacugauag

SEQ ID NO: 1128949 - RNA, 19 nt, Homo sapiens
aggaguaacugagauagaa

SEQ ID NO: 1128950 - RNA, 19 nt, Homo sapiens
ugaguggucuggucaucaa

SEQ ID NO: 1128951 - RNA, 19 nt, Homo sapiens
uccaggagauauauaauca

SEQ ID NO: 1128952 - RNA, 19 nt, Homo sapiens
gaacuucagaggaaacaag

SEQ ID NO: 1128953 - RNA, 19 nt, Homo sapiens
gcugcuuucucuccuuaaa

SEQ ID NO: 1128954 - RNA, 19 nt, Homo sapiens
ggaaggagcacgcagucau

SEQ ID NO: 1128955 - RNA, 19 nt, Homo sapiens
gaauucagaaggccuguca

SEQ ID NO: 1128956 - RNA, 19 nt, Homo sapiens
gguacuuucuggagauugu

SEQ ID NO: 1128957 - RNA, 19 nt, Homo sapiens
uggcugcuuucucuccuua

SEQ ID NO: 1128958 - RNA, 19 nt, Homo sapiens
ggaguaacugagauagaaa

SEQ ID NO: 1128959 - RNA, 19 nt, Homo sapiens
cgagaucgacuuccucugu

SEQ ID NO: 1128960 - RNA, 19 nt, Homo sapiens
ccaguuaacucaaaaccaa

SEQ ID NO: 1128961 - RNA, 19 nt, Homo sapiens
gaaggagcacgcagucauc

SEQ ID NO: 1128962 - RNA, 19 nt, Homo sapiens
ugaggcgccugucggacua

SEQ ID NO: 1128963 - RNA, 19 nt, Homo sapiens
ucgcagcugucuaugaugu

SEQ ID NO: 1128964 - RNA, 19 nt, Homo sapiens
gcagcuuccuuuggaguuc

SEQ ID NO: 1128965 - RNA, 19 nt, Homo sapiens
auacauggcguuugcauca

SEQ ID NO: 1128966 - RNA, 19 nt, Homo sapiens
caagaguaaagaauucaga

SEQ ID NO: 1128967 - RNA, 19 nt, Homo sapiens
acacacagagugcaggaaa

SEQ ID NO: 1128968 - RNA, 19 nt, Homo sapiens
uaauggcugugacugaaca

SEQ ID NO: 1128969 - RNA, 19 nt, Homo sapiens
cguggacccuccugaacuu

SEQ ID NO: 1128970 - RNA, 19 nt, Homo sapiens
agucgcagcugucuaugau

SEQ ID NO: 1128971 - RNA, 19 nt, Homo sapiens
gagaccaagcaccgcguua

SEQ ID NO: 1128972 - RNA, 19 nt, Homo sapiens
cagcucaguggcuucauaa

SEQ ID NO: 1128973 - RNA, 19 nt, Homo sapiens
gaaguacgaggcggacaug

SEQ ID NO: 1128974 - RNA, 19 nt, Homo sapiens
gaauaauuaauggcuguga

SEQ ID NO: 1128975 - RNA, 19 nt, Homo sapiens
acaugugguuucuccugua

SEQ ID NO: 1128976 - RNA, 19 nt, Homo sapiens
ggagcacgcagucaucauc

SEQ ID NO: 1128977 - RNA, 19 nt, Homo sapiens
ggagccaacuggucaugcu

SEQ ID NO: 1128978 - RNA, 19 nt, Homo sapiens
ucuaugauguaacccugaa

SEQ ID NO: 1128979 - RNA, 19 nt, Homo sapiens
gcuggucggcuuugucuuc

SEQ ID NO: 1128980 - RNA, 19 nt, Homo sapiens
ugugggagcagcuuccuuu

SEQ ID NO: 1128981 - RNA, 19 nt, Homo sapiens
ggcuuccuguccucaagua

SEQ ID NO: 1128982 - RNA, 19 nt, Homo sapiens
gggcaggugucuggcuugu

SEQ ID NO: 1128983 - RNA, 19 nt, Homo sapiens
ucaacugccgccucgcaua

SEQ ID NO: 1128984 - RNA, 19 nt, Homo sapiens
auuaauggcugugacugaa

SEQ ID NO: 1128985 - RNA, 19 nt, Homo sapiens
gcucaguggcuucauaaac

SEQ ID NO: 1128986 - RNA, 19 nt, Homo sapiens
caaccacaacuucgagauc

SEQ ID NO: 1128987 - RNA, 19 nt, Homo sapiens
cucaguggcuucauaaacu

SEQ ID NO: 1128988 - RNA, 19 nt, Homo sapiens
caacugccgccucgcauac

SEQ ID NO: 1128989 - RNA, 19 nt, Homo sapiens
guggguggaccauguguga

SEQ ID NO: 1128990 - RNA, 19 nt, Homo sapiens
agccaagaguaaagaauuc

SEQ ID NO: 1128991 - RNA, 19 nt, Homo sapiens
ugauaggaguaacugagau

SEQ ID NO: 1128992 - RNA, 19 nt, Homo sapiens
gggauccucuacgggaaga

SEQ ID NO: 1128993 - RNA, 19 nt, Homo sapiens
cuuucucuccuuaaacuua

SEQ ID NO: 1128994 - RNA, 19 nt, Homo sapiens
ggugguauccaguuaacuc

SEQ ID NO: 1128995 - RNA, 19 nt, Homo sapiens
ggugaguggucuggucauc

SEQ ID NO: 1128996 - RNA, 19 nt, Homo sapiens
gcaccugcuggucggcuuu

SEQ ID NO: 1128997 - RNA, 19 nt, Homo sapiens
gacggugguauccaguuaa

SEQ ID NO: 1128998 - RNA, 19 nt, Homo sapiens
caguuggagucagauguga

SEQ ID NO: 1128999 - RNA, 19 nt, Homo sapiens
ugauguaacccugaacuuc

SEQ ID NO: 1129000 - RNA, 19 nt, Homo sapiens
ggcuggacgugguacuuuc

SEQ ID NO: 1129001 - RNA, 19 nt, Homo sapiens
uaaucagaagggcauguuu

SEQ ID NO: 1129002 - RNA, 19 nt, Homo sapiens
ccgaguacaugugguuucu

SEQ ID NO: 1129003 - RNA, 19 nt, Homo sapiens
cgugguacuuucuggagau

SEQ ID NO: 1129004 - RNA, 19 nt, Homo sapiens
aaucagaagggcauguuuc

SEQ ID NO: 1129005 - RNA, 19 nt, Homo sapiens
gugguacuuucuggagauu

SEQ ID NO: 1129006 - RNA, 19 nt, Homo sapiens
guggucuggucaucaacuu

SEQ ID NO: 1129007 - RNA, 19 nt, Homo sapiens
agaaagagcuggccuaugu

SEQ ID NO: 1129008 - RNA, 19 nt, Homo sapiens
ggaguucgauggaugauug

SEQ ID NO: 1129009 - RNA, 19 nt, Homo sapiens
gugaggagcuugagaaaug

SEQ ID NO: 1129010 - RNA, 19 nt, Homo sapiens
ggaggaagauguuuuguaa

SEQ ID NO: 1129011 - RNA, 19 nt, Homo sapiens
uaggugagaugacuaaauu

SEQ ID NO: 1129012 - RNA, 19 nt, Homo sapiens
guauaugacuguacacuca

SEQ ID NO: 1129013 - RNA, 19 nt, Homo sapiens
uaaauuaugccuccaagaa

SEQ ID NO: 1129014 - RNA, 19 nt, Homo sapiens
gaucauagaaaggguauuu

SEQ ID NO: 1129015 - RNA, 19 nt, Homo sapiens
gcacacgguucacggagaa

SEQ ID NO: 1129016 - RNA, 19 nt, Homo sapiens
gacuguggguaguuauuua

SEQ ID NO: 1129017 - RNA, 19 nt, Homo sapiens
caucucagcuucugguuuc

SEQ ID NO: 1129018 - RNA, 19 nt, Homo sapiens
gcaagcagaaacugaauga

SEQ ID NO: 1129019 - RNA, 19 nt, Homo sapiens
aaauguaguuucagcugua

SEQ ID NO: 1129020 - RNA, 19 nt, Homo sapiens
ccaagguccuggccaagaa

SEQ ID NO: 1129021 - RNA, 19 nt, Homo sapiens
gcgccuaccucaaguaugg

SEQ ID NO: 1129022 - RNA, 19 nt, Homo sapiens
agacaucccugaagacgau

SEQ ID NO: 1129023 - RNA, 19 nt, Homo sapiens
caugcagauuuguauguua

SEQ ID NO: 1129024 - RNA, 19 nt, Homo sapiens
ugccagagauaaagugaaa

SEQ ID NO: 1129025 - RNA, 19 nt, Homo sapiens
uggaagacaucccugaaga

SEQ ID NO: 1129026 - RNA, 19 nt, Homo sapiens
ccucaagcaucaccuguug

SEQ ID NO: 1129027 - RNA, 19 nt, Homo sapiens
ugagaugacuaaauuaugc

SEQ ID NO: 1129028 - RNA, 19 nt, Homo sapiens
ccucagggcuaaucaucaa

SEQ ID NO: 1129029 - RNA, 19 nt, Homo sapiens
ucacggagaagaagcauga

SEQ ID NO: 1129030 - RNA, 19 nt, Homo sapiens
caaccacaaguuugaaauu

SEQ ID NO: 1129031 - RNA, 19 nt, Homo sapiens
ccaauuaucggcuggaugu

SEQ ID NO: 1129032 - RNA, 19 nt, Homo sapiens
ggucuucugcuacgucuuu

SEQ ID NO: 1129033 - RNA, 19 nt, Homo sapiens
ggugagaugacuaaauuau

SEQ ID NO: 1129034 - RNA, 19 nt, Homo sapiens
gcagaaacugaaugacuga

SEQ ID NO: 1129035 - RNA, 19 nt, Homo sapiens
ccauucagcucuucacucu

SEQ ID NO: 1129036 - RNA, 19 nt, Homo sapiens
cgaacgcuuugggcuguua

SEQ ID NO: 1129037 - RNA, 19 nt, Homo sapiens
gagccuguccgaacgcuuu

SEQ ID NO: 1129038 - RNA, 19 nt, Homo sapiens
aagaucaacugcagacugu

SEQ ID NO: 1129039 - RNA, 19 nt, Homo sapiens
gcagauuuguauguuagga

SEQ ID NO: 1129040 - RNA, 19 nt, Homo sapiens
caucaccuguugccacgaa

SEQ ID NO: 1129041 - RNA, 19 nt, Homo sapiens
guggguaguuauuuauuuc

SEQ ID NO: 1129042 - RNA, 19 nt, Homo sapiens
aaagaaauaccaugcagau

SEQ ID NO: 1129043 - RNA, 19 nt, Homo sapiens
ucaccgagauggucuucug

SEQ ID NO: 1129044 - RNA, 19 nt, Homo sapiens
caagaaagagcuggccuau

SEQ ID NO: 1129045 - RNA, 19 nt, Homo sapiens
aaccacaaguuugaaauug

SEQ ID NO: 1129046 - RNA, 19 nt, Homo sapiens
caacaccauucagcucuuc

SEQ ID NO: 1129047 - RNA, 19 nt, Homo sapiens
aaauuaugccuccaagaaa

SEQ ID NO: 1129048 - RNA, 19 nt, Homo sapiens
ccaugcagauuuguauguu

SEQ ID NO: 1129049 - RNA, 19 nt, Homo sapiens
gagaagaagcaugagauca

SEQ ID NO: 1129050 - RNA, 19 nt, Homo sapiens
gcuggccuaugucccaauu

SEQ ID NO: 1129051 - RNA, 19 nt, Homo sapiens
cugcauauccuccuuagug

SEQ ID NO: 1129052 - RNA, 19 nt, Homo sapiens
ggagaagaagcaugagauc

SEQ ID NO: 1129053 - RNA, 19 nt, Homo sapiens
ccacaaguuugaaauugac

SEQ ID NO: 1129054 - RNA, 19 nt, Homo sapiens
gcgagugugugugagaaug

SEQ ID NO: 1129055 - RNA, 19 nt, Homo sapiens
uggccuaugucccaauuau

SEQ ID NO: 1129056 - RNA, 19 nt, Homo sapiens
cuccuccucuggcccauua

SEQ ID NO: 1129057 - RNA, 19 nt, Homo sapiens
gagcuugagaaauguaguu

SEQ ID NO: 1129058 - RNA, 19 nt, Homo sapiens
gaauggcuguguggugagu

SEQ ID NO: 1129059 - RNA, 19 nt, Homo sapiens
gcacggaaugcaccaucuu

SEQ ID NO: 1129060 - RNA, 19 nt, Homo sapiens
caagccagcuggugaugcu

SEQ ID NO: 1129061 - RNA, 19 nt, Homo sapiens
cagggagucuggucucaag

SEQ ID NO: 1129062 - RNA, 19 nt, Homo sapiens
ccucaaguaugggaaggaa

SEQ ID NO: 1129063 - RNA, 19 nt, Homo sapiens
ccgagauggucuucuguuc

SEQ ID NO: 1129064 - RNA, 19 nt, Homo sapiens
accacaaguuugaaauuga

SEQ ID NO: 1129065 - RNA, 19 nt, Homo sapiens
acugcagacuguccuauug

SEQ ID NO: 1129066 - RNA, 19 nt, Homo sapiens
gacagcaagcagaaacuga

SEQ ID NO: 1129067 - RNA, 19 nt, Homo sapiens
ugauuggugugacggaaau

SEQ ID NO: 1129068 - RNA, 19 nt, Homo sapiens
ugacuguggguaguuauuu

SEQ ID NO: 1129069 - RNA, 19 nt, Homo sapiens
gaacugguggccucugcau

SEQ ID NO: 1129070 - RNA, 19 nt, Homo sapiens
gcuaaucaucaacaccauu

SEQ ID NO: 1129071 - RNA, 19 nt, Homo sapiens
gugagaugacuaaauuaug

SEQ ID NO: 1129072 - RNA, 19 nt, Homo sapiens
ggaggaucccacuggaaga

SEQ ID NO: 1129073 - RNA, 19 nt, Homo sapiens
guccuaaacggaaagaaau

SEQ ID NO: 1129074 - RNA, 19 nt, Homo sapiens
gacuguacacucaauuuca

SEQ ID NO: 1129075 - RNA, 19 nt, Homo sapiens
gaggagcuugagaaaugua

SEQ ID NO: 1129076 - RNA, 19 nt, Homo sapiens
ggaaaaugccaucgugguu

SEQ ID NO: 1129077 - RNA, 19 nt, Homo sapiens
ucaacaccauucagcucuu

SEQ ID NO: 1129078 - RNA, 19 nt, Homo sapiens
uuuauugccucagggcuaa

SEQ ID NO: 1129079 - RNA, 19 nt, Homo sapiens
ccugaguccuggaucuuuc

SEQ ID NO: 1129080 - RNA, 19 nt, Homo sapiens
guucucaaccacaaguuug

SEQ ID NO: 1129081 - RNA, 19 nt, Homo sapiens
caaaggcugccaggaagga

SEQ ID NO: 1129082 - RNA, 19 nt, Homo sapiens
ggguaguuauuuauuucug

SEQ ID NO: 1129083 - RNA, 19 nt, Homo sapiens
gugcgagugugugugagaa

SEQ ID NO: 1129084 - RNA, 19 nt, Homo sapiens
gggacuaccccgagaagua

SEQ ID NO: 1129085 - RNA, 19 nt, Homo sapiens
gaaagagcuggccuauguc

SEQ ID NO: 1129086 - RNA, 19 nt, Homo sapiens
uguggugagugugaacuuu

SEQ ID NO: 1129087 - RNA, 19 nt, Homo sapiens
ccuggacccucgugaacug

SEQ ID NO: 1129088 - RNA, 19 nt, Homo sapiens
ugacuguacacucaauuuc

SEQ ID NO: 1129089 - RNA, 19 nt, Homo sapiens
uaguuucagcuguauauga

SEQ ID NO: 1129090 - RNA, 19 nt, Homo sapiens
cuaaucaucaacaccauuc

SEQ ID NO: 1129091 - RNA, 19 nt, Homo sapiens
acagcaagcagaaacugaa

SEQ ID NO: 1129092 - RNA, 19 nt, Homo sapiens
ggaucccacuggaagacau

SEQ ID NO: 1129093 - RNA, 19 nt, Homo sapiens
ugaggagcuugagaaaugu

SEQ ID NO: 1129094 - RNA, 19 nt, Homo sapiens
ugccaaaggcugccaggaa

SEQ ID NO: 1129095 - RNA, 19 nt, Homo sapiens
agaagaagcaugagaucag

SEQ ID NO: 1129096 - RNA, 19 nt, Homo sapiens
ggcuggaugugguacuuca

SEQ ID NO: 1129097 - RNA, 19 nt, Homo sapiens
caagguccuggccaagaaa

SEQ ID NO: 1129098 - RNA, 19 nt, Homo sapiens
cuucauccucgucuucuuu

SEQ ID NO: 1129099 - RNA, 19 nt, Homo sapiens
ggaagacaucccugaagac

SEQ ID NO: 1129100 - RNA, 19 nt, Homo sapiens
cucagcuucugguuucuaa

SEQ ID NO: 1129101 - RNA, 19 nt, Homo sapiens
agacuguccuauugcaucu

SEQ ID NO: 1129102 - RNA, 19 nt, Homo sapiens
ggugcugaguuuucuguaa

SEQ ID NO: 1129103 - RNA, 19 nt, Homo sapiens
cuuugacuguggguaguua

SEQ ID NO: 1129104 - RNA, 19 nt, Homo sapiens
augcagauuuguauguuag

SEQ ID NO: 1129105 - RNA, 19 nt, Homo sapiens
accaagggcuucgccauca

SEQ ID NO: 1129106 - RNA, 19 nt, Homo sapiens
agacgguugccaccaguuu

SEQ ID NO: 1129107 - RNA, 19 nt, Homo sapiens
gcacagagcccaaugcaua

SEQ ID NO: 1129108 - RNA, 19 nt, Homo sapiens
gagaagacuuuaaagguua

SEQ ID NO: 1129109 - RNA, 19 nt, Homo sapiens
gaggaaagauggaugagaa

SEQ ID NO: 1129110 - RNA, 19 nt, Homo sapiens
gaacaugcuugccaacuca

SEQ ID NO: 1129111 - RNA, 19 nt, Homo sapiens
gcaagguggugaacgauga

SEQ ID NO: 1129112 - RNA, 19 nt, Homo sapiens
gaauagaugugguccuuag

SEQ ID NO: 1129113 - RNA, 19 nt, Homo sapiens
uagcagaugugguuucaaa

SEQ ID NO: 1129114 - RNA, 19 nt, Homo sapiens
cagaugugguuucaaagua

SEQ ID NO: 1129115 - RNA, 19 nt, Homo sapiens
gaggagacuucaaccugua

SEQ ID NO: 1129116 - RNA, 19 nt, Homo sapiens
ccacaaagcagaaagcuau

SEQ ID NO: 1129117 - RNA, 19 nt, Homo sapiens
caccagaccuucaugaaug

SEQ ID NO: 1129118 - RNA, 19 nt, Homo sapiens
uagaauagcgacaggaaua

SEQ ID NO: 1129119 - RNA, 19 nt, Homo sapiens
agagaagacuuuaaagguu

SEQ ID NO: 1129120 - RNA, 19 nt, Homo sapiens
ucagaucgaugaccauguu

SEQ ID NO: 1129121 - RNA, 19 nt, Homo sapiens
uaucgcagcugcuaagaug

SEQ ID NO: 1129122 - RNA, 19 nt, Homo sapiens
ccagagcacuuuagcagau

SEQ ID NO: 1129123 - RNA, 19 nt, Homo sapiens
gagagaagacuuuaaaggu

SEQ ID NO: 1129124 - RNA, 19 nt, Homo sapiens
ccacgaggcugacgucuac

SEQ ID NO: 1129125 - RNA, 19 nt, Homo sapiens
gaucacaggcccagaagga

SEQ ID NO: 1129126 - RNA, 19 nt, Homo sapiens
gaugugguuucaaaguaaa

SEQ ID NO: 1129127 - RNA, 19 nt, Homo sapiens
ugagggaccuucacgaauc

SEQ ID NO: 1129128 - RNA, 19 nt, Homo sapiens
ugacaggcuuacacuacua

SEQ ID NO: 1129129 - RNA, 19 nt, Homo sapiens
gaggcaagguggugaacga

SEQ ID NO: 1129130 - RNA, 19 nt, Homo sapiens
gaacaucguggcaucagau

SEQ ID NO: 1129131 - RNA, 19 nt, Homo sapiens
cccaaggucugcugugauu

SEQ ID NO: 1129132 - RNA, 19 nt, Homo sapiens
uaacaggcacuuugagaug

SEQ ID NO: 1129133 - RNA, 19 nt, Homo sapiens
agagagagaagacuuuaaa

SEQ ID NO: 1129134 - RNA, 19 nt, Homo sapiens
guacaugcuucgagacagu

SEQ ID NO: 1129135 - RNA, 19 nt, Homo sapiens
agaugugguuucaaaguaa

SEQ ID NO: 1129136 - RNA, 19 nt, Homo sapiens
cuaaggaggcacuggauuu

SEQ ID NO: 1129137 - RNA, 19 nt, Homo sapiens
gaagccacucaucguguua

SEQ ID NO: 1129138 - RNA, 19 nt, Homo sapiens
uaacggugcuugugucacu

SEQ ID NO: 1129139 - RNA, 19 nt, Homo sapiens
ccaggaagcccacacuaug

SEQ ID NO: 1129140 - RNA, 19 nt, Homo sapiens
gagaacggcgucuucaugu

SEQ ID NO: 1129141 - RNA, 19 nt, Homo sapiens
uaucucggcuggugacguu

SEQ ID NO: 1129142 - RNA, 19 nt, Homo sapiens
ccagagagagaagacuuua

SEQ ID NO: 1129143 - RNA, 19 nt, Homo sapiens
gcagaugugguuucaaagu

SEQ ID NO: 1129144 - RNA, 19 nt, Homo sapiens
caaccuguaugagaacaug

SEQ ID NO: 1129145 - RNA, 19 nt, Homo sapiens
ugaagccacucaucguguu

SEQ ID NO: 1129146 - RNA, 19 nt, Homo sapiens
agaagggugucaacucguu

SEQ ID NO: 1129147 - RNA, 19 nt, Homo sapiens
acacacgcauggcuuccua

SEQ ID NO: 1129148 - RNA, 19 nt, Homo sapiens
ggaauagaugugguccuua

SEQ ID NO: 1129149 - RNA, 19 nt, Homo sapiens
gcgcaguaguuugguuuga

SEQ ID NO: 1129150 - RNA, 19 nt, Homo sapiens
gaggagugguuggaggaaa

SEQ ID NO: 1129151 - RNA, 19 nt, Homo sapiens
cuaagcuucugaaccugua

SEQ ID NO: 1129152 - RNA, 19 nt, Homo sapiens
ucaacucguuccagauguu

SEQ ID NO: 1129153 - RNA, 19 nt, Homo sapiens
caaucuaccuggucaacgu

SEQ ID NO: 1129154 - RNA, 19 nt, Homo sapiens
gaugccagcccuucaggaa

SEQ ID NO: 1129155 - RNA, 19 nt, Homo sapiens
caucgagaauggcaucauc

SEQ ID NO: 1129156 - RNA, 19 nt, Homo sapiens
caaugacacucugaacauc

SEQ ID NO: 1129157 - RNA, 19 nt, Homo sapiens
ccaaugacacucugaacau

SEQ ID NO: 1129158 - RNA, 19 nt, Homo sapiens
ggaggcaccaccaugauca

SEQ ID NO: 1129159 - RNA, 19 nt, Homo sapiens
gaauagcgacaggaauaga

SEQ ID NO: 1129160 - RNA, 19 nt, Homo sapiens
gcaguaguuugguuugacu

SEQ ID NO: 1129161 - RNA, 19 nt, Homo sapiens
gaucccacauggagugagu

SEQ ID NO: 1129162 - RNA, 19 nt, Homo sapiens
agaaagcuaugggcaagga

SEQ ID NO: 1129163 - RNA, 19 nt, Homo sapiens
acaaggaccuguacaugcu

SEQ ID NO: 1129164 - RNA, 19 nt, Homo sapiens
cccuaugucugcaaaguga

SEQ ID NO: 1129165 - RNA, 19 nt, Homo sapiens
caucagaucaccggccuuu

SEQ ID NO: 1129166 - RNA, 19 nt, Homo sapiens
ugagccugcuggccaauga

SEQ ID NO: 1129167 - RNA, 19 nt, Homo sapiens
caaggugaaagcagaaaug

SEQ ID NO: 1129168 - RNA, 19 nt, Homo sapiens
ugagaacggcgucuucaug

SEQ ID NO: 1129169 - RNA, 19 nt, Homo sapiens
ggagagaggagugguugga

SEQ ID NO: 1129170 - RNA, 19 nt, Homo sapiens
ucagaucaccggccuuuca

SEQ ID NO: 1129171 - RNA, 19 nt, Homo sapiens
acgcauggcuuccuauaac

SEQ ID NO: 1129172 - RNA, 19 nt, Homo sapiens
aagcagaaauggagacacu

SEQ ID NO: 1129173 - RNA, 19 nt, Homo sapiens
cagcgcuccuccuguguga

SEQ ID NO: 1129174 - RNA, 19 nt, Homo sapiens
guuugugcauccugugaaa

SEQ ID NO: 1129175 - RNA, 19 nt, Homo sapiens
guggugacauuucccaagu

SEQ ID NO: 1129176 - RNA, 19 nt, Homo sapiens
ggucgaguggcauuuggua

SEQ ID NO: 1129177 - RNA, 19 nt, Homo sapiens
caugagggaccuucacgaa

SEQ ID NO: 1129178 - RNA, 19 nt, Homo sapiens
ccaccagaccuucaugaau

SEQ ID NO: 1129179 - RNA, 19 nt, Homo sapiens
cauagaauagcgacaggaa

SEQ ID NO: 1129180 - RNA, 19 nt, Homo sapiens
ggcauuugguaaaggcauu

SEQ ID NO: 1129181 - RNA, 19 nt, Homo sapiens
uguggacgcuuaugagaag

SEQ ID NO: 1129182 - RNA, 19 nt, Homo sapiens
uaaggaggcacuggauuug

SEQ ID NO: 1129183 - RNA, 19 nt, Homo sapiens
ggaggaaagauggaugaga

SEQ ID NO: 1129184 - RNA, 19 nt, Homo sapiens
guaguuugguuugacuugu

SEQ ID NO: 1129185 - RNA, 19 nt, Homo sapiens
gcaggucgaguggcauuug

SEQ ID NO: 1129186 - RNA, 19 nt, Homo sapiens
gcuaaggaggcacuggauu

SEQ ID NO: 1129187 - RNA, 19 nt, Homo sapiens
gaaagcagaaauggagaca

SEQ ID NO: 1129188 - RNA, 19 nt, Homo sapiens
cgaguggcauuugguaaag

SEQ ID NO: 1129189 - RNA, 19 nt, Homo sapiens
gcugacaggcuuacacuac

SEQ ID NO: 1129190 - RNA, 19 nt, Homo sapiens
cagaaggaaucgagaucag

SEQ ID NO: 1129191 - RNA, 19 nt, Homo sapiens
uaguuugguuugacuuguu

SEQ ID NO: 1129192 - RNA, 19 nt, Homo sapiens
gacuucaaccuguaugaga

SEQ ID NO: 1129193 - RNA, 19 nt, Homo sapiens
uaggagacgcugcacuuga

SEQ ID NO: 1129194 - RNA, 19 nt, Homo sapiens
cgaugaccauguuccaaag

SEQ ID NO: 1129195 - RNA, 19 nt, Homo sapiens
ucgaugaccauguuccaaa

SEQ ID NO: 1129196 - RNA, 19 nt, Homo sapiens
gagacuucaaccuguauga

SEQ ID NO: 1129197 - RNA, 19 nt, Homo sapiens
ugaacaucguggcaucaga

SEQ ID NO: 1129198 - RNA, 19 nt, Homo sapiens
acaccaacaccucaaccua

SEQ ID NO: 1129199 - RNA, 19 nt, Homo sapiens
gcauggcuuccuauaacuu

SEQ ID NO: 1129200 - RNA, 19 nt, Homo sapiens
acgcugcacuugacaccaa

SEQ ID NO: 1129201 - RNA, 19 nt, Homo sapiens
cagagagagaagacuuuaa

SEQ ID NO: 1129202 - RNA, 19 nt, Homo sapiens
agaacaugcuugccaacuc

SEQ ID NO: 1129203 - RNA, 19 nt, Homo sapiens
acacgcauggcuuccuaua

SEQ ID NO: 1129204 - RNA, 19 nt, Homo sapiens
ucgaguggcauuugguaaa

SEQ ID NO: 1129205 - RNA, 19 nt, Homo sapiens
gagagagaagacuuuaaag

SEQ ID NO: 1129206 - RNA, 19 nt, Homo sapiens
ggacccagaagccacaaag

SEQ ID NO: 1129207 - RNA, 19 nt, Homo sapiens
gaaaauaccuggcagcuuu

SEQ ID NO: 1129208 - RNA, 19 nt, Homo sapiens
gaaagaaaguuaguggauu

SEQ ID NO: 1129209 - RNA, 19 nt, Homo sapiens
gcgcaguucuuucgaauaa

SEQ ID NO: 1129210 - RNA, 19 nt, Homo sapiens
gacauuaucugcaacaaau

SEQ ID NO: 1129211 - RNA, 19 nt, Homo sapiens
cuaggaagauguucuguaa

SEQ ID NO: 1129212 - RNA, 19 nt, Homo sapiens
caacaaaugccaagacaaa

SEQ ID NO: 1129213 - RNA, 19 nt, Homo sapiens
cuacagcgaucccacauuu

SEQ ID NO: 1129214 - RNA, 19 nt, Homo sapiens
ccacuaggcugaugaagga

SEQ ID NO: 1129215 - RNA, 19 nt, Homo sapiens
gcauaagguuugugacauu

SEQ ID NO: 1129216 - RNA, 19 nt, Homo sapiens
caaaguccauugaggugua

SEQ ID NO: 1129217 - RNA, 19 nt, Homo sapiens
gaaaguuaguggauugcaa

SEQ ID NO: 1129218 - RNA, 19 nt, Homo sapiens
aaagaaaguuaguggauug

SEQ ID NO: 1129219 - RNA, 19 nt, Homo sapiens
gcaguucuuucgaauaaau

SEQ ID NO: 1129220 - RNA, 19 nt, Homo sapiens
guaccugccugaagaguug

SEQ ID NO: 1129221 - RNA, 19 nt, Homo sapiens
cauaagguuugugacauua

SEQ ID NO: 1129222 - RNA, 19 nt, Homo sapiens
guuaguggauugcaaaguu

SEQ ID NO: 1129223 - RNA, 19 nt, Homo sapiens
cauagaggauaaagcagua

SEQ ID NO: 1129224 - RNA, 19 nt, Homo sapiens
ggucaacgcugcucuucug

SEQ ID NO: 1129225 - RNA, 19 nt, Homo sapiens
caaaugaugugcgagaugu

SEQ ID NO: 1129226 - RNA, 19 nt, Homo sapiens
caagaaacauagcauaagg

SEQ ID NO: 1129227 - RNA, 19 nt, Homo sapiens
gcagaaggauguugcuuuu

SEQ ID NO: 1129228 - RNA, 19 nt, Homo sapiens
cugacacgcugcaggauua

SEQ ID NO: 1129229 - RNA, 19 nt, Homo sapiens
gaugaaggauuugggcuau

SEQ ID NO: 1129230 - RNA, 19 nt, Homo sapiens
uaccaaggcugucauuuua

SEQ ID NO: 1129231 - RNA, 19 nt, Homo sapiens
aggaagauguucuguaaga

SEQ ID NO: 1129232 - RNA, 19 nt, Homo sapiens
gagauucaucgguucaaua

SEQ ID NO: 1129233 - RNA, 19 nt, Homo sapiens
caaaugccaagacaaauga

SEQ ID NO: 1129234 - RNA, 19 nt, Homo sapiens
gugcagcgguuaugcuuau

SEQ ID NO: 1129235 - RNA, 19 nt, Homo sapiens
gggcaggugaggagcauua

SEQ ID NO: 1129236 - RNA, 19 nt, Homo sapiens
gagccgcugucgagugauu

SEQ ID NO: 1129237 - RNA, 19 nt, Homo sapiens
gccagaaauuuaagaguuc

SEQ ID NO: 1129238 - RNA, 19 nt, Homo sapiens
guacagcgccuacaacaac

SEQ ID NO: 1129239 - RNA, 19 nt, Homo sapiens
ugccagaaauuuaagaguu

SEQ ID NO: 1129240 - RNA, 19 nt, Homo sapiens
ccaaggcugucauuuuaua

SEQ ID NO: 1129241 - RNA, 19 nt, Homo sapiens
gaggcaauggugacuauuu

SEQ ID NO: 1129242 - RNA, 19 nt, Homo sapiens
uugagaagcuuccaguaga

SEQ ID NO: 1129243 - RNA, 19 nt, Homo sapiens
ggcaaaggcuacaaguaca

SEQ ID NO: 1129244 - RNA, 19 nt, Homo sapiens
gaagagugggcaauccuau

SEQ ID NO: 1129245 - RNA, 19 nt, Homo sapiens
uaagggagggccagaaaga

SEQ ID NO: 1129246 - RNA, 19 nt, Homo sapiens
gcaaaggcuacaaguacaa

SEQ ID NO: 1129247 - RNA, 19 nt, Homo sapiens
uagaggcaauggugacuau

SEQ ID NO: 1129248 - RNA, 19 nt, Homo sapiens
gcaagaaacauagcauaag

SEQ ID NO: 1129249 - RNA, 19 nt, Homo sapiens
cacucuggcucacaucaua

SEQ ID NO: 1129250 - RNA, 19 nt, Homo sapiens
ggucuuacgagccaauaaa

SEQ ID NO: 1129251 - RNA, 19 nt, Homo sapiens
aggaguaccugccugaaga

SEQ ID NO: 1129252 - RNA, 19 nt, Homo sapiens
gaucccacauuuuauauga

SEQ ID NO: 1129253 - RNA, 19 nt, Homo sapiens
gauuuaauacugcauagug

SEQ ID NO: 1129254 - RNA, 19 nt, Homo sapiens
auucaguucuguaggauuu

SEQ ID NO: 1129255 - RNA, 19 nt, Homo sapiens
gaauucaguucuguaggau

SEQ ID NO: 1129256 - RNA, 19 nt, Homo sapiens
cagcaagaaacauagcaua

SEQ ID NO: 1129257 - RNA, 19 nt, Homo sapiens
gaacagaccaacauuuugu

SEQ ID NO: 1129258 - RNA, 19 nt, Homo sapiens
cacggaggcuugucagguu

SEQ ID NO: 1129259 - RNA, 19 nt, Homo sapiens
caguagacacccuggcuua

SEQ ID NO: 1129260 - RNA, 19 nt, Homo sapiens
agguuaagcucuaggaaga

SEQ ID NO: 1129261 - RNA, 19 nt, Homo sapiens
aaucucagcaggacacuuu

SEQ ID NO: 1129262 - RNA, 19 nt, Homo sapiens
gcagcuuugugcaaugaau

SEQ ID NO: 1129263 - RNA, 19 nt, Homo sapiens
cuaggcugaugaaggauuu

SEQ ID NO: 1129264 - RNA, 19 nt, Homo sapiens
guuaagcucuaggaagaug

SEQ ID NO: 1129265 - RNA, 19 nt, Homo sapiens
guucauagaggauaaagca

SEQ ID NO: 1129266 - RNA, 19 nt, Homo sapiens
ggguagauuucuucaagca

SEQ ID NO: 1129267 - RNA, 19 nt, Homo sapiens
uguauauucuggguaguuu

SEQ ID NO: 1129268 - RNA, 19 nt, Homo sapiens
ccagaacgccucccucuac

SEQ ID NO: 1129269 - RNA, 19 nt, Homo sapiens
agauucaucgguucaauaa

SEQ ID NO: 1129270 - RNA, 19 nt, Homo sapiens
uaagguuugugacauuauc

SEQ ID NO: 1129271 - RNA, 19 nt, Homo sapiens
cagcgguuaugcuuaugaa

SEQ ID NO: 1129272 - RNA, 19 nt, Homo sapiens
gugaggagcauuacaacug

SEQ ID NO: 1129273 - RNA, 19 nt, Homo sapiens
aaaguuaguggauugcaaa

SEQ ID NO: 1129274 - RNA, 19 nt, Homo sapiens
ccauguucauagaggauaa

SEQ ID NO: 1129275 - RNA, 19 nt, Homo sapiens
cugagccgcugucgaguga

SEQ ID NO: 1129276 - RNA, 19 nt, Homo sapiens
acaaaugccaagacaaaug

SEQ ID NO: 1129277 - RNA, 19 nt, Homo sapiens
gcaauggugacuauuuuaa

SEQ ID NO: 1129278 - RNA, 19 nt, Homo sapiens
gacaaaugaugugcgagau

SEQ ID NO: 1129279 - RNA, 19 nt, Homo sapiens
uuaguggauugcaaaguug

SEQ ID NO: 1129280 - RNA, 19 nt, Homo sapiens
gcaacagcaagaaacauag

SEQ ID NO: 1129281 - RNA, 19 nt, Homo sapiens
agaaacauagcauaagguu

SEQ ID NO: 1129282 - RNA, 19 nt, Homo sapiens
agaaagaaaguuaguggau

SEQ ID NO: 1129283 - RNA, 19 nt, Homo sapiens
ugaaggauuugggcuaugg

SEQ ID NO: 1129284 - RNA, 19 nt, Homo sapiens
gucgagugauuguucuuga

SEQ ID NO: 1129285 - RNA, 19 nt, Homo sapiens
ugacauuaucugcaacaaa

SEQ ID NO: 1129286 - RNA, 19 nt, Homo sapiens
uuagaacagaccaacauuu

SEQ ID NO: 1129287 - RNA, 19 nt, Homo sapiens
cauagcauaagguuuguga

SEQ ID NO: 1129288 - RNA, 19 nt, Homo sapiens
gcaacaaaugccaagacaa

SEQ ID NO: 1129289 - RNA, 19 nt, Homo sapiens
guaagaagagugggcaauc

SEQ ID NO: 1129290 - RNA, 19 nt, Homo sapiens
uggcagcuuugugcaauga

SEQ ID NO: 1129291 - RNA, 19 nt, Homo sapiens
gcagcgguuaugcuuauga

SEQ ID NO: 1129292 - RNA, 19 nt, Homo sapiens
uggcggugcuggcuagguu

SEQ ID NO: 1129293 - RNA, 19 nt, Homo sapiens
cacccuggcuuaccucagu

SEQ ID NO: 1129294 - RNA, 19 nt, Homo sapiens
ugagaagcuuccaguagag

SEQ ID NO: 1129295 - RNA, 19 nt, Homo sapiens
ggagauccgacagaugcua

SEQ ID NO: 1129296 - RNA, 19 nt, Homo sapiens
uggcaaaggcuacaaguac

SEQ ID NO: 1129297 - RNA, 19 nt, Homo sapiens
caggugaggagcauuacaa

SEQ ID NO: 1129298 - RNA, 19 nt, Homo sapiens
cagagaaugacgugaagga

SEQ ID NO: 1129299 - RNA, 19 nt, Homo sapiens
uagaacagaccaacauuuu

SEQ ID NO: 1129300 - RNA, 19 nt, Homo sapiens
gaaauccccucgcuuaucc

SEQ ID NO: 1129301 - RNA, 19 nt, Homo sapiens
uagcauaagguuugugaca

SEQ ID NO: 1129302 - RNA, 19 nt, Homo sapiens
agcaacagcaagaaacaua

SEQ ID NO: 1129303 - RNA, 19 nt, Homo sapiens
gaugugcgagaugucauaa

SEQ ID NO: 1129304 - RNA, 19 nt, Homo sapiens
agcaagaaacauagcauaa

SEQ ID NO: 1129305 - RNA, 19 nt, Homo sapiens
ccgaggagauccgacagau

SEQ ID NO: 1129306 - RNA, 19 nt, Homo sapiens
guuagaacagaccaacauu

SEQ ID NO: 1129307 - RNA, 19 nt, Homo sapiens
gaaaauaccuggcagcuuu

SEQ ID NO: 1129308 - RNA, 19 nt, Homo sapiens
gaaagaaaguuaguggauu

SEQ ID NO: 1129309 - RNA, 19 nt, Homo sapiens
gcgcaguucuuucgaauaa

SEQ ID NO: 1129310 - RNA, 19 nt, Homo sapiens
gacauuaucugcaacaaau

SEQ ID NO: 1129311 - RNA, 19 nt, Homo sapiens
cuaggaagauguucuguaa

SEQ ID NO: 1129312 - RNA, 19 nt, Homo sapiens
caacaaaugccaagacaaa

SEQ ID NO: 1129313 - RNA, 19 nt, Homo sapiens
cuacagcgaucccacauuu

SEQ ID NO: 1129314 - RNA, 19 nt, Homo sapiens
ccacuaggcugaugaagga

SEQ ID NO: 1129315 - RNA, 19 nt, Homo sapiens
gcauaagguuugugacauu

SEQ ID NO: 1129316 - RNA, 19 nt, Homo sapiens
caaaguccauugaggugua

SEQ ID NO: 1129317 - RNA, 19 nt, Homo sapiens
gaaaguuaguggauugcaa

SEQ ID NO: 1129318 - RNA, 19 nt, Homo sapiens
aaagaaaguuaguggauug

SEQ ID NO: 1129319 - RNA, 19 nt, Homo sapiens
gcaguucuuucgaauaaau

SEQ ID NO: 1129320 - RNA, 19 nt, Homo sapiens
guaccugccugaagaguug

SEQ ID NO: 1129321 - RNA, 19 nt, Homo sapiens
cauaagguuugugacauua

SEQ ID NO: 1129322 - RNA, 19 nt, Homo sapiens
guuaguggauugcaaaguu

SEQ ID NO: 1129323 - RNA, 19 nt, Homo sapiens
cauagaggauaaagcagua

SEQ ID NO: 1129324 - RNA, 19 nt, Homo sapiens
ggucaacgcugcucuucug

SEQ ID NO: 1129325 - RNA, 19 nt, Homo sapiens
caaaugaugugcgagaugu

SEQ ID NO: 1129326 - RNA, 19 nt, Homo sapiens
caagaaacauagcauaagg

SEQ ID NO: 1129327 - RNA, 19 nt, Homo sapiens
gcagaaggauguugcuuuu

SEQ ID NO: 1129328 - RNA, 19 nt, Homo sapiens
cugacacgcugcaggauua

SEQ ID NO: 1129329 - RNA, 19 nt, Homo sapiens
gaugaaggauuugggcuau

SEQ ID NO: 1129330 - RNA, 19 nt, Homo sapiens
uaccaaggcugucauuuua

SEQ ID NO: 1129331 - RNA, 19 nt, Homo sapiens
aggaagauguucuguaaga

SEQ ID NO: 1129332 - RNA, 19 nt, Homo sapiens
gagauucaucgguucaaua

SEQ ID NO: 1129333 - RNA, 19 nt, Homo sapiens
caaaugccaagacaaauga

SEQ ID NO: 1129334 - RNA, 19 nt, Homo sapiens
gugcagcgguuaugcuuau

SEQ ID NO: 1129335 - RNA, 19 nt, Homo sapiens
gggcaggugaggagcauua

SEQ ID NO: 1129336 - RNA, 19 nt, Homo sapiens
gagccgcugucgagugauu

SEQ ID NO: 1129337 - RNA, 19 nt, Homo sapiens
gccagaaauuuaagaguuc

SEQ ID NO: 1129338 - RNA, 19 nt, Homo sapiens
guacagcgccuacaacaac

SEQ ID NO: 1129339 - RNA, 19 nt, Homo sapiens
ugccagaaauuuaagaguu

SEQ ID NO: 1129340 - RNA, 19 nt, Homo sapiens
ccaaggcugucauuuuaua

SEQ ID NO: 1129341 - RNA, 19 nt, Homo sapiens
gaggcaauggugacuauuu

SEQ ID NO: 1129342 - RNA, 19 nt, Homo sapiens
uugagaagcuuccaguaga

SEQ ID NO: 1129343 - RNA, 19 nt, Homo sapiens
ggcaaaggcuacaaguaca

SEQ ID NO: 1129344 - RNA, 19 nt, Homo sapiens
gaagagugggcaauccuau

SEQ ID NO: 1129345 - RNA, 19 nt, Homo sapiens
uaagggagggccagaaaga

SEQ ID NO: 1129346 - RNA, 19 nt, Homo sapiens
gcaaaggcuacaaguacaa

SEQ ID NO: 1129347 - RNA, 19 nt, Homo sapiens
uagaggcaauggugacuau

SEQ ID NO: 1129348 - RNA, 19 nt, Homo sapiens
gcaagaaacauagcauaag

SEQ ID NO: 1129349 - RNA, 19 nt, Homo sapiens
cacucuggcucacaucaua

SEQ ID NO: 1129350 - RNA, 19 nt, Homo sapiens
ggucuuacgagccaauaaa

SEQ ID NO: 1129351 - RNA, 19 nt, Homo sapiens
aggaguaccugccugaaga

SEQ ID NO: 1129352 - RNA, 19 nt, Homo sapiens
gaucccacauuuuauauga

SEQ ID NO: 1129353 - RNA, 19 nt, Homo sapiens
gauuuaauacugcauagug

SEQ ID NO: 1129354 - RNA, 19 nt, Homo sapiens
auucaguucuguaggauuu

SEQ ID NO: 1129355 - RNA, 19 nt, Homo sapiens
gaauucaguucuguaggau

SEQ ID NO: 1129356 - RNA, 19 nt, Homo sapiens
cagcaagaaacauagcaua

SEQ ID NO: 1129357 - RNA, 19 nt, Homo sapiens
gaacagaccaacauuuugu

SEQ ID NO: 1129358 - RNA, 19 nt, Homo sapiens
cacggaggcuugucagguu

SEQ ID NO: 1129359 - RNA, 19 nt, Homo sapiens
caguagacacccuggcuua

SEQ ID NO: 1129360 - RNA, 19 nt, Homo sapiens
agguuaagcucuaggaaga

SEQ ID NO: 1129361 - RNA, 19 nt, Homo sapiens
gcagcuuugugcaaugaau

SEQ ID NO: 1129362 - RNA, 19 nt, Homo sapiens
cuaggcugaugaaggauuu

SEQ ID NO: 1129363 - RNA, 19 nt, Homo sapiens
guuaagcucuaggaagaug

SEQ ID NO: 1129364 - RNA, 19 nt, Homo sapiens
guucauagaggauaaagca

SEQ ID NO: 1129365 - RNA, 19 nt, Homo sapiens
ggguagauuucuucaagca

SEQ ID NO: 1129366 - RNA, 19 nt, Homo sapiens
uguauauucuggguaguuu

SEQ ID NO: 1129367 - RNA, 19 nt, Homo sapiens
ccagaacgccucccucuac

SEQ ID NO: 1129368 - RNA, 19 nt, Homo sapiens
agauucaucgguucaauaa

SEQ ID NO: 1129369 - RNA, 19 nt, Homo sapiens
uaagguuugugacauuauc

SEQ ID NO: 1129370 - RNA, 19 nt, Homo sapiens
cagcgguuaugcuuaugaa

SEQ ID NO: 1129371 - RNA, 19 nt, Homo sapiens
gugaggagcauuacaacug

SEQ ID NO: 1129372 - RNA, 19 nt, Homo sapiens
aaaguuaguggauugcaaa

SEQ ID NO: 1129373 - RNA, 19 nt, Homo sapiens
ccauguucauagaggauaa

SEQ ID NO: 1129374 - RNA, 19 nt, Homo sapiens
cugagccgcugucgaguga

SEQ ID NO: 1129375 - RNA, 19 nt, Homo sapiens
acaaaugccaagacaaaug

SEQ ID NO: 1129376 - RNA, 19 nt, Homo sapiens
gcaauggugacuauuuuaa

SEQ ID NO: 1129377 - RNA, 19 nt, Homo sapiens
gacaaaugaugugcgagau

SEQ ID NO: 1129378 - RNA, 19 nt, Homo sapiens
uuaguggauugcaaaguug

SEQ ID NO: 1129379 - RNA, 19 nt, Homo sapiens
agaaagaaaguuaguggau

SEQ ID NO: 1129380 - RNA, 19 nt, Homo sapiens
ugaaggauuugggcuaugg

SEQ ID NO: 1129381 - RNA, 19 nt, Homo sapiens
gcaacagcaagaaacauag

SEQ ID NO: 1129382 - RNA, 19 nt, Homo sapiens
agaaacauagcauaagguu

SEQ ID NO: 1129383 - RNA, 19 nt, Homo sapiens
gucgagugauuguucuuga

SEQ ID NO: 1129384 - RNA, 19 nt, Homo sapiens
ugacauuaucugcaacaaa

SEQ ID NO: 1129385 - RNA, 19 nt, Homo sapiens
uuagaacagaccaacauuu

SEQ ID NO: 1129386 - RNA, 19 nt, Homo sapiens
cauagcauaagguuuguga

SEQ ID NO: 1129387 - RNA, 19 nt, Homo sapiens
gcaacaaaugccaagacaa

SEQ ID NO: 1129388 - RNA, 19 nt, Homo sapiens
guaagaagagugggcaauc

SEQ ID NO: 1129389 - RNA, 19 nt, Homo sapiens
uggcagcuuugugcaauga

SEQ ID NO: 1129390 - RNA, 19 nt, Homo sapiens
gcagcgguuaugcuuauga

SEQ ID NO: 1129391 - RNA, 19 nt, Homo sapiens
uggcggugcuggcuagguu

SEQ ID NO: 1129392 - RNA, 19 nt, Homo sapiens
cacccuggcuuaccucagu

SEQ ID NO: 1129393 - RNA, 19 nt, Homo sapiens
ugagaagcuuccaguagag

SEQ ID NO: 1129394 - RNA, 19 nt, Homo sapiens
ggagauccgacagaugcua

SEQ ID NO: 1129395 - RNA, 19 nt, Homo sapiens
uggcaaaggcuacaaguac

SEQ ID NO: 1129396 - RNA, 19 nt, Homo sapiens
caggugaggagcauuacaa

SEQ ID NO: 1129397 - RNA, 19 nt, Homo sapiens
cagagaaugacgugaagga

SEQ ID NO: 1129398 - RNA, 19 nt, Homo sapiens
agcaacagcaagaaacaua

SEQ ID NO: 1129399 - RNA, 19 nt, Homo sapiens
uagaacagaccaacauuuu

SEQ ID NO: 1129400 - RNA, 19 nt, Homo sapiens
gaaauccccucgcuuaucc

SEQ ID NO: 1129401 - RNA, 19 nt, Homo sapiens
uagcauaagguuugugaca

SEQ ID NO: 1129402 - RNA, 19 nt, Homo sapiens
gaugugcgagaugucauaa

SEQ ID NO: 1129403 - RNA, 19 nt, Homo sapiens
guuagaacagaccaacauu

SEQ ID NO: 1129404 - RNA, 19 nt, Homo sapiens
ccgaggagauccgacagau

SEQ ID NO: 1129405 - RNA, 19 nt, Homo sapiens
agcaagaaacauagcauaa

SEQ ID NO: 1129406 - RNA, 19 nt, Homo sapiens
caguagaguucugaucaca

SEQ ID NO: 1129407 - RNA, 19 nt, Homo sapiens
gaacuguccuggauuguga

SEQ ID NO: 1129408 - RNA, 19 nt, Homo sapiens
gaagaaaacucaccaauca

SEQ ID NO: 1129409 - RNA, 19 nt, Homo sapiens
gauguucucuuuaauguug

SEQ ID NO: 1129410 - RNA, 19 nt, Homo sapiens
ugaugaaucugcuuaugua

SEQ ID NO: 1129411 - RNA, 19 nt, Homo sapiens
caaagguugucucaaguuu

SEQ ID NO: 1129412 - RNA, 19 nt, Homo sapiens
guauuuggcuucugaugaa

SEQ ID NO: 1129413 - RNA, 19 nt, Homo sapiens
gaagaggcacggaaugauu

SEQ ID NO: 1129414 - RNA, 19 nt, Homo sapiens
gacuugauguucucuuuaa

SEQ ID NO: 1129415 - RNA, 19 nt, Homo sapiens
caaaggaguugugaacaga

SEQ ID NO: 1129416 - RNA, 19 nt, Homo sapiens
aaucaucuccuuccuguua

SEQ ID NO: 1129417 - RNA, 19 nt, Homo sapiens
uguaaucucuucugaaauc

SEQ ID NO: 1129418 - RNA, 19 nt, Homo sapiens
uuaaugaugucacuguuug

SEQ ID NO: 1129419 - RNA, 19 nt, Homo sapiens
gauggaggcuggagcuugu

SEQ ID NO: 1129420 - RNA, 19 nt, Homo sapiens
gcaauauuaucaacauguc

SEQ ID NO: 1129421 - RNA, 19 nt, Homo sapiens
ggagaaagacugggacuuc

SEQ ID NO: 1129422 - RNA, 19 nt, Homo sapiens
gagucugauucuuuaagua

SEQ ID NO: 1129423 - RNA, 19 nt, Homo sapiens
guaacccugucaucauuga

SEQ ID NO: 1129424 - RNA, 19 nt, Homo sapiens
gacugggacuucucgauga

SEQ ID NO: 1129425 - RNA, 19 nt, Homo sapiens
cauagcaggagaauaguuu

SEQ ID NO: 1129426 - RNA, 19 nt, Homo sapiens
aagagaaggugccaaaguc

SEQ ID NO: 1129427 - RNA, 19 nt, Homo sapiens
gcguguauuuggcuucuga

SEQ ID NO: 1129428 - RNA, 19 nt, Homo sapiens
ugaaucugcuuauguaacu

SEQ ID NO: 1129429 - RNA, 19 nt, Homo sapiens
ucaaaggaguugugaacag

SEQ ID NO: 1129430 - RNA, 19 nt, Homo sapiens
agucauagccacagacauu

SEQ ID NO: 1129431 - RNA, 19 nt, Homo sapiens
ccaaagucauagccacaga

SEQ ID NO: 1129432 - RNA, 19 nt, Homo sapiens
caagagaaggugccaaagu

SEQ ID NO: 1129433 - RNA, 19 nt, Homo sapiens
uaaaaugcuugcucagaaa

SEQ ID NO: 1129434 - RNA, 19 nt, Homo sapiens
ucauggaacuguccuggau

SEQ ID NO: 1129435 - RNA, 19 nt, Homo sapiens
agaaggugccaaagucaua

SEQ ID NO: 1129436 - RNA, 19 nt, Homo sapiens
acucauagcaggagaauag

SEQ ID NO: 1129437 - RNA, 19 nt, Homo sapiens
ugguaacccugucaucauu

SEQ ID NO: 1129438 - RNA, 19 nt, Homo sapiens
cugcuuauguaacugguaa

SEQ ID NO: 1129439 - RNA, 19 nt, Homo sapiens
gauacgccaucucuacaag

SEQ ID NO: 1129440 - RNA, 19 nt, Homo sapiens
aaacucguguccuugaugu

SEQ ID NO: 1129441 - RNA, 19 nt, Homo sapiens
gaauacaagccagaggaaa

SEQ ID NO: 1129442 - RNA, 19 nt, Homo sapiens
ucuuuaauguugcugguuu

SEQ ID NO: 1129443 - RNA, 19 nt, Homo sapiens
ccagugaaguugagagacu

SEQ ID NO: 1129444 - RNA, 19 nt, Homo sapiens
gaaaucuggcaauauuauc

SEQ ID NO: 1129445 - RNA, 19 nt, Homo sapiens
cuaaaaugcuugcucagaa

SEQ ID NO: 1129446 - RNA, 19 nt, Homo sapiens
aagguugucucaaguuugu

SEQ ID NO: 1129447 - RNA, 19 nt, Homo sapiens
gaacucauagcaggagaau

SEQ ID NO: 1129448 - RNA, 19 nt, Homo sapiens
ggcuggagcuugugauuuu

SEQ ID NO: 1129449 - RNA, 19 nt, Homo sapiens
cauuaugggucgacuugau

SEQ ID NO: 1129450 - RNA, 19 nt, Homo sapiens
gaugaaucugcuuauguaa

SEQ ID NO: 1129451 - RNA, 19 nt, Homo sapiens
gccaugcucugcguguauu

SEQ ID NO: 1129452 - RNA, 19 nt, Homo sapiens
gaagaaacaaauugaucag

SEQ ID NO: 1129453 - RNA, 19 nt, Homo sapiens
uggccaagcagcugccuua

SEQ ID NO: 1129454 - RNA, 19 nt, Homo sapiens
auucgcaacugcagaagaa

SEQ ID NO: 1129455 - RNA, 19 nt, Homo sapiens
agacauuaaugaguccaaa

SEQ ID NO: 1129456 - RNA, 19 nt, Homo sapiens
aagaggcacggaaugauuu

SEQ ID NO: 1129457 - RNA, 19 nt, Homo sapiens
gugaacagauguguguaca

SEQ ID NO: 1129458 - RNA, 19 nt, Homo sapiens
agacuugauguucucuuua

SEQ ID NO: 1129459 - RNA, 19 nt, Homo sapiens
cgcaacugcagaagaaaua

SEQ ID NO: 1129460 - RNA, 19 nt, Homo sapiens
uacgccaucucuacaagaa

SEQ ID NO: 1129461 - RNA, 19 nt, Homo sapiens
cagaagaaauagccaugcu

SEQ ID NO: 1129462 - RNA, 19 nt, Homo sapiens
auuaaugaguccaaacuuc

SEQ ID NO: 1129463 - RNA, 19 nt, Homo sapiens
guugagagacuugauguuc

SEQ ID NO: 1129464 - RNA, 19 nt, Homo sapiens
uugaucaguuugccaguga

SEQ ID NO: 1129465 - RNA, 19 nt, Homo sapiens
uauucaaacucguguccuu

SEQ ID NO: 1129466 - RNA, 19 nt, Homo sapiens
uuaaugaguccaaacuuca

SEQ ID NO: 1129467 - RNA, 19 nt, Homo sapiens
ggcaauauuaucaacaugu

SEQ ID NO: 1129468 - RNA, 19 nt, Homo sapiens
guaaucucuucugaaauca

SEQ ID NO: 1129469 - RNA, 19 nt, Homo sapiens
ucauagccacagacauuaa

SEQ ID NO: 1129470 - RNA, 19 nt, Homo sapiens
ggaacuguccuggauugug

SEQ ID NO: 1129471 - RNA, 19 nt, Homo sapiens
ucaguuugccagugaaguu

SEQ ID NO: 1129472 - RNA, 19 nt, Homo sapiens
gucauagccacagacauua

SEQ ID NO: 1129473 - RNA, 19 nt, Homo sapiens
gaggcuggagcuugugauu

SEQ ID NO: 1129474 - RNA, 19 nt, Homo sapiens
agagucugauucuuuaagu

SEQ ID NO: 1129475 - RNA, 19 nt, Homo sapiens
caaacucguguccuugaug

SEQ ID NO: 1129476 - RNA, 19 nt, Homo sapiens
cgccaucucuacaagaaag

SEQ ID NO: 1129477 - RNA, 19 nt, Homo sapiens
guugugaacagaugugugu

SEQ ID NO: 1129478 - RNA, 19 nt, Homo sapiens
gaaggugccaaagucauag

SEQ ID NO: 1129479 - RNA, 19 nt, Homo sapiens
gagaaggugccaaagucau

SEQ ID NO: 1129480 - RNA, 19 nt, Homo sapiens
aauacaagccagaggaaau

SEQ ID NO: 1129481 - RNA, 19 nt, Homo sapiens
aaccaaggcagccgugauu

SEQ ID NO: 1129482 - RNA, 19 nt, Homo sapiens
uuaucaacaugucuucugu

SEQ ID NO: 1129483 - RNA, 19 nt, Homo sapiens
ucaaugugcgcagcaugua

SEQ ID NO: 1129484 - RNA, 19 nt, Homo sapiens
uccuugaugucacaaagaa

SEQ ID NO: 1129485 - RNA, 19 nt, Homo sapiens
gggcaucaggugcaacugu

SEQ ID NO: 1129486 - RNA, 19 nt, Homo sapiens
ugccuuagcuuuugcaaga

SEQ ID NO: 1129487 - RNA, 19 nt, Homo sapiens
uccuguuaaucacauguua

SEQ ID NO: 1129488 - RNA, 19 nt, Homo sapiens
uagccaugcucugcgugua

SEQ ID NO: 1129489 - RNA, 19 nt, Homo sapiens
gacaaaagacgggaagauu

SEQ ID NO: 1129490 - RNA, 19 nt, Homo sapiens
cuacaagaaagaauacaag

SEQ ID NO: 1129491 - RNA, 19 nt, Homo sapiens
aaggaguugugaacagaug

SEQ ID NO: 1129492 - RNA, 19 nt, Homo sapiens
gggucgacuugaugggaaa

SEQ ID NO: 1129493 - RNA, 19 nt, Homo sapiens
uucaggaacuggaaaagua

SEQ ID NO: 1129494 - RNA, 19 nt, Homo sapiens
ggcaggcccuuccuaucca

SEQ ID NO: 1129495 - RNA, 19 nt, Homo sapiens
cuucugaugaaucugcuua

SEQ ID NO: 1129496 - RNA, 19 nt, Homo sapiens
uguauuuggcuucugauga

SEQ ID NO: 1129497 - RNA, 19 nt, Homo sapiens
ucucaaguuuguugcucaa

SEQ ID NO: 1129498 - RNA, 19 nt, Homo sapiens
guugauacgccaucucuac

SEQ ID NO: 1129499 - RNA, 19 nt, Homo sapiens
cgcagcauguaccugauga

SEQ ID NO: 1129500 - RNA, 19 nt, Homo sapiens
gguaacccugucaucauug

SEQ ID NO: 1129501 - RNA, 19 nt, Homo sapiens
ucugaugaaucugcuuaug

SEQ ID NO: 1129502 - RNA, 19 nt, Homo sapiens
cugaagaggcacggaauga

SEQ ID NO: 1129503 - RNA, 19 nt, Homo sapiens
gaugucacuguuugcaaga

SEQ ID NO: 1129504 - RNA, 19 nt, Homo sapiens
ugcaagagaaggugccaaa

SEQ ID NO: 1129505 - RNA, 19 nt, Homo sapiens
caaccaaggcagccgugau

SEQ ID NO: 1129506 - RNA, 19 nt, Homo sapiens
aaacuucaggaacuggaaa

SEQ ID NO: 1129507 - RNA, 19 nt, Homo sapiens
gagcuaggaucaagucaua

SEQ ID NO: 1129508 - RNA, 19 nt, Homo sapiens
gaagaccucucaacauuug

SEQ ID NO: 1129509 - RNA, 19 nt, Homo sapiens
cagaagaccucucaacauu

SEQ ID NO: 1129510 - RNA, 19 nt, Homo sapiens
gaaggucccuacuauuauu

SEQ ID NO: 1129511 - RNA, 19 nt, Homo sapiens
gaagcaauguuauggaaga

SEQ ID NO: 1129512 - RNA, 19 nt, Homo sapiens
cgaagucgcuuaccagcua

SEQ ID NO: 1129513 - RNA, 19 nt, Homo sapiens
guauuuagcuugaauccuu

SEQ ID NO: 1129514 - RNA, 19 nt, Homo sapiens
ugaagaaggucccuacuau

SEQ ID NO: 1129515 - RNA, 19 nt, Homo sapiens
gagcaugaaauucguaaua

SEQ ID NO: 1129516 - RNA, 19 nt, Homo sapiens
ccacuacugucauguguuu

SEQ ID NO: 1129517 - RNA, 19 nt, Homo sapiens
gcauugggcuaccucagua

SEQ ID NO: 1129518 - RNA, 19 nt, Homo sapiens
aagaaggucccuacuauua

SEQ ID NO: 1129519 - RNA, 19 nt, Homo sapiens
gaucaggauuuguuggaaa

SEQ ID NO: 1129520 - RNA, 19 nt, Homo sapiens
gggaagcaauguuauggaa

SEQ ID NO: 1129521 - RNA, 19 nt, Homo sapiens
gcaauguuauggaagauca

SEQ ID NO: 1129522 - RNA, 19 nt, Homo sapiens
ccugauggcuaauggauuu

SEQ ID NO: 1129523 - RNA, 19 nt, Homo sapiens
ggacacuccuccacacuuc

SEQ ID NO: 1129524 - RNA, 19 nt, Homo sapiens
gaagaaggucccuacuauu

SEQ ID NO: 1129525 - RNA, 19 nt, Homo sapiens
gcuaauggauuugacaaug

SEQ ID NO: 1129526 - RNA, 19 nt, Homo sapiens
gcacagacaaagaauucua

SEQ ID NO: 1129527 - RNA, 19 nt, Homo sapiens
cuacagagcaaaugaagaa

SEQ ID NO: 1129528 - RNA, 19 nt, Homo sapiens
caauccagcuccuuccaaa

SEQ ID NO: 1129529 - RNA, 19 nt, Homo sapiens
acagauaaaugacaagcaa

SEQ ID NO: 1129530 - RNA, 19 nt, Homo sapiens
gcaugaaauucguaauauc

SEQ ID NO: 1129531 - RNA, 19 nt, Homo sapiens
cuuaaacgcuucccucuuc

SEQ ID NO: 1129532 - RNA, 19 nt, Homo sapiens
gcaggaaccaucagagaga

SEQ ID NO: 1129533 - RNA, 19 nt, Homo sapiens
ggacaaugguuggaaagca

SEQ ID NO: 1129534 - RNA, 19 nt, Homo sapiens
ccaaagaugagacccauug

SEQ ID NO: 1129535 - RNA, 19 nt, Homo sapiens
guugauguauuuagcuuga

SEQ ID NO: 1129536 - RNA, 19 nt, Homo sapiens
ggacagaaucaacccaaga

SEQ ID NO: 1129537 - RNA, 19 nt, Homo sapiens
agaaccaccugauggcuaa

SEQ ID NO: 1129538 - RNA, 19 nt, Homo sapiens
cagaugcccuguccaaaca

SEQ ID NO: 1129539 - RNA, 19 nt, Homo sapiens
ggucuaaucaacagauaaa

SEQ ID NO: 1129540 - RNA, 19 nt, Homo sapiens
ggucgguaguaaagauuaa

SEQ ID NO: 1129541 - RNA, 19 nt, Homo sapiens
gcaaguccguggaucuucu

SEQ ID NO: 1129542 - RNA, 19 nt, Homo sapiens
gagguugaacuuauuaaug

SEQ ID NO: 1129543 - RNA, 19 nt, Homo sapiens
gcugagaacauuaaucugu

SEQ ID NO: 1129544 - RNA, 19 nt, Homo sapiens
ucucaacauuugccuauau

SEQ ID NO: 1129545 - RNA, 19 nt, Homo sapiens
ccagucgugugauuacaaa

SEQ ID NO: 1129546 - RNA, 19 nt, Homo sapiens
uauggaagaucaggauuug

SEQ ID NO: 1129547 - RNA, 19 nt, Homo sapiens
cuaauggauuugacaaugu

SEQ ID NO: 1129548 - RNA, 19 nt, Homo sapiens
ucagaagucuacagagcaa

SEQ ID NO: 1129549 - RNA, 19 nt, Homo sapiens
gggcacagacaaagaauuc

SEQ ID NO: 1129550 - RNA, 19 nt, Homo sapiens
ccagaaagcuuugaaaaca

SEQ ID NO: 1129551 - RNA, 19 nt, Homo sapiens
uagguucuaugcugauaaa

SEQ ID NO: 1129552 - RNA, 19 nt, Homo sapiens
ccauugaacugggcgacua

SEQ ID NO: 1129553 - RNA, 19 nt, Homo sapiens
gcugauaaagccuaaauag

SEQ ID NO: 1129554 - RNA, 19 nt, Homo sapiens
acacuucgauggaccuguu

SEQ ID NO: 1129555 - RNA, 19 nt, Homo sapiens
uguaagaaauguggagcua

SEQ ID NO: 1129556 - RNA, 19 nt, Homo sapiens
gacaaugguuggaaagcau

SEQ ID NO: 1129557 - RNA, 19 nt, Homo sapiens
gcccaggacuaccgcuauu

SEQ ID NO: 1129558 - RNA, 19 nt, Homo sapiens
gaaagguugauguauuuag

SEQ ID NO: 1129559 - RNA, 19 nt, Homo sapiens
gacggcuacucccugcuua

SEQ ID NO: 1129560 - RNA, 19 nt, Homo sapiens
gaagucuaaucaccacuac

SEQ ID NO: 1129561 - RNA, 19 nt, Homo sapiens
ggaaauuggaauccuuaau

SEQ ID NO: 1129562 - RNA, 19 nt, Homo sapiens
ggaagaucaggauuuguug

SEQ ID NO: 1129563 - RNA, 19 nt, Homo sapiens
uaauggauuugacaaugug

SEQ ID NO: 1129564 - RNA, 19 nt, Homo sapiens
ggccacaggaaacguauuu

SEQ ID NO: 1129565 - RNA, 19 nt, Homo sapiens
ucugggagguugaacuuau

SEQ ID NO: 1129566 - RNA, 19 nt, Homo sapiens
gauaaaugacaagcaaaga

SEQ ID NO: 1129567 - RNA, 19 nt, Homo sapiens
gaugugaauuuagccuaug

SEQ ID NO: 1129568 - RNA, 19 nt, Homo sapiens
cagagcaaaugaagaaggu

SEQ ID NO: 1129569 - RNA, 19 nt, Homo sapiens
guagcugaguggcuggauu

SEQ ID NO: 1129570 - RNA, 19 nt, Homo sapiens
aaagaauucuacaggcaau

SEQ ID NO: 1129571 - RNA, 19 nt, Homo sapiens
ugagaacauuaaucuguca

SEQ ID NO: 1129572 - RNA, 19 nt, Homo sapiens
cagaaaagcuuaucuucca

SEQ ID NO: 1129573 - RNA, 19 nt, Homo sapiens
gggagaaccuuccauuacc

SEQ ID NO: 1129574 - RNA, 19 nt, Homo sapiens
guacgagaaccaccugaug

SEQ ID NO: 1129575 - RNA, 19 nt, Homo sapiens
gggcaggaaccaucagaga

SEQ ID NO: 1129576 - RNA, 19 nt, Homo sapiens
ugaugugaauuuagccuau

SEQ ID NO: 1129577 - RNA, 19 nt, Homo sapiens
ccagaagaccucucaacau

SEQ ID NO: 1129578 - RNA, 19 nt, Homo sapiens
uggaagaucaggauuuguu

SEQ ID NO: 1129579 - RNA, 19 nt, Homo sapiens
ugccuuugaugugaauuua

SEQ ID NO: 1129580 - RNA, 19 nt, Homo sapiens
guucuaugcugauaaaaga

SEQ ID NO: 1129581 - RNA, 19 nt, Homo sapiens
ggagaaccuuccauuaccu

SEQ ID NO: 1129582 - RNA, 19 nt, Homo sapiens
ggacggcuacucccugcuu

SEQ ID NO: 1129583 - RNA, 19 nt, Homo sapiens
ggagguugaacuuauuaau

SEQ ID NO: 1129584 - RNA, 19 nt, Homo sapiens
ugacaagcaaagaaugaaa

SEQ ID NO: 1129585 - RNA, 19 nt, Homo sapiens
guggucuaaucaacagaua

SEQ ID NO: 1129586 - RNA, 19 nt, Homo sapiens
aaucaccacuacugucaug

SEQ ID NO: 1129587 - RNA, 19 nt, Homo sapiens
ggacccagaagaccucuca

SEQ ID NO: 1129588 - RNA, 19 nt, Homo sapiens
gcuugaguaugccuucuuc

SEQ ID NO: 1129589 - RNA, 19 nt, Homo sapiens
gugggacaaugguuggaaa

SEQ ID NO: 1129590 - RNA, 19 nt, Homo sapiens
aaauguauaccaaggcaaa

SEQ ID NO: 1129591 - RNA, 19 nt, Homo sapiens
agaagaccucucaacauuu

SEQ ID NO: 1129592 - RNA, 19 nt, Homo sapiens
guuggaaauuggaauccuu

SEQ ID NO: 1129593 - RNA, 19 nt, Homo sapiens
uuuaugggaagcaauguua

SEQ ID NO: 1129594 - RNA, 19 nt, Homo sapiens
uauagcugauaaagccuaa

SEQ ID NO: 1129595 - RNA, 19 nt, Homo sapiens
gacagaaucaacccaagau

SEQ ID NO: 1129596 - RNA, 19 nt, Homo sapiens
gcaauccagcuccuuccaa

SEQ ID NO: 1129597 - RNA, 19 nt, Homo sapiens
aagccuaaauagaaagguu

SEQ ID NO: 1129598 - RNA, 19 nt, Homo sapiens
gcuacucccugcuuaaacg

SEQ ID NO: 1129599 - RNA, 19 nt, Homo sapiens
ccaaacagugggacaaugg

SEQ ID NO: 1129600 - RNA, 19 nt, Homo sapiens
ugaagucuaaucaccacua

SEQ ID NO: 1129601 - RNA, 19 nt, Homo sapiens
agaaggucccuacuauuau

SEQ ID NO: 1129602 - RNA, 19 nt, Homo sapiens
uaauuaauggcuacacuuc

SEQ ID NO: 1129603 - RNA, 19 nt, Homo sapiens
uugacaaugugcaguuuau

SEQ ID NO: 1129604 - RNA, 19 nt, Homo sapiens
gauuugacaaugugcaguu

SEQ ID NO: 1129605 - RNA, 19 nt, Homo sapiens
gcaaagaaugaaacaaucc

SEQ ID NO: 1129606 - RNA, 19 nt, Homo sapiens
caccacuacugucaugugu

SEQ ID NO: 1129607 - RNA, 19 nt, Homo sapiens
gaagaccucucaacauuug

SEQ ID NO: 1129608 - RNA, 19 nt, Homo sapiens
cagaagaccucucaacauu

SEQ ID NO: 1129609 - RNA, 19 nt, Homo sapiens
gaaggucccuacuauuauu

SEQ ID NO: 1129610 - RNA, 19 nt, Homo sapiens
gaagcaauguuauggaaga

SEQ ID NO: 1129611 - RNA, 19 nt, Homo sapiens
cgaagucgcuuaccagcua

SEQ ID NO: 1129612 - RNA, 19 nt, Homo sapiens
ugaagaaggucccuacuau

SEQ ID NO: 1129613 - RNA, 19 nt, Homo sapiens
gagcaugaaauucguaaua

SEQ ID NO: 1129614 - RNA, 19 nt, Homo sapiens
gagcuaggaucaggucaua

SEQ ID NO: 1129615 - RNA, 19 nt, Homo sapiens
gaaguucauuauagcgaua

SEQ ID NO: 1129616 - RNA, 19 nt, Homo sapiens
ccacuacugucauguguuu

SEQ ID NO: 1129617 - RNA, 19 nt, Homo sapiens
gcauugggcuaccucagua

SEQ ID NO: 1129618 - RNA, 19 nt, Homo sapiens
caagauuucugucauggaa

SEQ ID NO: 1129619 - RNA, 19 nt, Homo sapiens
aagaaggucccuacuauua

SEQ ID NO: 1129620 - RNA, 19 nt, Homo sapiens
gcaaggaggagaagaaaug

SEQ ID NO: 1129621 - RNA, 19 nt, Homo sapiens
gcagaggaauuuauuaugc

SEQ ID NO: 1129622 - RNA, 19 nt, Homo sapiens
gaucaggauuuguuggaaa

SEQ ID NO: 1129623 - RNA, 19 nt, Homo sapiens
cgagggauguuucugguuu

SEQ ID NO: 1129624 - RNA, 19 nt, Homo sapiens
gggaagcaauguuauggaa

SEQ ID NO: 1129625 - RNA, 19 nt, Homo sapiens
ggauguuucugguuucauu

SEQ ID NO: 1129626 - RNA, 19 nt, Homo sapiens
gcaauguuauggaagauca

SEQ ID NO: 1129627 - RNA, 19 nt, Homo sapiens
ccugauggcuaauggauuu

SEQ ID NO: 1129628 - RNA, 19 nt, Homo sapiens
caacucccgugauaugauu

SEQ ID NO: 1129629 - RNA, 19 nt, Homo sapiens
guacuugcuuugcuucauu

SEQ ID NO: 1129630 - RNA, 19 nt, Homo sapiens
ggacacuccuccacacuuc

SEQ ID NO: 1129631 - RNA, 19 nt, Homo sapiens
gaagaaggucccuacuauu

SEQ ID NO: 1129632 - RNA, 19 nt, Homo sapiens
gcuaauggauuugacaaug

SEQ ID NO: 1129633 - RNA, 19 nt, Homo sapiens
ucaguuacauucaucaguu

SEQ ID NO: 1129634 - RNA, 19 nt, Homo sapiens
gagaugaucaguuacauuc

SEQ ID NO: 1129635 - RNA, 19 nt, Homo sapiens
caaagcagaggaauuuauu

SEQ ID NO: 1129636 - RNA, 19 nt, Homo sapiens
gcacagacaaagaauucua

SEQ ID NO: 1129637 - RNA, 19 nt, Homo sapiens
caaagcaucuguaaaauca

SEQ ID NO: 1129638 - RNA, 19 nt, Homo sapiens
cuacagagcaaaugaagaa

SEQ ID NO: 1129639 - RNA, 19 nt, Homo sapiens
caauccagcuccuuccaaa

SEQ ID NO: 1129640 - RNA, 19 nt, Homo sapiens
gcaugaaauucguaauauc

SEQ ID NO: 1129641 - RNA, 19 nt, Homo sapiens
gaaauauggacgaaucaga

SEQ ID NO: 1129642 - RNA, 19 nt, Homo sapiens
cuuaaacgcuucccucuuc

SEQ ID NO: 1129643 - RNA, 19 nt, Homo sapiens
ggacaaugguuggaaagca

SEQ ID NO: 1129644 - RNA, 19 nt, Homo sapiens
aaacaacucccgugauaug

SEQ ID NO: 1129645 - RNA, 19 nt, Homo sapiens
ccaaagaugagacccauug

SEQ ID NO: 1129646 - RNA, 19 nt, Homo sapiens
gcaaguccgugcagaucga

SEQ ID NO: 1129647 - RNA, 19 nt, Homo sapiens
ggacagaaucaacccaaga

SEQ ID NO: 1129648 - RNA, 19 nt, Homo sapiens
agaaccaccugauggcuaa

SEQ ID NO: 1129649 - RNA, 19 nt, Homo sapiens
cagaugcccuguccaaaca

SEQ ID NO: 1129650 - RNA, 19 nt, Homo sapiens
gcucagugguggcaaaaua

SEQ ID NO: 1129651 - RNA, 19 nt, Homo sapiens
ggucgguaguaaagauuaa

SEQ ID NO: 1129652 - RNA, 19 nt, Homo sapiens
ucacacuccuccucaguug

SEQ ID NO: 1129653 - RNA, 19 nt, Homo sapiens
gcugagaacauuaaucugu

SEQ ID NO: 1129654 - RNA, 19 nt, Homo sapiens
gagguugaacuuauuaaug

SEQ ID NO: 1129655 - RNA, 19 nt, Homo sapiens
guaaaggggaucucuaaua

SEQ ID NO: 1129656 - RNA, 19 nt, Homo sapiens
ucucaacauuugccuauau

SEQ ID NO: 1129657 - RNA, 19 nt, Homo sapiens
ccagucgugugauuacaaa

SEQ ID NO: 1129658 - RNA, 19 nt, Homo sapiens
gagaagaaaugaaaacuac

SEQ ID NO: 1129659 - RNA, 19 nt, Homo sapiens
ucaguugucuccaucacuu

SEQ ID NO: 1129660 - RNA, 19 nt, Homo sapiens
uauggaagaucaggauuug

SEQ ID NO: 1129661 - RNA, 19 nt, Homo sapiens
cuaauggauuugacaaugu

SEQ ID NO: 1129662 - RNA, 19 nt, Homo sapiens
aaaccuaacugagaugauc

SEQ ID NO: 1129663 - RNA, 19 nt, Homo sapiens
guggaguauuuguaugaua

SEQ ID NO: 1129664 - RNA, 19 nt, Homo sapiens
cccaagguauuucugauga

SEQ ID NO: 1129665 - RNA, 19 nt, Homo sapiens
ucagaagucuacagagcaa

SEQ ID NO: 1129666 - RNA, 19 nt, Homo sapiens
gggcacagacaaagaauuc

SEQ ID NO: 1129667 - RNA, 19 nt, Homo sapiens
aaaccacgauuuucugaua

SEQ ID NO: 1129668 - RNA, 19 nt, Homo sapiens
ccagaaagcuuugaaaaca

SEQ ID NO: 1129669 - RNA, 19 nt, Homo sapiens
uagguucuaugcugauaaa

SEQ ID NO: 1129670 - RNA, 19 nt, Homo sapiens
ucacuuagccaaagcacuu

SEQ ID NO: 1129671 - RNA, 19 nt, Homo sapiens
ccauugaacugggcgacua

SEQ ID NO: 1129672 - RNA, 19 nt, Homo sapiens
uaaugucucuguggaguau

SEQ ID NO: 1129673 - RNA, 19 nt, Homo sapiens
gcccaggacuaccgcuauu

SEQ ID NO: 1129674 - RNA, 19 nt, Homo sapiens
acacuucgauggaccuguu

SEQ ID NO: 1129675 - RNA, 19 nt, Homo sapiens
uguaagaaauguggagcua

SEQ ID NO: 1129676 - RNA, 19 nt, Homo sapiens
gacaaugguuggaaagcau

SEQ ID NO: 1129677 - RNA, 19 nt, Homo sapiens
ccuagacguuccucacauu

SEQ ID NO: 1129678 - RNA, 19 nt, Homo sapiens
gacggcuacucccugcuua

SEQ ID NO: 1129679 - RNA, 19 nt, Homo sapiens
gaucucuaauacugccuaa

SEQ ID NO: 1129680 - RNA, 19 nt, Homo sapiens
ccaucagccugccaagauu

SEQ ID NO: 1129681 - RNA, 19 nt, Homo sapiens
gaagucuaaucaccacuac

SEQ ID NO: 1129682 - RNA, 19 nt, Homo sapiens
ggaaauuggaauccuuaau

SEQ ID NO: 1129683 - RNA, 19 nt, Homo sapiens
ggaagaucaggauuuguug

SEQ ID NO: 1129684 - RNA, 19 nt, Homo sapiens
uaauggauuugacaaugug

SEQ ID NO: 1129685 - RNA, 19 nt, Homo sapiens
cagaggaauuuauuaugca

SEQ ID NO: 1129686 - RNA, 19 nt, Homo sapiens
aaauauggacgaaucagaa

SEQ ID NO: 1129687 - RNA, 19 nt, Homo sapiens
gaugcaaggaggagaagaa

SEQ ID NO: 1129688 - RNA, 19 nt, Homo sapiens
ggccacaggaaacguauuu

SEQ ID NO: 1129689 - RNA, 19 nt, Homo sapiens
ucugggagguugaacuuau

SEQ ID NO: 1129690 - RNA, 19 nt, Homo sapiens
ucaaagcagaggaauuuau

SEQ ID NO: 1129691 - RNA, 19 nt, Homo sapiens
ugugaaauauggacgaauc

SEQ ID NO: 1129692 - RNA, 19 nt, Homo sapiens
gaugugaauuuagccuaug

SEQ ID NO: 1129693 - RNA, 19 nt, Homo sapiens
cagagcaaaugaagaaggu

SEQ ID NO: 1129694 - RNA, 19 nt, Homo sapiens
guagcugaguggcuggauu

SEQ ID NO: 1129695 - RNA, 19 nt, Homo sapiens
aaagaauucuacaggcaau

SEQ ID NO: 1129696 - RNA, 19 nt, Homo sapiens
guggaauugucuuaauguu

SEQ ID NO: 1129697 - RNA, 19 nt, Homo sapiens
aaucaccuaugucagagaa

SEQ ID NO: 1129698 - RNA, 19 nt, Homo sapiens
uguaaucaccuaugucaga

SEQ ID NO: 1129699 - RNA, 19 nt, Homo sapiens
uaaaggggaucucuaauac

SEQ ID NO: 1129700 - RNA, 19 nt, Homo sapiens
cagaaaagcuuaucuucca

SEQ ID NO: 1129701 - RNA, 19 nt, Homo sapiens
gggagaaccuuccauuacc

SEQ ID NO: 1129702 - RNA, 19 nt, Homo sapiens
ugagaacauuaaucuguca

SEQ ID NO: 1129703 - RNA, 19 nt, Homo sapiens
guacgagaaccaccugaug

SEQ ID NO: 1129704 - RNA, 19 nt, Homo sapiens
gaaaucagagcagcacuac

SEQ ID NO: 1129705 - RNA, 19 nt, Homo sapiens
ugaugugaauuuagccuau

SEQ ID NO: 1129706 - RNA, 19 nt, Homo sapiens
ccagaagaccucucaacau

SEQ ID NO: 1129707 - RNA, 19 nt, Homo sapiens
gaaaguaccucgucucaaa

SEQ ID NO: 1129708 - RNA, 19 nt, Homo sapiens
gaaaggaaaucuaguggaa

SEQ ID NO: 1129709 - RNA, 19 nt, Homo sapiens
uuacauaccuccuucauaa

SEQ ID NO: 1129710 - RNA, 19 nt, Homo sapiens
aaacagaacuuugcaauug

SEQ ID NO: 1129711 - RNA, 19 nt, Homo sapiens
ggaaacagguucagcaugu

SEQ ID NO: 1129712 - RNA, 19 nt, Homo sapiens
gagagaaguugcugauauu

SEQ ID NO: 1129713 - RNA, 19 nt, Homo sapiens
gcugguaucuugagaguuu

SEQ ID NO: 1129714 - RNA, 19 nt, Homo sapiens
gaaauucuuuggcuuuaga

SEQ ID NO: 1129715 - RNA, 19 nt, Homo sapiens
ccaguugaauuguccauua

SEQ ID NO: 1129716 - RNA, 19 nt, Homo sapiens
ugaaguagcuguguuaugu

SEQ ID NO: 1129717 - RNA, 19 nt, Homo sapiens
gaaugucacucccuggaaa

SEQ ID NO: 1129718 - RNA, 19 nt, Homo sapiens
gcauagugcucauugcaaa

SEQ ID NO: 1129719 - RNA, 19 nt, Homo sapiens
gggaaacaguuaugaaaug

SEQ ID NO: 1129720 - RNA, 19 nt, Homo sapiens
cauauugcauugcucuuua

SEQ ID NO: 1129721 - RNA, 19 nt, Homo sapiens
ggcaauugcuuguguugua

SEQ ID NO: 1129722 - RNA, 19 nt, Homo sapiens
guuuagagcugcuucauau

SEQ ID NO: 1129723 - RNA, 19 nt, Homo sapiens
ucucuaagcuugguguuua

SEQ ID NO: 1129724 - RNA, 19 nt, Homo sapiens
gcuguuaucucuucaggaa

SEQ ID NO: 1129725 - RNA, 19 nt, Homo sapiens
aaagagaacagaugaagua

SEQ ID NO: 1129726 - RNA, 19 nt, Homo sapiens
gcacaaauccuugaaaaua

SEQ ID NO: 1129727 - RNA, 19 nt, Homo sapiens
gacccaaacucuuguguug

SEQ ID NO: 1129728 - RNA, 19 nt, Homo sapiens
ugagagaaguugcugauau

SEQ ID NO: 1129729 - RNA, 19 nt, Homo sapiens
gaucagaugguauaugaaa

SEQ ID NO: 1129730 - RNA, 19 nt, Homo sapiens
guuaugaaaugccaagaaa

SEQ ID NO: 1129731 - RNA, 19 nt, Homo sapiens
gcaauugcuuguguuguaa

SEQ ID NO: 1129732 - RNA, 19 nt, Homo sapiens
ggaaagagaguuacaccuu

SEQ ID NO: 1129733 - RNA, 19 nt, Homo sapiens
gaaauaggcaguuuaaugc

SEQ ID NO: 1129734 - RNA, 19 nt, Homo sapiens
gcaguaaauugucuucugu

SEQ ID NO: 1129735 - RNA, 19 nt, Homo sapiens
agaauuaucugugugauga

SEQ ID NO: 1129736 - RNA, 19 nt, Homo sapiens
gaacuugugauguuagauu

SEQ ID NO: 1129737 - RNA, 19 nt, Homo sapiens
uuacaaagccgcugugauu

SEQ ID NO: 1129738 - RNA, 19 nt, Homo sapiens
uacagaaagucaucaagua

SEQ ID NO: 1129739 - RNA, 19 nt, Homo sapiens
caaguuagcugugguugau

SEQ ID NO: 1129740 - RNA, 19 nt, Homo sapiens
gagguuguuuccugaagua

SEQ ID NO: 1129741 - RNA, 19 nt, Homo sapiens
aaacuggcaucaccauaaa

SEQ ID NO: 1129742 - RNA, 19 nt, Homo sapiens
caaacuggcaucaccauaa

SEQ ID NO: 1129743 - RNA, 19 nt, Homo sapiens
gcagauaagcagaaacuug

SEQ ID NO: 1129744 - RNA, 19 nt, Homo sapiens
ugaaauaggcaguuuaaug

SEQ ID NO: 1129745 - RNA, 19 nt, Homo sapiens
gagaacagaugaaguagcu

SEQ ID NO: 1129746 - RNA, 19 nt, Homo sapiens
ggaaggaacuaggcugugu

SEQ ID NO: 1129747 - RNA, 19 nt, Homo sapiens
aaaccuggcugcuaucaga

SEQ ID NO: 1129748 - RNA, 19 nt, Homo sapiens
ggaaugaagucagcuccuu

SEQ ID NO: 1129749 - RNA, 19 nt, Homo sapiens
guuaugugcugguaucuug

SEQ ID NO: 1129750 - RNA, 19 nt, Homo sapiens
ggaacaggaaagagaguua

SEQ ID NO: 1129751 - RNA, 19 nt, Homo sapiens
caaaucaaaugagguuguu

SEQ ID NO: 1129752 - RNA, 19 nt, Homo sapiens
cauauaauguccggauaaa

SEQ ID NO: 1129753 - RNA, 19 nt, Homo sapiens
ggaaggaucagcuguugga

SEQ ID NO: 1129754 - RNA, 19 nt, Homo sapiens
gcauauaauguccggauaa

SEQ ID NO: 1129755 - RNA, 19 nt, Homo sapiens
gcuaggaaguuuagauuuu

SEQ ID NO: 1129756 - RNA, 19 nt, Homo sapiens
caggguaaauuucaacaau

SEQ ID NO: 1129757 - RNA, 19 nt, Homo sapiens
uuagauggcucagcauuug

SEQ ID NO: 1129758 - RNA, 19 nt, Homo sapiens
ccacaaaucaaaugagguu

SEQ ID NO: 1129759 - RNA, 19 nt, Homo sapiens
gcauugcucuuuaguuguc

SEQ ID NO: 1129760 - RNA, 19 nt, Homo sapiens
caacuauugcuauuucgua

SEQ ID NO: 1129761 - RNA, 19 nt, Homo sapiens
gaaugaagucagcuccuuu

SEQ ID NO: 1129762 - RNA, 19 nt, Homo sapiens
gggcaaaugucucuaagcu

SEQ ID NO: 1129763 - RNA, 19 nt, Homo sapiens
guaaacacugcaugucuaa

SEQ ID NO: 1129764 - RNA, 19 nt, Homo sapiens
guacuuugccauggaguua

SEQ ID NO: 1129765 - RNA, 19 nt, Homo sapiens
uugaucagaugguauauga

SEQ ID NO: 1129766 - RNA, 19 nt, Homo sapiens
ugacgaacguguacuccuu

SEQ ID NO: 1129767 - RNA, 19 nt, Homo sapiens
gaauugguccacaggguaa

SEQ ID NO: 1129768 - RNA, 19 nt, Homo sapiens
gcaguggcuuagacaagaa

SEQ ID NO: 1129769 - RNA, 19 nt, Homo sapiens
ggaaacaguuaugaaaugc

SEQ ID NO: 1129770 - RNA, 19 nt, Homo sapiens
gcacccaagucaucaacug

SEQ ID NO: 1129771 - RNA, 19 nt, Homo sapiens
caaagccgcugugauugga

SEQ ID NO: 1129772 - RNA, 19 nt, Homo sapiens
gaaauucaaaugagagaag

SEQ ID NO: 1129773 - RNA, 19 nt, Homo sapiens
gaacguguacuccuuggau

SEQ ID NO: 1129774 - RNA, 19 nt, Homo sapiens
agacuucacuugaucagau

SEQ ID NO: 1129775 - RNA, 19 nt, Homo sapiens
gaaaaucugggccuacaua

SEQ ID NO: 1129776 - RNA, 19 nt, Homo sapiens
ggauucugguguuugguuu

SEQ ID NO: 1129777 - RNA, 19 nt, Homo sapiens
ccaaacucuuguguuguua

SEQ ID NO: 1129778 - RNA, 19 nt, Homo sapiens
cccaaacucuuguguuguu

SEQ ID NO: 1129779 - RNA, 19 nt, Homo sapiens
uuaaggacaugagaaauuc

SEQ ID NO: 1129780 - RNA, 19 nt, Homo sapiens
uugcauugcucuuuaguug

SEQ ID NO: 1129781 - RNA, 19 nt, Homo sapiens
caugagaaauucaaaugag

SEQ ID NO: 1129782 - RNA, 19 nt, Homo sapiens
uuaguugucucuggaaauu

SEQ ID NO: 1129783 - RNA, 19 nt, Homo sapiens
ucaccaguauccucaaaug

SEQ ID NO: 1129784 - RNA, 19 nt, Homo sapiens
uuagagcugcuucauauuu

SEQ ID NO: 1129785 - RNA, 19 nt, Homo sapiens
cagcauguuugcacuuguu

SEQ ID NO: 1129786 - RNA, 19 nt, Homo sapiens
aaagagaguuacaccuugu

SEQ ID NO: 1129787 - RNA, 19 nt, Homo sapiens
uguuaucucuucaggaauu

SEQ ID NO: 1129788 - RNA, 19 nt, Homo sapiens
aguaaacacugcaugucua

SEQ ID NO: 1129789 - RNA, 19 nt, Homo sapiens
acagaaagucaucaaguaa

SEQ ID NO: 1129790 - RNA, 19 nt, Homo sapiens
gcuuauaucuauggaagga

SEQ ID NO: 1129791 - RNA, 19 nt, Homo sapiens
ugaaguacuuugccaugga

SEQ ID NO: 1129792 - RNA, 19 nt, Homo sapiens
gacaugagaaauucaaaug

SEQ ID NO: 1129793 - RNA, 19 nt, Homo sapiens
cagaaagucaucaaguaaa

SEQ ID NO: 1129794 - RNA, 19 nt, Homo sapiens
guuguuuccugaaguagaa

SEQ ID NO: 1129795 - RNA, 19 nt, Homo sapiens
ggacaugagaaauucaaau

SEQ ID NO: 1129796 - RNA, 19 nt, Homo sapiens
caaauggagacuucacuug

SEQ ID NO: 1129797 - RNA, 19 nt, Homo sapiens
ccaaagcacccaagucauc

SEQ ID NO: 1129798 - RNA, 19 nt, Homo sapiens
gcacaagguaaagguaauu

SEQ ID NO: 1129799 - RNA, 19 nt, Homo sapiens
gagaugagagaaaggaaau

SEQ ID NO: 1129800 - RNA, 19 nt, Homo sapiens
gauauucaucaguguguuu

SEQ ID NO: 1129801 - RNA, 19 nt, Homo sapiens
cagauaagcagaaacuugu

SEQ ID NO: 1129802 - RNA, 19 nt, Homo sapiens
gguguuugguuugcucuuu

SEQ ID NO: 1129803 - RNA, 19 nt, Homo sapiens
gugauaagauuacauaccu

SEQ ID NO: 1129804 - RNA, 19 nt, Homo sapiens
ggaugggauucugguguuu

SEQ ID NO: 1129805 - RNA, 19 nt, Homo sapiens
cuaagcagauaagcagaaa

SEQ ID NO: 1129806 - RNA, 19 nt, Homo sapiens
gaucagcuguuggaugucu

SEQ ID NO: 1129807 - RNA, 19 nt, Homo sapiens
auaagaagcugaagaagga

SEQ ID NO: 1129808 - RNA, 19 nt, Homo sapiens
ccacuuggcucccagacaa

SEQ ID NO: 1129809 - RNA, 19 nt, Homo sapiens
ggagaaagugagcuaaguu

SEQ ID NO: 1129810 - RNA, 19 nt, Homo sapiens
ggaccggccagacuucuaa

SEQ ID NO: 1129811 - RNA, 19 nt, Homo sapiens
ccaaugaccaauacaaguu

SEQ ID NO: 1129812 - RNA, 19 nt, Homo sapiens
gagaaagugagcuaaguug

SEQ ID NO: 1129813 - RNA, 19 nt, Homo sapiens
ggaauugaggagaaaguga

SEQ ID NO: 1129814 - RNA, 19 nt, Homo sapiens
ggccuggaauugaggagaa

SEQ ID NO: 1129815 - RNA, 19 nt, Homo sapiens
ggagagcagaaaccacuug

SEQ ID NO: 1129816 - RNA, 19 nt, Homo sapiens
cuacgugagccaacaagaa

SEQ ID NO: 1129817 - RNA, 19 nt, Homo sapiens
acuauaagaagcugaagaa

SEQ ID NO: 1129818 - RNA, 19 nt, Homo sapiens
gagagucggagagcagaaa

SEQ ID NO: 1129819 - RNA, 19 nt, Homo sapiens
uggcacaggcuacguguug

SEQ ID NO: 1129820 - RNA, 19 nt, Homo sapiens
gaggagaaagugagcuaag

SEQ ID NO: 1129821 - RNA, 19 nt, Homo sapiens
gcuuugggccuggaauuga

SEQ ID NO: 1129822 - RNA, 19 nt, Homo sapiens
agaagcagccgugggcaaa

SEQ ID NO: 1129823 - RNA, 19 nt, Homo sapiens
cagcagggguccaccaaga

SEQ ID NO: 1129824 - RNA, 19 nt, Homo sapiens
ggcacaggcuacguguuga

SEQ ID NO: 1129825 - RNA, 19 nt, Homo sapiens
agaaggaccggccagacuu

SEQ ID NO: 1129826 - RNA, 19 nt, Homo sapiens
caaugaccaauacaaguuc

SEQ ID NO: 1129827 - RNA, 19 nt, Homo sapiens
gcugaucccuccccacuca

SEQ ID NO: 1129828 - RNA, 19 nt, Homo sapiens
ccagccagcccauccacuu

SEQ ID NO: 1129829 - RNA, 19 nt, Homo sapiens
ggaggagggagaggacaga

SEQ ID NO: 1129830 - RNA, 19 nt, Homo sapiens
ccucugacccuuggcuuga

SEQ ID NO: 1129831 - RNA, 19 nt, Homo sapiens
gacuauaagaagcugaaga

SEQ ID NO: 1129832 - RNA, 19 nt, Homo sapiens
aggagaaagugagcuaagu

SEQ ID NO: 1129833 - RNA, 19 nt, Homo sapiens
gaaaccagcugaacaauuu

SEQ ID NO: 1129834 - RNA, 19 nt, Homo sapiens
cggcagcgcuuuaagauuu

SEQ ID NO: 1129835 - RNA, 19 nt, Homo sapiens
gaaaucacauguagcagau

SEQ ID NO: 1129836 - RNA, 19 nt, Homo sapiens
caccaugccuggcuaauuu

SEQ ID NO: 1129837 - RNA, 19 nt, Homo sapiens
cagauacgcuuuaacuuga

SEQ ID NO: 1129838 - RNA, 19 nt, Homo sapiens
ugaugacccuuccuuaaua

SEQ ID NO: 1129839 - RNA, 19 nt, Homo sapiens
agucaaacaucauagcuua

SEQ ID NO: 1129840 - RNA, 19 nt, Homo sapiens
gaaagaagaaacaaggaaa

SEQ ID NO: 1129841 - RNA, 19 nt, Homo sapiens
aaacagcucuauauggauu

SEQ ID NO: 1129842 - RNA, 19 nt, Homo sapiens
uuaaacagcucuauaugga

SEQ ID NO: 1129843 - RNA, 19 nt, Homo sapiens
guagaaaucaggacuugua

SEQ ID NO: 1129844 - RNA, 19 nt, Homo sapiens
aaucaggacuuguaaagaa

SEQ ID NO: 1129845 - RNA, 19 nt, Homo sapiens
aaaccucucugaaugauga

SEQ ID NO: 1129846 - RNA, 19 nt, Homo sapiens
ggugaugugugaauauuug

SEQ ID NO: 1129847 - RNA, 19 nt, Homo sapiens
acagaugcuucucaacuua

SEQ ID NO: 1129848 - RNA, 19 nt, Homo sapiens
ggacuucagauacgcuuua

SEQ ID NO: 1129849 - RNA, 19 nt, Homo sapiens
uagcuuagccuaccuuaaa

SEQ ID NO: 1129850 - RNA, 19 nt, Homo sapiens
aagaaucgcuggcaaagga

SEQ ID NO: 1129851 - RNA, 19 nt, Homo sapiens
guaaagaaaccaaggaugu

SEQ ID NO: 1129852 - RNA, 19 nt, Homo sapiens
gaaaucaggacuuguaaag

SEQ ID NO: 1129853 - RNA, 19 nt, Homo sapiens
gauauuuacuccuauugug

SEQ ID NO: 1129854 - RNA, 19 nt, Homo sapiens
gaaugaugacccuuccuua

SEQ ID NO: 1129855 - RNA, 19 nt, Homo sapiens
caagaaaccagcugaacaa

SEQ ID NO: 1129856 - RNA, 19 nt, Homo sapiens
ccagaagcauaaacagaaa

SEQ ID NO: 1129857 - RNA, 19 nt, Homo sapiens
gauggaauccgaaauggaa

SEQ ID NO: 1129858 - RNA, 19 nt, Homo sapiens
uaacagauacacaccauug

SEQ ID NO: 1129859 - RNA, 19 nt, Homo sapiens
caagguuuauggcaauauu

SEQ ID NO: 1129860 - RNA, 19 nt, Homo sapiens
gaaaucaaggaauguagaa

SEQ ID NO: 1129861 - RNA, 19 nt, Homo sapiens
ggaaagaagaaacaaggaa

SEQ ID NO: 1129862 - RNA, 19 nt, Homo sapiens
gaucgauucugauuucaag

SEQ ID NO: 1129863 - RNA, 19 nt, Homo sapiens
uaucugaaaucacauguag

SEQ ID NO: 1129864 - RNA, 19 nt, Homo sapiens
aaagaaaccaaggauguua

SEQ ID NO: 1129865 - RNA, 19 nt, Homo sapiens
ucagauacgcuuuaacuug

SEQ ID NO: 1129866 - RNA, 19 nt, Homo sapiens
ccagauaagcccacuguga

SEQ ID NO: 1129867 - RNA, 19 nt, Homo sapiens
guauacagaugcuucucaa

SEQ ID NO: 1129868 - RNA, 19 nt, Homo sapiens
uuaagaggauucacacuca

SEQ ID NO: 1129869 - RNA, 19 nt, Homo sapiens
gaacaauuucagucauuug

SEQ ID NO: 1129870 - RNA, 19 nt, Homo sapiens
gaacauuugggacuucaga

SEQ ID NO: 1129871 - RNA, 19 nt, Homo sapiens
aaagaaaacuggaugaaga

SEQ ID NO: 1129872 - RNA, 19 nt, Homo sapiens
aaaccaaauucaccauaga

SEQ ID NO: 1129873 - RNA, 19 nt, Homo sapiens
ccaaagugcugggauuaca

SEQ ID NO: 1129874 - RNA, 19 nt, Homo sapiens
gccagaagcauaaacagaa

SEQ ID NO: 1129875 - RNA, 19 nt, Homo sapiens
gauacgcuuuaacuugaaa

SEQ ID NO: 1129876 - RNA, 19 nt, Homo sapiens
gauucacacucaacagguu

SEQ ID NO: 1129877 - RNA, 19 nt, Homo sapiens
gcaaaaucgucuaauacaa

SEQ ID NO: 1129878 - RNA, 19 nt, Homo sapiens
uggaugaccucuuccuaga

SEQ ID NO: 1129879 - RNA, 19 nt, Homo sapiens
gaagaaacaaggaaaauuc

SEQ ID NO: 1129880 - RNA, 19 nt, Homo sapiens
gauacacaccauugaaaga

SEQ ID NO: 1129881 - RNA, 19 nt, Homo sapiens
gcuaacagauacacaccau

SEQ ID NO: 1129882 - RNA, 19 nt, Homo sapiens
acauguagcagauugcaua

SEQ ID NO: 1129883 - RNA, 19 nt, Homo sapiens
ggguuuagguccagauaag

SEQ ID NO: 1129884 - RNA, 19 nt, Homo sapiens
gcaguuucuugcaguuuca

SEQ ID NO: 1129885 - RNA, 19 nt, Homo sapiens
aauacugggugauguguga

SEQ ID NO: 1129886 - RNA, 19 nt, Homo sapiens
gcaaccuaaucuugggaaa

SEQ ID NO: 1129887 - RNA, 19 nt, Homo sapiens
uaaagaaaccaaggauguu

SEQ ID NO: 1129888 - RNA, 19 nt, Homo sapiens
uacagaugcuucucaacuu

SEQ ID NO: 1129889 - RNA, 19 nt, Homo sapiens
cuugaugugugaauauuug

SEQ ID NO: 1129890 - RNA, 19 nt, Homo sapiens
caagaacugccauuugcaa

SEQ ID NO: 1129891 - RNA, 19 nt, Homo sapiens
cagauacacaccauugaaa

SEQ ID NO: 1129892 - RNA, 19 nt, Homo sapiens
gaauauuugagaggucaua

SEQ ID NO: 1129893 - RNA, 19 nt, Homo sapiens
gaugacccuuccuuaauac

SEQ ID NO: 1129894 - RNA, 19 nt, Homo sapiens
gaagaaacgacaggcugaa

SEQ ID NO: 1129895 - RNA, 19 nt, Homo sapiens
uaagaggauucacacucaa

SEQ ID NO: 1129896 - RNA, 19 nt, Homo sapiens
acacggacaaggauaguuu

SEQ ID NO: 1129897 - RNA, 19 nt, Homo sapiens
ccaaauucaccauagagaa

SEQ ID NO: 1129898 - RNA, 19 nt, Homo sapiens
ccuagagucuuuugaaauu

SEQ ID NO: 1129899 - RNA, 19 nt, Homo sapiens
gaacugccauuugcaaccu

SEQ ID NO: 1129900 - RNA, 19 nt, Homo sapiens
gauaagcccacugugaguu

SEQ ID NO: 1129901 - RNA, 19 nt, Homo sapiens
ccauauacaucaguaagag

SEQ ID NO: 1129902 - RNA, 19 nt, Homo sapiens
aaugaugacccuuccuuaa

SEQ ID NO: 1129903 - RNA, 19 nt, Homo sapiens
ggaagaaucgcuggcaaag

SEQ ID NO: 1129904 - RNA, 19 nt, Homo sapiens
caaggaauguagaaaucag

SEQ ID NO: 1129905 - RNA, 19 nt, Homo sapiens
gacuucagauacgcuuuaa

SEQ ID NO: 1129906 - RNA, 19 nt, Homo sapiens
uguagcagauugcauaguc

SEQ ID NO: 1129907 - RNA, 19 nt, Homo sapiens
uacacaccauugaaagaaa

SEQ ID NO: 1129908 - RNA, 19 nt, Homo sapiens
aaccuaaucuugggaaauc

SEQ ID NO: 1129909 - RNA, 19 nt, Homo sapiens
gagaaugugacacggacaa

SEQ ID NO: 1129910 - RNA, 19 nt, Homo sapiens
caacuuaugauggguuuag

SEQ ID NO: 1129911 - RNA, 19 nt, Homo sapiens
agaaaccagcugaacaauu

SEQ ID NO: 1129912 - RNA, 19 nt, Homo sapiens
aaauuccagucccagcuaa

SEQ ID NO: 1129913 - RNA, 19 nt, Homo sapiens
ccaaaagucaaacaucaua

SEQ ID NO: 1129914 - RNA, 19 nt, Homo sapiens
gcuccugagugggaaagaa

SEQ ID NO: 1129915 - RNA, 19 nt, Homo sapiens
acagcucuauauggauuua

SEQ ID NO: 1129916 - RNA, 19 nt, Homo sapiens
aguggucggucacaagaaa

SEQ ID NO: 1129917 - RNA, 19 nt, Homo sapiens
gauguuagugcucugacaa

SEQ ID NO: 1129918 - RNA, 19 nt, Homo sapiens
ggauguuagugcucugaca

SEQ ID NO: 1129919 - RNA, 19 nt, Homo sapiens
ggacuuguaaagaaaccaa

SEQ ID NO: 1129920 - RNA, 19 nt, Homo sapiens
ugaaaucaaggaauguaga

SEQ ID NO: 1129921 - RNA, 19 nt, Homo sapiens
cuacauuagccuacaguug

SEQ ID NO: 1129922 - RNA, 19 nt, Homo sapiens
gcuccgaacacuacauuag

SEQ ID NO: 1129923 - RNA, 19 nt, Homo sapiens
gaugugugaauauuugaga

SEQ ID NO: 1129924 - RNA, 19 nt, Homo sapiens
gccuugaugugugaauauu

SEQ ID NO: 1129925 - RNA, 19 nt, Homo sapiens
ucaacagguuuuaggauaa

SEQ ID NO: 1129926 - RNA, 19 nt, Homo sapiens
gaaacgacaggcugaacag

SEQ ID NO: 1129927 - RNA, 19 nt, Homo sapiens
ggguuaaugugaagaaagc

SEQ ID NO: 1129928 - RNA, 19 nt, Homo sapiens
cuacaucacaggguuaaug

SEQ ID NO: 1129929 - RNA, 19 nt, Homo sapiens
gaccuacaucacaggguua

SEQ ID NO: 1129930 - RNA, 19 nt, Homo sapiens
cuaaagggagaccaucuau

SEQ ID NO: 1129931 - RNA, 19 nt, Homo sapiens
uagaaaucaggacuuguaa

SEQ ID NO: 1129932 - RNA, 19 nt, Homo sapiens
aauguuggguauacagaug

SEQ ID NO: 1129933 - RNA, 19 nt, Homo sapiens
gcauugaucucaccuauga

SEQ ID NO: 1129934 - RNA, 19 nt, Homo sapiens
caacagaugugaaugaaug

SEQ ID NO: 1129935 - RNA, 19 nt, Homo sapiens
uuaacaggcuuuccaauua

SEQ ID NO: 1129936 - RNA, 19 nt, Homo sapiens
gacauuagaugcauaagaa

SEQ ID NO: 1129937 - RNA, 19 nt, Homo sapiens
gguagaagauugacagauu

SEQ ID NO: 1129938 - RNA, 19 nt, Homo sapiens
gcuccaagcuucuuucaaa

SEQ ID NO: 1129939 - RNA, 19 nt, Homo sapiens
gcaaauccaauuccuguua

SEQ ID NO: 1129940 - RNA, 19 nt, Homo sapiens
gcaagugcaucaacagaaa

SEQ ID NO: 1129941 - RNA, 19 nt, Homo sapiens
gaucuuggaugaccauuug

SEQ ID NO: 1129942 - RNA, 19 nt, Homo sapiens
gaucagaaguccacauuag

SEQ ID NO: 1129943 - RNA, 19 nt, Homo sapiens
gaacaucaguauagaucuu

SEQ ID NO: 1129944 - RNA, 19 nt, Homo sapiens
gacagcaucuucucuauug

SEQ ID NO: 1129945 - RNA, 19 nt, Homo sapiens
ggaagaauuucguacaaug

SEQ ID NO: 1129946 - RNA, 19 nt, Homo sapiens
gagcaucuaugauuaggaa

SEQ ID NO: 1129947 - RNA, 19 nt, Homo sapiens
gaagacaggcccauugauu

SEQ ID NO: 1129948 - RNA, 19 nt, Homo sapiens
guauagaucuuuccgguau

SEQ ID NO: 1129949 - RNA, 19 nt, Homo sapiens
uaucaaagcuccauauucu

SEQ ID NO: 1129950 - RNA, 19 nt, Homo sapiens
agagguuucuucacuauua

SEQ ID NO: 1129951 - RNA, 19 nt, Homo sapiens
guagaagauugacagauuu

SEQ ID NO: 1129952 - RNA, 19 nt, Homo sapiens
ccaauuagccuugcuuuaa

SEQ ID NO: 1129953 - RNA, 19 nt, Homo sapiens
cauacaggcuacugaauuu

SEQ ID NO: 1129954 - RNA, 19 nt, Homo sapiens
gaugaggcacuuuauauuu

SEQ ID NO: 1129955 - RNA, 19 nt, Homo sapiens
ggcaagcagugaauaguaa

SEQ ID NO: 1129956 - RNA, 19 nt, Homo sapiens
gcagugcauuuaagaagaa

SEQ ID NO: 1129957 - RNA, 19 nt, Homo sapiens
ccuaugauauccagucuuu

SEQ ID NO: 1129958 - RNA, 19 nt, Homo sapiens
gcaguagcgucaacucuug

SEQ ID NO: 1129959 - RNA, 19 nt, Homo sapiens
ggacuggauuuaugcuuga

SEQ ID NO: 1129960 - RNA, 19 nt, Homo sapiens
cagcagaacuccacauaca

SEQ ID NO: 1129961 - RNA, 19 nt, Homo sapiens
ggaaauucuucuugguauu

SEQ ID NO: 1129962 - RNA, 19 nt, Homo sapiens
ggugaagugugcacaauau

SEQ ID NO: 1129963 - RNA, 19 nt, Homo sapiens
gagguacuguuauuaaugu

SEQ ID NO: 1129964 - RNA, 19 nt, Homo sapiens
ggaggaagugaaagauuua

SEQ ID NO: 1129965 - RNA, 19 nt, Homo sapiens
guuuggcucuuacagauua

SEQ ID NO: 1129966 - RNA, 19 nt, Homo sapiens
gaagaggagaaacucaaua

SEQ ID NO: 1129967 - RNA, 19 nt, Homo sapiens
gaaagcacacucaacagaa

SEQ ID NO: 1129968 - RNA, 19 nt, Homo sapiens
agugauagguaccaucuua

SEQ ID NO: 1129969 - RNA, 19 nt, Homo sapiens
gagccagucuugaucagaa

SEQ ID NO: 1129970 - RNA, 19 nt, Homo sapiens
aacaauaucugccgacuga

SEQ ID NO: 1129971 - RNA, 19 nt, Homo sapiens
gcuggaaccuugggacuuu

SEQ ID NO: 1129972 - RNA, 19 nt, Homo sapiens
aggagaaacucaauacaaa

SEQ ID NO: 1129973 - RNA, 19 nt, Homo sapiens
caacaaacauaucuaaucc

SEQ ID NO: 1129974 - RNA, 19 nt, Homo sapiens
gcaacaaacauaucuaauc

SEQ ID NO: 1129975 - RNA, 19 nt, Homo sapiens
gguaaccgaugaaauuuua

SEQ ID NO: 1129976 - RNA, 19 nt, Homo sapiens
cagaauaccuccuuauagg

SEQ ID NO: 1129977 - RNA, 19 nt, Homo sapiens
caagaaagcacacucaaca

SEQ ID NO: 1129978 - RNA, 19 nt, Homo sapiens
gaaauucucagcauugauc

SEQ ID NO: 1129979 - RNA, 19 nt, Homo sapiens
gauuagcacuacagacuau

SEQ ID NO: 1129980 - RNA, 19 nt, Homo sapiens
gugaaugaaugaaaguuga

SEQ ID NO: 1129981 - RNA, 19 nt, Homo sapiens
gaaacucaauacaaagaca

SEQ ID NO: 1129982 - RNA, 19 nt, Homo sapiens
ggauauucuugccucauaa

SEQ ID NO: 1129983 - RNA, 19 nt, Homo sapiens
gauuuggacuuaagagaug

SEQ ID NO: 1129984 - RNA, 19 nt, Homo sapiens
gguaucagaauuccuuaua

SEQ ID NO: 1129985 - RNA, 19 nt, Homo sapiens
caucuggacuggauuuaug

SEQ ID NO: 1129986 - RNA, 19 nt, Homo sapiens
gguaugacuugaaauagau

SEQ ID NO: 1129987 - RNA, 19 nt, Homo sapiens
caaauccaauuccuguuau

SEQ ID NO: 1129988 - RNA, 19 nt, Homo sapiens
aaacucagcaacaaacaua

SEQ ID NO: 1129989 - RNA, 19 nt, Homo sapiens
gaaauggccaggcacaaau

SEQ ID NO: 1129990 - RNA, 19 nt, Homo sapiens
ggaauauagucauguccuu

SEQ ID NO: 1129991 - RNA, 19 nt, Homo sapiens
uaacaggcuuuccaauuag

SEQ ID NO: 1129992 - RNA, 19 nt, Homo sapiens
gagaaacucaauacaaaga

SEQ ID NO: 1129993 - RNA, 19 nt, Homo sapiens
gaggagaaacucaauacaa

SEQ ID NO: 1129994 - RNA, 19 nt, Homo sapiens
gcacacaguaugcuuaugu

SEQ ID NO: 1129995 - RNA, 19 nt, Homo sapiens
gagaugacagucuacuuaa

SEQ ID NO: 1129996 - RNA, 19 nt, Homo sapiens
cuuaagagaugacagucua

SEQ ID NO: 1129997 - RNA, 19 nt, Homo sapiens
gcacaaaacaccaaauauu

SEQ ID NO: 1129998 - RNA, 19 nt, Homo sapiens
gaagauugacagauuugaa

SEQ ID NO: 1129999 - RNA, 19 nt, Homo sapiens
agagaugacagucuacuua

SEQ ID NO: 1130000 - RNA, 19 nt, Homo sapiens
gaguggaguuugcuuuguu

SEQ ID NO: 1130001 - RNA, 19 nt, Homo sapiens
caccauuacuuucugauau

SEQ ID NO: 1130002 - RNA, 19 nt, Homo sapiens
ucuaaaccaugaugugaaa

SEQ ID NO: 1130003 - RNA, 19 nt, Homo sapiens
uaucuguacuccugguaua

SEQ ID NO: 1130004 - RNA, 19 nt, Homo sapiens
gaugaaacaccacauuuua

SEQ ID NO: 1130005 - RNA, 19 nt, Homo sapiens
gagguuucuucacuauuaa

SEQ ID NO: 1130006 - RNA, 19 nt, Homo sapiens
ucagaaguccacauuagua

SEQ ID NO: 1130007 - RNA, 19 nt, Homo sapiens
gacuagguaugacuugaaa

SEQ ID NO: 1130008 - RNA, 19 nt, Homo sapiens
gacugaaccuguugucuuc

SEQ ID NO: 1130009 - RNA, 19 nt, Homo sapiens
ggucaugauugaggaguuu

SEQ ID NO: 1130010 - RNA, 19 nt, Homo sapiens
gguaccaucuuaugccuau

SEQ ID NO: 1130011 - RNA, 19 nt, Homo sapiens
aggaggaagugaaagauuu

SEQ ID NO: 1130012 - RNA, 19 nt, Homo sapiens
caaauuuagucuggucauu

SEQ ID NO: 1130013 - RNA, 19 nt, Homo sapiens
uaaaacagguugaaugguu

SEQ ID NO: 1130014 - RNA, 19 nt, Homo sapiens
gaagaaaggaccaagaaaa

SEQ ID NO: 1130015 - RNA, 19 nt, Homo sapiens
caacagaagguagaagauu

SEQ ID NO: 1130016 - RNA, 19 nt, Homo sapiens
gaauauagucauguccuuu

SEQ ID NO: 1130017 - RNA, 19 nt, Homo sapiens
caauuccuguuaucaagaa

SEQ ID NO: 1130018 - RNA, 19 nt, Homo sapiens
gcauuaaacgaaaguauuc

SEQ ID NO: 1130019 - RNA, 19 nt, Homo sapiens
caaagaaaauccugauaug

SEQ ID NO: 1130020 - RNA, 19 nt, Homo sapiens
ccaggauggucaugauuga

SEQ ID NO: 1130021 - RNA, 19 nt, Homo sapiens
ccacauacaacgugucuau

SEQ ID NO: 1130022 - RNA, 19 nt, Homo sapiens
cuagguaugacuugaaaua

SEQ ID NO: 1130023 - RNA, 19 nt, Homo sapiens
ucaggaaacucagcaacaa

SEQ ID NO: 1130024 - RNA, 19 nt, Homo sapiens
aagacaggcccauugauua

SEQ ID NO: 1130025 - RNA, 19 nt, Homo sapiens
cagcauugaucucaccuau

SEQ ID NO: 1130026 - RNA, 19 nt, Homo sapiens
gaagaauuucguacaaugu

SEQ ID NO: 1130027 - RNA, 19 nt, Homo sapiens
cauacaacgugucuauuuc

SEQ ID NO: 1130028 - RNA, 19 nt, Homo sapiens
cauauucucuuguccucaa

SEQ ID NO: 1130029 - RNA, 19 nt, Homo sapiens
guagaacuguuuuagagua

SEQ ID NO: 1130030 - RNA, 19 nt, Homo sapiens
gggaaaauaugcaauacaa

SEQ ID NO: 1130031 - RNA, 19 nt, Homo sapiens
aaguacaacuccauuagaa

SEQ ID NO: 1130032 - RNA, 19 nt, Homo sapiens
gacaaguacaacuccauua

SEQ ID NO: 1130033 - RNA, 19 nt, Homo sapiens
ccacuuaacuuguuuguug

SEQ ID NO: 1130034 - RNA, 19 nt, Homo sapiens
ggacuuggaugccugcaaa

SEQ ID NO: 1130035 - RNA, 19 nt, Homo sapiens
ggaagacacugaucaaggu

SEQ ID NO: 1130036 - RNA, 19 nt, Homo sapiens
ggaagaccaucucgaagga

SEQ ID NO: 1130037 - RNA, 19 nt, Homo sapiens
gagacuagaccucguaauu

SEQ ID NO: 1130038 - RNA, 19 nt, Homo sapiens
gcaaagcgaggcugaagaa

SEQ ID NO: 1130039 - RNA, 19 nt, Homo sapiens
agacuagaccucguaauua

SEQ ID NO: 1130040 - RNA, 19 nt, Homo sapiens
gcaaagcucgggugcucua

SEQ ID NO: 1130041 - RNA, 19 nt, Homo sapiens
gacuagaccucguaauuac

SEQ ID NO: 1130042 - RNA, 19 nt, Homo sapiens
gacccugacuggcucauug

SEQ ID NO: 1130043 - RNA, 19 nt, Homo sapiens
gcucuggaaugaugaagug

SEQ ID NO: 1130044 - RNA, 19 nt, Homo sapiens
ggacagagaagaucuugag

SEQ ID NO: 1130045 - RNA, 19 nt, Homo sapiens
ccaauaaaccguccuugug

SEQ ID NO: 1130046 - RNA, 19 nt, Homo sapiens
ugacacaguuguucagagu

SEQ ID NO: 1130047 - RNA, 19 nt, Homo sapiens
ccacgacggugccugacuu

SEQ ID NO: 1130048 - RNA, 19 nt, Homo sapiens
caauaaaccguccuugugu

SEQ ID NO: 1130049 - RNA, 19 nt, Homo sapiens
augagaagcuggacaggaa

SEQ ID NO: 1130050 - RNA, 19 nt, Homo sapiens
accaagaacuggacagaga

SEQ ID NO: 1130051 - RNA, 19 nt, Homo sapiens
gggcagacagcaccaagaa

SEQ ID NO: 1130052 - RNA, 19 nt, Homo sapiens
aagcucgggugcucuauga

SEQ ID NO: 1130053 - RNA, 19 nt, Homo sapiens
gaacuggacagagaagauc

SEQ ID NO: 1130054 - RNA, 19 nt, Homo sapiens
gcagacagcaccaagaacu

SEQ ID NO: 1130055 - RNA, 19 nt, Homo sapiens
ugagcuugaugcccacuuu

SEQ ID NO: 1130056 - RNA, 19 nt, Homo sapiens
ggaaugaugaaguggacaa

SEQ ID NO: 1130057 - RNA, 19 nt, Homo sapiens
agaagugacccgucucuug

SEQ ID NO: 1130058 - RNA, 19 nt, Homo sapiens
ccuccgcgcucuggaauga

SEQ ID NO: 1130059 - RNA, 19 nt, Homo sapiens
caagguggcagaagcugaa

SEQ ID NO: 1130060 - RNA, 19 nt, Homo sapiens
ugagaagacugagcuugau

SEQ ID NO: 1130061 - RNA, 19 nt, Homo sapiens
gcaguucacggaggagaaa

SEQ ID NO: 1130062 - RNA, 19 nt, Homo sapiens
cgacggugccugacuuuca

SEQ ID NO: 1130063 - RNA, 19 nt, Homo sapiens
ggcagaagcugaaaagcaa

SEQ ID NO: 1130064 - RNA, 19 nt, Homo sapiens
gcaccaagaacuggacaga

SEQ ID NO: 1130065 - RNA, 19 nt, Homo sapiens
gcugcuggcucaguacaug

SEQ ID NO: 1130066 - RNA, 19 nt, Homo sapiens
cgagagcccugccuuucag

SEQ ID NO: 1130067 - RNA, 19 nt, Homo sapiens
gcgagagcccugccuuuca

SEQ ID NO: 1130068 - RNA, 19 nt, Homo sapiens
gagaagacugagcuugaug

SEQ ID NO: 1130069 - RNA, 19 nt, Homo sapiens
gccaauaaaccguccuugu

SEQ ID NO: 1130070 - RNA, 19 nt, Homo sapiens
cuucaccucuccacacuca

SEQ ID NO: 1130071 - RNA, 19 nt, Homo sapiens
acuuggaacugcucagcua

SEQ ID NO: 1130072 - RNA, 19 nt, Homo sapiens
gagcccugccuuucaguug

SEQ ID NO: 1130073 - RNA, 19 nt, Homo sapiens
ccacugcugcggccacuau

SEQ ID NO: 1130074 - RNA, 19 nt, Homo sapiens
ccaagaacuggacagagaa

SEQ ID NO: 1130075 - RNA, 19 nt, Homo sapiens
guucacggaggagaaauuu

SEQ ID NO: 1130076 - RNA, 19 nt, Homo sapiens
ucacggaggagaaauuugg

SEQ ID NO: 1130077 - RNA, 19 nt, Homo sapiens
uuugcucucuagccaauaa

SEQ ID NO: 1130078 - RNA, 19 nt, Homo sapiens
ccuccaggcuccacuaagg

SEQ ID NO: 1130079 - RNA, 19 nt, Homo sapiens
gaaggccaaggcugcagaa

SEQ ID NO: 1130080 - RNA, 19 nt, Homo sapiens
aaaccggcgucuggacuug

SEQ ID NO: 1130081 - RNA, 19 nt, Homo sapiens
cugagaagacugagcuuga

SEQ ID NO: 1130082 - RNA, 19 nt, Homo sapiens
caguagcacucacgugaac

SEQ ID NO: 1130083 - RNA, 19 nt, Homo sapiens
caggagacuagaccucgua

SEQ ID NO: 1130084 - RNA, 19 nt, Homo sapiens
cagcgagagcccugccuuu

SEQ ID NO: 1130085 - RNA, 19 nt, Homo sapiens
gcagaagugacccgucucu

SEQ ID NO: 1130086 - RNA, 19 nt, Homo sapiens
gcuugaugcccacuuugaa

SEQ ID NO: 1130087 - RNA, 19 nt, Homo sapiens
guuuguuggugacacaguu

SEQ ID NO: 1130088 - RNA, 19 nt, Homo sapiens
ccucguaauuacauucucu

SEQ ID NO: 1130089 - RNA, 19 nt, Homo sapiens
gagcuugaugcccacuuug

SEQ ID NO: 1130090 - RNA, 19 nt, Homo sapiens
cguuugcucucuagccaau

SEQ ID NO: 1130091 - RNA, 19 nt, Homo sapiens
ccgcagaugggcucaggaa

SEQ ID NO: 1130092 - RNA, 19 nt, Homo sapiens
ucacagcucaagccaaguc

SEQ ID NO: 1130093 - RNA, 19 nt, Homo sapiens
gccacaugcuggacuugca

SEQ ID NO: 1130094 - RNA, 19 nt, Homo sapiens
ggcacgccauggacuucaa

SEQ ID NO: 1130095 - RNA, 19 nt, Homo sapiens
ucacacccuugcgcaacuu

SEQ ID NO: 1130096 - RNA, 19 nt, Homo sapiens
gaucaagguggcagaagcu

SEQ ID NO: 1130097 - RNA, 19 nt, Homo sapiens
gauaauaccuacccacaaa

SEQ ID NO: 1130098 - RNA, 19 nt, Homo sapiens
gaucuuccauugagaauaa

SEQ ID NO: 1130099 - RNA, 19 nt, Homo sapiens
gaaaucagguuacaaagca

SEQ ID NO: 1130100 - RNA, 19 nt, Homo sapiens
guauagaucuguccuguga

SEQ ID NO: 1130101 - RNA, 19 nt, Homo sapiens
caucuacccuugacuauuu

SEQ ID NO: 1130102 - RNA, 19 nt, Homo sapiens
caaaugcucugaugugcua

SEQ ID NO: 1130103 - RNA, 19 nt, Homo sapiens
caagauaauuugacaguug

SEQ ID NO: 1130104 - RNA, 19 nt, Homo sapiens
uagaagaacuugcauguau

SEQ ID NO: 1130105 - RNA, 19 nt, Homo sapiens
gaauaucccuacucuucua

SEQ ID NO: 1130106 - RNA, 19 nt, Homo sapiens
gaagaaggcccagugcaua

SEQ ID NO: 1130107 - RNA, 19 nt, Homo sapiens
cuacaggacuugacauuug

SEQ ID NO: 1130108 - RNA, 19 nt, Homo sapiens
cagcaacacuuccuaauca

SEQ ID NO: 1130109 - RNA, 19 nt, Homo sapiens
gaagaacuugcauguauuu

SEQ ID NO: 1130110 - RNA, 19 nt, Homo sapiens
guacuacauuucuaacgua

SEQ ID NO: 1130111 - RNA, 19 nt, Homo sapiens
gauaauccaucuaauacug

SEQ ID NO: 1130112 - RNA, 19 nt, Homo sapiens
caucugcucugaccacuuu

SEQ ID NO: 1130113 - RNA, 19 nt, Homo sapiens
guagaaaucagguuacaaa

SEQ ID NO: 1130114 - RNA, 19 nt, Homo sapiens
gagcauuucugaugaaucu

SEQ ID NO: 1130115 - RNA, 19 nt, Homo sapiens
gcugauaauccaucuaaua

SEQ ID NO: 1130116 - RNA, 19 nt, Homo sapiens
caccucauaugucuucuua

SEQ ID NO: 1130117 - RNA, 19 nt, Homo sapiens
ggacaucuacccuugacua

SEQ ID NO: 1130118 - RNA, 19 nt, Homo sapiens
ccacaaacaucccuauucu

SEQ ID NO: 1130119 - RNA, 19 nt, Homo sapiens
gaauuguggucuagaacuu

SEQ ID NO: 1130120 - RNA, 19 nt, Homo sapiens
gcucugaugugcuauagau

SEQ ID NO: 1130121 - RNA, 19 nt, Homo sapiens
cagagugauuugucuuaua

SEQ ID NO: 1130122 - RNA, 19 nt, Homo sapiens
gacauuuacuccagugauu

SEQ ID NO: 1130123 - RNA, 19 nt, Homo sapiens
ucccuacucuucuaaauaa

SEQ ID NO: 1130124 - RNA, 19 nt, Homo sapiens
gaacuuccucucucuuuga

SEQ ID NO: 1130125 - RNA, 19 nt, Homo sapiens
ucauaugucuucuuaguuc

SEQ ID NO: 1130126 - RNA, 19 nt, Homo sapiens
gaggaauuguggucuagaa

SEQ ID NO: 1130127 - RNA, 19 nt, Homo sapiens
guaaaucuuucacuucaag

SEQ ID NO: 1130128 - RNA, 19 nt, Homo sapiens
uaacucugaucuuccauug

SEQ ID NO: 1130129 - RNA, 19 nt, Homo sapiens
cuacauuucuaacguauuc

SEQ ID NO: 1130130 - RNA, 19 nt, Homo sapiens
aaacaucccuauucucuac

SEQ ID NO: 1130131 - RNA, 19 nt, Homo sapiens
uagaauaucccuacucuuc

SEQ ID NO: 1130132 - RNA, 19 nt, Homo sapiens
ggaaucaauuuagagauag

SEQ ID NO: 1130133 - RNA, 19 nt, Homo sapiens
gacauuugcuaguuagaau

SEQ ID NO: 1130134 - RNA, 19 nt, Homo sapiens
gaaaucuguuugcaucagu

SEQ ID NO: 1130135 - RNA, 19 nt, Homo sapiens
agaagaacuugcauguauu

SEQ ID NO: 1130136 - RNA, 19 nt, Homo sapiens
gaacagagugauuugucuu

SEQ ID NO: 1130137 - RNA, 19 nt, Homo sapiens
ccucauaugucuucuuagu

SEQ ID NO: 1130138 - RNA, 19 nt, Homo sapiens
ccaacacaaugaagauaau

SEQ ID NO: 1130139 - RNA, 19 nt, Homo sapiens
gcugcagcuucacagauua

SEQ ID NO: 1130140 - RNA, 19 nt, Homo sapiens
accaugaaguaaacuguua

SEQ ID NO: 1130141 - RNA, 19 nt, Homo sapiens
ggcugcagcuucacagauu

SEQ ID NO: 1130142 - RNA, 19 nt, Homo sapiens
ggugaaagaagaaacaugu

SEQ ID NO: 1130143 - RNA, 19 nt, Homo sapiens
gaucuguccugugagcauu

SEQ ID NO: 1130144 - RNA, 19 nt, Homo sapiens
guuagaauaucccuacucu

SEQ ID NO: 1130145 - RNA, 19 nt, Homo sapiens
gcaacacuuccuaaucaaa

SEQ ID NO: 1130146 - RNA, 19 nt, Homo sapiens
caacaccucucuuuugaau

SEQ ID NO: 1130147 - RNA, 19 nt, Homo sapiens
cagcauaauuuguuuagcu

SEQ ID NO: 1130148 - RNA, 19 nt, Homo sapiens
ucucuucgguuauccagaa

SEQ ID NO: 1130149 - RNA, 19 nt, Homo sapiens
gccugacacuacuaaauga

SEQ ID NO: 1130150 - RNA, 19 nt, Homo sapiens
gccaacacaaugaagauaa

SEQ ID NO: 1130151 - RNA, 19 nt, Homo sapiens
uaucaagagugaacagagu

SEQ ID NO: 1130152 - RNA, 19 nt, Homo sapiens
acagaggaauuguggucua

SEQ ID NO: 1130153 - RNA, 19 nt, Homo sapiens
caucuaauacugucacuuc

SEQ ID NO: 1130154 - RNA, 19 nt, Homo sapiens
uuugacgucucuucgguua

SEQ ID NO: 1130155 - RNA, 19 nt, Homo sapiens
acaguugaguaucagcaua

SEQ ID NO: 1130156 - RNA, 19 nt, Homo sapiens
ucugagaagcauacuauaa

SEQ ID NO: 1130157 - RNA, 19 nt, Homo sapiens
ugagaaauaagcauggaaa

SEQ ID NO: 1130158 - RNA, 19 nt, Homo sapiens
gacuugacauuugcuaguu

SEQ ID NO: 1130159 - RNA, 19 nt, Homo sapiens
aaucuaugguucuuacaga

SEQ ID NO: 1130160 - RNA, 19 nt, Homo sapiens
ggacuugacauuugcuagu

SEQ ID NO: 1130161 - RNA, 19 nt, Homo sapiens
uaugucugcuuuaaggaaa

SEQ ID NO: 1130162 - RNA, 19 nt, Homo sapiens
uugcagguguuagguauuu

SEQ ID NO: 1130163 - RNA, 19 nt, Homo sapiens
auagagcaguaacacagua

SEQ ID NO: 1130164 - RNA, 19 nt, Homo sapiens
uguuuaagcuuaguucaga

SEQ ID NO: 1130165 - RNA, 19 nt, Homo sapiens
ugacgucucuucgguuauc

SEQ ID NO: 1130166 - RNA, 19 nt, Homo sapiens
uugaaaguauagagcagua

SEQ ID NO: 1130167 - RNA, 19 nt, Homo sapiens
acugggauaucaagaguga

SEQ ID NO: 1130168 - RNA, 19 nt, Homo sapiens
uaaugcaacuacucagaca

SEQ ID NO: 1130169 - RNA, 19 nt, Homo sapiens
cauugcagguguuagguau

SEQ ID NO: 1130170 - RNA, 19 nt, Homo sapiens
gcauuucugaugaaucuau

SEQ ID NO: 1130171 - RNA, 19 nt, Homo sapiens
gcaguaacacaguaacagu

SEQ ID NO: 1130172 - RNA, 19 nt, Homo sapiens
caaacaucccuauucucua

SEQ ID NO: 1130173 - RNA, 19 nt, Homo sapiens
acaaacaucccuauucucu

SEQ ID NO: 1130174 - RNA, 19 nt, Homo sapiens
gguauucaagccaaaguga

SEQ ID NO: 1130175 - RNA, 19 nt, Homo sapiens
aagaaggcccagugcauaa

SEQ ID NO: 1130176 - RNA, 19 nt, Homo sapiens
cacaauaucagcaacacuu

SEQ ID NO: 1130177 - RNA, 19 nt, Homo sapiens
ccucucucuuugacauuua

SEQ ID NO: 1130178 - RNA, 19 nt, Homo sapiens
uagaacuuccucucucuuu

SEQ ID NO: 1130179 - RNA, 19 nt, Homo sapiens
uacuauaacucugaucuuc

SEQ ID NO: 1130180 - RNA, 19 nt, Homo sapiens
ugagaagcauacuauaacu

SEQ ID NO: 1130181 - RNA, 19 nt, Homo sapiens
gagaaauaagcauggaaau

SEQ ID NO: 1130182 - RNA, 19 nt, Homo sapiens
caaaggaaucaauuuagag

SEQ ID NO: 1130183 - RNA, 19 nt, Homo sapiens
agacugggauaucaagagu

SEQ ID NO: 1130184 - RNA, 19 nt, Homo sapiens
uuacuccagugauucagaa

SEQ ID NO: 1130185 - RNA, 19 nt, Homo sapiens
agaacuuccucucucuuug

SEQ ID NO: 1130186 - RNA, 19 nt, Homo sapiens
gaaaaugaacuugugcaaa

SEQ ID NO: 1130187 - RNA, 19 nt, Homo sapiens
aaaaugaacuugugcaaac

SEQ ID NO: 1130188 - RNA, 19 nt, Homo sapiens
gaaaguauagagcaguaac

SEQ ID NO: 1130189 - RNA, 19 nt, Homo sapiens
ucugaugugcuauagauuu

SEQ ID NO: 1130190 - RNA, 19 nt, Homo sapiens
cuacucagacagaggaauu

SEQ ID NO: 1130191 - RNA, 19 nt, Homo sapiens
ugaacagagugauuugucu

SEQ ID NO: 1130192 - RNA, 19 nt, Homo sapiens
agagugaacagagugauuu

SEQ ID NO: 1130193 - RNA, 19 nt, Homo sapiens
aaagugaaagcguuuggaa

SEQ ID NO: 1130194 - RNA, 19 nt, Homo sapiens
acucugaucuuccauugag

SEQ ID NO: 1130195 - RNA, 19 nt, Homo sapiens
ccugugagcauuucugaug

SEQ ID NO: 1130196 - RNA, 19 nt, Homo sapiens
ccaagccugacacuacuaa

SEQ ID NO: 1130197 - RNA, 19 nt, Homo sapiens
aaacauagcuggauuaaga

SEQ ID NO: 1130198 - RNA, 19 nt, Homo sapiens
ggacaaaguuaacagcuua

SEQ ID NO: 1130199 - RNA, 19 nt, Homo sapiens
gaaagaaagucaaucugua

SEQ ID NO: 1130200 - RNA, 19 nt, Homo sapiens
ggaaugaccuuuacaacuu

SEQ ID NO: 1130201 - RNA, 19 nt, Homo sapiens
gaggaugucuuuauucuaa

SEQ ID NO: 1130202 - RNA, 19 nt, Homo sapiens
gaacaucucucgugucaca

SEQ ID NO: 1130203 - RNA, 19 nt, Homo sapiens
gcucaaagaugacagauug

SEQ ID NO: 1130204 - RNA, 19 nt, Homo sapiens
gaaauaagcuagggaaaca

SEQ ID NO: 1130205 - RNA, 19 nt, Homo sapiens
gaacaaaucuagcuaacag

SEQ ID NO: 1130206 - RNA, 19 nt, Homo sapiens
gcaugcauuucguuuauua

SEQ ID NO: 1130207 - RNA, 19 nt, Homo sapiens
gaacagaugcaaucaguga

SEQ ID NO: 1130208 - RNA, 19 nt, Homo sapiens
gacaugagaaguaugauua

SEQ ID NO: 1130209 - RNA, 19 nt, Homo sapiens
gaaugaccuuuacaacuuu

SEQ ID NO: 1130210 - RNA, 19 nt, Homo sapiens
gaagacaggacaaaguuaa

SEQ ID NO: 1130211 - RNA, 19 nt, Homo sapiens
gaacacuauuccuauaaga

SEQ ID NO: 1130212 - RNA, 19 nt, Homo sapiens
agaaagcguuguuaaugua

SEQ ID NO: 1130213 - RNA, 19 nt, Homo sapiens
gcauauauguccuacuuca

SEQ ID NO: 1130214 - RNA, 19 nt, Homo sapiens
gugcauauauguccuacuu

SEQ ID NO: 1130215 - RNA, 19 nt, Homo sapiens
caguaaagacucaguauaa

SEQ ID NO: 1130216 - RNA, 19 nt, Homo sapiens
gauaggagaugaaaaguug

SEQ ID NO: 1130217 - RNA, 19 nt, Homo sapiens
caagaaaucuggaaaacuu

SEQ ID NO: 1130218 - RNA, 19 nt, Homo sapiens
gcaccagcaucccuacuug

SEQ ID NO: 1130219 - RNA, 19 nt, Homo sapiens
gcaguaaagacucaguaua

SEQ ID NO: 1130220 - RNA, 19 nt, Homo sapiens
ggaagacaggacaaaguua

SEQ ID NO: 1130221 - RNA, 19 nt, Homo sapiens
aaguugagcuuaaugcuuu

SEQ ID NO: 1130222 - RNA, 19 nt, Homo sapiens
ggagacaugagaaguauga

SEQ ID NO: 1130223 - RNA, 19 nt, Homo sapiens
ggaggcagcaucacuuauu

SEQ ID NO: 1130224 - RNA, 19 nt, Homo sapiens
ggaguuaauuauagaaugg

SEQ ID NO: 1130225 - RNA, 19 nt, Homo sapiens
cagaagagcuaacaauugc

SEQ ID NO: 1130226 - RNA, 19 nt, Homo sapiens
ucagugggcuuuaaaauuu

SEQ ID NO: 1130227 - RNA, 19 nt, Homo sapiens
caaggaauguguagcagau

SEQ ID NO: 1130228 - RNA, 19 nt, Homo sapiens
gugcaugcauuucguuuau

SEQ ID NO: 1130229 - RNA, 19 nt, Homo sapiens
gcaaacauagcuggauuaa

SEQ ID NO: 1130230 - RNA, 19 nt, Homo sapiens
aaacacgucucaccacugu

SEQ ID NO: 1130231 - RNA, 19 nt, Homo sapiens
guauaggaauucccaugaa

SEQ ID NO: 1130232 - RNA, 19 nt, Homo sapiens
gcuagaaaucuguggguua

SEQ ID NO: 1130233 - RNA, 19 nt, Homo sapiens
gcauuucguuuauuagcaa

SEQ ID NO: 1130234 - RNA, 19 nt, Homo sapiens
gaggcagcaucacuuauug

SEQ ID NO: 1130235 - RNA, 19 nt, Homo sapiens
gaaagcguuguuaauguaa

SEQ ID NO: 1130236 - RNA, 19 nt, Homo sapiens
cagaacagaugcaaucagu

SEQ ID NO: 1130237 - RNA, 19 nt, Homo sapiens
gaggcucagugaaguauau

SEQ ID NO: 1130238 - RNA, 19 nt, Homo sapiens
uagaauggguuauuguugu

SEQ ID NO: 1130239 - RNA, 19 nt, Homo sapiens
aaagaaagcguuguuaaug

SEQ ID NO: 1130240 - RNA, 19 nt, Homo sapiens
gcuaacaauugcuggaaug

SEQ ID NO: 1130241 - RNA, 19 nt, Homo sapiens
cuagaaaucuguggguuau

SEQ ID NO: 1130242 - RNA, 19 nt, Homo sapiens
guagagcuguuccuuugga

SEQ ID NO: 1130243 - RNA, 19 nt, Homo sapiens
uagcaaacauagcuggauu

SEQ ID NO: 1130244 - RNA, 19 nt, Homo sapiens
gggaggaugucuuuauucu

SEQ ID NO: 1130245 - RNA, 19 nt, Homo sapiens
uaauugguaucccuccuaa

SEQ ID NO: 1130246 - RNA, 19 nt, Homo sapiens
aagaaagcguuguuaaugu

SEQ ID NO: 1130247 - RNA, 19 nt, Homo sapiens
auucacagcuuccucauga

SEQ ID NO: 1130248 - RNA, 19 nt, Homo sapiens
gcauuguucuuuaguugga

SEQ ID NO: 1130249 - RNA, 19 nt, Homo sapiens
gcucauuuggguaaacuua

SEQ ID NO: 1130250 - RNA, 19 nt, Homo sapiens
gaugaaacaauauccaaug

SEQ ID NO: 1130251 - RNA, 19 nt, Homo sapiens
gcaagcacgucgcguuugg

SEQ ID NO: 1130252 - RNA, 19 nt, Homo sapiens
gaacagauuggagauagga

SEQ ID NO: 1130253 - RNA, 19 nt, Homo sapiens
guggaggaguuaauuauag

SEQ ID NO: 1130254 - RNA, 19 nt, Homo sapiens
gagcaagcacgucgcguuu

SEQ ID NO: 1130255 - RNA, 19 nt, Homo sapiens
cgaaagaaagucaaucugu

SEQ ID NO: 1130256 - RNA, 19 nt, Homo sapiens
gugaaugaacuagguaaua

SEQ ID NO: 1130257 - RNA, 19 nt, Homo sapiens
ggaugucuuuauucuaaug

SEQ ID NO: 1130258 - RNA, 19 nt, Homo sapiens
gauuggagauaggagauga

SEQ ID NO: 1130259 - RNA, 19 nt, Homo sapiens
cucaugaaguuacagauuu

SEQ ID NO: 1130260 - RNA, 19 nt, Homo sapiens
gugguaagcuagguucauu

SEQ ID NO: 1130261 - RNA, 19 nt, Homo sapiens
uauauugacugauguuugg

SEQ ID NO: 1130262 - RNA, 19 nt, Homo sapiens
aauccaaaguugagcuuaa

SEQ ID NO: 1130263 - RNA, 19 nt, Homo sapiens
ucagaagagcuaacaauug

SEQ ID NO: 1130264 - RNA, 19 nt, Homo sapiens
gaaugcagaggcucaguga

SEQ ID NO: 1130265 - RNA, 19 nt, Homo sapiens
gcaggugcaucaguuacuu

SEQ ID NO: 1130266 - RNA, 19 nt, Homo sapiens
ugguaucccuccuaacuuu

SEQ ID NO: 1130267 - RNA, 19 nt, Homo sapiens
aaggaaagcucuccaacca

SEQ ID NO: 1130268 - RNA, 19 nt, Homo sapiens
ggaagugcaugcauuucgu

SEQ ID NO: 1130269 - RNA, 19 nt, Homo sapiens
gcagaggcucagugaagua

SEQ ID NO: 1130270 - RNA, 19 nt, Homo sapiens
cuguagagcuguuccuuug

SEQ ID NO: 1130271 - RNA, 19 nt, Homo sapiens
ccagagcucauuuggguaa

SEQ ID NO: 1130272 - RNA, 19 nt, Homo sapiens
ggaaugugacccugaagga

SEQ ID NO: 1130273 - RNA, 19 nt, Homo sapiens
ugagauauuugggcuuuau

SEQ ID NO: 1130274 - RNA, 19 nt, Homo sapiens
aaacagucauuuacgaaag

SEQ ID NO: 1130275 - RNA, 19 nt, Homo sapiens
gaaaaucaguuagaaccaa

SEQ ID NO: 1130276 - RNA, 19 nt, Homo sapiens
aaaucuagcuaacagugaa

SEQ ID NO: 1130277 - RNA, 19 nt, Homo sapiens
guuaacaucuguagcuuuu

SEQ ID NO: 1130278 - RNA, 19 nt, Homo sapiens
ucugugaguugaggacuua

SEQ ID NO: 1130279 - RNA, 19 nt, Homo sapiens
gcucuuaauucugugaguu

SEQ ID NO: 1130280 - RNA, 19 nt, Homo sapiens
guaaagcuguaugccauca

SEQ ID NO: 1130281 - RNA, 19 nt, Homo sapiens
cuuggaagcuggcaggauu

SEQ ID NO: 1130282 - RNA, 19 nt, Homo sapiens
ugacagaacagaugcaauc

SEQ ID NO: 1130283 - RNA, 19 nt, Homo sapiens
uagggcagcucuuugugaa

SEQ ID NO: 1130284 - RNA, 19 nt, Homo sapiens
uuacuucucuggacugauc

SEQ ID NO: 1130285 - RNA, 19 nt, Homo sapiens
ucaguuagaaccaauguau

SEQ ID NO: 1130286 - RNA, 19 nt, Homo sapiens
ucugucaacucucucauug

SEQ ID NO: 1130287 - RNA, 19 nt, Homo sapiens
ucucuggacugauccuauu

SEQ ID NO: 1130288 - RNA, 19 nt, Homo sapiens
cgugagauauuugggcuuu

SEQ ID NO: 1130289 - RNA, 19 nt, Homo sapiens
aagucaaucuguauccuaa

SEQ ID NO: 1130290 - RNA, 19 nt, Homo sapiens
ggagaaaggggauugaaaa

SEQ ID NO: 1130291 - RNA, 19 nt, Homo sapiens
ucagugaaguauauaugug

SEQ ID NO: 1130292 - RNA, 19 nt, Homo sapiens
gaggcauuguucuuuaguu

SEQ ID NO: 1130293 - RNA, 19 nt, Homo sapiens
gaauggguuauuguuguua

SEQ ID NO: 1130294 - RNA, 19 nt, Homo sapiens
uuaaugggauugucuuucu

SEQ ID NO: 1130295 - RNA, 19 nt, Homo sapiens
uaucagagugcauauaugu

SEQ ID NO: 1130296 - RNA, 19 nt, Homo sapiens
caugaauuaugacuucuca

SEQ ID NO: 1130297 - RNA, 19 nt, Homo sapiens
gauguaaucuugucucaaa

SEQ ID NO: 1130298 - RNA, 19 nt, Homo sapiens
ccaagaauauggagauuaa

SEQ ID NO: 1130299 - RNA, 19 nt, Homo sapiens
gaagaaggcuacauuugug

SEQ ID NO: 1130300 - RNA, 19 nt, Homo sapiens
gaauggcuuugacuacuua

SEQ ID NO: 1130301 - RNA, 19 nt, Homo sapiens
gcacccaccuuuaccagua

SEQ ID NO: 1130302 - RNA, 19 nt, Homo sapiens
guaaugauuucacuccuaa

SEQ ID NO: 1130303 - RNA, 19 nt, Homo sapiens
gcacacacaugcacaagug

SEQ ID NO: 1130304 - RNA, 19 nt, Homo sapiens
caaagcaaguuuccuguga

SEQ ID NO: 1130305 - RNA, 19 nt, Homo sapiens
gggaaauggugauggauaa

SEQ ID NO: 1130306 - RNA, 19 nt, Homo sapiens
gagacuaacuuaaacacuu

SEQ ID NO: 1130307 - RNA, 19 nt, Homo sapiens
gcacauggccacucugaaa

SEQ ID NO: 1130308 - RNA, 19 nt, Homo sapiens
ucacugagcuaaucuggaa

SEQ ID NO: 1130309 - RNA, 19 nt, Homo sapiens
ccagggacaugaauuugua

SEQ ID NO: 1130310 - RNA, 19 nt, Homo sapiens
uaacugaugucccauuuca

SEQ ID NO: 1130311 - RNA, 19 nt, Homo sapiens
gcagagaucuauuaaugag

SEQ ID NO: 1130312 - RNA, 19 nt, Homo sapiens
gaacgauacuuggcuaugu

SEQ ID NO: 1130313 - RNA, 19 nt, Homo sapiens
cuagagacaugaaguuauu

SEQ ID NO: 1130314 - RNA, 19 nt, Homo sapiens
gaaggcaucugcuguaacu

SEQ ID NO: 1130315 - RNA, 19 nt, Homo sapiens
gagcuaaucuggaacaaac

SEQ ID NO: 1130316 - RNA, 19 nt, Homo sapiens
gcaauuugauucugcacuu

SEQ ID NO: 1130317 - RNA, 19 nt, Homo sapiens
aaacuuagcaccugcaauu

SEQ ID NO: 1130318 - RNA, 19 nt, Homo sapiens
ggagauuugguuuauguua

SEQ ID NO: 1130319 - RNA, 19 nt, Homo sapiens
caagaacacugggagacua

SEQ ID NO: 1130320 - RNA, 19 nt, Homo sapiens
uggguuauguccaaacuua

SEQ ID NO: 1130321 - RNA, 19 nt, Homo sapiens
ucagaaggcuaaagucaga

SEQ ID NO: 1130322 - RNA, 19 nt, Homo sapiens
gcugcaauuuguuagaaua

SEQ ID NO: 1130323 - RNA, 19 nt, Homo sapiens
gaucauugccuccuuccua

SEQ ID NO: 1130324 - RNA, 19 nt, Homo sapiens
uugcagagaucuauuaaug

SEQ ID NO: 1130325 - RNA, 19 nt, Homo sapiens
caagcugugugaaugcaua

SEQ ID NO: 1130326 - RNA, 19 nt, Homo sapiens
ggagugcucuugguaacaa

SEQ ID NO: 1130327 - RNA, 19 nt, Homo sapiens
ggccaguucuucuauauuc

SEQ ID NO: 1130328 - RNA, 19 nt, Homo sapiens
cuaauacaguggagauuug

SEQ ID NO: 1130329 - RNA, 19 nt, Homo sapiens
gccagagucuccagaauuc

SEQ ID NO: 1130330 - RNA, 19 nt, Homo sapiens
aaauaggaguugaggaauu

SEQ ID NO: 1130331 - RNA, 19 nt, Homo sapiens
gcucaaaacaucacauuua

SEQ ID NO: 1130332 - RNA, 19 nt, Homo sapiens
ccaauguacucacgggauu

SEQ ID NO: 1130333 - RNA, 19 nt, Homo sapiens
gcucucagaucuacagaca

SEQ ID NO: 1130334 - RNA, 19 nt, Homo sapiens
gggaugcccugguaaucaa

SEQ ID NO: 1130335 - RNA, 19 nt, Homo sapiens
ugacucaccuuauccaaag

SEQ ID NO: 1130336 - RNA, 19 nt, Homo sapiens
uaacuuccagugcaagaua

SEQ ID NO: 1130337 - RNA, 19 nt, Homo sapiens
cagcuaagccucuggaaau

SEQ ID NO: 1130338 - RNA, 19 nt, Homo sapiens
ggaagaaaugucaaauaug

SEQ ID NO: 1130339 - RNA, 19 nt, Homo sapiens
guggagauuugguuuaugu

SEQ ID NO: 1130340 - RNA, 19 nt, Homo sapiens
cagacaagcugugugaaug

SEQ ID NO: 1130341 - RNA, 19 nt, Homo sapiens
gugcagcgcuuuggauuuc

SEQ ID NO: 1130342 - RNA, 19 nt, Homo sapiens
ccuuauugcucuuaucaaa

SEQ ID NO: 1130343 - RNA, 19 nt, Homo sapiens
gagaauggcuuugacuacu

SEQ ID NO: 1130344 - RNA, 19 nt, Homo sapiens
gaaugggugugaacgauac

SEQ ID NO: 1130345 - RNA, 19 nt, Homo sapiens
gaguugcagagaucuauua

SEQ ID NO: 1130346 - RNA, 19 nt, Homo sapiens
gagauuugguuuauguuac

SEQ ID NO: 1130347 - RNA, 19 nt, Homo sapiens
aauaacugaugucccauuu

SEQ ID NO: 1130348 - RNA, 19 nt, Homo sapiens
uagaaggcaucugcuguaa

SEQ ID NO: 1130349 - RNA, 19 nt, Homo sapiens
gaaauggugauggauaaga

SEQ ID NO: 1130350 - RNA, 19 nt, Homo sapiens
cuaguccgauuguauagaa

SEQ ID NO: 1130351 - RNA, 19 nt, Homo sapiens
ugagcugucugucucguuu

SEQ ID NO: 1130352 - RNA, 19 nt, Homo sapiens
aaacagaagggaaugaaga

SEQ ID NO: 1130353 - RNA, 19 nt, Homo sapiens
guggauggaugugugcaua

SEQ ID NO: 1130354 - RNA, 19 nt, Homo sapiens
aauaggaguugaggaauug

SEQ ID NO: 1130355 - RNA, 19 nt, Homo sapiens
gaggaggaguugcagagau

SEQ ID NO: 1130356 - RNA, 19 nt, Homo sapiens
gcaccacccuccagaacca

SEQ ID NO: 1130357 - RNA, 19 nt, Homo sapiens
uuuccucgcuacuguguua

SEQ ID NO: 1130358 - RNA, 19 nt, Homo sapiens
aaguagagauggaguuuca

SEQ ID NO: 1130359 - RNA, 19 nt, Homo sapiens
guaacaaucaugaugugaa

SEQ ID NO: 1130360 - RNA, 19 nt, Homo sapiens
cagaagaaggcuacauuug

SEQ ID NO: 1130361 - RNA, 19 nt, Homo sapiens
uguguuaguuggaugguuu

SEQ ID NO: 1130362 - RNA, 19 nt, Homo sapiens
ggcuuugacuacuuacuaa

SEQ ID NO: 1130363 - RNA, 19 nt, Homo sapiens
gaucauaugaaucccaaau

SEQ ID NO: 1130364 - RNA, 19 nt, Homo sapiens
aaauggugauggauaagaa

SEQ ID NO: 1130365 - RNA, 19 nt, Homo sapiens
ugauuucacuccuaacugu

SEQ ID NO: 1130366 - RNA, 19 nt, Homo sapiens
gaauaauagggaucaaguu

SEQ ID NO: 1130367 - RNA, 19 nt, Homo sapiens
gggaugaccuccauuugcu

SEQ ID NO: 1130368 - RNA, 19 nt, Homo sapiens
agaagaaggcuacauuugu

SEQ ID NO: 1130369 - RNA, 19 nt, Homo sapiens
cggcaguucuucaauguuc

SEQ ID NO: 1130370 - RNA, 19 nt, Homo sapiens
ggacacagaguauagaaaa

SEQ ID NO: 1130371 - RNA, 19 nt, Homo sapiens
uuacaggcacccaccuuua

SEQ ID NO: 1130372 - RNA, 19 nt, Homo sapiens
uguaaugauuucacuccua

SEQ ID NO: 1130373 - RNA, 19 nt, Homo sapiens
uacaguuacucaugucauu

SEQ ID NO: 1130374 - RNA, 19 nt, Homo sapiens
agacuaacuuaaacacuuc

SEQ ID NO: 1130375 - RNA, 19 nt, Homo sapiens
guaaucuugucucaaauac

SEQ ID NO: 1130376 - RNA, 19 nt, Homo sapiens
ucucagaucuacagacaag

SEQ ID NO: 1130377 - RNA, 19 nt, Homo sapiens
aaagcaaguuuccugugaa

SEQ ID NO: 1130378 - RNA, 19 nt, Homo sapiens
aaguauaguuggccaguug

SEQ ID NO: 1130379 - RNA, 19 nt, Homo sapiens
ccauuugcuucucugagua

SEQ ID NO: 1130380 - RNA, 19 nt, Homo sapiens
gcaggauucuacccuaguc

SEQ ID NO: 1130381 - RNA, 19 nt, Homo sapiens
gugggaguguugucauauu

SEQ ID NO: 1130382 - RNA, 19 nt, Homo sapiens
uaaaguaaaggacuacauc

SEQ ID NO: 1130383 - RNA, 19 nt, Homo sapiens
ucauaugaaucccaaaugg

SEQ ID NO: 1130384 - RNA, 19 nt, Homo sapiens
gauaagaaacacuuuaagc

SEQ ID NO: 1130385 - RNA, 19 nt, Homo sapiens
acuccuaacugugacauuu

SEQ ID NO: 1130386 - RNA, 19 nt, Homo sapiens
gauaaggucacaaucugau

SEQ ID NO: 1130387 - RNA, 19 nt, Homo sapiens
caguggagauuugguuuau

SEQ ID NO: 1130388 - RNA, 19 nt, Homo sapiens
aaaaugggaugcccuggua

SEQ ID NO: 1130389 - RNA, 19 nt, Homo sapiens
cuuagcaccugcaauuguu

SEQ ID NO: 1130390 - RNA, 19 nt, Homo sapiens
ccauuaaguuccucuaaaa

SEQ ID NO: 1130391 - RNA, 19 nt, Homo sapiens
ggccaugccucugccuuga

SEQ ID NO: 1130392 - RNA, 19 nt, Homo sapiens
gcuguaacuuccagugcaa

SEQ ID NO: 1130393 - RNA, 19 nt, Homo sapiens
gccaagaauauggagauua

SEQ ID NO: 1130394 - RNA, 19 nt, Homo sapiens
gcaaguuuccugugaaucg

SEQ ID NO: 1130395 - RNA, 19 nt, Homo sapiens
ggccaacuguuuugaaauu

SEQ ID NO: 1130396 - RNA, 19 nt, Homo sapiens
uuacuaacauacagugaca

SEQ ID NO: 1130397 - RNA, 19 nt, Homo sapiens
gauguaaucuugucucaaa

SEQ ID NO: 1130398 - RNA, 19 nt, Homo sapiens
ccaagaauauggagauuaa

SEQ ID NO: 1130399 - RNA, 19 nt, Homo sapiens
gaagaaggcuacauuugug

SEQ ID NO: 1130400 - RNA, 19 nt, Homo sapiens
gaauggcuuugacuacuua

SEQ ID NO: 1130401 - RNA, 19 nt, Homo sapiens
gcacccaccuuuaccagua

SEQ ID NO: 1130402 - RNA, 19 nt, Homo sapiens
guaaugauuucacuccuaa

SEQ ID NO: 1130403 - RNA, 19 nt, Homo sapiens
gcacacacaugcacaagug

SEQ ID NO: 1130404 - RNA, 19 nt, Homo sapiens
caaagcaaguuuccuguga

SEQ ID NO: 1130405 - RNA, 19 nt, Homo sapiens
gggaaauggugauggauaa

SEQ ID NO: 1130406 - RNA, 19 nt, Homo sapiens
gagacuaacuuaaacacuu

SEQ ID NO: 1130407 - RNA, 19 nt, Homo sapiens
gcacauggccacucugaaa

SEQ ID NO: 1130408 - RNA, 19 nt, Homo sapiens
ucacugagcuaaucuggaa

SEQ ID NO: 1130409 - RNA, 19 nt, Homo sapiens
ccagggacaugaauuugua

SEQ ID NO: 1130410 - RNA, 19 nt, Homo sapiens
uaacugaugucccauuuca

SEQ ID NO: 1130411 - RNA, 19 nt, Homo sapiens
gcagagaucuauuaaugag

SEQ ID NO: 1130412 - RNA, 19 nt, Homo sapiens
gaacgauacuuggcuaugu

SEQ ID NO: 1130413 - RNA, 19 nt, Homo sapiens
cuagagacaugaaguuauu

SEQ ID NO: 1130414 - RNA, 19 nt, Homo sapiens
gaaggcaucugcuguaacu

SEQ ID NO: 1130415 - RNA, 19 nt, Homo sapiens
gagcuaaucuggaacaaac

SEQ ID NO: 1130416 - RNA, 19 nt, Homo sapiens
gcaauuugauucugcacuu

SEQ ID NO: 1130417 - RNA, 19 nt, Homo sapiens
aaacuuagcaccugcaauu

SEQ ID NO: 1130418 - RNA, 19 nt, Homo sapiens
ggagauuugguuuauguua

SEQ ID NO: 1130419 - RNA, 19 nt, Homo sapiens
caagaacacugggagacua

SEQ ID NO: 1130420 - RNA, 19 nt, Homo sapiens
uggguuauguccaaacuua

SEQ ID NO: 1130421 - RNA, 19 nt, Homo sapiens
ucagaaggcuaaagucaga

SEQ ID NO: 1130422 - RNA, 19 nt, Homo sapiens
gcugcaauuuguuagaaua

SEQ ID NO: 1130423 - RNA, 19 nt, Homo sapiens
gaucauugccuccuuccua

SEQ ID NO: 1130424 - RNA, 19 nt, Homo sapiens
uugcagagaucuauuaaug

SEQ ID NO: 1130425 - RNA, 19 nt, Homo sapiens
caagcugugugaaugcaua

SEQ ID NO: 1130426 - RNA, 19 nt, Homo sapiens
ggagugcucuugguaacaa

SEQ ID NO: 1130427 - RNA, 19 nt, Homo sapiens
ggccaguucuucuauauuc

SEQ ID NO: 1130428 - RNA, 19 nt, Homo sapiens
cuaauacaguggagauuug

SEQ ID NO: 1130429 - RNA, 19 nt, Homo sapiens
gccagagucuccagaauuc

SEQ ID NO: 1130430 - RNA, 19 nt, Homo sapiens
aaauaggaguugaggaauu

SEQ ID NO: 1130431 - RNA, 19 nt, Homo sapiens
gcucaaaacaucacauuua

SEQ ID NO: 1130432 - RNA, 19 nt, Homo sapiens
ccaauguacucacgggauu

SEQ ID NO: 1130433 - RNA, 19 nt, Homo sapiens
gcucucagaucuacagaca

SEQ ID NO: 1130434 - RNA, 19 nt, Homo sapiens
gggaugcccugguaaucaa

SEQ ID NO: 1130435 - RNA, 19 nt, Homo sapiens
ugacucaccuuauccaaag

SEQ ID NO: 1130436 - RNA, 19 nt, Homo sapiens
uaacuuccagugcaagaua

SEQ ID NO: 1130437 - RNA, 19 nt, Homo sapiens
cagcuaagccucuggaaau

SEQ ID NO: 1130438 - RNA, 19 nt, Homo sapiens
ggaagaaaugucaaauaug

SEQ ID NO: 1130439 - RNA, 19 nt, Homo sapiens
guggagauuugguuuaugu

SEQ ID NO: 1130440 - RNA, 19 nt, Homo sapiens
cagacaagcugugugaaug

SEQ ID NO: 1130441 - RNA, 19 nt, Homo sapiens
gugcagcgcuuuggauuuc

SEQ ID NO: 1130442 - RNA, 19 nt, Homo sapiens
ccuuauugcucuuaucaaa

SEQ ID NO: 1130443 - RNA, 19 nt, Homo sapiens
gagaauggcuuugacuacu

SEQ ID NO: 1130444 - RNA, 19 nt, Homo sapiens
gaaugggugugaacgauac

SEQ ID NO: 1130445 - RNA, 19 nt, Homo sapiens
gaguugcagagaucuauua

SEQ ID NO: 1130446 - RNA, 19 nt, Homo sapiens
gagauuugguuuauguuac

SEQ ID NO: 1130447 - RNA, 19 nt, Homo sapiens
aauaacugaugucccauuu

SEQ ID NO: 1130448 - RNA, 19 nt, Homo sapiens
uagaaggcaucugcuguaa

SEQ ID NO: 1130449 - RNA, 19 nt, Homo sapiens
gaaauggugauggauaaga

SEQ ID NO: 1130450 - RNA, 19 nt, Homo sapiens
cuaguccgauuguauagaa

SEQ ID NO: 1130451 - RNA, 19 nt, Homo sapiens
ugagcugucugucucguuu

SEQ ID NO: 1130452 - RNA, 19 nt, Homo sapiens
aaacagaagggaaugaaga

SEQ ID NO: 1130453 - RNA, 19 nt, Homo sapiens
guggauggaugugugcaua

SEQ ID NO: 1130454 - RNA, 19 nt, Homo sapiens
aauaggaguugaggaauug

SEQ ID NO: 1130455 - RNA, 19 nt, Homo sapiens
gaggaggaguugcagagau

SEQ ID NO: 1130456 - RNA, 19 nt, Homo sapiens
gcaccacccuccagaacca

SEQ ID NO: 1130457 - RNA, 19 nt, Homo sapiens
uuuccucgcuacuguguua

SEQ ID NO: 1130458 - RNA, 19 nt, Homo sapiens
aaguagagauggaguuuca

SEQ ID NO: 1130459 - RNA, 19 nt, Homo sapiens
guaacaaucaugaugugaa

SEQ ID NO: 1130460 - RNA, 19 nt, Homo sapiens
cagaagaaggcuacauuug

SEQ ID NO: 1130461 - RNA, 19 nt, Homo sapiens
uguguuaguuggaugguuu

SEQ ID NO: 1130462 - RNA, 19 nt, Homo sapiens
ggcuuugacuacuuacuaa

SEQ ID NO: 1130463 - RNA, 19 nt, Homo sapiens
gaucauaugaaucccaaau

SEQ ID NO: 1130464 - RNA, 19 nt, Homo sapiens
aaauggugauggauaagaa

SEQ ID NO: 1130465 - RNA, 19 nt, Homo sapiens
ugauuucacuccuaacugu

SEQ ID NO: 1130466 - RNA, 19 nt, Homo sapiens
gaauaauagggaucaaguu

SEQ ID NO: 1130467 - RNA, 19 nt, Homo sapiens
gggaugaccuccauuugcu

SEQ ID NO: 1130468 - RNA, 19 nt, Homo sapiens
agaagaaggcuacauuugu

SEQ ID NO: 1130469 - RNA, 19 nt, Homo sapiens
cggcaguucuucaauguuc

SEQ ID NO: 1130470 - RNA, 19 nt, Homo sapiens
ggacacagaguauagaaaa

SEQ ID NO: 1130471 - RNA, 19 nt, Homo sapiens
uuacaggcacccaccuuua

SEQ ID NO: 1130472 - RNA, 19 nt, Homo sapiens
uguaaugauuucacuccua

SEQ ID NO: 1130473 - RNA, 19 nt, Homo sapiens
uacaguuacucaugucauu

SEQ ID NO: 1130474 - RNA, 19 nt, Homo sapiens
agacuaacuuaaacacuuc

SEQ ID NO: 1130475 - RNA, 19 nt, Homo sapiens
guaaucuugucucaaauac

SEQ ID NO: 1130476 - RNA, 19 nt, Homo sapiens
ucucagaucuacagacaag

SEQ ID NO: 1130477 - RNA, 19 nt, Homo sapiens
aaagcaaguuuccugugaa

SEQ ID NO: 1130478 - RNA, 19 nt, Homo sapiens
aaguauaguuggccaguug

SEQ ID NO: 1130479 - RNA, 19 nt, Homo sapiens
ccauuugcuucucugagua

SEQ ID NO: 1130480 - RNA, 19 nt, Homo sapiens
gcaggauucuacccuaguc

SEQ ID NO: 1130481 - RNA, 19 nt, Homo sapiens
gugggaguguugucauauu

SEQ ID NO: 1130482 - RNA, 19 nt, Homo sapiens
uaaaguaaaggacuacauc

SEQ ID NO: 1130483 - RNA, 19 nt, Homo sapiens
ucauaugaaucccaaaugg

SEQ ID NO: 1130484 - RNA, 19 nt, Homo sapiens
gauaagaaacacuuuaagc

SEQ ID NO: 1130485 - RNA, 19 nt, Homo sapiens
acuccuaacugugacauuu

SEQ ID NO: 1130486 - RNA, 19 nt, Homo sapiens
gauaaggucacaaucugau

SEQ ID NO: 1130487 - RNA, 19 nt, Homo sapiens
caguggagauuugguuuau

SEQ ID NO: 1130488 - RNA, 19 nt, Homo sapiens
aaaaugggaugcccuggua

SEQ ID NO: 1130489 - RNA, 19 nt, Homo sapiens
cuuagcaccugcaauuguu

SEQ ID NO: 1130490 - RNA, 19 nt, Homo sapiens
ccauuaaguuccucuaaaa

SEQ ID NO: 1130491 - RNA, 19 nt, Homo sapiens
gcuguaacuuccagugcaa

SEQ ID NO: 1130492 - RNA, 19 nt, Homo sapiens
ggccaugccucugccuuga

SEQ ID NO: 1130493 - RNA, 19 nt, Homo sapiens
gccaagaauauggagauua

SEQ ID NO: 1130494 - RNA, 19 nt, Homo sapiens
gcaaguuuccugugaaucg

SEQ ID NO: 1130495 - RNA, 19 nt, Homo sapiens
ggccaacuguuuugaaauu

SEQ ID NO: 1130496 - RNA, 19 nt, Homo sapiens
uuacuaacauacagugaca

SEQ ID NO: 1130497 - RNA, 19 nt, Homo sapiens
caacuugagugguuaaauu

SEQ ID NO: 1130498 - RNA, 19 nt, Homo sapiens
cuaacuggcuguuguaaua

SEQ ID NO: 1130499 - RNA, 19 nt, Homo sapiens
aaacaucagugaacuugua

SEQ ID NO: 1130500 - RNA, 19 nt, Homo sapiens
aaacagcacugccaaauag

SEQ ID NO: 1130501 - RNA, 19 nt, Homo sapiens
ucagugaacuuguaacuau

SEQ ID NO: 1130502 - RNA, 19 nt, Homo sapiens
ggacaaacccauaacaugu

SEQ ID NO: 1130503 - RNA, 19 nt, Homo sapiens
aaacuucucugcauguauu

SEQ ID NO: 1130504 - RNA, 19 nt, Homo sapiens
guaaacaucucugccuuug

SEQ ID NO: 1130505 - RNA, 19 nt, Homo sapiens
ggagcucauugccaaguua

SEQ ID NO: 1130506 - RNA, 19 nt, Homo sapiens
ccaaauagcagaagaauac

SEQ ID NO: 1130507 - RNA, 19 nt, Homo sapiens
aaagacaacuugagugguu

SEQ ID NO: 1130508 - RNA, 19 nt, Homo sapiens
ggacugagaauuguuguaa

SEQ ID NO: 1130509 - RNA, 19 nt, Homo sapiens
gauugcaccuuuagaaguu

SEQ ID NO: 1130510 - RNA, 19 nt, Homo sapiens
caaguuagaucaggcagaa

SEQ ID NO: 1130511 - RNA, 19 nt, Homo sapiens
caaacagcacugccaaaua

SEQ ID NO: 1130512 - RNA, 19 nt, Homo sapiens
ggaaugcagugguggaauc

SEQ ID NO: 1130513 - RNA, 19 nt, Homo sapiens
ccuaaaagcuucuucauga

SEQ ID NO: 1130514 - RNA, 19 nt, Homo sapiens
gcucaaauuuaaacuguca

SEQ ID NO: 1130515 - RNA, 19 nt, Homo sapiens
gaacgaggcagcagaucuu

SEQ ID NO: 1130516 - RNA, 19 nt, Homo sapiens
ggagaaacuucgaauacag

SEQ ID NO: 1130517 - RNA, 19 nt, Homo sapiens
cauaacauguucaccauag

SEQ ID NO: 1130518 - RNA, 19 nt, Homo sapiens
gagcauacgaggcugauga

SEQ ID NO: 1130519 - RNA, 19 nt, Homo sapiens
gugcuuggauuacaguauu

SEQ ID NO: 1130520 - RNA, 19 nt, Homo sapiens
gcaaagcgacuagaugguu

SEQ ID NO: 1130521 - RNA, 19 nt, Homo sapiens
ggacauuacuugggugagu

SEQ ID NO: 1130522 - RNA, 19 nt, Homo sapiens
gcaacaaguuuggccaugu

SEQ ID NO: 1130523 - RNA, 19 nt, Homo sapiens
uaaauggucacauauccua

SEQ ID NO: 1130524 - RNA, 19 nt, Homo sapiens
gaauaaauggucacauauc

SEQ ID NO: 1130525 - RNA, 19 nt, Homo sapiens
gaacaacuggagaaacuuc

SEQ ID NO: 1130526 - RNA, 19 nt, Homo sapiens
ggauuacaguauuucaguu

SEQ ID NO: 1130527 - RNA, 19 nt, Homo sapiens
ggugguguguucuugauau

SEQ ID NO: 1130528 - RNA, 19 nt, Homo sapiens
gcugaucauucguagugua

SEQ ID NO: 1130529 - RNA, 19 nt, Homo sapiens
aauccuggcuuccugcuuu

SEQ ID NO: 1130530 - RNA, 19 nt, Homo sapiens
ugagucagaucuauugcuu

SEQ ID NO: 1130531 - RNA, 19 nt, Homo sapiens
gauggagucucgcuauuuu

SEQ ID NO: 1130532 - RNA, 19 nt, Homo sapiens
guccauuucuauucaugua

SEQ ID NO: 1130533 - RNA, 19 nt, Homo sapiens
ugacugacccagcuaagaa

SEQ ID NO: 1130534 - RNA, 19 nt, Homo sapiens
gaauagugagucagaucua

SEQ ID NO: 1130535 - RNA, 19 nt, Homo sapiens
gggcucguccuaacuuuaa

SEQ ID NO: 1130536 - RNA, 19 nt, Homo sapiens
aaacagauaaggcugcauu

SEQ ID NO: 1130537 - RNA, 19 nt, Homo sapiens
gacaaacccauaacauguu

SEQ ID NO: 1130538 - RNA, 19 nt, Homo sapiens
gcgauuggaugcucacucu

SEQ ID NO: 1130539 - RNA, 19 nt, Homo sapiens
cuaguggcguuguuugauu

SEQ ID NO: 1130540 - RNA, 19 nt, Homo sapiens
ugagaucauuaacgugaaa

SEQ ID NO: 1130541 - RNA, 19 nt, Homo sapiens
gggacaaacccauaacaug

SEQ ID NO: 1130542 - RNA, 19 nt, Homo sapiens
gauaugaucaugcuguaca

SEQ ID NO: 1130543 - RNA, 19 nt, Homo sapiens
gguguggaauaacccuuaa

SEQ ID NO: 1130544 - RNA, 19 nt, Homo sapiens
uaauacugcucaggugaaa

SEQ ID NO: 1130545 - RNA, 19 nt, Homo sapiens
uaauaggaauaugcgagua

SEQ ID NO: 1130546 - RNA, 19 nt, Homo sapiens
aagauaugaucaugcugua

SEQ ID NO: 1130547 - RNA, 19 nt, Homo sapiens
gaucagaauucuuuuccaa

SEQ ID NO: 1130548 - RNA, 19 nt, Homo sapiens
gaucauuaacgugaaacua

SEQ ID NO: 1130549 - RNA, 19 nt, Homo sapiens
ucagaucuauugcuucucu

SEQ ID NO: 1130550 - RNA, 19 nt, Homo sapiens
gcugauugcaccuuuagaa

SEQ ID NO: 1130551 - RNA, 19 nt, Homo sapiens
aguaacagcuaauaggaau

SEQ ID NO: 1130552 - RNA, 19 nt, Homo sapiens
uaacauguucaccauaguu

SEQ ID NO: 1130553 - RNA, 19 nt, Homo sapiens
ggaagaaggagcucauugc

SEQ ID NO: 1130554 - RNA, 19 nt, Homo sapiens
agaauaccaugaggucaaa

SEQ ID NO: 1130555 - RNA, 19 nt, Homo sapiens
uuuggucuuuccagaauua

SEQ ID NO: 1130556 - RNA, 19 nt, Homo sapiens
ccugaagacuccauuccuu

SEQ ID NO: 1130557 - RNA, 19 nt, Homo sapiens
gauuggaugcucacucuga

SEQ ID NO: 1130558 - RNA, 19 nt, Homo sapiens
ucagcugauugcaccuuua

SEQ ID NO: 1130559 - RNA, 19 nt, Homo sapiens
gacugagaauuguuguaaa

SEQ ID NO: 1130560 - RNA, 19 nt, Homo sapiens
gaggagaaucggacguuga

SEQ ID NO: 1130561 - RNA, 19 nt, Homo sapiens
gaucuauugcuucucugua

SEQ ID NO: 1130562 - RNA, 19 nt, Homo sapiens
gcagggcucguccuaacuu

SEQ ID NO: 1130563 - RNA, 19 nt, Homo sapiens
uggaacaacuggagaaacu

SEQ ID NO: 1130564 - RNA, 19 nt, Homo sapiens
cuagaugguucagcugauu

SEQ ID NO: 1130565 - RNA, 19 nt, Homo sapiens
gaaaacaucagugaacuug

SEQ ID NO: 1130566 - RNA, 19 nt, Homo sapiens
gaaacuucucugcauguau

SEQ ID NO: 1130567 - RNA, 19 nt, Homo sapiens
cuauugcuucucuguauua

SEQ ID NO: 1130568 - RNA, 19 nt, Homo sapiens
guaauacugcucaggugaa

SEQ ID NO: 1130569 - RNA, 19 nt, Homo sapiens
gaucaguaacagcuaauag

SEQ ID NO: 1130570 - RNA, 19 nt, Homo sapiens
cagugaacuuguaacuauu

SEQ ID NO: 1130571 - RNA, 19 nt, Homo sapiens
acaaacccauaacauguuc

SEQ ID NO: 1130572 - RNA, 19 nt, Homo sapiens
gagaaacuucgaauacagu

SEQ ID NO: 1130573 - RNA, 19 nt, Homo sapiens
ggaaaucacccugcuugag

SEQ ID NO: 1130574 - RNA, 19 nt, Homo sapiens
cuuuagaaguuauguggaa

SEQ ID NO: 1130575 - RNA, 19 nt, Homo sapiens
uaacuggcuguuguaauaa

SEQ ID NO: 1130576 - RNA, 19 nt, Homo sapiens
agaauuagaccagcagcua

SEQ ID NO: 1130577 - RNA, 19 nt, Homo sapiens
ggugaaagacaacuugagu

SEQ ID NO: 1130578 - RNA, 19 nt, Homo sapiens
ggcaacagcuucguaaucc

SEQ ID NO: 1130579 - RNA, 19 nt, Homo sapiens
gaaauuauuagcagaaacc

SEQ ID NO: 1130580 - RNA, 19 nt, Homo sapiens
uuggagaucagaauucuuu

SEQ ID NO: 1130581 - RNA, 19 nt, Homo sapiens
gagagaagggauauuuuaa

SEQ ID NO: 1130582 - RNA, 19 nt, Homo sapiens
uggagaaacuucgaauaca

SEQ ID NO: 1130583 - RNA, 19 nt, Homo sapiens
uuaggaagauaugaucaug

SEQ ID NO: 1130584 - RNA, 19 nt, Homo sapiens
ugagagaagggauauuuua

SEQ ID NO: 1130585 - RNA, 19 nt, Homo sapiens
aagacaacuugagugguua

SEQ ID NO: 1130586 - RNA, 19 nt, Homo sapiens
ugauaucgguccaucuagu

SEQ ID NO: 1130587 - RNA, 19 nt, Homo sapiens
ucaaacagcacugccaaau

SEQ ID NO: 1130588 - RNA, 19 nt, Homo sapiens
ugaagacuccauuccuuug

SEQ ID NO: 1130589 - RNA, 19 nt, Homo sapiens
guggaaucauggcucacua

SEQ ID NO: 1130590 - RNA, 19 nt, Homo sapiens
acaacugucuauaaugagu

SEQ ID NO: 1130591 - RNA, 19 nt, Homo sapiens
uagcagaagaauaccauga

SEQ ID NO: 1130592 - RNA, 19 nt, Homo sapiens
gccaaauagcagaagaaua

SEQ ID NO: 1130593 - RNA, 19 nt, Homo sapiens
cugaagccaaagucuauua

SEQ ID NO: 1130594 - RNA, 19 nt, Homo sapiens
ggaacgaggcagcagaucu

SEQ ID NO: 1130595 - RNA, 19 nt, Homo sapiens
ccaccuugcugaucauucg

SEQ ID NO: 1130596 - RNA, 19 nt, Homo sapiens
ccucccaccuugcugauca

SEQ ID NO: 1130597 - RNA, 19 nt, Homo sapiens
ggauauugaugcauucuua

SEQ ID NO: 1130598 - RNA, 19 nt, Homo sapiens
guacacaccucaguugauu

SEQ ID NO: 1130599 - RNA, 19 nt, Homo sapiens
uaacagcagugaugaguau

SEQ ID NO: 1130600 - RNA, 19 nt, Homo sapiens
aagcaacucucgcgaauuu

SEQ ID NO: 1130601 - RNA, 19 nt, Homo sapiens
ggaagcaacucucgcgaau

SEQ ID NO: 1130602 - RNA, 19 nt, Homo sapiens
gaagagguugcaaguauuu

SEQ ID NO: 1130603 - RNA, 19 nt, Homo sapiens
ccgaagagguugcaaguau

SEQ ID NO: 1130604 - RNA, 19 nt, Homo sapiens
gaggaaagcuuaaaagaug

SEQ ID NO: 1130605 - RNA, 19 nt, Homo sapiens
ggaugaaccuucuacaaag

SEQ ID NO: 1130606 - RNA, 19 nt, Homo sapiens
gaaggagaccucacaguug

SEQ ID NO: 1130607 - RNA, 19 nt, Homo sapiens
gaaccugccugccucagau

SEQ ID NO: 1130608 - RNA, 19 nt, Homo sapiens
ugacaaccuuggccuauug

SEQ ID NO: 1130609 - RNA, 19 nt, Homo sapiens
caacggggcuuuagugaaa

SEQ ID NO: 1130610 - RNA, 19 nt, Homo sapiens
ugagagggauggaauuguu

SEQ ID NO: 1130611 - RNA, 19 nt, Homo sapiens
caacaucacacaacauaug

SEQ ID NO: 1130612 - RNA, 19 nt, Homo sapiens
acaaggcuauggcugauaa

SEQ ID NO: 1130613 - RNA, 19 nt, Homo sapiens
gagguuagauugggaggaa

SEQ ID NO: 1130614 - RNA, 19 nt, Homo sapiens
gagcaucucugaauuacac

SEQ ID NO: 1130615 - RNA, 19 nt, Homo sapiens
gacaugaucugugccauuc

SEQ ID NO: 1130616 - RNA, 19 nt, Homo sapiens
cgaagagguugcaaguauu

SEQ ID NO: 1130617 - RNA, 19 nt, Homo sapiens
uaacagagaauucuaagca

SEQ ID NO: 1130618 - RNA, 19 nt, Homo sapiens
cagcugagauggacagauc

SEQ ID NO: 1130619 - RNA, 19 nt, Homo sapiens
aaggagaccucacaguuga

SEQ ID NO: 1130620 - RNA, 19 nt, Homo sapiens
gaugagcgucuagagauua

SEQ ID NO: 1130621 - RNA, 19 nt, Homo sapiens
cagaagggcuacagaccaa

SEQ ID NO: 1130622 - RNA, 19 nt, Homo sapiens
ggaugacgaugaugaugau

SEQ ID NO: 1130623 - RNA, 19 nt, Homo sapiens
caugaucugugccauucua

SEQ ID NO: 1130624 - RNA, 19 nt, Homo sapiens
cagaguacauugacaugau

SEQ ID NO: 1130625 - RNA, 19 nt, Homo sapiens
caucugaaacugauucuga

SEQ ID NO: 1130626 - RNA, 19 nt, Homo sapiens
ccacagaggcaaagacaug

SEQ ID NO: 1130627 - RNA, 19 nt, Homo sapiens
ggagacauggagacauuaa

SEQ ID NO: 1130628 - RNA, 19 nt, Homo sapiens
cacaacaucacacaacaua

SEQ ID NO: 1130629 - RNA, 19 nt, Homo sapiens
aaacugauucugauucuga

SEQ ID NO: 1130630 - RNA, 19 nt, Homo sapiens
gagguugcaaguauuuaua

SEQ ID NO: 1130631 - RNA, 19 nt, Homo sapiens
uaugagcauuugccaguuu

SEQ ID NO: 1130632 - RNA, 19 nt, Homo sapiens
gaaaauagcaagguccuaa

SEQ ID NO: 1130633 - RNA, 19 nt, Homo sapiens
gcagugaugaguaugaaga

SEQ ID NO: 1130634 - RNA, 19 nt, Homo sapiens
uaacgacuccgaagagguu

SEQ ID NO: 1130635 - RNA, 19 nt, Homo sapiens
uaacaaggcuauggcugau

SEQ ID NO: 1130636 - RNA, 19 nt, Homo sapiens
ggauggaauuguuuucuuu

SEQ ID NO: 1130637 - RNA, 19 nt, Homo sapiens
uggaugaaccuucuacaaa

SEQ ID NO: 1130638 - RNA, 19 nt, Homo sapiens
gguauuggaugaaccuucu

SEQ ID NO: 1130639 - RNA, 19 nt, Homo sapiens
ugauugaccuggaccacaa

SEQ ID NO: 1130640 - RNA, 19 nt, Homo sapiens
uucaagaacucacagcauu

SEQ ID NO: 1130641 - RNA, 19 nt, Homo sapiens
ucacacaacauaugaaagu

SEQ ID NO: 1130642 - RNA, 19 nt, Homo sapiens
ucguaaaguuagugaguaa

SEQ ID NO: 1130643 - RNA, 19 nt, Homo sapiens
guugucagcuacuugaugu

SEQ ID NO: 1130644 - RNA, 19 nt, Homo sapiens
cuggagacauggagacauu

SEQ ID NO: 1130645 - RNA, 19 nt, Homo sapiens
caaccuuggccuauuggua

SEQ ID NO: 1130646 - RNA, 19 nt, Homo sapiens
uggaaagccugacaaccuu

SEQ ID NO: 1130647 - RNA, 19 nt, Homo sapiens
agaaggagaccucacaguu

SEQ ID NO: 1130648 - RNA, 19 nt, Homo sapiens
caucacacaacauaugaaa

SEQ ID NO: 1130649 - RNA, 19 nt, Homo sapiens
gagagggauggaauuguuu

SEQ ID NO: 1130650 - RNA, 19 nt, Homo sapiens
gaacucuuccaguacauca

SEQ ID NO: 1130651 - RNA, 19 nt, Homo sapiens
cuaugacccugcagacuau

SEQ ID NO: 1130652 - RNA, 19 nt, Homo sapiens
ccuaugacccugcagacua

SEQ ID NO: 1130653 - RNA, 19 nt, Homo sapiens
ugacgaugaugaugaugau

SEQ ID NO: 1130654 - RNA, 19 nt, Homo sapiens
gcaacucucgcgaauuuua

SEQ ID NO: 1130655 - RNA, 19 nt, Homo sapiens
aagaaagcauucacuccuu

SEQ ID NO: 1130656 - RNA, 19 nt, Homo sapiens
ucaagaacucacagcauuu

SEQ ID NO: 1130657 - RNA, 19 nt, Homo sapiens
uagaggagacggauucaga

SEQ ID NO: 1130658 - RNA, 19 nt, Homo sapiens
ugaaacugauucugauucu

SEQ ID NO: 1130659 - RNA, 19 nt, Homo sapiens
cagcagugaugaguaugaa

SEQ ID NO: 1130660 - RNA, 19 nt, Homo sapiens
gauaacagcagugaugagu

SEQ ID NO: 1130661 - RNA, 19 nt, Homo sapiens
ugaugagcgucuagagauu

SEQ ID NO: 1130662 - RNA, 19 nt, Homo sapiens
gggauuugaguuauaagaa

SEQ ID NO: 1130663 - RNA, 19 nt, Homo sapiens
gcagaguacauugacauga

SEQ ID NO: 1130664 - RNA, 19 nt, Homo sapiens
gaauuacaccguucuaagc

SEQ ID NO: 1130665 - RNA, 19 nt, Homo sapiens
gagaucccauggagguuag

SEQ ID NO: 1130666 - RNA, 19 nt, Homo sapiens
gggcacagaacauguuugu

SEQ ID NO: 1130667 - RNA, 19 nt, Homo sapiens
cacacaacauaugaaagua

SEQ ID NO: 1130668 - RNA, 19 nt, Homo sapiens
gguuaacagagaauucuaa

SEQ ID NO: 1130669 - RNA, 19 nt, Homo sapiens
gaugaaccuucuacaaagc

SEQ ID NO: 1130670 - RNA, 19 nt, Homo sapiens
gaccuggaccacaaacuga

SEQ ID NO: 1130671 - RNA, 19 nt, Homo sapiens
gaaacugauucugauucug

SEQ ID NO: 1130672 - RNA, 19 nt, Homo sapiens
acagaaaggagaagaagga

SEQ ID NO: 1130673 - RNA, 19 nt, Homo sapiens
gcacagaaaggagaagaag

SEQ ID NO: 1130674 - RNA, 19 nt, Homo sapiens
ugaugaguaugaagaggaa

SEQ ID NO: 1130675 - RNA, 19 nt, Homo sapiens
gaacucacagcauuuuaaa

SEQ ID NO: 1130676 - RNA, 19 nt, Homo sapiens
aaaugaggaugacgaugau

SEQ ID NO: 1130677 - RNA, 19 nt, Homo sapiens
guacagagagagccagaag

SEQ ID NO: 1130678 - RNA, 19 nt, Homo sapiens
ugagaucccauggagguua

SEQ ID NO: 1130679 - RNA, 19 nt, Homo sapiens
gaaagcauucacuccuuca

SEQ ID NO: 1130680 - RNA, 19 nt, Homo sapiens
accacaaacugaagccuuu

SEQ ID NO: 1130681 - RNA, 19 nt, Homo sapiens
agaccaagguuguugaaaa

SEQ ID NO: 1130682 - RNA, 19 nt, Homo sapiens
acacguggauugagagcau

SEQ ID NO: 1130683 - RNA, 19 nt, Homo sapiens
ugaugaugaugaugauuca

SEQ ID NO: 1130684 - RNA, 19 nt, Homo sapiens
gaagcaacucucgcgaauu

SEQ ID NO: 1130685 - RNA, 19 nt, Homo sapiens
guaaaguuagugaguaaag

SEQ ID NO: 1130686 - RNA, 19 nt, Homo sapiens
gagauggacagaucguugu

SEQ ID NO: 1130687 - RNA, 19 nt, Homo sapiens
acacaccucaguugauuga

SEQ ID NO: 1130688 - RNA, 19 nt, Homo sapiens
ccagaccccuucucaugua

SEQ ID NO: 1130689 - RNA, 19 nt, Homo sapiens
gcacaacaucacacaacau

SEQ ID NO: 1130690 - RNA, 19 nt, Homo sapiens
ggugcucucacucugguua

SEQ ID NO: 1130691 - RNA, 19 nt, Homo sapiens
guucugcccaucuuccuaa

SEQ ID NO: 1130692 - RNA, 19 nt, Homo sapiens
ugacaugaucugugccauu

SEQ ID NO: 1130693 - RNA, 19 nt, Homo sapiens
ccacggcagagauugauug

SEQ ID NO: 1130694 - RNA, 19 nt, Homo sapiens
ggcguggaauccuaaagug

SEQ ID NO: 1130695 - RNA, 19 nt, Homo sapiens
gccuauugguauuggauga

SEQ ID NO: 1130696 - RNA, 19 nt, Homo sapiens
uccaguacaucaguaggua

SEQ ID NO: 1130697 - RNA, 19 nt, Homo sapiens
gaacaaagguaauaugucu

SEQ ID NO: 1130698 - RNA, 19 nt, Homo sapiens
aaacagaucugccuuaaag

SEQ ID NO: 1130699 - RNA, 19 nt, Homo sapiens
uagaauaccucguuuauca

SEQ ID NO: 1130700 - RNA, 19 nt, Homo sapiens
gaacguauacuaaaggaaa

SEQ ID NO: 1130701 - RNA, 19 nt, Homo sapiens
ggagaugcauggaaauuau

SEQ ID NO: 1130702 - RNA, 19 nt, Homo sapiens
gaacauuccuuauagaaac

SEQ ID NO: 1130703 - RNA, 19 nt, Homo sapiens
ccagaacaccauuuaauua

SEQ ID NO: 1130704 - RNA, 19 nt, Homo sapiens
uaaaugagcugugaagugu

SEQ ID NO: 1130705 - RNA, 19 nt, Homo sapiens
gcauggaaauuaugaaugu

SEQ ID NO: 1130706 - RNA, 19 nt, Homo sapiens
gcucaguguuguuaauaua

SEQ ID NO: 1130707 - RNA, 19 nt, Homo sapiens
guacuggaauuacaacuau

SEQ ID NO: 1130708 - RNA, 19 nt, Homo sapiens
gaacuucaaugcagauucu

SEQ ID NO: 1130709 - RNA, 19 nt, Homo sapiens
gcaggagauuccagagaua

SEQ ID NO: 1130710 - RNA, 19 nt, Homo sapiens
acacauaguuccuccauug

SEQ ID NO: 1130711 - RNA, 19 nt, Homo sapiens
ugagguggcuucuuucaaa

SEQ ID NO: 1130712 - RNA, 19 nt, Homo sapiens
gagaucaacuauacuggaa

SEQ ID NO: 1130713 - RNA, 19 nt, Homo sapiens
gaagaacccauuuacuuug

SEQ ID NO: 1130714 - RNA, 19 nt, Homo sapiens
gcaaggcauucagaugaua

SEQ ID NO: 1130715 - RNA, 19 nt, Homo sapiens
gcucugaucuugcaguuuc

SEQ ID NO: 1130716 - RNA, 19 nt, Homo sapiens
uaccuuaccugaacguaua

SEQ ID NO: 1130717 - RNA, 19 nt, Homo sapiens
acagacaaguguacacaua

SEQ ID NO: 1130718 - RNA, 19 nt, Homo sapiens
agaagaugcugauugguuu

SEQ ID NO: 1130719 - RNA, 19 nt, Homo sapiens
gaacacagacauugcugaa

SEQ ID NO: 1130720 - RNA, 19 nt, Homo sapiens
guucucagcuauuuaguau

SEQ ID NO: 1130721 - RNA, 19 nt, Homo sapiens
ugaagaacccauuuacuuu

SEQ ID NO: 1130722 - RNA, 19 nt, Homo sapiens
aaacuacacugcaccaugu

SEQ ID NO: 1130723 - RNA, 19 nt, Homo sapiens
caacuauuauccuccugua

SEQ ID NO: 1130724 - RNA, 19 nt, Homo sapiens
ggaaauggccucuaaaucc

SEQ ID NO: 1130725 - RNA, 19 nt, Homo sapiens
gaaauggccucuaaauccu

SEQ ID NO: 1130726 - RNA, 19 nt, Homo sapiens
gcaguaugcuauaaaugau

SEQ ID NO: 1130727 - RNA, 19 nt, Homo sapiens
caaccuaccuuaccugaac

SEQ ID NO: 1130728 - RNA, 19 nt, Homo sapiens
agaauucuuugcuggguua

SEQ ID NO: 1130729 - RNA, 19 nt, Homo sapiens
ggaaauccuugaaagaaaa

SEQ ID NO: 1130730 - RNA, 19 nt, Homo sapiens
ggaaauuagucaagcaaac

SEQ ID NO: 1130731 - RNA, 19 nt, Homo sapiens
ggagcaggauauguacuaa

SEQ ID NO: 1130732 - RNA, 19 nt, Homo sapiens
acccugaagugcauuaaua

SEQ ID NO: 1130733 - RNA, 19 nt, Homo sapiens
gcaccauguuaguaauaaa

SEQ ID NO: 1130734 - RNA, 19 nt, Homo sapiens
gaaauuagucaagcaaaca

SEQ ID NO: 1130735 - RNA, 19 nt, Homo sapiens
aauuugagguggcuucuuu

SEQ ID NO: 1130736 - RNA, 19 nt, Homo sapiens
gccagaacaccauuuaauu

SEQ ID NO: 1130737 - RNA, 19 nt, Homo sapiens
gggagaugcauggaaauua

SEQ ID NO: 1130738 - RNA, 19 nt, Homo sapiens
gaaaagauuuguugaugca

SEQ ID NO: 1130739 - RNA, 19 nt, Homo sapiens
gauauguacuaagcaaaga

SEQ ID NO: 1130740 - RNA, 19 nt, Homo sapiens
auaaacagaucugccuuaa

SEQ ID NO: 1130741 - RNA, 19 nt, Homo sapiens
ccagagauaccauuggaaa

SEQ ID NO: 1130742 - RNA, 19 nt, Homo sapiens
aggcagagaucaacuauac

SEQ ID NO: 1130743 - RNA, 19 nt, Homo sapiens
gaaugacuauaaacugaag

SEQ ID NO: 1130744 - RNA, 19 nt, Homo sapiens
ucuaaauccuggcugaauu

SEQ ID NO: 1130745 - RNA, 19 nt, Homo sapiens
gcagagaucaacuauacug

SEQ ID NO: 1130746 - RNA, 19 nt, Homo sapiens
caaagaaggcagagaucaa

SEQ ID NO: 1130747 - RNA, 19 nt, Homo sapiens
gaugagaacacagacauug

SEQ ID NO: 1130748 - RNA, 19 nt, Homo sapiens
guaaagcagggcuacauga

SEQ ID NO: 1130749 - RNA, 19 nt, Homo sapiens
gaaggcagagaucaacuau

SEQ ID NO: 1130750 - RNA, 19 nt, Homo sapiens
gaccaucuguguuauuguc

SEQ ID NO: 1130751 - RNA, 19 nt, Homo sapiens
gacuauaaacugaagcuuu

SEQ ID NO: 1130752 - RNA, 19 nt, Homo sapiens
agccuaauguucuucauaa

SEQ ID NO: 1130753 - RNA, 19 nt, Homo sapiens
guuuaugaguucagaagaa

SEQ ID NO: 1130754 - RNA, 19 nt, Homo sapiens
gauaauggacagaaucauc

SEQ ID NO: 1130755 - RNA, 19 nt, Homo sapiens
ccagguagaggaacuagaa

SEQ ID NO: 1130756 - RNA, 19 nt, Homo sapiens
aaagugaaguuaggaaauc

SEQ ID NO: 1130757 - RNA, 19 nt, Homo sapiens
gaguuagaauaccucguuu

SEQ ID NO: 1130758 - RNA, 19 nt, Homo sapiens
ccauguaugaguuagaaua

SEQ ID NO: 1130759 - RNA, 19 nt, Homo sapiens
caggauauguacuaagcaa

SEQ ID NO: 1130760 - RNA, 19 nt, Homo sapiens
gaauguagaagcaggagau

SEQ ID NO: 1130761 - RNA, 19 nt, Homo sapiens
aagcaaagaagccuugaaa

SEQ ID NO: 1130762 - RNA, 19 nt, Homo sapiens
gaucaacuauacuggaaaa

SEQ ID NO: 1130763 - RNA, 19 nt, Homo sapiens
ggaauucuaagugaacauu

SEQ ID NO: 1130764 - RNA, 19 nt, Homo sapiens
ugacauagaacacuggaau

SEQ ID NO: 1130765 - RNA, 19 nt, Homo sapiens
guuagaauaccucguuuau

SEQ ID NO: 1130766 - RNA, 19 nt, Homo sapiens
ggacagaaucaucuagaag

SEQ ID NO: 1130767 - RNA, 19 nt, Homo sapiens
caaagaagccuugaaaaga

SEQ ID NO: 1130768 - RNA, 19 nt, Homo sapiens
uagaagaugcugauugguu

SEQ ID NO: 1130769 - RNA, 19 nt, Homo sapiens
gaaaaccucuaucagaaag

SEQ ID NO: 1130770 - RNA, 19 nt, Homo sapiens
acacagacauugcugaaaa

SEQ ID NO: 1130771 - RNA, 19 nt, Homo sapiens
uuucugaccaucuguguua

SEQ ID NO: 1130772 - RNA, 19 nt, Homo sapiens
gugaggaauucuaagugaa

SEQ ID NO: 1130773 - RNA, 19 nt, Homo sapiens
ggaauuacaacuauuaucc

SEQ ID NO: 1130774 - RNA, 19 nt, Homo sapiens
uggaggagcaggauaugua

SEQ ID NO: 1130775 - RNA, 19 nt, Homo sapiens
gaauaccucguuuaucauc

SEQ ID NO: 1130776 - RNA, 19 nt, Homo sapiens
cugaagaacccauuuacuu

SEQ ID NO: 1130777 - RNA, 19 nt, Homo sapiens
caacuauacuggaaaacaa

SEQ ID NO: 1130778 - RNA, 19 nt, Homo sapiens
aaaccucuaucagaaaguu

SEQ ID NO: 1130779 - RNA, 19 nt, Homo sapiens
gcagauucuagccaacaua

SEQ ID NO: 1130780 - RNA, 19 nt, Homo sapiens
cuucugcauuucugacaua

SEQ ID NO: 1130781 - RNA, 19 nt, Homo sapiens
gaaaauguugcugugauua

SEQ ID NO: 1130782 - RNA, 19 nt, Homo sapiens
aauaaacagaucugccuua
